United States Patent 11,254,933 (CRISPR/CAS TRANSCRIPTIONAL MODULATION) - sequence listing, part 10

SEQ ID NO: 421247 - DNA, 20 bp, mouse
ggagccgcgcggacagaacg

SEQ ID NO: 421248 - DNA, 20 bp, mouse
gggcctggcaggacagtccc

SEQ ID NO: 421249 - DNA, 20 bp, mouse
gctagagcggccgcccacgg

SEQ ID NO: 421250 - DNA, 20 bp, mouse
gcccgactggcaggatgaag

SEQ ID NO: 421251 - DNA, 20 bp, mouse
gagggaggcactgggctgcg

SEQ ID NO: 421252 - DNA, 20 bp, mouse
ggcggagctgtcctctcgtc

SEQ ID NO: 421253 - DNA, 20 bp, mouse
gagcccagtgcctccctccg

SEQ ID NO: 421254 - DNA, 20 bp, mouse
gggcactgggctgcggggag

SEQ ID NO: 421255 - DNA, 20 bp, mouse
ggccagtagcagcgctagag

SEQ ID NO: 421256 - DNA, 20 bp, mouse
gccatgctggcaagggttca

SEQ ID NO: 421257 - DNA, 20 bp, mouse
gggactccaagatgacctcg

SEQ ID NO: 421258 - DNA, 20 bp, mouse
gtgctgctcagtcaccatgg

SEQ ID NO: 421259 - DNA, 20 bp, mouse
gtcctgctgctcagtcacca

SEQ ID NO: 421260 - DNA, 20 bp, mouse
gtgacctcgtggctccatgc

SEQ ID NO: 421261 - DNA, 20 bp, mouse
gtggagccacgaggtcatct

SEQ ID NO: 421262 - DNA, 20 bp, mouse
ggaagaagtacgggttgctg

SEQ ID NO: 421263 - DNA, 20 bp, mouse
gttgccagcatggagccacg

SEQ ID NO: 421264 - DNA, 20 bp, mouse
gaattcagtcagggccctga

SEQ ID NO: 421265 - DNA, 20 bp, mouse
gtccccaggcgagcctcacc

SEQ ID NO: 421266 - DNA, 20 bp, mouse
ggcagcgcccaggagactac

SEQ ID NO: 421267 - DNA, 20 bp, mouse
gacctgaggccgagggacag

SEQ ID NO: 421268 - DNA, 20 bp, mouse
ggcgcccaggagactacggg

SEQ ID NO: 421269 - DNA, 20 bp, mouse
ggccccgcccgtagtctcct

SEQ ID NO: 421270 - DNA, 20 bp, mouse
ggggacagcggcccgagccg

SEQ ID NO: 421271 - DNA, 20 bp, mouse
gaggagcttcgccatagccc

SEQ ID NO: 421272 - DNA, 20 bp, mouse
ggtagatcttgtagagccgg

SEQ ID NO: 421273 - DNA, 20 bp, mouse
ggccctgcgtgactgggagg

SEQ ID NO: 421274 - DNA, 20 bp, mouse
ggacggcagtgggagtctcg

SEQ ID NO: 421275 - DNA, 20 bp, mouse
gactgggaccagccattcgg

SEQ ID NO: 421276 - DNA, 20 bp, mouse
ggcccagccggtgtctgcgg

SEQ ID NO: 421277 - DNA, 20 bp, mouse
ggcctccgcagacaccggct

SEQ ID NO: 421278 - DNA, 20 bp, mouse
gggcatgcaggtcatcccag

SEQ ID NO: 421279 - DNA, 20 bp, mouse
gagccagcggcccagtgagt

SEQ ID NO: 421280 - DNA, 20 bp, mouse
ggatgcaggcctggcccagc

SEQ ID NO: 421281 - DNA, 20 bp, mouse
gctggcccagccggtgtctg

SEQ ID NO: 421282 - DNA, 20 bp, mouse
ggaagtccaccggccagctg

SEQ ID NO: 421283 - DNA, 20 bp, mouse
gtacacgatgctgcactggg

SEQ ID NO: 421284 - DNA, 20 bp, mouse
gtcatttcacaactaggact

SEQ ID NO: 421285 - DNA, 20 bp, mouse
gcatcccagcggaagtccac

SEQ ID NO: 421286 - DNA, 20 bp, mouse
ggctgggtcggggtccccgg

SEQ ID NO: 421287 - DNA, 20 bp, mouse
ggggatgccagggacacggt

SEQ ID NO: 421288 - DNA, 20 bp, mouse
gagctcacttccgcccgcgg

SEQ ID NO: 421289 - DNA, 20 bp, mouse
gggtggcggtgcaggaggct

SEQ ID NO: 421290 - DNA, 20 bp, mouse
ggacagacggacgcacgggc

SEQ ID NO: 421291 - DNA, 20 bp, mouse
gggtgcaggaggctgggtcg

SEQ ID NO: 421292 - DNA, 20 bp, mouse
gggagagcgcagggaggtct

SEQ ID NO: 421293 - DNA, 20 bp, mouse
gcgcctcgcatcacttccgg

SEQ ID NO: 421294 - DNA, 20 bp, mouse
ggaggctgggtcggggtccc

SEQ ID NO: 421295 - DNA, 20 bp, mouse
gcaccaccgcagctccgccg

SEQ ID NO: 421296 - DNA, 20 bp, mouse
gtcactgagcagctcgaacc

SEQ ID NO: 421297 - DNA, 20 bp, mouse
gagggcgccgaagctgaccc

SEQ ID NO: 421298 - DNA, 20 bp, mouse
gtcgggccggagagccccgg

SEQ ID NO: 421299 - DNA, 20 bp, mouse
gacctcgggccggagagccc

SEQ ID NO: 421300 - DNA, 20 bp, mouse
gtccgggctgcaggcgatca

SEQ ID NO: 421301 - DNA, 20 bp, mouse
gtccgaaggccgccaggcgg

SEQ ID NO: 421302 - DNA, 20 bp, mouse
gccgaagtggcccagatcca

SEQ ID NO: 421303 - DNA, 20 bp, mouse
gacggctccgccgcgagggg

SEQ ID NO: 421304 - DNA, 20 bp, mouse
gtcggagcggagctaccgag

SEQ ID NO: 421305 - DNA, 20 bp, mouse
gctccgcagcccgccttcct

SEQ ID NO: 421306 - DNA, 20 bp, mouse
gcgggcgggagggaagcgca

SEQ ID NO: 421307 - DNA, 20 bp, mouse
gggagagcgccgagaactgg

SEQ ID NO: 421308 - DNA, 20 bp, mouse
ggaagcgcagggagcgcaga

SEQ ID NO: 421309 - DNA, 20 bp, mouse
ggagggagagcgccgagaac

SEQ ID NO: 421310 - DNA, 20 bp, mouse
ggatgcggctcggacaagga

SEQ ID NO: 421311 - DNA, 20 bp, mouse
ggggccgggctcgggcatcg

SEQ ID NO: 421312 - DNA, 20 bp, mouse
gtcgggcgccagcaccgtgt

SEQ ID NO: 421313 - DNA, 20 bp, mouse
ggcgagaagccgttcatcct

SEQ ID NO: 421314 - DNA, 20 bp, mouse
gtggaggccggccgagaagg

SEQ ID NO: 421315 - DNA, 20 bp, mouse
ggcttccctcccgcccgcgg

SEQ ID NO: 421316 - DNA, 20 bp, mouse
ggctgcgggaaccggactcc

SEQ ID NO: 421317 - DNA, 20 bp, mouse
ggcgggaaccggactccggg

SEQ ID NO: 421318 - DNA, 20 bp, mouse
gaaccggactccgggcgggt

SEQ ID NO: 421319 - DNA, 20 bp, mouse
gtgctggagtcaatgagaga

SEQ ID NO: 421320 - DNA, 20 bp, mouse
gagaaggtaagacctcggct

SEQ ID NO: 421321 - DNA, 20 bp, mouse
gggcactgcggggatctaga

SEQ ID NO: 421322 - DNA, 20 bp, mouse
gtccagcagtccaacccgcc

SEQ ID NO: 421323 - DNA, 20 bp, mouse
gtgagtgctccggatccgtg

SEQ ID NO: 421324 - DNA, 20 bp, mouse
ggtccaacccgcccggagtc

SEQ ID NO: 421325 - DNA, 20 bp, mouse
gatctggccggccagactca

SEQ ID NO: 421326 - DNA, 20 bp, mouse
gtgaggccgagaggacctag

SEQ ID NO: 421327 - DNA, 20 bp, mouse
ggacctgcgggtgctgtccc

SEQ ID NO: 421328 - DNA, 20 bp, mouse
gcgcctggccatggacctgc

SEQ ID NO: 421329 - DNA, 20 bp, mouse
ggagcccggctcaactgcag

SEQ ID NO: 421330 - DNA, 20 bp, mouse
gtggagcaccaggttcgcgt

SEQ ID NO: 421331 - DNA, 20 bp, mouse
gcaggtagagcgccagctcc

SEQ ID NO: 421332 - DNA, 20 bp, mouse
ggacagcacccgcaggtcca

SEQ ID NO: 421333 - DNA, 20 bp, mouse
ggaagaagccgacgcgaacc

SEQ ID NO: 421334 - DNA, 20 bp, mouse
gcgcaggcgaccctagcctc

SEQ ID NO: 421335 - DNA, 20 bp, mouse
gactatgcagcgcctggcca

SEQ ID NO: 421336 - DNA, 20 bp, mouse
gcggcagggcttgtttacta

SEQ ID NO: 421337 - DNA, 20 bp, mouse
gtggcgtcgagcggagggat

SEQ ID NO: 421338 - DNA, 20 bp, mouse
gctgtccgggccaggatccg

SEQ ID NO: 421339 - DNA, 20 bp, mouse
gctgagagatgagaaggctg

SEQ ID NO: 421340 - DNA, 20 bp, mouse
gtgcccggaactaaagtcgt

SEQ ID NO: 421341 - DNA, 20 bp, mouse
ggggcgatcgcgaagactag

SEQ ID NO: 421342 - DNA, 20 bp, mouse
gtctaactgggctaccagag

SEQ ID NO: 421343 - DNA, 20 bp, mouse
gcccttgaaggacaaggcat

SEQ ID NO: 421344 - DNA, 20 bp, mouse
gcgcaactacagacagtccc

SEQ ID NO: 421345 - DNA, 20 bp, mouse
gggtagcccagttagattag

SEQ ID NO: 421346 - DNA, 20 bp, mouse
gccaagctagaccactgagg

SEQ ID NO: 421347 - DNA, 20 bp, mouse
ggacgcttcccagagagttc

SEQ ID NO: 421348 - DNA, 20 bp, mouse
gaagagagccggaactctct

SEQ ID NO: 421349 - DNA, 20 bp, mouse
gtctctttgatccccctcag

SEQ ID NO: 421350 - DNA, 20 bp, mouse
gaaggggagaggtttaacag

SEQ ID NO: 421351 - DNA, 20 bp, mouse
ggccaggcaggttaagtccc

SEQ ID NO: 421352 - DNA, 20 bp, mouse
gagatttgtgaccggaacaa

SEQ ID NO: 421353 - DNA, 20 bp, mouse
ggccaagcgccggtttacac

SEQ ID NO: 421354 - DNA, 20 bp, mouse
gccagttcaggatcctgtag

SEQ ID NO: 421355 - DNA, 20 bp, mouse
gtgctctaatgatcggtcat

SEQ ID NO: 421356 - DNA, 20 bp, mouse
ggcggcggtgatgaaagcga

SEQ ID NO: 421357 - DNA, 20 bp, mouse
ggcggtgatgaaagcgatgg

SEQ ID NO: 421358 - DNA, 20 bp, mouse
gtgtccctgcgcttgcgcgg

SEQ ID NO: 421359 - DNA, 20 bp, mouse
gaggtggactcggcagacgc

SEQ ID NO: 421360 - DNA, 20 bp, mouse
ggccggctgacaggccgact

SEQ ID NO: 421361 - DNA, 20 bp, mouse
gcagggacacacctcgaagc

SEQ ID NO: 421362 - DNA, 20 bp, mouse
gccgccgccgcgcaagcgca

SEQ ID NO: 421363 - DNA, 20 bp, mouse
gaaagcgatggcggcggagg

SEQ ID NO: 421364 - DNA, 20 bp, mouse
gggcctgtcagccggcttcg

SEQ ID NO: 421365 - DNA, 20 bp, mouse
gagccgtgcgtcgccagggt

SEQ ID NO: 421366 - DNA, 20 bp, mouse
gggaccgcggtcactgaggt

SEQ ID NO: 421367 - DNA, 20 bp, mouse
gagcaggaccgcggtcactg

SEQ ID NO: 421368 - DNA, 20 bp, mouse
ggaggcagaaggaaaggcga

SEQ ID NO: 421369 - DNA, 20 bp, mouse
ggcggggacctgggactgga

SEQ ID NO: 421370 - DNA, 20 bp, mouse
ggcagaaggaaaggcgacgg

SEQ ID NO: 421371 - DNA, 20 bp, mouse
ggaggtaggtctggtgagcg

SEQ ID NO: 421372 - DNA, 20 bp, mouse
gctggcaggcggccaaccag

SEQ ID NO: 421373 - DNA, 20 bp, mouse
gtacgctcttaggagaggga

SEQ ID NO: 421374 - DNA, 20 bp, mouse
gcgaacgggcagcaggaccg

SEQ ID NO: 421375 - DNA, 20 bp, mouse
ggtcaggtcgtaggaatggg

SEQ ID NO: 421376 - DNA, 20 bp, mouse
ggcccggacggtcaacgcag

SEQ ID NO: 421377 - DNA, 20 bp, mouse
gacgctgggtgggacttaca

SEQ ID NO: 421378 - DNA, 20 bp, mouse
ggcaggtgccgcttacatgg

SEQ ID NO: 421379 - DNA, 20 bp, mouse
gacagggccggtttgctacg

SEQ ID NO: 421380 - DNA, 20 bp, mouse
ggcccctgcgttgaccgtcc

SEQ ID NO: 421381 - DNA, 20 bp, mouse
gccccgagagaggagtcacc

SEQ ID NO: 421382 - DNA, 20 bp, mouse
gaccccccacccctcagtgg

SEQ ID NO: 421383 - DNA, 20 bp, mouse
gtggccgcattagcgcggac

SEQ ID NO: 421384 - DNA, 20 bp, mouse
gggctgtggaaccccgactg

SEQ ID NO: 421385 - DNA, 20 bp, mouse
ggcctccactgaggggtggg

SEQ ID NO: 421386 - DNA, 20 bp, mouse
ggaggaagctgagtccgccg

SEQ ID NO: 421387 - DNA, 20 bp, mouse
gacaatacccggcggaggga

SEQ ID NO: 421388 - DNA, 20 bp, mouse
gtagaggaggagatcccgtc

SEQ ID NO: 421389 - DNA, 20 bp, mouse
gtaccagaacctgacccggg

SEQ ID NO: 421390 - DNA, 20 bp, mouse
gcggagtagggcagtcccca

SEQ ID NO: 421391 - DNA, 20 bp, mouse
ggagaggaagcgatgcggag

SEQ ID NO: 421392 - DNA, 20 bp, mouse
gtgtgcggagctcgggtccc

SEQ ID NO: 421393 - DNA, 20 bp, mouse
gtaggcgcagacctcagcca

SEQ ID NO: 421394 - DNA, 20 bp, mouse
ggccgcggcgatacaggaag

SEQ ID NO: 421395 - DNA, 20 bp, mouse
gtctggtctgtgcggagctc

SEQ ID NO: 421396 - DNA, 20 bp, mouse
gcggccgcgacgcccgggag

SEQ ID NO: 421397 - DNA, 20 bp, mouse
gctcctcatacagcccgcag

SEQ ID NO: 421398 - DNA, 20 bp, mouse
gccgcgacgcccgggagagg

SEQ ID NO: 421399 - DNA, 20 bp, mouse
gatacagcccgcagaggcag

SEQ ID NO: 421400 - DNA, 20 bp, mouse
gcggcggctgcagggagcga

SEQ ID NO: 421401 - DNA, 20 bp, mouse
gggaggagcagcggcggacg

SEQ ID NO: 421402 - DNA, 20 bp, mouse
gggacgcggcgggaatcggg

SEQ ID NO: 421403 - DNA, 20 bp, mouse
gcggcgcgcgacgagggagg

SEQ ID NO: 421404 - DNA, 20 bp, mouse
gcccgtgcgagtgaccggtg

SEQ ID NO: 421405 - DNA, 20 bp, mouse
gtgacaggagaggactgcgg

SEQ ID NO: 421406 - DNA, 20 bp, mouse
gccccaccgaggccaagcca

SEQ ID NO: 421407 - DNA, 20 bp, mouse
gaggcagagcggccaatcag

SEQ ID NO: 421408 - DNA, 20 bp, mouse
gtccccagggaaccccaccg

SEQ ID NO: 421409 - DNA, 20 bp, mouse
gcaccgaggccaagccatgg

SEQ ID NO: 421410 - DNA, 20 bp, mouse
ggcctcggtggggttccctg

SEQ ID NO: 421411 - DNA, 20 bp, mouse
gccggcacctgtgagaggta

SEQ ID NO: 421412 - DNA, 20 bp, mouse
gggctatggcccgagaacaa

SEQ ID NO: 421413 - DNA, 20 bp, mouse
ggcagagcctcccggcccgt

SEQ ID NO: 421414 - DNA, 20 bp, mouse
gaggagtttgatatccccac

SEQ ID NO: 421415 - DNA, 20 bp, mouse
ggtcagatgaccctaccaga

SEQ ID NO: 421416 - DNA, 20 bp, mouse
ggctcacacggggagtgatg

SEQ ID NO: 421417 - DNA, 20 bp, mouse
ggccctggccacagagacgg

SEQ ID NO: 421418 - DNA, 20 bp, mouse
ggatctgctgtacaatatgg

SEQ ID NO: 421419 - DNA, 20 bp, mouse
ggcaacatgctctccagcct

SEQ ID NO: 421420 - DNA, 20 bp, mouse
gtgtgaagggggtgactcag

SEQ ID NO: 421421 - DNA, 20 bp, mouse
ggcatttgcctgctcacacg

SEQ ID NO: 421422 - DNA, 20 bp, mouse
gctcccgcctctgtcagtgg

SEQ ID NO: 421423 - DNA, 20 bp, mouse
gcacggggagtgatgcggct

SEQ ID NO: 421424 - DNA, 20 bp, mouse
gatgcagttccagggttgca

SEQ ID NO: 421425 - DNA, 20 bp, mouse
gagtcacccccttcacacat

SEQ ID NO: 421426 - DNA, 20 bp, mouse
gggagagacaccgacccccg

SEQ ID NO: 421427 - DNA, 20 bp, mouse
gccagctccgacgcctctca

SEQ ID NO: 421428 - DNA, 20 bp, mouse
gtccattatggcggcctcgg

SEQ ID NO: 421429 - DNA, 20 bp, mouse
gaggcgtcggagctggaacc

SEQ ID NO: 421430 - DNA, 20 bp, mouse
ggtcggtgtctctccctgag

SEQ ID NO: 421431 - DNA, 20 bp, mouse
gagtcctcagccgcaggacc

SEQ ID NO: 421432 - DNA, 20 bp, mouse
gcgcggctcgtaatccatta

SEQ ID NO: 421433 - DNA, 20 bp, mouse
gaaccgggtgccgggtcctg

SEQ ID NO: 421434 - DNA, 20 bp, mouse
gcccgcggtccggaacctgg

SEQ ID NO: 421435 - DNA, 20 bp, mouse
gggctcgtaatccattatgg

SEQ ID NO: 421436 - DNA, 20 bp, mouse
ggagtctgtgagtcgctggg

SEQ ID NO: 421437 - DNA, 20 bp, mouse
gacgctcgccctgtgctcgg

SEQ ID NO: 421438 - DNA, 20 bp, mouse
gctcggtggtttaaagatgg

SEQ ID NO: 421439 - DNA, 20 bp, mouse
gggagcggcgccaggagctc

SEQ ID NO: 421440 - DNA, 20 bp, mouse
gagaggaggaatgtgagcaa

SEQ ID NO: 421441 - DNA, 20 bp, mouse
gccgcgtcggggaggctccg

SEQ ID NO: 421442 - DNA, 20 bp, mouse
gggagagtctgtgagtcgct

SEQ ID NO: 421443 - DNA, 20 bp, mouse
gtgtgagcaagggtcggcgg

SEQ ID NO: 421444 - DNA, 20 bp, mouse
gcgcagccgcgcgggatccg

SEQ ID NO: 421445 - DNA, 20 bp, mouse
ggagccggtggagggcatga

SEQ ID NO: 421446 - DNA, 20 bp, mouse
gcagcctcaggaactcccac

SEQ ID NO: 421447 - DNA, 20 bp, mouse
gtctcctgtgggagttcctg

SEQ ID NO: 421448 - DNA, 20 bp, mouse
gaattgtgcagctctgagat

SEQ ID NO: 421449 - DNA, 20 bp, mouse
gaggctggctctctctggtg

SEQ ID NO: 421450 - DNA, 20 bp, mouse
gccaagcaaggatggcatct

SEQ ID NO: 421451 - DNA, 20 bp, mouse
ggcttgggttaaagtgtctg

SEQ ID NO: 421452 - DNA, 20 bp, mouse
gagcagggtcaggagtctcg

SEQ ID NO: 421453 - DNA, 20 bp, mouse
gagctgctaaacctgagctc

SEQ ID NO: 421454 - DNA, 20 bp, mouse
gtcaataagcagtctcctgt

SEQ ID NO: 421455 - DNA, 20 bp, mouse
gtaatgaatggggcaggagt

SEQ ID NO: 421456 - DNA, 20 bp, mouse
gtcagcacgcttgaggccag

SEQ ID NO: 421457 - DNA, 20 bp, mouse
gcgtagcggcaacctcagta

SEQ ID NO: 421458 - DNA, 20 bp, mouse
gacgcttgaggccagcggct

SEQ ID NO: 421459 - DNA, 20 bp, mouse
gcgacagcccgaggaccggg

SEQ ID NO: 421460 - DNA, 20 bp, mouse
gcgggagccccgagctgcgg

SEQ ID NO: 421461 - DNA, 20 bp, mouse
gtcagcggcagctcccagta

SEQ ID NO: 421462 - DNA, 20 bp, mouse
gaggatcctcagcacgcttg

SEQ ID NO: 421463 - DNA, 20 bp, mouse
gctgcgacagcccgaggacc

SEQ ID NO: 421464 - DNA, 20 bp, mouse
gcgagctgcggtggcgctgc

SEQ ID NO: 421465 - DNA, 20 bp, mouse
gggaatccgcgggttcgtag

SEQ ID NO: 421466 - DNA, 20 bp, mouse
gaggctgcggagcccgaagg

SEQ ID NO: 421467 - DNA, 20 bp, mouse
ggaatcccgcgggtcgtctg

SEQ ID NO: 421468 - DNA, 20 bp, mouse
gagctcgccatccatgatgt

SEQ ID NO: 421469 - DNA, 20 bp, mouse
gtcatggatggcgagctctc

SEQ ID NO: 421470 - DNA, 20 bp, mouse
gtaaggctagtggacgaaca

SEQ ID NO: 421471 - DNA, 20 bp, mouse
gcacctgggacccgaacccc

SEQ ID NO: 421472 - DNA, 20 bp, mouse
gggtttcgcctggctcgcct

SEQ ID NO: 421473 - DNA, 20 bp, mouse
gcctgctggcccctccgtct

SEQ ID NO: 421474 - DNA, 20 bp, mouse
gtgggatgccaaggcgagcc

SEQ ID NO: 421475 - DNA, 20 bp, mouse
gctgccccggcccctgcaag

SEQ ID NO: 421476 - DNA, 20 bp, mouse
ggtctgtgcagcaagctgtt

SEQ ID NO: 421477 - DNA, 20 bp, mouse
ggttctgacatgaatctcag

SEQ ID NO: 421478 - DNA, 20 bp, mouse
gggccaggtctcaggcacac

SEQ ID NO: 421479 - DNA, 20 bp, mouse
gacagatccagggacactcg

SEQ ID NO: 421480 - DNA, 20 bp, mouse
gggggtcagaggctcagatg

SEQ ID NO: 421481 - DNA, 20 bp, mouse
gaggtgagctgaggaataag

SEQ ID NO: 421482 - DNA, 20 bp, mouse
gacaggagaactcaccccca

SEQ ID NO: 421483 - DNA, 20 bp, mouse
ggaagaggatgtccagtaaa

SEQ ID NO: 421484 - DNA, 20 bp, mouse
gaagggcaggagactccagg

SEQ ID NO: 421485 - DNA, 20 bp, mouse
gtgtgtattatctcccctgg

SEQ ID NO: 421486 - DNA, 20 bp, mouse
ggaaacctatggacccgcag

SEQ ID NO: 421487 - DNA, 20 bp, mouse
ggccagggaaacaggtagta

SEQ ID NO: 421488 - DNA, 20 bp, mouse
gagccgcagctgccaaggtg

SEQ ID NO: 421489 - DNA, 20 bp, mouse
ggtcacccctgcgggtccat

SEQ ID NO: 421490 - DNA, 20 bp, mouse
gagctgccaaggtgaggaca

SEQ ID NO: 421491 - DNA, 20 bp, mouse
gcggctggaggccatcggtg

SEQ ID NO: 421492 - DNA, 20 bp, mouse
ggctcccctcctcccctggt

SEQ ID NO: 421493 - DNA, 20 bp, mouse
gcagcccaaccaggggagga

SEQ ID NO: 421494 - DNA, 20 bp, mouse
gatcgtgcttagagatcctg

SEQ ID NO: 421495 - DNA, 20 bp, mouse
ggagcaagccgcagctgcca

SEQ ID NO: 421496 - DNA, 20 bp, mouse
ggcctgggcaccagctaaag

SEQ ID NO: 421497 - DNA, 20 bp, mouse
ggctgtgcggaccttccgga

SEQ ID NO: 421498 - DNA, 20 bp, mouse
gttaatgtgggagacctcgg

SEQ ID NO: 421499 - DNA, 20 bp, mouse
ggccggccaagagtgccctc

SEQ ID NO: 421500 - DNA, 20 bp, mouse
gaccttccggagggcactct

SEQ ID NO: 421501 - DNA, 20 bp, mouse
gaaacaggtagcatggctcc

SEQ ID NO: 421502 - DNA, 20 bp, mouse
gtgtcagcaaggcttatgag

SEQ ID NO: 421503 - DNA, 20 bp, mouse
gctccaaagccagatcgaga

SEQ ID NO: 421504 - DNA, 20 bp, mouse
gtccggagggcactcttggc

SEQ ID NO: 421505 - DNA, 20 bp, mouse
gtcccctttagctggtgccc

SEQ ID NO: 421506 - DNA, 20 bp, mouse
gccgcgccctggggaggaac

SEQ ID NO: 421507 - DNA, 20 bp, mouse
ggtggcccgggctaagagaa

SEQ ID NO: 421508 - DNA, 20 bp, mouse
gggcgcggaagccgagtaca

SEQ ID NO: 421509 - DNA, 20 bp, mouse
gggcccctctagctgtaccg

SEQ ID NO: 421510 - DNA, 20 bp, mouse
gactcggcttccgcgccctg

SEQ ID NO: 421511 - DNA, 20 bp, mouse
gggacaaggagaggcgtagg

SEQ ID NO: 421512 - DNA, 20 bp, mouse
gaagaaggaagcaatcggag

SEQ ID NO: 421513 - DNA, 20 bp, mouse
gtgccgcggtacagctagag

SEQ ID NO: 421514 - DNA, 20 bp, mouse
ggaggtgagctagtcctgga

SEQ ID NO: 421515 - DNA, 20 bp, mouse
gcggagaggtgagctagtcc

SEQ ID NO: 421516 - DNA, 20 bp, mouse
gttcaccatggcaagatctg

SEQ ID NO: 421517 - DNA, 20 bp, mouse
ggatcttgccatggtgaaag

SEQ ID NO: 421518 - DNA, 20 bp, mouse
gtgctccccagatcttgcca

SEQ ID NO: 421519 - DNA, 20 bp, mouse
gaactctcccgctttcacca

SEQ ID NO: 421520 - DNA, 20 bp, mouse
ggaagaggcgaatgcagagg

SEQ ID NO: 421521 - DNA, 20 bp, mouse
gtcagatggcgacagattca

SEQ ID NO: 421522 - DNA, 20 bp, mouse
ggaggaagaggcgaatgcag

SEQ ID NO: 421523 - DNA, 20 bp, mouse
gtcagcgcctacggcgaggt

SEQ ID NO: 421524 - DNA, 20 bp, mouse
gcaggatgtgcgtcatcaga

SEQ ID NO: 421525 - DNA, 20 bp, mouse
gacgcgtcccacctcgccgt

SEQ ID NO: 421526 - DNA, 20 bp, mouse
gcccccggccgagtgatctc

SEQ ID NO: 421527 - DNA, 20 bp, mouse
gaacaagtcgctggtatcca

SEQ ID NO: 421528 - DNA, 20 bp, mouse
ggacgactcccgagatcact

SEQ ID NO: 421529 - DNA, 20 bp, mouse
gcagctggcaaacaagtcgc

SEQ ID NO: 421530 - DNA, 20 bp, mouse
gtgaccgagtcagggagatc

SEQ ID NO: 421531 - DNA, 20 bp, mouse
gtatccatggcgaaagagac

SEQ ID NO: 421532 - DNA, 20 bp, mouse
gtcccgagatcactcggccg

SEQ ID NO: 421533 - DNA, 20 bp, mouse
gcctgcaccgagctaagtaa

SEQ ID NO: 421534 - DNA, 20 bp, mouse
ggcgcctcttggaacctcca

SEQ ID NO: 421535 - DNA, 20 bp, mouse
gtcttggaacctccacggag

SEQ ID NO: 421536 - DNA, 20 bp, mouse
gaggcgcccgaggtccgtct

SEQ ID NO: 421537 - DNA, 20 bp, mouse
gcgggcgcctcgctcttcgg

SEQ ID NO: 421538 - DNA, 20 bp, mouse
gttgtggagcgctttctcag

SEQ ID NO: 421539 - DNA, 20 bp, mouse
ggcacaggccgcgggaaggt

SEQ ID NO: 421540 - DNA, 20 bp, mouse
gctggtcccagacggacctc

SEQ ID NO: 421541 - DNA, 20 bp, mouse
ggggcggccaccgaagagcg

SEQ ID NO: 421542 - DNA, 20 bp, mouse
ggaatcccgagaaaacgggg

SEQ ID NO: 421543 - DNA, 20 bp, mouse
gctctccggacgctctgtaa

SEQ ID NO: 421544 - DNA, 20 bp, mouse
gaaagaatcccgagaaaacg

SEQ ID NO: 421545 - DNA, 20 bp, mouse
gcctcgggcgcctcgctctt

SEQ ID NO: 421546 - DNA, 20 bp, mouse
gacccagaacctaaacgagt

SEQ ID NO: 421547 - DNA, 20 bp, mouse
ggctttaggaacaggaatga

SEQ ID NO: 421548 - DNA, 20 bp, mouse
gagaacctaaacgagtaggt

SEQ ID NO: 421549 - DNA, 20 bp, mouse
ggggtcctacctactcgttt

SEQ ID NO: 421550 - DNA, 20 bp, mouse
ggttctgggtgcagagcttt

SEQ ID NO: 421551 - DNA, 20 bp, mouse
ggccagccgtggaggcttca

SEQ ID NO: 421552 - DNA, 20 bp, mouse
gggtgcagagctttaggaac

SEQ ID NO: 421553 - DNA, 20 bp, mouse
gacgtcgcaaggcctgaaag

SEQ ID NO: 421554 - DNA, 20 bp, mouse
gtgaaaggggatcacaaccc

SEQ ID NO: 421555 - DNA, 20 bp, mouse
gcaggaatgatggcaggcgc

SEQ ID NO: 421556 - DNA, 20 bp, mouse
gcagagcgctggcaaatcgg

SEQ ID NO: 421557 - DNA, 20 bp, mouse
gaaggacgcgggcttgcaca

SEQ ID NO: 421558 - DNA, 20 bp, mouse
ggggtgagcgcccagagcgc

SEQ ID NO: 421559 - DNA, 20 bp, mouse
gcgctcaccccagtgaatta

SEQ ID NO: 421560 - DNA, 20 bp, mouse
ggcccgcgtccttaattcac

SEQ ID NO: 421561 - DNA, 20 bp, mouse
gcccagtgaattaaggacgc

SEQ ID NO: 421562 - DNA, 20 bp, mouse
gtgcacagggcagagccaat

SEQ ID NO: 421563 - DNA, 20 bp, mouse
ggaaggcggccagcgcggat

SEQ ID NO: 421564 - DNA, 20 bp, mouse
ggcaggaagccagcggagca

SEQ ID NO: 421565 - DNA, 20 bp, mouse
gaccttgaagcagccacggc

SEQ ID NO: 421566 - DNA, 20 bp, mouse
gtcacctcgtagcagggcca

SEQ ID NO: 421567 - DNA, 20 bp, mouse
gacgaccgggggagcaccaa

SEQ ID NO: 421568 - DNA, 20 bp, mouse
gtcgccatggccctgctacg

SEQ ID NO: 421569 - DNA, 20 bp, mouse
gtgttgctgagagagccccg

SEQ ID NO: 421570 - DNA, 20 bp, mouse
ggataccgaagcacgaccgg

SEQ ID NO: 421571 - DNA, 20 bp, mouse
ggaggtgagcccagcgccct

SEQ ID NO: 421572 - DNA, 20 bp, mouse
gcccagggctgggatcgggg

SEQ ID NO: 421573 - DNA, 20 bp, mouse
gggaacaccgtggaaggcac

SEQ ID NO: 421574 - DNA, 20 bp, mouse
gcactcttaaggctgggcta

SEQ ID NO: 421575 - DNA, 20 bp, mouse
gctgggctcacctcgtagca

SEQ ID NO: 421576 - DNA, 20 bp, mouse
gggcggcacgcagggaccga

SEQ ID NO: 421577 - DNA, 20 bp, mouse
gtgcgccgagatgtgctggg

SEQ ID NO: 421578 - DNA, 20 bp, mouse
gccctgcgccgagatgtgct

SEQ ID NO: 421579 - DNA, 20 bp, mouse
ggggcgggaggcgacgccgg

SEQ ID NO: 421580 - DNA, 20 bp, mouse
ggagagggagaagaccacgt

SEQ ID NO: 421581 - DNA, 20 bp, mouse
gccgagatgtgctgggcggg

SEQ ID NO: 421582 - DNA, 20 bp, mouse
gcggctcggcgatggctgac

SEQ ID NO: 421583 - DNA, 20 bp, mouse
ggctgggcgggaggcgacgc

SEQ ID NO: 421584 - DNA, 20 bp, mouse
ggcagggtctcagcgaccgt

SEQ ID NO: 421585 - DNA, 20 bp, mouse
gtctgggcgccagtgggagg

SEQ ID NO: 421586 - DNA, 20 bp, mouse
gagcggagagcagcctgccg

SEQ ID NO: 421587 - DNA, 20 bp, mouse
gtgccggggcagcttagatc

SEQ ID NO: 421588 - DNA, 20 bp, mouse
ggcccggatctaagctgccc

SEQ ID NO: 421589 - DNA, 20 bp, mouse
gcaggacagggtgattccgg

SEQ ID NO: 421590 - DNA, 20 bp, mouse
gcatttttcaagctccttgt

SEQ ID NO: 421591 - DNA, 20 bp, mouse
gcttccaaactgcgtttcca

SEQ ID NO: 421592 - DNA, 20 bp, mouse
ggcctcaaagccttccctgt

SEQ ID NO: 421593 - DNA, 20 bp, mouse
gagatggtcagccacctaca

SEQ ID NO: 421594 - DNA, 20 bp, mouse
gtgtcctgggcaagtagaga

SEQ ID NO: 421595 - DNA, 20 bp, mouse
gaatagtcacggcagttata

SEQ ID NO: 421596 - DNA, 20 bp, mouse
gggaggacaaacgtagagag

SEQ ID NO: 421597 - DNA, 20 bp, mouse
gcagagcacgcaaagacgcc

SEQ ID NO: 421598 - DNA, 20 bp, mouse
gcttggctgaccgtctggac

SEQ ID NO: 421599 - DNA, 20 bp, mouse
ggaggggtcaaacgcaaaat

SEQ ID NO: 421600 - DNA, 20 bp, mouse
gctgcggacccatagactct

SEQ ID NO: 421601 - DNA, 20 bp, mouse
gagactctcggtgagccctg

SEQ ID NO: 421602 - DNA, 20 bp, mouse
ggatacgctgggaagcctat

SEQ ID NO: 421603 - DNA, 20 bp, mouse
gtaagagacagggatacgct

SEQ ID NO: 421604 - DNA, 20 bp, mouse
gtgcaggtatggcgaggggc

SEQ ID NO: 421605 - DNA, 20 bp, mouse
gtttctgcaggtatggcgag

SEQ ID NO: 421606 - DNA, 20 bp, mouse
ggattcctcggtgacaacag

SEQ ID NO: 421607 - DNA, 20 bp, mouse
gtcctcggtgacaacagtgg

SEQ ID NO: 421608 - DNA, 20 bp, mouse
gacagtggcggtcatggaga

SEQ ID NO: 421609 - DNA, 20 bp, mouse
ggaatccacagactgtacgg

SEQ ID NO: 421610 - DNA, 20 bp, mouse
ggtacagtctgtggattcct

SEQ ID NO: 421611 - DNA, 20 bp, mouse
ggtgacaacagtggcggtca

SEQ ID NO: 421612 - DNA, 20 bp, mouse
ggcaacctccgtacagtctg

SEQ ID NO: 421613 - DNA, 20 bp, mouse
ggatgtcaccagtgacaccg

SEQ ID NO: 421614 - DNA, 20 bp, mouse
ggccaaggcagaaaggagac

SEQ ID NO: 421615 - DNA, 20 bp, mouse
ggcacagacatgttcccagg

SEQ ID NO: 421616 - DNA, 20 bp, mouse
ggaaaactagggaggacaaa

SEQ ID NO: 421617 - DNA, 20 bp, mouse
gccaggaaccctctgattca

SEQ ID NO: 421618 - DNA, 20 bp, mouse
gtgattcacggtgaaccctg

SEQ ID NO: 421619 - DNA, 20 bp, mouse
ggggttcaccgtgaatcaga

SEQ ID NO: 421620 - DNA, 20 bp, mouse
ggggctggctaggagcgcag

SEQ ID NO: 421621 - DNA, 20 bp, mouse
gtttctgcaggtatgacgat

SEQ ID NO: 421622 - DNA, 20 bp, mouse
gagaaaacagccccagagcc

SEQ ID NO: 421623 - DNA, 20 bp, mouse
gccagacggtcagccaaggg

SEQ ID NO: 421624 - DNA, 20 bp, mouse
ggatacactggaaagcctag

SEQ ID NO: 421625 - DNA, 20 bp, mouse
gtgcaggtatgacgatgggc

SEQ ID NO: 421626 - DNA, 20 bp, mouse
gagagaagtgggtcccagac

SEQ ID NO: 421627 - DNA, 20 bp, mouse
gagttctggcctgggctaag

SEQ ID NO: 421628 - DNA, 20 bp, mouse
gcggtggtgggtctgagcca

SEQ ID NO: 421629 - DNA, 20 bp, mouse
gtccgtcaagggacccgaga

SEQ ID NO: 421630 - DNA, 20 bp, mouse
gcagccaaagcgcctgtatc

SEQ ID NO: 421631 - DNA, 20 bp, mouse
ggcctgggctaagaggcctg

SEQ ID NO: 421632 - DNA, 20 bp, mouse
gatctaggcgaggggagagt

SEQ ID NO: 421633 - DNA, 20 bp, mouse
ggatgttgcggtccggatac

SEQ ID NO: 421634 - DNA, 20 bp, mouse
ggggagagtgggtcttcggt

SEQ ID NO: 421635 - DNA, 20 bp, mouse
ggatgaagtgagtccgtcaa

SEQ ID NO: 421636 - DNA, 20 bp, mouse
gaagtcaggagcagcatgtc

SEQ ID NO: 421637 - DNA, 20 bp, mouse
gctctcgcgtggggcgactg

SEQ ID NO: 421638 - DNA, 20 bp, mouse
gcgggtgctgagggaattca

SEQ ID NO: 421639 - DNA, 20 bp, mouse
gtgtgtgctgctctcgcgtg

SEQ ID NO: 421640 - DNA, 20 bp, mouse
gtgggcaacatcgagcaggt

SEQ ID NO: 421641 - DNA, 20 bp, mouse
ggaatgaaaggtgggagcag

SEQ ID NO: 421642 - DNA, 20 bp, mouse
gctctggccagaatgaaagg

SEQ ID NO: 421643 - DNA, 20 bp, mouse
gcgtggggcgactgcggcgg

SEQ ID NO: 421644 - DNA, 20 bp, mouse
ggcaacatcgagcaggtagg

SEQ ID NO: 421645 - DNA, 20 bp, mouse
gtgggcaactctgaggaccg

SEQ ID NO: 421646 - DNA, 20 bp, mouse
ggccatggcgggatggacgg

SEQ ID NO: 421647 - DNA, 20 bp, mouse
ggcagccatggcgggatgga

SEQ ID NO: 421648 - DNA, 20 bp, mouse
gagcaggcgcgcagccatgg

SEQ ID NO: 421649 - DNA, 20 bp, mouse
ggcgcgcagccatggcggga

SEQ ID NO: 421650 - DNA, 20 bp, mouse
gggcgacgcggccggaggaa

SEQ ID NO: 421651 - DNA, 20 bp, mouse
gtaaaggtcgcactactcgg

SEQ ID NO: 421652 - DNA, 20 bp, mouse
ggccgccgtccatcccgcca

SEQ ID NO: 421653 - DNA, 20 bp, mouse
ggctgtggcgtggagaactc

SEQ ID NO: 421654 - DNA, 20 bp, mouse
gcagcgggcgtggcgccgag

SEQ ID NO: 421655 - DNA, 20 bp, mouse
gggctgtacccgcactcacc

SEQ ID NO: 421656 - DNA, 20 bp, mouse
ggctgcacggaggtggtcgg

SEQ ID NO: 421657 - DNA, 20 bp, mouse
gcttgctgcacggaggtggt

SEQ ID NO: 421658 - DNA, 20 bp, mouse
gtggcagcggcgttccgcag

SEQ ID NO: 421659 - DNA, 20 bp, mouse
gcccggagatcagtgaggga

SEQ ID NO: 421660 - DNA, 20 bp, mouse
gctccgtgcagcaagcaaaa

SEQ ID NO: 421661 - DNA, 20 bp, mouse
ggcgttccgcagaggctgca

SEQ ID NO: 421662 - DNA, 20 bp, mouse
gggttcccttcaagaagcgt

SEQ ID NO: 421663 - DNA, 20 bp, mouse
gtgaccgggtggtatcggga

SEQ ID NO: 421664 - DNA, 20 bp, mouse
gctgggtgtgcacagaacac

SEQ ID NO: 421665 - DNA, 20 bp, mouse
gcggtgtcagaaccctgctg

SEQ ID NO: 421666 - DNA, 20 bp, mouse
gcgagcaaggcggcagccat

SEQ ID NO: 421667 - DNA, 20 bp, mouse
gcgggcccgggcgagcaagg

SEQ ID NO: 421668 - DNA, 20 bp, mouse
gggctccgcactcacctcta

SEQ ID NO: 421669 - DNA, 20 bp, mouse
ggccatgggcacagacctcc

SEQ ID NO: 421670 - DNA, 20 bp, mouse
gcccgtggccctctccgtag

SEQ ID NO: 421671 - DNA, 20 bp, mouse
ggcagctctggagttccgga

SEQ ID NO: 421672 - DNA, 20 bp, mouse
gacgagtgggcagcacccag

SEQ ID NO: 421673 - DNA, 20 bp, mouse
gtggccccgggcagacgagt

SEQ ID NO: 421674 - DNA, 20 bp, mouse
gctggagttccggacggcag

SEQ ID NO: 421675 - DNA, 20 bp, mouse
gactccagagctgctgcagg

SEQ ID NO: 421676 - DNA, 20 bp, mouse
gccgagggagtcttgcgcaa

SEQ ID NO: 421677 - DNA, 20 bp, mouse
gaggggcggatgctcggagt

SEQ ID NO: 421678 - DNA, 20 bp, mouse
gaccctgcccgaagcgagga

SEQ ID NO: 421679 - DNA, 20 bp, mouse
gcccgagcttgccaggccga

SEQ ID NO: 421680 - DNA, 20 bp, mouse
gaagccttgcgagcttaaca

SEQ ID NO: 421681 - DNA, 20 bp, mouse
gagtcttgcgcaagggttcg

SEQ ID NO: 421682 - DNA, 20 bp, mouse
ggccatcctcgcttcgggca

SEQ ID NO: 421683 - DNA, 20 bp, mouse
gctgaaggaaaaccagacgg

SEQ ID NO: 421684 - DNA, 20 bp, mouse
gagtgggcggggactcaaag

SEQ ID NO: 421685 - DNA, 20 bp, mouse
ggagaccgccatcctcgctt

SEQ ID NO: 421686 - DNA, 20 bp, mouse
gggcgagacgcgaagagaag

SEQ ID NO: 421687 - DNA, 20 bp, mouse
gtcagtggtcaagacttcgg

SEQ ID NO: 421688 - DNA, 20 bp, mouse
ggcccagacacacaaccttt

SEQ ID NO: 421689 - DNA, 20 bp, mouse
ggtggtcaagacttcggcgg

SEQ ID NO: 421690 - DNA, 20 bp, mouse
gtcgcgtctcgcctgcccaa

SEQ ID NO: 421691 - DNA, 20 bp, mouse
gaaagtcgctgggcagagat

SEQ ID NO: 421692 - DNA, 20 bp, mouse
gcagctgtcgccccacactc

SEQ ID NO: 421693 - DNA, 20 bp, mouse
gtatgccagggaggccactc

SEQ ID NO: 421694 - DNA, 20 bp, mouse
ggctgggcagagataggccg

SEQ ID NO: 421695 - DNA, 20 bp, mouse
gagacacacaacctttgggc

SEQ ID NO: 421696 - DNA, 20 bp, mouse
gatgctagccggcgaggatg

SEQ ID NO: 421697 - DNA, 20 bp, mouse
ggctgaggacgcgtgcggaa

SEQ ID NO: 421698 - DNA, 20 bp, mouse
gacagagctgaggacgcgtg

SEQ ID NO: 421699 - DNA, 20 bp, mouse
ggcaccgcggggaggtaggt

SEQ ID NO: 421700 - DNA, 20 bp, mouse
ggcaggtgccgagggagttc

SEQ ID NO: 421701 - DNA, 20 bp, mouse
gacctccccgcggtgccaga

SEQ ID NO: 421702 - DNA, 20 bp, mouse
gccgcccacctacctccccg

SEQ ID NO: 421703 - DNA, 20 bp, mouse
ggcagggtcgatgaagggaa

SEQ ID NO: 421704 - DNA, 20 bp, mouse
gacgcgtgcggaacggctca

SEQ ID NO: 421705 - DNA, 20 bp, mouse
gagcagctagggattcctgg

SEQ ID NO: 421706 - DNA, 20 bp, mouse
ggagctgcctagaagtggtg

SEQ ID NO: 421707 - DNA, 20 bp, mouse
gtggagaagaatcctctggt

SEQ ID NO: 421708 - DNA, 20 bp, mouse
ggggaacggggtaacccagg

SEQ ID NO: 421709 - DNA, 20 bp, mouse
gtggggttagagctcctcct

SEQ ID NO: 421710 - DNA, 20 bp, mouse
gaaagggaacggggtaaccc

SEQ ID NO: 421711 - DNA, 20 bp, mouse
gttaatggagaagaatcctc

SEQ ID NO: 421712 - DNA, 20 bp, mouse
gggtccatgagactaaggag

SEQ ID NO: 421713 - DNA, 20 bp, mouse
gacttctaggcagctctggg

SEQ ID NO: 421714 - DNA, 20 bp, mouse
gcccaggctcttcctaccag

SEQ ID NO: 421715 - DNA, 20 bp, mouse
gtctttccccaaagggaacg

SEQ ID NO: 421716 - DNA, 20 bp, mouse
ggcagccgcgaagactgcaa

SEQ ID NO: 421717 - DNA, 20 bp, mouse
ggcggaggaagaggcggcca

SEQ ID NO: 421718 - DNA, 20 bp, mouse
gcgggaggcactaggagaca

SEQ ID NO: 421719 - DNA, 20 bp, mouse
gtcagctggggcggaggaag

SEQ ID NO: 421720 - DNA, 20 bp, mouse
gcgcgaagactgcaacggct

SEQ ID NO: 421721 - DNA, 20 bp, mouse
gcaggataggcagctccggg

SEQ ID NO: 421722 - DNA, 20 bp, mouse
gggagagcgctgcgctccct

SEQ ID NO: 421723 - DNA, 20 bp, mouse
gcagccggcgggcgctacca

SEQ ID NO: 421724 - DNA, 20 bp, mouse
gacggcggttacctgaagcg

SEQ ID NO: 421725 - DNA, 20 bp, mouse
gcacgccccgccgccaggat

SEQ ID NO: 421726 - DNA, 20 bp, mouse
gcgcgaggtgatcagcacag

SEQ ID NO: 421727 - DNA, 20 bp, mouse
gggcgccacagacggtccac

SEQ ID NO: 421728 - DNA, 20 bp, mouse
gctcactgtgcggaggacca

SEQ ID NO: 421729 - DNA, 20 bp, mouse
gccggcccgtggaccgtctg

SEQ ID NO: 421730 - DNA, 20 bp, mouse
gctggacggagcagaagacc

SEQ ID NO: 421731 - DNA, 20 bp, mouse
ggcgcgtcgagcggcatccc

SEQ ID NO: 421732 - DNA, 20 bp, mouse
ggcgagcggtgctcactgtg

SEQ ID NO: 421733 - DNA, 20 bp, mouse
gcgtccaggtggactcggag

SEQ ID NO: 421734 - DNA, 20 bp, mouse
gcgacggcggcggggagatc

SEQ ID NO: 421735 - DNA, 20 bp, mouse
gaggaccaaggcgcgtcgag

SEQ ID NO: 421736 - DNA, 20 bp, mouse
gagacgcgaaaggctgtcaa

SEQ ID NO: 421737 - DNA, 20 bp, mouse
gacgccgtgcagagccacca

SEQ ID NO: 421738 - DNA, 20 bp, mouse
gctctgcggtggggaagtgg

SEQ ID NO: 421739 - DNA, 20 bp, mouse
ggcagccatggagacgcgaa

SEQ ID NO: 421740 - DNA, 20 bp, mouse
gagggcagagagacgcgccg

SEQ ID NO: 421741 - DNA, 20 bp, mouse
gggtggggaagtggaggccg

SEQ ID NO: 421742 - DNA, 20 bp, mouse
ggacgtcgcaagctctgcgg

SEQ ID NO: 421743 - DNA, 20 bp, mouse
gaagctctgcggtggggaag

SEQ ID NO: 421744 - DNA, 20 bp, mouse
gcacgacgtcgcaagctctg

SEQ ID NO: 421745 - DNA, 20 bp, mouse
gcaggtggactgacacacga

SEQ ID NO: 421746 - DNA, 20 bp, mouse
gagagcgacaagatgaatgc

SEQ ID NO: 421747 - DNA, 20 bp, mouse
gcgctgagacgatgaccacg

SEQ ID NO: 421748 - DNA, 20 bp, mouse
ggcgggacactcacctatag

SEQ ID NO: 421749 - DNA, 20 bp, mouse
gggtgagcctggcagagcgg

SEQ ID NO: 421750 - DNA, 20 bp, mouse
gccgcgagctgtggagtctg

SEQ ID NO: 421751 - DNA, 20 bp, mouse
ggagccaatcgcagcacgag

SEQ ID NO: 421752 - DNA, 20 bp, mouse
gtgtcgggaaggagggtcac

SEQ ID NO: 421753 - DNA, 20 bp, mouse
gaatgcgggctcagaccccg

SEQ ID NO: 421754 - DNA, 20 bp, mouse
ggacatgatcgcggagactc

SEQ ID NO: 421755 - DNA, 20 bp, mouse
gcagcggcgcgcaccgctat

SEQ ID NO: 421756 - DNA, 20 bp, mouse
gagggctgtgcagacgccag

SEQ ID NO: 421757 - DNA, 20 bp, mouse
ggacgccaggggagagcaac

SEQ ID NO: 421758 - DNA, 20 bp, mouse
ggagacgatgaccactgggt

SEQ ID NO: 421759 - DNA, 20 bp, mouse
gctgtggtggcagatactag

SEQ ID NO: 421760 - DNA, 20 bp, mouse
gcgccgagacgatgaccact

SEQ ID NO: 421761 - DNA, 20 bp, mouse
gcctccgcaacactgaccta

SEQ ID NO: 421762 - DNA, 20 bp, mouse
gccgcaacactgacctatgg

SEQ ID NO: 421763 - DNA, 20 bp, mouse
ggaccaccgagggggagggt

SEQ ID NO: 421764 - DNA, 20 bp, mouse
gcagtgctttgccaagccca

SEQ ID NO: 421765 - DNA, 20 bp, mouse
gcactgacctatggcggtac

SEQ ID NO: 421766 - DNA, 20 bp, mouse
ggcgctgcgagcggagatgg

SEQ ID NO: 421767 - DNA, 20 bp, mouse
gcctcctcggcggggacagg

SEQ ID NO: 421768 - DNA, 20 bp, mouse
gtccgctcgcagcgcctcct

SEQ ID NO: 421769 - DNA, 20 bp, mouse
ggcgcctcctcggcggggac

SEQ ID NO: 421770 - DNA, 20 bp, mouse
gctgaacgtagagcagctcg

SEQ ID NO: 421771 - DNA, 20 bp, mouse
gtcagcaggaagtcgatacg

SEQ ID NO: 421772 - DNA, 20 bp, mouse
ggtgtgaccaggggccggac

SEQ ID NO: 421773 - DNA, 20 bp, mouse
gcggccccggggaatggact

SEQ ID NO: 421774 - DNA, 20 bp, mouse
gagggttctaggtctctcag

SEQ ID NO: 421775 - DNA, 20 bp, mouse
gccggcccgcagtcccgcag

SEQ ID NO: 421776 - DNA, 20 bp, mouse
ggcgcctaggggtgagtgag

SEQ ID NO: 421777 - DNA, 20 bp, mouse
gcctggcagtgggcgcctag

SEQ ID NO: 421778 - DNA, 20 bp, mouse
gcagcctctcactcacccct

SEQ ID NO: 421779 - DNA, 20 bp, mouse
gtcttctcatcactcaccag

SEQ ID NO: 421780 - DNA, 20 bp, mouse
ggaggtcaatcggaagcctc

SEQ ID NO: 421781 - DNA, 20 bp, mouse
gagtgatgagaagaggaccc

SEQ ID NO: 421782 - DNA, 20 bp, mouse
gaccctggtgtcctggcagt

SEQ ID NO: 421783 - DNA, 20 bp, mouse
gacttggccatgagtgggag

SEQ ID NO: 421784 - DNA, 20 bp, mouse
gagcgccaatgaggccaggg

SEQ ID NO: 421785 - DNA, 20 bp, mouse
gtctggaacaagaggtcaat

SEQ ID NO: 421786 - DNA, 20 bp, mouse
gggcgaacgcgtagacacca

SEQ ID NO: 421787 - DNA, 20 bp, mouse
ggcggagcgaggccgaactt

SEQ ID NO: 421788 - DNA, 20 bp, mouse
ggagcgaggccgaacttagg

SEQ ID NO: 421789 - DNA, 20 bp, mouse
gggcgcgcagctccaggcct

SEQ ID NO: 421790 - DNA, 20 bp, mouse
gtccaggcctggggtcccgc

SEQ ID NO: 421791 - DNA, 20 bp, mouse
gaagaccgactcactagtag

SEQ ID NO: 421792 - DNA, 20 bp, mouse
gtccctaagggacccggcta

SEQ ID NO: 421793 - DNA, 20 bp, mouse
gcccttgtctggctccctaa

SEQ ID NO: 421794 - DNA, 20 bp, mouse
ggcctcgcaccgcctaagtt

SEQ ID NO: 421795 - DNA, 20 bp, mouse
gggctaaggtggatggacta

SEQ ID NO: 421796 - DNA, 20 bp, mouse
gcccgccccagagtcaccgg

SEQ ID NO: 421797 - DNA, 20 bp, mouse
gcgcggcggcggaggctagt

SEQ ID NO: 421798 - DNA, 20 bp, mouse
gactctggggcggggctgtg

SEQ ID NO: 421799 - DNA, 20 bp, mouse
ggggtcctccggtgactctg

SEQ ID NO: 421800 - DNA, 20 bp, mouse
gtggggcggctgcccaccga

SEQ ID NO: 421801 - DNA, 20 bp, mouse
ggagaagttctgccgtcggt

SEQ ID NO: 421802 - DNA, 20 bp, mouse
gggtggggtttgctgcacgg

SEQ ID NO: 421803 - DNA, 20 bp, mouse
gggcaggcgtcgagacaaaa

SEQ ID NO: 421804 - DNA, 20 bp, mouse
gtcttagacacgccccacga

SEQ ID NO: 421805 - DNA, 20 bp, mouse
gagttcccataagcccgcgg

SEQ ID NO: 421806 - DNA, 20 bp, mouse
gcgggcctcggtgacagaca

SEQ ID NO: 421807 - DNA, 20 bp, mouse
gacccggatagggcccccag

SEQ ID NO: 421808 - DNA, 20 bp, mouse
gccgctcggctggaagatga

SEQ ID NO: 421809 - DNA, 20 bp, mouse
gaagcccgaggggaaaccgg

SEQ ID NO: 421810 - DNA, 20 bp, mouse
gccgcctgctccgctagcgt

SEQ ID NO: 421811 - DNA, 20 bp, mouse
gccgctagcgtgggttgcgg

SEQ ID NO: 421812 - DNA, 20 bp, mouse
ggggatggagatacgggcct

SEQ ID NO: 421813 - DNA, 20 bp, mouse
gcggcgcgtgcggctgggac

SEQ ID NO: 421814 - DNA, 20 bp, mouse
gaacgcagtgagctgtctgg

SEQ ID NO: 421815 - DNA, 20 bp, mouse
ggtatctccatcccgcaccg

SEQ ID NO: 421816 - DNA, 20 bp, mouse
gttgcaggtaagccagatct

SEQ ID NO: 421817 - DNA, 20 bp, mouse
gaggacataatgatgagaca

SEQ ID NO: 421818 - DNA, 20 bp, mouse
gctcagagtgagagtccccg

SEQ ID NO: 421819 - DNA, 20 bp, mouse
ggcgcttcggataattgctt

SEQ ID NO: 421820 - DNA, 20 bp, mouse
gaggtgtgggagtcactgca

SEQ ID NO: 421821 - DNA, 20 bp, mouse
gtatccgaagcgctctgatg

SEQ ID NO: 421822 - DNA, 20 bp, mouse
gaggttgctatagagatcct

SEQ ID NO: 421823 - DNA, 20 bp, mouse
gcagcagcagaaggctcctg

SEQ ID NO: 421824 - DNA, 20 bp, mouse
ggggactctcactctgagct

SEQ ID NO: 421825 - DNA, 20 bp, mouse
gagaattgacaagctcctgg

SEQ ID NO: 421826 - DNA, 20 bp, mouse
ggcgatctggcgggaacaca

SEQ ID NO: 421827 - DNA, 20 bp, mouse
ggagcaccgcggagcgaacc

SEQ ID NO: 421828 - DNA, 20 bp, mouse
ggctcgggctgtggacaacg

SEQ ID NO: 421829 - DNA, 20 bp, mouse
ggagtctgtgccctgactcc

SEQ ID NO: 421830 - DNA, 20 bp, mouse
ggaagcgatcaagagcaccg

SEQ ID NO: 421831 - DNA, 20 bp, mouse
gtcgcgcgcgtgaaaaccca

SEQ ID NO: 421832 - DNA, 20 bp, mouse
gtccgccacagtgcaccgaa

SEQ ID NO: 421833 - DNA, 20 bp, mouse
ggtatcacggaagtccgatc

SEQ ID NO: 421834 - DNA, 20 bp, mouse
gcaaggcgctgtagtcaatc

SEQ ID NO: 421835 - DNA, 20 bp, mouse
gtctgaggcccggaaacccc

SEQ ID NO: 421836 - DNA, 20 bp, mouse
gcagtccgaagtctaaatcc

SEQ ID NO: 421837 - DNA, 20 bp, mouse
gaatgaaggtgagctcggtg

SEQ ID NO: 421838 - DNA, 20 bp, mouse
ggtctaccagacacagaagt

SEQ ID NO: 421839 - DNA, 20 bp, mouse
gggagtgtctttgtcattca

SEQ ID NO: 421840 - DNA, 20 bp, mouse
gcacgaggcacggccactag

SEQ ID NO: 421841 - DNA, 20 bp, mouse
gaagccggtgcttgagaact

SEQ ID NO: 421842 - DNA, 20 bp, mouse
gcaggcacatcggcccctag

SEQ ID NO: 421843 - DNA, 20 bp, mouse
ggtcaaaacggaaaacaccg

SEQ ID NO: 421844 - DNA, 20 bp, mouse
gagctccagggcactgtgtg

SEQ ID NO: 421845 - DNA, 20 bp, mouse
gatgagaaatagaggctcaa

SEQ ID NO: 421846 - DNA, 20 bp, mouse
gctgggcgacccccaggaaa

SEQ ID NO: 421847 - DNA, 20 bp, mouse
gtctcccgctagaggcggag

SEQ ID NO: 421848 - DNA, 20 bp, mouse
gattagcagggcggcaccct

SEQ ID NO: 421849 - DNA, 20 bp, mouse
ggcgggaagaccctttcctg

SEQ ID NO: 421850 - DNA, 20 bp, mouse
ggcggagcggcggtgctcgc

SEQ ID NO: 421851 - DNA, 20 bp, mouse
ggtgcttcctctcccgctag

SEQ ID NO: 421852 - DNA, 20 bp, mouse
gcctgaatcggacattagca

SEQ ID NO: 421853 - DNA, 20 bp, mouse
ggagacccgggtagagaagg

SEQ ID NO: 421854 - DNA, 20 bp, mouse
gggcaccctgggcgaccccc

SEQ ID NO: 421855 - DNA, 20 bp, mouse
gcttcctctcccgctagagg

SEQ ID NO: 421856 - DNA, 20 bp, mouse
gggtcgcggcacgagagaag

SEQ ID NO: 421857 - DNA, 20 bp, mouse
ggcagcgacagcatcaagag

SEQ ID NO: 421858 - DNA, 20 bp, mouse
ggcgacagcatcaagagcgg

SEQ ID NO: 421859 - DNA, 20 bp, mouse
gtcaagagcggaggcgacaa

SEQ ID NO: 421860 - DNA, 20 bp, mouse
gcgcgcgcaccgcgccatgg

SEQ ID NO: 421861 - DNA, 20 bp, mouse
gataatccgcagggcggtcg

SEQ ID NO: 421862 - DNA, 20 bp, mouse
gtggccggacgcggccccca

SEQ ID NO: 421863 - DNA, 20 bp, mouse
ggcgcacgacaccaacatca

SEQ ID NO: 421864 - DNA, 20 bp, mouse
gcgcccccgctggccggacg

SEQ ID NO: 421865 - DNA, 20 bp, mouse
gggacgcagcggccaatcac

SEQ ID NO: 421866 - DNA, 20 bp, mouse
gtctagggaaagttgctcag

SEQ ID NO: 421867 - DNA, 20 bp, mouse
gggaaagttgctcagtggat

SEQ ID NO: 421868 - DNA, 20 bp, mouse
gtgctcagtggatgggatct

SEQ ID NO: 421869 - DNA, 20 bp, mouse
gagttcttgaggctacccag

SEQ ID NO: 421870 - DNA, 20 bp, mouse
gactaggatcagagctacag

SEQ ID NO: 421871 - DNA, 20 bp, mouse
gggatgggatcttggcgcac

SEQ ID NO: 421872 - DNA, 20 bp, mouse
gaagcaatcaataaccccct

SEQ ID NO: 421873 - DNA, 20 bp, mouse
gaatataatgagaatagtga

SEQ ID NO: 421874 - DNA, 20 bp, mouse
gtttagccatctgggagact

SEQ ID NO: 421875 - DNA, 20 bp, mouse
gactgctcagtccctcaccg

SEQ ID NO: 421876 - DNA, 20 bp, mouse
gcaagagttgccggtgagag

SEQ ID NO: 421877 - DNA, 20 bp, mouse
gctcccacagtcctgagcca

SEQ ID NO: 421878 - DNA, 20 bp, mouse
gagcacaagtagcaaggccc

SEQ ID NO: 421879 - DNA, 20 bp, mouse
gtgccatggctcaggactgt

SEQ ID NO: 421880 - DNA, 20 bp, mouse
ggagccatggcaagagttgc

SEQ ID NO: 421881 - DNA, 20 bp, mouse
gtcaccggcaactcttgcca

SEQ ID NO: 421882 - DNA, 20 bp, mouse
gcaagggagggagaacgtgt

SEQ ID NO: 421883 - DNA, 20 bp, mouse
gggagagacaagcttaagta

SEQ ID NO: 421884 - DNA, 20 bp, mouse
gcgtgtgggcctggaggaag

SEQ ID NO: 421885 - DNA, 20 bp, mouse
ggaacaagatgaacttgccc

SEQ ID NO: 421886 - DNA, 20 bp, mouse
gcagctggcgcacctctgcc

SEQ ID NO: 421887 - DNA, 20 bp, mouse
gggcacaggatgcatgtacc

SEQ ID NO: 421888 - DNA, 20 bp, mouse
gtccacctcagaactctgat

SEQ ID NO: 421889 - DNA, 20 bp, mouse
gtccctggctgggcactcct

SEQ ID NO: 421890 - DNA, 20 bp, mouse
ggcgcacctctgccaggcac

SEQ ID NO: 421891 - DNA, 20 bp, mouse
ggtgcccagccagggagagg

SEQ ID NO: 421892 - DNA, 20 bp, mouse
gatgctggacatctttgctc

SEQ ID NO: 421893 - DNA, 20 bp, mouse
ggggatggtgctgtgatggt

SEQ ID NO: 421894 - DNA, 20 bp, mouse
ggtggccgagttctacaata

SEQ ID NO: 421895 - DNA, 20 bp, mouse
gaatcagtaggatggaacct

SEQ ID NO: 421896 - DNA, 20 bp, mouse
gagaaaggctcagttctggt

SEQ ID NO: 421897 - DNA, 20 bp, mouse
ggtactagggcacctgaggc

SEQ ID NO: 421898 - DNA, 20 bp, mouse
gaggcgccagccccggtccc

SEQ ID NO: 421899 - DNA, 20 bp, mouse
ggtcctccggggaccggggc

SEQ ID NO: 421900 - DNA, 20 bp, mouse
ggccagccctaagccatctc

SEQ ID NO: 421901 - DNA, 20 bp, mouse
gatatatgtttacctaacac

SEQ ID NO: 421902 - DNA, 20 bp, mouse
ggccgagtttgcgcccgaga

SEQ ID NO: 421903 - DNA, 20 bp, mouse
gttgcgcccgagatggctta

SEQ ID NO: 421904 - DNA, 20 bp, mouse
gcggctggggttcgttcatt

SEQ ID NO: 421905 - DNA, 20 bp, mouse
ggcttagggctggcgccgat

SEQ ID NO: 421906 - DNA, 20 bp, mouse
ggcctgagccggcccgagag

SEQ ID NO: 421907 - DNA, 20 bp, mouse
gacgcggagggcgaacctgg

SEQ ID NO: 421908 - DNA, 20 bp, mouse
gctccggctgtggaccgcaa

SEQ ID NO: 421909 - DNA, 20 bp, mouse
ggcgccgaggggagacgtgt

SEQ ID NO: 421910 - DNA, 20 bp, mouse
gcgaacctggcggcgagggt

SEQ ID NO: 421911 - DNA, 20 bp, mouse
ggtgtggggcgtcagcgcga

SEQ ID NO: 421912 - DNA, 20 bp, mouse
gggcgtcagcgcgatggctc

SEQ ID NO: 421913 - DNA, 20 bp, mouse
ggacgtgtgggagaacgcgg

SEQ ID NO: 421914 - DNA, 20 bp, mouse
gagcgcgatggctccggctg

SEQ ID NO: 421915 - DNA, 20 bp, mouse
gggagacgtgtgggagaacg

SEQ ID NO: 421916 - DNA, 20 bp, mouse
gagcctgcgccggggaacat

SEQ ID NO: 421917 - DNA, 20 bp, mouse
ggggttgggagactcacctg

SEQ ID NO: 421918 - DNA, 20 bp, mouse
gcggaggcggctgtcactgt

SEQ ID NO: 421919 - DNA, 20 bp, mouse
gggaggcggccaatgttccc

SEQ ID NO: 421920 - DNA, 20 bp, mouse
gcggctagcgggagtttcag

SEQ ID NO: 421921 - DNA, 20 bp, mouse
gtcggtggagggtcctgggt

SEQ ID NO: 421922 - DNA, 20 bp, mouse
gcctctaggcaggccccacg

SEQ ID NO: 421923 - DNA, 20 bp, mouse
gattggccgcctccagctcc

SEQ ID NO: 421924 - DNA, 20 bp, mouse
gcacctgaggcggccaagcc

SEQ ID NO: 421925 - DNA, 20 bp, mouse
gcagtaggagctctgttggg

SEQ ID NO: 421926 - DNA, 20 bp, mouse
gagtacctcacgcaagatgg

SEQ ID NO: 421927 - DNA, 20 bp, mouse
gtccagtgcggccttcaggt

SEQ ID NO: 421928 - DNA, 20 bp, mouse
gaccgacctgaaggccgcac

SEQ ID NO: 421929 - DNA, 20 bp, mouse
gatgcccgaagccgtcggga

SEQ ID NO: 421930 - DNA, 20 bp, mouse
gccgagtacctcacgcaaga

SEQ ID NO: 421931 - DNA, 20 bp, mouse
gcgttgccgaggtgtcggag

SEQ ID NO: 421932 - DNA, 20 bp, mouse
gaggcctcgctgctccagtg

SEQ ID NO: 421933 - DNA, 20 bp, mouse
gctggacgggaagcctcttc

SEQ ID NO: 421934 - DNA, 20 bp, mouse
gtgtcggaggggagcggacc

SEQ ID NO: 421935 - DNA, 20 bp, mouse
ggaagatgcccgaagccgtc

SEQ ID NO: 421936 - DNA, 20 bp, mouse
ggcagcaccaccctccccaa

SEQ ID NO: 421937 - DNA, 20 bp, mouse
gacatccgccggagtctgag

SEQ ID NO: 421938 - DNA, 20 bp, mouse
gagtctggctctggtaggtc

SEQ ID NO: 421939 - DNA, 20 bp, mouse
ggggccctctcagactccgg

SEQ ID NO: 421940 - DNA, 20 bp, mouse
gtgtcctggggcaaacagtc

SEQ ID NO: 421941 - DNA, 20 bp, mouse
ggtccatggcctctcaccca

SEQ ID NO: 421942 - DNA, 20 bp, mouse
gagactccggcggatgtcct

SEQ ID NO: 421943 - DNA, 20 bp, mouse
gtttgccccaggacatccgc

SEQ ID NO: 421944 - DNA, 20 bp, mouse
gcagagtgagcaggagtctc

SEQ ID NO: 421945 - DNA, 20 bp, mouse
gatgcagggtcccaaagaag

SEQ ID NO: 421946 - DNA, 20 bp, mouse
gctgtggtttgccttcctga

SEQ ID NO: 421947 - DNA, 20 bp, mouse
ggcctgcagcgctcaccgtc

SEQ ID NO: 421948 - DNA, 20 bp, mouse
ggcagcgctcaccgtcagga

SEQ ID NO: 421949 - DNA, 20 bp, mouse
gggctttcttacttacctca

SEQ ID NO: 421950 - DNA, 20 bp, mouse
ggtagcaactgagatctctc

SEQ ID NO: 421951 - DNA, 20 bp, mouse
gctctaaagcccccagctca

SEQ ID NO: 421952 - DNA, 20 bp, mouse
ggagcagtagcttgcaatgc

SEQ ID NO: 421953 - DNA, 20 bp, mouse
gcagctttgccgagcaacta

SEQ ID NO: 421954 - DNA, 20 bp, mouse
gcaatctgataaccagaagt

SEQ ID NO: 421955 - DNA, 20 bp, mouse
ggctactgctcctgatttgg

SEQ ID NO: 421956 - DNA, 20 bp, mouse
gtgagaggtggacttcgtca

SEQ ID NO: 421957 - DNA, 20 bp, mouse
gaagcgcagggtgcgtatga

SEQ ID NO: 421958 - DNA, 20 bp, mouse
gatggcgtacctgagagaat

SEQ ID NO: 421959 - DNA, 20 bp, mouse
gcttggcgatcgctgagagg

SEQ ID NO: 421960 - DNA, 20 bp, mouse
ggggccgtctgccaagcgca

SEQ ID NO: 421961 - DNA, 20 bp, mouse
gccagaggcgaaggtaactc

SEQ ID NO: 421962 - DNA, 20 bp, mouse
gattcaagatggctacccag

SEQ ID NO: 421963 - DNA, 20 bp, mouse
gcatcttggcgatcgctgag

SEQ ID NO: 421964 - DNA, 20 bp, mouse
gagctcagggagattcaaga

SEQ ID NO: 421965 - DNA, 20 bp, mouse
ggagcagaaggccttagact

SEQ ID NO: 421966 - DNA, 20 bp, mouse
gtggagcgatccgaagagtt

SEQ ID NO: 421967 - DNA, 20 bp, mouse
gtttctcgaagaggtgagta

SEQ ID NO: 421968 - DNA, 20 bp, mouse
gtggggtgagctggtgctta

SEQ ID NO: 421969 - DNA, 20 bp, mouse
gaggtgagtacggcagtcgt

SEQ ID NO: 421970 - DNA, 20 bp, mouse
gacgcgcaaaggcaatccgg

SEQ ID NO: 421971 - DNA, 20 bp, mouse
gccgaagagttggggtgagc

SEQ ID NO: 421972 - DNA, 20 bp, mouse
ggcccagccagggagcccgg

SEQ ID NO: 421973 - DNA, 20 bp, mouse
gggcggggaggagcccactt

SEQ ID NO: 421974 - DNA, 20 bp, mouse
gggaacaaaagccggatccc

SEQ ID NO: 421975 - DNA, 20 bp, mouse
gcactcaggctttctcgaag

SEQ ID NO: 421976 - DNA, 20 bp, mouse
gcgtgtctcctctggtcctg

SEQ ID NO: 421977 - DNA, 20 bp, mouse
gtatgtacacgtgtctcctc

SEQ ID NO: 421978 - DNA, 20 bp, mouse
gcattggagatggaatggta

SEQ ID NO: 421979 - DNA, 20 bp, mouse
ggaaataagggccttctcgg

SEQ ID NO: 421980 - DNA, 20 bp, mouse
ggagagaaatctatgaacag

SEQ ID NO: 421981 - DNA, 20 bp, mouse
gctagatcgggccattcctt

SEQ ID NO: 421982 - DNA, 20 bp, mouse
ggaatggcccgatctagaaa

SEQ ID NO: 421983 - DNA, 20 bp, mouse
gcccgatctagaaaaggtaa

SEQ ID NO: 421984 - DNA, 20 bp, mouse
gacccccccaagaatgaaga

SEQ ID NO: 421985 - DNA, 20 bp, mouse
gaaaggctgtgtaatttgag

SEQ ID NO: 421986 - DNA, 20 bp, mouse
ggagagtccgggctttatat

SEQ ID NO: 421987 - DNA, 20 bp, mouse
gccagggctttgaggtccgg

SEQ ID NO: 421988 - DNA, 20 bp, mouse
gaagcatgtctcgagagtcc

SEQ ID NO: 421989 - DNA, 20 bp, mouse
gcccaaggtccgggacgagg

SEQ ID NO: 421990 - DNA, 20 bp, mouse
gccgcgcctgcgcagaaggt

SEQ ID NO: 421991 - DNA, 20 bp, mouse
gctgggtgaccagtacgtga

SEQ ID NO: 421992 - DNA, 20 bp, mouse
ggtccgtgcacggccaaaca

SEQ ID NO: 421993 - DNA, 20 bp, mouse
gcaggcgcggcgcgatgccg

SEQ ID NO: 421994 - DNA, 20 bp, mouse
gctctcgagacatgcttccc

SEQ ID NO: 421995 - DNA, 20 bp, mouse
gcgattcttgaaggaatggg

SEQ ID NO: 421996 - DNA, 20 bp, mouse
gcctgtttgttaggttccca

SEQ ID NO: 421997 - DNA, 20 bp, mouse
gcaactgagctgctccagaa

SEQ ID NO: 421998 - DNA, 20 bp, mouse
gtgaacacgtggtgagatgg

SEQ ID NO: 421999 - DNA, 20 bp, mouse
gcctgctcctgctctgacct

SEQ ID NO: 422000 - DNA, 20 bp, mouse
ggaattcagatgcacagtgt

SEQ ID NO: 422001 - DNA, 20 bp, mouse
gtcttgcctttaaggaacaa

SEQ ID NO: 422002 - DNA, 20 bp, mouse
gaacctaacaaacaggatct

SEQ ID NO: 422003 - DNA, 20 bp, mouse
ggctcagttgaaaggcagcc

SEQ ID NO: 422004 - DNA, 20 bp, mouse
gcagatgcacagtgtaggac

SEQ ID NO: 422005 - DNA, 20 bp, mouse
gtgaacaggtcatgaacacg

SEQ ID NO: 422006 - DNA, 20 bp, mouse
ggccccccttcccccaacca

SEQ ID NO: 422007 - DNA, 20 bp, mouse
gagtataaaatgtgtagctc

SEQ ID NO: 422008 - DNA, 20 bp, mouse
gtcatcatcaaggtgttgag

SEQ ID NO: 422009 - DNA, 20 bp, mouse
ggtccaaacagatgcaaagg

SEQ ID NO: 422010 - DNA, 20 bp, mouse
ggagaagacaccggctttgg

SEQ ID NO: 422011 - DNA, 20 bp, mouse
gcatagtcaccccccaaagc

SEQ ID NO: 422012 - DNA, 20 bp, mouse
gctggagaagacaccggctt

SEQ ID NO: 422013 - DNA, 20 bp, mouse
gctgggcagtagagagatgt

SEQ ID NO: 422014 - DNA, 20 bp, mouse
gagtagagagatgttggtgg

SEQ ID NO: 422015 - DNA, 20 bp, mouse
gggcagtagagagatgttgg

SEQ ID NO: 422016 - DNA, 20 bp, mouse
gcggaggaccgctcagtggg

SEQ ID NO: 422017 - DNA, 20 bp, mouse
gcgtccggaggaccgctcag

SEQ ID NO: 422018 - DNA, 20 bp, mouse
gtcgctgccggagcgtccgg

SEQ ID NO: 422019 - DNA, 20 bp, mouse
ggttccggcccgctctccac

SEQ ID NO: 422020 - DNA, 20 bp, mouse
gccgcgctcctcccactgag

SEQ ID NO: 422021 - DNA, 20 bp, mouse
gggcagcgaggcgggaccgg

SEQ ID NO: 422022 - DNA, 20 bp, mouse
gagttcccggagcacacagg

SEQ ID NO: 422023 - DNA, 20 bp, mouse
gtccagagcgacgcaggctg

SEQ ID NO: 422024 - DNA, 20 bp, mouse
ggcctcgctgccggagcgtc

SEQ ID NO: 422025 - DNA, 20 bp, mouse
gtgcagttcccggagcacac

SEQ ID NO: 422026 - DNA, 20 bp, mouse
gtaagcgagcccagagacgt

SEQ ID NO: 422027 - DNA, 20 bp, mouse
gacaacgcaggaacccacaa

SEQ ID NO: 422028 - DNA, 20 bp, mouse
gcagagacgtgggtttacgg

SEQ ID NO: 422029 - DNA, 20 bp, mouse
gggctcgcttacctgcagcc

SEQ ID NO: 422030 - DNA, 20 bp, mouse
gtcctaggtcaaggcgtccc

SEQ ID NO: 422031 - DNA, 20 bp, mouse
ggtcaaggcgtccctggcac

SEQ ID NO: 422032 - DNA, 20 bp, mouse
gcagccgcgggcaaggcagg

SEQ ID NO: 422033 - DNA, 20 bp, mouse
gtgggttcctgcgttgtcct

SEQ ID NO: 422034 - DNA, 20 bp, mouse
gtggaatccatgctccccca

SEQ ID NO: 422035 - DNA, 20 bp, mouse
gccttgacctaggacaacgc

SEQ ID NO: 422036 - DNA, 20 bp, mouse
gcgctgaaccttgagccctc

SEQ ID NO: 422037 - DNA, 20 bp, mouse
gcctccatctcgagctggac

SEQ ID NO: 422038 - DNA, 20 bp, mouse
gcgtcgcctccatctcgagc

SEQ ID NO: 422039 - DNA, 20 bp, mouse
gtgagcaaagggaatgtgga

SEQ ID NO: 422040 - DNA, 20 bp, mouse
ggggcagcggcttgcacatg

SEQ ID NO: 422041 - DNA, 20 bp, mouse
gcgtcacttcttggctccgg

SEQ ID NO: 422042 - DNA, 20 bp, mouse
gatcgccaaaaaggccgatc

SEQ ID NO: 422043 - DNA, 20 bp, mouse
ggcttgaccaatcgccaaaa

SEQ ID NO: 422044 - DNA, 20 bp, mouse
gcttccagtccagctcgaga

SEQ ID NO: 422045 - DNA, 20 bp, mouse
gcgagctggactggaagagg

SEQ ID NO: 422046 - DNA, 20 bp, mouse
gtggcgtcacctagaaggtg

SEQ ID NO: 422047 - DNA, 20 bp, mouse
ggttgccggtgtttggaggt

SEQ ID NO: 422048 - DNA, 20 bp, mouse
gtaccggtttttctctacct

SEQ ID NO: 422049 - DNA, 20 bp, mouse
gctaccaccgaggaaaataa

SEQ ID NO: 422050 - DNA, 20 bp, mouse
gatggcagaggactatctca

SEQ ID NO: 422051 - DNA, 20 bp, mouse
ggaacttgatggatgtgtaa

SEQ ID NO: 422052 - DNA, 20 bp, mouse
gagtaggtatttccacagtc

SEQ ID NO: 422053 - DNA, 20 bp, mouse
gcggtttttctctacctggg

SEQ ID NO: 422054 - DNA, 20 bp, mouse
gtgtccacccgtgggtaggc

SEQ ID NO: 422055 - DNA, 20 bp, mouse
gttcaaaatacagtaagatt

SEQ ID NO: 422056 - DNA, 20 bp, mouse
gccagggctcaggtgaccag

SEQ ID NO: 422057 - DNA, 20 bp, mouse
gaggctgtgggggggtctgt

SEQ ID NO: 422058 - DNA, 20 bp, mouse
gaggtgaccagcggcccttt

SEQ ID NO: 422059 - DNA, 20 bp, mouse
gtggacttgctggcagtccc

SEQ ID NO: 422060 - DNA, 20 bp, mouse
gggattgtgcacaggaccca

SEQ ID NO: 422061 - DNA, 20 bp, mouse
gggagggcggggaccttggg

SEQ ID NO: 422062 - DNA, 20 bp, mouse
gtaggctcctaaagggccgc

SEQ ID NO: 422063 - DNA, 20 bp, mouse
gtataacttaagaagtccgt

SEQ ID NO: 422064 - DNA, 20 bp, mouse
gaaaagcagccggcttctcc

SEQ ID NO: 422065 - DNA, 20 bp, mouse
gtgcgaagggtatggactgt

SEQ ID NO: 422066 - DNA, 20 bp, mouse
gaggacgatggagtcgatgg

SEQ ID NO: 422067 - DNA, 20 bp, mouse
ggttctctcagccaggacga

SEQ ID NO: 422068 - DNA, 20 bp, mouse
gtggaagccagagagagcgt

SEQ ID NO: 422069 - DNA, 20 bp, mouse
gtaggtgccggcccacgcga

SEQ ID NO: 422070 - DNA, 20 bp, mouse
gcgcgggagtcggcatgagc

SEQ ID NO: 422071 - DNA, 20 bp, mouse
gatgagccggctggatggcc

SEQ ID NO: 422072 - DNA, 20 bp, mouse
gagggaggtgatactgtccg

SEQ ID NO: 422073 - DNA, 20 bp, mouse
gtactgtccggggatcctga

SEQ ID NO: 422074 - DNA, 20 bp, mouse
gtggagtcgatggtggcgcc

SEQ ID NO: 422075 - DNA, 20 bp, mouse
ggggcaccgtcggtcgggga

SEQ ID NO: 422076 - DNA, 20 bp, mouse
gtctaggaccagggcgaccg

SEQ ID NO: 422077 - DNA, 20 bp, mouse
gcccgagcacgacgcgacag

SEQ ID NO: 422078 - DNA, 20 bp, mouse
ggctctgcgagaatgaactc

SEQ ID NO: 422079 - DNA, 20 bp, mouse
gaggtaacccgtgatcatct

SEQ ID NO: 422080 - DNA, 20 bp, mouse
ggacgtttgtgagaggacaa

SEQ ID NO: 422081 - DNA, 20 bp, mouse
gcctggtcctagatgatcac

SEQ ID NO: 422082 - DNA, 20 bp, mouse
gctggggcgctaaagagtga

SEQ ID NO: 422083 - DNA, 20 bp, mouse
gcgcgtcgtgctcgggagaa

SEQ ID NO: 422084 - DNA, 20 bp, mouse
gggacgcaaagcaagagtct

SEQ ID NO: 422085 - DNA, 20 bp, mouse
gagtggcctcgcaaacgcag

SEQ ID NO: 422086 - DNA, 20 bp, mouse
gctcaggacagcgaaagacg

SEQ ID NO: 422087 - DNA, 20 bp, mouse
gagtcaacgacgcaaaatgg

SEQ ID NO: 422088 - DNA, 20 bp, mouse
gccagctcttccaatcctgt

SEQ ID NO: 422089 - DNA, 20 bp, mouse
ggcaggcagctggccactag

SEQ ID NO: 422090 - DNA, 20 bp, mouse
gactttctctgcggaaccga

SEQ ID NO: 422091 - DNA, 20 bp, mouse
gtgaagtcaacgacgcaaaa

SEQ ID NO: 422092 - DNA, 20 bp, mouse
gtgctaggttccggatataa

SEQ ID NO: 422093 - DNA, 20 bp, mouse
ggcaagcaggttgtgccaac

SEQ ID NO: 422094 - DNA, 20 bp, mouse
ggatctcttaactttctctg

SEQ ID NO: 422095 - DNA, 20 bp, mouse
ggctaccgcgccgacgctgg

SEQ ID NO: 422096 - DNA, 20 bp, mouse
gtagccagaccgtgcaaggt

SEQ ID NO: 422097 - DNA, 20 bp, mouse
gactccaaccttgcacggtc

SEQ ID NO: 422098 - DNA, 20 bp, mouse
gctagtcttggagctttctg

SEQ ID NO: 422099 - DNA, 20 bp, mouse
gagctaagttgggtcagggt

SEQ ID NO: 422100 - DNA, 20 bp, mouse
gcgctagagctaatgacata

SEQ ID NO: 422101 - DNA, 20 bp, mouse
gctcatatttagcttatagt

SEQ ID NO: 422102 - DNA, 20 bp, mouse
gataaggcagaaccaaagag

SEQ ID NO: 422103 - DNA, 20 bp, mouse
ggcttatagtaggtgcagtc

SEQ ID NO: 422104 - DNA, 20 bp, mouse
gaactctccatagacagaaa

SEQ ID NO: 422105 - DNA, 20 bp, mouse
ggctgactaagttttaaggg

SEQ ID NO: 422106 - DNA, 20 bp, mouse
gtctaggacccagacaagag

SEQ ID NO: 422107 - DNA, 20 bp, mouse
gtcctagagacgcactaggt

SEQ ID NO: 422108 - DNA, 20 bp, mouse
gtgggtcctagagacgcact

SEQ ID NO: 422109 - DNA, 20 bp, mouse
gccaaattgctgacagatca

SEQ ID NO: 422110 - DNA, 20 bp, mouse
gggccaaaggtcatgcttcg

SEQ ID NO: 422111 - DNA, 20 bp, mouse
gttgggcacagaccggccaa

SEQ ID NO: 422112 - DNA, 20 bp, mouse
ggggcggcggctggcgcgga

SEQ ID NO: 422113 - DNA, 20 bp, mouse
gcatggttcctctcttgtct

SEQ ID NO: 422114 - DNA, 20 bp, mouse
gagccccgaagcatgacctt

SEQ ID NO: 422115 - DNA, 20 bp, mouse
gcagcaatttgggcacagac

SEQ ID NO: 422116 - DNA, 20 bp, mouse
gagtgtctctcgacttctgg

SEQ ID NO: 422117 - DNA, 20 bp, mouse
gattgccaacgcagacaagt

SEQ ID NO: 422118 - DNA, 20 bp, mouse
gaacgcagacaagtaggata

SEQ ID NO: 422119 - DNA, 20 bp, mouse
ggggcagtgcgcagtgtgac

SEQ ID NO: 422120 - DNA, 20 bp, mouse
ggcggagctagagctcagga

SEQ ID NO: 422121 - DNA, 20 bp, mouse
gatgaggagtcaggtcaccc

SEQ ID NO: 422122 - DNA, 20 bp, mouse
gcaagtaggataagggttca

SEQ ID NO: 422123 - DNA, 20 bp, mouse
ggaaaaatcaggatactgtc

SEQ ID NO: 422124 - DNA, 20 bp, mouse
gcagtaagcctggagcccac

SEQ ID NO: 422125 - DNA, 20 bp, mouse
gttgtctgcgttggcaatcg

SEQ ID NO: 422126 - DNA, 20 bp, mouse
gcccgtgcctcagacaagac

SEQ ID NO: 422127 - DNA, 20 bp, mouse
gcggagctctgccaggacag

SEQ ID NO: 422128 - DNA, 20 bp, mouse
gaaaccggctgactctatac

SEQ ID NO: 422129 - DNA, 20 bp, mouse
gtctgaggcacgggagccag

SEQ ID NO: 422130 - DNA, 20 bp, mouse
ggtagcagcggagctctgcc

SEQ ID NO: 422131 - DNA, 20 bp, mouse
gtcccagagacgcaccaggt

SEQ ID NO: 422132 - DNA, 20 bp, mouse
gaggcacgggagccaggggt

SEQ ID NO: 422133 - DNA, 20 bp, mouse
gacgtggtgttgaggatagg

SEQ ID NO: 422134 - DNA, 20 bp, mouse
gctcacgtggtgttgaggat

SEQ ID NO: 422135 - DNA, 20 bp, mouse
gtctgttcctgtcttgtctg

SEQ ID NO: 422136 - DNA, 20 bp, mouse
ggggactctgcgcctctggg

SEQ ID NO: 422137 - DNA, 20 bp, mouse
gccaggcgtcaggctcgaaa

SEQ ID NO: 422138 - DNA, 20 bp, mouse
gagtgaaggggcctcctcaa

SEQ ID NO: 422139 - DNA, 20 bp, mouse
gactctgcgcctctgggagg

SEQ ID NO: 422140 - DNA, 20 bp, mouse
ggtcgggactctgcgcctct

SEQ ID NO: 422141 - DNA, 20 bp, mouse
gacattgcgtcaccatggga

SEQ ID NO: 422142 - DNA, 20 bp, mouse
gcagtcgtcctaccttccca

SEQ ID NO: 422143 - DNA, 20 bp, mouse
ggcctggccaggagtgttcg

SEQ ID NO: 422144 - DNA, 20 bp, mouse
gtgcaatgaagctgctggtc

SEQ ID NO: 422145 - DNA, 20 bp, mouse
gctggttctgacagccctca

SEQ ID NO: 422146 - DNA, 20 bp, mouse
ggctcgtgaccagcacacta

SEQ ID NO: 422147 - DNA, 20 bp, mouse
gtgtcagcgccagagggtct

SEQ ID NO: 422148 - DNA, 20 bp, mouse
gctcatggcgacgccgaccg

SEQ ID NO: 422149 - DNA, 20 bp, mouse
gactacggaggtccccggaa

SEQ ID NO: 422150 - DNA, 20 bp, mouse
ggctgcggttgagagaaacg

SEQ ID NO: 422151 - DNA, 20 bp, mouse
ggaccgcggcgacctttccg

SEQ ID NO: 422152 - DNA, 20 bp, mouse
gagcacactacggaggtccc

SEQ ID NO: 422153 - DNA, 20 bp, mouse
ggtccccggaaaggtcgccg

SEQ ID NO: 422154 - DNA, 20 bp, mouse
ggaaacgcggaaacttatat

SEQ ID NO: 422155 - DNA, 20 bp, mouse
gcaggggccggaaatcccaa

SEQ ID NO: 422156 - DNA, 20 bp, mouse
gctcccgggtagagacaaac

SEQ ID NO: 422157 - DNA, 20 bp, mouse
gggaaggcgtgggcactccg

SEQ ID NO: 422158 - DNA, 20 bp, mouse
ggcagaagagcgtgagcgtg

SEQ ID NO: 422159 - DNA, 20 bp, mouse
ggcctcaaaggggaaggcgt

SEQ ID NO: 422160 - DNA, 20 bp, mouse
gggctcggagcctagcgggg

SEQ ID NO: 422161 - DNA, 20 bp, mouse
gcagggtaggccggaggacg

SEQ ID NO: 422162 - DNA, 20 bp, mouse
gtaggtggcagggcgtggaa

SEQ ID NO: 422163 - DNA, 20 bp, mouse
gtaccggtttgtctctaccc

SEQ ID NO: 422164 - DNA, 20 bp, mouse
gggcggaagaagccgcgggt

SEQ ID NO: 422165 - DNA, 20 bp, mouse
gccctggtgagcaaaaggat

SEQ ID NO: 422166 - DNA, 20 bp, mouse
gtgacggagaccagtgctgg

SEQ ID NO: 422167 - DNA, 20 bp, mouse
gctggtcggcgcctgagctg

SEQ ID NO: 422168 - DNA, 20 bp, mouse
gcgcagatcgggattcatga

SEQ ID NO: 422169 - DNA, 20 bp, mouse
ggccgaccaggccctatgag

SEQ ID NO: 422170 - DNA, 20 bp, mouse
gtccgctcatagggcctggt

SEQ ID NO: 422171 - DNA, 20 bp, mouse
gaactctggattgaaggtgg

SEQ ID NO: 422172 - DNA, 20 bp, mouse
gccggtgtcaggattaggag

SEQ ID NO: 422173 - DNA, 20 bp, mouse
gcggacgcccatcgaagtag

SEQ ID NO: 422174 - DNA, 20 bp, mouse
gtggggcctctggagttgag

SEQ ID NO: 422175 - DNA, 20 bp, mouse
gatctgatgggagtcaggga

SEQ ID NO: 422176 - DNA, 20 bp, mouse
gtaaacaacaagagaaccaa

SEQ ID NO: 422177 - DNA, 20 bp, mouse
gcagcgctgtcccaggacag

SEQ ID NO: 422178 - DNA, 20 bp, mouse
gagccagaggcaagacgagg

SEQ ID NO: 422179 - DNA, 20 bp, mouse
gaagtggcgggcatccttaa

SEQ ID NO: 422180 - DNA, 20 bp, mouse
ggtaatggcagtaaagtggc

SEQ ID NO: 422181 - DNA, 20 bp, mouse
gggaagccagaggcaagacg

SEQ ID NO: 422182 - DNA, 20 bp, mouse
gaactgacagaacataccaa

SEQ ID NO: 422183 - DNA, 20 bp, mouse
gagggcctcatgcaatactc

SEQ ID NO: 422184 - DNA, 20 bp, mouse
gggtgcaaggaacctcgatg

SEQ ID NO: 422185 - DNA, 20 bp, mouse
gctggcattgagtaagacag

SEQ ID NO: 422186 - DNA, 20 bp, mouse
gtccagacgccgggttgact

SEQ ID NO: 422187 - DNA, 20 bp, mouse
gatcccaagctggatccggg

SEQ ID NO: 422188 - DNA, 20 bp, mouse
gcacctcccggatccagctt

SEQ ID NO: 422189 - DNA, 20 bp, mouse
gttcgtggtcctagtcaacc

SEQ ID NO: 422190 - DNA, 20 bp, mouse
gccggcacgtcctcacctcc

SEQ ID NO: 422191 - DNA, 20 bp, mouse
gggaatatcctgacttctga

SEQ ID NO: 422192 - DNA, 20 bp, mouse
gcgaatcccaagctggatcc

SEQ ID NO: 422193 - DNA, 20 bp, mouse
gggcccgggagattccagac

SEQ ID NO: 422194 - DNA, 20 bp, mouse
gtcctagtcaacccggcgtc

SEQ ID NO: 422195 - DNA, 20 bp, mouse
gatagtgtcctccagacgcc

SEQ ID NO: 422196 - DNA, 20 bp, mouse
ggcagaagccaggatagctg

SEQ ID NO: 422197 - DNA, 20 bp, mouse
ggagtccccaagccccaaat

SEQ ID NO: 422198 - DNA, 20 bp, mouse
ggctaagaaggtttacagaa

SEQ ID NO: 422199 - DNA, 20 bp, mouse
ggagttctccatccaggtag

SEQ ID NO: 422200 - DNA, 20 bp, mouse
ggtcaactgcccataaggag

SEQ ID NO: 422201 - DNA, 20 bp, mouse
gggtgtggaccgctccttat

SEQ ID NO: 422202 - DNA, 20 bp, mouse
gggggccaatcagctaacct

SEQ ID NO: 422203 - DNA, 20 bp, mouse
gagctgattggccccaggtg

SEQ ID NO: 422204 - DNA, 20 bp, mouse
ggcaactccactaagtacct

SEQ ID NO: 422205 - DNA, 20 bp, mouse
gccagtcagagtcccaccta

SEQ ID NO: 422206 - DNA, 20 bp, mouse
gatgtccacggtcagaaccc

SEQ ID NO: 422207 - DNA, 20 bp, mouse
gaggcgcatgcgcactgcca

SEQ ID NO: 422208 - DNA, 20 bp, mouse
gcttgttcggaagcctaaca

SEQ ID NO: 422209 - DNA, 20 bp, mouse
gtccgaacaagagcgctggg

SEQ ID NO: 422210 - DNA, 20 bp, mouse
ggcactcggaagggtgacat

SEQ ID NO: 422211 - DNA, 20 bp, mouse
ggcttccgaacaagagcgct

SEQ ID NO: 422212 - DNA, 20 bp, mouse
gctggccgcgtacgaacgtg

SEQ ID NO: 422213 - DNA, 20 bp, mouse
ggccgcgtacgaacgtgggg

SEQ ID NO: 422214 - DNA, 20 bp, mouse
ggcggaggaagcagatcaga

SEQ ID NO: 422215 - DNA, 20 bp, mouse
ggaacaagagcgctgggcgg

SEQ ID NO: 422216 - DNA, 20 bp, mouse
gtgatggccggcagacagac

SEQ ID NO: 422217 - DNA, 20 bp, mouse
gggccggcagacagactggt

SEQ ID NO: 422218 - DNA, 20 bp, mouse
ggcacatgccaagaaggaac

SEQ ID NO: 422219 - DNA, 20 bp, mouse
gagcctacaacagtgatggc

SEQ ID NO: 422220 - DNA, 20 bp, mouse
gtatgggtggcatcaccgtt

SEQ ID NO: 422221 - DNA, 20 bp, mouse
ggactccgggcctgtatggg

SEQ ID NO: 422222 - DNA, 20 bp, mouse
gaggccggctggtagaggga

SEQ ID NO: 422223 - DNA, 20 bp, mouse
gcagactggttggagccagg

SEQ ID NO: 422224 - DNA, 20 bp, mouse
gcgttaggcacatgccaaga

SEQ ID NO: 422225 - DNA, 20 bp, mouse
ggtagactccgggcctgtat

SEQ ID NO: 422226 - DNA, 20 bp, mouse
gaagtgtcagaggagcgagg

SEQ ID NO: 422227 - DNA, 20 bp, mouse
ggctcctctgacacttaccc

SEQ ID NO: 422228 - DNA, 20 bp, mouse
gaccctggaggaagcacagg

SEQ ID NO: 422229 - DNA, 20 bp, mouse
gctgggaaggtggcccccac

SEQ ID NO: 422230 - DNA, 20 bp, mouse
gcagaggagcgaggtggaag

SEQ ID NO: 422231 - DNA, 20 bp, mouse
gaggtggaagaggcctgtgg

SEQ ID NO: 422232 - DNA, 20 bp, mouse
gaccgtgagaccaggctcag

SEQ ID NO: 422233 - DNA, 20 bp, mouse
gtaagctcctggaccaaaag

SEQ ID NO: 422234 - DNA, 20 bp, mouse
gggtgcatgcctataaactc

SEQ ID NO: 422235 - DNA, 20 bp, mouse
gtgacggctgtagatggcta

SEQ ID NO: 422236 - DNA, 20 bp, mouse
gtgcacgagttgggaagagg

SEQ ID NO: 422237 - DNA, 20 bp, mouse
gagggcaggcagggagccgt

SEQ ID NO: 422238 - DNA, 20 bp, mouse
gggctgcacgagttgggaag

SEQ ID NO: 422239 - DNA, 20 bp, mouse
gcgctccgggctgcacgagt

SEQ ID NO: 422240 - DNA, 20 bp, mouse
ggcgaatccgcagctcagtt

SEQ ID NO: 422241 - DNA, 20 bp, mouse
ggtgctacccaactgagctg

SEQ ID NO: 422242 - DNA, 20 bp, mouse
gattcgcggcgggtcgctcc

SEQ ID NO: 422243 - DNA, 20 bp, mouse
gctcttcgctgggtgacctg

SEQ ID NO: 422244 - DNA, 20 bp, mouse
gcactcgcacctctcagtag

SEQ ID NO: 422245 - DNA, 20 bp, mouse
gtgggtagcacagcttgtcc

SEQ ID NO: 422246 - DNA, 20 bp, mouse
ggaagttcgcgggaactgga

SEQ ID NO: 422247 - DNA, 20 bp, mouse
gctcagtcagggcagttact

SEQ ID NO: 422248 - DNA, 20 bp, mouse
gttgcggcctccccttcaca

SEQ ID NO: 422249 - DNA, 20 bp, mouse
gttcaaaccgtgtgaagggg

SEQ ID NO: 422250 - DNA, 20 bp, mouse
gggaggtcaggagattgcgt

SEQ ID NO: 422251 - DNA, 20 bp, mouse
gactgcatgcaggctcagtc

SEQ ID NO: 422252 - DNA, 20 bp, mouse
gcacttcaaaccgtgtgaag

SEQ ID NO: 422253 - DNA, 20 bp, mouse
gagcctgcatgcagtagggg

SEQ ID NO: 422254 - DNA, 20 bp, mouse
gccagcgacagtcaggccgg

SEQ ID NO: 422255 - DNA, 20 bp, mouse
ggagggctccgcaggcaacg

SEQ ID NO: 422256 - DNA, 20 bp, mouse
gcgacggaggccgggaccgt

SEQ ID NO: 422257 - DNA, 20 bp, mouse
gcggaggccgggaccgtagg

SEQ ID NO: 422258 - DNA, 20 bp, mouse
gtccctacgcacagcgacgg

SEQ ID NO: 422259 - DNA, 20 bp, mouse
gagatccctacgcacagcga

SEQ ID NO: 422260 - DNA, 20 bp, mouse
gctggggagcgcgtagataa

SEQ ID NO: 422261 - DNA, 20 bp, mouse
gggcctccgtcgctgtgcgt

SEQ ID NO: 422262 - DNA, 20 bp, mouse
gcactcccgccaggaggagc

SEQ ID NO: 422263 - DNA, 20 bp, mouse
gggtgcgcgccgggtcccag

SEQ ID NO: 422264 - DNA, 20 bp, mouse
gaccaggaggaggtaggcgt

SEQ ID NO: 422265 - DNA, 20 bp, mouse
gcactcaccgcctacggtcc

SEQ ID NO: 422266 - DNA, 20 bp, mouse
gtgaagtgcagcacctccta

SEQ ID NO: 422267 - DNA, 20 bp, mouse
gggcttgctgtccggctcag

SEQ ID NO: 422268 - DNA, 20 bp, mouse
gggaacggctcgcatggtcg

SEQ ID NO: 422269 - DNA, 20 bp, mouse
gtgctttgggcagccttagg

SEQ ID NO: 422270 - DNA, 20 bp, mouse
gacttcagaagccttcggga

SEQ ID NO: 422271 - DNA, 20 bp, mouse
gataggcacttccctcccga

SEQ ID NO: 422272 - DNA, 20 bp, mouse
gcctcaggcagacagcagag

SEQ ID NO: 422273 - DNA, 20 bp, mouse
gggcagaggaacggctcgca

SEQ ID NO: 422274 - DNA, 20 bp, mouse
gctgaacagtgcctgccctc

SEQ ID NO: 422275 - DNA, 20 bp, mouse
gccgaaggcattggacttga

SEQ ID NO: 422276 - DNA, 20 bp, mouse
ggagtctgaggctaatgagc

SEQ ID NO: 422277 - DNA, 20 bp, mouse
gcctcgaggccacaaggtgg

SEQ ID NO: 422278 - DNA, 20 bp, mouse
gagcagcagcaagggtccga

SEQ ID NO: 422279 - DNA, 20 bp, mouse
gaagcctcgaggccacaagg

SEQ ID NO: 422280 - DNA, 20 bp, mouse
ggacttggaaggtagagggt

SEQ ID NO: 422281 - DNA, 20 bp, mouse
gaggtcaggactgacttgga

SEQ ID NO: 422282 - DNA, 20 bp, mouse
gtcagcctccgtctgtgctg

SEQ ID NO: 422283 - DNA, 20 bp, mouse
gacggtgtggccctgagacc

SEQ ID NO: 422284 - DNA, 20 bp, mouse
ggaacgtgttggggcctgca

SEQ ID NO: 422285 - DNA, 20 bp, mouse
ggactgacttggaaggtaga

SEQ ID NO: 422286 - DNA, 20 bp, mouse
gcagcttgcaggccaggtta

SEQ ID NO: 422287 - DNA, 20 bp, mouse
gagaccagcacagcgacagt

SEQ ID NO: 422288 - DNA, 20 bp, mouse
gtcacacgtggtgttatcct

SEQ ID NO: 422289 - DNA, 20 bp, mouse
ggtgttatccttggcaacca

SEQ ID NO: 422290 - DNA, 20 bp, mouse
ggcagtgtccgtggttgcca

SEQ ID NO: 422291 - DNA, 20 bp, mouse
ggacactacagagcctgcta

SEQ ID NO: 422292 - DNA, 20 bp, mouse
gagacaaagggagtctagat

SEQ ID NO: 422293 - DNA, 20 bp, mouse
gccatactcctgccctaacc

SEQ ID NO: 422294 - DNA, 20 bp, mouse
gtgggtggacagagatgcaa

SEQ ID NO: 422295 - DNA, 20 bp, mouse
gaccaacacttactcacacg

SEQ ID NO: 422296 - DNA, 20 bp, mouse
ggcgaggctcggcccgttgg

SEQ ID NO: 422297 - DNA, 20 bp, mouse
gcaacaaagcgacctccaac

SEQ ID NO: 422298 - DNA, 20 bp, mouse
ggcagcgaggctcggcccgt

SEQ ID NO: 422299 - DNA, 20 bp, mouse
gctcgctgctagcgcgaaga

SEQ ID NO: 422300 - DNA, 20 bp, mouse
gccagcagctagattcatca

SEQ ID NO: 422301 - DNA, 20 bp, mouse
gctagcgcgaagaaggcagg

SEQ ID NO: 422302 - DNA, 20 bp, mouse
gctacagtggaaggcttcaa

SEQ ID NO: 422303 - DNA, 20 bp, mouse
gctgctagcgcgaagaaggc

SEQ ID NO: 422304 - DNA, 20 bp, mouse
ggggcccttcaggagcataa

SEQ ID NO: 422305 - DNA, 20 bp, mouse
gtcgcgctagcagcgaggct

SEQ ID NO: 422306 - DNA, 20 bp, mouse
gtaaataaagatctctaatg

SEQ ID NO: 422307 - DNA, 20 bp, mouse
gactaggtcaacatcagagg

SEQ ID NO: 422308 - DNA, 20 bp, mouse
gtgaaggagttaatcttact

SEQ ID NO: 422309 - DNA, 20 bp, mouse
gctaggacatccataaccag

SEQ ID NO: 422310 - DNA, 20 bp, mouse
ggtgttgaatcagagcctct

SEQ ID NO: 422311 - DNA, 20 bp, mouse
gcacctgtctttcatcaagg

SEQ ID NO: 422312 - DNA, 20 bp, mouse
gaacactaggtcaacatcag

SEQ ID NO: 422313 - DNA, 20 bp, mouse
gtccagcctaaattgaggtt

SEQ ID NO: 422314 - DNA, 20 bp, mouse
gataaccaggggaaatcagt

SEQ ID NO: 422315 - DNA, 20 bp, mouse
gtgcccccttgatgaaagac

SEQ ID NO: 422316 - DNA, 20 bp, mouse
gatcctgcttcagaaccgcg

SEQ ID NO: 422317 - DNA, 20 bp, mouse
gtgcggtctcccacagtgag

SEQ ID NO: 422318 - DNA, 20 bp, mouse
gtctctgctgtcaggcatgt

SEQ ID NO: 422319 - DNA, 20 bp, mouse
gtgggagaccgcactgtctt

SEQ ID NO: 422320 - DNA, 20 bp, mouse
ggcattcaccgaagacagtg

SEQ ID NO: 422321 - DNA, 20 bp, mouse
gtgccacgcggttctgaagc

SEQ ID NO: 422322 - DNA, 20 bp, mouse
ggccgttagagattcaactg

SEQ ID NO: 422323 - DNA, 20 bp, mouse
gtccaaccatggggagacaa

SEQ ID NO: 422324 - DNA, 20 bp, mouse
gtgagaggctggccttgagg

SEQ ID NO: 422325 - DNA, 20 bp, mouse
ggctccaaggtcagcacgtg

SEQ ID NO: 422326 - DNA, 20 bp, mouse
gtcaccctggctagactgag

SEQ ID NO: 422327 - DNA, 20 bp, mouse
gtcacccctcagtctagcca

SEQ ID NO: 422328 - DNA, 20 bp, mouse
gggggtgaccagagcaagaa

SEQ ID NO: 422329 - DNA, 20 bp, mouse
gtgaattatggagttgtgtt

SEQ ID NO: 422330 - DNA, 20 bp, mouse
gggtggccaggtgtcacaga

SEQ ID NO: 422331 - DNA, 20 bp, mouse
gcccacgcagagatcctctc

SEQ ID NO: 422332 - DNA, 20 bp, mouse
gcacagagttggtcagtggt

SEQ ID NO: 422333 - DNA, 20 bp, mouse
gaggtgctggtgctgcaggt

SEQ ID NO: 422334 - DNA, 20 bp, mouse
gagttggtaaggttcctgag

SEQ ID NO: 422335 - DNA, 20 bp, mouse
gtgtcacagatggagacatc

SEQ ID NO: 422336 - DNA, 20 bp, mouse
gggctgggcagtcccgagaa

SEQ ID NO: 422337 - DNA, 20 bp, mouse
gagcattccgaaaagagagg

SEQ ID NO: 422338 - DNA, 20 bp, mouse
gagtcccgagaagggaactt

SEQ ID NO: 422339 - DNA, 20 bp, mouse
gagcagcagccccagatccc

SEQ ID NO: 422340 - DNA, 20 bp, mouse
gtgtgagggctacccagagt

SEQ ID NO: 422341 - DNA, 20 bp, mouse
gcaggggctgaccccactct

SEQ ID NO: 422342 - DNA, 20 bp, mouse
ggttctgcagtgcttggcag

SEQ ID NO: 422343 - DNA, 20 bp, mouse
gaattaagaagcggacgggg

SEQ ID NO: 422344 - DNA, 20 bp, mouse
gtccgaaaagagagggggct

SEQ ID NO: 422345 - DNA, 20 bp, mouse
gcactttcaaagtttactcc

SEQ ID NO: 422346 - DNA, 20 bp, mouse
gagtgcgaggttgtccaggt

SEQ ID NO: 422347 - DNA, 20 bp, mouse
gcgggagtgcgaggttgtcc

SEQ ID NO: 422348 - DNA, 20 bp, mouse
ggctcacctggggtcaggcg

SEQ ID NO: 422349 - DNA, 20 bp, mouse
ggggtcccgagagccgacta

SEQ ID NO: 422350 - DNA, 20 bp, mouse
ggctcggcgcaaacaaatcg

SEQ ID NO: 422351 - DNA, 20 bp, mouse
ggtctgctgcgcgctcacct

SEQ ID NO: 422352 - DNA, 20 bp, mouse
gccggcccgcttcacctacc

SEQ ID NO: 422353 - DNA, 20 bp, mouse
gcccaaccccgcctgacccc

SEQ ID NO: 422354 - DNA, 20 bp, mouse
gcgtgagggacacttctgta

SEQ ID NO: 422355 - DNA, 20 bp, mouse
gagtatctggaggctctcac

SEQ ID NO: 422356 - DNA, 20 bp, mouse
gtgagtgcgccagccgcgaa

SEQ ID NO: 422357 - DNA, 20 bp, mouse
ggcaggggcacgtcacagag

SEQ ID NO: 422358 - DNA, 20 bp, mouse
gttgcagtgacagccgcctg

SEQ ID NO: 422359 - DNA, 20 bp, mouse
gaccctagccgggccgagac

SEQ ID NO: 422360 - DNA, 20 bp, mouse
gtcccgtctcggcccggcta

SEQ ID NO: 422361 - DNA, 20 bp, mouse
gaagggccgcgagtcggcca

SEQ ID NO: 422362 - DNA, 20 bp, mouse
gagcaagcaggaccacctct

SEQ ID NO: 422363 - DNA, 20 bp, mouse
gagacgggagaacctccccg

SEQ ID NO: 422364 - DNA, 20 bp, mouse
gcccggcgcggggcagttcg

SEQ ID NO: 422365 - DNA, 20 bp, mouse
ggctccggcaccggaagcgg

SEQ ID NO: 422366 - DNA, 20 bp, mouse
gcgcccgggaaacgtcgctg

SEQ ID NO: 422367 - DNA, 20 bp, mouse
ggggtgcgcgtccaggactg

SEQ ID NO: 422368 - DNA, 20 bp, mouse
ggaccctcatcgcctcacaa

SEQ ID NO: 422369 - DNA, 20 bp, mouse
gaaccgcagcgacgtttccc

SEQ ID NO: 422370 - DNA, 20 bp, mouse
ggcccgttgtgaggcgatga

SEQ ID NO: 422371 - DNA, 20 bp, mouse
gctgggcaggagccgctctg

SEQ ID NO: 422372 - DNA, 20 bp, mouse
gctgcgtgggtcggagcccg

SEQ ID NO: 422373 - DNA, 20 bp, mouse
gtcgtccgagcccgcgaccg

SEQ ID NO: 422374 - DNA, 20 bp, mouse
gtgcaacgagcgccagcccg

SEQ ID NO: 422375 - DNA, 20 bp, mouse
ggcggcccaggagtcccctc

SEQ ID NO: 422376 - DNA, 20 bp, mouse
gggcgagccgcggagaccag

SEQ ID NO: 422377 - DNA, 20 bp, mouse
ggagagggagagagccgcag

SEQ ID NO: 422378 - DNA, 20 bp, mouse
gtcttaaggccgggacccag

SEQ ID NO: 422379 - DNA, 20 bp, mouse
gcaacccggacagccagcgg

SEQ ID NO: 422380 - DNA, 20 bp, mouse
gaccttcggtgagtgatcct

SEQ ID NO: 422381 - DNA, 20 bp, mouse
gtggagctgcctggcaagga

SEQ ID NO: 422382 - DNA, 20 bp, mouse
ggcgcaacccggacagccag

SEQ ID NO: 422383 - DNA, 20 bp, mouse
gggctctcagggtacagcgg

SEQ ID NO: 422384 - DNA, 20 bp, mouse
gggttgcgcgcgcgccgctg

SEQ ID NO: 422385 - DNA, 20 bp, mouse
ggcgagcgaggcagcacctt

SEQ ID NO: 422386 - DNA, 20 bp, mouse
ggaagagctagtgggaccag

SEQ ID NO: 422387 - DNA, 20 bp, mouse
gttcattgccagagaaacgg

SEQ ID NO: 422388 - DNA, 20 bp, mouse
gttctctggcaatgaaccca

SEQ ID NO: 422389 - DNA, 20 bp, mouse
gatcttggagaagagctagt

SEQ ID NO: 422390 - DNA, 20 bp, mouse
gagaagcccggggtgaggaa

SEQ ID NO: 422391 - DNA, 20 bp, mouse
gaaatgaaaacgagttgagg

SEQ ID NO: 422392 - DNA, 20 bp, mouse
gtccaaatgaaaacgagttg

SEQ ID NO: 422393 - DNA, 20 bp, mouse
ggtctcctcctagtcaaaag

SEQ ID NO: 422394 - DNA, 20 bp, mouse
gatcagggcagggcagaagt

SEQ ID NO: 422395 - DNA, 20 bp, mouse
ggtgcgtgcggcccttccca

SEQ ID NO: 422396 - DNA, 20 bp, mouse
ggctctaactgtagggacag

SEQ ID NO: 422397 - DNA, 20 bp, mouse
gaggagaggctctaactgta

SEQ ID NO: 422398 - DNA, 20 bp, mouse
ggctctgagaagatggggtt

SEQ ID NO: 422399 - DNA, 20 bp, mouse
ggagaagatggggttaggag

SEQ ID NO: 422400 - DNA, 20 bp, mouse
gacaggtcttgtagggacca

SEQ ID NO: 422401 - DNA, 20 bp, mouse
gccataggccctagaaaggg

SEQ ID NO: 422402 - DNA, 20 bp, mouse
gctgtgggaacaggtcttgt

SEQ ID NO: 422403 - DNA, 20 bp, mouse
ggctccgggcactgatgagg

SEQ ID NO: 422404 - DNA, 20 bp, mouse
ggctccataggccctagaaa

SEQ ID NO: 422405 - DNA, 20 bp, mouse
gccctggtgcctgtgggaac

SEQ ID NO: 422406 - DNA, 20 bp, mouse
gaggccccgtgccaagggaa

SEQ ID NO: 422407 - DNA, 20 bp, mouse
gtcggtgagccggcccagcc

SEQ ID NO: 422408 - DNA, 20 bp, mouse
gaagcagtgcgggccgggct

SEQ ID NO: 422409 - DNA, 20 bp, mouse
gcgcagcagagggctccgca

SEQ ID NO: 422410 - DNA, 20 bp, mouse
gggctaaaaatacccggcgg

SEQ ID NO: 422411 - DNA, 20 bp, mouse
gagtatctcggcccagggtg

SEQ ID NO: 422412 - DNA, 20 bp, mouse
ggacccccaccagaattggg

SEQ ID NO: 422413 - DNA, 20 bp, mouse
ggggggctaaaaatacccgg

SEQ ID NO: 422414 - DNA, 20 bp, mouse
ggcgcctcggggaccttgaa

SEQ ID NO: 422415 - DNA, 20 bp, mouse
gtaaaaatacccggcggcgg

SEQ ID NO: 422416 - DNA, 20 bp, mouse
gctggtactgtgaaggacac

SEQ ID NO: 422417 - DNA, 20 bp, mouse
gccaggagagacggcttgta

SEQ ID NO: 422418 - DNA, 20 bp, mouse
gacacaggtagactatagcc

SEQ ID NO: 422419 - DNA, 20 bp, mouse
ggtcttacctggtactgtga

SEQ ID NO: 422420 - DNA, 20 bp, mouse
gggtaagaccaagcccatcc

SEQ ID NO: 422421 - DNA, 20 bp, mouse
gaagactgtgcacagagagc

SEQ ID NO: 422422 - DNA, 20 bp, mouse
gacacacggacacacggtga

SEQ ID NO: 422423 - DNA, 20 bp, mouse
gcgttggagagaggaatatc

SEQ ID NO: 422424 - DNA, 20 bp, mouse
gacagctgtgttcccagaac

SEQ ID NO: 422425 - DNA, 20 bp, mouse
gggaacttggcccctgactg

SEQ ID NO: 422426 - DNA, 20 bp, mouse
gggctactcaggcttgatta

SEQ ID NO: 422427 - DNA, 20 bp, mouse
gctcaaacgacttcccaaga

SEQ ID NO: 422428 - DNA, 20 bp, mouse
ggagccctcggaggctactc

SEQ ID NO: 422429 - DNA, 20 bp, mouse
gaagcctgagtagcctccga

SEQ ID NO: 422430 - DNA, 20 bp, mouse
ggaagcagagagttagctag

SEQ ID NO: 422431 - DNA, 20 bp, mouse
ggtcacaaggtgttagtgag

SEQ ID NO: 422432 - DNA, 20 bp, mouse
gatgctgatttgaagaggag

SEQ ID NO: 422433 - DNA, 20 bp, mouse
gaactcctagaagccacaaa

SEQ ID NO: 422434 - DNA, 20 bp, mouse
gtcaccttctggtcttcttc

SEQ ID NO: 422435 - DNA, 20 bp, mouse
gagtaacagatagcaaggac

SEQ ID NO: 422436 - DNA, 20 bp, mouse
gtgttggtggtggatcaaag

SEQ ID NO: 422437 - DNA, 20 bp, mouse
gtgatagtagacccgcttaa

SEQ ID NO: 422438 - DNA, 20 bp, mouse
gagctgccatgggagcactg

SEQ ID NO: 422439 - DNA, 20 bp, mouse
gagtggacggagtttgacgg

SEQ ID NO: 422440 - DNA, 20 bp, mouse
gacctctgctttagtgttgg

SEQ ID NO: 422441 - DNA, 20 bp, mouse
gactatcactccagctgtgt

SEQ ID NO: 422442 - DNA, 20 bp, mouse
gggtggtggatcaaagtgga

SEQ ID NO: 422443 - DNA, 20 bp, mouse
gggctttctcttccattaag

SEQ ID NO: 422444 - DNA, 20 bp, mouse
gcaaagtggacggagtttga

SEQ ID NO: 422445 - DNA, 20 bp, mouse
gcctgccagccatgtcctgg

SEQ ID NO: 422446 - DNA, 20 bp, mouse
gcagaggctcggggccacag

SEQ ID NO: 422447 - DNA, 20 bp, mouse
ggcctcccgctccttcccaa

SEQ ID NO: 422448 - DNA, 20 bp, mouse
gaggtacgtcagcacgaggt

SEQ ID NO: 422449 - DNA, 20 bp, mouse
gagccttgtggcccaatcaa

SEQ ID NO: 422450 - DNA, 20 bp, mouse
gactgtacaccagaggctcg

SEQ ID NO: 422451 - DNA, 20 bp, mouse
gtagcggagcagtagcagag

SEQ ID NO: 422452 - DNA, 20 bp, mouse
gcctcccaactgtacaccag

SEQ ID NO: 422453 - DNA, 20 bp, mouse
gcacatggaggggatactag

SEQ ID NO: 422454 - DNA, 20 bp, mouse
gaggtaggtacgtcagcacg

SEQ ID NO: 422455 - DNA, 20 bp, mouse
ggctttgcagccatctgtcg

SEQ ID NO: 422456 - DNA, 20 bp, mouse
gagcacagcctggagaaaac

SEQ ID NO: 422457 - DNA, 20 bp, mouse
gggtggcacgtgccagtgaa

SEQ ID NO: 422458 - DNA, 20 bp, mouse
ggaagcgatgaaggcaggat

SEQ ID NO: 422459 - DNA, 20 bp, mouse
ggcgatgtccgggagatccg

SEQ ID NO: 422460 - DNA, 20 bp, mouse
gggaggtcagccatcaagaa

SEQ ID NO: 422461 - DNA, 20 bp, mouse
gtagaggaggcggcttagaa

SEQ ID NO: 422462 - DNA, 20 bp, mouse
gtgtgtgtgaggcagaatac

SEQ ID NO: 422463 - DNA, 20 bp, mouse
ggctcgtagccactaacacc

SEQ ID NO: 422464 - DNA, 20 bp, mouse
gatttccccagaagcgatga

SEQ ID NO: 422465 - DNA, 20 bp, mouse
gttctaaccctgttttctcc

SEQ ID NO: 422466 - DNA, 20 bp, mouse
gcagcctcggcagcggtgtg

SEQ ID NO: 422467 - DNA, 20 bp, mouse
ggccagcggcccccagaagg

SEQ ID NO: 422468 - DNA, 20 bp, mouse
gaggctaccgcacccgcgtg

SEQ ID NO: 422469 - DNA, 20 bp, mouse
gtgtccaggagggaagaggt

SEQ ID NO: 422470 - DNA, 20 bp, mouse
gcgtggggcgtcgggcgaga

SEQ ID NO: 422471 - DNA, 20 bp, mouse
gactgctgcgtggcctgcaa

SEQ ID NO: 422472 - DNA, 20 bp, mouse
gagtcccagacagtatggta

SEQ ID NO: 422473 - DNA, 20 bp, mouse
gcggggccgtggagactctt

SEQ ID NO: 422474 - DNA, 20 bp, mouse
gagggcgctctggacaatcg

SEQ ID NO: 422475 - DNA, 20 bp, mouse
ggcgcccctaagagtctcca

SEQ ID NO: 422476 - DNA, 20 bp, mouse
ggcacccgcagcgaccgcaa

SEQ ID NO: 422477 - DNA, 20 bp, mouse
gcccgcagcgaccgcaacgg

SEQ ID NO: 422478 - DNA, 20 bp, mouse
ggcgaccgcaacggcggaca

SEQ ID NO: 422479 - DNA, 20 bp, mouse
gccgaggagcggcgcaagag

SEQ ID NO: 422480 - DNA, 20 bp, mouse
ggatggggcttcccgaggag

SEQ ID NO: 422481 - DNA, 20 bp, mouse
ggtgccggggcggggaaaac

SEQ ID NO: 422482 - DNA, 20 bp, mouse
ggcggtagcgctgcagagag

SEQ ID NO: 422483 - DNA, 20 bp, mouse
gttcggaacttgatgcgatg

SEQ ID NO: 422484 - DNA, 20 bp, mouse
gacccgaggccccgcctcta

SEQ ID NO: 422485 - DNA, 20 bp, mouse
gcgttctgtggaggagccac

SEQ ID NO: 422486 - DNA, 20 bp, mouse
gactgctccgactgcagcta

SEQ ID NO: 422487 - DNA, 20 bp, mouse
gggctagtgccacagctgtt

SEQ ID NO: 422488 - DNA, 20 bp, mouse
ggctgcagggctctgaccac

SEQ ID NO: 422489 - DNA, 20 bp, mouse
gctctgaccaccggcagtgg

SEQ ID NO: 422490 - DNA, 20 bp, mouse
gtgtggcactagccccgagg

SEQ ID NO: 422491 - DNA, 20 bp, mouse
gtgcgacattgcaaccagga

SEQ ID NO: 422492 - DNA, 20 bp, mouse
gagaggtgccccaagcgtcc

SEQ ID NO: 422493 - DNA, 20 bp, mouse
gaaagcccttcgggtcacag

SEQ ID NO: 422494 - DNA, 20 bp, mouse
gggagccgctgtgacccgaa

SEQ ID NO: 422495 - DNA, 20 bp, mouse
gctctgtccctagctgcagt

SEQ ID NO: 422496 - DNA, 20 bp, mouse
ggtgccgagggtaggaagtg

SEQ ID NO: 422497 - DNA, 20 bp, mouse
gttcctaccctcggcaccca

SEQ ID NO: 422498 - DNA, 20 bp, mouse
gactctggccctgggtgccg

SEQ ID NO: 422499 - DNA, 20 bp, mouse
gggccctgggtgccgagggt

SEQ ID NO: 422500 - DNA, 20 bp, mouse
gaaggggacaggcggtcaca

SEQ ID NO: 422501 - DNA, 20 bp, mouse
gctacctgctgctctgactc

SEQ ID NO: 422502 - DNA, 20 bp, mouse
gagtccccagtaagagggga

SEQ ID NO: 422503 - DNA, 20 bp, mouse
ggatcccagcagagaaagag

SEQ ID NO: 422504 - DNA, 20 bp, mouse
gccacacgccagcctctggt

SEQ ID NO: 422505 - DNA, 20 bp, mouse
ggggccagagtcagagcagc

SEQ ID NO: 422506 - DNA, 20 bp, mouse
ggcccagccagtcgctgtca

SEQ ID NO: 422507 - DNA, 20 bp, mouse
gaccctgacagcgactggct

SEQ ID NO: 422508 - DNA, 20 bp, mouse
gaagtcatatccctgggctg

SEQ ID NO: 422509 - DNA, 20 bp, mouse
ggggcttctccactctgggt

SEQ ID NO: 422510 - DNA, 20 bp, mouse
gtacttaccctgacagcgac

SEQ ID NO: 422511 - DNA, 20 bp, mouse
gtctgggtgggtggtgtccc

SEQ ID NO: 422512 - DNA, 20 bp, mouse
gtggctgggcttctccactc

SEQ ID NO: 422513 - DNA, 20 bp, mouse
gaaactcgaagtcatatccc

SEQ ID NO: 422514 - DNA, 20 bp, mouse
gatcccgcagcgtactgtag

SEQ ID NO: 422515 - DNA, 20 bp, mouse
gcgggaggctgaacgctgaa

SEQ ID NO: 422516 - DNA, 20 bp, mouse
gggtggacgcgactcgacag

SEQ ID NO: 422517 - DNA, 20 bp, mouse
gggcgtccctgcttacctgg

SEQ ID NO: 422518 - DNA, 20 bp, mouse
gaagaagctgtgctcgcggg

SEQ ID NO: 422519 - DNA, 20 bp, mouse
ggtccctgcttacctggtgg

SEQ ID NO: 422520 - DNA, 20 bp, mouse
gacccgccaccaggtaagca

SEQ ID NO: 422521 - DNA, 20 bp, mouse
gcccggcgtccctgcttacc

SEQ ID NO: 422522 - DNA, 20 bp, mouse
ggcagggacgccgggcccag

SEQ ID NO: 422523 - DNA, 20 bp, mouse
gcactcagaacggacaccat

SEQ ID NO: 422524 - DNA, 20 bp, mouse
gccgcggtgtagacactcgt

SEQ ID NO: 422525 - DNA, 20 bp, mouse
gtgtctacaccgcgggaatg

SEQ ID NO: 422526 - DNA, 20 bp, mouse
gctgcgctggtcgtcgacaa

SEQ ID NO: 422527 - DNA, 20 bp, mouse
ggtgtcttgatagttcgcca

SEQ ID NO: 422528 - DNA, 20 bp, mouse
gggaacagccttcttagcac

SEQ ID NO: 422529 - DNA, 20 bp, mouse
ggaaggctatagtcacctcg

SEQ ID NO: 422530 - DNA, 20 bp, mouse
gaaggctgttcccttccaca

SEQ ID NO: 422531 - DNA, 20 bp, mouse
gtggaggggaatacagcccg

SEQ ID NO: 422532 - DNA, 20 bp, mouse
gatcgatgccggtgctaaga

SEQ ID NO: 422533 - DNA, 20 bp, mouse
gtcccttccacagggtgtga

SEQ ID NO: 422534 - DNA, 20 bp, mouse
gactatcaagacacaaaaga

SEQ ID NO: 422535 - DNA, 20 bp, mouse
ggatgacgatatcgctgcgc

SEQ ID NO: 422536 - DNA, 20 bp, mouse
ggatgtgcgagacagagaat

SEQ ID NO: 422537 - DNA, 20 bp, mouse
ggtgaacaaaagttcaatag

SEQ ID NO: 422538 - DNA, 20 bp, mouse
gtccaggctctcttctctga

SEQ ID NO: 422539 - DNA, 20 bp, mouse
gtggctgggatcttccagat

SEQ ID NO: 422540 - DNA, 20 bp, mouse
gtggacgaccaaccatggag

SEQ ID NO: 422541 - DNA, 20 bp, mouse
gtgtcgtggacgaccaacca

SEQ ID NO: 422542 - DNA, 20 bp, mouse
gtggtcgtccacgacaccag

SEQ ID NO: 422543 - DNA, 20 bp, mouse
ggagcctggacctcgagcac

SEQ ID NO: 422544 - DNA, 20 bp, mouse
ggccagaaggactgttatgt

SEQ ID NO: 422545 - DNA, 20 bp, mouse
ggtgcctcggtgagaagaat

SEQ ID NO: 422546 - DNA, 20 bp, mouse
gggactcaccgtgctagggg

SEQ ID NO: 422547 - DNA, 20 bp, mouse
ggtgctgacaaggtcctgca

SEQ ID NO: 422548 - DNA, 20 bp, mouse
gctgggactcaccgtgctag

SEQ ID NO: 422549 - DNA, 20 bp, mouse
gaatccagccgcccctagca

SEQ ID NO: 422550 - DNA, 20 bp, mouse
gtggcgctggtggcaggcac

SEQ ID NO: 422551 - DNA, 20 bp, mouse
gggggcggctggattcagct

SEQ ID NO: 422552 - DNA, 20 bp, mouse
gtcagctgggctggcgctgg

SEQ ID NO: 422553 - DNA, 20 bp, mouse
gccccatgtatggctaggga

SEQ ID NO: 422554 - DNA, 20 bp, mouse
ggattcagctgggctggcgc

SEQ ID NO: 422555 - DNA, 20 bp, mouse
gtccctccctagccatacat

SEQ ID NO: 422556 - DNA, 20 bp, mouse
gcggagtgtgagaccgaccg

SEQ ID NO: 422557 - DNA, 20 bp, mouse
gcccgctcccgcttaaatag

SEQ ID NO: 422558 - DNA, 20 bp, mouse
gagcttaccggcgaaggacg

SEQ ID NO: 422559 - DNA, 20 bp, mouse
ggttccgccgcggcgaggag

SEQ ID NO: 422560 - DNA, 20 bp, mouse
gcgcagggcgcctgacgggt

SEQ ID NO: 422561 - DNA, 20 bp, mouse
ggctcccgcttaaatagcgg

SEQ ID NO: 422562 - DNA, 20 bp, mouse
gcagggccgagccaccccgg

SEQ ID NO: 422563 - DNA, 20 bp, mouse
ggcttaaatagcggcggggg

SEQ ID NO: 422564 - DNA, 20 bp, mouse
gggagcgcagggcgcctgac

SEQ ID NO: 422565 - DNA, 20 bp, mouse
gccccgggcggcgtaaccgt

SEQ ID NO: 422566 - DNA, 20 bp, mouse
gggcttcccccagaaggaag

SEQ ID NO: 422567 - DNA, 20 bp, mouse
gaccacggccctcagtctct

SEQ ID NO: 422568 - DNA, 20 bp, mouse
ggccctcagtctctcggaga

SEQ ID NO: 422569 - DNA, 20 bp, mouse
gtccttctccgagagactga

SEQ ID NO: 422570 - DNA, 20 bp, mouse
gctgagggccgtggtgtctt

SEQ ID NO: 422571 - DNA, 20 bp, mouse
gggaagtctgggaaccccca

SEQ ID NO: 422572 - DNA, 20 bp, mouse
gagttctataggcacacagg

SEQ ID NO: 422573 - DNA, 20 bp, mouse
gcaggtatcaatgacaccaa

SEQ ID NO: 422574 - DNA, 20 bp, mouse
gcaggacagttgtagactag

SEQ ID NO: 422575 - DNA, 20 bp, mouse
gtagcccaggtcacacgtca

SEQ ID NO: 422576 - DNA, 20 bp, mouse
gtgaagagagctgcctagga

SEQ ID NO: 422577 - DNA, 20 bp, mouse
gagagctgcctaggaaggct

SEQ ID NO: 422578 - DNA, 20 bp, mouse
gcgtgtgaagagagctgcct

SEQ ID NO: 422579 - DNA, 20 bp, mouse
ggcacaggccggtcccaact

SEQ ID NO: 422580 - DNA, 20 bp, mouse
gtccaatgaaggcagcctgt

SEQ ID NO: 422581 - DNA, 20 bp, mouse
ggttacctggatgtagaggt

SEQ ID NO: 422582 - DNA, 20 bp, mouse
gtccgccctgaaggcccata

SEQ ID NO: 422583 - DNA, 20 bp, mouse
gggcggagctgagaactaag

SEQ ID NO: 422584 - DNA, 20 bp, mouse
gtagagttacctggatgtag

SEQ ID NO: 422585 - DNA, 20 bp, mouse
gcagcaacgtggtccaatga

SEQ ID NO: 422586 - DNA, 20 bp, mouse
gagggcatggagcaggacta

SEQ ID NO: 422587 - DNA, 20 bp, mouse
gtggaagacaccaagaaggt

SEQ ID NO: 422588 - DNA, 20 bp, mouse
gagtgggggcagggcaccta

SEQ ID NO: 422589 - DNA, 20 bp, mouse
ggggcagggcacctagggca

SEQ ID NO: 422590 - DNA, 20 bp, mouse
gctgggggcccgatggatca

SEQ ID NO: 422591 - DNA, 20 bp, mouse
gtcagggccccccaccttct

SEQ ID NO: 422592 - DNA, 20 bp, mouse
gtaggcagtggatggccctg

SEQ ID NO: 422593 - DNA, 20 bp, mouse
ggcagccagcagctaacggg

SEQ ID NO: 422594 - DNA, 20 bp, mouse
gagttgaagcatgggttgag

SEQ ID NO: 422595 - DNA, 20 bp, mouse
ggttgacctgagcagaatta

SEQ ID NO: 422596 - DNA, 20 bp, mouse
gggaagggcccgccgaggac

SEQ ID NO: 422597 - DNA, 20 bp, mouse
gaccggacgaaagataacag

SEQ ID NO: 422598 - DNA, 20 bp, mouse
ggctttgttgccggaggggg

SEQ ID NO: 422599 - DNA, 20 bp, mouse
gggccggcgttctcagggag

SEQ ID NO: 422600 - DNA, 20 bp, mouse
gtggctgtgcagcgggcgtg

SEQ ID NO: 422601 - DNA, 20 bp, mouse
gagaggccgtggcccatacg

SEQ ID NO: 422602 - DNA, 20 bp, mouse
gtgcggggccggcgttctca

SEQ ID NO: 422603 - DNA, 20 bp, mouse
gcggcccgggtccgaagaga

SEQ ID NO: 422604 - DNA, 20 bp, mouse
gagggcccgccgaggaccgg

SEQ ID NO: 422605 - DNA, 20 bp, mouse
gagggaaacggaagcgacta

SEQ ID NO: 422606 - DNA, 20 bp, mouse
ggccgcgagcagcgtagaga

SEQ ID NO: 422607 - DNA, 20 bp, mouse
ggagagggcactatgagcgg

SEQ ID NO: 422608 - DNA, 20 bp, mouse
gtacgctgctcgcggcccgt

SEQ ID NO: 422609 - DNA, 20 bp, mouse
ggtagagagggcactatgag

SEQ ID NO: 422610 - DNA, 20 bp, mouse
gggcggcgggatcagcaccg

SEQ ID NO: 422611 - DNA, 20 bp, mouse
gggcgggatcagcaccgagg

SEQ ID NO: 422612 - DNA, 20 bp, mouse
ggaaaggtccagggcccgag

SEQ ID NO: 422613 - DNA, 20 bp, mouse
gcgggatcccgggagctgtc

SEQ ID NO: 422614 - DNA, 20 bp, mouse
gctatgagcgggggcgtcta

SEQ ID NO: 422615 - DNA, 20 bp, mouse
gaatggaaagcagaagtagt

SEQ ID NO: 422616 - DNA, 20 bp, mouse
gatgtctctggatggtgtgt

SEQ ID NO: 422617 - DNA, 20 bp, mouse
gagagcagtatgtctctgga

SEQ ID NO: 422618 - DNA, 20 bp, mouse
gtctgagagcagtatgtctc

SEQ ID NO: 422619 - DNA, 20 bp, mouse
gctcgatcctgctggctaca

SEQ ID NO: 422620 - DNA, 20 bp, mouse
gaaggataggccaagactag

SEQ ID NO: 422621 - DNA, 20 bp, mouse
gatggagacggccaagacgg

SEQ ID NO: 422622 - DNA, 20 bp, mouse
gctagaggtaaccaaagcag

SEQ ID NO: 422623 - DNA, 20 bp, mouse
gacagtgggcaagccctaca

SEQ ID NO: 422624 - DNA, 20 bp, mouse
gtcgcaaagagacctttgtg

SEQ ID NO: 422625 - DNA, 20 bp, mouse
gctccacagacagcaaacat

SEQ ID NO: 422626 - DNA, 20 bp, mouse
gagctctagggtatggatgt

SEQ ID NO: 422627 - DNA, 20 bp, mouse
gtcccaggagctctagggta

SEQ ID NO: 422628 - DNA, 20 bp, mouse
gcgccctgggctgtgcccat

SEQ ID NO: 422629 - DNA, 20 bp, mouse
gtagaggagatgaaataggt

SEQ ID NO: 422630 - DNA, 20 bp, mouse
ggcctctccagggtcgccct

SEQ ID NO: 422631 - DNA, 20 bp, mouse
gaggcgctggtcattgacct

SEQ ID NO: 422632 - DNA, 20 bp, mouse
ggcacagcccagggcgaccc

SEQ ID NO: 422633 - DNA, 20 bp, mouse
gacttcaaggagacatacgt

SEQ ID NO: 422634 - DNA, 20 bp, mouse
gaagaaaatacggaagatca

SEQ ID NO: 422635 - DNA, 20 bp, mouse
gacggtagaggagatgaaat

SEQ ID NO: 422636 - DNA, 20 bp, mouse
gtgcagcctatggatgtcaa

SEQ ID NO: 422637 - DNA, 20 bp, mouse
gcgaggccatctgcagccta

SEQ ID NO: 422638 - DNA, 20 bp, mouse
gatgggcacaggcacctgta

SEQ ID NO: 422639 - DNA, 20 bp, mouse
gaaagtggacctcttcactc

SEQ ID NO: 422640 - DNA, 20 bp, mouse
ggacatccataggctgcaga

SEQ ID NO: 422641 - DNA, 20 bp, mouse
ggtgctgtggttattgacat

SEQ ID NO: 422642 - DNA, 20 bp, mouse
ggtaatgctgcttgacaaag

SEQ ID NO: 422643 - DNA, 20 bp, mouse
ggcacaggcacctgtaaggt

SEQ ID NO: 422644 - DNA, 20 bp, mouse
gaggatggtggccaccgtgt

SEQ ID NO: 422645 - DNA, 20 bp, mouse
gccgctcccggccagaactg

SEQ ID NO: 422646 - DNA, 20 bp, mouse
gccgagcgcgcgccccagga

SEQ ID NO: 422647 - DNA, 20 bp, mouse
gccgtcgcctggagagaagg

SEQ ID NO: 422648 - DNA, 20 bp, mouse
gaggctgctgctgccggcgg

SEQ ID NO: 422649 - DNA, 20 bp, mouse
ggccgcggctctgttcgcag

SEQ ID NO: 422650 - DNA, 20 bp, mouse
gcagcggccagagcggatca

SEQ ID NO: 422651 - DNA, 20 bp, mouse
gagcagtgtgcgtggagatt

SEQ ID NO: 422652 - DNA, 20 bp, mouse
gaggagtgcagcggccagag

SEQ ID NO: 422653 - DNA, 20 bp, mouse
gccggagcccaggagtgcag

SEQ ID NO: 422654 - DNA, 20 bp, mouse
ggcctctgcgaacagagccg

SEQ ID NO: 422655 - DNA, 20 bp, mouse
ggctcgcggactgccttcct

SEQ ID NO: 422656 - DNA, 20 bp, mouse
gcgccccaggaaccgcgaga

SEQ ID NO: 422657 - DNA, 20 bp, mouse
ggaccttctcgcggttcctg

SEQ ID NO: 422658 - DNA, 20 bp, mouse
gggctgcggtgaccttctcg

SEQ ID NO: 422659 - DNA, 20 bp, mouse
gcgcctgggcgcggagtctc

SEQ ID NO: 422660 - DNA, 20 bp, mouse
gttcctggggcggcacgcct

SEQ ID NO: 422661 - DNA, 20 bp, mouse
gaggcgtgctggtacttcgc

SEQ ID NO: 422662 - DNA, 20 bp, mouse
gatggaaaggcggcgggctg

SEQ ID NO: 422663 - DNA, 20 bp, mouse
ggaagtaccagcacgcctgc

SEQ ID NO: 422664 - DNA, 20 bp, mouse
ggcgagcacagcgcaaggga

SEQ ID NO: 422665 - DNA, 20 bp, mouse
gcgccggagactccgcgccc

SEQ ID NO: 422666 - DNA, 20 bp, mouse
gatgcagcccgagggtctgg

SEQ ID NO: 422667 - DNA, 20 bp, mouse
gctcgcccagtgaagcagag

SEQ ID NO: 422668 - DNA, 20 bp, mouse
gtccccggcccccagaccct

SEQ ID NO: 422669 - DNA, 20 bp, mouse
gtgatggttatgcagcccga

SEQ ID NO: 422670 - DNA, 20 bp, mouse
gcgcccccaccgccagagaa

SEQ ID NO: 422671 - DNA, 20 bp, mouse
gaggccaggcagttcttctc

SEQ ID NO: 422672 - DNA, 20 bp, mouse
ggagtcactgagggactcca

SEQ ID NO: 422673 - DNA, 20 bp, mouse
ggtgctcacccatttcccaa

SEQ ID NO: 422674 - DNA, 20 bp, mouse
gaggacagcatatagctggt

SEQ ID NO: 422675 - DNA, 20 bp, mouse
gggcgagctcctgcacactc

SEQ ID NO: 422676 - DNA, 20 bp, mouse
gtgtgccggaggctccgact

SEQ ID NO: 422677 - DNA, 20 bp, mouse
gctgaaagcagctgaagcgg

SEQ ID NO: 422678 - DNA, 20 bp, mouse
ggctgaagcggcggccgagt

SEQ ID NO: 422679 - DNA, 20 bp, mouse
ggcgggagctgaggcggtag

SEQ ID NO: 422680 - DNA, 20 bp, mouse
gctgcgcaggcgtcagtctt

SEQ ID NO: 422681 - DNA, 20 bp, mouse
gaccagtacggcccgaacag

SEQ ID NO: 422682 - DNA, 20 bp, mouse
gagctgaggcggtagcggac

SEQ ID NO: 422683 - DNA, 20 bp, mouse
gtcagctcccgcccctgtgc

SEQ ID NO: 422684 - DNA, 20 bp, mouse
gcgcaggcgtcagtcttggg

SEQ ID NO: 422685 - DNA, 20 bp, mouse
gcggctggcgggctagcgaa

SEQ ID NO: 422686 - DNA, 20 bp, mouse
gtctacgagggccttgggag

SEQ ID NO: 422687 - DNA, 20 bp, mouse
gtgagagaccgacgtagaga

SEQ ID NO: 422688 - DNA, 20 bp, mouse
gctgaggcagcccccccgcc

SEQ ID NO: 422689 - DNA, 20 bp, mouse
gacgagggccttgggagcgg

SEQ ID NO: 422690 - DNA, 20 bp, mouse
gaggcagcccccccgccggg

SEQ ID NO: 422691 - DNA, 20 bp, mouse
gtgcccagcgggcctaaaga

SEQ ID NO: 422692 - DNA, 20 bp, mouse
ggagggtgaagtggtccgcc

SEQ ID NO: 422693 - DNA, 20 bp, mouse
gcaaagatgccgctctacga

SEQ ID NO: 422694 - DNA, 20 bp, mouse
gccccgtctaaggtgatcag

SEQ ID NO: 422695 - DNA, 20 bp, mouse
ggaagtggtccgcccggcgg

SEQ ID NO: 422696 - DNA, 20 bp, mouse
gtggttggcgatcacatcgt

SEQ ID NO: 422697 - DNA, 20 bp, mouse
gctggcagttccttcctcgg

SEQ ID NO: 422698 - DNA, 20 bp, mouse
ggatgtgaggaggacgcggg

SEQ ID NO: 422699 - DNA, 20 bp, mouse
ggtgtcagtggcgtttgctg

SEQ ID NO: 422700 - DNA, 20 bp, mouse
gtcgatcacaacaggctggt

SEQ ID NO: 422701 - DNA, 20 bp, mouse
ggcagctgaacccgcctgac

SEQ ID NO: 422702 - DNA, 20 bp, mouse
gatggatgtgaggaggacgc

SEQ ID NO: 422703 - DNA, 20 bp, mouse
gcgccggtactgggcatcca

SEQ ID NO: 422704 - DNA, 20 bp, mouse
ggccagtgacaaagagctgg

SEQ ID NO: 422705 - DNA, 20 bp, mouse
gtcaaactatggatgtgagg

SEQ ID NO: 422706 - DNA, 20 bp, mouse
gcgggctgcaggaggaccgg

SEQ ID NO: 422707 - DNA, 20 bp, mouse
gggaggaccggcgggctaca

SEQ ID NO: 422708 - DNA, 20 bp, mouse
gcctcggagtccaggatgtg

SEQ ID NO: 422709 - DNA, 20 bp, mouse
gcaaggttcgcggggagacc

SEQ ID NO: 422710 - DNA, 20 bp, mouse
gggtacagctgatcacagtc

SEQ ID NO: 422711 - DNA, 20 bp, mouse
gtctggagtcgcatccgtcc

SEQ ID NO: 422712 - DNA, 20 bp, mouse
gcggcgggctacaaggttcg

SEQ ID NO: 422713 - DNA, 20 bp, mouse
ggcctcgggagcacctccct

SEQ ID NO: 422714 - DNA, 20 bp, mouse
gagctctggccgcctgatgg

SEQ ID NO: 422715 - DNA, 20 bp, mouse
gtgctcccgaggcccacccc

SEQ ID NO: 422716 - DNA, 20 bp, mouse
gcgagggcggggccgtgtgg

SEQ ID NO: 422717 - DNA, 20 bp, mouse
ggggcggggccgtgtggagg

SEQ ID NO: 422718 - DNA, 20 bp, mouse
gcgggcgggcgagctctcgg

SEQ ID NO: 422719 - DNA, 20 bp, mouse
ggtcctggtgagccgccgcc

SEQ ID NO: 422720 - DNA, 20 bp, mouse
gcccgcgctgcacccgaagg

SEQ ID NO: 422721 - DNA, 20 bp, mouse
gctacccgcgctgcacccga

SEQ ID NO: 422722 - DNA, 20 bp, mouse
ggcgcgggtagcctagctcc

SEQ ID NO: 422723 - DNA, 20 bp, mouse
ggagaggccctgtccctcgg

SEQ ID NO: 422724 - DNA, 20 bp, mouse
ggccgagagatgggtctaga

SEQ ID NO: 422725 - DNA, 20 bp, mouse
ggcgctgcacccgaaggcgg

SEQ ID NO: 422726 - DNA, 20 bp, mouse
gagctgtgggaagcccgagc

SEQ ID NO: 422727 - DNA, 20 bp, mouse
gaggaggccgcggcagggta

SEQ ID NO: 422728 - DNA, 20 bp, mouse
gcggcctcctcggaaaggaa

SEQ ID NO: 422729 - DNA, 20 bp, mouse
gggagactgaggccggggac

SEQ ID NO: 422730 - DNA, 20 bp, mouse
gaccgaggacctccagacct

SEQ ID NO: 422731 - DNA, 20 bp, mouse
gactgtggcacggggtacgg

SEQ ID NO: 422732 - DNA, 20 bp, mouse
gggtgggtgccctgcttcac

SEQ ID NO: 422733 - DNA, 20 bp, mouse
gtacggcgggtcttcggggt

SEQ ID NO: 422734 - DNA, 20 bp, mouse
gagaggaggaggccgcggca

SEQ ID NO: 422735 - DNA, 20 bp, mouse
gcggccagactggcgagggg

SEQ ID NO: 422736 - DNA, 20 bp, mouse
gggcacccaggggcacgctg

SEQ ID NO: 422737 - DNA, 20 bp, mouse
gcgcagtcaaccacgcaggg

SEQ ID NO: 422738 - DNA, 20 bp, mouse
gagcggcgctgcctgcgacc

SEQ ID NO: 422739 - DNA, 20 bp, mouse
gtgcctgcgacccggcacct

SEQ ID NO: 422740 - DNA, 20 bp, mouse
gccagccccagcgtgcccct

SEQ ID NO: 422741 - DNA, 20 bp, mouse
gccctgggtgcccagtgcca

SEQ ID NO: 422742 - DNA, 20 bp, mouse
ggacccggcaccttggcact

SEQ ID NO: 422743 - DNA, 20 bp, mouse
gtgggctcccggcagctcct

SEQ ID NO: 422744 - DNA, 20 bp, mouse
gcaggaggagcgcggaggga

SEQ ID NO: 422745 - DNA, 20 bp, mouse
ggcagcgccgctccccaccc

SEQ ID NO: 422746 - DNA, 20 bp, mouse
gtgcggacaagctggagcta

SEQ ID NO: 422747 - DNA, 20 bp, mouse
ggacaagctggagctacggt

SEQ ID NO: 422748 - DNA, 20 bp, mouse
gggcgctccagaactttctg

SEQ ID NO: 422749 - DNA, 20 bp, mouse
gcttgaggcctggatcagcg

SEQ ID NO: 422750 - DNA, 20 bp, mouse
gggagctacggttggacttg

SEQ ID NO: 422751 - DNA, 20 bp, mouse
gtctcggaagcggaacacgt

SEQ ID NO: 422752 - DNA, 20 bp, mouse
ggaggctgttgcggacaagc

SEQ ID NO: 422753 - DNA, 20 bp, mouse
gcggagcagagcgggcatct

SEQ ID NO: 422754 - DNA, 20 bp, mouse
ggggcccagagactcagacg

SEQ ID NO: 422755 - DNA, 20 bp, mouse
gagagcgggcatctcggaag

SEQ ID NO: 422756 - DNA, 20 bp, mouse
ggctccattatccagaacta

SEQ ID NO: 422757 - DNA, 20 bp, mouse
gggcacgcaccacgctgcag

SEQ ID NO: 422758 - DNA, 20 bp, mouse
gccggaagaagcctgagcag

SEQ ID NO: 422759 - DNA, 20 bp, mouse
ggcagaggagattcaaacag

SEQ ID NO: 422760 - DNA, 20 bp, mouse
gagaactagggtcgtcattt

SEQ ID NO: 422761 - DNA, 20 bp, mouse
gcgcctccagcctcagtcgg

SEQ ID NO: 422762 - DNA, 20 bp, mouse
gcccatcgaccatagagtac

SEQ ID NO: 422763 - DNA, 20 bp, mouse
gaagcgactccgctgcagcg

SEQ ID NO: 422764 - DNA, 20 bp, mouse
gcgaccctagttctggataa

SEQ ID NO: 422765 - DNA, 20 bp, mouse
gggcttctcgagattgactg

SEQ ID NO: 422766 - DNA, 20 bp, mouse
gtcggtgtcccagagccccg

SEQ ID NO: 422767 - DNA, 20 bp, mouse
gcagaggcccaggctagcag

SEQ ID NO: 422768 - DNA, 20 bp, mouse
gcgagtcgctgcaggaggtg

SEQ ID NO: 422769 - DNA, 20 bp, mouse
ggatgacccaagccgagaag

SEQ ID NO: 422770 - DNA, 20 bp, mouse
gcccagagccccggggctgg

SEQ ID NO: 422771 - DNA, 20 bp, mouse
gggacgccgcgcctgcgcaa

SEQ ID NO: 422772 - DNA, 20 bp, mouse
gtgcaggaggtgaggtgcag

SEQ ID NO: 422773 - DNA, 20 bp, mouse
ggctagcagtggtctaacca

SEQ ID NO: 422774 - DNA, 20 bp, mouse
gcctctgactgctgtggcgt

SEQ ID NO: 422775 - DNA, 20 bp, mouse
gttctccgcgtcccccttct

SEQ ID NO: 422776 - DNA, 20 bp, mouse
ggatggactaggaacaactg

SEQ ID NO: 422777 - DNA, 20 bp, mouse
gagaaagaggcaatattcat

SEQ ID NO: 422778 - DNA, 20 bp, mouse
gtgaggacctgctactcaga

SEQ ID NO: 422779 - DNA, 20 bp, mouse
gtgtttagttggactatcca

SEQ ID NO: 422780 - DNA, 20 bp, mouse
gcagcaataggatgtttagt

SEQ ID NO: 422781 - DNA, 20 bp, mouse
gaggcaatattcatgggctg

SEQ ID NO: 422782 - DNA, 20 bp, mouse
gccctgaattcaccagaaag

SEQ ID NO: 422783 - DNA, 20 bp, mouse
gtgtcatcaactctgtcgtt

SEQ ID NO: 422784 - DNA, 20 bp, mouse
gcgtggactggtaactagat

SEQ ID NO: 422785 - DNA, 20 bp, mouse
gcttctctcgggtctcttgt

SEQ ID NO: 422786 - DNA, 20 bp, mouse
gcggaggatggagggttccc

SEQ ID NO: 422787 - DNA, 20 bp, mouse
gggaaagcagaccacctcgg

SEQ ID NO: 422788 - DNA, 20 bp, mouse
gagaggaaagcagaccacct

SEQ ID NO: 422789 - DNA, 20 bp, mouse
gggttcccgggcactggggt

SEQ ID NO: 422790 - DNA, 20 bp, mouse
gaaccctccatcctccgagg

SEQ ID NO: 422791 - DNA, 20 bp, mouse
gagaccacctcggaggatgg

SEQ ID NO: 422792 - DNA, 20 bp, mouse
gaggattccagggttcctgg

SEQ ID NO: 422793 - DNA, 20 bp, mouse
gcaggagcctcagacctgag

SEQ ID NO: 422794 - DNA, 20 bp, mouse
gagcagaccacctcggagga

SEQ ID NO: 422795 - DNA, 20 bp, mouse
ggggaggcctccaggaaccc

SEQ ID NO: 422796 - DNA, 20 bp, mouse
gcaccagtggtgatcgacaa

SEQ ID NO: 422797 - DNA, 20 bp, mouse
ggcagcaccagcggcatgag

SEQ ID NO: 422798 - DNA, 20 bp, mouse
gagcggctaccagccaccag

SEQ ID NO: 422799 - DNA, 20 bp, mouse
gcagcctgggaagagcggtc

SEQ ID NO: 422800 - DNA, 20 bp, mouse
gagccgttgtcgatcaccac

SEQ ID NO: 422801 - DNA, 20 bp, mouse
gcccgcagtacctgatggat

SEQ ID NO: 422802 - DNA, 20 bp, mouse
gggctcgggaatgatcaagg

SEQ ID NO: 422803 - DNA, 20 bp, mouse
gaacggctcgggaatgatca

SEQ ID NO: 422804 - DNA, 20 bp, mouse
gtattcgggtagacaaactg

SEQ ID NO: 422805 - DNA, 20 bp, mouse
ggaccagggaaggaacccca

SEQ ID NO: 422806 - DNA, 20 bp, mouse
ggggcggaggaaacttgcgg

SEQ ID NO: 422807 - DNA, 20 bp, mouse
gtggctgccggtgggatccg

SEQ ID NO: 422808 - DNA, 20 bp, mouse
ggaggcgagaccgggatcgg

SEQ ID NO: 422809 - DNA, 20 bp, mouse
gtgtccaccccggatcccac

SEQ ID NO: 422810 - DNA, 20 bp, mouse
gcggagagctcgaggcgacc

SEQ ID NO: 422811 - DNA, 20 bp, mouse
gaggcaccgggctggagccg

SEQ ID NO: 422812 - DNA, 20 bp, mouse
gctggcggcaggcaccgggc

SEQ ID NO: 422813 - DNA, 20 bp, mouse
gccgaccgccgctggaccag

SEQ ID NO: 422814 - DNA, 20 bp, mouse
gcgccggagctggggaccga

SEQ ID NO: 422815 - DNA, 20 bp, mouse
gaagttcccccagcgcttgg

SEQ ID NO: 422816 - DNA, 20 bp, mouse
ggcgagcaggaggacaacaa

SEQ ID NO: 422817 - DNA, 20 bp, mouse
ggctgcggcggcggttacta

SEQ ID NO: 422818 - DNA, 20 bp, mouse
ggcggcggcggttactatgg

SEQ ID NO: 422819 - DNA, 20 bp, mouse
ggcggttactatggcggagt

SEQ ID NO: 422820 - DNA, 20 bp, mouse
gtccagacggagcccgaccg

SEQ ID NO: 422821 - DNA, 20 bp, mouse
gttactatggcggagtcggc

SEQ ID NO: 422822 - DNA, 20 bp, mouse
gctcgcacggacgcgctgaa

SEQ ID NO: 422823 - DNA, 20 bp, mouse
gccagccgcgcaatatggcc

SEQ ID NO: 422824 - DNA, 20 bp, mouse
gcccgcccggccatattgcg

SEQ ID NO: 422825 - DNA, 20 bp, mouse
gatattgcgcggctggggag

SEQ ID NO: 422826 - DNA, 20 bp, mouse
ggcggtctgcgggtgatcag

SEQ ID NO: 422827 - DNA, 20 bp, mouse
gcgccccgggaacttcaaag

SEQ ID NO: 422828 - DNA, 20 bp, mouse
gaccttgcggcaggtatagt

SEQ ID NO: 422829 - DNA, 20 bp, mouse
gggccgctttgaagttcccg

SEQ ID NO: 422830 - DNA, 20 bp, mouse
ggcgcagccgcgacaccctt

SEQ ID NO: 422831 - DNA, 20 bp, mouse
ggcacttccgaagggtgtcg

SEQ ID NO: 422832 - DNA, 20 bp, mouse
gagttcccggggcgcgggag

SEQ ID NO: 422833 - DNA, 20 bp, mouse
gccaaccgcgcacttccgaa

SEQ ID NO: 422834 - DNA, 20 bp, mouse
gtggggtcatggccacccgg

SEQ ID NO: 422835 - DNA, 20 bp, mouse
gcggttggctctagtgacag

SEQ ID NO: 422836 - DNA, 20 bp, mouse
gacggcgacgggagagacgg

SEQ ID NO: 422837 - DNA, 20 bp, mouse
ggagacggcgacgggagaga

SEQ ID NO: 422838 - DNA, 20 bp, mouse
gcacagcctggaccagaact

SEQ ID NO: 422839 - DNA, 20 bp, mouse
gggccaggagaccgaaaacg

SEQ ID NO: 422840 - DNA, 20 bp, mouse
gggcggccaagttctggtcc

SEQ ID NO: 422841 - DNA, 20 bp, mouse
gacggaaccggaagtgtagg

SEQ ID NO: 422842 - DNA, 20 bp, mouse
gcctggctgaggcgacgagg

SEQ ID NO: 422843 - DNA, 20 bp, mouse
gcggccgcgggagacggcga

SEQ ID NO: 422844 - DNA, 20 bp, mouse
gacagtagccgagctcgcgg

SEQ ID NO: 422845 - DNA, 20 bp, mouse
ggagacggtggcgcaggcgg

SEQ ID NO: 422846 - DNA, 20 bp, mouse
gggctccgtggccaccgctc

SEQ ID NO: 422847 - DNA, 20 bp, mouse
gacctgaaccgagtccaaaa

SEQ ID NO: 422848 - DNA, 20 bp, mouse
gccggaggggccatgaacgg

SEQ ID NO: 422849 - DNA, 20 bp, mouse
gccatgaacgggggaggggt

SEQ ID NO: 422850 - DNA, 20 bp, mouse
gccgagccagcggggaaacc

SEQ ID NO: 422851 - DNA, 20 bp, mouse
gcaaaatggctcctgagcgg

SEQ ID NO: 422852 - DNA, 20 bp, mouse
gggctcctgagcggtggcca

SEQ ID NO: 422853 - DNA, 20 bp, mouse
gggccacggagccgagccag

SEQ ID NO: 422854 - DNA, 20 bp, mouse
gaggcagtatgcggagatag

SEQ ID NO: 422855 - DNA, 20 bp, mouse
ggcaggggccgagtccggag

SEQ ID NO: 422856 - DNA, 20 bp, mouse
ggagggtagcctgcacccag

SEQ ID NO: 422857 - DNA, 20 bp, mouse
gcgtccagagccggcctgtg

SEQ ID NO: 422858 - DNA, 20 bp, mouse
ggtcgctctaggccaggaga

SEQ ID NO: 422859 - DNA, 20 bp, mouse
gggtgtgtgtccacaaccag

SEQ ID NO: 422860 - DNA, 20 bp, mouse
gctccggcaaggagaggcgg

SEQ ID NO: 422861 - DNA, 20 bp, mouse
gagcagggctcggctctaga

SEQ ID NO: 422862 - DNA, 20 bp, mouse
gggagtgagcacaggtaagt

SEQ ID NO: 422863 - DNA, 20 bp, mouse
gggctctggacgtgagaccc

SEQ ID NO: 422864 - DNA, 20 bp, mouse
gtcagggagggacccgcgtg

SEQ ID NO: 422865 - DNA, 20 bp, mouse
gggaaaggtctcgatctgcg

SEQ ID NO: 422866 - DNA, 20 bp, mouse
gaaagcacaggactgagacg

SEQ ID NO: 422867 - DNA, 20 bp, mouse
gcagtctgagaggaaagcac

SEQ ID NO: 422868 - DNA, 20 bp, mouse
ggcaaggttggaggacctta

SEQ ID NO: 422869 - DNA, 20 bp, mouse
ggttccggccacagtctgag

SEQ ID NO: 422870 - DNA, 20 bp, mouse
gactcctcaagctctcccta

SEQ ID NO: 422871 - DNA, 20 bp, mouse
gggagagcttgaggagtatg

SEQ ID NO: 422872 - DNA, 20 bp, mouse
gagattgggagcgacctcgg

SEQ ID NO: 422873 - DNA, 20 bp, mouse
gagactgtggccggaactca

SEQ ID NO: 422874 - DNA, 20 bp, mouse
gcggagaccgaagactatag

SEQ ID NO: 422875 - DNA, 20 bp, mouse
gtcagagaggaggacccagt

SEQ ID NO: 422876 - DNA, 20 bp, mouse
gaggctcccgaccagttcag

SEQ ID NO: 422877 - DNA, 20 bp, mouse
ggctcgtaccagcaggtaag

SEQ ID NO: 422878 - DNA, 20 bp, mouse
gcaccctcctctgaactggt

SEQ ID NO: 422879 - DNA, 20 bp, mouse
gctcccgaccagttcagagg

SEQ ID NO: 422880 - DNA, 20 bp, mouse
gtacgagcctgggcttccct

SEQ ID NO: 422881 - DNA, 20 bp, mouse
ggccagagcctcttacctgc

SEQ ID NO: 422882 - DNA, 20 bp, mouse
gtctgtggtgacagtcgtgt

SEQ ID NO: 422883 - DNA, 20 bp, mouse
gcctagggggtggacacatt

SEQ ID NO: 422884 - DNA, 20 bp, mouse
gagcccaggctcgtaccagc

SEQ ID NO: 422885 - DNA, 20 bp, mouse
ggaggacctaagctgagaag

SEQ ID NO: 422886 - DNA, 20 bp, mouse
gggtcttcggggctgttcag

SEQ ID NO: 422887 - DNA, 20 bp, mouse
ggcggaagctcgagtttctg

SEQ ID NO: 422888 - DNA, 20 bp, mouse
ggacacttggatgatccgag

SEQ ID NO: 422889 - DNA, 20 bp, mouse
gacttggatgatccgagcgg

SEQ ID NO: 422890 - DNA, 20 bp, mouse
gccggaagtggcggttaaca

SEQ ID NO: 422891 - DNA, 20 bp, mouse
ggcgaaggctccccgaccag

SEQ ID NO: 422892 - DNA, 20 bp, mouse
ggttgatctgaaggtcttcg

SEQ ID NO: 422893 - DNA, 20 bp, mouse
gcggatcatccaagtgtcag

SEQ ID NO: 422894 - DNA, 20 bp, mouse
ggggcctctccggaacctca

SEQ ID NO: 422895 - DNA, 20 bp, mouse
ggctcgggcggttgatctga

SEQ ID NO: 422896 - DNA, 20 bp, mouse
ggacttgagcagctcggtca

SEQ ID NO: 422897 - DNA, 20 bp, mouse
gttgagcagctcggtcatgg

SEQ ID NO: 422898 - DNA, 20 bp, mouse
ggctaatgctgctcgggaga

SEQ ID NO: 422899 - DNA, 20 bp, mouse
gctgcgacagccgccagggg

SEQ ID NO: 422900 - DNA, 20 bp, mouse
gagactgcgacagccgccag

SEQ ID NO: 422901 - DNA, 20 bp, mouse
gtacccagctaatgctgctc

SEQ ID NO: 422902 - DNA, 20 bp, mouse
gttcgggacagtgcaaggta

SEQ ID NO: 422903 - DNA, 20 bp, mouse
gcgtcctcttcgggaaccca

SEQ ID NO: 422904 - DNA, 20 bp, mouse
ggggacggttcttctcactg

SEQ ID NO: 422905 - DNA, 20 bp, mouse
gattagctgggtatgtggcg

SEQ ID NO: 422906 - DNA, 20 bp, mouse
gagcttcggcggagagaacc

SEQ ID NO: 422907 - DNA, 20 bp, mouse
gtggcagggtcgcttcccga

SEQ ID NO: 422908 - DNA, 20 bp, mouse
gaagctctctgggtctgcgt

SEQ ID NO: 422909 - DNA, 20 bp, mouse
ggcggtctctgagagccatc

SEQ ID NO: 422910 - DNA, 20 bp, mouse
gtctctccgccgaagctctc

SEQ ID NO: 422911 - DNA, 20 bp, mouse
ggaacccgaaggccgactgg

SEQ ID NO: 422912 - DNA, 20 bp, mouse
gttaacctagaagcatggag

SEQ ID NO: 422913 - DNA, 20 bp, mouse
gagctaaggcctgggtcgag

SEQ ID NO: 422914 - DNA, 20 bp, mouse
gtgtcgagcgagagacgatg

SEQ ID NO: 422915 - DNA, 20 bp, mouse
gacatcccggaagcaagcta

SEQ ID NO: 422916 - DNA, 20 bp, mouse
gtgaggcgagaggtcgacgg

SEQ ID NO: 422917 - DNA, 20 bp, mouse
ggtctgaggcgagaggtcga

SEQ ID NO: 422918 - DNA, 20 bp, mouse
gcgtggcccgcagaggtctg

SEQ ID NO: 422919 - DNA, 20 bp, mouse
ggacggtggcagcgcagcaa

SEQ ID NO: 422920 - DNA, 20 bp, mouse
gagccgagggcccgggaccg

SEQ ID NO: 422921 - DNA, 20 bp, mouse
ggcccgggaccggggctcgt

SEQ ID NO: 422922 - DNA, 20 bp, mouse
ggctcgtcggctgccgcccg

SEQ ID NO: 422923 - DNA, 20 bp, mouse
ggcgcagcaatggcgaccgc

SEQ ID NO: 422924 - DNA, 20 bp, mouse
gctgaccgcgtggcccgcag

SEQ ID NO: 422925 - DNA, 20 bp, mouse
gccggcaggtgagctgccag

SEQ ID NO: 422926 - DNA, 20 bp, mouse
gagagcgcggggacgagacc

SEQ ID NO: 422927 - DNA, 20 bp, mouse
gccatggcgagtgtggacga

SEQ ID NO: 422928 - DNA, 20 bp, mouse
gggcgagtgtggacgagggt

SEQ ID NO: 422929 - DNA, 20 bp, mouse
gggtgcagccatggcgagtg

SEQ ID NO: 422930 - DNA, 20 bp, mouse
ggggcgcaggagacctcgac

SEQ ID NO: 422931 - DNA, 20 bp, mouse
ggccttggaagccctcagga

SEQ ID NO: 422932 - DNA, 20 bp, mouse
gctcagaactgagcccccca

SEQ ID NO: 422933 - DNA, 20 bp, mouse
ggccttgcaggcctccctgt

SEQ ID NO: 422934 - DNA, 20 bp, mouse
ggaagtcgcccgcaggcccc

SEQ ID NO: 422935 - DNA, 20 bp, mouse
ggtggagcacgtgcgtggga

SEQ ID NO: 422936 - DNA, 20 bp, mouse
ggctggtcccgggacccgtg

SEQ ID NO: 422937 - DNA, 20 bp, mouse
ggaccagcagcgccgcaaag

SEQ ID NO: 422938 - DNA, 20 bp, mouse
gaatagccgcggtggataag

SEQ ID NO: 422939 - DNA, 20 bp, mouse
ggaagtgacgcacccagaag

SEQ ID NO: 422940 - DNA, 20 bp, mouse
gtacgtgcgcgacccctttg

SEQ ID NO: 422941 - DNA, 20 bp, mouse
gtcgcgggcccatgacgaga

SEQ ID NO: 422942 - DNA, 20 bp, mouse
ggcgcacgtaatagccgcgg

SEQ ID NO: 422943 - DNA, 20 bp, mouse
gtaagcggcgtgcgccgcac

SEQ ID NO: 422944 - DNA, 20 bp, mouse
ggcacgccgcttatccaccg

SEQ ID NO: 422945 - DNA, 20 bp, mouse
gcgcgcgcacgtaatagccg

SEQ ID NO: 422946 - DNA, 20 bp, mouse
gcccctgaagtggagcgaga

SEQ ID NO: 422947 - DNA, 20 bp, mouse
gcgacgagcctccccggcag

SEQ ID NO: 422948 - DNA, 20 bp, mouse
ggggtcccgacgagcctccc

SEQ ID NO: 422949 - DNA, 20 bp, mouse
gggtgagacacgaccccggg

SEQ ID NO: 422950 - DNA, 20 bp, mouse
gatcctgagggagccgcgac

SEQ ID NO: 422951 - DNA, 20 bp, mouse
gcgcggtgcatcgatcctga

SEQ ID NO: 422952 - DNA, 20 bp, mouse
gtcgccgggtgccactgccg

SEQ ID NO: 422953 - DNA, 20 bp, mouse
gcctccccggcagtggcacc

SEQ ID NO: 422954 - DNA, 20 bp, mouse
gggaggtgagacacgacccc

SEQ ID NO: 422955 - DNA, 20 bp, mouse
ggagagggaggcgcttcgcc

SEQ ID NO: 422956 - DNA, 20 bp, mouse
gttatgagcgaaccatgagg

SEQ ID NO: 422957 - DNA, 20 bp, mouse
gggattatgagcgaaccatg

SEQ ID NO: 422958 - DNA, 20 bp, mouse
gccgcagcccccggacccgg

SEQ ID NO: 422959 - DNA, 20 bp, mouse
ggcgaaccatgaggcggctg

SEQ ID NO: 422960 - DNA, 20 bp, mouse
gctgcggcgctgggcgatcg

SEQ ID NO: 422961 - DNA, 20 bp, mouse
gcaccgggcggggggagaag

SEQ ID NO: 422962 - DNA, 20 bp, mouse
gcccgagctcgggagggtag

SEQ ID NO: 422963 - DNA, 20 bp, mouse
ggcccagtgggcatatgggt

SEQ ID NO: 422964 - DNA, 20 bp, mouse
gcataatcctccgggtccgg

SEQ ID NO: 422965 - DNA, 20 bp, mouse
ggccggtcccgagctcggga

SEQ ID NO: 422966 - DNA, 20 bp, mouse
ggggggtcgcggcagactca

SEQ ID NO: 422967 - DNA, 20 bp, mouse
ggcgctgcgcgagggggtcg

SEQ ID NO: 422968 - DNA, 20 bp, mouse
gccacgcgggcgccgagctg

SEQ ID NO: 422969 - DNA, 20 bp, mouse
ggccagcagggccccagcca

SEQ ID NO: 422970 - DNA, 20 bp, mouse
ggcgctgcagcatcccacgc

SEQ ID NO: 422971 - DNA, 20 bp, mouse
ggacccgggcgctgcgcgag

SEQ ID NO: 422972 - DNA, 20 bp, mouse
gcacgccaggccggcgacaa

SEQ ID NO: 422973 - DNA, 20 bp, mouse
gggtaagtcacccgcacagg

SEQ ID NO: 422974 - DNA, 20 bp, mouse
ggccacctcgctacaagtca

SEQ ID NO: 422975 - DNA, 20 bp, mouse
ggcgcatctgaggacccccc

SEQ ID NO: 422976 - DNA, 20 bp, mouse
gggagctccgggctggactg

SEQ ID NO: 422977 - DNA, 20 bp, mouse
ggcaggtgcggggctacgcg

SEQ ID NO: 422978 - DNA, 20 bp, mouse
ggctgcaccgagctggtgtc

SEQ ID NO: 422979 - DNA, 20 bp, mouse
gcgcatggccgcggagctcc

SEQ ID NO: 422980 - DNA, 20 bp, mouse
ggccccgccggacaccagct

SEQ ID NO: 422981 - DNA, 20 bp, mouse
gaccgagctggtgtccggcg

SEQ ID NO: 422982 - DNA, 20 bp, mouse
gggtgcggggctacgcgtgg

SEQ ID NO: 422983 - DNA, 20 bp, mouse
ggaggtacaaggaaacccgg

SEQ ID NO: 422984 - DNA, 20 bp, mouse
gcgcaggctgccctctggtt

SEQ ID NO: 422985 - DNA, 20 bp, mouse
gtcggtgcagcgcagcaact

SEQ ID NO: 422986 - DNA, 20 bp, mouse
gaaactgctcacattgggag

SEQ ID NO: 422987 - DNA, 20 bp, mouse
gttcgggaaactgctcacat

SEQ ID NO: 422988 - DNA, 20 bp, mouse
gcgggagggagaagtttgca

SEQ ID NO: 422989 - DNA, 20 bp, mouse
gtccctgtaggcggcgcggg

SEQ ID NO: 422990 - DNA, 20 bp, mouse
gtcccgtccaccacctctct

SEQ ID NO: 422991 - DNA, 20 bp, mouse
ggtgagcctagcttccctgt

SEQ ID NO: 422992 - DNA, 20 bp, mouse
gaagtttgcagggccgtgct

SEQ ID NO: 422993 - DNA, 20 bp, mouse
gagaaggtttcccagagagg

SEQ ID NO: 422994 - DNA, 20 bp, mouse
gcggagaaggtttcccagag

SEQ ID NO: 422995 - DNA, 20 bp, mouse
gcgtccctccaatcactctg

SEQ ID NO: 422996 - DNA, 20 bp, mouse
gcagccgagctcaagaccgt

SEQ ID NO: 422997 - DNA, 20 bp, mouse
gggctcgcaggggcttaccg

SEQ ID NO: 422998 - DNA, 20 bp, mouse
ggcctgagccagctgaacac

SEQ ID NO: 422999 - DNA, 20 bp, mouse
gaaagcaaaagggctcgcag

SEQ ID NO: 423000 - DNA, 20 bp, mouse
gtggcagccgtggggcacgt

SEQ ID NO: 423001 - DNA, 20 bp, mouse
ggtgcttctgaggaggaaca

SEQ ID NO: 423002 - DNA, 20 bp, mouse
ggctgaacacaggataatca

SEQ ID NO: 423003 - DNA, 20 bp, mouse
gtcgcaggggcttaccgagg

SEQ ID NO: 423004 - DNA, 20 bp, mouse
gctgccaacggtcttgagct

SEQ ID NO: 423005 - DNA, 20 bp, mouse
gcctctgctcttcatacttg

SEQ ID NO: 423006 - DNA, 20 bp, mouse
gcctgcccccggcctagcgg

SEQ ID NO: 423007 - DNA, 20 bp, mouse
gctaggccgggggcaggcaa

SEQ ID NO: 423008 - DNA, 20 bp, mouse
gtccgccgccgctaggccgg

SEQ ID NO: 423009 - DNA, 20 bp, mouse
ggcccccggcctagcggcgg

SEQ ID NO: 423010 - DNA, 20 bp, mouse
gcgcccgggcatgatagcaa

SEQ ID NO: 423011 - DNA, 20 bp, mouse
gctgcctggaatgggaggag

SEQ ID NO: 423012 - DNA, 20 bp, mouse
gtgggttctgaggcgactag

SEQ ID NO: 423013 - DNA, 20 bp, mouse
ggggatggaccacaagtaag

SEQ ID NO: 423014 - DNA, 20 bp, mouse
gggcggagcgtctgggatgt

SEQ ID NO: 423015 - DNA, 20 bp, mouse
ggttctgaggcgactagggg

SEQ ID NO: 423016 - DNA, 20 bp, mouse
gaggggcccatgacctgtgg

SEQ ID NO: 423017 - DNA, 20 bp, mouse
ggtcaggggcccatgacctg

SEQ ID NO: 423018 - DNA, 20 bp, mouse
ggagctggttaacatgtcag

SEQ ID NO: 423019 - DNA, 20 bp, mouse
ggatgtgacaagcacagaac

SEQ ID NO: 423020 - DNA, 20 bp, mouse
gatgagccctgcatctacag

SEQ ID NO: 423021 - DNA, 20 bp, mouse
gttcctcctccacaggtcat

SEQ ID NO: 423022 - DNA, 20 bp, mouse
gaagctccccagtaaggcac

SEQ ID NO: 423023 - DNA, 20 bp, mouse
gcttgggaagctccccagta

SEQ ID NO: 423024 - DNA, 20 bp, mouse
ggaggatctctgtccatcag

SEQ ID NO: 423025 - DNA, 20 bp, mouse
ggtggatatgtgcagcacag

SEQ ID NO: 423026 - DNA, 20 bp, mouse
gcagtcccacactgtagtag

SEQ ID NO: 423027 - DNA, 20 bp, mouse
gggtgcctctactacagtgt

SEQ ID NO: 423028 - DNA, 20 bp, mouse
ggctgagtcaggtacagtca

SEQ ID NO: 423029 - DNA, 20 bp, mouse
gcttttgacaagatggagag

SEQ ID NO: 423030 - DNA, 20 bp, mouse
gcgatgtagggataataccc

SEQ ID NO: 423031 - DNA, 20 bp, mouse
gggacttagagatggcgtac

SEQ ID NO: 423032 - DNA, 20 bp, mouse
gtgtcaaaaggacttagaga

SEQ ID NO: 423033 - DNA, 20 bp, mouse
gagtagctctcctgatctgg

SEQ ID NO: 423034 - DNA, 20 bp, mouse
ggacgctgaatgtctcgctg

SEQ ID NO: 423035 - DNA, 20 bp, mouse
ggggaggggtgttccgtgtg

SEQ ID NO: 423036 - DNA, 20 bp, mouse
gcatcttgcttctactgagt

SEQ ID NO: 423037 - DNA, 20 bp, mouse
gccaaaggccccaagacggg

SEQ ID NO: 423038 - DNA, 20 bp, mouse
gcacaggccccagaacccta

SEQ ID NO: 423039 - DNA, 20 bp, mouse
gttagccagtcccaaacaga

SEQ ID NO: 423040 - DNA, 20 bp, mouse
gatcccaaaggccccaagac

SEQ ID NO: 423041 - DNA, 20 bp, mouse
gtactcactgccttctgttt

SEQ ID NO: 423042 - DNA, 20 bp, mouse
gccccggggcggggtccagg

SEQ ID NO: 423043 - DNA, 20 bp, mouse
gggtgcggactgaatcccaa

SEQ ID NO: 423044 - DNA, 20 bp, mouse
gtggcagttggccctctaca

SEQ ID NO: 423045 - DNA, 20 bp, mouse
gggccaactgccattccccg

SEQ ID NO: 423046 - DNA, 20 bp, mouse
gaagtgaagtgagaatgtcc

SEQ ID NO: 423047 - DNA, 20 bp, mouse
gaagcagctatcattagaca

SEQ ID NO: 423048 - DNA, 20 bp, mouse
gctatcattagacaaggtcc

SEQ ID NO: 423049 - DNA, 20 bp, mouse
ggatgcatttgattaagcta

SEQ ID NO: 423050 - DNA, 20 bp, mouse
ggagtaaccacacattataa

SEQ ID NO: 423051 - DNA, 20 bp, mouse
ggcttcatgtcacatctgca

SEQ ID NO: 423052 - DNA, 20 bp, mouse
gcattcaagaattaacacta

SEQ ID NO: 423053 - DNA, 20 bp, mouse
gcaaataaatagagtagaat

SEQ ID NO: 423054 - DNA, 20 bp, mouse
gctactctatttatttgact

SEQ ID NO: 423055 - DNA, 20 bp, mouse
gagctatggaaagaaaacaa

SEQ ID NO: 423056 - DNA, 20 bp, mouse
ggcttaagcacaggtcccag

SEQ ID NO: 423057 - DNA, 20 bp, mouse
ggctgtgaagtagacaaagg

SEQ ID NO: 423058 - DNA, 20 bp, mouse
ggccaaccatctgacaaaag

SEQ ID NO: 423059 - DNA, 20 bp, mouse
ggccccttttgtcagatggt

SEQ ID NO: 423060 - DNA, 20 bp, mouse
gctggaatggaggactctag

SEQ ID NO: 423061 - DNA, 20 bp, mouse
gttagctgtgaagtagacaa

SEQ ID NO: 423062 - DNA, 20 bp, mouse
gatagatcaagtccccaggt

SEQ ID NO: 423063 - DNA, 20 bp, mouse
gattccgccctctaccccct

SEQ ID NO: 423064 - DNA, 20 bp, mouse
gaaacttctgtttactgata

SEQ ID NO: 423065 - DNA, 20 bp, mouse
ggctacttacctgaactgag

SEQ ID NO: 423066 - DNA, 20 bp, mouse
gcaatgcagcactgaggcca

SEQ ID NO: 423067 - DNA, 20 bp, mouse
gtgcctggcgagcgcttcgg

SEQ ID NO: 423068 - DNA, 20 bp, mouse
gagcggctcgagctgggaag

SEQ ID NO: 423069 - DNA, 20 bp, mouse
ggccacggaggctgcggtag

SEQ ID NO: 423070 - DNA, 20 bp, mouse
gcccctggcgcgctgcggtc

SEQ ID NO: 423071 - DNA, 20 bp, mouse
gctggcgagcgcttcggtgg

SEQ ID NO: 423072 - DNA, 20 bp, mouse
ggcgagcgcttcggtggcgg

SEQ ID NO: 423073 - DNA, 20 bp, mouse
gtgcggtagcggctcgagct

SEQ ID NO: 423074 - DNA, 20 bp, mouse
ggagctgggaaggggcggtt

SEQ ID NO: 423075 - DNA, 20 bp, mouse
ggccgccaccatgcaggcag

SEQ ID NO: 423076 - DNA, 20 bp, mouse
gaggcgcgcgcaggagcgag

SEQ ID NO: 423077 - DNA, 20 bp, mouse
ggccgcaccagtgactgcgg

SEQ ID NO: 423078 - DNA, 20 bp, mouse
ggccgggcctaaggatgctg

SEQ ID NO: 423079 - DNA, 20 bp, mouse
ggcgcctcctcagcatcctt

SEQ ID NO: 423080 - DNA, 20 bp, mouse
gtcctcagcatccttaggcc

SEQ ID NO: 423081 - DNA, 20 bp, mouse
ggccgcgcccgccactggga

SEQ ID NO: 423082 - DNA, 20 bp, mouse
gacccccgcagtcactggtg

SEQ ID NO: 423083 - DNA, 20 bp, mouse
gggctgcaccctcccagtgg

SEQ ID NO: 423084 - DNA, 20 bp, mouse
ggcggccgcaccagtgactg

SEQ ID NO: 423085 - DNA, 20 bp, mouse
gaacttggagcctcctccag

SEQ ID NO: 423086 - DNA, 20 bp, mouse
gagaagtagtgataatatct

SEQ ID NO: 423087 - DNA, 20 bp, mouse
gtcctggtaagtcactcaag

SEQ ID NO: 423088 - DNA, 20 bp, mouse
gacctcttgagtgacttacc

SEQ ID NO: 423089 - DNA, 20 bp, mouse
gatattatcactacttctcc

SEQ ID NO: 423090 - DNA, 20 bp, mouse
ggataagagttctactaata

SEQ ID NO: 423091 - DNA, 20 bp, mouse
ggaatctttgctttaaaaag

SEQ ID NO: 423092 - DNA, 20 bp, mouse
gtaattcctctgtctttatt

SEQ ID NO: 423093 - DNA, 20 bp, mouse
gttaacttaaatgatagtga

SEQ ID NO: 423094 - DNA, 20 bp, mouse
gtcctctgtctttatttggt

SEQ ID NO: 423095 - DNA, 20 bp, mouse
gttaaatgatagtgagggtt

SEQ ID NO: 423096 - DNA, 20 bp, mouse
gctatcaatagacaaggtta

SEQ ID NO: 423097 - DNA, 20 bp, mouse
gaagcaactatcaatagaca

SEQ ID NO: 423098 - DNA, 20 bp, mouse
gcattcaagaattaacacta

SEQ ID NO: 423099 - DNA, 20 bp, mouse
gtcttgaatgacttactagc

SEQ ID NO: 423100 - DNA, 20 bp, mouse
gagctatggaaagaaaacaa

SEQ ID NO: 423101 - DNA, 20 bp, mouse
gcaaataaatagagtagaat

SEQ ID NO: 423102 - DNA, 20 bp, mouse
gctactctatttatttgact

SEQ ID NO: 423103 - DNA, 20 bp, mouse
gaaatactaaataagaatca

SEQ ID NO: 423104 - DNA, 20 bp, mouse
gaaatgtcaggtagaatgga

SEQ ID NO: 423105 - DNA, 20 bp, mouse
gtctaaaactttataatgtg

SEQ ID NO: 423106 - DNA, 20 bp, mouse
gataaatttgatgaggttgt

SEQ ID NO: 423107 - DNA, 20 bp, mouse
ggagagccaaaataaaatct

SEQ ID NO: 423108 - DNA, 20 bp, mouse
ggctagatataaatttgatg

SEQ ID NO: 423109 - DNA, 20 bp, mouse
gtacagcctagattttattt

SEQ ID NO: 423110 - DNA, 20 bp, mouse
gtatttttcctctcaagttg

SEQ ID NO: 423111 - DNA, 20 bp, mouse
ggttcaaaaggcttaccctc

SEQ ID NO: 423112 - DNA, 20 bp, mouse
gctaagatctctaataattt

SEQ ID NO: 423113 - DNA, 20 bp, mouse
gctccatgagagacaagtga

SEQ ID NO: 423114 - DNA, 20 bp, mouse
gcatcctatctcaggaacaa

SEQ ID NO: 423115 - DNA, 20 bp, mouse
ggtccttcacttgtctctca

SEQ ID NO: 423116 - DNA, 20 bp, mouse
gtacagcctagatttgactt

SEQ ID NO: 423117 - DNA, 20 bp, mouse
gattaatatgatgaagttat

SEQ ID NO: 423118 - DNA, 20 bp, mouse
ggttataggagaaaacggta

SEQ ID NO: 423119 - DNA, 20 bp, mouse
ggagagccaaagtcaaatct

SEQ ID NO: 423120 - DNA, 20 bp, mouse
gatgaagttataggagaaaa

SEQ ID NO: 423121 - DNA, 20 bp, mouse
gctaagatctctaattattt

SEQ ID NO: 423122 - DNA, 20 bp, mouse
ggttcaaaaggcttaccatc

SEQ ID NO: 423123 - DNA, 20 bp, mouse
gctccatgagagacaagtga

SEQ ID NO: 423124 - DNA, 20 bp, mouse
gcatcctatctcaggaacaa

SEQ ID NO: 423125 - DNA, 20 bp, mouse
ggtccttcacttgtctctca

SEQ ID NO: 423126 - DNA, 20 bp, mouse
gggagcagaagcaacctcac

SEQ ID NO: 423127 - DNA, 20 bp, mouse
gtgctccaacctcctcttaa

SEQ ID NO: 423128 - DNA, 20 bp, mouse
ggtctcccttaagaggaggt

SEQ ID NO: 423129 - DNA, 20 bp, mouse
gatgcagcaatggagtcttc

SEQ ID NO: 423130 - DNA, 20 bp, mouse
gtgctgcattctgcgatccc

SEQ ID NO: 423131 - DNA, 20 bp, mouse
gtctttctgtctcccttaag

SEQ ID NO: 423132 - DNA, 20 bp, mouse
ggttaacacttacctggaac

SEQ ID NO: 423133 - DNA, 20 bp, mouse
gggaactgtgatggatgtga

SEQ ID NO: 423134 - DNA, 20 bp, mouse
gtagaaaagctagttaaagg

SEQ ID NO: 423135 - DNA, 20 bp, mouse
gcgaaggtgttgcacaactg

SEQ ID NO: 423136 - DNA, 20 bp, mouse
ggctgtcctgggcttcttgg

SEQ ID NO: 423137 - DNA, 20 bp, mouse
gttgtctttcttatgatgta

SEQ ID NO: 423138 - DNA, 20 bp, mouse
gaaacctggatacaagcaca

SEQ ID NO: 423139 - DNA, 20 bp, mouse
gtacttttatcatggaccaa

SEQ ID NO: 423140 - DNA, 20 bp, mouse
gtggttttgcaatattactt

SEQ ID NO: 423141 - DNA, 20 bp, mouse
gcatcacatttattaagcac

SEQ ID NO: 423142 - DNA, 20 bp, mouse
gttttatggataagtcatag

SEQ ID NO: 423143 - DNA, 20 bp, mouse
gatggttgttttgttacctt

SEQ ID NO: 423144 - DNA, 20 bp, mouse
gggagtcctccaagaagccc

SEQ ID NO: 423145 - DNA, 20 bp, mouse
ggtgtaaaagaagctgtcct

SEQ ID NO: 423146 - DNA, 20 bp, mouse
gcacttggcctaggtatgag

SEQ ID NO: 423147 - DNA, 20 bp, mouse
ggcctaggtatgagaggact

SEQ ID NO: 423148 - DNA, 20 bp, mouse
ggcatcaactgacaccaccg

SEQ ID NO: 423149 - DNA, 20 bp, mouse
ggtggtgtcagttgatgcaa

SEQ ID NO: 423150 - DNA, 20 bp, mouse
gtcctagtcctctcatacct

SEQ ID NO: 423151 - DNA, 20 bp, mouse
gtatgagaggactaggaata

SEQ ID NO: 423152 - DNA, 20 bp, mouse
gtgcagcgatcacttggcct

SEQ ID NO: 423153 - DNA, 20 bp, mouse
gactaggaataagggcagca

SEQ ID NO: 423154 - DNA, 20 bp, mouse
gaagtgatcgctgcaggcaa

SEQ ID NO: 423155 - DNA, 20 bp, mouse
gtcccactagcagggagaga

SEQ ID NO: 423156 - DNA, 20 bp, mouse
gtgggaaaacgggactctca

SEQ ID NO: 423157 - DNA, 20 bp, mouse
gtcccaggaaagcctgccag

SEQ ID NO: 423158 - DNA, 20 bp, mouse
ggggactctcagggcctaga

SEQ ID NO: 423159 - DNA, 20 bp, mouse
gaactggatgcgttaggtaa

SEQ ID NO: 423160 - DNA, 20 bp, mouse
gctctcagggcctagatggc

SEQ ID NO: 423161 - DNA, 20 bp, mouse
gcccaggcgcactgctcctc

SEQ ID NO: 423162 - DNA, 20 bp, mouse
gctagatggcgggtttcccc

SEQ ID NO: 423163 - DNA, 20 bp, mouse
gctataagcgcaggagcccc

SEQ ID NO: 423164 - DNA, 20 bp, mouse
gcagatcatgaggtcagtgt

SEQ ID NO: 423165 - DNA, 20 bp, mouse
ggaaacagccagcggtgctg

SEQ ID NO: 423166 - DNA, 20 bp, mouse
gtgcagcatggcgcccagca

SEQ ID NO: 423167 - DNA, 20 bp, mouse
gcgccttgcggagcgctcac

SEQ ID NO: 423168 - DNA, 20 bp, mouse
gctgctgctgctggccgagc

SEQ ID NO: 423169 - DNA, 20 bp, mouse
gactccaggagacgccatgc

SEQ ID NO: 423170 - DNA, 20 bp, mouse
ggcgggttctctgagattgg

SEQ ID NO: 423171 - DNA, 20 bp, mouse
gccgggtcctgatgccagca

SEQ ID NO: 423172 - DNA, 20 bp, mouse
gcgcccagcatggcgtctcc

SEQ ID NO: 423173 - DNA, 20 bp, mouse
gctagaggcaagcgttggac

SEQ ID NO: 423174 - DNA, 20 bp, mouse
ggccccacagccccgcgcaa

SEQ ID NO: 423175 - DNA, 20 bp, mouse
gacccggtgagcgctccgca

SEQ ID NO: 423176 - DNA, 20 bp, mouse
ggaggtgcgggagacccggg

SEQ ID NO: 423177 - DNA, 20 bp, mouse
gcgctccgcagcggacacga

SEQ ID NO: 423178 - DNA, 20 bp, mouse
ggcggcagcaatagcagcac

SEQ ID NO: 423179 - DNA, 20 bp, mouse
gagcagcaccggagaccccc

SEQ ID NO: 423180 - DNA, 20 bp, mouse
ggaaaggcactcccagccat

SEQ ID NO: 423181 - DNA, 20 bp, mouse
gcagccatgggctcgaggtg

SEQ ID NO: 423182 - DNA, 20 bp, mouse
gctcgaggtgcgggagaccc

SEQ ID NO: 423183 - DNA, 20 bp, mouse
gcagcacagcaagagtgaga

SEQ ID NO: 423184 - DNA, 20 bp, mouse
ggtcctggccaggtagccga

SEQ ID NO: 423185 - DNA, 20 bp, mouse
gacctggccaggacaggatg

SEQ ID NO: 423186 - DNA, 20 bp, mouse
ggcacgcagggagcaattgt

SEQ ID NO: 423187 - DNA, 20 bp, mouse
gcaagaagccgtttccgcag

SEQ ID NO: 423188 - DNA, 20 bp, mouse
gtggtgctgcccagccgctg

SEQ ID NO: 423189 - DNA, 20 bp, mouse
gtgcccagccgctgcggaaa

SEQ ID NO: 423190 - DNA, 20 bp, mouse
gctcgcacagcaatcaccgt

SEQ ID NO: 423191 - DNA, 20 bp, mouse
gccttgcctctccaacacct

SEQ ID NO: 423192 - DNA, 20 bp, mouse
ggagagaacagaacacgtga

SEQ ID NO: 423193 - DNA, 20 bp, mouse
gagcaagctagacctgggaa

SEQ ID NO: 423194 - DNA, 20 bp, mouse
gtgggaaaggctgggagcat

SEQ ID NO: 423195 - DNA, 20 bp, mouse
gggcacttctgaagtcagaa

SEQ ID NO: 423196 - DNA, 20 bp, mouse
gtgcctagcaagaggaaatc

SEQ ID NO: 423197 - DNA, 20 bp, mouse
gctggtaaaggtaaaaatcc

SEQ ID NO: 423198 - DNA, 20 bp, mouse
gtaaaggtaaaaatcctggt

SEQ ID NO: 423199 - DNA, 20 bp, mouse
gtaggcaatgtcccagaaga

SEQ ID NO: 423200 - DNA, 20 bp, mouse
gtagacagtggaccatcttc

SEQ ID NO: 423201 - DNA, 20 bp, mouse
gactgttgactacctggctt

SEQ ID NO: 423202 - DNA, 20 bp, mouse
ggttgactacctggcttagg

SEQ ID NO: 423203 - DNA, 20 bp, mouse
gaggaataataagccccacc

SEQ ID NO: 423204 - DNA, 20 bp, mouse
gtaccagatttcctcttgct

SEQ ID NO: 423205 - DNA, 20 bp, mouse
gtgggtgtatctggaatcac

SEQ ID NO: 423206 - DNA, 20 bp, mouse
gctatcaatagaaaaggtca

SEQ ID NO: 423207 - DNA, 20 bp, mouse
ggagtaaccacacattataa

SEQ ID NO: 423208 - DNA, 20 bp, mouse
gaagcaactatcaatagaaa

SEQ ID NO: 423209 - DNA, 20 bp, mouse
gttaaggtgtttgtaatgca

SEQ ID NO: 423210 - DNA, 20 bp, mouse
gaaagctatatgatctggat

SEQ ID NO: 423211 - DNA, 20 bp, mouse
gcattcaagaattaacacta

SEQ ID NO: 423212 - DNA, 20 bp, mouse
ggcttcatgtcacatctgca

SEQ ID NO: 423213 - DNA, 20 bp, mouse
gtcttgaatgacttactagc

SEQ ID NO: 423214 - DNA, 20 bp, mouse
gagctatggaaagaaaacaa

SEQ ID NO: 423215 - DNA, 20 bp, mouse
gcaaataaatagagtagaat

SEQ ID NO: 423216 - DNA, 20 bp, mouse
gtactagatacctgtactgg

SEQ ID NO: 423217 - DNA, 20 bp, mouse
gctatactagatacctgtac

SEQ ID NO: 423218 - DNA, 20 bp, mouse
gacaggtatctagtatagct

SEQ ID NO: 423219 - DNA, 20 bp, mouse
ggggcaaaagtgatatgtct

SEQ ID NO: 423220 - DNA, 20 bp, mouse
gcctttcagacctccagtac

SEQ ID NO: 423221 - DNA, 20 bp, mouse
gacttctacagcttcctgga

SEQ ID NO: 423222 - DNA, 20 bp, mouse
gaaatgggtaatccttctgt

SEQ ID NO: 423223 - DNA, 20 bp, mouse
gcagagcatgaggagagcag

SEQ ID NO: 423224 - DNA, 20 bp, mouse
gctggggatgacaatttcag

SEQ ID NO: 423225 - DNA, 20 bp, mouse
gagagaagcgccatttgggt

SEQ ID NO: 423226 - DNA, 20 bp, mouse
gtgctgcggagcaacaggct

SEQ ID NO: 423227 - DNA, 20 bp, mouse
gcgggcgttgtgtccagtaa

SEQ ID NO: 423228 - DNA, 20 bp, mouse
gtgcaaagcattcccggagt

SEQ ID NO: 423229 - DNA, 20 bp, mouse
gagtcgagaaagactctaga

SEQ ID NO: 423230 - DNA, 20 bp, mouse
ggctctttttgcatcttaaa

SEQ ID NO: 423231 - DNA, 20 bp, mouse
gagctttgctgcggagcaac

SEQ ID NO: 423232 - DNA, 20 bp, mouse
gcatacatggtaacagaatt

SEQ ID NO: 423233 - DNA, 20 bp, mouse
gttgatctctgtactcactc

SEQ ID NO: 423234 - DNA, 20 bp, mouse
ggaatgctttgcagccaaaa

SEQ ID NO: 423235 - DNA, 20 bp, mouse
ggtattgaggatctgaggga

SEQ ID NO: 423236 - DNA, 20 bp, mouse
gcgtatagcttgcgttttcg

SEQ ID NO: 423237 - DNA, 20 bp, mouse
ggaggggatcctgcaatcca

SEQ ID NO: 423238 - DNA, 20 bp, mouse
gctgtcaggggtcataaagt

SEQ ID NO: 423239 - DNA, 20 bp, mouse
gttctcaaggccatcccact

SEQ ID NO: 423240 - DNA, 20 bp, mouse
ggatgtaacgccaagtggga

SEQ ID NO: 423241 - DNA, 20 bp, mouse
gcacagtgaccatggattgc

SEQ ID NO: 423242 - DNA, 20 bp, mouse
gaggtcagagataacatcct

SEQ ID NO: 423243 - DNA, 20 bp, mouse
gtcagagataacatcctggg

SEQ ID NO: 423244 - DNA, 20 bp, mouse
ggagggagttagctccaccc

SEQ ID NO: 423245 - DNA, 20 bp, mouse
gggaggaccctggggaccac

SEQ ID NO: 423246 - DNA, 20 bp, mouse
gcatatagcttgcattttcg

SEQ ID NO: 423247 - DNA, 20 bp, mouse
ggaggggatcccacaatcca

SEQ ID NO: 423248 - DNA, 20 bp, mouse
gttctcaaggccatcctact

SEQ ID NO: 423249 - DNA, 20 bp, mouse
ggatgtaacgccaagtagga

SEQ ID NO: 423250 - DNA, 20 bp, mouse
gaggtcagagataacatcct

SEQ ID NO: 423251 - DNA, 20 bp, mouse
gtcagagataacatcctggg

SEQ ID NO: 423252 - DNA, 20 bp, mouse
gggaggaccctggggaccac

SEQ ID NO: 423253 - DNA, 20 bp, mouse
ggagggatttagctccaccc

SEQ ID NO: 423254 - DNA, 20 bp, mouse
gacctggggcatgaggctag

SEQ ID NO: 423255 - DNA, 20 bp, mouse
gatctctgacctggggcatg

SEQ ID NO: 423256 - DNA, 20 bp, mouse
gaggctgggcatccttgcag

SEQ ID NO: 423257 - DNA, 20 bp, mouse
ggaagcaagaacggggagta

SEQ ID NO: 423258 - DNA, 20 bp, mouse
gcccagcctagtaggtagac

SEQ ID NO: 423259 - DNA, 20 bp, mouse
gttgcaggggaagcaagaac

SEQ ID NO: 423260 - DNA, 20 bp, mouse
gacattctgaagggttatct

SEQ ID NO: 423261 - DNA, 20 bp, mouse
gctgtggttaacattctgaa

SEQ ID NO: 423262 - DNA, 20 bp, mouse
gctctgaggatagcaatgtc

SEQ ID NO: 423263 - DNA, 20 bp, mouse
ggcaatgtcaggcttggatt

SEQ ID NO: 423264 - DNA, 20 bp, mouse
ggtcatccaaaatattcctg

SEQ ID NO: 423265 - DNA, 20 bp, mouse
gcaaattggtgattactctg

SEQ ID NO: 423266 - DNA, 20 bp, mouse
gtggagcacactaaccctag

SEQ ID NO: 423267 - DNA, 20 bp, mouse
gggccaagcatgatgggatc

SEQ ID NO: 423268 - DNA, 20 bp, mouse
ggaccagaccaactccaggg

SEQ ID NO: 423269 - DNA, 20 bp, mouse
gagggaccagaccaactcca

SEQ ID NO: 423270 - DNA, 20 bp, mouse
gacaccaccaagcaatgaat

SEQ ID NO: 423271 - DNA, 20 bp, mouse
gttgctgctgtaggagtccc

SEQ ID NO: 423272 - DNA, 20 bp, mouse
ggaccaactccagggaggca

SEQ ID NO: 423273 - DNA, 20 bp, mouse
gtcagcgtcttatggacacc

SEQ ID NO: 423274 - DNA, 20 bp, mouse
ggcatcccccaggatcccaa

SEQ ID NO: 423275 - DNA, 20 bp, mouse
gctccagatcccatcatgct

SEQ ID NO: 423276 - DNA, 20 bp, mouse
ggcgcgcggccccatagcga

SEQ ID NO: 423277 - DNA, 20 bp, mouse
ggttgcaaggatgaccgaag

SEQ ID NO: 423278 - DNA, 20 bp, mouse
gcttagtcgcagagaggcaa

SEQ ID NO: 423279 - DNA, 20 bp, mouse
gcggtgcgctcgctactccc

SEQ ID NO: 423280 - DNA, 20 bp, mouse
gtccgggtcagcgctgacag

SEQ ID NO: 423281 - DNA, 20 bp, mouse
ggcaaggatgaccgaagggg

SEQ ID NO: 423282 - DNA, 20 bp, mouse
ggcggcggccgcgcgttgag

SEQ ID NO: 423283 - DNA, 20 bp, mouse
gagccaccttagtcgcagag

SEQ ID NO: 423284 - DNA, 20 bp, mouse
gaggtccacagggatcccga

SEQ ID NO: 423285 - DNA, 20 bp, mouse
gttgctgggcccagtcctcg

SEQ ID NO: 423286 - DNA, 20 bp, mouse
gtgggtagccgagaagtccc

SEQ ID NO: 423287 - DNA, 20 bp, mouse
gacagctatggtctctccag

SEQ ID NO: 423288 - DNA, 20 bp, mouse
gagcaggacccaagacatgc

SEQ ID NO: 423289 - DNA, 20 bp, mouse
gaactagaaggagataaaac

SEQ ID NO: 423290 - DNA, 20 bp, mouse
gaggagataaaactggccac

SEQ ID NO: 423291 - DNA, 20 bp, mouse
gtcaaatccaaggtaagaat

SEQ ID NO: 423292 - DNA, 20 bp, mouse
gacagaagccagcatgtctt

SEQ ID NO: 423293 - DNA, 20 bp, mouse
gccatagctgtatgctgcct

SEQ ID NO: 423294 - DNA, 20 bp, mouse
gggtcctgctttcagtcctg

SEQ ID NO: 423295 - DNA, 20 bp, mouse
gtttttcattcacaatgtaa

SEQ ID NO: 423296 - DNA, 20 bp, mouse
ggccagagcgcacagcccgg

SEQ ID NO: 423297 - DNA, 20 bp, mouse
gcgagctaggtgctatcgca

SEQ ID NO: 423298 - DNA, 20 bp, mouse
gaggatctgctctctccgcc

SEQ ID NO: 423299 - DNA, 20 bp, mouse
gggcggaggacgaagagtcc

SEQ ID NO: 423300 - DNA, 20 bp, mouse
ggccacagctcgtcactctg

SEQ ID NO: 423301 - DNA, 20 bp, mouse
gctatgtggctataaagggg

SEQ ID NO: 423302 - DNA, 20 bp, mouse
gctcctatgtggctataaag

SEQ ID NO: 423303 - DNA, 20 bp, mouse
ggcgcctcggggcctgaagg

SEQ ID NO: 423304 - DNA, 20 bp, mouse
gcagcgggcagcgagatctc

SEQ ID NO: 423305 - DNA, 20 bp, mouse
gtggggaacaagtccagaat

SEQ ID NO: 423306 - DNA, 20 bp, mouse
gaccgcccggcgcacaggaa

SEQ ID NO: 423307 - DNA, 20 bp, mouse
gcccggcgcacaggaaggga

SEQ ID NO: 423308 - DNA, 20 bp, mouse
gtgcgtctacagcggaccga

SEQ ID NO: 423309 - DNA, 20 bp, mouse
gcatctgggagcgactgtgt

SEQ ID NO: 423310 - DNA, 20 bp, mouse
gcgcaggtactggcgatctg

SEQ ID NO: 423311 - DNA, 20 bp, mouse
gtgagtctgtgcgtctacag

SEQ ID NO: 423312 - DNA, 20 bp, mouse
ggctccaggcacgcaggtac

SEQ ID NO: 423313 - DNA, 20 bp, mouse
ggtgactgcgccgcccaact

SEQ ID NO: 423314 - DNA, 20 bp, mouse
gggagggagcaagcgcccgg

SEQ ID NO: 423315 - DNA, 20 bp, mouse
gatctggggacccagttggg

SEQ ID NO: 423316 - DNA, 20 bp, mouse
ggctgaccaggaggctctag

SEQ ID NO: 423317 - DNA, 20 bp, mouse
gaaaagctctctggtcccat

SEQ ID NO: 423318 - DNA, 20 bp, mouse
gagcggcccgcaagctgacc

SEQ ID NO: 423319 - DNA, 20 bp, mouse
gtctctccctgtcctgaaag

SEQ ID NO: 423320 - DNA, 20 bp, mouse
gggagagaataaaagctctc

SEQ ID NO: 423321 - DNA, 20 bp, mouse
gctcccccgagcacatggca

SEQ ID NO: 423322 - DNA, 20 bp, mouse
ggagaacatggtccaagcat

SEQ ID NO: 423323 - DNA, 20 bp, mouse
gtaacagtggagtaggacag

SEQ ID NO: 423324 - DNA, 20 bp, mouse
gcatggtccaagcatgggaa

SEQ ID NO: 423325 - DNA, 20 bp, mouse
gaaccatgccatgtgctcgg

SEQ ID NO: 423326 - DNA, 20 bp, mouse
gaggctggcacgtcaaccac

SEQ ID NO: 423327 - DNA, 20 bp, mouse
gaccagaatcccagtcacta

SEQ ID NO: 423328 - DNA, 20 bp, mouse
ggacaggagccctagtgact

SEQ ID NO: 423329 - DNA, 20 bp, mouse
ggctggctcatctttagaaa

SEQ ID NO: 423330 - DNA, 20 bp, mouse
gtgacactgacagcataaca

SEQ ID NO: 423331 - DNA, 20 bp, mouse
gaggcagttgatggccggac

SEQ ID NO: 423332 - DNA, 20 bp, mouse
ggtgtcagaggaatcctcac

SEQ ID NO: 423333 - DNA, 20 bp, mouse
gactgacagcataacaaggc

SEQ ID NO: 423334 - DNA, 20 bp, mouse
gggatgccaaagctcttggg

SEQ ID NO: 423335 - DNA, 20 bp, mouse
gagcatgaggggcagtgcct

SEQ ID NO: 423336 - DNA, 20 bp, mouse
gccggctcgccgagtccctg

SEQ ID NO: 423337 - DNA, 20 bp, mouse
gccgctggagccaacagtga

SEQ ID NO: 423338 - DNA, 20 bp, mouse
gagcacggcgccctcactgt

SEQ ID NO: 423339 - DNA, 20 bp, mouse
gcggctcgggacagcgcggg

SEQ ID NO: 423340 - DNA, 20 bp, mouse
gcacagagcgcgcagtacca

SEQ ID NO: 423341 - DNA, 20 bp, mouse
gctgcggctcgggacagcgc

SEQ ID NO: 423342 - DNA, 20 bp, mouse
gcgttcccggccccccagca

SEQ ID NO: 423343 - DNA, 20 bp, mouse
ggtcccgagccgcagggact

SEQ ID NO: 423344 - DNA, 20 bp, mouse
gactcggcgagccgggctag

SEQ ID NO: 423345 - DNA, 20 bp, mouse
gccgggaacgggccagcagg

SEQ ID NO: 423346 - DNA, 20 bp, mouse
gcgctctgggagctttagta

SEQ ID NO: 423347 - DNA, 20 bp, mouse
ggtggagaagtgacgcgagg

SEQ ID NO: 423348 - DNA, 20 bp, mouse
ggccgtggagaagtgacgcg

SEQ ID NO: 423349 - DNA, 20 bp, mouse
ggagaagtgacgcgaggtgg

SEQ ID NO: 423350 - DNA, 20 bp, mouse
gggcagctccgagccagagt

SEQ ID NO: 423351 - DNA, 20 bp, mouse
gcgcgaaccgcagccgctag

SEQ ID NO: 423352 - DNA, 20 bp, mouse
gtgctcagggaggaacaggt

SEQ ID NO: 423353 - DNA, 20 bp, mouse
gcaccaacgcccgggacaat

SEQ ID NO: 423354 - DNA, 20 bp, mouse
gggagtctcgcggacttggt

SEQ ID NO: 423355 - DNA, 20 bp, mouse
gtgctctgggaggagtctcg

SEQ ID NO: 423356 - DNA, 20 bp, mouse
gtcggcaccgggaggtggag

SEQ ID NO: 423357 - DNA, 20 bp, mouse
gagcttcgttcggcaccggg

SEQ ID NO: 423358 - DNA, 20 bp, mouse
gttatcactgcagcttcgtt

SEQ ID NO: 423359 - DNA, 20 bp, mouse
gtcagtgagcaggtgagtcc

SEQ ID NO: 423360 - DNA, 20 bp, mouse
gagggtgcaaaggaccgacc

SEQ ID NO: 423361 - DNA, 20 bp, mouse
gcaaccaagggacagcaggg

SEQ ID NO: 423362 - DNA, 20 bp, mouse
gaagcacccgcagcaaccaa

SEQ ID NO: 423363 - DNA, 20 bp, mouse
gccggtgcccgagggctcac

SEQ ID NO: 423364 - DNA, 20 bp, mouse
gcagagcgcagcacaacctc

SEQ ID NO: 423365 - DNA, 20 bp, mouse
gagctggacccagagaatgg

SEQ ID NO: 423366 - DNA, 20 bp, mouse
gagagcagggactcgcgagg

SEQ ID NO: 423367 - DNA, 20 bp, mouse
gtgcagggctgcactccggt

SEQ ID NO: 423368 - DNA, 20 bp, mouse
gaggctgcagggctgcactc

SEQ ID NO: 423369 - DNA, 20 bp, mouse
ggatagagcagggactcgcg

SEQ ID NO: 423370 - DNA, 20 bp, mouse
ggcaaggacaggacgagagg

SEQ ID NO: 423371 - DNA, 20 bp, mouse
gagactgtagtgatagagca

SEQ ID NO: 423372 - DNA, 20 bp, mouse
ggcgccgggatgcttcggga

SEQ ID NO: 423373 - DNA, 20 bp, mouse
ggcgaggcggcgaagccaac

SEQ ID NO: 423374 - DNA, 20 bp, mouse
gctgacagcatcccctgagg

SEQ ID NO: 423375 - DNA, 20 bp, mouse
ggcggtccacctatgcaccc

SEQ ID NO: 423376 - DNA, 20 bp, mouse
gtgtggctatgaaactctgt

SEQ ID NO: 423377 - DNA, 20 bp, mouse
gagccacaggcgctgcagac

SEQ ID NO: 423378 - DNA, 20 bp, mouse
gcgcgggtctgggcgcttgt

SEQ ID NO: 423379 - DNA, 20 bp, mouse
gggtgcggacgcggtgactg

SEQ ID NO: 423380 - DNA, 20 bp, mouse
gcacggagcggaggagaggc

SEQ ID NO: 423381 - DNA, 20 bp, mouse
gcaatcacggagcggaggag

SEQ ID NO: 423382 - DNA, 20 bp, mouse
ggtatcagagtgattgtgtg

SEQ ID NO: 423383 - DNA, 20 bp, mouse
gcgtgctgccatgtgagcgg

SEQ ID NO: 423384 - DNA, 20 bp, mouse
ggcggcgcgcccctcggtgg

SEQ ID NO: 423385 - DNA, 20 bp, mouse
gccggagggcgcacaagcac

SEQ ID NO: 423386 - DNA, 20 bp, mouse
gggccgccgacgctccgggg

SEQ ID NO: 423387 - DNA, 20 bp, mouse
gcctggccgccgacgctccg

SEQ ID NO: 423388 - DNA, 20 bp, mouse
gcttggccagtgaggatcga

SEQ ID NO: 423389 - DNA, 20 bp, mouse
gagcagcctccccggagcgt

SEQ ID NO: 423390 - DNA, 20 bp, mouse
gcgtgcgctgtggatcgcgc

SEQ ID NO: 423391 - DNA, 20 bp, mouse
ggtgaggatcgagggcacac

SEQ ID NO: 423392 - DNA, 20 bp, mouse
ggcgctgtggatcgcgcggg

SEQ ID NO: 423393 - DNA, 20 bp, mouse
gagcctccccggagcgtcgg

SEQ ID NO: 423394 - DNA, 20 bp, mouse
gtgcgagtcaggcgcatctc

SEQ ID NO: 423395 - DNA, 20 bp, mouse
gcgcgcagtggagatgggcc

SEQ ID NO: 423396 - DNA, 20 bp, mouse
gctgcccagcccacatctgg

SEQ ID NO: 423397 - DNA, 20 bp, mouse
gtccagctgcccccagatgt

SEQ ID NO: 423398 - DNA, 20 bp, mouse
ggcgctgcccagcccacatc

SEQ ID NO: 423399 - DNA, 20 bp, mouse
gccctgcggtgctgcagctg

SEQ ID NO: 423400 - DNA, 20 bp, mouse
gaggcgaggcgcgcaggaga

SEQ ID NO: 423401 - DNA, 20 bp, mouse
gcgccaccgagcccccaggt

SEQ ID NO: 423402 - DNA, 20 bp, mouse
ggagggccgggaaaacccag

SEQ ID NO: 423403 - DNA, 20 bp, mouse
gcacctacctgggggctcgg

SEQ ID NO: 423404 - DNA, 20 bp, mouse
gccaggctggcacctacctg

SEQ ID NO: 423405 - DNA, 20 bp, mouse
ggctcccgccggcggatcca

SEQ ID NO: 423406 - DNA, 20 bp, mouse
ggcagcgcgcgatgaggcag

SEQ ID NO: 423407 - DNA, 20 bp, mouse
gaggcgggcagcgcgcgatg

SEQ ID NO: 423408 - DNA, 20 bp, mouse
gcccgcatggctgcacacag

SEQ ID NO: 423409 - DNA, 20 bp, mouse
gagtgagaaggagcgagatc

SEQ ID NO: 423410 - DNA, 20 bp, mouse
gagcacccgggactgcaccc

SEQ ID NO: 423411 - DNA, 20 bp, mouse
gcagcgagcgcttcccaggg

SEQ ID NO: 423412 - DNA, 20 bp, mouse
gaggggaggggatcccgact

SEQ ID NO: 423413 - DNA, 20 bp, mouse
gcatggctgcacacagggga

SEQ ID NO: 423414 - DNA, 20 bp, mouse
ggggcagcgagcgcttccca

SEQ ID NO: 423415 - DNA, 20 bp, mouse
gcgagccggggtgcagtccc

SEQ ID NO: 423416 - DNA, 20 bp, mouse
gcccagcgagcgggagaaag

SEQ ID NO: 423417 - DNA, 20 bp, mouse
gtcgggtcccgggagcgcag

SEQ ID NO: 423418 - DNA, 20 bp, mouse
ggtgtgcggcggaggatcca

SEQ ID NO: 423419 - DNA, 20 bp, mouse
gtctcccgctcgctgggctc

SEQ ID NO: 423420 - DNA, 20 bp, mouse
gccgacagtgagggagccag

SEQ ID NO: 423421 - DNA, 20 bp, mouse
gcagaggctgacccgagcgg

SEQ ID NO: 423422 - DNA, 20 bp, mouse
ggaagtggaaaggaccgaca

SEQ ID NO: 423423 - DNA, 20 bp, mouse
gcagctccggggtagagagt

SEQ ID NO: 423424 - DNA, 20 bp, mouse
gtccgccgcacacgcagtgg

SEQ ID NO: 423425 - DNA, 20 bp, mouse
gcggagacggctcgggtccc

SEQ ID NO: 423426 - DNA, 20 bp, mouse
gagaggctggggagaacccg

SEQ ID NO: 423427 - DNA, 20 bp, mouse
gtggagcagaaagaacccgt

SEQ ID NO: 423428 - DNA, 20 bp, mouse
gacctgggacagaaaggcaa

SEQ ID NO: 423429 - DNA, 20 bp, mouse
ggtatctgtgggtcttcccc

SEQ ID NO: 423430 - DNA, 20 bp, mouse
ggctcaggaaaagtgcccac

SEQ ID NO: 423431 - DNA, 20 bp, mouse
ggggcttgtgccaaaatctg

SEQ ID NO: 423432 - DNA, 20 bp, mouse
gtcccaggaggggcttgact

SEQ ID NO: 423433 - DNA, 20 bp, mouse
ggcccagtcaagcccctcct

SEQ ID NO: 423434 - DNA, 20 bp, mouse
gcatctgggacatggtaccc

SEQ ID NO: 423435 - DNA, 20 bp, mouse
gctcgtttctgtgtatctgt

SEQ ID NO: 423436 - DNA, 20 bp, mouse
ggcgctgtgaagatgcgagg

SEQ ID NO: 423437 - DNA, 20 bp, mouse
ggccgactggggatgatccc

SEQ ID NO: 423438 - DNA, 20 bp, mouse
ggcccgggatcatccccagt

SEQ ID NO: 423439 - DNA, 20 bp, mouse
gggaggacgcggcaacggaa

SEQ ID NO: 423440 - DNA, 20 bp, mouse
gcgcccgtagcagccgactg

SEQ ID NO: 423441 - DNA, 20 bp, mouse
gctgctacgggcgcggagag

SEQ ID NO: 423442 - DNA, 20 bp, mouse
gcggctccgctggaacccga

SEQ ID NO: 423443 - DNA, 20 bp, mouse
ggatcccgggcgggaggacg

SEQ ID NO: 423444 - DNA, 20 bp, mouse
gatccccagtcggctgctac

SEQ ID NO: 423445 - DNA, 20 bp, mouse
gacgcggcaacggaagggac

SEQ ID NO: 423446 - DNA, 20 bp, mouse
gagtctagcatggcccaagt

SEQ ID NO: 423447 - DNA, 20 bp, mouse
gactgctaccctgagagcac

SEQ ID NO: 423448 - DNA, 20 bp, mouse
ggatatgttaagctcttaat

SEQ ID NO: 423449 - DNA, 20 bp, mouse
ggacttgattatgatcatcg

SEQ ID NO: 423450 - DNA, 20 bp, mouse
gcgcgcgcgtgcgtgcttta

SEQ ID NO: 423451 - DNA, 20 bp, mouse
gtcaccagatagcgtggaga

SEQ ID NO: 423452 - DNA, 20 bp, mouse
gaactaatcaccagatagcg

SEQ ID NO: 423453 - DNA, 20 bp, mouse
gtaaagacactgacatgaaa

SEQ ID NO: 423454 - DNA, 20 bp, mouse
gtcgtggatgtaaaattccg

SEQ ID NO: 423455 - DNA, 20 bp, mouse
gttaaactctagtctactcg

SEQ ID NO: 423456 - DNA, 20 bp, mouse
gagcgagtgcagctgcccgg

SEQ ID NO: 423457 - DNA, 20 bp, mouse
ggagtcaggacccggacctt

SEQ ID NO: 423458 - DNA, 20 bp, mouse
gggcggctagagtcaggacc

SEQ ID NO: 423459 - DNA, 20 bp, mouse
gagggtcagacgggtcccag

SEQ ID NO: 423460 - DNA, 20 bp, mouse
gctgcccggcggctagagtc

SEQ ID NO: 423461 - DNA, 20 bp, mouse
gcagagcgcacaggatcagg

SEQ ID NO: 423462 - DNA, 20 bp, mouse
ggcagctgcactcgctcctc

SEQ ID NO: 423463 - DNA, 20 bp, mouse
gaggcccggctgggacgcaa

SEQ ID NO: 423464 - DNA, 20 bp, mouse
gggatcagctggggtcgtgt

SEQ ID NO: 423465 - DNA, 20 bp, mouse
ggcgggacgccagagcgcac

SEQ ID NO: 423466 - DNA, 20 bp, mouse
gaggaaggaggcgactgcac

SEQ ID NO: 423467 - DNA, 20 bp, mouse
gcgcgagcgcgcgtcctccg

SEQ ID NO: 423468 - DNA, 20 bp, mouse
ggcgactgcacgggacgccg

SEQ ID NO: 423469 - DNA, 20 bp, mouse
gtcctcgggaaacaccgagt

SEQ ID NO: 423470 - DNA, 20 bp, mouse
ggtggggtcgcggagcatgg

SEQ ID NO: 423471 - DNA, 20 bp, mouse
gcggtgtttcccgaggaagg

SEQ ID NO: 423472 - DNA, 20 bp, mouse
ggcccactcggtgtttcccg

SEQ ID NO: 423473 - DNA, 20 bp, mouse
gccggggcgccgcagacgag

SEQ ID NO: 423474 - DNA, 20 bp, mouse
ggggcgccgcagacgagtgg

SEQ ID NO: 423475 - DNA, 20 bp, mouse
gcgggctgcgcgatccagag

SEQ ID NO: 423476 - DNA, 20 bp, mouse
gctgcgggcaggagaaggcg

SEQ ID NO: 423477 - DNA, 20 bp, mouse
gccagcctgcgggcaggaga

SEQ ID NO: 423478 - DNA, 20 bp, mouse
gtggccccccattcaagaag

SEQ ID NO: 423479 - DNA, 20 bp, mouse
gggctaactcagccagcaaa

SEQ ID NO: 423480 - DNA, 20 bp, mouse
gccgcaggctggacattatg

SEQ ID NO: 423481 - DNA, 20 bp, mouse
ggcgcggaacgtgcgctccg

SEQ ID NO: 423482 - DNA, 20 bp, mouse
gtaatgtccagcctgcgggc

SEQ ID NO: 423483 - DNA, 20 bp, mouse
gccccattcaagaagcggct

SEQ ID NO: 423484 - DNA, 20 bp, mouse
gcacggccgccgcggagtca

SEQ ID NO: 423485 - DNA, 20 bp, mouse
ggcgctcgggccgcaggagg

SEQ ID NO: 423486 - DNA, 20 bp, mouse
ggcactggatgtgacagcag

SEQ ID NO: 423487 - DNA, 20 bp, mouse
gtgatggaagctgataggca

SEQ ID NO: 423488 - DNA, 20 bp, mouse
gtgtgccaggagctgcccga

SEQ ID NO: 423489 - DNA, 20 bp, mouse
gatgtgacagcagcgggcag

SEQ ID NO: 423490 - DNA, 20 bp, mouse
gggaaagccagaacgagcag

SEQ ID NO: 423491 - DNA, 20 bp, mouse
ggaaatgtgagcggggctga

SEQ ID NO: 423492 - DNA, 20 bp, mouse
gtctttgccggaatccgaat

SEQ ID NO: 423493 - DNA, 20 bp, mouse
gacatttcctgagcgagggt

SEQ ID NO: 423494 - DNA, 20 bp, mouse
gctcgctcaggaaatgtgag

SEQ ID NO: 423495 - DNA, 20 bp, mouse
gagtatggaatgctgccgtc

SEQ ID NO: 423496 - DNA, 20 bp, mouse
gtgggctgagagcccctcct

SEQ ID NO: 423497 - DNA, 20 bp, mouse
gtagtggcctacctcaccca

SEQ ID NO: 423498 - DNA, 20 bp, mouse
gagcagggacaagtatgtag

SEQ ID NO: 423499 - DNA, 20 bp, mouse
gaggacaacctgctgaccct

SEQ ID NO: 423500 - DNA, 20 bp, mouse
gccaggtgcacggtgcagga

SEQ ID NO: 423501 - DNA, 20 bp, mouse
gggtgagtgcagagatgtgc

SEQ ID NO: 423502 - DNA, 20 bp, mouse
gtgctgaccctgggtgaggt

SEQ ID NO: 423503 - DNA, 20 bp, mouse
gttcaagggagggggttccc

SEQ ID NO: 423504 - DNA, 20 bp, mouse
gatgctctttgaagtgggag

SEQ ID NO: 423505 - DNA, 20 bp, mouse
gagagctactgccaggtgca

SEQ ID NO: 423506 - DNA, 20 bp, mouse
ggtcctctgccctaacccag

SEQ ID NO: 423507 - DNA, 20 bp, mouse
ggatgcgcgctgcgagacag

SEQ ID NO: 423508 - DNA, 20 bp, mouse
gctgggaacgcggggacaag

SEQ ID NO: 423509 - DNA, 20 bp, mouse
ggctccgagccgcctggctg

SEQ ID NO: 423510 - DNA, 20 bp, mouse
gagtgctggccccgacccag

SEQ ID NO: 423511 - DNA, 20 bp, mouse
gcagaggacgcagggcggga

SEQ ID NO: 423512 - DNA, 20 bp, mouse
gtcccagcgcccctgggtta

SEQ ID NO: 423513 - DNA, 20 bp, mouse
gaggcggctcggagcgctcg

SEQ ID NO: 423514 - DNA, 20 bp, mouse
ggcgtctgacggtgcaagga

SEQ ID NO: 423515 - DNA, 20 bp, mouse
ggagtcgcagcagcgtctga

SEQ ID NO: 423516 - DNA, 20 bp, mouse
ggagagagcgggcgcagaga

SEQ ID NO: 423517 - DNA, 20 bp, mouse
gcggcgtgcagggaggtcct

SEQ ID NO: 423518 - DNA, 20 bp, mouse
gcagtcagagcccaggcggg

SEQ ID NO: 423519 - DNA, 20 bp, mouse
gcctctggtagtggccaccg

SEQ ID NO: 423520 - DNA, 20 bp, mouse
gcctccccgaccccccgcct

SEQ ID NO: 423521 - DNA, 20 bp, mouse
gatcttcccgaagcccctca

SEQ ID NO: 423522 - DNA, 20 bp, mouse
ggctgtgccggcgtgcaggg

SEQ ID NO: 423523 - DNA, 20 bp, mouse
ggagcccaggcggggggtcg

SEQ ID NO: 423524 - DNA, 20 bp, mouse
gctctgggaacgcagggata

SEQ ID NO: 423525 - DNA, 20 bp, mouse
gagggatagggtgtccggga

SEQ ID NO: 423526 - DNA, 20 bp, mouse
gggtggaatagtggcaggat

SEQ ID NO: 423527 - DNA, 20 bp, mouse
ggccacaccgggtggaatag

SEQ ID NO: 423528 - DNA, 20 bp, mouse
gaccatctgctgagagccca

SEQ ID NO: 423529 - DNA, 20 bp, mouse
gggggcgtcccggggaaact

SEQ ID NO: 423530 - DNA, 20 bp, mouse
gcagtccccggggcgtcccg

SEQ ID NO: 423531 - DNA, 20 bp, mouse
gtccccgccgccacaccggg

SEQ ID NO: 423532 - DNA, 20 bp, mouse
gccgcttccgccagtccccg

SEQ ID NO: 423533 - DNA, 20 bp, mouse
gtctgggcccgcagaaggaa

SEQ ID NO: 423534 - DNA, 20 bp, mouse
gagagggcattgacagacat

SEQ ID NO: 423535 - DNA, 20 bp, mouse
gagtgactggtgcaccaatg

SEQ ID NO: 423536 - DNA, 20 bp, mouse
gcgcgcggggccgccctgag

SEQ ID NO: 423537 - DNA, 20 bp, mouse
ggcgcgcgcagctccgctca

SEQ ID NO: 423538 - DNA, 20 bp, mouse
gccgcgcggcgacacgatcg

SEQ ID NO: 423539 - DNA, 20 bp, mouse
ggtgaggcgcagcatccgga

SEQ ID NO: 423540 - DNA, 20 bp, mouse
ggggaccggggagtaacgca

SEQ ID NO: 423541 - DNA, 20 bp, mouse
ggctgcgcgcgcggggaccg

SEQ ID NO: 423542 - DNA, 20 bp, mouse
gcccgtcccgcacctacccg

SEQ ID NO: 423543 - DNA, 20 bp, mouse
gacgcacggcgcgcccggga

SEQ ID NO: 423544 - DNA, 20 bp, mouse
gacccgcgctgcggaaggat

SEQ ID NO: 423545 - DNA, 20 bp, mouse
gcagcggcgcggacagggag

SEQ ID NO: 423546 - DNA, 20 bp, mouse
gaccatgggcgtccaggagc

SEQ ID NO: 423547 - DNA, 20 bp, mouse
gcagggaaacgccggaccat

SEQ ID NO: 423548 - DNA, 20 bp, mouse
gtcctagggaaggagcgggt

SEQ ID NO: 423549 - DNA, 20 bp, mouse
gcggcccagaggtctcagcg

SEQ ID NO: 423550 - DNA, 20 bp, mouse
ggatctgaatccttctccgg

SEQ ID NO: 423551 - DNA, 20 bp, mouse
gtcccgctcctggacgccca

SEQ ID NO: 423552 - DNA, 20 bp, mouse
gcgtgctcctagggaaggag

SEQ ID NO: 423553 - DNA, 20 bp, mouse
gagaaggattcagatcccca

SEQ ID NO: 423554 - DNA, 20 bp, mouse
ggcccacccgctccttccct

SEQ ID NO: 423555 - DNA, 20 bp, mouse
gcgccggaccatgggcgtcc

SEQ ID NO: 423556 - DNA, 20 bp, mouse
gcagccttgggctcacgagt

SEQ ID NO: 423557 - DNA, 20 bp, mouse
gcgttgggactagccgggaa

SEQ ID NO: 423558 - DNA, 20 bp, mouse
gaaggtggaagactacgcgt

SEQ ID NO: 423559 - DNA, 20 bp, mouse
gaccttcagtcaggaatcaa

SEQ ID NO: 423560 - DNA, 20 bp, mouse
gctgcccactcgtgagccca

SEQ ID NO: 423561 - DNA, 20 bp, mouse
gcagggccgcgggtacccag

SEQ ID NO: 423562 - DNA, 20 bp, mouse
gccgggaagggcgcagcctt

SEQ ID NO: 423563 - DNA, 20 bp, mouse
gtagtcttccaccttcagtc

SEQ ID NO: 423564 - DNA, 20 bp, mouse
gcacgagtgggcagcgtccg

SEQ ID NO: 423565 - DNA, 20 bp, mouse
gaaggagacatggggagcgg

SEQ ID NO: 423566 - DNA, 20 bp, mouse
gtgccggcactatgtctcaa

SEQ ID NO: 423567 - DNA, 20 bp, mouse
gtggggagccagccatctta

SEQ ID NO: 423568 - DNA, 20 bp, mouse
gccggcaaggcccgcacctg

SEQ ID NO: 423569 - DNA, 20 bp, mouse
ggaaacgaaagtgaactctg

SEQ ID NO: 423570 - DNA, 20 bp, mouse
gaccccgcgggcttacctgt

SEQ ID NO: 423571 - DNA, 20 bp, mouse
gcgcacctgtggccgtaaga

SEQ ID NO: 423572 - DNA, 20 bp, mouse
gctatgtctcaagggttcag

SEQ ID NO: 423573 - DNA, 20 bp, mouse
gcctgtggccgtaagatggc

SEQ ID NO: 423574 - DNA, 20 bp, mouse
gaacccttgagacatagtgc

SEQ ID NO: 423575 - DNA, 20 bp, mouse
gtatgagggtgcagaccccg

SEQ ID NO: 423576 - DNA, 20 bp, mouse
gccgccggcgccgaggctag

SEQ ID NO: 423577 - DNA, 20 bp, mouse
gtagccccgcggccccagct

SEQ ID NO: 423578 - DNA, 20 bp, mouse
gcgcagcgtgagcggaggta

SEQ ID NO: 423579 - DNA, 20 bp, mouse
gagcgtgagcggaggtaagg

SEQ ID NO: 423580 - DNA, 20 bp, mouse
gggcggagccgccggcgccg

SEQ ID NO: 423581 - DNA, 20 bp, mouse
ggcccgggccccgcaccata

SEQ ID NO: 423582 - DNA, 20 bp, mouse
ggagaggaccctgtactcca

SEQ ID NO: 423583 - DNA, 20 bp, mouse
gacggctcgtccgctcctgg

SEQ ID NO: 423584 - DNA, 20 bp, mouse
gggacctgtgcccatcagag

SEQ ID NO: 423585 - DNA, 20 bp, mouse
gagcgcccagagccagacgc

SEQ ID NO: 423586 - DNA, 20 bp, mouse
gttctggagcccagacgaag

SEQ ID NO: 423587 - DNA, 20 bp, mouse
gagctctctcctcttcgtct

SEQ ID NO: 423588 - DNA, 20 bp, mouse
gagagagctccagggcgctc

SEQ ID NO: 423589 - DNA, 20 bp, mouse
ggagctttcagcctaaggaa

SEQ ID NO: 423590 - DNA, 20 bp, mouse
gggtgccaaacaactcgcag

SEQ ID NO: 423591 - DNA, 20 bp, mouse
gggaggaggtccaagaggaa

SEQ ID NO: 423592 - DNA, 20 bp, mouse
gaagcggccaccgagatctg

SEQ ID NO: 423593 - DNA, 20 bp, mouse
gcaaatgcaagtccaagagg

SEQ ID NO: 423594 - DNA, 20 bp, mouse
gccagctcatccggaaccaa

SEQ ID NO: 423595 - DNA, 20 bp, mouse
gagatctgaggaaggacgag

SEQ ID NO: 423596 - DNA, 20 bp, mouse
gaacgagcgtggcggtagag

SEQ ID NO: 423597 - DNA, 20 bp, mouse
gttgcggcgcgtggataata

SEQ ID NO: 423598 - DNA, 20 bp, mouse
gcctggttaaacgagcgtgg

SEQ ID NO: 423599 - DNA, 20 bp, mouse
gtgaccggagcggccctcta

SEQ ID NO: 423600 - DNA, 20 bp, mouse
ggccctgcggtaggaagggt

SEQ ID NO: 423601 - DNA, 20 bp, mouse
ggtagaggggcatcgcgtgg

SEQ ID NO: 423602 - DNA, 20 bp, mouse
ggggcatcgcgtggaggttg

SEQ ID NO: 423603 - DNA, 20 bp, mouse
gggtgtgagggactccggat

SEQ ID NO: 423604 - DNA, 20 bp, mouse
gcgtggataatagggtgtga

SEQ ID NO: 423605 - DNA, 20 bp, mouse
gtccagccctgcggtaggaa

SEQ ID NO: 423606 - DNA, 20 bp, mouse
gtcggcccggagtctctgag

SEQ ID NO: 423607 - DNA, 20 bp, mouse
gccgagggacgagagaagag

SEQ ID NO: 423608 - DNA, 20 bp, mouse
gtctctgagcggcggaggta

SEQ ID NO: 423609 - DNA, 20 bp, mouse
ggggccgtctggagtagtgg

SEQ ID NO: 423610 - DNA, 20 bp, mouse
gcacgggccgtctggagtag

SEQ ID NO: 423611 - DNA, 20 bp, mouse
gggcggaggtatggaggaga

SEQ ID NO: 423612 - DNA, 20 bp, mouse
gctgtacggacaccacgcac

SEQ ID NO: 423613 - DNA, 20 bp, mouse
gaagagaggacagcggaacg

SEQ ID NO: 423614 - DNA, 20 bp, mouse
gaggaggacgggaaaagacg

SEQ ID NO: 423615 - DNA, 20 bp, mouse
ggtagggagcacacatcccc

SEQ ID NO: 423616 - DNA, 20 bp, mouse
gggcgaaagccgaaccccta

SEQ ID NO: 423617 - DNA, 20 bp, mouse
ggaaagccgaacccctacgg

SEQ ID NO: 423618 - DNA, 20 bp, mouse
gcggcccggttgctaggact

SEQ ID NO: 423619 - DNA, 20 bp, mouse
gaggtgagcagccgccgtag

SEQ ID NO: 423620 - DNA, 20 bp, mouse
ggctaggacttggataagcg

SEQ ID NO: 423621 - DNA, 20 bp, mouse
ggttcgctcgggtgtccctc

SEQ ID NO: 423622 - DNA, 20 bp, mouse
gcccgcggtggcaggcgtgg

SEQ ID NO: 423623 - DNA, 20 bp, mouse
gcgcgtgcgccgcaaaccaa

SEQ ID NO: 423624 - DNA, 20 bp, mouse
gtgccccgcggtggcaggcg

SEQ ID NO: 423625 - DNA, 20 bp, mouse
gccccatggcggattcggaa

SEQ ID NO: 423626 - DNA, 20 bp, mouse
gcgaggcccctgctgagagg

SEQ ID NO: 423627 - DNA, 20 bp, mouse
ggcccccgcgaaggaggacg

SEQ ID NO: 423628 - DNA, 20 bp, mouse
gccaggcgcgctgctagggg

SEQ ID NO: 423629 - DNA, 20 bp, mouse
gagcgagtgaatcggatcct

SEQ ID NO: 423630 - DNA, 20 bp, mouse
gtgctctatgagccacgggt

SEQ ID NO: 423631 - DNA, 20 bp, mouse
gactcgctggggagacctat

SEQ ID NO: 423632 - DNA, 20 bp, mouse
gaagggcacagaacatgact

SEQ ID NO: 423633 - DNA, 20 bp, mouse
ggggtcagcgcccaaagccg

SEQ ID NO: 423634 - DNA, 20 bp, mouse
ggcaacaccccgaggaggag

SEQ ID NO: 423635 - DNA, 20 bp, mouse
ggtctccccagcgagtgaat

SEQ ID NO: 423636 - DNA, 20 bp, mouse
gcgcgggtgctactcaccag

SEQ ID NO: 423637 - DNA, 20 bp, mouse
ggcgcagcttccctaccctc

SEQ ID NO: 423638 - DNA, 20 bp, mouse
ggtgctactcaccagagggt

SEQ ID NO: 423639 - DNA, 20 bp, mouse
gctccacgtcccgcacaatc

SEQ ID NO: 423640 - DNA, 20 bp, mouse
gaccttgcgtgccctggagt

SEQ ID NO: 423641 - DNA, 20 bp, mouse
ggtcccgcacaatctggcag

SEQ ID NO: 423642 - DNA, 20 bp, mouse
gcacaatctggcagcgggat

SEQ ID NO: 423643 - DNA, 20 bp, mouse
gaagtggccagtccacacta

SEQ ID NO: 423644 - DNA, 20 bp, mouse
gtcccacgcagaggtagctg

SEQ ID NO: 423645 - DNA, 20 bp, mouse
gtggccaggactctgtgcgc

SEQ ID NO: 423646 - DNA, 20 bp, mouse
gagagcgggcagtgacaacc

SEQ ID NO: 423647 - DNA, 20 bp, mouse
gcacgggccaggctcccggg

SEQ ID NO: 423648 - DNA, 20 bp, mouse
ggctcgggacctgcacagag

SEQ ID NO: 423649 - DNA, 20 bp, mouse
gaggtcccgagccatcggct

SEQ ID NO: 423650 - DNA, 20 bp, mouse
ggacctgagccggggaccac

SEQ ID NO: 423651 - DNA, 20 bp, mouse
gtgtgcaggtcccgagccat

SEQ ID NO: 423652 - DNA, 20 bp, mouse
gggccgcgggaagacctgag

SEQ ID NO: 423653 - DNA, 20 bp, mouse
gggcggagatgccgagccga

SEQ ID NO: 423654 - DNA, 20 bp, mouse
ggcacggagcgtctccacaa

SEQ ID NO: 423655 - DNA, 20 bp, mouse
ggtcactgcccgctctgtgc

SEQ ID NO: 423656 - DNA, 20 bp, mouse
ggctagaaggtaaacagaag

SEQ ID NO: 423657 - DNA, 20 bp, mouse
ggtgtgcggagcgctcgcag

SEQ ID NO: 423658 - DNA, 20 bp, mouse
ggccttaccgggctgcagga

SEQ ID NO: 423659 - DNA, 20 bp, mouse
gaacagaagcggagagtgtg

SEQ ID NO: 423660 - DNA, 20 bp, mouse
ggcgcggaggcgttgcgttg

SEQ ID NO: 423661 - DNA, 20 bp, mouse
gggaggcgttgcgttgcgga

SEQ ID NO: 423662 - DNA, 20 bp, mouse
gaccttcctgcagcccggta

SEQ ID NO: 423663 - DNA, 20 bp, mouse
ggccagagcacacagttcga

SEQ ID NO: 423664 - DNA, 20 bp, mouse
gccagacccgggtcgggaaa

SEQ ID NO: 423665 - DNA, 20 bp, mouse
gacgtgcgtggacgacgcag

SEQ ID NO: 423666 - DNA, 20 bp, mouse
ggtgtggactgaatatatac

SEQ ID NO: 423667 - DNA, 20 bp, mouse
ggtccacacgctgagttcta

SEQ ID NO: 423668 - DNA, 20 bp, mouse
gcacaggtagtagaatcaga

SEQ ID NO: 423669 - DNA, 20 bp, mouse
ggaccatagaactcagcgtg

SEQ ID NO: 423670 - DNA, 20 bp, mouse
gctgcctgtaggcctgggat

SEQ ID NO: 423671 - DNA, 20 bp, mouse
ggcacacacgggaactctga

SEQ ID NO: 423672 - DNA, 20 bp, mouse
gcaggtcaccctgtccttaa

SEQ ID NO: 423673 - DNA, 20 bp, mouse
ggtagactctctgatccgag

SEQ ID NO: 423674 - DNA, 20 bp, mouse
gcagcagacagtacagagtg

SEQ ID NO: 423675 - DNA, 20 bp, mouse
ggtgtcagtactggaaatag

SEQ ID NO: 423676 - DNA, 20 bp, mouse
gacctggagcctaaacctgg

SEQ ID NO: 423677 - DNA, 20 bp, mouse
ggcccagcgggtgctagacc

SEQ ID NO: 423678 - DNA, 20 bp, mouse
gtagacctggagcctaaacc

SEQ ID NO: 423679 - DNA, 20 bp, mouse
gggaagcttaagaggcccag

SEQ ID NO: 423680 - DNA, 20 bp, mouse
gagcctaaacctggtggact

SEQ ID NO: 423681 - DNA, 20 bp, mouse
gcacccagtccaccaggttt

SEQ ID NO: 423682 - DNA, 20 bp, mouse
gccgttacgaccccgttacg

SEQ ID NO: 423683 - DNA, 20 bp, mouse
ggggtcgtaacggggtgtct

SEQ ID NO: 423684 - DNA, 20 bp, mouse
gtccaggtctagcacccgct

SEQ ID NO: 423685 - DNA, 20 bp, mouse
gacgttcccggaagcttaag

SEQ ID NO: 423686 - DNA, 20 bp, mouse
gggctcaagccagataggga

SEQ ID NO: 423687 - DNA, 20 bp, mouse
gtgacgaacaacagaatgtg

SEQ ID NO: 423688 - DNA, 20 bp, mouse
ggaggaagagggaggcgtcc

SEQ ID NO: 423689 - DNA, 20 bp, mouse
gaagccagatagggagggca

SEQ ID NO: 423690 - DNA, 20 bp, mouse
gctggggctcaagccagata

SEQ ID NO: 423691 - DNA, 20 bp, mouse
gttgctgccatgcactgagg

SEQ ID NO: 423692 - DNA, 20 bp, mouse
gctgccatgcactgaggagg

SEQ ID NO: 423693 - DNA, 20 bp, mouse
gcacttgctgccatgcactg

SEQ ID NO: 423694 - DNA, 20 bp, mouse
gctgccctgccctccctatc

SEQ ID NO: 423695 - DNA, 20 bp, mouse
gtaccatttccactgctgac

SEQ ID NO: 423696 - DNA, 20 bp, mouse
gtgggcaccagggacgtctg

SEQ ID NO: 423697 - DNA, 20 bp, mouse
gggacgtctgcggcgaaacc

SEQ ID NO: 423698 - DNA, 20 bp, mouse
gcggggtcgtctgggcacca

SEQ ID NO: 423699 - DNA, 20 bp, mouse
ggacgaccccgcgaaagagt

SEQ ID NO: 423700 - DNA, 20 bp, mouse
gaccggccgccacatgtccc

SEQ ID NO: 423701 - DNA, 20 bp, mouse
ggagcactgccggggacatg

SEQ ID NO: 423702 - DNA, 20 bp, mouse
gcactgccggggacatgtgg

SEQ ID NO: 423703 - DNA, 20 bp, mouse
gccgggaagagagcactgcc

SEQ ID NO: 423704 - DNA, 20 bp, mouse
ggatgcggagcgcagagtca

SEQ ID NO: 423705 - DNA, 20 bp, mouse
gacccccagggccagaacaa

SEQ ID NO: 423706 - DNA, 20 bp, mouse
gcgcggggcgggcggagttg

SEQ ID NO: 423707 - DNA, 20 bp, mouse
gcgccagggcgcccgccagt

SEQ ID NO: 423708 - DNA, 20 bp, mouse
gcatggcgctgagatggcgg

SEQ ID NO: 423709 - DNA, 20 bp, mouse
gagctggaggcgctgttccg

SEQ ID NO: 423710 - DNA, 20 bp, mouse
ggcagagtagcgcgaaggtg

SEQ ID NO: 423711 - DNA, 20 bp, mouse
gccatctcagcgccatgcag

SEQ ID NO: 423712 - DNA, 20 bp, mouse
gacacgcccggaacccacgc

SEQ ID NO: 423713 - DNA, 20 bp, mouse
gggggccgcccagcgcgaag

SEQ ID NO: 423714 - DNA, 20 bp, mouse
gtgcagctgggacacctgca

SEQ ID NO: 423715 - DNA, 20 bp, mouse
gggaggcgcaatgggctcga

SEQ ID NO: 423716 - DNA, 20 bp, mouse
ggaagctcgagcctagatta

SEQ ID NO: 423717 - DNA, 20 bp, mouse
gcacagctaatagacttgag

SEQ ID NO: 423718 - DNA, 20 bp, mouse
ggacaaaactgtcatttgat

SEQ ID NO: 423719 - DNA, 20 bp, mouse
gttggagaacagaggtacgt

SEQ ID NO: 423720 - DNA, 20 bp, mouse
gaactgtcatttgatgggtc

SEQ ID NO: 423721 - DNA, 20 bp, mouse
ggcttctaatctaacctaaa

SEQ ID NO: 423722 - DNA, 20 bp, mouse
gtctagcaccttcatatgat

SEQ ID NO: 423723 - DNA, 20 bp, mouse
ggtaagtgcctatcatatga

SEQ ID NO: 423724 - DNA, 20 bp, mouse
gacagaggtacgtgggaagt

SEQ ID NO: 423725 - DNA, 20 bp, mouse
gaagatctagtccctaatct

SEQ ID NO: 423726 - DNA, 20 bp, mouse
gcgcccggagctgtgctcag

SEQ ID NO: 423727 - DNA, 20 bp, mouse
ggcggtaggtgaccacagag

SEQ ID NO: 423728 - DNA, 20 bp, mouse
gggcgggtcgcgaagcgcgg

SEQ ID NO: 423729 - DNA, 20 bp, mouse
ggggtcgcgaagcgcggggg

SEQ ID NO: 423730 - DNA, 20 bp, mouse
gagctgtgctcaggggcctc

SEQ ID NO: 423731 - DNA, 20 bp, mouse
gctgcgggaccgcgccgagg

SEQ ID NO: 423732 - DNA, 20 bp, mouse
gggcgcggtcccgcaggtag

SEQ ID NO: 423733 - DNA, 20 bp, mouse
gagcccgagcgcgaagaaga

SEQ ID NO: 423734 - DNA, 20 bp, mouse
gcgggaccgcgccgaggcgg

SEQ ID NO: 423735 - DNA, 20 bp, mouse
gggactcgtagagccagtcc

SEQ ID NO: 423736 - DNA, 20 bp, mouse
gagagcgcagcgcacggact

SEQ ID NO: 423737 - DNA, 20 bp, mouse
gcatcggtgggcgcagagga

SEQ ID NO: 423738 - DNA, 20 bp, mouse
gcactgcgggaagcagcctg

SEQ ID NO: 423739 - DNA, 20 bp, mouse
gcccgcgcacaggctccggg

SEQ ID NO: 423740 - DNA, 20 bp, mouse
ggtgtgcagagcgcagcgca

SEQ ID NO: 423741 - DNA, 20 bp, mouse
gagccgcgcgctccaaaccg

SEQ ID NO: 423742 - DNA, 20 bp, mouse
gcgcagcgcacggactcggc

SEQ ID NO: 423743 - DNA, 20 bp, mouse
gtcagcatcggtgggcgcag

SEQ ID NO: 423744 - DNA, 20 bp, mouse
gccacccggcgcccaggagg

SEQ ID NO: 423745 - DNA, 20 bp, mouse
gcatcctctccccgcacgca

SEQ ID NO: 423746 - DNA, 20 bp, mouse
gaggctccaggagggaacct

SEQ ID NO: 423747 - DNA, 20 bp, mouse
ggcaaagctaggctccagga

SEQ ID NO: 423748 - DNA, 20 bp, mouse
ggccactagcaaagcagcga

SEQ ID NO: 423749 - DNA, 20 bp, mouse
gagtagtagccatcccaccc

SEQ ID NO: 423750 - DNA, 20 bp, mouse
gctctcccgaagccactctc

SEQ ID NO: 423751 - DNA, 20 bp, mouse
gcagcgccctgtgatcccta

SEQ ID NO: 423752 - DNA, 20 bp, mouse
gaagttctctcagcaaagct

SEQ ID NO: 423753 - DNA, 20 bp, mouse
gttagtggcttgcccgagag

SEQ ID NO: 423754 - DNA, 20 bp, mouse
gacccaaagcggtgagtctg

SEQ ID NO: 423755 - DNA, 20 bp, mouse
ggagtggcttcgggagagat

SEQ ID NO: 423756 - DNA, 20 bp, mouse
ggcgctcccgaggggcccga

SEQ ID NO: 423757 - DNA, 20 bp, mouse
gaagagccgcggcgccccgg

SEQ ID NO: 423758 - DNA, 20 bp, mouse
ggccggcaacgaggaaccca

SEQ ID NO: 423759 - DNA, 20 bp, mouse
gcgagcgcagaaccactacg

SEQ ID NO: 423760 - DNA, 20 bp, mouse
gctgcgttggggcagaacgg

SEQ ID NO: 423761 - DNA, 20 bp, mouse
ggcagggcccgaggcgtgca

SEQ ID NO: 423762 - DNA, 20 bp, mouse
gcgaggggcccgagggagcc

SEQ ID NO: 423763 - DNA, 20 bp, mouse
gggcggcgagcgggcgagaa

SEQ ID NO: 423764 - DNA, 20 bp, mouse
gaacagcagccggccgataa

SEQ ID NO: 423765 - DNA, 20 bp, mouse
gagggccggccgaagagccg

SEQ ID NO: 423766 - DNA, 20 bp, mouse
gtgataggcaggcatctgac

SEQ ID NO: 423767 - DNA, 20 bp, mouse
ggacatggggcctgataggc

SEQ ID NO: 423768 - DNA, 20 bp, mouse
gaggcatctgactggctgga

SEQ ID NO: 423769 - DNA, 20 bp, mouse
gagctctggagactgacagc

SEQ ID NO: 423770 - DNA, 20 bp, mouse
gctcacctgaagtacgagag

SEQ ID NO: 423771 - DNA, 20 bp, mouse
gctgaagtacgagaggggaa

SEQ ID NO: 423772 - DNA, 20 bp, mouse
ggcgtggcagggaattgtta

SEQ ID NO: 423773 - DNA, 20 bp, mouse
gtaggggcgctggcagaacg

SEQ ID NO: 423774 - DNA, 20 bp, mouse
gtctgtcagtgtccaagaga

SEQ ID NO: 423775 - DNA, 20 bp, mouse
gtacagtgtgtagcgtggca

SEQ ID NO: 423776 - DNA, 20 bp, mouse
gggcgtccagtctcactcat

SEQ ID NO: 423777 - DNA, 20 bp, mouse
gcttaataccctggctccag

SEQ ID NO: 423778 - DNA, 20 bp, mouse
ggccttcccatgagtgagac

SEQ ID NO: 423779 - DNA, 20 bp, mouse
gatgggaaggctccttctac

SEQ ID NO: 423780 - DNA, 20 bp, mouse
gctggacgcctctggagcca

SEQ ID NO: 423781 - DNA, 20 bp, mouse
gggctgggaccttaataccc

SEQ ID NO: 423782 - DNA, 20 bp, mouse
gtaactaggtagccggtaga

SEQ ID NO: 423783 - DNA, 20 bp, mouse
gatgtgactcactcttaact

SEQ ID NO: 423784 - DNA, 20 bp, mouse
ggcaggcacagagcttggtt

SEQ ID NO: 423785 - DNA, 20 bp, mouse
ggagtgagactggacgcctc

SEQ ID NO: 423786 - DNA, 20 bp, mouse
ggggaagcgcggggctactt

SEQ ID NO: 423787 - DNA, 20 bp, mouse
gcggaaccgcgcagcgggac

SEQ ID NO: 423788 - DNA, 20 bp, mouse
gcagagcggtcagacacccg

SEQ ID NO: 423789 - DNA, 20 bp, mouse
gccggagcctgggaggaatt

SEQ ID NO: 423790 - DNA, 20 bp, mouse
gggtgtctgaccgctctgac

SEQ ID NO: 423791 - DNA, 20 bp, mouse
gaggtctccaaattcctccc

SEQ ID NO: 423792 - DNA, 20 bp, mouse
gggcgctcggaaccgcgcag

SEQ ID NO: 423793 - DNA, 20 bp, mouse
gcgcgcttccctggatccgg

SEQ ID NO: 423794 - DNA, 20 bp, mouse
ggaagaggctccaggccgag

SEQ ID NO: 423795 - DNA, 20 bp, mouse
gatttggagacctgtcagag

SEQ ID NO: 423796 - DNA, 20 bp, mouse
gcgcgctgcggcagaggaga

SEQ ID NO: 423797 - DNA, 20 bp, mouse
gtgtcagtgacagcgggagg

SEQ ID NO: 423798 - DNA, 20 bp, mouse
ggcgcgtctgtcagtgacag

SEQ ID NO: 423799 - DNA, 20 bp, mouse
gcgcagccgctgcctcaggt

SEQ ID NO: 423800 - DNA, 20 bp, mouse
gtcgcgggagtcaggctctg

SEQ ID NO: 423801 - DNA, 20 bp, mouse
ggtctgtcagtgacagcggg

SEQ ID NO: 423802 - DNA, 20 bp, mouse
ggcgcgtgtcccggacccgg

SEQ ID NO: 423803 - DNA, 20 bp, mouse
ggcgagcttgaggagcccga

SEQ ID NO: 423804 - DNA, 20 bp, mouse
gtagctcaggcagggcccct

SEQ ID NO: 423805 - DNA, 20 bp, mouse
gaggagggggccggagatgg

SEQ ID NO: 423806 - DNA, 20 bp, mouse
gtgcggaagtcgggagtcgg

SEQ ID NO: 423807 - DNA, 20 bp, mouse
gttctctgctctgaggtctc

SEQ ID NO: 423808 - DNA, 20 bp, mouse
ggcgtgacaccgaaggaagt

SEQ ID NO: 423809 - DNA, 20 bp, mouse
ggcctctgtgggagactatc

SEQ ID NO: 423810 - DNA, 20 bp, mouse
gggcgagcagccaaagggag

SEQ ID NO: 423811 - DNA, 20 bp, mouse
gggagggagcgtgacaccga

SEQ ID NO: 423812 - DNA, 20 bp, mouse
ggcttgcggaagtcgggagt

SEQ ID NO: 423813 - DNA, 20 bp, mouse
ggagtaggcgagcagccaaa

SEQ ID NO: 423814 - DNA, 20 bp, mouse
ggagggaagatggcctctgt

SEQ ID NO: 423815 - DNA, 20 bp, mouse
gctggcagcttgcggaagtc

SEQ ID NO: 423816 - DNA, 20 bp, mouse
gcggtcgagtggcacagggt

SEQ ID NO: 423817 - DNA, 20 bp, mouse
gcaggacagagccggtcgag

SEQ ID NO: 423818 - DNA, 20 bp, mouse
ggggcctggctgcgcagcag

SEQ ID NO: 423819 - DNA, 20 bp, mouse
gcggctctgtcctgcgggag

SEQ ID NO: 423820 - DNA, 20 bp, mouse
gggtgggctaaaggagacga

SEQ ID NO: 423821 - DNA, 20 bp, mouse
gagagccggtcgagtggcac

SEQ ID NO: 423822 - DNA, 20 bp, mouse
ggcagggacccagggcgcgg

SEQ ID NO: 423823 - DNA, 20 bp, mouse
gtcgggactgctgggcgcag

SEQ ID NO: 423824 - DNA, 20 bp, mouse
gtaggccgggggcagagatg

SEQ ID NO: 423825 - DNA, 20 bp, mouse
gccacacgcaccgagagacc

SEQ ID NO: 423826 - DNA, 20 bp, mouse
gtcacctccgcggagaatcg

SEQ ID NO: 423827 - DNA, 20 bp, mouse
gcgagccgcaggcgaggcgg

SEQ ID NO: 423828 - DNA, 20 bp, mouse
gggagagagcacggcttccc

SEQ ID NO: 423829 - DNA, 20 bp, mouse
gcggcggccgcactcggacc

SEQ ID NO: 423830 - DNA, 20 bp, mouse
gctcccgggcctcacctccg

SEQ ID NO: 423831 - DNA, 20 bp, mouse
ggcgaggcggcggccgcact

SEQ ID NO: 423832 - DNA, 20 bp, mouse
gtcctcgcccccgcactcgg

SEQ ID NO: 423833 - DNA, 20 bp, mouse
gctctctccccgattctccg

SEQ ID NO: 423834 - DNA, 20 bp, mouse
gccagcgcgagccgcaggcg

SEQ ID NO: 423835 - DNA, 20 bp, mouse
gtctccccgattctccgcgg

SEQ ID NO: 423836 - DNA, 20 bp, mouse
gagactcccacaaatggaag

SEQ ID NO: 423837 - DNA, 20 bp, mouse
gccttgaagactcccacaaa

SEQ ID NO: 423838 - DNA, 20 bp, mouse
gtgggagtcttcaaggatgg

SEQ ID NO: 423839 - DNA, 20 bp, mouse
gtgagtgtgggtctgacgct

SEQ ID NO: 423840 - DNA, 20 bp, mouse
gtatgggcaaggccagccac

SEQ ID NO: 423841 - DNA, 20 bp, mouse
gtggagcctagagctgtgga

SEQ ID NO: 423842 - DNA, 20 bp, mouse
gctgctgttacccagaatag

SEQ ID NO: 423843 - DNA, 20 bp, mouse
gcactgcctcttccatttgt

SEQ ID NO: 423844 - DNA, 20 bp, mouse
gggagccagtgcaccctcca

SEQ ID NO: 423845 - DNA, 20 bp, mouse
gatggaagaggcagtggcta

SEQ ID NO: 423846 - DNA, 20 bp, mouse
gccggcggtggcgaaggagt

SEQ ID NO: 423847 - DNA, 20 bp, mouse
gtaacggtcgtgcgggcgag

SEQ ID NO: 423848 - DNA, 20 bp, mouse
gagcgagcgacgttaagagg

SEQ ID NO: 423849 - DNA, 20 bp, mouse
gcccgcacgaccgttaccgg

SEQ ID NO: 423850 - DNA, 20 bp, mouse
gcgtgcgggcgaggggctgg

SEQ ID NO: 423851 - DNA, 20 bp, mouse
gcccgccggtaacggtcgtg

SEQ ID NO: 423852 - DNA, 20 bp, mouse
gcagcgagagctagacgcgt

SEQ ID NO: 423853 - DNA, 20 bp, mouse
gcgggaacgcgagccccacg

SEQ ID NO: 423854 - DNA, 20 bp, mouse
gctggtcccgccagagcgcg

SEQ ID NO: 423855 - DNA, 20 bp, mouse
gagccctcggcagcgggaag

SEQ ID NO: 423856 - DNA, 20 bp, mouse
gcactgcagccgcggagcag

SEQ ID NO: 423857 - DNA, 20 bp, mouse
gtgcagccgcggagcagcgg

SEQ ID NO: 423858 - DNA, 20 bp, mouse
gggattctgcagtgctgcac

SEQ ID NO: 423859 - DNA, 20 bp, mouse
ggtcttccccggcttaggtg

SEQ ID NO: 423860 - DNA, 20 bp, mouse
gtaacgcgtgggaaaggcaa

SEQ ID NO: 423861 - DNA, 20 bp, mouse
gcgcgtgggaaaggcaatgg

SEQ ID NO: 423862 - DNA, 20 bp, mouse
ggaccccaacccacctccaa

SEQ ID NO: 423863 - DNA, 20 bp, mouse
ggacgtgtgtccgtcttccc

SEQ ID NO: 423864 - DNA, 20 bp, mouse
gagaatccacacctaagccg

SEQ ID NO: 423865 - DNA, 20 bp, mouse
ggtgtgacttagagactcca

SEQ ID NO: 423866 - DNA, 20 bp, mouse
gtgctggaggctgctagagt

SEQ ID NO: 423867 - DNA, 20 bp, mouse
gctagagtgggccgcaggca

SEQ ID NO: 423868 - DNA, 20 bp, mouse
gcggaagtggctctagactg

SEQ ID NO: 423869 - DNA, 20 bp, mouse
gtgtttggaagccatgcctg

SEQ ID NO: 423870 - DNA, 20 bp, mouse
gacacaagccaggcaaatct

SEQ ID NO: 423871 - DNA, 20 bp, mouse
gccttggggcgcgctctcag

SEQ ID NO: 423872 - DNA, 20 bp, mouse
gggctgctagagtgggccgc

SEQ ID NO: 423873 - DNA, 20 bp, mouse
gtaagacagattcccggtaa

SEQ ID NO: 423874 - DNA, 20 bp, mouse
gaggaggttcagctctgggt

SEQ ID NO: 423875 - DNA, 20 bp, mouse
ggccaggcaaatctgggagg

SEQ ID NO: 423876 - DNA, 20 bp, mouse
gggcccggttcactagagga

SEQ ID NO: 423877 - DNA, 20 bp, mouse
gaggagggaagaagtctaca

SEQ ID NO: 423878 - DNA, 20 bp, mouse
gaggcaggcaggaaattgat

SEQ ID NO: 423879 - DNA, 20 bp, mouse
gctttggcccggttcactag

SEQ ID NO: 423880 - DNA, 20 bp, mouse
gtgtcctgcagaggaagtga

SEQ ID NO: 423881 - DNA, 20 bp, mouse
ggagcactgcgggaaaagta

SEQ ID NO: 423882 - DNA, 20 bp, mouse
gacaagagggcatagaacct

SEQ ID NO: 423883 - DNA, 20 bp, mouse
gcagacggcatgagcactgc

SEQ ID NO: 423884 - DNA, 20 bp, mouse
gggaacttattccaagtcag

SEQ ID NO: 423885 - DNA, 20 bp, mouse
ggtcctaccttagaaataac

SEQ ID NO: 423886 - DNA, 20 bp, mouse
gtttcaaagcaagcttccca

SEQ ID NO: 423887 - DNA, 20 bp, mouse
gcgactgaagtcagctgaag

SEQ ID NO: 423888 - DNA, 20 bp, mouse
ggccttgagtgtaacccgga

SEQ ID NO: 423889 - DNA, 20 bp, mouse
gtccttccgggttacactca

SEQ ID NO: 423890 - DNA, 20 bp, mouse
gcatgatttaaagtgggtgg

SEQ ID NO: 423891 - DNA, 20 bp, mouse
gcatcccacatgatttaaag

SEQ ID NO: 423892 - DNA, 20 bp, mouse
gccacatgatttaaagtggg

SEQ ID NO: 423893 - DNA, 20 bp, mouse
gttaaagtgggtgggggaga

SEQ ID NO: 423894 - DNA, 20 bp, mouse
gtgctgaagatgcttccttc

SEQ ID NO: 423895 - DNA, 20 bp, mouse
gtgcaaagacacagcagaag

SEQ ID NO: 423896 - DNA, 20 bp, mouse
gggccatggcgaaccaggta

SEQ ID NO: 423897 - DNA, 20 bp, mouse
gagttcgggatcgagcgcta

SEQ ID NO: 423898 - DNA, 20 bp, mouse
gcacgagtgtagcggaaccc

SEQ ID NO: 423899 - DNA, 20 bp, mouse
gtgtagcggaacccgggtga

SEQ ID NO: 423900 - DNA, 20 bp, mouse
ggcgctcgatcccgaactag

SEQ ID NO: 423901 - DNA, 20 bp, mouse
gctccatacctggttcgcca

SEQ ID NO: 423902 - DNA, 20 bp, mouse
gtcgccatggccgctagttc

SEQ ID NO: 423903 - DNA, 20 bp, mouse
ggatcccgaactagcggcca

SEQ ID NO: 423904 - DNA, 20 bp, mouse
gctaaggttcacgagtgtag

SEQ ID NO: 423905 - DNA, 20 bp, mouse
gtgctccgccggagcccggt

SEQ ID NO: 423906 - DNA, 20 bp, mouse
gagtgtaacctggaagaaac

SEQ ID NO: 423907 - DNA, 20 bp, mouse
ggtgtccagggcatcctaca

SEQ ID NO: 423908 - DNA, 20 bp, mouse
gttccaaagcaagctcccca

SEQ ID NO: 423909 - DNA, 20 bp, mouse
gtgggtgcccattttccttg

SEQ ID NO: 423910 - DNA, 20 bp, mouse
ggacccagtttaaaccatgt

SEQ ID NO: 423911 - DNA, 20 bp, mouse
ggagactgaagtcaactgaa

SEQ ID NO: 423912 - DNA, 20 bp, mouse
gtcggctgccggtttcttcc

SEQ ID NO: 423913 - DNA, 20 bp, mouse
gatcctacatggtttaaact

SEQ ID NO: 423914 - DNA, 20 bp, mouse
gtctatcagcattcggctgc

SEQ ID NO: 423915 - DNA, 20 bp, mouse
gaactgggtcagggagaggg

SEQ ID NO: 423916 - DNA, 20 bp, mouse
gagctcacttacctttccca

SEQ ID NO: 423917 - DNA, 20 bp, mouse
gttattcagagaaaccacaa

SEQ ID NO: 423918 - DNA, 20 bp, mouse
gacctttcccagggtattca

SEQ ID NO: 423919 - DNA, 20 bp, mouse
gaagtcaccatgaataccct

SEQ ID NO: 423920 - DNA, 20 bp, mouse
gaccatgaataccctgggaa

SEQ ID NO: 423921 - DNA, 20 bp, mouse
gcagaatctgaaggtgacat

SEQ ID NO: 423922 - DNA, 20 bp, mouse
gcagagagcacagaatctga

SEQ ID NO: 423923 - DNA, 20 bp, mouse
gctctgaagcttagaaactt

SEQ ID NO: 423924 - DNA, 20 bp, mouse
gaaaggacacacacgaaacc

SEQ ID NO: 423925 - DNA, 20 bp, mouse
ggtattcatggtgactttcc

SEQ ID NO: 423926 - DNA, 20 bp, mouse
gtctccaactggattaatgt

SEQ ID NO: 423927 - DNA, 20 bp, mouse
gcatccaacattaatccagt

SEQ ID NO: 423928 - DNA, 20 bp, mouse
gggctcctccttgactatgt

SEQ ID NO: 423929 - DNA, 20 bp, mouse
gtgactatgtaggcagtcac

SEQ ID NO: 423930 - DNA, 20 bp, mouse
ggctttgcaggccatgacga

SEQ ID NO: 423931 - DNA, 20 bp, mouse
gcagcagatttacctgcaga

SEQ ID NO: 423932 - DNA, 20 bp, mouse
gaaggagccttccagctatg

SEQ ID NO: 423933 - DNA, 20 bp, mouse
ggaaaatctataatataatg

SEQ ID NO: 423934 - DNA, 20 bp, mouse
gactgcctacatagtcaagg

SEQ ID NO: 423935 - DNA, 20 bp, mouse
gacacagctccaaagcctgt

SEQ ID NO: 423936 - DNA, 20 bp, mouse
gcacccaggagaggcaggat

SEQ ID NO: 423937 - DNA, 20 bp, mouse
gcaggaacgtcttctgactg

SEQ ID NO: 423938 - DNA, 20 bp, mouse
ggggtgtgtggcctgcaaac

SEQ ID NO: 423939 - DNA, 20 bp, mouse
gggcaccgctggaaaagtaa

SEQ ID NO: 423940 - DNA, 20 bp, mouse
gggcacggttcactcttcta

SEQ ID NO: 423941 - DNA, 20 bp, mouse
gacacacgttggggagatgt

SEQ ID NO: 423942 - DNA, 20 bp, mouse
gccataaggagacttcaaca

SEQ ID NO: 423943 - DNA, 20 bp, mouse
ggtttcccttacttttccag

SEQ ID NO: 423944 - DNA, 20 bp, mouse
gtctcccagaaagcagggaa

SEQ ID NO: 423945 - DNA, 20 bp, mouse
gtattgaaggccgaagatgc

SEQ ID NO: 423946 - DNA, 20 bp, mouse
ggcggggttgccgagcactg

SEQ ID NO: 423947 - DNA, 20 bp, mouse
ggtggagtaggcggcgaaca

SEQ ID NO: 423948 - DNA, 20 bp, mouse
ggacagcccagggaatactg

SEQ ID NO: 423949 - DNA, 20 bp, mouse
gctgagactacaacagggaa

SEQ ID NO: 423950 - DNA, 20 bp, mouse
gtactcacgctgtgctttgt

SEQ ID NO: 423951 - DNA, 20 bp, mouse
gtgagtacaggctgcactga

SEQ ID NO: 423952 - DNA, 20 bp, mouse
gctgggcaggcagtcatcat

SEQ ID NO: 423953 - DNA, 20 bp, mouse
gtgtggcccagctaccacta

SEQ ID NO: 423954 - DNA, 20 bp, mouse
gctctggaagatctccttag

SEQ ID NO: 423955 - DNA, 20 bp, mouse
gccggattggctgttagtgg

SEQ ID NO: 423956 - DNA, 20 bp, mouse
gatggtgcaggcctggtata

SEQ ID NO: 423957 - DNA, 20 bp, mouse
ggccccttccagccagttag

SEQ ID NO: 423958 - DNA, 20 bp, mouse
gggcttccgcgggtcggcgg

SEQ ID NO: 423959 - DNA, 20 bp, mouse
ggtggactcgtccatatacc

SEQ ID NO: 423960 - DNA, 20 bp, mouse
gtggggcttccgcgggtcgg

SEQ ID NO: 423961 - DNA, 20 bp, mouse
gcgagtccaccgccgacccg

SEQ ID NO: 423962 - DNA, 20 bp, mouse
gccaggctcacggggcggtc

SEQ ID NO: 423963 - DNA, 20 bp, mouse
gcacccggcccaccccgtca

SEQ ID NO: 423964 - DNA, 20 bp, mouse
gcggtggggcttccgcgggt

SEQ ID NO: 423965 - DNA, 20 bp, mouse
gtgcgcggtggggcttccgc

SEQ ID NO: 423966 - DNA, 20 bp, mouse
gccacctggattcagcggga

SEQ ID NO: 423967 - DNA, 20 bp, mouse
gcgctcaccagaggcaccag

SEQ ID NO: 423968 - DNA, 20 bp, mouse
gcggggccacctggattcag

SEQ ID NO: 423969 - DNA, 20 bp, mouse
ggtgtgaggtcgctcaccag

SEQ ID NO: 423970 - DNA, 20 bp, mouse
ggccaagctgacaggtcttc

SEQ ID NO: 423971 - DNA, 20 bp, mouse
ggcatacctggggccctgcg

SEQ ID NO: 423972 - DNA, 20 bp, mouse
gcagagagagcctacagggg

SEQ ID NO: 423973 - DNA, 20 bp, mouse
ggaatccaggtggccccgca

SEQ ID NO: 423974 - DNA, 20 bp, mouse
gtatgcgatgaagtaccctc

SEQ ID NO: 423975 - DNA, 20 bp, mouse
gggctggctgaaagacactc

SEQ ID NO: 423976 - DNA, 20 bp, mouse
gtggatctgacgacaccaaa

SEQ ID NO: 423977 - DNA, 20 bp, mouse
gctgtctgtacgattgtcag

SEQ ID NO: 423978 - DNA, 20 bp, mouse
gtgaatgcagaatcccactt

SEQ ID NO: 423979 - DNA, 20 bp, mouse
gacagggcaaacttccggtt

SEQ ID NO: 423980 - DNA, 20 bp, mouse
gaatcgtacagacagaaatg

SEQ ID NO: 423981 - DNA, 20 bp, mouse
gctcaagcttgtggaccgaa

SEQ ID NO: 423982 - DNA, 20 bp, mouse
gacctcaactggacttcctc

SEQ ID NO: 423983 - DNA, 20 bp, mouse
ggcccgaggaagtccagttg

SEQ ID NO: 423984 - DNA, 20 bp, mouse
gtggagatagtgaggtagga

SEQ ID NO: 423985 - DNA, 20 bp, mouse
gtcctgccatcaaatgaaca

SEQ ID NO: 423986 - DNA, 20 bp, mouse
gcgggcagggcgctgaggat

SEQ ID NO: 423987 - DNA, 20 bp, mouse
ggcggtgagcgacgatccag

SEQ ID NO: 423988 - DNA, 20 bp, mouse
gcggcgagcagccccccgaa

SEQ ID NO: 423989 - DNA, 20 bp, mouse
ggcccgggcgctacatcccg

SEQ ID NO: 423990 - DNA, 20 bp, mouse
gcgccctgcccgcgccggaa

SEQ ID NO: 423991 - DNA, 20 bp, mouse
gcgagcagccccccgaacgg

SEQ ID NO: 423992 - DNA, 20 bp, mouse
gtagcgccgggaaggtgacg

SEQ ID NO: 423993 - DNA, 20 bp, mouse
gctacatcccgcggcactgg

SEQ ID NO: 423994 - DNA, 20 bp, mouse
ggaggcggcctgcggccgag

SEQ ID NO: 423995 - DNA, 20 bp, mouse
ggaagggccgcgcgaccgca

SEQ ID NO: 423996 - DNA, 20 bp, mouse
gcacacaacacaagaatccg

SEQ ID NO: 423997 - DNA, 20 bp, mouse
gcagcagtaccctcagactc

SEQ ID NO: 423998 - DNA, 20 bp, mouse
gtctggtctacaactctgac

SEQ ID NO: 423999 - DNA, 20 bp, mouse
gcacatcaatggaggagggt

SEQ ID NO: 424000 - DNA, 20 bp, mouse
gatgtcacatcaatggagga

SEQ ID NO: 424001 - DNA, 20 bp, mouse
ggtgtggaaagacttgcacc

SEQ ID NO: 424002 - DNA, 20 bp, mouse
gatgctttaactggaccctg

SEQ ID NO: 424003 - DNA, 20 bp, mouse
gtgagaacacggaagagaaa

SEQ ID NO: 424004 - DNA, 20 bp, mouse
gggggttcatgtcacatcaa

SEQ ID NO: 424005 - DNA, 20 bp, mouse
ggatgtgacatgaacccctc

SEQ ID NO: 424006 - DNA, 20 bp, mouse
gcagtcccgacgcggtaccg

SEQ ID NO: 424007 - DNA, 20 bp, mouse
gcgcgagcacagtcccgacg

SEQ ID NO: 424008 - DNA, 20 bp, mouse
gcgacgcggtaccgcggtgg

SEQ ID NO: 424009 - DNA, 20 bp, mouse
gcccgggtcggaaggaggtg

SEQ ID NO: 424010 - DNA, 20 bp, mouse
ggattgcccgggtcggaagg

SEQ ID NO: 424011 - DNA, 20 bp, mouse
ggtgagacggccgctaactc

SEQ ID NO: 424012 - DNA, 20 bp, mouse
gtggtgcggggcccaagcag

SEQ ID NO: 424013 - DNA, 20 bp, mouse
ggggaagcagcgcctcgggg

SEQ ID NO: 424014 - DNA, 20 bp, mouse
gcgactagagacggagcgag

SEQ ID NO: 424015 - DNA, 20 bp, mouse
gcggccggaactctgacctg

SEQ ID NO: 424016 - DNA, 20 bp, mouse
gagctagggagcagttgctg

SEQ ID NO: 424017 - DNA, 20 bp, mouse
gtagctctggcactcagcgt

SEQ ID NO: 424018 - DNA, 20 bp, mouse
gcccgcgcgcggggtgtgta

SEQ ID NO: 424019 - DNA, 20 bp, mouse
gtgtggtacctactgctacc

SEQ ID NO: 424020 - DNA, 20 bp, mouse
ggaggctctagacctaggga

SEQ ID NO: 424021 - DNA, 20 bp, mouse
ggctgcggtgcgggacgggt

SEQ ID NO: 424022 - DNA, 20 bp, mouse
gaaagggaggctctagacct

SEQ ID NO: 424023 - DNA, 20 bp, mouse
gccccacagtgggtcgatgg

SEQ ID NO: 424024 - DNA, 20 bp, mouse
ggaccctggaatctgagcaa

SEQ ID NO: 424025 - DNA, 20 bp, mouse
ggaaccagtgagaagtgtga

SEQ ID NO: 424026 - DNA, 20 bp, mouse
ggcgcggcagagccaaacta

SEQ ID NO: 424027 - DNA, 20 bp, mouse
gtgagagctgccctacgtgg

SEQ ID NO: 424028 - DNA, 20 bp, mouse
gaagcccaaaaagctcaagg

SEQ ID NO: 424029 - DNA, 20 bp, mouse
gagaacaagagggcactgag

SEQ ID NO: 424030 - DNA, 20 bp, mouse
ggcggggccaccggactgag

SEQ ID NO: 424031 - DNA, 20 bp, mouse
gagcagagtccagaacaaga

SEQ ID NO: 424032 - DNA, 20 bp, mouse
gagtgagccaaggcccacgt

SEQ ID NO: 424033 - DNA, 20 bp, mouse
gggaagcgccacaagcgctg

SEQ ID NO: 424034 - DNA, 20 bp, mouse
ggactgaggggcgggacgcg

SEQ ID NO: 424035 - DNA, 20 bp, mouse
gcagctgcgccagcccacgt

SEQ ID NO: 424036 - DNA, 20 bp, mouse
gaagccgagaaaccaggagc

SEQ ID NO: 424037 - DNA, 20 bp, mouse
gcctccagcatgttagggag

SEQ ID NO: 424038 - DNA, 20 bp, mouse
gggagcgggagcggtaacgc

SEQ ID NO: 424039 - DNA, 20 bp, mouse
ggccgggtgggtgacaagca

SEQ ID NO: 424040 - DNA, 20 bp, mouse
gcactggcgcagagaaacac

SEQ ID NO: 424041 - DNA, 20 bp, mouse
ggcggttcctacctgataaa

SEQ ID NO: 424042 - DNA, 20 bp, mouse
gcggccagcgcaaaaatctc

SEQ ID NO: 424043 - DNA, 20 bp, mouse
ggctggcctccagcatgtta

SEQ ID NO: 424044 - DNA, 20 bp, mouse
gggatctcagcccaaggagg

SEQ ID NO: 424045 - DNA, 20 bp, mouse
gacattggataccctaaagt

SEQ ID NO: 424046 - DNA, 20 bp, mouse
gagcacgcaacggaacttgt

SEQ ID NO: 424047 - DNA, 20 bp, mouse
gcagttcccagagcacgcaa

SEQ ID NO: 424048 - DNA, 20 bp, mouse
gggtcaggtcgtggtctcct

SEQ ID NO: 424049 - DNA, 20 bp, mouse
ggaacttgtgggtcaggtcg

SEQ ID NO: 424050 - DNA, 20 bp, mouse
ggaagggctccccaactggt

SEQ ID NO: 424051 - DNA, 20 bp, mouse
gagagccttctggggtccag

SEQ ID NO: 424052 - DNA, 20 bp, mouse
gactggtgggcaaagagggt

SEQ ID NO: 424053 - DNA, 20 bp, mouse
gtccagcggaaaaccagttt

SEQ ID NO: 424054 - DNA, 20 bp, mouse
gcgtgccggggagcaggtag

SEQ ID NO: 424055 - DNA, 20 bp, mouse
gctaggaaagagagccttct

SEQ ID NO: 424056 - DNA, 20 bp, mouse
ggccgtcatggcttccacgg

SEQ ID NO: 424057 - DNA, 20 bp, mouse
ggcctctcgcagagccgtca

SEQ ID NO: 424058 - DNA, 20 bp, mouse
ggcgaggagcggccctgcgg

SEQ ID NO: 424059 - DNA, 20 bp, mouse
gagagccgtcatggcttcca

SEQ ID NO: 424060 - DNA, 20 bp, mouse
ggccatgacggctctgcgag

SEQ ID NO: 424061 - DNA, 20 bp, mouse
gagactgcgactcgcccccg

SEQ ID NO: 424062 - DNA, 20 bp, mouse
ggccgcgagcaggctcggga

SEQ ID NO: 424063 - DNA, 20 bp, mouse
ggtcgcgaggagcggccctg

SEQ ID NO: 424064 - DNA, 20 bp, mouse
ggagcaggctcgggagggag

SEQ ID NO: 424065 - DNA, 20 bp, mouse
gcttctccgagaggtagaag

SEQ ID NO: 424066 - DNA, 20 bp, mouse
gtgtctgctgaggggagacg

SEQ ID NO: 424067 - DNA, 20 bp, mouse
gggttcggggacttgctctg

SEQ ID NO: 424068 - DNA, 20 bp, mouse
gggcggcggagaccgagaga

SEQ ID NO: 424069 - DNA, 20 bp, mouse
gcggccgcgcggctcctcgg

SEQ ID NO: 424070 - DNA, 20 bp, mouse
ggcttgtattgtctgctgag

SEQ ID NO: 424071 - DNA, 20 bp, mouse
gcctgccctagccaaaatgg

SEQ ID NO: 424072 - DNA, 20 bp, mouse
gggcggcgggtagaccggac

SEQ ID NO: 424073 - DNA, 20 bp, mouse
gtttggctagggcaggttcg

SEQ ID NO: 424074 - DNA, 20 bp, mouse
gaccggacgggtggcggcgg

SEQ ID NO: 424075 - DNA, 20 bp, mouse
gaatggcggccgagaaagag

SEQ ID NO: 424076 - DNA, 20 bp, mouse
ggacagcgctagggacgtcg

SEQ ID NO: 424077 - DNA, 20 bp, mouse
ggcgcgccagaaagagaaga

SEQ ID NO: 424078 - DNA, 20 bp, mouse
ggcgtcctccgcctacgcgg

SEQ ID NO: 424079 - DNA, 20 bp, mouse
gggcgcgacaggccacagtg

SEQ ID NO: 424080 - DNA, 20 bp, mouse
ggccgcgtcctccgcctacg

SEQ ID NO: 424081 - DNA, 20 bp, mouse
ggaaggcgcggaggtagcga

SEQ ID NO: 424082 - DNA, 20 bp, mouse
ggaggcgacgtcacttcctg

SEQ ID NO: 424083 - DNA, 20 bp, mouse
ggggcggacccaggagtgga

SEQ ID NO: 424084 - DNA, 20 bp, mouse
gagcgctagggacgtcgggg

SEQ ID NO: 424085 - DNA, 20 bp, mouse
gagaaggtccgggattccga

SEQ ID NO: 424086 - DNA, 20 bp, mouse
gagcgggcgaccgtgcaagg

SEQ ID NO: 424087 - DNA, 20 bp, mouse
gcgggcaagcgcccgaccat

SEQ ID NO: 424088 - DNA, 20 bp, mouse
gcgaccattggcgcgctaag

SEQ ID NO: 424089 - DNA, 20 bp, mouse
ggcgatgcgctggatcaggg

SEQ ID NO: 424090 - DNA, 20 bp, mouse
gcgcgcggggccgccttgca

SEQ ID NO: 424091 - DNA, 20 bp, mouse
gccgcaacaaccggccagcg

SEQ ID NO: 424092 - DNA, 20 bp, mouse
gaggcgtgtctcaccttccg

SEQ ID NO: 424093 - DNA, 20 bp, mouse
gcgccggagaccgcaagggg

SEQ ID NO: 424094 - DNA, 20 bp, mouse
ggagacctccccgcaacaac

SEQ ID NO: 424095 - DNA, 20 bp, mouse
gggccgccggagaccgcaag

SEQ ID NO: 424096 - DNA, 20 bp, mouse
ggagccgcgccgggcagggt

SEQ ID NO: 424097 - DNA, 20 bp, mouse
gaagccgcccggggaactta

SEQ ID NO: 424098 - DNA, 20 bp, mouse
gccgggcagggttgggttct

SEQ ID NO: 424099 - DNA, 20 bp, mouse
ggcgttgccctaagttcccc

SEQ ID NO: 424100 - DNA, 20 bp, mouse
gggccgggctgggagcgcag

SEQ ID NO: 424101 - DNA, 20 bp, mouse
gaacccaaccctgcccggcg

SEQ ID NO: 424102 - DNA, 20 bp, mouse
gttgccctaagttccccggg

SEQ ID NO: 424103 - DNA, 20 bp, mouse
gagcggcgtcccaggtgggt

SEQ ID NO: 424104 - DNA, 20 bp, mouse
gaaccggtagggggtcccaa

SEQ ID NO: 424105 - DNA, 20 bp, mouse
ggccagccgagactccactc

SEQ ID NO: 424106 - DNA, 20 bp, mouse
ggagcggtcgctgagacggt

SEQ ID NO: 424107 - DNA, 20 bp, mouse
ggcccgagcggtcgctgaga

SEQ ID NO: 424108 - DNA, 20 bp, mouse
gtgcagggtgcgcccatgag

SEQ ID NO: 424109 - DNA, 20 bp, mouse
gagcaagaggcaggtcagcg

SEQ ID NO: 424110 - DNA, 20 bp, mouse
gggaggaaggggctcgagta

SEQ ID NO: 424111 - DNA, 20 bp, mouse
gaccgctcccgaagtggcca

SEQ ID NO: 424112 - DNA, 20 bp, mouse
ggcccacccgaaaaccccca

SEQ ID NO: 424113 - DNA, 20 bp, mouse
gccgcgcggcgacaaatcga

SEQ ID NO: 424114 - DNA, 20 bp, mouse
ggcgggtctagacgactgta

SEQ ID NO: 424115 - DNA, 20 bp, mouse
ggcgaccggaaagtgctcaa

SEQ ID NO: 424116 - DNA, 20 bp, mouse
ggggctcaggacagctgcta

SEQ ID NO: 424117 - DNA, 20 bp, mouse
gcccggggagtcctctactg

SEQ ID NO: 424118 - DNA, 20 bp, mouse
gcagctgctagggtgccgcc

SEQ ID NO: 424119 - DNA, 20 bp, mouse
gtcctctactggggtagtgt

SEQ ID NO: 424120 - DNA, 20 bp, mouse
gcccgacactaccccagtag

SEQ ID NO: 424121 - DNA, 20 bp, mouse
ggcttctgcacggacttcca

SEQ ID NO: 424122 - DNA, 20 bp, mouse
gaccccagtagaggactccc

SEQ ID NO: 424123 - DNA, 20 bp, mouse
gagaccgcgcgtcccaagct

SEQ ID NO: 424124 - DNA, 20 bp, mouse
ggcactcgaggctcccaccg

SEQ ID NO: 424125 - DNA, 20 bp, mouse
gacgcgcggtctcagcgctg

SEQ ID NO: 424126 - DNA, 20 bp, mouse
gaatgtgctaacattaacac

SEQ ID NO: 424127 - DNA, 20 bp, mouse
gatgtggagagctctgtatt

SEQ ID NO: 424128 - DNA, 20 bp, mouse
gagacttcatcaagcacatg

SEQ ID NO: 424129 - DNA, 20 bp, mouse
gtccctctaggtctaggatc

SEQ ID NO: 424130 - DNA, 20 bp, mouse
gtcagagagattgggttcgg

SEQ ID NO: 424131 - DNA, 20 bp, mouse
ggaagtgaatgatcagagtt

SEQ ID NO: 424132 - DNA, 20 bp, mouse
gctgacaagcccaagatggg

SEQ ID NO: 424133 - DNA, 20 bp, mouse
gtcctgatcctagacctaga

SEQ ID NO: 424134 - DNA, 20 bp, mouse
gtgggcttgtcagagagatt

SEQ ID NO: 424135 - DNA, 20 bp, mouse
gtcccagcacttgatggcca

SEQ ID NO: 424136 - DNA, 20 bp, mouse
ggatcctgtagccaccggtg

SEQ ID NO: 424137 - DNA, 20 bp, mouse
gaggaggcgcgagccgagaa

SEQ ID NO: 424138 - DNA, 20 bp, mouse
ggcacacaccgccgcaccgg

SEQ ID NO: 424139 - DNA, 20 bp, mouse
gagcaggaacacgcagccca

SEQ ID NO: 424140 - DNA, 20 bp, mouse
gcctgtagccaccggtgcgg

SEQ ID NO: 424141 - DNA, 20 bp, mouse
gtgcacatggcgctgtggcg

SEQ ID NO: 424142 - DNA, 20 bp, mouse
gcacgcgcccagctgggagg

SEQ ID NO: 424143 - DNA, 20 bp, mouse
ggcgatgagggcgtcccaag

SEQ ID NO: 424144 - DNA, 20 bp, mouse
ggcagcccacggccagcgcc

SEQ ID NO: 424145 - DNA, 20 bp, mouse
gtgtgcacacaccgccgcac

SEQ ID NO: 424146 - DNA, 20 bp, mouse
ggagctggaggcggggtacc

SEQ ID NO: 424147 - DNA, 20 bp, mouse
gggattgcccgagctggagg

SEQ ID NO: 424148 - DNA, 20 bp, mouse
gcggggtggtccagagccga

SEQ ID NO: 424149 - DNA, 20 bp, mouse
gcaagccaaaagccgaacag

SEQ ID NO: 424150 - DNA, 20 bp, mouse
gtcctggcctgggtagaaag

SEQ ID NO: 424151 - DNA, 20 bp, mouse
ggccaaaagccgaacagggg

SEQ ID NO: 424152 - DNA, 20 bp, mouse
ggtggtccagagccgagggc

SEQ ID NO: 424153 - DNA, 20 bp, mouse
gccgcggctccgcccctgtt

SEQ ID NO: 424154 - DNA, 20 bp, mouse
gaggcggagctgagagcgtg

SEQ ID NO: 424155 - DNA, 20 bp, mouse
gagggcaggattgcccgagc

SEQ ID NO: 424156 - DNA, 20 bp, mouse
gggcaaccgcagggtaagag

SEQ ID NO: 424157 - DNA, 20 bp, mouse
gtccaagatggagaagttca

SEQ ID NO: 424158 - DNA, 20 bp, mouse
ggaggacaaaggcaaccgca

SEQ ID NO: 424159 - DNA, 20 bp, mouse
gtgaagccctgaccacaggt

SEQ ID NO: 424160 - DNA, 20 bp, mouse
gggtgacccctcttaccctg

SEQ ID NO: 424161 - DNA, 20 bp, mouse
ggaggggtcaccttccaaga

SEQ ID NO: 424162 - DNA, 20 bp, mouse
gccttgtgctctcacctggg

SEQ ID NO: 424163 - DNA, 20 bp, mouse
ggggctggctaagggtggcc

SEQ ID NO: 424164 - DNA, 20 bp, mouse
ggaggagctgcaaaagacag

SEQ ID NO: 424165 - DNA, 20 bp, mouse
gcgccagtcagtcctacctg

SEQ ID NO: 424166 - DNA, 20 bp, mouse
ggcagctacagcgatgtcgg

SEQ ID NO: 424167 - DNA, 20 bp, mouse
ggtccgcgcgcggatggcgg

SEQ ID NO: 424168 - DNA, 20 bp, mouse
ggcagcagctacagcgatgt

SEQ ID NO: 424169 - DNA, 20 bp, mouse
ggaagagacgaccaaagagg

SEQ ID NO: 424170 - DNA, 20 bp, mouse
ggcagcatcgatgccggaag

SEQ ID NO: 424171 - DNA, 20 bp, mouse
gctagtccgcgcgcggatgg

SEQ ID NO: 424172 - DNA, 20 bp, mouse
gagagcctggagccggaccc

SEQ ID NO: 424173 - DNA, 20 bp, mouse
gtcggaagcgcgagatggag

SEQ ID NO: 424174 - DNA, 20 bp, mouse
ggggcagcgcgcggacaggt

SEQ ID NO: 424175 - DNA, 20 bp, mouse
gcgatcgggtccccacccct

SEQ ID NO: 424176 - DNA, 20 bp, mouse
gcgggtccggcggctgatag

SEQ ID NO: 424177 - DNA, 20 bp, mouse
gtgtggaggagtcccgggtc

SEQ ID NO: 424178 - DNA, 20 bp, mouse
gggactcctccacaaccaga

SEQ ID NO: 424179 - DNA, 20 bp, mouse
gggaggagtcccgggtccgg

SEQ ID NO: 424180 - DNA, 20 bp, mouse
gtccggcggctgatagcggt

SEQ ID NO: 424181 - DNA, 20 bp, mouse
gcccagctgcaagggactag

SEQ ID NO: 424182 - DNA, 20 bp, mouse
gttctgccggaagccgaagg

SEQ ID NO: 424183 - DNA, 20 bp, mouse
gaacccggctagaagaccca

SEQ ID NO: 424184 - DNA, 20 bp, mouse
ggcgtcaccaacgagccaag

SEQ ID NO: 424185 - DNA, 20 bp, mouse
gttagaccgggcagtaggaa

SEQ ID NO: 424186 - DNA, 20 bp, mouse
gtcctggacacagaaaagag

SEQ ID NO: 424187 - DNA, 20 bp, mouse
ggaatcgaggctaagtccag

SEQ ID NO: 424188 - DNA, 20 bp, mouse
gcaggaactgaatatcaaac

SEQ ID NO: 424189 - DNA, 20 bp, mouse
ggctcgggttgacgtagtac

SEQ ID NO: 424190 - DNA, 20 bp, mouse
gaagcgagcccggagtttga

SEQ ID NO: 424191 - DNA, 20 bp, mouse
gagggctctgcgaggactga

SEQ ID NO: 424192 - DNA, 20 bp, mouse
gcagcaggtgagtagcgcag

SEQ ID NO: 424193 - DNA, 20 bp, mouse
ggtcagcgggtgctaaggac

SEQ ID NO: 424194 - DNA, 20 bp, mouse
gagaaccagagggctctgcg

SEQ ID NO: 424195 - DNA, 20 bp, mouse
gggtgagtcagcgggtgcta

SEQ ID NO: 424196 - DNA, 20 bp, mouse
gcgccgtgcagtcagcccag

SEQ ID NO: 424197 - DNA, 20 bp, mouse
ggtcgcctgcctgcacccag

SEQ ID NO: 424198 - DNA, 20 bp, mouse
gctgggcggagaaggcaccg

SEQ ID NO: 424199 - DNA, 20 bp, mouse
gcgcgatcgctgggcggaga

SEQ ID NO: 424200 - DNA, 20 bp, mouse
gcgcccagcgatcgcgagga

SEQ ID NO: 424201 - DNA, 20 bp, mouse
gcggctcgctcgcctgtcag

SEQ ID NO: 424202 - DNA, 20 bp, mouse
ggcctctggaaagaagacca

SEQ ID NO: 424203 - DNA, 20 bp, mouse
ggcggcgggtctacggaccg

SEQ ID NO: 424204 - DNA, 20 bp, mouse
ggcgagaagtcatctccccc

SEQ ID NO: 424205 - DNA, 20 bp, mouse
ggaccctcctcgcgatcgct

SEQ ID NO: 424206 - DNA, 20 bp, mouse
gccaggacacgcttggagag

SEQ ID NO: 424207 - DNA, 20 bp, mouse
gagcgtgtcctggcgagcgg

SEQ ID NO: 424208 - DNA, 20 bp, mouse
gcctgcactgacgctcccgg

SEQ ID NO: 424209 - DNA, 20 bp, mouse
gccctctgccgcgggaactt

SEQ ID NO: 424210 - DNA, 20 bp, mouse
gccaagcgtgtcctggcgag

SEQ ID NO: 424211 - DNA, 20 bp, mouse
gcaggccgtgaaggtcccaa

SEQ ID NO: 424212 - DNA, 20 bp, mouse
gggagcgtcagtgcaggcgg

SEQ ID NO: 424213 - DNA, 20 bp, mouse
ggggagcagggagccggccc

SEQ ID NO: 424214 - DNA, 20 bp, mouse
gcaacgggaacgggctctgg

SEQ ID NO: 424215 - DNA, 20 bp, mouse
gggcgagcggtggctcctcc

SEQ ID NO: 424216 - DNA, 20 bp, mouse
gtggagctggaggcgctggg

SEQ ID NO: 424217 - DNA, 20 bp, mouse
gccagtccagcgtagagcgg

SEQ ID NO: 424218 - DNA, 20 bp, mouse
gcccgtggggctcctagagg

SEQ ID NO: 424219 - DNA, 20 bp, mouse
gtgcacggaagcgggagccg

SEQ ID NO: 424220 - DNA, 20 bp, mouse
gctggaggcgctgggtggct

SEQ ID NO: 424221 - DNA, 20 bp, mouse
ggccctgaggaccgaggtgg

SEQ ID NO: 424222 - DNA, 20 bp, mouse
gggagccgcggcggagccaa

SEQ ID NO: 424223 - DNA, 20 bp, mouse
gttcgcaggaccgcaggact

SEQ ID NO: 424224 - DNA, 20 bp, mouse
gagcttggccctgaggaccg

SEQ ID NO: 424225 - DNA, 20 bp, mouse
gtagagcggcggagcagcct

SEQ ID NO: 424226 - DNA, 20 bp, mouse
gggactcacagaaccgactg

SEQ ID NO: 424227 - DNA, 20 bp, mouse
gcagggacgccgggcaccag

SEQ ID NO: 424228 - DNA, 20 bp, mouse
gcgcaccctgctctcggtaa

SEQ ID NO: 424229 - DNA, 20 bp, mouse
gcggtaaaggcgctctctcc

SEQ ID NO: 424230 - DNA, 20 bp, mouse
gggagggctgactgcaggcg

SEQ ID NO: 424231 - DNA, 20 bp, mouse
gtgcgcggagggctgactgc

SEQ ID NO: 424232 - DNA, 20 bp, mouse
ggggaagcgcaccctgctct

SEQ ID NO: 424233 - DNA, 20 bp, mouse
gcagggtgcgcttccccagt

SEQ ID NO: 424234 - DNA, 20 bp, mouse
gcggacctccggccaggcta

SEQ ID NO: 424235 - DNA, 20 bp, mouse
gtgactgcaggcgcggctcc

SEQ ID NO: 424236 - DNA, 20 bp, mouse
ggccgcctagggctcctccc

SEQ ID NO: 424237 - DNA, 20 bp, mouse
ggccggggaggagccctagg

SEQ ID NO: 424238 - DNA, 20 bp, mouse
ggcctgggcgaacctgccgg

SEQ ID NO: 424239 - DNA, 20 bp, mouse
ggccgcctgggcgaacctgc

SEQ ID NO: 424240 - DNA, 20 bp, mouse
ggccgaacgcggaccttggg

SEQ ID NO: 424241 - DNA, 20 bp, mouse
ggccgccggcaggttcgccc

SEQ ID NO: 424242 - DNA, 20 bp, mouse
gcgcctgtaaccgagtgagg

SEQ ID NO: 424243 - DNA, 20 bp, mouse
gacggtccgggtgcccgact

SEQ ID NO: 424244 - DNA, 20 bp, mouse
gtgcgccaagcgctccgcgg

SEQ ID NO: 424245 - DNA, 20 bp, mouse
gcgccctgcgccgccgccta

SEQ ID NO: 424246 - DNA, 20 bp, mouse
ggctcttccagcagcgacag

SEQ ID NO: 424247 - DNA, 20 bp, mouse
gaaacatgctgaggtcccgg

SEQ ID NO: 424248 - DNA, 20 bp, mouse
gggaggtcgcggccaggtca

SEQ ID NO: 424249 - DNA, 20 bp, mouse
gagacagcgctcggctacgg

SEQ ID NO: 424250 - DNA, 20 bp, mouse
gcgctcggctacggaggaga

SEQ ID NO: 424251 - DNA, 20 bp, mouse
gctggagccgctgtcgctgc

SEQ ID NO: 424252 - DNA, 20 bp, mouse
gcgctgctggaagagccgcc

SEQ ID NO: 424253 - DNA, 20 bp, mouse
gggcctccgcagctcggcat

SEQ ID NO: 424254 - DNA, 20 bp, mouse
gagcagtaggcccatacccg

SEQ ID NO: 424255 - DNA, 20 bp, mouse
gcggtccactgctgcgacag

SEQ ID NO: 424256 - DNA, 20 bp, mouse
gtcctgcacactcagctcgt

SEQ ID NO: 424257 - DNA, 20 bp, mouse
ggccgtaggtggctgtgctg

SEQ ID NO: 424258 - DNA, 20 bp, mouse
gaccccagcacagccaccta

SEQ ID NO: 424259 - DNA, 20 bp, mouse
gactcagctcgtgggtgctc

SEQ ID NO: 424260 - DNA, 20 bp, mouse
gacgggcagggcgcactgca

SEQ ID NO: 424261 - DNA, 20 bp, mouse
gcgtgggtgctccgggctcg

SEQ ID NO: 424262 - DNA, 20 bp, mouse
ggcacccgctgagagcgcct

SEQ ID NO: 424263 - DNA, 20 bp, mouse
gacccacgagctgagtgtgc

SEQ ID NO: 424264 - DNA, 20 bp, mouse
gttcattcagcggccgtagg

SEQ ID NO: 424265 - DNA, 20 bp, mouse
gacttcttgctggcacccaa

SEQ ID NO: 424266 - DNA, 20 bp, mouse
gcttagggaaggggacagta

SEQ ID NO: 424267 - DNA, 20 bp, mouse
gagacccgctggcttaggga

SEQ ID NO: 424268 - DNA, 20 bp, mouse
gtaagccagcgggtctgggg

SEQ ID NO: 424269 - DNA, 20 bp, mouse
gccaggagtaccatgggcag

SEQ ID NO: 424270 - DNA, 20 bp, mouse
gacatggggggtgagatgga

SEQ ID NO: 424271 - DNA, 20 bp, mouse
ggcaactagggtgtacatgg

SEQ ID NO: 424272 - DNA, 20 bp, mouse
gagacttaccccagcaatta

SEQ ID NO: 424273 - DNA, 20 bp, mouse
gccctagttgccgggaggag

SEQ ID NO: 424274 - DNA, 20 bp, mouse
gccctcctccccagacccgc

SEQ ID NO: 424275 - DNA, 20 bp, mouse
gccccagcaattagggaaga

SEQ ID NO: 424276 - DNA, 20 bp, mouse
gccgagccggcgccatgggg

SEQ ID NO: 424277 - DNA, 20 bp, mouse
ggccatcaggtagctcacat

SEQ ID NO: 424278 - DNA, 20 bp, mouse
gaagatggccgacctggagg

SEQ ID NO: 424279 - DNA, 20 bp, mouse
gcccgccgggactgcagtcg

SEQ ID NO: 424280 - DNA, 20 bp, mouse
ggcgccagcgagccgccgag

SEQ ID NO: 424281 - DNA, 20 bp, mouse
gaccacaagggaacacgaga

SEQ ID NO: 424282 - DNA, 20 bp, mouse
gctcgtcgccggctcacagg

SEQ ID NO: 424283 - DNA, 20 bp, mouse
gcctagggcacgggatcccg

SEQ ID NO: 424284 - DNA, 20 bp, mouse
ggccccgactgcagtcccgg

SEQ ID NO: 424285 - DNA, 20 bp, mouse
ggccggcgacgagcgaggac

SEQ ID NO: 424286 - DNA, 20 bp, mouse
ggcgcgccgtggccccgtcg

SEQ ID NO: 424287 - DNA, 20 bp, mouse
ggcctccaggtccgccatgg

SEQ ID NO: 424288 - DNA, 20 bp, mouse
gacggcctccaggtccgcca

SEQ ID NO: 424289 - DNA, 20 bp, mouse
ggccatcaggtagctgacgt

SEQ ID NO: 424290 - DNA, 20 bp, mouse
gagctgcggagccgccatgg

SEQ ID NO: 424291 - DNA, 20 bp, mouse
ggagggccagagcagtacct

SEQ ID NO: 424292 - DNA, 20 bp, mouse
ggaccaggagggatccggaa

SEQ ID NO: 424293 - DNA, 20 bp, mouse
gcgggcggaccagaaaagga

SEQ ID NO: 424294 - DNA, 20 bp, mouse
gctgggacagcgggacggag

SEQ ID NO: 424295 - DNA, 20 bp, mouse
gaaccgaaggagactggata

SEQ ID NO: 424296 - DNA, 20 bp, mouse
gcggcctaggggcaccgtcc

SEQ ID NO: 424297 - DNA, 20 bp, mouse
gggcccggcaggcgccgagg

SEQ ID NO: 424298 - DNA, 20 bp, mouse
ggaggaagagcgagcccgga

SEQ ID NO: 424299 - DNA, 20 bp, mouse
gccaccgggcccctacctgg

SEQ ID NO: 424300 - DNA, 20 bp, mouse
gccgccaccgggcccctacc

SEQ ID NO: 424301 - DNA, 20 bp, mouse
ggtgtgagcaccgccaggta

SEQ ID NO: 424302 - DNA, 20 bp, mouse
gcgaggcccggcaggcgccg

SEQ ID NO: 424303 - DNA, 20 bp, mouse
gcgggctcgctcttcctcct

SEQ ID NO: 424304 - DNA, 20 bp, mouse
ggagcccggacggtgcccct

SEQ ID NO: 424305 - DNA, 20 bp, mouse
gagcgaggctccctccgcac

SEQ ID NO: 424306 - DNA, 20 bp, mouse
gtcaacacgcgaccaggacg

SEQ ID NO: 424307 - DNA, 20 bp, mouse
gacacgcgaccaggacgcgg

SEQ ID NO: 424308 - DNA, 20 bp, mouse
gtggctgcatccggcgaccc

SEQ ID NO: 424309 - DNA, 20 bp, mouse
gcctggtcgcgtgttgaaaa

SEQ ID NO: 424310 - DNA, 20 bp, mouse
gtcagcactgccagggtcgc

SEQ ID NO: 424311 - DNA, 20 bp, mouse
gagcagggccaaaagcggaa

SEQ ID NO: 424312 - DNA, 20 bp, mouse
gcttgtcccgagggaggtca

SEQ ID NO: 424313 - DNA, 20 bp, mouse
ggctggtgtccgccgcgtcc

SEQ ID NO: 424314 - DNA, 20 bp, mouse
gccagcagcagggccaaaag

SEQ ID NO: 424315 - DNA, 20 bp, mouse
gtggcgtagcgggccgccag

SEQ ID NO: 424316 - DNA, 20 bp, mouse
ggaagagccttaaggagacg

SEQ ID NO: 424317 - DNA, 20 bp, mouse
gctgctctcggagatcgaca

SEQ ID NO: 424318 - DNA, 20 bp, mouse
gatcgacatggctcccggca

SEQ ID NO: 424319 - DNA, 20 bp, mouse
gagcgtcaccggagactcca

SEQ ID NO: 424320 - DNA, 20 bp, mouse
ggagcgcagtggggcgacga

SEQ ID NO: 424321 - DNA, 20 bp, mouse
gctccgcatgtggctggtgg

SEQ ID NO: 424322 - DNA, 20 bp, mouse
gtggtggcggcgcagcagtt

SEQ ID NO: 424323 - DNA, 20 bp, mouse
gctcctgccccgtctcctta

SEQ ID NO: 424324 - DNA, 20 bp, mouse
gcggagatcgacatggctcc

SEQ ID NO: 424325 - DNA, 20 bp, mouse
gagccttaaggagacggggc

SEQ ID NO: 424326 - DNA, 20 bp, mouse
gcacaggcggagtcaagagg

SEQ ID NO: 424327 - DNA, 20 bp, mouse
gaatggagcgagagctctgg

SEQ ID NO: 424328 - DNA, 20 bp, mouse
gcagtggggaaggtactcct

SEQ ID NO: 424329 - DNA, 20 bp, mouse
gggagcgagagctctggcgg

SEQ ID NO: 424330 - DNA, 20 bp, mouse
gtgactccgcctgtgccggg

SEQ ID NO: 424331 - DNA, 20 bp, mouse
gtggcagcgactgacgatgt

SEQ ID NO: 424332 - DNA, 20 bp, mouse
gtcgctgggcaggttaggga

SEQ ID NO: 424333 - DNA, 20 bp, mouse
ggctcgggtcccggacatgc

SEQ ID NO: 424334 - DNA, 20 bp, mouse
gggccggtcgttggaggctc

SEQ ID NO: 424335 - DNA, 20 bp, mouse
gacgaccggccccccggcac

SEQ ID NO: 424336 - DNA, 20 bp, mouse
ggacagagcgtgtcttagta

SEQ ID NO: 424337 - DNA, 20 bp, mouse
gcttagtaaggtggcgatct

SEQ ID NO: 424338 - DNA, 20 bp, mouse
gtgcaggtgaacagtcgctg

SEQ ID NO: 424339 - DNA, 20 bp, mouse
ggatcaagccagatttctag

SEQ ID NO: 424340 - DNA, 20 bp, mouse
gagtgggcaggaacatactc

SEQ ID NO: 424341 - DNA, 20 bp, mouse
gagagcgtgtcttagtaagg

SEQ ID NO: 424342 - DNA, 20 bp, mouse
gggtgggagtggatgatcaa

SEQ ID NO: 424343 - DNA, 20 bp, mouse
gctcacacgtggcgctgaca

SEQ ID NO: 424344 - DNA, 20 bp, mouse
gtccatccaacttatctagt

SEQ ID NO: 424345 - DNA, 20 bp, mouse
gaagataagaagtgttcggt

SEQ ID NO: 424346 - DNA, 20 bp, mouse
ggttctggcgggcccagctc

SEQ ID NO: 424347 - DNA, 20 bp, mouse
gcccagctccggcagcaact

SEQ ID NO: 424348 - DNA, 20 bp, mouse
gggcccgccagaacctctcc

SEQ ID NO: 424349 - DNA, 20 bp, mouse
ggctccaggagaggttctgg

SEQ ID NO: 424350 - DNA, 20 bp, mouse
ggcttgagcagggacttggg

SEQ ID NO: 424351 - DNA, 20 bp, mouse
gggggctccaggagaggttc

SEQ ID NO: 424352 - DNA, 20 bp, mouse
gccgtcgcaagcgctctgga

SEQ ID NO: 424353 - DNA, 20 bp, mouse
gcgaggaacgtgggcgtcaa

SEQ ID NO: 424354 - DNA, 20 bp, mouse
gcgtgagagccagccacgcg

SEQ ID NO: 424355 - DNA, 20 bp, mouse
ggaaagggcgcgaggaacgt

SEQ ID NO: 424356 - DNA, 20 bp, mouse
ggccgagccgccggaggaag

SEQ ID NO: 424357 - DNA, 20 bp, mouse
gtcctccaggtcggccatgt

SEQ ID NO: 424358 - DNA, 20 bp, mouse
gggcgaggcggagaccatgt

SEQ ID NO: 424359 - DNA, 20 bp, mouse
ggaggcgggagagctcctcc

SEQ ID NO: 424360 - DNA, 20 bp, mouse
ggcggccgccgcagagcggg

SEQ ID NO: 424361 - DNA, 20 bp, mouse
gcgggagagctcctccaggt

SEQ ID NO: 424362 - DNA, 20 bp, mouse
gagcgggaggagggcccgcg

SEQ ID NO: 424363 - DNA, 20 bp, mouse
gtcaggctgcacacgcgcta

SEQ ID NO: 424364 - DNA, 20 bp, mouse
gccctcctcccgctctgcgg

SEQ ID NO: 424365 - DNA, 20 bp, mouse
gctcgccgacatggccgacc

SEQ ID NO: 424366 - DNA, 20 bp, mouse
ggagcttccgcacccggcaa

SEQ ID NO: 424367 - DNA, 20 bp, mouse
gcaccagctgaggcgtccag

SEQ ID NO: 424368 - DNA, 20 bp, mouse
ggccgaagccgggcttgtcc

SEQ ID NO: 424369 - DNA, 20 bp, mouse
gggcggcccgggactccctg

SEQ ID NO: 424370 - DNA, 20 bp, mouse
gccgtcccgagagccacagg

SEQ ID NO: 424371 - DNA, 20 bp, mouse
ggtggaacccttgccgggtg

SEQ ID NO: 424372 - DNA, 20 bp, mouse
gagggttccacgtgaaacct

SEQ ID NO: 424373 - DNA, 20 bp, mouse
gggctggcgacagaaacggg

SEQ ID NO: 424374 - DNA, 20 bp, mouse
gggcaaggagcttccgcacc

SEQ ID NO: 424375 - DNA, 20 bp, mouse
gtttcaggtgagctagggga

SEQ ID NO: 424376 - DNA, 20 bp, mouse
gacgggatccgacctagaag

SEQ ID NO: 424377 - DNA, 20 bp, mouse
gggaagcgtagggagcccct

SEQ ID NO: 424378 - DNA, 20 bp, mouse
gcgcccgcgctattgtgtaa

SEQ ID NO: 424379 - DNA, 20 bp, mouse
gtccccgatcgacagctccg

SEQ ID NO: 424380 - DNA, 20 bp, mouse
ggccccggagctgtcgatcg

SEQ ID NO: 424381 - DNA, 20 bp, mouse
gtgggagctggggaagcgta

SEQ ID NO: 424382 - DNA, 20 bp, mouse
gctattgtgtaatggcgacg

SEQ ID NO: 424383 - DNA, 20 bp, mouse
gcaaagccggcactcggtaa

SEQ ID NO: 424384 - DNA, 20 bp, mouse
gacatcatgtcagtcgcggg

SEQ ID NO: 424385 - DNA, 20 bp, mouse
ggtggggtgcaaggaccttg

SEQ ID NO: 424386 - DNA, 20 bp, mouse
ggcctcaacaatggagcccg

SEQ ID NO: 424387 - DNA, 20 bp, mouse
gctccggccacagctcgcac

SEQ ID NO: 424388 - DNA, 20 bp, mouse
gtcaacaatggagcccgggg

SEQ ID NO: 424389 - DNA, 20 bp, mouse
ggtggctcgtgagcactgga

SEQ ID NO: 424390 - DNA, 20 bp, mouse
gcctggagcccagacaccgc

SEQ ID NO: 424391 - DNA, 20 bp, mouse
gccttgcccgaggacatcgt

SEQ ID NO: 424392 - DNA, 20 bp, mouse
ggagtccccagggccaggta

SEQ ID NO: 424393 - DNA, 20 bp, mouse
ggcgcctgcgcagaatcctc

SEQ ID NO: 424394 - DNA, 20 bp, mouse
gccgagaggagcgcagcccg

SEQ ID NO: 424395 - DNA, 20 bp, mouse
gcggccacagctcgcaccgg

SEQ ID NO: 424396 - DNA, 20 bp, mouse
ggagcgcacgccgcctggtg

SEQ ID NO: 424397 - DNA, 20 bp, mouse
gtcctggagcactcagccca

SEQ ID NO: 424398 - DNA, 20 bp, mouse
gcagcggctgccgcaccagg

SEQ ID NO: 424399 - DNA, 20 bp, mouse
gatggctccggcgtgaatcc

SEQ ID NO: 424400 - DNA, 20 bp, mouse
gagtgctccaggattcacgc

SEQ ID NO: 424401 - DNA, 20 bp, mouse
gctagccaccggggcagccc

SEQ ID NO: 424402 - DNA, 20 bp, mouse
gctgcttcggtccatggctc

SEQ ID NO: 424403 - DNA, 20 bp, mouse
ggactcagacctaggccaca

SEQ ID NO: 424404 - DNA, 20 bp, mouse
gtccgaggctgggtaggact

SEQ ID NO: 424405 - DNA, 20 bp, mouse
gagacctaggccacagggtt

SEQ ID NO: 424406 - DNA, 20 bp, mouse
gccgggatggagcgctacaa

SEQ ID NO: 424407 - DNA, 20 bp, mouse
gcgggatacccggagcaagt

SEQ ID NO: 424408 - DNA, 20 bp, mouse
gtggagcgctacaaaggtga

SEQ ID NO: 424409 - DNA, 20 bp, mouse
ggcgcacaccgtgcccggga

SEQ ID NO: 424410 - DNA, 20 bp, mouse
gtgatactcctgggcccctg

SEQ ID NO: 424411 - DNA, 20 bp, mouse
gcagcgcggagaactcagcg

SEQ ID NO: 424412 - DNA, 20 bp, mouse
gtagcgctccatcccgggca

SEQ ID NO: 424413 - DNA, 20 bp, mouse
gagcagcgcacaccgtgccc

SEQ ID NO: 424414 - DNA, 20 bp, mouse
gtcctcggtcgccctctcta

SEQ ID NO: 424415 - DNA, 20 bp, mouse
gcacctgagtccgggatacc

SEQ ID NO: 424416 - DNA, 20 bp, mouse
gggacacagagctgaggacg

SEQ ID NO: 424417 - DNA, 20 bp, mouse
ggccgagagcgcagagtctg

SEQ ID NO: 424418 - DNA, 20 bp, mouse
gtgcggggcagtatcgccga

SEQ ID NO: 424419 - DNA, 20 bp, mouse
gctgcggccgacgctgagag

SEQ ID NO: 424420 - DNA, 20 bp, mouse
gcagcgtcggccgcagccgt

SEQ ID NO: 424421 - DNA, 20 bp, mouse
gcccgcgccgctctcagcgt

SEQ ID NO: 424422 - DNA, 20 bp, mouse
gggcagtgtgagccgagcca

SEQ ID NO: 424423 - DNA, 20 bp, mouse
ggcagtatcgccgacggctg

SEQ ID NO: 424424 - DNA, 20 bp, mouse
gggcgtctgggacccgggag

SEQ ID NO: 424425 - DNA, 20 bp, mouse
gcccgcagactctgcgctct

SEQ ID NO: 424426 - DNA, 20 bp, mouse
gctgcgctccggagcagtgg

SEQ ID NO: 424427 - DNA, 20 bp, mouse
gtggcgggtggcgacggcag

SEQ ID NO: 424428 - DNA, 20 bp, mouse
gcgaggcagtggcagtggcg

SEQ ID NO: 424429 - DNA, 20 bp, mouse
gagtgctggggccgcatcag

SEQ ID NO: 424430 - DNA, 20 bp, mouse
gcagtggcagtggcgcggcg

SEQ ID NO: 424431 - DNA, 20 bp, mouse
gggctgctggcgggtggcga

SEQ ID NO: 424432 - DNA, 20 bp, mouse
gaggcgaccccagctctaag

SEQ ID NO: 424433 - DNA, 20 bp, mouse
gtgctccggagcgcaggact

SEQ ID NO: 424434 - DNA, 20 bp, mouse
gggaagcgatggcaccgggc

SEQ ID NO: 424435 - DNA, 20 bp, mouse
gtggaccagagcgggaggtc

SEQ ID NO: 424436 - DNA, 20 bp, mouse
gcgctggcaagcgttctgaa

SEQ ID NO: 424437 - DNA, 20 bp, mouse
gtgtacggatccctcctcgc

SEQ ID NO: 424438 - DNA, 20 bp, mouse
ggaacgcttgccagcgagga

SEQ ID NO: 424439 - DNA, 20 bp, mouse
gggcttctctcttctgtgta

SEQ ID NO: 424440 - DNA, 20 bp, mouse
gcaggtcacgattctctcta

SEQ ID NO: 424441 - DNA, 20 bp, mouse
gcagatgtggaacataacca

SEQ ID NO: 424442 - DNA, 20 bp, mouse
gcaacacctgcacacttggg

SEQ ID NO: 424443 - DNA, 20 bp, mouse
gagaagccgaacaatttatt

SEQ ID NO: 424444 - DNA, 20 bp, mouse
gcgcccgagtgcacagtcct

SEQ ID NO: 424445 - DNA, 20 bp, mouse
gcatggctagataatgggac

SEQ ID NO: 424446 - DNA, 20 bp, mouse
gcggcgagagagcgagctcg

SEQ ID NO: 424447 - DNA, 20 bp, mouse
gacggcggcggcggacacag

SEQ ID NO: 424448 - DNA, 20 bp, mouse
gtcgcggctctcggcgagtg

SEQ ID NO: 424449 - DNA, 20 bp, mouse
gggagtcccggcccaggtga

SEQ ID NO: 424450 - DNA, 20 bp, mouse
gtcagtgcccggcacccccg

SEQ ID NO: 424451 - DNA, 20 bp, mouse
ggcggcccgaggctcggcag

SEQ ID NO: 424452 - DNA, 20 bp, mouse
gagcgggtgagtgcgccggg

SEQ ID NO: 424453 - DNA, 20 bp, mouse
gggcgcactcacccgctcgc

SEQ ID NO: 424454 - DNA, 20 bp, mouse
gagagcgagctcgcggctct

SEQ ID NO: 424455 - DNA, 20 bp, mouse
ggctaagtcgaagctgtcca

SEQ ID NO: 424456 - DNA, 20 bp, mouse
gagcccggccctggtcacat

SEQ ID NO: 424457 - DNA, 20 bp, mouse
gtccccgccccgtccgctgg

SEQ ID NO: 424458 - DNA, 20 bp, mouse
gggcggcgcacctcacaccg

SEQ ID NO: 424459 - DNA, 20 bp, mouse
gttcgggcccgcccaggagg

SEQ ID NO: 424460 - DNA, 20 bp, mouse
ggactcccgcagccgggact

SEQ ID NO: 424461 - DNA, 20 bp, mouse
gtcagtcccagtcccggctg

SEQ ID NO: 424462 - DNA, 20 bp, mouse
gaccggctgcctggggcgag

SEQ ID NO: 424463 - DNA, 20 bp, mouse
gctagcggagcggggactgg

SEQ ID NO: 424464 - DNA, 20 bp, mouse
gcccggacgggtgactgagg

SEQ ID NO: 424465 - DNA, 20 bp, mouse
ggcccggcctgcaccttcac

SEQ ID NO: 424466 - DNA, 20 bp, mouse
gatgttactgcggctggtgg

SEQ ID NO: 424467 - DNA, 20 bp, mouse
ggggccgggggatgttactg

SEQ ID NO: 424468 - DNA, 20 bp, mouse
gtagacactagtggagtcgg

SEQ ID NO: 424469 - DNA, 20 bp, mouse
gcagccgcagtaacatcccc

SEQ ID NO: 424470 - DNA, 20 bp, mouse
gggcggcgcgaggtcagggc

SEQ ID NO: 424471 - DNA, 20 bp, mouse
gcacagcttggagaaaggcc

SEQ ID NO: 424472 - DNA, 20 bp, mouse
gagggggcggcgcgaggtca

SEQ ID NO: 424473 - DNA, 20 bp, mouse
gggcgcgaggtcagggccgg

SEQ ID NO: 424474 - DNA, 20 bp, mouse
ggcggcgggcagtcgagccc

SEQ ID NO: 424475 - DNA, 20 bp, mouse
gagccgtaggtagacactag

SEQ ID NO: 424476 - DNA, 20 bp, mouse
gccggacccaggcaacctct

SEQ ID NO: 424477 - DNA, 20 bp, mouse
ggcgagcacgcgtggagcgt

SEQ ID NO: 424478 - DNA, 20 bp, mouse
gcaggggaggaaggccgcga

SEQ ID NO: 424479 - DNA, 20 bp, mouse
gctctgggcacgagcagggg

SEQ ID NO: 424480 - DNA, 20 bp, mouse
gagccgaggcgggcgatcgg

SEQ ID NO: 424481 - DNA, 20 bp, mouse
gccgaagaaccgataagctg

SEQ ID NO: 424482 - DNA, 20 bp, mouse
ggacgcggggactcaccgta

SEQ ID NO: 424483 - DNA, 20 bp, mouse
ggcggggactcaccgtacgg

SEQ ID NO: 424484 - DNA, 20 bp, mouse
gtgctgctgtggagccgggg

SEQ ID NO: 424485 - DNA, 20 bp, mouse
gggcagcggtgggccatggt

SEQ ID NO: 424486 - DNA, 20 bp, mouse
ggggctagggattcagtcaa

SEQ ID NO: 424487 - DNA, 20 bp, mouse
ggtcctgaggctttgtgggt

SEQ ID NO: 424488 - DNA, 20 bp, mouse
gtgagacacttaaaacttac

SEQ ID NO: 424489 - DNA, 20 bp, mouse
gccacaaagcctcaggacgt

SEQ ID NO: 424490 - DNA, 20 bp, mouse
gaccaggaatgctaagttag

SEQ ID NO: 424491 - DNA, 20 bp, mouse
gggattcagtcaaaggcaac

SEQ ID NO: 424492 - DNA, 20 bp, mouse
gcaaaatgtaaatctatagt

SEQ ID NO: 424493 - DNA, 20 bp, mouse
ggccctacccacaaagcctc

SEQ ID NO: 424494 - DNA, 20 bp, mouse
gttaaaggagcaatgtgact

SEQ ID NO: 424495 - DNA, 20 bp, mouse
gagcagttagaaacggccaa

SEQ ID NO: 424496 - DNA, 20 bp, mouse
gcctatggcgcggccaacgc

SEQ ID NO: 424497 - DNA, 20 bp, mouse
gctcggtggcgaaagcgaca

SEQ ID NO: 424498 - DNA, 20 bp, mouse
gtcgaaggagccgcccgcgt

SEQ ID NO: 424499 - DNA, 20 bp, mouse
gcgcagagcgcgacaggtgg

SEQ ID NO: 424500 - DNA, 20 bp, mouse
ggcgaaagcgacatggagag

SEQ ID NO: 424501 - DNA, 20 bp, mouse
gacatggagagcggggccta

SEQ ID NO: 424502 - DNA, 20 bp, mouse
gcgaggcgcgtcaccacctg

SEQ ID NO: 424503 - DNA, 20 bp, mouse
gaggggacagagacgcggag

SEQ ID NO: 424504 - DNA, 20 bp, mouse
gaggaagcgccgcaggtcga

SEQ ID NO: 424505 - DNA, 20 bp, mouse
gggccgcagagcgcgacagg

SEQ ID NO: 424506 - DNA, 20 bp, mouse
ggccatggccagatccggag

SEQ ID NO: 424507 - DNA, 20 bp, mouse
gtctggcccgcagaaaggga

SEQ ID NO: 424508 - DNA, 20 bp, mouse
ggaaagggaaggaaacgcca

SEQ ID NO: 424509 - DNA, 20 bp, mouse
ggaaacgccatggccagatc

SEQ ID NO: 424510 - DNA, 20 bp, mouse
gtgcgggccagaatccctgg

SEQ ID NO: 424511 - DNA, 20 bp, mouse
gtcccctccggatctggcca

SEQ ID NO: 424512 - DNA, 20 bp, mouse
gccgaagacaagttcctcca

SEQ ID NO: 424513 - DNA, 20 bp, mouse
gttctgcgggccagaatccc

SEQ ID NO: 424514 - DNA, 20 bp, mouse
gagttccagcaggaactaag

SEQ ID NO: 424515 - DNA, 20 bp, mouse
gtttcacgtagctgagaggt

SEQ ID NO: 424516 - DNA, 20 bp, mouse
ggcgggtgtgatccacttca

SEQ ID NO: 424517 - DNA, 20 bp, mouse
gcgcagcgaaatgtagcagg

SEQ ID NO: 424518 - DNA, 20 bp, mouse
gaaatgtagcaggaggatga

SEQ ID NO: 424519 - DNA, 20 bp, mouse
gccttcaccgcaggcagtgc

SEQ ID NO: 424520 - DNA, 20 bp, mouse
gctgctggttccttcaccgc

SEQ ID NO: 424521 - DNA, 20 bp, mouse
gtacctggagatgcaaatat

SEQ ID NO: 424522 - DNA, 20 bp, mouse
ggaccaggtatagatctaag

SEQ ID NO: 424523 - DNA, 20 bp, mouse
gggacgcagcgaaatgtagc

SEQ ID NO: 424524 - DNA, 20 bp, mouse
gtgatccacttcatggctgc

SEQ ID NO: 424525 - DNA, 20 bp, mouse
gtaccacttagatctatacc

SEQ ID NO: 424526 - DNA, 20 bp, mouse
gcagcgctgaaactccgggt

SEQ ID NO: 424527 - DNA, 20 bp, mouse
ggcggcagcgctgaaactcc

SEQ ID NO: 424528 - DNA, 20 bp, mouse
gtgagctggtgagggcggaa

SEQ ID NO: 424529 - DNA, 20 bp, mouse
gaactccgggtgggcgtcca

SEQ ID NO: 424530 - DNA, 20 bp, mouse
gtggcgccgcgccgctgaca

SEQ ID NO: 424531 - DNA, 20 bp, mouse
gccgcgccgctgacagggct

SEQ ID NO: 424532 - DNA, 20 bp, mouse
gggcggcggaagagggcgga

SEQ ID NO: 424533 - DNA, 20 bp, mouse
ggaagagggcggagggtagt

SEQ ID NO: 424534 - DNA, 20 bp, mouse
gcactcacctggctcgtccc

SEQ ID NO: 424535 - DNA, 20 bp, mouse
ggagcaggaggacgccggag

SEQ ID NO: 424536 - DNA, 20 bp, mouse
ggggtcactcagctatggag

SEQ ID NO: 424537 - DNA, 20 bp, mouse
gcatgcccaggaccagcagt

SEQ ID NO: 424538 - DNA, 20 bp, mouse
gtcggcgggtcactcagcta

SEQ ID NO: 424539 - DNA, 20 bp, mouse
ggccaagtgttgacgaccag

SEQ ID NO: 424540 - DNA, 20 bp, mouse
gccgcaccaggggcatgccc

SEQ ID NO: 424541 - DNA, 20 bp, mouse
gaagctgcactcagtcccta

SEQ ID NO: 424542 - DNA, 20 bp, mouse
gtgttgacgaccaggggcag

SEQ ID NO: 424543 - DNA, 20 bp, mouse
gcagccggccagcgcgagaa

SEQ ID NO: 424544 - DNA, 20 bp, mouse
gctggtcctgggcatgcccc

SEQ ID NO: 424545 - DNA, 20 bp, mouse
gggttccctcctgcaacctt

SEQ ID NO: 424546 - DNA, 20 bp, mouse
gcggcgggcggcgctcggag

SEQ ID NO: 424547 - DNA, 20 bp, mouse
ggcgctcggagcggtctccg

SEQ ID NO: 424548 - DNA, 20 bp, mouse
gcaagccgggaccgagctgt

SEQ ID NO: 424549 - DNA, 20 bp, mouse
gtggcaaggcgcctacagct

SEQ ID NO: 424550 - DNA, 20 bp, mouse
gtcggctccgtgctccccgg

SEQ ID NO: 424551 - DNA, 20 bp, mouse
gccgtgcgcccggagcagag

SEQ ID NO: 424552 - DNA, 20 bp, mouse
gtgaggatgaagcagtagag

SEQ ID NO: 424553 - DNA, 20 bp, mouse
ggacggcgcagggcagctga

SEQ ID NO: 424554 - DNA, 20 bp, mouse
ggggccgtccgggaagaccg

SEQ ID NO: 424555 - DNA, 20 bp, mouse
gcccggcggagagagcactg

SEQ ID NO: 424556 - DNA, 20 bp, mouse
ggagcacggggaggatgcta

SEQ ID NO: 424557 - DNA, 20 bp, mouse
gtccggaccgagccgatccc

SEQ ID NO: 424558 - DNA, 20 bp, mouse
ggattcgcaggagcacgggg

SEQ ID NO: 424559 - DNA, 20 bp, mouse
ggcccgggatcggctcggtc

SEQ ID NO: 424560 - DNA, 20 bp, mouse
gttgagggtagagactagtg

SEQ ID NO: 424561 - DNA, 20 bp, mouse
ggcctcctcctcaatgtgag

SEQ ID NO: 424562 - DNA, 20 bp, mouse
gcagatgcagtgggaaaggg

SEQ ID NO: 424563 - DNA, 20 bp, mouse
ggcgggaatgcggactcaat

SEQ ID NO: 424564 - DNA, 20 bp, mouse
gccggatgcgcgttgtgtcc

SEQ ID NO: 424565 - DNA, 20 bp, mouse
gtgggaaaggggggtcttga

SEQ ID NO: 424566 - DNA, 20 bp, mouse
ggctggaggcagctccgagg

SEQ ID NO: 424567 - DNA, 20 bp, mouse
ggccgctggaggcagctccg

SEQ ID NO: 424568 - DNA, 20 bp, mouse
gcctccagcggcaacaacaa

SEQ ID NO: 424569 - DNA, 20 bp, mouse
gggcggcgggatctcagcgc

SEQ ID NO: 424570 - DNA, 20 bp, mouse
ggagccgaggccagaaggcg

SEQ ID NO: 424571 - DNA, 20 bp, mouse
gggcgcggccgcgcacgctg

SEQ ID NO: 424572 - DNA, 20 bp, mouse
gagcgcgggtaaacgccggg

SEQ ID NO: 424573 - DNA, 20 bp, mouse
gtctcagcgcgggtaaacgc

SEQ ID NO: 424574 - DNA, 20 bp, mouse
ggcggcaacaacaacgggac

SEQ ID NO: 424575 - DNA, 20 bp, mouse
gcgcatgaggcccggagccg

SEQ ID NO: 424576 - DNA, 20 bp, mouse
ggggagcccctgacatacca

SEQ ID NO: 424577 - DNA, 20 bp, mouse
gtgaagccctggtatgtcag

SEQ ID NO: 424578 - DNA, 20 bp, mouse
gacagttgcatattgaagag

SEQ ID NO: 424579 - DNA, 20 bp, mouse
gaaacctcactataaagtgt

SEQ ID NO: 424580 - DNA, 20 bp, mouse
gtgtgtggagtccaactcat

SEQ ID NO: 424581 - DNA, 20 bp, mouse
gtgttgtaaaagggagctaa

SEQ ID NO: 424582 - DNA, 20 bp, mouse
gaaagggagctaaaggtgag

SEQ ID NO: 424583 - DNA, 20 bp, mouse
ggaagctctgcatatgtact

SEQ ID NO: 424584 - DNA, 20 bp, mouse
gctggtaaaaaagtctctgt

SEQ ID NO: 424585 - DNA, 20 bp, mouse
gaaagcaaacaagcaggtcc

SEQ ID NO: 424586 - DNA, 20 bp, mouse
gaccaggacgccgcagaaaa

SEQ ID NO: 424587 - DNA, 20 bp, mouse
gaggctcctggtgaatctag

SEQ ID NO: 424588 - DNA, 20 bp, mouse
gtctgcggcgtcctggtgtt

SEQ ID NO: 424589 - DNA, 20 bp, mouse
gggagccagaagcggaagga

SEQ ID NO: 424590 - DNA, 20 bp, mouse
ggattcaccaggagcctcat

SEQ ID NO: 424591 - DNA, 20 bp, mouse
gcggagtgtggactgcccag

SEQ ID NO: 424592 - DNA, 20 bp, mouse
gagcaaccgggagccagaag

SEQ ID NO: 424593 - DNA, 20 bp, mouse
gagtggttgtgggtgtgaaa

SEQ ID NO: 424594 - DNA, 20 bp, mouse
gcacacccacaaccactcgg

SEQ ID NO: 424595 - DNA, 20 bp, mouse
gctggtccactagattcacc

SEQ ID NO: 424596 - DNA, 20 bp, mouse
gcaggcaccgggcgacgaca

SEQ ID NO: 424597 - DNA, 20 bp, mouse
gtaggatgtcccccaggcac

SEQ ID NO: 424598 - DNA, 20 bp, mouse
gagcgaccgctgaatttcga

SEQ ID NO: 424599 - DNA, 20 bp, mouse
gtctaggtgacatctcgggg

SEQ ID NO: 424600 - DNA, 20 bp, mouse
gcagcggtcgctgagagagc

SEQ ID NO: 424601 - DNA, 20 bp, mouse
gcctgccgggagaatacttt

SEQ ID NO: 424602 - DNA, 20 bp, mouse
gcgcgccaggccttctctcg

SEQ ID NO: 424603 - DNA, 20 bp, mouse
gccgttgccctggcaacaag

SEQ ID NO: 424604 - DNA, 20 bp, mouse
ggtctgtagacgtcaaccgg

SEQ ID NO: 424605 - DNA, 20 bp, mouse
gccggcaggggtgggacgac

SEQ ID NO: 424606 - DNA, 20 bp, mouse
ggagcgagcggtgggatccg

SEQ ID NO: 424607 - DNA, 20 bp, mouse
gatccgcgggctgacagaaa

SEQ ID NO: 424608 - DNA, 20 bp, mouse
gccgcgcagcgtcttcctga

SEQ ID NO: 424609 - DNA, 20 bp, mouse
gctcccagccggccgctcag

SEQ ID NO: 424610 - DNA, 20 bp, mouse
gctacaagggcgcctcctca

SEQ ID NO: 424611 - DNA, 20 bp, mouse
gcggagccagacagcgccag

SEQ ID NO: 424612 - DNA, 20 bp, mouse
ggcagtggggagcgagcggt

SEQ ID NO: 424613 - DNA, 20 bp, mouse
gtgccagtcttgggcctgag

SEQ ID NO: 424614 - DNA, 20 bp, mouse
ggggcgcctcctcagggata

SEQ ID NO: 424615 - DNA, 20 bp, mouse
gctcgctccccactgcccgg

SEQ ID NO: 424616 - DNA, 20 bp, mouse
ggcacccgggccctccaccc

SEQ ID NO: 424617 - DNA, 20 bp, mouse
gagcagagggagtcaaccaa

SEQ ID NO: 424618 - DNA, 20 bp, mouse
gccctctcccgctagcgagg

SEQ ID NO: 424619 - DNA, 20 bp, mouse
ggcgctgcctggcttgtcca

SEQ ID NO: 424620 - DNA, 20 bp, mouse
gtcgctagcgggagagggag

SEQ ID NO: 424621 - DNA, 20 bp, mouse
ggctagcgaggcggcacctc

SEQ ID NO: 424622 - DNA, 20 bp, mouse
gacaggaaggcgggtcctag

SEQ ID NO: 424623 - DNA, 20 bp, mouse
gggcagagcgggctgagaag

SEQ ID NO: 424624 - DNA, 20 bp, mouse
ggttttgtgtgggtcccggg

SEQ ID NO: 424625 - DNA, 20 bp, mouse
ggcggggtggcattcgacgg

SEQ ID NO: 424626 - DNA, 20 bp, mouse
ggtggccacagcgggaagag

SEQ ID NO: 424627 - DNA, 20 bp, mouse
gtgcgtgtgtaggacagggt

SEQ ID NO: 424628 - DNA, 20 bp, mouse
ggggacagcagctagagcct

SEQ ID NO: 424629 - DNA, 20 bp, mouse
gctctagctgctgtccccgc

SEQ ID NO: 424630 - DNA, 20 bp, mouse
gaggaagcaccatgccagcg

SEQ ID NO: 424631 - DNA, 20 bp, mouse
gcattgtgggagggtggaag

SEQ ID NO: 424632 - DNA, 20 bp, mouse
ggggtgctggggaccctcaa

SEQ ID NO: 424633 - DNA, 20 bp, mouse
gccctcaagggtaactcctg

SEQ ID NO: 424634 - DNA, 20 bp, mouse
gtgggtgatagcatcattgt

SEQ ID NO: 424635 - DNA, 20 bp, mouse
ggctgctgtccccgctggca

SEQ ID NO: 424636 - DNA, 20 bp, mouse
gcccttaggagaagtcggga

SEQ ID NO: 424637 - DNA, 20 bp, mouse
gttaggagaagtcgggaagg

SEQ ID NO: 424638 - DNA, 20 bp, mouse
ggccgcggctccgaccgagg

SEQ ID NO: 424639 - DNA, 20 bp, mouse
ggccgaccggtcacaccaac

SEQ ID NO: 424640 - DNA, 20 bp, mouse
ggatgctgcgggacatgacg

SEQ ID NO: 424641 - DNA, 20 bp, mouse
gttcccccttaggagaagtc

SEQ ID NO: 424642 - DNA, 20 bp, mouse
gatggccgcggctccgaccg

SEQ ID NO: 424643 - DNA, 20 bp, mouse
gccgagaccggagtccgcga

SEQ ID NO: 424644 - DNA, 20 bp, mouse
gagcgcgaagcggaagcagg

SEQ ID NO: 424645 - DNA, 20 bp, mouse
ggacccccgtccgcactcac

SEQ ID NO: 424646 - DNA, 20 bp, mouse
ggtcggagggagcaaagcgg

SEQ ID NO: 424647 - DNA, 20 bp, mouse
gcgtatgtggacatcaccgt

SEQ ID NO: 424648 - DNA, 20 bp, mouse
ggcccagctcccgcactcgg

SEQ ID NO: 424649 - DNA, 20 bp, mouse
gcggcaccacacctccgaag

SEQ ID NO: 424650 - DNA, 20 bp, mouse
gagctggtgtcagggttgcc

SEQ ID NO: 424651 - DNA, 20 bp, mouse
ggttgccgggcgtgcgaagg

SEQ ID NO: 424652 - DNA, 20 bp, mouse
gaggcagcgagcggttaaag

SEQ ID NO: 424653 - DNA, 20 bp, mouse
gctgggcgcactcgaaacag

SEQ ID NO: 424654 - DNA, 20 bp, mouse
gggctgcaggagctggtgtc

SEQ ID NO: 424655 - DNA, 20 bp, mouse
gcccccccggatccactcac

SEQ ID NO: 424656 - DNA, 20 bp, mouse
gctccgggaagccagcggac

SEQ ID NO: 424657 - DNA, 20 bp, mouse
gccgcccggtgacagtctcc

SEQ ID NO: 424658 - DNA, 20 bp, mouse
gagaactaaagcgaacccag

SEQ ID NO: 424659 - DNA, 20 bp, mouse
ggacgaagccgactctaccc

SEQ ID NO: 424660 - DNA, 20 bp, mouse
gcgcgcggcccgggtagagt

SEQ ID NO: 424661 - DNA, 20 bp, mouse
gggaactagaggcttccgct

SEQ ID NO: 424662 - DNA, 20 bp, mouse
gggccgcgcggacacccgcc

SEQ ID NO: 424663 - DNA, 20 bp, mouse
ggcttcccggagactgtcac

SEQ ID NO: 424664 - DNA, 20 bp, mouse
ggggctgcttaggacgacac

SEQ ID NO: 424665 - DNA, 20 bp, mouse
ggagaaggcgaaggcggcga

SEQ ID NO: 424666 - DNA, 20 bp, mouse
ggacagggcgggagatgagg

SEQ ID NO: 424667 - DNA, 20 bp, mouse
gggcgggcagcggtgagttc

SEQ ID NO: 424668 - DNA, 20 bp, mouse
gacggctctgggactcgaac

SEQ ID NO: 424669 - DNA, 20 bp, mouse
gagcgacagggcgggagatg

SEQ ID NO: 424670 - DNA, 20 bp, mouse
gtgctcaacgcagccaccag

SEQ ID NO: 424671 - DNA, 20 bp, mouse
ggtaccccacagcccaaggt

SEQ ID NO: 424672 - DNA, 20 bp, mouse
ggcggtttccctgaaaagag

SEQ ID NO: 424673 - DNA, 20 bp, mouse
gcctgactcgcagggacaac

SEQ ID NO: 424674 - DNA, 20 bp, mouse
gcgtcggaacccgagagcag

SEQ ID NO: 424675 - DNA, 20 bp, mouse
gcctgacaacacacatcccg

SEQ ID NO: 424676 - DNA, 20 bp, mouse
gtacgagcgggatagacgtg

SEQ ID NO: 424677 - DNA, 20 bp, mouse
ggagccggagccgggtacag

SEQ ID NO: 424678 - DNA, 20 bp, mouse
gagacgtgcggcgtcgggag

SEQ ID NO: 424679 - DNA, 20 bp, mouse
ggcgggaacgccggacgcag

SEQ ID NO: 424680 - DNA, 20 bp, mouse
ggggtctgaagccaccaata

SEQ ID NO: 424681 - DNA, 20 bp, mouse
gcattccaggcacttacgag

SEQ ID NO: 424682 - DNA, 20 bp, mouse
gagggcagggcggccgtgaa

SEQ ID NO: 424683 - DNA, 20 bp, mouse
gcggccgccctgccctcccc

SEQ ID NO: 424684 - DNA, 20 bp, mouse
gttcccgctgtacccggctc

SEQ ID NO: 424685 - DNA, 20 bp, mouse
ggatcaggctgctgaacagg

SEQ ID NO: 424686 - DNA, 20 bp, mouse
gggttgggctcctcaatagg

SEQ ID NO: 424687 - DNA, 20 bp, mouse
gaggctgctgaggtccagct

SEQ ID NO: 424688 - DNA, 20 bp, mouse
gcctcgggggaggactgcag

SEQ ID NO: 424689 - DNA, 20 bp, mouse
ggcagcgtccagcccctcgg

SEQ ID NO: 424690 - DNA, 20 bp, mouse
gcctggttgggctcctcaat

SEQ ID NO: 424691 - DNA, 20 bp, mouse
gggacgaaagagccccgctg

SEQ ID NO: 424692 - DNA, 20 bp, mouse
gtgaagcctggcggatccca

SEQ ID NO: 424693 - DNA, 20 bp, mouse
gtgaggtccagctgggcccg

SEQ ID NO: 424694 - DNA, 20 bp, mouse
ggctggcacactgtcctggt

SEQ ID NO: 424695 - DNA, 20 bp, mouse
gaccggcccggggcaaggta

SEQ ID NO: 424696 - DNA, 20 bp, mouse
ggaacactagcagcaagagt

SEQ ID NO: 424697 - DNA, 20 bp, mouse
ggttcagtggaagattcccc

SEQ ID NO: 424698 - DNA, 20 bp, mouse
gctccagctggaaatcagac

SEQ ID NO: 424699 - DNA, 20 bp, mouse
gtgcacacaaactctgctgt

SEQ ID NO: 424700 - DNA, 20 bp, mouse
gtattctagggcgaagaata

SEQ ID NO: 424701 - DNA, 20 bp, mouse
gtggaagattccccaggaag

SEQ ID NO: 424702 - DNA, 20 bp, mouse
gttccccaggaagaggaagt

SEQ ID NO: 424703 - DNA, 20 bp, mouse
gggtgagcctgtcttggaag

SEQ ID NO: 424704 - DNA, 20 bp, mouse
gacctcttcaacagtttgga

SEQ ID NO: 424705 - DNA, 20 bp, mouse
gaaaaaaggtgagcctgtct

SEQ ID NO: 424706 - DNA, 20 bp, mouse
ggctgctgcaggctccgcgg

SEQ ID NO: 424707 - DNA, 20 bp, mouse
ggctactcgggcgctagcag

SEQ ID NO: 424708 - DNA, 20 bp, mouse
gtgcgcactggcagctactc

SEQ ID NO: 424709 - DNA, 20 bp, mouse
gtccgcacgggtatatggga

SEQ ID NO: 424710 - DNA, 20 bp, mouse
gtatgccgcgagagcctata

SEQ ID NO: 424711 - DNA, 20 bp, mouse
ggcggcggcaacggaggctg

SEQ ID NO: 424712 - DNA, 20 bp, mouse
gacaggcggccgggagactg

SEQ ID NO: 424713 - DNA, 20 bp, mouse
gggatggaagcgggaccctc

SEQ ID NO: 424714 - DNA, 20 bp, mouse
ggagcggccgggcttcgggg

SEQ ID NO: 424715 - DNA, 20 bp, mouse
gtacccgtgcggaggacagg

SEQ ID NO: 424716 - DNA, 20 bp, mouse
gcgcgccggggcggatcgag

SEQ ID NO: 424717 - DNA, 20 bp, mouse
gccggccgctcgatccgccc

SEQ ID NO: 424718 - DNA, 20 bp, mouse
gagcggccggcggctcctcg

SEQ ID NO: 424719 - DNA, 20 bp, mouse
gttacccgacgcggccgggg

SEQ ID NO: 424720 - DNA, 20 bp, mouse
gacagctatgcgctcgggaa

SEQ ID NO: 424721 - DNA, 20 bp, mouse
gcgccaaccgccaaccgccg

SEQ ID NO: 424722 - DNA, 20 bp, mouse
gggtttacccgacgcggccg

SEQ ID NO: 424723 - DNA, 20 bp, mouse
gagaacaggtttacccgacg

SEQ ID NO: 424724 - DNA, 20 bp, mouse
ggctatgcgctcgggaacgg

SEQ ID NO: 424725 - DNA, 20 bp, mouse
gtggcgggcggggcaggcga

SEQ ID NO: 424726 - DNA, 20 bp, mouse
ggcctgcagcgaggtaagag

SEQ ID NO: 424727 - DNA, 20 bp, mouse
ggcggcgacagtcctgagtg

SEQ ID NO: 424728 - DNA, 20 bp, mouse
ggggcacaagaggcacagtc

SEQ ID NO: 424729 - DNA, 20 bp, mouse
gggttccagcgtcctcactc

SEQ ID NO: 424730 - DNA, 20 bp, mouse
gtgctcaggggacaacatcg

SEQ ID NO: 424731 - DNA, 20 bp, mouse
gtgcacgcgtcagcatctgt

SEQ ID NO: 424732 - DNA, 20 bp, mouse
gggaaagctccgggcacaag

SEQ ID NO: 424733 - DNA, 20 bp, mouse
ggagaagggtgccaccacag

SEQ ID NO: 424734 - DNA, 20 bp, mouse
ggcgctgacagcacctgaag

SEQ ID NO: 424735 - DNA, 20 bp, mouse
gtgaggcgagctgcgggaca

SEQ ID NO: 424736 - DNA, 20 bp, mouse
gggtccagcgagcctgaccg

SEQ ID NO: 424737 - DNA, 20 bp, mouse
ggggtcccggctagcgaagg

SEQ ID NO: 424738 - DNA, 20 bp, mouse
gtcagacctggggctcggga

SEQ ID NO: 424739 - DNA, 20 bp, mouse
gcccgccccctgcctcggtc

SEQ ID NO: 424740 - DNA, 20 bp, mouse
gggaagagccgtgacagagt

SEQ ID NO: 424741 - DNA, 20 bp, mouse
gcgcctgcggtcccgggtcc

SEQ ID NO: 424742 - DNA, 20 bp, mouse
gctcgggagggcagacagac

SEQ ID NO: 424743 - DNA, 20 bp, mouse
gcccgggtcccggctagcga

SEQ ID NO: 424744 - DNA, 20 bp, mouse
ggcgagcctgaccgaggcag

SEQ ID NO: 424745 - DNA, 20 bp, mouse
gtcgggacccgtctaaggga

SEQ ID NO: 424746 - DNA, 20 bp, mouse
gtatcggtaggaatggtggg

SEQ ID NO: 424747 - DNA, 20 bp, mouse
ggaccctcagagagccggca

SEQ ID NO: 424748 - DNA, 20 bp, mouse
gcctccctgccggctctctg

SEQ ID NO: 424749 - DNA, 20 bp, mouse
gaagctgggcccatatcggt

SEQ ID NO: 424750 - DNA, 20 bp, mouse
gcccatatcggtaggaatgg

SEQ ID NO: 424751 - DNA, 20 bp, mouse
gggggtgggggagatagcgg

SEQ ID NO: 424752 - DNA, 20 bp, mouse
gcaggctgcggcaacggtgg

SEQ ID NO: 424753 - DNA, 20 bp, mouse
gagccaggctgcggcaacgg

SEQ ID NO: 424754 - DNA, 20 bp, mouse
ggggcccatatcggtaggaa

SEQ ID NO: 424755 - DNA, 20 bp, mouse
gaagtcagcaggcgctggga

SEQ ID NO: 424756 - DNA, 20 bp, mouse
gcatggccacgggtccatgg

SEQ ID NO: 424757 - DNA, 20 bp, mouse
gccgtggccatggctgacgg

SEQ ID NO: 424758 - DNA, 20 bp, mouse
gagccatggccacgggtcca

SEQ ID NO: 424759 - DNA, 20 bp, mouse
ggcagcgccgccgtcagcca

SEQ ID NO: 424760 - DNA, 20 bp, mouse
gggccgcggcggagaaggac

SEQ ID NO: 424761 - DNA, 20 bp, mouse
gccgcaccgtggataacatg

SEQ ID NO: 424762 - DNA, 20 bp, mouse
gcctcggcgctcctcaaaag

SEQ ID NO: 424763 - DNA, 20 bp, mouse
gtgcggccgccatggacccg

SEQ ID NO: 424764 - DNA, 20 bp, mouse
gcgcagcaggcagacgatcg

SEQ ID NO: 424765 - DNA, 20 bp, mouse
gtggataacatgaggcaagg

SEQ ID NO: 424766 - DNA, 20 bp, mouse
ggatcgccgcgcacaggaag

SEQ ID NO: 424767 - DNA, 20 bp, mouse
gcccgcgccggcggaactgt

SEQ ID NO: 424768 - DNA, 20 bp, mouse
gccggcccggccctgcgtcg

SEQ ID NO: 424769 - DNA, 20 bp, mouse
ggtcggggcctcagcgagtg

SEQ ID NO: 424770 - DNA, 20 bp, mouse
gcgcgcacaggaagtggcgg

SEQ ID NO: 424771 - DNA, 20 bp, mouse
ggccaacggacagcaagcgg

SEQ ID NO: 424772 - DNA, 20 bp, mouse
gccatcgccgccctccgcct

SEQ ID NO: 424773 - DNA, 20 bp, mouse
ggagaaccgcgaccagcagg

SEQ ID NO: 424774 - DNA, 20 bp, mouse
gggagcgcagccggccactg

SEQ ID NO: 424775 - DNA, 20 bp, mouse
gcgaccagcaggtggagtgc

SEQ ID NO: 424776 - DNA, 20 bp, mouse
gctcacaagccagaactgcg

SEQ ID NO: 424777 - DNA, 20 bp, mouse
gtacagcttctctaaagtag

SEQ ID NO: 424778 - DNA, 20 bp, mouse
gggcagagggaggagcaccg

SEQ ID NO: 424779 - DNA, 20 bp, mouse
gctcggagcgggatgctggt

SEQ ID NO: 424780 - DNA, 20 bp, mouse
gctagtactttggaagggat

SEQ ID NO: 424781 - DNA, 20 bp, mouse
gtctgcgagcagccctccca

SEQ ID NO: 424782 - DNA, 20 bp, mouse
gacaccacctacctcgctcc

SEQ ID NO: 424783 - DNA, 20 bp, mouse
ggctgtaagtcagccaacac

SEQ ID NO: 424784 - DNA, 20 bp, mouse
ggcgagcagccctcccaggg

SEQ ID NO: 424785 - DNA, 20 bp, mouse
gggaagggataggctcggag

SEQ ID NO: 424786 - DNA, 20 bp, mouse
gctgctcgccgccttggaaa

SEQ ID NO: 424787 - DNA, 20 bp, mouse
gcctccccgctgacaagcac

SEQ ID NO: 424788 - DNA, 20 bp, mouse
gaggcgtgccctttccaagg

SEQ ID NO: 424789 - DNA, 20 bp, mouse
ggacccggcggggacagtga

SEQ ID NO: 424790 - DNA, 20 bp, mouse
gtgccgggcgcactcgcctc

SEQ ID NO: 424791 - DNA, 20 bp, mouse
ggagtacgtgtggagcacca

SEQ ID NO: 424792 - DNA, 20 bp, mouse
ggcggtggctgaggtcctgg

SEQ ID NO: 424793 - DNA, 20 bp, mouse
gggcaacgcaggcggagtcg

SEQ ID NO: 424794 - DNA, 20 bp, mouse
gaccccgaggcgagtgcgcc

SEQ ID NO: 424795 - DNA, 20 bp, mouse
gcgcgacccgtgcttgtcag

SEQ ID NO: 424796 - DNA, 20 bp, mouse
gagcggcagtcaccgaggac

SEQ ID NO: 424797 - DNA, 20 bp, mouse
gggactggagccgagcctca

SEQ ID NO: 424798 - DNA, 20 bp, mouse
gccaggtccatccaactcac

SEQ ID NO: 424799 - DNA, 20 bp, mouse
gcagcggcgtagacaaagac

SEQ ID NO: 424800 - DNA, 20 bp, mouse
gcgtacgcctgggccggcgg

SEQ ID NO: 424801 - DNA, 20 bp, mouse
gactcaccggccgtgaggct

SEQ ID NO: 424802 - DNA, 20 bp, mouse
gttacgtacgcctgggccgg

SEQ ID NO: 424803 - DNA, 20 bp, mouse
gagctcggaccgcccggcag

SEQ ID NO: 424804 - DNA, 20 bp, mouse
ggctggcgaaggacaggagt

SEQ ID NO: 424805 - DNA, 20 bp, mouse
gaggcggcaagaggacagcg

SEQ ID NO: 424806 - DNA, 20 bp, mouse
ggtgactcaccgaggccctc

SEQ ID NO: 424807 - DNA, 20 bp, mouse
ggttccctgcacctcggcgt

SEQ ID NO: 424808 - DNA, 20 bp, mouse
ggacccagctgggtgaccta

SEQ ID NO: 424809 - DNA, 20 bp, mouse
gccaaccgggacccaagggg

SEQ ID NO: 424810 - DNA, 20 bp, mouse
gcttctcgccagagacactc

SEQ ID NO: 424811 - DNA, 20 bp, mouse
ggggccaaccgggacccaag

SEQ ID NO: 424812 - DNA, 20 bp, mouse
gctgcactagggtgtcccgt

SEQ ID NO: 424813 - DNA, 20 bp, mouse
gcggcagcgaggatccccgc

SEQ ID NO: 424814 - DNA, 20 bp, mouse
gctgcggagcgaagaggaaa

SEQ ID NO: 424815 - DNA, 20 bp, mouse
gcagcccacgccgaggtgca

SEQ ID NO: 424816 - DNA, 20 bp, mouse
gggtgaaaggtcactcagag

SEQ ID NO: 424817 - DNA, 20 bp, mouse
gctcgggcggcggcacaagg

SEQ ID NO: 424818 - DNA, 20 bp, mouse
gcgcatcccggcagtcaccg

SEQ ID NO: 424819 - DNA, 20 bp, mouse
ggccgctgggctcgggtgaa

SEQ ID NO: 424820 - DNA, 20 bp, mouse
gtctggtgcggcaggagtag

SEQ ID NO: 424821 - DNA, 20 bp, mouse
gcgagcccagcggcctcggg

SEQ ID NO: 424822 - DNA, 20 bp, mouse
gcagtcaccgcggcgactgg

SEQ ID NO: 424823 - DNA, 20 bp, mouse
gatggtgcccgactctggtg

SEQ ID NO: 424824 - DNA, 20 bp, mouse
ggagaggagagcacgggagt

SEQ ID NO: 424825 - DNA, 20 bp, mouse
gtggtactcggagcctcctg

SEQ ID NO: 424826 - DNA, 20 bp, mouse
gacttggacggcaacccttg

SEQ ID NO: 424827 - DNA, 20 bp, mouse
ggcacactgagaaacttgga

SEQ ID NO: 424828 - DNA, 20 bp, mouse
gctacagtggaggaacccag

SEQ ID NO: 424829 - DNA, 20 bp, mouse
ggctggcacactgagaaact

SEQ ID NO: 424830 - DNA, 20 bp, mouse
gtgctttgtgtgagccgcaa

SEQ ID NO: 424831 - DNA, 20 bp, mouse
ggatgaagccaaggttcccg

SEQ ID NO: 424832 - DNA, 20 bp, mouse
gagagtatcgcccaatctca

SEQ ID NO: 424833 - DNA, 20 bp, mouse
gctcccactaggtaacgcaa

SEQ ID NO: 424834 - DNA, 20 bp, mouse
gggttcccggggcagaaagc

SEQ ID NO: 424835 - DNA, 20 bp, mouse
ggaggatcgcatgcatgcct

SEQ ID NO: 424836 - DNA, 20 bp, mouse
ggattatttagatacagcag

SEQ ID NO: 424837 - DNA, 20 bp, mouse
gcgtttctaacaagagcgct

SEQ ID NO: 424838 - DNA, 20 bp, mouse
ggatgttacgcgttgcgaag

SEQ ID NO: 424839 - DNA, 20 bp, mouse
gtacgcgttgcgaaggggtg

SEQ ID NO: 424840 - DNA, 20 bp, mouse
ggctcttccgaaaaggacct

SEQ ID NO: 424841 - DNA, 20 bp, mouse
gaatgatctcttaatagtcc

SEQ ID NO: 424842 - DNA, 20 bp, mouse
gaaaactgtgaagccagctc

SEQ ID NO: 424843 - DNA, 20 bp, mouse
gtcttgttagaaacgtgttt

SEQ ID NO: 424844 - DNA, 20 bp, mouse
gtctgttgttgctactgact

SEQ ID NO: 424845 - DNA, 20 bp, mouse
gcaagagcgctgggcagctc

SEQ ID NO: 424846 - DNA, 20 bp, mouse
gaccatggcgcagcccggaa

SEQ ID NO: 424847 - DNA, 20 bp, mouse
ggcagcccggaacggcggga

SEQ ID NO: 424848 - DNA, 20 bp, mouse
gatggcgcagcccggaacgg

SEQ ID NO: 424849 - DNA, 20 bp, mouse
gtccagtcctgccccccgag

SEQ ID NO: 424850 - DNA, 20 bp, mouse
ggcgggccggaccgctcggg

SEQ ID NO: 424851 - DNA, 20 bp, mouse
gaggcgaacgtggtgctcac

SEQ ID NO: 424852 - DNA, 20 bp, mouse
gggctccctcccgccgttcc

SEQ ID NO: 424853 - DNA, 20 bp, mouse
ggtgctcaccggcacagtgg

SEQ ID NO: 424854 - DNA, 20 bp, mouse
gcccggagcgcgccttggag

SEQ ID NO: 424855 - DNA, 20 bp, mouse
gctgcgccatggtccgcccg

SEQ ID NO: 424856 - DNA, 20 bp, mouse
gtgccactgctgctggaggt

SEQ ID NO: 424857 - DNA, 20 bp, mouse
ggcagaggcggggaacacga

SEQ ID NO: 424858 - DNA, 20 bp, mouse
ggaggacgacactggctagt

SEQ ID NO: 424859 - DNA, 20 bp, mouse
ggcggcggcgggaggagcaa

SEQ ID NO: 424860 - DNA, 20 bp, mouse
ggagagagaataaagaaccg

SEQ ID NO: 424861 - DNA, 20 bp, mouse
gagagaataaagaaccgcgg

SEQ ID NO: 424862 - DNA, 20 bp, mouse
gtctcgtcttcgctgggctg

SEQ ID NO: 424863 - DNA, 20 bp, mouse
gactgctgctggaggtgggc

SEQ ID NO: 424864 - DNA, 20 bp, mouse
gccggcgcccctggtctctg

SEQ ID NO: 424865 - DNA, 20 bp, mouse
ggagccaacgcaacccctgt

SEQ ID NO: 424866 - DNA, 20 bp, mouse
ggaagctgtatgcccaccgg

SEQ ID NO: 424867 - DNA, 20 bp, mouse
gaaaacactgttcccccggt

SEQ ID NO: 424868 - DNA, 20 bp, mouse
gctaaggttcctggaaacca

SEQ ID NO: 424869 - DNA, 20 bp, mouse
gggaaccttaggtagaaagg

SEQ ID NO: 424870 - DNA, 20 bp, mouse
gtctgaagctgtatgcccac

SEQ ID NO: 424871 - DNA, 20 bp, mouse
gttgtcaagggcaccaaaga

SEQ ID NO: 424872 - DNA, 20 bp, mouse
gtccataagagcagaaccta

SEQ ID NO: 424873 - DNA, 20 bp, mouse
gcttccaggaactttgtcaa

SEQ ID NO: 424874 - DNA, 20 bp, mouse
gtctcttccaaagaaacctt

SEQ ID NO: 424875 - DNA, 20 bp, mouse
gcacgccccctttctaccta

SEQ ID NO: 424876 - DNA, 20 bp, mouse
gtagctgtgcttgtctaggt

SEQ ID NO: 424877 - DNA, 20 bp, mouse
ggacaagcacagctatcccc

SEQ ID NO: 424878 - DNA, 20 bp, mouse
gaagcctgcttggctcacca

SEQ ID NO: 424879 - DNA, 20 bp, mouse
gttctggagtgagaagtctg

SEQ ID NO: 424880 - DNA, 20 bp, mouse
gttgtctaggttggcgctga

SEQ ID NO: 424881 - DNA, 20 bp, mouse
gacccatctggactcacagg

SEQ ID NO: 424882 - DNA, 20 bp, mouse
gccagcctgaagggagaaca

SEQ ID NO: 424883 - DNA, 20 bp, mouse
ggttcccagtgagcccagtt

SEQ ID NO: 424884 - DNA, 20 bp, mouse
gaagcagagagactctcaca

SEQ ID NO: 424885 - DNA, 20 bp, mouse
gccctgtgggtcaccaaact

SEQ ID NO: 424886 - DNA, 20 bp, mouse
gcgggtggcaggagaggcgg

SEQ ID NO: 424887 - DNA, 20 bp, mouse
ggaggcggcgaagacggccg

SEQ ID NO: 424888 - DNA, 20 bp, mouse
gcggcgccccgcccaactca

SEQ ID NO: 424889 - DNA, 20 bp, mouse
ggcctccgccaagtgaaccg

SEQ ID NO: 424890 - DNA, 20 bp, mouse
gggccctcggagccgtgagt

SEQ ID NO: 424891 - DNA, 20 bp, mouse
ggggatgcgggcatgttccg

SEQ ID NO: 424892 - DNA, 20 bp, mouse
gctcggagccgtgagttggg

SEQ ID NO: 424893 - DNA, 20 bp, mouse
gtccgcgcccgggactcccg

SEQ ID NO: 424894 - DNA, 20 bp, mouse
gggctcgcgtgcgcccggta

SEQ ID NO: 424895 - DNA, 20 bp, mouse
ggaagggcgcttccagggaa

SEQ ID NO: 424896 - DNA, 20 bp, mouse
gtctggccggagaggactcg

SEQ ID NO: 424897 - DNA, 20 bp, mouse
gccgccagcgtggtgatcag

SEQ ID NO: 424898 - DNA, 20 bp, mouse
ggacccaccccagcgacccg

SEQ ID NO: 424899 - DNA, 20 bp, mouse
gagagccgcagagctggtac

SEQ ID NO: 424900 - DNA, 20 bp, mouse
gtgctgatcgccaggcagtt

SEQ ID NO: 424901 - DNA, 20 bp, mouse
gtgatgctgtctggccggag

SEQ ID NO: 424902 - DNA, 20 bp, mouse
gcctggtccacgggtcgctg

SEQ ID NO: 424903 - DNA, 20 bp, mouse
gtcaagcctcgagtcctctc

SEQ ID NO: 424904 - DNA, 20 bp, mouse
gtgcctggcgatcagcagcg

SEQ ID NO: 424905 - DNA, 20 bp, mouse
gccagcgtggtgatcagggg

SEQ ID NO: 424906 - DNA, 20 bp, mouse
gaggctgtgcgtgtcttgtc

SEQ ID NO: 424907 - DNA, 20 bp, mouse
ggccagcagcactgtagatg

SEQ ID NO: 424908 - DNA, 20 bp, mouse
gaccgtgcacgggtgagtcg

SEQ ID NO: 424909 - DNA, 20 bp, mouse
gtggtgaactgttctaggga

SEQ ID NO: 424910 - DNA, 20 bp, mouse
gcctgcagctgtaatcctag

SEQ ID NO: 424911 - DNA, 20 bp, mouse
gtagagccccaggatcaagc

SEQ ID NO: 424912 - DNA, 20 bp, mouse
gtctacagtgctgctggcgc

SEQ ID NO: 424913 - DNA, 20 bp, mouse
gaggagccggcttgatcctg

SEQ ID NO: 424914 - DNA, 20 bp, mouse
ggctcagatgagaggcttca

SEQ ID NO: 424915 - DNA, 20 bp, mouse
gccctagcagagagattggg

SEQ ID NO: 424916 - DNA, 20 bp, mouse
gctcagaggctggcgatgga

SEQ ID NO: 424917 - DNA, 20 bp, mouse
gtggtgcagttacatctcag

SEQ ID NO: 424918 - DNA, 20 bp, mouse
gtaggttgaaggctccccag

SEQ ID NO: 424919 - DNA, 20 bp, mouse
gcagcctgcattttaaggta

SEQ ID NO: 424920 - DNA, 20 bp, mouse
gtgtaactgcaccagatctc

SEQ ID NO: 424921 - DNA, 20 bp, mouse
ggtcagctccagaattctgt

SEQ ID NO: 424922 - DNA, 20 bp, mouse
gacagagcgaatatataaga

SEQ ID NO: 424923 - DNA, 20 bp, mouse
gcacatgcttgactagggaa

SEQ ID NO: 424924 - DNA, 20 bp, mouse
gctcttgcaggagtgcatgc

SEQ ID NO: 424925 - DNA, 20 bp, mouse
gctgccttaccttaaaatgc

SEQ ID NO: 424926 - DNA, 20 bp, mouse
gaggcagctccatcccgacc

SEQ ID NO: 424927 - DNA, 20 bp, mouse
ggcggagggcacctgagcga

SEQ ID NO: 424928 - DNA, 20 bp, mouse
gtccatcccgacccggcgga

SEQ ID NO: 424929 - DNA, 20 bp, mouse
gcagctccatcccgacccgg

SEQ ID NO: 424930 - DNA, 20 bp, mouse
gactcctgggctccgaactc

SEQ ID NO: 424931 - DNA, 20 bp, mouse
ggcggccaccttcaagttca

SEQ ID NO: 424932 - DNA, 20 bp, mouse
gcaggtgccctccgccgggt

SEQ ID NO: 424933 - DNA, 20 bp, mouse
ggccctccgccgggtcggga

SEQ ID NO: 424934 - DNA, 20 bp, mouse
gccaccttcaagttcacggc

SEQ ID NO: 424935 - DNA, 20 bp, mouse
ggaggcggcggacacggaga

SEQ ID NO: 424936 - DNA, 20 bp, mouse
gagctctgcgttgaactcag

SEQ ID NO: 424937 - DNA, 20 bp, mouse
gctggagcccagcgtcacac

SEQ ID NO: 424938 - DNA, 20 bp, mouse
ggtgacgctgggctccagag

SEQ ID NO: 424939 - DNA, 20 bp, mouse
gagctagctgggaaatgttc

SEQ ID NO: 424940 - DNA, 20 bp, mouse
gggcaggagcctccatctag

SEQ ID NO: 424941 - DNA, 20 bp, mouse
gctgatacgagcccatggtc

SEQ ID NO: 424942 - DNA, 20 bp, mouse
ggacccaacaggagcctcgt

SEQ ID NO: 424943 - DNA, 20 bp, mouse
gggctccagagcggcaggtt

SEQ ID NO: 424944 - DNA, 20 bp, mouse
ggatcaccacccctagatgg

SEQ ID NO: 424945 - DNA, 20 bp, mouse
gaaacagggactcatcaacc

SEQ ID NO: 424946 - DNA, 20 bp, mouse
ggacaatccgagttgagtaa

SEQ ID NO: 424947 - DNA, 20 bp, mouse
gaggcagaaagaaaatcctg

SEQ ID NO: 424948 - DNA, 20 bp, mouse
gcccgctgacctgcttccac

SEQ ID NO: 424949 - DNA, 20 bp, mouse
gggtttctgcaaatttctcc

SEQ ID NO: 424950 - DNA, 20 bp, mouse
gtaggacgactcagaaccat

SEQ ID NO: 424951 - DNA, 20 bp, mouse
gggaagagatgtctctagcc

SEQ ID NO: 424952 - DNA, 20 bp, mouse
ggacgactcagaaccattgg

SEQ ID NO: 424953 - DNA, 20 bp, mouse
ggctcagggatggacgcatc

SEQ ID NO: 424954 - DNA, 20 bp, mouse
gagctgtgagtggaaaccat

SEQ ID NO: 424955 - DNA, 20 bp, mouse
gttgcagaaacccttttatc

SEQ ID NO: 424956 - DNA, 20 bp, mouse
ggatccttccctgggcggag

SEQ ID NO: 424957 - DNA, 20 bp, mouse
ggcgctctgcgcattacccc

SEQ ID NO: 424958 - DNA, 20 bp, mouse
gctggccacgatccttccct

SEQ ID NO: 424959 - DNA, 20 bp, mouse
gtactgggctggcaccgctc

SEQ ID NO: 424960 - DNA, 20 bp, mouse
gtggcccgcgggctcaggta

SEQ ID NO: 424961 - DNA, 20 bp, mouse
ggctggcgactcgacttact

SEQ ID NO: 424962 - DNA, 20 bp, mouse
gcagcctctccgcccaggga

SEQ ID NO: 424963 - DNA, 20 bp, mouse
gggagcacccggggcctgag

SEQ ID NO: 424964 - DNA, 20 bp, mouse
gggctgtgtgtgtggggttc

SEQ ID NO: 424965 - DNA, 20 bp, mouse
ggtccgtcacagcatctccc

SEQ ID NO: 424966 - DNA, 20 bp, mouse
ggccaggccagcgattctag

SEQ ID NO: 424967 - DNA, 20 bp, mouse
gcggggcagggatctacgcc

SEQ ID NO: 424968 - DNA, 20 bp, mouse
gccgcggtaggcgcccagag

SEQ ID NO: 424969 - DNA, 20 bp, mouse
gagggatctacgcctggcgc

SEQ ID NO: 424970 - DNA, 20 bp, mouse
ggacgggagccgagtcgcca

SEQ ID NO: 424971 - DNA, 20 bp, mouse
ggggactcaccgactttgta

SEQ ID NO: 424972 - DNA, 20 bp, mouse
gcgtgtggactccaatcccc

SEQ ID NO: 424973 - DNA, 20 bp, mouse
ggccagggtctgggcctcta

SEQ ID NO: 424974 - DNA, 20 bp, mouse
gagcgattctaggggtcccg

SEQ ID NO: 424975 - DNA, 20 bp, mouse
gcgccgccgagagccaggag

SEQ ID NO: 424976 - DNA, 20 bp, mouse
gggagcctgccggacagcga

SEQ ID NO: 424977 - DNA, 20 bp, mouse
gagctgcttgggcttccgaa

SEQ ID NO: 424978 - DNA, 20 bp, mouse
ggcctcgtcggctccgagac

SEQ ID NO: 424979 - DNA, 20 bp, mouse
ggcgagggccctcgaggaag

SEQ ID NO: 424980 - DNA, 20 bp, mouse
gtgtggccgccgtcgctgtc

SEQ ID NO: 424981 - DNA, 20 bp, mouse
gtccggtctcggagccgacg

SEQ ID NO: 424982 - DNA, 20 bp, mouse
ggccatgaaggagtacttct

SEQ ID NO: 424983 - DNA, 20 bp, mouse
ggccccgcgccgagctgctt

SEQ ID NO: 424984 - DNA, 20 bp, mouse
gaagcacgcacgcaaagtaa

SEQ ID NO: 424985 - DNA, 20 bp, mouse
gttcatggccacggtcacca

SEQ ID NO: 424986 - DNA, 20 bp, mouse
ggtgcaggttgtgtcagcag

SEQ ID NO: 424987 - DNA, 20 bp, mouse
ggagtcggcggttgcagtgg

SEQ ID NO: 424988 - DNA, 20 bp, mouse
gtcagagtcggcggttgcag

SEQ ID NO: 424989 - DNA, 20 bp, mouse
ggtgcgagagtcagagtcgg

SEQ ID NO: 424990 - DNA, 20 bp, mouse
gtccacctcaggcaccttgg

SEQ ID NO: 424991 - DNA, 20 bp, mouse
ggccgccaaggtgcctgagg

SEQ ID NO: 424992 - DNA, 20 bp, mouse
ggaggcggtgatgtcggtgc

SEQ ID NO: 424993 - DNA, 20 bp, mouse
gaaggatctgagcccctccg

SEQ ID NO: 424994 - DNA, 20 bp, mouse
ggcagccgccaaggtgcctg

SEQ ID NO: 424995 - DNA, 20 bp, mouse
ggccgcagggctcagagccg

SEQ ID NO: 424996 - DNA, 20 bp, mouse
ggagctcgcagaggcaacgg

SEQ ID NO: 424997 - DNA, 20 bp, mouse
gggcgagctcgcagaggcaa

SEQ ID NO: 424998 - DNA, 20 bp, mouse
gggcgagggcgagagacgga

SEQ ID NO: 424999 - DNA, 20 bp, mouse
ggcagggcgagggcgagaga

SEQ ID NO: 425000 - DNA, 20 bp, mouse
gaggtaaggcgagctcgcag

SEQ ID NO: 425001 - DNA, 20 bp, mouse
gctcgcagaggcaacggcgg

SEQ ID NO: 425002 - DNA, 20 bp, mouse
gggcggagacggagagaggc

SEQ ID NO: 425003 - DNA, 20 bp, mouse
gatggtgagcagcgaaggta

SEQ ID NO: 425004 - DNA, 20 bp, mouse
gctgggaagaggagtcgtag

SEQ ID NO: 425005 - DNA, 20 bp, mouse
gtccggatggtgagcagcga

SEQ ID NO: 425006 - DNA, 20 bp, mouse
gtgcgcctaggcgaggacga

SEQ ID NO: 425007 - DNA, 20 bp, mouse
ggagaggagggacagcccgg

SEQ ID NO: 425008 - DNA, 20 bp, mouse
gctgggcagcgggaaaggag

SEQ ID NO: 425009 - DNA, 20 bp, mouse
gagggaggcggcagcttggc

SEQ ID NO: 425010 - DNA, 20 bp, mouse
ggcggcgcgcctccgcactg

SEQ ID NO: 425011 - DNA, 20 bp, mouse
gggttccctgcgcctaggcg

SEQ ID NO: 425012 - DNA, 20 bp, mouse
gggacagcgcgcgtcgccag

SEQ ID NO: 425013 - DNA, 20 bp, mouse
ggcttggccggcaggaccgc

SEQ ID NO: 425014 - DNA, 20 bp, mouse
ggaagcggttccctgcgcct

SEQ ID NO: 425015 - DNA, 20 bp, mouse
gtgagttacctaggcaacag

SEQ ID NO: 425016 - DNA, 20 bp, mouse
gcgacggcgagccccagtcg

SEQ ID NO: 425017 - DNA, 20 bp, mouse
ggccagacccgccccgactg

SEQ ID NO: 425018 - DNA, 20 bp, mouse
gcggcgagccccagtcgggg

SEQ ID NO: 425019 - DNA, 20 bp, mouse
ggcggacagtgcagtccccg

SEQ ID NO: 425020 - DNA, 20 bp, mouse
gcagtgctgactgctggcga

SEQ ID NO: 425021 - DNA, 20 bp, mouse
gacttggagcagctctgccg

SEQ ID NO: 425022 - DNA, 20 bp, mouse
gggagagagggactcggaca

SEQ ID NO: 425023 - DNA, 20 bp, mouse
gccagggttcgggcgaccag

SEQ ID NO: 425024 - DNA, 20 bp, mouse
gtcgggcgaccaggggagag

SEQ ID NO: 425025 - DNA, 20 bp, mouse
gaccaggggagagagggact

SEQ ID NO: 425026 - DNA, 20 bp, mouse
gagctgatgcgccaggagaa

SEQ ID NO: 425027 - DNA, 20 bp, mouse
gaggagaagggcggctccca

SEQ ID NO: 425028 - DNA, 20 bp, mouse
gcaccgggcagcgaggccgt

SEQ ID NO: 425029 - DNA, 20 bp, mouse
ggttagctgcagtcacaacc

SEQ ID NO: 425030 - DNA, 20 bp, mouse
ggcggcagcaccgggcagcg

SEQ ID NO: 425031 - DNA, 20 bp, mouse
gggccctgcgcgtccagtcg

SEQ ID NO: 425032 - DNA, 20 bp, mouse
gaggctgcgcgcgtcagaaa

SEQ ID NO: 425033 - DNA, 20 bp, mouse
gctcctggcgcatcagctct

SEQ ID NO: 425034 - DNA, 20 bp, mouse
gggctgcccgcggcagcacc

SEQ ID NO: 425035 - DNA, 20 bp, mouse
gcacagcccacccgcccgag

SEQ ID NO: 425036 - DNA, 20 bp, mouse
ggcgcgggcaccatgagcag

SEQ ID NO: 425037 - DNA, 20 bp, mouse
gcggtcccgagggtcaggag

SEQ ID NO: 425038 - DNA, 20 bp, mouse
gcgggcgacagaggagactc

SEQ ID NO: 425039 - DNA, 20 bp, mouse
ggcctctccgggacacgcgt

SEQ ID NO: 425040 - DNA, 20 bp, mouse
ggtggggcaccgagcgtcaa

SEQ ID NO: 425041 - DNA, 20 bp, mouse
ggaggggccgcagtgctcta

SEQ ID NO: 425042 - DNA, 20 bp, mouse
ggtcgcggctgcggaggagc

SEQ ID NO: 425043 - DNA, 20 bp, mouse
gctcactgaggtgagatgtt

SEQ ID NO: 425044 - DNA, 20 bp, mouse
gcggctggcataggtgatgt

SEQ ID NO: 425045 - DNA, 20 bp, mouse
gagcgacccggaggacgaac

SEQ ID NO: 425046 - DNA, 20 bp, mouse
ggcctccgcggctccctcag

SEQ ID NO: 425047 - DNA, 20 bp, mouse
gaggcggggcgcagaagatc

SEQ ID NO: 425048 - DNA, 20 bp, mouse
ggatcgggcgcgcccgctga

SEQ ID NO: 425049 - DNA, 20 bp, mouse
ggcgcccgctgagggagccg

SEQ ID NO: 425050 - DNA, 20 bp, mouse
ggtccaagagtacttacccg

SEQ ID NO: 425051 - DNA, 20 bp, mouse
gtacttacccggggcaggcg

SEQ ID NO: 425052 - DNA, 20 bp, mouse
gccagtcccagggatagcta

SEQ ID NO: 425053 - DNA, 20 bp, mouse
ggctttccttctctagtctg

SEQ ID NO: 425054 - DNA, 20 bp, mouse
gcctgggactggagcaccac

SEQ ID NO: 425055 - DNA, 20 bp, mouse
ggaaagtgatgggcactcca

SEQ ID NO: 425056 - DNA, 20 bp, mouse
ggtttccaggcgctgccagg

SEQ ID NO: 425057 - DNA, 20 bp, mouse
ggaagcagcacagcacctcc

SEQ ID NO: 425058 - DNA, 20 bp, mouse
gctgggaccgagcggtcctc

SEQ ID NO: 425059 - DNA, 20 bp, mouse
ggctgcttgggagctggtag

SEQ ID NO: 425060 - DNA, 20 bp, mouse
gcaggcgctgccaggcggct

SEQ ID NO: 425061 - DNA, 20 bp, mouse
gccgcaggagcactgttaac

SEQ ID NO: 425062 - DNA, 20 bp, mouse
gccccaggccagggttactt

SEQ ID NO: 425063 - DNA, 20 bp, mouse
ggtgagctgatggccaagtg

SEQ ID NO: 425064 - DNA, 20 bp, mouse
ggctgcttctagtagtttcc

SEQ ID NO: 425065 - DNA, 20 bp, mouse
gtggtatgggccagcaagac

SEQ ID NO: 425066 - DNA, 20 bp, mouse
gacgacgacggccctggtag

SEQ ID NO: 425067 - DNA, 20 bp, mouse
gatggcggcgctgacgacga

SEQ ID NO: 425068 - DNA, 20 bp, mouse
ggcgctgacgacgacggccc

SEQ ID NO: 425069 - DNA, 20 bp, mouse
ggaggcacagctgtccggta

SEQ ID NO: 425070 - DNA, 20 bp, mouse
gccgcgcgctcccgctacca

SEQ ID NO: 425071 - DNA, 20 bp, mouse
ggcgccgccatggccaagtg

SEQ ID NO: 425072 - DNA, 20 bp, mouse
ggagctcgcccaacttcagg

SEQ ID NO: 425073 - DNA, 20 bp, mouse
gaggaaccgtctcccgccac

SEQ ID NO: 425074 - DNA, 20 bp, mouse
gagcaggcgggcgggctcct

SEQ ID NO: 425075 - DNA, 20 bp, mouse
gtctgggagctgcgggcgat

SEQ ID NO: 425076 - DNA, 20 bp, mouse
gaaacaaaggagcaagacca

SEQ ID NO: 425077 - DNA, 20 bp, mouse
gagcaagaccagggacttca

SEQ ID NO: 425078 - DNA, 20 bp, mouse
ggcagcccggataatcagct

SEQ ID NO: 425079 - DNA, 20 bp, mouse
gcttcatggttgctccagag

SEQ ID NO: 425080 - DNA, 20 bp, mouse
gtcacagaggatgctcccac

SEQ ID NO: 425081 - DNA, 20 bp, mouse
gaggccctctgcccctctat

SEQ ID NO: 425082 - DNA, 20 bp, mouse
gtctcccagtggagatggaa

SEQ ID NO: 425083 - DNA, 20 bp, mouse
gggagcaaccatgaagtccc

SEQ ID NO: 425084 - DNA, 20 bp, mouse
gtggagagctagaccaatag

SEQ ID NO: 425085 - DNA, 20 bp, mouse
ggacatttgcccattttcca

SEQ ID NO: 425086 - DNA, 20 bp, mouse
ggtcacgctggagaccgata

SEQ ID NO: 425087 - DNA, 20 bp, mouse
gctttggcctaagactttga

SEQ ID NO: 425088 - DNA, 20 bp, mouse
ggcttgaagcaagcttcctt

SEQ ID NO: 425089 - DNA, 20 bp, mouse
ggctggagaccgatatggac

SEQ ID NO: 425090 - DNA, 20 bp, mouse
gagaggcccgcgccacaaag

SEQ ID NO: 425091 - DNA, 20 bp, mouse
gttgactccctcaaagtctt

SEQ ID NO: 425092 - DNA, 20 bp, mouse
ggcaaagcctccatccagac

SEQ ID NO: 425093 - DNA, 20 bp, mouse
gggagtcaagaaagtcacgc

SEQ ID NO: 425094 - DNA, 20 bp, mouse
gagagggtggcaagcagacg

SEQ ID NO: 425095 - DNA, 20 bp, mouse
gggggaagggaagaacttcg

SEQ ID NO: 425096 - DNA, 20 bp, mouse
ggagacggagagaaccgacg

SEQ ID NO: 425097 - DNA, 20 bp, mouse
gaccgacggggccgcgacag

SEQ ID NO: 425098 - DNA, 20 bp, mouse
gctggagaccgcaccagctg

SEQ ID NO: 425099 - DNA, 20 bp, mouse
gaggccgccccaatcctcgg

SEQ ID NO: 425100 - DNA, 20 bp, mouse
gtgtctctgaggggcgggtt

SEQ ID NO: 425101 - DNA, 20 bp, mouse
gagagcaggcgtcacgtgac

SEQ ID NO: 425102 - DNA, 20 bp, mouse
gcccgctgtcgcggccccgt

SEQ ID NO: 425103 - DNA, 20 bp, mouse
gtggcggcccccgaggattg

SEQ ID NO: 425104 - DNA, 20 bp, mouse
gccacgccccagttaggttg

SEQ ID NO: 425105 - DNA, 20 bp, mouse
ggggttcggtcccgctgtcg

SEQ ID NO: 425106 - DNA, 20 bp, mouse
gggcagctggaggatctcag

SEQ ID NO: 425107 - DNA, 20 bp, mouse
ggaacggtcccagaagagac

SEQ ID NO: 425108 - DNA, 20 bp, mouse
gctcatggctcctcagacgc

SEQ ID NO: 425109 - DNA, 20 bp, mouse
ggacgctggttgtcttaggc

SEQ ID NO: 425110 - DNA, 20 bp, mouse
gcagcacttgggtaacacct

SEQ ID NO: 425111 - DNA, 20 bp, mouse
gccagaagagactggggagc

SEQ ID NO: 425112 - DNA, 20 bp, mouse
gctaagacaaccagcgtctg

SEQ ID NO: 425113 - DNA, 20 bp, mouse
gttcctcctgaggggtacag

SEQ ID NO: 425114 - DNA, 20 bp, mouse
gggctggcagtctgtccgct

SEQ ID NO: 425115 - DNA, 20 bp, mouse
gagcaagggaatgagtggaa

SEQ ID NO: 425116 - DNA, 20 bp, mouse
ggtgtggcgacgggacccag

SEQ ID NO: 425117 - DNA, 20 bp, mouse
gcatggtatgagcccgactc

SEQ ID NO: 425118 - DNA, 20 bp, mouse
gatgagcccgactccggaca

SEQ ID NO: 425119 - DNA, 20 bp, mouse
gagagtcggcggggaagcta

SEQ ID NO: 425120 - DNA, 20 bp, mouse
gcctgcgggagacaaagagt

SEQ ID NO: 425121 - DNA, 20 bp, mouse
gtggcgacgggacccagggg

SEQ ID NO: 425122 - DNA, 20 bp, mouse
gccgactccggacaaggcca

SEQ ID NO: 425123 - DNA, 20 bp, mouse
gttgctgagtgcgaccgaca

SEQ ID NO: 425124 - DNA, 20 bp, mouse
gtgttgtccctggccttgtc

SEQ ID NO: 425125 - DNA, 20 bp, mouse
ggcgcgcgggaactcggagg

SEQ ID NO: 425126 - DNA, 20 bp, mouse
gacccgccaggcctccacac

SEQ ID NO: 425127 - DNA, 20 bp, mouse
ggaaggagcgggagcttccg

SEQ ID NO: 425128 - DNA, 20 bp, mouse
gtggtattcgacccgttcga

SEQ ID NO: 425129 - DNA, 20 bp, mouse
gcatttcggcgatcactcct

SEQ ID NO: 425130 - DNA, 20 bp, mouse
gccgttcgacggtgcgtgga

SEQ ID NO: 425131 - DNA, 20 bp, mouse
gtagtgtgcgtgtgacggga

SEQ ID NO: 425132 - DNA, 20 bp, mouse
gcctccacaccggaacattt

SEQ ID NO: 425133 - DNA, 20 bp, mouse
gggacaggggagctctgcga

SEQ ID NO: 425134 - DNA, 20 bp, mouse
gcgtccagaggccgaaacag

SEQ ID NO: 425135 - DNA, 20 bp, mouse
gcgtacaccgtccgcaccaa

SEQ ID NO: 425136 - DNA, 20 bp, mouse
gccggaagacgcgaggacca

SEQ ID NO: 425137 - DNA, 20 bp, mouse
ggaggaccaaggaccgctac

SEQ ID NO: 425138 - DNA, 20 bp, mouse
ggcgacccggagacagtgat

SEQ ID NO: 425139 - DNA, 20 bp, mouse
gcacgccgcgcgagggaaca

SEQ ID NO: 425140 - DNA, 20 bp, mouse
ggcggcgtggggtacactag

SEQ ID NO: 425141 - DNA, 20 bp, mouse
gcgacacggggcctcagcgc

SEQ ID NO: 425142 - DNA, 20 bp, mouse
gtgatgggcacgccccgaca

SEQ ID NO: 425143 - DNA, 20 bp, mouse
gccgctacaggtgaggtcac

SEQ ID NO: 425144 - DNA, 20 bp, mouse
gtacactaggggcatgacag

SEQ ID NO: 425145 - DNA, 20 bp, mouse
gtgtaccccacgccgcgcga

SEQ ID NO: 425146 - DNA, 20 bp, mouse
gccgcgagcgagctgtcccg

SEQ ID NO: 425147 - DNA, 20 bp, mouse
gcgcccgcggccaccaagcc

SEQ ID NO: 425148 - DNA, 20 bp, mouse
ggtgcctcactctgccacca

SEQ ID NO: 425149 - DNA, 20 bp, mouse
gctaccctggtggcagagtg

SEQ ID NO: 425150 - DNA, 20 bp, mouse
ggccgcaaagaagccggtaa

SEQ ID NO: 425151 - DNA, 20 bp, mouse
gagctgtcccggggcgcgtg

SEQ ID NO: 425152 - DNA, 20 bp, mouse
ggcagagtgaggcactcagg

SEQ ID NO: 425153 - DNA, 20 bp, mouse
gagggacaggcgcgctcacc

SEQ ID NO: 425154 - DNA, 20 bp, mouse
ggcgcgctcacctggcttgg

SEQ ID NO: 425155 - DNA, 20 bp, mouse
ggaccagcacaaggtaggga

SEQ ID NO: 425156 - DNA, 20 bp, mouse
ggccgggctgctcgtgggga

SEQ ID NO: 425157 - DNA, 20 bp, mouse
gcgccgcgccccggttccca

SEQ ID NO: 425158 - DNA, 20 bp, mouse
gcctcgcatcagacctacgg

SEQ ID NO: 425159 - DNA, 20 bp, mouse
gtgccctcgcatcagaccta

SEQ ID NO: 425160 - DNA, 20 bp, mouse
gccccgccgggctgctcgtg

SEQ ID NO: 425161 - DNA, 20 bp, mouse
ggggccaggccgcgcgaaca

SEQ ID NO: 425162 - DNA, 20 bp, mouse
gccaggccgccagctcgcgt

SEQ ID NO: 425163 - DNA, 20 bp, mouse
gggccttaccagatcaatga

SEQ ID NO: 425164 - DNA, 20 bp, mouse
gcacacgggggtgcagccca

SEQ ID NO: 425165 - DNA, 20 bp, mouse
ggccgggcgccgtgggaacc

SEQ ID NO: 425166 - DNA, 20 bp, mouse
gcgccagaggagcacctcgt

SEQ ID NO: 425167 - DNA, 20 bp, mouse
gagcacctcgtgggaggagt

SEQ ID NO: 425168 - DNA, 20 bp, mouse
ggacagcgagaggtgtgtcg

SEQ ID NO: 425169 - DNA, 20 bp, mouse
gcagaggagcacctcgtggg

SEQ ID NO: 425170 - DNA, 20 bp, mouse
ggagtaggagaggcccccga

SEQ ID NO: 425171 - DNA, 20 bp, mouse
gctctcctactcctcccacg

SEQ ID NO: 425172 - DNA, 20 bp, mouse
ggcccccagagagcccgctt

SEQ ID NO: 425173 - DNA, 20 bp, mouse
gacgccgggggctccgtcgg

SEQ ID NO: 425174 - DNA, 20 bp, mouse
ggcttcggcacccacgccgg

SEQ ID NO: 425175 - DNA, 20 bp, mouse
ggtgtcggggtcgccgccag

SEQ ID NO: 425176 - DNA, 20 bp, mouse
gttgcagggtgacagtgata

SEQ ID NO: 425177 - DNA, 20 bp, mouse
gtccggcagaagctcctagt

SEQ ID NO: 425178 - DNA, 20 bp, mouse
gaccctgcaagggtgcggac

SEQ ID NO: 425179 - DNA, 20 bp, mouse
ggatgctgtggggctttcag

SEQ ID NO: 425180 - DNA, 20 bp, mouse
gcacagagacgagtgtgtac

SEQ ID NO: 425181 - DNA, 20 bp, mouse
ggcggccctgaggaatccag

SEQ ID NO: 425182 - DNA, 20 bp, mouse
gtggcacccgagggacgtga

SEQ ID NO: 425183 - DNA, 20 bp, mouse
ggcccgtccgcacccttgca

SEQ ID NO: 425184 - DNA, 20 bp, mouse
ggggtaagcccgacacccca

SEQ ID NO: 425185 - DNA, 20 bp, mouse
gcgtggggagtccaggaaca

SEQ ID NO: 425186 - DNA, 20 bp, mouse
gtgctgtgtcaatatcaagt

SEQ ID NO: 425187 - DNA, 20 bp, mouse
gaagctgaggagcccccaag

SEQ ID NO: 425188 - DNA, 20 bp, mouse
gctggagcacgggatgctgg

SEQ ID NO: 425189 - DNA, 20 bp, mouse
gggagcataggccccttacc

SEQ ID NO: 425190 - DNA, 20 bp, mouse
ggtgaaccaaggagcctctt

SEQ ID NO: 425191 - DNA, 20 bp, mouse
gggttccttcaggtgaacca

SEQ ID NO: 425192 - DNA, 20 bp, mouse
gttttccaggttatatgtgt

SEQ ID NO: 425193 - DNA, 20 bp, mouse
gcccacactgaagtatgaca

SEQ ID NO: 425194 - DNA, 20 bp, mouse
gtatctgttgggttgtatga

SEQ ID NO: 425195 - DNA, 20 bp, mouse
gcaacccaacagatagtcta

SEQ ID NO: 425196 - DNA, 20 bp, mouse
gaccggcctggaccacatca

SEQ ID NO: 425197 - DNA, 20 bp, mouse
gggcctggaccacatcacgg

SEQ ID NO: 425198 - DNA, 20 bp, mouse
ggccaggagcacactcgacg

SEQ ID NO: 425199 - DNA, 20 bp, mouse
gtgactaccggcatcagaca

SEQ ID NO: 425200 - DNA, 20 bp, mouse
gggtcaacaacagcatttcc

SEQ ID NO: 425201 - DNA, 20 bp, mouse
gttcctccgtgatgtggtcc

SEQ ID NO: 425202 - DNA, 20 bp, mouse
gctctcatatcattaaggga

SEQ ID NO: 425203 - DNA, 20 bp, mouse
gcacactcgacgtggcagat

SEQ ID NO: 425204 - DNA, 20 bp, mouse
gagtgactctggggggtgaa

SEQ ID NO: 425205 - DNA, 20 bp, mouse
gctgattcaaagtgcaggtg

SEQ ID NO: 425206 - DNA, 20 bp, mouse
gctgctcaagagctgcggtt

SEQ ID NO: 425207 - DNA, 20 bp, mouse
gtcgggacactcacatgaag

SEQ ID NO: 425208 - DNA, 20 bp, mouse
gcctcagccgggagaaggaa

SEQ ID NO: 425209 - DNA, 20 bp, mouse
gagggagagcatgctactgg

SEQ ID NO: 425210 - DNA, 20 bp, mouse
gagcatgctactggaggcag

SEQ ID NO: 425211 - DNA, 20 bp, mouse
gagcagcctcagccgggaga

SEQ ID NO: 425212 - DNA, 20 bp, mouse
ggccagcctcccgcagtccc

SEQ ID NO: 425213 - DNA, 20 bp, mouse
gctttttcccgggtgagaaa

SEQ ID NO: 425214 - DNA, 20 bp, mouse
gactgttgccgggagtatag

SEQ ID NO: 425215 - DNA, 20 bp, mouse
ggtctgtctgggcaagggac

SEQ ID NO: 425216 - DNA, 20 bp, mouse
gtgtctgaggtggccttggg

SEQ ID NO: 425217 - DNA, 20 bp, mouse
gaggcggctgctgtctgagg

SEQ ID NO: 425218 - DNA, 20 bp, mouse
gaacgctcagaagccaccca

SEQ ID NO: 425219 - DNA, 20 bp, mouse
gcatggtgggaacccaagga

SEQ ID NO: 425220 - DNA, 20 bp, mouse
gtgctgtctgaggtggcctt

SEQ ID NO: 425221 - DNA, 20 bp, mouse
gctagactggacgagggata

SEQ ID NO: 425222 - DNA, 20 bp, mouse
gaaggtagcgggcgagggac

SEQ ID NO: 425223 - DNA, 20 bp, mouse
gctcgcccgctaccttcctt

SEQ ID NO: 425224 - DNA, 20 bp, mouse
gacgcgggccacgtgcaggt

SEQ ID NO: 425225 - DNA, 20 bp, mouse
gcagaagggaccgggaccct

SEQ ID NO: 425226 - DNA, 20 bp, mouse
gggagttgccgaaacaggtc

SEQ ID NO: 425227 - DNA, 20 bp, mouse
gtcggcaactcctagcgcct

SEQ ID NO: 425228 - DNA, 20 bp, mouse
ggagggcagaagccaaaaaa

SEQ ID NO: 425229 - DNA, 20 bp, mouse
gaagagacgctgggaaagtg

SEQ ID NO: 425230 - DNA, 20 bp, mouse
gatgtgagaggtagcctgac

SEQ ID NO: 425231 - DNA, 20 bp, mouse
ggtcgagctcggcatgtgag

SEQ ID NO: 425232 - DNA, 20 bp, mouse
gcttctgccctcagtcaaaa

SEQ ID NO: 425233 - DNA, 20 bp, mouse
gcagaagctgccgaggcgct

SEQ ID NO: 425234 - DNA, 20 bp, mouse
gagttgccggactttcagga

SEQ ID NO: 425235 - DNA, 20 bp, mouse
gggaagctaccgagcgagtc

SEQ ID NO: 425236 - DNA, 20 bp, mouse
ggacgtccatgctgcaggta

SEQ ID NO: 425237 - DNA, 20 bp, mouse
ggtctctctactcctcaatg

SEQ ID NO: 425238 - DNA, 20 bp, mouse
ggggagcctgggtaatggaa

SEQ ID NO: 425239 - DNA, 20 bp, mouse
gcttgacaccctccacattg

SEQ ID NO: 425240 - DNA, 20 bp, mouse
gtctctactcctcaatgtgg

SEQ ID NO: 425241 - DNA, 20 bp, mouse
gctctcccctacctgcagca

SEQ ID NO: 425242 - DNA, 20 bp, mouse
ggtaggggagaggtttgttc

SEQ ID NO: 425243 - DNA, 20 bp, mouse
gaccaaagcagggaacaatc

SEQ ID NO: 425244 - DNA, 20 bp, mouse
ggaagaccattctgcatggg

SEQ ID NO: 425245 - DNA, 20 bp, mouse
ggaaccacggggtcctatct

SEQ ID NO: 425246 - DNA, 20 bp, mouse
ggtcgtggtgctatccggag

SEQ ID NO: 425247 - DNA, 20 bp, mouse
ggatagcaccacgacaccca

SEQ ID NO: 425248 - DNA, 20 bp, mouse
gagagcatgcagcagcggaa

SEQ ID NO: 425249 - DNA, 20 bp, mouse
gttactccccagcggcggaa

SEQ ID NO: 425250 - DNA, 20 bp, mouse
gtatatttactccccagcgg

SEQ ID NO: 425251 - DNA, 20 bp, mouse
ggtttatatttactccccag

SEQ ID NO: 425252 - DNA, 20 bp, mouse
ggcaccacgacacccaagga

SEQ ID NO: 425253 - DNA, 20 bp, mouse
gggagaatgagaggcaccgg

SEQ ID NO: 425254 - DNA, 20 bp, mouse
gcggctagagcatgcagcag

SEQ ID NO: 425255 - DNA, 20 bp, mouse
ggctctagccgaccacgacg

SEQ ID NO: 425256 - DNA, 20 bp, mouse
ggaggcagacgcgcagaggg

SEQ ID NO: 425257 - DNA, 20 bp, mouse
ggcagacgcgcagagggagg

SEQ ID NO: 425258 - DNA, 20 bp, mouse
ggctctgcggagggcgcggt

SEQ ID NO: 425259 - DNA, 20 bp, mouse
ggcagagggaggcggccgag

SEQ ID NO: 425260 - DNA, 20 bp, mouse
gtgcagagcgagcgcttaga

SEQ ID NO: 425261 - DNA, 20 bp, mouse
gtctggaggcagacgcgcag

SEQ ID NO: 425262 - DNA, 20 bp, mouse
gggacagaggcccctcgacc

SEQ ID NO: 425263 - DNA, 20 bp, mouse
gggaggcgcgcggggatccc

SEQ ID NO: 425264 - DNA, 20 bp, mouse
ggcgcgggcggctctgcgga

SEQ ID NO: 425265 - DNA, 20 bp, mouse
gcgacgagtagcgaagcggg

SEQ ID NO: 425266 - DNA, 20 bp, mouse
gcgtgcaagtgagagccagg

SEQ ID NO: 425267 - DNA, 20 bp, mouse
gggccaggcagacaaaagtt

SEQ ID NO: 425268 - DNA, 20 bp, mouse
gctgcaggccccagatccgt

SEQ ID NO: 425269 - DNA, 20 bp, mouse
gggatgcaagtcactcacgg

SEQ ID NO: 425270 - DNA, 20 bp, mouse
gccttcccggaaagtagatc

SEQ ID NO: 425271 - DNA, 20 bp, mouse
gccggaaagtagatccggcc

SEQ ID NO: 425272 - DNA, 20 bp, mouse
gcaagtgagagccagggggg

SEQ ID NO: 425273 - DNA, 20 bp, mouse
gctggcagggcccacggtag

SEQ ID NO: 425274 - DNA, 20 bp, mouse
gcagatccgtgggcatggaa

SEQ ID NO: 425275 - DNA, 20 bp, mouse
ggccgggctcgagttccccg

SEQ ID NO: 425276 - DNA, 20 bp, mouse
gtgcaggcggctgagaggac

SEQ ID NO: 425277 - DNA, 20 bp, mouse
gggacaggcagggcactcac

SEQ ID NO: 425278 - DNA, 20 bp, mouse
ggagggtgtggtgggcgctg

SEQ ID NO: 425279 - DNA, 20 bp, mouse
ggcctttgcaggcggctgag

SEQ ID NO: 425280 - DNA, 20 bp, mouse
gcttccacgcgggcagacaa

SEQ ID NO: 425281 - DNA, 20 bp, mouse
ggcccaccacaccctccccc

SEQ ID NO: 425282 - DNA, 20 bp, mouse
gagcagacacacactgacct

SEQ ID NO: 425283 - DNA, 20 bp, mouse
gcacacactgacctggggga

SEQ ID NO: 425284 - DNA, 20 bp, mouse
gctgaggccctaagggacaa

SEQ ID NO: 425285 - DNA, 20 bp, mouse
gaaatagtcgcctttgcagg

SEQ ID NO: 425286 - DNA, 20 bp, mouse
gccaggaccctaaggccagg

SEQ ID NO: 425287 - DNA, 20 bp, mouse
gcttaacacccaggacccta

SEQ ID NO: 425288 - DNA, 20 bp, mouse
gcagcaggatggaaggtatg

SEQ ID NO: 425289 - DNA, 20 bp, mouse
gctgctgagatctgggagct

SEQ ID NO: 425290 - DNA, 20 bp, mouse
ggtcagcactctgcaagaca

SEQ ID NO: 425291 - DNA, 20 bp, mouse
gaaggtatgtggtcccctcc

SEQ ID NO: 425292 - DNA, 20 bp, mouse
gcttccatcctgctgagatc

SEQ ID NO: 425293 - DNA, 20 bp, mouse
gtggctataaataccagcat

SEQ ID NO: 425294 - DNA, 20 bp, mouse
ggtcctgggtgttaaggaat

SEQ ID NO: 425295 - DNA, 20 bp, mouse
gtctcagagattgagagggt

SEQ ID NO: 425296 - DNA, 20 bp, mouse
gggttcggaagccaacacgt

SEQ ID NO: 425297 - DNA, 20 bp, mouse
gtggaagcgctagacctgtg

SEQ ID NO: 425298 - DNA, 20 bp, mouse
gccgaaccggagattccgaa

SEQ ID NO: 425299 - DNA, 20 bp, mouse
gagccagccgcacacctcac

SEQ ID NO: 425300 - DNA, 20 bp, mouse
gagtgaagctttggaagaca

SEQ ID NO: 425301 - DNA, 20 bp, mouse
gaccagtgtgagcccggagt

SEQ ID NO: 425302 - DNA, 20 bp, mouse
gggatgcccttcggaatctc

SEQ ID NO: 425303 - DNA, 20 bp, mouse
gacaactggagaccccgcga

SEQ ID NO: 425304 - DNA, 20 bp, mouse
gttcccgccccggagctggg

SEQ ID NO: 425305 - DNA, 20 bp, mouse
gagaagctacaaggtcaggg

SEQ ID NO: 425306 - DNA, 20 bp, mouse
gcaggctccgcggccctgga

SEQ ID NO: 425307 - DNA, 20 bp, mouse
gccaccgccagccaccatgg

SEQ ID NO: 425308 - DNA, 20 bp, mouse
gcgccccgacgcccccatgg

SEQ ID NO: 425309 - DNA, 20 bp, mouse
gcatgctgcagggcacaggt

SEQ ID NO: 425310 - DNA, 20 bp, mouse
gctgcgcagacgctggtctg

SEQ ID NO: 425311 - DNA, 20 bp, mouse
gcccggggcccccatgatca

SEQ ID NO: 425312 - DNA, 20 bp, mouse
gctgcgcgccgtgatcatgg

SEQ ID NO: 425313 - DNA, 20 bp, mouse
gggaccaccgccagccacca

SEQ ID NO: 425314 - DNA, 20 bp, mouse
gggcagcttcgggtagatgg

SEQ ID NO: 425315 - DNA, 20 bp, mouse
gacgcccccatggtggctgg

SEQ ID NO: 425316 - DNA, 20 bp, mouse
gcccctacaggggaaaggag

SEQ ID NO: 425317 - DNA, 20 bp, mouse
gtcgcctgccacccctacag

SEQ ID NO: 425318 - DNA, 20 bp, mouse
gagcagggaaggactcgggt

SEQ ID NO: 425319 - DNA, 20 bp, mouse
gtgccacccctacaggggaa

SEQ ID NO: 425320 - DNA, 20 bp, mouse
gcggcacgggtgaggagcta

SEQ ID NO: 425321 - DNA, 20 bp, mouse
gagaacctcaagaccggcac

SEQ ID NO: 425322 - DNA, 20 bp, mouse
ggcctctcctttcccctgta

SEQ ID NO: 425323 - DNA, 20 bp, mouse
ggctaaggcggggggagtga

SEQ ID NO: 425324 - DNA, 20 bp, mouse
gggagttgcgcgcctggact

SEQ ID NO: 425325 - DNA, 20 bp, mouse
gaggcagcggccactgtggg

SEQ ID NO: 425326 - DNA, 20 bp, mouse
gcagcgcgagcgccagggga

SEQ ID NO: 425327 - DNA, 20 bp, mouse
gcaggcagcgcgagcgccag

SEQ ID NO: 425328 - DNA, 20 bp, mouse
gttgtctggggcgaagggaa

SEQ ID NO: 425329 - DNA, 20 bp, mouse
gggcgcggaggaggaccacg

SEQ ID NO: 425330 - DNA, 20 bp, mouse
gctaatgaaggcgctcacag

SEQ ID NO: 425331 - DNA, 20 bp, mouse
gggtcccctcagcgactccc

SEQ ID NO: 425332 - DNA, 20 bp, mouse
gagcgcgcagagccgggagg

SEQ ID NO: 425333 - DNA, 20 bp, mouse
gccgagcgcgcagagccggg

SEQ ID NO: 425334 - DNA, 20 bp, mouse
ggcgagcagcagcggcttcc

SEQ ID NO: 425335 - DNA, 20 bp, mouse
gagctgaggaatgtccctcc

SEQ ID NO: 425336 - DNA, 20 bp, mouse
ggcttccaccatggctgaag

SEQ ID NO: 425337 - DNA, 20 bp, mouse
gactactacagcttccacca

SEQ ID NO: 425338 - DNA, 20 bp, mouse
gctgttaggagcctccccgg

SEQ ID NO: 425339 - DNA, 20 bp, mouse
ggaagctgtagtagttgcta

SEQ ID NO: 425340 - DNA, 20 bp, mouse
gttgctgtggagatagatca

SEQ ID NO: 425341 - DNA, 20 bp, mouse
gatcttcagaactttttcgg

SEQ ID NO: 425342 - DNA, 20 bp, mouse
ggtcggttgctaaggaggag

SEQ ID NO: 425343 - DNA, 20 bp, mouse
ggaggctcggactctcggag

SEQ ID NO: 425344 - DNA, 20 bp, mouse
ggcttagggacaggtcctgg

SEQ ID NO: 425345 - DNA, 20 bp, mouse
gtaaggtgaaagagtcctgt

SEQ ID NO: 425346 - DNA, 20 bp, mouse
gtccgggggaatgcgatgag

SEQ ID NO: 425347 - DNA, 20 bp, mouse
gcgtactgaggcatttccgg

SEQ ID NO: 425348 - DNA, 20 bp, mouse
gcggagcgctgtcggaaaca

SEQ ID NO: 425349 - DNA, 20 bp, mouse
gagtagtcttccccgtactg

SEQ ID NO: 425350 - DNA, 20 bp, mouse
ggcccctcatcgcattcccc

SEQ ID NO: 425351 - DNA, 20 bp, mouse
gaatggcgcagtagtctcca

SEQ ID NO: 425352 - DNA, 20 bp, mouse
ggcgctccgctccttagtaa

SEQ ID NO: 425353 - DNA, 20 bp, mouse
gccagcttaggtaagactca

SEQ ID NO: 425354 - DNA, 20 bp, mouse
gacaatgccagaagaggccc

SEQ ID NO: 425355 - DNA, 20 bp, mouse
gctaaggagcggagcgctgt

SEQ ID NO: 425356 - DNA, 20 bp, mouse
gctcagagtatcctctaata

SEQ ID NO: 425357 - DNA, 20 bp, mouse
ggatactctgagacatgcca

SEQ ID NO: 425358 - DNA, 20 bp, mouse
gtaatatggcaaacacctct

SEQ ID NO: 425359 - DNA, 20 bp, mouse
ggagcagccacatgataaac

SEQ ID NO: 425360 - DNA, 20 bp, mouse
gggatatgtgggatagaagg

SEQ ID NO: 425361 - DNA, 20 bp, mouse
ggataaacaggctgaaatac

SEQ ID NO: 425362 - DNA, 20 bp, mouse
gtttcagcctgtttatcatg

SEQ ID NO: 425363 - DNA, 20 bp, mouse
gaaagacatacatctaggag

SEQ ID NO: 425364 - DNA, 20 bp, mouse
ggatagaagggggggaagtc

SEQ ID NO: 425365 - DNA, 20 bp, mouse
gtaggagaggatgtgtttgt

SEQ ID NO: 425366 - DNA, 20 bp, mouse
gccggtccacaggtaagcag

SEQ ID NO: 425367 - DNA, 20 bp, mouse
gtgtcgcgtccccggtccac

SEQ ID NO: 425368 - DNA, 20 bp, mouse
gcgacagcagctatcttctg

SEQ ID NO: 425369 - DNA, 20 bp, mouse
gagggaattgtccacattct

SEQ ID NO: 425370 - DNA, 20 bp, mouse
gcggccactgttaccctttg

SEQ ID NO: 425371 - DNA, 20 bp, mouse
gactggtgtggggtccccgc

SEQ ID NO: 425372 - DNA, 20 bp, mouse
gtgtactttcctgcaactga

SEQ ID NO: 425373 - DNA, 20 bp, mouse
gggaagtgctaggtttcaca

SEQ ID NO: 425374 - DNA, 20 bp, mouse
gatagctgctgtcgcgtccc

SEQ ID NO: 425375 - DNA, 20 bp, mouse
gaattctggaatatagcgag

SEQ ID NO: 425376 - DNA, 20 bp, mouse
gccacgtgctagcccaggcc

SEQ ID NO: 425377 - DNA, 20 bp, mouse
gctctgtgttcgcccggcct

SEQ ID NO: 425378 - DNA, 20 bp, mouse
gcccaggagcaggtaagtga

SEQ ID NO: 425379 - DNA, 20 bp, mouse
gtgctcctgggcgaccgtct

SEQ ID NO: 425380 - DNA, 20 bp, mouse
gacagagacattaaatactg

SEQ ID NO: 425381 - DNA, 20 bp, mouse
gctcccccacgtgctagccc

SEQ ID NO: 425382 - DNA, 20 bp, mouse
ggcgcgcgccaggtactccg

SEQ ID NO: 425383 - DNA, 20 bp, mouse
ggcccggagagagaacgagt

SEQ ID NO: 425384 - DNA, 20 bp, mouse
gggccccccacctagtccag

SEQ ID NO: 425385 - DNA, 20 bp, mouse
ggggccgctggactaggtgg

SEQ ID NO: 425386 - DNA, 20 bp, mouse
gtggcttgttgataacatgg

SEQ ID NO: 425387 - DNA, 20 bp, mouse
gccgccacctcgggatgccc

SEQ ID NO: 425388 - DNA, 20 bp, mouse
ggacggaccggaactctaag

SEQ ID NO: 425389 - DNA, 20 bp, mouse
gctgccggggcatcccgagg

SEQ ID NO: 425390 - DNA, 20 bp, mouse
ggaccggaactctaagcggg

SEQ ID NO: 425391 - DNA, 20 bp, mouse
ggggtggcttgttgataaca

SEQ ID NO: 425392 - DNA, 20 bp, mouse
ggccccgcgcgcggacggac

SEQ ID NO: 425393 - DNA, 20 bp, mouse
gttccgccggaagaaggaca

SEQ ID NO: 425394 - DNA, 20 bp, mouse
ggcgcccacacccggaagaa

SEQ ID NO: 425395 - DNA, 20 bp, mouse
ggactccgcagggaagaagg

SEQ ID NO: 425396 - DNA, 20 bp, mouse
gcacggcccgcaacgcccgg

SEQ ID NO: 425397 - DNA, 20 bp, mouse
gcgttgcgggccgtgacggg

SEQ ID NO: 425398 - DNA, 20 bp, mouse
ggggcgttgcgggccgtgac

SEQ ID NO: 425399 - DNA, 20 bp, mouse
gggctctcgcgagagtgagt

SEQ ID NO: 425400 - DNA, 20 bp, mouse
ggtgacagcgatgcaaacag

SEQ ID NO: 425401 - DNA, 20 bp, mouse
ggagggccgggtccagactg

SEQ ID NO: 425402 - DNA, 20 bp, mouse
gccctgccccgctcaccagg

SEQ ID NO: 425403 - DNA, 20 bp, mouse
ggttcggacgctgacaggga

SEQ ID NO: 425404 - DNA, 20 bp, mouse
gctgggttcggacgctgaca

SEQ ID NO: 425405 - DNA, 20 bp, mouse
gagcgccggggacctgggtt

SEQ ID NO: 425406 - DNA, 20 bp, mouse
gcaggaccacagggactaag

SEQ ID NO: 425407 - DNA, 20 bp, mouse
gatgtgcgcccaggaccaca

SEQ ID NO: 425408 - DNA, 20 bp, mouse
gcagcaggatcgtggagagc

SEQ ID NO: 425409 - DNA, 20 bp, mouse
gatcctgctgagaacacacc

SEQ ID NO: 425410 - DNA, 20 bp, mouse
gtgtgttctcagcaggatcg

SEQ ID NO: 425411 - DNA, 20 bp, mouse
gtgggaccgcggagaagcag

SEQ ID NO: 425412 - DNA, 20 bp, mouse
gctgtaccggcgggaagttg

SEQ ID NO: 425413 - DNA, 20 bp, mouse
gcctcaccccttagtccctg

SEQ ID NO: 425414 - DNA, 20 bp, mouse
gagtggccatgggcccgcag

SEQ ID NO: 425415 - DNA, 20 bp, mouse
gaggcagttccaccgagcag

SEQ ID NO: 425416 - DNA, 20 bp, mouse
ggagcaaggagcaagcacgg

SEQ ID NO: 425417 - DNA, 20 bp, mouse
gctggagcaaggagcaagca

SEQ ID NO: 425418 - DNA, 20 bp, mouse
gcgcggagaaggacaatagg

SEQ ID NO: 425419 - DNA, 20 bp, mouse
gggccgcggagaaggacaat

SEQ ID NO: 425420 - DNA, 20 bp, mouse
gggcaggtctgtgtgcaggg

SEQ ID NO: 425421 - DNA, 20 bp, mouse
gcagccggcgccacagaagc

SEQ ID NO: 425422 - DNA, 20 bp, mouse
gagtttgggcgtctgaggag

SEQ ID NO: 425423 - DNA, 20 bp, mouse
gcgcggccgagagcagccga

SEQ ID NO: 425424 - DNA, 20 bp, mouse
gggcggtgacggctggagca

SEQ ID NO: 425425 - DNA, 20 bp, mouse
gtgcagggcggtcgcagagc

SEQ ID NO: 425426 - DNA, 20 bp, mouse
gcactgctgagagactgcta

SEQ ID NO: 425427 - DNA, 20 bp, mouse
gtttgaagcagtagcagagg

SEQ ID NO: 425428 - DNA, 20 bp, mouse
gttctttgaagcagtagcag

SEQ ID NO: 425429 - DNA, 20 bp, mouse
gattctctttaggaaccttg

SEQ ID NO: 425430 - DNA, 20 bp, mouse
gtctcagcagtgctgcccca

SEQ ID NO: 425431 - DNA, 20 bp, mouse
gagtgctgccacagcaacga

SEQ ID NO: 425432 - DNA, 20 bp, mouse
gatggatgcatatcattcat

SEQ ID NO: 425433 - DNA, 20 bp, mouse
ggaataatctttaggtattg

SEQ ID NO: 425434 - DNA, 20 bp, mouse
gcctgaaagggggcttgaag

SEQ ID NO: 425435 - DNA, 20 bp, mouse
gcagaccccaaagaagctaa

SEQ ID NO: 425436 - DNA, 20 bp, mouse
gcccccagccaggaatcagg

SEQ ID NO: 425437 - DNA, 20 bp, mouse
ggtccgctggagcccaccaa

SEQ ID NO: 425438 - DNA, 20 bp, mouse
gggcgaggccagctgttgaa

SEQ ID NO: 425439 - DNA, 20 bp, mouse
gcctgcctgctccaatccct

SEQ ID NO: 425440 - DNA, 20 bp, mouse
gcaccctgtagcccccagcc

SEQ ID NO: 425441 - DNA, 20 bp, mouse
gagggggcggagctctcgag

SEQ ID NO: 425442 - DNA, 20 bp, mouse
gagccacctggaagctcacg

SEQ ID NO: 425443 - DNA, 20 bp, mouse
gcaagggatggcagcgaagg

SEQ ID NO: 425444 - DNA, 20 bp, mouse
gatcccttggtgggctccag

SEQ ID NO: 425445 - DNA, 20 bp, mouse
gaggcacccaagactccggt

SEQ ID NO: 425446 - DNA, 20 bp, mouse
ggcccagtgcacgcacctcc

SEQ ID NO: 425447 - DNA, 20 bp, mouse
gggaatctgtctagagaaag

SEQ ID NO: 425448 - DNA, 20 bp, mouse
gaaagaggcgattctgactg

SEQ ID NO: 425449 - DNA, 20 bp, mouse
ggcccaccacgcaacaggag

SEQ ID NO: 425450 - DNA, 20 bp, mouse
gcagattccagtgctcacac

SEQ ID NO: 425451 - DNA, 20 bp, mouse
ggattctgactgcggactcc

SEQ ID NO: 425452 - DNA, 20 bp, mouse
gtcccggaggtgcgtgcact

SEQ ID NO: 425453 - DNA, 20 bp, mouse
gtcccagccttggtgctaag

SEQ ID NO: 425454 - DNA, 20 bp, mouse
gtgaggagggagtcagggtc

SEQ ID NO: 425455 - DNA, 20 bp, mouse
ggcctctcctgttgcgtggt

SEQ ID NO: 425456 - DNA, 20 bp, mouse
gcctagtgccaacaaggagg

SEQ ID NO: 425457 - DNA, 20 bp, mouse
gctccctagtgccaacaagg

SEQ ID NO: 425458 - DNA, 20 bp, mouse
gcaaggaggaggtgcatgga

SEQ ID NO: 425459 - DNA, 20 bp, mouse
gaggaggtgcatggaaggct

SEQ ID NO: 425460 - DNA, 20 bp, mouse
gccaacaaggaggaggtgca

SEQ ID NO: 425461 - DNA, 20 bp, mouse
gtgatcccctgtggttagaa

SEQ ID NO: 425462 - DNA, 20 bp, mouse
gtaaagtcaatgaagatgct

SEQ ID NO: 425463 - DNA, 20 bp, mouse
gagaggtaggaaagcccatt

SEQ ID NO: 425464 - DNA, 20 bp, mouse
gagtcccacaggattcaaag

SEQ ID NO: 425465 - DNA, 20 bp, mouse
ggcggaaactaaaactggct

SEQ ID NO: 425466 - DNA, 20 bp, mouse
ggtctaacagctgaccgggg

SEQ ID NO: 425467 - DNA, 20 bp, mouse
gctggtctaacagctgaccg

SEQ ID NO: 425468 - DNA, 20 bp, mouse
gggggcagtgccaagttctt

SEQ ID NO: 425469 - DNA, 20 bp, mouse
gtgcccctttagatggaagg

SEQ ID NO: 425470 - DNA, 20 bp, mouse
gctgcaagtgcctaagaact

SEQ ID NO: 425471 - DNA, 20 bp, mouse
ggctgttagaccagactgat

SEQ ID NO: 425472 - DNA, 20 bp, mouse
gtgcccccttccatctaaag

SEQ ID NO: 425473 - DNA, 20 bp, mouse
gtgagatgtgcccctttaga

SEQ ID NO: 425474 - DNA, 20 bp, mouse
ggcctactgtggtactacaa

SEQ ID NO: 425475 - DNA, 20 bp, mouse
gagtatgccaagctacctac

SEQ ID NO: 425476 - DNA, 20 bp, mouse
gggagcacgggcccaaacaa

SEQ ID NO: 425477 - DNA, 20 bp, mouse
gtcccgaggtcgaggagcac

SEQ ID NO: 425478 - DNA, 20 bp, mouse
gcggagagccccggagaccg

SEQ ID NO: 425479 - DNA, 20 bp, mouse
gcccaaacaacggagagccc

SEQ ID NO: 425480 - DNA, 20 bp, mouse
ggcccgtgctcctcgacctc

SEQ ID NO: 425481 - DNA, 20 bp, mouse
gcgacgatctgggtaagtag

SEQ ID NO: 425482 - DNA, 20 bp, mouse
gtcctcagacggctccaggt

SEQ ID NO: 425483 - DNA, 20 bp, mouse
gagctctgctcccgaggtcg

SEQ ID NO: 425484 - DNA, 20 bp, mouse
gcgggcggcagaacagccca

SEQ ID NO: 425485 - DNA, 20 bp, mouse
ggtgcactgagccctggtaa

SEQ ID NO: 425486 - DNA, 20 bp, mouse
gtcatgcagcaggtcaaaca

SEQ ID NO: 425487 - DNA, 20 bp, mouse
gatctgtaggatgcaatact

SEQ ID NO: 425488 - DNA, 20 bp, mouse
ggcagcctgaaaacagaatt

SEQ ID NO: 425489 - DNA, 20 bp, mouse
gtagtctgtggcgtctacta

SEQ ID NO: 425490 - DNA, 20 bp, mouse
gcgtctactaaggcagggat

SEQ ID NO: 425491 - DNA, 20 bp, mouse
gatgtgctgtaaacatcaaa

SEQ ID NO: 425492 - DNA, 20 bp, mouse
gaacatcaaaaggcgacgtt

SEQ ID NO: 425493 - DNA, 20 bp, mouse
gtgtggcgtctactaaggca

SEQ ID NO: 425494 - DNA, 20 bp, mouse
gtaaaaataacaggcggaga

SEQ ID NO: 425495 - DNA, 20 bp, mouse
gggatgttgtctgcttaaaa

SEQ ID NO: 425496 - DNA, 20 bp, mouse
ggtgcaggctcagggcatcc

SEQ ID NO: 425497 - DNA, 20 bp, mouse
ggatggtggttggtcaagta

SEQ ID NO: 425498 - DNA, 20 bp, mouse
gtcacatcgggccagaccgg

SEQ ID NO: 425499 - DNA, 20 bp, mouse
gaagcagggttggttcatag

SEQ ID NO: 425500 - DNA, 20 bp, mouse
gagcctggcttgatggtggt

SEQ ID NO: 425501 - DNA, 20 bp, mouse
gggctccccaaactctgagg

SEQ ID NO: 425502 - DNA, 20 bp, mouse
gggcatccgggtctgcggat

SEQ ID NO: 425503 - DNA, 20 bp, mouse
gctcagggcatccgggtctg

SEQ ID NO: 425504 - DNA, 20 bp, mouse
gctggtgtcctccacctcac

SEQ ID NO: 425505 - DNA, 20 bp, mouse
gcctgctggagttgggttcg

SEQ ID NO: 425506 - DNA, 20 bp, mouse
gaggctacggaggttagtgt

SEQ ID NO: 425507 - DNA, 20 bp, mouse
gacatggagcaaggctacgg

SEQ ID NO: 425508 - DNA, 20 bp, mouse
gcagacatggagcaaggcta

SEQ ID NO: 425509 - DNA, 20 bp, mouse
ggcgggtcgcgtcgcagaca

SEQ ID NO: 425510 - DNA, 20 bp, mouse
gttgcgcagaggcccaataa

SEQ ID NO: 425511 - DNA, 20 bp, mouse
gcatgcgccagggtctcccg

SEQ ID NO: 425512 - DNA, 20 bp, mouse
gtaagacaaggatctgctgg

SEQ ID NO: 425513 - DNA, 20 bp, mouse
ggattggccggtaggactcg

SEQ ID NO: 425514 - DNA, 20 bp, mouse
gatctaagacaaggatctgc

SEQ ID NO: 425515 - DNA, 20 bp, mouse
gcgaacgctgaggaagcggg

SEQ ID NO: 425516 - DNA, 20 bp, mouse
gcgtcagacgcgcagagtag

SEQ ID NO: 425517 - DNA, 20 bp, mouse
gctgcggccatgagctacac

SEQ ID NO: 425518 - DNA, 20 bp, mouse
gcgtgtgtggaaggacccca

SEQ ID NO: 425519 - DNA, 20 bp, mouse
gtacacaggtaggcccaaca

SEQ ID NO: 425520 - DNA, 20 bp, mouse
gggtaggcccaacagggtga

SEQ ID NO: 425521 - DNA, 20 bp, mouse
gggccatgagctacacaggt

SEQ ID NO: 425522 - DNA, 20 bp, mouse
ggagtagcggtctgtgtcca

SEQ ID NO: 425523 - DNA, 20 bp, mouse
ggcagagaacacccgagccg

SEQ ID NO: 425524 - DNA, 20 bp, mouse
gtgagggatgcgaccccgaa

SEQ ID NO: 425525 - DNA, 20 bp, mouse
gcggtctgtgtccacggctc

SEQ ID NO: 425526 - DNA, 20 bp, mouse
gtacgtggagacgaagatgg

SEQ ID NO: 425527 - DNA, 20 bp, mouse
gcagccggcaaggcgaaggt

SEQ ID NO: 425528 - DNA, 20 bp, mouse
ggctcaccggcgactcgtgc

SEQ ID NO: 425529 - DNA, 20 bp, mouse
gtggccacccgggacacgct

SEQ ID NO: 425530 - DNA, 20 bp, mouse
ggtcgggaggcggtgacccg

SEQ ID NO: 425531 - DNA, 20 bp, mouse
gcagagctccgtggccaccc

SEQ ID NO: 425532 - DNA, 20 bp, mouse
ggtttacgtggagacgaaga

SEQ ID NO: 425533 - DNA, 20 bp, mouse
gagggtaggctgggacgcag

SEQ ID NO: 425534 - DNA, 20 bp, mouse
ggtgaccgcggggcccgtgc

SEQ ID NO: 425535 - DNA, 20 bp, mouse
gtaccctgcagacgccatgg

SEQ ID NO: 425536 - DNA, 20 bp, mouse
gagggccgcgggaacacgga

SEQ ID NO: 425537 - DNA, 20 bp, mouse
ggtacccagggtctgagagg

SEQ ID NO: 425538 - DNA, 20 bp, mouse
gtaggaggcgctgggaacca

SEQ ID NO: 425539 - DNA, 20 bp, mouse
ggccgcggcgctgaacggag

SEQ ID NO: 425540 - DNA, 20 bp, mouse
ggagaagcaggccgggtgag

SEQ ID NO: 425541 - DNA, 20 bp, mouse
gaagaagggccgcgggaaca

SEQ ID NO: 425542 - DNA, 20 bp, mouse
ggcgcccggagaagcaggcc

SEQ ID NO: 425543 - DNA, 20 bp, mouse
gaactaggcccggatccggg

SEQ ID NO: 425544 - DNA, 20 bp, mouse
gcacgcgcatagcgctcaca

SEQ ID NO: 425545 - DNA, 20 bp, mouse
gttggagcgcgccaagagga

SEQ ID NO: 425546 - DNA, 20 bp, mouse
gccggctccaatggcgcctc

SEQ ID NO: 425547 - DNA, 20 bp, mouse
gacgcccgtgacgtcacagg

SEQ ID NO: 425548 - DNA, 20 bp, mouse
gcgggtgccggaggcgccat

SEQ ID NO: 425549 - DNA, 20 bp, mouse
gccggggacgagagacatcc

SEQ ID NO: 425550 - DNA, 20 bp, mouse
gcgacgctcgctgccgggtg

SEQ ID NO: 425551 - DNA, 20 bp, mouse
gtctgcatctgaagcggcgg

SEQ ID NO: 425552 - DNA, 20 bp, mouse
gcgtgacgtcacaggaggcg

SEQ ID NO: 425553 - DNA, 20 bp, mouse
gagcagcagcgcaggttacc

SEQ ID NO: 425554 - DNA, 20 bp, mouse
gagcgcaggttaccgggagt

SEQ ID NO: 425555 - DNA, 20 bp, mouse
gggcagtgaccccacagtgt

SEQ ID NO: 425556 - DNA, 20 bp, mouse
ggggtggcagagttgttccg

SEQ ID NO: 425557 - DNA, 20 bp, mouse
ggttgttccgtggagaagag

SEQ ID NO: 425558 - DNA, 20 bp, mouse
gcccgccgccggccccaata

SEQ ID NO: 425559 - DNA, 20 bp, mouse
gggacggcggagccgcgaca

SEQ ID NO: 425560 - DNA, 20 bp, mouse
ggcagacggaagctcgtgag

SEQ ID NO: 425561 - DNA, 20 bp, mouse
gcagcccgagcgcacggcgg

SEQ ID NO: 425562 - DNA, 20 bp, mouse
ggacggaagctcgtgagtgg

SEQ ID NO: 425563 - DNA, 20 bp, mouse
ggccatattggggccggcgg

SEQ ID NO: 425564 - DNA, 20 bp, mouse
ggccacgcgcgggagctgcg

SEQ ID NO: 425565 - DNA, 20 bp, mouse
gggccgggtccacttccgaa

SEQ ID NO: 425566 - DNA, 20 bp, mouse
ggcgttccaggctgctgtgg

SEQ ID NO: 425567 - DNA, 20 bp, mouse
gtcccagaactggacaggag

SEQ ID NO: 425568 - DNA, 20 bp, mouse
gagcagtctggaggcgttcc

SEQ ID NO: 425569 - DNA, 20 bp, mouse
gtctggctggcagagcagtc

SEQ ID NO: 425570 - DNA, 20 bp, mouse
ggagctgaggccgttctggc

SEQ ID NO: 425571 - DNA, 20 bp, mouse
gcatagactctggacaaccc

SEQ ID NO: 425572 - DNA, 20 bp, mouse
gggacagagagggaccaaca

SEQ ID NO: 425573 - DNA, 20 bp, mouse
gctgtgagctgaggccgttc

SEQ ID NO: 425574 - DNA, 20 bp, mouse
ggactctggacaaccctggc

SEQ ID NO: 425575 - DNA, 20 bp, mouse
gtgagatgagcccaccccgg

SEQ ID NO: 425576 - DNA, 20 bp, mouse
ggactgagctgggtagtatc

SEQ ID NO: 425577 - DNA, 20 bp, mouse
gacaggtggtgggaaaggac

SEQ ID NO: 425578 - DNA, 20 bp, mouse
gtgtagcccttacaggtggt

SEQ ID NO: 425579 - DNA, 20 bp, mouse
gttgctgtagcccttacagg

SEQ ID NO: 425580 - DNA, 20 bp, mouse
gcctttcccaccacctgtaa

SEQ ID NO: 425581 - DNA, 20 bp, mouse
gcagattccaagactgagct

SEQ ID NO: 425582 - DNA, 20 bp, mouse
gtagtatcaggaagatgttc

SEQ ID NO: 425583 - DNA, 20 bp, mouse
gcctttgctgtagcccttac

SEQ ID NO: 425584 - DNA, 20 bp, mouse
ggaattctctcattacacac

SEQ ID NO: 425585 - DNA, 20 bp, mouse
ggtgtgtgagagagatactg

SEQ ID NO: 425586 - DNA, 20 bp, mouse
gagcacccaggtgccctgca

SEQ ID NO: 425587 - DNA, 20 bp, mouse
gcaccagccccagccatgca

SEQ ID NO: 425588 - DNA, 20 bp, mouse
gcaagggaatagcagaggaa

SEQ ID NO: 425589 - DNA, 20 bp, mouse
gagcatgaagggccatgggt

SEQ ID NO: 425590 - DNA, 20 bp, mouse
gctattcccttggccagtgg

SEQ ID NO: 425591 - DNA, 20 bp, mouse
gctggccaagggaatagcag

SEQ ID NO: 425592 - DNA, 20 bp, mouse
gctgtgctttagttgatccc

SEQ ID NO: 425593 - DNA, 20 bp, mouse
gtcgtcaggactgaaccctg

SEQ ID NO: 425594 - DNA, 20 bp, mouse
gttacctggaatgacactaa

SEQ ID NO: 425595 - DNA, 20 bp, mouse
ggacaaagacacgagacacc

SEQ ID NO: 425596 - DNA, 20 bp, mouse
gtggagtgagaggttcccag

SEQ ID NO: 425597 - DNA, 20 bp, mouse
gagtgagaggttcccagggg

SEQ ID NO: 425598 - DNA, 20 bp, mouse
gacgttcgtggtggagtgag

SEQ ID NO: 425599 - DNA, 20 bp, mouse
gcccttccagacgttcgtgg

SEQ ID NO: 425600 - DNA, 20 bp, mouse
gtgtcctgcgaagtagaaga

SEQ ID NO: 425601 - DNA, 20 bp, mouse
gcggcccttccagacgttcg

SEQ ID NO: 425602 - DNA, 20 bp, mouse
gcagcaggaagaactcacct

SEQ ID NO: 425603 - DNA, 20 bp, mouse
gctttgcacattcctcccct

SEQ ID NO: 425604 - DNA, 20 bp, mouse
gggccctgttgcctcagtac

SEQ ID NO: 425605 - DNA, 20 bp, mouse
gacagggcccgacttaagtc

SEQ ID NO: 425606 - DNA, 20 bp, mouse
gccggtaaggagcgtcacga

SEQ ID NO: 425607 - DNA, 20 bp, mouse
ggcctgtctcctcaaggaca

SEQ ID NO: 425608 - DNA, 20 bp, mouse
ggttgccagactcctaattt

SEQ ID NO: 425609 - DNA, 20 bp, mouse
gagcgtcacgaaggcggcca

SEQ ID NO: 425610 - DNA, 20 bp, mouse
ggggagcctttgcctaaatt

SEQ ID NO: 425611 - DNA, 20 bp, mouse
ggccatggttgctgcagaaa

SEQ ID NO: 425612 - DNA, 20 bp, mouse
gccttcagcatgggtagcaa

SEQ ID NO: 425613 - DNA, 20 bp, mouse
gtccgtgtccttgaggagac

SEQ ID NO: 425614 - DNA, 20 bp, mouse
ggtaaggagcgtcacgaagg

SEQ ID NO: 425615 - DNA, 20 bp, mouse
gagaagagcctgtctcctca

SEQ ID NO: 425616 - DNA, 20 bp, mouse
gtccgtgccgctaggaccta

SEQ ID NO: 425617 - DNA, 20 bp, mouse
gaaatgtgcagcgctggctc

SEQ ID NO: 425618 - DNA, 20 bp, mouse
ggtgccagatgacaaatcta

SEQ ID NO: 425619 - DNA, 20 bp, mouse
gctctcagccgtgcaaccaa

SEQ ID NO: 425620 - DNA, 20 bp, mouse
gcccgctgggtgaccctgag

SEQ ID NO: 425621 - DNA, 20 bp, mouse
gggccgttggggctatttaa

SEQ ID NO: 425622 - DNA, 20 bp, mouse
gttctttccctaggtcctag

SEQ ID NO: 425623 - DNA, 20 bp, mouse
gaccggcaaatgtgcagcgc

SEQ ID NO: 425624 - DNA, 20 bp, mouse
gctctcacccgggtcaccgt

SEQ ID NO: 425625 - DNA, 20 bp, mouse
gtccgcgtgggcgccccagg

SEQ ID NO: 425626 - DNA, 20 bp, mouse
ggcctccttgtagagaaagc

SEQ ID NO: 425627 - DNA, 20 bp, mouse
gtgtccagacctcccctcaa

SEQ ID NO: 425628 - DNA, 20 bp, mouse
ggctggccttatcaaaccca

SEQ ID NO: 425629 - DNA, 20 bp, mouse
ggcctgctttctctacaagg

SEQ ID NO: 425630 - DNA, 20 bp, mouse
gggactctgagggtctctgt

SEQ ID NO: 425631 - DNA, 20 bp, mouse
gcctttccttgggactctga

SEQ ID NO: 425632 - DNA, 20 bp, mouse
ggacacctgctgcctttgag

SEQ ID NO: 425633 - DNA, 20 bp, mouse
gtgacaacaggtgataatgc

SEQ ID NO: 425634 - DNA, 20 bp, mouse
gacctgctgcctttgagggg

SEQ ID NO: 425635 - DNA, 20 bp, mouse
ggactatgccaacatctgag

SEQ ID NO: 425636 - DNA, 20 bp, mouse
gttgttaatgagacagatgg

SEQ ID NO: 425637 - DNA, 20 bp, mouse
gctagagacagaacacaagt

SEQ ID NO: 425638 - DNA, 20 bp, mouse
gaggtctgaaacagcacaaa

SEQ ID NO: 425639 - DNA, 20 bp, mouse
gagagccggcctcttcatcc

SEQ ID NO: 425640 - DNA, 20 bp, mouse
gacgtcctggatgaagaggc

SEQ ID NO: 425641 - DNA, 20 bp, mouse
ggagggtaactggcaagttc

SEQ ID NO: 425642 - DNA, 20 bp, mouse
gagcttgttaagagggtaac

SEQ ID NO: 425643 - DNA, 20 bp, mouse
gagtcttgggcacctggtct

SEQ ID NO: 425644 - DNA, 20 bp, mouse
gtagatgtcataaaaagaag

SEQ ID NO: 425645 - DNA, 20 bp, mouse
gttcacagggatatctctgc

SEQ ID NO: 425646 - DNA, 20 bp, mouse
gactatgtcaaactaaacga

SEQ ID NO: 425647 - DNA, 20 bp, mouse
gtcctggtcagtccataggg

SEQ ID NO: 425648 - DNA, 20 bp, mouse
gctataagcatgcctcccta

SEQ ID NO: 425649 - DNA, 20 bp, mouse
ggagactgagctggttccat

SEQ ID NO: 425650 - DNA, 20 bp, mouse
gcttatagggaacataggaa

SEQ ID NO: 425651 - DNA, 20 bp, mouse
gtatggactgaccaggaaca

SEQ ID NO: 425652 - DNA, 20 bp, mouse
gtcttgggtacatgcctcag

SEQ ID NO: 425653 - DNA, 20 bp, mouse
ggcatgcttatagggaacat

SEQ ID NO: 425654 - DNA, 20 bp, mouse
gataagaaaagtcaacaagt

SEQ ID NO: 425655 - DNA, 20 bp, mouse
ggcctccctatggactgacc

SEQ ID NO: 425656 - DNA, 20 bp, mouse
gtcctggtgaatcagtaggg

SEQ ID NO: 425657 - DNA, 20 bp, mouse
gactgattcaccaggaacag

SEQ ID NO: 425658 - DNA, 20 bp, mouse
gctgcactaacacctaccac

SEQ ID NO: 425659 - DNA, 20 bp, mouse
gcagcagcacttgaaattgg

SEQ ID NO: 425660 - DNA, 20 bp, mouse
ggattgttcttgataaatag

SEQ ID NO: 425661 - DNA, 20 bp, mouse
ggtagggaggcatgctgaag

SEQ ID NO: 425662 - DNA, 20 bp, mouse
gacaggattgtcagtatctc

SEQ ID NO: 425663 - DNA, 20 bp, mouse
gcatgctgaaggggaacaaa

SEQ ID NO: 425664 - DNA, 20 bp, mouse
ggcctccctactgattcacc

SEQ ID NO: 425665 - DNA, 20 bp, mouse
ggaaattggtggctgtggtt

SEQ ID NO: 425666 - DNA, 20 bp, mouse
gcacgtgtggtactaaacga

SEQ ID NO: 425667 - DNA, 20 bp, mouse
ggttactcatgcaaccacgc

SEQ ID NO: 425668 - DNA, 20 bp, mouse
gaattctgtatccccacgtg

SEQ ID NO: 425669 - DNA, 20 bp, mouse
gtttataggagaagagatca

SEQ ID NO: 425670 - DNA, 20 bp, mouse
ggcacagcagtagtactgat

SEQ ID NO: 425671 - DNA, 20 bp, mouse
gtccacatgataagtctcca

SEQ ID NO: 425672 - DNA, 20 bp, mouse
gggaaccactgtgcccgata

SEQ ID NO: 425673 - DNA, 20 bp, mouse
gcaggctcacattagacatc

SEQ ID NO: 425674 - DNA, 20 bp, mouse
gatgtgagcctgaagcaaac

SEQ ID NO: 425675 - DNA, 20 bp, mouse
gggagctgtagcaattttcc

SEQ ID NO: 425676 - DNA, 20 bp, mouse
gtgagcctggagtttaccta

SEQ ID NO: 425677 - DNA, 20 bp, mouse
gttcctgcacgaatttaaaa

SEQ ID NO: 425678 - DNA, 20 bp, mouse
gtgtgccttaggtaaactcc

SEQ ID NO: 425679 - DNA, 20 bp, mouse
gtatcagagataatgtttaa

SEQ ID NO: 425680 - DNA, 20 bp, mouse
gctggaaaagataagaatgt

SEQ ID NO: 425681 - DNA, 20 bp, mouse
gctagtttttaatttaggag

SEQ ID NO: 425682 - DNA, 20 bp, mouse
gtgatattgacatgccaggt

SEQ ID NO: 425683 - DNA, 20 bp, mouse
gttctactcacttgtcaaaa

SEQ ID NO: 425684 - DNA, 20 bp, mouse
ggttaaaagcccataggctt

SEQ ID NO: 425685 - DNA, 20 bp, mouse
gatccattttaaattcgtgc

SEQ ID NO: 425686 - DNA, 20 bp, mouse
gatcttctaggtcagagcag

SEQ ID NO: 425687 - DNA, 20 bp, mouse
gcgctggcttgtgaaagcag

SEQ ID NO: 425688 - DNA, 20 bp, mouse
gccaaagcccaggacaggaa

SEQ ID NO: 425689 - DNA, 20 bp, mouse
ggctgtgctatgtagaagag

SEQ ID NO: 425690 - DNA, 20 bp, mouse
gtgtagaagagaggcagact

SEQ ID NO: 425691 - DNA, 20 bp, mouse
gtagcacagctctaatctgg

SEQ ID NO: 425692 - DNA, 20 bp, mouse
ggactgggtgggttctacta

SEQ ID NO: 425693 - DNA, 20 bp, mouse
gggcacctatgcaactgaag

SEQ ID NO: 425694 - DNA, 20 bp, mouse
gagaagcagatcgacactga

SEQ ID NO: 425695 - DNA, 20 bp, mouse
gactgaagaggtaataaaaa

SEQ ID NO: 425696 - DNA, 20 bp, mouse
gggtgccaaagcccagcgca

SEQ ID NO: 425697 - DNA, 20 bp, mouse
gtcatccctgcgctgggctt

SEQ ID NO: 425698 - DNA, 20 bp, mouse
gtgactcagtgggactcaac

SEQ ID NO: 425699 - DNA, 20 bp, mouse
gcacttgctatgtgactcag

SEQ ID NO: 425700 - DNA, 20 bp, mouse
gaagaaaatggactgagggt

SEQ ID NO: 425701 - DNA, 20 bp, mouse
ggctgctcctgcacccttcg

SEQ ID NO: 425702 - DNA, 20 bp, mouse
gactgttccacgaagggtgc

SEQ ID NO: 425703 - DNA, 20 bp, mouse
gtagcaagtgagtgacttga

SEQ ID NO: 425704 - DNA, 20 bp, mouse
gcagtggtgctgcggtgaat

SEQ ID NO: 425705 - DNA, 20 bp, mouse
gtgaatgggtcaaaagaaaa

SEQ ID NO: 425706 - DNA, 20 bp, mouse
gtcagtatcttctcagtcag

SEQ ID NO: 425707 - DNA, 20 bp, mouse
gagacagttcttctaaatga

SEQ ID NO: 425708 - DNA, 20 bp, mouse
ggactgagaagatactgagc

SEQ ID NO: 425709 - DNA, 20 bp, mouse
gacatatagagagtttgggt

SEQ ID NO: 425710 - DNA, 20 bp, mouse
gtagtccttttgcaagtaaa

SEQ ID NO: 425711 - DNA, 20 bp, mouse
ggatgtgacattaagcatga

SEQ ID NO: 425712 - DNA, 20 bp, mouse
gcccgcaataatctcgagct

SEQ ID NO: 425713 - DNA, 20 bp, mouse
gtggttcttcagcgctaacc

SEQ ID NO: 425714 - DNA, 20 bp, mouse
ggcctagctcgagattattg

SEQ ID NO: 425715 - DNA, 20 bp, mouse
ggcagtcattgaatctgata

SEQ ID NO: 425716 - DNA, 20 bp, mouse
gtcctctagaggtaagacca

SEQ ID NO: 425717 - DNA, 20 bp, mouse
ggtccctcttcaaaataagc

SEQ ID NO: 425718 - DNA, 20 bp, mouse
ggagccagcttattttgaag

SEQ ID NO: 425719 - DNA, 20 bp, mouse
gagcagagcaccatattaaa

SEQ ID NO: 425720 - DNA, 20 bp, mouse
gtattacaacagcattggaa

SEQ ID NO: 425721 - DNA, 20 bp, mouse
gaccctggtcttacctctag

SEQ ID NO: 425722 - DNA, 20 bp, mouse
gcagtaccaaaacccagcac

SEQ ID NO: 425723 - DNA, 20 bp, mouse
gggtactgctcttcctctag

SEQ ID NO: 425724 - DNA, 20 bp, mouse
gccagggttgctgggtttga

SEQ ID NO: 425725 - DNA, 20 bp, mouse
gcattttaattgaacagtat

SEQ ID NO: 425726 - DNA, 20 bp, mouse
gtgctagaatcccggatcac

SEQ ID NO: 425727 - DNA, 20 bp, mouse
gggactaaccaagtccattg

SEQ ID NO: 425728 - DNA, 20 bp, mouse
gtacaagccggtatgcaacc

SEQ ID NO: 425729 - DNA, 20 bp, mouse
gtcctcacctggttgcatac

SEQ ID NO: 425730 - DNA, 20 bp, mouse
gcttcagtttttatgacaga

SEQ ID NO: 425731 - DNA, 20 bp, mouse
gtatcaaccaatggcaagaa

SEQ ID NO: 425732 - DNA, 20 bp, mouse
gcctgggctcaagtacaagc

SEQ ID NO: 425733 - DNA, 20 bp, mouse
ggaggctgaggatcctcacc

SEQ ID NO: 425734 - DNA, 20 bp, mouse
gcagaatatctatcaaccaa

SEQ ID NO: 425735 - DNA, 20 bp, mouse
gaaaactgaagctatttcca

SEQ ID NO: 425736 - DNA, 20 bp, mouse
gtagtatcttctcagttggt

SEQ ID NO: 425737 - DNA, 20 bp, mouse
gagacagtgcgtctaagtga

SEQ ID NO: 425738 - DNA, 20 bp, mouse
gttggtgggctgagaagcca

SEQ ID NO: 425739 - DNA, 20 bp, mouse
gactgctaaaacagagaatt

SEQ ID NO: 425740 - DNA, 20 bp, mouse
gagaatagtatcttctcagt

SEQ ID NO: 425741 - DNA, 20 bp, mouse
gctcacaataatctggaact

SEQ ID NO: 425742 - DNA, 20 bp, mouse
gaacaaagagagaatttggt

SEQ ID NO: 425743 - DNA, 20 bp, mouse
gattctgatgtgattcttca

SEQ ID NO: 425744 - DNA, 20 bp, mouse
gtttggtaggtgggttgata

SEQ ID NO: 425745 - DNA, 20 bp, mouse
gactagtgctcacaataatc

SEQ ID NO: 425746 - DNA, 20 bp, mouse
gggtaaggcaggggcggcag

SEQ ID NO: 425747 - DNA, 20 bp, mouse
gaccatcgtggctcagacgg

SEQ ID NO: 425748 - DNA, 20 bp, mouse
ggaacagagtcaggaactga

SEQ ID NO: 425749 - DNA, 20 bp, mouse
gaattgctgaaacccttggg

SEQ ID NO: 425750 - DNA, 20 bp, mouse
gtgattgattagtagcagct

SEQ ID NO: 425751 - DNA, 20 bp, mouse
gccaatataacttaaagacc

SEQ ID NO: 425752 - DNA, 20 bp, mouse
ggagagtaagctctccttgt

SEQ ID NO: 425753 - DNA, 20 bp, mouse
gtaatctaaaagaaccatcg

SEQ ID NO: 425754 - DNA, 20 bp, mouse
gatcttatcaactccccaca

SEQ ID NO: 425755 - DNA, 20 bp, mouse
gtccgccgtctgagccacga

SEQ ID NO: 425756 - DNA, 20 bp, mouse
gaggttccaagcccaatgag

SEQ ID NO: 425757 - DNA, 20 bp, mouse
gcccatcacttagggatatt

SEQ ID NO: 425758 - DNA, 20 bp, mouse
ggtgattctgaacagggcag

SEQ ID NO: 425759 - DNA, 20 bp, mouse
gatcacttagggatatttgg

SEQ ID NO: 425760 - DNA, 20 bp, mouse
gaccggtctaggatctgagt

SEQ ID NO: 425761 - DNA, 20 bp, mouse
gtctggggtgattctgaaca

SEQ ID NO: 425762 - DNA, 20 bp, mouse
gatgttgttcccatcactta

SEQ ID NO: 425763 - DNA, 20 bp, mouse
gctttgaagcctgtactctg

SEQ ID NO: 425764 - DNA, 20 bp, mouse
gacctactcagatcctagac

SEQ ID NO: 425765 - DNA, 20 bp, mouse
gacagaccacatctggacaa

SEQ ID NO: 425766 - DNA, 20 bp, mouse
gggtgcccaagcccactgta

SEQ ID NO: 425767 - DNA, 20 bp, mouse
ggccgctaaagtgcaggaag

SEQ ID NO: 425768 - DNA, 20 bp, mouse
gacatccctacagtgggctt

SEQ ID NO: 425769 - DNA, 20 bp, mouse
ggtctggaaggaatcaccct

SEQ ID NO: 425770 - DNA, 20 bp, mouse
gtctctggccgctaaagtgc

SEQ ID NO: 425771 - DNA, 20 bp, mouse
ggcggccagagagcgttcca

SEQ ID NO: 425772 - DNA, 20 bp, mouse
gatggttcccctttgctcaa

SEQ ID NO: 425773 - DNA, 20 bp, mouse
gaggtccctggaacgctctc

SEQ ID NO: 425774 - DNA, 20 bp, mouse
gatggaaaacatccctacag

SEQ ID NO: 425775 - DNA, 20 bp, mouse
gatcagagcccgggtctgga

SEQ ID NO: 425776 - DNA, 20 bp, mouse
ggtgcagcgtccagagccgt

SEQ ID NO: 425777 - DNA, 20 bp, mouse
ggcgctccgggacttcggtc

SEQ ID NO: 425778 - DNA, 20 bp, mouse
gggacgcccgaccgaagtcc

SEQ ID NO: 425779 - DNA, 20 bp, mouse
ggaggccgggacatggcgag

SEQ ID NO: 425780 - DNA, 20 bp, mouse
gcgcggagcgaacagcagcg

SEQ ID NO: 425781 - DNA, 20 bp, mouse
ggcagcgcggcccacggctc

SEQ ID NO: 425782 - DNA, 20 bp, mouse
gaggaaggcgcggaccgaag

SEQ ID NO: 425783 - DNA, 20 bp, mouse
ggcgcagcgctccgggactt

SEQ ID NO: 425784 - DNA, 20 bp, mouse
ggccagtccgagaacatcct

SEQ ID NO: 425785 - DNA, 20 bp, mouse
gtggccgtcgcagtacatga

SEQ ID NO: 425786 - DNA, 20 bp, mouse
gcacgcgagtccgggaccag

SEQ ID NO: 425787 - DNA, 20 bp, mouse
gggcggcggcagcaccgagt

SEQ ID NO: 425788 - DNA, 20 bp, mouse
ggagtccgggaccagcggag

SEQ ID NO: 425789 - DNA, 20 bp, mouse
gcggcagcgcacgcgagtcc

SEQ ID NO: 425790 - DNA, 20 bp, mouse
gggcggcagcaccgagtcgg

SEQ ID NO: 425791 - DNA, 20 bp, mouse
ggtggccgcggcccggaaca

SEQ ID NO: 425792 - DNA, 20 bp, mouse
ggcagcaccgagtcggcggg

SEQ ID NO: 425793 - DNA, 20 bp, mouse
ggcgcggcgcgggcactcac

SEQ ID NO: 425794 - DNA, 20 bp, mouse
ggcgggcggccggcccagcg

SEQ ID NO: 425795 - DNA, 20 bp, mouse
ggccacccaaggtcacgcag

SEQ ID NO: 425796 - DNA, 20 bp, mouse
ggtcgtgccccgcaaagaga

SEQ ID NO: 425797 - DNA, 20 bp, mouse
gtggaagccatgttaatgcg

SEQ ID NO: 425798 - DNA, 20 bp, mouse
gtctcgaggacaaaccagag

SEQ ID NO: 425799 - DNA, 20 bp, mouse
ggtagtgccccgcattaaca

SEQ ID NO: 425800 - DNA, 20 bp, mouse
gagctggcaaagattcaata

SEQ ID NO: 425801 - DNA, 20 bp, mouse
ggggtgctggaaaagcgaaa

SEQ ID NO: 425802 - DNA, 20 bp, mouse
ggctacgggcacgtgagtgg

SEQ ID NO: 425803 - DNA, 20 bp, mouse
gtggtgcagtcctctttcca

SEQ ID NO: 425804 - DNA, 20 bp, mouse
gacaaaccagagcggcttgg

SEQ ID NO: 425805 - DNA, 20 bp, mouse
gctggctacgggcacgtgag

SEQ ID NO: 425806 - DNA, 20 bp, mouse
ggaactggcggcagcaacgg

SEQ ID NO: 425807 - DNA, 20 bp, mouse
gtatgaactggcggcagcaa

SEQ ID NO: 425808 - DNA, 20 bp, mouse
ggcaacggcggcagtgctgg

SEQ ID NO: 425809 - DNA, 20 bp, mouse
gacggcggcagtgctggcgg

SEQ ID NO: 425810 - DNA, 20 bp, mouse
gcccagcgaggccccacggg

SEQ ID NO: 425811 - DNA, 20 bp, mouse
gctgccctcggggacatcgg

SEQ ID NO: 425812 - DNA, 20 bp, mouse
gactccgttccggaagaggg

SEQ ID NO: 425813 - DNA, 20 bp, mouse
ggccgcagtggtatggacca

SEQ ID NO: 425814 - DNA, 20 bp, mouse
gctcttccggaacggagtgg

SEQ ID NO: 425815 - DNA, 20 bp, mouse
gggccaggacgcgaccatcg

SEQ ID NO: 425816 - DNA, 20 bp, mouse
ggaaaggagactgtaaaaag

SEQ ID NO: 425817 - DNA, 20 bp, mouse
gctgcctaagaccaccaggt

SEQ ID NO: 425818 - DNA, 20 bp, mouse
gctcctttcagcaactaaga

SEQ ID NO: 425819 - DNA, 20 bp, mouse
gtgccttcttagttgctgaa

SEQ ID NO: 425820 - DNA, 20 bp, mouse
gctcaggcagttaagagcag

SEQ ID NO: 425821 - DNA, 20 bp, mouse
gaccagcagaggctcacact

SEQ ID NO: 425822 - DNA, 20 bp, mouse
gggtgtggctaaggatggtc

SEQ ID NO: 425823 - DNA, 20 bp, mouse
gtggttgagctcctctggta

SEQ ID NO: 425824 - DNA, 20 bp, mouse
gttgctggtgagctgggtaa

SEQ ID NO: 425825 - DNA, 20 bp, mouse
ggtgcattggacaccagcag

SEQ ID NO: 425826 - DNA, 20 bp, mouse
ggacgaagggctgcagggga

SEQ ID NO: 425827 - DNA, 20 bp, mouse
ggggagacgaagggctgcag

SEQ ID NO: 425828 - DNA, 20 bp, mouse
gccggcgggaggggagacga

SEQ ID NO: 425829 - DNA, 20 bp, mouse
gctgttacctgcaaaggcgg

SEQ ID NO: 425830 - DNA, 20 bp, mouse
gagcttcaggaggaacgggg

SEQ ID NO: 425831 - DNA, 20 bp, mouse
gcggggccctcggggagtgc

SEQ ID NO: 425832 - DNA, 20 bp, mouse
gcccaaagcttcaggaggaa

SEQ ID NO: 425833 - DNA, 20 bp, mouse
gccggcgacaccgggctcca

SEQ ID NO: 425834 - DNA, 20 bp, mouse
gcgcgcggccgaccgagtcg

SEQ ID NO: 425835 - DNA, 20 bp, mouse
gccctcccgccggcgacacc

SEQ ID NO: 425836 - DNA, 20 bp, mouse
gcgcgggccaacagcatctc

SEQ ID NO: 425837 - DNA, 20 bp, mouse
gcggccgcgcggggacacgg

SEQ ID NO: 425838 - DNA, 20 bp, mouse
gacgggacccagcgcaggag

SEQ ID NO: 425839 - DNA, 20 bp, mouse
gggacagccggagatgctgt

SEQ ID NO: 425840 - DNA, 20 bp, mouse
gctgcgggagaggagcggca

SEQ ID NO: 425841 - DNA, 20 bp, mouse
gtcggtagccaccagcccag

SEQ ID NO: 425842 - DNA, 20 bp, mouse
gtacctggatgccctcggtg

SEQ ID NO: 425843 - DNA, 20 bp, mouse
gctgctgcacccgaggaaga

SEQ ID NO: 425844 - DNA, 20 bp, mouse
gcctcggtgcggagcgctgg

SEQ ID NO: 425845 - DNA, 20 bp, mouse
gcggtccctagcgcacccca

SEQ ID NO: 425846 - DNA, 20 bp, mouse
gtccagagcccggctcggag

SEQ ID NO: 425847 - DNA, 20 bp, mouse
gggcgcctgctcacgtacca

SEQ ID NO: 425848 - DNA, 20 bp, mouse
gaaagcgcaagcccacgtgg

SEQ ID NO: 425849 - DNA, 20 bp, mouse
ggagcgcggtgtccagagcc

SEQ ID NO: 425850 - DNA, 20 bp, mouse
gacgcagcaagaccttgtag

SEQ ID NO: 425851 - DNA, 20 bp, mouse
gcctatgcacctactagagt

SEQ ID NO: 425852 - DNA, 20 bp, mouse
gctgaggcctccgagaaagg

SEQ ID NO: 425853 - DNA, 20 bp, mouse
gcggcggcgagcagcgtcct

SEQ ID NO: 425854 - DNA, 20 bp, mouse
ggaatcccgcccactctagt

SEQ ID NO: 425855 - DNA, 20 bp, mouse
gaaggtgaggtgcaccccta

SEQ ID NO: 425856 - DNA, 20 bp, mouse
ggcggcggtaggcactcgag

SEQ ID NO: 425857 - DNA, 20 bp, mouse
gcgtgaacaagggcactggt

SEQ ID NO: 425858 - DNA, 20 bp, mouse
ggcggtaggcactcgagcgg

SEQ ID NO: 425859 - DNA, 20 bp, mouse
gttaggctgctcgtgaacaa

SEQ ID NO: 425860 - DNA, 20 bp, mouse
gctctcgacgaagcggcggt

SEQ ID NO: 425861 - DNA, 20 bp, mouse
gggtagcccgagaggtagag

SEQ ID NO: 425862 - DNA, 20 bp, mouse
ggcgtctgaggtagcccgag

SEQ ID NO: 425863 - DNA, 20 bp, mouse
ggcgcgggctctcgacgaag

SEQ ID NO: 425864 - DNA, 20 bp, mouse
gcgggctctcgacgaagcgg

SEQ ID NO: 425865 - DNA, 20 bp, mouse
gcgagagcccgcgcaggtga

SEQ ID NO: 425866 - DNA, 20 bp, mouse
gactgaggacgaaccaaaga

SEQ ID NO: 425867 - DNA, 20 bp, mouse
ggtcctcagtgcagggcaac

SEQ ID NO: 425868 - DNA, 20 bp, mouse
gcagagacagaaggagacta

SEQ ID NO: 425869 - DNA, 20 bp, mouse
gccacagcactcaccgtctt

SEQ ID NO: 425870 - DNA, 20 bp, mouse
gaaggtcaaaagtccaccca

SEQ ID NO: 425871 - DNA, 20 bp, mouse
ggggtagggggtcagatcca

SEQ ID NO: 425872 - DNA, 20 bp, mouse
gactgtatgttgaccctggg

SEQ ID NO: 425873 - DNA, 20 bp, mouse
gtggcctagaacagagtgtg

SEQ ID NO: 425874 - DNA, 20 bp, mouse
gacggtgagtgctgtgggct

SEQ ID NO: 425875 - DNA, 20 bp, mouse
gaacactgtatgttgaccct

SEQ ID NO: 425876 - DNA, 20 bp, mouse
gagcagagccggagacgaag

SEQ ID NO: 425877 - DNA, 20 bp, mouse
ggcctctggcaaaatgaagt

SEQ ID NO: 425878 - DNA, 20 bp, mouse
gagaggctagtggggttgat

SEQ ID NO: 425879 - DNA, 20 bp, mouse
gctagtggggttgataggaa

SEQ ID NO: 425880 - DNA, 20 bp, mouse
gattttgccagaggctagtg

SEQ ID NO: 425881 - DNA, 20 bp, mouse
gtctcggcgaaacacacccc

SEQ ID NO: 425882 - DNA, 20 bp, mouse
gcaataatataaccacctaa

SEQ ID NO: 425883 - DNA, 20 bp, mouse
gccggctctgctttttccag

SEQ ID NO: 425884 - DNA, 20 bp, mouse
gtttgcatctgagaaccctt

SEQ ID NO: 425885 - DNA, 20 bp, mouse
ggcatctgagaacccttagg

SEQ ID NO: 425886 - DNA, 20 bp, mouse
ggaggcagaggctgtagcgg

SEQ ID NO: 425887 - DNA, 20 bp, mouse
gtctcctcaggtggcagccg

SEQ ID NO: 425888 - DNA, 20 bp, mouse
gcccgacggtgggtctcctc

SEQ ID NO: 425889 - DNA, 20 bp, mouse
gcagcgccgcggggtcccga

SEQ ID NO: 425890 - DNA, 20 bp, mouse
gtcagagcagccggagcccg

SEQ ID NO: 425891 - DNA, 20 bp, mouse
gacctgaggagacccaccgt

SEQ ID NO: 425892 - DNA, 20 bp, mouse
gctctgagtggaggacggga

SEQ ID NO: 425893 - DNA, 20 bp, mouse
ggatcaccgggagcagagaa

SEQ ID NO: 425894 - DNA, 20 bp, mouse
ggctgctctgagtggaggac

SEQ ID NO: 425895 - DNA, 20 bp, mouse
ggagcagagaagggtcggcg

SEQ ID NO: 425896 - DNA, 20 bp, mouse
gtccgcgagggattgctgga

SEQ ID NO: 425897 - DNA, 20 bp, mouse
gtgctggacggtctacctag

SEQ ID NO: 425898 - DNA, 20 bp, mouse
gaatccctcgcggaaggctc

SEQ ID NO: 425899 - DNA, 20 bp, mouse
gaccgtccagcaatccctcg

SEQ ID NO: 425900 - DNA, 20 bp, mouse
gctcccggagccttccgcga

SEQ ID NO: 425901 - DNA, 20 bp, mouse
gaacttggaggtccgaaggg

SEQ ID NO: 425902 - DNA, 20 bp, mouse
gaggaacttggaggtccgaa

SEQ ID NO: 425903 - DNA, 20 bp, mouse
ggcttccgagaaggccgcag

SEQ ID NO: 425904 - DNA, 20 bp, mouse
ggccttccgcgagggattgc

SEQ ID NO: 425905 - DNA, 20 bp, mouse
ggtagccgccatcgctctcc

SEQ ID NO: 425906 - DNA, 20 bp, mouse
gtggacgtagacggaagaaa

SEQ ID NO: 425907 - DNA, 20 bp, mouse
gacgtagacggaagaaaagg

SEQ ID NO: 425908 - DNA, 20 bp, mouse
gtagacggaagaaaaggcgg

SEQ ID NO: 425909 - DNA, 20 bp, mouse
gcgccgcgaagagtggtcca

SEQ ID NO: 425910 - DNA, 20 bp, mouse
gccggagagctggacgtaga

SEQ ID NO: 425911 - DNA, 20 bp, mouse
gagccctggaccactcttcg

SEQ ID NO: 425912 - DNA, 20 bp, mouse
gagtggtccagggctggggt

SEQ ID NO: 425913 - DNA, 20 bp, mouse
gacggggcttcagtctaacg

SEQ ID NO: 425914 - DNA, 20 bp, mouse
gtgcagccgcgggtccggag

SEQ ID NO: 425915 - DNA, 20 bp, mouse
gaacgcggctgacgcaactc

SEQ ID NO: 425916 - DNA, 20 bp, mouse
gagttagtggcctgattcag

SEQ ID NO: 425917 - DNA, 20 bp, mouse
gatcttcaagtcggccagtg

SEQ ID NO: 425918 - DNA, 20 bp, mouse
gcaagtcggccagtggggca

SEQ ID NO: 425919 - DNA, 20 bp, mouse
gggagtgggcacttatggta

SEQ ID NO: 425920 - DNA, 20 bp, mouse
gggtgagtcactagtgaaca

SEQ ID NO: 425921 - DNA, 20 bp, mouse
gtggtaaggcagacaaacag

SEQ ID NO: 425922 - DNA, 20 bp, mouse
gccaggtcaactgaagctta

SEQ ID NO: 425923 - DNA, 20 bp, mouse
gtccgtggagtgggcactta

SEQ ID NO: 425924 - DNA, 20 bp, mouse
gtatatgatattgtccgata

SEQ ID NO: 425925 - DNA, 20 bp, mouse
gttattagaactgctctcta

SEQ ID NO: 425926 - DNA, 20 bp, mouse
gcgatctcgctggaagtcat

SEQ ID NO: 425927 - DNA, 20 bp, mouse
ggtcatgggcggccacgggt

SEQ ID NO: 425928 - DNA, 20 bp, mouse
gccccgcgcacacccacccg

SEQ ID NO: 425929 - DNA, 20 bp, mouse
ggcggaggcgcggagatgac

SEQ ID NO: 425930 - DNA, 20 bp, mouse
ggccatgccgggcgaggtga

SEQ ID NO: 425931 - DNA, 20 bp, mouse
gggcctctgaagggatccag

SEQ ID NO: 425932 - DNA, 20 bp, mouse
ggggcgcgctcgctgtatat

SEQ ID NO: 425933 - DNA, 20 bp, mouse
gccagcgagatcgccatgcc

SEQ ID NO: 425934 - DNA, 20 bp, mouse
gggtcggccttcacctcgcc

SEQ ID NO: 425935 - DNA, 20 bp, mouse
gtgcagcgaggccatgagcg

SEQ ID NO: 425936 - DNA, 20 bp, mouse
ggtgcgtcggggacacggac

SEQ ID NO: 425937 - DNA, 20 bp, mouse
gaggccaagctggtgcgtcg

SEQ ID NO: 425938 - DNA, 20 bp, mouse
gaccagagacgctcaggtgt

SEQ ID NO: 425939 - DNA, 20 bp, mouse
gggagagtgcgaaccagtta

SEQ ID NO: 425940 - DNA, 20 bp, mouse
ggttatggctaccaccaacg

SEQ ID NO: 425941 - DNA, 20 bp, mouse
gagctggtgcgtcggggaca

SEQ ID NO: 425942 - DNA, 20 bp, mouse
gtgcgccgagcagcctggta

SEQ ID NO: 425943 - DNA, 20 bp, mouse
gagcaggctgcgcaccgccc

SEQ ID NO: 425944 - DNA, 20 bp, mouse
gcggagctgtcacccagagc

SEQ ID NO: 425945 - DNA, 20 bp, mouse
ggcggtgcgcagcctgctct

SEQ ID NO: 425946 - DNA, 20 bp, mouse
gatcttcaagttggccagcg

SEQ ID NO: 425947 - DNA, 20 bp, mouse
gcagcaaaatggttctgaaa

SEQ ID NO: 425948 - DNA, 20 bp, mouse
gcaagttggccagcggggca

SEQ ID NO: 425949 - DNA, 20 bp, mouse
gctccactctgtctgtataa

SEQ ID NO: 425950 - DNA, 20 bp, mouse
ggcctggttaaagcacaggt

SEQ ID NO: 425951 - DNA, 20 bp, mouse
gaggggcctggttaaagcac

SEQ ID NO: 425952 - DNA, 20 bp, mouse
gactcttccaaatgatctaa

SEQ ID NO: 425953 - DNA, 20 bp, mouse
ggagattcccttagatcatt

SEQ ID NO: 425954 - DNA, 20 bp, mouse
gtagtaagaaaatctacaat

SEQ ID NO: 425955 - DNA, 20 bp, mouse
gttcctttatacagacagag

SEQ ID NO: 425956 - DNA, 20 bp, mouse
ggcacggctgctgaactgac

SEQ ID NO: 425957 - DNA, 20 bp, mouse
gagctacctgcggtggtctg

SEQ ID NO: 425958 - DNA, 20 bp, mouse
gtgagcgaggcgggtccgca

SEQ ID NO: 425959 - DNA, 20 bp, mouse
gcggcggtagctacctgcgg

SEQ ID NO: 425960 - DNA, 20 bp, mouse
gagtggctctagccccagat

SEQ ID NO: 425961 - DNA, 20 bp, mouse
ggtgccccagtgcggaggga

SEQ ID NO: 425962 - DNA, 20 bp, mouse
gcaggctccgaatcgcgctc

SEQ ID NO: 425963 - DNA, 20 bp, mouse
ggtgtctccccgataggaag

SEQ ID NO: 425964 - DNA, 20 bp, mouse
gtccgcactggggcacgcta

SEQ ID NO: 425965 - DNA, 20 bp, mouse
ggcacgctacggtccccgaa

SEQ ID NO: 425966 - DNA, 20 bp, mouse
gcagaagggcgcacaagctc

SEQ ID NO: 425967 - DNA, 20 bp, mouse
ggctgtcagcagtcagcaca

SEQ ID NO: 425968 - DNA, 20 bp, mouse
ggtcttgtgcagagagggtt

SEQ ID NO: 425969 - DNA, 20 bp, mouse
ggggtcagtgctcctcctcc

SEQ ID NO: 425970 - DNA, 20 bp, mouse
ggcagctagcaggtacttct

SEQ ID NO: 425971 - DNA, 20 bp, mouse
gctgaggatccaaggttcag

SEQ ID NO: 425972 - DNA, 20 bp, mouse
ggttcagcggctgcctgtag

SEQ ID NO: 425973 - DNA, 20 bp, mouse
gctcgggtcttgtgcagaga

SEQ ID NO: 425974 - DNA, 20 bp, mouse
ggcggctgcctgtagtggag

SEQ ID NO: 425975 - DNA, 20 bp, mouse
gacaggcagccgctgaacct

SEQ ID NO: 425976 - DNA, 20 bp, mouse
gcgggagtgggtaggtacca

SEQ ID NO: 425977 - DNA, 20 bp, mouse
gcgagcgattgccaggcggg

SEQ ID NO: 425978 - DNA, 20 bp, mouse
gagaggagcgagcgattgcc

SEQ ID NO: 425979 - DNA, 20 bp, mouse
gggagcgagcgattgccagg

SEQ ID NO: 425980 - DNA, 20 bp, mouse
gggccgggacggcaaggctg

SEQ ID NO: 425981 - DNA, 20 bp, mouse
ggcggggtagccaggcgcta

SEQ ID NO: 425982 - DNA, 20 bp, mouse
ggaagcctgtggcagtatcc

SEQ ID NO: 425983 - DNA, 20 bp, mouse
gctgtggcagtatccgggat

SEQ ID NO: 425984 - DNA, 20 bp, mouse
gttgcagggccgggacggca

SEQ ID NO: 425985 - DNA, 20 bp, mouse
gcgcgtctgcagctgattcc

SEQ ID NO: 425986 - DNA, 20 bp, mouse
gcgatcggcaaggcttctct

SEQ ID NO: 425987 - DNA, 20 bp, mouse
gatgggcgagccgagccgaa

SEQ ID NO: 425988 - DNA, 20 bp, mouse
ggctgcagtcgccctccgat

SEQ ID NO: 425989 - DNA, 20 bp, mouse
gacccgaactgaactgaaat

SEQ ID NO: 425990 - DNA, 20 bp, mouse
gcccgccctagggcccgagg

SEQ ID NO: 425991 - DNA, 20 bp, mouse
gagaagccttgccgatcgga

SEQ ID NO: 425992 - DNA, 20 bp, mouse
gcgacacactgcggccacat

SEQ ID NO: 425993 - DNA, 20 bp, mouse
gggcttctctcggctccgtt

SEQ ID NO: 425994 - DNA, 20 bp, mouse
gctctcggctccgttcggct

SEQ ID NO: 425995 - DNA, 20 bp, mouse
gggcggcggcggacaacagg

SEQ ID NO: 425996 - DNA, 20 bp, mouse
gagacgaagtaagagagatg

SEQ ID NO: 425997 - DNA, 20 bp, mouse
gctctcagcccctagaaagg

SEQ ID NO: 425998 - DNA, 20 bp, mouse
gtcggaaggtgacagacctc

SEQ ID NO: 425999 - DNA, 20 bp, mouse
gaggactctgaggtccaagt

SEQ ID NO: 426000 - DNA, 20 bp, mouse
gtccaagtgggcggggagaa

SEQ ID NO: 426001 - DNA, 20 bp, mouse
gtcttacttcgtctctagat

SEQ ID NO: 426002 - DNA, 20 bp, mouse
ggtgagaagagtaggactga

SEQ ID NO: 426003 - DNA, 20 bp, mouse
ggactctcttggtccaatgt

SEQ ID NO: 426004 - DNA, 20 bp, mouse
gggactagttgccctcagag

SEQ ID NO: 426005 - DNA, 20 bp, mouse
gactctgaggtccaagtggg

SEQ ID NO: 426006 - DNA, 20 bp, mouse
gggcggataggacccagcag

SEQ ID NO: 426007 - DNA, 20 bp, mouse
gggaaagtggcagtgagctg

SEQ ID NO: 426008 - DNA, 20 bp, mouse
gtctaggccagtaggcggat

SEQ ID NO: 426009 - DNA, 20 bp, mouse
gccgggtctaggccagtagg

SEQ ID NO: 426010 - DNA, 20 bp, mouse
ggccgggcctgaggagaacg

SEQ ID NO: 426011 - DNA, 20 bp, mouse
ggggccgggtctaggccagt

SEQ ID NO: 426012 - DNA, 20 bp, mouse
gatccatagcagctccttac

SEQ ID NO: 426013 - DNA, 20 bp, mouse
gcatggagcgccaggtccta

SEQ ID NO: 426014 - DNA, 20 bp, mouse
gaagtgagcctccacagggt

SEQ ID NO: 426015 - DNA, 20 bp, mouse
ggaaatcttagcagccatcg

SEQ ID NO: 426016 - DNA, 20 bp, mouse
gtcccaggatacggtacctg

SEQ ID NO: 426017 - DNA, 20 bp, mouse
ggccgcaggtaccgtatcct

SEQ ID NO: 426018 - DNA, 20 bp, mouse
gtaccgtatcctgggaagat

SEQ ID NO: 426019 - DNA, 20 bp, mouse
ggaatccagtgcagattcaa

SEQ ID NO: 426020 - DNA, 20 bp, mouse
gcatagggcctggaagacat

SEQ ID NO: 426021 - DNA, 20 bp, mouse
gtgcataagggcagggtgcc

SEQ ID NO: 426022 - DNA, 20 bp, mouse
gtgcagcttggcgaagccgc

SEQ ID NO: 426023 - DNA, 20 bp, mouse
gcaggcagagccggacagcc

SEQ ID NO: 426024 - DNA, 20 bp, mouse
ggcttgaggagaaaacggga

SEQ ID NO: 426025 - DNA, 20 bp, mouse
ggagaggctccaaggatcat

SEQ ID NO: 426026 - DNA, 20 bp, mouse
gtgaccccacctagaaggat

SEQ ID NO: 426027 - DNA, 20 bp, mouse
gggcgctgcactgccagata

SEQ ID NO: 426028 - DNA, 20 bp, mouse
gcacctagaaggatcggcag

SEQ ID NO: 426029 - DNA, 20 bp, mouse
gaggctcggagccctctcag

SEQ ID NO: 426030 - DNA, 20 bp, mouse
gtgttgggatacggagtcac

SEQ ID NO: 426031 - DNA, 20 bp, mouse
gccaagagtctcaggacgag

SEQ ID NO: 426032 - DNA, 20 bp, mouse
ggcagaggcaattgagagcc

SEQ ID NO: 426033 - DNA, 20 bp, mouse
gatacggagtcacgggtgag

SEQ ID NO: 426034 - DNA, 20 bp, mouse
ggtctctgcagcagacattc

SEQ ID NO: 426035 - DNA, 20 bp, mouse
ggccccacctacccctgaga

SEQ ID NO: 426036 - DNA, 20 bp, mouse
gatcggcggagcgacggcag

SEQ ID NO: 426037 - DNA, 20 bp, mouse
ggacggcagcggcagcatcg

SEQ ID NO: 426038 - DNA, 20 bp, mouse
ggcagggatcggcggagcga

SEQ ID NO: 426039 - DNA, 20 bp, mouse
gccagcgcccctccaggcat

SEQ ID NO: 426040 - DNA, 20 bp, mouse
gtgctgtcccatgcctggag

SEQ ID NO: 426041 - DNA, 20 bp, mouse
gaccataaggagaggagacg

SEQ ID NO: 426042 - DNA, 20 bp, mouse
gggcgccacaggttctccat

SEQ ID NO: 426043 - DNA, 20 bp, mouse
gactcacccagcgcccctcc

SEQ ID NO: 426044 - DNA, 20 bp, mouse
gatagggaccctggagataa

SEQ ID NO: 426045 - DNA, 20 bp, mouse
gtgggtcataccataaggag

SEQ ID NO: 426046 - DNA, 20 bp, mouse
ggcgagctgcaggatctcag

SEQ ID NO: 426047 - DNA, 20 bp, mouse
gggcgacaccggcaagggac

SEQ ID NO: 426048 - DNA, 20 bp, mouse
ggtagcggcgacaccggcaa

SEQ ID NO: 426049 - DNA, 20 bp, mouse
gccggcagtagcggcgacac

SEQ ID NO: 426050 - DNA, 20 bp, mouse
gcgggaaagcgggagcccgg

SEQ ID NO: 426051 - DNA, 20 bp, mouse
gcagctgttgaaggcatcgt

SEQ ID NO: 426052 - DNA, 20 bp, mouse
gaaagcaggtcgccatggcc

SEQ ID NO: 426053 - DNA, 20 bp, mouse
gtccgcggggacagcttcgt

SEQ ID NO: 426054 - DNA, 20 bp, mouse
gggagcccgcaggaaccccg

SEQ ID NO: 426055 - DNA, 20 bp, mouse
gtcgtacaccgggaaggtgg

SEQ ID NO: 426056 - DNA, 20 bp, mouse
gcagagtcggtgagccatgg

SEQ ID NO: 426057 - DNA, 20 bp, mouse
ggggcagagtcggtgagcca

SEQ ID NO: 426058 - DNA, 20 bp, mouse
gaacggtgttgcttcaaggg

SEQ ID NO: 426059 - DNA, 20 bp, mouse
ggcactggcagccgagacgc

SEQ ID NO: 426060 - DNA, 20 bp, mouse
gcgggtctggtggaacacaa

SEQ ID NO: 426061 - DNA, 20 bp, mouse
ggttgcttcaagggaggcac

SEQ ID NO: 426062 - DNA, 20 bp, mouse
gtgagccatggcggcggcag

SEQ ID NO: 426063 - DNA, 20 bp, mouse
gctgggccaagaagtctgtc

SEQ ID NO: 426064 - DNA, 20 bp, mouse
ggcccagctcgcctgcgtct

SEQ ID NO: 426065 - DNA, 20 bp, mouse
gggcggcagcggcagcaatg

SEQ ID NO: 426066 - DNA, 20 bp, mouse
gactgcacacagagcctgcg

SEQ ID NO: 426067 - DNA, 20 bp, mouse
gggctccgcgaggataacga

SEQ ID NO: 426068 - DNA, 20 bp, mouse
ggcgggcctgctccaaggtc

SEQ ID NO: 426069 - DNA, 20 bp, mouse
gatcagcagagtagacatgt

SEQ ID NO: 426070 - DNA, 20 bp, mouse
ggcaagaagcccctccgcca

SEQ ID NO: 426071 - DNA, 20 bp, mouse
gagcagagtagacatgtggg

SEQ ID NO: 426072 - DNA, 20 bp, mouse
gtatgtggcgtgtgccccgc

SEQ ID NO: 426073 - DNA, 20 bp, mouse
gcggcctcccgggcaaacct

SEQ ID NO: 426074 - DNA, 20 bp, mouse
gcttgcagccaggcatactg

SEQ ID NO: 426075 - DNA, 20 bp, mouse
gcaaggtccggaaagcttgc

SEQ ID NO: 426076 - DNA, 20 bp, mouse
gcgagttccgcgcagcccag

SEQ ID NO: 426077 - DNA, 20 bp, mouse
gcacaaaactcagcgctggg

SEQ ID NO: 426078 - DNA, 20 bp, mouse
gggtttccccaaggaaggta

SEQ ID NO: 426079 - DNA, 20 bp, mouse
gcagcccagcggtttcccca

SEQ ID NO: 426080 - DNA, 20 bp, mouse
gggtgagaggcgggaggtca

SEQ ID NO: 426081 - DNA, 20 bp, mouse
gcccgtgcgggcgagcgcta

SEQ ID NO: 426082 - DNA, 20 bp, mouse
gcttccttggggaaaccgct

SEQ ID NO: 426083 - DNA, 20 bp, mouse
gcgaatgccttaccttcctt

SEQ ID NO: 426084 - DNA, 20 bp, mouse
gagagcatccgggtgagagg

SEQ ID NO: 426085 - DNA, 20 bp, mouse
gacagccacgcgcgccaacg

SEQ ID NO: 426086 - DNA, 20 bp, mouse
gtcctgagggcagtcacaga

SEQ ID NO: 426087 - DNA, 20 bp, mouse
gagagggcactttcctaaca

SEQ ID NO: 426088 - DNA, 20 bp, mouse
ggttggagaactttataggt

SEQ ID NO: 426089 - DNA, 20 bp, mouse
gccctttttccagccatgtt

SEQ ID NO: 426090 - DNA, 20 bp, mouse
ggaggtaagtctattcactt

SEQ ID NO: 426091 - DNA, 20 bp, mouse
gtcctaacatggctggaaaa

SEQ ID NO: 426092 - DNA, 20 bp, mouse
gataaacccatggagccagt

SEQ ID NO: 426093 - DNA, 20 bp, mouse
gaagtgcccactggctccat

SEQ ID NO: 426094 - DNA, 20 bp, mouse
gggcactttcctaacatggc

SEQ ID NO: 426095 - DNA, 20 bp, mouse
gggactggtctgagctggaa

SEQ ID NO: 426096 - DNA, 20 bp, mouse
gtgcagcccggtgaatgcgg

SEQ ID NO: 426097 - DNA, 20 bp, mouse
gacgcgtagcagatgatcct

SEQ ID NO: 426098 - DNA, 20 bp, mouse
ggagagctcggaaggactcg

SEQ ID NO: 426099 - DNA, 20 bp, mouse
gtgctgcagcccggtgaatg

SEQ ID NO: 426100 - DNA, 20 bp, mouse
gaaggtgccagtactcatgg

SEQ ID NO: 426101 - DNA, 20 bp, mouse
gcacagaaccgactgcaccg

SEQ ID NO: 426102 - DNA, 20 bp, mouse
gcagtcgccgccatgagtac

SEQ ID NO: 426103 - DNA, 20 bp, mouse
ggggcaggggtggaccacta

SEQ ID NO: 426104 - DNA, 20 bp, mouse
gccgtgccggaagcatccac

SEQ ID NO: 426105 - DNA, 20 bp, mouse
gccccgcgccaggttaccgg

SEQ ID NO: 426106 - DNA, 20 bp, mouse
gctgtcactgcgccacaggt

SEQ ID NO: 426107 - DNA, 20 bp, mouse
ggagtgagcccggcagtcca

SEQ ID NO: 426108 - DNA, 20 bp, mouse
gccggatagcggcccacctg

SEQ ID NO: 426109 - DNA, 20 bp, mouse
gggcgcaggccggagaaccc

SEQ ID NO: 426110 - DNA, 20 bp, mouse
gcatcctgcaatccggatag

SEQ ID NO: 426111 - DNA, 20 bp, mouse
gctacacagccggaagccag

SEQ ID NO: 426112 - DNA, 20 bp, mouse
gcggccacatcggaactgag

SEQ ID NO: 426113 - DNA, 20 bp, mouse
gactcagccggaatgtgggt

SEQ ID NO: 426114 - DNA, 20 bp, mouse
ggggctcactctctgctgac

SEQ ID NO: 426115 - DNA, 20 bp, mouse
ggcttctgtcactgcgccac

SEQ ID NO: 426116 - DNA, 20 bp, mouse
gagtctgctgggtacgccgg

SEQ ID NO: 426117 - DNA, 20 bp, mouse
gtggaatgcgccgcagaatg

SEQ ID NO: 426118 - DNA, 20 bp, mouse
ggtgagtctgctgggtacgc

SEQ ID NO: 426119 - DNA, 20 bp, mouse
gcagacaaaggagttaggaa

SEQ ID NO: 426120 - DNA, 20 bp, mouse
gttgacagaggtgagtctgc

SEQ ID NO: 426121 - DNA, 20 bp, mouse
gctcacctctgtcaagtgcc

SEQ ID NO: 426122 - DNA, 20 bp, mouse
gcgattgcccatgcttccaa

SEQ ID NO: 426123 - DNA, 20 bp, mouse
gctctgtcaagtgccaggca

SEQ ID NO: 426124 - DNA, 20 bp, mouse
gtcagtgctgggtatgggca

SEQ ID NO: 426125 - DNA, 20 bp, mouse
gaacacccaccaacagacaa

SEQ ID NO: 426126 - DNA, 20 bp, mouse
gcggcgagaccaccacccaa

SEQ ID NO: 426127 - DNA, 20 bp, mouse
gtgggcattaaggtggacaa

SEQ ID NO: 426128 - DNA, 20 bp, mouse
gcgccgttagttcctgccag

SEQ ID NO: 426129 - DNA, 20 bp, mouse
gcataatggcgagggctgag

SEQ ID NO: 426130 - DNA, 20 bp, mouse
gattaaggtggacaagggcg

SEQ ID NO: 426131 - DNA, 20 bp, mouse
gtccttccaggtagacatgg

SEQ ID NO: 426132 - DNA, 20 bp, mouse
gaagggctggatgatctgtc

SEQ ID NO: 426133 - DNA, 20 bp, mouse
ggtcatggtcgccatcaggg

SEQ ID NO: 426134 - DNA, 20 bp, mouse
gtggcctgcggtgaccatgt

SEQ ID NO: 426135 - DNA, 20 bp, mouse
gaggatttctggctccacaa

SEQ ID NO: 426136 - DNA, 20 bp, mouse
gacagcttctgataccttgg

SEQ ID NO: 426137 - DNA, 20 bp, mouse
gtggcagccgccaaatacga

SEQ ID NO: 426138 - DNA, 20 bp, mouse
ggcagatccatcgtatttgg

SEQ ID NO: 426139 - DNA, 20 bp, mouse
gctcaagaggtgcctcacac

SEQ ID NO: 426140 - DNA, 20 bp, mouse
gctccaggaaaggtgtgaat

SEQ ID NO: 426141 - DNA, 20 bp, mouse
gtgagcagatccatcgtatt

SEQ ID NO: 426142 - DNA, 20 bp, mouse
gttttacttacacagcaaag

SEQ ID NO: 426143 - DNA, 20 bp, mouse
gtagtgcagcagatccatca

SEQ ID NO: 426144 - DNA, 20 bp, mouse
gcatcaataccaataggggt

SEQ ID NO: 426145 - DNA, 20 bp, mouse
ggttactgttcgcctgtgtg

SEQ ID NO: 426146 - DNA, 20 bp, mouse
gcttggaccgagctaatcag

SEQ ID NO: 426147 - DNA, 20 bp, mouse
gcaagctggagtaaataagg

SEQ ID NO: 426148 - DNA, 20 bp, mouse
gagggagtcacgtagctctg

SEQ ID NO: 426149 - DNA, 20 bp, mouse
ggtccaagctggagtaaata

SEQ ID NO: 426150 - DNA, 20 bp, mouse
ggagctacgtgactccctgg

SEQ ID NO: 426151 - DNA, 20 bp, mouse
ggagagggcaaggacagcat

SEQ ID NO: 426152 - DNA, 20 bp, mouse
gcagaggaacttgggtccca

SEQ ID NO: 426153 - DNA, 20 bp, mouse
gggtatctgtcacgccccca

SEQ ID NO: 426154 - DNA, 20 bp, mouse
gaggcttgtcctctactcta

SEQ ID NO: 426155 - DNA, 20 bp, mouse
gcactcagccagtcagccgc

SEQ ID NO: 426156 - DNA, 20 bp, mouse
gcggcgccggccggccaaga

SEQ ID NO: 426157 - DNA, 20 bp, mouse
gaagatggcagcgtcctgcg

SEQ ID NO: 426158 - DNA, 20 bp, mouse
gcccaaaacagggagagtca

SEQ ID NO: 426159 - DNA, 20 bp, mouse
gtgagtggcggggacctgag

SEQ ID NO: 426160 - DNA, 20 bp, mouse
gtgcgtggcgctgctggttc

SEQ ID NO: 426161 - DNA, 20 bp, mouse
gctgagagggaggctcaatc

SEQ ID NO: 426162 - DNA, 20 bp, mouse
ggctgggcttgtggaagcgt

SEQ ID NO: 426163 - DNA, 20 bp, mouse
gagaccagaacaggcaggag

SEQ ID NO: 426164 - DNA, 20 bp, mouse
ggctggggttctacagtgag

SEQ ID NO: 426165 - DNA, 20 bp, mouse
gccgcctctgtcccaaaaca

SEQ ID NO: 426166 - DNA, 20 bp, mouse
gtgcgggacgagggacagca

SEQ ID NO: 426167 - DNA, 20 bp, mouse
ggctcagaggcccagcgctg

SEQ ID NO: 426168 - DNA, 20 bp, mouse
gcgcagagcgcggctgaagg

SEQ ID NO: 426169 - DNA, 20 bp, mouse
ggcccagcgctgcgggacga

SEQ ID NO: 426170 - DNA, 20 bp, mouse
ggcctctgagcccgcgttcc

SEQ ID NO: 426171 - DNA, 20 bp, mouse
gaagtctgggagggctgacg

SEQ ID NO: 426172 - DNA, 20 bp, mouse
gcggcgctccgggctgccca

SEQ ID NO: 426173 - DNA, 20 bp, mouse
ggcccggaacgcgggctcag

SEQ ID NO: 426174 - DNA, 20 bp, mouse
ggctctgcgggagccgtaca

SEQ ID NO: 426175 - DNA, 20 bp, mouse
gaggaaggtgcagctcaagg

SEQ ID NO: 426176 - DNA, 20 bp, mouse
ggtgcgtgtacgccgtgctg

SEQ ID NO: 426177 - DNA, 20 bp, mouse
gtggtggcctgagctcacga

SEQ ID NO: 426178 - DNA, 20 bp, mouse
gccgtgctgcggtgaggatc

SEQ ID NO: 426179 - DNA, 20 bp, mouse
gtgtacgccgtgctgcggtg

SEQ ID NO: 426180 - DNA, 20 bp, mouse
gaggggagggtgggataaga

SEQ ID NO: 426181 - DNA, 20 bp, mouse
gttccgggctgtgagagggg

SEQ ID NO: 426182 - DNA, 20 bp, mouse
gtaagatggcggcggacact

SEQ ID NO: 426183 - DNA, 20 bp, mouse
ggagctcacgagggcgtgga

SEQ ID NO: 426184 - DNA, 20 bp, mouse
gcgcttccgggctgtgagag

SEQ ID NO: 426185 - DNA, 20 bp, mouse
gcacgagggcgtggagggtt

SEQ ID NO: 426186 - DNA, 20 bp, mouse
gcagctccgggcgccaggtg

SEQ ID NO: 426187 - DNA, 20 bp, mouse
gctccgggcgccaggtgagg

SEQ ID NO: 426188 - DNA, 20 bp, mouse
gtcagttccgcggggtcctg

SEQ ID NO: 426189 - DNA, 20 bp, mouse
gggtgaggaggatggatgaa

SEQ ID NO: 426190 - DNA, 20 bp, mouse
gcgcccgagtacaccaatcc

SEQ ID NO: 426191 - DNA, 20 bp, mouse
gtgagcagactgaccaaggc

SEQ ID NO: 426192 - DNA, 20 bp, mouse
ggtcagtctgctcagttccg

SEQ ID NO: 426193 - DNA, 20 bp, mouse
gcccgggttgaggaactcaa

SEQ ID NO: 426194 - DNA, 20 bp, mouse
gtagcgcgcgtcgccgggat

SEQ ID NO: 426195 - DNA, 20 bp, mouse
gggatggacctgtcacttag

SEQ ID NO: 426196 - DNA, 20 bp, mouse
gctgagaggagacccagcag

SEQ ID NO: 426197 - DNA, 20 bp, mouse
ggagagcgtttgtgactgtc

SEQ ID NO: 426198 - DNA, 20 bp, mouse
ggaggctccgggaggcgcaa

SEQ ID NO: 426199 - DNA, 20 bp, mouse
gctcccccggcgcctcggga

SEQ ID NO: 426200 - DNA, 20 bp, mouse
gccagtgaggtcgcatgaag

SEQ ID NO: 426201 - DNA, 20 bp, mouse
gatcgcgcgggttccagatt

SEQ ID NO: 426202 - DNA, 20 bp, mouse
gaggcgccgggggagctgaa

SEQ ID NO: 426203 - DNA, 20 bp, mouse
ggacgagctcgtcgcacggg

SEQ ID NO: 426204 - DNA, 20 bp, mouse
gcgggagggagaagaaacgg

SEQ ID NO: 426205 - DNA, 20 bp, mouse
gaagtagtcgaggcccgggg

SEQ ID NO: 426206 - DNA, 20 bp, mouse
gcgtgtagacctggcgccag

SEQ ID NO: 426207 - DNA, 20 bp, mouse
ggagcaaagcgcctctctgt

SEQ ID NO: 426208 - DNA, 20 bp, mouse
gaccatccccgcccacagag

SEQ ID NO: 426209 - DNA, 20 bp, mouse
gaggccgacggtcttgagtt

SEQ ID NO: 426210 - DNA, 20 bp, mouse
gtggcgcatgcgtgtagacc

SEQ ID NO: 426211 - DNA, 20 bp, mouse
gccgcgcttaagagcaaaca

SEQ ID NO: 426212 - DNA, 20 bp, mouse
gctggatccggtaagtatcc

SEQ ID NO: 426213 - DNA, 20 bp, mouse
gagagtcgcgatgcattctg

SEQ ID NO: 426214 - DNA, 20 bp, mouse
gctcctaaaggcgctaagaa

SEQ ID NO: 426215 - DNA, 20 bp, mouse
ggatccggtaagtatccggg

SEQ ID NO: 426216 - DNA, 20 bp, mouse
gtgggctgtaaacccgggaa

SEQ ID NO: 426217 - DNA, 20 bp, mouse
gacagatgggctgtaaaccc

SEQ ID NO: 426218 - DNA, 20 bp, mouse
gccgggaacgggctcggtac

SEQ ID NO: 426219 - DNA, 20 bp, mouse
ggtaaacccgggaacgggct

SEQ ID NO: 426220 - DNA, 20 bp, mouse
ggagcttgcagaagctcgcg

SEQ ID NO: 426221 - DNA, 20 bp, mouse
gagtagccagagggggccag

SEQ ID NO: 426222 - DNA, 20 bp, mouse
gcgcgcggagagcgcaagcg

SEQ ID NO: 426223 - DNA, 20 bp, mouse
gtccgcctatacccatgtct

SEQ ID NO: 426224 - DNA, 20 bp, mouse
gcgcacgtaggagcagatgg

SEQ ID NO: 426225 - DNA, 20 bp, mouse
ggcgggtctcgatgaagcag

SEQ ID NO: 426226 - DNA, 20 bp, mouse
gccggctggccgacagaagc

SEQ ID NO: 426227 - DNA, 20 bp, mouse
gctgctgggctgcggaaacg

SEQ ID NO: 426228 - DNA, 20 bp, mouse
ggagtggtgcactgtcaaga

SEQ ID NO: 426229 - DNA, 20 bp, mouse
ggcggccagccggcttctgt

SEQ ID NO: 426230 - DNA, 20 bp, mouse
gcggccagccggcaggaatc

SEQ ID NO: 426231 - DNA, 20 bp, mouse
gggcatgtgagttcactgaa

SEQ ID NO: 426232 - DNA, 20 bp, mouse
ggcctctgcatagcagaggt

SEQ ID NO: 426233 - DNA, 20 bp, mouse
gggtaacctccctcccatat

SEQ ID NO: 426234 - DNA, 20 bp, mouse
gaccttctgggtcattcaca

SEQ ID NO: 426235 - DNA, 20 bp, mouse
gctggccgacagaagccggc

SEQ ID NO: 426236 - DNA, 20 bp, mouse
gcaagtgtggagctgcggga

SEQ ID NO: 426237 - DNA, 20 bp, mouse
gggagcaccggactccacca

SEQ ID NO: 426238 - DNA, 20 bp, mouse
gcagctgctggggctcggcg

SEQ ID NO: 426239 - DNA, 20 bp, mouse
gggctctgggcactcaaata

SEQ ID NO: 426240 - DNA, 20 bp, mouse
gggtctcaccagaatgagcg

SEQ ID NO: 426241 - DNA, 20 bp, mouse
gtccgcaagtgtggagctgc

SEQ ID NO: 426242 - DNA, 20 bp, mouse
gggagccccgaaaagctggg

SEQ ID NO: 426243 - DNA, 20 bp, mouse
ggcaggagccccgaaaagct

SEQ ID NO: 426244 - DNA, 20 bp, mouse
gcattctggtgagaccgtgg

SEQ ID NO: 426245 - DNA, 20 bp, mouse
ggaagggacacccggagcac

SEQ ID NO: 426246 - DNA, 20 bp, mouse
ggcctgccgcctccagacct

SEQ ID NO: 426247 - DNA, 20 bp, mouse
gtccagacctcggcaacccc

SEQ ID NO: 426248 - DNA, 20 bp, mouse
gcgcattcgctggttctctg

SEQ ID NO: 426249 - DNA, 20 bp, mouse
gggttgccgaggtctggagg

SEQ ID NO: 426250 - DNA, 20 bp, mouse
gcagaggctggtaagagcct

SEQ ID NO: 426251 - DNA, 20 bp, mouse
gtctctgcgggcgccaattc

SEQ ID NO: 426252 - DNA, 20 bp, mouse
gtcgggagggacagacccac

SEQ ID NO: 426253 - DNA, 20 bp, mouse
gagcctctgctctccagaat

SEQ ID NO: 426254 - DNA, 20 bp, mouse
gggcaggcgtcgggaggtcc

SEQ ID NO: 426255 - DNA, 20 bp, mouse
gcccgaatggtggcactggg

SEQ ID NO: 426256 - DNA, 20 bp, mouse
ggagaaccaatggccaccag

SEQ ID NO: 426257 - DNA, 20 bp, mouse
ggacgggactccaggaatgg

SEQ ID NO: 426258 - DNA, 20 bp, mouse
gccaccagcggttgcagacc

SEQ ID NO: 426259 - DNA, 20 bp, mouse
gccggaagtgacgggactcc

SEQ ID NO: 426260 - DNA, 20 bp, mouse
gcgcagtgtcccggaagtga

SEQ ID NO: 426261 - DNA, 20 bp, mouse
gtccaggaatggcggcgtcc

SEQ ID NO: 426262 - DNA, 20 bp, mouse
gcgtccgggtctgcaaccgc

SEQ ID NO: 426263 - DNA, 20 bp, mouse
gcaaaggcggagagaacacg

SEQ ID NO: 426264 - DNA, 20 bp, mouse
gtgcaaccgctggtggccat

SEQ ID NO: 426265 - DNA, 20 bp, mouse
ggctatattctggatctcag

SEQ ID NO: 426266 - DNA, 20 bp, mouse
gtcggggaaaggatagaact

SEQ ID NO: 426267 - DNA, 20 bp, mouse
gcacgctacgaaatcggcga

SEQ ID NO: 426268 - DNA, 20 bp, mouse
gggctcgccatgcccagcgt

SEQ ID NO: 426269 - DNA, 20 bp, mouse
gcgaaggcgcagacattgct

SEQ ID NO: 426270 - DNA, 20 bp, mouse
gactcggcacgctacgaaat

SEQ ID NO: 426271 - DNA, 20 bp, mouse
gcccggcagcgcctcaaggg

SEQ ID NO: 426272 - DNA, 20 bp, mouse
gggaggcaggcgcagagccg

SEQ ID NO: 426273 - DNA, 20 bp, mouse
gcatgcccagcgtcggggaa

SEQ ID NO: 426274 - DNA, 20 bp, mouse
gcatggcgagccgaagggcc

SEQ ID NO: 426275 - DNA, 20 bp, mouse
ggagtacgtgtgcggtcgga

SEQ ID NO: 426276 - DNA, 20 bp, mouse
gccaggcagatgcgatccag

SEQ ID NO: 426277 - DNA, 20 bp, mouse
gtgtccagcggttctcgggg

SEQ ID NO: 426278 - DNA, 20 bp, mouse
gtgcgatccagcggctctgg

SEQ ID NO: 426279 - DNA, 20 bp, mouse
gtgcttgggagtgaactccg

SEQ ID NO: 426280 - DNA, 20 bp, mouse
gcggcagcagcggtggcaac

SEQ ID NO: 426281 - DNA, 20 bp, mouse
gctccgaggaaccaagacgt

SEQ ID NO: 426282 - DNA, 20 bp, mouse
gcagcggaggtcacttgagg

SEQ ID NO: 426283 - DNA, 20 bp, mouse
gaggcaaggaccaccggagg

SEQ ID NO: 426284 - DNA, 20 bp, mouse
gtctaggcaaggaccaccgg

SEQ ID NO: 426285 - DNA, 20 bp, mouse
gtgacaggagcggaggacgt

SEQ ID NO: 426286 - DNA, 20 bp, mouse
gtccggaaagcatcctctct

SEQ ID NO: 426287 - DNA, 20 bp, mouse
gtgttggcagcctcgagatg

SEQ ID NO: 426288 - DNA, 20 bp, mouse
gtgcttccgggccaaactgt

SEQ ID NO: 426289 - DNA, 20 bp, mouse
gccggaggcggcccagtctc

SEQ ID NO: 426290 - DNA, 20 bp, mouse
ggtgccccaggtaggaaagg

SEQ ID NO: 426291 - DNA, 20 bp, mouse
gctgggctctgcagccagcg

SEQ ID NO: 426292 - DNA, 20 bp, mouse
ggactgggccacccgagact

SEQ ID NO: 426293 - DNA, 20 bp, mouse
ggtagtgtgtgccagcctag

SEQ ID NO: 426294 - DNA, 20 bp, mouse
gagcccggcgtgccccaggt

SEQ ID NO: 426295 - DNA, 20 bp, mouse
ggaggcggcccagtctcggg

SEQ ID NO: 426296 - DNA, 20 bp, mouse
gtccaccggagagcccggag

SEQ ID NO: 426297 - DNA, 20 bp, mouse
ggcgagcaaccgggctccac

SEQ ID NO: 426298 - DNA, 20 bp, mouse
gctggcacgggcgagcaacc

SEQ ID NO: 426299 - DNA, 20 bp, mouse
gccggagagcccggagcggt

SEQ ID NO: 426300 - DNA, 20 bp, mouse
gctgcggccccgcggggtag

SEQ ID NO: 426301 - DNA, 20 bp, mouse
ggagcccggagcggtgggtc

SEQ ID NO: 426302 - DNA, 20 bp, mouse
gagacctgacccaccgctcc

SEQ ID NO: 426303 - DNA, 20 bp, mouse
ggcccatcggtaggaatccc

SEQ ID NO: 426304 - DNA, 20 bp, mouse
gaattccgaagaggacggac

SEQ ID NO: 426305 - DNA, 20 bp, mouse
gaacccaaaaggctacacat

SEQ ID NO: 426306 - DNA, 20 bp, mouse
ggcgtccagacggctgatta

SEQ ID NO: 426307 - DNA, 20 bp, mouse
gtgggcgccccggaccaacc

SEQ ID NO: 426308 - DNA, 20 bp, mouse
ggaggcctgaggtcagacgg

SEQ ID NO: 426309 - DNA, 20 bp, mouse
gccggggaaccttcagagtg

SEQ ID NO: 426310 - DNA, 20 bp, mouse
ggtgtcgggacctctgctca

SEQ ID NO: 426311 - DNA, 20 bp, mouse
gaggttccccggcgtccaga

SEQ ID NO: 426312 - DNA, 20 bp, mouse
gatcagccgtctggacgccg

SEQ ID NO: 426313 - DNA, 20 bp, mouse
gcggctgattagggtcgtgt

SEQ ID NO: 426314 - DNA, 20 bp, mouse
ggcccagccaggttggtccg

SEQ ID NO: 426315 - DNA, 20 bp, mouse
gctctgtacctcagcctcga

SEQ ID NO: 426316 - DNA, 20 bp, mouse
gtgcaggagtgcggctgtaa

SEQ ID NO: 426317 - DNA, 20 bp, mouse
gtgatcggaggacgcgatgg

SEQ ID NO: 426318 - DNA, 20 bp, mouse
gctcgcagataagacaggtc

SEQ ID NO: 426319 - DNA, 20 bp, mouse
gaactgatcggaggacgcga

SEQ ID NO: 426320 - DNA, 20 bp, mouse
gtgcgctcttaactgatcgg

SEQ ID NO: 426321 - DNA, 20 bp, mouse
ggcgcaggcgcgagacgcag

SEQ ID NO: 426322 - DNA, 20 bp, mouse
gcctgaaggcagatctgcca

SEQ ID NO: 426323 - DNA, 20 bp, mouse
gtgtctctcgcagataagac

SEQ ID NO: 426324 - DNA, 20 bp, mouse
gcatcggctgattaatggaa

SEQ ID NO: 426325 - DNA, 20 bp, mouse
ggtgagcttccggagcacaa

SEQ ID NO: 426326 - DNA, 20 bp, mouse
gcgagaagcccgctaaggag

SEQ ID NO: 426327 - DNA, 20 bp, mouse
ggcgctgtcggaggtcgggc

SEQ ID NO: 426328 - DNA, 20 bp, mouse
gagcggcgctgtcggaggtc

SEQ ID NO: 426329 - DNA, 20 bp, mouse
gtaaggagcggcgctgtcgg

SEQ ID NO: 426330 - DNA, 20 bp, mouse
gggctggcggtgacgtcgtg

SEQ ID NO: 426331 - DNA, 20 bp, mouse
gcgcgtcgagaagcccgcta

SEQ ID NO: 426332 - DNA, 20 bp, mouse
ggtggctcaagggaccaaag

SEQ ID NO: 426333 - DNA, 20 bp, mouse
gactccgccagactcccggt

SEQ ID NO: 426334 - DNA, 20 bp, mouse
gggcgtctgagggtccgacc

SEQ ID NO: 426335 - DNA, 20 bp, mouse
gggtgctgcatgaccgaccg

SEQ ID NO: 426336 - DNA, 20 bp, mouse
gggtctgagaggttctacag

SEQ ID NO: 426337 - DNA, 20 bp, mouse
gtccgagaagacgctgtaga

SEQ ID NO: 426338 - DNA, 20 bp, mouse
gtcagggtgagagctctagg

SEQ ID NO: 426339 - DNA, 20 bp, mouse
gggtaggagtgagtgtccaa

SEQ ID NO: 426340 - DNA, 20 bp, mouse
gaggatgcgcgcgttgagtc

SEQ ID NO: 426341 - DNA, 20 bp, mouse
ggcaatctggctcagatctg

SEQ ID NO: 426342 - DNA, 20 bp, mouse
gtgcttggcggaagtggcag

SEQ ID NO: 426343 - DNA, 20 bp, mouse
gttctgagtggggagataag

SEQ ID NO: 426344 - DNA, 20 bp, mouse
gggaggtctaaggcgactca

SEQ ID NO: 426345 - DNA, 20 bp, mouse
gtgctgaagtgggttctgag

SEQ ID NO: 426346 - DNA, 20 bp, mouse
gcagcaggaggctagcgatg

SEQ ID NO: 426347 - DNA, 20 bp, mouse
gtcacgcaggcggcccagca

SEQ ID NO: 426348 - DNA, 20 bp, mouse
ggtcaatccctgaagatggc

SEQ ID NO: 426349 - DNA, 20 bp, mouse
gtgtggtcaatccctgaaga

SEQ ID NO: 426350 - DNA, 20 bp, mouse
gggcggagcggcgagctaag

SEQ ID NO: 426351 - DNA, 20 bp, mouse
gccactgggacatagtgagg

SEQ ID NO: 426352 - DNA, 20 bp, mouse
gccactgggacgcggtgagt

SEQ ID NO: 426353 - DNA, 20 bp, mouse
ggagtacgaccactgggacg

SEQ ID NO: 426354 - DNA, 20 bp, mouse
gcgaactggagccccagctg

SEQ ID NO: 426355 - DNA, 20 bp, mouse
gttgctttctgggtgcgcct

SEQ ID NO: 426356 - DNA, 20 bp, mouse
gtgtcagagcataggtggtc

SEQ ID NO: 426357 - DNA, 20 bp, mouse
gtgaaagggtgtcagagcat

SEQ ID NO: 426358 - DNA, 20 bp, mouse
gaagggtgtcagagcatagg

SEQ ID NO: 426359 - DNA, 20 bp, mouse
gggtcaggctgcaccgggga

SEQ ID NO: 426360 - DNA, 20 bp, mouse
ggtcaatcgccagccttccc

SEQ ID NO: 426361 - DNA, 20 bp, mouse
gtggcggcgtccggttgaaa

SEQ ID NO: 426362 - DNA, 20 bp, mouse
gactattgtctgcaacatgg

SEQ ID NO: 426363 - DNA, 20 bp, mouse
ggctctgacaccctttcaac

SEQ ID NO: 426364 - DNA, 20 bp, mouse
gggtagccccagggactcat

SEQ ID NO: 426365 - DNA, 20 bp, mouse
gtaggtggtcaggctgcacc

SEQ ID NO: 426366 - DNA, 20 bp, mouse
gttcaaaacactggactgtg

SEQ ID NO: 426367 - DNA, 20 bp, mouse
gccttgaatcctgaagactg

SEQ ID NO: 426368 - DNA, 20 bp, mouse
gaacactggactgtggggag

SEQ ID NO: 426369 - DNA, 20 bp, mouse
ggggtctgcactcttgggtg

SEQ ID NO: 426370 - DNA, 20 bp, mouse
gttatcagtatggagttcta

SEQ ID NO: 426371 - DNA, 20 bp, mouse
gagactggggtctgcactct

SEQ ID NO: 426372 - DNA, 20 bp, mouse
gggttgcggggaaaataggg

SEQ ID NO: 426373 - DNA, 20 bp, mouse
ggcccagctaagaaggactg

SEQ ID NO: 426374 - DNA, 20 bp, mouse
gcttggttgcggggaaaata

SEQ ID NO: 426375 - DNA, 20 bp, mouse
gagtgcagaccccagtcttc

SEQ ID NO: 426376 - DNA, 20 bp, mouse
gtggcctgacgagctggagg

SEQ ID NO: 426377 - DNA, 20 bp, mouse
gaggtcctcaggctccatgt

SEQ ID NO: 426378 - DNA, 20 bp, mouse
gctggagcgcgaggccaaca

SEQ ID NO: 426379 - DNA, 20 bp, mouse
gcctgacgagctggaggagg

SEQ ID NO: 426380 - DNA, 20 bp, mouse
gcaggccacggcaggtcctc

SEQ ID NO: 426381 - DNA, 20 bp, mouse
gccgtggcctgacgagctgg

SEQ ID NO: 426382 - DNA, 20 bp, mouse
gcctgacctctgaggagagt

SEQ ID NO: 426383 - DNA, 20 bp, mouse
gagactggaagagttcgaag

SEQ ID NO: 426384 - DNA, 20 bp, mouse
ggagagctcggacgaagagg

SEQ ID NO: 426385 - DNA, 20 bp, mouse
gcaggcgcctttggaagagg

SEQ ID NO: 426386 - DNA, 20 bp, mouse
gaggcgacggtggccctggg

SEQ ID NO: 426387 - DNA, 20 bp, mouse
gcccagtgaccacacggacg

SEQ ID NO: 426388 - DNA, 20 bp, mouse
gagcggcccatggctccctc

SEQ ID NO: 426389 - DNA, 20 bp, mouse
gtcgcctcctgagaggccag

SEQ ID NO: 426390 - DNA, 20 bp, mouse
gacttggatcgcctcctgag

SEQ ID NO: 426391 - DNA, 20 bp, mouse
gggcaagggacaggagacta

SEQ ID NO: 426392 - DNA, 20 bp, mouse
gtactgtccaagcagagagt

SEQ ID NO: 426393 - DNA, 20 bp, mouse
ggaccacacggacgcggtag

SEQ ID NO: 426394 - DNA, 20 bp, mouse
gggtcagtgagcaagaactg

SEQ ID NO: 426395 - DNA, 20 bp, mouse
gtaggaggatggcaagggac

SEQ ID NO: 426396 - DNA, 20 bp, mouse
gatccctcccgccccgccaa

SEQ ID NO: 426397 - DNA, 20 bp, mouse
gcggctccagaggcattcgc

SEQ ID NO: 426398 - DNA, 20 bp, mouse
gttagaaacgaggtagacaa

SEQ ID NO: 426399 - DNA, 20 bp, mouse
ggatgtgagcctggcagatg

SEQ ID NO: 426400 - DNA, 20 bp, mouse
gagaggcattcgcgggacag

SEQ ID NO: 426401 - DNA, 20 bp, mouse
gctcttcaggagccaagaga

SEQ ID NO: 426402 - DNA, 20 bp, mouse
gcagtgatggagcagtcagc

SEQ ID NO: 426403 - DNA, 20 bp, mouse
ggcagctgctgcccttggcg

SEQ ID NO: 426404 - DNA, 20 bp, mouse
gataaagtcaaggtggccac

SEQ ID NO: 426405 - DNA, 20 bp, mouse
gcgtcacccaggatggatgg

SEQ ID NO: 426406 - DNA, 20 bp, mouse
gtcctctagagggacctggg

SEQ ID NO: 426407 - DNA, 20 bp, mouse
gtctaggtgtgactctctgg

SEQ ID NO: 426408 - DNA, 20 bp, mouse
gtccccccaggtccctctag

SEQ ID NO: 426409 - DNA, 20 bp, mouse
gtgatcctctagagggacct

SEQ ID NO: 426410 - DNA, 20 bp, mouse
gtctcggctgatcctctaga

SEQ ID NO: 426411 - DNA, 20 bp, mouse
ggcaaaaaccgagtctccag

SEQ ID NO: 426412 - DNA, 20 bp, mouse
gatcttgtacttgaccatct

SEQ ID NO: 426413 - DNA, 20 bp, mouse
gtgagtgccggccactacgt

SEQ ID NO: 426414 - DNA, 20 bp, mouse
gccgcgagagccccacgtag

SEQ ID NO: 426415 - DNA, 20 bp, mouse
ggggggaaactgctcttaag

SEQ ID NO: 426416 - DNA, 20 bp, mouse
ggcgtacacggagtccccgg

SEQ ID NO: 426417 - DNA, 20 bp, mouse
gggagtccccggtggagacg

SEQ ID NO: 426418 - DNA, 20 bp, mouse
gcccggtggagacgcggatg

SEQ ID NO: 426419 - DNA, 20 bp, mouse
gcccgcgtacacggagtccc

SEQ ID NO: 426420 - DNA, 20 bp, mouse
gtacgcgggctccaacaacg

SEQ ID NO: 426421 - DNA, 20 bp, mouse
gatgctgtccgatcaaccac

SEQ ID NO: 426422 - DNA, 20 bp, mouse
gcacaggtagacctcgttgt

SEQ ID NO: 426423 - DNA, 20 bp, mouse
gttgttggagcccgcgtaca

SEQ ID NO: 426424 - DNA, 20 bp, mouse
gcccttctgagaatcaagag

SEQ ID NO: 426425 - DNA, 20 bp, mouse
gaagcggaaagggtgcacag

SEQ ID NO: 426426 - DNA, 20 bp, mouse
gacctgtcaccaaagggtca

SEQ ID NO: 426427 - DNA, 20 bp, mouse
gaccacgtacctgtcaccaa

SEQ ID NO: 426428 - DNA, 20 bp, mouse
gccctttggtgacaggtacg

SEQ ID NO: 426429 - DNA, 20 bp, mouse
gtcagcttgccctgaccctt

SEQ ID NO: 426430 - DNA, 20 bp, mouse
gacactatgactcagccaca

SEQ ID NO: 426431 - DNA, 20 bp, mouse
gtggagacgtctcagaactc

SEQ ID NO: 426432 - DNA, 20 bp, mouse
gtgcaaggtgcccaggacag

SEQ ID NO: 426433 - DNA, 20 bp, mouse
gcagaggtaataagaatccc

SEQ ID NO: 426434 - DNA, 20 bp, mouse
ggccctgaccctttggtgac

SEQ ID NO: 426435 - DNA, 20 bp, mouse
gtccttggcttggttgggtg

SEQ ID NO: 426436 - DNA, 20 bp, mouse
gggagctgccgcgagtgaca

SEQ ID NO: 426437 - DNA, 20 bp, mouse
gacagggtcaagaagttggt

SEQ ID NO: 426438 - DNA, 20 bp, mouse
ggagcccgcgaagctcggcg

SEQ ID NO: 426439 - DNA, 20 bp, mouse
gtgtaggagggcatgactcc

SEQ ID NO: 426440 - DNA, 20 bp, mouse
gagcaggagcccgcgaagct

SEQ ID NO: 426441 - DNA, 20 bp, mouse
gacagcccgcagagccaatg

SEQ ID NO: 426442 - DNA, 20 bp, mouse
gctgccacgccgagcttcgc

SEQ ID NO: 426443 - DNA, 20 bp, mouse
gccacggtgaccgtgtagga

SEQ ID NO: 426444 - DNA, 20 bp, mouse
ggtggccacggtgaccgtgt

SEQ ID NO: 426445 - DNA, 20 bp, mouse
gcaagtgagtgctgctggtg

SEQ ID NO: 426446 - DNA, 20 bp, mouse
gtgaggtgctagcaccagcc

SEQ ID NO: 426447 - DNA, 20 bp, mouse
ggaagcaagcatggatcaag

SEQ ID NO: 426448 - DNA, 20 bp, mouse
ggcaccagcctggttgtctc

SEQ ID NO: 426449 - DNA, 20 bp, mouse
ggcatggatcaagaggctgt

SEQ ID NO: 426450 - DNA, 20 bp, mouse
gcagcctggttgtctctggc

SEQ ID NO: 426451 - DNA, 20 bp, mouse
gggatggagagcaacctgaa

SEQ ID NO: 426452 - DNA, 20 bp, mouse
gggtggagcaagggcatgaa

SEQ ID NO: 426453 - DNA, 20 bp, mouse
gagccttcctgcgcagaaag

SEQ ID NO: 426454 - DNA, 20 bp, mouse
gcattcaggcgggtgtccaa

SEQ ID NO: 426455 - DNA, 20 bp, mouse
gggcgggcctgaagcaagca

SEQ ID NO: 426456 - DNA, 20 bp, mouse
gagggtgagagtatccacgg

SEQ ID NO: 426457 - DNA, 20 bp, mouse
gaggaggatggcgaaatgca

SEQ ID NO: 426458 - DNA, 20 bp, mouse
ggccccacaggcttcccccg

SEQ ID NO: 426459 - DNA, 20 bp, mouse
gtccacgggggaagcctgtg

SEQ ID NO: 426460 - DNA, 20 bp, mouse
ggagagctaaactggtcagg

SEQ ID NO: 426461 - DNA, 20 bp, mouse
gtactgcaagctggactacc

SEQ ID NO: 426462 - DNA, 20 bp, mouse
ggagctggagtggctacctg

SEQ ID NO: 426463 - DNA, 20 bp, mouse
ggagcaggcaatggcgactg

SEQ ID NO: 426464 - DNA, 20 bp, mouse
ggcctgtggggctggcacat

SEQ ID NO: 426465 - DNA, 20 bp, mouse
gtgctgaggatggtccccct

SEQ ID NO: 426466 - DNA, 20 bp, mouse
gtgaggaaggatccagctct

SEQ ID NO: 426467 - DNA, 20 bp, mouse
gagtactcccgagctaccag

SEQ ID NO: 426468 - DNA, 20 bp, mouse
gtaagagagagtcagctcct

SEQ ID NO: 426469 - DNA, 20 bp, mouse
gccagctctaggacgttcct

SEQ ID NO: 426470 - DNA, 20 bp, mouse
gagcagaagctggatcgcgt

SEQ ID NO: 426471 - DNA, 20 bp, mouse
gaatgtgccagccttcaggt

SEQ ID NO: 426472 - DNA, 20 bp, mouse
gtattagggtgcaagtcggt

SEQ ID NO: 426473 - DNA, 20 bp, mouse
gtctggatcggtgagtacag

SEQ ID NO: 426474 - DNA, 20 bp, mouse
gtccagtcatggcagtatat

SEQ ID NO: 426475 - DNA, 20 bp, mouse
ggcagctccgctggtagctc

SEQ ID NO: 426476 - DNA, 20 bp, mouse
gctgcccggctagggaacca

SEQ ID NO: 426477 - DNA, 20 bp, mouse
gcatggttggggttactgat

SEQ ID NO: 426478 - DNA, 20 bp, mouse
ggagcccaggcagactaagc

SEQ ID NO: 426479 - DNA, 20 bp, mouse
ggctcctgcttagtctgcct

SEQ ID NO: 426480 - DNA, 20 bp, mouse
ggtgccttggttccctagcc

SEQ ID NO: 426481 - DNA, 20 bp, mouse
gccatctctgatttgagccc

SEQ ID NO: 426482 - DNA, 20 bp, mouse
gccagctgaagaggagaacc

SEQ ID NO: 426483 - DNA, 20 bp, mouse
gcccaaccatgcagggagac

SEQ ID NO: 426484 - DNA, 20 bp, mouse
gccttctgtgggagtcagaa

SEQ ID NO: 426485 - DNA, 20 bp, mouse
gggtaggttagtccttctgt

SEQ ID NO: 426486 - DNA, 20 bp, mouse
gggagaagtaggcgtcgcag

SEQ ID NO: 426487 - DNA, 20 bp, mouse
gtctcggaattggagcgcag

SEQ ID NO: 426488 - DNA, 20 bp, mouse
gtgcacttgaggccaagctg

SEQ ID NO: 426489 - DNA, 20 bp, mouse
gtgggggtcgatctcggaat

SEQ ID NO: 426490 - DNA, 20 bp, mouse
ggcagatgctcgcaggatgg

SEQ ID NO: 426491 - DNA, 20 bp, mouse
gcagagcagcagtctgaccc

SEQ ID NO: 426492 - DNA, 20 bp, mouse
gcgagatcgacccccaaaag

SEQ ID NO: 426493 - DNA, 20 bp, mouse
ggccaagacacgccccgtta

SEQ ID NO: 426494 - DNA, 20 bp, mouse
ggcgtggcgttagacaagca

SEQ ID NO: 426495 - DNA, 20 bp, mouse
gcgacccccaaaaggggaca

SEQ ID NO: 426496 - DNA, 20 bp, mouse
gcttcttccagagcttgctt

SEQ ID NO: 426497 - DNA, 20 bp, mouse
gtccgagagacgttattgaa

SEQ ID NO: 426498 - DNA, 20 bp, mouse
gtccagagcttgcttgggca

SEQ ID NO: 426499 - DNA, 20 bp, mouse
gggacttgacacatgaccgt

SEQ ID NO: 426500 - DNA, 20 bp, mouse
ggcctgcccttgaatgaact

SEQ ID NO: 426501 - DNA, 20 bp, mouse
ggcacggacttttccctctt

SEQ ID NO: 426502 - DNA, 20 bp, mouse
gacctagttcattcaagggc

SEQ ID NO: 426503 - DNA, 20 bp, mouse
gcagtgacctagttcattca

SEQ ID NO: 426504 - DNA, 20 bp, mouse
gactaggtcactgctgaagc

SEQ ID NO: 426505 - DNA, 20 bp, mouse
gatgcttcacatacagccag

SEQ ID NO: 426506 - DNA, 20 bp, mouse
gaggggcgcgcgtcagagtc

SEQ ID NO: 426507 - DNA, 20 bp, mouse
ggcggccctccgcgacccca

SEQ ID NO: 426508 - DNA, 20 bp, mouse
gcaggggctgcggtgccatg

SEQ ID NO: 426509 - DNA, 20 bp, mouse
gggtgccatggggtcgcgga

SEQ ID NO: 426510 - DNA, 20 bp, mouse
gagcagcctggggcaaccca

SEQ ID NO: 426511 - DNA, 20 bp, mouse
gtagcgtgcggccagaggct

SEQ ID NO: 426512 - DNA, 20 bp, mouse
gaggctaggtgagtcgccca

SEQ ID NO: 426513 - DNA, 20 bp, mouse
gtgggtggtcgagcaggagc

SEQ ID NO: 426514 - DNA, 20 bp, mouse
ggtggtcgagcaggagctgg

SEQ ID NO: 426515 - DNA, 20 bp, mouse
gggccctcaagggaccaaaa

SEQ ID NO: 426516 - DNA, 20 bp, mouse
ggcagccctaaggagcgcag

SEQ ID NO: 426517 - DNA, 20 bp, mouse
gctcgcgagcggcagcccta

SEQ ID NO: 426518 - DNA, 20 bp, mouse
ggtctgttccggctcgcgag

SEQ ID NO: 426519 - DNA, 20 bp, mouse
gcccgccactgcgctcctta

SEQ ID NO: 426520 - DNA, 20 bp, mouse
gctgcaggcactcgtgggga

SEQ ID NO: 426521 - DNA, 20 bp, mouse
gcagtggcgggagcgtactc

SEQ ID NO: 426522 - DNA, 20 bp, mouse
gtgggagtcgcgcaagccac

SEQ ID NO: 426523 - DNA, 20 bp, mouse
gatgcgcgcggagtccggag

SEQ ID NO: 426524 - DNA, 20 bp, mouse
gagcacgagggtgaggtcct

SEQ ID NO: 426525 - DNA, 20 bp, mouse
gtggcgggagcgtactctgg

SEQ ID NO: 426526 - DNA, 20 bp, mouse
ggacgctcgggcacacctgt

SEQ ID NO: 426527 - DNA, 20 bp, mouse
gcgagcgagcaaacacctgg

SEQ ID NO: 426528 - DNA, 20 bp, mouse
gtgatgtgttcctcttaaat

SEQ ID NO: 426529 - DNA, 20 bp, mouse
ggttacctgggatgacgctc

SEQ ID NO: 426530 - DNA, 20 bp, mouse
gagacgagcgagcaaacacc

SEQ ID NO: 426531 - DNA, 20 bp, mouse
gtggaggagcctcgttacct

SEQ ID NO: 426532 - DNA, 20 bp, mouse
gagggtcagactgaagaccc

SEQ ID NO: 426533 - DNA, 20 bp, mouse
gctgctgggcctcagcctac

SEQ ID NO: 426534 - DNA, 20 bp, mouse
gtgctggtctgtgaggatgg

SEQ ID NO: 426535 - DNA, 20 bp, mouse
gcgtgaggcctgcctatcct

SEQ ID NO: 426536 - DNA, 20 bp, mouse
gcacgtccggagctcttcac

SEQ ID NO: 426537 - DNA, 20 bp, mouse
gtggggcgctgggacccgga

SEQ ID NO: 426538 - DNA, 20 bp, mouse
gggagaagagcgcggagctg

SEQ ID NO: 426539 - DNA, 20 bp, mouse
ggggcggggcctccaggtag

SEQ ID NO: 426540 - DNA, 20 bp, mouse
ggcgctgggacccggagggt

SEQ ID NO: 426541 - DNA, 20 bp, mouse
gtgccgtggtcggagctgtg

SEQ ID NO: 426542 - DNA, 20 bp, mouse
ggcgtacccgcggtgcagtc

SEQ ID NO: 426543 - DNA, 20 bp, mouse
ggagatcagctgattcatgg

SEQ ID NO: 426544 - DNA, 20 bp, mouse
gggaccgcccggacccgcgc

SEQ ID NO: 426545 - DNA, 20 bp, mouse
gagctgatctcgcgtacccg

SEQ ID NO: 426546 - DNA, 20 bp, mouse
ggggcggccacgggaccggg

SEQ ID NO: 426547 - DNA, 20 bp, mouse
ggccgggcggccacgggacc

SEQ ID NO: 426548 - DNA, 20 bp, mouse
ggtcacgagccctccatctt

SEQ ID NO: 426549 - DNA, 20 bp, mouse
gagctgagaccgaagatgga

SEQ ID NO: 426550 - DNA, 20 bp, mouse
gctggctggtcagggcggaa

SEQ ID NO: 426551 - DNA, 20 bp, mouse
gggagactgggaggcatgta

SEQ ID NO: 426552 - DNA, 20 bp, mouse
ggatggagggctcgtgacca

SEQ ID NO: 426553 - DNA, 20 bp, mouse
ggaggcatgtagggcaagag

SEQ ID NO: 426554 - DNA, 20 bp, mouse
gggcggggcgcggagaggaa

SEQ ID NO: 426555 - DNA, 20 bp, mouse
gtgaccatggcagcgggagg

SEQ ID NO: 426556 - DNA, 20 bp, mouse
gcagcggttagtggcagata

SEQ ID NO: 426557 - DNA, 20 bp, mouse
gaaaccctccggtttcccgg

SEQ ID NO: 426558 - DNA, 20 bp, mouse
gcctcctccgggaaaccgga

SEQ ID NO: 426559 - DNA, 20 bp, mouse
gcgcagcaagcagcggttag

SEQ ID NO: 426560 - DNA, 20 bp, mouse
gtgctctgcagagaacctgg

SEQ ID NO: 426561 - DNA, 20 bp, mouse
ggttattgatggaaaccctc

SEQ ID NO: 426562 - DNA, 20 bp, mouse
gatggaaggcctgtaggcgt

SEQ ID NO: 426563 - DNA, 20 bp, mouse
ggtctcttgagggttattga

SEQ ID NO: 426564 - DNA, 20 bp, mouse
ggaaacccggctgaggtggt

SEQ ID NO: 426565 - DNA, 20 bp, mouse
ggagctgcggttgctcatca

SEQ ID NO: 426566 - DNA, 20 bp, mouse
gagtcaaaggactagctaga

SEQ ID NO: 426567 - DNA, 20 bp, mouse
gcaccagggagataagacag

SEQ ID NO: 426568 - DNA, 20 bp, mouse
ggacttgcaaacccagccag

SEQ ID NO: 426569 - DNA, 20 bp, mouse
gcagccagtggtgtttagaa

SEQ ID NO: 426570 - DNA, 20 bp, mouse
ggcagagctttagaaagggt

SEQ ID NO: 426571 - DNA, 20 bp, mouse
gttccgcggccatccacccc

SEQ ID NO: 426572 - DNA, 20 bp, mouse
ggtcatttctcacccaatca

SEQ ID NO: 426573 - DNA, 20 bp, mouse
gccaatgaggtgccgccatt

SEQ ID NO: 426574 - DNA, 20 bp, mouse
gctcctggggtggatggccg

SEQ ID NO: 426575 - DNA, 20 bp, mouse
ggaacccttctaaacaccac

SEQ ID NO: 426576 - DNA, 20 bp, mouse
gcagtgggcgggagtaggga

SEQ ID NO: 426577 - DNA, 20 bp, mouse
gtacgtcccggctgcagaag

SEQ ID NO: 426578 - DNA, 20 bp, mouse
gcgggacgtattaagagtct

SEQ ID NO: 426579 - DNA, 20 bp, mouse
gttacttggcgggctcttca

SEQ ID NO: 426580 - DNA, 20 bp, mouse
ggctgtccgcgagctctccg

SEQ ID NO: 426581 - DNA, 20 bp, mouse
ggtcaggccgctagggagta

SEQ ID NO: 426582 - DNA, 20 bp, mouse
gagccctggtcaggccgcta

SEQ ID NO: 426583 - DNA, 20 bp, mouse
gatgggcacaggaggcgcgt

SEQ ID NO: 426584 - DNA, 20 bp, mouse
gctccctagcggcctgacca

SEQ ID NO: 426585 - DNA, 20 bp, mouse
gggcgcgttggagcacgtta

SEQ ID NO: 426586 - DNA, 20 bp, mouse
gccgccggccccacggagaa

SEQ ID NO: 426587 - DNA, 20 bp, mouse
ggcggcctgtgagcccgagc

SEQ ID NO: 426588 - DNA, 20 bp, mouse
gcagcgctcggggtccatgc

SEQ ID NO: 426589 - DNA, 20 bp, mouse
gtggcgggctctgggaggta

SEQ ID NO: 426590 - DNA, 20 bp, mouse
gcccgcggccgcgtaaggac

SEQ ID NO: 426591 - DNA, 20 bp, mouse
gggccaggcccggtgctcaa

SEQ ID NO: 426592 - DNA, 20 bp, mouse
gctgtgagcccgagccggca

SEQ ID NO: 426593 - DNA, 20 bp, mouse
gggaccggccgccggcccca

SEQ ID NO: 426594 - DNA, 20 bp, mouse
gctgggaggtagggttccag

SEQ ID NO: 426595 - DNA, 20 bp, mouse
ggaaaggcgcgcagcgctcg

SEQ ID NO: 426596 - DNA, 20 bp, mouse
gggccagctgtagggagcaa

SEQ ID NO: 426597 - DNA, 20 bp, mouse
ggggctgtagtaggcgtcca

SEQ ID NO: 426598 - DNA, 20 bp, mouse
gccgctggagagcagctccg

SEQ ID NO: 426599 - DNA, 20 bp, mouse
gtagtaggcgtccatggcag

SEQ ID NO: 426600 - DNA, 20 bp, mouse
gtgcgacaccgggctgtagt

SEQ ID NO: 426601 - DNA, 20 bp, mouse
gccaagagccgggcccgcta

SEQ ID NO: 426602 - DNA, 20 bp, mouse
gtggggaggcaaagaggcgg

SEQ ID NO: 426603 - DNA, 20 bp, mouse
ggcgcgccttggctaggagt

SEQ ID NO: 426604 - DNA, 20 bp, mouse
gtaagagggtttgggagatc

SEQ ID NO: 426605 - DNA, 20 bp, mouse
gtcccaggaggcgacaagtt

SEQ ID NO: 426606 - DNA, 20 bp, mouse
gccgcgcgggtgaatcgagg

SEQ ID NO: 426607 - DNA, 20 bp, mouse
gccgccgcgcgggtgaatcg

SEQ ID NO: 426608 - DNA, 20 bp, mouse
gggccgctgcgagagaactt

SEQ ID NO: 426609 - DNA, 20 bp, mouse
ggacgcgcgggctcgatccg

SEQ ID NO: 426610 - DNA, 20 bp, mouse
gacttcggaggagcccgacg

SEQ ID NO: 426611 - DNA, 20 bp, mouse
gtcgcccgcggcgccgcagg

SEQ ID NO: 426612 - DNA, 20 bp, mouse
gcccgcgcgtcagcacgccg

SEQ ID NO: 426613 - DNA, 20 bp, mouse
gtgaaccggagccagcgagg

SEQ ID NO: 426614 - DNA, 20 bp, mouse
ggcagggccggctcccaggg

SEQ ID NO: 426615 - DNA, 20 bp, mouse
gcccgaggccaggatcttcc

SEQ ID NO: 426616 - DNA, 20 bp, mouse
gaccagcgccgggtgaatcg

SEQ ID NO: 426617 - DNA, 20 bp, mouse
gagcgccgggtgaatcgagg

SEQ ID NO: 426618 - DNA, 20 bp, mouse
ggagcgatcgtagtccacag

SEQ ID NO: 426619 - DNA, 20 bp, mouse
gattcacccggcgctggtta

SEQ ID NO: 426620 - DNA, 20 bp, mouse
gggcgctgggcggccaccag

SEQ ID NO: 426621 - DNA, 20 bp, mouse
gattccagcaccggtcggag

SEQ ID NO: 426622 - DNA, 20 bp, mouse
ggacatctgggacaaattcg

SEQ ID NO: 426623 - DNA, 20 bp, mouse
gggcggatgtacactttgaa

SEQ ID NO: 426624 - DNA, 20 bp, mouse
gagaggcggagtcaaggcgg

SEQ ID NO: 426625 - DNA, 20 bp, mouse
gcccgcagccgctgtcgaat

SEQ ID NO: 426626 - DNA, 20 bp, mouse
gccgctccgctctcacccta

SEQ ID NO: 426627 - DNA, 20 bp, mouse
gatggtgctgcgtggcgtca

SEQ ID NO: 426628 - DNA, 20 bp, mouse
ggccagccttagggtgagag

SEQ ID NO: 426629 - DNA, 20 bp, mouse
gagggctcaccgcagcggaa

SEQ ID NO: 426630 - DNA, 20 bp, mouse
gctgcgtggcgtcagggttg

SEQ ID NO: 426631 - DNA, 20 bp, mouse
gaagcgctctcagggagtca

SEQ ID NO: 426632 - DNA, 20 bp, mouse
ggggcggggcagataaactg

SEQ ID NO: 426633 - DNA, 20 bp, mouse
gctcaccctaaggctggcca

SEQ ID NO: 426634 - DNA, 20 bp, mouse
gattccgcagaacggccccg

SEQ ID NO: 426635 - DNA, 20 bp, mouse
gtggccccggggccgttctg

SEQ ID NO: 426636 - DNA, 20 bp, mouse
gttttttctggactgttcct

SEQ ID NO: 426637 - DNA, 20 bp, mouse
gttcttagaactgttttgat

SEQ ID NO: 426638 - DNA, 20 bp, mouse
gtgattggcatcatcaggcc

SEQ ID NO: 426639 - DNA, 20 bp, mouse
gttgtcagttcactctcgaa

SEQ ID NO: 426640 - DNA, 20 bp, mouse
gcagtgaatgtcagcatcta

SEQ ID NO: 426641 - DNA, 20 bp, mouse
gggaagcagatctgatcagc

SEQ ID NO: 426642 - DNA, 20 bp, mouse
gcttttttgtaaaggttatc

SEQ ID NO: 426643 - DNA, 20 bp, mouse
gctcaagattattcattttt

SEQ ID NO: 426644 - DNA, 20 bp, mouse
gagaatttatagcaaacaca

SEQ ID NO: 426645 - DNA, 20 bp, mouse
gatactcaactttagcttga

SEQ ID NO: 426646 - DNA, 20 bp, mouse
gggagcagggattacttccc

SEQ ID NO: 426647 - DNA, 20 bp, mouse
ggcagaggtgatcacagtgg

SEQ ID NO: 426648 - DNA, 20 bp, mouse
gaggctggggaaggatccgg

SEQ ID NO: 426649 - DNA, 20 bp, mouse
ggggattacttccccggcag

SEQ ID NO: 426650 - DNA, 20 bp, mouse
gagtactcccaagacaggac

SEQ ID NO: 426651 - DNA, 20 bp, mouse
gctgaggctggggaaggatc

SEQ ID NO: 426652 - DNA, 20 bp, mouse
ggagaccctgcatggctctg

SEQ ID NO: 426653 - DNA, 20 bp, mouse
gcttcagtgagtcccgggta

SEQ ID NO: 426654 - DNA, 20 bp, mouse
gcagctacaaactgaggctg

SEQ ID NO: 426655 - DNA, 20 bp, mouse
gaagaccacagagccatgca

SEQ ID NO: 426656 - DNA, 20 bp, mouse
ggataactcagtccaggacc

SEQ ID NO: 426657 - DNA, 20 bp, mouse
gttggttgatgtctccggag

SEQ ID NO: 426658 - DNA, 20 bp, mouse
gcggcggctgtgccaggtcc

SEQ ID NO: 426659 - DNA, 20 bp, mouse
gtctcctcgcaggtaggccc

SEQ ID NO: 426660 - DNA, 20 bp, mouse
ggtaggcccgggaggagcct

SEQ ID NO: 426661 - DNA, 20 bp, mouse
gggtccgctcgaccgaccag

SEQ ID NO: 426662 - DNA, 20 bp, mouse
gctccgggataactcagtcc

SEQ ID NO: 426663 - DNA, 20 bp, mouse
ggagcgcacggagccacgga

SEQ ID NO: 426664 - DNA, 20 bp, mouse
gcctcgcaggtaggcccggg

SEQ ID NO: 426665 - DNA, 20 bp, mouse
ggagcgagaagccggaagga

SEQ ID NO: 426666 - DNA, 20 bp, mouse
gggccatactgtgtaagcga

SEQ ID NO: 426667 - DNA, 20 bp, mouse
gaaccctcgcttacacagta

SEQ ID NO: 426668 - DNA, 20 bp, mouse
gcggggaggatgcttatata

SEQ ID NO: 426669 - DNA, 20 bp, mouse
gccaggcacccaccttggga

SEQ ID NO: 426670 - DNA, 20 bp, mouse
gaggcccaggcacccacctt

SEQ ID NO: 426671 - DNA, 20 bp, mouse
gggtgggtgcctgggcctga

SEQ ID NO: 426672 - DNA, 20 bp, mouse
gactcgtgcctcgcagtcgg

SEQ ID NO: 426673 - DNA, 20 bp, mouse
gggatcttcgtaccatccca

SEQ ID NO: 426674 - DNA, 20 bp, mouse
ggactgcgaggcacgagtcg

SEQ ID NO: 426675 - DNA, 20 bp, mouse
gtataagcatcctccccgac

SEQ ID NO: 426676 - DNA, 20 bp, mouse
gtgcgttctccagcaggagg

SEQ ID NO: 426677 - DNA, 20 bp, mouse
ggttctccagcaggaggcgg

SEQ ID NO: 426678 - DNA, 20 bp, mouse
ggtcctccgcagcccgccag

SEQ ID NO: 426679 - DNA, 20 bp, mouse
gctgtgcgttctccagcagg

SEQ ID NO: 426680 - DNA, 20 bp, mouse
gctggagaacgcacagcaag

SEQ ID NO: 426681 - DNA, 20 bp, mouse
ggcgcagcgcagacccggtc

SEQ ID NO: 426682 - DNA, 20 bp, mouse
ggctggggacaggcgagatg

SEQ ID NO: 426683 - DNA, 20 bp, mouse
gtgtcgctctagccgctggc

SEQ ID NO: 426684 - DNA, 20 bp, mouse
ggtcaggaagcgctcgccgc

SEQ ID NO: 426685 - DNA, 20 bp, mouse
ggtagccagtagctggggac

SEQ ID NO: 426686 - DNA, 20 bp, mouse
gtggagggcgggactatcgt

SEQ ID NO: 426687 - DNA, 20 bp, mouse
gcagagatggggatagtgta

SEQ ID NO: 426688 - DNA, 20 bp, mouse
ggctcgggccagggaaccca

SEQ ID NO: 426689 - DNA, 20 bp, mouse
gtgggtgcgagatagaacta

SEQ ID NO: 426690 - DNA, 20 bp, mouse
gagtgcggggtgcagagatg

SEQ ID NO: 426691 - DNA, 20 bp, mouse
gactgccgcatcctgcgtgg

SEQ ID NO: 426692 - DNA, 20 bp, mouse
gcgtgccgccacgcaggatg

SEQ ID NO: 426693 - DNA, 20 bp, mouse
ggccctcagggaggatctgt

SEQ ID NO: 426694 - DNA, 20 bp, mouse
gcggcacgctcctcaggtct

SEQ ID NO: 426695 - DNA, 20 bp, mouse
gaccatgcagcccagacctg

SEQ ID NO: 426696 - DNA, 20 bp, mouse
gcagagttggaagaaaccat

SEQ ID NO: 426697 - DNA, 20 bp, mouse
ggaaatgaccacagtggaga

SEQ ID NO: 426698 - DNA, 20 bp, mouse
gtcagggatgcttgatccga

SEQ ID NO: 426699 - DNA, 20 bp, mouse
ggcatacactcaaaggtatg

SEQ ID NO: 426700 - DNA, 20 bp, mouse
ggaagtacatatggtgtaga

SEQ ID NO: 426701 - DNA, 20 bp, mouse
gatcaaatctggctcccaaa

SEQ ID NO: 426702 - DNA, 20 bp, mouse
gtattacctcaacctttggg

SEQ ID NO: 426703 - DNA, 20 bp, mouse
ggagtttctgtctgaagctc

SEQ ID NO: 426704 - DNA, 20 bp, mouse
gttcttattacctcaacctt

SEQ ID NO: 426705 - DNA, 20 bp, mouse
gtgctgttttaacaggctga

SEQ ID NO: 426706 - DNA, 20 bp, mouse
ggagcctggagaagggtagt

SEQ ID NO: 426707 - DNA, 20 bp, mouse
ggtagtcccggtgaaggctg

SEQ ID NO: 426708 - DNA, 20 bp, mouse
gactgctgtagtcccggtga

SEQ ID NO: 426709 - DNA, 20 bp, mouse
gtcctgccgcagccttcacc

SEQ ID NO: 426710 - DNA, 20 bp, mouse
gctagtccaggagaccagag

SEQ ID NO: 426711 - DNA, 20 bp, mouse
gcagaagactgctgtagtcc

SEQ ID NO: 426712 - DNA, 20 bp, mouse
ggcgccgactacccttctcc

SEQ ID NO: 426713 - DNA, 20 bp, mouse
ggtggtggcgttctcagcag

SEQ ID NO: 426714 - DNA, 20 bp, mouse
gcctataactgtggagtccg

SEQ ID NO: 426715 - DNA, 20 bp, mouse
gtgtccagcgaagggcccag

SEQ ID NO: 426716 - DNA, 20 bp, mouse
gccgtcggggaagatcaata

SEQ ID NO: 426717 - DNA, 20 bp, mouse
gtgagaagcaggacccacga

SEQ ID NO: 426718 - DNA, 20 bp, mouse
gcccgacggcggctctgcgg

SEQ ID NO: 426719 - DNA, 20 bp, mouse
ggagtccatgtctgcagcga

SEQ ID NO: 426720 - DNA, 20 bp, mouse
gcggctgtcagcgagcgcgg

SEQ ID NO: 426721 - DNA, 20 bp, mouse
gttccccgacggcggctctg

SEQ ID NO: 426722 - DNA, 20 bp, mouse
gggggccctcgctgcagaca

SEQ ID NO: 426723 - DNA, 20 bp, mouse
gagctcggggccgacgggaa

SEQ ID NO: 426724 - DNA, 20 bp, mouse
gggaagagctcggggccgac

SEQ ID NO: 426725 - DNA, 20 bp, mouse
gctggcgggagcgatcacag

SEQ ID NO: 426726 - DNA, 20 bp, mouse
gaagtggctgaggccccgag

SEQ ID NO: 426727 - DNA, 20 bp, mouse
gcgacactccccagccccgg

SEQ ID NO: 426728 - DNA, 20 bp, mouse
gggaccaacgcagcctctcg

SEQ ID NO: 426729 - DNA, 20 bp, mouse
gccccagccccggcggtaag

SEQ ID NO: 426730 - DNA, 20 bp, mouse
ggagtgaaggggccctagat

SEQ ID NO: 426731 - DNA, 20 bp, mouse
gcctcagccacttaccgccg

SEQ ID NO: 426732 - DNA, 20 bp, mouse
gtctgggcgccgcggagtgg

SEQ ID NO: 426733 - DNA, 20 bp, mouse
ggcgcactcgttcctggctc

SEQ ID NO: 426734 - DNA, 20 bp, mouse
gggggctggggagtgtcgca

SEQ ID NO: 426735 - DNA, 20 bp, mouse
gctcccgatgaggaccagcg

SEQ ID NO: 426736 - DNA, 20 bp, mouse
gcagcgacgccagagcccgt

SEQ ID NO: 426737 - DNA, 20 bp, mouse
gaggccgctgaggcccgtgt

SEQ ID NO: 426738 - DNA, 20 bp, mouse
gccttgcgaaaggcgcccac

SEQ ID NO: 426739 - DNA, 20 bp, mouse
gccgtcctccggctgactga

SEQ ID NO: 426740 - DNA, 20 bp, mouse
ggcacctacacgggcctcag

SEQ ID NO: 426741 - DNA, 20 bp, mouse
gcgagcagctaggagcggcc

SEQ ID NO: 426742 - DNA, 20 bp, mouse
gggctgactgagggcgcggt

SEQ ID NO: 426743 - DNA, 20 bp, mouse
gcctgcggcggccttgcgaa

SEQ ID NO: 426744 - DNA, 20 bp, mouse
gccggctcggcccggcgcag

SEQ ID NO: 426745 - DNA, 20 bp, mouse
ggaggcccgtgtaggtgcgg

SEQ ID NO: 426746 - DNA, 20 bp, mouse
gctgctgctagcgactatgg

SEQ ID NO: 426747 - DNA, 20 bp, mouse
ggtactgctgctagcgacta

SEQ ID NO: 426748 - DNA, 20 bp, mouse
ggagaggtgtggcccctgca

SEQ ID NO: 426749 - DNA, 20 bp, mouse
gtggtggtacagcaaggtcc

SEQ ID NO: 426750 - DNA, 20 bp, mouse
gtgtgcctggtgacagtgag

SEQ ID NO: 426751 - DNA, 20 bp, mouse
gttgctgtaccaccatgcag

SEQ ID NO: 426752 - DNA, 20 bp, mouse
ggctgtgttacagcctgagg

SEQ ID NO: 426753 - DNA, 20 bp, mouse
gagcagagcttccctgaggg

SEQ ID NO: 426754 - DNA, 20 bp, mouse
gtcctggacagcctccagga

SEQ ID NO: 426755 - DNA, 20 bp, mouse
gagaccccccaccaccctca

SEQ ID NO: 426756 - DNA, 20 bp, mouse
gccactggcctccttcaagt

SEQ ID NO: 426757 - DNA, 20 bp, mouse
gaaggcttcctacaaataca

SEQ ID NO: 426758 - DNA, 20 bp, mouse
ggcagcagccacccacttga

SEQ ID NO: 426759 - DNA, 20 bp, mouse
gacaaatacagggcactgtg

SEQ ID NO: 426760 - DNA, 20 bp, mouse
gcctgcaaaaggatgccagc

SEQ ID NO: 426761 - DNA, 20 bp, mouse
ggcagccacccacttgaagg

SEQ ID NO: 426762 - DNA, 20 bp, mouse
ggtccccagcatcctgcaaa

SEQ ID NO: 426763 - DNA, 20 bp, mouse
gttggctgaggtagctgtgc

SEQ ID NO: 426764 - DNA, 20 bp, mouse
gctggcctccttcaagtggg

SEQ ID NO: 426765 - DNA, 20 bp, mouse
ggtcagtacagcagaagcac

SEQ ID NO: 426766 - DNA, 20 bp, mouse
gatgctgtggcaggagatcg

SEQ ID NO: 426767 - DNA, 20 bp, mouse
gctgtggcaggagatcgcgg

SEQ ID NO: 426768 - DNA, 20 bp, mouse
ggcggtggactgttcttcct

SEQ ID NO: 426769 - DNA, 20 bp, mouse
ggaagtctctcagttggtgt

SEQ ID NO: 426770 - DNA, 20 bp, mouse
gtcctgggcactgtcatctt

SEQ ID NO: 426771 - DNA, 20 bp, mouse
gtgctgtgaggtagaccagt

SEQ ID NO: 426772 - DNA, 20 bp, mouse
gctggcagaagtctctcagt

SEQ ID NO: 426773 - DNA, 20 bp, mouse
gtctgccagcacaggagatc

SEQ ID NO: 426774 - DNA, 20 bp, mouse
ggtgtgggcgatgctgtggc

SEQ ID NO: 426775 - DNA, 20 bp, mouse
gcagcccacctgcagagacc

SEQ ID NO: 426776 - DNA, 20 bp, mouse
gagccgagggagcagcgtgg

SEQ ID NO: 426777 - DNA, 20 bp, mouse
ggacgccgcgatcccagccg

SEQ ID NO: 426778 - DNA, 20 bp, mouse
gtggcccgtggctccggagg

SEQ ID NO: 426779 - DNA, 20 bp, mouse
gcgagaagcagtgcggcgag

SEQ ID NO: 426780 - DNA, 20 bp, mouse
gcagtccaggagctccgtcg

SEQ ID NO: 426781 - DNA, 20 bp, mouse
gaacccagggaaggtcaaca

SEQ ID NO: 426782 - DNA, 20 bp, mouse
gggcggcagtcgtgccaggt

SEQ ID NO: 426783 - DNA, 20 bp, mouse
gagcaggtgcagtgacccga

SEQ ID NO: 426784 - DNA, 20 bp, mouse
gcagcgcccagcgtacgtag

SEQ ID NO: 426785 - DNA, 20 bp, mouse
ggcagtgacccgagggtcta

SEQ ID NO: 426786 - DNA, 20 bp, mouse
gagcctgcgagcgccaccgg

SEQ ID NO: 426787 - DNA, 20 bp, mouse
ggtgtcggtggagggagtta

SEQ ID NO: 426788 - DNA, 20 bp, mouse
gtgcagcctgcgagcgccac

SEQ ID NO: 426789 - DNA, 20 bp, mouse
gcggcgcggccgagctccgg

SEQ ID NO: 426790 - DNA, 20 bp, mouse
gggctcggagaggccgccga

SEQ ID NO: 426791 - DNA, 20 bp, mouse
gaagccgcagcggctcggag

SEQ ID NO: 426792 - DNA, 20 bp, mouse
ggagcgcgcggggcgcaaac

SEQ ID NO: 426793 - DNA, 20 bp, mouse
gcagccgagcgagagagccg

SEQ ID NO: 426794 - DNA, 20 bp, mouse
gcccgggcgcacgggataaa

SEQ ID NO: 426795 - DNA, 20 bp, mouse
ggcgagcgccaccggcgggc

SEQ ID NO: 426796 - DNA, 20 bp, mouse
gtggtctgggttgtgaggtg

SEQ ID NO: 426797 - DNA, 20 bp, mouse
gcgagttctgcagcagtggt

SEQ ID NO: 426798 - DNA, 20 bp, mouse
gctatggcccatggctcgag

SEQ ID NO: 426799 - DNA, 20 bp, mouse
gggctcgagaggcacaacgc

SEQ ID NO: 426800 - DNA, 20 bp, mouse
gcaacccagaccagaagagc

SEQ ID NO: 426801 - DNA, 20 bp, mouse
gtatcttccctggtagtcac

SEQ ID NO: 426802 - DNA, 20 bp, mouse
gtgcagaagtaggtgagtct

SEQ ID NO: 426803 - DNA, 20 bp, mouse
gcagtggtaggcagtgctac

SEQ ID NO: 426804 - DNA, 20 bp, mouse
gaagctagaagaagggctgc

SEQ ID NO: 426805 - DNA, 20 bp, mouse
gcccgcacagctcaacacat

SEQ ID NO: 426806 - DNA, 20 bp, mouse
gggtcggaagcgctgcgtgg

SEQ ID NO: 426807 - DNA, 20 bp, mouse
gaccaccacccgagccggag

SEQ ID NO: 426808 - DNA, 20 bp, mouse
gatggcggcgggttgctgtg

SEQ ID NO: 426809 - DNA, 20 bp, mouse
gcgccgccgcagccctgagg

SEQ ID NO: 426810 - DNA, 20 bp, mouse
ggagccggaggggggcgaac

SEQ ID NO: 426811 - DNA, 20 bp, mouse
gtgtccagttcgcccccctc

SEQ ID NO: 426812 - DNA, 20 bp, mouse
gctctccccgctgcagtgag

SEQ ID NO: 426813 - DNA, 20 bp, mouse
gccactccgcagctcagagg

SEQ ID NO: 426814 - DNA, 20 bp, mouse
ggccagctcgcctcacttat

SEQ ID NO: 426815 - DNA, 20 bp, mouse
gggcggccggagtagaaagt

SEQ ID NO: 426816 - DNA, 20 bp, mouse
gagagctagaggtattcccg

SEQ ID NO: 426817 - DNA, 20 bp, mouse
gccggtgcctgctgggatag

SEQ ID NO: 426818 - DNA, 20 bp, mouse
ggcggaggaccgagtcgagt

SEQ ID NO: 426819 - DNA, 20 bp, mouse
ggagccatgcgcctaggtgg

SEQ ID NO: 426820 - DNA, 20 bp, mouse
ggctagaggtattcccgggg

SEQ ID NO: 426821 - DNA, 20 bp, mouse
gctcgggtcccgactcgact

SEQ ID NO: 426822 - DNA, 20 bp, mouse
gagggcacaggaggaagcgg

SEQ ID NO: 426823 - DNA, 20 bp, mouse
gcagagtcccaagacgggtg

SEQ ID NO: 426824 - DNA, 20 bp, mouse
gccgaaggaggccggcggga

SEQ ID NO: 426825 - DNA, 20 bp, mouse
ggaggtattcccggggcggg

SEQ ID NO: 426826 - DNA, 20 bp, mouse
ggcatctgtgagagcctcgg

SEQ ID NO: 426827 - DNA, 20 bp, mouse
gagagcctcggcggagagat

SEQ ID NO: 426828 - DNA, 20 bp, mouse
gtctgggccgggtcctgctg

SEQ ID NO: 426829 - DNA, 20 bp, mouse
ggcggagagatgggtgctct

SEQ ID NO: 426830 - DNA, 20 bp, mouse
gccagacccagggggacacg

SEQ ID NO: 426831 - DNA, 20 bp, mouse
gatcaaggtccagacccagg

SEQ ID NO: 426832 - DNA, 20 bp, mouse
ggagatgggtgctctgggcc

SEQ ID NO: 426833 - DNA, 20 bp, mouse
gggtccacgggaataggctg

SEQ ID NO: 426834 - DNA, 20 bp, mouse
gcaggggctgggaggtccac

SEQ ID NO: 426835 - DNA, 20 bp, mouse
gagcacccatctctccgccg

SEQ ID NO: 426836 - DNA, 20 bp, mouse
gcgagaacgtctgcgggtgg

SEQ ID NO: 426837 - DNA, 20 bp, mouse
ggcgcgagaacgtctgcggg

SEQ ID NO: 426838 - DNA, 20 bp, mouse
gcgtcgcgcgagaacgtctg

SEQ ID NO: 426839 - DNA, 20 bp, mouse
gaccagcggccaggagagcg

SEQ ID NO: 426840 - DNA, 20 bp, mouse
ggcagagacgcgcagatcca

SEQ ID NO: 426841 - DNA, 20 bp, mouse
gaggtgagtgagtcttgacc

SEQ ID NO: 426842 - DNA, 20 bp, mouse
gtgaacgcaggaaagcgcag

SEQ ID NO: 426843 - DNA, 20 bp, mouse
gaagcgcaggcggccctcgc

SEQ ID NO: 426844 - DNA, 20 bp, mouse
ggactctctcctcgctctcc

SEQ ID NO: 426845 - DNA, 20 bp, mouse
gcatctgggtgggggcacgg

SEQ ID NO: 426846 - DNA, 20 bp, mouse
gctgccgtccaggcttaaga

SEQ ID NO: 426847 - DNA, 20 bp, mouse
ggactgactactccggacaa

SEQ ID NO: 426848 - DNA, 20 bp, mouse
gaagccctcttaagcctgga

SEQ ID NO: 426849 - DNA, 20 bp, mouse
gactccggacaaaggcatcg

SEQ ID NO: 426850 - DNA, 20 bp, mouse
gaggagctgactgactactc

SEQ ID NO: 426851 - DNA, 20 bp, mouse
gagggccgcaactgccgtcc

SEQ ID NO: 426852 - DNA, 20 bp, mouse
gaccggaagttggttgtgga

SEQ ID NO: 426853 - DNA, 20 bp, mouse
gcctgagacaggccatcggg

SEQ ID NO: 426854 - DNA, 20 bp, mouse
ggccagcaggacgtgaggga

SEQ ID NO: 426855 - DNA, 20 bp, mouse
gcttccgcgatgcctttgtc

SEQ ID NO: 426856 - DNA, 20 bp, mouse
gaaggcagctcctaagagaa

SEQ ID NO: 426857 - DNA, 20 bp, mouse
gaaagctcctcggaaggaag

SEQ ID NO: 426858 - DNA, 20 bp, mouse
gtacctctcacccttctctt

SEQ ID NO: 426859 - DNA, 20 bp, mouse
gccaccaaggagagacccga

SEQ ID NO: 426860 - DNA, 20 bp, mouse
gagccagaaagctcctcgga

SEQ ID NO: 426861 - DNA, 20 bp, mouse
ggtcacgccccttccttccg

SEQ ID NO: 426862 - DNA, 20 bp, mouse
gacgcagccagaaagctcct

SEQ ID NO: 426863 - DNA, 20 bp, mouse
gcggaggccagggatgggta

SEQ ID NO: 426864 - DNA, 20 bp, mouse
gaggataccgggccagaggg

SEQ ID NO: 426865 - DNA, 20 bp, mouse
gcagagggtggagcagcgga

SEQ ID NO: 426866 - DNA, 20 bp, mouse
ggcgcccagggacccggcag

SEQ ID NO: 426867 - DNA, 20 bp, mouse
gaccccgctgccgggtccct

SEQ ID NO: 426868 - DNA, 20 bp, mouse
gaccctcctgggtagcacgc

SEQ ID NO: 426869 - DNA, 20 bp, mouse
gcgcggcggcaggggaatgg

SEQ ID NO: 426870 - DNA, 20 bp, mouse
gcctggcttgggcaacgcgg

SEQ ID NO: 426871 - DNA, 20 bp, mouse
ggacctctcggcccagtcag

SEQ ID NO: 426872 - DNA, 20 bp, mouse
ggaagggtgcctctgcactc

SEQ ID NO: 426873 - DNA, 20 bp, mouse
gcaggtggggcggtcaggat

SEQ ID NO: 426874 - DNA, 20 bp, mouse
gcgccagcgtgctacccagg

SEQ ID NO: 426875 - DNA, 20 bp, mouse
gcacaggctcgcaaggtccc

SEQ ID NO: 426876 - DNA, 20 bp, mouse
gggaggtgcgcactagtcgg

SEQ ID NO: 426877 - DNA, 20 bp, mouse
gggcgcacgcagacccggtt

SEQ ID NO: 426878 - DNA, 20 bp, mouse
gtaggtacagtcagcaacgg

SEQ ID NO: 426879 - DNA, 20 bp, mouse
gaacggaggtgcgcactagt

SEQ ID NO: 426880 - DNA, 20 bp, mouse
gcgcagacccggttcggctt

SEQ ID NO: 426881 - DNA, 20 bp, mouse
gccagcgcgggctgacctag

SEQ ID NO: 426882 - DNA, 20 bp, mouse
gctgccggcgcacgcagacc

SEQ ID NO: 426883 - DNA, 20 bp, mouse
gcagtctaggctagacaccc

SEQ ID NO: 426884 - DNA, 20 bp, mouse
ggcaaggtgccgggcactcc

SEQ ID NO: 426885 - DNA, 20 bp, mouse
gggtcagcccgcgctggagg

SEQ ID NO: 426886 - DNA, 20 bp, mouse
gtacctgttagtttgaatag

SEQ ID NO: 426887 - DNA, 20 bp, mouse
gggctgggatccttgattct

SEQ ID NO: 426888 - DNA, 20 bp, mouse
gagtttgaatagaggcattg

SEQ ID NO: 426889 - DNA, 20 bp, mouse
ggaatagaggcattgtggct

SEQ ID NO: 426890 - DNA, 20 bp, mouse
gagtgtggaccgtagaacac

SEQ ID NO: 426891 - DNA, 20 bp, mouse
gtaggtgtgcagaaaggatt

SEQ ID NO: 426892 - DNA, 20 bp, mouse
gtagaacactggaacagtct

SEQ ID NO: 426893 - DNA, 20 bp, mouse
gagatggacacgtcaggcca

SEQ ID NO: 426894 - DNA, 20 bp, mouse
gtcctaaagatcatgaccat

SEQ ID NO: 426895 - DNA, 20 bp, mouse
gtattatgaaccccacataa

SEQ ID NO: 426896 - DNA, 20 bp, mouse
ggaccccgccgaaaccttcc

SEQ ID NO: 426897 - DNA, 20 bp, mouse
gtcctgtggccgggctacgg

SEQ ID NO: 426898 - DNA, 20 bp, mouse
gcgcgcagcccggaaggttt

SEQ ID NO: 426899 - DNA, 20 bp, mouse
gcactgagaagcgggaagga

SEQ ID NO: 426900 - DNA, 20 bp, mouse
gagcccggaaggtttcggcg

SEQ ID NO: 426901 - DNA, 20 bp, mouse
gggactcccgccgacttcag

SEQ ID NO: 426902 - DNA, 20 bp, mouse
gagtcccgcgtggaccagga

SEQ ID NO: 426903 - DNA, 20 bp, mouse
ggattggcgcgcagcccgga

SEQ ID NO: 426904 - DNA, 20 bp, mouse
ggggtctcctgaggtcagtc

SEQ ID NO: 426905 - DNA, 20 bp, mouse
ggagggagccgggctgaaga

SEQ ID NO: 426906 - DNA, 20 bp, mouse
ggacagcggaggaacctcac

SEQ ID NO: 426907 - DNA, 20 bp, mouse
ggctggggccaaggcgacag

SEQ ID NO: 426908 - DNA, 20 bp, mouse
ggacttgcctgggccaggat

SEQ ID NO: 426909 - DNA, 20 bp, mouse
ggggccaggataggatgcca

SEQ ID NO: 426910 - DNA, 20 bp, mouse
ggtcgccttggccccagcca

SEQ ID NO: 426911 - DNA, 20 bp, mouse
gagcttggccccagccggtg

SEQ ID NO: 426912 - DNA, 20 bp, mouse
gggataggatgccatggctg

SEQ ID NO: 426913 - DNA, 20 bp, mouse
gcagaaggggaccttatcgg

SEQ ID NO: 426914 - DNA, 20 bp, mouse
gggggccaaggcgacagcgg

SEQ ID NO: 426915 - DNA, 20 bp, mouse
gggaggaacctcaccggctg

SEQ ID NO: 426916 - DNA, 20 bp, mouse
gactcagctccgggcagcac

SEQ ID NO: 426917 - DNA, 20 bp, mouse
gcccggagctgagtcagagc

SEQ ID NO: 426918 - DNA, 20 bp, mouse
ggcctccataaatgatcctg

SEQ ID NO: 426919 - DNA, 20 bp, mouse
gtcctcaggatcatttatgg

SEQ ID NO: 426920 - DNA, 20 bp, mouse
gcatggcacagacctgagcc

SEQ ID NO: 426921 - DNA, 20 bp, mouse
gctaggttctggccggagga

SEQ ID NO: 426922 - DNA, 20 bp, mouse
gtgaagccagcagacttgta

SEQ ID NO: 426923 - DNA, 20 bp, mouse
gctgctgccgctggggtggg

SEQ ID NO: 426924 - DNA, 20 bp, mouse
gaggcatgatggggcagctg

SEQ ID NO: 426925 - DNA, 20 bp, mouse
ggaacaggtttgttagtgta

SEQ ID NO: 426926 - DNA, 20 bp, mouse
ggtcctgagtccccagggta

SEQ ID NO: 426927 - DNA, 20 bp, mouse
gaggaccaggcctcaggtca

SEQ ID NO: 426928 - DNA, 20 bp, mouse
gacaaaaggcccgtgacctg

SEQ ID NO: 426929 - DNA, 20 bp, mouse
gcctggtccttggtcagctg

SEQ ID NO: 426930 - DNA, 20 bp, mouse
gtcctcggggacagtaaaca

SEQ ID NO: 426931 - DNA, 20 bp, mouse
ggctaaggtgctccgagaag

SEQ ID NO: 426932 - DNA, 20 bp, mouse
gtccgatgggacagtcctcg

SEQ ID NO: 426933 - DNA, 20 bp, mouse
ggtggatgtcctgagtcccc

SEQ ID NO: 426934 - DNA, 20 bp, mouse
gccttttgttccttaccctg

SEQ ID NO: 426935 - DNA, 20 bp, mouse
ggcggagaaggtgtttgcta

SEQ ID NO: 426936 - DNA, 20 bp, mouse
gagcagagcgcgcagcgagc

SEQ ID NO: 426937 - DNA, 20 bp, mouse
gcggcggcaccgaggagccc

SEQ ID NO: 426938 - DNA, 20 bp, mouse
gctgcggaccgcagcagcca

SEQ ID NO: 426939 - DNA, 20 bp, mouse
gaggggcgcggcgacaggac

SEQ ID NO: 426940 - DNA, 20 bp, mouse
ggcggatgtgcggccactag

SEQ ID NO: 426941 - DNA, 20 bp, mouse
gctgctgcggtccgcagagc

SEQ ID NO: 426942 - DNA, 20 bp, mouse
ggacaggggagtcctccacc

SEQ ID NO: 426943 - DNA, 20 bp, mouse
ggaggcaacggatgagggag

SEQ ID NO: 426944 - DNA, 20 bp, mouse
gcgcctcccgggaccagggg

SEQ ID NO: 426945 - DNA, 20 bp, mouse
gcagagggcagcgggatgcg

SEQ ID NO: 426946 - DNA, 20 bp, mouse
gtgcaggcgaaaacccagag

SEQ ID NO: 426947 - DNA, 20 bp, mouse
gagcgtgcctggcagagtag

SEQ ID NO: 426948 - DNA, 20 bp, mouse
gatgcatcggatagtcagtg

SEQ ID NO: 426949 - DNA, 20 bp, mouse
gtcagtgtggtagcccctct

SEQ ID NO: 426950 - DNA, 20 bp, mouse
ggttgcgggtgacaatgcat

SEQ ID NO: 426951 - DNA, 20 bp, mouse
ggtgggcgactctggaccaa

SEQ ID NO: 426952 - DNA, 20 bp, mouse
gtgccggccgcaccagttgc

SEQ ID NO: 426953 - DNA, 20 bp, mouse
ggccctggtggcactaagtc

SEQ ID NO: 426954 - DNA, 20 bp, mouse
gttgtcacccgcaactggtg

SEQ ID NO: 426955 - DNA, 20 bp, mouse
gctaggtggaagtcatagag

SEQ ID NO: 426956 - DNA, 20 bp, mouse
ggtaaagtggagaagtcatc

SEQ ID NO: 426957 - DNA, 20 bp, mouse
ggatcattctacttgcaata

SEQ ID NO: 426958 - DNA, 20 bp, mouse
gacacttactggtaatgact

SEQ ID NO: 426959 - DNA, 20 bp, mouse
gaaatggctgtaaggagaca

SEQ ID NO: 426960 - DNA, 20 bp, mouse
gctgtaaggagacatggctt

SEQ ID NO: 426961 - DNA, 20 bp, mouse
gaattttgcaccgagtaaag

SEQ ID NO: 426962 - DNA, 20 bp, mouse
gattttgcctggtagcagaa

SEQ ID NO: 426963 - DNA, 20 bp, mouse
gagcaatatagcagccctga

SEQ ID NO: 426964 - DNA, 20 bp, mouse
ggtaaagatatcacacttac

SEQ ID NO: 426965 - DNA, 20 bp, mouse
gaaatgtcatcttctttcat

SEQ ID NO: 426966 - DNA, 20 bp, mouse
gcagaagattccaactgcag

SEQ ID NO: 426967 - DNA, 20 bp, mouse
gcatggtatgtaatccttaa

SEQ ID NO: 426968 - DNA, 20 bp, mouse
gcaaactagcatatccttta

SEQ ID NO: 426969 - DNA, 20 bp, mouse
gcaataagcaaacaggtcta

SEQ ID NO: 426970 - DNA, 20 bp, mouse
gcagaagcctgcactatgat

SEQ ID NO: 426971 - DNA, 20 bp, mouse
gtggctgctctaacctgagc

SEQ ID NO: 426972 - DNA, 20 bp, mouse
gccactaacaataagcaaac

SEQ ID NO: 426973 - DNA, 20 bp, mouse
gcattaggtgttattttgaa

SEQ ID NO: 426974 - DNA, 20 bp, mouse
gtatcatgtcacaaagtaat

SEQ ID NO: 426975 - DNA, 20 bp, mouse
gatcattccaatcatagtgc

SEQ ID NO: 426976 - DNA, 20 bp, mouse
gagtccatcataggtcactg

SEQ ID NO: 426977 - DNA, 20 bp, mouse
gtgctgacagaatccatatt

SEQ ID NO: 426978 - DNA, 20 bp, mouse
gtgaaagagaggatagtgaa

SEQ ID NO: 426979 - DNA, 20 bp, mouse
ggaatactaaactctagatt

SEQ ID NO: 426980 - DNA, 20 bp, mouse
gcctctaataaagtacaaaa

SEQ ID NO: 426981 - DNA, 20 bp, mouse
gtctgttatttagggcttca

SEQ ID NO: 426982 - DNA, 20 bp, mouse
gggccagattaaacgttttt

SEQ ID NO: 426983 - DNA, 20 bp, mouse
gtaaaataagtttagagcca

SEQ ID NO: 426984 - DNA, 20 bp, mouse
gcaatagaaatctcaccatt

SEQ ID NO: 426985 - DNA, 20 bp, mouse
gttcctaaaaacgtttaatc

SEQ ID NO: 426986 - DNA, 20 bp, mouse
ggcatgtgtgcggtaagtga

SEQ ID NO: 426987 - DNA, 20 bp, mouse
ggtgacacgagcgtgcctgg

SEQ ID NO: 426988 - DNA, 20 bp, mouse
ggctcacactacccagctcc

SEQ ID NO: 426989 - DNA, 20 bp, mouse
gcacgctcgtgtcacttcaa

SEQ ID NO: 426990 - DNA, 20 bp, mouse
ggaagtgacacgagcgtgcc

SEQ ID NO: 426991 - DNA, 20 bp, mouse
ggtgcggtaagtgagggctt

SEQ ID NO: 426992 - DNA, 20 bp, mouse
gacgggtgccgccaggagct

SEQ ID NO: 426993 - DNA, 20 bp, mouse
gacacatgccacacaccgcc

SEQ ID NO: 426994 - DNA, 20 bp, mouse
ggctaggaggtccacttcga

SEQ ID NO: 426995 - DNA, 20 bp, mouse
ggcacagtgatgggaaatag

SEQ ID NO: 426996 - DNA, 20 bp, mouse
gtctctggggcagttccgga

SEQ ID NO: 426997 - DNA, 20 bp, mouse
ggggctggggctgcgaggta

SEQ ID NO: 426998 - DNA, 20 bp, mouse
ggcaccacccgcacccaccc

SEQ ID NO: 426999 - DNA, 20 bp, mouse
gctgcgaggtaggggccgcg

SEQ ID NO: 427000 - DNA, 20 bp, mouse
gcacaggcgcggggagctga

SEQ ID NO: 427001 - DNA, 20 bp, mouse
ggggagctgatggccggggt

SEQ ID NO: 427002 - DNA, 20 bp, mouse
gggatgtgctcggtgtactt

SEQ ID NO: 427003 - DNA, 20 bp, mouse
gctgggagctgggtcccaag

SEQ ID NO: 427004 - DNA, 20 bp, mouse
gcgcggggagctgatggccg

SEQ ID NO: 427005 - DNA, 20 bp, mouse
gtaggtgagtctcaacgact

SEQ ID NO: 427006 - DNA, 20 bp, mouse
gaggcctgtccgggtgaggg

SEQ ID NO: 427007 - DNA, 20 bp, mouse
gatgcgtgctaggaccaccg

SEQ ID NO: 427008 - DNA, 20 bp, mouse
ggtggtatgaggaaccgtca

SEQ ID NO: 427009 - DNA, 20 bp, mouse
ggaagcagaggggacctcgg

SEQ ID NO: 427010 - DNA, 20 bp, mouse
ggcggcctagaggcctgtcc

SEQ ID NO: 427011 - DNA, 20 bp, mouse
gtagaggcctgtccgggtga

SEQ ID NO: 427012 - DNA, 20 bp, mouse
gcagcttgagggcggcctag

SEQ ID NO: 427013 - DNA, 20 bp, mouse
gacccagggagcaaccggaa

SEQ ID NO: 427014 - DNA, 20 bp, mouse
gataccaccctcacccggac

SEQ ID NO: 427015 - DNA, 20 bp, mouse
gatgaggaaccgtcagggct

SEQ ID NO: 427016 - DNA, 20 bp, mouse
gatgccggaggaagaatggg

SEQ ID NO: 427017 - DNA, 20 bp, mouse
gcggatgccggaggaagaat

SEQ ID NO: 427018 - DNA, 20 bp, mouse
gcaggtcgggaaatccaaga

SEQ ID NO: 427019 - DNA, 20 bp, mouse
ggacttgcgaacaactcaaa

SEQ ID NO: 427020 - DNA, 20 bp, mouse
ggaggaagaatgggcggcag

SEQ ID NO: 427021 - DNA, 20 bp, mouse
ggcccgcacctgaataactc

SEQ ID NO: 427022 - DNA, 20 bp, mouse
gtgagttgttcgcaagtctt

SEQ ID NO: 427023 - DNA, 20 bp, mouse
gctgctccccggaggcacaa

SEQ ID NO: 427024 - DNA, 20 bp, mouse
gtgcgaacaactcaaatggc

SEQ ID NO: 427025 - DNA, 20 bp, mouse
gcttcctccggcatccggga

SEQ ID NO: 427026 - DNA, 20 bp, mouse
gccgccgagactagggagaa

SEQ ID NO: 427027 - DNA, 20 bp, mouse
gcctaacgccgccgagacta

SEQ ID NO: 427028 - DNA, 20 bp, mouse
gaatcaggtgtgtaagacag

SEQ ID NO: 427029 - DNA, 20 bp, mouse
ggagcccttctccctagtct

SEQ ID NO: 427030 - DNA, 20 bp, mouse
ggggcggcccatctcgacac

SEQ ID NO: 427031 - DNA, 20 bp, mouse
gtagatgagacaaaacgcta

SEQ ID NO: 427032 - DNA, 20 bp, mouse
gacacagttctctaaaccga

SEQ ID NO: 427033 - DNA, 20 bp, mouse
gccggtaagacggaggtggt

SEQ ID NO: 427034 - DNA, 20 bp, mouse
gggcctgagaaccggaattg

SEQ ID NO: 427035 - DNA, 20 bp, mouse
gactgtgtgctagcgggcgc

SEQ ID NO: 427036 - DNA, 20 bp, mouse
gacttcggaggagcccgacg

SEQ ID NO: 427037 - DNA, 20 bp, mouse
gccgcgcggaggcaacggaa

SEQ ID NO: 427038 - DNA, 20 bp, mouse
ggtggctggcgctacttcgg

SEQ ID NO: 427039 - DNA, 20 bp, mouse
ggggaggccggaagatcctc

SEQ ID NO: 427040 - DNA, 20 bp, mouse
gccaagtcggacccacggac

SEQ ID NO: 427041 - DNA, 20 bp, mouse
gggaggagcccgacgcggcg

SEQ ID NO: 427042 - DNA, 20 bp, mouse
gcacgatcgcacggtgagga

SEQ ID NO: 427043 - DNA, 20 bp, mouse
gcgcacggtgaggagggacg

SEQ ID NO: 427044 - DNA, 20 bp, mouse
ggcggtggctggcgctactt

SEQ ID NO: 427045 - DNA, 20 bp, mouse
ggcctgcgtacggctcgccg

SEQ ID NO: 427046 - DNA, 20 bp, mouse
gacgcgcgcgcagtgggtaa

SEQ ID NO: 427047 - DNA, 20 bp, mouse
gggtagacgccggagttcga

SEQ ID NO: 427048 - DNA, 20 bp, mouse
ggaagccgacgcgcgcgcag

SEQ ID NO: 427049 - DNA, 20 bp, mouse
ggtgacccagaagaagggcg

SEQ ID NO: 427050 - DNA, 20 bp, mouse
gtggccaccctcggaaaccc

SEQ ID NO: 427051 - DNA, 20 bp, mouse
gcacgctgtgcggagtggaa

SEQ ID NO: 427052 - DNA, 20 bp, mouse
gccgcggcccgggtttccga

SEQ ID NO: 427053 - DNA, 20 bp, mouse
gaggtcgagcgtcgccatgg

SEQ ID NO: 427054 - DNA, 20 bp, mouse
gtacatgcggaagtgcaagg

SEQ ID NO: 427055 - DNA, 20 bp, mouse
gggtgggaggatactacatg

SEQ ID NO: 427056 - DNA, 20 bp, mouse
gcacttaccgcgccaagagc

SEQ ID NO: 427057 - DNA, 20 bp, mouse
gtggcccagcactgtaggaa

SEQ ID NO: 427058 - DNA, 20 bp, mouse
gtgctagggaagcgagtcaa

SEQ ID NO: 427059 - DNA, 20 bp, mouse
ggacctggggaaacgcttcc

SEQ ID NO: 427060 - DNA, 20 bp, mouse
gagtgctttcgggatcgtgg

SEQ ID NO: 427061 - DNA, 20 bp, mouse
gcggctgccggctcttggcg

SEQ ID NO: 427062 - DNA, 20 bp, mouse
ggacccggaagcgtttcccc

SEQ ID NO: 427063 - DNA, 20 bp, mouse
ggggcttagactctaggaaa

SEQ ID NO: 427064 - DNA, 20 bp, mouse
ggatcctggcccagcactgt

SEQ ID NO: 427065 - DNA, 20 bp, mouse
gagattgaccaacaggaagg

SEQ ID NO: 427066 - DNA, 20 bp, mouse
gcaaagaatgggcagtgatg

SEQ ID NO: 427067 - DNA, 20 bp, mouse
gacatgagggaagagtgacg

SEQ ID NO: 427068 - DNA, 20 bp, mouse
gatgataatgactgcgagat

SEQ ID NO: 427069 - DNA, 20 bp, mouse
gtctgcgatgctttggagcc

SEQ ID NO: 427070 - DNA, 20 bp, mouse
gactgcgagattggccaaca

SEQ ID NO: 427071 - DNA, 20 bp, mouse
gcaggactcaaactcagctt

SEQ ID NO: 427072 - DNA, 20 bp, mouse
gaatctaggtagaaaagcca

SEQ ID NO: 427073 - DNA, 20 bp, mouse
gaagagtgacggggacaagg

SEQ ID NO: 427074 - DNA, 20 bp, mouse
ggggaagagtgacggggaca

SEQ ID NO: 427075 - DNA, 20 bp, mouse
gtcagagcactacgatgatg

SEQ ID NO: 427076 - DNA, 20 bp, mouse
gctcgccacgacgtagacgg

SEQ ID NO: 427077 - DNA, 20 bp, mouse
gcgcgcgcccgcctgagctg

SEQ ID NO: 427078 - DNA, 20 bp, mouse
ggcgtaggaagagaccctgg

SEQ ID NO: 427079 - DNA, 20 bp, mouse
gcaggactaactgggagcgt

SEQ ID NO: 427080 - DNA, 20 bp, mouse
gccctcaccgccgcagggac

SEQ ID NO: 427081 - DNA, 20 bp, mouse
gtcgctcgccacgacgtaga

SEQ ID NO: 427082 - DNA, 20 bp, mouse
gagctgtgggagtttgatgg

SEQ ID NO: 427083 - DNA, 20 bp, mouse
gccgcgccggccgtatgcaa

SEQ ID NO: 427084 - DNA, 20 bp, mouse
gcacgccgccgtctacgtcg

SEQ ID NO: 427085 - DNA, 20 bp, mouse
gggtgctgcgcctgtccctg

SEQ ID NO: 427086 - DNA, 20 bp, mouse
gatggaggccgagggtgtgg

SEQ ID NO: 427087 - DNA, 20 bp, mouse
gctagagtcgcagtcatcgg

SEQ ID NO: 427088 - DNA, 20 bp, mouse
gggcctagagtcgcagtcat

SEQ ID NO: 427089 - DNA, 20 bp, mouse
ggccgccaccgccacaccct

SEQ ID NO: 427090 - DNA, 20 bp, mouse
gcaccgtgcgctctactggg

SEQ ID NO: 427091 - DNA, 20 bp, mouse
gggacagtgatggaggccga

SEQ ID NO: 427092 - DNA, 20 bp, mouse
gaaggaggcaagcccactac

SEQ ID NO: 427093 - DNA, 20 bp, mouse
ggaggccgagggtgtggcgg

SEQ ID NO: 427094 - DNA, 20 bp, mouse
ggtgatggaggccgagggtg

SEQ ID NO: 427095 - DNA, 20 bp, mouse
gcatcaccgtgcgctctact

SEQ ID NO: 427096 - DNA, 20 bp, mouse
gaaggccgctggctaggagt

SEQ ID NO: 427097 - DNA, 20 bp, mouse
ggcacccggccacaaagctc

SEQ ID NO: 427098 - DNA, 20 bp, mouse
gtaggccgagtctgcgactc

SEQ ID NO: 427099 - DNA, 20 bp, mouse
gcgcggagggcggagtgaga

SEQ ID NO: 427100 - DNA, 20 bp, mouse
gcctgccagagtcgcagact

SEQ ID NO: 427101 - DNA, 20 bp, mouse
gtcggcctactcctagccag

SEQ ID NO: 427102 - DNA, 20 bp, mouse
gcagccatgctgagatgtag

SEQ ID NO: 427103 - DNA, 20 bp, mouse
ggcaggtaccgctgctggca

SEQ ID NO: 427104 - DNA, 20 bp, mouse
gagggcggagtgagagggcg

SEQ ID NO: 427105 - DNA, 20 bp, mouse
gctggtgagagaggtcgcct

SEQ ID NO: 427106 - DNA, 20 bp, mouse
gggctgcagccatggcgtaa

SEQ ID NO: 427107 - DNA, 20 bp, mouse
gtggcgtaaaggcggctcgt

SEQ ID NO: 427108 - DNA, 20 bp, mouse
gtgcagccatggcgtaaagg

SEQ ID NO: 427109 - DNA, 20 bp, mouse
gggcgggttaaggtgccggg

SEQ ID NO: 427110 - DNA, 20 bp, mouse
gtcgttgagcagcaccagga

SEQ ID NO: 427111 - DNA, 20 bp, mouse
gctactgtgggaaacagtct

SEQ ID NO: 427112 - DNA, 20 bp, mouse
ggcaaggacaggccctctcc

SEQ ID NO: 427113 - DNA, 20 bp, mouse
gccaggacggcgatcttata

SEQ ID NO: 427114 - DNA, 20 bp, mouse
gctgaggcccccgctactgt

SEQ ID NO: 427115 - DNA, 20 bp, mouse
gcgtggacgccggcaaggac

SEQ ID NO: 427116 - DNA, 20 bp, mouse
gtcccgggaaccgagagcag

SEQ ID NO: 427117 - DNA, 20 bp, mouse
ggacaccgcggcaccggcag

SEQ ID NO: 427118 - DNA, 20 bp, mouse
gcagcggcggacagaactcc

SEQ ID NO: 427119 - DNA, 20 bp, mouse
ggtggcccccggcgacaccg

SEQ ID NO: 427120 - DNA, 20 bp, mouse
gaaccgagagcagaggctcg

SEQ ID NO: 427121 - DNA, 20 bp, mouse
gcccggcgacaccgcggcac

SEQ ID NO: 427122 - DNA, 20 bp, mouse
gctcggggaaagttccaaaa

SEQ ID NO: 427123 - DNA, 20 bp, mouse
ggaccacgtgcgggacatgg

SEQ ID NO: 427124 - DNA, 20 bp, mouse
ggtctggaccggaaggaccc

SEQ ID NO: 427125 - DNA, 20 bp, mouse
gctgctgaggagccgcacgt

SEQ ID NO: 427126 - DNA, 20 bp, mouse
gagctggacacattcccagt

SEQ ID NO: 427127 - DNA, 20 bp, mouse
gtggacacattcccagtcgg

SEQ ID NO: 427128 - DNA, 20 bp, mouse
ggtctccaggagcacgcagc

SEQ ID NO: 427129 - DNA, 20 bp, mouse
ggaccaccaccaccagactc

SEQ ID NO: 427130 - DNA, 20 bp, mouse
gaaaaccccgagtctggtgg

SEQ ID NO: 427131 - DNA, 20 bp, mouse
gaggaaaaccccgagtctgg

SEQ ID NO: 427132 - DNA, 20 bp, mouse
gtggcttcctaagcctttgg

SEQ ID NO: 427133 - DNA, 20 bp, mouse
gtgtgattaaaagcccccaa

SEQ ID NO: 427134 - DNA, 20 bp, mouse
gtgccaagccaagcttgtta

SEQ ID NO: 427135 - DNA, 20 bp, mouse
gctccataacaagcttggct

SEQ ID NO: 427136 - DNA, 20 bp, mouse
ggccgacctcacccatatcg

SEQ ID NO: 427137 - DNA, 20 bp, mouse
gatcggggacgagattccaa

SEQ ID NO: 427138 - DNA, 20 bp, mouse
gggaatctcgtccccgatat

SEQ ID NO: 427139 - DNA, 20 bp, mouse
gctcgtccccgatatgggtg

SEQ ID NO: 427140 - DNA, 20 bp, mouse
gtccccgatatgggtgaggt

SEQ ID NO: 427141 - DNA, 20 bp, mouse
gctggacccggaactggagg

SEQ ID NO: 427142 - DNA, 20 bp, mouse
gcacctggacccggaactgg

SEQ ID NO: 427143 - DNA, 20 bp, mouse
gctagaaccagggctcatag

SEQ ID NO: 427144 - DNA, 20 bp, mouse
gattcgccatcccaacagga

SEQ ID NO: 427145 - DNA, 20 bp, mouse
gggacatccacgctggactc

SEQ ID NO: 427146 - DNA, 20 bp, mouse
ggatcacaaccagacccaac

SEQ ID NO: 427147 - DNA, 20 bp, mouse
gtgttcttggtcttcctgtt

SEQ ID NO: 427148 - DNA, 20 bp, mouse
gcaggtaccgagcctctaaa

SEQ ID NO: 427149 - DNA, 20 bp, mouse
gtccatagacagcagacccc

SEQ ID NO: 427150 - DNA, 20 bp, mouse
gaggctcggtacctgcatgg

SEQ ID NO: 427151 - DNA, 20 bp, mouse
gacacaaaggaaggtctccc

SEQ ID NO: 427152 - DNA, 20 bp, mouse
gggttcagatatattattat

SEQ ID NO: 427153 - DNA, 20 bp, mouse
gtcaccacttgcacacacaa

SEQ ID NO: 427154 - DNA, 20 bp, mouse
gtcttaaatttcgtccataa

SEQ ID NO: 427155 - DNA, 20 bp, mouse
gtagaggctcggtacctgca

SEQ ID NO: 427156 - DNA, 20 bp, mouse
gagctagactcgtccccagt

SEQ ID NO: 427157 - DNA, 20 bp, mouse
ggtctctagcttgacaccga

SEQ ID NO: 427158 - DNA, 20 bp, mouse
gtggcttcctaagcgtctgg

SEQ ID NO: 427159 - DNA, 20 bp, mouse
gaaatggcttcctaagcgtc

SEQ ID NO: 427160 - DNA, 20 bp, mouse
gttatggaagaaaacacggc

SEQ ID NO: 427161 - DNA, 20 bp, mouse
gtagactcgtccccagttgg

SEQ ID NO: 427162 - DNA, 20 bp, mouse
gcagatacaaaccacaccaa

SEQ ID NO: 427163 - DNA, 20 bp, mouse
gcttgttatggaagaaaaca

SEQ ID NO: 427164 - DNA, 20 bp, mouse
gaagcgtaaggggggataat

SEQ ID NO: 427165 - DNA, 20 bp, mouse
gaaaacaggttcctttggtg

SEQ ID NO: 427166 - DNA, 20 bp, mouse
gtgtaagggggggtgttaat

SEQ ID NO: 427167 - DNA, 20 bp, mouse
ggtgctcctgtgacagggta

SEQ ID NO: 427168 - DNA, 20 bp, mouse
ggttctccctaccctgtcac

SEQ ID NO: 427169 - DNA, 20 bp, mouse
ggtccagaaagtgtaagggg

SEQ ID NO: 427170 - DNA, 20 bp, mouse
gatatagtgctcctgtgaca

SEQ ID NO: 427171 - DNA, 20 bp, mouse
gtggctccctaagcctctgg

SEQ ID NO: 427172 - DNA, 20 bp, mouse
gccagctttcctccaacggg

SEQ ID NO: 427173 - DNA, 20 bp, mouse
gtagggagccatttgcggaa

SEQ ID NO: 427174 - DNA, 20 bp, mouse
gttcctccaacggggggtgg

SEQ ID NO: 427175 - DNA, 20 bp, mouse
gcagagagttgagcacccac

SEQ ID NO: 427176 - DNA, 20 bp, mouse
ggaccaacatcaaggaacct

SEQ ID NO: 427177 - DNA, 20 bp, mouse
gagcacaaagaccaacatca

SEQ ID NO: 427178 - DNA, 20 bp, mouse
gatctctcccactctggcta

SEQ ID NO: 427179 - DNA, 20 bp, mouse
ggtgtcatggataaaggtgt

SEQ ID NO: 427180 - DNA, 20 bp, mouse
gcacttgcaatcactcagga

SEQ ID NO: 427181 - DNA, 20 bp, mouse
gtcatcgaagtggacaggcc

SEQ ID NO: 427182 - DNA, 20 bp, mouse
ggatgccaagccaacaggct

SEQ ID NO: 427183 - DNA, 20 bp, mouse
gtcaccacttgcaatcactc

SEQ ID NO: 427184 - DNA, 20 bp, mouse
gatctttaaagtctctgtac

SEQ ID NO: 427185 - DNA, 20 bp, mouse
gtaaagtctctgtactggca

SEQ ID NO: 427186 - DNA, 20 bp, mouse
gtggcagcagcaggtaatac

SEQ ID NO: 427187 - DNA, 20 bp, mouse
ggccggtacctgagagaaag

SEQ ID NO: 427188 - DNA, 20 bp, mouse
gtacaggcacgacgcgatca

SEQ ID NO: 427189 - DNA, 20 bp, mouse
gggcacgacgcgatcatggc

SEQ ID NO: 427190 - DNA, 20 bp, mouse
ggctggcgggcgactctcgt

SEQ ID NO: 427191 - DNA, 20 bp, mouse
gagcggaagaggcgcgcggc

SEQ ID NO: 427192 - DNA, 20 bp, mouse
gcggtgtgcagcagtgtgga

SEQ ID NO: 427193 - DNA, 20 bp, mouse
gtgcttagaggcaaagtgtg

SEQ ID NO: 427194 - DNA, 20 bp, mouse
gcggcgggtagagttaggga

SEQ ID NO: 427195 - DNA, 20 bp, mouse
ggtggggcggggtcgaacag

SEQ ID NO: 427196 - DNA, 20 bp, mouse
gcgagtgatggggatccggt

SEQ ID NO: 427197 - DNA, 20 bp, mouse
gggccgggagccgagtgatg

SEQ ID NO: 427198 - DNA, 20 bp, mouse
gtccggtaggacccggcgag

SEQ ID NO: 427199 - DNA, 20 bp, mouse
ggccgctcgccgggtcctac

SEQ ID NO: 427200 - DNA, 20 bp, mouse
ggagccgagtgatggggatc

SEQ ID NO: 427201 - DNA, 20 bp, mouse
gcgcggctgcacctcagctt

SEQ ID NO: 427202 - DNA, 20 bp, mouse
gcggccggcgggatggacag

SEQ ID NO: 427203 - DNA, 20 bp, mouse
ggcctcgccccgccacacag

SEQ ID NO: 427204 - DNA, 20 bp, mouse
gctgtgagcgcccaacgccc

SEQ ID NO: 427205 - DNA, 20 bp, mouse
gcagcgccacgtctccatct

SEQ ID NO: 427206 - DNA, 20 bp, mouse
gagcagatctgctgcagata

SEQ ID NO: 427207 - DNA, 20 bp, mouse
gtctgctgcagatagggtag

SEQ ID NO: 427208 - DNA, 20 bp, mouse
ggcagatagggtagaggaaa

SEQ ID NO: 427209 - DNA, 20 bp, mouse
gatgtactcgcagctgacgc

SEQ ID NO: 427210 - DNA, 20 bp, mouse
gaggcacggaaggcaagcgc

SEQ ID NO: 427211 - DNA, 20 bp, mouse
gatggcagcgaagaatgcaa

SEQ ID NO: 427212 - DNA, 20 bp, mouse
gtctggaagaatgaaagtgt

SEQ ID NO: 427213 - DNA, 20 bp, mouse
ggctttgcaggaggcacgga

SEQ ID NO: 427214 - DNA, 20 bp, mouse
gactcgcagctgacgcgggc

SEQ ID NO: 427215 - DNA, 20 bp, mouse
gtccaagccaagctggaagc

SEQ ID NO: 427216 - DNA, 20 bp, mouse
gactgacactgtagactcag

SEQ ID NO: 427217 - DNA, 20 bp, mouse
gcagacctctggagtgagca

SEQ ID NO: 427218 - DNA, 20 bp, mouse
gcggagctgtcctgagagga

SEQ ID NO: 427219 - DNA, 20 bp, mouse
gaagagtccgtgcagacctc

SEQ ID NO: 427220 - DNA, 20 bp, mouse
gggaagagcgtggacagcac

SEQ ID NO: 427221 - DNA, 20 bp, mouse
ggacagctccgagtgtgccg

SEQ ID NO: 427222 - DNA, 20 bp, mouse
gagctctcagctgctgtcta

SEQ ID NO: 427223 - DNA, 20 bp, mouse
ggcctgctgcgggacggaga

SEQ ID NO: 427224 - DNA, 20 bp, mouse
gcacggcattggacatgtag

SEQ ID NO: 427225 - DNA, 20 bp, mouse
gctcttctccccggcacact

SEQ ID NO: 427226 - DNA, 20 bp, mouse
gagcatctgagaccaagtgg

SEQ ID NO: 427227 - DNA, 20 bp, mouse
ggcacagcacatctgggcga

SEQ ID NO: 427228 - DNA, 20 bp, mouse
gtcttgtcaggtaccaggac

SEQ ID NO: 427229 - DNA, 20 bp, mouse
ggcgccagctggcagatatc

SEQ ID NO: 427230 - DNA, 20 bp, mouse
gccggacctggtgaatctgg

SEQ ID NO: 427231 - DNA, 20 bp, mouse
ggtggtgaggtggtcttgtc

SEQ ID NO: 427232 - DNA, 20 bp, mouse
ggctggcagatatcaggctc

SEQ ID NO: 427233 - DNA, 20 bp, mouse
gcggcgcctgaggctttggg

SEQ ID NO: 427234 - DNA, 20 bp, mouse
gtggctgcagcccagcacag

SEQ ID NO: 427235 - DNA, 20 bp, mouse
gtgaatctggcggtgcccac

SEQ ID NO: 427236 - DNA, 20 bp, mouse
ggagtctactgagaacgaga

SEQ ID NO: 427237 - DNA, 20 bp, mouse
gtgtaacttggggctatctg

SEQ ID NO: 427238 - DNA, 20 bp, mouse
gacagtctgtcagctgcggc

SEQ ID NO: 427239 - DNA, 20 bp, mouse
gaatcactcttcggactgtg

SEQ ID NO: 427240 - DNA, 20 bp, mouse
ggggcaaggacgcacgttca

SEQ ID NO: 427241 - DNA, 20 bp, mouse
ggctctgaccggtgaatcca

SEQ ID NO: 427242 - DNA, 20 bp, mouse
gccttactccttggattcac

SEQ ID NO: 427243 - DNA, 20 bp, mouse
gtagccccaagttacatagg

SEQ ID NO: 427244 - DNA, 20 bp, mouse
ggggccacctatgtaacttg

SEQ ID NO: 427245 - DNA, 20 bp, mouse
gttttttcaacagacaacaa

SEQ ID NO: 427246 - DNA, 20 bp, mouse
ggcacgtaaaggctccacaa

SEQ ID NO: 427247 - DNA, 20 bp, mouse
gttcctctggcggcacgtaa

SEQ ID NO: 427248 - DNA, 20 bp, mouse
gggtccaacaacaccactca

SEQ ID NO: 427249 - DNA, 20 bp, mouse
gcagcctcagttgaactccc

SEQ ID NO: 427250 - DNA, 20 bp, mouse
gatggaccccaagccctgag

SEQ ID NO: 427251 - DNA, 20 bp, mouse
gaaaggctccacaaaggacc

SEQ ID NO: 427252 - DNA, 20 bp, mouse
gtgctcacagtttcctctgg

SEQ ID NO: 427253 - DNA, 20 bp, mouse
gcctgcagccaaccagggtc

SEQ ID NO: 427254 - DNA, 20 bp, mouse
ggtgcagctggaccccacag

SEQ ID NO: 427255 - DNA, 20 bp, mouse
gctgtgagggagagcaggtt

SEQ ID NO: 427256 - DNA, 20 bp, mouse
ggaggtccaggtctccttac

SEQ ID NO: 427257 - DNA, 20 bp, mouse
gtccaggtctccttacagga

SEQ ID NO: 427258 - DNA, 20 bp, mouse
gctctggatgcaattactaa

SEQ ID NO: 427259 - DNA, 20 bp, mouse
gggaacttctccctcctgta

SEQ ID NO: 427260 - DNA, 20 bp, mouse
ggaaaggtctggatccactc

SEQ ID NO: 427261 - DNA, 20 bp, mouse
ggccctgaccttgtgttgaa

SEQ ID NO: 427262 - DNA, 20 bp, mouse
gctacaagttaaaaacgagg

SEQ ID NO: 427263 - DNA, 20 bp, mouse
gccgtgtatataaagtcaag

SEQ ID NO: 427264 - DNA, 20 bp, mouse
ggcccttcaacacaaggtca

SEQ ID NO: 427265 - DNA, 20 bp, mouse
gaagtccatgacccagctgc

SEQ ID NO: 427266 - DNA, 20 bp, mouse
gtctggtgcagaagaagatc

SEQ ID NO: 427267 - DNA, 20 bp, mouse
ggtagccgcgcatagcacca

SEQ ID NO: 427268 - DNA, 20 bp, mouse
ggtgaaacgcttatgagcta

SEQ ID NO: 427269 - DNA, 20 bp, mouse
gagcaagtctaagtctgagc

SEQ ID NO: 427270 - DNA, 20 bp, mouse
gacacgtggagcgcacccgt

SEQ ID NO: 427271 - DNA, 20 bp, mouse
gcccaggatgcaaagcgcgg

SEQ ID NO: 427272 - DNA, 20 bp, mouse
ggctggagttctgggggagc

SEQ ID NO: 427273 - DNA, 20 bp, mouse
ggcgcagcgcatgattctgg

SEQ ID NO: 427274 - DNA, 20 bp, mouse
ggctatgcgcggctactgcg

SEQ ID NO: 427275 - DNA, 20 bp, mouse
gccctgacaagcgttaccac

SEQ ID NO: 427276 - DNA, 20 bp, mouse
ggcctgaaggaccaggacga

SEQ ID NO: 427277 - DNA, 20 bp, mouse
gactcacccagaaggactcc

SEQ ID NO: 427278 - DNA, 20 bp, mouse
gaaggaccaggacgaaggac

SEQ ID NO: 427279 - DNA, 20 bp, mouse
ggactcccggtccttcgtcc

SEQ ID NO: 427280 - DNA, 20 bp, mouse
gggcaattccacaaaatctg

SEQ ID NO: 427281 - DNA, 20 bp, mouse
gacccagatactcacccaga

SEQ ID NO: 427282 - DNA, 20 bp, mouse
ggtccttctgggtgagtatc

SEQ ID NO: 427283 - DNA, 20 bp, mouse
ggaaggaccgggagtccttc

SEQ ID NO: 427284 - DNA, 20 bp, mouse
gtggtttccaagtcttctct

SEQ ID NO: 427285 - DNA, 20 bp, mouse
gcaaggtacatcaactacag

SEQ ID NO: 427286 - DNA, 20 bp, mouse
gacagaggaaggagatcacg

SEQ ID NO: 427287 - DNA, 20 bp, mouse
gtggtggggtattcagacta

SEQ ID NO: 427288 - DNA, 20 bp, mouse
ggaatctctagctttaagaa

SEQ ID NO: 427289 - DNA, 20 bp, mouse
gtccagggacagactctaag

SEQ ID NO: 427290 - DNA, 20 bp, mouse
gggctgctgtgaggagatga

SEQ ID NO: 427291 - DNA, 20 bp, mouse
gaaagctagagattctgaaa

SEQ ID NO: 427292 - DNA, 20 bp, mouse
gaggcttctgcagccacact

SEQ ID NO: 427293 - DNA, 20 bp, mouse
gggaagaaaactgccagtgt

SEQ ID NO: 427294 - DNA, 20 bp, mouse
gcaccatgctgagggagacc

SEQ ID NO: 427295 - DNA, 20 bp, mouse
gttaagatgctgccttggtg

SEQ ID NO: 427296 - DNA, 20 bp, mouse
gcagaggcttctgctgacag

SEQ ID NO: 427297 - DNA, 20 bp, mouse
ggggcccagagcgcttataa

SEQ ID NO: 427298 - DNA, 20 bp, mouse
gagagcagcagcgcttggag

SEQ ID NO: 427299 - DNA, 20 bp, mouse
gcagcacagtgccctcgcgg

SEQ ID NO: 427300 - DNA, 20 bp, mouse
ggggacagggacggcagcgg

SEQ ID NO: 427301 - DNA, 20 bp, mouse
gcgcggcggcagatgagtgt

SEQ ID NO: 427302 - DNA, 20 bp, mouse
gccgccgccccaggccccgc

SEQ ID NO: 427303 - DNA, 20 bp, mouse
ggcaccaggaaccggatcag

SEQ ID NO: 427304 - DNA, 20 bp, mouse
gggcatccaaggccgaggct

SEQ ID NO: 427305 - DNA, 20 bp, mouse
gagcaagcgacgggatgatg

SEQ ID NO: 427306 - DNA, 20 bp, mouse
gagcagtggcaagtccccta

SEQ ID NO: 427307 - DNA, 20 bp, mouse
gtgccggccggagggctgga

SEQ ID NO: 427308 - DNA, 20 bp, mouse
ggggagagctgtcagagcag

SEQ ID NO: 427309 - DNA, 20 bp, mouse
gtggtcccgagcaacaagat

SEQ ID NO: 427310 - DNA, 20 bp, mouse
gcaggaccctgccggccgga

SEQ ID NO: 427311 - DNA, 20 bp, mouse
gggcgacgcggggcagacat

SEQ ID NO: 427312 - DNA, 20 bp, mouse
ggggaacagtctctccctag

SEQ ID NO: 427313 - DNA, 20 bp, mouse
gtctggttgcagggtagcag

SEQ ID NO: 427314 - DNA, 20 bp, mouse
gggaccaggaccctgccggc

SEQ ID NO: 427315 - DNA, 20 bp, mouse
gcgggtggcctgagtcaggg

SEQ ID NO: 427316 - DNA, 20 bp, mouse
gggccgcgggaacagaccac

SEQ ID NO: 427317 - DNA, 20 bp, mouse
gcagctcagaaaagcgacag

SEQ ID NO: 427318 - DNA, 20 bp, mouse
gacagtggagagaagtttaa

SEQ ID NO: 427319 - DNA, 20 bp, mouse
ggaggatggtgacgttgcca

SEQ ID NO: 427320 - DNA, 20 bp, mouse
ggcagtcagataaacagttg

SEQ ID NO: 427321 - DNA, 20 bp, mouse
ggtaagtgcacgcacgccag

SEQ ID NO: 427322 - DNA, 20 bp, mouse
gacaagagacaagcgagagc

SEQ ID NO: 427323 - DNA, 20 bp, mouse
gacccaagaaggtgcattgg

SEQ ID NO: 427324 - DNA, 20 bp, mouse
ggttgtggcagctgctgcca

SEQ ID NO: 427325 - DNA, 20 bp, mouse
gcaagggcggggaaacggtg

SEQ ID NO: 427326 - DNA, 20 bp, mouse
gttcagggcttgcttctcca

SEQ ID NO: 427327 - DNA, 20 bp, mouse
gttccaagctagaatcaccg

SEQ ID NO: 427328 - DNA, 20 bp, mouse
gctcgcctcagggaggaact

SEQ ID NO: 427329 - DNA, 20 bp, mouse
gagatcttgacaacatttca

SEQ ID NO: 427330 - DNA, 20 bp, mouse
gaactcagctcgcctcaggg

SEQ ID NO: 427331 - DNA, 20 bp, mouse
ggcccgccaagcctgctcat

SEQ ID NO: 427332 - DNA, 20 bp, mouse
ggatcaggggagttgagacg

SEQ ID NO: 427333 - DNA, 20 bp, mouse
gcttttctcggggtaacgac

SEQ ID NO: 427334 - DNA, 20 bp, mouse
gtccatttagggaactcccc

SEQ ID NO: 427335 - DNA, 20 bp, mouse
gcggctcccgggaggtgatc

SEQ ID NO: 427336 - DNA, 20 bp, mouse
ggagaagccattccaagcaa

SEQ ID NO: 427337 - DNA, 20 bp, mouse
ggcaaaggctgtctcttcct

SEQ ID NO: 427338 - DNA, 20 bp, mouse
gagacagcctttgcttggaa

SEQ ID NO: 427339 - DNA, 20 bp, mouse
ggctttgacgatggtcccta

SEQ ID NO: 427340 - DNA, 20 bp, mouse
gctcttcctgggaatacctt

SEQ ID NO: 427341 - DNA, 20 bp, mouse
gtgaagcgcacgagacactc

SEQ ID NO: 427342 - DNA, 20 bp, mouse
gtatagtgaaggaaggccaa

SEQ ID NO: 427343 - DNA, 20 bp, mouse
gttgtctcttcccatgacca

SEQ ID NO: 427344 - DNA, 20 bp, mouse
gtaatcaacagtaactgcca

SEQ ID NO: 427345 - DNA, 20 bp, mouse
gaacaggtattttaaggtct

SEQ ID NO: 427346 - DNA, 20 bp, mouse
gcatggagctgtctctccag

SEQ ID NO: 427347 - DNA, 20 bp, mouse
ggaggcctcccgctggaatc

SEQ ID NO: 427348 - DNA, 20 bp, mouse
gctctccaggggaagcacta

SEQ ID NO: 427349 - DNA, 20 bp, mouse
ggctccatgaggcctcccgc

SEQ ID NO: 427350 - DNA, 20 bp, mouse
ggagaagagagttaacatca

SEQ ID NO: 427351 - DNA, 20 bp, mouse
gtccacctgattccagcggg

SEQ ID NO: 427352 - DNA, 20 bp, mouse
gctctccacctgattccagc

SEQ ID NO: 427353 - DNA, 20 bp, mouse
gatagggtagcagcactgta

SEQ ID NO: 427354 - DNA, 20 bp, mouse
gcacagggacttgtcccata

SEQ ID NO: 427355 - DNA, 20 bp, mouse
gggactcgtagcctgagctc

SEQ ID NO: 427356 - DNA, 20 bp, mouse
gtgctgtagggaccccacta

SEQ ID NO: 427357 - DNA, 20 bp, mouse
gcagcagctgcaggacatga

SEQ ID NO: 427358 - DNA, 20 bp, mouse
gggaagggctggagaacgga

SEQ ID NO: 427359 - DNA, 20 bp, mouse
gccagctccacaccttagtg

SEQ ID NO: 427360 - DNA, 20 bp, mouse
gatgcgccacgcaggagcgc

SEQ ID NO: 427361 - DNA, 20 bp, mouse
gtcctgggatgaggtgtgat

SEQ ID NO: 427362 - DNA, 20 bp, mouse
gggactgagcctgctctctt

SEQ ID NO: 427363 - DNA, 20 bp, mouse
gaagccggaggtgcaggacc

SEQ ID NO: 427364 - DNA, 20 bp, mouse
ggccaggctcctccagggtc

SEQ ID NO: 427365 - DNA, 20 bp, mouse
ggtggccctgggcactctca

SEQ ID NO: 427366 - DNA, 20 bp, mouse
ggcgcgggcagcagcgaagt

SEQ ID NO: 427367 - DNA, 20 bp, mouse
gcgtgcagcaggatgactat

SEQ ID NO: 427368 - DNA, 20 bp, mouse
gggaggccctcaggagacca

SEQ ID NO: 427369 - DNA, 20 bp, mouse
gacccagtgaatcacccttc

SEQ ID NO: 427370 - DNA, 20 bp, mouse
gtgccagaagggtgattcac

SEQ ID NO: 427371 - DNA, 20 bp, mouse
gctggcctgctctgccagaa

SEQ ID NO: 427372 - DNA, 20 bp, mouse
gctgggactggctcgagcca

SEQ ID NO: 427373 - DNA, 20 bp, mouse
gcgtgggtgaagctcacagt

SEQ ID NO: 427374 - DNA, 20 bp, mouse
ggcaagtgctcagagagatc

SEQ ID NO: 427375 - DNA, 20 bp, mouse
gctggctcctgatcccctct

SEQ ID NO: 427376 - DNA, 20 bp, mouse
gagaagaagcttagtgatca

SEQ ID NO: 427377 - DNA, 20 bp, mouse
gaaaagcaggagcgatgcat

SEQ ID NO: 427378 - DNA, 20 bp, mouse
gaagctcttcgaggcagcag

SEQ ID NO: 427379 - DNA, 20 bp, mouse
gaggagcgatgcatgggcag

SEQ ID NO: 427380 - DNA, 20 bp, mouse
gtgcctcgaagagcttaagc

SEQ ID NO: 427381 - DNA, 20 bp, mouse
gtgctcctggctgttccaca

SEQ ID NO: 427382 - DNA, 20 bp, mouse
gtaccagcttaagctcttcg

SEQ ID NO: 427383 - DNA, 20 bp, mouse
gcaaagaataaaatgcgaac

SEQ ID NO: 427384 - DNA, 20 bp, mouse
gatggacttcagctcttgcc

SEQ ID NO: 427385 - DNA, 20 bp, mouse
ggacggctatgtatatgcct

SEQ ID NO: 427386 - DNA, 20 bp, mouse
gggcagggccgggcccgaca

SEQ ID NO: 427387 - DNA, 20 bp, mouse
gggaagacgcgaagcaatag

SEQ ID NO: 427388 - DNA, 20 bp, mouse
ggcccgacatggcggaaggt

SEQ ID NO: 427389 - DNA, 20 bp, mouse
gagggccgggcccgacatgg

SEQ ID NO: 427390 - DNA, 20 bp, mouse
gagccggacaacccttccag

SEQ ID NO: 427391 - DNA, 20 bp, mouse
gccgggcccgacatggcgga

SEQ ID NO: 427392 - DNA, 20 bp, mouse
gtatcgcgaggctgtaggca

SEQ ID NO: 427393 - DNA, 20 bp, mouse
gggaaggtaggttttttgtg

SEQ ID NO: 427394 - DNA, 20 bp, mouse
ggaagcaataggggtaccac

SEQ ID NO: 427395 - DNA, 20 bp, mouse
ggcgaggctgtaggcagggc

SEQ ID NO: 427396 - DNA, 20 bp, mouse
ggccgcggctgatcccggga

SEQ ID NO: 427397 - DNA, 20 bp, mouse
gggctgatcccgggaaggtg

SEQ ID NO: 427398 - DNA, 20 bp, mouse
gtagtggcgctgctgggacg

SEQ ID NO: 427399 - DNA, 20 bp, mouse
ggggcgggaggcagcaggtt

SEQ ID NO: 427400 - DNA, 20 bp, mouse
ggcggtggccgcgagtgact

SEQ ID NO: 427401 - DNA, 20 bp, mouse
gtcactcgcggccaccgccg

SEQ ID NO: 427402 - DNA, 20 bp, mouse
gccagcccgacccctcccgg

SEQ ID NO: 427403 - DNA, 20 bp, mouse
gcgggaaggtgaggagcagc

SEQ ID NO: 427404 - DNA, 20 bp, mouse
ggcctccccaaagagcctca

SEQ ID NO: 427405 - DNA, 20 bp, mouse
gccaccgccgcggctgatcc

SEQ ID NO: 427406 - DNA, 20 bp, mouse
gcgcgcgaagtggcacggac

SEQ ID NO: 427407 - DNA, 20 bp, mouse
gcacggaccggcacgaacgg

SEQ ID NO: 427408 - DNA, 20 bp, mouse
gctgcggccgccgcgcgaag

SEQ ID NO: 427409 - DNA, 20 bp, mouse
gtggcacggaccggcacgaa

SEQ ID NO: 427410 - DNA, 20 bp, mouse
gctcaggctatggaggaggg

SEQ ID NO: 427411 - DNA, 20 bp, mouse
ggcggcggccgcagctgtct

SEQ ID NO: 427412 - DNA, 20 bp, mouse
ggccgcagctgtctgggagc

SEQ ID NO: 427413 - DNA, 20 bp, mouse
gcgcccggcgagctcacact

SEQ ID NO: 427414 - DNA, 20 bp, mouse
ggcgcgcagcgggagaagat

SEQ ID NO: 427415 - DNA, 20 bp, mouse
ggtgagctcgcggggtttgg

SEQ ID NO: 427416 - DNA, 20 bp, mouse
gatccctcgtgaagacggtg

SEQ ID NO: 427417 - DNA, 20 bp, mouse
gtcgctgccagagtaaggtg

SEQ ID NO: 427418 - DNA, 20 bp, mouse
gcaagggaccgactgccatg

SEQ ID NO: 427419 - DNA, 20 bp, mouse
gagaggcacaggggagtgta

SEQ ID NO: 427420 - DNA, 20 bp, mouse
gagagtaaggtgcggtgcag

SEQ ID NO: 427421 - DNA, 20 bp, mouse
gagcctcaccgtcttcacga

SEQ ID NO: 427422 - DNA, 20 bp, mouse
ggtcccttggcgcagcagct

SEQ ID NO: 427423 - DNA, 20 bp, mouse
gggcacctagtagccagtgg

SEQ ID NO: 427424 - DNA, 20 bp, mouse
gaccttgctgaagccaccac

SEQ ID NO: 427425 - DNA, 20 bp, mouse
gactctggcagcgagctggg

SEQ ID NO: 427426 - DNA, 20 bp, mouse
gctagcagcactacgcgagg

SEQ ID NO: 427427 - DNA, 20 bp, mouse
ggcagcactacgcgaggagg

SEQ ID NO: 427428 - DNA, 20 bp, mouse
gcagagggcggtgactccta

SEQ ID NO: 427429 - DNA, 20 bp, mouse
gctgctagcagcactacgcg

SEQ ID NO: 427430 - DNA, 20 bp, mouse
gagtatcggccatgtcccat

SEQ ID NO: 427431 - DNA, 20 bp, mouse
gcggtgactcctatgggaca

SEQ ID NO: 427432 - DNA, 20 bp, mouse
gcgaggaggaggcgcggtga

SEQ ID NO: 427433 - DNA, 20 bp, mouse
ggagctgctgcgcctcggag

SEQ ID NO: 427434 - DNA, 20 bp, mouse
gctcggagcggaccccaacc

SEQ ID NO: 427435 - DNA, 20 bp, mouse
ggcggaccccaacctggtgt

SEQ ID NO: 427436 - DNA, 20 bp, mouse
gagcccgcctggtctaacca

SEQ ID NO: 427437 - DNA, 20 bp, mouse
ggtggccgcacagccaggta

SEQ ID NO: 427438 - DNA, 20 bp, mouse
ggcccggccgtggttagacc

SEQ ID NO: 427439 - DNA, 20 bp, mouse
gggtccgccggctagagaag

SEQ ID NO: 427440 - DNA, 20 bp, mouse
gccggaggcgggagcgacgc

SEQ ID NO: 427441 - DNA, 20 bp, mouse
gaaccacggccgggcggagg

SEQ ID NO: 427442 - DNA, 20 bp, mouse
gcggctggctgtggtggagt

SEQ ID NO: 427443 - DNA, 20 bp, mouse
gtctaaccacggccgggcgg

SEQ ID NO: 427444 - DNA, 20 bp, mouse
ggtcttctgagggccggagg

SEQ ID NO: 427445 - DNA, 20 bp, mouse
ggtaaggcagcgtcagtcgt

SEQ ID NO: 427446 - DNA, 20 bp, mouse
gaccaagtgtctcagagtaa

SEQ ID NO: 427447 - DNA, 20 bp, mouse
gagcctcggccactgacctc

SEQ ID NO: 427448 - DNA, 20 bp, mouse
gccctcagaaccgtggacag

SEQ ID NO: 427449 - DNA, 20 bp, mouse
gcttggtgtgatttagacca

SEQ ID NO: 427450 - DNA, 20 bp, mouse
gaagccctcaggagctagag

SEQ ID NO: 427451 - DNA, 20 bp, mouse
gcttcagcagaccgaaacct

SEQ ID NO: 427452 - DNA, 20 bp, mouse
gggagtggtcgccactgtaa

SEQ ID NO: 427453 - DNA, 20 bp, mouse
gtccattactctgagacact

SEQ ID NO: 427454 - DNA, 20 bp, mouse
ggccgaggctagatcccaca

SEQ ID NO: 427455 - DNA, 20 bp, mouse
gcctttccccgaactcccat

SEQ ID NO: 427456 - DNA, 20 bp, mouse
gtgaagtggcagagtcgcta

SEQ ID NO: 427457 - DNA, 20 bp, mouse
gcagagtcgctagggtctca

SEQ ID NO: 427458 - DNA, 20 bp, mouse
ggccacagcaaggcaactcg

SEQ ID NO: 427459 - DNA, 20 bp, mouse
ggcgactctgccacttcact

SEQ ID NO: 427460 - DNA, 20 bp, mouse
ggtggaagaccgccacagca

SEQ ID NO: 427461 - DNA, 20 bp, mouse
gcagcaaggcaactcgaggc

SEQ ID NO: 427462 - DNA, 20 bp, mouse
ggctagggtctcacggctgg

SEQ ID NO: 427463 - DNA, 20 bp, mouse
ggaagtgatcgggaaaggta

SEQ ID NO: 427464 - DNA, 20 bp, mouse
gcctaggcccggaggacctt

SEQ ID NO: 427465 - DNA, 20 bp, mouse
gaagagacgtgtatgcgtcg

SEQ ID NO: 427466 - DNA, 20 bp, mouse
gtccgagaggatgggctacg

SEQ ID NO: 427467 - DNA, 20 bp, mouse
gccggaactgaggcgatcca

SEQ ID NO: 427468 - DNA, 20 bp, mouse
ggaaggcgagacgactccca

SEQ ID NO: 427469 - DNA, 20 bp, mouse
ggatgggctacggggcgcta

SEQ ID NO: 427470 - DNA, 20 bp, mouse
gccatcctctcggagaacca

SEQ ID NO: 427471 - DNA, 20 bp, mouse
gctccaatgacccggaactg

SEQ ID NO: 427472 - DNA, 20 bp, mouse
gcaatggaagctaatcacag

SEQ ID NO: 427473 - DNA, 20 bp, mouse
gcgatccatggttctccgag

SEQ ID NO: 427474 - DNA, 20 bp, mouse
gtccagaggagataaaagat

SEQ ID NO: 427475 - DNA, 20 bp, mouse
gagcccagagcgttcggtga

SEQ ID NO: 427476 - DNA, 20 bp, mouse
gctcacggctgccaacatga

SEQ ID NO: 427477 - DNA, 20 bp, mouse
gagagaaaaacatagactca

SEQ ID NO: 427478 - DNA, 20 bp, mouse
ggtactgagagtagaggagc

SEQ ID NO: 427479 - DNA, 20 bp, mouse
gggtgtggaggggctccaca

SEQ ID NO: 427480 - DNA, 20 bp, mouse
gcactcaaccaccttctctt

SEQ ID NO: 427481 - DNA, 20 bp, mouse
gtggctgtcgctggatggag

SEQ ID NO: 427482 - DNA, 20 bp, mouse
gtctcttgtggatgaacccc

SEQ ID NO: 427483 - DNA, 20 bp, mouse
gacccctggaactggccctg

SEQ ID NO: 427484 - DNA, 20 bp, mouse
gataacgggctggtgtggag

SEQ ID NO: 427485 - DNA, 20 bp, mouse
gagcgacagccaccttcagg

SEQ ID NO: 427486 - DNA, 20 bp, mouse
gccactcgaacacaaaggac

SEQ ID NO: 427487 - DNA, 20 bp, mouse
gctcggatgcggatgggacg

SEQ ID NO: 427488 - DNA, 20 bp, mouse
gcagcttcgcaggccttcac

SEQ ID NO: 427489 - DNA, 20 bp, mouse
gtgccgccactcgaacacaa

SEQ ID NO: 427490 - DNA, 20 bp, mouse
ggctgcgctcggatgcggat

SEQ ID NO: 427491 - DNA, 20 bp, mouse
gtgctcgctgcgctcggatg

SEQ ID NO: 427492 - DNA, 20 bp, mouse
gccgtagaaggagtcctcag

SEQ ID NO: 427493 - DNA, 20 bp, mouse
gatcggccagaggaatgtgc

SEQ ID NO: 427494 - DNA, 20 bp, mouse
gcgagcgcagcgagcactga

SEQ ID NO: 427495 - DNA, 20 bp, mouse
gcagaggaatgtgccggtga

SEQ ID NO: 427496 - DNA, 20 bp, mouse
gaccagtgttgctcaggaat

SEQ ID NO: 427497 - DNA, 20 bp, mouse
gatgggtatgaactccagca

SEQ ID NO: 427498 - DNA, 20 bp, mouse
gatgcaagaagcagtactca

SEQ ID NO: 427499 - DNA, 20 bp, mouse
gcagggcagtatgctctgaa

SEQ ID NO: 427500 - DNA, 20 bp, mouse
gacccattcctgagcaacac

SEQ ID NO: 427501 - DNA, 20 bp, mouse
gccccaggagatttcatggt

SEQ ID NO: 427502 - DNA, 20 bp, mouse
ggcaaaaaccagtgttgctc

SEQ ID NO: 427503 - DNA, 20 bp, mouse
gccctgagcaaacctcaatc

SEQ ID NO: 427504 - DNA, 20 bp, mouse
ggcctaccatgaaatctcct

SEQ ID NO: 427505 - DNA, 20 bp, mouse
gaatgggcaggacaggtctg

SEQ ID NO: 427506 - DNA, 20 bp, mouse
ggagtctgtcccgggtacca

SEQ ID NO: 427507 - DNA, 20 bp, mouse
gagaacgctgtccaggagca

SEQ ID NO: 427508 - DNA, 20 bp, mouse
gatcgcggagaacgctgtcc

SEQ ID NO: 427509 - DNA, 20 bp, mouse
ggggggcgtggcgaccagag

SEQ ID NO: 427510 - DNA, 20 bp, mouse
ggggtctgtgcgggccaggg

SEQ ID NO: 427511 - DNA, 20 bp, mouse
gtcctccccggagccaggta

SEQ ID NO: 427512 - DNA, 20 bp, mouse
gcgcgagcacgtgacccggg

SEQ ID NO: 427513 - DNA, 20 bp, mouse
gcgggcggggcggccaccaa

SEQ ID NO: 427514 - DNA, 20 bp, mouse
gcgttctccgcgattggctg

SEQ ID NO: 427515 - DNA, 20 bp, mouse
gaccacagcctccttgctcc

SEQ ID NO: 427516 - DNA, 20 bp, mouse
gcgaccggccggagagcgag

SEQ ID NO: 427517 - DNA, 20 bp, mouse
gcaccagcctggacccgacg

SEQ ID NO: 427518 - DNA, 20 bp, mouse
gggccgaaccgccccgaaca

SEQ ID NO: 427519 - DNA, 20 bp, mouse
ggtgtcgcgggccgaggaca

SEQ ID NO: 427520 - DNA, 20 bp, mouse
gtggagcgcaccactggaag

SEQ ID NO: 427521 - DNA, 20 bp, mouse
ggccgagcgggtccccgagc

SEQ ID NO: 427522 - DNA, 20 bp, mouse
ggttcgcgagctgtcagcgc

SEQ ID NO: 427523 - DNA, 20 bp, mouse
gaagcgctctatggatcccg

SEQ ID NO: 427524 - DNA, 20 bp, mouse
gcggttcggccggcagcagt

SEQ ID NO: 427525 - DNA, 20 bp, mouse
gcgggcccccgagaccccgt

SEQ ID NO: 427526 - DNA, 20 bp, mouse
gcagcccgagcggacggtga

SEQ ID NO: 427527 - DNA, 20 bp, mouse
gtgtccctcaccgtccgctc

SEQ ID NO: 427528 - DNA, 20 bp, mouse
gggctgagggccgggctatg

SEQ ID NO: 427529 - DNA, 20 bp, mouse
ggacgcgcgcccgcaccctc

SEQ ID NO: 427530 - DNA, 20 bp, mouse
gggagggagcgggcactcgg

SEQ ID NO: 427531 - DNA, 20 bp, mouse
gggccctcagcccgagcgga

SEQ ID NO: 427532 - DNA, 20 bp, mouse
gaagcgaatgcggggaagag

SEQ ID NO: 427533 - DNA, 20 bp, mouse
ggccgggctatgcggcttag

SEQ ID NO: 427534 - DNA, 20 bp, mouse
gacacaaagacgcctctcgg

SEQ ID NO: 427535 - DNA, 20 bp, mouse
gtgagggacaagcgaatgcg

SEQ ID NO: 427536 - DNA, 20 bp, mouse
gtgagggaggttgacaaaca

SEQ ID NO: 427537 - DNA, 20 bp, mouse
gacctccctcagaacgacgt

SEQ ID NO: 427538 - DNA, 20 bp, mouse
ggccgccgcggagtgttaga

SEQ ID NO: 427539 - DNA, 20 bp, mouse
ggtgctctgggccttcgtaa

SEQ ID NO: 427540 - DNA, 20 bp, mouse
ggagaggagccggggaaaga

SEQ ID NO: 427541 - DNA, 20 bp, mouse
gcctctcgcgagagcttcgg

SEQ ID NO: 427542 - DNA, 20 bp, mouse
ggccctctaacactccgcgg

SEQ ID NO: 427543 - DNA, 20 bp, mouse
gcgacgtaggaagacaccac

SEQ ID NO: 427544 - DNA, 20 bp, mouse
gtcctacgtcgttctgaggg

SEQ ID NO: 427545 - DNA, 20 bp, mouse
gcgtcacgtccgatatccgg

SEQ ID NO: 427546 - DNA, 20 bp, mouse
gagcgggtgcggctgaggtg

SEQ ID NO: 427547 - DNA, 20 bp, mouse
ggccgcagcaagagcgaagg

SEQ ID NO: 427548 - DNA, 20 bp, mouse
gctgcggcggcttctagcag

SEQ ID NO: 427549 - DNA, 20 bp, mouse
gcttctagcaggggtccgcg

SEQ ID NO: 427550 - DNA, 20 bp, mouse
gcgcaaggtgaggccctgaa

SEQ ID NO: 427551 - DNA, 20 bp, mouse
ggccgccttcgctcttgctg

SEQ ID NO: 427552 - DNA, 20 bp, mouse
gccggctagtctgggcgaac

SEQ ID NO: 427553 - DNA, 20 bp, mouse
gctgcggagcacagcagggg

SEQ ID NO: 427554 - DNA, 20 bp, mouse
gccgaatcggatccccttca

SEQ ID NO: 427555 - DNA, 20 bp, mouse
gccggtgcagcgggaaggtg

SEQ ID NO: 427556 - DNA, 20 bp, mouse
gagaggcgccgcggatcccc

SEQ ID NO: 427557 - DNA, 20 bp, mouse
ggaccaggatggacaaaagt

SEQ ID NO: 427558 - DNA, 20 bp, mouse
gcagtcccggtggcccatag

SEQ ID NO: 427559 - DNA, 20 bp, mouse
gctgctctaagactgaacct

SEQ ID NO: 427560 - DNA, 20 bp, mouse
gcaggatggacaaaagtagg

SEQ ID NO: 427561 - DNA, 20 bp, mouse
gtccgtggcgtgctgcacag

SEQ ID NO: 427562 - DNA, 20 bp, mouse
gatcctagcgtacctagtgg

SEQ ID NO: 427563 - DNA, 20 bp, mouse
gagctaggttccagggtggt

SEQ ID NO: 427564 - DNA, 20 bp, mouse
ggatatcctagcgtacctag

SEQ ID NO: 427565 - DNA, 20 bp, mouse
gccatcctggtccagggcga

SEQ ID NO: 427566 - DNA, 20 bp, mouse
ggcagtagaggtgaccgagg

SEQ ID NO: 427567 - DNA, 20 bp, mouse
ggcggcagtagaggtgaccg

SEQ ID NO: 427568 - DNA, 20 bp, mouse
ggtagaggtgaccgaggcgg

SEQ ID NO: 427569 - DNA, 20 bp, mouse
gcccggcgcgaccgaagtcg

SEQ ID NO: 427570 - DNA, 20 bp, mouse
gggagaagggagtcccccgg

SEQ ID NO: 427571 - DNA, 20 bp, mouse
ggcagtggcggccccccccg

SEQ ID NO: 427572 - DNA, 20 bp, mouse
gccatccccgcgggaagagg

SEQ ID NO: 427573 - DNA, 20 bp, mouse
ggagggagaagggagtcccc

SEQ ID NO: 427574 - DNA, 20 bp, mouse
gcggagcgctgtgtcggccc

SEQ ID NO: 427575 - DNA, 20 bp, mouse
ggaccgaagtcgcggtagag

SEQ ID NO: 427576 - DNA, 20 bp, mouse
gaccatggaggggcccgagg

SEQ ID NO: 427577 - DNA, 20 bp, mouse
gaccgcctcgggcccctcca

SEQ ID NO: 427578 - DNA, 20 bp, mouse
gcgctgctcgatgagctctg

SEQ ID NO: 427579 - DNA, 20 bp, mouse
ggtcatggagggtaccatgg

SEQ ID NO: 427580 - DNA, 20 bp, mouse
gacagtcatggagggtacca

SEQ ID NO: 427581 - DNA, 20 bp, mouse
ggagcagcggcttgcccagg

SEQ ID NO: 427582 - DNA, 20 bp, mouse
gcttgcagaaacagtcatgg

SEQ ID NO: 427583 - DNA, 20 bp, mouse
gtggctctctgcaccgcctc

SEQ ID NO: 427584 - DNA, 20 bp, mouse
gtcttgaagcccaggtgagt

SEQ ID NO: 427585 - DNA, 20 bp, mouse
ggcaaacaggcacttggagg

SEQ ID NO: 427586 - DNA, 20 bp, mouse
ggtatcactgttacagccag

SEQ ID NO: 427587 - DNA, 20 bp, mouse
ggtacctctgccagtggagg

SEQ ID NO: 427588 - DNA, 20 bp, mouse
gcatgtacctctgccagtgg

SEQ ID NO: 427589 - DNA, 20 bp, mouse
ggcagtagtgaatcttctag

SEQ ID NO: 427590 - DNA, 20 bp, mouse
gctgccgcctccactggcag

SEQ ID NO: 427591 - DNA, 20 bp, mouse
gactcagaaaccggttcccc

SEQ ID NO: 427592 - DNA, 20 bp, mouse
gaggtacatgactcagaaac

SEQ ID NO: 427593 - DNA, 20 bp, mouse
gggtccctggaagtccaagc

SEQ ID NO: 427594 - DNA, 20 bp, mouse
ggtggaggcggcagtaaaaa

SEQ ID NO: 427595 - DNA, 20 bp, mouse
gtgaacataggagtccgaag

SEQ ID NO: 427596 - DNA, 20 bp, mouse
gctaggtgcatggagagcaa

SEQ ID NO: 427597 - DNA, 20 bp, mouse
gtcaatgctgatgaagtcca

SEQ ID NO: 427598 - DNA, 20 bp, mouse
gggagagcaaggggggacca

SEQ ID NO: 427599 - DNA, 20 bp, mouse
ggtaaggatgtgaggaggat

SEQ ID NO: 427600 - DNA, 20 bp, mouse
gcagcattgagcagttggta

SEQ ID NO: 427601 - DNA, 20 bp, mouse
ggcgaagtctggctgagtga

SEQ ID NO: 427602 - DNA, 20 bp, mouse
gagtctggctgagtgagggt

SEQ ID NO: 427603 - DNA, 20 bp, mouse
ggaaggagctgcgagaggat

SEQ ID NO: 427604 - DNA, 20 bp, mouse
ggggtcaggtctcatgtgag

SEQ ID NO: 427605 - DNA, 20 bp, mouse
gccttgtcctgaatcttcag

SEQ ID NO: 427606 - DNA, 20 bp, mouse
gcaaacgcctaccgcgaagg

SEQ ID NO: 427607 - DNA, 20 bp, mouse
gcacaggcacagctgcttca

SEQ ID NO: 427608 - DNA, 20 bp, mouse
gttcatggcgaaccgcagga

SEQ ID NO: 427609 - DNA, 20 bp, mouse
gtgtgctgctgcctccttcg

SEQ ID NO: 427610 - DNA, 20 bp, mouse
gatctggccccgccctcctg

SEQ ID NO: 427611 - DNA, 20 bp, mouse
gacccaaacgcctaccgcga

SEQ ID NO: 427612 - DNA, 20 bp, mouse
gaaagaggggaaggcgcaga

SEQ ID NO: 427613 - DNA, 20 bp, mouse
gctgctgcctccttcgcggt

SEQ ID NO: 427614 - DNA, 20 bp, mouse
gaggtaggcgtggtctgatc

SEQ ID NO: 427615 - DNA, 20 bp, mouse
gtggcgaaccgcaggagggc

SEQ ID NO: 427616 - DNA, 20 bp, mouse
gagacgcacgggatcccacc

SEQ ID NO: 427617 - DNA, 20 bp, mouse
gcagagggtacgcccctcac

SEQ ID NO: 427618 - DNA, 20 bp, mouse
ggcgcggcagcaagaaggcg

SEQ ID NO: 427619 - DNA, 20 bp, mouse
ggggcctgtgtgagcatgcg

SEQ ID NO: 427620 - DNA, 20 bp, mouse
gaaagccggcctagacgcac

SEQ ID NO: 427621 - DNA, 20 bp, mouse
gttggacgcgagagtgctag

SEQ ID NO: 427622 - DNA, 20 bp, mouse
ggatatgggcaagatccaca

SEQ ID NO: 427623 - DNA, 20 bp, mouse
gccccaaagccagacaaggt

SEQ ID NO: 427624 - DNA, 20 bp, mouse
gatgcagcgtctttcccggt

SEQ ID NO: 427625 - DNA, 20 bp, mouse
ggcccgcgcagcaactgcgt

SEQ ID NO: 427626 - DNA, 20 bp, mouse
gtggagccaccgcacccggg

SEQ ID NO: 427627 - DNA, 20 bp, mouse
ggagtggagccaccgcaccc

SEQ ID NO: 427628 - DNA, 20 bp, mouse
gaacggcggagtaaagaggt

SEQ ID NO: 427629 - DNA, 20 bp, mouse
ggcactcaggtcccagccca

SEQ ID NO: 427630 - DNA, 20 bp, mouse
gaggtgctgtcgtagcacag

SEQ ID NO: 427631 - DNA, 20 bp, mouse
ggacctgagtgcccaccacc

SEQ ID NO: 427632 - DNA, 20 bp, mouse
ggcccaccacccgggtgcgg

SEQ ID NO: 427633 - DNA, 20 bp, mouse
gggagcagggttccgcccaa

SEQ ID NO: 427634 - DNA, 20 bp, mouse
ggcagggttccgcccaacgg

SEQ ID NO: 427635 - DNA, 20 bp, mouse
ggacagcacctcccggaccc

SEQ ID NO: 427636 - DNA, 20 bp, mouse
ggcgggtagtggccgaacag

SEQ ID NO: 427637 - DNA, 20 bp, mouse
gtggtggtaatattgtggag

SEQ ID NO: 427638 - DNA, 20 bp, mouse
ggaggtggctgagagctaga

SEQ ID NO: 427639 - DNA, 20 bp, mouse
gggcggtggtggtaatattg

SEQ ID NO: 427640 - DNA, 20 bp, mouse
gcccgcgcggccgccaatcg

SEQ ID NO: 427641 - DNA, 20 bp, mouse
ggctacgttgaagagagcgc

SEQ ID NO: 427642 - DNA, 20 bp, mouse
gtccttggaggaggcgggac

SEQ ID NO: 427643 - DNA, 20 bp, mouse
ggcgcggccgccaatcgcgg

SEQ ID NO: 427644 - DNA, 20 bp, mouse
gagagggcgggagtccttgg

SEQ ID NO: 427645 - DNA, 20 bp, mouse
gcgaccaggtaggtgagggg

SEQ ID NO: 427646 - DNA, 20 bp, mouse
ggagcgagcggggaccgagc

SEQ ID NO: 427647 - DNA, 20 bp, mouse
ggcgggcgcagagagcgagc

SEQ ID NO: 427648 - DNA, 20 bp, mouse
ggcgcccgcccgccgcagag

SEQ ID NO: 427649 - DNA, 20 bp, mouse
gcccgcccgccgcagagggg

SEQ ID NO: 427650 - DNA, 20 bp, mouse
gagcgcagcgcaggacggga

SEQ ID NO: 427651 - DNA, 20 bp, mouse
gcctcggccgctgacagaca

SEQ ID NO: 427652 - DNA, 20 bp, mouse
gggaccgagcggggaccggc

SEQ ID NO: 427653 - DNA, 20 bp, mouse
gggaccggcgggcggtggca

SEQ ID NO: 427654 - DNA, 20 bp, mouse
gccgcccgccggtccccgct

SEQ ID NO: 427655 - DNA, 20 bp, mouse
gtagtaacaggccaaggctg

SEQ ID NO: 427656 - DNA, 20 bp, mouse
gggagcagggagtcctacgg

SEQ ID NO: 427657 - DNA, 20 bp, mouse
ggggcgacgactaccaccgt

SEQ ID NO: 427658 - DNA, 20 bp, mouse
gcgtcttgcgaagctgccgg

SEQ ID NO: 427659 - DNA, 20 bp, mouse
gtcgcccctaccgccaccac

SEQ ID NO: 427660 - DNA, 20 bp, mouse
gaggacggccgggaagtcag

SEQ ID NO: 427661 - DNA, 20 bp, mouse
gctccctgctccaataaact

SEQ ID NO: 427662 - DNA, 20 bp, mouse
gcttgcgaagctgccggtgg

SEQ ID NO: 427663 - DNA, 20 bp, mouse
gccgggcaggccgagatcgg

SEQ ID NO: 427664 - DNA, 20 bp, mouse
ggctgccggtggtggcggta

SEQ ID NO: 427665 - DNA, 20 bp, mouse
gcttcccggccgaagcttct

SEQ ID NO: 427666 - DNA, 20 bp, mouse
gtatcagctaccccacagaa

SEQ ID NO: 427667 - DNA, 20 bp, mouse
ggctcactagcccttctgtg

SEQ ID NO: 427668 - DNA, 20 bp, mouse
gacagcagagggccagcctg

SEQ ID NO: 427669 - DNA, 20 bp, mouse
gctctgcctagacccaagac

SEQ ID NO: 427670 - DNA, 20 bp, mouse
ggaccctagagtcccaggta

SEQ ID NO: 427671 - DNA, 20 bp, mouse
gaaccttacctgggactcta

SEQ ID NO: 427672 - DNA, 20 bp, mouse
gcagaggtgagacaccctcc

SEQ ID NO: 427673 - DNA, 20 bp, mouse
ggggtctccatcacagcaga

SEQ ID NO: 427674 - DNA, 20 bp, mouse
gctagtgagcttttgaggtg

SEQ ID NO: 427675 - DNA, 20 bp, mouse
ggagtcactattgccccgag

SEQ ID NO: 427676 - DNA, 20 bp, mouse
ggaacgcaggggccaagggt

SEQ ID NO: 427677 - DNA, 20 bp, mouse
gccggaggcgaggaagagta

SEQ ID NO: 427678 - DNA, 20 bp, mouse
ggctcccggtgcaaagtcac

SEQ ID NO: 427679 - DNA, 20 bp, mouse
gcagacaggagaagacccag

SEQ ID NO: 427680 - DNA, 20 bp, mouse
gctgcgaacgcaggggccaa

SEQ ID NO: 427681 - DNA, 20 bp, mouse
gctgtctgctcgctacgggg

SEQ ID NO: 427682 - DNA, 20 bp, mouse
gcaccgggagcgcagccgcc

SEQ ID NO: 427683 - DNA, 20 bp, mouse
gctgccaggctggagcgcgc

SEQ ID NO: 427684 - DNA, 20 bp, mouse
gcccggaggtcaccgaccct

SEQ ID NO: 427685 - DNA, 20 bp, mouse
gcctggagctgctttctgcc

SEQ ID NO: 427686 - DNA, 20 bp, mouse
ggcacagatactgacaccaa

SEQ ID NO: 427687 - DNA, 20 bp, mouse
gggaccaggattcagcgctg

SEQ ID NO: 427688 - DNA, 20 bp, mouse
gtggaggagccgggtacctg

SEQ ID NO: 427689 - DNA, 20 bp, mouse
gactgacaccaagggaatcc

SEQ ID NO: 427690 - DNA, 20 bp, mouse
gccacatggcgtgtgtgggg

SEQ ID NO: 427691 - DNA, 20 bp, mouse
gcgcaccgggaggagggacc

SEQ ID NO: 427692 - DNA, 20 bp, mouse
gccggggcgcaccgggagga

SEQ ID NO: 427693 - DNA, 20 bp, mouse
gggaagaacaaggagcaatg

SEQ ID NO: 427694 - DNA, 20 bp, mouse
ggtgccccagcgctgaatcc

SEQ ID NO: 427695 - DNA, 20 bp, mouse
gggacccacatggcgtgtgt

SEQ ID NO: 427696 - DNA, 20 bp, mouse
ggcgggcgcgtcactcccag

SEQ ID NO: 427697 - DNA, 20 bp, mouse
ggggccacgaagcgctggag

SEQ ID NO: 427698 - DNA, 20 bp, mouse
gggcccggtgacacggacag

SEQ ID NO: 427699 - DNA, 20 bp, mouse
ggaagcgccagccccgcgtc

SEQ ID NO: 427700 - DNA, 20 bp, mouse
ggcgcacctcgccagacgcg

SEQ ID NO: 427701 - DNA, 20 bp, mouse
gcaggcgggccacgaagcgc

SEQ ID NO: 427702 - DNA, 20 bp, mouse
gagggtctccgtccccacac

SEQ ID NO: 427703 - DNA, 20 bp, mouse
ggtccgagcaggagccgatc

SEQ ID NO: 427704 - DNA, 20 bp, mouse
gagctgcggtgtcaaatgtg

SEQ ID NO: 427705 - DNA, 20 bp, mouse
gtgcgagactgaggcaccga

SEQ ID NO: 427706 - DNA, 20 bp, mouse
ggaagtattaaagaaatgtg

SEQ ID NO: 427707 - DNA, 20 bp, mouse
gttctgagcaagtcattcaa

SEQ ID NO: 427708 - DNA, 20 bp, mouse
gcttcaggttggctccagga

SEQ ID NO: 427709 - DNA, 20 bp, mouse
gcggctggagagcctttctc

SEQ ID NO: 427710 - DNA, 20 bp, mouse
gcagctagaagctgcagtct

SEQ ID NO: 427711 - DNA, 20 bp, mouse
gctgcaggactgggctgcgc

SEQ ID NO: 427712 - DNA, 20 bp, mouse
gtcctcctgcggcttcaggt

SEQ ID NO: 427713 - DNA, 20 bp, mouse
ggcccgctggcgcccgagaa

SEQ ID NO: 427714 - DNA, 20 bp, mouse
gaccacaagttggaagatca

SEQ ID NO: 427715 - DNA, 20 bp, mouse
gggaccaaggtagcatctct

SEQ ID NO: 427716 - DNA, 20 bp, mouse
ggccgtagccgagttgggtt

SEQ ID NO: 427717 - DNA, 20 bp, mouse
gtcctaacccaactcggcta

SEQ ID NO: 427718 - DNA, 20 bp, mouse
gggcacagccgtagccgagt

SEQ ID NO: 427719 - DNA, 20 bp, mouse
ggccggggctagggccacgg

SEQ ID NO: 427720 - DNA, 20 bp, mouse
gctagggccacggggggacg

SEQ ID NO: 427721 - DNA, 20 bp, mouse
ggagttgggttaggaacttg

SEQ ID NO: 427722 - DNA, 20 bp, mouse
gcggtaggtgccaaatgtgt

SEQ ID NO: 427723 - DNA, 20 bp, mouse
gacttgagagccagccaggg

SEQ ID NO: 427724 - DNA, 20 bp, mouse
gaagatgcgcttcatggccg

SEQ ID NO: 427725 - DNA, 20 bp, mouse
ggcgcgtccccgtccccccg

SEQ ID NO: 427726 - DNA, 20 bp, mouse
ggtcctgccaactgcctaag

SEQ ID NO: 427727 - DNA, 20 bp, mouse
gcaactgcctaagaggtgga

SEQ ID NO: 427728 - DNA, 20 bp, mouse
gcgcccacaaaagagcccca

SEQ ID NO: 427729 - DNA, 20 bp, mouse
gggagggatgctaaaccttg

SEQ ID NO: 427730 - DNA, 20 bp, mouse
gcgagattctgagacttggt

SEQ ID NO: 427731 - DNA, 20 bp, mouse
gaaccttggggctcttttgt

SEQ ID NO: 427732 - DNA, 20 bp, mouse
ggctggcggtggctaagact

SEQ ID NO: 427733 - DNA, 20 bp, mouse
gccatgaagaagatcttcaa

SEQ ID NO: 427734 - DNA, 20 bp, mouse
gcaagtctcagaatctcgcc

SEQ ID NO: 427735 - DNA, 20 bp, mouse
gctcttttgtgggcgcatcc

SEQ ID NO: 427736 - DNA, 20 bp, mouse
gctagcaccgcaagtataag

SEQ ID NO: 427737 - DNA, 20 bp, mouse
ggaaacactgaactgtgagt

SEQ ID NO: 427738 - DNA, 20 bp, mouse
ggcggcgtgtagccgttctg

SEQ ID NO: 427739 - DNA, 20 bp, mouse
ggcggtgctagaaaacaaac

SEQ ID NO: 427740 - DNA, 20 bp, mouse
ggccactctagaatgtcaca

SEQ ID NO: 427741 - DNA, 20 bp, mouse
gtacctcttgcagttatcca

SEQ ID NO: 427742 - DNA, 20 bp, mouse
gttatccagggcgtttatgt

SEQ ID NO: 427743 - DNA, 20 bp, mouse
gtacacgccgcttatacttg

SEQ ID NO: 427744 - DNA, 20 bp, mouse
gcgccctggataactgcaag

SEQ ID NO: 427745 - DNA, 20 bp, mouse
ggagccctgctgtatgctga

SEQ ID NO: 427746 - DNA, 20 bp, mouse
gcatcgcgctgggcagaacc

SEQ ID NO: 427747 - DNA, 20 bp, mouse
gtgtccccgggagttcagag

SEQ ID NO: 427748 - DNA, 20 bp, mouse
gtgcaggctagatctcccag

SEQ ID NO: 427749 - DNA, 20 bp, mouse
ggggctggggacatcgcgct

SEQ ID NO: 427750 - DNA, 20 bp, mouse
gctgggcagaaccaggccgt

SEQ ID NO: 427751 - DNA, 20 bp, mouse
gggtacgtgaggccgcagcg

SEQ ID NO: 427752 - DNA, 20 bp, mouse
gaggccgtgggaacgctccc

SEQ ID NO: 427753 - DNA, 20 bp, mouse
ggatgtccccagccccgctg

SEQ ID NO: 427754 - DNA, 20 bp, mouse
gctggccggtaagaatgcaa

SEQ ID NO: 427755 - DNA, 20 bp, mouse
gcccaggctggggagcggcg

SEQ ID NO: 427756 - DNA, 20 bp, mouse
gagccatccgcgcaaaggtg

SEQ ID NO: 427757 - DNA, 20 bp, mouse
gtaccccgggcaccgcacta

SEQ ID NO: 427758 - DNA, 20 bp, mouse
ggcaggagccatccgcgcaa

SEQ ID NO: 427759 - DNA, 20 bp, mouse
gtggtcaacctgggacggag

SEQ ID NO: 427760 - DNA, 20 bp, mouse
gggaggggtgggcatttcgt

SEQ ID NO: 427761 - DNA, 20 bp, mouse
gcaacctgggacggaggggt

SEQ ID NO: 427762 - DNA, 20 bp, mouse
ggagcgcttggctgcagtcc

SEQ ID NO: 427763 - DNA, 20 bp, mouse
gaggtgcggcgccgccatcc

SEQ ID NO: 427764 - DNA, 20 bp, mouse
ggcagtcccggccgccggga

SEQ ID NO: 427765 - DNA, 20 bp, mouse
gccagcgtctgctgtacccc

SEQ ID NO: 427766 - DNA, 20 bp, mouse
ggccttcggaggcgcggtgg

SEQ ID NO: 427767 - DNA, 20 bp, mouse
gcagccagggagctgtcggt

SEQ ID NO: 427768 - DNA, 20 bp, mouse
gcgagcagccagggagctgt

SEQ ID NO: 427769 - DNA, 20 bp, mouse
gccgcccaccgacagctccc

SEQ ID NO: 427770 - DNA, 20 bp, mouse
gccccggagccggccttcgg

SEQ ID NO: 427771 - DNA, 20 bp, mouse
gcacaccgaatagggtcccc

SEQ ID NO: 427772 - DNA, 20 bp, mouse
ggagccggccttcggaggcg

SEQ ID NO: 427773 - DNA, 20 bp, mouse
gggaggaggcctgggcctgc

SEQ ID NO: 427774 - DNA, 20 bp, mouse
gtggctgctcgcggccccgc

SEQ ID NO: 427775 - DNA, 20 bp, mouse
gggcgctgacaggctcgggg

SEQ ID NO: 427776 - DNA, 20 bp, mouse
gacgctggaaaacgactcgg

SEQ ID NO: 427777 - DNA, 20 bp, mouse
ggagacgctggaaaacgact

SEQ ID NO: 427778 - DNA, 20 bp, mouse
gtcagttcccgcagcctgga

SEQ ID NO: 427779 - DNA, 20 bp, mouse
ggctgcgggaactgagacgc

SEQ ID NO: 427780 - DNA, 20 bp, mouse
gaggagagcgttcccgccga

SEQ ID NO: 427781 - DNA, 20 bp, mouse
gagagcgttcccgccgacgg

SEQ ID NO: 427782 - DNA, 20 bp, mouse
gcgcctcaccaggatctctt

SEQ ID NO: 427783 - DNA, 20 bp, mouse
gacccgcgggcccaggaaac

SEQ ID NO: 427784 - DNA, 20 bp, mouse
ggcgcggagaccacagtctc

SEQ ID NO: 427785 - DNA, 20 bp, mouse
gcagcagagcagtccacggg

SEQ ID NO: 427786 - DNA, 20 bp, mouse
gggctctgagaggcaggcgg

SEQ ID NO: 427787 - DNA, 20 bp, mouse
gccaggagctgggctcgcga

SEQ ID NO: 427788 - DNA, 20 bp, mouse
ggcgcgcgggaaaggaagaa

SEQ ID NO: 427789 - DNA, 20 bp, mouse
gaaactctgcgagcaggtag

SEQ ID NO: 427790 - DNA, 20 bp, mouse
gggcggcggccgagcagtgg

SEQ ID NO: 427791 - DNA, 20 bp, mouse
ggacggcccgggaaagctcc

SEQ ID NO: 427792 - DNA, 20 bp, mouse
gcagctcctggagctttccc

SEQ ID NO: 427793 - DNA, 20 bp, mouse
gctctgcgagcaggtagggg

SEQ ID NO: 427794 - DNA, 20 bp, mouse
gctgcgactcccgcgagccg

SEQ ID NO: 427795 - DNA, 20 bp, mouse
ggttcgcggccggagagggt

SEQ ID NO: 427796 - DNA, 20 bp, mouse
ggtgaggtgagtaggagtcc

SEQ ID NO: 427797 - DNA, 20 bp, mouse
gtggagctgaggtcctgggt

SEQ ID NO: 427798 - DNA, 20 bp, mouse
gaggtcctgggtgggcgatg

SEQ ID NO: 427799 - DNA, 20 bp, mouse
ggccgtcgccatggtaaccg

SEQ ID NO: 427800 - DNA, 20 bp, mouse
gctcctactcacctcactca

SEQ ID NO: 427801 - DNA, 20 bp, mouse
gctcagggcccaggcttccg

SEQ ID NO: 427802 - DNA, 20 bp, mouse
gaagcccaccggacacacaa

SEQ ID NO: 427803 - DNA, 20 bp, mouse
gcgagggcgattccagggaa

SEQ ID NO: 427804 - DNA, 20 bp, mouse
gtgggcgatggggtgtgatg

SEQ ID NO: 427805 - DNA, 20 bp, mouse
gaaagtcgagggcgattcca

SEQ ID NO: 427806 - DNA, 20 bp, mouse
ggcgcccgcggcagcagtga

SEQ ID NO: 427807 - DNA, 20 bp, mouse
gccctcagaggagctgtcac

SEQ ID NO: 427808 - DNA, 20 bp, mouse
ggccgcgggcgcaggtacca

SEQ ID NO: 427809 - DNA, 20 bp, mouse
ggccctggtacctgcgcccg

SEQ ID NO: 427810 - DNA, 20 bp, mouse
ggtaccagggccggggccgt

SEQ ID NO: 427811 - DNA, 20 bp, mouse
gccgcctgtcgccgctggag

SEQ ID NO: 427812 - DNA, 20 bp, mouse
gcagctgctgcccacggccc

SEQ ID NO: 427813 - DNA, 20 bp, mouse
gggggcgcggacgaccacag

SEQ ID NO: 427814 - DNA, 20 bp, mouse
gacactgcccagggtatccg

SEQ ID NO: 427815 - DNA, 20 bp, mouse
gggcgcaggtaccagggccg

SEQ ID NO: 427816 - DNA, 20 bp, mouse
ggtgaggcgcgtgtccggag

SEQ ID NO: 427817 - DNA, 20 bp, mouse
ggcgcgtgtccggagcggtg

SEQ ID NO: 427818 - DNA, 20 bp, mouse
gcacctcgcaggtagcatcg

SEQ ID NO: 427819 - DNA, 20 bp, mouse
ggccgcccgccccaccgctc

SEQ ID NO: 427820 - DNA, 20 bp, mouse
gcgaaggggcgaacccggaa

SEQ ID NO: 427821 - DNA, 20 bp, mouse
ggtgaggttctctctgtgaa

SEQ ID NO: 427822 - DNA, 20 bp, mouse
gggaaaggaagttctcggtg

SEQ ID NO: 427823 - DNA, 20 bp, mouse
gcccttctgaggtcctgagg

SEQ ID NO: 427824 - DNA, 20 bp, mouse
gagcagcgaaggggcgaacc

SEQ ID NO: 427825 - DNA, 20 bp, mouse
gcgtgtccggagcggtgggg

SEQ ID NO: 427826 - DNA, 20 bp, mouse
ggcccggccgccccgcacag

SEQ ID NO: 427827 - DNA, 20 bp, mouse
gggcccgagctccgctacag

SEQ ID NO: 427828 - DNA, 20 bp, mouse
gggagcgccgctgtgcgggg

SEQ ID NO: 427829 - DNA, 20 bp, mouse
gcagccccgggaatccaaag

SEQ ID NO: 427830 - DNA, 20 bp, mouse
gacagtctttgcgccggcgg

SEQ ID NO: 427831 - DNA, 20 bp, mouse
ggaaggactgaggtaaccgc

SEQ ID NO: 427832 - DNA, 20 bp, mouse
gggcggagcgccgctgtgcg

SEQ ID NO: 427833 - DNA, 20 bp, mouse
ggagcggcggcagagagcac

SEQ ID NO: 427834 - DNA, 20 bp, mouse
ggctgagacagtctttgcgc

SEQ ID NO: 427835 - DNA, 20 bp, mouse
gtccgcctcgcacccgcctg

SEQ ID NO: 427836 - DNA, 20 bp, mouse
gctccaccggggacacgggg

SEQ ID NO: 427837 - DNA, 20 bp, mouse
gcacggggcggcccaggcgg

SEQ ID NO: 427838 - DNA, 20 bp, mouse
gatcgagctcgcggcagcgg

SEQ ID NO: 427839 - DNA, 20 bp, mouse
ggcggctccaccggggacac

SEQ ID NO: 427840 - DNA, 20 bp, mouse
gggacacccgctccacggag

SEQ ID NO: 427841 - DNA, 20 bp, mouse
gcgcatcgagctcgcggcag

SEQ ID NO: 427842 - DNA, 20 bp, mouse
gctgggccgccccgtgtccc

SEQ ID NO: 427843 - DNA, 20 bp, mouse
gacgcgagcccggggatgtg

SEQ ID NO: 427844 - DNA, 20 bp, mouse
gtgggctcgggagtcactgg

SEQ ID NO: 427845 - DNA, 20 bp, mouse
gtccgtccgcatcgagctcg

SEQ ID NO: 427846 - DNA, 20 bp, mouse
gaagcagggcccaagtgtac

SEQ ID NO: 427847 - DNA, 20 bp, mouse
gacgcgctgcctgtacactt

SEQ ID NO: 427848 - DNA, 20 bp, mouse
ggagtggtgtggctcctagg

SEQ ID NO: 427849 - DNA, 20 bp, mouse
gagtcctgcgcggagtggtg

SEQ ID NO: 427850 - DNA, 20 bp, mouse
gcccagccaggactcaaggg

SEQ ID NO: 427851 - DNA, 20 bp, mouse
gtggctggggccaaaggcgt

SEQ ID NO: 427852 - DNA, 20 bp, mouse
gtgtcacggaaagtgcaatc

SEQ ID NO: 427853 - DNA, 20 bp, mouse
gtctctgctcatagaaagca

SEQ ID NO: 427854 - DNA, 20 bp, mouse
gcccgcccatctgtacaagg

SEQ ID NO: 427855 - DNA, 20 bp, mouse
gggcccagtcctgcgcggag

SEQ ID NO: 427856 - DNA, 20 bp, mouse
gtcgctgtcagcgaacggac

SEQ ID NO: 427857 - DNA, 20 bp, mouse
gctcgctccgaaccgaccaa

SEQ ID NO: 427858 - DNA, 20 bp, mouse
gcagcgaggcttctcctgga

SEQ ID NO: 427859 - DNA, 20 bp, mouse
gtggagggaagcgggtccgt

SEQ ID NO: 427860 - DNA, 20 bp, mouse
gaagcctcgctgtcagcgaa

SEQ ID NO: 427861 - DNA, 20 bp, mouse
gctgtcagcgaacggacggg

SEQ ID NO: 427862 - DNA, 20 bp, mouse
ggggaagcgggtccgttggt

SEQ ID NO: 427863 - DNA, 20 bp, mouse
ggcgggtccgttggtcggtt

SEQ ID NO: 427864 - DNA, 20 bp, mouse
gccaccggcaaggaggtaca

SEQ ID NO: 427865 - DNA, 20 bp, mouse
ggcctcccgggccggtcggt

SEQ ID NO: 427866 - DNA, 20 bp, mouse
gaataagacagccttcacgg

SEQ ID NO: 427867 - DNA, 20 bp, mouse
gaaggcaggcacccccgtga

SEQ ID NO: 427868 - DNA, 20 bp, mouse
ggatctcagagcttcggctg

SEQ ID NO: 427869 - DNA, 20 bp, mouse
gttcggctgaggcgactgga

SEQ ID NO: 427870 - DNA, 20 bp, mouse
gcccagtcagggctctggag

SEQ ID NO: 427871 - DNA, 20 bp, mouse
ggagcttcggctgaggcgac

SEQ ID NO: 427872 - DNA, 20 bp, mouse
ggatctgccgggcgccttca

SEQ ID NO: 427873 - DNA, 20 bp, mouse
gtgctgaagctgactgacgt

SEQ ID NO: 427874 - DNA, 20 bp, mouse
ggtcagtgttgatggtgaat

SEQ ID NO: 427875 - DNA, 20 bp, mouse
gcactcattgaggtttctat

SEQ ID NO: 427876 - DNA, 20 bp, mouse
gccacgcgcggtggagcgtg

SEQ ID NO: 427877 - DNA, 20 bp, mouse
gcggtggagcgtggggcgag

SEQ ID NO: 427878 - DNA, 20 bp, mouse
ggcggcccgcgagctccgtg

SEQ ID NO: 427879 - DNA, 20 bp, mouse
gcgcgggagcgaaaggtact

SEQ ID NO: 427880 - DNA, 20 bp, mouse
gcgctccgcacggagctcgc

SEQ ID NO: 427881 - DNA, 20 bp, mouse
ggccggccggccgctccgca

SEQ ID NO: 427882 - DNA, 20 bp, mouse
gcaggcatccaggccacgcg

SEQ ID NO: 427883 - DNA, 20 bp, mouse
gcggccggcgcgggagcgaa

SEQ ID NO: 427884 - DNA, 20 bp, mouse
ggagagcgcccggagccaga

SEQ ID NO: 427885 - DNA, 20 bp, mouse
gcggagccagacggccacta

SEQ ID NO: 427886 - DNA, 20 bp, mouse
gggcccgcgcacaggttagg

SEQ ID NO: 427887 - DNA, 20 bp, mouse
gcagggcccgcgcacaggtt

SEQ ID NO: 427888 - DNA, 20 bp, mouse
gaagtctggcgacacggtgg

SEQ ID NO: 427889 - DNA, 20 bp, mouse
gcaggttagggggcacacag

SEQ ID NO: 427890 - DNA, 20 bp, mouse
gaagagctggacctgatggt

SEQ ID NO: 427891 - DNA, 20 bp, mouse
gtccagcagggcccgcgcac

SEQ ID NO: 427892 - DNA, 20 bp, mouse
gtggagcgctggccactcaa

SEQ ID NO: 427893 - DNA, 20 bp, mouse
ggtcaagtctggcgacacgg

SEQ ID NO: 427894 - DNA, 20 bp, mouse
gagacgtcaggagtcaagtc

SEQ ID NO: 427895 - DNA, 20 bp, mouse
gggagtcaagtctggcgaca

SEQ ID NO: 427896 - DNA, 20 bp, mouse
gagcaagggcttacaggtga

SEQ ID NO: 427897 - DNA, 20 bp, mouse
ggagaacggctttagagcaa

SEQ ID NO: 427898 - DNA, 20 bp, mouse
ggttatgtttcccatgagaa

SEQ ID NO: 427899 - DNA, 20 bp, mouse
gagttggccaggatggtcag

SEQ ID NO: 427900 - DNA, 20 bp, mouse
gacagagaggagggagtacc

SEQ ID NO: 427901 - DNA, 20 bp, mouse
ggctctaaagccgttctcat

SEQ ID NO: 427902 - DNA, 20 bp, mouse
gtgggaaacataaccaagag

SEQ ID NO: 427903 - DNA, 20 bp, mouse
gctcagtagtctgtaacggg

SEQ ID NO: 427904 - DNA, 20 bp, mouse
gaggctctcctccaccaacg

SEQ ID NO: 427905 - DNA, 20 bp, mouse
gtggctcagtagtctgtaac

SEQ ID NO: 427906 - DNA, 20 bp, mouse
gggagccacccgctcaacag

SEQ ID NO: 427907 - DNA, 20 bp, mouse
gccgctcaacaggggagcag

SEQ ID NO: 427908 - DNA, 20 bp, mouse
gcaagccacgagggaccaag

SEQ ID NO: 427909 - DNA, 20 bp, mouse
gcccccacgcctggaggtgt

SEQ ID NO: 427910 - DNA, 20 bp, mouse
ggcgaggcagccgagcggta

SEQ ID NO: 427911 - DNA, 20 bp, mouse
ggagggcccaagagttgagg

SEQ ID NO: 427912 - DNA, 20 bp, mouse
ggagcggcgaggcagccgag

SEQ ID NO: 427913 - DNA, 20 bp, mouse
gcgctccccgccgaggcagg

SEQ ID NO: 427914 - DNA, 20 bp, mouse
ggacgccccttggtccctcg

SEQ ID NO: 427915 - DNA, 20 bp, mouse
gccggcccccgcaagaaagg

SEQ ID NO: 427916 - DNA, 20 bp, mouse
ggctagtgcaggccaggaca

SEQ ID NO: 427917 - DNA, 20 bp, mouse
gtctgggcccaggaccaaaa

SEQ ID NO: 427918 - DNA, 20 bp, mouse
gcagccccaggatggagtgg

SEQ ID NO: 427919 - DNA, 20 bp, mouse
gctggagaacaggctaagac

SEQ ID NO: 427920 - DNA, 20 bp, mouse
ggctgcccacatctagaatc

SEQ ID NO: 427921 - DNA, 20 bp, mouse
gcatgtggacacttgactct

SEQ ID NO: 427922 - DNA, 20 bp, mouse
ggaggtagaaaagtgtctgt

SEQ ID NO: 427923 - DNA, 20 bp, mouse
gtaggaataaggcactcatg

SEQ ID NO: 427924 - DNA, 20 bp, mouse
ggcaaagtacctacatctag

SEQ ID NO: 427925 - DNA, 20 bp, mouse
gaaaagtgtctgtaggaata

SEQ ID NO: 427926 - DNA, 20 bp, mouse
gcaccaggccgtggctgcag

SEQ ID NO: 427927 - DNA, 20 bp, mouse
ggtcccctgcagccacggcc

SEQ ID NO: 427928 - DNA, 20 bp, mouse
ggacatgaccaagctccacc

SEQ ID NO: 427929 - DNA, 20 bp, mouse
gctagcagattctgtcatgg

SEQ ID NO: 427930 - DNA, 20 bp, mouse
gctggtgccagagagtggga

SEQ ID NO: 427931 - DNA, 20 bp, mouse
gttcactgggctgcgatcag

SEQ ID NO: 427932 - DNA, 20 bp, mouse
gcctctagcagattctgtca

SEQ ID NO: 427933 - DNA, 20 bp, mouse
gaaatgtccatcccactctc

SEQ ID NO: 427934 - DNA, 20 bp, mouse
gatgatggcagaggactgag

SEQ ID NO: 427935 - DNA, 20 bp, mouse
gggcctccggaatgtggact

SEQ ID NO: 427936 - DNA, 20 bp, mouse
gcaccgcccagcctgtccat

SEQ ID NO: 427937 - DNA, 20 bp, mouse
gcagcacacaagtctagatt

SEQ ID NO: 427938 - DNA, 20 bp, mouse
gttggtccctggctatagcc

SEQ ID NO: 427939 - DNA, 20 bp, mouse
gtagatttggtcagatcgag

SEQ ID NO: 427940 - DNA, 20 bp, mouse
gtggttgcggcagaggaccc

SEQ ID NO: 427941 - DNA, 20 bp, mouse
gagcaggtgaccggaaccta

SEQ ID NO: 427942 - DNA, 20 bp, mouse
gcggaacctagggtctagag

SEQ ID NO: 427943 - DNA, 20 bp, mouse
gcgcccagcctgtccatagg

SEQ ID NO: 427944 - DNA, 20 bp, mouse
gatatcctccacctatggac

SEQ ID NO: 427945 - DNA, 20 bp, mouse
ggaagctctgcacagtttct

SEQ ID NO: 427946 - DNA, 20 bp, mouse
gccctcggcggcaccagcac

SEQ ID NO: 427947 - DNA, 20 bp, mouse
gcccgccgccctcccctcgg

SEQ ID NO: 427948 - DNA, 20 bp, mouse
gggccggtggccaggatcag

SEQ ID NO: 427949 - DNA, 20 bp, mouse
gtcgggagacggtgtcgcgg

SEQ ID NO: 427950 - DNA, 20 bp, mouse
ggatcccacgacgccgggag

SEQ ID NO: 427951 - DNA, 20 bp, mouse
ggcatcgggagacggtgtcg

SEQ ID NO: 427952 - DNA, 20 bp, mouse
gcggcaccagcaccggcatc

SEQ ID NO: 427953 - DNA, 20 bp, mouse
ggcgcgcgccgtccatgcac

SEQ ID NO: 427954 - DNA, 20 bp, mouse
gtcctccctgacccctcccg

SEQ ID NO: 427955 - DNA, 20 bp, mouse
gcgtctcccgatgccggtgc

SEQ ID NO: 427956 - DNA, 20 bp, mouse
gcacccctcggacctcaacc

SEQ ID NO: 427957 - DNA, 20 bp, mouse
gagccttgcagagcctgctc

SEQ ID NO: 427958 - DNA, 20 bp, mouse
gctccgggttgaggtccgag

SEQ ID NO: 427959 - DNA, 20 bp, mouse
ggcccggagacggaaagttt

SEQ ID NO: 427960 - DNA, 20 bp, mouse
gggggtgcgttgcccggaga

SEQ ID NO: 427961 - DNA, 20 bp, mouse
gcgtccccggccggtttgag

SEQ ID NO: 427962 - DNA, 20 bp, mouse
gcgggtggctagaagaaccg

SEQ ID NO: 427963 - DNA, 20 bp, mouse
gggcaacgcacccctcaaac

SEQ ID NO: 427964 - DNA, 20 bp, mouse
gacctcagcagactggagag

SEQ ID NO: 427965 - DNA, 20 bp, mouse
gcgccgctgcggagaatggg

SEQ ID NO: 427966 - DNA, 20 bp, mouse
gggaggcctcgggaatgcag

SEQ ID NO: 427967 - DNA, 20 bp, mouse
gaccttagcagattagacag

SEQ ID NO: 427968 - DNA, 20 bp, mouse
ggtggacctggagcagggaa

SEQ ID NO: 427969 - DNA, 20 bp, mouse
ggactcggtgagagactatg

SEQ ID NO: 427970 - DNA, 20 bp, mouse
gcctcgggaatgcaggggag

SEQ ID NO: 427971 - DNA, 20 bp, mouse
gcccgcgggaaggaggcctc

SEQ ID NO: 427972 - DNA, 20 bp, mouse
gtcccgaggcctccttcccg

SEQ ID NO: 427973 - DNA, 20 bp, mouse
gccgctcgcaccccacccgc

SEQ ID NO: 427974 - DNA, 20 bp, mouse
gcagggaaaggactctgtag

SEQ ID NO: 427975 - DNA, 20 bp, mouse
gtggtggagaaactcctatc

SEQ ID NO: 427976 - DNA, 20 bp, mouse
gagggctgtcggccggtgag

SEQ ID NO: 427977 - DNA, 20 bp, mouse
gacagcggctcgcccctcac

SEQ ID NO: 427978 - DNA, 20 bp, mouse
gagccgctgtcgctggaggg

SEQ ID NO: 427979 - DNA, 20 bp, mouse
ggcgagccgctgtcgctgga

SEQ ID NO: 427980 - DNA, 20 bp, mouse
gtgcaaggcctcaggttccc

SEQ ID NO: 427981 - DNA, 20 bp, mouse
gcgcggcagggccctctgag

SEQ ID NO: 427982 - DNA, 20 bp, mouse
gtgtcgctggagggtggccc

SEQ ID NO: 427983 - DNA, 20 bp, mouse
gcggcccggcctaccttgca

SEQ ID NO: 427984 - DNA, 20 bp, mouse
gacgaccgcaggctcccgtg

SEQ ID NO: 427985 - DNA, 20 bp, mouse
gatagtcgccgggaccgcta

SEQ ID NO: 427986 - DNA, 20 bp, mouse
gctcgctgcttggtgatagc

SEQ ID NO: 427987 - DNA, 20 bp, mouse
gcaggtaggagtctttgtct

SEQ ID NO: 427988 - DNA, 20 bp, mouse
gtgggtggggagtaccacac

SEQ ID NO: 427989 - DNA, 20 bp, mouse
ggcagcgagtgacagctacc

SEQ ID NO: 427990 - DNA, 20 bp, mouse
gcctgttagggtatcctggg

SEQ ID NO: 427991 - DNA, 20 bp, mouse
ggcctaccacggcaacctcg

SEQ ID NO: 427992 - DNA, 20 bp, mouse
gaggagtcactcaggcagag

SEQ ID NO: 427993 - DNA, 20 bp, mouse
gagtcactcaggcagagggg

SEQ ID NO: 427994 - DNA, 20 bp, mouse
gattcctgttagggtatcct

SEQ ID NO: 427995 - DNA, 20 bp, mouse
gagggtgagtgattcctgtt

SEQ ID NO: 427996 - DNA, 20 bp, mouse
gggagcgggcggtcagcgat

SEQ ID NO: 427997 - DNA, 20 bp, mouse
gacgcgcgcggccccggggt

SEQ ID NO: 427998 - DNA, 20 bp, mouse
ggccgcccgctcccaccccg

SEQ ID NO: 427999 - DNA, 20 bp, mouse
gggcggtcagcgatgggcga

SEQ ID NO: 428000 - DNA, 20 bp, mouse
ggagccggcagggcccgagg

SEQ ID NO: 428001 - DNA, 20 bp, mouse
ggagcagggtgacaccgaca

SEQ ID NO: 428002 - DNA, 20 bp, mouse
gcctcatcggaacagtccac

SEQ ID NO: 428003 - DNA, 20 bp, mouse
ggagcgcgctccagccgtag

SEQ ID NO: 428004 - DNA, 20 bp, mouse
gggcgcggagcagcagctgc

SEQ ID NO: 428005 - DNA, 20 bp, mouse
gtcggtgtcaccctgctcgc

SEQ ID NO: 428006 - DNA, 20 bp, mouse
gtcggctctcgggacattag

SEQ ID NO: 428007 - DNA, 20 bp, mouse
ggctctcgggacattagggg

SEQ ID NO: 428008 - DNA, 20 bp, mouse
gcaattcggcggctacggag

SEQ ID NO: 428009 - DNA, 20 bp, mouse
gcaacaccacaacaattcgg

SEQ ID NO: 428010 - DNA, 20 bp, mouse
gtggctgaagaagaaacgga

SEQ ID NO: 428011 - DNA, 20 bp, mouse
gcgtagccgccgaattgttg

SEQ ID NO: 428012 - DNA, 20 bp, mouse
gtcgaacgtggtcttgcgtg

SEQ ID NO: 428013 - DNA, 20 bp, mouse
gagggacaacagggaaacgg

SEQ ID NO: 428014 - DNA, 20 bp, mouse
gggagcgggtaaaggctgaa

SEQ ID NO: 428015 - DNA, 20 bp, mouse
gcggctacggagaggcgaag

SEQ ID NO: 428016 - DNA, 20 bp, mouse
gaggaggactgcagtcgagg

SEQ ID NO: 428017 - DNA, 20 bp, mouse
gggctcggcgcagctcctgg

SEQ ID NO: 428018 - DNA, 20 bp, mouse
gtggaggaggactgcagtcg

SEQ ID NO: 428019 - DNA, 20 bp, mouse
ggcggagggcagagccgact

SEQ ID NO: 428020 - DNA, 20 bp, mouse
ggggcgctctcacacccagt

SEQ ID NO: 428021 - DNA, 20 bp, mouse
gggtagcctaccgactccgt

SEQ ID NO: 428022 - DNA, 20 bp, mouse
gccgcacccacggagtcggt

SEQ ID NO: 428023 - DNA, 20 bp, mouse
gaggactgcagtcgaggcgg

SEQ ID NO: 428024 - DNA, 20 bp, mouse
gcccaggcctcaccagtgga

SEQ ID NO: 428025 - DNA, 20 bp, mouse
gtcgccccaggcctcaccag

SEQ ID NO: 428026 - DNA, 20 bp, mouse
gccagcagagggaccggcag

SEQ ID NO: 428027 - DNA, 20 bp, mouse
ggcagagggaccggcagagg

SEQ ID NO: 428028 - DNA, 20 bp, mouse
gagggaccggcagaggcggg

SEQ ID NO: 428029 - DNA, 20 bp, mouse
gcaggagagcgcagggactt

SEQ ID NO: 428030 - DNA, 20 bp, mouse
gacgcaggaacccccaactc

SEQ ID NO: 428031 - DNA, 20 bp, mouse
gtctcctgcagagcggctca

SEQ ID NO: 428032 - DNA, 20 bp, mouse
ggtagtgccccccctctcga

SEQ ID NO: 428033 - DNA, 20 bp, mouse
gcggagcgaacacatcatgc

SEQ ID NO: 428034 - DNA, 20 bp, mouse
gcccaggactagagcgccgg

SEQ ID NO: 428035 - DNA, 20 bp, mouse
gcaggttccctcgagagggg

SEQ ID NO: 428036 - DNA, 20 bp, mouse
gcgcgggagcggggagaacc

SEQ ID NO: 428037 - DNA, 20 bp, mouse
gcaggcccgcggcgctaagg

SEQ ID NO: 428038 - DNA, 20 bp, mouse
gaaccaggcccgcggcgcta

SEQ ID NO: 428039 - DNA, 20 bp, mouse
gcagggctggagatccgcaa

SEQ ID NO: 428040 - DNA, 20 bp, mouse
gcggccaaggcgccacgccc

SEQ ID NO: 428041 - DNA, 20 bp, mouse
gagggtgtgaaagccggcgg

SEQ ID NO: 428042 - DNA, 20 bp, mouse
gcggactggatacacgaccg

SEQ ID NO: 428043 - DNA, 20 bp, mouse
ggtccccgaggacgccgcgt

SEQ ID NO: 428044 - DNA, 20 bp, mouse
gcggcgtcctcggggaccgc

SEQ ID NO: 428045 - DNA, 20 bp, mouse
gccgcggcgctaaggcggac

SEQ ID NO: 428046 - DNA, 20 bp, mouse
gcctatccagagtggagcga

SEQ ID NO: 428047 - DNA, 20 bp, mouse
gcatctggggaccagcacca

SEQ ID NO: 428048 - DNA, 20 bp, mouse
ggtggagcgagggcagccaa

SEQ ID NO: 428049 - DNA, 20 bp, mouse
gcgcagcccaggggccgcca

SEQ ID NO: 428050 - DNA, 20 bp, mouse
gcctgaggtagggaaggtga

SEQ ID NO: 428051 - DNA, 20 bp, mouse
gaacttacctcgcagcccag

SEQ ID NO: 428052 - DNA, 20 bp, mouse
gcagcaccatggcggcccct

SEQ ID NO: 428053 - DNA, 20 bp, mouse
gcacataagcctatccagag

SEQ ID NO: 428054 - DNA, 20 bp, mouse
gccaaggggcttggcatctg

SEQ ID NO: 428055 - DNA, 20 bp, mouse
gggctgccctcgctccactc

SEQ ID NO: 428056 - DNA, 20 bp, mouse
gcagattgcgatgagcttgg

SEQ ID NO: 428057 - DNA, 20 bp, mouse
gggagtgtctctggaaagtc

SEQ ID NO: 428058 - DNA, 20 bp, mouse
ggctaagtgctggctaaagc

SEQ ID NO: 428059 - DNA, 20 bp, mouse
gagccttcagagctaagtgc

SEQ ID NO: 428060 - DNA, 20 bp, mouse
gagagccccaggagtgtctc

SEQ ID NO: 428061 - DNA, 20 bp, mouse
gggagatgcagagcgggatg

SEQ ID NO: 428062 - DNA, 20 bp, mouse
ggctatgacgatgagactgg

SEQ ID NO: 428063 - DNA, 20 bp, mouse
gagccgcacagcgcccggga

SEQ ID NO: 428064 - DNA, 20 bp, mouse
ggttgctatgacgatgagac

SEQ ID NO: 428065 - DNA, 20 bp, mouse
gagccagcacttagctctga

SEQ ID NO: 428066 - DNA, 20 bp, mouse
gcctgttccagacttctcgg

SEQ ID NO: 428067 - DNA, 20 bp, mouse
gtccccaccgggtgcagggg

SEQ ID NO: 428068 - DNA, 20 bp, mouse
gacctcggcaaagtgatggg

SEQ ID NO: 428069 - DNA, 20 bp, mouse
ggcaaggtttgggttaggga

SEQ ID NO: 428070 - DNA, 20 bp, mouse
ggctttggaaagcaaggttt

SEQ ID NO: 428071 - DNA, 20 bp, mouse
gggaatactgatgtgctcac

SEQ ID NO: 428072 - DNA, 20 bp, mouse
gagtctggaacaggactctc

SEQ ID NO: 428073 - DNA, 20 bp, mouse
gtcctccccaccgggtgcag

SEQ ID NO: 428074 - DNA, 20 bp, mouse
ggcaggggcggcatggggta

SEQ ID NO: 428075 - DNA, 20 bp, mouse
ggccgcccctgcacccggtg

SEQ ID NO: 428076 - DNA, 20 bp, mouse
gccgattgctgcgactccag

SEQ ID NO: 428077 - DNA, 20 bp, mouse
gatggtggagcaggaaggta

SEQ ID NO: 428078 - DNA, 20 bp, mouse
gagctccagctggattgcgg

SEQ ID NO: 428079 - DNA, 20 bp, mouse
gggcggagctgaaaaccagg

SEQ ID NO: 428080 - DNA, 20 bp, mouse
gcagaggcactggagacact

SEQ ID NO: 428081 - DNA, 20 bp, mouse
gcaggcggcgggatgacttg

SEQ ID NO: 428082 - DNA, 20 bp, mouse
ggagagctccagctggattg

SEQ ID NO: 428083 - DNA, 20 bp, mouse
gcaccatctccagcaggtcg

SEQ ID NO: 428084 - DNA, 20 bp, mouse
ggcccaggagcctgagaaga

SEQ ID NO: 428085 - DNA, 20 bp, mouse
ggcggcgggatgacttgggg

SEQ ID NO: 428086 - DNA, 20 bp, mouse
gcagtgccgagagggcagag

SEQ ID NO: 428087 - DNA, 20 bp, mouse
gctggaggaggacgacgatg

SEQ ID NO: 428088 - DNA, 20 bp, mouse
gccagggcaagggggatccg

SEQ ID NO: 428089 - DNA, 20 bp, mouse
gctgctgaacatggagctgg

SEQ ID NO: 428090 - DNA, 20 bp, mouse
gaagctccgctctgccctct

SEQ ID NO: 428091 - DNA, 20 bp, mouse
ggcagcggggcagtgccgag

SEQ ID NO: 428092 - DNA, 20 bp, mouse
gaaccggggccagggcaagg

SEQ ID NO: 428093 - DNA, 20 bp, mouse
gcctgtggcctcggagaatc

SEQ ID NO: 428094 - DNA, 20 bp, mouse
gggagcggcggcgtccctct

SEQ ID NO: 428095 - DNA, 20 bp, mouse
ggagcgcgggcggagcgcag

SEQ ID NO: 428096 - DNA, 20 bp, mouse
gctcactgcacagggtaagg

SEQ ID NO: 428097 - DNA, 20 bp, mouse
gaccctgtgcagtgaggcaa

SEQ ID NO: 428098 - DNA, 20 bp, mouse
gtgtgcagtgaggcaagggc

SEQ ID NO: 428099 - DNA, 20 bp, mouse
gtaagtgcagtcagccacca

SEQ ID NO: 428100 - DNA, 20 bp, mouse
gtgagcggctgccacagctc

SEQ ID NO: 428101 - DNA, 20 bp, mouse
gacaatcagagacctcaccc

SEQ ID NO: 428102 - DNA, 20 bp, mouse
ggaagccactgtgccaggta

SEQ ID NO: 428103 - DNA, 20 bp, mouse
ggccactgtgccaggtaggg

SEQ ID NO: 428104 - DNA, 20 bp, mouse
gtccagcaggagcaaaatca

SEQ ID NO: 428105 - DNA, 20 bp, mouse
gggcccaagcatccaggagg

SEQ ID NO: 428106 - DNA, 20 bp, mouse
ggggctcatgaggaccggag

SEQ ID NO: 428107 - DNA, 20 bp, mouse
ggcaccaccgagcgcgccgg

SEQ ID NO: 428108 - DNA, 20 bp, mouse
gccaccgagcgcgccggagg

SEQ ID NO: 428109 - DNA, 20 bp, mouse
gctcggccatggcgaggaca

SEQ ID NO: 428110 - DNA, 20 bp, mouse
ggcaagaggccccctcccga

SEQ ID NO: 428111 - DNA, 20 bp, mouse
gctgcgcgggcgggcgagag

SEQ ID NO: 428112 - DNA, 20 bp, mouse
ggtggcaccaccgagcgcgc

SEQ ID NO: 428113 - DNA, 20 bp, mouse
gagcaagtggagcgcaggga

SEQ ID NO: 428114 - DNA, 20 bp, mouse
gccgggcgctggggggccac

SEQ ID NO: 428115 - DNA, 20 bp, mouse
ggggacgcccgggcgctggg

SEQ ID NO: 428116 - DNA, 20 bp, mouse
gctggtccctcggtcaatgt

SEQ ID NO: 428117 - DNA, 20 bp, mouse
ggcatgtaccctcagaaccg

SEQ ID NO: 428118 - DNA, 20 bp, mouse
gagagccccacattgaccga

SEQ ID NO: 428119 - DNA, 20 bp, mouse
gatggggcaggctaaggaag

SEQ ID NO: 428120 - DNA, 20 bp, mouse
gggagcacgctggctagagt

SEQ ID NO: 428121 - DNA, 20 bp, mouse
ggtaacaaccgggagcccgc

SEQ ID NO: 428122 - DNA, 20 bp, mouse
gggaaggatgacagctgtag

SEQ ID NO: 428123 - DNA, 20 bp, mouse
gactgacggggagggactat

SEQ ID NO: 428124 - DNA, 20 bp, mouse
gaggtgagcctcggttctga

SEQ ID NO: 428125 - DNA, 20 bp, mouse
gggaccagccaccagcatgc

SEQ ID NO: 428126 - DNA, 20 bp, mouse
gtgggggctcgagaaccgag

SEQ ID NO: 428127 - DNA, 20 bp, mouse
gtgtgcgccgcgggtgctgg

SEQ ID NO: 428128 - DNA, 20 bp, mouse
ggtagtcagtcacacaccaa

SEQ ID NO: 428129 - DNA, 20 bp, mouse
gtcaataaaccccgaaccca

SEQ ID NO: 428130 - DNA, 20 bp, mouse
gctcgagaaccgagcggagc

SEQ ID NO: 428131 - DNA, 20 bp, mouse
gacaccaagggcagcagcga

SEQ ID NO: 428132 - DNA, 20 bp, mouse
gctcgagcccccagcacccg

SEQ ID NO: 428133 - DNA, 20 bp, mouse
ggccgcaggtcccgcctcta

SEQ ID NO: 428134 - DNA, 20 bp, mouse
ggccgtagaggcgggacctg

SEQ ID NO: 428135 - DNA, 20 bp, mouse
gcacgcgggagcacacgcac

SEQ ID NO: 428136 - DNA, 20 bp, mouse
gcccgggctcccgagccgag

SEQ ID NO: 428137 - DNA, 20 bp, mouse
ggctgcagcgcggacttggg

SEQ ID NO: 428138 - DNA, 20 bp, mouse
gagccgagcggcgccgcgca

SEQ ID NO: 428139 - DNA, 20 bp, mouse
ggccgtaagcagaacccctc

SEQ ID NO: 428140 - DNA, 20 bp, mouse
gggctccactcggccctgcg

SEQ ID NO: 428141 - DNA, 20 bp, mouse
ggacttgggaggcgcacgga

SEQ ID NO: 428142 - DNA, 20 bp, mouse
gttacttgcaagtcatcggg

SEQ ID NO: 428143 - DNA, 20 bp, mouse
gcaagtccgcgctgcagccc

SEQ ID NO: 428144 - DNA, 20 bp, mouse
gcccgcggccacggggagga

SEQ ID NO: 428145 - DNA, 20 bp, mouse
ggctgctcgcagctcggacg

SEQ ID NO: 428146 - DNA, 20 bp, mouse
gctcgcagcagccattgaag

SEQ ID NO: 428147 - DNA, 20 bp, mouse
gtgtgtggactcggaggtgg

SEQ ID NO: 428148 - DNA, 20 bp, mouse
gcagcagccattgaagggga

SEQ ID NO: 428149 - DNA, 20 bp, mouse
gttgaaggggaaggaactgc

SEQ ID NO: 428150 - DNA, 20 bp, mouse
gtggcggtgccgtgtcatgg

SEQ ID NO: 428151 - DNA, 20 bp, mouse
gcgcgggtgtgtggactcgg

SEQ ID NO: 428152 - DNA, 20 bp, mouse
gaagaacagagccccggagg

SEQ ID NO: 428153 - DNA, 20 bp, mouse
gccgcctccaccccaagtgg

SEQ ID NO: 428154 - DNA, 20 bp, mouse
gggttggcggtgccgtgtca

SEQ ID NO: 428155 - DNA, 20 bp, mouse
gttgaagaacagagccccgg

SEQ ID NO: 428156 - DNA, 20 bp, mouse
ggccatgatgccggtggaca

SEQ ID NO: 428157 - DNA, 20 bp, mouse
gcccttggccatgatgccgg

SEQ ID NO: 428158 - DNA, 20 bp, mouse
gttccgagctccctgtccac

SEQ ID NO: 428159 - DNA, 20 bp, mouse
gtgccggtggacagggagct

SEQ ID NO: 428160 - DNA, 20 bp, mouse
gtccctgtccaccggcatca

SEQ ID NO: 428161 - DNA, 20 bp, mouse
gggtctcaggatcacccggt

SEQ ID NO: 428162 - DNA, 20 bp, mouse
gagtcaggtataagagtctt

SEQ ID NO: 428163 - DNA, 20 bp, mouse
gagggagctcggaatagctc

SEQ ID NO: 428164 - DNA, 20 bp, mouse
gaaccccttggccatgatgc

SEQ ID NO: 428165 - DNA, 20 bp, mouse
gctacgctcaggagaagaat

SEQ ID NO: 428166 - DNA, 20 bp, mouse
gtgcagtcctaggcaagtgt

SEQ ID NO: 428167 - DNA, 20 bp, mouse
gtgttggagtgagtccccga

SEQ ID NO: 428168 - DNA, 20 bp, mouse
ggagtccccgagggtgccag

SEQ ID NO: 428169 - DNA, 20 bp, mouse
ggagatgagaggatacagaa

SEQ ID NO: 428170 - DNA, 20 bp, mouse
gggtggtgagggacacatag

SEQ ID NO: 428171 - DNA, 20 bp, mouse
gagagccgctggcaccctcg

SEQ ID NO: 428172 - DNA, 20 bp, mouse
ggccaggcctggagaaaaag

SEQ ID NO: 428173 - DNA, 20 bp, mouse
gcctgctctggcgggttaaa

SEQ ID NO: 428174 - DNA, 20 bp, mouse
gggactcactccaacagctt

SEQ ID NO: 428175 - DNA, 20 bp, mouse
gagtttacccatctgagtag

SEQ ID NO: 428176 - DNA, 20 bp, mouse
gcggcctggtggccctatcc

SEQ ID NO: 428177 - DNA, 20 bp, mouse
gggcgtccgtgtgacatcag

SEQ ID NO: 428178 - DNA, 20 bp, mouse
gggacaaagagccatcggga

SEQ ID NO: 428179 - DNA, 20 bp, mouse
ggggccaccaggccgctccc

SEQ ID NO: 428180 - DNA, 20 bp, mouse
ggtgtggagctgccgggata

SEQ ID NO: 428181 - DNA, 20 bp, mouse
gctgccgggatagggccacc

SEQ ID NO: 428182 - DNA, 20 bp, mouse
gtctaggacaaagagccatc

SEQ ID NO: 428183 - DNA, 20 bp, mouse
gttcgagtttcagggaccca

SEQ ID NO: 428184 - DNA, 20 bp, mouse
gcccagggcgttctgctgtg

SEQ ID NO: 428185 - DNA, 20 bp, mouse
gtctgctgtgtggagctgcc

SEQ ID NO: 428186 - DNA, 20 bp, mouse
gtagctgcggtggtgagctg

SEQ ID NO: 428187 - DNA, 20 bp, mouse
gcgcccacccgggagcagaa

SEQ ID NO: 428188 - DNA, 20 bp, mouse
ggcggtccgaggaagagagg

SEQ ID NO: 428189 - DNA, 20 bp, mouse
gggctggcgtctagctgcgg

SEQ ID NO: 428190 - DNA, 20 bp, mouse
ggctgcgggacaggcacccg

SEQ ID NO: 428191 - DNA, 20 bp, mouse
gtgggcggtccgaggaagag

SEQ ID NO: 428192 - DNA, 20 bp, mouse
gcggtggtgagctgcgggac

SEQ ID NO: 428193 - DNA, 20 bp, mouse
gcgaggaagagaggcggaag

SEQ ID NO: 428194 - DNA, 20 bp, mouse
ggagttcccgcggcgatcgt

SEQ ID NO: 428195 - DNA, 20 bp, mouse
ggatttgcccagagttccgg

SEQ ID NO: 428196 - DNA, 20 bp, mouse
ggcctcttcacagcatcagt

SEQ ID NO: 428197 - DNA, 20 bp, mouse
gcagtgggcatggacttcct

SEQ ID NO: 428198 - DNA, 20 bp, mouse
gaagctctgggcctccgcca

SEQ ID NO: 428199 - DNA, 20 bp, mouse
gtgggcatggacttccttgg

SEQ ID NO: 428200 - DNA, 20 bp, mouse
ggcccactgatgctgtgaag

SEQ ID NO: 428201 - DNA, 20 bp, mouse
ggtcatgaaaccctaacctg

SEQ ID NO: 428202 - DNA, 20 bp, mouse
ggtgaagaggctcagatcac

SEQ ID NO: 428203 - DNA, 20 bp, mouse
gggtcaaggcaccaaggggt

SEQ ID NO: 428204 - DNA, 20 bp, mouse
gaagaggtcaaggcaccaag

SEQ ID NO: 428205 - DNA, 20 bp, mouse
gcagggagagaccacaggtt

SEQ ID NO: 428206 - DNA, 20 bp, mouse
gggaagacaagcaaatacaa

SEQ ID NO: 428207 - DNA, 20 bp, mouse
gtgctcagatggtttcagac

SEQ ID NO: 428208 - DNA, 20 bp, mouse
gaagagagactctgctcaga

SEQ ID NO: 428209 - DNA, 20 bp, mouse
ggcaaagagaaagtgtgctc

SEQ ID NO: 428210 - DNA, 20 bp, mouse
gaattcaactacaggattta

SEQ ID NO: 428211 - DNA, 20 bp, mouse
gcacttccttaagaagcccc

SEQ ID NO: 428212 - DNA, 20 bp, mouse
gtgcatttcttagttaagaa

SEQ ID NO: 428213 - DNA, 20 bp, mouse
gttcttgcttggtttgcctg

SEQ ID NO: 428214 - DNA, 20 bp, mouse
ggactgctgaattcaactac

SEQ ID NO: 428215 - DNA, 20 bp, mouse
gagagctgtgagttttgtgt

SEQ ID NO: 428216 - DNA, 20 bp, mouse
gatcaccaggatttcagtaa

SEQ ID NO: 428217 - DNA, 20 bp, mouse
ggtaaccagggtagatcacc

SEQ ID NO: 428218 - DNA, 20 bp, mouse
gcagccattctggcctcata

SEQ ID NO: 428219 - DNA, 20 bp, mouse
gaaatcctggtgatctaccc

SEQ ID NO: 428220 - DNA, 20 bp, mouse
gtagggaacaactctgaagc

SEQ ID NO: 428221 - DNA, 20 bp, mouse
gcagggaacctcagccattc

SEQ ID NO: 428222 - DNA, 20 bp, mouse
gttcagagttgttccctatg

SEQ ID NO: 428223 - DNA, 20 bp, mouse
gaggacctttactgaaatcc

SEQ ID NO: 428224 - DNA, 20 bp, mouse
gatttaaatttggaactgca

SEQ ID NO: 428225 - DNA, 20 bp, mouse
gcgcaaaacattttcaagag

SEQ ID NO: 428226 - DNA, 20 bp, mouse
gaccgtgcgcagacactctc

SEQ ID NO: 428227 - DNA, 20 bp, mouse
gcaggaaagcgggagtagga

SEQ ID NO: 428228 - DNA, 20 bp, mouse
ggatccaggaaagcgggagt

SEQ ID NO: 428229 - DNA, 20 bp, mouse
ggcgcagacactctcgggtt

SEQ ID NO: 428230 - DNA, 20 bp, mouse
ggtctgcgcacggtcgaagg

SEQ ID NO: 428231 - DNA, 20 bp, mouse
ggtcgaaggaggagccggca

SEQ ID NO: 428232 - DNA, 20 bp, mouse
ggcacggtcgaaggaggagc

SEQ ID NO: 428233 - DNA, 20 bp, mouse
gcactctcgggttaggatcc

SEQ ID NO: 428234 - DNA, 20 bp, mouse
ggaaggaggagccggcaagg

SEQ ID NO: 428235 - DNA, 20 bp, mouse
gcaaggcccggagttgaacg

SEQ ID NO: 428236 - DNA, 20 bp, mouse
gacagaaaacggagtcccaa

SEQ ID NO: 428237 - DNA, 20 bp, mouse
gtctctgggatgactgccct

SEQ ID NO: 428238 - DNA, 20 bp, mouse
gtataaacttggtctgtggg

SEQ ID NO: 428239 - DNA, 20 bp, mouse
gcccaataaagattgcctca

SEQ ID NO: 428240 - DNA, 20 bp, mouse
ggggtgctgggcaataacac

SEQ ID NO: 428241 - DNA, 20 bp, mouse
gctaaactagatggcctcac

SEQ ID NO: 428242 - DNA, 20 bp, mouse
ggccgtgaggcaatctttat

SEQ ID NO: 428243 - DNA, 20 bp, mouse
gcctcacggcagtgagcaaa

SEQ ID NO: 428244 - DNA, 20 bp, mouse
gtgctgggcaataacactgg

SEQ ID NO: 428245 - DNA, 20 bp, mouse
gtgctaatactagccacgag

SEQ ID NO: 428246 - DNA, 20 bp, mouse
gggccgcgccccacttacct

SEQ ID NO: 428247 - DNA, 20 bp, mouse
gggctgctccgcttcaaggg

SEQ ID NO: 428248 - DNA, 20 bp, mouse
gccgggctgctccgcttcaa

SEQ ID NO: 428249 - DNA, 20 bp, mouse
gccccgacccctcaggagag

SEQ ID NO: 428250 - DNA, 20 bp, mouse
gctgagagcctcccttgaag

SEQ ID NO: 428251 - DNA, 20 bp, mouse
gccctgctccgactccacaa

SEQ ID NO: 428252 - DNA, 20 bp, mouse
ggcaaccccgaggccatagc

SEQ ID NO: 428253 - DNA, 20 bp, mouse
ggtcggagcagggtacctgg

SEQ ID NO: 428254 - DNA, 20 bp, mouse
gacgtgctagatgtcaggag

SEQ ID NO: 428255 - DNA, 20 bp, mouse
ggcagtgcggaaagcgaagt

SEQ ID NO: 428256 - DNA, 20 bp, mouse
gccaggctagccgggagcta

SEQ ID NO: 428257 - DNA, 20 bp, mouse
gcgggagctacggccggccg

SEQ ID NO: 428258 - DNA, 20 bp, mouse
ggctagccgggagctacggc

SEQ ID NO: 428259 - DNA, 20 bp, mouse
gcttacccttggggccgcgg

SEQ ID NO: 428260 - DNA, 20 bp, mouse
gtccgtggttgtagaggggc

SEQ ID NO: 428261 - DNA, 20 bp, mouse
gagaagagacttgacctggg

SEQ ID NO: 428262 - DNA, 20 bp, mouse
ggtcccctggatgtgagctt

SEQ ID NO: 428263 - DNA, 20 bp, mouse
gcttgacctggggggcacaa

SEQ ID NO: 428264 - DNA, 20 bp, mouse
gatgttccgtggttgtagag

SEQ ID NO: 428265 - DNA, 20 bp, mouse
gggcatgggaaacttaccct

SEQ ID NO: 428266 - DNA, 20 bp, mouse
gggagaaaggctctagacta

SEQ ID NO: 428267 - DNA, 20 bp, mouse
gtctccgcaccagaggtaag

SEQ ID NO: 428268 - DNA, 20 bp, mouse
ggccctaagccccttacctc

SEQ ID NO: 428269 - DNA, 20 bp, mouse
gaagccccttacctctggtg

SEQ ID NO: 428270 - DNA, 20 bp, mouse
gatcggccgggacgagggtg

SEQ ID NO: 428271 - DNA, 20 bp, mouse
gacccagaccccagagcccg

SEQ ID NO: 428272 - DNA, 20 bp, mouse
ggagcctttctccgcaccag

SEQ ID NO: 428273 - DNA, 20 bp, mouse
ggtcctatcggccgggacga

SEQ ID NO: 428274 - DNA, 20 bp, mouse
ggcttggacctgggaatctt

SEQ ID NO: 428275 - DNA, 20 bp, mouse
gtcagtgcggagtcccgggg

SEQ ID NO: 428276 - DNA, 20 bp, mouse
gggcagtagagcgcaggctg

SEQ ID NO: 428277 - DNA, 20 bp, mouse
gatgcacacgccaaaggaca

SEQ ID NO: 428278 - DNA, 20 bp, mouse
ggcaggctgcgggtgagagc

SEQ ID NO: 428279 - DNA, 20 bp, mouse
gttaccaggcagtagagcgc

SEQ ID NO: 428280 - DNA, 20 bp, mouse
gggaccgatgcacacgccaa

SEQ ID NO: 428281 - DNA, 20 bp, mouse
gcgatcgggaccctctctga

SEQ ID NO: 428282 - DNA, 20 bp, mouse
ggggactacggccacttacc

SEQ ID NO: 428283 - DNA, 20 bp, mouse
gcacagagcgggacacagat

SEQ ID NO: 428284 - DNA, 20 bp, mouse
gtgatgctgtcggtcaggag

SEQ ID NO: 428285 - DNA, 20 bp, mouse
gggagcgactcctccaccaa

SEQ ID NO: 428286 - DNA, 20 bp, mouse
gctagggaggcctcagatca

SEQ ID NO: 428287 - DNA, 20 bp, mouse
gcggctgctgctaggctaac

SEQ ID NO: 428288 - DNA, 20 bp, mouse
gggcctcagatcagggcgta

SEQ ID NO: 428289 - DNA, 20 bp, mouse
ggtccatacgccctgatctg

SEQ ID NO: 428290 - DNA, 20 bp, mouse
gctgcacactcaccgcgcta

SEQ ID NO: 428291 - DNA, 20 bp, mouse
gcacactcaccgcgctaggg

SEQ ID NO: 428292 - DNA, 20 bp, mouse
gatctgaggcctccctagcg

SEQ ID NO: 428293 - DNA, 20 bp, mouse
gagggtgtggtccaagaccc

SEQ ID NO: 428294 - DNA, 20 bp, mouse
ggcctctgcggctcccggaa

SEQ ID NO: 428295 - DNA, 20 bp, mouse
gctggttgacagcaccctga

SEQ ID NO: 428296 - DNA, 20 bp, mouse
gaccgacggaagaacagcaa

SEQ ID NO: 428297 - DNA, 20 bp, mouse
ggaacgagctgactgaccga

SEQ ID NO: 428298 - DNA, 20 bp, mouse
gacggaagaacagcaagggg

SEQ ID NO: 428299 - DNA, 20 bp, mouse
gcggttggaagaccagacca

SEQ ID NO: 428300 - DNA, 20 bp, mouse
gaacgaggtgggcctccggg

SEQ ID NO: 428301 - DNA, 20 bp, mouse
gccctgcgtgctggaggact

SEQ ID NO: 428302 - DNA, 20 bp, mouse
ggcgcggggctctacgacta

SEQ ID NO: 428303 - DNA, 20 bp, mouse
ggccagagggcgtggcgcat

SEQ ID NO: 428304 - DNA, 20 bp, mouse
gattgcaggaaagcgggcta

SEQ ID NO: 428305 - DNA, 20 bp, mouse
gggaagaccagaccagggac

SEQ ID NO: 428306 - DNA, 20 bp, mouse
gatggcctggtggaaagcct

SEQ ID NO: 428307 - DNA, 20 bp, mouse
gaacctgcgaggccaagtcc

SEQ ID NO: 428308 - DNA, 20 bp, mouse
gacactcccaacaaggacta

SEQ ID NO: 428309 - DNA, 20 bp, mouse
gaagcctgggtaagttgaaa

SEQ ID NO: 428310 - DNA, 20 bp, mouse
gcttacccaggctttccacc

SEQ ID NO: 428311 - DNA, 20 bp, mouse
ggtcctccacactcccaaca

SEQ ID NO: 428312 - DNA, 20 bp, mouse
gacattgcacatatccacag

SEQ ID NO: 428313 - DNA, 20 bp, mouse
gagaccatttcaacttaccc

SEQ ID NO: 428314 - DNA, 20 bp, mouse
gaagtcccggtgaggaaact

SEQ ID NO: 428315 - DNA, 20 bp, mouse
gtactccccgatagtaggtg

SEQ ID NO: 428316 - DNA, 20 bp, mouse
ggtcgtgaaggcaccagctc

SEQ ID NO: 428317 - DNA, 20 bp, mouse
gcttctctgcccggctactc

SEQ ID NO: 428318 - DNA, 20 bp, mouse
gcaccagctccggagtagcc

SEQ ID NO: 428319 - DNA, 20 bp, mouse
gttatggttcagcgtcgtga

SEQ ID NO: 428320 - DNA, 20 bp, mouse
gctgactgactgctcaacct

SEQ ID NO: 428321 - DNA, 20 bp, mouse
gtggtcagcaggtgtaatct

SEQ ID NO: 428322 - DNA, 20 bp, mouse
gaaaggtgctgaaaataaga

SEQ ID NO: 428323 - DNA, 20 bp, mouse
ggttccagaacttacctgaa

SEQ ID NO: 428324 - DNA, 20 bp, mouse
ggggtgggggaatctcagat

SEQ ID NO: 428325 - DNA, 20 bp, mouse
gtgcccggctactccggagc

SEQ ID NO: 428326 - DNA, 20 bp, mouse
gcagatgtccagatctggaa

SEQ ID NO: 428327 - DNA, 20 bp, mouse
gggctggagaagttctagta

SEQ ID NO: 428328 - DNA, 20 bp, mouse
gtgtccagatctggaagggc

SEQ ID NO: 428329 - DNA, 20 bp, mouse
gaagttcagatgtccagatc

SEQ ID NO: 428330 - DNA, 20 bp, mouse
gtctgaacttctctcagaca

SEQ ID NO: 428331 - DNA, 20 bp, mouse
gtctccagcccttccagatc

SEQ ID NO: 428332 - DNA, 20 bp, mouse
gtggtcctcagagggcacag

SEQ ID NO: 428333 - DNA, 20 bp, mouse
gtggtcttgaagactttcca

SEQ ID NO: 428334 - DNA, 20 bp, mouse
ggccaagcaacattgagaag

SEQ ID NO: 428335 - DNA, 20 bp, mouse
gatcttgtggtccaagagtg

SEQ ID NO: 428336 - DNA, 20 bp, mouse
gcggagcagagcacacaggt

SEQ ID NO: 428337 - DNA, 20 bp, mouse
gtctgggagctggggagcga

SEQ ID NO: 428338 - DNA, 20 bp, mouse
ggcacacaggtgggttctga

SEQ ID NO: 428339 - DNA, 20 bp, mouse
ggccatcacaggcaactcca

SEQ ID NO: 428340 - DNA, 20 bp, mouse
ggaacaaagtctgggagctg

SEQ ID NO: 428341 - DNA, 20 bp, mouse
gagcttcagaaggccatcac

SEQ ID NO: 428342 - DNA, 20 bp, mouse
gttctgatggaacaccaaac

SEQ ID NO: 428343 - DNA, 20 bp, mouse
gcttctcctgactacctgtt

SEQ ID NO: 428344 - DNA, 20 bp, mouse
gagtggccaggaacaaagtc

SEQ ID NO: 428345 - DNA, 20 bp, mouse
gaactccagggtgagagaag

SEQ ID NO: 428346 - DNA, 20 bp, mouse
gccagcggaagcatgaacag

SEQ ID NO: 428347 - DNA, 20 bp, mouse
gaggcagggatggggtctgt

SEQ ID NO: 428348 - DNA, 20 bp, mouse
gtcaggaaccatgagtgagg

SEQ ID NO: 428349 - DNA, 20 bp, mouse
gtgtgggtcctcctcactca

SEQ ID NO: 428350 - DNA, 20 bp, mouse
gcagaggaccagagagcgtc

SEQ ID NO: 428351 - DNA, 20 bp, mouse
gaatcacaggggacagccag

SEQ ID NO: 428352 - DNA, 20 bp, mouse
gcccagcatgtcctcaccac

SEQ ID NO: 428353 - DNA, 20 bp, mouse
gaggctggcacagatgagtc

SEQ ID NO: 428354 - DNA, 20 bp, mouse
gcccctgtgattcacacaga

SEQ ID NO: 428355 - DNA, 20 bp, mouse
gatgagtctggccttcggct

SEQ ID NO: 428356 - DNA, 20 bp, mouse
ggtgccagccatgaatctca

SEQ ID NO: 428357 - DNA, 20 bp, mouse
ggatgagctctcaggacggg

SEQ ID NO: 428358 - DNA, 20 bp, mouse
gaccgatgagctctcaggac

SEQ ID NO: 428359 - DNA, 20 bp, mouse
gagcagcaccttgagattca

SEQ ID NO: 428360 - DNA, 20 bp, mouse
ggcaccttgagattcatggc

SEQ ID NO: 428361 - DNA, 20 bp, mouse
gcagacaccgatgagctctc

SEQ ID NO: 428362 - DNA, 20 bp, mouse
gaattctgggaggtatggaa

SEQ ID NO: 428363 - DNA, 20 bp, mouse
gtccagggatgaattctggg

SEQ ID NO: 428364 - DNA, 20 bp, mouse
gggaagggcatcgaggagac

SEQ ID NO: 428365 - DNA, 20 bp, mouse
gtggctagtgcctctcgcac

SEQ ID NO: 428366 - DNA, 20 bp, mouse
ggacaggcttctaccagaaa

SEQ ID NO: 428367 - DNA, 20 bp, mouse
gagaggggcaatgaagaggt

SEQ ID NO: 428368 - DNA, 20 bp, mouse
ggaacagaggggcaatgaag

SEQ ID NO: 428369 - DNA, 20 bp, mouse
gagagccaggagcactaggg

SEQ ID NO: 428370 - DNA, 20 bp, mouse
gcttttggctggggtctccc

SEQ ID NO: 428371 - DNA, 20 bp, mouse
gctgctattgcctagcgcct

SEQ ID NO: 428372 - DNA, 20 bp, mouse
gaccagaaatggactccttt

SEQ ID NO: 428373 - DNA, 20 bp, mouse
gtcattgcttcttgatggac

SEQ ID NO: 428374 - DNA, 20 bp, mouse
ggccaaaaggagtccatttc

SEQ ID NO: 428375 - DNA, 20 bp, mouse
gtagctggcaggagcggaga

SEQ ID NO: 428376 - DNA, 20 bp, mouse
gcgctgctagggacctgcta

SEQ ID NO: 428377 - DNA, 20 bp, mouse
gaaggtgagagcccgcgggt

SEQ ID NO: 428378 - DNA, 20 bp, mouse
ggctagggacctcggagtca

SEQ ID NO: 428379 - DNA, 20 bp, mouse
ggtagaagagcagctgaatg

SEQ ID NO: 428380 - DNA, 20 bp, mouse
gagggacctgctagggacct

SEQ ID NO: 428381 - DNA, 20 bp, mouse
gaatggggtccatgactccg

SEQ ID NO: 428382 - DNA, 20 bp, mouse
gcaggagtctgcctacccgc

SEQ ID NO: 428383 - DNA, 20 bp, mouse
gccagaactggggtccgggg

SEQ ID NO: 428384 - DNA, 20 bp, mouse
gcagggcgcaggctgggata

SEQ ID NO: 428385 - DNA, 20 bp, mouse
gccagaaggtgagagcccgc

SEQ ID NO: 428386 - DNA, 20 bp, mouse
gcagctgggacagcttggag

SEQ ID NO: 428387 - DNA, 20 bp, mouse
gctggagcccctggagtcag

SEQ ID NO: 428388 - DNA, 20 bp, mouse
gaggaaacccctgactccag

SEQ ID NO: 428389 - DNA, 20 bp, mouse
gtgggtcctggcatagtggg

SEQ ID NO: 428390 - DNA, 20 bp, mouse
ggggactccgaatctcaggg

SEQ ID NO: 428391 - DNA, 20 bp, mouse
ggctgggcaaggcatggctc

SEQ ID NO: 428392 - DNA, 20 bp, mouse
gtacccctgggattctaaca

SEQ ID NO: 428393 - DNA, 20 bp, mouse
gagctggtatccgagccaag

SEQ ID NO: 428394 - DNA, 20 bp, mouse
gtatgccaggacccagttgt

SEQ ID NO: 428395 - DNA, 20 bp, mouse
gagggggactccgaatctca

SEQ ID NO: 428396 - DNA, 20 bp, mouse
gggtacagttgcacagagtg

SEQ ID NO: 428397 - DNA, 20 bp, mouse
gcagcagttcatctgagagg

SEQ ID NO: 428398 - DNA, 20 bp, mouse
gaggtggacttagacacatt

SEQ ID NO: 428399 - DNA, 20 bp, mouse
gtagaaggagacattacttg

SEQ ID NO: 428400 - DNA, 20 bp, mouse
ggctcatctgactccttaga

SEQ ID NO: 428401 - DNA, 20 bp, mouse
gtgtgaaagcagaagttggg

SEQ ID NO: 428402 - DNA, 20 bp, mouse
gaagccagtgcccagtgctt

SEQ ID NO: 428403 - DNA, 20 bp, mouse
gtaaatcctgtagggcaatt

SEQ ID NO: 428404 - DNA, 20 bp, mouse
gtatgcttcttggggaacaa

SEQ ID NO: 428405 - DNA, 20 bp, mouse
gggagaccgaattgccctac

SEQ ID NO: 428406 - DNA, 20 bp, mouse
ggaggcacggaaacttaaga

SEQ ID NO: 428407 - DNA, 20 bp, mouse
gccttgaagcccaagaggca

SEQ ID NO: 428408 - DNA, 20 bp, mouse
gacggaaacttaagagggct

SEQ ID NO: 428409 - DNA, 20 bp, mouse
gaaaatccttgaagcccaag

SEQ ID NO: 428410 - DNA, 20 bp, mouse
gtgacactagaacattgaaa

SEQ ID NO: 428411 - DNA, 20 bp, mouse
gcatcaacaacccctcagaa

SEQ ID NO: 428412 - DNA, 20 bp, mouse
gccacagagcaagcagagtc

SEQ ID NO: 428413 - DNA, 20 bp, mouse
gttaagtttccgtgcctctt

SEQ ID NO: 428414 - DNA, 20 bp, mouse
gactctgatgtgggattcag

SEQ ID NO: 428415 - DNA, 20 bp, mouse
ggtcaaatggatgaagtaaa

SEQ ID NO: 428416 - DNA, 20 bp, mouse
gcccggggaagccaaatcgg

SEQ ID NO: 428417 - DNA, 20 bp, mouse
ggtgctgctatatgagatag

SEQ ID NO: 428418 - DNA, 20 bp, mouse
gttgggcacctgcagtcccg

SEQ ID NO: 428419 - DNA, 20 bp, mouse
gtatagcagcactgtaactt

SEQ ID NO: 428420 - DNA, 20 bp, mouse
gacaaatgccctaccgacaa

SEQ ID NO: 428421 - DNA, 20 bp, mouse
ggcagatacccttgtcggta

SEQ ID NO: 428422 - DNA, 20 bp, mouse
gcggcggcacagcccaacac

SEQ ID NO: 428423 - DNA, 20 bp, mouse
gagtcccggggaagccaaat

SEQ ID NO: 428424 - DNA, 20 bp, mouse
gttcacagagggcaaaagtc

SEQ ID NO: 428425 - DNA, 20 bp, mouse
gagctcgtcagactcggaga

SEQ ID NO: 428426 - DNA, 20 bp, mouse
gctggagacccgggacccca

SEQ ID NO: 428427 - DNA, 20 bp, mouse
gtgcggacggctggagaccc

SEQ ID NO: 428428 - DNA, 20 bp, mouse
gggcgagcgggccatgcgga

SEQ ID NO: 428429 - DNA, 20 bp, mouse
gacggcgacgccgggaacaa

SEQ ID NO: 428430 - DNA, 20 bp, mouse
gcggctgccggggcggtgac

SEQ ID NO: 428431 - DNA, 20 bp, mouse
gggacagggagcctgcacgg

SEQ ID NO: 428432 - DNA, 20 bp, mouse
gtccaatgggagcccgggag

SEQ ID NO: 428433 - DNA, 20 bp, mouse
gccccgagcgcgagcccagg

SEQ ID NO: 428434 - DNA, 20 bp, mouse
gctccgggcggcatgcgatg

SEQ ID NO: 428435 - DNA, 20 bp, mouse
gccggagcccgcgggcctag

SEQ ID NO: 428436 - DNA, 20 bp, mouse
gtgcgacgcaccggaggaga

SEQ ID NO: 428437 - DNA, 20 bp, mouse
gccggcggctccaagctcca

SEQ ID NO: 428438 - DNA, 20 bp, mouse
gggctgctgcgacgcaccgg

SEQ ID NO: 428439 - DNA, 20 bp, mouse
gggtgcgtcgcagcagccgg

SEQ ID NO: 428440 - DNA, 20 bp, mouse
ggctcggcaggtgacagccg

SEQ ID NO: 428441 - DNA, 20 bp, mouse
gagggttgcgagccgcgaga

SEQ ID NO: 428442 - DNA, 20 bp, mouse
ggataaggccctgaacgagg

SEQ ID NO: 428443 - DNA, 20 bp, mouse
ggagaggacgctgcgctgga

SEQ ID NO: 428444 - DNA, 20 bp, mouse
gaggtgacagccgtggagct

SEQ ID NO: 428445 - DNA, 20 bp, mouse
ggggcggcggctaagagata

SEQ ID NO: 428446 - DNA, 20 bp, mouse
gccacaccaggaaccaagca

SEQ ID NO: 428447 - DNA, 20 bp, mouse
gaaaggttaagagccacacc

SEQ ID NO: 428448 - DNA, 20 bp, mouse
ggtattccttgcttggttcc

SEQ ID NO: 428449 - DNA, 20 bp, mouse
gtagagaatgttggaagtta

SEQ ID NO: 428450 - DNA, 20 bp, mouse
gagtacaggtattccttgct

SEQ ID NO: 428451 - DNA, 20 bp, mouse
ggaaaagcaaggtgtcatat

SEQ ID NO: 428452 - DNA, 20 bp, mouse
gcttccaacattctctaaaa

SEQ ID NO: 428453 - DNA, 20 bp, mouse
gagctttggctcgggagggt

SEQ ID NO: 428454 - DNA, 20 bp, mouse
gggggaagggagaactgcac

SEQ ID NO: 428455 - DNA, 20 bp, mouse
gatttcggccgtgaaaactt

SEQ ID NO: 428456 - DNA, 20 bp, mouse
gtaccaggaagtgctgggtg

SEQ ID NO: 428457 - DNA, 20 bp, mouse
gctggtatgggacagagctg

SEQ ID NO: 428458 - DNA, 20 bp, mouse
ggtcccataccaggaagtgc

SEQ ID NO: 428459 - DNA, 20 bp, mouse
ggcgtccttgctccaccctg

SEQ ID NO: 428460 - DNA, 20 bp, mouse
ggtggcccccgggtacatgt

SEQ ID NO: 428461 - DNA, 20 bp, mouse
gcaccgaagccaggtgagct

SEQ ID NO: 428462 - DNA, 20 bp, mouse
gcaagacgcaggcccaggaa

SEQ ID NO: 428463 - DNA, 20 bp, mouse
gaccagaaggaaaactagag

SEQ ID NO: 428464 - DNA, 20 bp, mouse
gacctcccacatgtacccgg

SEQ ID NO: 428465 - DNA, 20 bp, mouse
gcccccattcccacttcaga

SEQ ID NO: 428466 - DNA, 20 bp, mouse
gtagccgagggcggcggcaa

SEQ ID NO: 428467 - DNA, 20 bp, mouse
gtggccgaccagcccagcta

SEQ ID NO: 428468 - DNA, 20 bp, mouse
ggcggcaacggcaggaactg

SEQ ID NO: 428469 - DNA, 20 bp, mouse
gaacagggtgggtcctgaca

SEQ ID NO: 428470 - DNA, 20 bp, mouse
gtctacgtactggatctgaa

SEQ ID NO: 428471 - DNA, 20 bp, mouse
gacggcgctggcggacatgg

SEQ ID NO: 428472 - DNA, 20 bp, mouse
gttcatggaccggaagtgga

SEQ ID NO: 428473 - DNA, 20 bp, mouse
ggtggaggggaagtgtctcg

SEQ ID NO: 428474 - DNA, 20 bp, mouse
gaggtctcggcagtagccga

SEQ ID NO: 428475 - DNA, 20 bp, mouse
gctagggcgtcaggcaggcg

SEQ ID NO: 428476 - DNA, 20 bp, mouse
gactgccgaggccgacatgg

SEQ ID NO: 428477 - DNA, 20 bp, mouse
gaagactgccgaggccgaca

SEQ ID NO: 428478 - DNA, 20 bp, mouse
gaggcgagagcgagctgcag

SEQ ID NO: 428479 - DNA, 20 bp, mouse
gttcagggcgctcagatggt

SEQ ID NO: 428480 - DNA, 20 bp, mouse
gggtggcagtccgtgaagct

SEQ ID NO: 428481 - DNA, 20 bp, mouse
gtccagaatgaagactgccg

SEQ ID NO: 428482 - DNA, 20 bp, mouse
gtcttcattctggacgtcaa

SEQ ID NO: 428483 - DNA, 20 bp, mouse
ggcctcggcagtcttcattc

SEQ ID NO: 428484 - DNA, 20 bp, mouse
gactgccaccatgtcggcct

SEQ ID NO: 428485 - DNA, 20 bp, mouse
gaggcgcttccgcaggaaga

SEQ ID NO: 428486 - DNA, 20 bp, mouse
gctggaggctgcaggatggt

SEQ ID NO: 428487 - DNA, 20 bp, mouse
gggccggagagggacgcacc

SEQ ID NO: 428488 - DNA, 20 bp, mouse
ggagggacgcaccgggctgg

SEQ ID NO: 428489 - DNA, 20 bp, mouse
gtgctggagagagctgacct

SEQ ID NO: 428490 - DNA, 20 bp, mouse
gggagagggacgcaccgggc

SEQ ID NO: 428491 - DNA, 20 bp, mouse
ggtggagctggcttctacgg

SEQ ID NO: 428492 - DNA, 20 bp, mouse
gcttctacggtggccggaga

SEQ ID NO: 428493 - DNA, 20 bp, mouse
ggaggggacggggacccgag

SEQ ID NO: 428494 - DNA, 20 bp, mouse
gccagagcctaggtccccga

SEQ ID NO: 428495 - DNA, 20 bp, mouse
gcccatggagagctcggtgt

SEQ ID NO: 428496 - DNA, 20 bp, mouse
gtcccctccccgcggcacca

SEQ ID NO: 428497 - DNA, 20 bp, mouse
gttccacagcacggcgacgg

SEQ ID NO: 428498 - DNA, 20 bp, mouse
gtgctgtggaagggaagccg

SEQ ID NO: 428499 - DNA, 20 bp, mouse
gaggggacccgtctggtgga

SEQ ID NO: 428500 - DNA, 20 bp, mouse
ggccgcggagactgaggcgc

SEQ ID NO: 428501 - DNA, 20 bp, mouse
gaagggaagccgtggtgccg

SEQ ID NO: 428502 - DNA, 20 bp, mouse
gcccttccacagcacggcga

SEQ ID NO: 428503 - DNA, 20 bp, mouse
gggcttaggctgcgagggta

SEQ ID NO: 428504 - DNA, 20 bp, mouse
gcgtcggggcgctcacgggg

SEQ ID NO: 428505 - DNA, 20 bp, mouse
gagcccccgtcgccgtgctg

SEQ ID NO: 428506 - DNA, 20 bp, mouse
gtcaccgctagccccaccca

SEQ ID NO: 428507 - DNA, 20 bp, mouse
gcccgggaccatggtgagta

SEQ ID NO: 428508 - DNA, 20 bp, mouse
gaccctcgcctgtgactcgg

SEQ ID NO: 428509 - DNA, 20 bp, mouse
ggcgctccaggtgacacctg

SEQ ID NO: 428510 - DNA, 20 bp, mouse
gtggggctagcggtgatgag

SEQ ID NO: 428511 - DNA, 20 bp, mouse
gctgggtaccgccgagtcac

SEQ ID NO: 428512 - DNA, 20 bp, mouse
gcaaaggaagaaccaggggg

SEQ ID NO: 428513 - DNA, 20 bp, mouse
gggctccagggccgaacacg

SEQ ID NO: 428514 - DNA, 20 bp, mouse
gggtgacacctgcggctcca

SEQ ID NO: 428515 - DNA, 20 bp, mouse
gctgcaaactttcagttcaa

SEQ ID NO: 428516 - DNA, 20 bp, mouse
gctggcggcaccgggcggaa

SEQ ID NO: 428517 - DNA, 20 bp, mouse
gcggatgtcggagatgaaca

SEQ ID NO: 428518 - DNA, 20 bp, mouse
ggctccaagcctggccgaac

SEQ ID NO: 428519 - DNA, 20 bp, mouse
ggatacagccggcatgatgg

SEQ ID NO: 428520 - DNA, 20 bp, mouse
gggctcctcggcgccgtctg

SEQ ID NO: 428521 - DNA, 20 bp, mouse
gcccggatgacaatccgtag

SEQ ID NO: 428522 - DNA, 20 bp, mouse
gtcagggacgcagaagagat

SEQ ID NO: 428523 - DNA, 20 bp, mouse
gcctcccccggccggctcct

SEQ ID NO: 428524 - DNA, 20 bp, mouse
gcaaaggcgatggcatgcgt

SEQ ID NO: 428525 - DNA, 20 bp, mouse
ggcctagatggaggaaatca

SEQ ID NO: 428526 - DNA, 20 bp, mouse
ggcgcgcgcagcccagcgag

SEQ ID NO: 428527 - DNA, 20 bp, mouse
gcggtcacgccgaagagccc

SEQ ID NO: 428528 - DNA, 20 bp, mouse
ggccgaagagccctggagcg

SEQ ID NO: 428529 - DNA, 20 bp, mouse
gcccagcgagcggcgctcgg

SEQ ID NO: 428530 - DNA, 20 bp, mouse
gtaggcggctccgcgctcca

SEQ ID NO: 428531 - DNA, 20 bp, mouse
ggcccgaggcggctgtggct

SEQ ID NO: 428532 - DNA, 20 bp, mouse
gtccgcgctccagggctctt

SEQ ID NO: 428533 - DNA, 20 bp, mouse
gagcggcgctcgggggcccg

SEQ ID NO: 428534 - DNA, 20 bp, mouse
gtagaacagcacgggcgcgg

SEQ ID NO: 428535 - DNA, 20 bp, mouse
gcgggggcccgaggcggctg

SEQ ID NO: 428536 - DNA, 20 bp, mouse
gaagcaccgcgagtcagtca

SEQ ID NO: 428537 - DNA, 20 bp, mouse
ggccgccttgaactcaccgg

SEQ ID NO: 428538 - DNA, 20 bp, mouse
ggcctccggtgagttcaagg

SEQ ID NO: 428539 - DNA, 20 bp, mouse
gcagtcggagagcacagccg

SEQ ID NO: 428540 - DNA, 20 bp, mouse
gggagagccgaggagcgtga

SEQ ID NO: 428541 - DNA, 20 bp, mouse
ggtgtgccctgactgactcg

SEQ ID NO: 428542 - DNA, 20 bp, mouse
gcgcggtgcttgtgagggag

SEQ ID NO: 428543 - DNA, 20 bp, mouse
gttgaactcaccggaggcaa

SEQ ID NO: 428544 - DNA, 20 bp, mouse
gctcaccggaggcaagggcg

SEQ ID NO: 428545 - DNA, 20 bp, mouse
ggagggtggaaggagtcctc

SEQ ID NO: 428546 - DNA, 20 bp, mouse
gcgtctccgggaagagacta

SEQ ID NO: 428547 - DNA, 20 bp, mouse
gtcagccttcagacccggga

SEQ ID NO: 428548 - DNA, 20 bp, mouse
gcgggagggagtagacaacc

SEQ ID NO: 428549 - DNA, 20 bp, mouse
ggagggagtagacaaccggg

SEQ ID NO: 428550 - DNA, 20 bp, mouse
gcgcctggcgggtcactgga

SEQ ID NO: 428551 - DNA, 20 bp, mouse
gttgggcgcgattgcagcaa

SEQ ID NO: 428552 - DNA, 20 bp, mouse
gctgtcactgtccaagggag

SEQ ID NO: 428553 - DNA, 20 bp, mouse
gctgaggccactccccggtg

SEQ ID NO: 428554 - DNA, 20 bp, mouse
gtgccctgcacggtgctggg

SEQ ID NO: 428555 - DNA, 20 bp, mouse
gggcgcagctgcgatcgggg

SEQ ID NO: 428556 - DNA, 20 bp, mouse
gcccgggtcccgctgtaaca

SEQ ID NO: 428557 - DNA, 20 bp, mouse
gggtcaggaatggggatcag

SEQ ID NO: 428558 - DNA, 20 bp, mouse
ggggtcgccatggtaacggg

SEQ ID NO: 428559 - DNA, 20 bp, mouse
gcagcgggacccgggcctct

SEQ ID NO: 428560 - DNA, 20 bp, mouse
gtaccatggcgacccctgtc

SEQ ID NO: 428561 - DNA, 20 bp, mouse
gggagccgccctgttacagc

SEQ ID NO: 428562 - DNA, 20 bp, mouse
ggacgctccccccgttacca

SEQ ID NO: 428563 - DNA, 20 bp, mouse
gccacaactgcaagcagagc

SEQ ID NO: 428564 - DNA, 20 bp, mouse
ggtccagacaggggtcgcca

SEQ ID NO: 428565 - DNA, 20 bp, mouse
gcttgcagttgtggggccca

SEQ ID NO: 428566 - DNA, 20 bp, mouse
ggagcgtgcggggtcctcta

SEQ ID NO: 428567 - DNA, 20 bp, mouse
ggaacgccagccatccgtag

SEQ ID NO: 428568 - DNA, 20 bp, mouse
ggtgcggggtcctctacgga

SEQ ID NO: 428569 - DNA, 20 bp, mouse
gagaggccgaaggcgcccga

SEQ ID NO: 428570 - DNA, 20 bp, mouse
gaacgagcagtcgggaggag

SEQ ID NO: 428571 - DNA, 20 bp, mouse
gcaggaaccgagagcagccc

SEQ ID NO: 428572 - DNA, 20 bp, mouse
ggaaccgagagcagcccggg

SEQ ID NO: 428573 - DNA, 20 bp, mouse
gtcgctgctgaagaggccga

SEQ ID NO: 428574 - DNA, 20 bp, mouse
gcctacaacgagcagtcggg

SEQ ID NO: 428575 - DNA, 20 bp, mouse
gctccgccccagaactagtt

SEQ ID NO: 428576 - DNA, 20 bp, mouse
ggacatggatctgcgctgag

SEQ ID NO: 428577 - DNA, 20 bp, mouse
gggatgcacgcctagctctg

SEQ ID NO: 428578 - DNA, 20 bp, mouse
gcggcctacagcgaagacaa

SEQ ID NO: 428579 - DNA, 20 bp, mouse
ggagcggccgggttgggctt

SEQ ID NO: 428580 - DNA, 20 bp, mouse
gtcttcgctgtaggccggag

SEQ ID NO: 428581 - DNA, 20 bp, mouse
gggagctgcaatctgcgcgg

SEQ ID NO: 428582 - DNA, 20 bp, mouse
gcctacagcgaagacaaggg

SEQ ID NO: 428583 - DNA, 20 bp, mouse
gattgcagctccgcagagct

SEQ ID NO: 428584 - DNA, 20 bp, mouse
gttgggctttggtcgaggaa

SEQ ID NO: 428585 - DNA, 20 bp, mouse
gccgggttgggctttggtcg

SEQ ID NO: 428586 - DNA, 20 bp, mouse
gagcggccctaagctgggaa

SEQ ID NO: 428587 - DNA, 20 bp, mouse
gcaaatggcggccaagatgg

SEQ ID NO: 428588 - DNA, 20 bp, mouse
gttagggccgctgcaaatgg

SEQ ID NO: 428589 - DNA, 20 bp, mouse
gtcttggccgccatttgcag

SEQ ID NO: 428590 - DNA, 20 bp, mouse
gagcttagggccgctgcaaa

SEQ ID NO: 428591 - DNA, 20 bp, mouse
gtggcggccaagatggcggt

SEQ ID NO: 428592 - DNA, 20 bp, mouse
gagctgacccaccgccatct

SEQ ID NO: 428593 - DNA, 20 bp, mouse
gaccatcttgagggccatcg

SEQ ID NO: 428594 - DNA, 20 bp, mouse
gtggccctcaagatggtcaa

SEQ ID NO: 428595 - DNA, 20 bp, mouse
ggcgggccagaggcaatggg

SEQ ID NO: 428596 - DNA, 20 bp, mouse
gctgagtcgcccaggtgtcg

SEQ ID NO: 428597 - DNA, 20 bp, mouse
gcacactcaccccgacacct

SEQ ID NO: 428598 - DNA, 20 bp, mouse
gagggtccgagaaccctacg

SEQ ID NO: 428599 - DNA, 20 bp, mouse
gtccgagcgcggggtcctcg

SEQ ID NO: 428600 - DNA, 20 bp, mouse
gctagccagctgggccggaa

SEQ ID NO: 428601 - DNA, 20 bp, mouse
gtagtaatcgaggtcctgta

SEQ ID NO: 428602 - DNA, 20 bp, mouse
ggtgagggcggggagtctcc

SEQ ID NO: 428603 - DNA, 20 bp, mouse
ggcgcctgcccggcacgtcc

SEQ ID NO: 428604 - DNA, 20 bp, mouse
gagcagccgcagaggcacca

SEQ ID NO: 428605 - DNA, 20 bp, mouse
ggcggtgcacctgccacgta

SEQ ID NO: 428606 - DNA, 20 bp, mouse
gctgcgctgcggagccggaa

SEQ ID NO: 428607 - DNA, 20 bp, mouse
gcggaacggagcctgagacc

SEQ ID NO: 428608 - DNA, 20 bp, mouse
ggacctggtcgaagctggta

SEQ ID NO: 428609 - DNA, 20 bp, mouse
gggtcgaagctggtagggtt

SEQ ID NO: 428610 - DNA, 20 bp, mouse
gccagcttcgaccaggtctc

SEQ ID NO: 428611 - DNA, 20 bp, mouse
ggggcgcgcgcggatgggaa

SEQ ID NO: 428612 - DNA, 20 bp, mouse
gaagctggtagggttgggct

SEQ ID NO: 428613 - DNA, 20 bp, mouse
ggtcgcctgggagagaggta

SEQ ID NO: 428614 - DNA, 20 bp, mouse
gccagcagcctgcaagccta

SEQ ID NO: 428615 - DNA, 20 bp, mouse
gctggagccccaaggcccat

SEQ ID NO: 428616 - DNA, 20 bp, mouse
gtcgcccgacaggaaaacag

SEQ ID NO: 428617 - DNA, 20 bp, mouse
ggcaggggcatactcacata

SEQ ID NO: 428618 - DNA, 20 bp, mouse
gcggcgcgagggtcgttcgg

SEQ ID NO: 428619 - DNA, 20 bp, mouse
gagcgccgggcagcgcccag

SEQ ID NO: 428620 - DNA, 20 bp, mouse
gcgcccgagctgacagccag

SEQ ID NO: 428621 - DNA, 20 bp, mouse
gactgaggtaccgggcaggt

SEQ ID NO: 428622 - DNA, 20 bp, mouse
gtgggcagcgccccttgagg

SEQ ID NO: 428623 - DNA, 20 bp, mouse
gagccagcggcgcgagaagt

SEQ ID NO: 428624 - DNA, 20 bp, mouse
gtcggacgccgggagggccg

SEQ ID NO: 428625 - DNA, 20 bp, mouse
ggagaagtcggacgccggga

SEQ ID NO: 428626 - DNA, 20 bp, mouse
gcaggtggtaccgagagaag

SEQ ID NO: 428627 - DNA, 20 bp, mouse
ggtaccgagagaagcgggac

SEQ ID NO: 428628 - DNA, 20 bp, mouse
gttgccggtcccgcttctct

SEQ ID NO: 428629 - DNA, 20 bp, mouse
ggatccaggaaggatgaggg

SEQ ID NO: 428630 - DNA, 20 bp, mouse
ggaaggtgcgttcttggagc

SEQ ID NO: 428631 - DNA, 20 bp, mouse
gccaagaacgcaccttcttc

SEQ ID NO: 428632 - DNA, 20 bp, mouse
gctttcagcgggacaccaac

SEQ ID NO: 428633 - DNA, 20 bp, mouse
gttcgtgttgtgccggaaga

SEQ ID NO: 428634 - DNA, 20 bp, mouse
gtggctctggtgctccgcag

SEQ ID NO: 428635 - DNA, 20 bp, mouse
ggaaaagccaagatccagga

SEQ ID NO: 428636 - DNA, 20 bp, mouse
gctagcacagcctcctccct

SEQ ID NO: 428637 - DNA, 20 bp, mouse
ggactagattcccagggagg

SEQ ID NO: 428638 - DNA, 20 bp, mouse
gagacccgtagggaactcgt

SEQ ID NO: 428639 - DNA, 20 bp, mouse
gttccgcaggaagctgtctg

SEQ ID NO: 428640 - DNA, 20 bp, mouse
ggaatgtgttccgccctggg

SEQ ID NO: 428641 - DNA, 20 bp, mouse
ggagccgcccggagacccac

SEQ ID NO: 428642 - DNA, 20 bp, mouse
ggagagagttgagatctgct

SEQ ID NO: 428643 - DNA, 20 bp, mouse
gtagtcagtgaaaacactaa

SEQ ID NO: 428644 - DNA, 20 bp, mouse
gcgtcctcagagccaaggta

SEQ ID NO: 428645 - DNA, 20 bp, mouse
ggatgtgggagcctgaataa

SEQ ID NO: 428646 - DNA, 20 bp, mouse
ggaggcagcgatgagcgaca

SEQ ID NO: 428647 - DNA, 20 bp, mouse
ggcagcgatgagcgacatgg

SEQ ID NO: 428648 - DNA, 20 bp, mouse
ggcgaagtagcctcgtaggg

SEQ ID NO: 428649 - DNA, 20 bp, mouse
ggatgagcgacatggtggag

SEQ ID NO: 428650 - DNA, 20 bp, mouse
gcagcgcgaagtagcctcgt

SEQ ID NO: 428651 - DNA, 20 bp, mouse
gacgccggaagtgactacgg

SEQ ID NO: 428652 - DNA, 20 bp, mouse
gtcatcgctgcctccctacg

SEQ ID NO: 428653 - DNA, 20 bp, mouse
gtcctcccagctggttctgc

SEQ ID NO: 428654 - DNA, 20 bp, mouse
gggtcggtacaggcaacttg

SEQ ID NO: 428655 - DNA, 20 bp, mouse
gaaaacgccggaagtgacta

SEQ ID NO: 428656 - DNA, 20 bp, mouse
gtagatgagcggatccccct

SEQ ID NO: 428657 - DNA, 20 bp, mouse
ggacagtggtggtcgtgatg

SEQ ID NO: 428658 - DNA, 20 bp, mouse
gccgcgtccacaaggcgggg

SEQ ID NO: 428659 - DNA, 20 bp, mouse
ggttccgcgtccacaaggcg

SEQ ID NO: 428660 - DNA, 20 bp, mouse
gccaggtggaaagatagtta

SEQ ID NO: 428661 - DNA, 20 bp, mouse
gagtgcctcctccctgtcaa

SEQ ID NO: 428662 - DNA, 20 bp, mouse
gggaacaaaaggccgcacgg

SEQ ID NO: 428663 - DNA, 20 bp, mouse
gtaaagcgccagcctccgtg

SEQ ID NO: 428664 - DNA, 20 bp, mouse
ggctgcccttgacagggagg

SEQ ID NO: 428665 - DNA, 20 bp, mouse
gctgtcaagggcagcttggt

SEQ ID NO: 428666 - DNA, 20 bp, mouse
gcgcgctgcgggcatccttg

SEQ ID NO: 428667 - DNA, 20 bp, mouse
gagggtgaggccacgcggag

SEQ ID NO: 428668 - DNA, 20 bp, mouse
ggcaggacgccacatcggaa

SEQ ID NO: 428669 - DNA, 20 bp, mouse
gcgcttgtgggtccccttga

SEQ ID NO: 428670 - DNA, 20 bp, mouse
gaggcaaagacgctcatccc

SEQ ID NO: 428671 - DNA, 20 bp, mouse
gcgcgtggcctcaccctcaa

SEQ ID NO: 428672 - DNA, 20 bp, mouse
gctgaggcccgtgccctcaa

SEQ ID NO: 428673 - DNA, 20 bp, mouse
ggccgcagcagggacccggg

SEQ ID NO: 428674 - DNA, 20 bp, mouse
gagggggcaggacgccacat

SEQ ID NO: 428675 - DNA, 20 bp, mouse
ggccggggccccacacacaa

SEQ ID NO: 428676 - DNA, 20 bp, mouse
gccgcggcagctgactcaag

SEQ ID NO: 428677 - DNA, 20 bp, mouse
gctgactcaagcggtgagag

SEQ ID NO: 428678 - DNA, 20 bp, mouse
gggagccgaccgagcgcccg

SEQ ID NO: 428679 - DNA, 20 bp, mouse
ggaggccgacccgttaccac

SEQ ID NO: 428680 - DNA, 20 bp, mouse
gcccctggcgcccgtggtaa

SEQ ID NO: 428681 - DNA, 20 bp, mouse
ggctgccgcgggcgctcggt

SEQ ID NO: 428682 - DNA, 20 bp, mouse
gtaagcctcccgcctacgaa

SEQ ID NO: 428683 - DNA, 20 bp, mouse
gcgctcggtcggctccttcc

SEQ ID NO: 428684 - DNA, 20 bp, mouse
gtaggtcccgagatgaactc

SEQ ID NO: 428685 - DNA, 20 bp, mouse
ggtcccgagatgaactctgg

SEQ ID NO: 428686 - DNA, 20 bp, mouse
gcctacacccggaatctcaa

SEQ ID NO: 428687 - DNA, 20 bp, mouse
gggtcttaagaacctacacc

SEQ ID NO: 428688 - DNA, 20 bp, mouse
ggggccgccgtcccggaagt

SEQ ID NO: 428689 - DNA, 20 bp, mouse
gtgaggtgactcaagtctcc

SEQ ID NO: 428690 - DNA, 20 bp, mouse
ggattaaaacactcctcaga

SEQ ID NO: 428691 - DNA, 20 bp, mouse
gcagagcgatgtagaaacta

SEQ ID NO: 428692 - DNA, 20 bp, mouse
ggaaagcctaaattgcccaa

SEQ ID NO: 428693 - DNA, 20 bp, mouse
gctggtacagcccatctaga

SEQ ID NO: 428694 - DNA, 20 bp, mouse
gtacttgggaggcttaacca

SEQ ID NO: 428695 - DNA, 20 bp, mouse
ggctgtaccaggcaacgtcc

SEQ ID NO: 428696 - DNA, 20 bp, mouse
ggcggcagaagggtgaccag

SEQ ID NO: 428697 - DNA, 20 bp, mouse
ggctctgggcaaagcgagag

SEQ ID NO: 428698 - DNA, 20 bp, mouse
gtgagcgcgtcattacccca

SEQ ID NO: 428699 - DNA, 20 bp, mouse
gcgcaactggggcagatagt

SEQ ID NO: 428700 - DNA, 20 bp, mouse
gtagcaagcccgcttcagga

SEQ ID NO: 428701 - DNA, 20 bp, mouse
ggagagagcctggccgctct

SEQ ID NO: 428702 - DNA, 20 bp, mouse
ggtggcagcccccggtctca

SEQ ID NO: 428703 - DNA, 20 bp, mouse
gcgaggcagtgacgcaactg

SEQ ID NO: 428704 - DNA, 20 bp, mouse
gggtcaaagtctgcaaatct

SEQ ID NO: 428705 - DNA, 20 bp, mouse
gtcggctgggacagagtgag

SEQ ID NO: 428706 - DNA, 20 bp, mouse
gggtgggcttggagccgtgt

SEQ ID NO: 428707 - DNA, 20 bp, mouse
gcgccgagaacatgccgaca

SEQ ID NO: 428708 - DNA, 20 bp, mouse
gacacgatcccggaagtccg

SEQ ID NO: 428709 - DNA, 20 bp, mouse
gcaacgtttcgggcactggt

SEQ ID NO: 428710 - DNA, 20 bp, mouse
gcatggacccagacacgatg

SEQ ID NO: 428711 - DNA, 20 bp, mouse
gaagtccgcggcaacgtttc

SEQ ID NO: 428712 - DNA, 20 bp, mouse
gtaagaggtggggcgaaaga

SEQ ID NO: 428713 - DNA, 20 bp, mouse
ggcgacctgcgtggaatgtg

SEQ ID NO: 428714 - DNA, 20 bp, mouse
gagccgtgtcggcatgttct

SEQ ID NO: 428715 - DNA, 20 bp, mouse
gcgtcctggctggatcacgt

SEQ ID NO: 428716 - DNA, 20 bp, mouse
gtcccgccagaggggtgaag

SEQ ID NO: 428717 - DNA, 20 bp, mouse
ggagcagctgatacccaggg

SEQ ID NO: 428718 - DNA, 20 bp, mouse
ggcgcgctgtgtggactggg

SEQ ID NO: 428719 - DNA, 20 bp, mouse
gggcgcgcgctgtgtggact

SEQ ID NO: 428720 - DNA, 20 bp, mouse
ggcggtgtttgagtgctccg

SEQ ID NO: 428721 - DNA, 20 bp, mouse
gggtgaagcggcgactggag

SEQ ID NO: 428722 - DNA, 20 bp, mouse
ggcccgaggcaagcccaccg

SEQ ID NO: 428723 - DNA, 20 bp, mouse
gtcgcggaagggtgtgagag

SEQ ID NO: 428724 - DNA, 20 bp, mouse
gggtgtgtgccatcagccac

SEQ ID NO: 428725 - DNA, 20 bp, mouse
gcccgagcagctgataccca

SEQ ID NO: 428726 - DNA, 20 bp, mouse
ggcggctgccgagctagagc

SEQ ID NO: 428727 - DNA, 20 bp, mouse
ggcggccggaggggcccgag

SEQ ID NO: 428728 - DNA, 20 bp, mouse
gcgctcctccggctctagct

SEQ ID NO: 428729 - DNA, 20 bp, mouse
ggctgccgagctagagccgg

SEQ ID NO: 428730 - DNA, 20 bp, mouse
gtctagctcggcagccgctc

SEQ ID NO: 428731 - DNA, 20 bp, mouse
gcggcaggcgacatccaggg

SEQ ID NO: 428732 - DNA, 20 bp, mouse
ggccccggcgcgcgtcacga

SEQ ID NO: 428733 - DNA, 20 bp, mouse
gcgtcacgagggcgagcggg

SEQ ID NO: 428734 - DNA, 20 bp, mouse
ggcgcgtcacgagggcgagc

SEQ ID NO: 428735 - DNA, 20 bp, mouse
gaggcaaggtaccaccgcca

SEQ ID NO: 428736 - DNA, 20 bp, mouse
gagcccgggaagctggatag

SEQ ID NO: 428737 - DNA, 20 bp, mouse
ggcctcgccgacccagtcgg

SEQ ID NO: 428738 - DNA, 20 bp, mouse
gccgccgcccccgactgggt

SEQ ID NO: 428739 - DNA, 20 bp, mouse
gccgggctcattagcagtct

SEQ ID NO: 428740 - DNA, 20 bp, mouse
gctggccgctaggttatcag

SEQ ID NO: 428741 - DNA, 20 bp, mouse
ggcagtctcggtgtgcggct

SEQ ID NO: 428742 - DNA, 20 bp, mouse
gtagcaccccccggtcccag

SEQ ID NO: 428743 - DNA, 20 bp, mouse
gtcggtgtgcggctcggcgc

SEQ ID NO: 428744 - DNA, 20 bp, mouse
gagccccacaaggtccgaaa

SEQ ID NO: 428745 - DNA, 20 bp, mouse
gcgccgctatccagcttccc

SEQ ID NO: 428746 - DNA, 20 bp, mouse
gactcttctggaaggacggg

SEQ ID NO: 428747 - DNA, 20 bp, mouse
gcggcccgggcaggattgtc

SEQ ID NO: 428748 - DNA, 20 bp, mouse
gagctgctgactcttctgga

SEQ ID NO: 428749 - DNA, 20 bp, mouse
ggtcagagcctgagttctag

SEQ ID NO: 428750 - DNA, 20 bp, mouse
gcagaagcctgagttcccgg

SEQ ID NO: 428751 - DNA, 20 bp, mouse
gctgcccgggccggagacac

SEQ ID NO: 428752 - DNA, 20 bp, mouse
ggtacctgtgtctccggccc

SEQ ID NO: 428753 - DNA, 20 bp, mouse
gctctctgggatcccagctt

SEQ ID NO: 428754 - DNA, 20 bp, mouse
ggctcccgtgggtgacccaa

SEQ ID NO: 428755 - DNA, 20 bp, mouse
ggcagtgcttgagttcccag

SEQ ID NO: 428756 - DNA, 20 bp, mouse
gcggcctgcgcgctcctggg

SEQ ID NO: 428757 - DNA, 20 bp, mouse
gcaggcccgcggtaggaagg

SEQ ID NO: 428758 - DNA, 20 bp, mouse
gtcgcggcctgcgcgctcct

SEQ ID NO: 428759 - DNA, 20 bp, mouse
ggaggccgcgccccgagcgg

SEQ ID NO: 428760 - DNA, 20 bp, mouse
gcgcggaggtgagtccacgg

SEQ ID NO: 428761 - DNA, 20 bp, mouse
gcacggagtctgatccgcta

SEQ ID NO: 428762 - DNA, 20 bp, mouse
ggagtctgatccgctaggga

SEQ ID NO: 428763 - DNA, 20 bp, mouse
gcgacgcggaggtgagtcca

SEQ ID NO: 428764 - DNA, 20 bp, mouse
gcccccgccgggcatcctag

SEQ ID NO: 428765 - DNA, 20 bp, mouse
gcggtgcaggaccgacgcgg

SEQ ID NO: 428766 - DNA, 20 bp, mouse
ggctcaacccggcccatctc

SEQ ID NO: 428767 - DNA, 20 bp, mouse
gggcttgcagagatgcgagg

SEQ ID NO: 428768 - DNA, 20 bp, mouse
ggggttgagcctaagtgcac

SEQ ID NO: 428769 - DNA, 20 bp, mouse
gggctgtgcagagatgcgcg

SEQ ID NO: 428770 - DNA, 20 bp, mouse
gcggaatgagcagagatgag

SEQ ID NO: 428771 - DNA, 20 bp, mouse
gtgctcattccggtgcactt

SEQ ID NO: 428772 - DNA, 20 bp, mouse
gccccataggacacgcagtg

SEQ ID NO: 428773 - DNA, 20 bp, mouse
gctgggaggagggtgcgagg

SEQ ID NO: 428774 - DNA, 20 bp, mouse
ggagcacaagaggtgcccag

SEQ ID NO: 428775 - DNA, 20 bp, mouse
ggtggcacaggtccacgcac

SEQ ID NO: 428776 - DNA, 20 bp, mouse
gagccagtgctgctctaagt

SEQ ID NO: 428777 - DNA, 20 bp, mouse
gtgagcacccggatcagctg

SEQ ID NO: 428778 - DNA, 20 bp, mouse
gtgcagcccgcagctgatcc

SEQ ID NO: 428779 - DNA, 20 bp, mouse
gggcgagcgggactccgcag

SEQ ID NO: 428780 - DNA, 20 bp, mouse
gtcagcggactgcgagacct

SEQ ID NO: 428781 - DNA, 20 bp, mouse
gacgcctgctgcagatgcga

SEQ ID NO: 428782 - DNA, 20 bp, mouse
ggtgggagtgagggagtaat

SEQ ID NO: 428783 - DNA, 20 bp, mouse
gccgaaccccagctctgggt

SEQ ID NO: 428784 - DNA, 20 bp, mouse
gcggagggcaaagtgcgggt

SEQ ID NO: 428785 - DNA, 20 bp, mouse
gctgaaggcatggaaggaag

SEQ ID NO: 428786 - DNA, 20 bp, mouse
ggacactacgaactccgcac

SEQ ID NO: 428787 - DNA, 20 bp, mouse
gtaactatgagttcctcgga

SEQ ID NO: 428788 - DNA, 20 bp, mouse
gttagtaactatgagttcct

SEQ ID NO: 428789 - DNA, 20 bp, mouse
gtagtgtcagtacgcttcgt

SEQ ID NO: 428790 - DNA, 20 bp, mouse
gggccagcagaggctatgct

SEQ ID NO: 428791 - DNA, 20 bp, mouse
gggcggtctccggcgcagag

SEQ ID NO: 428792 - DNA, 20 bp, mouse
gcagctccggaggtcgcgtt

SEQ ID NO: 428793 - DNA, 20 bp, mouse
gtctccggcgcagagaggct

SEQ ID NO: 428794 - DNA, 20 bp, mouse
gacgctgggcgggataggga

SEQ ID NO: 428795 - DNA, 20 bp, mouse
ggtgcaccgagggtccggtt

SEQ ID NO: 428796 - DNA, 20 bp, mouse
gcgaagctcccccaaggtag

SEQ ID NO: 428797 - DNA, 20 bp, mouse
gagtgtggctgccggaaacc

SEQ ID NO: 428798 - DNA, 20 bp, mouse
gtccgggccccgagagtcac

SEQ ID NO: 428799 - DNA, 20 bp, mouse
gcttcccgcctccaacaaga

SEQ ID NO: 428800 - DNA, 20 bp, mouse
ggcaggaaggcgtacatagg

SEQ ID NO: 428801 - DNA, 20 bp, mouse
gagagtcacgggcggtacgg

SEQ ID NO: 428802 - DNA, 20 bp, mouse
gagggccttcgccatcttgt

SEQ ID NO: 428803 - DNA, 20 bp, mouse
gccgagagtcacgggcggta

SEQ ID NO: 428804 - DNA, 20 bp, mouse
gaccggccccgagcgcagga

SEQ ID NO: 428805 - DNA, 20 bp, mouse
gctcccccaaggtagcggcc

SEQ ID NO: 428806 - DNA, 20 bp, mouse
gccgggctcgaaaatggggt

SEQ ID NO: 428807 - DNA, 20 bp, mouse
gacagaatggaggtgctgcc

SEQ ID NO: 428808 - DNA, 20 bp, mouse
ggctgccgggctcgaaaatg

SEQ ID NO: 428809 - DNA, 20 bp, mouse
gcagcttgccggggtgtcac

SEQ ID NO: 428810 - DNA, 20 bp, mouse
gtttgctacaggggagaggg

SEQ ID NO: 428811 - DNA, 20 bp, mouse
gggcagtggtagccaagagt

SEQ ID NO: 428812 - DNA, 20 bp, mouse
gatggccaggtttgctacag

SEQ ID NO: 428813 - DNA, 20 bp, mouse
gaggtttgctacaggggaga

SEQ ID NO: 428814 - DNA, 20 bp, mouse
gtctcctgtactgcagtggg

SEQ ID NO: 428815 - DNA, 20 bp, mouse
ggtgctgggctgtgatggcc

SEQ ID NO: 428816 - DNA, 20 bp, mouse
ggaaggaggatcagtcgtgg

SEQ ID NO: 428817 - DNA, 20 bp, mouse
ggtctcaggatagccttgga

SEQ ID NO: 428818 - DNA, 20 bp, mouse
gcagcttggctctccctcca

SEQ ID NO: 428819 - DNA, 20 bp, mouse
gacggaaggaggatcagtcg

SEQ ID NO: 428820 - DNA, 20 bp, mouse
gctcacgcaagggtccccag

SEQ ID NO: 428821 - DNA, 20 bp, mouse
ggatcagtcgtggaggtctc

SEQ ID NO: 428822 - DNA, 20 bp, mouse
gggaagggaacaaagacgga

SEQ ID NO: 428823 - DNA, 20 bp, mouse
gagggaacaaagacggaagg

SEQ ID NO: 428824 - DNA, 20 bp, mouse
ggtgctggccaactggacag

SEQ ID NO: 428825 - DNA, 20 bp, mouse
ggctgtgacggagctgaggg

SEQ ID NO: 428826 - DNA, 20 bp, mouse
gctcggcagcacaggcagag

SEQ ID NO: 428827 - DNA, 20 bp, mouse
gagcgccgcctggctaggcc

SEQ ID NO: 428828 - DNA, 20 bp, mouse
ggagggacaaagccgcatcc

SEQ ID NO: 428829 - DNA, 20 bp, mouse
gcagagggggttgttccaga

SEQ ID NO: 428830 - DNA, 20 bp, mouse
gggcctacaagccagacctg

SEQ ID NO: 428831 - DNA, 20 bp, mouse
ggcatcccggcctagccagg

SEQ ID NO: 428832 - DNA, 20 bp, mouse
gggggtgtctaggtctccgg

SEQ ID NO: 428833 - DNA, 20 bp, mouse
gagtccgtactgacagggcg

SEQ ID NO: 428834 - DNA, 20 bp, mouse
gcctgtcagtacggactcca

SEQ ID NO: 428835 - DNA, 20 bp, mouse
gcctgtgctgccgagacccc

SEQ ID NO: 428836 - DNA, 20 bp, mouse
gcgcggcgtgcacagctcag

SEQ ID NO: 428837 - DNA, 20 bp, mouse
gccagtcccgaggcccgccc

SEQ ID NO: 428838 - DNA, 20 bp, mouse
ggctcccagccccagtcccg

SEQ ID NO: 428839 - DNA, 20 bp, mouse
gtgaggagagtctgccgcgg

SEQ ID NO: 428840 - DNA, 20 bp, mouse
gatatgaggagagtctgccg

SEQ ID NO: 428841 - DNA, 20 bp, mouse
ggcgtcccgccccggcccct

SEQ ID NO: 428842 - DNA, 20 bp, mouse
ggtgcacgccgcggccgggg

SEQ ID NO: 428843 - DNA, 20 bp, mouse
gagccgagggcgccctgtac

SEQ ID NO: 428844 - DNA, 20 bp, mouse
ggcggcgctctgcaaatatg

SEQ ID NO: 428845 - DNA, 20 bp, mouse
gggcgggacgcggagaggct

SEQ ID NO: 428846 - DNA, 20 bp, mouse
gagctgctgctgtcataccc

SEQ ID NO: 428847 - DNA, 20 bp, mouse
gacagcagcagctgttactt

SEQ ID NO: 428848 - DNA, 20 bp, mouse
gagcagctgttacttgggtg

SEQ ID NO: 428849 - DNA, 20 bp, mouse
gtaccttggatgacaatgaa

SEQ ID NO: 428850 - DNA, 20 bp, mouse
gtcagacaggtaagaagctt

SEQ ID NO: 428851 - DNA, 20 bp, mouse
ggatctgggagtacctcaca

SEQ ID NO: 428852 - DNA, 20 bp, mouse
gtctctgcccttgacactgt

SEQ ID NO: 428853 - DNA, 20 bp, mouse
ggagaatacagcctatacat

SEQ ID NO: 428854 - DNA, 20 bp, mouse
gaaggcttctgaaagaaggc

SEQ ID NO: 428855 - DNA, 20 bp, mouse
gttatctcacagacctcaag

SEQ ID NO: 428856 - DNA, 20 bp, mouse
gactatggagcgtcaggtga

SEQ ID NO: 428857 - DNA, 20 bp, mouse
gcgggctacggaggccacgg

SEQ ID NO: 428858 - DNA, 20 bp, mouse
ggctaccgaaagaccgacta

SEQ ID NO: 428859 - DNA, 20 bp, mouse
gcccggaagtgaagctccgg

SEQ ID NO: 428860 - DNA, 20 bp, mouse
gagaccgactatggagcgtc

SEQ ID NO: 428861 - DNA, 20 bp, mouse
gttcggtagcagctaagtcc

SEQ ID NO: 428862 - DNA, 20 bp, mouse
gaggtcaccacgcagtatgg

SEQ ID NO: 428863 - DNA, 20 bp, mouse
gcggaggccacgggggccac

SEQ ID NO: 428864 - DNA, 20 bp, mouse
gacactggtgtgtagaccga

SEQ ID NO: 428865 - DNA, 20 bp, mouse
ggcatccaggtggagagatg

SEQ ID NO: 428866 - DNA, 20 bp, mouse
gacgaagccagagaccctca

SEQ ID NO: 428867 - DNA, 20 bp, mouse
gcgcgaaacgcgctagaaca

SEQ ID NO: 428868 - DNA, 20 bp, mouse
gaccctcacggcacaaagaa

SEQ ID NO: 428869 - DNA, 20 bp, mouse
gcaatcgcccacgtgggaac

SEQ ID NO: 428870 - DNA, 20 bp, mouse
gggtctctggcttcgttggg

SEQ ID NO: 428871 - DNA, 20 bp, mouse
gcggtgctccaggagcctaa

SEQ ID NO: 428872 - DNA, 20 bp, mouse
ggcagcgaggcgcctcccgt

SEQ ID NO: 428873 - DNA, 20 bp, mouse
gtcgctgaagggcctaacgc

SEQ ID NO: 428874 - DNA, 20 bp, mouse
gttaggcccttcagcgagca

SEQ ID NO: 428875 - DNA, 20 bp, mouse
gccacaccaatcgcccacgt

SEQ ID NO: 428876 - DNA, 20 bp, mouse
gtggtaagctggaacatcaa

SEQ ID NO: 428877 - DNA, 20 bp, mouse
ggcccgcctaagcttccttt

SEQ ID NO: 428878 - DNA, 20 bp, mouse
gttcccaaaggaagcttagg

SEQ ID NO: 428879 - DNA, 20 bp, mouse
gcgagaatccaagatctcta

SEQ ID NO: 428880 - DNA, 20 bp, mouse
ggaaacgcgagaggaaggcg

SEQ ID NO: 428881 - DNA, 20 bp, mouse
ggcgaaatgagacagaacaa

SEQ ID NO: 428882 - DNA, 20 bp, mouse
gttcgggctatagaatgagt

SEQ ID NO: 428883 - DNA, 20 bp, mouse
gggggagccagctcacttcc

SEQ ID NO: 428884 - DNA, 20 bp, mouse
gaatgctgcgcgtggtaagc

SEQ ID NO: 428885 - DNA, 20 bp, mouse
gagggcaggattctaagtat

SEQ ID NO: 428886 - DNA, 20 bp, mouse
ggccatggggcagcgaccgg

SEQ ID NO: 428887 - DNA, 20 bp, mouse
gcgtctacggaagccgaaga

SEQ ID NO: 428888 - DNA, 20 bp, mouse
gccgaagagggaacaacccc

SEQ ID NO: 428889 - DNA, 20 bp, mouse
gcttgggagcctgagttggg

SEQ ID NO: 428890 - DNA, 20 bp, mouse
gccgggggtgggaattagat

SEQ ID NO: 428891 - DNA, 20 bp, mouse
ggtgtcgagtggtggagacg

SEQ ID NO: 428892 - DNA, 20 bp, mouse
ggaggaactggagcaggctt

SEQ ID NO: 428893 - DNA, 20 bp, mouse
ggacttctgccccccaactc

SEQ ID NO: 428894 - DNA, 20 bp, mouse
gaggcttgggagcctgagtt

SEQ ID NO: 428895 - DNA, 20 bp, mouse
gggcagaagtcggaaaaggt

SEQ ID NO: 428896 - DNA, 20 bp, mouse
ggctcccgaggtcgtcatga

SEQ ID NO: 428897 - DNA, 20 bp, mouse
gctgagaagagcaggcccgt

SEQ ID NO: 428898 - DNA, 20 bp, mouse
gtgacggctgcggtgttctt

SEQ ID NO: 428899 - DNA, 20 bp, mouse
gcccccgcgactggctcccg

SEQ ID NO: 428900 - DNA, 20 bp, mouse
ggaggtcgtcatgacggctg

SEQ ID NO: 428901 - DNA, 20 bp, mouse
gcgacctcgggagccagtcg

SEQ ID NO: 428902 - DNA, 20 bp, mouse
ggtcagagcagtggacgagg

SEQ ID NO: 428903 - DNA, 20 bp, mouse
gcagggctggaactgttcct

SEQ ID NO: 428904 - DNA, 20 bp, mouse
gcagcttgtggtgcggtcca

SEQ ID NO: 428905 - DNA, 20 bp, mouse
gcggtgctccgtcagagcag

SEQ ID NO: 428906 - DNA, 20 bp, mouse
gaggcgcaaccgaagaacac

SEQ ID NO: 428907 - DNA, 20 bp, mouse
gccacagaagccagtcccgg

SEQ ID NO: 428908 - DNA, 20 bp, mouse
ggagtggatccgaggtgact

SEQ ID NO: 428909 - DNA, 20 bp, mouse
gggggacctgagtggatccg

SEQ ID NO: 428910 - DNA, 20 bp, mouse
gcaggagagggagggacccg

SEQ ID NO: 428911 - DNA, 20 bp, mouse
gcgggctcgatcagagaagg

SEQ ID NO: 428912 - DNA, 20 bp, mouse
ggaaatcgtcccagtcacct

SEQ ID NO: 428913 - DNA, 20 bp, mouse
gaagaacacaggcagcgtca

SEQ ID NO: 428914 - DNA, 20 bp, mouse
gcactcaggtcccccgggac

SEQ ID NO: 428915 - DNA, 20 bp, mouse
gtgatcgagcccggagtacc

SEQ ID NO: 428916 - DNA, 20 bp, mouse
gggctcccggcgtactagtg

SEQ ID NO: 428917 - DNA, 20 bp, mouse
gggcgtactagtgcggtcga

SEQ ID NO: 428918 - DNA, 20 bp, mouse
ggctcagataagttccgtgg

SEQ ID NO: 428919 - DNA, 20 bp, mouse
gtgctgtacgcggtgactgg

SEQ ID NO: 428920 - DNA, 20 bp, mouse
ggcgggagcccagacccgag

SEQ ID NO: 428921 - DNA, 20 bp, mouse
gacggctcagataagttccg

SEQ ID NO: 428922 - DNA, 20 bp, mouse
gataagttccgtggaggcgg

SEQ ID NO: 428923 - DNA, 20 bp, mouse
ggtgactggtggcggcccgg

SEQ ID NO: 428924 - DNA, 20 bp, mouse
gggtacagctcctccaccgt

SEQ ID NO: 428925 - DNA, 20 bp, mouse
gtgtacgcggtgactggtgg

SEQ ID NO: 428926 - DNA, 20 bp, mouse
gacgagcgcgggacagataa

SEQ ID NO: 428927 - DNA, 20 bp, mouse
gcggccggcagaacgctatt

SEQ ID NO: 428928 - DNA, 20 bp, mouse
gtctgccggccgctcagact

SEQ ID NO: 428929 - DNA, 20 bp, mouse
gcgctcgttccaagtctgag

SEQ ID NO: 428930 - DNA, 20 bp, mouse
gtgtggcgcgcaggtaagga

SEQ ID NO: 428931 - DNA, 20 bp, mouse
gcagtcctactagcacagag

SEQ ID NO: 428932 - DNA, 20 bp, mouse
ggcagagtcagaaccatgtc

SEQ ID NO: 428933 - DNA, 20 bp, mouse
ggaggcccctctgtgctagt

SEQ ID NO: 428934 - DNA, 20 bp, mouse
gtgtctggctgtcaagctca

SEQ ID NO: 428935 - DNA, 20 bp, mouse
gcccagtccgcgaaagtcag

SEQ ID NO: 428936 - DNA, 20 bp, mouse
gcactgcggacaaccccggt

SEQ ID NO: 428937 - DNA, 20 bp, mouse
gccatcactgcggacaaccc

SEQ ID NO: 428938 - DNA, 20 bp, mouse
ggccggtgagagaactcctg

SEQ ID NO: 428939 - DNA, 20 bp, mouse
gccggtcggcgcgccactgt

SEQ ID NO: 428940 - DNA, 20 bp, mouse
ggccgcaggagttctctcac

SEQ ID NO: 428941 - DNA, 20 bp, mouse
gcccgtcgcagaggtagcgc

SEQ ID NO: 428942 - DNA, 20 bp, mouse
gtcgctcggctgcaaggagg

SEQ ID NO: 428943 - DNA, 20 bp, mouse
gcgcgcgcgggacaggaagg

SEQ ID NO: 428944 - DNA, 20 bp, mouse
gtcggcgccgcccgtcgcag

SEQ ID NO: 428945 - DNA, 20 bp, mouse
ggcgctacagagagacgatg

SEQ ID NO: 428946 - DNA, 20 bp, mouse
gtattccctgcacgaatcac

SEQ ID NO: 428947 - DNA, 20 bp, mouse
gcacaggctctcaaggagtg

SEQ ID NO: 428948 - DNA, 20 bp, mouse
gagtttggcggtctgttgac

SEQ ID NO: 428949 - DNA, 20 bp, mouse
gcacgaatcacaggctctca

SEQ ID NO: 428950 - DNA, 20 bp, mouse
gcgcggggaccgccgtccag

SEQ ID NO: 428951 - DNA, 20 bp, mouse
gaggagtggggattccggaa

SEQ ID NO: 428952 - DNA, 20 bp, mouse
gcgctgctgggagtaagtgt

SEQ ID NO: 428953 - DNA, 20 bp, mouse
gagagcctgtgattcgtgca

SEQ ID NO: 428954 - DNA, 20 bp, mouse
gcagtctgccccggccccac

SEQ ID NO: 428955 - DNA, 20 bp, mouse
gaagaagtccgaaggcatgg

SEQ ID NO: 428956 - DNA, 20 bp, mouse
ggcgactcccaactacccgt

SEQ ID NO: 428957 - DNA, 20 bp, mouse
gggccttggtggcttcgggt

SEQ ID NO: 428958 - DNA, 20 bp, mouse
ggcggcaaaaactctctaag

SEQ ID NO: 428959 - DNA, 20 bp, mouse
gtctaacagcctggaccaac

SEQ ID NO: 428960 - DNA, 20 bp, mouse
ggaggcagcgagcaggagtg

SEQ ID NO: 428961 - DNA, 20 bp, mouse
gcctggaccaacgggtagtt

SEQ ID NO: 428962 - DNA, 20 bp, mouse
gcccagaggagccggcgagt

SEQ ID NO: 428963 - DNA, 20 bp, mouse
ggggcaggcagccagcggtg

SEQ ID NO: 428964 - DNA, 20 bp, mouse
gggcacccggacgcaaagaa

SEQ ID NO: 428965 - DNA, 20 bp, mouse
ggcagaccccgaagtgagca

SEQ ID NO: 428966 - DNA, 20 bp, mouse
gccagcgggatgagcagttc

SEQ ID NO: 428967 - DNA, 20 bp, mouse
gactgggagctcagacccag

SEQ ID NO: 428968 - DNA, 20 bp, mouse
gggcatgcgaaccgccccac

SEQ ID NO: 428969 - DNA, 20 bp, mouse
gctcagagtaagaggtctga

SEQ ID NO: 428970 - DNA, 20 bp, mouse
gagggagtgcagagtttagg

SEQ ID NO: 428971 - DNA, 20 bp, mouse
gaggtataagtggcccacag

SEQ ID NO: 428972 - DNA, 20 bp, mouse
gggacaccagttccagagat

SEQ ID NO: 428973 - DNA, 20 bp, mouse
gggccagtcaaactcccggt

SEQ ID NO: 428974 - DNA, 20 bp, mouse
gtgctgaatgaagtgaagct

SEQ ID NO: 428975 - DNA, 20 bp, mouse
gaggagggagtgcagagttt

SEQ ID NO: 428976 - DNA, 20 bp, mouse
gtcaccgctggggccgggta

SEQ ID NO: 428977 - DNA, 20 bp, mouse
ggggagcgcaggggacgtga

SEQ ID NO: 428978 - DNA, 20 bp, mouse
gggagctcctgtcaccgctg

SEQ ID NO: 428979 - DNA, 20 bp, mouse
gacccggccgggcctcacct

SEQ ID NO: 428980 - DNA, 20 bp, mouse
gcggcgccggcgcagcccgg

SEQ ID NO: 428981 - DNA, 20 bp, mouse
gccaacagccaggttcccga

SEQ ID NO: 428982 - DNA, 20 bp, mouse
ggggcagggacgtcagacga

SEQ ID NO: 428983 - DNA, 20 bp, mouse
ggacctgcccacctaagcgt

SEQ ID NO: 428984 - DNA, 20 bp, mouse
ggcgggaccgggcctcgacc

SEQ ID NO: 428985 - DNA, 20 bp, mouse
gcaggtccgacgatgcgggt

SEQ ID NO: 428986 - DNA, 20 bp, mouse
gcctggctgtgcgagagacg

SEQ ID NO: 428987 - DNA, 20 bp, mouse
gacgcttctgggtcgcggta

SEQ ID NO: 428988 - DNA, 20 bp, mouse
ggctctggctggctacatag

SEQ ID NO: 428989 - DNA, 20 bp, mouse
ggcccagcgccacagcgacc

SEQ ID NO: 428990 - DNA, 20 bp, mouse
ggtagggaagcgctgtagcc

SEQ ID NO: 428991 - DNA, 20 bp, mouse
gcgccacagcgacctggaga

SEQ ID NO: 428992 - DNA, 20 bp, mouse
ggtggccgccatccttctcc

SEQ ID NO: 428993 - DNA, 20 bp, mouse
gttcagacgcttctgggtcg

SEQ ID NO: 428994 - DNA, 20 bp, mouse
gaccggaggagacgcagatc

SEQ ID NO: 428995 - DNA, 20 bp, mouse
gggctggctacatagaggtg

SEQ ID NO: 428996 - DNA, 20 bp, mouse
gggaggtgtcagtggagagg

SEQ ID NO: 428997 - DNA, 20 bp, mouse
ggttggaggtgtcagtggag

SEQ ID NO: 428998 - DNA, 20 bp, mouse
gggcggcagaatgagcgaag

SEQ ID NO: 428999 - DNA, 20 bp, mouse
gagtgtcaaggcgctgttgg

SEQ ID NO: 429000 - DNA, 20 bp, mouse
gcagaatgagcgaagcggac

SEQ ID NO: 429001 - DNA, 20 bp, mouse
gctgagtgtcaaggcgctgt

SEQ ID NO: 429002 - DNA, 20 bp, mouse
gggtccaagccgggataatg

SEQ ID NO: 429003 - DNA, 20 bp, mouse
gaggtcccggaggtcaagga

SEQ ID NO: 429004 - DNA, 20 bp, mouse
ggccttgacactcagcaacg

SEQ ID NO: 429005 - DNA, 20 bp, mouse
gagcgtgagggaggacaacc

SEQ ID NO: 429006 - DNA, 20 bp, mouse
gatggagccagagccaccga

SEQ ID NO: 429007 - DNA, 20 bp, mouse
gctgtcggagagctccgggg

SEQ ID NO: 429008 - DNA, 20 bp, mouse
gagactgtcggagagctccg

SEQ ID NO: 429009 - DNA, 20 bp, mouse
gggacagtggagcatcaact

SEQ ID NO: 429010 - DNA, 20 bp, mouse
gagctggacacccagactgt

SEQ ID NO: 429011 - DNA, 20 bp, mouse
gtgctgctacctgccttcgg

SEQ ID NO: 429012 - DNA, 20 bp, mouse
gagccagagccaccgaaggc

SEQ ID NO: 429013 - DNA, 20 bp, mouse
gcagtggagcatcaactggg

SEQ ID NO: 429014 - DNA, 20 bp, mouse
gcatcaactgggaggcgcta

SEQ ID NO: 429015 - DNA, 20 bp, mouse
gtaaaggtgcgagatatcca

SEQ ID NO: 429016 - DNA, 20 bp, mouse
gtctgctggctgatgacccg

SEQ ID NO: 429017 - DNA, 20 bp, mouse
gtagtcgaatgtccgggctg

SEQ ID NO: 429018 - DNA, 20 bp, mouse
gctctgctagtcgaatgtcc

SEQ ID NO: 429019 - DNA, 20 bp, mouse
gggccccagcaccccagggg

SEQ ID NO: 429020 - DNA, 20 bp, mouse
gctggctgatgacccgtggc

SEQ ID NO: 429021 - DNA, 20 bp, mouse
gacttccctcagtcaggagg

SEQ ID NO: 429022 - DNA, 20 bp, mouse
gcaggtggggaggtccccgg

SEQ ID NO: 429023 - DNA, 20 bp, mouse
gccggcggtggcgcacacag

SEQ ID NO: 429024 - DNA, 20 bp, mouse
gcggggctcggagaccatgg

SEQ ID NO: 429025 - DNA, 20 bp, mouse
ggccaggacttccctcagtc

SEQ ID NO: 429026 - DNA, 20 bp, mouse
gagtcaagcccagagtagac

SEQ ID NO: 429027 - DNA, 20 bp, mouse
ggctgagggaacagagctgt

SEQ ID NO: 429028 - DNA, 20 bp, mouse
gctactctgggcttgactgg

SEQ ID NO: 429029 - DNA, 20 bp, mouse
gcacagaatcggtatgctga

SEQ ID NO: 429030 - DNA, 20 bp, mouse
gctgggcttgactggaggta

SEQ ID NO: 429031 - DNA, 20 bp, mouse
gggcaacgtgcaaagagcat

SEQ ID NO: 429032 - DNA, 20 bp, mouse
ggagaatggcaagtccagaa

SEQ ID NO: 429033 - DNA, 20 bp, mouse
gattgcgagcagcttcatga

SEQ ID NO: 429034 - DNA, 20 bp, mouse
gcccaccccgtcaggtgata

SEQ ID NO: 429035 - DNA, 20 bp, mouse
gggttgagtgcatcaaccag

SEQ ID NO: 429036 - DNA, 20 bp, mouse
gcaagtgccagggagaacaa

SEQ ID NO: 429037 - DNA, 20 bp, mouse
gagtagacactgcacctggg

SEQ ID NO: 429038 - DNA, 20 bp, mouse
gcagccttcaggaacatcct

SEQ ID NO: 429039 - DNA, 20 bp, mouse
gcactgggctgggacagttt

SEQ ID NO: 429040 - DNA, 20 bp, mouse
gccatccctgggataaccca

SEQ ID NO: 429041 - DNA, 20 bp, mouse
gccagggagcacaagtgcca

SEQ ID NO: 429042 - DNA, 20 bp, mouse
ggagcccaggatgttcctga

SEQ ID NO: 429043 - DNA, 20 bp, mouse
gggctacactggatgtttcc

SEQ ID NO: 429044 - DNA, 20 bp, mouse
ggggacagtttcggctacac

SEQ ID NO: 429045 - DNA, 20 bp, mouse
gccagcccagtgaggagccc

SEQ ID NO: 429046 - DNA, 20 bp, mouse
ggtggggtggcagcaaaggt

SEQ ID NO: 429047 - DNA, 20 bp, mouse
gccgagcaggtgagcttaca

SEQ ID NO: 429048 - DNA, 20 bp, mouse
gtacatggcacagggatggt

SEQ ID NO: 429049 - DNA, 20 bp, mouse
gtgggtgggtcatctctcta

SEQ ID NO: 429050 - DNA, 20 bp, mouse
gaggagagagctgcagatac

SEQ ID NO: 429051 - DNA, 20 bp, mouse
gagcttacatggcacaggga

SEQ ID NO: 429052 - DNA, 20 bp, mouse
gctaggaagcctggtctagg

SEQ ID NO: 429053 - DNA, 20 bp, mouse
gttggctgaagtagtcccag

SEQ ID NO: 429054 - DNA, 20 bp, mouse
gagtagggaacctggaactc

SEQ ID NO: 429055 - DNA, 20 bp, mouse
gaggcacttgcggggactgg

SEQ ID NO: 429056 - DNA, 20 bp, mouse
gtgctctacagggtcttcgg

SEQ ID NO: 429057 - DNA, 20 bp, mouse
ggtcttcggaggcggagctc

SEQ ID NO: 429058 - DNA, 20 bp, mouse
gtcggaggcggagctcaggc

SEQ ID NO: 429059 - DNA, 20 bp, mouse
gccctgctgcttgctctaca

SEQ ID NO: 429060 - DNA, 20 bp, mouse
gtctacagggtcttcggagg

SEQ ID NO: 429061 - DNA, 20 bp, mouse
gcgtctgggctcgtgagtta

SEQ ID NO: 429062 - DNA, 20 bp, mouse
ggcttgctctacagggtctt

SEQ ID NO: 429063 - DNA, 20 bp, mouse
gcaggtacttgatccactgc

SEQ ID NO: 429064 - DNA, 20 bp, mouse
gaggcagccgcagggtccta

SEQ ID NO: 429065 - DNA, 20 bp, mouse
gccatggcggatggatggtg

SEQ ID NO: 429066 - DNA, 20 bp, mouse
gctgtagcgggagtaggcac

SEQ ID NO: 429067 - DNA, 20 bp, mouse
ggtggttctgtagcgggagt

SEQ ID NO: 429068 - DNA, 20 bp, mouse
gtgcagaatccaacgctcat

SEQ ID NO: 429069 - DNA, 20 bp, mouse
gccacggtgcccatgagcgt

SEQ ID NO: 429070 - DNA, 20 bp, mouse
gtcagatcaggaagaagtaa

SEQ ID NO: 429071 - DNA, 20 bp, mouse
gcttcctgatctgatttcaa

SEQ ID NO: 429072 - DNA, 20 bp, mouse
gtctgcaggcagcaacagca

SEQ ID NO: 429073 - DNA, 20 bp, mouse
ggcagctcttaagctttctg

SEQ ID NO: 429074 - DNA, 20 bp, mouse
gcctgatctgatttcaaggg

SEQ ID NO: 429075 - DNA, 20 bp, mouse
ggagccattgtccaacacat

SEQ ID NO: 429076 - DNA, 20 bp, mouse
gaggttgtcaagccagccaa

SEQ ID NO: 429077 - DNA, 20 bp, mouse
gctgtggccgaaatgtggag

SEQ ID NO: 429078 - DNA, 20 bp, mouse
gacagagagaggaccggatt

SEQ ID NO: 429079 - DNA, 20 bp, mouse
gctctctgtcatccccagcc

SEQ ID NO: 429080 - DNA, 20 bp, mouse
gcagtgacaatctcgaaggg

SEQ ID NO: 429081 - DNA, 20 bp, mouse
gttgtggggagcaccaaatc

SEQ ID NO: 429082 - DNA, 20 bp, mouse
gctcctgcctgggaaagggt

SEQ ID NO: 429083 - DNA, 20 bp, mouse
ggaaggttaggacaagaata

SEQ ID NO: 429084 - DNA, 20 bp, mouse
gtacccagtgacaatctcga

SEQ ID NO: 429085 - DNA, 20 bp, mouse
gcggcgccagcctctcagaa

SEQ ID NO: 429086 - DNA, 20 bp, mouse
gtcgggagctggggacctag

SEQ ID NO: 429087 - DNA, 20 bp, mouse
gtcgaggggagtgggagcta

SEQ ID NO: 429088 - DNA, 20 bp, mouse
gaggtcagtttcacttctgg

SEQ ID NO: 429089 - DNA, 20 bp, mouse
gtcagaacaaggaccctcga

SEQ ID NO: 429090 - DNA, 20 bp, mouse
gggctgcatcccagacagaa

SEQ ID NO: 429091 - DNA, 20 bp, mouse
gtgggagctacggagtatcc

SEQ ID NO: 429092 - DNA, 20 bp, mouse
gggatgggaccattctgtct

SEQ ID NO: 429093 - DNA, 20 bp, mouse
gattttctgtgagcaggcta

SEQ ID NO: 429094 - DNA, 20 bp, mouse
gtccagggctaggctggtct

SEQ ID NO: 429095 - DNA, 20 bp, mouse
gaccgaagcggctcagaaca

SEQ ID NO: 429096 - DNA, 20 bp, mouse
gacctcagcaagaactaacc

SEQ ID NO: 429097 - DNA, 20 bp, mouse
gaattcaacagtgttcttag

SEQ ID NO: 429098 - DNA, 20 bp, mouse
gtccaggttagttcttgctg

SEQ ID NO: 429099 - DNA, 20 bp, mouse
gctcacactgcaggtgttag

SEQ ID NO: 429100 - DNA, 20 bp, mouse
gcagttcgcactggagtagt

SEQ ID NO: 429101 - DNA, 20 bp, mouse
gtcgtctcggataccacagc

SEQ ID NO: 429102 - DNA, 20 bp, mouse
gccaagcctggagacaaaga

SEQ ID NO: 429103 - DNA, 20 bp, mouse
gtcagctaggagtgctgcta

SEQ ID NO: 429104 - DNA, 20 bp, mouse
ggtgccatcaagactcgtct

SEQ ID NO: 429105 - DNA, 20 bp, mouse
gagcagattgcacacggatt

SEQ ID NO: 429106 - DNA, 20 bp, mouse
gtagcccagggagacgaagc

SEQ ID NO: 429107 - DNA, 20 bp, mouse
ggtgctggggaggacttcgt

SEQ ID NO: 429108 - DNA, 20 bp, mouse
gtaagtgggtacacttgtag

SEQ ID NO: 429109 - DNA, 20 bp, mouse
ggaagagtgaaggcactcag

SEQ ID NO: 429110 - DNA, 20 bp, mouse
gtctccggcttcgtctccct

SEQ ID NO: 429111 - DNA, 20 bp, mouse
gctgctaagggaccccgaca

SEQ ID NO: 429112 - DNA, 20 bp, mouse
gtaggagtctggctgactgt

SEQ ID NO: 429113 - DNA, 20 bp, mouse
gcaggctttgaggggagcac

SEQ ID NO: 429114 - DNA, 20 bp, mouse
gctgcaggatggattttctc

SEQ ID NO: 429115 - DNA, 20 bp, mouse
gcgtctccctgggctacatc

SEQ ID NO: 429116 - DNA, 20 bp, mouse
gctacgaccacaatcaggac

SEQ ID NO: 429117 - DNA, 20 bp, mouse
gcccttagctgtaggtagtg

SEQ ID NO: 429118 - DNA, 20 bp, mouse
ggccttggaaggtaagaaag

SEQ ID NO: 429119 - DNA, 20 bp, mouse
gctggatctaaggatctctc

SEQ ID NO: 429120 - DNA, 20 bp, mouse
gtacagctaagggattgggg

SEQ ID NO: 429121 - DNA, 20 bp, mouse
gtagatccaggttagtgcat

SEQ ID NO: 429122 - DNA, 20 bp, mouse
ggtgggaggatcctgcacag

SEQ ID NO: 429123 - DNA, 20 bp, mouse
gggttggaggggcaccctgg

SEQ ID NO: 429124 - DNA, 20 bp, mouse
gaggatcctcccaccgccat

SEQ ID NO: 429125 - DNA, 20 bp, mouse
gcatggctacgaccacaatc

SEQ ID NO: 429126 - DNA, 20 bp, mouse
gcaggtaagaggtggaccag

SEQ ID NO: 429127 - DNA, 20 bp, mouse
gctgaatgtagtggcaggaa

SEQ ID NO: 429128 - DNA, 20 bp, mouse
gttggggcagaatataaggg

SEQ ID NO: 429129 - DNA, 20 bp, mouse
ggggttggggcagaatataa

SEQ ID NO: 429130 - DNA, 20 bp, mouse
gaggggggcaaggattccta

SEQ ID NO: 429131 - DNA, 20 bp, mouse
gactacattcaggtaagagg

SEQ ID NO: 429132 - DNA, 20 bp, mouse
ggccactacattcaggtaag

SEQ ID NO: 429133 - DNA, 20 bp, mouse
gatattctgccccaaccccc

SEQ ID NO: 429134 - DNA, 20 bp, mouse
gctccagtactccagtgggt

SEQ ID NO: 429135 - DNA, 20 bp, mouse
gagtcaggcacactaaggct

SEQ ID NO: 429136 - DNA, 20 bp, mouse
gagagtggagtacagcagga

SEQ ID NO: 429137 - DNA, 20 bp, mouse
gcccttccccggtgaaagag

SEQ ID NO: 429138 - DNA, 20 bp, mouse
gcctcagcagggacatttct

SEQ ID NO: 429139 - DNA, 20 bp, mouse
gctttcaccggggaagggac

SEQ ID NO: 429140 - DNA, 20 bp, mouse
ggggtcagtagccatgtaag

SEQ ID NO: 429141 - DNA, 20 bp, mouse
gtctgagtggggcacgactg

SEQ ID NO: 429142 - DNA, 20 bp, mouse
gaggtggggttctctgagtg

SEQ ID NO: 429143 - DNA, 20 bp, mouse
gagggacatttctggggact

SEQ ID NO: 429144 - DNA, 20 bp, mouse
ggtgtcacgttcctcttaca

SEQ ID NO: 429145 - DNA, 20 bp, mouse
gcctgctgaggtgcaggcca

SEQ ID NO: 429146 - DNA, 20 bp, mouse
gtaatgcccctggggaggag

SEQ ID NO: 429147 - DNA, 20 bp, mouse
gactccaggtaatgcccctg

SEQ ID NO: 429148 - DNA, 20 bp, mouse
gctcagagcaagctaaacaa

SEQ ID NO: 429149 - DNA, 20 bp, mouse
gctgtgaaggagcctgtcac

SEQ ID NO: 429150 - DNA, 20 bp, mouse
gcctccccaggggcattacc

SEQ ID NO: 429151 - DNA, 20 bp, mouse
ggagtagctagctgcttcta

SEQ ID NO: 429152 - DNA, 20 bp, mouse
gctaccggctcacctagatg

SEQ ID NO: 429153 - DNA, 20 bp, mouse
gttcctccgttgctccacag

SEQ ID NO: 429154 - DNA, 20 bp, mouse
gaaagccttgcactgggtag

SEQ ID NO: 429155 - DNA, 20 bp, mouse
gtgccactgtggagcaacgg

SEQ ID NO: 429156 - DNA, 20 bp, mouse
gagagtggagtacagcagga

SEQ ID NO: 429157 - DNA, 20 bp, mouse
gcccttccccggtgaaagag

SEQ ID NO: 429158 - DNA, 20 bp, mouse
gcctcagcagggacatttct

SEQ ID NO: 429159 - DNA, 20 bp, mouse
gctttcaccggggaagggac

SEQ ID NO: 429160 - DNA, 20 bp, mouse
ggggtcagtagccatgtaag

SEQ ID NO: 429161 - DNA, 20 bp, mouse
gtctgagtggggcacgactg

SEQ ID NO: 429162 - DNA, 20 bp, mouse
gaggtggggttctctgagtg

SEQ ID NO: 429163 - DNA, 20 bp, mouse
gagggacatttctggggact

SEQ ID NO: 429164 - DNA, 20 bp, mouse
ggtgtcacgttcctcttaca

SEQ ID NO: 429165 - DNA, 20 bp, mouse
gcctgctgaggtgcaggcca

SEQ ID NO: 429166 - DNA, 20 bp, mouse
gtcacttggaggattctggg

SEQ ID NO: 429167 - DNA, 20 bp, mouse
gtgagaggtacgttcatagt

SEQ ID NO: 429168 - DNA, 20 bp, mouse
gagccacacacctcacttgg

SEQ ID NO: 429169 - DNA, 20 bp, mouse
gatcctccaagtgaggtgtg

SEQ ID NO: 429170 - DNA, 20 bp, mouse
gtgcacttggggtaaccgat

SEQ ID NO: 429171 - DNA, 20 bp, mouse
gtcaggtgattaggtggagg

SEQ ID NO: 429172 - DNA, 20 bp, mouse
gagaagccacacacctcact

SEQ ID NO: 429173 - DNA, 20 bp, mouse
gatagttggagcttgcactt

SEQ ID NO: 429174 - DNA, 20 bp, mouse
ggacagtgagcaccaactga

SEQ ID NO: 429175 - DNA, 20 bp, mouse
gacccctcccccctatcaaa

SEQ ID NO: 429176 - DNA, 20 bp, mouse
gtcccctgctcagaccctgg

SEQ ID NO: 429177 - DNA, 20 bp, mouse
ggctagaatagagtccacag

SEQ ID NO: 429178 - DNA, 20 bp, mouse
gcaccagcagaagagatcta

SEQ ID NO: 429179 - DNA, 20 bp, mouse
gtgggctggggattcaccca

SEQ ID NO: 429180 - DNA, 20 bp, mouse
gacatcctaccaaggtccct

SEQ ID NO: 429181 - DNA, 20 bp, mouse
gggagctggtaagacaagct

SEQ ID NO: 429182 - DNA, 20 bp, mouse
gttcacccagggaccttggt

SEQ ID NO: 429183 - DNA, 20 bp, mouse
gtacctccaggaaggagtac

SEQ ID NO: 429184 - DNA, 20 bp, mouse
gcccagcccacatcctacca

SEQ ID NO: 429185 - DNA, 20 bp, mouse
ggacttgtttcggaaggagc

SEQ ID NO: 429186 - DNA, 20 bp, mouse
gaaacactggaaaaacactc

SEQ ID NO: 429187 - DNA, 20 bp, mouse
gcaaatctccacaaaaaggt

SEQ ID NO: 429188 - DNA, 20 bp, mouse
gtttaaaaatatgggtgaaa

SEQ ID NO: 429189 - DNA, 20 bp, mouse
gggcgcccaatgcccaagga

SEQ ID NO: 429190 - DNA, 20 bp, mouse
ggtgcgggaccaccaccagc

SEQ ID NO: 429191 - DNA, 20 bp, mouse
gacaaggacagagtctactg

SEQ ID NO: 429192 - DNA, 20 bp, mouse
gcagcccagccgtctaaacg

SEQ ID NO: 429193 - DNA, 20 bp, mouse
gcaaacaaatctccacaaaa

SEQ ID NO: 429194 - DNA, 20 bp, mouse
gttgtggatccggctggtgg

SEQ ID NO: 429195 - DNA, 20 bp, mouse
ggaagtctctgaagaccgtc

SEQ ID NO: 429196 - DNA, 20 bp, mouse
gcagaggaaggcggagaaca

SEQ ID NO: 429197 - DNA, 20 bp, mouse
gcggagaacaaggcgagcac

SEQ ID NO: 429198 - DNA, 20 bp, mouse
gtggtgggacgcatccgcaa

SEQ ID NO: 429199 - DNA, 20 bp, mouse
gccgtcctgcaatagcaaca

SEQ ID NO: 429200 - DNA, 20 bp, mouse
gtcagcagaagacaccactt

SEQ ID NO: 429201 - DNA, 20 bp, mouse
gagcaccggggaaaccattg

SEQ ID NO: 429202 - DNA, 20 bp, mouse
ggcatccgcaatggtttccc

SEQ ID NO: 429203 - DNA, 20 bp, mouse
gccactttggtgaagctggt

SEQ ID NO: 429204 - DNA, 20 bp, mouse
ggtcggatgagatcttgtgt

SEQ ID NO: 429205 - DNA, 20 bp, mouse
gatcttgtgtaggaagtatt

SEQ ID NO: 429206 - DNA, 20 bp, mouse
ggaagccatgaacaggaagt

SEQ ID NO: 429207 - DNA, 20 bp, mouse
gcagtcatgaagccatgaac

SEQ ID NO: 429208 - DNA, 20 bp, mouse
gccagccattctttactcat

SEQ ID NO: 429209 - DNA, 20 bp, mouse
gaggatggctccgaagatac

SEQ ID NO: 429210 - DNA, 20 bp, mouse
gccaacctatgagtaaagaa

SEQ ID NO: 429211 - DNA, 20 bp, mouse
gctcgtgagctgcaaaccta

SEQ ID NO: 429212 - DNA, 20 bp, mouse
gtgctcccacttcctgttca

SEQ ID NO: 429213 - DNA, 20 bp, mouse
gctaatgaggcccagggaac

SEQ ID NO: 429214 - DNA, 20 bp, mouse
gttgcttcagcagttggata

SEQ ID NO: 429215 - DNA, 20 bp, mouse
gcgtctctcagtaacagaaa

SEQ ID NO: 429216 - DNA, 20 bp, mouse
gggacatggaatcctcagat

SEQ ID NO: 429217 - DNA, 20 bp, mouse
gaggttacatccctacgaat

SEQ ID NO: 429218 - DNA, 20 bp, mouse
gctacgaatgggcgagctca

SEQ ID NO: 429219 - DNA, 20 bp, mouse
gcttgtcccacttgctctgg

SEQ ID NO: 429220 - DNA, 20 bp, mouse
gccttctcctccagagcaag

SEQ ID NO: 429221 - DNA, 20 bp, mouse
gatgcttgtcccacttgctc

SEQ ID NO: 429222 - DNA, 20 bp, mouse
gcagaaaaaggaagtgaatg

SEQ ID NO: 429223 - DNA, 20 bp, mouse
ggcctcattctctttggtca

SEQ ID NO: 429224 - DNA, 20 bp, mouse
gcatggtccccgactcacca

SEQ ID NO: 429225 - DNA, 20 bp, mouse
gaagattccttggtgagtcg

SEQ ID NO: 429226 - DNA, 20 bp, mouse
gagagtggggatcctatctg

SEQ ID NO: 429227 - DNA, 20 bp, mouse
gttcgtgcactgagtgtatc

SEQ ID NO: 429228 - DNA, 20 bp, mouse
gaagtaaaatttctgtctga

SEQ ID NO: 429229 - DNA, 20 bp, mouse
gataggatccccactctgcc

SEQ ID NO: 429230 - DNA, 20 bp, mouse
gttctatgcacagggtagag

SEQ ID NO: 429231 - DNA, 20 bp, mouse
gtaaaatttctgtctgaggg

SEQ ID NO: 429232 - DNA, 20 bp, mouse
gcatgatccccaactcacca

SEQ ID NO: 429233 - DNA, 20 bp, mouse
ggggttatggctacaaggat

SEQ ID NO: 429234 - DNA, 20 bp, mouse
ggggtagaggggagagaagc

SEQ ID NO: 429235 - DNA, 20 bp, mouse
gacaaggatgggcgagctca

SEQ ID NO: 429236 - DNA, 20 bp, mouse
ggctctggaggagaagattg

SEQ ID NO: 429237 - DNA, 20 bp, mouse
gaagattgtggcctcacaga

SEQ ID NO: 429238 - DNA, 20 bp, mouse
ggtcaccagctgcacatctg

SEQ ID NO: 429239 - DNA, 20 bp, mouse
gctcacagatgggtgagctc

SEQ ID NO: 429240 - DNA, 20 bp, mouse
gatcttcctgcagccaagtt

SEQ ID NO: 429241 - DNA, 20 bp, mouse
gacagagccatcaaccacgc

SEQ ID NO: 429242 - DNA, 20 bp, mouse
gcattgatcccaactcacca

SEQ ID NO: 429243 - DNA, 20 bp, mouse
ggtgtggagatcccatctga

SEQ ID NO: 429244 - DNA, 20 bp, mouse
gccaaaacagaaaaaggaaa

SEQ ID NO: 429245 - DNA, 20 bp, mouse
gaaacagaaaaaggaaatgg

SEQ ID NO: 429246 - DNA, 20 bp, mouse
ggggttatggctacaaggat

SEQ ID NO: 429247 - DNA, 20 bp, mouse
ggtgtagagatcccatctga

SEQ ID NO: 429248 - DNA, 20 bp, mouse
gttgagaggatgaacatgtg

SEQ ID NO: 429249 - DNA, 20 bp, mouse
gaaacagaaaaaggaaatgg

SEQ ID NO: 429250 - DNA, 20 bp, mouse
gacaaggatgggcgagctca

SEQ ID NO: 429251 - DNA, 20 bp, mouse
gctctggaggagaagggtta

SEQ ID NO: 429252 - DNA, 20 bp, mouse
gcaatggctctggaggagaa

SEQ ID NO: 429253 - DNA, 20 bp, mouse
gccaaaacagaaaaaggaaa

SEQ ID NO: 429254 - DNA, 20 bp, mouse
gtgaacatgtggggaaagca

SEQ ID NO: 429255 - DNA, 20 bp, mouse
gcatggatcccaactcacca

SEQ ID NO: 429256 - DNA, 20 bp, mouse
gtgcctgctggactgattgg

SEQ ID NO: 429257 - DNA, 20 bp, mouse
ggctcaggcagctaggaact

SEQ ID NO: 429258 - DNA, 20 bp, mouse
gggcactgtgaccagtatca

SEQ ID NO: 429259 - DNA, 20 bp, mouse
ggagctgacaggggctaaca

SEQ ID NO: 429260 - DNA, 20 bp, mouse
gcagtgcctgctggactgat

SEQ ID NO: 429261 - DNA, 20 bp, mouse
gggactgattggaggactct

SEQ ID NO: 429262 - DNA, 20 bp, mouse
gagctcactgggaacctcac

SEQ ID NO: 429263 - DNA, 20 bp, mouse
gtctggggaacagccagcta

SEQ ID NO: 429264 - DNA, 20 bp, mouse
gctgcagacacagtccagag

SEQ ID NO: 429265 - DNA, 20 bp, mouse
ggtcctccaatcagtccagc

SEQ ID NO: 429266 - DNA, 20 bp, mouse
gcggtgctatgatggctgtt

SEQ ID NO: 429267 - DNA, 20 bp, mouse
gcgcttgtaaggccagagtg

SEQ ID NO: 429268 - DNA, 20 bp, mouse
gctgtctacgcatggcaggt

SEQ ID NO: 429269 - DNA, 20 bp, mouse
ggtaaggccagagtggggta

SEQ ID NO: 429270 - DNA, 20 bp, mouse
gctctgtttcggtgctatga

SEQ ID NO: 429271 - DNA, 20 bp, mouse
gaaggctgtctacgcatggc

SEQ ID NO: 429272 - DNA, 20 bp, mouse
gctgctgcctgcttgagata

SEQ ID NO: 429273 - DNA, 20 bp, mouse
gtcagactagctcgcttgta

SEQ ID NO: 429274 - DNA, 20 bp, mouse
gtgtaagcttccagcaggtg

SEQ ID NO: 429275 - DNA, 20 bp, mouse
gtaggacagaccaactgaga

SEQ ID NO: 429276 - DNA, 20 bp, mouse
gttggagacatgggatgggg

SEQ ID NO: 429277 - DNA, 20 bp, mouse
gttgtttggagacatgggat

SEQ ID NO: 429278 - DNA, 20 bp, mouse
gtataaaatacaacactatg

SEQ ID NO: 429279 - DNA, 20 bp, mouse
gagagtttgtttggagacat

SEQ ID NO: 429280 - DNA, 20 bp, mouse
gaccaggagtcttcaacagg

SEQ ID NO: 429281 - DNA, 20 bp, mouse
gcctccgcaggcccatgata

SEQ ID NO: 429282 - DNA, 20 bp, mouse
gggatgcacagacagtcact

SEQ ID NO: 429283 - DNA, 20 bp, mouse
gcaggtggtcctcagctgtg

SEQ ID NO: 429284 - DNA, 20 bp, mouse
gtatccatcatggaacctca

SEQ ID NO: 429285 - DNA, 20 bp, mouse
gaccacctgttgaagactcc

SEQ ID NO: 429286 - DNA, 20 bp, mouse
gtatgcaggtgggagagttt

SEQ ID NO: 429287 - DNA, 20 bp, mouse
gacttgacccggagacctca

SEQ ID NO: 429288 - DNA, 20 bp, mouse
ggtgcttagggaagatggaa

SEQ ID NO: 429289 - DNA, 20 bp, mouse
gggtctccgggtcaagtctt

SEQ ID NO: 429290 - DNA, 20 bp, mouse
gcaaactatagagtataggg

SEQ ID NO: 429291 - DNA, 20 bp, mouse
gggatgcctaagacttgacc

SEQ ID NO: 429292 - DNA, 20 bp, mouse
gccatctccctgaggtctcc

SEQ ID NO: 429293 - DNA, 20 bp, mouse
gccccaagaacagagaggct

SEQ ID NO: 429294 - DNA, 20 bp, mouse
ggaccaaactatagagtata

SEQ ID NO: 429295 - DNA, 20 bp, mouse
ggtcttgtgcttagggaaga

SEQ ID NO: 429296 - DNA, 20 bp, mouse
gctgatctcccgccaggtct

SEQ ID NO: 429297 - DNA, 20 bp, mouse
gtgacgtcacggggtacggt

SEQ ID NO: 429298 - DNA, 20 bp, mouse
gagttctctagtcccagacc

SEQ ID NO: 429299 - DNA, 20 bp, mouse
gagagtccgggtgacgtcac

SEQ ID NO: 429300 - DNA, 20 bp, mouse
gcgggtgacgtcacggggta

SEQ ID NO: 429301 - DNA, 20 bp, mouse
ggagatgctgatctcccgcc

SEQ ID NO: 429302 - DNA, 20 bp, mouse
gtggagcctaaggaagcctg

SEQ ID NO: 429303 - DNA, 20 bp, mouse
gtaccaccccaggcttcctt

SEQ ID NO: 429304 - DNA, 20 bp, mouse
ggcctattggcccagagtcc

SEQ ID NO: 429305 - DNA, 20 bp, mouse
ggattcctacagggacaagg

SEQ ID NO: 429306 - DNA, 20 bp, mouse
gtattgcaattgggaaaggg

SEQ ID NO: 429307 - DNA, 20 bp, mouse
ggtgtttgatgtctaagaac

SEQ ID NO: 429308 - DNA, 20 bp, mouse
gttggggacatgggatgagg

SEQ ID NO: 429309 - DNA, 20 bp, mouse
gtatagcatagagtttgttt

SEQ ID NO: 429310 - DNA, 20 bp, mouse
gataaaatacaacactacgg

SEQ ID NO: 429311 - DNA, 20 bp, mouse
gaacgaaagagaaagcccca

SEQ ID NO: 429312 - DNA, 20 bp, mouse
gtggatgcacagtcagtcac

SEQ ID NO: 429313 - DNA, 20 bp, mouse
gcctccgcaggcccatgata

SEQ ID NO: 429314 - DNA, 20 bp, mouse
gaccaggagtcttcaacagg

SEQ ID NO: 429315 - DNA, 20 bp, mouse
gtatccatcatggaacctca

SEQ ID NO: 429316 - DNA, 20 bp, mouse
gccagctgcagcacaggacc

SEQ ID NO: 429317 - DNA, 20 bp, mouse
gagtcacagcccccatcaag

SEQ ID NO: 429318 - DNA, 20 bp, mouse
gatggtagacctcttgatgg

SEQ ID NO: 429319 - DNA, 20 bp, mouse
gggcatggtagacctcttga

SEQ ID NO: 429320 - DNA, 20 bp, mouse
gggaaagccttgcactgacc

SEQ ID NO: 429321 - DNA, 20 bp, mouse
gttcctgaggggccaaagaa

SEQ ID NO: 429322 - DNA, 20 bp, mouse
gcccaggcaaagacgttcat

SEQ ID NO: 429323 - DNA, 20 bp, mouse
gggccaaagaatggagactg

SEQ ID NO: 429324 - DNA, 20 bp, mouse
gctggctcccctcacctcta

SEQ ID NO: 429325 - DNA, 20 bp, mouse
gtatagggttaactaccaca

SEQ ID NO: 429326 - DNA, 20 bp, mouse
gcaatgttacctcgggaaag

SEQ ID NO: 429327 - DNA, 20 bp, mouse
gagttcacggcataatatat

SEQ ID NO: 429328 - DNA, 20 bp, mouse
gcactcacagagacagttca

SEQ ID NO: 429329 - DNA, 20 bp, mouse
gggatgtggaggagaacaaa

SEQ ID NO: 429330 - DNA, 20 bp, mouse
gattgctgccaagacaaggt

SEQ ID NO: 429331 - DNA, 20 bp, mouse
gggatgctcataaaaactga

SEQ ID NO: 429332 - DNA, 20 bp, mouse
ggtttcagttgccctgggca

SEQ ID NO: 429333 - DNA, 20 bp, mouse
gcataaatctgttttctctc

SEQ ID NO: 429334 - DNA, 20 bp, mouse
gggcctgctgtccagatcat

SEQ ID NO: 429335 - DNA, 20 bp, mouse
gggatagctgcctcattcta

SEQ ID NO: 429336 - DNA, 20 bp, mouse
gcagggcaattgaagactag

SEQ ID NO: 429337 - DNA, 20 bp, mouse
gtaaggatgctcataaaaac

SEQ ID NO: 429338 - DNA, 20 bp, mouse
gcagttcatgacataatctt

SEQ ID NO: 429339 - DNA, 20 bp, mouse
gggatgtggaggagaaaaag

SEQ ID NO: 429340 - DNA, 20 bp, mouse
gggatgctcataaaaactgg

SEQ ID NO: 429341 - DNA, 20 bp, mouse
gattgctgccaagacaatgt

SEQ ID NO: 429342 - DNA, 20 bp, mouse
gtcttcaattgccctgggca

SEQ ID NO: 429343 - DNA, 20 bp, mouse
gcataaatctgttttctgtc

SEQ ID NO: 429344 - DNA, 20 bp, mouse
gtgtgaggatgaggaggcag

SEQ ID NO: 429345 - DNA, 20 bp, mouse
gggcctgctgtccagatcat

SEQ ID NO: 429346 - DNA, 20 bp, mouse
gccagagtgaagggtaagtg

SEQ ID NO: 429347 - DNA, 20 bp, mouse
ggggtaagtggggagtccga

SEQ ID NO: 429348 - DNA, 20 bp, mouse
gggcctccaggaagaaaagt

SEQ ID NO: 429349 - DNA, 20 bp, mouse
gccattgcagacacatccct

SEQ ID NO: 429350 - DNA, 20 bp, mouse
ggtggaggccggagaatcgg

SEQ ID NO: 429351 - DNA, 20 bp, mouse
gttcaggtaacaagaaggtt

SEQ ID NO: 429352 - DNA, 20 bp, mouse
gctcccacttttcttcctgg

SEQ ID NO: 429353 - DNA, 20 bp, mouse
gctggtcagctagatcatgg

SEQ ID NO: 429354 - DNA, 20 bp, mouse
gatatcggggtcaactctcg

SEQ ID NO: 429355 - DNA, 20 bp, mouse
gtgtcggacctgaacgagca

SEQ ID NO: 429356 - DNA, 20 bp, mouse
gggccatcagagaacagtta

SEQ ID NO: 429357 - DNA, 20 bp, mouse
gcatcagagaacagttaagg

SEQ ID NO: 429358 - DNA, 20 bp, mouse
gcagagaacagttaaggcgg

SEQ ID NO: 429359 - DNA, 20 bp, mouse
gggaggcagagtagaccgag

SEQ ID NO: 429360 - DNA, 20 bp, mouse
gaaacttggtggaacatctc

SEQ ID NO: 429361 - DNA, 20 bp, mouse
ggtcaagggtcgaggcgagg

SEQ ID NO: 429362 - DNA, 20 bp, mouse
gcagagctgcccaaacttgg

SEQ ID NO: 429363 - DNA, 20 bp, mouse
gctgggaatggacgacacag

SEQ ID NO: 429364 - DNA, 20 bp, mouse
gagttggtgctctgcagttg

SEQ ID NO: 429365 - DNA, 20 bp, mouse
ggcgggagcagcctccacca

SEQ ID NO: 429366 - DNA, 20 bp, mouse
ggaaggtagccgctccaact

SEQ ID NO: 429367 - DNA, 20 bp, mouse
gcactcagtaggtccctagt

SEQ ID NO: 429368 - DNA, 20 bp, mouse
gcaagaagttaacctctgga

SEQ ID NO: 429369 - DNA, 20 bp, mouse
gcctacaagaagttaacctc

SEQ ID NO: 429370 - DNA, 20 bp, mouse
gaagtctacccaaagagagg

SEQ ID NO: 429371 - DNA, 20 bp, mouse
gttgtgaaggagcagagctc

SEQ ID NO: 429372 - DNA, 20 bp, mouse
gacttcttgtaggtgatgac

SEQ ID NO: 429373 - DNA, 20 bp, mouse
ggctctgctccttcacaaca

SEQ ID NO: 429374 - DNA, 20 bp, mouse
gaatgcagcctggatcatgg

SEQ ID NO: 429375 - DNA, 20 bp, mouse
ggaggtcccgacaggtaatg

SEQ ID NO: 429376 - DNA, 20 bp, mouse
gggccgatcccaccaatcta

SEQ ID NO: 429377 - DNA, 20 bp, mouse
gggtgaccctgccggagccg

SEQ ID NO: 429378 - DNA, 20 bp, mouse
gcatgttcaaggtgagaatg

SEQ ID NO: 429379 - DNA, 20 bp, mouse
ggaggaggtgggcacgatag

SEQ ID NO: 429380 - DNA, 20 bp, mouse
gctcggtaccagcacctgtg

SEQ ID NO: 429381 - DNA, 20 bp, mouse
gagtgaaaccctagattggt

SEQ ID NO: 429382 - DNA, 20 bp, mouse
gaaagacgcccgggagcgtg

SEQ ID NO: 429383 - DNA, 20 bp, mouse
gaagggaggggtgaccctgc

SEQ ID NO: 429384 - DNA, 20 bp, mouse
gcattcgcgagagagctcaa

SEQ ID NO: 429385 - DNA, 20 bp, mouse
ggggcattagccgaggaggt

SEQ ID NO: 429386 - DNA, 20 bp, mouse
ggaatattgtcggaccctgg

SEQ ID NO: 429387 - DNA, 20 bp, mouse
gaaagaatattgtcggaccc

SEQ ID NO: 429388 - DNA, 20 bp, mouse
gatagttgtctactccccac

SEQ ID NO: 429389 - DNA, 20 bp, mouse
gtctgaaggtgagcaggctc

SEQ ID NO: 429390 - DNA, 20 bp, mouse
gggtgctgcatagactctga

SEQ ID NO: 429391 - DNA, 20 bp, mouse
gaaggtaattcagagatctg

SEQ ID NO: 429392 - DNA, 20 bp, mouse
gatagactctgaaggtgagc

SEQ ID NO: 429393 - DNA, 20 bp, mouse
gtgttgtgggtaatagacag

SEQ ID NO: 429394 - DNA, 20 bp, mouse
gtgagcaggctcaggctggc

SEQ ID NO: 429395 - DNA, 20 bp, mouse
gtccaccttgggtttagtat

SEQ ID NO: 429396 - DNA, 20 bp, mouse
ggccgagagggtcataggta

SEQ ID NO: 429397 - DNA, 20 bp, mouse
gcttgagccgagagggtcat

SEQ ID NO: 429398 - DNA, 20 bp, mouse
ggctcagagcgagcggggag

SEQ ID NO: 429399 - DNA, 20 bp, mouse
gtgcttgggctcagagcgag

SEQ ID NO: 429400 - DNA, 20 bp, mouse
gcccgcagggattaaggaga

SEQ ID NO: 429401 - DNA, 20 bp, mouse
gataggtatggcggccttta

SEQ ID NO: 429402 - DNA, 20 bp, mouse
gtttcagacggagagcgcag

SEQ ID NO: 429403 - DNA, 20 bp, mouse
gctgaaaacttgagccgaga

SEQ ID NO: 429404 - DNA, 20 bp, mouse
gcagttacccgcagggatta

SEQ ID NO: 429405 - DNA, 20 bp, mouse
gacccgctgagtgagtgatg

SEQ ID NO: 429406 - DNA, 20 bp, mouse
ggccgccgccggagaaggac

SEQ ID NO: 429407 - DNA, 20 bp, mouse
ggaaggaccggcagagaagc

SEQ ID NO: 429408 - DNA, 20 bp, mouse
gttctctgccggtccttctc

SEQ ID NO: 429409 - DNA, 20 bp, mouse
gtctgccggtccttctccgg

SEQ ID NO: 429410 - DNA, 20 bp, mouse
gacgccgccgccgccggaga

SEQ ID NO: 429411 - DNA, 20 bp, mouse
gaggctcgcgctctccacag

SEQ ID NO: 429412 - DNA, 20 bp, mouse
ggccgcctgcacctctccga

SEQ ID NO: 429413 - DNA, 20 bp, mouse
gccgggccgcaaagccgcca

SEQ ID NO: 429414 - DNA, 20 bp, mouse
gctgccgtacgcgcgggcca

SEQ ID NO: 429415 - DNA, 20 bp, mouse
gtacggcaggatcgcgacag

SEQ ID NO: 429416 - DNA, 20 bp, mouse
gggcgggaggcgagagcacc

SEQ ID NO: 429417 - DNA, 20 bp, mouse
gagcgcggggccaccggaga

SEQ ID NO: 429418 - DNA, 20 bp, mouse
ggcggggccaccggagacgg

SEQ ID NO: 429419 - DNA, 20 bp, mouse
ggctctgtcagtttcctcgg

SEQ ID NO: 429420 - DNA, 20 bp, mouse
gtgacagagctggagcgagg

SEQ ID NO: 429421 - DNA, 20 bp, mouse
gcgccttgggaacgagactg

SEQ ID NO: 429422 - DNA, 20 bp, mouse
gccgggagcagagcgagcgc

SEQ ID NO: 429423 - DNA, 20 bp, mouse
gcagtttcctcggcggcggg

SEQ ID NO: 429424 - DNA, 20 bp, mouse
ggcagggcgcccgcaggcgg

SEQ ID NO: 429425 - DNA, 20 bp, mouse
gcggttcgggctctggaggt

SEQ ID NO: 429426 - DNA, 20 bp, mouse
ggaatgtgaggctctcggta

SEQ ID NO: 429427 - DNA, 20 bp, mouse
gtgagagcctggacggaact

SEQ ID NO: 429428 - DNA, 20 bp, mouse
ggcggcggccacggaagatc

SEQ ID NO: 429429 - DNA, 20 bp, mouse
gctctcctgttgggaatgtg

SEQ ID NO: 429430 - DNA, 20 bp, mouse
gctgggctcgctctcctgtt

SEQ ID NO: 429431 - DNA, 20 bp, mouse
gggctccggaggcttccgag

SEQ ID NO: 429432 - DNA, 20 bp, mouse
gagagcctcacattcccaac

SEQ ID NO: 429433 - DNA, 20 bp, mouse
gagcgagcccagttccgtcc

SEQ ID NO: 429434 - DNA, 20 bp, mouse
ggcctcacacgggttcgcta

SEQ ID NO: 429435 - DNA, 20 bp, mouse
gcagatggtgctggcggtag

SEQ ID NO: 429436 - DNA, 20 bp, mouse
gtgggcggcggcaggacact

SEQ ID NO: 429437 - DNA, 20 bp, mouse
gccacgcgcggagctgtggg

SEQ ID NO: 429438 - DNA, 20 bp, mouse
gcatcgtggcgaaggctggg

SEQ ID NO: 429439 - DNA, 20 bp, mouse
ggggccacgcgcggagctgt

SEQ ID NO: 429440 - DNA, 20 bp, mouse
gagcccggcccgggagtgta

SEQ ID NO: 429441 - DNA, 20 bp, mouse
gggcagacagcgaccccggg

SEQ ID NO: 429442 - DNA, 20 bp, mouse
ggccccacgggagacagtga

SEQ ID NO: 429443 - DNA, 20 bp, mouse
gcggcatcgtggcgaaggct

SEQ ID NO: 429444 - DNA, 20 bp, mouse
gcccggcagacagcgacccc

SEQ ID NO: 429445 - DNA, 20 bp, mouse
gacctgcggactgtcctcca

SEQ ID NO: 429446 - DNA, 20 bp, mouse
ggagcgcgggatgcgaggag

SEQ ID NO: 429447 - DNA, 20 bp, mouse
gtccagcaggagcttgtcca

SEQ ID NO: 429448 - DNA, 20 bp, mouse
gcacggcgggcatggcgcgg

SEQ ID NO: 429449 - DNA, 20 bp, mouse
ggctagggagctactactgt

SEQ ID NO: 429450 - DNA, 20 bp, mouse
gaccggcgctcggggaggtc

SEQ ID NO: 429451 - DNA, 20 bp, mouse
gcgcggcggcgagggagcgc

SEQ ID NO: 429452 - DNA, 20 bp, mouse
gagcaggagcttgtccacgg

SEQ ID NO: 429453 - DNA, 20 bp, mouse
gccatcgccaagtcgaccca

SEQ ID NO: 429454 - DNA, 20 bp, mouse
ggctccctagcagggtaaca

SEQ ID NO: 429455 - DNA, 20 bp, mouse
ggcggagagtgggcaggcgc

SEQ ID NO: 429456 - DNA, 20 bp, mouse
gcgcgtgcgtgtaggaggca

SEQ ID NO: 429457 - DNA, 20 bp, mouse
gtacacgcacgcggccatgt

SEQ ID NO: 429458 - DNA, 20 bp, mouse
gatggccgcgtgcgtgtagg

SEQ ID NO: 429459 - DNA, 20 bp, mouse
ggcccgggattgggaagtcg

SEQ ID NO: 429460 - DNA, 20 bp, mouse
ggcgccaccagtttcaactc

SEQ ID NO: 429461 - DNA, 20 bp, mouse
gttcaactcaggttccgaca

SEQ ID NO: 429462 - DNA, 20 bp, mouse
gagaggggcgagatatccct

SEQ ID NO: 429463 - DNA, 20 bp, mouse
gaggccccgcaagatccccg

SEQ ID NO: 429464 - DNA, 20 bp, mouse
gtcggaacctgagttgaaac

SEQ ID NO: 429465 - DNA, 20 bp, mouse
gtgggaagtcggggaagctg

SEQ ID NO: 429466 - DNA, 20 bp, mouse
ggtgggaggccggaacaatg

SEQ ID NO: 429467 - DNA, 20 bp, mouse
gttgtgggtgtccacagtcg

SEQ ID NO: 429468 - DNA, 20 bp, mouse
gctaacccagcaaactacga

SEQ ID NO: 429469 - DNA, 20 bp, mouse
gggaggccggaacaatgcgg

SEQ ID NO: 429470 - DNA, 20 bp, mouse
gagtttgctgggttagaagc

SEQ ID NO: 429471 - DNA, 20 bp, mouse
gctaggtacaggagccgggt

SEQ ID NO: 429472 - DNA, 20 bp, mouse
gcccagcaaactacgaaggc

SEQ ID NO: 429473 - DNA, 20 bp, mouse
gctggcagccaactaggtac

SEQ ID NO: 429474 - DNA, 20 bp, mouse
gcccttggtcttgctcaggt

SEQ ID NO: 429475 - DNA, 20 bp, mouse
gagcaaactacgaaggcagg

SEQ ID NO: 429476 - DNA, 20 bp, mouse
ggcatccagcggttaagtcg

SEQ ID NO: 429477 - DNA, 20 bp, mouse
gctggtccaggacaacgtga

SEQ ID NO: 429478 - DNA, 20 bp, mouse
gcaaccctgcggtcacactg

SEQ ID NO: 429479 - DNA, 20 bp, mouse
ggggacctcgacttaaccgc

SEQ ID NO: 429480 - DNA, 20 bp, mouse
gctactctggcccaaagtgt

SEQ ID NO: 429481 - DNA, 20 bp, mouse
gtcgccacggccattctctc

SEQ ID NO: 429482 - DNA, 20 bp, mouse
gttcactggccatgctggca

SEQ ID NO: 429483 - DNA, 20 bp, mouse
gaagaagaagctcttctgga

SEQ ID NO: 429484 - DNA, 20 bp, mouse
ggtagcgatgctcaaaccaa

SEQ ID NO: 429485 - DNA, 20 bp, mouse
gctaggcttcaattacccac

SEQ ID NO: 429486 - DNA, 20 bp, mouse
gagccccagtagcgcggaca

SEQ ID NO: 429487 - DNA, 20 bp, mouse
gcagccatccccagcggtga

SEQ ID NO: 429488 - DNA, 20 bp, mouse
gagggacagaggagcgtcgg

SEQ ID NO: 429489 - DNA, 20 bp, mouse
gcatggctccctcaccgctg

SEQ ID NO: 429490 - DNA, 20 bp, mouse
ggctccctcaccgctgggga

SEQ ID NO: 429491 - DNA, 20 bp, mouse
ggcactggcggaggggacaa

SEQ ID NO: 429492 - DNA, 20 bp, mouse
gtcagtgtcagagtccaggt

SEQ ID NO: 429493 - DNA, 20 bp, mouse
gggtgtcctgcacctcgggc

SEQ ID NO: 429494 - DNA, 20 bp, mouse
gagccatgtccgcgctactg

SEQ ID NO: 429495 - DNA, 20 bp, mouse
gcggcgagggagctgtccct

SEQ ID NO: 429496 - DNA, 20 bp, mouse
gtcagactggccatcagtct

SEQ ID NO: 429497 - DNA, 20 bp, mouse
gcaaggacctggtgacgtgt

SEQ ID NO: 429498 - DNA, 20 bp, mouse
gtctacaaggagcaaggacc

SEQ ID NO: 429499 - DNA, 20 bp, mouse
gcatcagtctgggttctaca

SEQ ID NO: 429500 - DNA, 20 bp, mouse
gtgcctggagatgcgagtgt

SEQ ID NO: 429501 - DNA, 20 bp, mouse
gcagagggacacattcagac

SEQ ID NO: 429502 - DNA, 20 bp, mouse
gccagggtcagcaacaggtc

SEQ ID NO: 429503 - DNA, 20 bp, mouse
gttggcagaggccccatcga

SEQ ID NO: 429504 - DNA, 20 bp, mouse
ggtccgaagccccctgccca

SEQ ID NO: 429505 - DNA, 20 bp, mouse
ggctacttgtgccatctgtg

SEQ ID NO: 429506 - DNA, 20 bp, mouse
gaccgctcgggagaacgcta

SEQ ID NO: 429507 - DNA, 20 bp, mouse
gagaaggccgagcagcatgt

SEQ ID NO: 429508 - DNA, 20 bp, mouse
gggaggaagagccacccccg

SEQ ID NO: 429509 - DNA, 20 bp, mouse
gagcctctccggaggcccag

SEQ ID NO: 429510 - DNA, 20 bp, mouse
gtccggagaggctagactgt

SEQ ID NO: 429511 - DNA, 20 bp, mouse
gcccccgtggcccagaccac

SEQ ID NO: 429512 - DNA, 20 bp, mouse
gtcgggagaacgctatggac

SEQ ID NO: 429513 - DNA, 20 bp, mouse
gagctgggcagccacgtaga

SEQ ID NO: 429514 - DNA, 20 bp, mouse
ggagcagcatgtgggaactc

SEQ ID NO: 429515 - DNA, 20 bp, mouse
gaactcggccagcaccgctc

SEQ ID NO: 429516 - DNA, 20 bp, mouse
gaggcagcggcgaggtccgg

SEQ ID NO: 429517 - DNA, 20 bp, mouse
gtagcgcaaggcaccgagag

SEQ ID NO: 429518 - DNA, 20 bp, mouse
gcgcaaggcaccgagagcgg

SEQ ID NO: 429519 - DNA, 20 bp, mouse
gagcctcgggagcagagctg

SEQ ID NO: 429520 - DNA, 20 bp, mouse
gtcgacccatggcgcgaggc

SEQ ID NO: 429521 - DNA, 20 bp, mouse
gtctgtcgacccatggcgcg

SEQ ID NO: 429522 - DNA, 20 bp, mouse
ggctgcctgcctcgcgccat

SEQ ID NO: 429523 - DNA, 20 bp, mouse
gcgctccgggccaccgctct

SEQ ID NO: 429524 - DNA, 20 bp, mouse
gcacggggcctgaaatagat

SEQ ID NO: 429525 - DNA, 20 bp, mouse
gaactccttctgtcgaccca

SEQ ID NO: 429526 - DNA, 20 bp, mouse
gtgacagagctgcggcaagg

SEQ ID NO: 429527 - DNA, 20 bp, mouse
gagctgcggcaaggcggtgg

SEQ ID NO: 429528 - DNA, 20 bp, mouse
ggagtgacagagctgcggca

SEQ ID NO: 429529 - DNA, 20 bp, mouse
gcagagctgcggcaaggcgg

SEQ ID NO: 429530 - DNA, 20 bp, mouse
gtgtttcctgaaggcaaaga

SEQ ID NO: 429531 - DNA, 20 bp, mouse
ggaccgggctccagtaatct

SEQ ID NO: 429532 - DNA, 20 bp, mouse
gggagactaagcttatgcag

SEQ ID NO: 429533 - DNA, 20 bp, mouse
gtactggagcccggtcggtc

SEQ ID NO: 429534 - DNA, 20 bp, mouse
ggtagcaacagcgcaggtgc

SEQ ID NO: 429535 - DNA, 20 bp, mouse
gactgagctgcactctggcc

SEQ ID NO: 429536 - DNA, 20 bp, mouse
gaggccgcctgccacggagt

SEQ ID NO: 429537 - DNA, 20 bp, mouse
gacgtgcggtgcccactccg

SEQ ID NO: 429538 - DNA, 20 bp, mouse
ggcaggggcgcgctatatag

SEQ ID NO: 429539 - DNA, 20 bp, mouse
gcgcggggcggccgtcgggg

SEQ ID NO: 429540 - DNA, 20 bp, mouse
gcgtcgcggggcggccgtcg

SEQ ID NO: 429541 - DNA, 20 bp, mouse
gcgcgccaggccgcctgcca

SEQ ID NO: 429542 - DNA, 20 bp, mouse
ggtcggggcggcgctggcag

SEQ ID NO: 429543 - DNA, 20 bp, mouse
gagcggcgggcgtctgtctg

SEQ ID NO: 429544 - DNA, 20 bp, mouse
gcggggctctgcgcgacgtg

SEQ ID NO: 429545 - DNA, 20 bp, mouse
ggcttgggccaaggtaccta

SEQ ID NO: 429546 - DNA, 20 bp, mouse
gggggaagctgccacagaaa

SEQ ID NO: 429547 - DNA, 20 bp, mouse
gtctaaggccagcagtgtgc

SEQ ID NO: 429548 - DNA, 20 bp, mouse
gggggcaccttagctggctg

SEQ ID NO: 429549 - DNA, 20 bp, mouse
gtgccacagaaagggaggcc

SEQ ID NO: 429550 - DNA, 20 bp, mouse
ggtgctgggggcaccttagc

SEQ ID NO: 429551 - DNA, 20 bp, mouse
ggcagggcttaccttctggt

SEQ ID NO: 429552 - DNA, 20 bp, mouse
ggatcccacgaggtaggcca

SEQ ID NO: 429553 - DNA, 20 bp, mouse
gttcatggggagccagctga

SEQ ID NO: 429554 - DNA, 20 bp, mouse
gcgatataggccatagcccg

SEQ ID NO: 429555 - DNA, 20 bp, mouse
gagaacgaatcagggagaag

SEQ ID NO: 429556 - DNA, 20 bp, mouse
gaagaccagctgtgagacgg

SEQ ID NO: 429557 - DNA, 20 bp, mouse
gcgtgtcacacggccacaca

SEQ ID NO: 429558 - DNA, 20 bp, mouse
gttccgtttctctatcaggg

SEQ ID NO: 429559 - DNA, 20 bp, mouse
gtgattccgtttctctatca

SEQ ID NO: 429560 - DNA, 20 bp, mouse
gccgtgtgacacggacagat

SEQ ID NO: 429561 - DNA, 20 bp, mouse
gaccctggcagtctaagagg

SEQ ID NO: 429562 - DNA, 20 bp, mouse
gattggctgtcacttggatg

SEQ ID NO: 429563 - DNA, 20 bp, mouse
ggcacttcagagagtgagcg

SEQ ID NO: 429564 - DNA, 20 bp, mouse
gtgctgggcttgccccaagg

SEQ ID NO: 429565 - DNA, 20 bp, mouse
gctgcgggtagtctgggaca

SEQ ID NO: 429566 - DNA, 20 bp, mouse
ggataagtgagtacaatcta

SEQ ID NO: 429567 - DNA, 20 bp, mouse
ggatccgagccagagctacc

SEQ ID NO: 429568 - DNA, 20 bp, mouse
ggagctaccaggagcttcgc

SEQ ID NO: 429569 - DNA, 20 bp, mouse
ggactggaggtagagtctag

SEQ ID NO: 429570 - DNA, 20 bp, mouse
ggtaggtccatactacacat

SEQ ID NO: 429571 - DNA, 20 bp, mouse
gttatctctaggtcacagac

SEQ ID NO: 429572 - DNA, 20 bp, mouse
gcttgagcagatgtctgggg

SEQ ID NO: 429573 - DNA, 20 bp, mouse
gtgtagtatggacctacctg

SEQ ID NO: 429574 - DNA, 20 bp, mouse
gattgtactcacttatctct

SEQ ID NO: 429575 - DNA, 20 bp, mouse
gaaaagacaggaaacatggg

SEQ ID NO: 429576 - DNA, 20 bp, mouse
ggctctgcacggatctctgg

SEQ ID NO: 429577 - DNA, 20 bp, mouse
gttagctctgcacggatctc

SEQ ID NO: 429578 - DNA, 20 bp, mouse
gcacagttcctaattaggac

SEQ ID NO: 429579 - DNA, 20 bp, mouse
gtaagtcacagttcctaatt

SEQ ID NO: 429580 - DNA, 20 bp, mouse
gaagctcacttagctctgca

SEQ ID NO: 429581 - DNA, 20 bp, mouse
gggactggaactgataatca

SEQ ID NO: 429582 - DNA, 20 bp, mouse
gctctgcacgaggttcttct

SEQ ID NO: 429583 - DNA, 20 bp, mouse
gctgaagagctgtctggcta

SEQ ID NO: 429584 - DNA, 20 bp, mouse
ggagcgaacgaagctcttaa

SEQ ID NO: 429585 - DNA, 20 bp, mouse
ggacttgctgcctcctagaa

SEQ ID NO: 429586 - DNA, 20 bp, mouse
gcgcccggcacagacacgct

SEQ ID NO: 429587 - DNA, 20 bp, mouse
ggctgaccagaggctcgtag

SEQ ID NO: 429588 - DNA, 20 bp, mouse
gaggttccgggaggaaccgt

SEQ ID NO: 429589 - DNA, 20 bp, mouse
gcgggcgctctggcacctcg

SEQ ID NO: 429590 - DNA, 20 bp, mouse
gcggcggcgacccagccccg

SEQ ID NO: 429591 - DNA, 20 bp, mouse
gctagtgggcccggaagtca

SEQ ID NO: 429592 - DNA, 20 bp, mouse
ggggaacgccgggacttctc

SEQ ID NO: 429593 - DNA, 20 bp, mouse
gggacttctcaggttccggg

SEQ ID NO: 429594 - DNA, 20 bp, mouse
gccccggaagcagaactagt

SEQ ID NO: 429595 - DNA, 20 bp, mouse
ggggctcccacggttcctcc

SEQ ID NO: 429596 - DNA, 20 bp, mouse
gttcagagcaagagacgagg

SEQ ID NO: 429597 - DNA, 20 bp, mouse
gctcttcagagcaagagacg

SEQ ID NO: 429598 - DNA, 20 bp, mouse
ggcaggataagggaattcgg

SEQ ID NO: 429599 - DNA, 20 bp, mouse
gcccggagcttcccgcaggt

SEQ ID NO: 429600 - DNA, 20 bp, mouse
gctacagacaagctcaagga

SEQ ID NO: 429601 - DNA, 20 bp, mouse
gctctcagggtggccctcgg

SEQ ID NO: 429602 - DNA, 20 bp, mouse
gagatactacatcatcagtc

SEQ ID NO: 429603 - DNA, 20 bp, mouse
ggcaggagactagcccccgg

SEQ ID NO: 429604 - DNA, 20 bp, mouse
gccgctaacatagcacctcc

SEQ ID NO: 429605 - DNA, 20 bp, mouse
gagcagcaggcagcctccga

SEQ ID NO: 429606 - DNA, 20 bp, mouse
gggtgagggcaggcccggta

SEQ ID NO: 429607 - DNA, 20 bp, mouse
gcccaagatggaggcggtgg

SEQ ID NO: 429608 - DNA, 20 bp, mouse
ggtggtggtagcggtgtgac

SEQ ID NO: 429609 - DNA, 20 bp, mouse
gacggtggcggtggactgag

SEQ ID NO: 429610 - DNA, 20 bp, mouse
gcggtgtgacaggtgagggc

SEQ ID NO: 429611 - DNA, 20 bp, mouse
gccaaaacccgaaccctacc

SEQ ID NO: 429612 - DNA, 20 bp, mouse
gcgaccgtgggagtggatgg

SEQ ID NO: 429613 - DNA, 20 bp, mouse
gtagggttcgggttttggag

SEQ ID NO: 429614 - DNA, 20 bp, mouse
ggggcaggcccggtagggtt

SEQ ID NO: 429615 - DNA, 20 bp, mouse
gccgcccggaaccaaaggag

SEQ ID NO: 429616 - DNA, 20 bp, mouse
gggagcctgagatcctccag

SEQ ID NO: 429617 - DNA, 20 bp, mouse
gggagcccctggaggatctc

SEQ ID NO: 429618 - DNA, 20 bp, mouse
gccacaggccctcaccctgt

SEQ ID NO: 429619 - DNA, 20 bp, mouse
gggtcctgaggcacagctgc

SEQ ID NO: 429620 - DNA, 20 bp, mouse
gtccctctgccttgtagcag

SEQ ID NO: 429621 - DNA, 20 bp, mouse
gaggctacccagctgaggct

SEQ ID NO: 429622 - DNA, 20 bp, mouse
gtgggtctcagccaggtcag

SEQ ID NO: 429623 - DNA, 20 bp, mouse
gctgagacccaggcactcct

SEQ ID NO: 429624 - DNA, 20 bp, mouse
gtgcagcacacagggcctag

SEQ ID NO: 429625 - DNA, 20 bp, mouse
ggcccctgctacaaggcaga

SEQ ID NO: 429626 - DNA, 20 bp, mouse
gtaaatatgtcagggagggg

SEQ ID NO: 429627 - DNA, 20 bp, mouse
gtataatcataaatatgtca

SEQ ID NO: 429628 - DNA, 20 bp, mouse
gatcataaatatgtcaggga

SEQ ID NO: 429629 - DNA, 20 bp, mouse
gtgtccctagaagcctgtgt

SEQ ID NO: 429630 - DNA, 20 bp, mouse
gggtaagagaggcggagagc

SEQ ID NO: 429631 - DNA, 20 bp, mouse
gctggggctcacatatacaa

SEQ ID NO: 429632 - DNA, 20 bp, mouse
gtcagacacagacgacaata

SEQ ID NO: 429633 - DNA, 20 bp, mouse
gctaggcctaagaactccta

SEQ ID NO: 429634 - DNA, 20 bp, mouse
gattcagagacactacccat

SEQ ID NO: 429635 - DNA, 20 bp, mouse
gggattcagcaggcctctga

SEQ ID NO: 429636 - DNA, 20 bp, mouse
gcgggcaggcgcggcttccg

SEQ ID NO: 429637 - DNA, 20 bp, mouse
gggcgcggcgccgagcacct

SEQ ID NO: 429638 - DNA, 20 bp, mouse
ggacgcgtggagtgctcggg

SEQ ID NO: 429639 - DNA, 20 bp, mouse
gtgggcggcccgggcaggcg

SEQ ID NO: 429640 - DNA, 20 bp, mouse
gcgtggggcgctgtccccgg

SEQ ID NO: 429641 - DNA, 20 bp, mouse
gcgcacccgggaccggaccg

SEQ ID NO: 429642 - DNA, 20 bp, mouse
gcttctggttacacacttaa

SEQ ID NO: 429643 - DNA, 20 bp, mouse
gcagcgcctggaacttgccc

SEQ ID NO: 429644 - DNA, 20 bp, mouse
ggggggcggcccgagctcaa

SEQ ID NO: 429645 - DNA, 20 bp, mouse
ggcgttctcgcacccgggac

SEQ ID NO: 429646 - DNA, 20 bp, mouse
ggcccgcaccctgaagctga

SEQ ID NO: 429647 - DNA, 20 bp, mouse
gtctgagaagctgggcccga

SEQ ID NO: 429648 - DNA, 20 bp, mouse
ggctgaaggaggccacagcg

SEQ ID NO: 429649 - DNA, 20 bp, mouse
gaggggtcctcacctcgctg

SEQ ID NO: 429650 - DNA, 20 bp, mouse
gaggtcccggaggaggtgat

SEQ ID NO: 429651 - DNA, 20 bp, mouse
ggcttgggggagggcaagaa

SEQ ID NO: 429652 - DNA, 20 bp, mouse
ggagcccacggaggtcccgg

SEQ ID NO: 429653 - DNA, 20 bp, mouse
ggggccggacccctcagcct

SEQ ID NO: 429654 - DNA, 20 bp, mouse
gggtatgggacacaattcgt

SEQ ID NO: 429655 - DNA, 20 bp, mouse
gggaccctgagagcccacgg

SEQ ID NO: 429656 - DNA, 20 bp, mouse
gctgcagagtaagacaggag

SEQ ID NO: 429657 - DNA, 20 bp, mouse
ggagagacatccactcacac

SEQ ID NO: 429658 - DNA, 20 bp, mouse
gtccaactgcagagtaagac

SEQ ID NO: 429659 - DNA, 20 bp, mouse
gacactggtttccagagcag

SEQ ID NO: 429660 - DNA, 20 bp, mouse
ggcgatgtccaggtcctgag

SEQ ID NO: 429661 - DNA, 20 bp, mouse
gagagctgtgccagaagata

SEQ ID NO: 429662 - DNA, 20 bp, mouse
gcagcaagctacactagtgt

SEQ ID NO: 429663 - DNA, 20 bp, mouse
gaagtctgaggcttggacag

SEQ ID NO: 429664 - DNA, 20 bp, mouse
gaatgctacagggccgggca

SEQ ID NO: 429665 - DNA, 20 bp, mouse
gatagaaattgaggaaacgg

SEQ ID NO: 429666 - DNA, 20 bp, mouse
ggtcgccgctgaagctagag

SEQ ID NO: 429667 - DNA, 20 bp, mouse
gagctggaccatatgaccac

SEQ ID NO: 429668 - DNA, 20 bp, mouse
gccaccccgcggggcagggt

SEQ ID NO: 429669 - DNA, 20 bp, mouse
gacacgtacggaggacccac

SEQ ID NO: 429670 - DNA, 20 bp, mouse
gcggggcagggtaggcgtgg

SEQ ID NO: 429671 - DNA, 20 bp, mouse
gagtggcaggtgtgcggtgc

SEQ ID NO: 429672 - DNA, 20 bp, mouse
gggtggagcgagagctgaaa

SEQ ID NO: 429673 - DNA, 20 bp, mouse
ggcaccgaaaccgccaccag

SEQ ID NO: 429674 - DNA, 20 bp, mouse
ggaggccgccggtggtcata

SEQ ID NO: 429675 - DNA, 20 bp, mouse
gtgagatgctggaacacgta

SEQ ID NO: 429676 - DNA, 20 bp, mouse
gatcttggcaagaggcgaag

SEQ ID NO: 429677 - DNA, 20 bp, mouse
gttggcaagaggcgaagcgg

SEQ ID NO: 429678 - DNA, 20 bp, mouse
ggccagagctccgcgtctct

SEQ ID NO: 429679 - DNA, 20 bp, mouse
gctgccggcggaggctaggt

SEQ ID NO: 429680 - DNA, 20 bp, mouse
gtcgcctcttgccaagatgg

SEQ ID NO: 429681 - DNA, 20 bp, mouse
ggggaggccgtgccaagcct

SEQ ID NO: 429682 - DNA, 20 bp, mouse
gttcgctctaggactccggg

SEQ ID NO: 429683 - DNA, 20 bp, mouse
gtggcttggggccgccatct

SEQ ID NO: 429684 - DNA, 20 bp, mouse
ggggccgccatcttggcaag

SEQ ID NO: 429685 - DNA, 20 bp, mouse
gcaagcctgggccgacagca

SEQ ID NO: 429686 - DNA, 20 bp, mouse
gcggtggccgcgggtcagaa

SEQ ID NO: 429687 - DNA, 20 bp, mouse
gtcagctggagatgtccggg

SEQ ID NO: 429688 - DNA, 20 bp, mouse
gggaagcgggatccagggtg

SEQ ID NO: 429689 - DNA, 20 bp, mouse
ggcgaaggaagcgggatcca

SEQ ID NO: 429690 - DNA, 20 bp, mouse
gagcgcgccagcggtagcag

SEQ ID NO: 429691 - DNA, 20 bp, mouse
ggggctccggacggctggag

SEQ ID NO: 429692 - DNA, 20 bp, mouse
ggtagcagcggagttctcat

SEQ ID NO: 429693 - DNA, 20 bp, mouse
gcaaggggcaacaacctgag

SEQ ID NO: 429694 - DNA, 20 bp, mouse
gacagcactgagcgcgccag

SEQ ID NO: 429695 - DNA, 20 bp, mouse
ggctggagatgtccgggcgg

SEQ ID NO: 429696 - DNA, 20 bp, mouse
gcgctggcggagatcgacac

SEQ ID NO: 429697 - DNA, 20 bp, mouse
gaaggcgagcgagagaagag

SEQ ID NO: 429698 - DNA, 20 bp, mouse
ggcagagcccagccgaccgt

SEQ ID NO: 429699 - DNA, 20 bp, mouse
gccggcaaaggccaacccgg

SEQ ID NO: 429700 - DNA, 20 bp, mouse
gccgagccggctcctaacgc

SEQ ID NO: 429701 - DNA, 20 bp, mouse
ggcgagagaagaggggacga

SEQ ID NO: 429702 - DNA, 20 bp, mouse
gagccggctcctaacgctgg

SEQ ID NO: 429703 - DNA, 20 bp, mouse
ggtcgatctccgccagcgtt

SEQ ID NO: 429704 - DNA, 20 bp, mouse
gcggaggcggaagctacttt

SEQ ID NO: 429705 - DNA, 20 bp, mouse
gcagaggggtcgggaatcct

SEQ ID NO: 429706 - DNA, 20 bp, mouse
ggccccgcgtctcacctccg

SEQ ID NO: 429707 - DNA, 20 bp, mouse
gccgcgtctcacctccgcgg

SEQ ID NO: 429708 - DNA, 20 bp, mouse
ggtcagcgccgccatcttgt

SEQ ID NO: 429709 - DNA, 20 bp, mouse
gtgggagcgaaaccaacgcc

SEQ ID NO: 429710 - DNA, 20 bp, mouse
ggggccgtggagcctaggag

SEQ ID NO: 429711 - DNA, 20 bp, mouse
gcgtaagggccgcggagtgg

SEQ ID NO: 429712 - DNA, 20 bp, mouse
gctatgctcagtgagctcgg

SEQ ID NO: 429713 - DNA, 20 bp, mouse
ggcaggccggacagaggatc

SEQ ID NO: 429714 - DNA, 20 bp, mouse
gcgcgctgaggccgaaactg

SEQ ID NO: 429715 - DNA, 20 bp, mouse
gtggtttcgctcccacaaga

SEQ ID NO: 429716 - DNA, 20 bp, mouse
ggcgcctcctggctcgacag

SEQ ID NO: 429717 - DNA, 20 bp, mouse
ggagcccgccgaacgtcaag

SEQ ID NO: 429718 - DNA, 20 bp, mouse
ggcggccgctgtgaggaatt

SEQ ID NO: 429719 - DNA, 20 bp, mouse
gacagaggcggggaatccag

SEQ ID NO: 429720 - DNA, 20 bp, mouse
gggtgagacgcgggctgtag

SEQ ID NO: 429721 - DNA, 20 bp, mouse
ggacaacctggggccggtga

SEQ ID NO: 429722 - DNA, 20 bp, mouse
gcaagggcaggagcgacagt

SEQ ID NO: 429723 - DNA, 20 bp, mouse
gcgaaaacgctactcggccg

SEQ ID NO: 429724 - DNA, 20 bp, mouse
gggacactggagagccgcgg

SEQ ID NO: 429725 - DNA, 20 bp, mouse
gcacgcgcgccgacaacctg

SEQ ID NO: 429726 - DNA, 20 bp, mouse
gctagcaccggaagccgcga

SEQ ID NO: 429727 - DNA, 20 bp, mouse
gcccgccctccacctagcac

SEQ ID NO: 429728 - DNA, 20 bp, mouse
gggcttccggtgctaggtgg

SEQ ID NO: 429729 - DNA, 20 bp, mouse
gggcgggcaggagggagccg

SEQ ID NO: 429730 - DNA, 20 bp, mouse
gtccggtgctaggtggaggg

SEQ ID NO: 429731 - DNA, 20 bp, mouse
ggaagaggctgggtccgggt

SEQ ID NO: 429732 - DNA, 20 bp, mouse
gccgcaagccgacccgaccg

SEQ ID NO: 429733 - DNA, 20 bp, mouse
gggtccgctggcccgctccc

SEQ ID NO: 429734 - DNA, 20 bp, mouse
gacagctcctgtcgccgtcg

SEQ ID NO: 429735 - DNA, 20 bp, mouse
gggtccggctcgcaccgtct

SEQ ID NO: 429736 - DNA, 20 bp, mouse
gacctgctaggcgtctggtg

SEQ ID NO: 429737 - DNA, 20 bp, mouse
gccgcggccgccgtgtgacg

SEQ ID NO: 429738 - DNA, 20 bp, mouse
ggctgtgccacgtcacacgg

SEQ ID NO: 429739 - DNA, 20 bp, mouse
ggcggccgcggagactcagg

SEQ ID NO: 429740 - DNA, 20 bp, mouse
gaacaggcgcgagaagagag

SEQ ID NO: 429741 - DNA, 20 bp, mouse
ggagatggtgaggcccatag

SEQ ID NO: 429742 - DNA, 20 bp, mouse
gagcgggaccgggacctgct

SEQ ID NO: 429743 - DNA, 20 bp, mouse
gtggtgcggtggctccggcg

SEQ ID NO: 429744 - DNA, 20 bp, mouse
gcggcgcggcgttaagtgtt

SEQ ID NO: 429745 - DNA, 20 bp, mouse
gatggtgaggcccatagcgg

SEQ ID NO: 429746 - DNA, 20 bp, mouse
gggggcgcaacagcagaagg

SEQ ID NO: 429747 - DNA, 20 bp, mouse
ggatggggcgcaacagcaga

SEQ ID NO: 429748 - DNA, 20 bp, mouse
gggaaccggccggccgcggg

SEQ ID NO: 429749 - DNA, 20 bp, mouse
gacgggagcgcggcccccag

SEQ ID NO: 429750 - DNA, 20 bp, mouse
ggttgcgccccatccccccg

SEQ ID NO: 429751 - DNA, 20 bp, mouse
gccagcccggctgctaagaa

SEQ ID NO: 429752 - DNA, 20 bp, mouse
ggccttgagggcagtctggg

SEQ ID NO: 429753 - DNA, 20 bp, mouse
ggcggggcgagggctggaac

SEQ ID NO: 429754 - DNA, 20 bp, mouse
gggccggccgcggggggatg

SEQ ID NO: 429755 - DNA, 20 bp, mouse
gggcgagggctggaaccggc

SEQ ID NO: 429756 - DNA, 20 bp, mouse
gcggcagcagagctaggagg

SEQ ID NO: 429757 - DNA, 20 bp, mouse
gcggcggcagcagagctagg

SEQ ID NO: 429758 - DNA, 20 bp, mouse
gcggctggaggtaacctcaa

SEQ ID NO: 429759 - DNA, 20 bp, mouse
gcccgagcgcgggttccctc

SEQ ID NO: 429760 - DNA, 20 bp, mouse
ggcgcgtgcgcagttgggag

SEQ ID NO: 429761 - DNA, 20 bp, mouse
gccgccgccgctgccggaaa

SEQ ID NO: 429762 - DNA, 20 bp, mouse
gtaccgccgggcctccgagg

SEQ ID NO: 429763 - DNA, 20 bp, mouse
gggcctgcgagcaccggact

SEQ ID NO: 429764 - DNA, 20 bp, mouse
gggaagtgaggcggtttcct

SEQ ID NO: 429765 - DNA, 20 bp, mouse
gtcggcgcccggtcaggtca

SEQ ID NO: 429766 - DNA, 20 bp, mouse
ggccggacccgacctcctgg

SEQ ID NO: 429767 - DNA, 20 bp, mouse
gcgaggtgccaagctggact

SEQ ID NO: 429768 - DNA, 20 bp, mouse
gggcaccggggagtaagtca

SEQ ID NO: 429769 - DNA, 20 bp, mouse
ggcccccaggaggtcgggtc

SEQ ID NO: 429770 - DNA, 20 bp, mouse
gaggaggtcgggtccggccg

SEQ ID NO: 429771 - DNA, 20 bp, mouse
gctcacctgctgcccccagg

SEQ ID NO: 429772 - DNA, 20 bp, mouse
gcgtagccggaagctgctgg

SEQ ID NO: 429773 - DNA, 20 bp, mouse
gggtgatctgagagccggaa

SEQ ID NO: 429774 - DNA, 20 bp, mouse
gagtcagggctgaagaccgg

SEQ ID NO: 429775 - DNA, 20 bp, mouse
gaggtacgcgggaggcaccg

SEQ ID NO: 429776 - DNA, 20 bp, mouse
gggcgcgggccaatcctcgg

SEQ ID NO: 429777 - DNA, 20 bp, mouse
gcgccgggacctgtcggtcg

SEQ ID NO: 429778 - DNA, 20 bp, mouse
gacgcacacagcccccgtgg

SEQ ID NO: 429779 - DNA, 20 bp, mouse
gtgagggagggcgaggacgg

SEQ ID NO: 429780 - DNA, 20 bp, mouse
gcggttagggcccagagtcg

SEQ ID NO: 429781 - DNA, 20 bp, mouse
gagacacaaccgcgaccgac

SEQ ID NO: 429782 - DNA, 20 bp, mouse
gcaccgcgccggtcacgaca

SEQ ID NO: 429783 - DNA, 20 bp, mouse
gagggcccagagtcgaggcc

SEQ ID NO: 429784 - DNA, 20 bp, mouse
gtgccttcgccgccgaggat

SEQ ID NO: 429785 - DNA, 20 bp, mouse
ggtcgaatcactccactcgt

SEQ ID NO: 429786 - DNA, 20 bp, mouse
gcgacaaccgggaagagaca

SEQ ID NO: 429787 - DNA, 20 bp, mouse
gccatagtcactgagaactg

SEQ ID NO: 429788 - DNA, 20 bp, mouse
ggaagcagtccccgacaacc

SEQ ID NO: 429789 - DNA, 20 bp, mouse
ggccgcctcccggagaccga

SEQ ID NO: 429790 - DNA, 20 bp, mouse
ggcgtctggggtcacagggg

SEQ ID NO: 429791 - DNA, 20 bp, mouse
gaaaagggggcgcccaccag

SEQ ID NO: 429792 - DNA, 20 bp, mouse
gcggccgttaccttgttagt

SEQ ID NO: 429793 - DNA, 20 bp, mouse
ggtgcccactaacaaggtaa

SEQ ID NO: 429794 - DNA, 20 bp, mouse
gcgacgtgtcacaggccggg

SEQ ID NO: 429795 - DNA, 20 bp, mouse
gcacggccgcggccacaccg

SEQ ID NO: 429796 - DNA, 20 bp, mouse
gcctctcaacatggcgtccg

SEQ ID NO: 429797 - DNA, 20 bp, mouse
gggctgccctagctaccgtg

SEQ ID NO: 429798 - DNA, 20 bp, mouse
gctggtccccacggtagcta

SEQ ID NO: 429799 - DNA, 20 bp, mouse
ggcgtcacgcagcggccgaa

SEQ ID NO: 429800 - DNA, 20 bp, mouse
gggcaggtcggcggtgatgg

SEQ ID NO: 429801 - DNA, 20 bp, mouse
gcgggccgtagggacgagtg

SEQ ID NO: 429802 - DNA, 20 bp, mouse
gggcgtccggggcaggtcgg

SEQ ID NO: 429803 - DNA, 20 bp, mouse
gcggcggatgctggtcccca

SEQ ID NO: 429804 - DNA, 20 bp, mouse
gcggccgggaagcgaccccc

SEQ ID NO: 429805 - DNA, 20 bp, mouse
gggcggtgatggaggccagt

SEQ ID NO: 429806 - DNA, 20 bp, mouse
gaagagacgccccggcccca

SEQ ID NO: 429807 - DNA, 20 bp, mouse
ggtgacgcgctgcaacttgg

SEQ ID NO: 429808 - DNA, 20 bp, mouse
gctgtcaggaagagacgccc

SEQ ID NO: 429809 - DNA, 20 bp, mouse
gcacgtgacgcgctgcaact

SEQ ID NO: 429810 - DNA, 20 bp, mouse
gccgtgcgcgccgccctgtc

SEQ ID NO: 429811 - DNA, 20 bp, mouse
ggagggcccggcgacccggc

SEQ ID NO: 429812 - DNA, 20 bp, mouse
gagggcggcgcgcacggacg

SEQ ID NO: 429813 - DNA, 20 bp, mouse
gacagcgagcggaagaggac

SEQ ID NO: 429814 - DNA, 20 bp, mouse
gtcagctaggatcttctcca

SEQ ID NO: 429815 - DNA, 20 bp, mouse
gctcccacggggacagcgag

SEQ ID NO: 429816 - DNA, 20 bp, mouse
gcgccggagaccgggttgag

SEQ ID NO: 429817 - DNA, 20 bp, mouse
gggtgcaagcgccggagacc

SEQ ID NO: 429818 - DNA, 20 bp, mouse
ggagcagctacagctgtcac

SEQ ID NO: 429819 - DNA, 20 bp, mouse
gcccgctgacagacaggtga

SEQ ID NO: 429820 - DNA, 20 bp, mouse
gcgaccgggagagcccgcga

SEQ ID NO: 429821 - DNA, 20 bp, mouse
gcgggtgcaagtgtcctcgg

SEQ ID NO: 429822 - DNA, 20 bp, mouse
gtcgcgggtgcaagtgtcct

SEQ ID NO: 429823 - DNA, 20 bp, mouse
gtggccgacgtgattcccga

SEQ ID NO: 429824 - DNA, 20 bp, mouse
gtccgggcaaccaaccgccg

SEQ ID NO: 429825 - DNA, 20 bp, mouse
gcagccctcgggaatcacgt

SEQ ID NO: 429826 - DNA, 20 bp, mouse
gcggaccgcgcggggacctc

SEQ ID NO: 429827 - DNA, 20 bp, mouse
gcgacgagaactggaacccg

SEQ ID NO: 429828 - DNA, 20 bp, mouse
gtagcagcaggtcagagatt

SEQ ID NO: 429829 - DNA, 20 bp, mouse
gctaggatcgcgacgagaac

SEQ ID NO: 429830 - DNA, 20 bp, mouse
gcgggccgctcttcccctca

SEQ ID NO: 429831 - DNA, 20 bp, mouse
gcggaagtgacatgctctct

SEQ ID NO: 429832 - DNA, 20 bp, mouse
gggagcccctcacatctggg

SEQ ID NO: 429833 - DNA, 20 bp, mouse
ggcgcgaggcccggaccgcg

SEQ ID NO: 429834 - DNA, 20 bp, mouse
ggcttcagctgactttggaa

SEQ ID NO: 429835 - DNA, 20 bp, mouse
gtgagcccttggcaaggatg

SEQ ID NO: 429836 - DNA, 20 bp, mouse
gggtcagcgtgaggtcggtg

SEQ ID NO: 429837 - DNA, 20 bp, mouse
gttccgtcaggcactgtgag

SEQ ID NO: 429838 - DNA, 20 bp, mouse
gcagagctcctgaggagggt

SEQ ID NO: 429839 - DNA, 20 bp, mouse
ggtctaggaagcgaccagag

SEQ ID NO: 429840 - DNA, 20 bp, mouse
gactgtgaggggtcagcgtg

SEQ ID NO: 429841 - DNA, 20 bp, mouse
gcggaacaaggagcgaagga

SEQ ID NO: 429842 - DNA, 20 bp, mouse
gcacagtgcctgacggaaca

SEQ ID NO: 429843 - DNA, 20 bp, mouse
ggcgaaggacggagcacggg

SEQ ID NO: 429844 - DNA, 20 bp, mouse
gcttcgctccttgttccgtc

SEQ ID NO: 429845 - DNA, 20 bp, mouse
ggatctgagcaggtacgggt

SEQ ID NO: 429846 - DNA, 20 bp, mouse
gagggttacggccggtggag

SEQ ID NO: 429847 - DNA, 20 bp, mouse
ggctgctgctgcatgtgctc

SEQ ID NO: 429848 - DNA, 20 bp, mouse
gggcgctccgataatctcta

SEQ ID NO: 429849 - DNA, 20 bp, mouse
gtggagctcatgctctctct

SEQ ID NO: 429850 - DNA, 20 bp, mouse
gcgtaaccctaaaagacaga

SEQ ID NO: 429851 - DNA, 20 bp, mouse
gtgggaagcttgtagcccca

SEQ ID NO: 429852 - DNA, 20 bp, mouse
gcttttagggttacggccgg

SEQ ID NO: 429853 - DNA, 20 bp, mouse
gctagcacctggagcccaga

SEQ ID NO: 429854 - DNA, 20 bp, mouse
gacaggtgatctacatccag

SEQ ID NO: 429855 - DNA, 20 bp, mouse
gaagcttcccagcaccatct

SEQ ID NO: 429856 - DNA, 20 bp, mouse
ggcagggaggggattaccct

SEQ ID NO: 429857 - DNA, 20 bp, mouse
gtgcccgtggaggagacggg

SEQ ID NO: 429858 - DNA, 20 bp, mouse
ggggattaccctaggagaac

SEQ ID NO: 429859 - DNA, 20 bp, mouse
gcaccgagccggttctccta

SEQ ID NO: 429860 - DNA, 20 bp, mouse
gtaccctaggagaaccggct

SEQ ID NO: 429861 - DNA, 20 bp, mouse
ggaagcatcgaagctgtggg

SEQ ID NO: 429862 - DNA, 20 bp, mouse
ggggaggctgcactcactcg

SEQ ID NO: 429863 - DNA, 20 bp, mouse
ggtcctgagttgcaccgagc

SEQ ID NO: 429864 - DNA, 20 bp, mouse
gggaacatgattggcaggga

SEQ ID NO: 429865 - DNA, 20 bp, mouse
gaagagctcgcgggatccca

SEQ ID NO: 429866 - DNA, 20 bp, mouse
gcggcccggagtccctaaga

SEQ ID NO: 429867 - DNA, 20 bp, mouse
ggtccctaagatggcagctg

SEQ ID NO: 429868 - DNA, 20 bp, mouse
gctgccatcttagggactcc

SEQ ID NO: 429869 - DNA, 20 bp, mouse
ggcctgctaggccttcgcgg

SEQ ID NO: 429870 - DNA, 20 bp, mouse
gaggcctagcaggcccggcc

SEQ ID NO: 429871 - DNA, 20 bp, mouse
gtccgccgcgaaggcctagc

SEQ ID NO: 429872 - DNA, 20 bp, mouse
ggcgctcgcgggacaaggag

SEQ ID NO: 429873 - DNA, 20 bp, mouse
gagcgcacccgccacgcaca

SEQ ID NO: 429874 - DNA, 20 bp, mouse
gcttagagcgggacgagctc

SEQ ID NO: 429875 - DNA, 20 bp, mouse
ggaggcggccgtgtgcgtgg

SEQ ID NO: 429876 - DNA, 20 bp, mouse
ggccggaacgaggtgagctg

SEQ ID NO: 429877 - DNA, 20 bp, mouse
gtgccgagctttgacaggcg

SEQ ID NO: 429878 - DNA, 20 bp, mouse
gaggaagcattgccggaacg

SEQ ID NO: 429879 - DNA, 20 bp, mouse
ggctttgacaggcgtggcag

SEQ ID NO: 429880 - DNA, 20 bp, mouse
gatgtttgccgagctttgac

SEQ ID NO: 429881 - DNA, 20 bp, mouse
gccggctccgagatgggaat

SEQ ID NO: 429882 - DNA, 20 bp, mouse
gtccgcagctcacctcgttc

SEQ ID NO: 429883 - DNA, 20 bp, mouse
ggccgaaatgggaaaaatcc

SEQ ID NO: 429884 - DNA, 20 bp, mouse
gcgggcagcaagccggaagt

SEQ ID NO: 429885 - DNA, 20 bp, mouse
gaaacatccggctccgagat

SEQ ID NO: 429886 - DNA, 20 bp, mouse
gagcgaccctggagagtacg

SEQ ID NO: 429887 - DNA, 20 bp, mouse
ggccgagctgggctcccagg

SEQ ID NO: 429888 - DNA, 20 bp, mouse
gcggcagcgagcggctagca

SEQ ID NO: 429889 - DNA, 20 bp, mouse
gcggcgcagctccccaatcc

SEQ ID NO: 429890 - DNA, 20 bp, mouse
gtctccagggtcgctgggct

SEQ ID NO: 429891 - DNA, 20 bp, mouse
ggaacgcgcccgaacctcct

SEQ ID NO: 429892 - DNA, 20 bp, mouse
ggatcctctcccggaaccac

SEQ ID NO: 429893 - DNA, 20 bp, mouse
gtcctgggagaggaatgccc

SEQ ID NO: 429894 - DNA, 20 bp, mouse
ggcacgaagcggagctcgag

SEQ ID NO: 429895 - DNA, 20 bp, mouse
ggtgcgcgcggatcctctcc

SEQ ID NO: 429896 - DNA, 20 bp, mouse
ggatgtgtgccgagaaggtg

SEQ ID NO: 429897 - DNA, 20 bp, mouse
gcgcgaccgcacctgagcag

SEQ ID NO: 429898 - DNA, 20 bp, mouse
gggtctgatgtgtgccgaga

SEQ ID NO: 429899 - DNA, 20 bp, mouse
gggccacaggcaaggctgat

SEQ ID NO: 429900 - DNA, 20 bp, mouse
ggtggatcgagggaaagtgg

SEQ ID NO: 429901 - DNA, 20 bp, mouse
gggagtcggcctcggagagt

SEQ ID NO: 429902 - DNA, 20 bp, mouse
gagagaggcgcgagagaaga

SEQ ID NO: 429903 - DNA, 20 bp, mouse
gctgcggggaagaggataag

SEQ ID NO: 429904 - DNA, 20 bp, mouse
ggtgaaacaagagtgaagag

SEQ ID NO: 429905 - DNA, 20 bp, mouse
gagcggggaaggccaccctg

SEQ ID NO: 429906 - DNA, 20 bp, mouse
gtgagggagggtaagttcca

SEQ ID NO: 429907 - DNA, 20 bp, mouse
gcccgcaggctggtctctga

SEQ ID NO: 429908 - DNA, 20 bp, mouse
gctcggccgcaactacaacc

SEQ ID NO: 429909 - DNA, 20 bp, mouse
gcccggagcccgctacccca

SEQ ID NO: 429910 - DNA, 20 bp, mouse
gtacccctcagcagaaccgg

SEQ ID NO: 429911 - DNA, 20 bp, mouse
gggacgcccggttgtagttg

SEQ ID NO: 429912 - DNA, 20 bp, mouse
gtacaaccgggcgtccccgc

SEQ ID NO: 429913 - DNA, 20 bp, mouse
gaagcggccgccgccctccc

SEQ ID NO: 429914 - DNA, 20 bp, mouse
gagtcgctcggccacagcat

SEQ ID NO: 429915 - DNA, 20 bp, mouse
gcgcctgaagagcgctcact

SEQ ID NO: 429916 - DNA, 20 bp, mouse
ggttacataccttttctcca

SEQ ID NO: 429917 - DNA, 20 bp, mouse
gctcttacaacaaaacggaa

SEQ ID NO: 429918 - DNA, 20 bp, mouse
gggtcacgtgtcctaagggg

SEQ ID NO: 429919 - DNA, 20 bp, mouse
gcgaacacaggcctcccctt

SEQ ID NO: 429920 - DNA, 20 bp, mouse
gtaaggtcacgtgtcctaag

SEQ ID NO: 429921 - DNA, 20 bp, mouse
gttttaatagcaagtcacca

SEQ ID NO: 429922 - DNA, 20 bp, mouse
gaacaaaacggaaaggagta

SEQ ID NO: 429923 - DNA, 20 bp, mouse
gtaaagtagctatcagttaa

SEQ ID NO: 429924 - DNA, 20 bp, mouse
gaaagaaacaagctgatatt

SEQ ID NO: 429925 - DNA, 20 bp, mouse
gtatgtaaagagctataaga

SEQ ID NO: 429926 - DNA, 20 bp, mouse
gaggcgggcggaggagaact

SEQ ID NO: 429927 - DNA, 20 bp, mouse
ggccgggaagcgatgtaggt

SEQ ID NO: 429928 - DNA, 20 bp, mouse
gagaactggggaccgtctgg

SEQ ID NO: 429929 - DNA, 20 bp, mouse
ggtaggtaggacccgccaga

SEQ ID NO: 429930 - DNA, 20 bp, mouse
gtcctgcgcgcgaggagccg

SEQ ID NO: 429931 - DNA, 20 bp, mouse
ggtcctcgggagactcacga

SEQ ID NO: 429932 - DNA, 20 bp, mouse
gctcctccggccaggacaat

SEQ ID NO: 429933 - DNA, 20 bp, mouse
gcggttgaattgcttcttca

SEQ ID NO: 429934 - DNA, 20 bp, mouse
gtggtcactgggaacctaag

SEQ ID NO: 429935 - DNA, 20 bp, mouse
ggggggtctgcgcctagcta

SEQ ID NO: 429936 - DNA, 20 bp, mouse
gcagttcatggtgagagaag

SEQ ID NO: 429937 - DNA, 20 bp, mouse
ggcagttagcacaactcccg

SEQ ID NO: 429938 - DNA, 20 bp, mouse
gctgggattctgacacagag

SEQ ID NO: 429939 - DNA, 20 bp, mouse
gtaactgcttaccaccccag

SEQ ID NO: 429940 - DNA, 20 bp, mouse
gactggctatcgagttcctc

SEQ ID NO: 429941 - DNA, 20 bp, mouse
gacagggaagttgtcaagag

SEQ ID NO: 429942 - DNA, 20 bp, mouse
gtatgttgcagcgtcaggtc

SEQ ID NO: 429943 - DNA, 20 bp, mouse
gaggcgacgaagccacctcc

SEQ ID NO: 429944 - DNA, 20 bp, mouse
gcctgacgctgcaacatagg

SEQ ID NO: 429945 - DNA, 20 bp, mouse
gaagccacctccaggtaagg

SEQ ID NO: 429946 - DNA, 20 bp, mouse
ggaggcgccgagtggagggg

SEQ ID NO: 429947 - DNA, 20 bp, mouse
gcggctgaggcgccgagtgg

SEQ ID NO: 429948 - DNA, 20 bp, mouse
gtccggccagagtcgcagac

SEQ ID NO: 429949 - DNA, 20 bp, mouse
gccggcgcctcccctccact

SEQ ID NO: 429950 - DNA, 20 bp, mouse
gcctcagccgccatcttccg

SEQ ID NO: 429951 - DNA, 20 bp, mouse
gtggcggctgaggcgccgag

SEQ ID NO: 429952 - DNA, 20 bp, mouse
ggcccacagtcccgtctcct

SEQ ID NO: 429953 - DNA, 20 bp, mouse
gaccaagctgccgcggaaga

SEQ ID NO: 429954 - DNA, 20 bp, mouse
ggcgtcggcgtagacaccac

SEQ ID NO: 429955 - DNA, 20 bp, mouse
gggcagcaggacggaaaact

SEQ ID NO: 429956 - DNA, 20 bp, mouse
gggtccatggccccgacggg

SEQ ID NO: 429957 - DNA, 20 bp, mouse
gggcggtccatggccccgac

SEQ ID NO: 429958 - DNA, 20 bp, mouse
gtccgcagcaggatgctcta

SEQ ID NO: 429959 - DNA, 20 bp, mouse
gcgctcgccgcactctgctc

SEQ ID NO: 429960 - DNA, 20 bp, mouse
ggcccaagccgaggaccggg

SEQ ID NO: 429961 - DNA, 20 bp, mouse
gtcagcgaggaggagcgccc

SEQ ID NO: 429962 - DNA, 20 bp, mouse
gccccgggtcagagatggag

SEQ ID NO: 429963 - DNA, 20 bp, mouse
ggacatgcctgtcagcgagg

SEQ ID NO: 429964 - DNA, 20 bp, mouse
ggcggcgagcgcgacgagcg

SEQ ID NO: 429965 - DNA, 20 bp, mouse
gagcgcgacgagcgcggcgc

SEQ ID NO: 429966 - DNA, 20 bp, mouse
gggcgacccgcctcaggaag

SEQ ID NO: 429967 - DNA, 20 bp, mouse
ggggcgcgtgcgggaagcaa

SEQ ID NO: 429968 - DNA, 20 bp, mouse
ggagaggagcggccacgcaa

SEQ ID NO: 429969 - DNA, 20 bp, mouse
gcccgcgcttcagccccagg

SEQ ID NO: 429970 - DNA, 20 bp, mouse
gtgtgcagcgagggaggccg

SEQ ID NO: 429971 - DNA, 20 bp, mouse
ggggcggaggaaatagtggt

SEQ ID NO: 429972 - DNA, 20 bp, mouse
gatcgcgggcgcgggagcgt

SEQ ID NO: 429973 - DNA, 20 bp, mouse
gcgcgtgtgtgcagcgaggg

SEQ ID NO: 429974 - DNA, 20 bp, mouse
gcactcaagcctggccgggc

SEQ ID NO: 429975 - DNA, 20 bp, mouse
ggagaacgcgggttaagggt

SEQ ID NO: 429976 - DNA, 20 bp, mouse
gaggcagcagccacatcctc

SEQ ID NO: 429977 - DNA, 20 bp, mouse
gggatctgagagcagacttg

SEQ ID NO: 429978 - DNA, 20 bp, mouse
gagccgtcggcagcattgct

SEQ ID NO: 429979 - DNA, 20 bp, mouse
gctgtgggcaccatgaagtg

SEQ ID NO: 429980 - DNA, 20 bp, mouse
gtatttagaacgctctttcc

SEQ ID NO: 429981 - DNA, 20 bp, mouse
gctgtggagcatgtaccttg

SEQ ID NO: 429982 - DNA, 20 bp, mouse
gcgaacaaagcctgctgtga

SEQ ID NO: 429983 - DNA, 20 bp, mouse
gtgccttccagagaagacac

SEQ ID NO: 429984 - DNA, 20 bp, mouse
gagcctagcaatgctgccga

SEQ ID NO: 429985 - DNA, 20 bp, mouse
gacagcccgcaagaccaacg

SEQ ID NO: 429986 - DNA, 20 bp, mouse
gacgcggcgggatcccgacc

SEQ ID NO: 429987 - DNA, 20 bp, mouse
ggaacagctgcgctaggcaa

SEQ ID NO: 429988 - DNA, 20 bp, mouse
gtggtcagccctcacctggg

SEQ ID NO: 429989 - DNA, 20 bp, mouse
gtccattcatcgggccgcag

SEQ ID NO: 429990 - DNA, 20 bp, mouse
ggcgggacagcaagctccca

SEQ ID NO: 429991 - DNA, 20 bp, mouse
gcgctaggcaagggctttgg

SEQ ID NO: 429992 - DNA, 20 bp, mouse
gattcatcgggccgcagtgg

SEQ ID NO: 429993 - DNA, 20 bp, mouse
gcggcagtgcccaccgacgg

SEQ ID NO: 429994 - DNA, 20 bp, mouse
gacgcagccccacccggagg

SEQ ID NO: 429995 - DNA, 20 bp, mouse
ggagtcgctttctgcctggt

SEQ ID NO: 429996 - DNA, 20 bp, mouse
ggctcgccctgggaagtaaa

SEQ ID NO: 429997 - DNA, 20 bp, mouse
gaagccggtgggactcggaa

SEQ ID NO: 429998 - DNA, 20 bp, mouse
ggcatgtggcaattcagccc

SEQ ID NO: 429999 - DNA, 20 bp, mouse
gcaccggctttctctcaccc

SEQ ID NO: 430000 - DNA, 20 bp, mouse
gatgccggacctacaaggga

SEQ ID NO: 430001 - DNA, 20 bp, mouse
ggctgcatggaaagttgggg

SEQ ID NO: 430002 - DNA, 20 bp, mouse
gatgtccaggctcctaggac

SEQ ID NO: 430003 - DNA, 20 bp, mouse
gagggatgccggacctacaa

SEQ ID NO: 430004 - DNA, 20 bp, mouse
ggcgagacagcgactgctgg

SEQ ID NO: 430005 - DNA, 20 bp, mouse
gcacgcaggcctggcgaatg

SEQ ID NO: 430006 - DNA, 20 bp, mouse
ggagaaaggaggagacacgt

SEQ ID NO: 430007 - DNA, 20 bp, mouse
gccctgctgggcagaatctc

SEQ ID NO: 430008 - DNA, 20 bp, mouse
gccagttgacactgcctctt

SEQ ID NO: 430009 - DNA, 20 bp, mouse
gtcacaacttcacttcagta

SEQ ID NO: 430010 - DNA, 20 bp, mouse
gacacgtgggcagatcggtc

SEQ ID NO: 430011 - DNA, 20 bp, mouse
gaggagacacgtgggcagat

SEQ ID NO: 430012 - DNA, 20 bp, mouse
gtcccacccacagtccccca

SEQ ID NO: 430013 - DNA, 20 bp, mouse
gaccagctactcacccacct

SEQ ID NO: 430014 - DNA, 20 bp, mouse
gtgcctgcaaagcaagcaac

SEQ ID NO: 430015 - DNA, 20 bp, mouse
ggcctgagattctgcccagc

SEQ ID NO: 430016 - DNA, 20 bp, mouse
gctgaggagcaagcccgcag

SEQ ID NO: 430017 - DNA, 20 bp, mouse
gagcaagcccgcagaggagg

SEQ ID NO: 430018 - DNA, 20 bp, mouse
gaggctgcttgaggctgctg

SEQ ID NO: 430019 - DNA, 20 bp, mouse
gttctgtgagagggcgctcg

SEQ ID NO: 430020 - DNA, 20 bp, mouse
ggagccaccgaactgcacac

SEQ ID NO: 430021 - DNA, 20 bp, mouse
gacggccgatccacaggtgt

SEQ ID NO: 430022 - DNA, 20 bp, mouse
gacaccggcagaaagcgcgg

SEQ ID NO: 430023 - DNA, 20 bp, mouse
gcgcggcggcggacccttgg

SEQ ID NO: 430024 - DNA, 20 bp, mouse
gggcggcccggacgccggag

SEQ ID NO: 430025 - DNA, 20 bp, mouse
gggcccggacgccggagggg

SEQ ID NO: 430026 - DNA, 20 bp, mouse
gcagcctcccgccatctccg

SEQ ID NO: 430027 - DNA, 20 bp, mouse
gggggaccacaactctgagg

SEQ ID NO: 430028 - DNA, 20 bp, mouse
gagcctgggaaagcttaggg

SEQ ID NO: 430029 - DNA, 20 bp, mouse
gacaactctgaggtggcaca

SEQ ID NO: 430030 - DNA, 20 bp, mouse
ggaagctgcctcggagatgg

SEQ ID NO: 430031 - DNA, 20 bp, mouse
gcagaaggccgccccttcag

SEQ ID NO: 430032 - DNA, 20 bp, mouse
gcaagaagctgcctcggaga

SEQ ID NO: 430033 - DNA, 20 bp, mouse
gctgcctcggagatggcggg

SEQ ID NO: 430034 - DNA, 20 bp, mouse
ggtgcggcatagacccactg

SEQ ID NO: 430035 - DNA, 20 bp, mouse
gagttagcagaactcgggaa

SEQ ID NO: 430036 - DNA, 20 bp, mouse
gagctccgggagcgggtcag

SEQ ID NO: 430037 - DNA, 20 bp, mouse
gtcccggagctagtccacgt

SEQ ID NO: 430038 - DNA, 20 bp, mouse
gaccaacgtggactagctcc

SEQ ID NO: 430039 - DNA, 20 bp, mouse
gacaaagaccgagaccaacg

SEQ ID NO: 430040 - DNA, 20 bp, mouse
ggccccaaggctctgcgact

SEQ ID NO: 430041 - DNA, 20 bp, mouse
ggtcagcggccccgagcgtc

SEQ ID NO: 430042 - DNA, 20 bp, mouse
gtcctagtcgcagagccttg

SEQ ID NO: 430043 - DNA, 20 bp, mouse
gagctagtccacgttggtct

SEQ ID NO: 430044 - DNA, 20 bp, mouse
gttggggcgccggacgctcg

SEQ ID NO: 430045 - DNA, 20 bp, mouse
gggggccgctgacccgctcc

SEQ ID NO: 430046 - DNA, 20 bp, mouse
gggcccggcatggaggatgg

SEQ ID NO: 430047 - DNA, 20 bp, mouse
gagcaagtttgagccctagg

SEQ ID NO: 430048 - DNA, 20 bp, mouse
gaacgcccacagcctggcgg

SEQ ID NO: 430049 - DNA, 20 bp, mouse
gcagcagtgctggctcggcc

SEQ ID NO: 430050 - DNA, 20 bp, mouse
ggtgctggctcggcccggca

SEQ ID NO: 430051 - DNA, 20 bp, mouse
ggagtctgggtccgaatgtg

SEQ ID NO: 430052 - DNA, 20 bp, mouse
gagactcgatagcaactcag

SEQ ID NO: 430053 - DNA, 20 bp, mouse
gcagatgaacgcccacagcc

SEQ ID NO: 430054 - DNA, 20 bp, mouse
ggtgggcgttcatctgaagt

SEQ ID NO: 430055 - DNA, 20 bp, mouse
gtgcctccatcctccatgcc

SEQ ID NO: 430056 - DNA, 20 bp, mouse
ggcggcggcggatcctcgac

SEQ ID NO: 430057 - DNA, 20 bp, mouse
ggtcctcaggccagtcgtgg

SEQ ID NO: 430058 - DNA, 20 bp, mouse
gggcctgaggacgccggtcg

SEQ ID NO: 430059 - DNA, 20 bp, mouse
ggtggcggtagctgcagggg

SEQ ID NO: 430060 - DNA, 20 bp, mouse
gacgactggcctgaggacgc

SEQ ID NO: 430061 - DNA, 20 bp, mouse
gagccccacggtgagttgag

SEQ ID NO: 430062 - DNA, 20 bp, mouse
ggcggctggcgcggtcgtgg

SEQ ID NO: 430063 - DNA, 20 bp, mouse
ggtcgcctcctgactctcac

SEQ ID NO: 430064 - DNA, 20 bp, mouse
ggcctcctgactctcacggg

SEQ ID NO: 430065 - DNA, 20 bp, mouse
gggtcgtggcggtagctgca

SEQ ID NO: 430066 - DNA, 20 bp, mouse
ggagctgcacaggacgagaa

SEQ ID NO: 430067 - DNA, 20 bp, mouse
gggccacacggaagtagata

SEQ ID NO: 430068 - DNA, 20 bp, mouse
gcgtcctgtgcagctcgagg

SEQ ID NO: 430069 - DNA, 20 bp, mouse
ggagacacagcttcatgcca

SEQ ID NO: 430070 - DNA, 20 bp, mouse
ggctccccctcgagctgcac

SEQ ID NO: 430071 - DNA, 20 bp, mouse
gggccctggtcatgaagtct

SEQ ID NO: 430072 - DNA, 20 bp, mouse
gactgactgggattccatgg

SEQ ID NO: 430073 - DNA, 20 bp, mouse
gtggagccctgccccccctg

SEQ ID NO: 430074 - DNA, 20 bp, mouse
gagcagcgcttgcctctggg

SEQ ID NO: 430075 - DNA, 20 bp, mouse
gcagcttcatgccagggttc

SEQ ID NO: 430076 - DNA, 20 bp, mouse
gcgccgccggagcccgagta

SEQ ID NO: 430077 - DNA, 20 bp, mouse
gcgccggagcccgagtaggg

SEQ ID NO: 430078 - DNA, 20 bp, mouse
ggggtgtcacctccctactc

SEQ ID NO: 430079 - DNA, 20 bp, mouse
ggcagagagcgcagacggag

SEQ ID NO: 430080 - DNA, 20 bp, mouse
gaggtgacacccgcccgggg

SEQ ID NO: 430081 - DNA, 20 bp, mouse
gcggcgccgcgggtccgcat

SEQ ID NO: 430082 - DNA, 20 bp, mouse
ggctaactcatgaagaacaa

SEQ ID NO: 430083 - DNA, 20 bp, mouse
gccgcatgggcgcgcagatt

SEQ ID NO: 430084 - DNA, 20 bp, mouse
gttgggccgtgcaccgcccc

SEQ ID NO: 430085 - DNA, 20 bp, mouse
gtagggaggtgacacccgcc

SEQ ID NO: 430086 - DNA, 20 bp, mouse
gagtgtggctgccataccag

SEQ ID NO: 430087 - DNA, 20 bp, mouse
gagcagcacggtgtccaggt

SEQ ID NO: 430088 - DNA, 20 bp, mouse
ggctctgctgatgcacactc

SEQ ID NO: 430089 - DNA, 20 bp, mouse
gactacagacaggaaacccc

SEQ ID NO: 430090 - DNA, 20 bp, mouse
ggtgtaacccagctgactga

SEQ ID NO: 430091 - DNA, 20 bp, mouse
gccacatcatcacctgccac

SEQ ID NO: 430092 - DNA, 20 bp, mouse
ggtggagcagcacggtgtcc

SEQ ID NO: 430093 - DNA, 20 bp, mouse
gcagctgactgatggtgacg

SEQ ID NO: 430094 - DNA, 20 bp, mouse
gttgtcttgtgagatcctca

SEQ ID NO: 430095 - DNA, 20 bp, mouse
gtcagcagagctgacccacc

SEQ ID NO: 430096 - DNA, 20 bp, mouse
gtggcgaggactgcgaacga

SEQ ID NO: 430097 - DNA, 20 bp, mouse
gccgccatggtgacacaaag

SEQ ID NO: 430098 - DNA, 20 bp, mouse
ggtcaccatggcggcggagg

SEQ ID NO: 430099 - DNA, 20 bp, mouse
gaccgaggtggagaccgtag

SEQ ID NO: 430100 - DNA, 20 bp, mouse
ggaccgcgaggaagggtgag

SEQ ID NO: 430101 - DNA, 20 bp, mouse
gaagccgccggggtctgagg

SEQ ID NO: 430102 - DNA, 20 bp, mouse
gacccaggaccgcaccgagg

SEQ ID NO: 430103 - DNA, 20 bp, mouse
gcgtaggggaccgcgaggaa

SEQ ID NO: 430104 - DNA, 20 bp, mouse
ggagggctcgaaagccgccg

SEQ ID NO: 430105 - DNA, 20 bp, mouse
gcgagggcccctcaccacca

SEQ ID NO: 430106 - DNA, 20 bp, mouse
gtccttgcggggagactgca

SEQ ID NO: 430107 - DNA, 20 bp, mouse
gaggctgccggcactcagca

SEQ ID NO: 430108 - DNA, 20 bp, mouse
gctcaaaggccgatgcgaat

SEQ ID NO: 430109 - DNA, 20 bp, mouse
gttgcggggagactgcacgg

SEQ ID NO: 430110 - DNA, 20 bp, mouse
gcataacccgtgctgagtgc

SEQ ID NO: 430111 - DNA, 20 bp, mouse
gcggggagactgcacggagg

SEQ ID NO: 430112 - DNA, 20 bp, mouse
gcccagggcgtggtcaccgg

SEQ ID NO: 430113 - DNA, 20 bp, mouse
gtttatgcgggtcctcgacg

SEQ ID NO: 430114 - DNA, 20 bp, mouse
gaggttagctgcgaggctgc

SEQ ID NO: 430115 - DNA, 20 bp, mouse
gccagcgggaaaggaggcaa

SEQ ID NO: 430116 - DNA, 20 bp, mouse
gccgcagcgcactggaccag

SEQ ID NO: 430117 - DNA, 20 bp, mouse
gcagcgcactggaccagcgg

SEQ ID NO: 430118 - DNA, 20 bp, mouse
gggaccagcggcggagaccc

SEQ ID NO: 430119 - DNA, 20 bp, mouse
ggctgcgccccagctcccgg

SEQ ID NO: 430120 - DNA, 20 bp, mouse
gggacgtgaagcgctggctg

SEQ ID NO: 430121 - DNA, 20 bp, mouse
ggcgtgcggtcggtgatgag

SEQ ID NO: 430122 - DNA, 20 bp, mouse
gcgtgaagcgctggctgcgg

SEQ ID NO: 430123 - DNA, 20 bp, mouse
gctagcacgactggactggg

SEQ ID NO: 430124 - DNA, 20 bp, mouse
ggacccaggacgtgaagcgc

SEQ ID NO: 430125 - DNA, 20 bp, mouse
gcgggcacgcgtgcagacca

SEQ ID NO: 430126 - DNA, 20 bp, mouse
gcgtgaacgcgtgcactcgg

SEQ ID NO: 430127 - DNA, 20 bp, mouse
ggacgataggagcttggact

SEQ ID NO: 430128 - DNA, 20 bp, mouse
gggactggggccaggatcct

SEQ ID NO: 430129 - DNA, 20 bp, mouse
gctgcagcagccttaaggtc

SEQ ID NO: 430130 - DNA, 20 bp, mouse
gggtcgtgaacgcgtgcact

SEQ ID NO: 430131 - DNA, 20 bp, mouse
gcagccttaaggtccggcgt

SEQ ID NO: 430132 - DNA, 20 bp, mouse
gcgctgcaggcaggtcggag

SEQ ID NO: 430133 - DNA, 20 bp, mouse
gccggcgtcggcagacctac

SEQ ID NO: 430134 - DNA, 20 bp, mouse
gcaggatcctgggacggcgg

SEQ ID NO: 430135 - DNA, 20 bp, mouse
gtgcatgccgcatggaaaca

SEQ ID NO: 430136 - DNA, 20 bp, mouse
gagaagggacggctctgtca

SEQ ID NO: 430137 - DNA, 20 bp, mouse
gggacggctctgtcatggac

SEQ ID NO: 430138 - DNA, 20 bp, mouse
gccctgctgccaagatggaa

SEQ ID NO: 430139 - DNA, 20 bp, mouse
ggtgattcattcagtcccag

SEQ ID NO: 430140 - DNA, 20 bp, mouse
gagggccagcccttccatct

SEQ ID NO: 430141 - DNA, 20 bp, mouse
gagtgagagtcggaggaagg

SEQ ID NO: 430142 - DNA, 20 bp, mouse
ggtactggtgtccagggtgg

SEQ ID NO: 430143 - DNA, 20 bp, mouse
gctgcaggtactggtgtcca

SEQ ID NO: 430144 - DNA, 20 bp, mouse
ggaatcacagtgagagtcgg

SEQ ID NO: 430145 - DNA, 20 bp, mouse
ggggttggaactctcagatg

SEQ ID NO: 430146 - DNA, 20 bp, mouse
ggcgcgcgccactgtcccca

SEQ ID NO: 430147 - DNA, 20 bp, mouse
ggctacaagctgtagcgcag

SEQ ID NO: 430148 - DNA, 20 bp, mouse
gtcgctcgctcgcaccgtgg

SEQ ID NO: 430149 - DNA, 20 bp, mouse
ggcgtcactcgctgaccctg

SEQ ID NO: 430150 - DNA, 20 bp, mouse
gtgtagcctcgccaccccca

SEQ ID NO: 430151 - DNA, 20 bp, mouse
gaatcgctgaactccagagt

SEQ ID NO: 430152 - DNA, 20 bp, mouse
gaggctccgggcgctgtcac

SEQ ID NO: 430153 - DNA, 20 bp, mouse
gctcgctcgcaccgtggggg

SEQ ID NO: 430154 - DNA, 20 bp, mouse
gccgccgcgcctgggccatg

SEQ ID NO: 430155 - DNA, 20 bp, mouse
gcagccccatggcccaggcg

SEQ ID NO: 430156 - DNA, 20 bp, mouse
gcagcccggcgagcgaaccg

SEQ ID NO: 430157 - DNA, 20 bp, mouse
gagttggccaaccagacggt

SEQ ID NO: 430158 - DNA, 20 bp, mouse
gaggcggaggtgctctcggg

SEQ ID NO: 430159 - DNA, 20 bp, mouse
ggacccgcgcggacccagga

SEQ ID NO: 430160 - DNA, 20 bp, mouse
gccagcctcccgggcgacgg

SEQ ID NO: 430161 - DNA, 20 bp, mouse
gactaggcggaggtgctctc

SEQ ID NO: 430162 - DNA, 20 bp, mouse
gcccgggcgtggcacagaga

SEQ ID NO: 430163 - DNA, 20 bp, mouse
gatgcggcgggcggactagg

SEQ ID NO: 430164 - DNA, 20 bp, mouse
gcgaaccggggagtctccgc

SEQ ID NO: 430165 - DNA, 20 bp, mouse
gagcccaccgcagggttaca

SEQ ID NO: 430166 - DNA, 20 bp, mouse
gcgcgccgggagagatgctg

SEQ ID NO: 430167 - DNA, 20 bp, mouse
gtaaagttcgggagagagag

SEQ ID NO: 430168 - DNA, 20 bp, mouse
ggtcgcgctgggctcagtaa

SEQ ID NO: 430169 - DNA, 20 bp, mouse
gtcagcgcgaggagcccgag

SEQ ID NO: 430170 - DNA, 20 bp, mouse
gagatgctgaggtaaagttc

SEQ ID NO: 430171 - DNA, 20 bp, mouse
gtcagtaatggcggccactc

SEQ ID NO: 430172 - DNA, 20 bp, mouse
gtcctccgtcgcctcctcaa

SEQ ID NO: 430173 - DNA, 20 bp, mouse
ggcgagaggcgagccgagag

SEQ ID NO: 430174 - DNA, 20 bp, mouse
ggcgcgtgcgtgcgttccgg

SEQ ID NO: 430175 - DNA, 20 bp, mouse
gggagcgcgccggccgcgag

SEQ ID NO: 430176 - DNA, 20 bp, mouse
gctctgatacccggcctcta

SEQ ID NO: 430177 - DNA, 20 bp, mouse
gctctgggcccaaccaaggt

SEQ ID NO: 430178 - DNA, 20 bp, mouse
gccagctctgggcccaacca

SEQ ID NO: 430179 - DNA, 20 bp, mouse
gctctagggagaaagtcttg

SEQ ID NO: 430180 - DNA, 20 bp, mouse
gccagaggcagcggggaaag

SEQ ID NO: 430181 - DNA, 20 bp, mouse
gaccctcgcgccagaggcag

SEQ ID NO: 430182 - DNA, 20 bp, mouse
gacaatcccgagggctaggg

SEQ ID NO: 430183 - DNA, 20 bp, mouse
gcccagcaccctcgcgccag

SEQ ID NO: 430184 - DNA, 20 bp, mouse
gggcctgaggacaatcccga

SEQ ID NO: 430185 - DNA, 20 bp, mouse
ggcccgggacgcagcacata

SEQ ID NO: 430186 - DNA, 20 bp, mouse
ggcgttgcagagaccaggtg

SEQ ID NO: 430187 - DNA, 20 bp, mouse
ggaccaggtgaggtgctcgg

SEQ ID NO: 430188 - DNA, 20 bp, mouse
gcgagcaggtccccaagggg

SEQ ID NO: 430189 - DNA, 20 bp, mouse
gacccgagcaggtccccaag

SEQ ID NO: 430190 - DNA, 20 bp, mouse
gggctggcgttgcagagacc

SEQ ID NO: 430191 - DNA, 20 bp, mouse
gccccaagggggggactcac

SEQ ID NO: 430192 - DNA, 20 bp, mouse
gggtgaggtgctcggtggtc

SEQ ID NO: 430193 - DNA, 20 bp, mouse
gtccggtgagtccccccctt

SEQ ID NO: 430194 - DNA, 20 bp, mouse
gcccaaaggggaccgaacct

SEQ ID NO: 430195 - DNA, 20 bp, mouse
gcggggacgggccaggtgtg

SEQ ID NO: 430196 - DNA, 20 bp, mouse
gcttagggcgagaggaagag

SEQ ID NO: 430197 - DNA, 20 bp, mouse
gtgtgtgtgcaggaccctta

SEQ ID NO: 430198 - DNA, 20 bp, mouse
ggcaggacccttagggcgag

SEQ ID NO: 430199 - DNA, 20 bp, mouse
gagatcagcacaggtttggg

SEQ ID NO: 430200 - DNA, 20 bp, mouse
gaagtatctggggaaatcta

SEQ ID NO: 430201 - DNA, 20 bp, mouse
gctggtgcctccgtacagaa

SEQ ID NO: 430202 - DNA, 20 bp, mouse
gtgtcacctataggaaaagg

SEQ ID NO: 430203 - DNA, 20 bp, mouse
gcaccaccggcctgagaaca

SEQ ID NO: 430204 - DNA, 20 bp, mouse
gagatgggccgagagctggg

SEQ ID NO: 430205 - DNA, 20 bp, mouse
ggatagagggcgcagagctg

SEQ ID NO: 430206 - DNA, 20 bp, mouse
gagaagagcaaagactgtga

SEQ ID NO: 430207 - DNA, 20 bp, mouse
ggagagatcgggagggacag

SEQ ID NO: 430208 - DNA, 20 bp, mouse
ggggtagaaaccccagtccc

SEQ ID NO: 430209 - DNA, 20 bp, mouse
ggtcagctccgggcccgggg

SEQ ID NO: 430210 - DNA, 20 bp, mouse
ggaccagggaccctggacgt

SEQ ID NO: 430211 - DNA, 20 bp, mouse
ggagctgaccgtgagtaaat

SEQ ID NO: 430212 - DNA, 20 bp, mouse
gtaaaaaacagccagggact

SEQ ID NO: 430213 - DNA, 20 bp, mouse
gaatgggagagagatcggga

SEQ ID NO: 430214 - DNA, 20 bp, mouse
gggaccctggacgtcggaga

SEQ ID NO: 430215 - DNA, 20 bp, mouse
gatgtaccagggcccccccc

SEQ ID NO: 430216 - DNA, 20 bp, mouse
gccacgcgcccactcaccgg

SEQ ID NO: 430217 - DNA, 20 bp, mouse
ggcgccacgcgcccactcac

SEQ ID NO: 430218 - DNA, 20 bp, mouse
ggccgccggcgacagcatca

SEQ ID NO: 430219 - DNA, 20 bp, mouse
gccggaagtgaccgtccgag

SEQ ID NO: 430220 - DNA, 20 bp, mouse
ggaagtgaccgtccgagcgg

SEQ ID NO: 430221 - DNA, 20 bp, mouse
gggtcgagcctccggtgagt

SEQ ID NO: 430222 - DNA, 20 bp, mouse
ggcggcggtccgaaacccgg

SEQ ID NO: 430223 - DNA, 20 bp, mouse
gtgaccgtccgagcggcggg

SEQ ID NO: 430224 - DNA, 20 bp, mouse
gcgcccgcgaggccgaggaa

SEQ ID NO: 430225 - DNA, 20 bp, mouse
gtggcggtgaggaaccaacc

SEQ ID NO: 430226 - DNA, 20 bp, mouse
gggtaacctccagagacaca

SEQ ID NO: 430227 - DNA, 20 bp, mouse
gccagagacacagggccgac

SEQ ID NO: 430228 - DNA, 20 bp, mouse
gagtcagagttgagagacag

SEQ ID NO: 430229 - DNA, 20 bp, mouse
gctcaactctgactgaggac

SEQ ID NO: 430230 - DNA, 20 bp, mouse
gggaagtcagccctgagaag

SEQ ID NO: 430231 - DNA, 20 bp, mouse
gagacggctgatcggaagat

SEQ ID NO: 430232 - DNA, 20 bp, mouse
gagcttgtctccccttctca

SEQ ID NO: 430233 - DNA, 20 bp, mouse
gtcctctggcaagggcagta

SEQ ID NO: 430234 - DNA, 20 bp, mouse
gctgttgctgttcttaggaa

SEQ ID NO: 430235 - DNA, 20 bp, mouse
gaggggagacaagctgaagg

SEQ ID NO: 430236 - DNA, 20 bp, mouse
ggggcgcggcagggacgacc

SEQ ID NO: 430237 - DNA, 20 bp, mouse
gctggacgcgtgtgagctgg

SEQ ID NO: 430238 - DNA, 20 bp, mouse
gtctagggaagggagcgagg

SEQ ID NO: 430239 - DNA, 20 bp, mouse
gcgactcgggcgctcacctc

SEQ ID NO: 430240 - DNA, 20 bp, mouse
ggacgaaacgcgcgtctctg

SEQ ID NO: 430241 - DNA, 20 bp, mouse
gggacgaccgggttccggcg

SEQ ID NO: 430242 - DNA, 20 bp, mouse
gttccacgcagacccttcta

SEQ ID NO: 430243 - DNA, 20 bp, mouse
gggtgagcgcccgagtcggg

SEQ ID NO: 430244 - DNA, 20 bp, mouse
gagggcgcgtggggacctcg

SEQ ID NO: 430245 - DNA, 20 bp, mouse
gcgtggccgccgcccgactc

SEQ ID NO: 430246 - DNA, 20 bp, mouse
gcggcgaggcgcccgaggtc

SEQ ID NO: 430247 - DNA, 20 bp, mouse
ggatccccgagcccgacctc

SEQ ID NO: 430248 - DNA, 20 bp, mouse
gaagccggagtcgggacacc

SEQ ID NO: 430249 - DNA, 20 bp, mouse
ggagtcgggacaccgggccc

SEQ ID NO: 430250 - DNA, 20 bp, mouse
ggtgaccggcgaggcgcccg

SEQ ID NO: 430251 - DNA, 20 bp, mouse
gacctggtgtccgcgcgggg

SEQ ID NO: 430252 - DNA, 20 bp, mouse
ggggccagggacagtgtacc

SEQ ID NO: 430253 - DNA, 20 bp, mouse
gtctggcgggcaggaagtcg

SEQ ID NO: 430254 - DNA, 20 bp, mouse
gcgcggggaggtgaccggcg

SEQ ID NO: 430255 - DNA, 20 bp, mouse
gacttgtcgagagcacaagt

SEQ ID NO: 430256 - DNA, 20 bp, mouse
gcccatccgacaggtgagat

SEQ ID NO: 430257 - DNA, 20 bp, mouse
gtcggttcctgaggctgcag

SEQ ID NO: 430258 - DNA, 20 bp, mouse
ggcggaggcttcggttcctg

SEQ ID NO: 430259 - DNA, 20 bp, mouse
gacctggagctcgagcgcgg

SEQ ID NO: 430260 - DNA, 20 bp, mouse
gcaggtttcacggcaaccaa

SEQ ID NO: 430261 - DNA, 20 bp, mouse
gggtggcagggaagacgtgt

SEQ ID NO: 430262 - DNA, 20 bp, mouse
ggcttctcttcccatccgac

SEQ ID NO: 430263 - DNA, 20 bp, mouse
gagctcgagcgcggaggctt

SEQ ID NO: 430264 - DNA, 20 bp, mouse
gagcaagccactgcagcctc

SEQ ID NO: 430265 - DNA, 20 bp, mouse
gggaacctggagctcgagcg

SEQ ID NO: 430266 - DNA, 20 bp, mouse
gcggcctgggacgggacttg

SEQ ID NO: 430267 - DNA, 20 bp, mouse
gaactggcggacgcagacgg

SEQ ID NO: 430268 - DNA, 20 bp, mouse
ggtccctcggtgagtgagca

SEQ ID NO: 430269 - DNA, 20 bp, mouse
gcgtgcaagcggcctgggac

SEQ ID NO: 430270 - DNA, 20 bp, mouse
gcgccgtgctcactcaccga

SEQ ID NO: 430271 - DNA, 20 bp, mouse
gcggatggcgcccggtccct

SEQ ID NO: 430272 - DNA, 20 bp, mouse
gcaacccgtgcaagcggcct

SEQ ID NO: 430273 - DNA, 20 bp, mouse
gcgctgtctctggcacagga

SEQ ID NO: 430274 - DNA, 20 bp, mouse
ggggggcgcgggacaactgg

SEQ ID NO: 430275 - DNA, 20 bp, mouse
ggacaactggcggacgcaga

SEQ ID NO: 430276 - DNA, 20 bp, mouse
gagacggagggacactcaag

SEQ ID NO: 430277 - DNA, 20 bp, mouse
gccagtcaggactcagacgg

SEQ ID NO: 430278 - DNA, 20 bp, mouse
ggagacccggacacacaaag

SEQ ID NO: 430279 - DNA, 20 bp, mouse
gcagccgcgcgccccgggac

SEQ ID NO: 430280 - DNA, 20 bp, mouse
ggcgcctcccgctcctgccg

SEQ ID NO: 430281 - DNA, 20 bp, mouse
gccctggagcccgggaacca

SEQ ID NO: 430282 - DNA, 20 bp, mouse
ggggatggggaaagtatggg

SEQ ID NO: 430283 - DNA, 20 bp, mouse
gccggggctgcagtggggcg

SEQ ID NO: 430284 - DNA, 20 bp, mouse
gaacatcgaatcacagggta

SEQ ID NO: 430285 - DNA, 20 bp, mouse
gttgtgtgtccgggtctccc

SEQ ID NO: 430286 - DNA, 20 bp, mouse
gcagcgggcaagcatctggt

SEQ ID NO: 430287 - DNA, 20 bp, mouse
gtggcgcctgccccggtcac

SEQ ID NO: 430288 - DNA, 20 bp, mouse
gcggggcaggcgccaccagc

SEQ ID NO: 430289 - DNA, 20 bp, mouse
gagtccaactgtggtcctca

SEQ ID NO: 430290 - DNA, 20 bp, mouse
gggagaagatgccagtgacc

SEQ ID NO: 430291 - DNA, 20 bp, mouse
gccaccagcgggcaagcatc

SEQ ID NO: 430292 - DNA, 20 bp, mouse
ggaacgaagagggcttaact

SEQ ID NO: 430293 - DNA, 20 bp, mouse
gcatctggtggggaagctgc

SEQ ID NO: 430294 - DNA, 20 bp, mouse
gctcccctgaggaccacagt

SEQ ID NO: 430295 - DNA, 20 bp, mouse
gtgggagagactgaccgacc

SEQ ID NO: 430296 - DNA, 20 bp, mouse
ggccagggcgccctccacag

SEQ ID NO: 430297 - DNA, 20 bp, mouse
gacagcggcgcggagagccc

SEQ ID NO: 430298 - DNA, 20 bp, mouse
gaagcgcagcggccgcgacg

SEQ ID NO: 430299 - DNA, 20 bp, mouse
gtcgccgcagcgctctggag

SEQ ID NO: 430300 - DNA, 20 bp, mouse
ggagcacacagagctgactg

SEQ ID NO: 430301 - DNA, 20 bp, mouse
gctgcggcgagagagacttt

SEQ ID NO: 430302 - DNA, 20 bp, mouse
gctgaggctgggttaggtgg

SEQ ID NO: 430303 - DNA, 20 bp, mouse
ggccgatctgaggctgggtt

SEQ ID NO: 430304 - DNA, 20 bp, mouse
gggcgccctccacagcggcg

SEQ ID NO: 430305 - DNA, 20 bp, mouse
gcagccacagcctccccgct

SEQ ID NO: 430306 - DNA, 20 bp, mouse
gaagcccggcccccgagcag

SEQ ID NO: 430307 - DNA, 20 bp, mouse
gcccggcccccgagcagcgg

SEQ ID NO: 430308 - DNA, 20 bp, mouse
ggccgttcgcccggtctcag

SEQ ID NO: 430309 - DNA, 20 bp, mouse
gcgcgagtgcccctgagacc

SEQ ID NO: 430310 - DNA, 20 bp, mouse
gtgccccgggcgctgagaca

SEQ ID NO: 430311 - DNA, 20 bp, mouse
gtcctccccgacgctctggt

SEQ ID NO: 430312 - DNA, 20 bp, mouse
gccctcggcccggggacatg

SEQ ID NO: 430313 - DNA, 20 bp, mouse
ggcccctgagaccgggcgaa

SEQ ID NO: 430314 - DNA, 20 bp, mouse
gcgcgggagcgcgcccaggg

SEQ ID NO: 430315 - DNA, 20 bp, mouse
gcgcgggacggtgtgagacg

SEQ ID NO: 430316 - DNA, 20 bp, mouse
gccgagagctgagtgagtag

SEQ ID NO: 430317 - DNA, 20 bp, mouse
gaatgagcccagagagtcgg

SEQ ID NO: 430318 - DNA, 20 bp, mouse
gtcagctctcggaggtgact

SEQ ID NO: 430319 - DNA, 20 bp, mouse
gtggggtcccccgactctct

SEQ ID NO: 430320 - DNA, 20 bp, mouse
gcagaatgagcccagagagt

SEQ ID NO: 430321 - DNA, 20 bp, mouse
ggagtgagctgcaatctaag

SEQ ID NO: 430322 - DNA, 20 bp, mouse
gtagattgcagctcactcag

SEQ ID NO: 430323 - DNA, 20 bp, mouse
gacccggtatggggaagggt

SEQ ID NO: 430324 - DNA, 20 bp, mouse
gctatgaccagacccaggtg

SEQ ID NO: 430325 - DNA, 20 bp, mouse
gactggagggtaagtgcttg

SEQ ID NO: 430326 - DNA, 20 bp, mouse
gtgtgcgcgcaaccgagggt

SEQ ID NO: 430327 - DNA, 20 bp, mouse
gcacctgtgcgcgcaaccga

SEQ ID NO: 430328 - DNA, 20 bp, mouse
ggcgcaaccgagggtcggcc

SEQ ID NO: 430329 - DNA, 20 bp, mouse
gactgcaggctacaccctcc

SEQ ID NO: 430330 - DNA, 20 bp, mouse
gtgcgcgcacaggtgagtct

SEQ ID NO: 430331 - DNA, 20 bp, mouse
gcaccctcccggccgaccct

SEQ ID NO: 430332 - DNA, 20 bp, mouse
gcaaccgagggtcggccggg

SEQ ID NO: 430333 - DNA, 20 bp, mouse
gagtcgccgaggtacaggag

SEQ ID NO: 430334 - DNA, 20 bp, mouse
ggtgggataagggcacgagg

SEQ ID NO: 430335 - DNA, 20 bp, mouse
gcagccggcgcggccaggtg

SEQ ID NO: 430336 - DNA, 20 bp, mouse
gagctagctgcttagaggga

SEQ ID NO: 430337 - DNA, 20 bp, mouse
ggctggagcgggagctcgag

SEQ ID NO: 430338 - DNA, 20 bp, mouse
ggtccgcctgccaagcccgg

SEQ ID NO: 430339 - DNA, 20 bp, mouse
gggtgcggagacgtgagcag

SEQ ID NO: 430340 - DNA, 20 bp, mouse
gcgagaggggccgcccagga

SEQ ID NO: 430341 - DNA, 20 bp, mouse
gcgagccttaggcccctcac

SEQ ID NO: 430342 - DNA, 20 bp, mouse
gggtgctagtcactccgggg

SEQ ID NO: 430343 - DNA, 20 bp, mouse
ggtcgaagatcaagtttccg

SEQ ID NO: 430344 - DNA, 20 bp, mouse
gtcccgcagaggctaaggct

SEQ ID NO: 430345 - DNA, 20 bp, mouse
gggagaggccagggacatcg

SEQ ID NO: 430346 - DNA, 20 bp, mouse
ggacccgggagccagcaggg

SEQ ID NO: 430347 - DNA, 20 bp, mouse
ggagactgcgagagcgaccc

SEQ ID NO: 430348 - DNA, 20 bp, mouse
gcctccgcggggtccctcac

SEQ ID NO: 430349 - DNA, 20 bp, mouse
gctccaagtggagaatgtgg

SEQ ID NO: 430350 - DNA, 20 bp, mouse
gcggcctgtgagggaccccg

SEQ ID NO: 430351 - DNA, 20 bp, mouse
gcggctcctaggaggccggg

SEQ ID NO: 430352 - DNA, 20 bp, mouse
gaccgcttccggctcctagg

SEQ ID NO: 430353 - DNA, 20 bp, mouse
ggcgcagggacagggtgact

SEQ ID NO: 430354 - DNA, 20 bp, mouse
gttccggctcctaggaggcc

SEQ ID NO: 430355 - DNA, 20 bp, mouse
gcgtccacggcgcagggaca

SEQ ID NO: 430356 - DNA, 20 bp, mouse
gaggctctgactactgtaga

SEQ ID NO: 430357 - DNA, 20 bp, mouse
gtactgtagagggacctagc

SEQ ID NO: 430358 - DNA, 20 bp, mouse
ggcttcctgcggttccagct

SEQ ID NO: 430359 - DNA, 20 bp, mouse
ggggacctagctggaaccgc

SEQ ID NO: 430360 - DNA, 20 bp, mouse
ggaggagcgttgagcctgga

SEQ ID NO: 430361 - DNA, 20 bp, mouse
ggttgagcctggatggagcg

SEQ ID NO: 430362 - DNA, 20 bp, mouse
gcattgtcaaggagccagag

SEQ ID NO: 430363 - DNA, 20 bp, mouse
gtgtctagtacacagctgtt

SEQ ID NO: 430364 - DNA, 20 bp, mouse
gccgcaggaccaacttctaa

SEQ ID NO: 430365 - DNA, 20 bp, mouse
gaacttctaagggaggggag

SEQ ID NO: 430366 - DNA, 20 bp, mouse
gaagctgctggtacagtcca

SEQ ID NO: 430367 - DNA, 20 bp, mouse
ggggctccaggccaccctgg

SEQ ID NO: 430368 - DNA, 20 bp, mouse
gggccaccctgggggcaatg

SEQ ID NO: 430369 - DNA, 20 bp, mouse
gtccctcgggatacaggaag

SEQ ID NO: 430370 - DNA, 20 bp, mouse
ggccaagcaaagtcccagga

SEQ ID NO: 430371 - DNA, 20 bp, mouse
gaagttgccagagcatccct

SEQ ID NO: 430372 - DNA, 20 bp, mouse
gcctgccccacacaataccc

SEQ ID NO: 430373 - DNA, 20 bp, mouse
gagcttacattgcccggcct

SEQ ID NO: 430374 - DNA, 20 bp, mouse
ggagggagggctgggtacca

SEQ ID NO: 430375 - DNA, 20 bp, mouse
ggaggtcatggccagaaagg

SEQ ID NO: 430376 - DNA, 20 bp, mouse
gggccccgggtgtccagcaa

SEQ ID NO: 430377 - DNA, 20 bp, mouse
gcccgggtgtccagcaacgg

SEQ ID NO: 430378 - DNA, 20 bp, mouse
gcgtgagccgcgggaggacg

SEQ ID NO: 430379 - DNA, 20 bp, mouse
ggggtgtccagcaacggcgg

SEQ ID NO: 430380 - DNA, 20 bp, mouse
ggaactggtgctgggtgcag

SEQ ID NO: 430381 - DNA, 20 bp, mouse
gtccccgaggccgacgcgtg

SEQ ID NO: 430382 - DNA, 20 bp, mouse
gggaggcccagaggtcggca

SEQ ID NO: 430383 - DNA, 20 bp, mouse
gctgcgagcgcgtgaggagg

SEQ ID NO: 430384 - DNA, 20 bp, mouse
gatccagcgtgagccgcggg

SEQ ID NO: 430385 - DNA, 20 bp, mouse
gaggagcaggcaaccaaggt

SEQ ID NO: 430386 - DNA, 20 bp, mouse
gtatcgaggaggatcagaca

SEQ ID NO: 430387 - DNA, 20 bp, mouse
gttgcggggaaactgagtcg

SEQ ID NO: 430388 - DNA, 20 bp, mouse
ggtcagtgcggccaggggtg

SEQ ID NO: 430389 - DNA, 20 bp, mouse
gttcggcagtagcaactccc

SEQ ID NO: 430390 - DNA, 20 bp, mouse
gttcaagtttcagggccgag

SEQ ID NO: 430391 - DNA, 20 bp, mouse
gcaggggtggggcggtccgg

SEQ ID NO: 430392 - DNA, 20 bp, mouse
gggccctgaaacttgaagca

SEQ ID NO: 430393 - DNA, 20 bp, mouse
gctaagggatctctctccgg

SEQ ID NO: 430394 - DNA, 20 bp, mouse
ggtcgtggcagcctaggaaa

SEQ ID NO: 430395 - DNA, 20 bp, mouse
gacccgggcaggagggggta

SEQ ID NO: 430396 - DNA, 20 bp, mouse
gccttccggggcacagacca

SEQ ID NO: 430397 - DNA, 20 bp, mouse
gaaggacccaggccaccctc

SEQ ID NO: 430398 - DNA, 20 bp, mouse
ggagtactccctgtccccga

SEQ ID NO: 430399 - DNA, 20 bp, mouse
gggggacagggagtactcct

SEQ ID NO: 430400 - DNA, 20 bp, mouse
gctgtccccgagggtggcct

SEQ ID NO: 430401 - DNA, 20 bp, mouse
gttgtctccgcgctttagta

SEQ ID NO: 430402 - DNA, 20 bp, mouse
ggggggcgggaaggacgcag

SEQ ID NO: 430403 - DNA, 20 bp, mouse
gcggctagatggagacgcgg

SEQ ID NO: 430404 - DNA, 20 bp, mouse
gcgctggagaccgcataccg

SEQ ID NO: 430405 - DNA, 20 bp, mouse
gctgggtccttactaaagcg

SEQ ID NO: 430406 - DNA, 20 bp, mouse
gtgtccccgaggcctgccga

SEQ ID NO: 430407 - DNA, 20 bp, mouse
gtcgccctcggcaggcctcg

SEQ ID NO: 430408 - DNA, 20 bp, mouse
gctggccggcgggtcgccct

SEQ ID NO: 430409 - DNA, 20 bp, mouse
gtgcccaccggagttctcag

SEQ ID NO: 430410 - DNA, 20 bp, mouse
gaacgccaggagccctggcc

SEQ ID NO: 430411 - DNA, 20 bp, mouse
ggccatccccaggtaccagg

SEQ ID NO: 430412 - DNA, 20 bp, mouse
gcggccagcgtcgcccggag

SEQ ID NO: 430413 - DNA, 20 bp, mouse
gcggggacagcgcctggcca

SEQ ID NO: 430414 - DNA, 20 bp, mouse
gtgcaagcgatggaaatcag

SEQ ID NO: 430415 - DNA, 20 bp, mouse
gcctgccgagggcgacccgc

SEQ ID NO: 430416 - DNA, 20 bp, mouse
ggcagagcctggtggacagg

SEQ ID NO: 430417 - DNA, 20 bp, mouse
ggcctggtggacaggaggct

SEQ ID NO: 430418 - DNA, 20 bp, mouse
gctcatccaccccaattccc

SEQ ID NO: 430419 - DNA, 20 bp, mouse
ggcggggaggagttccctca

SEQ ID NO: 430420 - DNA, 20 bp, mouse
gtgctaagtgcagcagagcc

SEQ ID NO: 430421 - DNA, 20 bp, mouse
ggtcggagcgccccatggtg

SEQ ID NO: 430422 - DNA, 20 bp, mouse
ggagtcagaatctgaggtgt

SEQ ID NO: 430423 - DNA, 20 bp, mouse
gcattgggagtcagaatctg

SEQ ID NO: 430424 - DNA, 20 bp, mouse
gtccgagcctcctgtccacc

SEQ ID NO: 430425 - DNA, 20 bp, mouse
gatgaggtcggagcgcccca

SEQ ID NO: 430426 - DNA, 20 bp, mouse
gccccagtccaaggcttatc

SEQ ID NO: 430427 - DNA, 20 bp, mouse
gtcagaatccagataagcct

SEQ ID NO: 430428 - DNA, 20 bp, mouse
ggtacaccatagataaagat

SEQ ID NO: 430429 - DNA, 20 bp, mouse
gtaaccacagcaggcaccat

SEQ ID NO: 430430 - DNA, 20 bp, mouse
gatgagctaacagcctgcaa

SEQ ID NO: 430431 - DNA, 20 bp, mouse
ggagactgtcatatgctaac

SEQ ID NO: 430432 - DNA, 20 bp, mouse
gacagagtaacattgattta

SEQ ID NO: 430433 - DNA, 20 bp, mouse
gagctacccatctttatcta

SEQ ID NO: 430434 - DNA, 20 bp, mouse
gatatgacagtctcctatca

SEQ ID NO: 430435 - DNA, 20 bp, mouse
gatccagataagccttggac

SEQ ID NO: 430436 - DNA, 20 bp, mouse
ggcgcgtgcacagcagacag

SEQ ID NO: 430437 - DNA, 20 bp, mouse
ggggtgcaagtgactccgga

SEQ ID NO: 430438 - DNA, 20 bp, mouse
gagtggagcttcccagagcc

SEQ ID NO: 430439 - DNA, 20 bp, mouse
gttccccgcagccctcctgg

SEQ ID NO: 430440 - DNA, 20 bp, mouse
ggggagccacctgaatctgg

SEQ ID NO: 430441 - DNA, 20 bp, mouse
gggagtcacttgcacccgct

SEQ ID NO: 430442 - DNA, 20 bp, mouse
gttgttggggtcaggcagag

SEQ ID NO: 430443 - DNA, 20 bp, mouse
gagtgactccggagggcatc

SEQ ID NO: 430444 - DNA, 20 bp, mouse
ggtgcgcggtgagtccagcc

SEQ ID NO: 430445 - DNA, 20 bp, mouse
ggccgcctcacatccgaacc

SEQ ID NO: 430446 - DNA, 20 bp, mouse
gagctgtgtagttagaaggg

SEQ ID NO: 430447 - DNA, 20 bp, mouse
gaggtggcttaagtgtctca

SEQ ID NO: 430448 - DNA, 20 bp, mouse
gccgctgggaaggaaaccat

SEQ ID NO: 430449 - DNA, 20 bp, mouse
gcttctctgggctccatcgg

SEQ ID NO: 430450 - DNA, 20 bp, mouse
gaggaggaagacggatactg

SEQ ID NO: 430451 - DNA, 20 bp, mouse
ggcaaagagacaaagttctg

SEQ ID NO: 430452 - DNA, 20 bp, mouse
gaagttctgaggtttgcagg

SEQ ID NO: 430453 - DNA, 20 bp, mouse
ggtgaagctgtgtagttaga

SEQ ID NO: 430454 - DNA, 20 bp, mouse
gaggaagacggatactgtgg

SEQ ID NO: 430455 - DNA, 20 bp, mouse
gcaggctgtatatgctggag

SEQ ID NO: 430456 - DNA, 20 bp, mouse
ggcgggaagagtaaaaccct

SEQ ID NO: 430457 - DNA, 20 bp, mouse
gtgtagcaccgggcagcacg

SEQ ID NO: 430458 - DNA, 20 bp, mouse
gccacggtggggctcgatgg

SEQ ID NO: 430459 - DNA, 20 bp, mouse
ggctgcagccagaaactgta

SEQ ID NO: 430460 - DNA, 20 bp, mouse
gggtcaaacatggagagttc

SEQ ID NO: 430461 - DNA, 20 bp, mouse
gacgctaccaggaacaactg

SEQ ID NO: 430462 - DNA, 20 bp, mouse
gaatctccggcgcgacgctg

SEQ ID NO: 430463 - DNA, 20 bp, mouse
gactctccatgtttgaccca

SEQ ID NO: 430464 - DNA, 20 bp, mouse
ggagcacgctgctgtagcac

SEQ ID NO: 430465 - DNA, 20 bp, mouse
ggtctccagcagctcccgag

SEQ ID NO: 430466 - DNA, 20 bp, mouse
gtcacgcccggccaacctcc

SEQ ID NO: 430467 - DNA, 20 bp, mouse
gcccggcgataggagcccgg

SEQ ID NO: 430468 - DNA, 20 bp, mouse
gacctccgggctcctatcgc

SEQ ID NO: 430469 - DNA, 20 bp, mouse
gaggagcccggaggttggcc

SEQ ID NO: 430470 - DNA, 20 bp, mouse
gccctccttcccagcctcta

SEQ ID NO: 430471 - DNA, 20 bp, mouse
gggagatcccagctcaaggc

SEQ ID NO: 430472 - DNA, 20 bp, mouse
gtctcccggcgataggagcc

SEQ ID NO: 430473 - DNA, 20 bp, mouse
ggccggaggcgccggaaagg

SEQ ID NO: 430474 - DNA, 20 bp, mouse
ggggaaccgcgcagggtgag

SEQ ID NO: 430475 - DNA, 20 bp, mouse
gctcaggatggcatccccgg

SEQ ID NO: 430476 - DNA, 20 bp, mouse
gggcagggcgcagagcgcgt

SEQ ID NO: 430477 - DNA, 20 bp, mouse
gcgctctgcgccctgccggg

SEQ ID NO: 430478 - DNA, 20 bp, mouse
ggcccggcagtgtccagacg

SEQ ID NO: 430479 - DNA, 20 bp, mouse
gagtccagtggccctaccag

SEQ ID NO: 430480 - DNA, 20 bp, mouse
gagggccactggactcgctg

SEQ ID NO: 430481 - DNA, 20 bp, mouse
gccgcggcgagcctgctcag

SEQ ID NO: 430482 - DNA, 20 bp, mouse
gagctgcgaagggcgagagg

SEQ ID NO: 430483 - DNA, 20 bp, mouse
ggcgggcgcgggaccccgtc

SEQ ID NO: 430484 - DNA, 20 bp, mouse
ggccctgccgggtggccgcc

SEQ ID NO: 430485 - DNA, 20 bp, mouse
ggccctaccagcggcgatct

SEQ ID NO: 430486 - DNA, 20 bp, mouse
gagactgagcgcccggaggg

SEQ ID NO: 430487 - DNA, 20 bp, mouse
ggcgagactgagcgcccgga

SEQ ID NO: 430488 - DNA, 20 bp, mouse
ggttgtcctgcagctagacc

SEQ ID NO: 430489 - DNA, 20 bp, mouse
ggaacgagcggggagagccg

SEQ ID NO: 430490 - DNA, 20 bp, mouse
ggtcatggcaatactcggta

SEQ ID NO: 430491 - DNA, 20 bp, mouse
ggaggtgtcccactctccgg

SEQ ID NO: 430492 - DNA, 20 bp, mouse
gcgggaggtgtcccactctc

SEQ ID NO: 430493 - DNA, 20 bp, mouse
gagctgcaggacaactcgcg

SEQ ID NO: 430494 - DNA, 20 bp, mouse
gcgcccgcccgccggagagt

SEQ ID NO: 430495 - DNA, 20 bp, mouse
ggagagtctccgaagcgcca

SEQ ID NO: 430496 - DNA, 20 bp, mouse
gcgggcgcccggacctggag

SEQ ID NO: 430497 - DNA, 20 bp, mouse
gtggcccgagagtcccctcc

SEQ ID NO: 430498 - DNA, 20 bp, mouse
gcgcggcgggcgcccggacc

SEQ ID NO: 430499 - DNA, 20 bp, mouse
gcgcagactccggaaatggg

SEQ ID NO: 430500 - DNA, 20 bp, mouse
gcggacctggaggggactct

SEQ ID NO: 430501 - DNA, 20 bp, mouse
gaagagagcacccacctggt

SEQ ID NO: 430502 - DNA, 20 bp, mouse
ggcagcatgtgactccgacc

SEQ ID NO: 430503 - DNA, 20 bp, mouse
gcagtcccggccaggtcccg

SEQ ID NO: 430504 - DNA, 20 bp, mouse
gccgggtggaggtaaggcag

SEQ ID NO: 430505 - DNA, 20 bp, mouse
gcagccaggccaggccgccc

SEQ ID NO: 430506 - DNA, 20 bp, mouse
ggacgctctgaacagctctc

SEQ ID NO: 430507 - DNA, 20 bp, mouse
ggcagatgcaatcacggatg

SEQ ID NO: 430508 - DNA, 20 bp, mouse
gagatataagccatgtcaca

SEQ ID NO: 430509 - DNA, 20 bp, mouse
gagaagaacgccttgtgaca

SEQ ID NO: 430510 - DNA, 20 bp, mouse
gagacttctgcctggctcgg

SEQ ID NO: 430511 - DNA, 20 bp, mouse
gaggactgccaatcagggat

SEQ ID NO: 430512 - DNA, 20 bp, mouse
gctgcctggctcggtggaga

SEQ ID NO: 430513 - DNA, 20 bp, mouse
gtattattgctgctctgtgg

SEQ ID NO: 430514 - DNA, 20 bp, mouse
gaagtcctcgctgaaaaatg

SEQ ID NO: 430515 - DNA, 20 bp, mouse
gtttagtaaggtaacatcag

SEQ ID NO: 430516 - DNA, 20 bp, mouse
gctgggtctggaagaaccct

SEQ ID NO: 430517 - DNA, 20 bp, mouse
ggctgcctggagccagaacc

SEQ ID NO: 430518 - DNA, 20 bp, mouse
gctgctggcccggtctctcc

SEQ ID NO: 430519 - DNA, 20 bp, mouse
gcggcgggacggccacagca

SEQ ID NO: 430520 - DNA, 20 bp, mouse
gctggaagaaccctgggtcc

SEQ ID NO: 430521 - DNA, 20 bp, mouse
gctcctggacgcgtgaggag

SEQ ID NO: 430522 - DNA, 20 bp, mouse
gtgctctctctccctggttc

SEQ ID NO: 430523 - DNA, 20 bp, mouse
ggcagccccgtgactctgaa

SEQ ID NO: 430524 - DNA, 20 bp, mouse
gctggaggccagtgggagcc

SEQ ID NO: 430525 - DNA, 20 bp, mouse
gctgtgcctccaagctcccc

SEQ ID NO: 430526 - DNA, 20 bp, mouse
gtagcggcgcaggaacctgc

SEQ ID NO: 430527 - DNA, 20 bp, mouse
gcgtcgcccgatgacatcac

SEQ ID NO: 430528 - DNA, 20 bp, mouse
gagggtgatgagccacgtaa

SEQ ID NO: 430529 - DNA, 20 bp, mouse
ggccctgagagcacagacag

SEQ ID NO: 430530 - DNA, 20 bp, mouse
gcgcctgcaagaagacctca

SEQ ID NO: 430531 - DNA, 20 bp, mouse
gtcttctccggtgatgtcat

SEQ ID NO: 430532 - DNA, 20 bp, mouse
gcaggcgtcgctcaaggacg

SEQ ID NO: 430533 - DNA, 20 bp, mouse
gcgcaaggcgcggggaccgg

SEQ ID NO: 430534 - DNA, 20 bp, mouse
ggcgcgcgatcacctcggag

SEQ ID NO: 430535 - DNA, 20 bp, mouse
gccgcctccgcgcccatggg

SEQ ID NO: 430536 - DNA, 20 bp, mouse
gccatgcagtggattagagg

SEQ ID NO: 430537 - DNA, 20 bp, mouse
gcttcgtggacaccatgcag

SEQ ID NO: 430538 - DNA, 20 bp, mouse
gcagcttctgtgaggccggg

SEQ ID NO: 430539 - DNA, 20 bp, mouse
gacaccatgcagtggattag

SEQ ID NO: 430540 - DNA, 20 bp, mouse
gtcacagaagctggacttcg

SEQ ID NO: 430541 - DNA, 20 bp, mouse
gattagaggcggaacgggaa

SEQ ID NO: 430542 - DNA, 20 bp, mouse
ggtccagcttctgtgaggcc

SEQ ID NO: 430543 - DNA, 20 bp, mouse
ggcggtgggcagaggtatgg

SEQ ID NO: 430544 - DNA, 20 bp, mouse
gagtggattagaggcggaac

SEQ ID NO: 430545 - DNA, 20 bp, mouse
gggacagtggtgagggcggt

SEQ ID NO: 430546 - DNA, 20 bp, mouse
gggagagggcaagctaggaa

SEQ ID NO: 430547 - DNA, 20 bp, mouse
ggtctgctagctctcttcaa

SEQ ID NO: 430548 - DNA, 20 bp, mouse
ggctctcttcaagggattcc

SEQ ID NO: 430549 - DNA, 20 bp, mouse
gcgcatgcccggacagactc

SEQ ID NO: 430550 - DNA, 20 bp, mouse
gggaagagtggctggtagcc

SEQ ID NO: 430551 - DNA, 20 bp, mouse
gcagactctggagaaccgat

SEQ ID NO: 430552 - DNA, 20 bp, mouse
gcaacctaccggctgaggtg

SEQ ID NO: 430553 - DNA, 20 bp, mouse
gtgatgaactagaaagagta

SEQ ID NO: 430554 - DNA, 20 bp, mouse
ggactgaccggtagccagct

SEQ ID NO: 430555 - DNA, 20 bp, mouse
gggcgcccaagagagaatgc

SEQ ID NO: 430556 - DNA, 20 bp, mouse
gcccttgcctgggaatgagg

SEQ ID NO: 430557 - DNA, 20 bp, mouse
gtttctccggcagcagaaag

SEQ ID NO: 430558 - DNA, 20 bp, mouse
gaaagcggagagtcacagcg

SEQ ID NO: 430559 - DNA, 20 bp, mouse
gacagcggggccaggccctg

SEQ ID NO: 430560 - DNA, 20 bp, mouse
ggctgccggagaaaggagga

SEQ ID NO: 430561 - DNA, 20 bp, mouse
gacagggccgggtctctccg

SEQ ID NO: 430562 - DNA, 20 bp, mouse
ggccagcccggagcctgagc

SEQ ID NO: 430563 - DNA, 20 bp, mouse
gggagagtcacagcggggcc

SEQ ID NO: 430564 - DNA, 20 bp, mouse
gtcccaggcaagggcttggg

SEQ ID NO: 430565 - DNA, 20 bp, mouse
ggccgagcgcggggaaatga

SEQ ID NO: 430566 - DNA, 20 bp, mouse
ggcagcaggagccggagctg

SEQ ID NO: 430567 - DNA, 20 bp, mouse
ggccgcgagcctcagcaagg

SEQ ID NO: 430568 - DNA, 20 bp, mouse
gcagaaccagcacccgtcgg

SEQ ID NO: 430569 - DNA, 20 bp, mouse
gggtcggtgtagcccccgac

SEQ ID NO: 430570 - DNA, 20 bp, mouse
ggccccatgatgaggagcta

SEQ ID NO: 430571 - DNA, 20 bp, mouse
gggccagaaccagcacccgt

SEQ ID NO: 430572 - DNA, 20 bp, mouse
gccatgatgaggagctacgg

SEQ ID NO: 430573 - DNA, 20 bp, mouse
gagggcggcggcatgatgat

SEQ ID NO: 430574 - DNA, 20 bp, mouse
ggccggcggccgccttgctg

SEQ ID NO: 430575 - DNA, 20 bp, mouse
ggctccccgcggcagcaggg

SEQ ID NO: 430576 - DNA, 20 bp, mouse
gagcagccctcggagagaag

SEQ ID NO: 430577 - DNA, 20 bp, mouse
gcgccgcgctgggcccgatt

SEQ ID NO: 430578 - DNA, 20 bp, mouse
gcgggcccagcgcggcgtga

SEQ ID NO: 430579 - DNA, 20 bp, mouse
ggtgagggagccgagcgagc

SEQ ID NO: 430580 - DNA, 20 bp, mouse
ggacttgcctgagcctaatc

SEQ ID NO: 430581 - DNA, 20 bp, mouse
ggctgggcccgattaggctc

SEQ ID NO: 430582 - DNA, 20 bp, mouse
ggcgagtgcgcagcagccct

SEQ ID NO: 430583 - DNA, 20 bp, mouse
gcgcccgctacggcctgaac

SEQ ID NO: 430584 - DNA, 20 bp, mouse
gctctaacccggatatgggg

SEQ ID NO: 430585 - DNA, 20 bp, mouse
ggccccgggccgcccgccgg

SEQ ID NO: 430586 - DNA, 20 bp, mouse
ggcgcccggagcccattcct

SEQ ID NO: 430587 - DNA, 20 bp, mouse
gccaccgccggccgaggaat

SEQ ID NO: 430588 - DNA, 20 bp, mouse
gtagggagcgcggggagcgg

SEQ ID NO: 430589 - DNA, 20 bp, mouse
gggtgagagcaggaccgggg

SEQ ID NO: 430590 - DNA, 20 bp, mouse
gtcctcggccggcggtggcg

SEQ ID NO: 430591 - DNA, 20 bp, mouse
gatgggctccgggcgctggt

SEQ ID NO: 430592 - DNA, 20 bp, mouse
ggactgagccccgccaccgc

SEQ ID NO: 430593 - DNA, 20 bp, mouse
gctcagtcatgggccggcgg

SEQ ID NO: 430594 - DNA, 20 bp, mouse
ggccccgccaccgccggccg

SEQ ID NO: 430595 - DNA, 20 bp, mouse
gccagatcgcggttcaaacg

SEQ ID NO: 430596 - DNA, 20 bp, mouse
gccggagagccgccacagag

SEQ ID NO: 430597 - DNA, 20 bp, mouse
gggacgtccacggtgggagg

SEQ ID NO: 430598 - DNA, 20 bp, mouse
gatctgaggacgtccacggt

SEQ ID NO: 430599 - DNA, 20 bp, mouse
gagagccgccacagagtgga

SEQ ID NO: 430600 - DNA, 20 bp, mouse
gcccggggctgctgaatcac

SEQ ID NO: 430601 - DNA, 20 bp, mouse
ggagcgtgcactgggcacca

SEQ ID NO: 430602 - DNA, 20 bp, mouse
gccttctccaactcaatctg

SEQ ID NO: 430603 - DNA, 20 bp, mouse
gcatccgtctggatcggata

SEQ ID NO: 430604 - DNA, 20 bp, mouse
gcctccacctcctcccaccg

SEQ ID NO: 430605 - DNA, 20 bp, mouse
gtagacgcggcctggagact

SEQ ID NO: 430606 - DNA, 20 bp, mouse
gagcccggaacgctgcacat

SEQ ID NO: 430607 - DNA, 20 bp, mouse
gtccgggctcgcgggtaggg

SEQ ID NO: 430608 - DNA, 20 bp, mouse
gcgttccgggctcgcgggta

SEQ ID NO: 430609 - DNA, 20 bp, mouse
gcaggtgtgtaggggagacg

SEQ ID NO: 430610 - DNA, 20 bp, mouse
gccagctgcggaggagtagc

SEQ ID NO: 430611 - DNA, 20 bp, mouse
gctcccggtgtccaaaggag

SEQ ID NO: 430612 - DNA, 20 bp, mouse
gaacgctgcacataggtgag

SEQ ID NO: 430613 - DNA, 20 bp, mouse
gccgtcctcccggtgtccaa

SEQ ID NO: 430614 - DNA, 20 bp, mouse
gcaggtggaggggaccgaaa

SEQ ID NO: 430615 - DNA, 20 bp, mouse
gcacagcccctctcccgccg

SEQ ID NO: 430616 - DNA, 20 bp, mouse
gcggtcagaagagcgcaggg

SEQ ID NO: 430617 - DNA, 20 bp, mouse
ggggcggcaagagcgcacag

SEQ ID NO: 430618 - DNA, 20 bp, mouse
gaccgccagtgagcgcacgg

SEQ ID NO: 430619 - DNA, 20 bp, mouse
gggaccagacgggcatgagg

SEQ ID NO: 430620 - DNA, 20 bp, mouse
gacaggagccgcccgaaagg

SEQ ID NO: 430621 - DNA, 20 bp, mouse
ggcgaccgccagtgagcgca

SEQ ID NO: 430622 - DNA, 20 bp, mouse
gaccgccgtgcgctcactgg

SEQ ID NO: 430623 - DNA, 20 bp, mouse
gtgctctgccgcctttcggg

SEQ ID NO: 430624 - DNA, 20 bp, mouse
ggaagagggcagcaatgtct

SEQ ID NO: 430625 - DNA, 20 bp, mouse
gaccgccgtggagacacccg

SEQ ID NO: 430626 - DNA, 20 bp, mouse
gctgcaccgggaccccatcg

SEQ ID NO: 430627 - DNA, 20 bp, mouse
gtcgccgtgggtccccgtcc

SEQ ID NO: 430628 - DNA, 20 bp, mouse
gagtaaatcggggcgagtgg

SEQ ID NO: 430629 - DNA, 20 bp, mouse
gggattgtggcagtaaatcg

SEQ ID NO: 430630 - DNA, 20 bp, mouse
ggtaggtaggtagtcagcgg

SEQ ID NO: 430631 - DNA, 20 bp, mouse
gctgccgctgcggccgggag

SEQ ID NO: 430632 - DNA, 20 bp, mouse
gggacccacggcgatcagtg

SEQ ID NO: 430633 - DNA, 20 bp, mouse
gctgcccggacggggaccca

SEQ ID NO: 430634 - DNA, 20 bp, mouse
gcggggcgagtgggggaacc

SEQ ID NO: 430635 - DNA, 20 bp, mouse
ggtccgggcagcaccgctcc

SEQ ID NO: 430636 - DNA, 20 bp, mouse
gaggagctcgggcgctggag

SEQ ID NO: 430637 - DNA, 20 bp, mouse
ggctcgggcgctggagcgga

SEQ ID NO: 430638 - DNA, 20 bp, mouse
gctccgggcagaagtccagg

SEQ ID NO: 430639 - DNA, 20 bp, mouse
ggtccaggcggtggccgtcg

SEQ ID NO: 430640 - DNA, 20 bp, mouse
gtccctccgggcagaagtcc

SEQ ID NO: 430641 - DNA, 20 bp, mouse
gcggagcggccgccaaacaa

SEQ ID NO: 430642 - DNA, 20 bp, mouse
gactcctcctcctcccgtgg

SEQ ID NO: 430643 - DNA, 20 bp, mouse
ggccctccagaggaacacgg

SEQ ID NO: 430644 - DNA, 20 bp, mouse
ggtcagtcgagtccggagtg

SEQ ID NO: 430645 - DNA, 20 bp, mouse
ggagtccggagtgaggagct

SEQ ID NO: 430646 - DNA, 20 bp, mouse
gcgagagcgctgggacagga

SEQ ID NO: 430647 - DNA, 20 bp, mouse
gggacggctgtgcgtgtaga

SEQ ID NO: 430648 - DNA, 20 bp, mouse
ggcgccgagagcgctgggac

SEQ ID NO: 430649 - DNA, 20 bp, mouse
gaaaccgcagcaggaagtgt

SEQ ID NO: 430650 - DNA, 20 bp, mouse
gtctcggcgcgactgactac

SEQ ID NO: 430651 - DNA, 20 bp, mouse
gcagtcgcgccgagagcgct

SEQ ID NO: 430652 - DNA, 20 bp, mouse
gtcgctgggccatgggtaag

SEQ ID NO: 430653 - DNA, 20 bp, mouse
gcccgccagccgcttaccca

SEQ ID NO: 430654 - DNA, 20 bp, mouse
gtttcagtccagactcggag

SEQ ID NO: 430655 - DNA, 20 bp, mouse
gttctcgtggaaagtcgggg

SEQ ID NO: 430656 - DNA, 20 bp, mouse
ggccgggaccgcaggagcgg

SEQ ID NO: 430657 - DNA, 20 bp, mouse
gggcgccgggaccgcaggag

SEQ ID NO: 430658 - DNA, 20 bp, mouse
gcggaggagagcgaaatacc

SEQ ID NO: 430659 - DNA, 20 bp, mouse
gatggagcccaactcactcc

SEQ ID NO: 430660 - DNA, 20 bp, mouse
ggaaatacctggagtgagtt

SEQ ID NO: 430661 - DNA, 20 bp, mouse
gcatatggggaactggggag

SEQ ID NO: 430662 - DNA, 20 bp, mouse
gcgcctcatatggggaactg

SEQ ID NO: 430663 - DNA, 20 bp, mouse
gtcctccgctcctgcggtcc

SEQ ID NO: 430664 - DNA, 20 bp, mouse
gtcaattcagaacgtcgaga

SEQ ID NO: 430665 - DNA, 20 bp, mouse
gggcccacagatagaacgct

SEQ ID NO: 430666 - DNA, 20 bp, mouse
gggctcagtagcggtagcag

SEQ ID NO: 430667 - DNA, 20 bp, mouse
gccctttgttggctcagtag

SEQ ID NO: 430668 - DNA, 20 bp, mouse
ggtcccctgcgccacctccg

SEQ ID NO: 430669 - DNA, 20 bp, mouse
gtttccgtccgagcccggag

SEQ ID NO: 430670 - DNA, 20 bp, mouse
ggtcagacgccgctccgctc

SEQ ID NO: 430671 - DNA, 20 bp, mouse
ggcggagcggcgtctgactg

SEQ ID NO: 430672 - DNA, 20 bp, mouse
ggaggacagcggcgccgagg

SEQ ID NO: 430673 - DNA, 20 bp, mouse
gccgggacacgagcaggagg

SEQ ID NO: 430674 - DNA, 20 bp, mouse
gaaccaggcctgcgtccgga

SEQ ID NO: 430675 - DNA, 20 bp, mouse
ggacgaggagtgcagcgagg

SEQ ID NO: 430676 - DNA, 20 bp, mouse
gtcgcctggagcgcccagaa

SEQ ID NO: 430677 - DNA, 20 bp, mouse
gggcccggcctcgcaagcgg

SEQ ID NO: 430678 - DNA, 20 bp, mouse
gaacacttccggagctgcgg

SEQ ID NO: 430679 - DNA, 20 bp, mouse
gcaacgaggaagaggaaccc

SEQ ID NO: 430680 - DNA, 20 bp, mouse
ggactgataggcactcccgg

SEQ ID NO: 430681 - DNA, 20 bp, mouse
gagagacgccaggcacccgc

SEQ ID NO: 430682 - DNA, 20 bp, mouse
gccctggcctccgacctctc

SEQ ID NO: 430683 - DNA, 20 bp, mouse
ggggagctaaagagccaacg

SEQ ID NO: 430684 - DNA, 20 bp, mouse
ggggatcccccccctcccgg

SEQ ID NO: 430685 - DNA, 20 bp, mouse
gtagctccccgagaggtcgg

SEQ ID NO: 430686 - DNA, 20 bp, mouse
gccccgctgggtggacgacg

SEQ ID NO: 430687 - DNA, 20 bp, mouse
gccggactccggttccgaag

SEQ ID NO: 430688 - DNA, 20 bp, mouse
gaaccggagtccgggagtag

SEQ ID NO: 430689 - DNA, 20 bp, mouse
gttccacgtcgtccacccag

SEQ ID NO: 430690 - DNA, 20 bp, mouse
gggctcccgcccccgctggg

SEQ ID NO: 430691 - DNA, 20 bp, mouse
gtggaagttgctggccgacc

SEQ ID NO: 430692 - DNA, 20 bp, mouse
gcggagtccgggagtagcgg

SEQ ID NO: 430693 - DNA, 20 bp, mouse
gcatcatgggtgaggagcgt

SEQ ID NO: 430694 - DNA, 20 bp, mouse
gagggcgtcaggcgaccgag

SEQ ID NO: 430695 - DNA, 20 bp, mouse
gccgccacctccgctactcc

SEQ ID NO: 430696 - DNA, 20 bp, mouse
gagcaagaccgaccagcctg

SEQ ID NO: 430697 - DNA, 20 bp, mouse
gtaggcctccctgacctcgg

SEQ ID NO: 430698 - DNA, 20 bp, mouse
gtcttccaccgcaggctggt

SEQ ID NO: 430699 - DNA, 20 bp, mouse
gaagaccgaccagcctgcgg

SEQ ID NO: 430700 - DNA, 20 bp, mouse
gcgagccgccgaggtcaggg

SEQ ID NO: 430701 - DNA, 20 bp, mouse
gctccctcagtgggacgagt

SEQ ID NO: 430702 - DNA, 20 bp, mouse
ggtgcgagccgccgaggtca

SEQ ID NO: 430703 - DNA, 20 bp, mouse
gccaaggggcccagcggccg

SEQ ID NO: 430704 - DNA, 20 bp, mouse
ggtcttgctcccaggccaaa

SEQ ID NO: 430705 - DNA, 20 bp, mouse
ggcgtaggcctccctgacct

SEQ ID NO: 430706 - DNA, 20 bp, mouse
gggcagacatccctccgcta

SEQ ID NO: 430707 - DNA, 20 bp, mouse
gttgtggagaggtgccctag

SEQ ID NO: 430708 - DNA, 20 bp, mouse
gtggagaggtgccctagcgg

SEQ ID NO: 430709 - DNA, 20 bp, mouse
ggcagaaagaagcttgattg

SEQ ID NO: 430710 - DNA, 20 bp, mouse
gtctgtggttgcctggactg

SEQ ID NO: 430711 - DNA, 20 bp, mouse
gtcccaagagcaggatatga

SEQ ID NO: 430712 - DNA, 20 bp, mouse
gacttaggagaaagttagag

SEQ ID NO: 430713 - DNA, 20 bp, mouse
ggagtggagaagccaggtca

SEQ ID NO: 430714 - DNA, 20 bp, mouse
gtccttcatatcctgctctt

SEQ ID NO: 430715 - DNA, 20 bp, mouse
gatatcctgctcttgggaca

SEQ ID NO: 430716 - DNA, 20 bp, mouse
gaccctttaagtggacatct

SEQ ID NO: 430717 - DNA, 20 bp, mouse
gagcccagatgtccacttaa

SEQ ID NO: 430718 - DNA, 20 bp, mouse
gatctctctgaaattcaaca

SEQ ID NO: 430719 - DNA, 20 bp, mouse
gtcactttacaggcccctac

SEQ ID NO: 430720 - DNA, 20 bp, mouse
gcaggccatgtatgagggag

SEQ ID NO: 430721 - DNA, 20 bp, mouse
gctggattaatctatccaga

SEQ ID NO: 430722 - DNA, 20 bp, mouse
gatattgcctaccctttaag

SEQ ID NO: 430723 - DNA, 20 bp, mouse
gcaggcctctccctcataca

SEQ ID NO: 430724 - DNA, 20 bp, mouse
gcttaaaggaagaacttgta

SEQ ID NO: 430725 - DNA, 20 bp, mouse
gctttaagagctcaggaggt

SEQ ID NO: 430726 - DNA, 20 bp, mouse
gcccgggacagcccgaacac

SEQ ID NO: 430727 - DNA, 20 bp, mouse
gacagcccgaacactggctc

SEQ ID NO: 430728 - DNA, 20 bp, mouse
gatccgagcctcgggaggag

SEQ ID NO: 430729 - DNA, 20 bp, mouse
gccctaggcgtgagaggagt

SEQ ID NO: 430730 - DNA, 20 bp, mouse
gtggtcgtccccatccctca

SEQ ID NO: 430731 - DNA, 20 bp, mouse
gaacacaggagcggcgtcag

SEQ ID NO: 430732 - DNA, 20 bp, mouse
gctcacgcctagggaagagg

SEQ ID NO: 430733 - DNA, 20 bp, mouse
gtgttcctgagccagtgttc

SEQ ID NO: 430734 - DNA, 20 bp, mouse
gccgaggctcggatgggagg

SEQ ID NO: 430735 - DNA, 20 bp, mouse
gctcccgaggctcggatggg

SEQ ID NO: 430736 - DNA, 20 bp, mouse
gggagcccagcggagacccg

SEQ ID NO: 430737 - DNA, 20 bp, mouse
ggccccgcgcagaaaccgag

SEQ ID NO: 430738 - DNA, 20 bp, mouse
gtctctgcacaggccaagct

SEQ ID NO: 430739 - DNA, 20 bp, mouse
gggaagcaccgtctctgcac

SEQ ID NO: 430740 - DNA, 20 bp, mouse
gcggtgcttccggagcccag

SEQ ID NO: 430741 - DNA, 20 bp, mouse
gaccgagaggacggcgaggg

SEQ ID NO: 430742 - DNA, 20 bp, mouse
gggtccacctgagctgccac

SEQ ID NO: 430743 - DNA, 20 bp, mouse
ggctgccacgggtctccgct

SEQ ID NO: 430744 - DNA, 20 bp, mouse
gcgcgcagaaaccgagagga

SEQ ID NO: 430745 - DNA, 20 bp, mouse
ggaaaccgagaggacggcga

SEQ ID NO: 430746 - DNA, 20 bp, mouse
gcagagagtcagcgcaaagg

SEQ ID NO: 430747 - DNA, 20 bp, mouse
gagagtcagcgcaaaggggg

SEQ ID NO: 430748 - DNA, 20 bp, mouse
gctccagagagtcagcgcaa

SEQ ID NO: 430749 - DNA, 20 bp, mouse
gcagccctagggtggcatac

SEQ ID NO: 430750 - DNA, 20 bp, mouse
gtcaaaaggcagccctaggg

SEQ ID NO: 430751 - DNA, 20 bp, mouse
ggctgactctctggagatct

SEQ ID NO: 430752 - DNA, 20 bp, mouse
gtgaggggaggaggacgcag

SEQ ID NO: 430753 - DNA, 20 bp, mouse
ggggagccagcctttctcat

SEQ ID NO: 430754 - DNA, 20 bp, mouse
ggcaccctcttgtttaaaaa

SEQ ID NO: 430755 - DNA, 20 bp, mouse
gccaaccttaggatcaaaga

SEQ ID NO: 430756 - DNA, 20 bp, mouse
gggccaccgcgagatccgag

SEQ ID NO: 430757 - DNA, 20 bp, mouse
gcagcctaaagcatccggaa

SEQ ID NO: 430758 - DNA, 20 bp, mouse
gtatccggagatcagacatc

SEQ ID NO: 430759 - DNA, 20 bp, mouse
gaaaaaagcagcagcgtctc

SEQ ID NO: 430760 - DNA, 20 bp, mouse
gtccggaatggctccgaacc

SEQ ID NO: 430761 - DNA, 20 bp, mouse
gtttttcaggagctgctcgc

SEQ ID NO: 430762 - DNA, 20 bp, mouse
gggagccgaagattacacca

SEQ ID NO: 430763 - DNA, 20 bp, mouse
gtccggcagcctaaagcatc

SEQ ID NO: 430764 - DNA, 20 bp, mouse
gctgccggatgtctgatctc

SEQ ID NO: 430765 - DNA, 20 bp, mouse
gagatcgccgagagcagccg

SEQ ID NO: 430766 - DNA, 20 bp, mouse
gaagcgcgttatccgaggaa

SEQ ID NO: 430767 - DNA, 20 bp, mouse
ggtggggagggagcacaccg

SEQ ID NO: 430768 - DNA, 20 bp, mouse
gggtacaagcgcgttatccg

SEQ ID NO: 430769 - DNA, 20 bp, mouse
gagaggccgacacctaccgt

SEQ ID NO: 430770 - DNA, 20 bp, mouse
ggcttggagctgctggggtc

SEQ ID NO: 430771 - DNA, 20 bp, mouse
ggcggtcaagggccatggcg

SEQ ID NO: 430772 - DNA, 20 bp, mouse
gtcattgcgtggtagctcgg

SEQ ID NO: 430773 - DNA, 20 bp, mouse
gtgagctccggagatggcaa

SEQ ID NO: 430774 - DNA, 20 bp, mouse
ggcgcggaaggatattctga

SEQ ID NO: 430775 - DNA, 20 bp, mouse
ggagatggcaaaggcgacct

SEQ ID NO: 430776 - DNA, 20 bp, mouse
gagggggctacgggatcatg

SEQ ID NO: 430777 - DNA, 20 bp, mouse
gccgggactagaagaaacgg

SEQ ID NO: 430778 - DNA, 20 bp, mouse
gtgatcccgtagccccctcc

SEQ ID NO: 430779 - DNA, 20 bp, mouse
ggaagaaacggcggccggga

SEQ ID NO: 430780 - DNA, 20 bp, mouse
ggcagaaagagcgagagctg

SEQ ID NO: 430781 - DNA, 20 bp, mouse
gaggctggccaataggagac

SEQ ID NO: 430782 - DNA, 20 bp, mouse
gcggcaataggtacccacgg

SEQ ID NO: 430783 - DNA, 20 bp, mouse
gcaccggcaataggtaccca

SEQ ID NO: 430784 - DNA, 20 bp, mouse
gactagaagaaacggcggcc

SEQ ID NO: 430785 - DNA, 20 bp, mouse
gaggagcagggcccacgctc

SEQ ID NO: 430786 - DNA, 20 bp, mouse
gcggcgatcgcgcgaggacg

SEQ ID NO: 430787 - DNA, 20 bp, mouse
gtagccccgcgagaggccgg

SEQ ID NO: 430788 - DNA, 20 bp, mouse
gtctagggcgtccatcgtag

SEQ ID NO: 430789 - DNA, 20 bp, mouse
gctaccccgccggtgtgtta

SEQ ID NO: 430790 - DNA, 20 bp, mouse
gcgcccgccggcctctcgcg

SEQ ID NO: 430791 - DNA, 20 bp, mouse
gctgccctaacacaccggcg

SEQ ID NO: 430792 - DNA, 20 bp, mouse
gaccatagtgacaggaggcg

SEQ ID NO: 430793 - DNA, 20 bp, mouse
ggggtagccccgcgagaggc

SEQ ID NO: 430794 - DNA, 20 bp, mouse
gcggcgggcgcggtaggaag

SEQ ID NO: 430795 - DNA, 20 bp, mouse
ggccgaggtcgagcagaccc

SEQ ID NO: 430796 - DNA, 20 bp, mouse
gtgcgtgcgagggacgtcag

SEQ ID NO: 430797 - DNA, 20 bp, mouse
gtccctcgcacgcacagcgg

SEQ ID NO: 430798 - DNA, 20 bp, mouse
ggtaaagccgaggaggacgt

SEQ ID NO: 430799 - DNA, 20 bp, mouse
gcgcacgcacagcggaggaa

SEQ ID NO: 430800 - DNA, 20 bp, mouse
gcagcagttacccctggtaa

SEQ ID NO: 430801 - DNA, 20 bp, mouse
gccctccaggcccactttag

SEQ ID NO: 430802 - DNA, 20 bp, mouse
ggcgccgcagcagttacccc

SEQ ID NO: 430803 - DNA, 20 bp, mouse
gacgtccctcgcacgcacag

SEQ ID NO: 430804 - DNA, 20 bp, mouse
gccgaggaggacgtgggatg

SEQ ID NO: 430805 - DNA, 20 bp, mouse
ggctgcgcgtaaagccgagg

SEQ ID NO: 430806 - DNA, 20 bp, mouse
ggctggagtcgggattccaa

SEQ ID NO: 430807 - DNA, 20 bp, mouse
gtggttagatctcccagata

SEQ ID NO: 430808 - DNA, 20 bp, mouse
gggtgaccggcaccagatag

SEQ ID NO: 430809 - DNA, 20 bp, mouse
ggattccaatggagggacat

SEQ ID NO: 430810 - DNA, 20 bp, mouse
gcagagcggcgcggaggtct

SEQ ID NO: 430811 - DNA, 20 bp, mouse
gcgcggaggtctcggttgag

SEQ ID NO: 430812 - DNA, 20 bp, mouse
gagctgtggcgtgttcctcg

SEQ ID NO: 430813 - DNA, 20 bp, mouse
gcagcggcgaggcctgacgg

SEQ ID NO: 430814 - DNA, 20 bp, mouse
ggtccgccagagcggcgcgg

SEQ ID NO: 430815 - DNA, 20 bp, mouse
gccacagggaagcccagact

SEQ ID NO: 430816 - DNA, 20 bp, mouse
gagcagcgcctagtactgca

SEQ ID NO: 430817 - DNA, 20 bp, mouse
ggactcggccggcaagacta

SEQ ID NO: 430818 - DNA, 20 bp, mouse
gcgaggtgcgccgagaccag

SEQ ID NO: 430819 - DNA, 20 bp, mouse
gttgctgtccctgcagtact

SEQ ID NO: 430820 - DNA, 20 bp, mouse
gccgccacggacagacgccg

SEQ ID NO: 430821 - DNA, 20 bp, mouse
ggcgcagacatcctacaccg

SEQ ID NO: 430822 - DNA, 20 bp, mouse
ggctcccgggagcgccgcaa

SEQ ID NO: 430823 - DNA, 20 bp, mouse
gcgccgcagcgaggagccat

SEQ ID NO: 430824 - DNA, 20 bp, mouse
gtacgctaactcggacgccg

SEQ ID NO: 430825 - DNA, 20 bp, mouse
gggcgcgcttaggctcggag

SEQ ID NO: 430826 - DNA, 20 bp, mouse
gtggctgagacgcgacgagt

SEQ ID NO: 430827 - DNA, 20 bp, mouse
gtgcggctggctgaaggtaa

SEQ ID NO: 430828 - DNA, 20 bp, mouse
gggcactgcaaagtccgctg

SEQ ID NO: 430829 - DNA, 20 bp, mouse
gtaacgaggaaccggagcag

SEQ ID NO: 430830 - DNA, 20 bp, mouse
ggctggctgaaggtaaagga

SEQ ID NO: 430831 - DNA, 20 bp, mouse
ggggtgtctggaccatgcaa

SEQ ID NO: 430832 - DNA, 20 bp, mouse
gaagcaccgcatacccacaa

SEQ ID NO: 430833 - DNA, 20 bp, mouse
gcgtcgcgtctcagccacag

SEQ ID NO: 430834 - DNA, 20 bp, mouse
gtgaggtcagagaaactctc

SEQ ID NO: 430835 - DNA, 20 bp, mouse
gtcgcatgaaggaggcggtc

SEQ ID NO: 430836 - DNA, 20 bp, mouse
ggaggttcgagcagacaacg

SEQ ID NO: 430837 - DNA, 20 bp, mouse
ggttcgagcagacaacgcgg

SEQ ID NO: 430838 - DNA, 20 bp, mouse
gagccaggcgagcgccgcgg

SEQ ID NO: 430839 - DNA, 20 bp, mouse
gtcccccagctcctctccgg

SEQ ID NO: 430840 - DNA, 20 bp, mouse
ggcccgagccaccgccggag

SEQ ID NO: 430841 - DNA, 20 bp, mouse
gggccccgccgctaccgccg

SEQ ID NO: 430842 - DNA, 20 bp, mouse
gggctccgctgcccgaggat

SEQ ID NO: 430843 - DNA, 20 bp, mouse
gggaggtcccggcccttgtc

SEQ ID NO: 430844 - DNA, 20 bp, mouse
ggcgagccaggcgagcgccg

SEQ ID NO: 430845 - DNA, 20 bp, mouse
gtcctctccggcggtggctc

SEQ ID NO: 430846 - DNA, 20 bp, mouse
gctgcgaacaaaggagtctg

SEQ ID NO: 430847 - DNA, 20 bp, mouse
gggcgcagaccgagcgacta

SEQ ID NO: 430848 - DNA, 20 bp, mouse
gaccgagcgactacgggtcg

SEQ ID NO: 430849 - DNA, 20 bp, mouse
gcgcccgcggtggaaccgag

SEQ ID NO: 430850 - DNA, 20 bp, mouse
gaggctccgcggctccggat

SEQ ID NO: 430851 - DNA, 20 bp, mouse
gcttcctgggcagcactcgg

SEQ ID NO: 430852 - DNA, 20 bp, mouse
gccgtccggggctcatgatg

SEQ ID NO: 430853 - DNA, 20 bp, mouse
gcggacgggacagacttcct

SEQ ID NO: 430854 - DNA, 20 bp, mouse
ggcgaagctttggtcctccg

SEQ ID NO: 430855 - DNA, 20 bp, mouse
gcgaacaaaggagtctgcgg

SEQ ID NO: 430856 - DNA, 20 bp, mouse
gccagctccgggagtgccat

SEQ ID NO: 430857 - DNA, 20 bp, mouse
gtcggtgctgagggtctgag

SEQ ID NO: 430858 - DNA, 20 bp, mouse
gagctgtcccatggcactcc

SEQ ID NO: 430859 - DNA, 20 bp, mouse
gtgaagcgcggggtcaaggt

SEQ ID NO: 430860 - DNA, 20 bp, mouse
gagcctccaggaccagagtc

SEQ ID NO: 430861 - DNA, 20 bp, mouse
gcaggaggccatggagagta

SEQ ID NO: 430862 - DNA, 20 bp, mouse
gtgcgaatctttgggagtca

SEQ ID NO: 430863 - DNA, 20 bp, mouse
gtcgtccgtgaagactgact

SEQ ID NO: 430864 - DNA, 20 bp, mouse
gtggcgtcaccacgaagact

SEQ ID NO: 430865 - DNA, 20 bp, mouse
gtcagggtaagcggcgcacc

SEQ ID NO: 430866 - DNA, 20 bp, mouse
gcccaggatgcgagcatcag

SEQ ID NO: 430867 - DNA, 20 bp, mouse
gagaaacagccggttcaccc

SEQ ID NO: 430868 - DNA, 20 bp, mouse
gtgtagcgctgtggaaccgg

SEQ ID NO: 430869 - DNA, 20 bp, mouse
gaagggaacgccgcgcgccg

SEQ ID NO: 430870 - DNA, 20 bp, mouse
gttcctacggaggcatagag

SEQ ID NO: 430871 - DNA, 20 bp, mouse
gggacaagggaaccttccta

SEQ ID NO: 430872 - DNA, 20 bp, mouse
ggtgtgagcacggaagacac

SEQ ID NO: 430873 - DNA, 20 bp, mouse
gtgggacgcaagggagctgg

SEQ ID NO: 430874 - DNA, 20 bp, mouse
gacacctacgacgcccgggt

SEQ ID NO: 430875 - DNA, 20 bp, mouse
ggctcgcatcctgggtgaac

SEQ ID NO: 430876 - DNA, 20 bp, mouse
gcgcgagtctggaacgatgg

SEQ ID NO: 430877 - DNA, 20 bp, mouse
gcaaggcaacccgagcgcgg

SEQ ID NO: 430878 - DNA, 20 bp, mouse
gcagccaggccttatctcca

SEQ ID NO: 430879 - DNA, 20 bp, mouse
gtcgcgagggctgtcgggaa

SEQ ID NO: 430880 - DNA, 20 bp, mouse
gaaccgcgagtctggaacga

SEQ ID NO: 430881 - DNA, 20 bp, mouse
gccaggccttatctccacgg

SEQ ID NO: 430882 - DNA, 20 bp, mouse
ggacctccaccgtggagata

SEQ ID NO: 430883 - DNA, 20 bp, mouse
gtggcctcggtggactacca

SEQ ID NO: 430884 - DNA, 20 bp, mouse
gcgctagacaaggcccctgg

SEQ ID NO: 430885 - DNA, 20 bp, mouse
gtctggaacgatggcggagg

SEQ ID NO: 430886 - DNA, 20 bp, mouse
gctttcgcgggaggaaacgg

SEQ ID NO: 430887 - DNA, 20 bp, mouse
ggcctgctgtgggctaatgg

SEQ ID NO: 430888 - DNA, 20 bp, mouse
gtcgccggagacgcgtcccg

SEQ ID NO: 430889 - DNA, 20 bp, mouse
gagctgcaataggaccgcgt

SEQ ID NO: 430890 - DNA, 20 bp, mouse
gtgggctaatggtggatgtg

SEQ ID NO: 430891 - DNA, 20 bp, mouse
gcccacagcaggcctttcgc

SEQ ID NO: 430892 - DNA, 20 bp, mouse
ggacgcgtcccgaggctgct

SEQ ID NO: 430893 - DNA, 20 bp, mouse
gggcctttcgcgggaggaaa

SEQ ID NO: 430894 - DNA, 20 bp, mouse
gtcccgcgaaaggcctgctg

SEQ ID NO: 430895 - DNA, 20 bp, mouse
gcagcctcgggacgcgtctc

SEQ ID NO: 430896 - DNA, 20 bp, mouse
gaatcgtcccaggcacggag

SEQ ID NO: 430897 - DNA, 20 bp, mouse
gggcgaagctcgcgaagcag

SEQ ID NO: 430898 - DNA, 20 bp, mouse
gcccgggaagaaatcgtccc

SEQ ID NO: 430899 - DNA, 20 bp, mouse
gggcgaaacgatcagagccc

SEQ ID NO: 430900 - DNA, 20 bp, mouse
gcttcgccttcggaatctgg

SEQ ID NO: 430901 - DNA, 20 bp, mouse
ggaagaaatcgtcccaggca

SEQ ID NO: 430902 - DNA, 20 bp, mouse
gttgagcagggaccctggga

SEQ ID NO: 430903 - DNA, 20 bp, mouse
gtgtccagggtcaggacgta

SEQ ID NO: 430904 - DNA, 20 bp, mouse
gcgggaagtggcccacccag

SEQ ID NO: 430905 - DNA, 20 bp, mouse
gcgccttcggaatctggagg

SEQ ID NO: 430906 - DNA, 20 bp, mouse
ggtcgttcgtggagagttgg

SEQ ID NO: 430907 - DNA, 20 bp, mouse
ggcgtcgtcggagaccaaga

SEQ ID NO: 430908 - DNA, 20 bp, mouse
gctctccacgaacgacatgg

SEQ ID NO: 430909 - DNA, 20 bp, mouse
gtcctgccggataagcgcaa

SEQ ID NO: 430910 - DNA, 20 bp, mouse
ggagtgtagtcggaataccc

SEQ ID NO: 430911 - DNA, 20 bp, mouse
ggcgaaggcgacgaagacga

SEQ ID NO: 430912 - DNA, 20 bp, mouse
gtggagagttggaggtttgc

SEQ ID NO: 430913 - DNA, 20 bp, mouse
gggccgagtcgcagggcctg

SEQ ID NO: 430914 - DNA, 20 bp, mouse
gttctcagccagggcgtcgt

SEQ ID NO: 430915 - DNA, 20 bp, mouse
gtaccccaggccctgcgact

SEQ ID NO: 430916 - DNA, 20 bp, mouse
gcatcggcgagcggatcctc

SEQ ID NO: 430917 - DNA, 20 bp, mouse
ggcgccgtggccacacccat

SEQ ID NO: 430918 - DNA, 20 bp, mouse
gcgggtcccgcggctcggtg

SEQ ID NO: 430919 - DNA, 20 bp, mouse
ggagcggcccctccccggtg

SEQ ID NO: 430920 - DNA, 20 bp, mouse
ggcccaggccagagaacggg

SEQ ID NO: 430921 - DNA, 20 bp, mouse
gtcctcgggcagcgcgtcgt

SEQ ID NO: 430922 - DNA, 20 bp, mouse
gagcgcgagggcaccgaagg

SEQ ID NO: 430923 - DNA, 20 bp, mouse
gctcgcgctgcggcccggag

SEQ ID NO: 430924 - DNA, 20 bp, mouse
gcctagcccaggccagagaa

SEQ ID NO: 430925 - DNA, 20 bp, mouse
ggcggggtagcgaggaccag

SEQ ID NO: 430926 - DNA, 20 bp, mouse
ggcgcgacgcgggcagacag

SEQ ID NO: 430927 - DNA, 20 bp, mouse
gcagaggctggcggcagcga

SEQ ID NO: 430928 - DNA, 20 bp, mouse
gtcggccccgaacccgccaa

SEQ ID NO: 430929 - DNA, 20 bp, mouse
gcccgccaacggctcttcgg

SEQ ID NO: 430930 - DNA, 20 bp, mouse
gggccccgccgaagagccgt

SEQ ID NO: 430931 - DNA, 20 bp, mouse
gggggcccctggcgcgacgc

SEQ ID NO: 430932 - DNA, 20 bp, mouse
ggaacccgccaacggctctt

SEQ ID NO: 430933 - DNA, 20 bp, mouse
gggctggcggcagcgacggc

SEQ ID NO: 430934 - DNA, 20 bp, mouse
ggagatgagcgccagcatgg

SEQ ID NO: 430935 - DNA, 20 bp, mouse
gtatgacccgctgggcttcc

SEQ ID NO: 430936 - DNA, 20 bp, mouse
ggactcgtagtagaaatggt

SEQ ID NO: 430937 - DNA, 20 bp, mouse
ggagtcctacccaggctacc

SEQ ID NO: 430938 - DNA, 20 bp, mouse
gtctactacgagtcctaccc

SEQ ID NO: 430939 - DNA, 20 bp, mouse
ggtaggactcgtagtagaaa

SEQ ID NO: 430940 - DNA, 20 bp, mouse
gaagtgtgaccgggtagcct

SEQ ID NO: 430941 - DNA, 20 bp, mouse
gcggatggaaaaggaggtta

SEQ ID NO: 430942 - DNA, 20 bp, mouse
gtaatagaggcactaaaaaa

SEQ ID NO: 430943 - DNA, 20 bp, mouse
ggtgaccgggtagcctgggt

SEQ ID NO: 430944 - DNA, 20 bp, mouse
ggcacactttaaagtaatag

SEQ ID NO: 430945 - DNA, 20 bp, mouse
gacacttcggatggaaaagg

SEQ ID NO: 430946 - DNA, 20 bp, mouse
gcccgactcaaagaaccaca

SEQ ID NO: 430947 - DNA, 20 bp, mouse
gcacagggctgagtcgctgg

SEQ ID NO: 430948 - DNA, 20 bp, mouse
gcaccacggcggacaacggg

SEQ ID NO: 430949 - DNA, 20 bp, mouse
gagagccgcacccaccacgg

SEQ ID NO: 430950 - DNA, 20 bp, mouse
gatcagagccgcacccacca

SEQ ID NO: 430951 - DNA, 20 bp, mouse
gagggctgagtcgctggcgg

SEQ ID NO: 430952 - DNA, 20 bp, mouse
gcacccaccacggcggacaa

SEQ ID NO: 430953 - DNA, 20 bp, mouse
gaaccacagggctgagtcgc

SEQ ID NO: 430954 - DNA, 20 bp, mouse
gagaggtgacagggtcaccg

SEQ ID NO: 430955 - DNA, 20 bp, mouse
ggcacgtccggagccgtccg

SEQ ID NO: 430956 - DNA, 20 bp, mouse
gtagcagggcggcttccgga

SEQ ID NO: 430957 - DNA, 20 bp, mouse
gatgcagtcgcgggtgtcta

SEQ ID NO: 430958 - DNA, 20 bp, mouse
gcagggcggcttccggaagg

SEQ ID NO: 430959 - DNA, 20 bp, mouse
ggacccacccaaggcaacct

SEQ ID NO: 430960 - DNA, 20 bp, mouse
ggcggctcaggacccaccca

SEQ ID NO: 430961 - DNA, 20 bp, mouse
gctcacctgcggatcgcgaa

SEQ ID NO: 430962 - DNA, 20 bp, mouse
ggatccgcaggtgaggcgat

SEQ ID NO: 430963 - DNA, 20 bp, mouse
gcagcccatcgcctcacctg

SEQ ID NO: 430964 - DNA, 20 bp, mouse
gggaggtagacagacgactc

SEQ ID NO: 430965 - DNA, 20 bp, mouse
ggcctggcctgaggtgggtc

SEQ ID NO: 430966 - DNA, 20 bp, mouse
gaaggcagcacggaagacat

SEQ ID NO: 430967 - DNA, 20 bp, mouse
gccagttgctccaggaaccg

SEQ ID NO: 430968 - DNA, 20 bp, mouse
gacctagccacaaggcagca

SEQ ID NO: 430969 - DNA, 20 bp, mouse
gtgctccaggaaccggggaa

SEQ ID NO: 430970 - DNA, 20 bp, mouse
gtagctcctacctagccaca

SEQ ID NO: 430971 - DNA, 20 bp, mouse
gcccaggggaggccttaggg

SEQ ID NO: 430972 - DNA, 20 bp, mouse
ggccccaggaagcctcccta

SEQ ID NO: 430973 - DNA, 20 bp, mouse
ggatgaggtccagttgctcc

SEQ ID NO: 430974 - DNA, 20 bp, mouse
gtccgtgctgccttgtggct

SEQ ID NO: 430975 - DNA, 20 bp, mouse
ggggaactgagacagaccgg

SEQ ID NO: 430976 - DNA, 20 bp, mouse
ggcgctagacacttagaccc

SEQ ID NO: 430977 - DNA, 20 bp, mouse
gctagacacttagaccccgg

SEQ ID NO: 430978 - DNA, 20 bp, mouse
gaggccgtcacactccgccg

SEQ ID NO: 430979 - DNA, 20 bp, mouse
gagaccccggcggagtgtga

SEQ ID NO: 430980 - DNA, 20 bp, mouse
gctgctggctagcatctcca

SEQ ID NO: 430981 - DNA, 20 bp, mouse
gcctgctgccctgcgagagc

SEQ ID NO: 430982 - DNA, 20 bp, mouse
gaagcgggatgcgctggagt

SEQ ID NO: 430983 - DNA, 20 bp, mouse
gctagccagcagggcaaagg

SEQ ID NO: 430984 - DNA, 20 bp, mouse
ggcaaaggcggtgcgcggga

SEQ ID NO: 430985 - DNA, 20 bp, mouse
gccttcaccggtccaggtta

SEQ ID NO: 430986 - DNA, 20 bp, mouse
gagcagtggctctgtacatg

SEQ ID NO: 430987 - DNA, 20 bp, mouse
gctccgcgcaggtaaacgac

SEQ ID NO: 430988 - DNA, 20 bp, mouse
gtaactgcgggtgcaggtct

SEQ ID NO: 430989 - DNA, 20 bp, mouse
gcagttacgaggtcacttaa

SEQ ID NO: 430990 - DNA, 20 bp, mouse
gggccaaggactagaagaca

SEQ ID NO: 430991 - DNA, 20 bp, mouse
gcgcaggtaaacgacaggca

SEQ ID NO: 430992 - DNA, 20 bp, mouse
gtaaagctcagagactgaga

SEQ ID NO: 430993 - DNA, 20 bp, mouse
gcctgtcccgagggttggag

SEQ ID NO: 430994 - DNA, 20 bp, mouse
gacctgcacccgcagttacg

SEQ ID NO: 430995 - DNA, 20 bp, mouse
gcttggcctctccaaccctc

SEQ ID NO: 430996 - DNA, 20 bp, mouse
gtgcaggtgagtagtctccg

SEQ ID NO: 430997 - DNA, 20 bp, mouse
gcgtggcgtgcgctgaggtc

SEQ ID NO: 430998 - DNA, 20 bp, mouse
gaaatccctaggccaactcg

SEQ ID NO: 430999 - DNA, 20 bp, mouse
gctgctgggaagagggtgag

SEQ ID NO: 431000 - DNA, 20 bp, mouse
gctaggaagggactgaaatg

SEQ ID NO: 431001 - DNA, 20 bp, mouse
gacgaagcacgcgggcacct

SEQ ID NO: 431002 - DNA, 20 bp, mouse
gagagcaggaggccaagcag

SEQ ID NO: 431003 - DNA, 20 bp, mouse
gatgggagagagatgagact

SEQ ID NO: 431004 - DNA, 20 bp, mouse
gtgaggtcgggctcacagtc

SEQ ID NO: 431005 - DNA, 20 bp, mouse
gagtggagaccaagagggat

SEQ ID NO: 431006 - DNA, 20 bp, mouse
gcccgagagactctaggaag

SEQ ID NO: 431007 - DNA, 20 bp, mouse
gcccaagcccgagagactct

SEQ ID NO: 431008 - DNA, 20 bp, mouse
gggcagcgaactttcccggt

SEQ ID NO: 431009 - DNA, 20 bp, mouse
gggacgtaccgggagcgaag

SEQ ID NO: 431010 - DNA, 20 bp, mouse
gaccagggagaatctagatg

SEQ ID NO: 431011 - DNA, 20 bp, mouse
gaagtggcagcgaactttcc

SEQ ID NO: 431012 - DNA, 20 bp, mouse
gaggatcagacgccccgcgg

SEQ ID NO: 431013 - DNA, 20 bp, mouse
gtgaaagagttaaacctacc

SEQ ID NO: 431014 - DNA, 20 bp, mouse
gtggaggccggtaccggaaa

SEQ ID NO: 431015 - DNA, 20 bp, mouse
ggccggtaccggaaacggaa

SEQ ID NO: 431016 - DNA, 20 bp, mouse
gctcagggccgagtctacct

SEQ ID NO: 431017 - DNA, 20 bp, mouse
ggcgcgctgctcacttctca

SEQ ID NO: 431018 - DNA, 20 bp, mouse
gtactctcaatgctactcct

SEQ ID NO: 431019 - DNA, 20 bp, mouse
gttgaggggaagcgacacct

SEQ ID NO: 431020 - DNA, 20 bp, mouse
ggagcctctcggctgaagga

SEQ ID NO: 431021 - DNA, 20 bp, mouse
ggagggacgccgaggcgagg

SEQ ID NO: 431022 - DNA, 20 bp, mouse
gcctcatgcgcaagcgtcga

SEQ ID NO: 431023 - DNA, 20 bp, mouse
gcgcatgaggacctaggcgg

SEQ ID NO: 431024 - DNA, 20 bp, mouse
gtggctgcgtagacccggtg

SEQ ID NO: 431025 - DNA, 20 bp, mouse
gggagccacagaatacgcgt

SEQ ID NO: 431026 - DNA, 20 bp, mouse
gcaacccgggcgagacgctg

SEQ ID NO: 431027 - DNA, 20 bp, mouse
gtccgccctgaaccaggaag

SEQ ID NO: 431028 - DNA, 20 bp, mouse
gcggtgcagggagtgtggta

SEQ ID NO: 431029 - DNA, 20 bp, mouse
gtgtcccggcggcgacagag

SEQ ID NO: 431030 - DNA, 20 bp, mouse
ggaaaaccaaaattcaaccc

SEQ ID NO: 431031 - DNA, 20 bp, mouse
gaagccacagcgtctcgccc

SEQ ID NO: 431032 - DNA, 20 bp, mouse
ggcggcggagttgggagctc

SEQ ID NO: 431033 - DNA, 20 bp, mouse
gaactccgccgccccagcca

SEQ ID NO: 431034 - DNA, 20 bp, mouse
gcggatctcaggacaagact

SEQ ID NO: 431035 - DNA, 20 bp, mouse
gagctggggatgagctgtgg

SEQ ID NO: 431036 - DNA, 20 bp, mouse
ggggcgggtcactcaccgag

SEQ ID NO: 431037 - DNA, 20 bp, mouse
gccggtgggagctctcgagt

SEQ ID NO: 431038 - DNA, 20 bp, mouse
gcaccgagaggacgctcatg

SEQ ID NO: 431039 - DNA, 20 bp, mouse
gagaggacgctcatgcggat

SEQ ID NO: 431040 - DNA, 20 bp, mouse
gccggtgcgggttcccagga

SEQ ID NO: 431041 - DNA, 20 bp, mouse
gctcaagatggcgtgcctgt

SEQ ID NO: 431042 - DNA, 20 bp, mouse
gaatgctgtgggcaggaccg

SEQ ID NO: 431043 - DNA, 20 bp, mouse
gggcgccggggtaatgctgt

SEQ ID NO: 431044 - DNA, 20 bp, mouse
ggcacagagctgccagacca

SEQ ID NO: 431045 - DNA, 20 bp, mouse
gcgtcgctcgagcaccgaag

SEQ ID NO: 431046 - DNA, 20 bp, mouse
ggccgcgcttacctgctgca

SEQ ID NO: 431047 - DNA, 20 bp, mouse
gagctcgccggccgtcaccc

SEQ ID NO: 431048 - DNA, 20 bp, mouse
gcggcgagctggcggtctgg

SEQ ID NO: 431049 - DNA, 20 bp, mouse
gcgcagcgcagcggagtcgg

SEQ ID NO: 431050 - DNA, 20 bp, mouse
gaagggtgcagtcgcaagga

SEQ ID NO: 431051 - DNA, 20 bp, mouse
gggccggcgagctggcggtc

SEQ ID NO: 431052 - DNA, 20 bp, mouse
ggtagcggttgcccgggtga

SEQ ID NO: 431053 - DNA, 20 bp, mouse
gtgacttcggctagcggtag

SEQ ID NO: 431054 - DNA, 20 bp, mouse
gcggttgcccgggtgacggc

SEQ ID NO: 431055 - DNA, 20 bp, mouse
gctagcggtagcggttgccc

SEQ ID NO: 431056 - DNA, 20 bp, mouse
gactaaggtagaccagaatt

SEQ ID NO: 431057 - DNA, 20 bp, mouse
gaaggtagaccagaattagg

SEQ ID NO: 431058 - DNA, 20 bp, mouse
ggagattccaggagagaccc

SEQ ID NO: 431059 - DNA, 20 bp, mouse
ggtagaccagaattaggagg

SEQ ID NO: 431060 - DNA, 20 bp, mouse
gcacccccaagaggatcgga

SEQ ID NO: 431061 - DNA, 20 bp, mouse
gggaggcggtgaatcttgga

SEQ ID NO: 431062 - DNA, 20 bp, mouse
gggtgggaggcggtgaatct

SEQ ID NO: 431063 - DNA, 20 bp, mouse
gtcttggagggagagattcc

SEQ ID NO: 431064 - DNA, 20 bp, mouse
ggttattgttgagagcaggc

SEQ ID NO: 431065 - DNA, 20 bp, mouse
gtagctgttagccaagatac

SEQ ID NO: 431066 - DNA, 20 bp, mouse
gtaatagcgttggtacccgg

SEQ ID NO: 431067 - DNA, 20 bp, mouse
gcggccagcagagagtgcag

SEQ ID NO: 431068 - DNA, 20 bp, mouse
ggttggtacccggaggaaga

SEQ ID NO: 431069 - DNA, 20 bp, mouse
gatccctgccatcttcctcc

SEQ ID NO: 431070 - DNA, 20 bp, mouse
gctcgggaactccagcacag

SEQ ID NO: 431071 - DNA, 20 bp, mouse
gcagcacagcggattttggt

SEQ ID NO: 431072 - DNA, 20 bp, mouse
gaccaacgctattaaagctg

SEQ ID NO: 431073 - DNA, 20 bp, mouse
ggtgtctgaaaagggagggt

SEQ ID NO: 431074 - DNA, 20 bp, mouse
gagaacagcacggcaagcaa

SEQ ID NO: 431075 - DNA, 20 bp, mouse
gaccgcagctttaatagcgt

SEQ ID NO: 431076 - DNA, 20 bp, mouse
gcaagtgggagagacgacgg

SEQ ID NO: 431077 - DNA, 20 bp, mouse
gcagcaagtgggagagacga

SEQ ID NO: 431078 - DNA, 20 bp, mouse
gtggaaagagggcagcaagt

SEQ ID NO: 431079 - DNA, 20 bp, mouse
ggtgggagagacgacggcgg

SEQ ID NO: 431080 - DNA, 20 bp, mouse
ggcggaggccgtcgcaggtc

SEQ ID NO: 431081 - DNA, 20 bp, mouse
gggaggcccgcaatccggaa

SEQ ID NO: 431082 - DNA, 20 bp, mouse
gggaaagtggggaaccgagt

SEQ ID NO: 431083 - DNA, 20 bp, mouse
gggcggctccggacctgcga

SEQ ID NO: 431084 - DNA, 20 bp, mouse
gttcccctccggcagagtcc

SEQ ID NO: 431085 - DNA, 20 bp, mouse
gtcccaggcactgacctgca

SEQ ID NO: 431086 - DNA, 20 bp, mouse
ggggcacgggagaatcagag

SEQ ID NO: 431087 - DNA, 20 bp, mouse
ggagaggcggcggctaacag

SEQ ID NO: 431088 - DNA, 20 bp, mouse
ggcgctgagggatcgagagg

SEQ ID NO: 431089 - DNA, 20 bp, mouse
ggcaggtaagggcccccggg

SEQ ID NO: 431090 - DNA, 20 bp, mouse
gagagcaggtaagggccccc

SEQ ID NO: 431091 - DNA, 20 bp, mouse
gtgcagtcgtcactctcgtc

SEQ ID NO: 431092 - DNA, 20 bp, mouse
gattgcgctgagggatcgag

SEQ ID NO: 431093 - DNA, 20 bp, mouse
gtacctgctctgctcgcccc

SEQ ID NO: 431094 - DNA, 20 bp, mouse
gggtggtgtctcagaaggag

SEQ ID NO: 431095 - DNA, 20 bp, mouse
gggaagcccgcggacatgtg

SEQ ID NO: 431096 - DNA, 20 bp, mouse
gagtgcgtcccggcggatgt

SEQ ID NO: 431097 - DNA, 20 bp, mouse
ggtgttgggaagacagacta

SEQ ID NO: 431098 - DNA, 20 bp, mouse
gaacaggtcagtaagaagga

SEQ ID NO: 431099 - DNA, 20 bp, mouse
gctatgtagtcgcttcgtga

SEQ ID NO: 431100 - DNA, 20 bp, mouse
gttaggtgcgttctctccgg

SEQ ID NO: 431101 - DNA, 20 bp, mouse
gggaggcaggcaaacgccgt

SEQ ID NO: 431102 - DNA, 20 bp, mouse
gttgggaagacagactaggg

SEQ ID NO: 431103 - DNA, 20 bp, mouse
gttcttaggtgcgttctctc

SEQ ID NO: 431104 - DNA, 20 bp, mouse
gagccgcgcctagtgcgtcc

SEQ ID NO: 431105 - DNA, 20 bp, mouse
gggaagggagatggatgcaa

SEQ ID NO: 431106 - DNA, 20 bp, mouse
ggcgcctgcagagtaatagg

SEQ ID NO: 431107 - DNA, 20 bp, mouse
gtgcaggcgcgtgaaggaga

SEQ ID NO: 431108 - DNA, 20 bp, mouse
gttactctgcaggcgcgtga

SEQ ID NO: 431109 - DNA, 20 bp, mouse
gctgggaccgtgcaggtcgg

SEQ ID NO: 431110 - DNA, 20 bp, mouse
gtcgctgggaccgtgcaggt

SEQ ID NO: 431111 - DNA, 20 bp, mouse
gaaactcgctgggaccgtgc

SEQ ID NO: 431112 - DNA, 20 bp, mouse
gccagtcagaggcgactaac

SEQ ID NO: 431113 - DNA, 20 bp, mouse
gcttggaaggcgatgtgggt

SEQ ID NO: 431114 - DNA, 20 bp, mouse
gcagcttccaccgacctgca

SEQ ID NO: 431115 - DNA, 20 bp, mouse
ggaagtggcaggcttcaggt

SEQ ID NO: 431116 - DNA, 20 bp, mouse
gcggtaaggtgcctaatctg

SEQ ID NO: 431117 - DNA, 20 bp, mouse
gaggtgcctaatctgcggag

SEQ ID NO: 431118 - DNA, 20 bp, mouse
ggattccgcggtagcggtgg

SEQ ID NO: 431119 - DNA, 20 bp, mouse
ggctaccgcggaatccaaga

SEQ ID NO: 431120 - DNA, 20 bp, mouse
gaccgcggaatccaagatgg

SEQ ID NO: 431121 - DNA, 20 bp, mouse
gacagctaacccaggtgagg

SEQ ID NO: 431122 - DNA, 20 bp, mouse
gactacagctaacccaggtg

SEQ ID NO: 431123 - DNA, 20 bp, mouse
gaagagccactccgcagatt

SEQ ID NO: 431124 - DNA, 20 bp, mouse
gtccctgcgccaccctcggt

SEQ ID NO: 431125 - DNA, 20 bp, mouse
gcccaggtgaggcggcagaa

SEQ ID NO: 431126 - DNA, 20 bp, mouse
gtcacccggagggttgacgg

SEQ ID NO: 431127 - DNA, 20 bp, mouse
ggggccgctactcacccgga

SEQ ID NO: 431128 - DNA, 20 bp, mouse
gcggccgccgtcaaccctcc

SEQ ID NO: 431129 - DNA, 20 bp, mouse
gtcaggctcggccagaggct

SEQ ID NO: 431130 - DNA, 20 bp, mouse
gcccggcaagatggcaaccc

SEQ ID NO: 431131 - DNA, 20 bp, mouse
gtactcacccggagggttga

SEQ ID NO: 431132 - DNA, 20 bp, mouse
gggctgggccgctactcacc

SEQ ID NO: 431133 - DNA, 20 bp, mouse
ggcgtctcaggctcggccag

SEQ ID NO: 431134 - DNA, 20 bp, mouse
gccgcggccgcgccacacaa

SEQ ID NO: 431135 - DNA, 20 bp, mouse
gcggcgctccggtcccttcc

SEQ ID NO: 431136 - DNA, 20 bp, mouse
gaagtccggcgcgggtaaac

SEQ ID NO: 431137 - DNA, 20 bp, mouse
ggaaagtaggtcagggacgg

SEQ ID NO: 431138 - DNA, 20 bp, mouse
ggtggtgcgacatttaggga

SEQ ID NO: 431139 - DNA, 20 bp, mouse
ggccatgccgacactcaccg

SEQ ID NO: 431140 - DNA, 20 bp, mouse
gcacccgcactcggatcccg

SEQ ID NO: 431141 - DNA, 20 bp, mouse
gccgccgcgggatccgagtg

SEQ ID NO: 431142 - DNA, 20 bp, mouse
gcctccccgaggctaggtgg

SEQ ID NO: 431143 - DNA, 20 bp, mouse
gagcgagccacggtgagtgt

SEQ ID NO: 431144 - DNA, 20 bp, mouse
gtttagggaaggcagaaagt

SEQ ID NO: 431145 - DNA, 20 bp, mouse
gccgacgggacgccccgaga

SEQ ID NO: 431146 - DNA, 20 bp, mouse
ggccagcccggggagggaca

SEQ ID NO: 431147 - DNA, 20 bp, mouse
gcatgcggcctgggcgcaca

SEQ ID NO: 431148 - DNA, 20 bp, mouse
ggcctgggcgcacagggctt

SEQ ID NO: 431149 - DNA, 20 bp, mouse
gagggacaaggcacccgcac

SEQ ID NO: 431150 - DNA, 20 bp, mouse
gagccctagccagcccgggg

SEQ ID NO: 431151 - DNA, 20 bp, mouse
gggcagccctagccagcccg

SEQ ID NO: 431152 - DNA, 20 bp, mouse
gtccctccccgggctggcta

SEQ ID NO: 431153 - DNA, 20 bp, mouse
gccgcatgcggggagccgcg

SEQ ID NO: 431154 - DNA, 20 bp, mouse
gaggtgatacaactgcgctg

SEQ ID NO: 431155 - DNA, 20 bp, mouse
gcgggtgccttgtccctccc

SEQ ID NO: 431156 - DNA, 20 bp, mouse
gcggaggagggaggcctaga

SEQ ID NO: 431157 - DNA, 20 bp, mouse
gtggctccggcgggcgcgga

SEQ ID NO: 431158 - DNA, 20 bp, mouse
gcggcgggcgcggacggagg

SEQ ID NO: 431159 - DNA, 20 bp, mouse
gcgacgcgaactggctccgg

SEQ ID NO: 431160 - DNA, 20 bp, mouse
gactcagaggtaaccacgaa

SEQ ID NO: 431161 - DNA, 20 bp, mouse
gcaggtaaggagccacaggg

SEQ ID NO: 431162 - DNA, 20 bp, mouse
gctggtcagtcgacgcgaac

SEQ ID NO: 431163 - DNA, 20 bp, mouse
gagtcgacgcgaactggctc

SEQ ID NO: 431164 - DNA, 20 bp, mouse
ggtccggagcggacgattcg

SEQ ID NO: 431165 - DNA, 20 bp, mouse
gcctcaggtaaggagccaca

SEQ ID NO: 431166 - DNA, 20 bp, mouse
gccgcggccgaggagacccg

SEQ ID NO: 431167 - DNA, 20 bp, mouse
gctggcaaggagctagtggg

SEQ ID NO: 431168 - DNA, 20 bp, mouse
ggtcgactgtccagagtccg

SEQ ID NO: 431169 - DNA, 20 bp, mouse
ggacagtcgacgcgccgaac

SEQ ID NO: 431170 - DNA, 20 bp, mouse
ggccgaggagacccgaggtg

SEQ ID NO: 431171 - DNA, 20 bp, mouse
ggctgcgcgggtctcagagc

SEQ ID NO: 431172 - DNA, 20 bp, mouse
ggcgggtctcagagccggtt

SEQ ID NO: 431173 - DNA, 20 bp, mouse
ggccgcagccacttcctcgt

SEQ ID NO: 431174 - DNA, 20 bp, mouse
ggaggccacctagaagtcag

SEQ ID NO: 431175 - DNA, 20 bp, mouse
gtctcctcggccgcggactc

SEQ ID NO: 431176 - DNA, 20 bp, mouse
gggatcgtcaagtaaggcgg

SEQ ID NO: 431177 - DNA, 20 bp, mouse
gccgggatcgtcaagtaagg

SEQ ID NO: 431178 - DNA, 20 bp, mouse
gaggcgggttgaagcttcgg

SEQ ID NO: 431179 - DNA, 20 bp, mouse
gggtgagggtgggcaatcga

SEQ ID NO: 431180 - DNA, 20 bp, mouse
gagggtgggcaatcgagggt

SEQ ID NO: 431181 - DNA, 20 bp, mouse
gccgctgcccctgacgaggg

SEQ ID NO: 431182 - DNA, 20 bp, mouse
gacccagcccccctcgtcag

SEQ ID NO: 431183 - DNA, 20 bp, mouse
gtccagcaggatcatggcgg

SEQ ID NO: 431184 - DNA, 20 bp, mouse
ggtggggagaggctgagata

SEQ ID NO: 431185 - DNA, 20 bp, mouse
gcaatcgagggtaggacgga

SEQ ID NO: 431186 - DNA, 20 bp, mouse
gtccgacgaccgagcctggg

SEQ ID NO: 431187 - DNA, 20 bp, mouse
ggtttccgacgaccgagcct

SEQ ID NO: 431188 - DNA, 20 bp, mouse
gcaaaggctggagatcaggg

SEQ ID NO: 431189 - DNA, 20 bp, mouse
gagggtgggatctgggaaca

SEQ ID NO: 431190 - DNA, 20 bp, mouse
gaggttcgaggctctagggt

SEQ ID NO: 431191 - DNA, 20 bp, mouse
gggcggaagtaagccggaag

SEQ ID NO: 431192 - DNA, 20 bp, mouse
gggagtgggcggaagtaagc

SEQ ID NO: 431193 - DNA, 20 bp, mouse
gatgcttaccggcatcttga

SEQ ID NO: 431194 - DNA, 20 bp, mouse
ggtaagccggaagaggcggg

SEQ ID NO: 431195 - DNA, 20 bp, mouse
gctggggctcgaatgcttac

SEQ ID NO: 431196 - DNA, 20 bp, mouse
gcgcgatggtgagagaccag

SEQ ID NO: 431197 - DNA, 20 bp, mouse
gcagggaggaccccaacccc

SEQ ID NO: 431198 - DNA, 20 bp, mouse
ggcccagacagcgcccgcga

SEQ ID NO: 431199 - DNA, 20 bp, mouse
gcctctacaggcaaaacaca

SEQ ID NO: 431200 - DNA, 20 bp, mouse
gctacaggcaaaacacaggg

SEQ ID NO: 431201 - DNA, 20 bp, mouse
gccagacccacagcctctac

SEQ ID NO: 431202 - DNA, 20 bp, mouse
gctcgggccgcaagccctag

SEQ ID NO: 431203 - DNA, 20 bp, mouse
gaggttgccccgggatgagg

SEQ ID NO: 431204 - DNA, 20 bp, mouse
gaccatcgcgggcgctgtct

SEQ ID NO: 431205 - DNA, 20 bp, mouse
gtagcccgggattcccaacc

SEQ ID NO: 431206 - DNA, 20 bp, mouse
ggacgccccagagcggaaga

SEQ ID NO: 431207 - DNA, 20 bp, mouse
gagcgtaaggatattgccgt

SEQ ID NO: 431208 - DNA, 20 bp, mouse
ggcgccggcgaacttaccgg

SEQ ID NO: 431209 - DNA, 20 bp, mouse
ggtgcccactaggacaccag

SEQ ID NO: 431210 - DNA, 20 bp, mouse
gcggctctaggtggggacgg

SEQ ID NO: 431211 - DNA, 20 bp, mouse
gctgtgcccggctctaggtg

SEQ ID NO: 431212 - DNA, 20 bp, mouse
gccgcgcacctgaggaatcg

SEQ ID NO: 431213 - DNA, 20 bp, mouse
gtcaggtgcgcggtcctaag

SEQ ID NO: 431214 - DNA, 20 bp, mouse
gcccagaagcttgcaagccg

SEQ ID NO: 431215 - DNA, 20 bp, mouse
ggcaccgctggtgtcctagt

SEQ ID NO: 431216 - DNA, 20 bp, mouse
gaagcggagccggtgcggag

SEQ ID NO: 431217 - DNA, 20 bp, mouse
gggaaagagcgaagcctagg

SEQ ID NO: 431218 - DNA, 20 bp, mouse
gtcccggctcccctccgcac

SEQ ID NO: 431219 - DNA, 20 bp, mouse
ggagcccgtctacctcgcag

SEQ ID NO: 431220 - DNA, 20 bp, mouse
gccgcaccggctccgcttgg

SEQ ID NO: 431221 - DNA, 20 bp, mouse
ggactgacaggagccgggag

SEQ ID NO: 431222 - DNA, 20 bp, mouse
ggccggtgcggaggggagcc

SEQ ID NO: 431223 - DNA, 20 bp, mouse
gcgacccctgcgaggtagac

SEQ ID NO: 431224 - DNA, 20 bp, mouse
gccacagaccgggagaacct

SEQ ID NO: 431225 - DNA, 20 bp, mouse
gttcgtagacgagcacgaag

SEQ ID NO: 431226 - DNA, 20 bp, mouse
gcgcggggataggtaggtaa

SEQ ID NO: 431227 - DNA, 20 bp, mouse
gcggaggcgcggggataggt

SEQ ID NO: 431228 - DNA, 20 bp, mouse
gtcgggcgtcgcagggccgg

SEQ ID NO: 431229 - DNA, 20 bp, mouse
ggcctgggctgcgggagcta

SEQ ID NO: 431230 - DNA, 20 bp, mouse
gggataggtaggtaagggcg

SEQ ID NO: 431231 - DNA, 20 bp, mouse
gatgtccgcggaagtccccg

SEQ ID NO: 431232 - DNA, 20 bp, mouse
gtgggctgcgggagctacgg

SEQ ID NO: 431233 - DNA, 20 bp, mouse
ggaagtgctcgggcgtcgca

SEQ ID NO: 431234 - DNA, 20 bp, mouse
ggagaagacagattaccggg

SEQ ID NO: 431235 - DNA, 20 bp, mouse
ggtccccgaggcagcgtctg

SEQ ID NO: 431236 - DNA, 20 bp, mouse
ggtgcgttctagaagaggct

SEQ ID NO: 431237 - DNA, 20 bp, mouse
gacccgctggtgacctggtg

SEQ ID NO: 431238 - DNA, 20 bp, mouse
gggctgggcaagggacccgc

SEQ ID NO: 431239 - DNA, 20 bp, mouse
gaaagagtgcgttctagaag

SEQ ID NO: 431240 - DNA, 20 bp, mouse
ggcctcaccaggtcaccagc

SEQ ID NO: 431241 - DNA, 20 bp, mouse
gaagggacccgctggtgacc

SEQ ID NO: 431242 - DNA, 20 bp, mouse
gtaggctcaaagcaaaccag

SEQ ID NO: 431243 - DNA, 20 bp, mouse
gtgggagaagcagcctcacc

SEQ ID NO: 431244 - DNA, 20 bp, mouse
ggagcagctgagtgaaaatg

SEQ ID NO: 431245 - DNA, 20 bp, mouse
ggtaatcagacaggacctaa

SEQ ID NO: 431246 - DNA, 20 bp, mouse
ggcacacagtaagtaagact

SEQ ID NO: 431247 - DNA, 20 bp, mouse
gccttcattggagaagaagc

SEQ ID NO: 431248 - DNA, 20 bp, mouse
gtgctaatggggacatggga

SEQ ID NO: 431249 - DNA, 20 bp, mouse
gagctgggagcgagatttgc

SEQ ID NO: 431250 - DNA, 20 bp, mouse
ggagaagaagccggcagctt

SEQ ID NO: 431251 - DNA, 20 bp, mouse
ggatctgggcgaatgactgg

SEQ ID NO: 431252 - DNA, 20 bp, mouse
gtgcctcgagatggacactc

SEQ ID NO: 431253 - DNA, 20 bp, mouse
gaatccacgcaagtgatcag

SEQ ID NO: 431254 - DNA, 20 bp, mouse
gggactgctaatggggacat

SEQ ID NO: 431255 - DNA, 20 bp, mouse
gtaaggaaactgcctcgaga

SEQ ID NO: 431256 - DNA, 20 bp, mouse
gaaggaggtggacttagtat

SEQ ID NO: 431257 - DNA, 20 bp, mouse
ggatttagaatattacctga

SEQ ID NO: 431258 - DNA, 20 bp, mouse
gatgctaaaggcaaaggagg

SEQ ID NO: 431259 - DNA, 20 bp, mouse
gtgctagggaagcatagaga

SEQ ID NO: 431260 - DNA, 20 bp, mouse
ggtggcagtagaagcctctg

SEQ ID NO: 431261 - DNA, 20 bp, mouse
gagaggattgtggatataag

SEQ ID NO: 431262 - DNA, 20 bp, mouse
gaagaagatgctaaaggcaa

SEQ ID NO: 431263 - DNA, 20 bp, mouse
gtcagagggatgagttgggg

SEQ ID NO: 431264 - DNA, 20 bp, mouse
gacatagtaggcttggtcag

SEQ ID NO: 431265 - DNA, 20 bp, mouse
gtggtcagagggatgagttg

SEQ ID NO: 431266 - DNA, 20 bp, mouse
ggcggccgcagggaggtccg

SEQ ID NO: 431267 - DNA, 20 bp, mouse
ggtccaggctggaaaatccc

SEQ ID NO: 431268 - DNA, 20 bp, mouse
gtggcccgcgcttctcctgg

SEQ ID NO: 431269 - DNA, 20 bp, mouse
ggtccgcggcgtcagcgtcc

SEQ ID NO: 431270 - DNA, 20 bp, mouse
ggacgccgcggacctccctg

SEQ ID NO: 431271 - DNA, 20 bp, mouse
gtgcggccgccgcggaccat

SEQ ID NO: 431272 - DNA, 20 bp, mouse
gcggccgccaggagaagcgc

SEQ ID NO: 431273 - DNA, 20 bp, mouse
gggctggcccgcgcttctcc

SEQ ID NO: 431274 - DNA, 20 bp, mouse
ggtaccgaggcacccagggt

SEQ ID NO: 431275 - DNA, 20 bp, mouse
gaggagccgtgaacccaatg

SEQ ID NO: 431276 - DNA, 20 bp, mouse
ggagcgagccgcgaacccgg

SEQ ID NO: 431277 - DNA, 20 bp, mouse
gtgcgagcgagccgcgaacc

SEQ ID NO: 431278 - DNA, 20 bp, mouse
gcccggaccgctaccctcta

SEQ ID NO: 431279 - DNA, 20 bp, mouse
ggagccgcgaacccggcggg

SEQ ID NO: 431280 - DNA, 20 bp, mouse
ggcgagcgcgcgcgcaccat

SEQ ID NO: 431281 - DNA, 20 bp, mouse
gcaccatgggagaaaaaccc

SEQ ID NO: 431282 - DNA, 20 bp, mouse
gtccacagacaaggacaccg

SEQ ID NO: 431283 - DNA, 20 bp, mouse
gggacgcctgggtccctaga

SEQ ID NO: 431284 - DNA, 20 bp, mouse
gctgggtccctagagggtag

SEQ ID NO: 431285 - DNA, 20 bp, mouse
ggagtggagcgtgcgtgcta

SEQ ID NO: 431286 - DNA, 20 bp, mouse
gaccgcggcgcgggagaccg

SEQ ID NO: 431287 - DNA, 20 bp, mouse
gtctagcaggcgtcagaccg

SEQ ID NO: 431288 - DNA, 20 bp, mouse
gggagaccgcggtatgggga

SEQ ID NO: 431289 - DNA, 20 bp, mouse
ggacgacgcggccctgactc

SEQ ID NO: 431290 - DNA, 20 bp, mouse
gtcgagatccgcctgagtca

SEQ ID NO: 431291 - DNA, 20 bp, mouse
gcccaggaccgtagacgacg

SEQ ID NO: 431292 - DNA, 20 bp, mouse
gctgcaccctccccataccg

SEQ ID NO: 431293 - DNA, 20 bp, mouse
ggacgcggccctgactcagg

SEQ ID NO: 431294 - DNA, 20 bp, mouse
gcgcgggagaccgcggtatg

SEQ ID NO: 431295 - DNA, 20 bp, mouse
gccccgcgcccacctcggaa

SEQ ID NO: 431296 - DNA, 20 bp, mouse
ggggatgtcccgagaagtca

SEQ ID NO: 431297 - DNA, 20 bp, mouse
ggcgacagtggggcttacat

SEQ ID NO: 431298 - DNA, 20 bp, mouse
gctagagactgcgaacgcag

SEQ ID NO: 431299 - DNA, 20 bp, mouse
gcgctgctcgcgccaggtac

SEQ ID NO: 431300 - DNA, 20 bp, mouse
gcacacacaagcgggacaac

SEQ ID NO: 431301 - DNA, 20 bp, mouse
gcgcagcgtgcagggaccca

SEQ ID NO: 431302 - DNA, 20 bp, mouse
gaacagtacccggcctgcca

SEQ ID NO: 431303 - DNA, 20 bp, mouse
gttccacggaggccaggccg

SEQ ID NO: 431304 - DNA, 20 bp, mouse
gaacaagacccggggctcag

SEQ ID NO: 431305 - DNA, 20 bp, mouse
gcctggcctccgtggaacac

SEQ ID NO: 431306 - DNA, 20 bp, mouse
gggagaccactgagacgagc

SEQ ID NO: 431307 - DNA, 20 bp, mouse
gacgctcctgctcgtctcag

SEQ ID NO: 431308 - DNA, 20 bp, mouse
ggtctccttacaaagacggg

SEQ ID NO: 431309 - DNA, 20 bp, mouse
gccagccgcccgtctttgta

SEQ ID NO: 431310 - DNA, 20 bp, mouse
ggtggtctccttacaaagac

SEQ ID NO: 431311 - DNA, 20 bp, mouse
ggtgtccccgctagaataca

SEQ ID NO: 431312 - DNA, 20 bp, mouse
gaggacatgcgaaagtacgg

SEQ ID NO: 431313 - DNA, 20 bp, mouse
gaagaggacatgcgaaagta

SEQ ID NO: 431314 - DNA, 20 bp, mouse
gagctgctcttaaagtgagc

SEQ ID NO: 431315 - DNA, 20 bp, mouse
gtcagtgtaattctgtgtat

SEQ ID NO: 431316 - DNA, 20 bp, mouse
gggcgccggccgcacaccca

SEQ ID NO: 431317 - DNA, 20 bp, mouse
gcgcacacccagggccacta

SEQ ID NO: 431318 - DNA, 20 bp, mouse
gctgggcgctgtggccgtag

SEQ ID NO: 431319 - DNA, 20 bp, mouse
gtccgcgacgctgctgtcac

SEQ ID NO: 431320 - DNA, 20 bp, mouse
gagagacagggccccagtgc

SEQ ID NO: 431321 - DNA, 20 bp, mouse
ggcccgtgacagcagcgtcg

SEQ ID NO: 431322 - DNA, 20 bp, mouse
gccagtgcgggtgtttcacc

SEQ ID NO: 431323 - DNA, 20 bp, mouse
gtgttcgaagatgagagcaa

SEQ ID NO: 431324 - DNA, 20 bp, mouse
gctgtggccgtagtggccct

SEQ ID NO: 431325 - DNA, 20 bp, mouse
gtactcaagcggcgagacag

SEQ ID NO: 431326 - DNA, 20 bp, mouse
gccaggtagaccgcatcttg

SEQ ID NO: 431327 - DNA, 20 bp, mouse
gtggggcagcactacctcga

SEQ ID NO: 431328 - DNA, 20 bp, mouse
gggccggctctatcatagac

SEQ ID NO: 431329 - DNA, 20 bp, mouse
ggacatgggagattgggcgg

SEQ ID NO: 431330 - DNA, 20 bp, mouse
gtggacttcaccacagacat

SEQ ID NO: 431331 - DNA, 20 bp, mouse
gacagacatgggagattggg

SEQ ID NO: 431332 - DNA, 20 bp, mouse
gttcacgacggggtccacga

SEQ ID NO: 431333 - DNA, 20 bp, mouse
gtccacgagggtactgttga

SEQ ID NO: 431334 - DNA, 20 bp, mouse
gtatcatgcgagttagagat

SEQ ID NO: 431335 - DNA, 20 bp, mouse
gtgcccgtctatgatagagc

SEQ ID NO: 431336 - DNA, 20 bp, mouse
gcagcgccatgggacaaggg

SEQ ID NO: 431337 - DNA, 20 bp, mouse
ggggcggttcgaaattgagg

SEQ ID NO: 431338 - DNA, 20 bp, mouse
gggtagacagcgtcgatctc

SEQ ID NO: 431339 - DNA, 20 bp, mouse
gcaagggcggttcgaaattg

SEQ ID NO: 431340 - DNA, 20 bp, mouse
gcacttcacattgacccggg

SEQ ID NO: 431341 - DNA, 20 bp, mouse
ggctctgccttccctaccaa

SEQ ID NO: 431342 - DNA, 20 bp, mouse
gttcgaaattgaggaggaac

SEQ ID NO: 431343 - DNA, 20 bp, mouse
gccgggaggctccagcgcca

SEQ ID NO: 431344 - DNA, 20 bp, mouse
gctcagtcccttggtaggga

SEQ ID NO: 431345 - DNA, 20 bp, mouse
gtcgaaccgcccttgtccca

SEQ ID NO: 431346 - DNA, 20 bp, mouse
ggggcacccccgacagaatc

SEQ ID NO: 431347 - DNA, 20 bp, mouse
gcagttcccgattctgtcgg

SEQ ID NO: 431348 - DNA, 20 bp, mouse
gaatcgggaactgagcggcc

SEQ ID NO: 431349 - DNA, 20 bp, mouse
gtctgcaggctgctaaggat

SEQ ID NO: 431350 - DNA, 20 bp, mouse
gtccgcgagggcgtgcacag

SEQ ID NO: 431351 - DNA, 20 bp, mouse
ggcctgcagagcccgtgctg

SEQ ID NO: 431352 - DNA, 20 bp, mouse
gggtggatgaaatcttgctg

SEQ ID NO: 431353 - DNA, 20 bp, mouse
ggcacgaagaccacatgcgg

SEQ ID NO: 431354 - DNA, 20 bp, mouse
gccgccagcgcatccaggtg

SEQ ID NO: 431355 - DNA, 20 bp, mouse
gggaggctgggtagctccgg

SEQ ID NO: 431356 - DNA, 20 bp, mouse
ggaagctttcggatgaactg

SEQ ID NO: 431357 - DNA, 20 bp, mouse
ggacagaccttgctggctcg

SEQ ID NO: 431358 - DNA, 20 bp, mouse
gggttactcagacaactgtt

SEQ ID NO: 431359 - DNA, 20 bp, mouse
gccagggtcaggtgatggag

SEQ ID NO: 431360 - DNA, 20 bp, mouse
ggaggttggacagaccttgc

SEQ ID NO: 431361 - DNA, 20 bp, mouse
ggcccctgagccaggttata

SEQ ID NO: 431362 - DNA, 20 bp, mouse
gataggttggcgatagacaa

SEQ ID NO: 431363 - DNA, 20 bp, mouse
gacaaacaggctctcccgag

SEQ ID NO: 431364 - DNA, 20 bp, mouse
gggagtggctatccaggccg

SEQ ID NO: 431365 - DNA, 20 bp, mouse
gtgtttcgccagccaaccca

SEQ ID NO: 431366 - DNA, 20 bp, mouse
ggtcgggccaaggaccccag

SEQ ID NO: 431367 - DNA, 20 bp, mouse
gcagaggcgtcggcggggat

SEQ ID NO: 431368 - DNA, 20 bp, mouse
gggagctgcgctcggagagg

SEQ ID NO: 431369 - DNA, 20 bp, mouse
gccaaggaccccagaggcgt

SEQ ID NO: 431370 - DNA, 20 bp, mouse
ggatcgggccgggatcacac

SEQ ID NO: 431371 - DNA, 20 bp, mouse
ggcgacccgcgatgacagcg

SEQ ID NO: 431372 - DNA, 20 bp, mouse
gcgcgggcccacgtggatcg

SEQ ID NO: 431373 - DNA, 20 bp, mouse
gggtaaccgcgctgtcatcg

SEQ ID NO: 431374 - DNA, 20 bp, mouse
gcccagccccggcagccggc

SEQ ID NO: 431375 - DNA, 20 bp, mouse
gcggggctgggggtcacgga

SEQ ID NO: 431376 - DNA, 20 bp, mouse
gagcctgagtcgtggagtgg

SEQ ID NO: 431377 - DNA, 20 bp, mouse
ggctttgcggggataccggg

SEQ ID NO: 431378 - DNA, 20 bp, mouse
ggccagcctgagtcgtggag

SEQ ID NO: 431379 - DNA, 20 bp, mouse
gactgctttgcggggatacc

SEQ ID NO: 431380 - DNA, 20 bp, mouse
gtggtccaggaccctcggac

SEQ ID NO: 431381 - DNA, 20 bp, mouse
gggctggcccgtcagagctg

SEQ ID NO: 431382 - DNA, 20 bp, mouse
gcaggtagcccaagctgagt

SEQ ID NO: 431383 - DNA, 20 bp, mouse
gtcctggaccagagccccga

SEQ ID NO: 431384 - DNA, 20 bp, mouse
gagggcgctcccggaaggtc

SEQ ID NO: 431385 - DNA, 20 bp, mouse
gaagctgagtaggctgacca

SEQ ID NO: 431386 - DNA, 20 bp, mouse
gactgcctggcgaacagagg

SEQ ID NO: 431387 - DNA, 20 bp, mouse
ggcgactgcctggcgaacag

SEQ ID NO: 431388 - DNA, 20 bp, mouse
ggctccagcgtgcccttggg

SEQ ID NO: 431389 - DNA, 20 bp, mouse
gctgaagaggaggccggctg

SEQ ID NO: 431390 - DNA, 20 bp, mouse
ggctgctccagcgtgccctt

SEQ ID NO: 431391 - DNA, 20 bp, mouse
gatctccggctgcgactgcc

SEQ ID NO: 431392 - DNA, 20 bp, mouse
ggagcagctgcagcacccac

SEQ ID NO: 431393 - DNA, 20 bp, mouse
gggcgtggtgggactgacat

SEQ ID NO: 431394 - DNA, 20 bp, mouse
gcgggcccccgaagtgagaa

SEQ ID NO: 431395 - DNA, 20 bp, mouse
gacattcacagagtcctggg

SEQ ID NO: 431396 - DNA, 20 bp, mouse
ggagcaggggccggactcta

SEQ ID NO: 431397 - DNA, 20 bp, mouse
ggctctccagtcatgagcag

SEQ ID NO: 431398 - DNA, 20 bp, mouse
gagggacaagactagaagtt

SEQ ID NO: 431399 - DNA, 20 bp, mouse
ggtacttacgaaggagtcac

SEQ ID NO: 431400 - DNA, 20 bp, mouse
gtccggcccctgctcatgac

SEQ ID NO: 431401 - DNA, 20 bp, mouse
gtggcgaccagcaccacgtt

SEQ ID NO: 431402 - DNA, 20 bp, mouse
gatacagaagtaaatatgag

SEQ ID NO: 431403 - DNA, 20 bp, mouse
gttcagaagcggctgctgag

SEQ ID NO: 431404 - DNA, 20 bp, mouse
gctgcccttggcctgatggg

SEQ ID NO: 431405 - DNA, 20 bp, mouse
ggggcatggccgttcagaag

SEQ ID NO: 431406 - DNA, 20 bp, mouse
gctccctatgcgaggaggtg

SEQ ID NO: 431407 - DNA, 20 bp, mouse
gccatggagaaggctaggta

SEQ ID NO: 431408 - DNA, 20 bp, mouse
gtggtctcctgggatagaca

SEQ ID NO: 431409 - DNA, 20 bp, mouse
gccctgctccctatgcgagg

SEQ ID NO: 431410 - DNA, 20 bp, mouse
ggctttgcccgccatggaga

SEQ ID NO: 431411 - DNA, 20 bp, mouse
gaggtcagctttgcccgcca

SEQ ID NO: 431412 - DNA, 20 bp, mouse
gtccctgccctgtctatccc

SEQ ID NO: 431413 - DNA, 20 bp, mouse
gctacctcacctcctcgcat

SEQ ID NO: 431414 - DNA, 20 bp, mouse
gccagaaaaaggaaaaccga

SEQ ID NO: 431415 - DNA, 20 bp, mouse
gcctccctgctccctatgcg

SEQ ID NO: 431416 - DNA, 20 bp, mouse
gtgtcatattgcaaagaggt

SEQ ID NO: 431417 - DNA, 20 bp, mouse
gattgcaaagaggtgggcag

SEQ ID NO: 431418 - DNA, 20 bp, mouse
gctaccacagactcaactgt

SEQ ID NO: 431419 - DNA, 20 bp, mouse
ggaactgtcatattgcaaag

SEQ ID NO: 431420 - DNA, 20 bp, mouse
ggttcccacagttgagtctg

SEQ ID NO: 431421 - DNA, 20 bp, mouse
gagagaggtcaacaggatgt

SEQ ID NO: 431422 - DNA, 20 bp, mouse
gctgggttagccaccaagtt

SEQ ID NO: 431423 - DNA, 20 bp, mouse
gaggtgggcaggggaaagag

SEQ ID NO: 431424 - DNA, 20 bp, mouse
gcaagttcttcctaacttgg

SEQ ID NO: 431425 - DNA, 20 bp, mouse
gctcagaagggagaaaggca

SEQ ID NO: 431426 - DNA, 20 bp, mouse
gccacagcagagtgggaatc

SEQ ID NO: 431427 - DNA, 20 bp, mouse
gaagtctaaggaatacccat

SEQ ID NO: 431428 - DNA, 20 bp, mouse
gaacaacatcctatcctgga

SEQ ID NO: 431429 - DNA, 20 bp, mouse
gtgggaatccggtgtgagac

SEQ ID NO: 431430 - DNA, 20 bp, mouse
gcttggcacgtgctgcccat

SEQ ID NO: 431431 - DNA, 20 bp, mouse
gcacgtgccaagccagccgt

SEQ ID NO: 431432 - DNA, 20 bp, mouse
gtatgtatgtgagagaccgg

SEQ ID NO: 431433 - DNA, 20 bp, mouse
gctgcagaggcacaaacgcc

SEQ ID NO: 431434 - DNA, 20 bp, mouse
gttccctctcaaaaagtcta

SEQ ID NO: 431435 - DNA, 20 bp, mouse
ggagataataaacagcatag

SEQ ID NO: 431436 - DNA, 20 bp, mouse
ggtgagcgttgagctccggg

SEQ ID NO: 431437 - DNA, 20 bp, mouse
gcaggaggcagagggatagt

SEQ ID NO: 431438 - DNA, 20 bp, mouse
gttcttcagcagatcagtgc

SEQ ID NO: 431439 - DNA, 20 bp, mouse
ggaagaaaagaagcacttta

SEQ ID NO: 431440 - DNA, 20 bp, mouse
gggacagagaggagagcccc

SEQ ID NO: 431441 - DNA, 20 bp, mouse
gagaggcaggcccattgggt

SEQ ID NO: 431442 - DNA, 20 bp, mouse
gaccgagaggcaggcccatt

SEQ ID NO: 431443 - DNA, 20 bp, mouse
gagagtgagcgttgagctcc

SEQ ID NO: 431444 - DNA, 20 bp, mouse
gttcgtaggaggtttggcaa

SEQ ID NO: 431445 - DNA, 20 bp, mouse
gggttccctaccacctgcaa

SEQ ID NO: 431446 - DNA, 20 bp, mouse
gctgtctagtcggcatgcag

SEQ ID NO: 431447 - DNA, 20 bp, mouse
gagatgtgcgcggcacagaa

SEQ ID NO: 431448 - DNA, 20 bp, mouse
gctgaccctgaacagaccct

SEQ ID NO: 431449 - DNA, 20 bp, mouse
gcgaaagggccagatgtgcg

SEQ ID NO: 431450 - DNA, 20 bp, mouse
ggcatgcaggggaatgccaa

SEQ ID NO: 431451 - DNA, 20 bp, mouse
gacacccgcggggagcactg

SEQ ID NO: 431452 - DNA, 20 bp, mouse
gcgcggggagcactgaggta

SEQ ID NO: 431453 - DNA, 20 bp, mouse
gggactctagagcgtattct

SEQ ID NO: 431454 - DNA, 20 bp, mouse
gaaccgtctctctgtctagt

SEQ ID NO: 431455 - DNA, 20 bp, mouse
gaatgccaagggtctgttca

SEQ ID NO: 431456 - DNA, 20 bp, mouse
gaacaaggagagatcctcgt

SEQ ID NO: 431457 - DNA, 20 bp, mouse
gcaggccacgaagccccacg

SEQ ID NO: 431458 - DNA, 20 bp, mouse
gaggggcgtgggagctgaac

SEQ ID NO: 431459 - DNA, 20 bp, mouse
gccatggccctcagaccccc

SEQ ID NO: 431460 - DNA, 20 bp, mouse
ggagtccttgggtgattgag

SEQ ID NO: 431461 - DNA, 20 bp, mouse
gtgtcgggttaccagtccag

SEQ ID NO: 431462 - DNA, 20 bp, mouse
gttaactagcgtaatgaaca

SEQ ID NO: 431463 - DNA, 20 bp, mouse
gagatcctcgtggggcttcg

SEQ ID NO: 431464 - DNA, 20 bp, mouse
ggggtctgagggccatggcc

SEQ ID NO: 431465 - DNA, 20 bp, mouse
gtcgtggcctgggggtctga

SEQ ID NO: 431466 - DNA, 20 bp, mouse
ggctaggtccctctaggtgg

SEQ ID NO: 431467 - DNA, 20 bp, mouse
ggaggcagagtagagatcgc

SEQ ID NO: 431468 - DNA, 20 bp, mouse
gtaggctaggtccctctagg

SEQ ID NO: 431469 - DNA, 20 bp, mouse
ggacatttggagaagacccc

SEQ ID NO: 431470 - DNA, 20 bp, mouse
ggcagcgagacgctgaaact

SEQ ID NO: 431471 - DNA, 20 bp, mouse
ggcccgcgggccgcatctgg

SEQ ID NO: 431472 - DNA, 20 bp, mouse
gatgtctagcccccacctag

SEQ ID NO: 431473 - DNA, 20 bp, mouse
ggccggtctgtgccctgtgg

SEQ ID NO: 431474 - DNA, 20 bp, mouse
ggctgctgagggatggagtt

SEQ ID NO: 431475 - DNA, 20 bp, mouse
gagcggggaccggatccgga

SEQ ID NO: 431476 - DNA, 20 bp, mouse
gaaaggcacggaaggcgcag

SEQ ID NO: 431477 - DNA, 20 bp, mouse
gggagccctagagtggccat

SEQ ID NO: 431478 - DNA, 20 bp, mouse
gtgggagcttgagcacgtgg

SEQ ID NO: 431479 - DNA, 20 bp, mouse
gagtggccatggggaccggc

SEQ ID NO: 431480 - DNA, 20 bp, mouse
ggacttgtggcacccaggag

SEQ ID NO: 431481 - DNA, 20 bp, mouse
gggtccgggaaaggcacgga

SEQ ID NO: 431482 - DNA, 20 bp, mouse
gcatggggaccggcgggcgt

SEQ ID NO: 431483 - DNA, 20 bp, mouse
gtccaggcgtcttccgccag

SEQ ID NO: 431484 - DNA, 20 bp, mouse
gcggcgggcgtagggggacg

SEQ ID NO: 431485 - DNA, 20 bp, mouse
ggcgtagggggacgcggtcc

SEQ ID NO: 431486 - DNA, 20 bp, mouse
gggagtcagtagagccggag

SEQ ID NO: 431487 - DNA, 20 bp, mouse
gtggagggagtcagtagagc

SEQ ID NO: 431488 - DNA, 20 bp, mouse
ggcagctggaccgcactccg

SEQ ID NO: 431489 - DNA, 20 bp, mouse
gcaggtccgcctgcactgga

SEQ ID NO: 431490 - DNA, 20 bp, mouse
gctgggaagctgcaagccgg

SEQ ID NO: 431491 - DNA, 20 bp, mouse
gctgccaggtccgcctgcac

SEQ ID NO: 431492 - DNA, 20 bp, mouse
gccggagcgcccgcggagtg

SEQ ID NO: 431493 - DNA, 20 bp, mouse
gcgggctgcattgaccccca

SEQ ID NO: 431494 - DNA, 20 bp, mouse
gagcagacaatagctgcgga

SEQ ID NO: 431495 - DNA, 20 bp, mouse
gaccagcagccaatcgggag

SEQ ID NO: 431496 - DNA, 20 bp, mouse
gctggctgctccagtagggg

SEQ ID NO: 431497 - DNA, 20 bp, mouse
gttgctggctgctccagtag

SEQ ID NO: 431498 - DNA, 20 bp, mouse
gcacgggcagcgggaggggt

SEQ ID NO: 431499 - DNA, 20 bp, mouse
gactggagcagccagcaagc

SEQ ID NO: 431500 - DNA, 20 bp, mouse
gaacactcctcctcccctac

SEQ ID NO: 431501 - DNA, 20 bp, mouse
gccaggtccgctttgcgcac

SEQ ID NO: 431502 - DNA, 20 bp, mouse
gttgcgcacgggcagcggga

SEQ ID NO: 431503 - DNA, 20 bp, mouse
gcaggtgagctcggccgggt

SEQ ID NO: 431504 - DNA, 20 bp, mouse
gggagggctagcctgcttgc

SEQ ID NO: 431505 - DNA, 20 bp, mouse
ggggccccggccaggattag

SEQ ID NO: 431506 - DNA, 20 bp, mouse
gtgggagcccgcaaccgagg

SEQ ID NO: 431507 - DNA, 20 bp, mouse
gcgagctccggctgaggtca

SEQ ID NO: 431508 - DNA, 20 bp, mouse
ggcttgtcctgagcgcggag

SEQ ID NO: 431509 - DNA, 20 bp, mouse
gagaggacgagctccggctg

SEQ ID NO: 431510 - DNA, 20 bp, mouse
gatgctgtcgatgcagtagg

SEQ ID NO: 431511 - DNA, 20 bp, mouse
ggcaaccgagggggacggaa

SEQ ID NO: 431512 - DNA, 20 bp, mouse
ggcaatcagtaccaggaaga

SEQ ID NO: 431513 - DNA, 20 bp, mouse
gtctgctcctctctcctgga

SEQ ID NO: 431514 - DNA, 20 bp, mouse
gagcccgcaaccgaggggga

SEQ ID NO: 431515 - DNA, 20 bp, mouse
gatccaaccctccaggagag

SEQ ID NO: 431516 - DNA, 20 bp, mouse
gtggctggctggctcggcac

SEQ ID NO: 431517 - DNA, 20 bp, mouse
gccctccacgcgggctccac

SEQ ID NO: 431518 - DNA, 20 bp, mouse
ggccagccagcgagcgccgg

SEQ ID NO: 431519 - DNA, 20 bp, mouse
ggaggaaggcagagggaccg

SEQ ID NO: 431520 - DNA, 20 bp, mouse
ggcgagccagaggaaggcag

SEQ ID NO: 431521 - DNA, 20 bp, mouse
gttgcagggtgttcaatcgg

SEQ ID NO: 431522 - DNA, 20 bp, mouse
gagcgccggtggagcccgcg

SEQ ID NO: 431523 - DNA, 20 bp, mouse
gtggagacgtgcaggcgcac

SEQ ID NO: 431524 - DNA, 20 bp, mouse
gatcggcggctccctccacg

SEQ ID NO: 431525 - DNA, 20 bp, mouse
gatcttgcagggtgttcaat

SEQ ID NO: 431526 - DNA, 20 bp, mouse
gacacgggctcaagggaaac

SEQ ID NO: 431527 - DNA, 20 bp, mouse
gggctggctggctctgcacg

SEQ ID NO: 431528 - DNA, 20 bp, mouse
gccctccacgcgggctccac

SEQ ID NO: 431529 - DNA, 20 bp, mouse
gttccgcgcgagccagagga

SEQ ID NO: 431530 - DNA, 20 bp, mouse
ggccagccagcgagcgccgg

SEQ ID NO: 431531 - DNA, 20 bp, mouse
ggaggaaggcagagggaccg

SEQ ID NO: 431532 - DNA, 20 bp, mouse
gttgcagggtgttcaatcgg

SEQ ID NO: 431533 - DNA, 20 bp, mouse
ggcgagccagaggaaggcag

SEQ ID NO: 431534 - DNA, 20 bp, mouse
gagcgccggtggagcccgcg

SEQ ID NO: 431535 - DNA, 20 bp, mouse
gtggagacgtgcaggcgcac

SEQ ID NO: 431536 - DNA, 20 bp, mouse
gcaccacacagagaacgaca

SEQ ID NO: 431537 - DNA, 20 bp, mouse
ggggctgaagccaagatgga

SEQ ID NO: 431538 - DNA, 20 bp, mouse
gaatcctggacagggaatcc

SEQ ID NO: 431539 - DNA, 20 bp, mouse
gatggagggcgagcaggaca

SEQ ID NO: 431540 - DNA, 20 bp, mouse
gactcacgatctccacgtcc

SEQ ID NO: 431541 - DNA, 20 bp, mouse
gggacagggaatcctggacg

SEQ ID NO: 431542 - DNA, 20 bp, mouse
ggagggcgagcaggacacgg

SEQ ID NO: 431543 - DNA, 20 bp, mouse
gcgttcaggtgagggtccta

SEQ ID NO: 431544 - DNA, 20 bp, mouse
gaggggactggccagaagac

SEQ ID NO: 431545 - DNA, 20 bp, mouse
gtgagcccgtgggaaggcag

SEQ ID NO: 431546 - DNA, 20 bp, mouse
gctgctagagtccctcggag

SEQ ID NO: 431547 - DNA, 20 bp, mouse
ggacccaggtgagaagactt

SEQ ID NO: 431548 - DNA, 20 bp, mouse
gactgccgcggctaggaccc

SEQ ID NO: 431549 - DNA, 20 bp, mouse
gttgcagctgggaagatgcg

SEQ ID NO: 431550 - DNA, 20 bp, mouse
gctcacctgggtcctagccg

SEQ ID NO: 431551 - DNA, 20 bp, mouse
ggctggagctcacccaccgg

SEQ ID NO: 431552 - DNA, 20 bp, mouse
gcggagcggcgcttgcagct

SEQ ID NO: 431553 - DNA, 20 bp, mouse
ggagttcccccgacgcctca

SEQ ID NO: 431554 - DNA, 20 bp, mouse
gggccaaagtcttctcacct

SEQ ID NO: 431555 - DNA, 20 bp, mouse
gatcttccgtgaggcgtcgg

SEQ ID NO: 431556 - DNA, 20 bp, mouse
gtcagcctgagcaacctgca

SEQ ID NO: 431557 - DNA, 20 bp, mouse
ggagcaacctgcaaggcaca

SEQ ID NO: 431558 - DNA, 20 bp, mouse
gtaagacctgggtacaatct

SEQ ID NO: 431559 - DNA, 20 bp, mouse
gcaaggcacaagattctgca

SEQ ID NO: 431560 - DNA, 20 bp, mouse
gggttatttgctctcccagg

SEQ ID NO: 431561 - DNA, 20 bp, mouse
gaatctctcttcagtagatt

SEQ ID NO: 431562 - DNA, 20 bp, mouse
gcatggttatttgctctccc

SEQ ID NO: 431563 - DNA, 20 bp, mouse
gaaaacaagtgttcacctcc

SEQ ID NO: 431564 - DNA, 20 bp, mouse
gactgtaaggtcagatcaag

SEQ ID NO: 431565 - DNA, 20 bp, mouse
gaaactcccagattgtaccc

SEQ ID NO: 431566 - DNA, 20 bp, mouse
gcatgttccccagacagggt

SEQ ID NO: 431567 - DNA, 20 bp, mouse
ggaaaaactggagagccggg

SEQ ID NO: 431568 - DNA, 20 bp, mouse
gttcctccagagattcacta

SEQ ID NO: 431569 - DNA, 20 bp, mouse
gccagcatgttccccagaca

SEQ ID NO: 431570 - DNA, 20 bp, mouse
gtcctggcctaccctgtctg

SEQ ID NO: 431571 - DNA, 20 bp, mouse
gtccccagacagggtaggcc

SEQ ID NO: 431572 - DNA, 20 bp, mouse
gcgattccatagtgaatctc

SEQ ID NO: 431573 - DNA, 20 bp, mouse
gtcactatggaatcggtgag

SEQ ID NO: 431574 - DNA, 20 bp, mouse
gtgctggtgccgtgcagggt

SEQ ID NO: 431575 - DNA, 20 bp, mouse
gttccatagtgaatctctgg

SEQ ID NO: 431576 - DNA, 20 bp, mouse
gctctctcgagcccgctcgg

SEQ ID NO: 431577 - DNA, 20 bp, mouse
gggacacccggagcccacag

SEQ ID NO: 431578 - DNA, 20 bp, mouse
ggtcccggtgagtggcgagg

SEQ ID NO: 431579 - DNA, 20 bp, mouse
ggggccgggagtgcttagtc

SEQ ID NO: 431580 - DNA, 20 bp, mouse
gccagcggcccgcccggtcc

SEQ ID NO: 431581 - DNA, 20 bp, mouse
gtccgcagagcaccagccgg

SEQ ID NO: 431582 - DNA, 20 bp, mouse
ggaccatgtgccgaggaggg

SEQ ID NO: 431583 - DNA, 20 bp, mouse
gtgctccgcggaggagaccc

SEQ ID NO: 431584 - DNA, 20 bp, mouse
gagaaggagagagtcccaat

SEQ ID NO: 431585 - DNA, 20 bp, mouse
gagaaggaaagcgcccccaa

SEQ ID NO: 431586 - DNA, 20 bp, mouse
ggcccgccgggcacacttca

SEQ ID NO: 431587 - DNA, 20 bp, mouse
ggcgggccaagggttaaacg

SEQ ID NO: 431588 - DNA, 20 bp, mouse
ggcggcgggagcccccggag

SEQ ID NO: 431589 - DNA, 20 bp, mouse
gggacacccggagcccacag

SEQ ID NO: 431590 - DNA, 20 bp, mouse
ggccgagcgcggcgcaggaa

SEQ ID NO: 431591 - DNA, 20 bp, mouse
gtaaacgcggcgggagcccc

SEQ ID NO: 431592 - DNA, 20 bp, mouse
ggaccatgtgccgaggaggg

SEQ ID NO: 431593 - DNA, 20 bp, mouse
gggccaagggttaaacgcgg

SEQ ID NO: 431594 - DNA, 20 bp, mouse
ggggccgggagtgcttagtc

SEQ ID NO: 431595 - DNA, 20 bp, mouse
gccgagcgggctcgagagag

SEQ ID NO: 431596 - DNA, 20 bp, mouse
gtcgctcgaagaggacgcgg

SEQ ID NO: 431597 - DNA, 20 bp, mouse
gcttcgagcgagcccagacg

SEQ ID NO: 431598 - DNA, 20 bp, mouse
gagacgcgggcgcgcacagc

SEQ ID NO: 431599 - DNA, 20 bp, mouse
gagaggggcgggcccgacta

SEQ ID NO: 431600 - DNA, 20 bp, mouse
ggcgggcgcgcacagccggc

SEQ ID NO: 431601 - DNA, 20 bp, mouse
gcagcagccgctcagggaca

SEQ ID NO: 431602 - DNA, 20 bp, mouse
gcggcatcgctgcaacaccg

SEQ ID NO: 431603 - DNA, 20 bp, mouse
gctcagggacacggacaaag

SEQ ID NO: 431604 - DNA, 20 bp, mouse
gggtggcgggttgttcccgc

SEQ ID NO: 431605 - DNA, 20 bp, mouse
ggcgggcccgactagggagg

SEQ ID NO: 431606 - DNA, 20 bp, mouse
ggagtgaagaggcctcgact

SEQ ID NO: 431607 - DNA, 20 bp, mouse
gaccggagctgcctggaacg

SEQ ID NO: 431608 - DNA, 20 bp, mouse
gtgagctgctcgggcatggt

SEQ ID NO: 431609 - DNA, 20 bp, mouse
ggggaacgaggcgaaaacac

SEQ ID NO: 431610 - DNA, 20 bp, mouse
gacgctgcgggtggtgagac

SEQ ID NO: 431611 - DNA, 20 bp, mouse
gctggcacgggaggaggtga

SEQ ID NO: 431612 - DNA, 20 bp, mouse
gctcgggcatggtgggaacg

SEQ ID NO: 431613 - DNA, 20 bp, mouse
gtcgactaggacgctgcggg

SEQ ID NO: 431614 - DNA, 20 bp, mouse
gcggcaccggggcatcttgg

SEQ ID NO: 431615 - DNA, 20 bp, mouse
gggcctcgactaggacgctg

SEQ ID NO: 431616 - DNA, 20 bp, mouse
gcggaggctgaggaccaagt

SEQ ID NO: 431617 - DNA, 20 bp, mouse
ggattgctgcggaggtggac

SEQ ID NO: 431618 - DNA, 20 bp, mouse
gtgctgcggaggtggacagg

SEQ ID NO: 431619 - DNA, 20 bp, mouse
gctctctgacaggattgctg

SEQ ID NO: 431620 - DNA, 20 bp, mouse
gtggacaggcggcggggtca

SEQ ID NO: 431621 - DNA, 20 bp, mouse
gggaccgaggacccgagtcc

SEQ ID NO: 431622 - DNA, 20 bp, mouse
gcacctgccggaaacgccgg

SEQ ID NO: 431623 - DNA, 20 bp, mouse
gtgcgcggctaggggtagta

SEQ ID NO: 431624 - DNA, 20 bp, mouse
gtctgacaggattgctgcgg

SEQ ID NO: 431625 - DNA, 20 bp, mouse
ggctgtcagagaagcaccgc

SEQ ID NO: 431626 - DNA, 20 bp, mouse
ggaaagggatagtctcagaa

SEQ ID NO: 431627 - DNA, 20 bp, mouse
gtgggctccagagagggaca

SEQ ID NO: 431628 - DNA, 20 bp, mouse
ggccagattgggctccagag

SEQ ID NO: 431629 - DNA, 20 bp, mouse
gggtagagaagcctgataga

SEQ ID NO: 431630 - DNA, 20 bp, mouse
gggcatggaagggtctgagt

SEQ ID NO: 431631 - DNA, 20 bp, mouse
ggacacgggacctctgcctg

SEQ ID NO: 431632 - DNA, 20 bp, mouse
ggctggagcagccaccagag

SEQ ID NO: 431633 - DNA, 20 bp, mouse
gaccagtgctggagtccgag

SEQ ID NO: 431634 - DNA, 20 bp, mouse
gaagccgagcggatgatgat

SEQ ID NO: 431635 - DNA, 20 bp, mouse
gcagcagcggtggtgaccca

SEQ ID NO: 431636 - DNA, 20 bp, mouse
gttctcggcacaggttccta

SEQ ID NO: 431637 - DNA, 20 bp, mouse
gggatagcagaggagatcta

SEQ ID NO: 431638 - DNA, 20 bp, mouse
ggaggcagctaggatagcag

SEQ ID NO: 431639 - DNA, 20 bp, mouse
ggcaggagcatcttccattt

SEQ ID NO: 431640 - DNA, 20 bp, mouse
gagtaaaaatttgcagccgt

SEQ ID NO: 431641 - DNA, 20 bp, mouse
gagatctatggtggactgtc

SEQ ID NO: 431642 - DNA, 20 bp, mouse
ggagaagtaatgctctatga

SEQ ID NO: 431643 - DNA, 20 bp, mouse
gcattcagcacacaagtaca

SEQ ID NO: 431644 - DNA, 20 bp, mouse
gtaagaggtaaacagaatag

SEQ ID NO: 431645 - DNA, 20 bp, mouse
gatgagggctctgggttagt

SEQ ID NO: 431646 - DNA, 20 bp, mouse
gaacaagaactctaaacacg

SEQ ID NO: 431647 - DNA, 20 bp, mouse
gttcaatgcactagacaact

SEQ ID NO: 431648 - DNA, 20 bp, mouse
ggaagacaggagtcacgtac

SEQ ID NO: 431649 - DNA, 20 bp, mouse
gtatgtcacacatttcaggg

SEQ ID NO: 431650 - DNA, 20 bp, mouse
gtggtgaagaaggtgtcaga

SEQ ID NO: 431651 - DNA, 20 bp, mouse
gtaacagaacatcaaatgtt

SEQ ID NO: 431652 - DNA, 20 bp, mouse
gaatgaagcatgatctagaa

SEQ ID NO: 431653 - DNA, 20 bp, mouse
gttgacatcagtttggatgg

SEQ ID NO: 431654 - DNA, 20 bp, mouse
gttctgagtactcagcatcc

SEQ ID NO: 431655 - DNA, 20 bp, mouse
ggggaggtatgtaattttgg

SEQ ID NO: 431656 - DNA, 20 bp, mouse
ggaagctcaaaggtcctggt

SEQ ID NO: 431657 - DNA, 20 bp, mouse
gcccaaagagctctagcctg

SEQ ID NO: 431658 - DNA, 20 bp, mouse
gaccccaggctagagctctt

SEQ ID NO: 431659 - DNA, 20 bp, mouse
gctgtgaagctcaaaggtcc

SEQ ID NO: 431660 - DNA, 20 bp, mouse
gtgttcccagtagaaagact

SEQ ID NO: 431661 - DNA, 20 bp, mouse
gacatactttgggacagata

SEQ ID NO: 431662 - DNA, 20 bp, mouse
ggcatctaggagtgcttaga

SEQ ID NO: 431663 - DNA, 20 bp, mouse
gagctggagcccgcgctcaa

SEQ ID NO: 431664 - DNA, 20 bp, mouse
gcttgttggaccaagcatct

SEQ ID NO: 431665 - DNA, 20 bp, mouse
ggcaagtactaggaagcctg

SEQ ID NO: 431666 - DNA, 20 bp, mouse
gtcacaaggccggtagacag

SEQ ID NO: 431667 - DNA, 20 bp, mouse
ggctgggctcccctgtctac

SEQ ID NO: 431668 - DNA, 20 bp, mouse
ggacagagcaagctcatggg

SEQ ID NO: 431669 - DNA, 20 bp, mouse
gtgcgctccggggtaggtct

SEQ ID NO: 431670 - DNA, 20 bp, mouse
ggcggcctgcgctccggggt

SEQ ID NO: 431671 - DNA, 20 bp, mouse
ggcccagcgggcgagcagca

SEQ ID NO: 431672 - DNA, 20 bp, mouse
gtccatgctgctcgcccgct

SEQ ID NO: 431673 - DNA, 20 bp, mouse
gagagctctgggacctgagc

SEQ ID NO: 431674 - DNA, 20 bp, mouse
gtaggtctcggtttaggtcc

SEQ ID NO: 431675 - DNA, 20 bp, mouse
ggcaatcaggccccgcccag

SEQ ID NO: 431676 - DNA, 20 bp, mouse
gacctttttcatatcctcta

SEQ ID NO: 431677 - DNA, 20 bp, mouse
gaacttcagagcagccctag

SEQ ID NO: 431678 - DNA, 20 bp, mouse
gaatggtcaccggaggagag

SEQ ID NO: 431679 - DNA, 20 bp, mouse
gtccatgttgcagggttatc

SEQ ID NO: 431680 - DNA, 20 bp, mouse
gtatttataatggtcaccgg

SEQ ID NO: 431681 - DNA, 20 bp, mouse
gaaaggtaaaaattagtctt

SEQ ID NO: 431682 - DNA, 20 bp, mouse
gtaccgttttgatatagaat

SEQ ID NO: 431683 - DNA, 20 bp, mouse
gtgacaacgaccatgctatg

SEQ ID NO: 431684 - DNA, 20 bp, mouse
gaattatactacacagaata

SEQ ID NO: 431685 - DNA, 20 bp, mouse
gagctatttataatggtcac

SEQ ID NO: 431686 - DNA, 20 bp, mouse
gagtactcagagacgtcagt

SEQ ID NO: 431687 - DNA, 20 bp, mouse
gacacaagcggctccacgca

SEQ ID NO: 431688 - DNA, 20 bp, mouse
gcctgcgcagctcacacaag

SEQ ID NO: 431689 - DNA, 20 bp, mouse
ggcggctccacgcagggctt

SEQ ID NO: 431690 - DNA, 20 bp, mouse
gtataaagggacacatcccg

SEQ ID NO: 431691 - DNA, 20 bp, mouse
gtaagaaaagcgctacgcta

SEQ ID NO: 431692 - DNA, 20 bp, mouse
ggctatgaggtactacaaaa

SEQ ID NO: 431693 - DNA, 20 bp, mouse
gcgggtaaaatagcagtcga

SEQ ID NO: 431694 - DNA, 20 bp, mouse
gcctcaggttatggaaatga

SEQ ID NO: 431695 - DNA, 20 bp, mouse
ggtggccctctacaacaggt

SEQ ID NO: 431696 - DNA, 20 bp, mouse
gggtctgggcagtgccacct

SEQ ID NO: 431697 - DNA, 20 bp, mouse
gcctgccatgaggggtccag

SEQ ID NO: 431698 - DNA, 20 bp, mouse
gcagaccactggacccctca

SEQ ID NO: 431699 - DNA, 20 bp, mouse
gcaaggtgctagctgggaca

SEQ ID NO: 431700 - DNA, 20 bp, mouse
ggcagtgtggaggatgtgaa

SEQ ID NO: 431701 - DNA, 20 bp, mouse
ggaacgattctctgcctagg

SEQ ID NO: 431702 - DNA, 20 bp, mouse
gcggagagcacgcagtgtgg

SEQ ID NO: 431703 - DNA, 20 bp, mouse
gagggtggctccccagagca

SEQ ID NO: 431704 - DNA, 20 bp, mouse
gaaggaacgattctctgcct

SEQ ID NO: 431705 - DNA, 20 bp, mouse
gagctgggtctcggcaggag

SEQ ID NO: 431706 - DNA, 20 bp, mouse
gagggtaggaagagcacggt

SEQ ID NO: 431707 - DNA, 20 bp, mouse
gaaggcctgtgactgaggaa

SEQ ID NO: 431708 - DNA, 20 bp, mouse
gttcattgcttcttaagggt

SEQ ID NO: 431709 - DNA, 20 bp, mouse
gttatcaaggcctgtgactg

SEQ ID NO: 431710 - DNA, 20 bp, mouse
gcaggccttgataatgtggg

SEQ ID NO: 431711 - DNA, 20 bp, mouse
ggaggctctactccagacgc

SEQ ID NO: 431712 - DNA, 20 bp, mouse
gccctcatcagccagaggga

SEQ ID NO: 431713 - DNA, 20 bp, mouse
gaatcctgggttcatagcag

SEQ ID NO: 431714 - DNA, 20 bp, mouse
ggtcacaggccttgataatg

SEQ ID NO: 431715 - DNA, 20 bp, mouse
gtccagagagaggtgtgtct

SEQ ID NO: 431716 - DNA, 20 bp, mouse
gagctgagggggtaatctgg

SEQ ID NO: 431717 - DNA, 20 bp, mouse
gagaaggctggccctgcaca

SEQ ID NO: 431718 - DNA, 20 bp, mouse
ggagtcccagctggacattg

SEQ ID NO: 431719 - DNA, 20 bp, mouse
gtacctagcagtacgcccgt

SEQ ID NO: 431720 - DNA, 20 bp, mouse
gtggcaggtagacactgtgt

SEQ ID NO: 431721 - DNA, 20 bp, mouse
gcgtactgctaggtaaccac

SEQ ID NO: 431722 - DNA, 20 bp, mouse
gatggagagactctccaaga

SEQ ID NO: 431723 - DNA, 20 bp, mouse
ggataccacaatgtccagct

SEQ ID NO: 431724 - DNA, 20 bp, mouse
gtccaagacggcagctgtgt

SEQ ID NO: 431725 - DNA, 20 bp, mouse
gccgtgggcagctcggctga

SEQ ID NO: 431726 - DNA, 20 bp, mouse
gagctcagggccagcacagg

SEQ ID NO: 431727 - DNA, 20 bp, mouse
gagctgcctggcacaacagc

SEQ ID NO: 431728 - DNA, 20 bp, mouse
gtgcggcaggggcacaggtc

SEQ ID NO: 431729 - DNA, 20 bp, mouse
ggtttgggtacaggtctcag

SEQ ID NO: 431730 - DNA, 20 bp, mouse
gggctctgcggcaggggcac

SEQ ID NO: 431731 - DNA, 20 bp, mouse
gagagtgtttcagagctgcc

SEQ ID NO: 431732 - DNA, 20 bp, mouse
gagcttccagctgttgtgcc

SEQ ID NO: 431733 - DNA, 20 bp, mouse
gctgcaaggctctgcggcag

SEQ ID NO: 431734 - DNA, 20 bp, mouse
ggagacctgtacccaaactg

SEQ ID NO: 431735 - DNA, 20 bp, mouse
ggaaaggcatggccacagtt

SEQ ID NO: 431736 - DNA, 20 bp, mouse
gacagcaggaaggagatcta

SEQ ID NO: 431737 - DNA, 20 bp, mouse
ggggtgagctgcgagccggg

SEQ ID NO: 431738 - DNA, 20 bp, mouse
gccccttggaacagacccag

SEQ ID NO: 431739 - DNA, 20 bp, mouse
gtggagggtgagctgcgagc

SEQ ID NO: 431740 - DNA, 20 bp, mouse
gtcacttagactcttcctcc

SEQ ID NO: 431741 - DNA, 20 bp, mouse
gagtcatgctggagccagta

SEQ ID NO: 431742 - DNA, 20 bp, mouse
gtgggttctcgggagacgaa

SEQ ID NO: 431743 - DNA, 20 bp, mouse
gctggagccagtaaggagga

SEQ ID NO: 431744 - DNA, 20 bp, mouse
gcgcgggccggtgggttctc

SEQ ID NO: 431745 - DNA, 20 bp, mouse
gcatctgggaggtcttgaac

SEQ ID NO: 431746 - DNA, 20 bp, mouse
gtgctgctgtagcatcctag

SEQ ID NO: 431747 - DNA, 20 bp, mouse
gttcaaccggcgtcagtccc

SEQ ID NO: 431748 - DNA, 20 bp, mouse
ggactcaaacgcagaggccc

SEQ ID NO: 431749 - DNA, 20 bp, mouse
gagaggcccgggactgacgc

SEQ ID NO: 431750 - DNA, 20 bp, mouse
ggctgtagcatcctagcggt

SEQ ID NO: 431751 - DNA, 20 bp, mouse
gggttgaacgggtctggaga

SEQ ID NO: 431752 - DNA, 20 bp, mouse
gacgtggcaggtgtcactgg

SEQ ID NO: 431753 - DNA, 20 bp, mouse
gagggactctcgggatttgg

SEQ ID NO: 431754 - DNA, 20 bp, mouse
gtgcaacgcgacccaagcgc

SEQ ID NO: 431755 - DNA, 20 bp, mouse
gaaatcccgagagtccctag

SEQ ID NO: 431756 - DNA, 20 bp, mouse
gagcggagcaatgatttatc

SEQ ID NO: 431757 - DNA, 20 bp, mouse
gttccacagggctccgagga

SEQ ID NO: 431758 - DNA, 20 bp, mouse
gtcattgctccgcttccaca

SEQ ID NO: 431759 - DNA, 20 bp, mouse
gcagtgatgccgtccatcct

SEQ ID NO: 431760 - DNA, 20 bp, mouse
ggactccacgtagagcggaa

SEQ ID NO: 431761 - DNA, 20 bp, mouse
ggctccagctttgctgatag

SEQ ID NO: 431762 - DNA, 20 bp, mouse
gatcgagaggcaaatagatg

SEQ ID NO: 431763 - DNA, 20 bp, mouse
gaactcagggagagtctggg

SEQ ID NO: 431764 - DNA, 20 bp, mouse
gtggagagtccacaaactgc

SEQ ID NO: 431765 - DNA, 20 bp, mouse
ggttaagaaagatttcctgg

SEQ ID NO: 431766 - DNA, 20 bp, mouse
gtggctgggacctaacacta

SEQ ID NO: 431767 - DNA, 20 bp, mouse
ggccagacacagttgagact

SEQ ID NO: 431768 - DNA, 20 bp, mouse
gcttgaacagctggtccgaa

SEQ ID NO: 431769 - DNA, 20 bp, mouse
ggccaagtctcaactgtgtc

SEQ ID NO: 431770 - DNA, 20 bp, mouse
gcaactggtaatgatgtcta

SEQ ID NO: 431771 - DNA, 20 bp, mouse
gagaaatctgccctagtgtt

SEQ ID NO: 431772 - DNA, 20 bp, mouse
gactgtgtctggctctgttc

SEQ ID NO: 431773 - DNA, 20 bp, mouse
gatcgtgaaaggcaaccgaa

SEQ ID NO: 431774 - DNA, 20 bp, mouse
gtagctgttgagcaaatggc

SEQ ID NO: 431775 - DNA, 20 bp, mouse
gcacgatgtagaaatgacta

SEQ ID NO: 431776 - DNA, 20 bp, mouse
gtctgaaccggtagatcggg

SEQ ID NO: 431777 - DNA, 20 bp, mouse
gaccggcgcggggtctgaac

SEQ ID NO: 431778 - DNA, 20 bp, mouse
ggcctgggaggattgctcac

SEQ ID NO: 431779 - DNA, 20 bp, mouse
ggggtctgaaccggtagatc

SEQ ID NO: 431780 - DNA, 20 bp, mouse
gccggtagatcgggaggtgg

SEQ ID NO: 431781 - DNA, 20 bp, mouse
gtcgggaggtggtggcctgt

SEQ ID NO: 431782 - DNA, 20 bp, mouse
ggaaccggtagatcgggagg

SEQ ID NO: 431783 - DNA, 20 bp, mouse
gtgcggaagccgtgcaagaa

SEQ ID NO: 431784 - DNA, 20 bp, mouse
ggggctcggagtgtcttgta

SEQ ID NO: 431785 - DNA, 20 bp, mouse
ggggcatccaggatctggag

SEQ ID NO: 431786 - DNA, 20 bp, mouse
gcagcagggtgtcccgacag

SEQ ID NO: 431787 - DNA, 20 bp, mouse
gagctaccgagggactcaag

SEQ ID NO: 431788 - DNA, 20 bp, mouse
ggagggactcaagaggtctg

SEQ ID NO: 431789 - DNA, 20 bp, mouse
gtcggacctggtatgactta

SEQ ID NO: 431790 - DNA, 20 bp, mouse
ggccagccccctcccctcaa

SEQ ID NO: 431791 - DNA, 20 bp, mouse
gcatcccgaaagccccctgt

SEQ ID NO: 431792 - DNA, 20 bp, mouse
ggctgctgacacttcggacc

SEQ ID NO: 431793 - DNA, 20 bp, mouse
gggaggctttcagctaccga

SEQ ID NO: 431794 - DNA, 20 bp, mouse
gcggagcagcctccgggaag

SEQ ID NO: 431795 - DNA, 20 bp, mouse
gtagtcgatcaggctggggg

SEQ ID NO: 431796 - DNA, 20 bp, mouse
gcccggaccgatctgacccg

SEQ ID NO: 431797 - DNA, 20 bp, mouse
gccgggtcacgccttgacag

SEQ ID NO: 431798 - DNA, 20 bp, mouse
gaccgaaccgcgggtcagat

SEQ ID NO: 431799 - DNA, 20 bp, mouse
gggccgcactcaccgaaccg

SEQ ID NO: 431800 - DNA, 20 bp, mouse
ggtccgggaagccgctgtca

SEQ ID NO: 431801 - DNA, 20 bp, mouse
gaccgcgggtcagatcggtc

SEQ ID NO: 431802 - DNA, 20 bp, mouse
gtgagtgcggccgtgagtgc

SEQ ID NO: 431803 - DNA, 20 bp, mouse
gcaacaccgtcccgcactca

SEQ ID NO: 431804 - DNA, 20 bp, mouse
gaggccaagggtcaccgcgg

SEQ ID NO: 431805 - DNA, 20 bp, mouse
gcacccgcaaaggccgggaa

SEQ ID NO: 431806 - DNA, 20 bp, mouse
gcagaactggaatttcccag

SEQ ID NO: 431807 - DNA, 20 bp, mouse
gcccaggggctccgggaaca

SEQ ID NO: 431808 - DNA, 20 bp, mouse
gtgcatgggaatctgaccac

SEQ ID NO: 431809 - DNA, 20 bp, mouse
ggtttaaccagccacagaac

SEQ ID NO: 431810 - DNA, 20 bp, mouse
ggcaatgtgagtactacctg

SEQ ID NO: 431811 - DNA, 20 bp, mouse
gtccagcctgctaggtggag

SEQ ID NO: 431812 - DNA, 20 bp, mouse
gccatggatggtgaacaaag

SEQ ID NO: 431813 - DNA, 20 bp, mouse
ggggtggttaacgtgctcaa

SEQ ID NO: 431814 - DNA, 20 bp, mouse
gggaggtgagtcatagaaga

SEQ ID NO: 431815 - DNA, 20 bp, mouse
gggttaaactgcacacgtct

SEQ ID NO: 431816 - DNA, 20 bp, mouse
ggcgtaggaagagaccctgg

SEQ ID NO: 431817 - DNA, 20 bp, mouse
gcaggactaactgggagcgt

SEQ ID NO: 431818 - DNA, 20 bp, mouse
gccgcgccggccgtatgcaa

SEQ ID NO: 431819 - DNA, 20 bp, mouse
gctacctgccaggactaact

SEQ ID NO: 431820 - DNA, 20 bp, mouse
gtcctggcaggtaggagcgt

SEQ ID NO: 431821 - DNA, 20 bp, mouse
gctcgccacgacgtagacgg

SEQ ID NO: 431822 - DNA, 20 bp, mouse
gggcaggtaggagcgtaggg

SEQ ID NO: 431823 - DNA, 20 bp, mouse
gccctcaccgccgcagggac

SEQ ID NO: 431824 - DNA, 20 bp, mouse
gtgcggcggtgagggctaga

SEQ ID NO: 431825 - DNA, 20 bp, mouse
ggctcccagttagtcctggc

SEQ ID NO: 431826 - DNA, 20 bp, mouse
gcggcacgtacttacctccc

SEQ ID NO: 431827 - DNA, 20 bp, mouse
gcagctgaacatctcgggtg

SEQ ID NO: 431828 - DNA, 20 bp, mouse
gcatctcgggtgtggagccg

SEQ ID NO: 431829 - DNA, 20 bp, mouse
gctcgggtgtggagccgggg

SEQ ID NO: 431830 - DNA, 20 bp, mouse
ggtacgtgccggggccccac

SEQ ID NO: 431831 - DNA, 20 bp, mouse
gagcttgggagaaggtggtg

SEQ ID NO: 431832 - DNA, 20 bp, mouse
gctcccgagcaccaccggtg

SEQ ID NO: 431833 - DNA, 20 bp, mouse
gggtcaaactgcgattccgt

SEQ ID NO: 431834 - DNA, 20 bp, mouse
gggctcctcccgagcaccac

SEQ ID NO: 431835 - DNA, 20 bp, mouse
gctgcgcctaggtctgtact

SEQ ID NO: 431836 - DNA, 20 bp, mouse
gtcgctcggcgcgggtgtgt

SEQ ID NO: 431837 - DNA, 20 bp, mouse
gcgcgggtgtgtgggtttgt

SEQ ID NO: 431838 - DNA, 20 bp, mouse
ggtcacgccttagcgcgcga

SEQ ID NO: 431839 - DNA, 20 bp, mouse
gcgcgcgagggctgcccagc

SEQ ID NO: 431840 - DNA, 20 bp, mouse
gcccgcgccgagcgacggag

SEQ ID NO: 431841 - DNA, 20 bp, mouse
gtgtgctgcggaggaggtcg

SEQ ID NO: 431842 - DNA, 20 bp, mouse
ggctccgccggagtgagaag

SEQ ID NO: 431843 - DNA, 20 bp, mouse
ggggcagccctcgcgcgcta

SEQ ID NO: 431844 - DNA, 20 bp, mouse
gagccgggacgcccagccga

SEQ ID NO: 431845 - DNA, 20 bp, mouse
gcccgccccgccgcacactc

SEQ ID NO: 431846 - DNA, 20 bp, mouse
ggggaacgtggaaggcgtac

SEQ ID NO: 431847 - DNA, 20 bp, mouse
gttagggagggcgaattggg

SEQ ID NO: 431848 - DNA, 20 bp, mouse
ggctgggagccggttaggga

SEQ ID NO: 431849 - DNA, 20 bp, mouse
ggaagtgagagactgctggg

SEQ ID NO: 431850 - DNA, 20 bp, mouse
gtctggccagggaacgtgga

SEQ ID NO: 431851 - DNA, 20 bp, mouse
gcacttctggccagggaacg

SEQ ID NO: 431852 - DNA, 20 bp, mouse
gcgtggaaggcgtaccggct

SEQ ID NO: 431853 - DNA, 20 bp, mouse
gcggttagggagggcgaatt

SEQ ID NO: 431854 - DNA, 20 bp, mouse
gagtctctcacttctggcca

SEQ ID NO: 431855 - DNA, 20 bp, mouse
ggccaggtggagctgctccg

SEQ ID NO: 431856 - DNA, 20 bp, mouse
ggcggtgaccaagaggtagg

SEQ ID NO: 431857 - DNA, 20 bp, mouse
gaggctcgtgctaccctagg

SEQ ID NO: 431858 - DNA, 20 bp, mouse
ggcaggtcccgcacactcag

SEQ ID NO: 431859 - DNA, 20 bp, mouse
gtttgcggtgaccaagaggt

SEQ ID NO: 431860 - DNA, 20 bp, mouse
gagaagagcgcgacccccta

SEQ ID NO: 431861 - DNA, 20 bp, mouse
gttgcagccggatgaagaac

SEQ ID NO: 431862 - DNA, 20 bp, mouse
gcgctaggtgtgcggagacc

SEQ ID NO: 431863 - DNA, 20 bp, mouse
gaagctttgcggtgaccaag

SEQ ID NO: 431864 - DNA, 20 bp, mouse
ggctgcaagcgctaggtgtg

SEQ ID NO: 431865 - DNA, 20 bp, mouse
gtgagagagggtccgagaga

SEQ ID NO: 431866 - DNA, 20 bp, mouse
gtgtgcctggagcctttctt

SEQ ID NO: 431867 - DNA, 20 bp, mouse
gtgctccacaatgacccacg

SEQ ID NO: 431868 - DNA, 20 bp, mouse
ggtctccccgtgggtcattg

SEQ ID NO: 431869 - DNA, 20 bp, mouse
gggaatcatcgtctccccgt

SEQ ID NO: 431870 - DNA, 20 bp, mouse
ggcatcttgaactacaaaac

SEQ ID NO: 431871 - DNA, 20 bp, mouse
ggattcctaagaaaggctcc

SEQ ID NO: 431872 - DNA, 20 bp, mouse
gggagcgtcgagaatctctt

SEQ ID NO: 431873 - DNA, 20 bp, mouse
gtctgagccttgcattgtag

SEQ ID NO: 431874 - DNA, 20 bp, mouse
ggttcaagatgctgtatttg

SEQ ID NO: 431875 - DNA, 20 bp, mouse
gttatgggatgggagagctg

SEQ ID NO: 431876 - DNA, 20 bp, mouse
gcgggagcccgaacttgttc

SEQ ID NO: 431877 - DNA, 20 bp, mouse
gtcagcaagtgtggctatcc

SEQ ID NO: 431878 - DNA, 20 bp, mouse
gagccgatcagccagtgcct

SEQ ID NO: 431879 - DNA, 20 bp, mouse
gtccccaggcactggctgat

SEQ ID NO: 431880 - DNA, 20 bp, mouse
gggagtgaattacaacaatt

SEQ ID NO: 431881 - DNA, 20 bp, mouse
ggaagaaggggcaaagatag

SEQ ID NO: 431882 - DNA, 20 bp, mouse
ggcgtgcgctgtgtgaacga

SEQ ID NO: 431883 - DNA, 20 bp, mouse
gctgcagggcgaggctccgg

SEQ ID NO: 431884 - DNA, 20 bp, mouse
gggttcccagcctggataga

SEQ ID NO: 431885 - DNA, 20 bp, mouse
gcaagcggcagggacgagta

SEQ ID NO: 431886 - DNA, 20 bp, mouse
gtggaccgtgggcccccggg

SEQ ID NO: 431887 - DNA, 20 bp, mouse
gctagctgcatgccccccgg

SEQ ID NO: 431888 - DNA, 20 bp, mouse
gccgagctctggtggaccgt

SEQ ID NO: 431889 - DNA, 20 bp, mouse
ggccgggaaagggcacgtag

SEQ ID NO: 431890 - DNA, 20 bp, mouse
gcggcgccctgactgagaag

SEQ ID NO: 431891 - DNA, 20 bp, mouse
ggaagcgcaacgagcgagag

SEQ ID NO: 431892 - DNA, 20 bp, mouse
gacgttgctcaagggttcgg

SEQ ID NO: 431893 - DNA, 20 bp, mouse
ggatgaaggcaggctcgaac

SEQ ID NO: 431894 - DNA, 20 bp, mouse
gtaggggaacaccccagtgt

SEQ ID NO: 431895 - DNA, 20 bp, mouse
gcagcggcgtctgtccagca

SEQ ID NO: 431896 - DNA, 20 bp, mouse
gctagttatcagggcagaat

SEQ ID NO: 431897 - DNA, 20 bp, mouse
gggaaagctgcaaaacaccg

SEQ ID NO: 431898 - DNA, 20 bp, mouse
gggccgcgcgcgggactcgg

SEQ ID NO: 431899 - DNA, 20 bp, mouse
ggttcaggtgaacaatgtag

SEQ ID NO: 431900 - DNA, 20 bp, mouse
gggctgtagtttagtgaaat

SEQ ID NO: 431901 - DNA, 20 bp, mouse
gactggaacgggttgtagaa

SEQ ID NO: 431902 - DNA, 20 bp, mouse
gttcctttttatttacacgg

SEQ ID NO: 431903 - DNA, 20 bp, mouse
ggccgggctgtcagttgcgg

SEQ ID NO: 431904 - DNA, 20 bp, mouse
gctgtctgaaggtgagcgag

SEQ ID NO: 431905 - DNA, 20 bp, mouse
ggcatcgaggacctgtctga

SEQ ID NO: 431906 - DNA, 20 bp, mouse
gcgcttcagagggaagagtt

SEQ ID NO: 431907 - DNA, 20 bp, mouse
gagaagaagggggggacgac

SEQ ID NO: 431908 - DNA, 20 bp, mouse
gagagttgggagacgcaggg

SEQ ID NO: 431909 - DNA, 20 bp, mouse
gggaagagttgggagacgca

SEQ ID NO: 431910 - DNA, 20 bp, mouse
gagcggaggagcgcttcaga

SEQ ID NO: 431911 - DNA, 20 bp, mouse
ggcagtgaggccctgtctga

SEQ ID NO: 431912 - DNA, 20 bp, mouse
gttgaagggagcgcgctgag

SEQ ID NO: 431913 - DNA, 20 bp, mouse
gccgagggcaggagggtctg

SEQ ID NO: 431914 - DNA, 20 bp, mouse
gtgacttgcgacagagaaga

SEQ ID NO: 431915 - DNA, 20 bp, mouse
gccggcctcaccgtcagaca

SEQ ID NO: 431916 - DNA, 20 bp, mouse
gggctgaagcctgaagaacc

SEQ ID NO: 431917 - DNA, 20 bp, mouse
gtcagcaccacgaagagccc

SEQ ID NO: 431918 - DNA, 20 bp, mouse
gaagagccctgggcaatggg

SEQ ID NO: 431919 - DNA, 20 bp, mouse
gcttcagtaagtacagcagg

SEQ ID NO: 431920 - DNA, 20 bp, mouse
gggtgacagccaagagagag

SEQ ID NO: 431921 - DNA, 20 bp, mouse
gaggggacagggtccatcca

SEQ ID NO: 431922 - DNA, 20 bp, mouse
gagcgtgctcggacacacat

SEQ ID NO: 431923 - DNA, 20 bp, mouse
gcctgggcaatgggagggga

SEQ ID NO: 431924 - DNA, 20 bp, mouse
ggctcttcacctggttcttc

SEQ ID NO: 431925 - DNA, 20 bp, mouse
gtcaggcttgggagcagata

SEQ ID NO: 431926 - DNA, 20 bp, mouse
gagaaagaggggctaaacct

SEQ ID NO: 431927 - DNA, 20 bp, mouse
gacctgggagacgggacagg

SEQ ID NO: 431928 - DNA, 20 bp, mouse
gtaaacctgggagacgggac

SEQ ID NO: 431929 - DNA, 20 bp, mouse
gacgggacaggtggtgctag

SEQ ID NO: 431930 - DNA, 20 bp, mouse
gagggaggaggggccaatct

SEQ ID NO: 431931 - DNA, 20 bp, mouse
gaggtaactgaggtagtggg

SEQ ID NO: 431932 - DNA, 20 bp, mouse
gaggggctaaacctgggaga

SEQ ID NO: 431933 - DNA, 20 bp, mouse
gaccacctgtcccgtctccc

SEQ ID NO: 431934 - DNA, 20 bp, mouse
gggaaggaccgaggggacgt

SEQ ID NO: 431935 - DNA, 20 bp, mouse
gcagagccaggtcacctctt

SEQ ID NO: 431936 - DNA, 20 bp, mouse
gagagcgagcgaaggtacct

SEQ ID NO: 431937 - DNA, 20 bp, mouse
gacctaggcgcggacctcct

SEQ ID NO: 431938 - DNA, 20 bp, mouse
gccgcccccacggctaccaa

SEQ ID NO: 431939 - DNA, 20 bp, mouse
ggagcgaaggtacctaggcg

SEQ ID NO: 431940 - DNA, 20 bp, mouse
gaggcgagccgaggaggaga

SEQ ID NO: 431941 - DNA, 20 bp, mouse
ggcagcaagcctcggcgtcg

SEQ ID NO: 431942 - DNA, 20 bp, mouse
ggtacgcgtgagggccgaga

SEQ ID NO: 431943 - DNA, 20 bp, mouse
gtcccaggaggtccgcgcct

SEQ ID NO: 431944 - DNA, 20 bp, mouse
gcgcggtggcccgtcccagg

SEQ ID NO: 431945 - DNA, 20 bp, mouse
gacgggccaccgcgacgccg

SEQ ID NO: 431946 - DNA, 20 bp, mouse
gtgggaaggagcagcgatgg

SEQ ID NO: 431947 - DNA, 20 bp, mouse
gttctcgcgagagcttggga

SEQ ID NO: 431948 - DNA, 20 bp, mouse
ggcttgggaaggagcagcga

SEQ ID NO: 431949 - DNA, 20 bp, mouse
ggcggctccgggaccagggc

SEQ ID NO: 431950 - DNA, 20 bp, mouse
gcagggccggcgctgactcc

SEQ ID NO: 431951 - DNA, 20 bp, mouse
ggccgttgtggcacttgcag

SEQ ID NO: 431952 - DNA, 20 bp, mouse
gcggcggctggagcgggtcc

SEQ ID NO: 431953 - DNA, 20 bp, mouse
gtgcagcggctccgggacca

SEQ ID NO: 431954 - DNA, 20 bp, mouse
gctccggagaggccgaaagt

SEQ ID NO: 431955 - DNA, 20 bp, mouse
gcggcgctgactcccggacc

SEQ ID NO: 431956 - DNA, 20 bp, mouse
gaggagtcgccattgagaca

SEQ ID NO: 431957 - DNA, 20 bp, mouse
gcaactggagtaagtcacca

SEQ ID NO: 431958 - DNA, 20 bp, mouse
gaggacgagaccaagatgat

SEQ ID NO: 431959 - DNA, 20 bp, mouse
gtacagtgggaagatatcaa

SEQ ID NO: 431960 - DNA, 20 bp, mouse
gattgagacacggatgaagg

SEQ ID NO: 431961 - DNA, 20 bp, mouse
ggccattgagacacggatga

SEQ ID NO: 431962 - DNA, 20 bp, mouse
ggtggcgttacctatcatct

SEQ ID NO: 431963 - DNA, 20 bp, mouse
gccagtgaggcaggttcggg

SEQ ID NO: 431964 - DNA, 20 bp, mouse
gatgataggtaacgccacag

SEQ ID NO: 431965 - DNA, 20 bp, mouse
gaggaagaagggaggtcaac

SEQ ID NO: 431966 - DNA, 20 bp, mouse
gctctgcttgcgaggccctg

SEQ ID NO: 431967 - DNA, 20 bp, mouse
gcggctccgggatccgaacg

SEQ ID NO: 431968 - DNA, 20 bp, mouse
gcgcaagcagagagcggagc

SEQ ID NO: 431969 - DNA, 20 bp, mouse
gtggatccctgcagatcccg

SEQ ID NO: 431970 - DNA, 20 bp, mouse
ggaggcagctctgctgagag

SEQ ID NO: 431971 - DNA, 20 bp, mouse
gcagagagcggagccggctc

SEQ ID NO: 431972 - DNA, 20 bp, mouse
ggatccatcgtccggccggg

SEQ ID NO: 431973 - DNA, 20 bp, mouse
gccatcgtccggccgggagg

SEQ ID NO: 431974 - DNA, 20 bp, mouse
gcgtgtgcgcgcaggaagga

SEQ ID NO: 431975 - DNA, 20 bp, mouse
gtctgcagggatccatcgtc

SEQ ID NO: 431976 - DNA, 20 bp, mouse
gcggatgccatggagagtag

SEQ ID NO: 431977 - DNA, 20 bp, mouse
ggcctggccacacgctgaca

SEQ ID NO: 431978 - DNA, 20 bp, mouse
gtccaggcgataaggagggc

SEQ ID NO: 431979 - DNA, 20 bp, mouse
gcaggagctagagtttgaat

SEQ ID NO: 431980 - DNA, 20 bp, mouse
gtcaggttgatcagatctca

SEQ ID NO: 431981 - DNA, 20 bp, mouse
gccatggagagtagaggtgt

SEQ ID NO: 431982 - DNA, 20 bp, mouse
gttatcgcctggaaaaaatc

SEQ ID NO: 431983 - DNA, 20 bp, mouse
gttgcaggctgccctcgctg

SEQ ID NO: 431984 - DNA, 20 bp, mouse
gtttttccaggcgataagga

SEQ ID NO: 431985 - DNA, 20 bp, mouse
gagggtcccgatggacctca

SEQ ID NO: 431986 - DNA, 20 bp, mouse
gagtagggcgcaggaggtag

SEQ ID NO: 431987 - DNA, 20 bp, mouse
gctgcagtaaagaccaagta

SEQ ID NO: 431988 - DNA, 20 bp, mouse
gaacaggcgttgactccgtg

SEQ ID NO: 431989 - DNA, 20 bp, mouse
gcaggaggtagtggcaggca

SEQ ID NO: 431990 - DNA, 20 bp, mouse
gtgtagggctagcaggatag

SEQ ID NO: 431991 - DNA, 20 bp, mouse
gggagtcaacgcctgttctg

SEQ ID NO: 431992 - DNA, 20 bp, mouse
ggctctgccttccccagaac

SEQ ID NO: 431993 - DNA, 20 bp, mouse
gggctagcaggatagtggtg

SEQ ID NO: 431994 - DNA, 20 bp, mouse
gaggagaaggtagagacggg

SEQ ID NO: 431995 - DNA, 20 bp, mouse
gcaaggaatacggagagaga

SEQ ID NO: 431996 - DNA, 20 bp, mouse
gctcgcagggacacacgcag

SEQ ID NO: 431997 - DNA, 20 bp, mouse
ggctgtgcgggtgctgataa

SEQ ID NO: 431998 - DNA, 20 bp, mouse
ggatcgaggagagagacaag

SEQ ID NO: 431999 - DNA, 20 bp, mouse
gaccactccggagggcacca

SEQ ID NO: 432000 - DNA, 20 bp, mouse
ggagagacaagcggcagcag

SEQ ID NO: 432001 - DNA, 20 bp, mouse
gaaggtggccaggtcccgag

SEQ ID NO: 432002 - DNA, 20 bp, mouse
ggccctggtgccctccggag

SEQ ID NO: 432003 - DNA, 20 bp, mouse
ggtgccctccggagtggtgg

SEQ ID NO: 432004 - DNA, 20 bp, mouse
gtaaactcagggcaaccagg

SEQ ID NO: 432005 - DNA, 20 bp, mouse
gggttctgcgcagtccatgg

SEQ ID NO: 432006 - DNA, 20 bp, mouse
gagtgcacgcggagaaaggt

SEQ ID NO: 432007 - DNA, 20 bp, mouse
ggatcactgagatcaaaaca

SEQ ID NO: 432008 - DNA, 20 bp, mouse
gcacaagtgcacgcggagaa

SEQ ID NO: 432009 - DNA, 20 bp, mouse
gctgtcaggaagcccaaaat

SEQ ID NO: 432010 - DNA, 20 bp, mouse
ggagaaatcacaagtgcacg

SEQ ID NO: 432011 - DNA, 20 bp, mouse
gtcagtgatccgaagtcctc

SEQ ID NO: 432012 - DNA, 20 bp, mouse
gagcaaaagaataacttatg

SEQ ID NO: 432013 - DNA, 20 bp, mouse
gtggtcattatagaaacgtt

SEQ ID NO: 432014 - DNA, 20 bp, mouse
gcggaaataagcagagagca

SEQ ID NO: 432015 - DNA, 20 bp, mouse
gagggggtaggcttcatcct

SEQ ID NO: 432016 - DNA, 20 bp, mouse
gtagtggatcaagacactca

SEQ ID NO: 432017 - DNA, 20 bp, mouse
ggagagaccagaaggtaacc

SEQ ID NO: 432018 - DNA, 20 bp, mouse
gcactaggtccagggaacgt

SEQ ID NO: 432019 - DNA, 20 bp, mouse
gccagggaacgtgggacaga

SEQ ID NO: 432020 - DNA, 20 bp, mouse
gatcaagacactcagggacc

SEQ ID NO: 432021 - DNA, 20 bp, mouse
gtcggctcgggaggtctacg

SEQ ID NO: 432022 - DNA, 20 bp, mouse
ggaggaggaaccgcccaaca

SEQ ID NO: 432023 - DNA, 20 bp, mouse
gtcttgatccactaggtcca

SEQ ID NO: 432024 - DNA, 20 bp, mouse
gtgctcggcttgcaggacgt

SEQ ID NO: 432025 - DNA, 20 bp, mouse
gcagaggtgtgtaggactga

SEQ ID NO: 432026 - DNA, 20 bp, mouse
gagcggcccctgtgcatcgt

SEQ ID NO: 432027 - DNA, 20 bp, mouse
gcgcgtcccacgatgcacag

SEQ ID NO: 432028 - DNA, 20 bp, mouse
gtgggaggccatgaagccgt

SEQ ID NO: 432029 - DNA, 20 bp, mouse
gccgtgggccaggtccatga

SEQ ID NO: 432030 - DNA, 20 bp, mouse
gaagtcgcgctcctggcgag

SEQ ID NO: 432031 - DNA, 20 bp, mouse
gggcccggaagtcgcgctcc

SEQ ID NO: 432032 - DNA, 20 bp, mouse
gggatgactgtgagtaactg

SEQ ID NO: 432033 - DNA, 20 bp, mouse
gcgcgacttccgggccctca

SEQ ID NO: 432034 - DNA, 20 bp, mouse
ggacgctgagtgactgtgta

SEQ ID NO: 432035 - DNA, 20 bp, mouse
gacggtcccccccgccacct

SEQ ID NO: 432036 - DNA, 20 bp, mouse
gacgtgagccgggtccaaga

SEQ ID NO: 432037 - DNA, 20 bp, mouse
gctagcggggcccagaggac

SEQ ID NO: 432038 - DNA, 20 bp, mouse
ggttgaagcagaagagttcg

SEQ ID NO: 432039 - DNA, 20 bp, mouse
gagactctagcggggcccag

SEQ ID NO: 432040 - DNA, 20 bp, mouse
gagtagagggagcgacacta

SEQ ID NO: 432041 - DNA, 20 bp, mouse
gcggctcacgtgattaatcg

SEQ ID NO: 432042 - DNA, 20 bp, mouse
gcagcgtgtgggatgtgcag

SEQ ID NO: 432043 - DNA, 20 bp, mouse
gactggaccaaagggaggac

SEQ ID NO: 432044 - DNA, 20 bp, mouse
ggatgtaccactggaccaaa

SEQ ID NO: 432045 - DNA, 20 bp, mouse
ggcaggtaaggagactctag

SEQ ID NO: 432046 - DNA, 20 bp, mouse
gagcccggcgactctaaggt

SEQ ID NO: 432047 - DNA, 20 bp, mouse
ggcgcagtgacaagaccggt

SEQ ID NO: 432048 - DNA, 20 bp, mouse
gggcagcgcagtgacaagac

SEQ ID NO: 432049 - DNA, 20 bp, mouse
gcagaagcccggcgactcta

SEQ ID NO: 432050 - DNA, 20 bp, mouse
ggtgggaagcggcctccaac

SEQ ID NO: 432051 - DNA, 20 bp, mouse
gacctgagcactagcggcca

SEQ ID NO: 432052 - DNA, 20 bp, mouse
ggcgactctaaggtgggaag

SEQ ID NO: 432053 - DNA, 20 bp, mouse
gcagtgacaagaccggttgg

SEQ ID NO: 432054 - DNA, 20 bp, mouse
gcgcacgcgttacagaagcc

SEQ ID NO: 432055 - DNA, 20 bp, mouse
gctgcaccgcagcatcggtc

SEQ ID NO: 432056 - DNA, 20 bp, mouse
gaccgcgactgaggaaggaa

SEQ ID NO: 432057 - DNA, 20 bp, mouse
gacgccaagaaccgcgactg

SEQ ID NO: 432058 - DNA, 20 bp, mouse
ggctaggcgatgcccagcag

SEQ ID NO: 432059 - DNA, 20 bp, mouse
gcaagaaccgcgactgagga

SEQ ID NO: 432060 - DNA, 20 bp, mouse
ggccgttccttcctcagtcg

SEQ ID NO: 432061 - DNA, 20 bp, mouse
gatgcacggcggaggctaca

SEQ ID NO: 432062 - DNA, 20 bp, mouse
gtggtgctgagaatgcacgg

SEQ ID NO: 432063 - DNA, 20 bp, mouse
ggaaggggcggattcctgag

SEQ ID NO: 432064 - DNA, 20 bp, mouse
gcggttcttggcgtgcggcg

SEQ ID NO: 432065 - DNA, 20 bp, mouse
gtgctgagaatgcacggcgg

SEQ ID NO: 432066 - DNA, 20 bp, mouse
gttactcactggctaaggaa

SEQ ID NO: 432067 - DNA, 20 bp, mouse
gagtctctgagggtatatat

SEQ ID NO: 432068 - DNA, 20 bp, mouse
gtctcaattagatctaaact

SEQ ID NO: 432069 - DNA, 20 bp, mouse
gcccttggattggtaatgaa

SEQ ID NO: 432070 - DNA, 20 bp, mouse
gagtgtttctagttactcac

SEQ ID NO: 432071 - DNA, 20 bp, mouse
gcactgaagttcacagagca

SEQ ID NO: 432072 - DNA, 20 bp, mouse
ggaagattgccatctttgga

SEQ ID NO: 432073 - DNA, 20 bp, mouse
gagatggcaatcttcttaat

SEQ ID NO: 432074 - DNA, 20 bp, mouse
gtccacacatagaacatctg

SEQ ID NO: 432075 - DNA, 20 bp, mouse
gttctccaccgcccttggat

SEQ ID NO: 432076 - DNA, 20 bp, mouse
gggaacttgagggagcgtac

SEQ ID NO: 432077 - DNA, 20 bp, mouse
gactgtcaggcctggtacag

SEQ ID NO: 432078 - DNA, 20 bp, mouse
gaacaaggtaccctgctgtg

SEQ ID NO: 432079 - DNA, 20 bp, mouse
gacttgagggagcgtactgg

SEQ ID NO: 432080 - DNA, 20 bp, mouse
ggtggccatggtctttaaca

SEQ ID NO: 432081 - DNA, 20 bp, mouse
ggggagcgtactggtggcca

SEQ ID NO: 432082 - DNA, 20 bp, mouse
gcaccttgtaaggaacttga

SEQ ID NO: 432083 - DNA, 20 bp, mouse
gggtaccttgttaaagacca

SEQ ID NO: 432084 - DNA, 20 bp, mouse
gggctggggtgaaagataga

SEQ ID NO: 432085 - DNA, 20 bp, mouse
gccaccacccccaccttgta

SEQ ID NO: 432086 - DNA, 20 bp, mouse
ggcgtgctatgggaccagag

SEQ ID NO: 432087 - DNA, 20 bp, mouse
ggagccagctgtctcagcca

SEQ ID NO: 432088 - DNA, 20 bp, mouse
gtgctatgggaccagagcgg

SEQ ID NO: 432089 - DNA, 20 bp, mouse
ggcgccatggctgagacagc

SEQ ID NO: 432090 - DNA, 20 bp, mouse
gcggccctagaaagggtgag

SEQ ID NO: 432091 - DNA, 20 bp, mouse
gggagccccggccctagaaa

SEQ ID NO: 432092 - DNA, 20 bp, mouse
gggtcccatagcacgcgcca

SEQ ID NO: 432093 - DNA, 20 bp, mouse
gggctgctggccatttacac

SEQ ID NO: 432094 - DNA, 20 bp, mouse
gcagccatggcgcgtgctat

SEQ ID NO: 432095 - DNA, 20 bp, mouse
gatggtgccgccagtgtaaa

SEQ ID NO: 432096 - DNA, 20 bp, mouse
ggcacgcgaggctaaccgcg

SEQ ID NO: 432097 - DNA, 20 bp, mouse
ggcccagcctgcgactcctt

SEQ ID NO: 432098 - DNA, 20 bp, mouse
gcgctggtgcaagtcgtccg

SEQ ID NO: 432099 - DNA, 20 bp, mouse
gtggcagcctaaggagtcgc

SEQ ID NO: 432100 - DNA, 20 bp, mouse
ggcctaaggagtcgcaggct

SEQ ID NO: 432101 - DNA, 20 bp, mouse
gcgaggcgcagcgagcgcag

SEQ ID NO: 432102 - DNA, 20 bp, mouse
gcgcgcaagaacgccaaggg

SEQ ID NO: 432103 - DNA, 20 bp, mouse
ggcgagcgcagtggacgcta

SEQ ID NO: 432104 - DNA, 20 bp, mouse
gtaaccgcgcggctgcacgc

SEQ ID NO: 432105 - DNA, 20 bp, mouse
ggcccgagcacgggtagcag

SEQ ID NO: 432106 - DNA, 20 bp, mouse
gtagccaagccaggggaaag

SEQ ID NO: 432107 - DNA, 20 bp, mouse
gtctggcgtagccaagccag

SEQ ID NO: 432108 - DNA, 20 bp, mouse
gcccacgtggcgctcggtca

SEQ ID NO: 432109 - DNA, 20 bp, mouse
ggccagcacagagcaagacg

SEQ ID NO: 432110 - DNA, 20 bp, mouse
ggaactgcgagtccggccgt

SEQ ID NO: 432111 - DNA, 20 bp, mouse
gtgagtgggcgcccaagaag

SEQ ID NO: 432112 - DNA, 20 bp, mouse
gccagggacccgcaggccca

SEQ ID NO: 432113 - DNA, 20 bp, mouse
gaggaggtcgggaatcggag

SEQ ID NO: 432114 - DNA, 20 bp, mouse
gttgcggggcggctagaggt

SEQ ID NO: 432115 - DNA, 20 bp, mouse
gcagcccagccctgcaaggg

SEQ ID NO: 432116 - DNA, 20 bp, mouse
gaaaagtcaccgcagtgggg

SEQ ID NO: 432117 - DNA, 20 bp, mouse
gaggaaaagtcaccgcagtg

SEQ ID NO: 432118 - DNA, 20 bp, mouse
gacagtgaggcctgccaact

SEQ ID NO: 432119 - DNA, 20 bp, mouse
gggcaggaaccgagggacag

SEQ ID NO: 432120 - DNA, 20 bp, mouse
ggtgccctggagacgcccag

SEQ ID NO: 432121 - DNA, 20 bp, mouse
gagtcctctgggcgtctcca

SEQ ID NO: 432122 - DNA, 20 bp, mouse
gcacggagtccctcaagatg

SEQ ID NO: 432123 - DNA, 20 bp, mouse
gcctagtgggcccagttggc

SEQ ID NO: 432124 - DNA, 20 bp, mouse
gcggcatgcaggttagcagg

SEQ ID NO: 432125 - DNA, 20 bp, mouse
gggagttgacagacacgtgg

SEQ ID NO: 432126 - DNA, 20 bp, mouse
ggaagccaacgaccaggaca

SEQ ID NO: 432127 - DNA, 20 bp, mouse
gcatccccgaagcagaggaa

SEQ ID NO: 432128 - DNA, 20 bp, mouse
gttcccggaagccaacgacc

SEQ ID NO: 432129 - DNA, 20 bp, mouse
ggcggctgggctactttccc

SEQ ID NO: 432130 - DNA, 20 bp, mouse
ggaagggaacgccgcagaag

SEQ ID NO: 432131 - DNA, 20 bp, mouse
gaaagatcccctaaactccc

SEQ ID NO: 432132 - DNA, 20 bp, mouse
gctactttcccgggagttta

SEQ ID NO: 432133 - DNA, 20 bp, mouse
ggaaccgagcaaaagcggct

SEQ ID NO: 432134 - DNA, 20 bp, mouse
gcgggcgcgaccagatcctg

SEQ ID NO: 432135 - DNA, 20 bp, mouse
ggcttcggggatgtccgcgt

SEQ ID NO: 432136 - DNA, 20 bp, mouse
gcagccacacagaggctggt

SEQ ID NO: 432137 - DNA, 20 bp, mouse
gccacacagaggctggtagg

SEQ ID NO: 432138 - DNA, 20 bp, mouse
gactaacatggactaatctg

SEQ ID NO: 432139 - DNA, 20 bp, mouse
ggtttattccagtatcaccc

SEQ ID NO: 432140 - DNA, 20 bp, mouse
gtgaaaacctaccttgtcag

SEQ ID NO: 432141 - DNA, 20 bp, mouse
gtcgctcttcagtactaaca

SEQ ID NO: 432142 - DNA, 20 bp, mouse
gattgcagttaagtagtaca

SEQ ID NO: 432143 - DNA, 20 bp, mouse
ggcagttaagtagtacaggg

SEQ ID NO: 432144 - DNA, 20 bp, mouse
gcaataaaataattgtatac

SEQ ID NO: 432145 - DNA, 20 bp, mouse
gtaaacatgtgtgagttata

SEQ ID NO: 432146 - DNA, 20 bp, mouse
gaaccctgggggcccaggtt

SEQ ID NO: 432147 - DNA, 20 bp, mouse
gggagaatgaggaaccctgg

SEQ ID NO: 432148 - DNA, 20 bp, mouse
gtgcccaacctgggccccca

SEQ ID NO: 432149 - DNA, 20 bp, mouse
ggttactgctgaacttccag

SEQ ID NO: 432150 - DNA, 20 bp, mouse
gcctgcctggacgagttgaa

SEQ ID NO: 432151 - DNA, 20 bp, mouse
gtgttctgcttcttctgcag

SEQ ID NO: 432152 - DNA, 20 bp, mouse
gtggagagcgagggctctgt

SEQ ID NO: 432153 - DNA, 20 bp, mouse
ggaaacgcacagaagagtgt

SEQ ID NO: 432154 - DNA, 20 bp, mouse
gcaatcacgctggagagcga

SEQ ID NO: 432155 - DNA, 20 bp, mouse
gggctcccttcaactcgtcc

SEQ ID NO: 432156 - DNA, 20 bp, mouse
gccggctgcggtcacgtgag

SEQ ID NO: 432157 - DNA, 20 bp, mouse
gtcacgtgagcggaagatgg

SEQ ID NO: 432158 - DNA, 20 bp, mouse
ggccctaggagcaaccgcag

SEQ ID NO: 432159 - DNA, 20 bp, mouse
gcggtcacgtgagcggaaga

SEQ ID NO: 432160 - DNA, 20 bp, mouse
gggggccagcaccgacaccg

SEQ ID NO: 432161 - DNA, 20 bp, mouse
gccccgggacccagatctag

SEQ ID NO: 432162 - DNA, 20 bp, mouse
gggttgctcctagggcggta

SEQ ID NO: 432163 - DNA, 20 bp, mouse
gacaagcgccgaagattctg

SEQ ID NO: 432164 - DNA, 20 bp, mouse
ggacccagatctagaggatg

SEQ ID NO: 432165 - DNA, 20 bp, mouse
gcggaagatggcggccccgg

SEQ ID NO: 432166 - DNA, 20 bp, mouse
gcacggaccccgggaaactg

SEQ ID NO: 432167 - DNA, 20 bp, mouse
ggcgccgccagtccgaggta

SEQ ID NO: 432168 - DNA, 20 bp, mouse
gagagcggttgcaggcggag

SEQ ID NO: 432169 - DNA, 20 bp, mouse
gttcccatacctcggactgg

SEQ ID NO: 432170 - DNA, 20 bp, mouse
gacatcatggcgtgcgcccg

SEQ ID NO: 432171 - DNA, 20 bp, mouse
gcctcggactggcggcgcca

SEQ ID NO: 432172 - DNA, 20 bp, mouse
gtcaaactggccaagccacc

SEQ ID NO: 432173 - DNA, 20 bp, mouse
ggacctggcaggggcatctg

SEQ ID NO: 432174 - DNA, 20 bp, mouse
gggagcggtttgctgcctgg

SEQ ID NO: 432175 - DNA, 20 bp, mouse
gcttttcccatacctcggac

SEQ ID NO: 432176 - DNA, 20 bp, mouse
gcactgccgcctgggctcac

SEQ ID NO: 432177 - DNA, 20 bp, mouse
gtcttaccagtgagcccagg

SEQ ID NO: 432178 - DNA, 20 bp, mouse
ggagaccctggatagagagt

SEQ ID NO: 432179 - DNA, 20 bp, mouse
gctgcctagggaacccatgt

SEQ ID NO: 432180 - DNA, 20 bp, mouse
gagtggcagacggcggagca

SEQ ID NO: 432181 - DNA, 20 bp, mouse
ggtggggaccaagaagggcc

SEQ ID NO: 432182 - DNA, 20 bp, mouse
gtctcctacatgggttccct

SEQ ID NO: 432183 - DNA, 20 bp, mouse
gggtccccactctctatcca

SEQ ID NO: 432184 - DNA, 20 bp, mouse
gctcactggtaagaagttcc

SEQ ID NO: 432185 - DNA, 20 bp, mouse
gtaactgcgcggtcactcgg

SEQ ID NO: 432186 - DNA, 20 bp, mouse
ggtaggatcccggggagaaa

SEQ ID NO: 432187 - DNA, 20 bp, mouse
gcagcagcaggtaggatccc

SEQ ID NO: 432188 - DNA, 20 bp, mouse
gagcagccggcggatccgga

SEQ ID NO: 432189 - DNA, 20 bp, mouse
gggagaaacggcagacccgc

SEQ ID NO: 432190 - DNA, 20 bp, mouse
ggtgaagtgagccggcggtc

SEQ ID NO: 432191 - DNA, 20 bp, mouse
ggccgcaagtgtgagaggaa

SEQ ID NO: 432192 - DNA, 20 bp, mouse
gtgctggtgaagtgagccgg

SEQ ID NO: 432193 - DNA, 20 bp, mouse
gaagtgagccggcggtcggg

SEQ ID NO: 432194 - DNA, 20 bp, mouse
gagaagctgagggctctccc

SEQ ID NO: 432195 - DNA, 20 bp, mouse
ggtgcgtggaagaccgcgag

SEQ ID NO: 432196 - DNA, 20 bp, mouse
ggacttgagaccagacaatg

SEQ ID NO: 432197 - DNA, 20 bp, mouse
gagcctgtggttgaactggg

SEQ ID NO: 432198 - DNA, 20 bp, mouse
gtggttgaactgggagggtt

SEQ ID NO: 432199 - DNA, 20 bp, mouse
gtaaatgtggggtctgatca

SEQ ID NO: 432200 - DNA, 20 bp, mouse
gcagaccactcagccatcgc

SEQ ID NO: 432201 - DNA, 20 bp, mouse
ggttatgcacccttcatcca

SEQ ID NO: 432202 - DNA, 20 bp, mouse
gagagcagtaccacattgtc

SEQ ID NO: 432203 - DNA, 20 bp, mouse
gagggtgcataacctacccc

SEQ ID NO: 432204 - DNA, 20 bp, mouse
ggtaaagcactcaagagcta

SEQ ID NO: 432205 - DNA, 20 bp, mouse
gccacacactaggtaaatgt

SEQ ID NO: 432206 - DNA, 20 bp, mouse
gacctcagcgctggaaccta

SEQ ID NO: 432207 - DNA, 20 bp, mouse
gccccagcagcaggcgaaca

SEQ ID NO: 432208 - DNA, 20 bp, mouse
gaggcggccagggctcaaga

SEQ ID NO: 432209 - DNA, 20 bp, mouse
gtcccggagctgcttatctg

SEQ ID NO: 432210 - DNA, 20 bp, mouse
ggccttaggttccagcgctg

SEQ ID NO: 432211 - DNA, 20 bp, mouse
gcccagcgctgcgatggtgg

SEQ ID NO: 432212 - DNA, 20 bp, mouse
gggcgacgtggatccatcca

SEQ ID NO: 432213 - DNA, 20 bp, mouse
ggctctccagacctcagcgc

SEQ ID NO: 432214 - DNA, 20 bp, mouse
gatgctactcagagagcctt

SEQ ID NO: 432215 - DNA, 20 bp, mouse
gacacggagctcgagagccc

SEQ ID NO: 432216 - DNA, 20 bp, mouse
ggtggcgaccgtgaagaaga

SEQ ID NO: 432217 - DNA, 20 bp, mouse
gaaccaggacgcccgagcta

SEQ ID NO: 432218 - DNA, 20 bp, mouse
ggcggacactgaagcgaacc

SEQ ID NO: 432219 - DNA, 20 bp, mouse
gtgctggctagtggctctct

SEQ ID NO: 432220 - DNA, 20 bp, mouse
gtctctaggctccttagctc

SEQ ID NO: 432221 - DNA, 20 bp, mouse
gtggcgccggccagcaacgg

SEQ ID NO: 432222 - DNA, 20 bp, mouse
gctccttagctcgggcgtcc

SEQ ID NO: 432223 - DNA, 20 bp, mouse
gccgtggcgccggccagcaa

SEQ ID NO: 432224 - DNA, 20 bp, mouse
gctctgcgggaaagcgacat

SEQ ID NO: 432225 - DNA, 20 bp, mouse
gggcagcgtggatacggtga

SEQ ID NO: 432226 - DNA, 20 bp, mouse
ggccagcctcggctctggac

SEQ ID NO: 432227 - DNA, 20 bp, mouse
gccggactggaggcggagag

SEQ ID NO: 432228 - DNA, 20 bp, mouse
gtaccggcccggactggagg

SEQ ID NO: 432229 - DNA, 20 bp, mouse
gaggccgaaccggaagaggg

SEQ ID NO: 432230 - DNA, 20 bp, mouse
gcagaggccgaaccggaaga

SEQ ID NO: 432231 - DNA, 20 bp, mouse
gaggggctaccggcccggac

SEQ ID NO: 432232 - DNA, 20 bp, mouse
gaagccaccagaggccgaac

SEQ ID NO: 432233 - DNA, 20 bp, mouse
gtcctgcagtgaatgaacgg

SEQ ID NO: 432234 - DNA, 20 bp, mouse
gaagagggcggagcaagtga

SEQ ID NO: 432235 - DNA, 20 bp, mouse
gggctaccggcccggactgg

SEQ ID NO: 432236 - DNA, 20 bp, mouse
gctgcgtcagtcgcccacgg

SEQ ID NO: 432237 - DNA, 20 bp, mouse
gcagtcgcccacggtggcag

SEQ ID NO: 432238 - DNA, 20 bp, mouse
gcccacggtggcagcggcag

SEQ ID NO: 432239 - DNA, 20 bp, mouse
ggggcccggatggcgagacg

SEQ ID NO: 432240 - DNA, 20 bp, mouse
gcgatggctaaggaatgcgg

SEQ ID NO: 432241 - DNA, 20 bp, mouse
gccgcgatggctaaggaatg

SEQ ID NO: 432242 - DNA, 20 bp, mouse
gatgcgtgcgtgtctgccgt

SEQ ID NO: 432243 - DNA, 20 bp, mouse
gggcggctccgcataaccac

SEQ ID NO: 432244 - DNA, 20 bp, mouse
gttctctctcacacacacgc

SEQ ID NO: 432245 - DNA, 20 bp, mouse
ggcgctgcgtcagtcgccca

SEQ ID NO: 432246 - DNA, 20 bp, mouse
ggaacccaatatggcagcgg

SEQ ID NO: 432247 - DNA, 20 bp, mouse
ggtggcagcggcagcaggac

SEQ ID NO: 432248 - DNA, 20 bp, mouse
gtaagaacccaatatggcag

SEQ ID NO: 432249 - DNA, 20 bp, mouse
gctaccgccgctgccatatt

SEQ ID NO: 432250 - DNA, 20 bp, mouse
gaaaagggccgtaggaagaa

SEQ ID NO: 432251 - DNA, 20 bp, mouse
ggggggtagggggctctacg

SEQ ID NO: 432252 - DNA, 20 bp, mouse
gggaggccgccaagacggta

SEQ ID NO: 432253 - DNA, 20 bp, mouse
gcggccgcggaggcgcgcag

SEQ ID NO: 432254 - DNA, 20 bp, mouse
gggaaagcgcgcgcagagag

SEQ ID NO: 432255 - DNA, 20 bp, mouse
ggccacccgtcgcaaggcaa

SEQ ID NO: 432256 - DNA, 20 bp, mouse
gccgggttcgcgctgtttgt

SEQ ID NO: 432257 - DNA, 20 bp, mouse
gtgctcgcacagtgtcctca

SEQ ID NO: 432258 - DNA, 20 bp, mouse
gtcacggaatgcacacgaca

SEQ ID NO: 432259 - DNA, 20 bp, mouse
ggagcatgttttgtgtggac

SEQ ID NO: 432260 - DNA, 20 bp, mouse
ggtttcaccgctggcttgct

SEQ ID NO: 432261 - DNA, 20 bp, mouse
gtctctatagaaatgctggt

SEQ ID NO: 432262 - DNA, 20 bp, mouse
ggttcagtgacatttgtcct

SEQ ID NO: 432263 - DNA, 20 bp, mouse
gcagaggggcgtcggcgtcc

SEQ ID NO: 432264 - DNA, 20 bp, mouse
gctttaacgtttcagagctt

SEQ ID NO: 432265 - DNA, 20 bp, mouse
ggctacgtgtgtttcaccgc

SEQ ID NO: 432266 - DNA, 20 bp, mouse
gcatggcagcgggcacactg

SEQ ID NO: 432267 - DNA, 20 bp, mouse
gggcgagagcagcgatagtg

SEQ ID NO: 432268 - DNA, 20 bp, mouse
gtagggagctgggcacgaag

SEQ ID NO: 432269 - DNA, 20 bp, mouse
gccgcggttggtaaacaagg

SEQ ID NO: 432270 - DNA, 20 bp, mouse
ggcagcgatagtgaggatga

SEQ ID NO: 432271 - DNA, 20 bp, mouse
gtctgatagtgcgcaggcac

SEQ ID NO: 432272 - DNA, 20 bp, mouse
gggagctaggcctagacacg

SEQ ID NO: 432273 - DNA, 20 bp, mouse
ggccacgggaggccccaaac

SEQ ID NO: 432274 - DNA, 20 bp, mouse
ggggcacgaaggggaaaact

SEQ ID NO: 432275 - DNA, 20 bp, mouse
ggaccggtcctctcaggtag

SEQ ID NO: 432276 - DNA, 20 bp, mouse
gaggcaggaccagagacgat

SEQ ID NO: 432277 - DNA, 20 bp, mouse
ggaacccgctactcacccag

SEQ ID NO: 432278 - DNA, 20 bp, mouse
gcctgcctctgggtgagtag

SEQ ID NO: 432279 - DNA, 20 bp, mouse
gcgtctctggtcctgcctct

SEQ ID NO: 432280 - DNA, 20 bp, mouse
gccgtagcccggcctcgcac

SEQ ID NO: 432281 - DNA, 20 bp, mouse
gacggctctcccatcgtctc

SEQ ID NO: 432282 - DNA, 20 bp, mouse
gcagcgctggcgggagactc

SEQ ID NO: 432283 - DNA, 20 bp, mouse
gtaacctccaagggcgtccg

SEQ ID NO: 432284 - DNA, 20 bp, mouse
gagcgccgccccggatccag

SEQ ID NO: 432285 - DNA, 20 bp, mouse
gtaatccgctggatccgggg

SEQ ID NO: 432286 - DNA, 20 bp, mouse
ggtggagaacctggctccgg

SEQ ID NO: 432287 - DNA, 20 bp, mouse
ggcgggggaagtggagaacc

SEQ ID NO: 432288 - DNA, 20 bp, mouse
ggctccggaggaggctgctc

SEQ ID NO: 432289 - DNA, 20 bp, mouse
gttgcagaagccggaacccg

SEQ ID NO: 432290 - DNA, 20 bp, mouse
gtgcaggctgaggaactcac

SEQ ID NO: 432291 - DNA, 20 bp, mouse
ggaagccggaacccgaggcg

SEQ ID NO: 432292 - DNA, 20 bp, mouse
gcgagccgggaggaaatcga

SEQ ID NO: 432293 - DNA, 20 bp, mouse
ggggcgtgagtaccgaccta

SEQ ID NO: 432294 - DNA, 20 bp, mouse
ggctcacgcgctctgaattc

SEQ ID NO: 432295 - DNA, 20 bp, mouse
ggacaggtccagagagtcgg

SEQ ID NO: 432296 - DNA, 20 bp, mouse
ggtcctcagcgggagccgag

SEQ ID NO: 432297 - DNA, 20 bp, mouse
gcccgctgaggaccgctgag

SEQ ID NO: 432298 - DNA, 20 bp, mouse
ggcgccagagacctgacgca

SEQ ID NO: 432299 - DNA, 20 bp, mouse
gagaccctgcgcccgctcag

SEQ ID NO: 432300 - DNA, 20 bp, mouse
gtcgggcctgcgtcccggag

SEQ ID NO: 432301 - DNA, 20 bp, mouse
gcaggcccgacaggctagag

SEQ ID NO: 432302 - DNA, 20 bp, mouse
gttagaggagcgggtccgag

SEQ ID NO: 432303 - DNA, 20 bp, mouse
gcagcggccgcgtccagaag

SEQ ID NO: 432304 - DNA, 20 bp, mouse
ggacgaggcccgggtaagag

SEQ ID NO: 432305 - DNA, 20 bp, mouse
ggctagagcggagcagaagc

SEQ ID NO: 432306 - DNA, 20 bp, mouse
gcgccctcggcggaccgtac

SEQ ID NO: 432307 - DNA, 20 bp, mouse
gcgcgagtcacgctccggta

SEQ ID NO: 432308 - DNA, 20 bp, mouse
gagcctcgcgagtcacgctc

SEQ ID NO: 432309 - DNA, 20 bp, mouse
gctccggtacggtccgccga

SEQ ID NO: 432310 - DNA, 20 bp, mouse
gtcggcatcaagggccccaa

SEQ ID NO: 432311 - DNA, 20 bp, mouse
gtcaggtcacctgaaaggta

SEQ ID NO: 432312 - DNA, 20 bp, mouse
gaagaggaccaaagtcctaa

SEQ ID NO: 432313 - DNA, 20 bp, mouse
gctgtcaacacgtaggtcgt

SEQ ID NO: 432314 - DNA, 20 bp, mouse
gttgccgcccgctcaacccg

SEQ ID NO: 432315 - DNA, 20 bp, mouse
ggacagctacaagtgcaaga

SEQ ID NO: 432316 - DNA, 20 bp, mouse
gacaatacaaggtgcccccg

SEQ ID NO: 432317 - DNA, 20 bp, mouse
ggtggcggcgggacaataca

SEQ ID NO: 432318 - DNA, 20 bp, mouse
gtggctggaggccatagggg

SEQ ID NO: 432319 - DNA, 20 bp, mouse
gtctggagaatctgccccgg

SEQ ID NO: 432320 - DNA, 20 bp, mouse
ggtccgatctgcgttctgtg

SEQ ID NO: 432321 - DNA, 20 bp, mouse
gtaggggcggcaggtccagt

SEQ ID NO: 432322 - DNA, 20 bp, mouse
gaacgcagatcggactagtg

SEQ ID NO: 432323 - DNA, 20 bp, mouse
ggcctggctggaggccatag

SEQ ID NO: 432324 - DNA, 20 bp, mouse
ggctgggccggacctctgaa

SEQ ID NO: 432325 - DNA, 20 bp, mouse
gccgggctcaggccccgagg

SEQ ID NO: 432326 - DNA, 20 bp, mouse
gatggagttcccgttcgatg

SEQ ID NO: 432327 - DNA, 20 bp, mouse
gacagcgcatccacatcgaa

SEQ ID NO: 432328 - DNA, 20 bp, mouse
gccggagcggatcaccgtgc

SEQ ID NO: 432329 - DNA, 20 bp, mouse
gtgtgacgcggtaggaaggg

SEQ ID NO: 432330 - DNA, 20 bp, mouse
gcgtgctggaccagcacctg

SEQ ID NO: 432331 - DNA, 20 bp, mouse
ggcggaagtgacgttgtgtg

SEQ ID NO: 432332 - DNA, 20 bp, mouse
gtactgtgacgcggtaggaa

SEQ ID NO: 432333 - DNA, 20 bp, mouse
gcgtgtctggtcccgcacaa

SEQ ID NO: 432334 - DNA, 20 bp, mouse
gaactccatggcccattgtg

SEQ ID NO: 432335 - DNA, 20 bp, mouse
ggatgtggatgcgctgttcc

SEQ ID NO: 432336 - DNA, 20 bp, mouse
gaagggaaaagccagagccg

SEQ ID NO: 432337 - DNA, 20 bp, mouse
gcggcaggcctgggctgcga

SEQ ID NO: 432338 - DNA, 20 bp, mouse
gagcttcctccactatctga

SEQ ID NO: 432339 - DNA, 20 bp, mouse
ggcctgggctgcgatggcag

SEQ ID NO: 432340 - DNA, 20 bp, mouse
gcccaggcctgccgcggctc

SEQ ID NO: 432341 - DNA, 20 bp, mouse
gcgctgtcacttggacacaa

SEQ ID NO: 432342 - DNA, 20 bp, mouse
gtctcggtggagcatcctgg

SEQ ID NO: 432343 - DNA, 20 bp, mouse
ggatgctccaccgagaactg

SEQ ID NO: 432344 - DNA, 20 bp, mouse
gagggccaagtccacatctg

SEQ ID NO: 432345 - DNA, 20 bp, mouse
gcatctgaggaaggtcaccc

SEQ ID NO: 432346 - DNA, 20 bp, mouse
ggcggctgcgtaggactggg

SEQ ID NO: 432347 - DNA, 20 bp, mouse
ggcggcggctgcgtaggact

SEQ ID NO: 432348 - DNA, 20 bp, mouse
ggtaggactgggtggcgcag

SEQ ID NO: 432349 - DNA, 20 bp, mouse
ggctactgcgagtccaggga

SEQ ID NO: 432350 - DNA, 20 bp, mouse
gcctcggtggtggaatacaa

SEQ ID NO: 432351 - DNA, 20 bp, mouse
ggccgctgagggagcaaggg

SEQ ID NO: 432352 - DNA, 20 bp, mouse
gggactgggtggcgcagcgg

SEQ ID NO: 432353 - DNA, 20 bp, mouse
gtgaaggccggctactactg

SEQ ID NO: 432354 - DNA, 20 bp, mouse
gggccgagctcgctcaccat

SEQ ID NO: 432355 - DNA, 20 bp, mouse
gccgctcctcaagcccacag

SEQ ID NO: 432356 - DNA, 20 bp, mouse
gactcgagagccaaccgtcg

SEQ ID NO: 432357 - DNA, 20 bp, mouse
gcaggcggcatgatccgcac

SEQ ID NO: 432358 - DNA, 20 bp, mouse
gcagcggcgagactcccgga

SEQ ID NO: 432359 - DNA, 20 bp, mouse
gctcccaacgcgccccgcgg

SEQ ID NO: 432360 - DNA, 20 bp, mouse
gtggcgcgcgtcccaggggt

SEQ ID NO: 432361 - DNA, 20 bp, mouse
gcatgatccgcacaggccgg

SEQ ID NO: 432362 - DNA, 20 bp, mouse
gtcggcgccgcctgggacgg

SEQ ID NO: 432363 - DNA, 20 bp, mouse
gaaacggtagccgcgacggt

SEQ ID NO: 432364 - DNA, 20 bp, mouse
gtccatgactgggaaaaccg

SEQ ID NO: 432365 - DNA, 20 bp, mouse
gcgggaaacggtagccgcga

SEQ ID NO: 432366 - DNA, 20 bp, mouse
gcggatctcgcgagagagga

SEQ ID NO: 432367 - DNA, 20 bp, mouse
gaaaggccacgggctcccac

SEQ ID NO: 432368 - DNA, 20 bp, mouse
gaaactagccccggaggaga

SEQ ID NO: 432369 - DNA, 20 bp, mouse
gcagtcggatctcgcgagag

SEQ ID NO: 432370 - DNA, 20 bp, mouse
gagagaggacggaagcctgt

SEQ ID NO: 432371 - DNA, 20 bp, mouse
ggcaggggcgcaaaaggggt

SEQ ID NO: 432372 - DNA, 20 bp, mouse
ggtttacaaactagccccgg

SEQ ID NO: 432373 - DNA, 20 bp, mouse
ggggctgaatcgcactttaa

SEQ ID NO: 432374 - DNA, 20 bp, mouse
ggggttggggtccacagcag

SEQ ID NO: 432375 - DNA, 20 bp, mouse
gcgattcagccctctcctcc

SEQ ID NO: 432376 - DNA, 20 bp, mouse
gtagccgattggctccactg

SEQ ID NO: 432377 - DNA, 20 bp, mouse
ggcgcacggtgcttccccag

SEQ ID NO: 432378 - DNA, 20 bp, mouse
ggactgtggcacggacacta

SEQ ID NO: 432379 - DNA, 20 bp, mouse
gaatcggctaacccgcgctc

SEQ ID NO: 432380 - DNA, 20 bp, mouse
gcgagcgccaaggactctgc

SEQ ID NO: 432381 - DNA, 20 bp, mouse
gcgcgctccggcagagtcct

SEQ ID NO: 432382 - DNA, 20 bp, mouse
ggcggccagggtccagagag

SEQ ID NO: 432383 - DNA, 20 bp, mouse
gccgggactggtcaccagag

SEQ ID NO: 432384 - DNA, 20 bp, mouse
gcttccccagtggagccaat

SEQ ID NO: 432385 - DNA, 20 bp, mouse
gtccagagagcggccagagg

SEQ ID NO: 432386 - DNA, 20 bp, mouse
gcagcaagcagaaatggcgg

SEQ ID NO: 432387 - DNA, 20 bp, mouse
gccctggccgaggctataaa

SEQ ID NO: 432388 - DNA, 20 bp, mouse
gccgagcacacaacttaaac

SEQ ID NO: 432389 - DNA, 20 bp, mouse
gaagctaagacaggacgaag

SEQ ID NO: 432390 - DNA, 20 bp, mouse
gatggtggccgcaagccctg

SEQ ID NO: 432391 - DNA, 20 bp, mouse
gggccgcaagccctgcggga

SEQ ID NO: 432392 - DNA, 20 bp, mouse
gggccaccatggcgtattag

SEQ ID NO: 432393 - DNA, 20 bp, mouse
ggcgctccggaaccagaccg

SEQ ID NO: 432394 - DNA, 20 bp, mouse
gtgctgcctctaatacgcca

SEQ ID NO: 432395 - DNA, 20 bp, mouse
gctgcagcggcaacccccac

SEQ ID NO: 432396 - DNA, 20 bp, mouse
gggcgtggcgggagcgttaa

SEQ ID NO: 432397 - DNA, 20 bp, mouse
gaaggcagttggcgagggag

SEQ ID NO: 432398 - DNA, 20 bp, mouse
gggctacagagccattgcgc

SEQ ID NO: 432399 - DNA, 20 bp, mouse
gagccccgcgagctctgaaa

SEQ ID NO: 432400 - DNA, 20 bp, mouse
ggcggtgagcgcggagacgg

SEQ ID NO: 432401 - DNA, 20 bp, mouse
ggccagcagcgaggaagggt

SEQ ID NO: 432402 - DNA, 20 bp, mouse
gtacagagccattgcgcggg

SEQ ID NO: 432403 - DNA, 20 bp, mouse
ggccgcctccgcccgcgcaa

SEQ ID NO: 432404 - DNA, 20 bp, mouse
gcgaaaaggcgaggaggcaa

SEQ ID NO: 432405 - DNA, 20 bp, mouse
gccacccccggcctgaacta

SEQ ID NO: 432406 - DNA, 20 bp, mouse
gcatccgagttgtgagggag

SEQ ID NO: 432407 - DNA, 20 bp, mouse
gtggcgccggcaacacaagc

SEQ ID NO: 432408 - DNA, 20 bp, mouse
gggactaaaaggcgactcca

SEQ ID NO: 432409 - DNA, 20 bp, mouse
ggaggaagaaccggactaaa

SEQ ID NO: 432410 - DNA, 20 bp, mouse
gccggtggcggtgacaggtg

SEQ ID NO: 432411 - DNA, 20 bp, mouse
ggggagaggtgtctgtttcg

SEQ ID NO: 432412 - DNA, 20 bp, mouse
gctggtccatgaggaagaac

SEQ ID NO: 432413 - DNA, 20 bp, mouse
gccaccgggcggaaatcggg

SEQ ID NO: 432414 - DNA, 20 bp, mouse
gatggaccagatgaagactg

SEQ ID NO: 432415 - DNA, 20 bp, mouse
gtcacccatccgagttgtga

SEQ ID NO: 432416 - DNA, 20 bp, mouse
gcgggtcggcgatctcactg

SEQ ID NO: 432417 - DNA, 20 bp, mouse
gcggggagccggctcatggt

SEQ ID NO: 432418 - DNA, 20 bp, mouse
ggcacgcgggaaggcagcag

SEQ ID NO: 432419 - DNA, 20 bp, mouse
ggtgaagaagcgcgtcgggt

SEQ ID NO: 432420 - DNA, 20 bp, mouse
gagggtgaacgaggaaggct

SEQ ID NO: 432421 - DNA, 20 bp, mouse
ggtcggtgaagaagcgcgtc

SEQ ID NO: 432422 - DNA, 20 bp, mouse
gccgctgcgctctccctcgg

SEQ ID NO: 432423 - DNA, 20 bp, mouse
gaggcagcagagggtgaacg

SEQ ID NO: 432424 - DNA, 20 bp, mouse
ggcgctctccctcggaggat

SEQ ID NO: 432425 - DNA, 20 bp, mouse
gagcagagggtgaacgagga

SEQ ID NO: 432426 - DNA, 20 bp, mouse
ggagttccttgaggatggag

SEQ ID NO: 432427 - DNA, 20 bp, mouse
gagcctggggagacccagac

SEQ ID NO: 432428 - DNA, 20 bp, mouse
ggggttgagttccttgagga

SEQ ID NO: 432429 - DNA, 20 bp, mouse
ggactgggttgagttccttg

SEQ ID NO: 432430 - DNA, 20 bp, mouse
gtccagtggtagactctgac

SEQ ID NO: 432431 - DNA, 20 bp, mouse
gtgtcagggcaagggatgga

SEQ ID NO: 432432 - DNA, 20 bp, mouse
gacctgtcagagtctaccac

SEQ ID NO: 432433 - DNA, 20 bp, mouse
gcaatacctctccatcctca

SEQ ID NO: 432434 - DNA, 20 bp, mouse
gtaaggcacagtatatgtca

SEQ ID NO: 432435 - DNA, 20 bp, mouse
gaaggaagaagggatagtta

SEQ ID NO: 432436 - DNA, 20 bp, mouse
gagcgagtgagcagacccac

SEQ ID NO: 432437 - DNA, 20 bp, mouse
gctgtctgtggggagagtgg

SEQ ID NO: 432438 - DNA, 20 bp, mouse
gtgtaagcggcgcacactcc

SEQ ID NO: 432439 - DNA, 20 bp, mouse
gcttacacgaggcagaatgt

SEQ ID NO: 432440 - DNA, 20 bp, mouse
gcgcgtgcctcgggcagcag

SEQ ID NO: 432441 - DNA, 20 bp, mouse
ggtatagacagaaacgagtt

SEQ ID NO: 432442 - DNA, 20 bp, mouse
gactttgagaagagatccca

SEQ ID NO: 432443 - DNA, 20 bp, mouse
gagtgtgcgccgcttacacg

SEQ ID NO: 432444 - DNA, 20 bp, mouse
gtacatctagagccactatt

SEQ ID NO: 432445 - DNA, 20 bp, mouse
gtcatgtgaagaaagcccaa

SEQ ID NO: 432446 - DNA, 20 bp, mouse
gtctagctccagcccaaccg

SEQ ID NO: 432447 - DNA, 20 bp, mouse
gcaagtccggccaggaacct

SEQ ID NO: 432448 - DNA, 20 bp, mouse
gggccgcaacgtacctggag

SEQ ID NO: 432449 - DNA, 20 bp, mouse
ggacaaaatgacccgcggtt

SEQ ID NO: 432450 - DNA, 20 bp, mouse
gccccagacaaaatgacccg

SEQ ID NO: 432451 - DNA, 20 bp, mouse
ggccaggtaactcccaagtc

SEQ ID NO: 432452 - DNA, 20 bp, mouse
gcctacggccggcttcatgg

SEQ ID NO: 432453 - DNA, 20 bp, mouse
gggagccggaagcgtcaggg

SEQ ID NO: 432454 - DNA, 20 bp, mouse
gtaccgcaggtgaaccgatg

SEQ ID NO: 432455 - DNA, 20 bp, mouse
ggaggcagaacgacccggtg

SEQ ID NO: 432456 - DNA, 20 bp, mouse
gcgccgccggctccaggtca

SEQ ID NO: 432457 - DNA, 20 bp, mouse
gaacctcggcgacctaacca

SEQ ID NO: 432458 - DNA, 20 bp, mouse
ggggtgagtacacctaacct

SEQ ID NO: 432459 - DNA, 20 bp, mouse
gctcggcgacctaaccacgg

SEQ ID NO: 432460 - DNA, 20 bp, mouse
gcgccctgacctggagccgg

SEQ ID NO: 432461 - DNA, 20 bp, mouse
gcgggaccgcaggagcgaca

SEQ ID NO: 432462 - DNA, 20 bp, mouse
ggggcgagggctgcaggcag

SEQ ID NO: 432463 - DNA, 20 bp, mouse
gcggaggtaccgccgtggtt

SEQ ID NO: 432464 - DNA, 20 bp, mouse
gccaggtcagggcgagcgag

SEQ ID NO: 432465 - DNA, 20 bp, mouse
gcgcaggagcgacacggcag

SEQ ID NO: 432466 - DNA, 20 bp, mouse
gaagatgtcggaagattcag

SEQ ID NO: 432467 - DNA, 20 bp, mouse
gtctcgccgccggctcctac

SEQ ID NO: 432468 - DNA, 20 bp, mouse
gatctttgcttgctgagagg

SEQ ID NO: 432469 - DNA, 20 bp, mouse
ggccagccaactctccggag

SEQ ID NO: 432470 - DNA, 20 bp, mouse
gcggctcctgtaggagccgg

SEQ ID NO: 432471 - DNA, 20 bp, mouse
gccggaacggaggaacctcc

SEQ ID NO: 432472 - DNA, 20 bp, mouse
gtgctcacggaggcgcgtca

SEQ ID NO: 432473 - DNA, 20 bp, mouse
gaacatccgttagtgggcgg

SEQ ID NO: 432474 - DNA, 20 bp, mouse
ggacctgaggtgtgtgacgt

SEQ ID NO: 432475 - DNA, 20 bp, mouse
gctgctgtttctaggagtgg

SEQ ID NO: 432476 - DNA, 20 bp, mouse
gcggatgaaaacaaacacta

SEQ ID NO: 432477 - DNA, 20 bp, mouse
gaaacaaacactaaggatgg

SEQ ID NO: 432478 - DNA, 20 bp, mouse
gttcagtgcaggcggtgggg

SEQ ID NO: 432479 - DNA, 20 bp, mouse
gagggttccgcgctcccggg

SEQ ID NO: 432480 - DNA, 20 bp, mouse
ggtggggaggtagagcgcta

SEQ ID NO: 432481 - DNA, 20 bp, mouse
ggtgagtacctgcgaagcta

SEQ ID NO: 432482 - DNA, 20 bp, mouse
gctggttgctggcttagggc

SEQ ID NO: 432483 - DNA, 20 bp, mouse
ggaagctacggcacagagag

SEQ ID NO: 432484 - DNA, 20 bp, mouse
gcgggcggtagtgacagcac

SEQ ID NO: 432485 - DNA, 20 bp, mouse
gcgcttcagtgcaggcggtg

SEQ ID NO: 432486 - DNA, 20 bp, mouse
gtcccagtgggaagggatct

SEQ ID NO: 432487 - DNA, 20 bp, mouse
ggccgcgaccgggagaggta

SEQ ID NO: 432488 - DNA, 20 bp, mouse
gcatcatggcgtctcccagt

SEQ ID NO: 432489 - DNA, 20 bp, mouse
ggcgcccgcggcccaaaacc

SEQ ID NO: 432490 - DNA, 20 bp, mouse
gtggcgtctcccagtgggaa

SEQ ID NO: 432491 - DNA, 20 bp, mouse
ggcccaaaaccaggagcctc

SEQ ID NO: 432492 - DNA, 20 bp, mouse
ggtccaagatcccttcccac

SEQ ID NO: 432493 - DNA, 20 bp, mouse
gaagggatcttggacgcccg

SEQ ID NO: 432494 - DNA, 20 bp, mouse
gagctcagggccagtcacgt

SEQ ID NO: 432495 - DNA, 20 bp, mouse
ggcgctagcacgggacctgg

SEQ ID NO: 432496 - DNA, 20 bp, mouse
ggatccgtgccgacactggg

SEQ ID NO: 432497 - DNA, 20 bp, mouse
ggcctccgggtgccctgtgt

SEQ ID NO: 432498 - DNA, 20 bp, mouse
gtcccacacagggcacccgg

SEQ ID NO: 432499 - DNA, 20 bp, mouse
ggccgccagcgaacagaagc

SEQ ID NO: 432500 - DNA, 20 bp, mouse
gctgccccggcgcctcaggg

SEQ ID NO: 432501 - DNA, 20 bp, mouse
gtgggaaggtgaggttccgg

SEQ ID NO: 432502 - DNA, 20 bp, mouse
ggcgccgggaccgactgcag

SEQ ID NO: 432503 - DNA, 20 bp, mouse
gtcacatcgcggaggaactg

SEQ ID NO: 432504 - DNA, 20 bp, mouse
ggggcacccggaggcgatcc

SEQ ID NO: 432505 - DNA, 20 bp, mouse
ggtgtgggaaggtgaggttc

SEQ ID NO: 432506 - DNA, 20 bp, mouse
ggggcgcgcagggatcgcag

SEQ ID NO: 432507 - DNA, 20 bp, mouse
gatggccgccgagtccctag

SEQ ID NO: 432508 - DNA, 20 bp, mouse
gatgtggcgcttccagacag

SEQ ID NO: 432509 - DNA, 20 bp, mouse
ggcggccgctagggactcgg

SEQ ID NO: 432510 - DNA, 20 bp, mouse
gcggcggccatggcaggacc

SEQ ID NO: 432511 - DNA, 20 bp, mouse
gctggaagcgccacatcgtg

SEQ ID NO: 432512 - DNA, 20 bp, mouse
gtgtctaggatgctcaaggg

SEQ ID NO: 432513 - DNA, 20 bp, mouse
gtgcgcggccgctagggact

SEQ ID NO: 432514 - DNA, 20 bp, mouse
gtggcgcttccagacagcgg

SEQ ID NO: 432515 - DNA, 20 bp, mouse
ggagctttgcgcggccgcta

SEQ ID NO: 432516 - DNA, 20 bp, mouse
gggcctggcgctgagagaag

SEQ ID NO: 432517 - DNA, 20 bp, mouse
gaagcggcggggcgaaccgg

SEQ ID NO: 432518 - DNA, 20 bp, mouse
gacagccggcgatctcggtc

SEQ ID NO: 432519 - DNA, 20 bp, mouse
gggctgtcggccagcggaag

SEQ ID NO: 432520 - DNA, 20 bp, mouse
gacagccggaccgagatcgc

SEQ ID NO: 432521 - DNA, 20 bp, mouse
gtcagcctggatctgtacaa

SEQ ID NO: 432522 - DNA, 20 bp, mouse
ggtagtgctgtagcaagtag

SEQ ID NO: 432523 - DNA, 20 bp, mouse
gatcgccggctgtcggccag

SEQ ID NO: 432524 - DNA, 20 bp, mouse
gggtccccgagatgtcacga

SEQ ID NO: 432525 - DNA, 20 bp, mouse
gggccgacagccggcgatct

SEQ ID NO: 432526 - DNA, 20 bp, mouse
ggagtacgtgccgggagtct

SEQ ID NO: 432527 - DNA, 20 bp, mouse
ggcgagacaagactccgacg

SEQ ID NO: 432528 - DNA, 20 bp, mouse
ggccaggagcgtgtctcagg

SEQ ID NO: 432529 - DNA, 20 bp, mouse
gcccgcctgagacacgctcc

SEQ ID NO: 432530 - DNA, 20 bp, mouse
gtccgtcggtagggagacag

SEQ ID NO: 432531 - DNA, 20 bp, mouse
gcgcgccaggagcgtgtctc

SEQ ID NO: 432532 - DNA, 20 bp, mouse
gtcggcgccgccgtccctca

SEQ ID NO: 432533 - DNA, 20 bp, mouse
gatggggttgccctgaggga

SEQ ID NO: 432534 - DNA, 20 bp, mouse
ggggttgccctgagggacgg

SEQ ID NO: 432535 - DNA, 20 bp, mouse
gtgagcctggatctgtacca

SEQ ID NO: 432536 - DNA, 20 bp, mouse
ggaggaaggggaagccggaa

SEQ ID NO: 432537 - DNA, 20 bp, mouse
gagtcacgtgaggccttagg

SEQ ID NO: 432538 - DNA, 20 bp, mouse
gcacgtgaggccttaggtgg

SEQ ID NO: 432539 - DNA, 20 bp, mouse
gctggcatcgaacctcgcag

SEQ ID NO: 432540 - DNA, 20 bp, mouse
gaccgggacttgggcaacca

SEQ ID NO: 432541 - DNA, 20 bp, mouse
gggtgttcagtggagctccg

SEQ ID NO: 432542 - DNA, 20 bp, mouse
gtggggctggagcagcgata

SEQ ID NO: 432543 - DNA, 20 bp, mouse
gctagccgtgcactccaagg

SEQ ID NO: 432544 - DNA, 20 bp, mouse
ggtcgcaatccgggccacag

SEQ ID NO: 432545 - DNA, 20 bp, mouse
gctccactgaacaccccttc

SEQ ID NO: 432546 - DNA, 20 bp, mouse
gtccaccggcaacttgacta

SEQ ID NO: 432547 - DNA, 20 bp, mouse
gtggagtcaggtaatgggag

SEQ ID NO: 432548 - DNA, 20 bp, mouse
gctgcaagtgagggccccga

SEQ ID NO: 432549 - DNA, 20 bp, mouse
gcccgagggacaagatctgt

SEQ ID NO: 432550 - DNA, 20 bp, mouse
gtgtgtgaaaaagctagggt

SEQ ID NO: 432551 - DNA, 20 bp, mouse
gggagggtagctacagtcaa

SEQ ID NO: 432552 - DNA, 20 bp, mouse
gccggagtggcatcagagta

SEQ ID NO: 432553 - DNA, 20 bp, mouse
gcttgcagtggcaggcggaa

SEQ ID NO: 432554 - DNA, 20 bp, mouse
gcgcctgccactgcaagtga

SEQ ID NO: 432555 - DNA, 20 bp, mouse
gagggtgggtggtctttggt

SEQ ID NO: 432556 - DNA, 20 bp, mouse
ggtcagtcggcagccggaca

SEQ ID NO: 432557 - DNA, 20 bp, mouse
gcagtagtccgtcggagcga

SEQ ID NO: 432558 - DNA, 20 bp, mouse
ggagcgacggcacggtcagt

SEQ ID NO: 432559 - DNA, 20 bp, mouse
ggtgtcgcgcagtagtccgt

SEQ ID NO: 432560 - DNA, 20 bp, mouse
gacacggcgacgggaagccg

SEQ ID NO: 432561 - DNA, 20 bp, mouse
gagatggacgcaggtaagga

SEQ ID NO: 432562 - DNA, 20 bp, mouse
gaggccgaggcgctgacgag

SEQ ID NO: 432563 - DNA, 20 bp, mouse
ggtccgtcggagcgacggca

SEQ ID NO: 432564 - DNA, 20 bp, mouse
ggaccgtgccgtcgctccga

SEQ ID NO: 432565 - DNA, 20 bp, mouse
gcgggagcccgcccgcgaca

SEQ ID NO: 432566 - DNA, 20 bp, mouse
ggcgtacgcgctgttcggag

SEQ ID NO: 432567 - DNA, 20 bp, mouse
ggaggaagcagaatcgagag

SEQ ID NO: 432568 - DNA, 20 bp, mouse
gtggtgtggggactcctgcg

SEQ ID NO: 432569 - DNA, 20 bp, mouse
ggccgacgcgcgtctggtgt

SEQ ID NO: 432570 - DNA, 20 bp, mouse
gccccacaccagacgcgcgt

SEQ ID NO: 432571 - DNA, 20 bp, mouse
gggccacgggtctgcaccaa

SEQ ID NO: 432572 - DNA, 20 bp, mouse
ggagcttagggtctccgaca

SEQ ID NO: 432573 - DNA, 20 bp, mouse
ggacccgtggccaaccgtct

SEQ ID NO: 432574 - DNA, 20 bp, mouse
ggccgacccctcggcgacac

SEQ ID NO: 432575 - DNA, 20 bp, mouse
gcagcctcgagccgacccct

SEQ ID NO: 432576 - DNA, 20 bp, mouse
gctggccgcagcggataccc

SEQ ID NO: 432577 - DNA, 20 bp, mouse
gggagcccgggtatccgctg

SEQ ID NO: 432578 - DNA, 20 bp, mouse
gtactcagagccgggctccc

SEQ ID NO: 432579 - DNA, 20 bp, mouse
gggtccggctctggccgcag

SEQ ID NO: 432580 - DNA, 20 bp, mouse
gtaccgcagcgggagctcgg

SEQ ID NO: 432581 - DNA, 20 bp, mouse
gtatccgctgcggccagagc

SEQ ID NO: 432582 - DNA, 20 bp, mouse
gcagagcacccggatacggt

SEQ ID NO: 432583 - DNA, 20 bp, mouse
gggcccagagcacccggata

SEQ ID NO: 432584 - DNA, 20 bp, mouse
gagagccgggctcccgggtc

SEQ ID NO: 432585 - DNA, 20 bp, mouse
ggaccccgccgagcccgacg

SEQ ID NO: 432586 - DNA, 20 bp, mouse
ggcgcgaaagccgctcggtc

SEQ ID NO: 432587 - DNA, 20 bp, mouse
gcagacagaacccgaccgag

SEQ ID NO: 432588 - DNA, 20 bp, mouse
gagagccggcacctcgggta

SEQ ID NO: 432589 - DNA, 20 bp, mouse
gtcccgggcgtggaagtgtg

SEQ ID NO: 432590 - DNA, 20 bp, mouse
gggacagctagactgcccaa

SEQ ID NO: 432591 - DNA, 20 bp, mouse
gggagcagagccggcacctc

SEQ ID NO: 432592 - DNA, 20 bp, mouse
gccgagggtgactggaccta

SEQ ID NO: 432593 - DNA, 20 bp, mouse
ggcacccggagggatggcgg

SEQ ID NO: 432594 - DNA, 20 bp, mouse
gcaaccccacctccgcccag

SEQ ID NO: 432595 - DNA, 20 bp, mouse
gagcgccgggcgcccaccgt

SEQ ID NO: 432596 - DNA, 20 bp, mouse
gggcagctgctccgcaacca

SEQ ID NO: 432597 - DNA, 20 bp, mouse
ggtggttgccggaagttgag

SEQ ID NO: 432598 - DNA, 20 bp, mouse
ggggctggcggggttcactt

SEQ ID NO: 432599 - DNA, 20 bp, mouse
gagcggcggtaagtaagccg

SEQ ID NO: 432600 - DNA, 20 bp, mouse
ggccggtccacacacgccaa

SEQ ID NO: 432601 - DNA, 20 bp, mouse
gggtaagtaagccgtggttg

SEQ ID NO: 432602 - DNA, 20 bp, mouse
ggaggggaccgagtatagac

SEQ ID NO: 432603 - DNA, 20 bp, mouse
gtcacagaatgagcaaccag

SEQ ID NO: 432604 - DNA, 20 bp, mouse
gttccagaccagcccaaaac

SEQ ID NO: 432605 - DNA, 20 bp, mouse
gctctctgccggagtacgag

SEQ ID NO: 432606 - DNA, 20 bp, mouse
gcgcaggaaccgggatccag

SEQ ID NO: 432607 - DNA, 20 bp, mouse
gacggagggcctagagctcc

SEQ ID NO: 432608 - DNA, 20 bp, mouse
gacagtgaatgacagacgga

SEQ ID NO: 432609 - DNA, 20 bp, mouse
gtccaggggattccagaagc

SEQ ID NO: 432610 - DNA, 20 bp, mouse
gggtgacagtgaatgacaga

SEQ ID NO: 432611 - DNA, 20 bp, mouse
gctgccagacccggagctct

SEQ ID NO: 432612 - DNA, 20 bp, mouse
gcgcgtgtcaccgcaggaac

SEQ ID NO: 432613 - DNA, 20 bp, mouse
gcagcctcgcgtgtcaccgc

SEQ ID NO: 432614 - DNA, 20 bp, mouse
gagcttgtaatgcgtaacgg

SEQ ID NO: 432615 - DNA, 20 bp, mouse
gccctgtgctcaggtctagg

SEQ ID NO: 432616 - DNA, 20 bp, mouse
gcttctcttgagaggttgaa

SEQ ID NO: 432617 - DNA, 20 bp, mouse
gggccgcagcttctcttgag

SEQ ID NO: 432618 - DNA, 20 bp, mouse
gctccatgccggggaactgg

SEQ ID NO: 432619 - DNA, 20 bp, mouse
gaagagaagctgcggcctga

SEQ ID NO: 432620 - DNA, 20 bp, mouse
ggccggagggaacactgaag

SEQ ID NO: 432621 - DNA, 20 bp, mouse
gcctgatggtgagacgaacg

SEQ ID NO: 432622 - DNA, 20 bp, mouse
gatggtgagacgaacggggt

SEQ ID NO: 432623 - DNA, 20 bp, mouse
ggagtgggacccccacgagg

SEQ ID NO: 432624 - DNA, 20 bp, mouse
ggggagaccctgaggccgga

SEQ ID NO: 432625 - DNA, 20 bp, mouse
gccctgcctggtgattcagg

SEQ ID NO: 432626 - DNA, 20 bp, mouse
gtccccgcactgagtggaga

SEQ ID NO: 432627 - DNA, 20 bp, mouse
gcccggatccccgcactgag

SEQ ID NO: 432628 - DNA, 20 bp, mouse
gcgggtgtaagaaggctctg

SEQ ID NO: 432629 - DNA, 20 bp, mouse
gcggggatccgggtgtaaga

SEQ ID NO: 432630 - DNA, 20 bp, mouse
gttcttcttcctaccgccag

SEQ ID NO: 432631 - DNA, 20 bp, mouse
ggccctctccactcagtgcg

SEQ ID NO: 432632 - DNA, 20 bp, mouse
gaggaagcccgtgtaggggt

SEQ ID NO: 432633 - DNA, 20 bp, mouse
gggaaagaggaagcccgtgt

SEQ ID NO: 432634 - DNA, 20 bp, mouse
gtggggtggggccgcaactg

SEQ ID NO: 432635 - DNA, 20 bp, mouse
gggccctaaatcctcaggga

SEQ ID NO: 432636 - DNA, 20 bp, mouse
ggggtcgcggagtcaaggga

SEQ ID NO: 432637 - DNA, 20 bp, mouse
gcgttgggtcgcggagtcaa

SEQ ID NO: 432638 - DNA, 20 bp, mouse
ggcggagtcaagggacggac

SEQ ID NO: 432639 - DNA, 20 bp, mouse
ggggcctcaccaagctgaga

SEQ ID NO: 432640 - DNA, 20 bp, mouse
gtctcccggggaggactcct

SEQ ID NO: 432641 - DNA, 20 bp, mouse
ggcaggcaggccggaccccg

SEQ ID NO: 432642 - DNA, 20 bp, mouse
gacggacaggccacgtgcgt

SEQ ID NO: 432643 - DNA, 20 bp, mouse
gctggcaccgagatctcccg

SEQ ID NO: 432644 - DNA, 20 bp, mouse
ggacggagccatgctgcgtt

SEQ ID NO: 432645 - DNA, 20 bp, mouse
ggccatgctgcgttgggtcg

SEQ ID NO: 432646 - DNA, 20 bp, mouse
gccagtggccggcggactag

SEQ ID NO: 432647 - DNA, 20 bp, mouse
gccggcggactagaggagga

SEQ ID NO: 432648 - DNA, 20 bp, mouse
ggtggccggcggactagagg

SEQ ID NO: 432649 - DNA, 20 bp, mouse
ggcagaaggcagcgctccgg

SEQ ID NO: 432650 - DNA, 20 bp, mouse
ggaagcagaaggcagcgctc

SEQ ID NO: 432651 - DNA, 20 bp, mouse
gggattcgcccagtggccgg

SEQ ID NO: 432652 - DNA, 20 bp, mouse
gaggaggagggtctgtccgc

SEQ ID NO: 432653 - DNA, 20 bp, mouse
gccaggattcgcccagtggc

SEQ ID NO: 432654 - DNA, 20 bp, mouse
gtggctctgggaaaccctgg

SEQ ID NO: 432655 - DNA, 20 bp, mouse
gcgtctgacccgcccagcct

SEQ ID NO: 432656 - DNA, 20 bp, mouse
gtcggtacaagatggcggag

SEQ ID NO: 432657 - DNA, 20 bp, mouse
gaagatggcggagggggacg

SEQ ID NO: 432658 - DNA, 20 bp, mouse
ggaaggcagcagccgcagca

SEQ ID NO: 432659 - DNA, 20 bp, mouse
gttaaatcggtacaagatgg

SEQ ID NO: 432660 - DNA, 20 bp, mouse
gccgcggtcttcgaccccag

SEQ ID NO: 432661 - DNA, 20 bp, mouse
gccctaggtacgggccggag

SEQ ID NO: 432662 - DNA, 20 bp, mouse
ggctcgctcgcagggcctag

SEQ ID NO: 432663 - DNA, 20 bp, mouse
gcgagtcgctggtctgtcgc

SEQ ID NO: 432664 - DNA, 20 bp, mouse
gagaccagcgactcgagcgt

SEQ ID NO: 432665 - DNA, 20 bp, mouse
gcggtgcccgccagcccgaa

SEQ ID NO: 432666 - DNA, 20 bp, mouse
gtccgagccgagacacccgg

SEQ ID NO: 432667 - DNA, 20 bp, mouse
gctacttctgctgaaggagg

SEQ ID NO: 432668 - DNA, 20 bp, mouse
ggttcgctgaggggacaaca

SEQ ID NO: 432669 - DNA, 20 bp, mouse
gctgcagcggtggcatcgag

SEQ ID NO: 432670 - DNA, 20 bp, mouse
gtcggagccgaagcactggg

SEQ ID NO: 432671 - DNA, 20 bp, mouse
gcctcagcgaactgcagcgg

SEQ ID NO: 432672 - DNA, 20 bp, mouse
gtgccctggaggagggaaac

SEQ ID NO: 432673 - DNA, 20 bp, mouse
gagaagacaggagcgggttg

SEQ ID NO: 432674 - DNA, 20 bp, mouse
gtcccctcagcgaactgcag

SEQ ID NO: 432675 - DNA, 20 bp, mouse
gaagcactgggaggcagcgt

SEQ ID NO: 432676 - DNA, 20 bp, mouse
gtatagagccggaagcggga

SEQ ID NO: 432677 - DNA, 20 bp, mouse
gtaaggcacgggtgccccaa

SEQ ID NO: 432678 - DNA, 20 bp, mouse
ggatccgtgcacgcgggaaa

SEQ ID NO: 432679 - DNA, 20 bp, mouse
gaatgcagcggtaggagcga

SEQ ID NO: 432680 - DNA, 20 bp, mouse
gtgcctgccaatgcaaaccc

SEQ ID NO: 432681 - DNA, 20 bp, mouse
gaagcgacctgggtttgcat

SEQ ID NO: 432682 - DNA, 20 bp, mouse
gggaaaaggcgaagcgacct

SEQ ID NO: 432683 - DNA, 20 bp, mouse
gtgctttatagagccggaag

SEQ ID NO: 432684 - DNA, 20 bp, mouse
ggtgccccaaaggaagaagt

SEQ ID NO: 432685 - DNA, 20 bp, mouse
gtttaggctcactccatcta

SEQ ID NO: 432686 - DNA, 20 bp, mouse
gggccgtgcgggagccatgg

SEQ ID NO: 432687 - DNA, 20 bp, mouse
gggcgtggccgggacacccg

SEQ ID NO: 432688 - DNA, 20 bp, mouse
gctccacgggctagaggcgg

SEQ ID NO: 432689 - DNA, 20 bp, mouse
ggggacagctcgctcacagt

SEQ ID NO: 432690 - DNA, 20 bp, mouse
gggcctccacgggctagagg

SEQ ID NO: 432691 - DNA, 20 bp, mouse
gggcggccgtgcgggagcca

SEQ ID NO: 432692 - DNA, 20 bp, mouse
ggcggcggcggccgattctg

SEQ ID NO: 432693 - DNA, 20 bp, mouse
ggcgggagccatggcggcca

SEQ ID NO: 432694 - DNA, 20 bp, mouse
gcgactcgggcggcctccac

SEQ ID NO: 432695 - DNA, 20 bp, mouse
ggtcggctggatcagctccc

SEQ ID NO: 432696 - DNA, 20 bp, mouse
gctggcccgaggccccggtc

SEQ ID NO: 432697 - DNA, 20 bp, mouse
ggcagccccgcgcccgaccg

SEQ ID NO: 432698 - DNA, 20 bp, mouse
ggcgggcggacggacaggct

SEQ ID NO: 432699 - DNA, 20 bp, mouse
ggccaggacgcgtttcgggg

SEQ ID NO: 432700 - DNA, 20 bp, mouse
ggaagccgcgctgtaaggag

SEQ ID NO: 432701 - DNA, 20 bp, mouse
ggagcgcgagaagccgatcg

SEQ ID NO: 432702 - DNA, 20 bp, mouse
gactcgcacaggaaagcgga

SEQ ID NO: 432703 - DNA, 20 bp, mouse
gcgcgtccggcgactcgcac

SEQ ID NO: 432704 - DNA, 20 bp, mouse
gacctgcgagcagctcggga

SEQ ID NO: 432705 - DNA, 20 bp, mouse
gcggcgcgttccgggcggga

SEQ ID NO: 432706 - DNA, 20 bp, mouse
ggcgatctccgagtgagagg

SEQ ID NO: 432707 - DNA, 20 bp, mouse
gctgctgcatgcagaagagt

SEQ ID NO: 432708 - DNA, 20 bp, mouse
gcaggtggctgtggcgtcag

SEQ ID NO: 432709 - DNA, 20 bp, mouse
gggaggtgccgtgttagagg

SEQ ID NO: 432710 - DNA, 20 bp, mouse
gatctccgagtgagaggggg

SEQ ID NO: 432711 - DNA, 20 bp, mouse
gtcgcactgcaatggctcgg

SEQ ID NO: 432712 - DNA, 20 bp, mouse
ggcgggacatcgcactgcaa

SEQ ID NO: 432713 - DNA, 20 bp, mouse
ggcgtgcaacgaagcttctc

SEQ ID NO: 432714 - DNA, 20 bp, mouse
gtcagcggcgggacgtggtg

SEQ ID NO: 432715 - DNA, 20 bp, mouse
gcttgcagaagagactagga

SEQ ID NO: 432716 - DNA, 20 bp, mouse
gctgcatctgggcaagggaa

SEQ ID NO: 432717 - DNA, 20 bp, mouse
gccagaagctctgctaggtc

SEQ ID NO: 432718 - DNA, 20 bp, mouse
gggtagaccctgagccctat

SEQ ID NO: 432719 - DNA, 20 bp, mouse
gcccagcaggacccaagcta

SEQ ID NO: 432720 - DNA, 20 bp, mouse
ggacagcttgcagtagatgt

SEQ ID NO: 432721 - DNA, 20 bp, mouse
gtcggacagagcgatgaggg

SEQ ID NO: 432722 - DNA, 20 bp, mouse
gtcttgtcctggccccactg

SEQ ID NO: 432723 - DNA, 20 bp, mouse
gcaccccgaaaagcagtctc

SEQ ID NO: 432724 - DNA, 20 bp, mouse
ggcggcagcgtggatgaagt

SEQ ID NO: 432725 - DNA, 20 bp, mouse
gctgctaggtcaggagcgtt

SEQ ID NO: 432726 - DNA, 20 bp, mouse
ggcgtgcagagtgatcgctg

SEQ ID NO: 432727 - DNA, 20 bp, mouse
gcgccgcccgcccggagagg

SEQ ID NO: 432728 - DNA, 20 bp, mouse
gacacagccagggaattccg

SEQ ID NO: 432729 - DNA, 20 bp, mouse
gagagagcgcggcgacaagg

SEQ ID NO: 432730 - DNA, 20 bp, mouse
gcgctgcgggcgcgcgtccc

SEQ ID NO: 432731 - DNA, 20 bp, mouse
ggcggcggtggtgctgactg

SEQ ID NO: 432732 - DNA, 20 bp, mouse
gcagcgccgcccgcccggag

SEQ ID NO: 432733 - DNA, 20 bp, mouse
gtgactgtggcgccgagctc

SEQ ID NO: 432734 - DNA, 20 bp, mouse
gaggagagagcgcggcgaca

SEQ ID NO: 432735 - DNA, 20 bp, mouse
gtcatggcgaggacggcgtg

SEQ ID NO: 432736 - DNA, 20 bp, mouse
gtgactgacgcggcacacac

SEQ ID NO: 432737 - DNA, 20 bp, mouse
gacgcggcacacacgggcag

SEQ ID NO: 432738 - DNA, 20 bp, mouse
gcttaccggcatgactgacg

SEQ ID NO: 432739 - DNA, 20 bp, mouse
ggggtcgaacggccacttac

SEQ ID NO: 432740 - DNA, 20 bp, mouse
gaaactgaggcagggaggta

SEQ ID NO: 432741 - DNA, 20 bp, mouse
ggccctagagagtcttcgag

SEQ ID NO: 432742 - DNA, 20 bp, mouse
ggaagttcccgcgggtcgaa

SEQ ID NO: 432743 - DNA, 20 bp, mouse
gctggagacagaagttcccg

SEQ ID NO: 432744 - DNA, 20 bp, mouse
gccgaagccggaggaccgtg

SEQ ID NO: 432745 - DNA, 20 bp, mouse
ggcctctcgaagactctcta

SEQ ID NO: 432746 - DNA, 20 bp, mouse
gcggcgggcgatgatcacct

SEQ ID NO: 432747 - DNA, 20 bp, mouse
gccgcggggactagtagacc

SEQ ID NO: 432748 - DNA, 20 bp, mouse
gccacgatcggagcccccaa

SEQ ID NO: 432749 - DNA, 20 bp, mouse
gtagacctggaagtctggac

SEQ ID NO: 432750 - DNA, 20 bp, mouse
gcgggcgatgatcacctagg

SEQ ID NO: 432751 - DNA, 20 bp, mouse
gactagtagacctggaagtc

SEQ ID NO: 432752 - DNA, 20 bp, mouse
gcctaggaggctggcgcgag

SEQ ID NO: 432753 - DNA, 20 bp, mouse
ggcagcctgtccagacttcc

SEQ ID NO: 432754 - DNA, 20 bp, mouse
gaggctggcgcgagcggcag

SEQ ID NO: 432755 - DNA, 20 bp, mouse
gcgcgaagaaggcgctggga

SEQ ID NO: 432756 - DNA, 20 bp, mouse
ggccggtctgcaagcagtat

SEQ ID NO: 432757 - DNA, 20 bp, mouse
gtatgggagaactctctgga

SEQ ID NO: 432758 - DNA, 20 bp, mouse
ggaaggagtttgctgagaat

SEQ ID NO: 432759 - DNA, 20 bp, mouse
gagcaggtggaggttcaaac

SEQ ID NO: 432760 - DNA, 20 bp, mouse
gtcccatactgcttgcagac

SEQ ID NO: 432761 - DNA, 20 bp, mouse
gtgtagggccatccttcgaa

SEQ ID NO: 432762 - DNA, 20 bp, mouse
ggcttgagcagaaatgagga

SEQ ID NO: 432763 - DNA, 20 bp, mouse
gccccaaccgccattatcgg

SEQ ID NO: 432764 - DNA, 20 bp, mouse
gcctacattccagcaggtgg

SEQ ID NO: 432765 - DNA, 20 bp, mouse
ggtcaatgcgttccagccag

SEQ ID NO: 432766 - DNA, 20 bp, mouse
gagagccggctccagaggcg

SEQ ID NO: 432767 - DNA, 20 bp, mouse
gtactcccgtcgggccgacg

SEQ ID NO: 432768 - DNA, 20 bp, mouse
ggcccggcgctactcccgtc

SEQ ID NO: 432769 - DNA, 20 bp, mouse
gcgcgcaggcggctcggagg

SEQ ID NO: 432770 - DNA, 20 bp, mouse
gtccgcgcctgctcctcccg

SEQ ID NO: 432771 - DNA, 20 bp, mouse
gcatcgagcgcaggccgcgt

SEQ ID NO: 432772 - DNA, 20 bp, mouse
ggagccgggagcgataacca

SEQ ID NO: 432773 - DNA, 20 bp, mouse
gcaggccgcgtcggcccgac

SEQ ID NO: 432774 - DNA, 20 bp, mouse
gcaggccgtgaccgggcggg

SEQ ID NO: 432775 - DNA, 20 bp, mouse
gggcgcggagcatcgagcgc

SEQ ID NO: 432776 - DNA, 20 bp, mouse
gcaacggtcagagatgaagg

SEQ ID NO: 432777 - DNA, 20 bp, mouse
ggcggtgcttcgggtgacaa

SEQ ID NO: 432778 - DNA, 20 bp, mouse
gtgacaacggtcagagatga

SEQ ID NO: 432779 - DNA, 20 bp, mouse
gtcagagatgaaggtggcgg

SEQ ID NO: 432780 - DNA, 20 bp, mouse
gagccgcgcgggccccgagg

SEQ ID NO: 432781 - DNA, 20 bp, mouse
gccgcgcctgtaggacctcc

SEQ ID NO: 432782 - DNA, 20 bp, mouse
gcgcggctcgcgaccctcag

SEQ ID NO: 432783 - DNA, 20 bp, mouse
gggcagcagctggtaagtga

SEQ ID NO: 432784 - DNA, 20 bp, mouse
gcgcgtccggcgggccacga

SEQ ID NO: 432785 - DNA, 20 bp, mouse
gcggggagtagtgctgcgcc

SEQ ID NO: 432786 - DNA, 20 bp, mouse
ggtgggcccgcggcgcaaag

SEQ ID NO: 432787 - DNA, 20 bp, mouse
gcggcagcgggctggcgaca

SEQ ID NO: 432788 - DNA, 20 bp, mouse
ggggcgcgcagaggcgagga

SEQ ID NO: 432789 - DNA, 20 bp, mouse
gccgtccacaaaacacactg

SEQ ID NO: 432790 - DNA, 20 bp, mouse
gacactgcggcgtgggcccg

SEQ ID NO: 432791 - DNA, 20 bp, mouse
ggccagcgagcgggccaccg

SEQ ID NO: 432792 - DNA, 20 bp, mouse
gagggcaggcggcagcgggc

SEQ ID NO: 432793 - DNA, 20 bp, mouse
gtccccacccaggccacccg

SEQ ID NO: 432794 - DNA, 20 bp, mouse
gagagactgcgaaggagcgg

SEQ ID NO: 432795 - DNA, 20 bp, mouse
gcggggtacgcgtggagccg

SEQ ID NO: 432796 - DNA, 20 bp, mouse
gtgttggcgttacagagaca

SEQ ID NO: 432797 - DNA, 20 bp, mouse
ggtgcgtgctgggtccgggt

SEQ ID NO: 432798 - DNA, 20 bp, mouse
ggcaggtccgggtccctgag

SEQ ID NO: 432799 - DNA, 20 bp, mouse
gcagagacaaggcaccaacc

SEQ ID NO: 432800 - DNA, 20 bp, mouse
ggtggtgacagcgacgatgt

SEQ ID NO: 432801 - DNA, 20 bp, mouse
ggacccagcacgcacctccg

SEQ ID NO: 432802 - DNA, 20 bp, mouse
gctccacctccccaggacag

SEQ ID NO: 432803 - DNA, 20 bp, mouse
gggtgagcccggtaagtatg

SEQ ID NO: 432804 - DNA, 20 bp, mouse
gtgcgtcgccccaggtacgt

SEQ ID NO: 432805 - DNA, 20 bp, mouse
ggccagccgctgtcctgggg

SEQ ID NO: 432806 - DNA, 20 bp, mouse
ggcaatcgcgacccaggctg

SEQ ID NO: 432807 - DNA, 20 bp, mouse
gagcgcagcgctgggaaaga

SEQ ID NO: 432808 - DNA, 20 bp, mouse
gtgggaaagatggcggtggt

SEQ ID NO: 432809 - DNA, 20 bp, mouse
gcgccaggccgggctccgca

SEQ ID NO: 432810 - DNA, 20 bp, mouse
gtgggcaacgcggttccttg

SEQ ID NO: 432811 - DNA, 20 bp, mouse
ggcgtgcgcgaggcagatgg

SEQ ID NO: 432812 - DNA, 20 bp, mouse
gctggcggggcccgggacaa

SEQ ID NO: 432813 - DNA, 20 bp, mouse
gggcaaacggcagcacggtg

SEQ ID NO: 432814 - DNA, 20 bp, mouse
gttccttgcggagcccggcc

SEQ ID NO: 432815 - DNA, 20 bp, mouse
ggcctgagccataggacagg

SEQ ID NO: 432816 - DNA, 20 bp, mouse
gcagcacctgcaagacgcga

SEQ ID NO: 432817 - DNA, 20 bp, mouse
ggcttgacggccgcagactg

SEQ ID NO: 432818 - DNA, 20 bp, mouse
gtccgcggaggggccgggct

SEQ ID NO: 432819 - DNA, 20 bp, mouse
gctcggcgtgcgaggccccg

SEQ ID NO: 432820 - DNA, 20 bp, mouse
gcggttgcggcgatccgcgg

SEQ ID NO: 432821 - DNA, 20 bp, mouse
ggccccggggcacggtcggg

SEQ ID NO: 432822 - DNA, 20 bp, mouse
ggaggccccggggcacggtc

SEQ ID NO: 432823 - DNA, 20 bp, mouse
gggacgcaggcgccgtggag

SEQ ID NO: 432824 - DNA, 20 bp, mouse
ggtgctgcacagaggaccca

SEQ ID NO: 432825 - DNA, 20 bp, mouse
gcctggggatgagacccgaa

SEQ ID NO: 432826 - DNA, 20 bp, mouse
gggagggccggcgggcacac

SEQ ID NO: 432827 - DNA, 20 bp, mouse
gccgggcagggcgagaacaa

SEQ ID NO: 432828 - DNA, 20 bp, mouse
ggtcacgctgcggggagggc

SEQ ID NO: 432829 - DNA, 20 bp, mouse
gacggcgcccggtcacgctg

SEQ ID NO: 432830 - DNA, 20 bp, mouse
gccgccccgggcgccgacag

SEQ ID NO: 432831 - DNA, 20 bp, mouse
ggcccggtcacgctgcgggg

SEQ ID NO: 432832 - DNA, 20 bp, mouse
ggactcccgcgccggatgtg

SEQ ID NO: 432833 - DNA, 20 bp, mouse
ggcgggagtcctgagctcgc

SEQ ID NO: 432834 - DNA, 20 bp, mouse
ggaagcggaccccctccccg

SEQ ID NO: 432835 - DNA, 20 bp, mouse
gggagcgcggcgcggaagac

SEQ ID NO: 432836 - DNA, 20 bp, mouse
gctgtaatagctgctaagta

SEQ ID NO: 432837 - DNA, 20 bp, mouse
gagctattacaggctcgtag

SEQ ID NO: 432838 - DNA, 20 bp, mouse
gagagtggcagaggaatcat

SEQ ID NO: 432839 - DNA, 20 bp, mouse
gttggcacagaggatatgag

SEQ ID NO: 432840 - DNA, 20 bp, mouse
gatgagtgtcgagagagaat

SEQ ID NO: 432841 - DNA, 20 bp, mouse
gctggcctggcccattcaga

SEQ ID NO: 432842 - DNA, 20 bp, mouse
ggagagaatcggagagtgat

SEQ ID NO: 432843 - DNA, 20 bp, mouse
ggaatcatgggataggaggt

SEQ ID NO: 432844 - DNA, 20 bp, mouse
gtactcaggacaacatccta

SEQ ID NO: 432845 - DNA, 20 bp, mouse
gcctctgtgccaagcaagac

SEQ ID NO: 432846 - DNA, 20 bp, mouse
gctggagtgggtcctgaaag

SEQ ID NO: 432847 - DNA, 20 bp, mouse
gagcggtccggaggcgtctc

SEQ ID NO: 432848 - DNA, 20 bp, mouse
gtgtgtgcgaagctagggaa

SEQ ID NO: 432849 - DNA, 20 bp, mouse
ggagtggagcgtgtttccat

SEQ ID NO: 432850 - DNA, 20 bp, mouse
gttctcaaggtggtcaccca

SEQ ID NO: 432851 - DNA, 20 bp, mouse
gcccactccagagacgcctc

SEQ ID NO: 432852 - DNA, 20 bp, mouse
gactctttcatccagcggtc

SEQ ID NO: 432853 - DNA, 20 bp, mouse
ggaaggggacgagaatgaga

SEQ ID NO: 432854 - DNA, 20 bp, mouse
gcttgtgtgcagccgctttc

SEQ ID NO: 432855 - DNA, 20 bp, mouse
gagaggaacacagagttgtc

SEQ ID NO: 432856 - DNA, 20 bp, mouse
gagtagtgcctgaatcacag

SEQ ID NO: 432857 - DNA, 20 bp, mouse
gcattaagagcagcgtgtgt

SEQ ID NO: 432858 - DNA, 20 bp, mouse
gcaggctgtgctcaatgaag

SEQ ID NO: 432859 - DNA, 20 bp, mouse
gtacaggaaagccgagactg

SEQ ID NO: 432860 - DNA, 20 bp, mouse
gttgacattccctcacacag

SEQ ID NO: 432861 - DNA, 20 bp, mouse
ggttctggtgacatcagcgg

SEQ ID NO: 432862 - DNA, 20 bp, mouse
gctttctgaccactgtgtga

SEQ ID NO: 432863 - DNA, 20 bp, mouse
ggctgtgctcaatgaagggg

SEQ ID NO: 432864 - DNA, 20 bp, mouse
ggaccaccccctgaccacta

SEQ ID NO: 432865 - DNA, 20 bp, mouse
gagcaagaaggatggccacc

SEQ ID NO: 432866 - DNA, 20 bp, mouse
gggaggcggacacgtggcag

SEQ ID NO: 432867 - DNA, 20 bp, mouse
ggaggcacgggctcgagctg

SEQ ID NO: 432868 - DNA, 20 bp, mouse
gagccgagaggcgggaacta

SEQ ID NO: 432869 - DNA, 20 bp, mouse
gacgggctcgagctgcggct

SEQ ID NO: 432870 - DNA, 20 bp, mouse
gccgggaggaggagcacccg

SEQ ID NO: 432871 - DNA, 20 bp, mouse
gcgggctctcggcaatggag

SEQ ID NO: 432872 - DNA, 20 bp, mouse
gccctgtcggagctccccgg

SEQ ID NO: 432873 - DNA, 20 bp, mouse
gctcacccccttccccatgg

SEQ ID NO: 432874 - DNA, 20 bp, mouse
gcgcggtgaaggcgaccaga

SEQ ID NO: 432875 - DNA, 20 bp, mouse
gacactcacccccttcccca

SEQ ID NO: 432876 - DNA, 20 bp, mouse
gagaccacaccgcctgtctg

SEQ ID NO: 432877 - DNA, 20 bp, mouse
gctgccccagacaggcggtg

SEQ ID NO: 432878 - DNA, 20 bp, mouse
gtggctgaggggacctaggc

SEQ ID NO: 432879 - DNA, 20 bp, mouse
ggagatctagaaggacactt

SEQ ID NO: 432880 - DNA, 20 bp, mouse
gttgtggagtaaggatgagt

SEQ ID NO: 432881 - DNA, 20 bp, mouse
gcaccccacgacccatcttg

SEQ ID NO: 432882 - DNA, 20 bp, mouse
gcttaggctagttgtgggag

SEQ ID NO: 432883 - DNA, 20 bp, mouse
ggaggggtgagagacgctga

SEQ ID NO: 432884 - DNA, 20 bp, mouse
gagtatccctccaagatcag

SEQ ID NO: 432885 - DNA, 20 bp, mouse
gtcaggggccactctctgga

SEQ ID NO: 432886 - DNA, 20 bp, mouse
gggccgccgcagcctctgtg

SEQ ID NO: 432887 - DNA, 20 bp, mouse
gcgtgggtcccaccgcacag

SEQ ID NO: 432888 - DNA, 20 bp, mouse
gtgagcggtggccgcaggat

SEQ ID NO: 432889 - DNA, 20 bp, mouse
gcggcgttcagactgatgag

SEQ ID NO: 432890 - DNA, 20 bp, mouse
gggtgggagcgtgcgtctgt

SEQ ID NO: 432891 - DNA, 20 bp, mouse
ggcagcgcccgcgccgcggt

SEQ ID NO: 432892 - DNA, 20 bp, mouse
gcgcggagccgccaagatgg

SEQ ID NO: 432893 - DNA, 20 bp, mouse
ggtggccgcaggatgggctc

SEQ ID NO: 432894 - DNA, 20 bp, mouse
ggcaggatgggctcaggcgc

SEQ ID NO: 432895 - DNA, 20 bp, mouse
gcaccgcacagaggctgcgg

SEQ ID NO: 432896 - DNA, 20 bp, mouse
gcagcaggtgggaagtgcag

SEQ ID NO: 432897 - DNA, 20 bp, mouse
gggaagtgcagtgggagccg

SEQ ID NO: 432898 - DNA, 20 bp, mouse
gactggcacaaagggtaccc

SEQ ID NO: 432899 - DNA, 20 bp, mouse
gatagcacccagaggaccca

SEQ ID NO: 432900 - DNA, 20 bp, mouse
gctaaatgatgaagatgcag

SEQ ID NO: 432901 - DNA, 20 bp, mouse
gacccagaggacccagggct

SEQ ID NO: 432902 - DNA, 20 bp, mouse
ggagggctatctataagcat

SEQ ID NO: 432903 - DNA, 20 bp, mouse
ggagcagggactggcacaaa

SEQ ID NO: 432904 - DNA, 20 bp, mouse
gctgtcgccatagcacccag

SEQ ID NO: 432905 - DNA, 20 bp, mouse
ggtctagactctgaatgaga

SEQ ID NO: 432906 - DNA, 20 bp, mouse
gcgcactcggagagccgcag

SEQ ID NO: 432907 - DNA, 20 bp, mouse
gcctctggcgagatggacca

SEQ ID NO: 432908 - DNA, 20 bp, mouse
gagtcaccgggaagggcgag

SEQ ID NO: 432909 - DNA, 20 bp, mouse
gcggccgcgcgcccacctct

SEQ ID NO: 432910 - DNA, 20 bp, mouse
ggcgagatggaccagggaca

SEQ ID NO: 432911 - DNA, 20 bp, mouse
ggacaaggagggaaagtcac

SEQ ID NO: 432912 - DNA, 20 bp, mouse
ggccctgggcgtcctcgcgg

SEQ ID NO: 432913 - DNA, 20 bp, mouse
gcgagccccgcacctagagg

SEQ ID NO: 432914 - DNA, 20 bp, mouse
gaggccaggagccgagaaat

SEQ ID NO: 432915 - DNA, 20 bp, mouse
gggcgagcggagtggagcgc

SEQ ID NO: 432916 - DNA, 20 bp, mouse
ggcccagccagtgggagctg

SEQ ID NO: 432917 - DNA, 20 bp, mouse
gcggggacaagcagttgtgg

SEQ ID NO: 432918 - DNA, 20 bp, mouse
gaggagcggagcctccgatt

SEQ ID NO: 432919 - DNA, 20 bp, mouse
gataggggccccccaatcgg

SEQ ID NO: 432920 - DNA, 20 bp, mouse
gtccccgcactgctgaggag

SEQ ID NO: 432921 - DNA, 20 bp, mouse
gagcggagcctccgattggg

SEQ ID NO: 432922 - DNA, 20 bp, mouse
gaggataggggccccccaat

SEQ ID NO: 432923 - DNA, 20 bp, mouse
gccacagttggcccagccag

SEQ ID NO: 432924 - DNA, 20 bp, mouse
ggtgggggaaagacaaggat

SEQ ID NO: 432925 - DNA, 20 bp, mouse
gccgactgcgatagaaaggg

SEQ ID NO: 432926 - DNA, 20 bp, mouse
gcccgggagaccaatatcat

SEQ ID NO: 432927 - DNA, 20 bp, mouse
gccggtgctgtaaccatagt

SEQ ID NO: 432928 - DNA, 20 bp, mouse
gttggggaccctacccacta

SEQ ID NO: 432929 - DNA, 20 bp, mouse
gaaggctagacgccaagatg

SEQ ID NO: 432930 - DNA, 20 bp, mouse
ggctgtaaccatagtgggta

SEQ ID NO: 432931 - DNA, 20 bp, mouse
gagttcaaccggacccaact

SEQ ID NO: 432932 - DNA, 20 bp, mouse
gcccaactgggcgattgctc

SEQ ID NO: 432933 - DNA, 20 bp, mouse
gccaggaagtctaaccaggt

SEQ ID NO: 432934 - DNA, 20 bp, mouse
gcagaggccacagcactata

SEQ ID NO: 432935 - DNA, 20 bp, mouse
gctaaccaggtgggcaggta

SEQ ID NO: 432936 - DNA, 20 bp, mouse
gcggcgcgtcctggcgacgg

SEQ ID NO: 432937 - DNA, 20 bp, mouse
ggaggcgacgaggggctcgg

SEQ ID NO: 432938 - DNA, 20 bp, mouse
gcgcgtcctggcgacggcgg

SEQ ID NO: 432939 - DNA, 20 bp, mouse
gcgctcaccccagctcttgg

SEQ ID NO: 432940 - DNA, 20 bp, mouse
ggcgcgctcaccccagctct

SEQ ID NO: 432941 - DNA, 20 bp, mouse
gcggagacgtcaggctcccg

SEQ ID NO: 432942 - DNA, 20 bp, mouse
gctggaggcgacgaggggct

SEQ ID NO: 432943 - DNA, 20 bp, mouse
gcagggcgcgcgccctacaa

SEQ ID NO: 432944 - DNA, 20 bp, mouse
ggggccgggcctcctttgta

SEQ ID NO: 432945 - DNA, 20 bp, mouse
gtgcggcgggcggagacgtc

SEQ ID NO: 432946 - DNA, 20 bp, mouse
gatgcagaggcaggcgagta

SEQ ID NO: 432947 - DNA, 20 bp, mouse
ggttggccaagacgatgcag

SEQ ID NO: 432948 - DNA, 20 bp, mouse
gagaggcaggcgagtagggc

SEQ ID NO: 432949 - DNA, 20 bp, mouse
gcaactgagcagccatgaga

SEQ ID NO: 432950 - DNA, 20 bp, mouse
gcggcaactccgctccagaa

SEQ ID NO: 432951 - DNA, 20 bp, mouse
gctggagcttctgctggtac

SEQ ID NO: 432952 - DNA, 20 bp, mouse
gggcgggagcccttctggag

SEQ ID NO: 432953 - DNA, 20 bp, mouse
ggagcggagttgccgtctca

SEQ ID NO: 432954 - DNA, 20 bp, mouse
ggcctgcctctgcatcgtct

SEQ ID NO: 432955 - DNA, 20 bp, mouse
gtagcgataaccgtaaggaa

SEQ ID NO: 432956 - DNA, 20 bp, mouse
ggactggggtcagaacttcg

SEQ ID NO: 432957 - DNA, 20 bp, mouse
gggtggccggctgcgcaagt

SEQ ID NO: 432958 - DNA, 20 bp, mouse
ggtggaaaggagaagaatct

SEQ ID NO: 432959 - DNA, 20 bp, mouse
gccggctgcgcaagtaggac

SEQ ID NO: 432960 - DNA, 20 bp, mouse
ggggcaagcaagaaaaagga

SEQ ID NO: 432961 - DNA, 20 bp, mouse
gggaaggagcccagatcaac

SEQ ID NO: 432962 - DNA, 20 bp, mouse
ggggtcagaacttcgtggaa

SEQ ID NO: 432963 - DNA, 20 bp, mouse
gccccaggaagggagcacaa

SEQ ID NO: 432964 - DNA, 20 bp, mouse
gcaggaagggagcacaatgg

SEQ ID NO: 432965 - DNA, 20 bp, mouse
gtcccctgacaggggtagga

SEQ ID NO: 432966 - DNA, 20 bp, mouse
gtctgcacccccgacagcgg

SEQ ID NO: 432967 - DNA, 20 bp, mouse
gagctctgcacccccgacag

SEQ ID NO: 432968 - DNA, 20 bp, mouse
ggaactgcggcggaggagac

SEQ ID NO: 432969 - DNA, 20 bp, mouse
ggcgctgcgccgaggagacg

SEQ ID NO: 432970 - DNA, 20 bp, mouse
ggtcggggacggctccgcgg

SEQ ID NO: 432971 - DNA, 20 bp, mouse
ggaggtggcggcgtcgggga

SEQ ID NO: 432972 - DNA, 20 bp, mouse
gggaaccgcgaggcaggcga

SEQ ID NO: 432973 - DNA, 20 bp, mouse
gagacgggaggtggcggcgt

SEQ ID NO: 432974 - DNA, 20 bp, mouse
gccctccgccgccgctgtcg

SEQ ID NO: 432975 - DNA, 20 bp, mouse
gcgacgggagaggagctgcg

SEQ ID NO: 432976 - DNA, 20 bp, mouse
gacgctgggaccttccccga

SEQ ID NO: 432977 - DNA, 20 bp, mouse
gtccccgacggcagtggcta

SEQ ID NO: 432978 - DNA, 20 bp, mouse
ggccatagccactgccgtcg

SEQ ID NO: 432979 - DNA, 20 bp, mouse
ggaaggtcccagcgtggtca

SEQ ID NO: 432980 - DNA, 20 bp, mouse
ggcccagaggacggagcccc

SEQ ID NO: 432981 - DNA, 20 bp, mouse
gggaccttccccgacggcag

SEQ ID NO: 432982 - DNA, 20 bp, mouse
gcgtggtcatggcctcccga

SEQ ID NO: 432983 - DNA, 20 bp, mouse
ggagtgctgcgagcttgggg

SEQ ID NO: 432984 - DNA, 20 bp, mouse
ggggaggccatgaccacgct

SEQ ID NO: 432985 - DNA, 20 bp, mouse
gcaggtgcgggcatccagta

SEQ ID NO: 432986 - DNA, 20 bp, mouse
ggccgcgcgagcatccgcag

SEQ ID NO: 432987 - DNA, 20 bp, mouse
ggcgcgagcatccgcagcgg

SEQ ID NO: 432988 - DNA, 20 bp, mouse
gtgaccgcgcccagccaagg

SEQ ID NO: 432989 - DNA, 20 bp, mouse
gcgcccagccaaggcggcag

SEQ ID NO: 432990 - DNA, 20 bp, mouse
ggctgccagcgtggagcggg

SEQ ID NO: 432991 - DNA, 20 bp, mouse
gctgcacctcgggaaggagg

SEQ ID NO: 432992 - DNA, 20 bp, mouse
gacgtgaccgcgcccagcca

SEQ ID NO: 432993 - DNA, 20 bp, mouse
ggcggcggagcccagagact

SEQ ID NO: 432994 - DNA, 20 bp, mouse
gtagcaggagcgaaccccgg

SEQ ID NO: 432995 - DNA, 20 bp, mouse
gagggagcgtcggaccggaa

SEQ ID NO: 432996 - DNA, 20 bp, mouse
ggcagcccgtaatcgcggtg

SEQ ID NO: 432997 - DNA, 20 bp, mouse
gatcggttcgggttccaggc

SEQ ID NO: 432998 - DNA, 20 bp, mouse
ggctgccgcaccgcgattac

SEQ ID NO: 432999 - DNA, 20 bp, mouse
gcaatcgccagcgatcggtt

SEQ ID NO: 433000 - DNA, 20 bp, mouse
gtaaggcaatcgccagcgat

SEQ ID NO: 433001 - DNA, 20 bp, mouse
gtggaacccgaaccgatcgc

SEQ ID NO: 433002 - DNA, 20 bp, mouse
gggcgggcagcccgtaatcg

SEQ ID NO: 433003 - DNA, 20 bp, mouse
gtacagtctgcgcagggacc

SEQ ID NO: 433004 - DNA, 20 bp, mouse
gcccttgcataacatcctgg

SEQ ID NO: 433005 - DNA, 20 bp, mouse
ggttatgcaagggctagtgg

SEQ ID NO: 433006 - DNA, 20 bp, mouse
ggaagaagccgcgggaaagg

SEQ ID NO: 433007 - DNA, 20 bp, mouse
gcgggcggagcgcagtgcag

SEQ ID NO: 433008 - DNA, 20 bp, mouse
ggagcgcagtgcagcggcgg

SEQ ID NO: 433009 - DNA, 20 bp, mouse
ggcggagcgcagtgcagcgg

SEQ ID NO: 433010 - DNA, 20 bp, mouse
ggcgcaggggcaccagacta

SEQ ID NO: 433011 - DNA, 20 bp, mouse
gagcgggcgcaggtgagggt

SEQ ID NO: 433012 - DNA, 20 bp, mouse
gctgggtcccccaggctaca

SEQ ID NO: 433013 - DNA, 20 bp, mouse
gaggaggcgggtgatatctg

SEQ ID NO: 433014 - DNA, 20 bp, mouse
gggctctgccacctttcccg

SEQ ID NO: 433015 - DNA, 20 bp, mouse
gcgaggccgctgggtccccc

SEQ ID NO: 433016 - DNA, 20 bp, mouse
gtgcggagcaggaccctccg

SEQ ID NO: 433017 - DNA, 20 bp, mouse
gtgctccccacgctccgcac

SEQ ID NO: 433018 - DNA, 20 bp, mouse
ggaccctccgcggcaggcga

SEQ ID NO: 433019 - DNA, 20 bp, mouse
gccacgctccgcaccggcgg

SEQ ID NO: 433020 - DNA, 20 bp, mouse
gcccagggcacaacttaccc

SEQ ID NO: 433021 - DNA, 20 bp, mouse
gtccccacgctccgcaccgg

SEQ ID NO: 433022 - DNA, 20 bp, mouse
gccctccgcgctcagagctg

SEQ ID NO: 433023 - DNA, 20 bp, mouse
ggcacaggcgggcgcagaag

SEQ ID NO: 433024 - DNA, 20 bp, mouse
ggcacaacttaccccggcat

SEQ ID NO: 433025 - DNA, 20 bp, mouse
gacgggcgcgcgtcacccag

SEQ ID NO: 433026 - DNA, 20 bp, mouse
ggccaactccggccagactg

SEQ ID NO: 433027 - DNA, 20 bp, mouse
ggccccagtctggccggagt

SEQ ID NO: 433028 - DNA, 20 bp, mouse
gcttaagaaaatgcttgtca

SEQ ID NO: 433029 - DNA, 20 bp, mouse
gtaggtggtttgccacactg

SEQ ID NO: 433030 - DNA, 20 bp, mouse
ggcgcaaagccagcatcact

SEQ ID NO: 433031 - DNA, 20 bp, mouse
gtccatggaccgagtagggt

SEQ ID NO: 433032 - DNA, 20 bp, mouse
gcaacagctccagccaactc

SEQ ID NO: 433033 - DNA, 20 bp, mouse
gaccgtccctgggagaaaat

SEQ ID NO: 433034 - DNA, 20 bp, mouse
gccacactggggagagcggt

SEQ ID NO: 433035 - DNA, 20 bp, mouse
gcaaagccagcatcactagg

SEQ ID NO: 433036 - DNA, 20 bp, mouse
gggccgtgcgcggagacgcg

SEQ ID NO: 433037 - DNA, 20 bp, mouse
gagagctgctcggccgtgcg

SEQ ID NO: 433038 - DNA, 20 bp, mouse
ggaagcggagctgaggagag

SEQ ID NO: 433039 - DNA, 20 bp, mouse
gaaggagcaggacggcggca

SEQ ID NO: 433040 - DNA, 20 bp, mouse
gagggaaggggaggacgtct

SEQ ID NO: 433041 - DNA, 20 bp, mouse
ggaggacgtctggggtgtcg

SEQ ID NO: 433042 - DNA, 20 bp, mouse
gggccacactgggaatagag

SEQ ID NO: 433043 - DNA, 20 bp, mouse
gcgtcccgaggagaaggagc

SEQ ID NO: 433044 - DNA, 20 bp, mouse
gccggcgggccgagcttgac

SEQ ID NO: 433045 - DNA, 20 bp, mouse
ggcgaagggcccgtcaagct

SEQ ID NO: 433046 - DNA, 20 bp, mouse
gctggccgcccgggaagcct

SEQ ID NO: 433047 - DNA, 20 bp, mouse
gagcagccgcggcctcgcta

SEQ ID NO: 433048 - DNA, 20 bp, mouse
gcggcctcgctagggcccca

SEQ ID NO: 433049 - DNA, 20 bp, mouse
ggctagggccccagggacgc

SEQ ID NO: 433050 - DNA, 20 bp, mouse
gctgcgcgcccaggcttccc

SEQ ID NO: 433051 - DNA, 20 bp, mouse
ggtccctgcccgcgtccctg

SEQ ID NO: 433052 - DNA, 20 bp, mouse
ggaccaggtagacagctccc

SEQ ID NO: 433053 - DNA, 20 bp, mouse
gagggacgaggtggagaccc

SEQ ID NO: 433054 - DNA, 20 bp, mouse
gcgcgcccaggcttcccggg

SEQ ID NO: 433055 - DNA, 20 bp, mouse
gcaggggcggagctcacctg

SEQ ID NO: 433056 - DNA, 20 bp, mouse
gaggctctgtaggccaagga

SEQ ID NO: 433057 - DNA, 20 bp, mouse
gcagagcaccaggcaccatg

SEQ ID NO: 433058 - DNA, 20 bp, mouse
gggcagtgagtggcatctgg

SEQ ID NO: 433059 - DNA, 20 bp, mouse
gaagtaggctctgtaggcca

SEQ ID NO: 433060 - DNA, 20 bp, mouse
gcctggtgctctgccctcct

SEQ ID NO: 433061 - DNA, 20 bp, mouse
gagacccaagtaggctctgt

SEQ ID NO: 433062 - DNA, 20 bp, mouse
gaccaaggtgagctaggagt

SEQ ID NO: 433063 - DNA, 20 bp, mouse
gcctgggcaggattgaggtg

SEQ ID NO: 433064 - DNA, 20 bp, mouse
ggattttgcggctggaggtg

SEQ ID NO: 433065 - DNA, 20 bp, mouse
ggcccactcctagctcacct

SEQ ID NO: 433066 - DNA, 20 bp, mouse
ggagtcgcgtggatcctcca

SEQ ID NO: 433067 - DNA, 20 bp, mouse
gcgctccagcacgcgctcag

SEQ ID NO: 433068 - DNA, 20 bp, mouse
ggcaggtgccgggagtcgcg

SEQ ID NO: 433069 - DNA, 20 bp, mouse
ggctatgtatcaagaagggt

SEQ ID NO: 433070 - DNA, 20 bp, mouse
gggatcctccagggtatgaa

SEQ ID NO: 433071 - DNA, 20 bp, mouse
gggtatgaatggacagctgt

SEQ ID NO: 433072 - DNA, 20 bp, mouse
gctgtccattcataccctgg

SEQ ID NO: 433073 - DNA, 20 bp, mouse
gggcgcccttcatcaccagc

SEQ ID NO: 433074 - DNA, 20 bp, mouse
gctgcccctgggccagaggt

SEQ ID NO: 433075 - DNA, 20 bp, mouse
gtgatacatagcccagtcca

SEQ ID NO: 433076 - DNA, 20 bp, mouse
gcgcttcctgggcccagtcc

SEQ ID NO: 433077 - DNA, 20 bp, mouse
ggcccaggaagcgtcctcta

SEQ ID NO: 433078 - DNA, 20 bp, mouse
gccagcgcatggccgaattc

SEQ ID NO: 433079 - DNA, 20 bp, mouse
gcgggttccaacagtagtgc

SEQ ID NO: 433080 - DNA, 20 bp, mouse
ggccctagaggacgcttcct

SEQ ID NO: 433081 - DNA, 20 bp, mouse
gcgaattccggcactactgt

SEQ ID NO: 433082 - DNA, 20 bp, mouse
gcatgacttcttctcctgca

SEQ ID NO: 433083 - DNA, 20 bp, mouse
gacctctcagcaggaagtta

SEQ ID NO: 433084 - DNA, 20 bp, mouse
gtctcctgcttgcctggact

SEQ ID NO: 433085 - DNA, 20 bp, mouse
ggtgtgggccatgtgaaggg

SEQ ID NO: 433086 - DNA, 20 bp, mouse
ggtctctccgagaagctgca

SEQ ID NO: 433087 - DNA, 20 bp, mouse
ggccagtcgtccggaggctg

SEQ ID NO: 433088 - DNA, 20 bp, mouse
gagtcccgcccgtcgaggga

SEQ ID NO: 433089 - DNA, 20 bp, mouse
ggccgcagcctccggacgac

SEQ ID NO: 433090 - DNA, 20 bp, mouse
gcgagcgcaaaggaaggtca

SEQ ID NO: 433091 - DNA, 20 bp, mouse
gcgagggagggcacgggcca

SEQ ID NO: 433092 - DNA, 20 bp, mouse
gccgcagccacggtgcaaga

SEQ ID NO: 433093 - DNA, 20 bp, mouse
gccggacgactggcacaaaa

SEQ ID NO: 433094 - DNA, 20 bp, mouse
ggcgcgggagcggagatctc

SEQ ID NO: 433095 - DNA, 20 bp, mouse
gcgggcaggccagacgagca

SEQ ID NO: 433096 - DNA, 20 bp, mouse
gctgtggcagagccgccgaa

SEQ ID NO: 433097 - DNA, 20 bp, mouse
gagtccccgcaaggccccgg

SEQ ID NO: 433098 - DNA, 20 bp, mouse
gcccacaagactcaacatgg

SEQ ID NO: 433099 - DNA, 20 bp, mouse
gcgccccacaagactcaaca

SEQ ID NO: 433100 - DNA, 20 bp, mouse
gctgagtccccgcaaggccc

SEQ ID NO: 433101 - DNA, 20 bp, mouse
gcaacatggcggaatccggg

SEQ ID NO: 433102 - DNA, 20 bp, mouse
ggaagggctgagtccccgca

SEQ ID NO: 433103 - DNA, 20 bp, mouse
gactcaacatggcggaatcc

SEQ ID NO: 433104 - DNA, 20 bp, mouse
gcggggactcagcccttcgg

SEQ ID NO: 433105 - DNA, 20 bp, mouse
gccggcggagaggaccgctt

SEQ ID NO: 433106 - DNA, 20 bp, mouse
gctcgcccgcgagaacatgg

SEQ ID NO: 433107 - DNA, 20 bp, mouse
gacgctcgcccgcgagaaca

SEQ ID NO: 433108 - DNA, 20 bp, mouse
gggctccaccatgttctcgc

SEQ ID NO: 433109 - DNA, 20 bp, mouse
gcacatcgggagggatgcgg

SEQ ID NO: 433110 - DNA, 20 bp, mouse
gcaagctgtgctcccgggta

SEQ ID NO: 433111 - DNA, 20 bp, mouse
gtggtaggaccacatcggga

SEQ ID NO: 433112 - DNA, 20 bp, mouse
gctcgcgggcgagcgttgtc

SEQ ID NO: 433113 - DNA, 20 bp, mouse
gtgtgctcccgggtacggag

SEQ ID NO: 433114 - DNA, 20 bp, mouse
gcgggtacggagcggaagta

SEQ ID NO: 433115 - DNA, 20 bp, mouse
ggccgtgcagccgcaatggt

SEQ ID NO: 433116 - DNA, 20 bp, mouse
gagtgaggcgggcaacatgg

SEQ ID NO: 433117 - DNA, 20 bp, mouse
gagcgaggcggccttcaggg

SEQ ID NO: 433118 - DNA, 20 bp, mouse
gcgcgggcggccgacacact

SEQ ID NO: 433119 - DNA, 20 bp, mouse
ggcaagcgaggcggccttca

SEQ ID NO: 433120 - DNA, 20 bp, mouse
gcttccacgggtcagatcag

SEQ ID NO: 433121 - DNA, 20 bp, mouse
gacacactgggcaagcgagg

SEQ ID NO: 433122 - DNA, 20 bp, mouse
gtccaggtgaccccatccag

SEQ ID NO: 433123 - DNA, 20 bp, mouse
gatggtggcggaaaagtcag

SEQ ID NO: 433124 - DNA, 20 bp, mouse
gcggccttcagggagggaga

SEQ ID NO: 433125 - DNA, 20 bp, mouse
gccgacacactgggcaagcg

SEQ ID NO: 433126 - DNA, 20 bp, mouse
ggcgcccgctcgagacacca

SEQ ID NO: 433127 - DNA, 20 bp, mouse
gcgcgtcgggcagaaccgct

SEQ ID NO: 433128 - DNA, 20 bp, mouse
ggaaggtcaggcctgagtag

SEQ ID NO: 433129 - DNA, 20 bp, mouse
gcccgctcgagacaccatgg

SEQ ID NO: 433130 - DNA, 20 bp, mouse
ggagtagcctcaaaccggcc

SEQ ID NO: 433131 - DNA, 20 bp, mouse
gtgtctcgagcgggcgcgtc

SEQ ID NO: 433132 - DNA, 20 bp, mouse
gaaccggcccggcagcagga

SEQ ID NO: 433133 - DNA, 20 bp, mouse
gccgcgaagagccttgtcca

SEQ ID NO: 433134 - DNA, 20 bp, mouse
ggccaccatggtgtctcgag

SEQ ID NO: 433135 - DNA, 20 bp, mouse
gtcaggcctgagtagcggaa

SEQ ID NO: 433136 - DNA, 20 bp, mouse
gcccgacccgagcctgtcag

SEQ ID NO: 433137 - DNA, 20 bp, mouse
gcgggccgcccagcatctca

SEQ ID NO: 433138 - DNA, 20 bp, mouse
gcgtctctcacccgctgtgg

SEQ ID NO: 433139 - DNA, 20 bp, mouse
gctaggaagaagccaggccg

SEQ ID NO: 433140 - DNA, 20 bp, mouse
gctctccagatcgctcccgt

SEQ ID NO: 433141 - DNA, 20 bp, mouse
gttgggcccgagctcaccca

SEQ ID NO: 433142 - DNA, 20 bp, mouse
gcagacaatgctgtcccggg

SEQ ID NO: 433143 - DNA, 20 bp, mouse
gccagggccgacacccggga

SEQ ID NO: 433144 - DNA, 20 bp, mouse
gttagcgtagcagggtgact

SEQ ID NO: 433145 - DNA, 20 bp, mouse
gcagcattgtctgcgaagag

SEQ ID NO: 433146 - DNA, 20 bp, mouse
gcggccgctggggagagtag

SEQ ID NO: 433147 - DNA, 20 bp, mouse
gaccaagggctaaagctggg

SEQ ID NO: 433148 - DNA, 20 bp, mouse
gtgggagtgcaggtgacttg

SEQ ID NO: 433149 - DNA, 20 bp, mouse
gggtctcccgggaagaccgg

SEQ ID NO: 433150 - DNA, 20 bp, mouse
ggagtcagtcaccttgagca

SEQ ID NO: 433151 - DNA, 20 bp, mouse
gtgtcccctactctccccag

SEQ ID NO: 433152 - DNA, 20 bp, mouse
ggtgtgctgtgggccgagca

SEQ ID NO: 433153 - DNA, 20 bp, mouse
gacagcacactccctgctca

SEQ ID NO: 433154 - DNA, 20 bp, mouse
gctcccctgcagcccctgct

SEQ ID NO: 433155 - DNA, 20 bp, mouse
ggaagggactccgaacacgt

SEQ ID NO: 433156 - DNA, 20 bp, mouse
gaaggccttacctgctccca

SEQ ID NO: 433157 - DNA, 20 bp, mouse
ggcgcctgcgcggcacgaag

SEQ ID NO: 433158 - DNA, 20 bp, mouse
gaagaggacgcgaggcctca

SEQ ID NO: 433159 - DNA, 20 bp, mouse
gccgcgcggttagaggtcat

SEQ ID NO: 433160 - DNA, 20 bp, mouse
ggcggcacgaagaggacgcg

SEQ ID NO: 433161 - DNA, 20 bp, mouse
gcggccacgcgtcctcgcaa

SEQ ID NO: 433162 - DNA, 20 bp, mouse
gaggtcatcggcacgaggaa

SEQ ID NO: 433163 - DNA, 20 bp, mouse
ggtgggagctagcaaggtca

SEQ ID NO: 433164 - DNA, 20 bp, mouse
gtcttctctgccctgggagc

SEQ ID NO: 433165 - DNA, 20 bp, mouse
ggacaaggggaggcaaaggt

SEQ ID NO: 433166 - DNA, 20 bp, mouse
gggcagaggtcgaagcagtg

SEQ ID NO: 433167 - DNA, 20 bp, mouse
gcgcctcgggaggtaagcga

SEQ ID NO: 433168 - DNA, 20 bp, mouse
gggtaagcgaaggtaaacgg

SEQ ID NO: 433169 - DNA, 20 bp, mouse
gtaccttcgcttacctcccg

SEQ ID NO: 433170 - DNA, 20 bp, mouse
gtctaggtgacaggcgacgt

SEQ ID NO: 433171 - DNA, 20 bp, mouse
ggagggaggagaggacatcg

SEQ ID NO: 433172 - DNA, 20 bp, mouse
gggtcaagtgtcccccccag

SEQ ID NO: 433173 - DNA, 20 bp, mouse
gctctctgcggagcgaaaag

SEQ ID NO: 433174 - DNA, 20 bp, mouse
gtcgctccgcagagaggaag

SEQ ID NO: 433175 - DNA, 20 bp, mouse
gtggcaaggacaggcccctg

SEQ ID NO: 433176 - DNA, 20 bp, mouse
gactcaccttcaccgacccc

SEQ ID NO: 433177 - DNA, 20 bp, mouse
ggtgttgggtcgaatctcca

SEQ ID NO: 433178 - DNA, 20 bp, mouse
gtggccaaggagagaacttc

SEQ ID NO: 433179 - DNA, 20 bp, mouse
gccccgcgggaaagcgagca

SEQ ID NO: 433180 - DNA, 20 bp, mouse
gtgagtggggtctgaggtgt

SEQ ID NO: 433181 - DNA, 20 bp, mouse
gcaagtgtggaagcgaggtc

SEQ ID NO: 433182 - DNA, 20 bp, mouse
gtgtgtggcgatctcaggag

SEQ ID NO: 433183 - DNA, 20 bp, mouse
gctccgccgggggtcggtga

SEQ ID NO: 433184 - DNA, 20 bp, mouse
gtgtctggtggtcacgaagt

SEQ ID NO: 433185 - DNA, 20 bp, mouse
ggacctccggagcggacggg

SEQ ID NO: 433186 - DNA, 20 bp, mouse
gagggccggaagtagaacgg

SEQ ID NO: 433187 - DNA, 20 bp, mouse
ggccggaagtagaacggtgg

SEQ ID NO: 433188 - DNA, 20 bp, mouse
ggactcagtgcaaggtgact

SEQ ID NO: 433189 - DNA, 20 bp, mouse
ggtggcggcggcggtgactc

SEQ ID NO: 433190 - DNA, 20 bp, mouse
gcagctcgggactcagtgca

SEQ ID NO: 433191 - DNA, 20 bp, mouse
ggcggtgactctggcagctc

SEQ ID NO: 433192 - DNA, 20 bp, mouse
gggaagtagaacggtggcgg

SEQ ID NO: 433193 - DNA, 20 bp, mouse
ggcgtgtgtaggcggagcca

SEQ ID NO: 433194 - DNA, 20 bp, mouse
gtcagtgcaaggtgactggg

SEQ ID NO: 433195 - DNA, 20 bp, mouse
ggggctgcgctctactccca

SEQ ID NO: 433196 - DNA, 20 bp, mouse
gccaaccccaaggccaggaa

SEQ ID NO: 433197 - DNA, 20 bp, mouse
ggcgcgcggctggagttctg

SEQ ID NO: 433198 - DNA, 20 bp, mouse
gaggctccagggccacagtg

SEQ ID NO: 433199 - DNA, 20 bp, mouse
gacttcaagatggcgtcact

SEQ ID NO: 433200 - DNA, 20 bp, mouse
gtggagcctgtgcccaaatc

SEQ ID NO: 433201 - DNA, 20 bp, mouse
gaatcgggcttccaacccca

SEQ ID NO: 433202 - DNA, 20 bp, mouse
gggcttccaaccccaaggcc

SEQ ID NO: 433203 - DNA, 20 bp, mouse
gagacccagtcagcacggag

SEQ ID NO: 433204 - DNA, 20 bp, mouse
gaaatccgctgcagagtgga

SEQ ID NO: 433205 - DNA, 20 bp, mouse
ggtggaagacccagtcagca

SEQ ID NO: 433206 - DNA, 20 bp, mouse
gcgcgccggaagctcaactg

SEQ ID NO: 433207 - DNA, 20 bp, mouse
gcaggtctctccactcatca

SEQ ID NO: 433208 - DNA, 20 bp, mouse
gtgagcaccgcgcaacaacg

SEQ ID NO: 433209 - DNA, 20 bp, mouse
gtactgggagagggagtacg

SEQ ID NO: 433210 - DNA, 20 bp, mouse
ggccggaagctcaactgagg

SEQ ID NO: 433211 - DNA, 20 bp, mouse
gaggcacaccgagggaacaa

SEQ ID NO: 433212 - DNA, 20 bp, mouse
gtcggacatcgaggagtact

SEQ ID NO: 433213 - DNA, 20 bp, mouse
ggggaacaaggggatcgcag

SEQ ID NO: 433214 - DNA, 20 bp, mouse
gtgggagagggagtacgggg

SEQ ID NO: 433215 - DNA, 20 bp, mouse
gggtactccgctctgatcat

SEQ ID NO: 433216 - DNA, 20 bp, mouse
gctgccgcgggtccttccgg

SEQ ID NO: 433217 - DNA, 20 bp, mouse
ggctcaccggctaccatcga

SEQ ID NO: 433218 - DNA, 20 bp, mouse
gtcacccccggaaggacccg

SEQ ID NO: 433219 - DNA, 20 bp, mouse
gcttccaggaggccactgta

SEQ ID NO: 433220 - DNA, 20 bp, mouse
gcccctcgcgagcctctccc

SEQ ID NO: 433221 - DNA, 20 bp, mouse
ggaagggaggtcggtaacag

SEQ ID NO: 433222 - DNA, 20 bp, mouse
ggctcggccggggagcgagt

SEQ ID NO: 433223 - DNA, 20 bp, mouse
ggccgcgggcaggccaggcg

SEQ ID NO: 433224 - DNA, 20 bp, mouse
gttcgcggcggagtgaggcc

SEQ ID NO: 433225 - DNA, 20 bp, mouse
ggcccgggagaggctcgcga

SEQ ID NO: 433226 - DNA, 20 bp, mouse
ggcgtccggactgtctcgac

SEQ ID NO: 433227 - DNA, 20 bp, mouse
gtctacctgtcgagacagtc

SEQ ID NO: 433228 - DNA, 20 bp, mouse
gggcgactgcaggcagcgtg

SEQ ID NO: 433229 - DNA, 20 bp, mouse
ggccggggacccgcaaccct

SEQ ID NO: 433230 - DNA, 20 bp, mouse
ggggacccgcaaccctggga

SEQ ID NO: 433231 - DNA, 20 bp, mouse
gtccttgctggtaaacctaa

SEQ ID NO: 433232 - DNA, 20 bp, mouse
gacaggtagaagctggcggg

SEQ ID NO: 433233 - DNA, 20 bp, mouse
ggtttgacctacagccgccc

SEQ ID NO: 433234 - DNA, 20 bp, mouse
ggagcagctggcaagggcat

SEQ ID NO: 433235 - DNA, 20 bp, mouse
gtccaggactcactgcatag

SEQ ID NO: 433236 - DNA, 20 bp, mouse
gcgtggaaggaaaagaccga

SEQ ID NO: 433237 - DNA, 20 bp, mouse
ggcagcacgccgtgagtaag

SEQ ID NO: 433238 - DNA, 20 bp, mouse
gccctagctcctcttactca

SEQ ID NO: 433239 - DNA, 20 bp, mouse
ggcagggtagtgacagggag

SEQ ID NO: 433240 - DNA, 20 bp, mouse
ggaagggccggccaggcgca

SEQ ID NO: 433241 - DNA, 20 bp, mouse
gcgagggcgaagggccggcc

SEQ ID NO: 433242 - DNA, 20 bp, mouse
ggccgtgagtaagaggagct

SEQ ID NO: 433243 - DNA, 20 bp, mouse
gagaggagctagggcgaagg

SEQ ID NO: 433244 - DNA, 20 bp, mouse
gggaaaagaccgagggcgaa

SEQ ID NO: 433245 - DNA, 20 bp, mouse
ggcgtcgccaaccgaccagg

SEQ ID NO: 433246 - DNA, 20 bp, mouse
gtggcggcgcccagagcggt

SEQ ID NO: 433247 - DNA, 20 bp, mouse
gcaggtaacgtaaacagaag

SEQ ID NO: 433248 - DNA, 20 bp, mouse
gtgcggtcacctaccgctct

SEQ ID NO: 433249 - DNA, 20 bp, mouse
gcgtccgcgtcccggaacta

SEQ ID NO: 433250 - DNA, 20 bp, mouse
ggaaccatagttccgggacg

SEQ ID NO: 433251 - DNA, 20 bp, mouse
gcaaagtgaaccatagttcc

SEQ ID NO: 433252 - DNA, 20 bp, mouse
gtttacgttacctggcaaga

SEQ ID NO: 433253 - DNA, 20 bp, mouse
gagcgactcgagactctctg

SEQ ID NO: 433254 - DNA, 20 bp, mouse
ggaccgcagcgtccgcgtcc

SEQ ID NO: 433255 - DNA, 20 bp, mouse
gctcctgccggacctcgctc

SEQ ID NO: 433256 - DNA, 20 bp, mouse
gaaagctgaggctatgatgg

SEQ ID NO: 433257 - DNA, 20 bp, mouse
gggtatctcggatacggacg

SEQ ID NO: 433258 - DNA, 20 bp, mouse
gaacagtggtatctcggata

SEQ ID NO: 433259 - DNA, 20 bp, mouse
gtgatctgcagtggcttcag

SEQ ID NO: 433260 - DNA, 20 bp, mouse
gggcggcaacagtggtatct

SEQ ID NO: 433261 - DNA, 20 bp, mouse
gtcggatacggacggggaca

SEQ ID NO: 433262 - DNA, 20 bp, mouse
gacagagacagccacatgac

SEQ ID NO: 433263 - DNA, 20 bp, mouse
gcaagccggccagcccaacc

SEQ ID NO: 433264 - DNA, 20 bp, mouse
ggccaggagccgatagggtt

SEQ ID NO: 433265 - DNA, 20 bp, mouse
ggtgaagccaggagccgata

SEQ ID NO: 433266 - DNA, 20 bp, mouse
gtgtagagcaagcagagcag

SEQ ID NO: 433267 - DNA, 20 bp, mouse
ggaagcatacacttcttgat

SEQ ID NO: 433268 - DNA, 20 bp, mouse
gtacttgccaggaagaatgt

SEQ ID NO: 433269 - DNA, 20 bp, mouse
gaagaatgtagggtgagtaa

SEQ ID NO: 433270 - DNA, 20 bp, mouse
gctgagagtccgttaagcag

SEQ ID NO: 433271 - DNA, 20 bp, mouse
gcacaggttacgcatcccta

SEQ ID NO: 433272 - DNA, 20 bp, mouse
gtatatgagtggagacctta

SEQ ID NO: 433273 - DNA, 20 bp, mouse
ggtataataactactgtcgt

SEQ ID NO: 433274 - DNA, 20 bp, mouse
gactcaccctacattcttcc

SEQ ID NO: 433275 - DNA, 20 bp, mouse
gacaaattaacagatgcgct

SEQ ID NO: 433276 - DNA, 20 bp, mouse
ggagatgagccacacgaaaa

SEQ ID NO: 433277 - DNA, 20 bp, mouse
ggcagtgctcgcttgagtcc

SEQ ID NO: 433278 - DNA, 20 bp, mouse
gggtgccacggttgctgaag

SEQ ID NO: 433279 - DNA, 20 bp, mouse
gctccgcccgagccagatca

SEQ ID NO: 433280 - DNA, 20 bp, mouse
gccacacgaaaagggacgcc

SEQ ID NO: 433281 - DNA, 20 bp, mouse
gaggtccagaaccccgaaga

SEQ ID NO: 433282 - DNA, 20 bp, mouse
gacgagcagggccacctggg

SEQ ID NO: 433283 - DNA, 20 bp, mouse
gacccgccaccagaaagaac

SEQ ID NO: 433284 - DNA, 20 bp, mouse
gctccaaagggccttgaaca

SEQ ID NO: 433285 - DNA, 20 bp, mouse
gccgtcgggagcgcgtcact

SEQ ID NO: 433286 - DNA, 20 bp, mouse
gcttcggacacccttcctgt

SEQ ID NO: 433287 - DNA, 20 bp, mouse
gaggacagaagagatcggat

SEQ ID NO: 433288 - DNA, 20 bp, mouse
gagccggggtcgctttgctg

SEQ ID NO: 433289 - DNA, 20 bp, mouse
gaccccagctcacctctcgc

SEQ ID NO: 433290 - DNA, 20 bp, mouse
gagccggcgagaggtgagct

SEQ ID NO: 433291 - DNA, 20 bp, mouse
gcgccgcagcaaagcgaccc

SEQ ID NO: 433292 - DNA, 20 bp, mouse
gtcccctcgaaagccactcg

SEQ ID NO: 433293 - DNA, 20 bp, mouse
gctcaggaatgacccgggag

SEQ ID NO: 433294 - DNA, 20 bp, mouse
gcactgctcaggaatgaccc

SEQ ID NO: 433295 - DNA, 20 bp, mouse
gtctctgagaaaaatatggg

SEQ ID NO: 433296 - DNA, 20 bp, mouse
gggccgcggtggcatcggag

SEQ ID NO: 433297 - DNA, 20 bp, mouse
ggcatcggaggggagcccca

SEQ ID NO: 433298 - DNA, 20 bp, mouse
gcggaagagagagcccatgg

SEQ ID NO: 433299 - DNA, 20 bp, mouse
gggaggggagccccatggtg

SEQ ID NO: 433300 - DNA, 20 bp, mouse
gggcccgcgcacccgcacca

SEQ ID NO: 433301 - DNA, 20 bp, mouse
ggcgtggcgggtggttgtgg

SEQ ID NO: 433302 - DNA, 20 bp, mouse
gctgcggaagagagagccca

SEQ ID NO: 433303 - DNA, 20 bp, mouse
gctcccctccgatgccaccg

SEQ ID NO: 433304 - DNA, 20 bp, mouse
ggccaaggagggcccctcta

SEQ ID NO: 433305 - DNA, 20 bp, mouse
gagcgaggcagcgccgccat

SEQ ID NO: 433306 - DNA, 20 bp, mouse
gacttagtgtgtactatgac

SEQ ID NO: 433307 - DNA, 20 bp, mouse
ggggtcaaggttctaggagc

SEQ ID NO: 433308 - DNA, 20 bp, mouse
gagacacttagaaagatgtt

SEQ ID NO: 433309 - DNA, 20 bp, mouse
gatggcgaggactctgctag

SEQ ID NO: 433310 - DNA, 20 bp, mouse
gaggtagaaatgacatggcg

SEQ ID NO: 433311 - DNA, 20 bp, mouse
ggatgttgggtcaaggttct

SEQ ID NO: 433312 - DNA, 20 bp, mouse
gtggtccaggtgggagtaca

SEQ ID NO: 433313 - DNA, 20 bp, mouse
gtttggaggtagaaatgaca

SEQ ID NO: 433314 - DNA, 20 bp, mouse
gctcccacctggaccagatg

SEQ ID NO: 433315 - DNA, 20 bp, mouse
ggtaagcctatatacttcat

SEQ ID NO: 433316 - DNA, 20 bp, mouse
gggcgggccgacagactgcg

SEQ ID NO: 433317 - DNA, 20 bp, mouse
ggcgacggcaggggtcggat

SEQ ID NO: 433318 - DNA, 20 bp, mouse
gcagactgcggggcggacgg

SEQ ID NO: 433319 - DNA, 20 bp, mouse
gcggcaggggtcggatcggt

SEQ ID NO: 433320 - DNA, 20 bp, mouse
gcagcggcgacggcaggggt

SEQ ID NO: 433321 - DNA, 20 bp, mouse
gatggcagcggcgacggcag

SEQ ID NO: 433322 - DNA, 20 bp, mouse
ggaaggccacaaagatcccg

SEQ ID NO: 433323 - DNA, 20 bp, mouse
gtgggctgcgagagtcacac

SEQ ID NO: 433324 - DNA, 20 bp, mouse
gagtcacaccggctattcca

SEQ ID NO: 433325 - DNA, 20 bp, mouse
gcgtcgccgctgccatgacg

SEQ ID NO: 433326 - DNA, 20 bp, mouse
ggagcgcagcgcctgactgg

SEQ ID NO: 433327 - DNA, 20 bp, mouse
ggaaggcgaccccgccagtc

SEQ ID NO: 433328 - DNA, 20 bp, mouse
ggcaccgcaaagcaagatgg

SEQ ID NO: 433329 - DNA, 20 bp, mouse
gcgcgggccagcgaagaccc

SEQ ID NO: 433330 - DNA, 20 bp, mouse
ggccagcgaagacccaggca

SEQ ID NO: 433331 - DNA, 20 bp, mouse
gttagagcgcagcgcctgac

SEQ ID NO: 433332 - DNA, 20 bp, mouse
gaaagtggtacagcccgtgg

SEQ ID NO: 433333 - DNA, 20 bp, mouse
gccagcaccgcaaagcaaga

SEQ ID NO: 433334 - DNA, 20 bp, mouse
gccccacagaagcgaggcac

SEQ ID NO: 433335 - DNA, 20 bp, mouse
gtcctgggaagtaggaatga

SEQ ID NO: 433336 - DNA, 20 bp, mouse
gcgccgcgtcagctgatccg

SEQ ID NO: 433337 - DNA, 20 bp, mouse
gagctccgggaagaacgaca

SEQ ID NO: 433338 - DNA, 20 bp, mouse
gcgcacgcaactagactccc

SEQ ID NO: 433339 - DNA, 20 bp, mouse
gctccccggatcagctgacg

SEQ ID NO: 433340 - DNA, 20 bp, mouse
gtgcagtgcgagacgctcga

SEQ ID NO: 433341 - DNA, 20 bp, mouse
gcgcgcagagccgcagctag

SEQ ID NO: 433342 - DNA, 20 bp, mouse
gggcctccctgagccgggaa

SEQ ID NO: 433343 - DNA, 20 bp, mouse
gctcagacagcccggacccg

SEQ ID NO: 433344 - DNA, 20 bp, mouse
gtcagctcgcgggttcccag

SEQ ID NO: 433345 - DNA, 20 bp, mouse
gccgcgagctgattgatggt

SEQ ID NO: 433346 - DNA, 20 bp, mouse
gcatactgctcaggctgaag

SEQ ID NO: 433347 - DNA, 20 bp, mouse
gtcctcgaaccaggccctcc

SEQ ID NO: 433348 - DNA, 20 bp, mouse
gctgaagtggctccgagtcc

SEQ ID NO: 433349 - DNA, 20 bp, mouse
ggcagagctgtacttcaatg

SEQ ID NO: 433350 - DNA, 20 bp, mouse
gccctggtccgggaaagtgt

SEQ ID NO: 433351 - DNA, 20 bp, mouse
gagtctcaagcatactgctc

SEQ ID NO: 433352 - DNA, 20 bp, mouse
gtcagttgctatccaggact

SEQ ID NO: 433353 - DNA, 20 bp, mouse
gctgggcagaagtcctgaag

SEQ ID NO: 433354 - DNA, 20 bp, mouse
ggtggaccatggctacctgg

SEQ ID NO: 433355 - DNA, 20 bp, mouse
gctggatagcaactgaacac

SEQ ID NO: 433356 - DNA, 20 bp, mouse
ggcgcaggcatggcatacca

SEQ ID NO: 433357 - DNA, 20 bp, mouse
gcccagcagccgaatcggtc

SEQ ID NO: 433358 - DNA, 20 bp, mouse
ggcgaggctccggaccgatt

SEQ ID NO: 433359 - DNA, 20 bp, mouse
gcacccggaagtgtcaacag

SEQ ID NO: 433360 - DNA, 20 bp, mouse
gacacgctcatcacgatcaa

SEQ ID NO: 433361 - DNA, 20 bp, mouse
ggatcgtacgtggaggacta

SEQ ID NO: 433362 - DNA, 20 bp, mouse
gcaaaggcacagtaaggccg

SEQ ID NO: 433363 - DNA, 20 bp, mouse
gtccgggtgggacgagagcg

SEQ ID NO: 433364 - DNA, 20 bp, mouse
ggaccccggtgggaggatca

SEQ ID NO: 433365 - DNA, 20 bp, mouse
gggactacggcgggaggatg

SEQ ID NO: 433366 - DNA, 20 bp, mouse
gtctaagcaggtgcaagtct

SEQ ID NO: 433367 - DNA, 20 bp, mouse
gggtgcgcgatgctcaggtg

SEQ ID NO: 433368 - DNA, 20 bp, mouse
gccgatgaggccccagaatg

SEQ ID NO: 433369 - DNA, 20 bp, mouse
gtaatgggtgagcccagcta

SEQ ID NO: 433370 - DNA, 20 bp, mouse
gcgaacggcagactctaagc

SEQ ID NO: 433371 - DNA, 20 bp, mouse
gcaggtgcaagtctcggcag

SEQ ID NO: 433372 - DNA, 20 bp, mouse
gacagggagggcaaaggaat

SEQ ID NO: 433373 - DNA, 20 bp, mouse
gtagcggcgagctatcccag

SEQ ID NO: 433374 - DNA, 20 bp, mouse
ggggctgtgcgcatgcgcaa

SEQ ID NO: 433375 - DNA, 20 bp, mouse
gtgtaggggcgtctctgtga

SEQ ID NO: 433376 - DNA, 20 bp, mouse
ggagcctctgggtcccgtct

SEQ ID NO: 433377 - DNA, 20 bp, mouse
gctcaacccagggaaaaggt

SEQ ID NO: 433378 - DNA, 20 bp, mouse
ggcagaaagtgtacctagac

SEQ ID NO: 433379 - DNA, 20 bp, mouse
gcgcccgtgcaggaggacaa

SEQ ID NO: 433380 - DNA, 20 bp, mouse
gctggtggggacgattgaca

SEQ ID NO: 433381 - DNA, 20 bp, mouse
gaggtgcgacaggtaactcg

SEQ ID NO: 433382 - DNA, 20 bp, mouse
ggtgcaggaggacaacggaa

SEQ ID NO: 433383 - DNA, 20 bp, mouse
gggtgatggtgaagggccag

SEQ ID NO: 433384 - DNA, 20 bp, mouse
gatccctagtcaatggacca

SEQ ID NO: 433385 - DNA, 20 bp, mouse
gagtcaatggaccacggtga

SEQ ID NO: 433386 - DNA, 20 bp, mouse
gcagtagacagcaggtcctc

SEQ ID NO: 433387 - DNA, 20 bp, mouse
gagctaccaccaggcttctc

SEQ ID NO: 433388 - DNA, 20 bp, mouse
ggcaggtcctcgggattcac

SEQ ID NO: 433389 - DNA, 20 bp, mouse
gcccagctctccacacgcca

SEQ ID NO: 433390 - DNA, 20 bp, mouse
gctattgccagtgaatcccg

SEQ ID NO: 433391 - DNA, 20 bp, mouse
gagacctagggaggagatca

SEQ ID NO: 433392 - DNA, 20 bp, mouse
gtccagctggtgaggggagt

SEQ ID NO: 433393 - DNA, 20 bp, mouse
ggccatggcgtgtggagagc

SEQ ID NO: 433394 - DNA, 20 bp, mouse
gagaaagagggccaagacct

SEQ ID NO: 433395 - DNA, 20 bp, mouse
gagagggccaagacctaggg

SEQ ID NO: 433396 - DNA, 20 bp, mouse
ggctgcggggccagtcggga

SEQ ID NO: 433397 - DNA, 20 bp, mouse
gcggccatcggcccaccggt

SEQ ID NO: 433398 - DNA, 20 bp, mouse
gcggtgggcacgggcagttc

SEQ ID NO: 433399 - DNA, 20 bp, mouse
ggcggggccagtcgggacgg

SEQ ID NO: 433400 - DNA, 20 bp, mouse
gggcacgggcagttcgggtg

SEQ ID NO: 433401 - DNA, 20 bp, mouse
gcgatgcggggaatcgtgaa

SEQ ID NO: 433402 - DNA, 20 bp, mouse
gtggcgttgcgagcgatgcg

SEQ ID NO: 433403 - DNA, 20 bp, mouse
gcgctgctgcggggccagtc

SEQ ID NO: 433404 - DNA, 20 bp, mouse
gactgcccgtgcccaccggt

SEQ ID NO: 433405 - DNA, 20 bp, mouse
gtcggcccaccggtgggcac

SEQ ID NO: 433406 - DNA, 20 bp, mouse
gccctcccggacctaagctc

SEQ ID NO: 433407 - DNA, 20 bp, mouse
gtgacttgctctgggcgcag

SEQ ID NO: 433408 - DNA, 20 bp, mouse
ggcccagacggggaactcag

SEQ ID NO: 433409 - DNA, 20 bp, mouse
gaggggtcgaggaagccgaa

SEQ ID NO: 433410 - DNA, 20 bp, mouse
ggccggagcttaggtccggg

SEQ ID NO: 433411 - DNA, 20 bp, mouse
gagccgaaaggccggagctt

SEQ ID NO: 433412 - DNA, 20 bp, mouse
gaaccctaggccctgagatg

SEQ ID NO: 433413 - DNA, 20 bp, mouse
gtggccgccggggaaggatg

SEQ ID NO: 433414 - DNA, 20 bp, mouse
gctggcacgtgacttgctct

SEQ ID NO: 433415 - DNA, 20 bp, mouse
ggtcgaggaagccgaaaggc

SEQ ID NO: 433416 - DNA, 20 bp, mouse
ggagtccttaccaggagcga

SEQ ID NO: 433417 - DNA, 20 bp, mouse
gaccgtgcgggaggctccgc

SEQ ID NO: 433418 - DNA, 20 bp, mouse
gacacgcggggacaccgtgc

SEQ ID NO: 433419 - DNA, 20 bp, mouse
gcccggaccacgaggaccca

SEQ ID NO: 433420 - DNA, 20 bp, mouse
gagccggccgtgcgctcccg

SEQ ID NO: 433421 - DNA, 20 bp, mouse
ggccagggagagtgcggtgt

SEQ ID NO: 433422 - DNA, 20 bp, mouse
ggagctgtagaagacacgcg

SEQ ID NO: 433423 - DNA, 20 bp, mouse
ggagctgcgacaaggatcag

SEQ ID NO: 433424 - DNA, 20 bp, mouse
gcatagaagccgctgcctcc

SEQ ID NO: 433425 - DNA, 20 bp, mouse
ggaggctccgcgggagcgca

SEQ ID NO: 433426 - DNA, 20 bp, mouse
gggtcagctgactcccgtgg

SEQ ID NO: 433427 - DNA, 20 bp, mouse
gtatgggcggtgtgaaccaa

SEQ ID NO: 433428 - DNA, 20 bp, mouse
ggccccccggcgagacaatc

SEQ ID NO: 433429 - DNA, 20 bp, mouse
gaacctcgctcggaactcag

SEQ ID NO: 433430 - DNA, 20 bp, mouse
ggcgcctgcgcagtgagagg

SEQ ID NO: 433431 - DNA, 20 bp, mouse
ggagtcaccgtcaggatgtc

SEQ ID NO: 433432 - DNA, 20 bp, mouse
gcccggtcagctgactcccg

SEQ ID NO: 433433 - DNA, 20 bp, mouse
gggttcacaccgcccatatt

SEQ ID NO: 433434 - DNA, 20 bp, mouse
gaggagcgacccagaaacca

SEQ ID NO: 433435 - DNA, 20 bp, mouse
ggagagggcgctgtgacgaa

SEQ ID NO: 433436 - DNA, 20 bp, mouse
ggaatctgggttcaaagtgg

SEQ ID NO: 433437 - DNA, 20 bp, mouse
gccatggcgaaggcaaagtc

SEQ ID NO: 433438 - DNA, 20 bp, mouse
gaaggaagctggacctccca

SEQ ID NO: 433439 - DNA, 20 bp, mouse
ggaaggcaaagtccggccag

SEQ ID NO: 433440 - DNA, 20 bp, mouse
gttcgaatctgggttcaaag

SEQ ID NO: 433441 - DNA, 20 bp, mouse
gcagattcgaagctgtcccc

SEQ ID NO: 433442 - DNA, 20 bp, mouse
gctgagacgaaaaccctggg

SEQ ID NO: 433443 - DNA, 20 bp, mouse
gaacctgagacgaaaaccct

SEQ ID NO: 433444 - DNA, 20 bp, mouse
gacccgcgcccgagtgtcgg

SEQ ID NO: 433445 - DNA, 20 bp, mouse
ggcagagcagggtcttcggg

SEQ ID NO: 433446 - DNA, 20 bp, mouse
gactcccggcgccagaccaa

SEQ ID NO: 433447 - DNA, 20 bp, mouse
gtcggacacccggacatgtg

SEQ ID NO: 433448 - DNA, 20 bp, mouse
gtcctggcatggaagtggta

SEQ ID NO: 433449 - DNA, 20 bp, mouse
ggacacccggacatgtgtgg

SEQ ID NO: 433450 - DNA, 20 bp, mouse
ggggagccaccctagatgaa

SEQ ID NO: 433451 - DNA, 20 bp, mouse
gacattctgtgtcagactcc

SEQ ID NO: 433452 - DNA, 20 bp, mouse
gcccttaccacttccatgcc

SEQ ID NO: 433453 - DNA, 20 bp, mouse
gcaccctagatgaagggtaa

SEQ ID NO: 433454 - DNA, 20 bp, mouse
ggctccctgagtaactccaa

SEQ ID NO: 433455 - DNA, 20 bp, mouse
gtattcctccacacatgtcc

SEQ ID NO: 433456 - DNA, 20 bp, mouse
ggtgattggagacgaggaca

SEQ ID NO: 433457 - DNA, 20 bp, mouse
gaagggcggggtctctgcgg

SEQ ID NO: 433458 - DNA, 20 bp, mouse
gatcgcggtgattggagacg

SEQ ID NO: 433459 - DNA, 20 bp, mouse
gctacaagcacggggagaat

SEQ ID NO: 433460 - DNA, 20 bp, mouse
ggcccgccatcctgtccgcc

SEQ ID NO: 433461 - DNA, 20 bp, mouse
gagcgctctgcccggcggac

SEQ ID NO: 433462 - DNA, 20 bp, mouse
gtcgaagacactttcaggta

SEQ ID NO: 433463 - DNA, 20 bp, mouse
gggaactgcgcatgactgaa

SEQ ID NO: 433464 - DNA, 20 bp, mouse
gtggcggaggcccctgctca

SEQ ID NO: 433465 - DNA, 20 bp, mouse
gcaagcacggggagaattgg

SEQ ID NO: 433466 - DNA, 20 bp, mouse
gcgcaggcgcagagtctggg

SEQ ID NO: 433467 - DNA, 20 bp, mouse
ggtgatccgaggggcttcgg

SEQ ID NO: 433468 - DNA, 20 bp, mouse
gggtggatcaggtgatccga

SEQ ID NO: 433469 - DNA, 20 bp, mouse
ggtgcctgtggagacagtag

SEQ ID NO: 433470 - DNA, 20 bp, mouse
gcaggtgatccgaggggctt

SEQ ID NO: 433471 - DNA, 20 bp, mouse
gagtcagctgagacaccggg

SEQ ID NO: 433472 - DNA, 20 bp, mouse
gctaggctgggacggcgact

SEQ ID NO: 433473 - DNA, 20 bp, mouse
ggcaagcgtgagctccggga

SEQ ID NO: 433474 - DNA, 20 bp, mouse
gtgggagtcaccggactcaa

SEQ ID NO: 433475 - DNA, 20 bp, mouse
gcaagggatcgggatcgggt

SEQ ID NO: 433476 - DNA, 20 bp, mouse
gaggagctgctggataccct

SEQ ID NO: 433477 - DNA, 20 bp, mouse
gtggataccctgggtctgac

SEQ ID NO: 433478 - DNA, 20 bp, mouse
gggagtaggcgctggagggt

SEQ ID NO: 433479 - DNA, 20 bp, mouse
gctcctccaggctgagaagc

SEQ ID NO: 433480 - DNA, 20 bp, mouse
gagagaggatgctgttccga

SEQ ID NO: 433481 - DNA, 20 bp, mouse
gctggagggtgggagccgtc

SEQ ID NO: 433482 - DNA, 20 bp, mouse
gtacctcagtgaggttcgag

SEQ ID NO: 433483 - DNA, 20 bp, mouse
gtcagtctcctgcaccgggt

SEQ ID NO: 433484 - DNA, 20 bp, mouse
gtgggagccgtctggtacct

SEQ ID NO: 433485 - DNA, 20 bp, mouse
gtgggggactgaggctatta

SEQ ID NO: 433486 - DNA, 20 bp, mouse
gccctgagactggctggtca

SEQ ID NO: 433487 - DNA, 20 bp, mouse
ggccaaggacaagctagatg

SEQ ID NO: 433488 - DNA, 20 bp, mouse
gaccatgaccagccagtctc

SEQ ID NO: 433489 - DNA, 20 bp, mouse
gccaaggaaggtgacttcgg

SEQ ID NO: 433490 - DNA, 20 bp, mouse
ggctccaaggaaggtgactt

SEQ ID NO: 433491 - DNA, 20 bp, mouse
gtggatcccctgagactggc

SEQ ID NO: 433492 - DNA, 20 bp, mouse
gcggtggaagctgggagata

SEQ ID NO: 433493 - DNA, 20 bp, mouse
ggctgcagagttcctcctaa

SEQ ID NO: 433494 - DNA, 20 bp, mouse
gtggtgtcttgctccaagga

SEQ ID NO: 433495 - DNA, 20 bp, mouse
ggcctcatctagcttgtcct

SEQ ID NO: 433496 - DNA, 20 bp, mouse
ggagacccagagcagaacga

SEQ ID NO: 433497 - DNA, 20 bp, mouse
gaggctcgcaacgtctccca

SEQ ID NO: 433498 - DNA, 20 bp, mouse
gagaacgaaggcgactccgt

SEQ ID NO: 433499 - DNA, 20 bp, mouse
gcgttgcgagcctcactcag

SEQ ID NO: 433500 - DNA, 20 bp, mouse
gtcgagctccgaggtctcag

SEQ ID NO: 433501 - DNA, 20 bp, mouse
gttccggcttcctctgagtg

SEQ ID NO: 433502 - DNA, 20 bp, mouse
gagggaagcagagagcgcgg

SEQ ID NO: 433503 - DNA, 20 bp, mouse
gctctctgcttccctccgag

SEQ ID NO: 433504 - DNA, 20 bp, mouse
gtccgaggtctcagtggcca

SEQ ID NO: 433505 - DNA, 20 bp, mouse
gcgggcaaggctggcaccaa

SEQ ID NO: 433506 - DNA, 20 bp, mouse
gagctccgcagggcgcaggg

SEQ ID NO: 433507 - DNA, 20 bp, mouse
gggctttaccctctcaacca

SEQ ID NO: 433508 - DNA, 20 bp, mouse
gtggagctccgcagggcgca

SEQ ID NO: 433509 - DNA, 20 bp, mouse
gcgcacacacagaagagtct

SEQ ID NO: 433510 - DNA, 20 bp, mouse
gcacagaagagtctaggcgc

SEQ ID NO: 433511 - DNA, 20 bp, mouse
gtcccagagcggcttcccat

SEQ ID NO: 433512 - DNA, 20 bp, mouse
ggcggcagctcctccctcga

SEQ ID NO: 433513 - DNA, 20 bp, mouse
gaggtcaccactttaagctg

SEQ ID NO: 433514 - DNA, 20 bp, mouse
gtcttctgtgtgtgcgagcg

SEQ ID NO: 433515 - DNA, 20 bp, mouse
gttgtctgtacgatctagga

SEQ ID NO: 433516 - DNA, 20 bp, mouse
gatgcctgaacaggagagac

SEQ ID NO: 433517 - DNA, 20 bp, mouse
gagcaggtgcgtacacgctg

SEQ ID NO: 433518 - DNA, 20 bp, mouse
ggaagaacttggcgtctgtg

SEQ ID NO: 433519 - DNA, 20 bp, mouse
ggtgcgtacacgctgcggtc

SEQ ID NO: 433520 - DNA, 20 bp, mouse
gcacagccaaagaggccagt

SEQ ID NO: 433521 - DNA, 20 bp, mouse
ggtggggacgatgcctgaac

SEQ ID NO: 433522 - DNA, 20 bp, mouse
gacacgctgcggtcaggcaa

SEQ ID NO: 433523 - DNA, 20 bp, mouse
gagacaggtcacagccaaag

SEQ ID NO: 433524 - DNA, 20 bp, mouse
gactttccgactggcctctt

SEQ ID NO: 433525 - DNA, 20 bp, mouse
gggaaaaccctctagatcaa

SEQ ID NO: 433526 - DNA, 20 bp, mouse
ggagccgcctgggcactgga

SEQ ID NO: 433527 - DNA, 20 bp, mouse
ggggccgcgcctcccaccca

SEQ ID NO: 433528 - DNA, 20 bp, mouse
ggcctgggcactggacggga

SEQ ID NO: 433529 - DNA, 20 bp, mouse
gtcgccgccaggagccgcct

SEQ ID NO: 433530 - DNA, 20 bp, mouse
gcactgcggggagacctagg

SEQ ID NO: 433531 - DNA, 20 bp, mouse
gggagacctaggcggctctg

SEQ ID NO: 433532 - DNA, 20 bp, mouse
gtgccactgcggggagacct

SEQ ID NO: 433533 - DNA, 20 bp, mouse
ggtgcccaggcggctcctgg

SEQ ID NO: 433534 - DNA, 20 bp, mouse
gcggcgacgctgccctgggt

SEQ ID NO: 433535 - DNA, 20 bp, mouse
ggtgcgcccagagtgcgtgg

SEQ ID NO: 433536 - DNA, 20 bp, mouse
ggctacggtctagtctccag

SEQ ID NO: 433537 - DNA, 20 bp, mouse
gtcttctgcgggctacaaga

SEQ ID NO: 433538 - DNA, 20 bp, mouse
gaggggcaggctaggtgcat

SEQ ID NO: 433539 - DNA, 20 bp, mouse
gtctgttggagaccagctag

SEQ ID NO: 433540 - DNA, 20 bp, mouse
gggcaggctaggtgcatagg

SEQ ID NO: 433541 - DNA, 20 bp, mouse
gaggatgctctggagagact

SEQ ID NO: 433542 - DNA, 20 bp, mouse
gtagtctccaggggcaggct

SEQ ID NO: 433543 - DNA, 20 bp, mouse
gccagccgcgaaggatgctc

SEQ ID NO: 433544 - DNA, 20 bp, mouse
ggcagaggatgagatgtccc

SEQ ID NO: 433545 - DNA, 20 bp, mouse
gaacgggtcctgcagaatcg

SEQ ID NO: 433546 - DNA, 20 bp, mouse
gagcgctgcatggcacacag

SEQ ID NO: 433547 - DNA, 20 bp, mouse
ggagtcgcggccaactggac

SEQ ID NO: 433548 - DNA, 20 bp, mouse
gcaactggacaggcttcccg

SEQ ID NO: 433549 - DNA, 20 bp, mouse
ggaggcgagaggctcctccc

SEQ ID NO: 433550 - DNA, 20 bp, mouse
gagtgagcactaggtaagag

SEQ ID NO: 433551 - DNA, 20 bp, mouse
gtccgtgcgcccttcctagg

SEQ ID NO: 433552 - DNA, 20 bp, mouse
gcaaccatggaccatggcgg

SEQ ID NO: 433553 - DNA, 20 bp, mouse
gaagggctgccgcctaggaa

SEQ ID NO: 433554 - DNA, 20 bp, mouse
ggctcccttgggtgatccac

SEQ ID NO: 433555 - DNA, 20 bp, mouse
gctgaggagtcgcggccaac

SEQ ID NO: 433556 - DNA, 20 bp, mouse
gggctctcctgacccccccg

SEQ ID NO: 433557 - DNA, 20 bp, mouse
gtagcgggccggggccccgg

SEQ ID NO: 433558 - DNA, 20 bp, mouse
gggccgcggggcggaagtga

SEQ ID NO: 433559 - DNA, 20 bp, mouse
gcgcgcggagcgctaaggta

SEQ ID NO: 433560 - DNA, 20 bp, mouse
gcgaaactgacacaaagtag

SEQ ID NO: 433561 - DNA, 20 bp, mouse
ggggtgtggaccgggagggt

SEQ ID NO: 433562 - DNA, 20 bp, mouse
gtccctctctaggcacctaa

SEQ ID NO: 433563 - DNA, 20 bp, mouse
ggtaaggcgctgccaccgtg

SEQ ID NO: 433564 - DNA, 20 bp, mouse
ggagagaagggctaccagga

SEQ ID NO: 433565 - DNA, 20 bp, mouse
gaggagagccgggctgctgt

SEQ ID NO: 433566 - DNA, 20 bp, mouse
gcagtcctgaggttcgggag

SEQ ID NO: 433567 - DNA, 20 bp, mouse
gagctccgctcccgaacctc

SEQ ID NO: 433568 - DNA, 20 bp, mouse
gagcggagctcctgcagagc

SEQ ID NO: 433569 - DNA, 20 bp, mouse
ggactgaggcgagctccgag

SEQ ID NO: 433570 - DNA, 20 bp, mouse
gagctggtggtcccaggcgc

SEQ ID NO: 433571 - DNA, 20 bp, mouse
gctcacggccacctgcgcct

SEQ ID NO: 433572 - DNA, 20 bp, mouse
ggcgcaggtggccgtgagga

SEQ ID NO: 433573 - DNA, 20 bp, mouse
gcggcccgggcccacttctc

SEQ ID NO: 433574 - DNA, 20 bp, mouse
ggaagggaggctaaagacaa

SEQ ID NO: 433575 - DNA, 20 bp, mouse
gtggtggtcccaggcgcagg

SEQ ID NO: 433576 - DNA, 20 bp, mouse
ggctaacagctccacaacat

SEQ ID NO: 433577 - DNA, 20 bp, mouse
gaacagctccacaacatcgg

SEQ ID NO: 433578 - DNA, 20 bp, mouse
gtccagggccgccgatgttg

SEQ ID NO: 433579 - DNA, 20 bp, mouse
ggggccgccagcggcgtcca

SEQ ID NO: 433580 - DNA, 20 bp, mouse
ggggcctggctgcctagggc

SEQ ID NO: 433581 - DNA, 20 bp, mouse
gctgtaggtaagctccacct

SEQ ID NO: 433582 - DNA, 20 bp, mouse
gtgcgagggccgggcttggt

SEQ ID NO: 433583 - DNA, 20 bp, mouse
gccacccgtttcagacccgt

SEQ ID NO: 433584 - DNA, 20 bp, mouse
gcagcacttgagacaggaga

SEQ ID NO: 433585 - DNA, 20 bp, mouse
gtccacaacatcggcggccc

SEQ ID NO: 433586 - DNA, 20 bp, mouse
gagacacgaggagtgaacag

SEQ ID NO: 433587 - DNA, 20 bp, mouse
gagaggattgtggaaagtga

SEQ ID NO: 433588 - DNA, 20 bp, mouse
gtagggaagatgactcatga

SEQ ID NO: 433589 - DNA, 20 bp, mouse
gtttctgaagtgcagacacg

SEQ ID NO: 433590 - DNA, 20 bp, mouse
gcctgtcttggtccagacct

SEQ ID NO: 433591 - DNA, 20 bp, mouse
gcccatgagcagaaacaaga

SEQ ID NO: 433592 - DNA, 20 bp, mouse
gaccgcctaggcagggatgc

SEQ ID NO: 433593 - DNA, 20 bp, mouse
gtaggcggtgggtatcatct

SEQ ID NO: 433594 - DNA, 20 bp, mouse
gcatcctcgttaaagtggaa

SEQ ID NO: 433595 - DNA, 20 bp, mouse
ggatacccaccgcctaggca

SEQ ID NO: 433596 - DNA, 20 bp, mouse
ggtgaggcgacggtaagtag

SEQ ID NO: 433597 - DNA, 20 bp, mouse
gagatggaggttgctggagt

SEQ ID NO: 433598 - DNA, 20 bp, mouse
ggaaaggtgcgttaagatgg

SEQ ID NO: 433599 - DNA, 20 bp, mouse
gccctgtgggagcaacctgg

SEQ ID NO: 433600 - DNA, 20 bp, mouse
gggcgcccgaggagaagtta

SEQ ID NO: 433601 - DNA, 20 bp, mouse
ggtaggaggctgtgaggcga

SEQ ID NO: 433602 - DNA, 20 bp, mouse
gctgtggcacaagcgcagaa

SEQ ID NO: 433603 - DNA, 20 bp, mouse
ggcagaaaggtgcgttaaga

SEQ ID NO: 433604 - DNA, 20 bp, mouse
ggcgttaagatggaggttgc

SEQ ID NO: 433605 - DNA, 20 bp, mouse
gaaaaccgtaacttctcctc

SEQ ID NO: 433606 - DNA, 20 bp, mouse
ggcccgcgcggcccgaccga

SEQ ID NO: 433607 - DNA, 20 bp, mouse
gggccgggcccgcagcgcag

SEQ ID NO: 433608 - DNA, 20 bp, mouse
gcggagcggggcccatggtg

SEQ ID NO: 433609 - DNA, 20 bp, mouse
gatggtgcggccgtgtccgt

SEQ ID NO: 433610 - DNA, 20 bp, mouse
ggcccgtgcgccacaagaag

SEQ ID NO: 433611 - DNA, 20 bp, mouse
gtccgtcggtcgggccgcgc

SEQ ID NO: 433612 - DNA, 20 bp, mouse
gcaagaagcgggtggacagt

SEQ ID NO: 433613 - DNA, 20 bp, mouse
gcgccaatcggagcccctgg

SEQ ID NO: 433614 - DNA, 20 bp, mouse
gacactgcggcggccccggg

SEQ ID NO: 433615 - DNA, 20 bp, mouse
gaggagagaatgcccggggt

SEQ ID NO: 433616 - DNA, 20 bp, mouse
gagggccgaagcgcacccca

SEQ ID NO: 433617 - DNA, 20 bp, mouse
ggccgaagcgcaccccaggg

SEQ ID NO: 433618 - DNA, 20 bp, mouse
gactggaaactgagtagact

SEQ ID NO: 433619 - DNA, 20 bp, mouse
gggtgcgcttcggccctgac

SEQ ID NO: 433620 - DNA, 20 bp, mouse
gctgccccacagcctcagct

SEQ ID NO: 433621 - DNA, 20 bp, mouse
gcgaccggcgcggcaggtaa

SEQ ID NO: 433622 - DNA, 20 bp, mouse
gcaggcaggccggagcatgg

SEQ ID NO: 433623 - DNA, 20 bp, mouse
ggggagattccgccgagctg

SEQ ID NO: 433624 - DNA, 20 bp, mouse
gaaactgagtagactcggct

SEQ ID NO: 433625 - DNA, 20 bp, mouse
gccgcccgcgcccggctcaa

SEQ ID NO: 433626 - DNA, 20 bp, mouse
ggagtcgcaggcggccatgg

SEQ ID NO: 433627 - DNA, 20 bp, mouse
ggggcacgctccacccgcag

SEQ ID NO: 433628 - DNA, 20 bp, mouse
ggctgacgcgcccgaggagg

SEQ ID NO: 433629 - DNA, 20 bp, mouse
ggaggctgacgcgcccgagg

SEQ ID NO: 433630 - DNA, 20 bp, mouse
gcgacacccctagagcgggt

SEQ ID NO: 433631 - DNA, 20 bp, mouse
ggcggcggtagtgtccgctg

SEQ ID NO: 433632 - DNA, 20 bp, mouse
gtgagcgcgcggaacctcgg

SEQ ID NO: 433633 - DNA, 20 bp, mouse
ggtagagacccgccacctgc

SEQ ID NO: 433634 - DNA, 20 bp, mouse
gcggtagtgtccgctgcggg

SEQ ID NO: 433635 - DNA, 20 bp, mouse
ggcggctgcgcactgcacac

SEQ ID NO: 433636 - DNA, 20 bp, mouse
gggcgtgctgaggaggctga

SEQ ID NO: 433637 - DNA, 20 bp, mouse
ggctgagggctatgaaccct

SEQ ID NO: 433638 - DNA, 20 bp, mouse
gagatggcggcgtgctgagg

SEQ ID NO: 433639 - DNA, 20 bp, mouse
ggtaggtgtcatgaggaaga

SEQ ID NO: 433640 - DNA, 20 bp, mouse
ggctatgaacccttggtgag

SEQ ID NO: 433641 - DNA, 20 bp, mouse
gtccgtacagaaccagcgag

SEQ ID NO: 433642 - DNA, 20 bp, mouse
ggcgcgccgtaggtgtcatg

SEQ ID NO: 433643 - DNA, 20 bp, mouse
ggtacggaaacctctcacca

SEQ ID NO: 433644 - DNA, 20 bp, mouse
gcggccatactgagacggtg

SEQ ID NO: 433645 - DNA, 20 bp, mouse
ggatgtggcgaatctacccc

SEQ ID NO: 433646 - DNA, 20 bp, mouse
gtgagcaacgccgaagacaa

SEQ ID NO: 433647 - DNA, 20 bp, mouse
gcagtcggatagcatggata

SEQ ID NO: 433648 - DNA, 20 bp, mouse
gccgactgcaaagagagtcg

SEQ ID NO: 433649 - DNA, 20 bp, mouse
gcctagcgcgctaactgcga

SEQ ID NO: 433650 - DNA, 20 bp, mouse
gggacagggaggacgactgg

SEQ ID NO: 433651 - DNA, 20 bp, mouse
gtcgtggacgtgaaaagaaa

SEQ ID NO: 433652 - DNA, 20 bp, mouse
gcaagggaccaggtaaagat

SEQ ID NO: 433653 - DNA, 20 bp, mouse
gagagagcgtagaaaggaca

SEQ ID NO: 433654 - DNA, 20 bp, mouse
gtctcggactcggtaggtgg

SEQ ID NO: 433655 - DNA, 20 bp, mouse
gagcgcgctaactgcgaggg

SEQ ID NO: 433656 - DNA, 20 bp, mouse
gcgcccatggtgacaccgag

SEQ ID NO: 433657 - DNA, 20 bp, mouse
ggacgctccgccctctccac

SEQ ID NO: 433658 - DNA, 20 bp, mouse
gtggagaagcccggcgccgg

SEQ ID NO: 433659 - DNA, 20 bp, mouse
gagccgctcggtgtcaccat

SEQ ID NO: 433660 - DNA, 20 bp, mouse
gtgtcaccatgggcgaccac

SEQ ID NO: 433661 - DNA, 20 bp, mouse
ggccactgtgagggagggaa

SEQ ID NO: 433662 - DNA, 20 bp, mouse
gtccagcccgtggtcgccca

SEQ ID NO: 433663 - DNA, 20 bp, mouse
gactgtgagggagggaacgg

SEQ ID NO: 433664 - DNA, 20 bp, mouse
gccgccctctccaccggagg

SEQ ID NO: 433665 - DNA, 20 bp, mouse
gctgtggagaagcccggcgc

SEQ ID NO: 433666 - DNA, 20 bp, mouse
gtcgcgagctgtcaagacgg

SEQ ID NO: 433667 - DNA, 20 bp, mouse
gtggcgtctcgggagtcagg

SEQ ID NO: 433668 - DNA, 20 bp, mouse
gcagtgggaaatggcgtctc

SEQ ID NO: 433669 - DNA, 20 bp, mouse
ggagctggcagaagaaccct

SEQ ID NO: 433670 - DNA, 20 bp, mouse
gtcaagacggtggaaagcag

SEQ ID NO: 433671 - DNA, 20 bp, mouse
gtgtacctcaggtagagcca

SEQ ID NO: 433672 - DNA, 20 bp, mouse
gcacgcccagaaccaggagc

SEQ ID NO: 433673 - DNA, 20 bp, mouse
gaaatggcgtctcgggagtc

SEQ ID NO: 433674 - DNA, 20 bp, mouse
gagaaccctgggactcgtct

SEQ ID NO: 433675 - DNA, 20 bp, mouse
gagggcccggggaagcttca

SEQ ID NO: 433676 - DNA, 20 bp, mouse
gtggaaggcgaggggaacgg

SEQ ID NO: 433677 - DNA, 20 bp, mouse
gggccagctcaggctttctg

SEQ ID NO: 433678 - DNA, 20 bp, mouse
gcgctggaaggcgaggggaa

SEQ ID NO: 433679 - DNA, 20 bp, mouse
gggagacgctggaaggcgag

SEQ ID NO: 433680 - DNA, 20 bp, mouse
gcgggcggttgggccagctc

SEQ ID NO: 433681 - DNA, 20 bp, mouse
ggagcacgcggaatttactg

SEQ ID NO: 433682 - DNA, 20 bp, mouse
gctgtggacaaggctgtgct

SEQ ID NO: 433683 - DNA, 20 bp, mouse
gcggaccccgaagacccatt

SEQ ID NO: 433684 - DNA, 20 bp, mouse
gtgcgggttgaaggtagtca

SEQ ID NO: 433685 - DNA, 20 bp, mouse
gcggcggcgcgcgggcggtt

SEQ ID NO: 433686 - DNA, 20 bp, mouse
ggcagcagcgaaaagagcag

SEQ ID NO: 433687 - DNA, 20 bp, mouse
gcagcgcctgcgggcaggaa

SEQ ID NO: 433688 - DNA, 20 bp, mouse
gccaccgccaccatcttcct

SEQ ID NO: 433689 - DNA, 20 bp, mouse
gcgactgaggcgcggctgag

SEQ ID NO: 433690 - DNA, 20 bp, mouse
ggcgcccgcgacagcacccg

SEQ ID NO: 433691 - DNA, 20 bp, mouse
gctagcacggccaggcgaag

SEQ ID NO: 433692 - DNA, 20 bp, mouse
gcgggaggccgaggccgctg

SEQ ID NO: 433693 - DNA, 20 bp, mouse
ggccggtgccagggttgcag

SEQ ID NO: 433694 - DNA, 20 bp, mouse
gcgcccggctgtgtctaccg

SEQ ID NO: 433695 - DNA, 20 bp, mouse
gaccggccgtgtgtcaacgg

SEQ ID NO: 433696 - DNA, 20 bp, mouse
ggagccgaaccctgcagcca

SEQ ID NO: 433697 - DNA, 20 bp, mouse
ggccacggtagctccgggag

SEQ ID NO: 433698 - DNA, 20 bp, mouse
gtcgccgaggacaaggtcag

SEQ ID NO: 433699 - DNA, 20 bp, mouse
gtccgctcccggagctaccg

SEQ ID NO: 433700 - DNA, 20 bp, mouse
ggctcccctgaccttgtcct

SEQ ID NO: 433701 - DNA, 20 bp, mouse
gctgcagccacggtagctcc

SEQ ID NO: 433702 - DNA, 20 bp, mouse
gcgggagcggagcgaagagc

SEQ ID NO: 433703 - DNA, 20 bp, mouse
ggatgcccgagtgtgactgg

SEQ ID NO: 433704 - DNA, 20 bp, mouse
gcgctccggaggggacccga

SEQ ID NO: 433705 - DNA, 20 bp, mouse
ggcggcggcgaggtcctctg

SEQ ID NO: 433706 - DNA, 20 bp, mouse
gaagcctcggcccaacaaaa

SEQ ID NO: 433707 - DNA, 20 bp, mouse
ggctgctgctgcaagagcca

SEQ ID NO: 433708 - DNA, 20 bp, mouse
gagcgcagaacggtacccaa

SEQ ID NO: 433709 - DNA, 20 bp, mouse
gacgccggggcccgtgacaa

SEQ ID NO: 433710 - DNA, 20 bp, mouse
ggacgatccagcactatctg

SEQ ID NO: 433711 - DNA, 20 bp, mouse
gggcgccgaggagcgcagaa

SEQ ID NO: 433712 - DNA, 20 bp, mouse
gaacaaaatggcgtcggcat

SEQ ID NO: 433713 - DNA, 20 bp, mouse
gcttggcttggcaacccctt

SEQ ID NO: 433714 - DNA, 20 bp, mouse
gaggccttgctttgtttccg

SEQ ID NO: 433715 - DNA, 20 bp, mouse
ggcccgggagcagaacgccg

SEQ ID NO: 433716 - DNA, 20 bp, mouse
gctctagctgcggctccaca

SEQ ID NO: 433717 - DNA, 20 bp, mouse
gcagtgaaacaggtcctgta

SEQ ID NO: 433718 - DNA, 20 bp, mouse
gtacagtggaggagccgtac

SEQ ID NO: 433719 - DNA, 20 bp, mouse
ggacatcatttctactacag

SEQ ID NO: 433720 - DNA, 20 bp, mouse
gctccggagagagcagattg

SEQ ID NO: 433721 - DNA, 20 bp, mouse
ggctgctgtagctctagctg

SEQ ID NO: 433722 - DNA, 20 bp, mouse
ggatccccctgcagtgaaac

SEQ ID NO: 433723 - DNA, 20 bp, mouse
gatcatttctactacagtgg

SEQ ID NO: 433724 - DNA, 20 bp, mouse
ggtagtagaaatgatgtctg

SEQ ID NO: 433725 - DNA, 20 bp, mouse
ggagcaggagcggctagcaa

SEQ ID NO: 433726 - DNA, 20 bp, mouse
ggccgggagggtggcatcct

SEQ ID NO: 433727 - DNA, 20 bp, mouse
gcgaagaggacaaggcgacg

SEQ ID NO: 433728 - DNA, 20 bp, mouse
ggcctcaggcgaagaggaca

SEQ ID NO: 433729 - DNA, 20 bp, mouse
ggcagagcgaagagaagtgg

SEQ ID NO: 433730 - DNA, 20 bp, mouse
gagagcgagtggcaagatgg

SEQ ID NO: 433731 - DNA, 20 bp, mouse
gccgcgtcacccagatcccg

SEQ ID NO: 433732 - DNA, 20 bp, mouse
gcccagagcgagtggcaaga

SEQ ID NO: 433733 - DNA, 20 bp, mouse
ggccttgtcctcttcgcctg

SEQ ID NO: 433734 - DNA, 20 bp, mouse
gtggcttgcctcaggcgaag

SEQ ID NO: 433735 - DNA, 20 bp, mouse
gtgatgcccgacagccggga

SEQ ID NO: 433736 - DNA, 20 bp, mouse
gccgcgggccccctaaacag

SEQ ID NO: 433737 - DNA, 20 bp, mouse
ggacgagcgggaggagtcct

SEQ ID NO: 433738 - DNA, 20 bp, mouse
gccgggcgcccggcttgggg

SEQ ID NO: 433739 - DNA, 20 bp, mouse
gtgcgctcaacgccatctcc

SEQ ID NO: 433740 - DNA, 20 bp, mouse
ggtgaggcaacgggcttcta

SEQ ID NO: 433741 - DNA, 20 bp, mouse
ggcggcggctccgggacgag

SEQ ID NO: 433742 - DNA, 20 bp, mouse
gcaagccgggcgcccggaga

SEQ ID NO: 433743 - DNA, 20 bp, mouse
ggggggtgcccgctgggtgt

SEQ ID NO: 433744 - DNA, 20 bp, mouse
gaggcaacgggcttctaggg

SEQ ID NO: 433745 - DNA, 20 bp, mouse
gcctgggttcggagctctag

SEQ ID NO: 433746 - DNA, 20 bp, mouse
gaacagtctgaggcgcaggg

SEQ ID NO: 433747 - DNA, 20 bp, mouse
gttgctaccaaaacagtctg

SEQ ID NO: 433748 - DNA, 20 bp, mouse
gtggtgagcggcccatacac

SEQ ID NO: 433749 - DNA, 20 bp, mouse
gcaacgacgaaggggcgggg

SEQ ID NO: 433750 - DNA, 20 bp, mouse
gccgccgaggaagacgccac

SEQ ID NO: 433751 - DNA, 20 bp, mouse
gcagcaggacaacgacgaag

SEQ ID NO: 433752 - DNA, 20 bp, mouse
gcaacggccacggcgcgtcc

SEQ ID NO: 433753 - DNA, 20 bp, mouse
gcgctccggcgtctcctcct

SEQ ID NO: 433754 - DNA, 20 bp, mouse
gcagacaccgagcagccgcc

SEQ ID NO: 433755 - DNA, 20 bp, mouse
gggcgtgcgagccggtgtat

SEQ ID NO: 433756 - DNA, 20 bp, mouse
ggggtggatcgagaagacgg

SEQ ID NO: 433757 - DNA, 20 bp, mouse
gagccccgcggtgtcagggg

SEQ ID NO: 433758 - DNA, 20 bp, mouse
gcaggggtggatcgagaaga

SEQ ID NO: 433759 - DNA, 20 bp, mouse
ggaaagagatcgccaagcag

SEQ ID NO: 433760 - DNA, 20 bp, mouse
gaagcgccgcgaggcggaag

SEQ ID NO: 433761 - DNA, 20 bp, mouse
ggcgggaccagccctcccaa

SEQ ID NO: 433762 - DNA, 20 bp, mouse
gggctccccccgcccgccaa

SEQ ID NO: 433763 - DNA, 20 bp, mouse
ggccgcgaggcggaagggga

SEQ ID NO: 433764 - DNA, 20 bp, mouse
gcgcgtcgctggagaaggag

SEQ ID NO: 433765 - DNA, 20 bp, mouse
gtccccccgcccgccaacgg

SEQ ID NO: 433766 - DNA, 20 bp, mouse
ggcccacactcactttctcg

SEQ ID NO: 433767 - DNA, 20 bp, mouse
gggctccagacaaataaaca

SEQ ID NO: 433768 - DNA, 20 bp, mouse
gctacccgcccggtcttcta

SEQ ID NO: 433769 - DNA, 20 bp, mouse
gtgagtgtgggcgttcggtg

SEQ ID NO: 433770 - DNA, 20 bp, mouse
gtgtctggagccaacggccc

SEQ ID NO: 433771 - DNA, 20 bp, mouse
gtgccgggaacgcatgcggg

SEQ ID NO: 433772 - DNA, 20 bp, mouse
gctcgccctagaagaccggg

SEQ ID NO: 433773 - DNA, 20 bp, mouse
gaccctcgccctagaagacc

SEQ ID NO: 433774 - DNA, 20 bp, mouse
gtttatttgtctggagccaa

SEQ ID NO: 433775 - DNA, 20 bp, mouse
gcttcacgagcggagccatg

SEQ ID NO: 433776 - DNA, 20 bp, mouse
gatgcgagcgcccgcagggt

SEQ ID NO: 433777 - DNA, 20 bp, mouse
gcccgcggctgcccaccctg

SEQ ID NO: 433778 - DNA, 20 bp, mouse
gcgcgcgtccgtccgagcgg

SEQ ID NO: 433779 - DNA, 20 bp, mouse
gcgcagccggcgccctacga

SEQ ID NO: 433780 - DNA, 20 bp, mouse
gcccggccggctcccttaag

SEQ ID NO: 433781 - DNA, 20 bp, mouse
ggtccgcgcgtccgtccgag

SEQ ID NO: 433782 - DNA, 20 bp, mouse
ggcctcccgcggccctcgta

SEQ ID NO: 433783 - DNA, 20 bp, mouse
gaggaggcgcctccgcttaa

SEQ ID NO: 433784 - DNA, 20 bp, mouse
ggcaggcaggcctgaggtcg

SEQ ID NO: 433785 - DNA, 20 bp, mouse
gaggcgaaagcgaaagccgg

SEQ ID NO: 433786 - DNA, 20 bp, mouse
ggccactgacggcagatccc

SEQ ID NO: 433787 - DNA, 20 bp, mouse
gtcgtagcatcagattaagt

SEQ ID NO: 433788 - DNA, 20 bp, mouse
gcctctgggacgctccgaag

SEQ ID NO: 433789 - DNA, 20 bp, mouse
gtccctggcacgtttgtcgt

SEQ ID NO: 433790 - DNA, 20 bp, mouse
gaccacttacagaacgactc

SEQ ID NO: 433791 - DNA, 20 bp, mouse
ggccagggatctgccgtcag

SEQ ID NO: 433792 - DNA, 20 bp, mouse
gcggagcgtcccagaggaaa

SEQ ID NO: 433793 - DNA, 20 bp, mouse
ggcccgagtcgttctgtaag

SEQ ID NO: 433794 - DNA, 20 bp, mouse
ggccctgcccaggagccagt

SEQ ID NO: 433795 - DNA, 20 bp, mouse
gcctctgtcattttttacga

SEQ ID NO: 433796 - DNA, 20 bp, mouse
gagcaatggccgctctggag

SEQ ID NO: 433797 - DNA, 20 bp, mouse
gggcactcgccgctccagag

SEQ ID NO: 433798 - DNA, 20 bp, mouse
ggcggtgcgtgaacgcgcgg

SEQ ID NO: 433799 - DNA, 20 bp, mouse
gggacagagctggagctcgt

SEQ ID NO: 433800 - DNA, 20 bp, mouse
gccgcgaagtcatcgagact

SEQ ID NO: 433801 - DNA, 20 bp, mouse
ggccggacggcggctctagt

SEQ ID NO: 433802 - DNA, 20 bp, mouse
gcagagctggagctcgtggg

SEQ ID NO: 433803 - DNA, 20 bp, mouse
ggtggcagcaatggccgctc

SEQ ID NO: 433804 - DNA, 20 bp, mouse
gagggccccctccagctgag

SEQ ID NO: 433805 - DNA, 20 bp, mouse
gggacggcggctctagtcgg

SEQ ID NO: 433806 - DNA, 20 bp, mouse
gcgacgggacgagaagggag

SEQ ID NO: 433807 - DNA, 20 bp, mouse
gtccatccatcctccggtcg

SEQ ID NO: 433808 - DNA, 20 bp, mouse
gggcggcgacgggacgagaa

SEQ ID NO: 433809 - DNA, 20 bp, mouse
gcgcaccccccgcccgggag

SEQ ID NO: 433810 - DNA, 20 bp, mouse
gccagcccgcctctcccggg

SEQ ID NO: 433811 - DNA, 20 bp, mouse
ggcgtgccgcgaccggagga

SEQ ID NO: 433812 - DNA, 20 bp, mouse
ggcgcgcgtgccgcgaccgg

SEQ ID NO: 433813 - DNA, 20 bp, mouse
ggcggggtgagtacagaaca

SEQ ID NO: 433814 - DNA, 20 bp, mouse
gggcgcgcgaaagcgaaagg

SEQ ID NO: 433815 - DNA, 20 bp, mouse
ggcgctgacccagacctggg

SEQ ID NO: 433816 - DNA, 20 bp, mouse
gcgagaggaagaggcccgaa

SEQ ID NO: 433817 - DNA, 20 bp, mouse
gaggcccgaacggctgggtg

SEQ ID NO: 433818 - DNA, 20 bp, mouse
gggaagaggcccgaacggct

SEQ ID NO: 433819 - DNA, 20 bp, mouse
gggcccagactgtcagcgag

SEQ ID NO: 433820 - DNA, 20 bp, mouse
gctcgccgcgaaaaccgtct

SEQ ID NO: 433821 - DNA, 20 bp, mouse
gttcgcggcgagccgggctc

SEQ ID NO: 433822 - DNA, 20 bp, mouse
gcggaggacgaggcccggag

SEQ ID NO: 433823 - DNA, 20 bp, mouse
gggcgccgagacggttttcg

SEQ ID NO: 433824 - DNA, 20 bp, mouse
gtctgagctgcacccgagcc

SEQ ID NO: 433825 - DNA, 20 bp, mouse
gagggcgctggctttactca

SEQ ID NO: 433826 - DNA, 20 bp, mouse
gagctcggaggtgaagacgg

SEQ ID NO: 433827 - DNA, 20 bp, mouse
gctgtaaacatacaacatgg

SEQ ID NO: 433828 - DNA, 20 bp, mouse
gcgcgtgcggcacctggagg

SEQ ID NO: 433829 - DNA, 20 bp, mouse
ggctctgggcgccttgagaa

SEQ ID NO: 433830 - DNA, 20 bp, mouse
gccgctgtaaacatacaaca

SEQ ID NO: 433831 - DNA, 20 bp, mouse
gtgggcgccttgagaacggt

SEQ ID NO: 433832 - DNA, 20 bp, mouse
gcggacgccaaccgttctca

SEQ ID NO: 433833 - DNA, 20 bp, mouse
gcagccggggcagacctccg

SEQ ID NO: 433834 - DNA, 20 bp, mouse
gagcgtgtagtacagggcca

SEQ ID NO: 433835 - DNA, 20 bp, mouse
gtacagctcggaggtgaaga

SEQ ID NO: 433836 - DNA, 20 bp, mouse
gaggcatagagggcccgagg

SEQ ID NO: 433837 - DNA, 20 bp, mouse
gggccctctatgcctcatgg

SEQ ID NO: 433838 - DNA, 20 bp, mouse
gcatagagggcccgaggagg

SEQ ID NO: 433839 - DNA, 20 bp, mouse
gggccgccatgaggcataga

SEQ ID NO: 433840 - DNA, 20 bp, mouse
gtcgggccctctatgcctca

SEQ ID NO: 433841 - DNA, 20 bp, mouse
ggtggcgggagatctgaacg

SEQ ID NO: 433842 - DNA, 20 bp, mouse
ggggagatctgaacgcgggt

SEQ ID NO: 433843 - DNA, 20 bp, mouse
ggcctgaggcgccagttcaa

SEQ ID NO: 433844 - DNA, 20 bp, mouse
gtgggtagaccgcaccctgt

SEQ ID NO: 433845 - DNA, 20 bp, mouse
gacaccacacgcctcctcct

SEQ ID NO: 433846 - DNA, 20 bp, mouse
gcgcggccctgcgaagatgg

SEQ ID NO: 433847 - DNA, 20 bp, mouse
ggaagagtcgcaggaccagg

SEQ ID NO: 433848 - DNA, 20 bp, mouse
gcgcagccgcttcaggagag

SEQ ID NO: 433849 - DNA, 20 bp, mouse
gcccagctccggggccggag

SEQ ID NO: 433850 - DNA, 20 bp, mouse
ggcgaagatggcggcgacag

SEQ ID NO: 433851 - DNA, 20 bp, mouse
gccccgcggccctgcgaaga

SEQ ID NO: 433852 - DNA, 20 bp, mouse
gggaacctcccccagctccg

SEQ ID NO: 433853 - DNA, 20 bp, mouse
gccaggaggcagaggccgac

SEQ ID NO: 433854 - DNA, 20 bp, mouse
gcaggaagacgtggagcccg

SEQ ID NO: 433855 - DNA, 20 bp, mouse
ggcgagtcaaagagccgctc

SEQ ID NO: 433856 - DNA, 20 bp, mouse
gatgtccctttccaactcac

SEQ ID NO: 433857 - DNA, 20 bp, mouse
gagctaccgggatcgcttgg

SEQ ID NO: 433858 - DNA, 20 bp, mouse
gcgggatcgcttggaggctt

SEQ ID NO: 433859 - DNA, 20 bp, mouse
ggaagagcagcaccagtcct

SEQ ID NO: 433860 - DNA, 20 bp, mouse
ggagaacctttgaattgtaa

SEQ ID NO: 433861 - DNA, 20 bp, mouse
gagtcctgggcactctacga

SEQ ID NO: 433862 - DNA, 20 bp, mouse
ggtgagtaagatggcgagaa

SEQ ID NO: 433863 - DNA, 20 bp, mouse
ggtgcgcctgcgcccagcta

SEQ ID NO: 433864 - DNA, 20 bp, mouse
gcaggttcctgcctgtgagt

SEQ ID NO: 433865 - DNA, 20 bp, mouse
gtcctgcctgtgagttggaa

SEQ ID NO: 433866 - DNA, 20 bp, mouse
ggcggggctcagatgatgag

SEQ ID NO: 433867 - DNA, 20 bp, mouse
ggggctcagatgatgagcgg

SEQ ID NO: 433868 - DNA, 20 bp, mouse
gaccagctgaggtcacgcag

SEQ ID NO: 433869 - DNA, 20 bp, mouse
gattcggtgggcctgttgcg

SEQ ID NO: 433870 - DNA, 20 bp, mouse
gcggaagtggtcgaggtcag

SEQ ID NO: 433871 - DNA, 20 bp, mouse
gaggtcagaggcgacctgat

SEQ ID NO: 433872 - DNA, 20 bp, mouse
ggctgcgtaggaccagggac

SEQ ID NO: 433873 - DNA, 20 bp, mouse
gcaacaggcccaccgaatcc

SEQ ID NO: 433874 - DNA, 20 bp, mouse
gcgcagagccgggcaccaga

SEQ ID NO: 433875 - DNA, 20 bp, mouse
gtgttgctgctggacaacag

SEQ ID NO: 433876 - DNA, 20 bp, mouse
gtgcgagcgcctagtggcgt

SEQ ID NO: 433877 - DNA, 20 bp, mouse
gtccgtgtgcgagcgcctag

SEQ ID NO: 433878 - DNA, 20 bp, mouse
ggccactaggcgctcgcaca

SEQ ID NO: 433879 - DNA, 20 bp, mouse
ggcgctcgcacacggagaac

SEQ ID NO: 433880 - DNA, 20 bp, mouse
gtccagggcgagagcgggag

SEQ ID NO: 433881 - DNA, 20 bp, mouse
ggagccgtagggccacgggt

SEQ ID NO: 433882 - DNA, 20 bp, mouse
ggctatccgcctggaaggag

SEQ ID NO: 433883 - DNA, 20 bp, mouse
ggagagggaaacaacagcga

SEQ ID NO: 433884 - DNA, 20 bp, mouse
gcgcctagtggcgtaggctg

SEQ ID NO: 433885 - DNA, 20 bp, mouse
gtccgggtcgcggggtaaac

SEQ ID NO: 433886 - DNA, 20 bp, mouse
gggatccgcagccaggggtt

SEQ ID NO: 433887 - DNA, 20 bp, mouse
gcacacacataccgaacccc

SEQ ID NO: 433888 - DNA, 20 bp, mouse
gtagcactgccgcactcaag

SEQ ID NO: 433889 - DNA, 20 bp, mouse
gtctggaaacctcttgagtg

SEQ ID NO: 433890 - DNA, 20 bp, mouse
gggaatgtctcacccaccca

SEQ ID NO: 433891 - DNA, 20 bp, mouse
ggtgaagcccagcccgaagg

SEQ ID NO: 433892 - DNA, 20 bp, mouse
gccctgcaagcaggaggatg

SEQ ID NO: 433893 - DNA, 20 bp, mouse
gaggtttccagattgcgctt

SEQ ID NO: 433894 - DNA, 20 bp, mouse
gggcttcacacacaagtaag

SEQ ID NO: 433895 - DNA, 20 bp, mouse
gagagagcgagagggagtga

SEQ ID NO: 433896 - DNA, 20 bp, mouse
gtgcacggcgtgtccccggg

SEQ ID NO: 433897 - DNA, 20 bp, mouse
gggacacgccgtgcaccctc

SEQ ID NO: 433898 - DNA, 20 bp, mouse
gtgcagccagagcccgggca

SEQ ID NO: 433899 - DNA, 20 bp, mouse
gcccggagcccgagggtgca

SEQ ID NO: 433900 - DNA, 20 bp, mouse
gggaggatgaggccgtgccc

SEQ ID NO: 433901 - DNA, 20 bp, mouse
ggcgaggcgggcggaggatg

SEQ ID NO: 433902 - DNA, 20 bp, mouse
ggggtgcacggcgtgtcccc

SEQ ID NO: 433903 - DNA, 20 bp, mouse
gtgaggccgtgcccgggctc

SEQ ID NO: 433904 - DNA, 20 bp, mouse
gggcgctgtgtgagcgaggc

SEQ ID NO: 433905 - DNA, 20 bp, mouse
gggcggcggcgccaccacac

SEQ ID NO: 433906 - DNA, 20 bp, mouse
gctcgccggcggcctcatgc

SEQ ID NO: 433907 - DNA, 20 bp, mouse
gcggagagcgcaggccccac

SEQ ID NO: 433908 - DNA, 20 bp, mouse
gcgcgcgttctgctcgccgg

SEQ ID NO: 433909 - DNA, 20 bp, mouse
gttcggccacaagcagccag

SEQ ID NO: 433910 - DNA, 20 bp, mouse
gcagaacgcgcgagccgccg

SEQ ID NO: 433911 - DNA, 20 bp, mouse
ggctcgcgcgttctgctcgc

SEQ ID NO: 433912 - DNA, 20 bp, mouse
gcggagccagcactcgggta

SEQ ID NO: 433913 - DNA, 20 bp, mouse
gggcggcggagccagcactc

SEQ ID NO: 433914 - DNA, 20 bp, mouse
ggctgggagcctggaggccg

SEQ ID NO: 433915 - DNA, 20 bp, mouse
gcccggaggggaccgagagc

SEQ ID NO: 433916 - DNA, 20 bp, mouse
gctgaaacaggcttcaggac

SEQ ID NO: 433917 - DNA, 20 bp, mouse
ggccggacttcggaggacag

SEQ ID NO: 433918 - DNA, 20 bp, mouse
gccctctgtcctccgaagtc

SEQ ID NO: 433919 - DNA, 20 bp, mouse
gctgctgctttgccggactt

SEQ ID NO: 433920 - DNA, 20 bp, mouse
gagatcccactggctaggtt

SEQ ID NO: 433921 - DNA, 20 bp, mouse
gctgctttgccggacttcgg

SEQ ID NO: 433922 - DNA, 20 bp, mouse
gcctagccagtgggatctac

SEQ ID NO: 433923 - DNA, 20 bp, mouse
ggtgcggccattgctgaaac

SEQ ID NO: 433924 - DNA, 20 bp, mouse
gggccgcacagcatagacac

SEQ ID NO: 433925 - DNA, 20 bp, mouse
gacgtgcccaacctagccag

SEQ ID NO: 433926 - DNA, 20 bp, mouse
ggagaggtggaggcccggtg

SEQ ID NO: 433927 - DNA, 20 bp, mouse
gacctccgcggagccccacc

SEQ ID NO: 433928 - DNA, 20 bp, mouse
gggtgacagcccggaagctg

SEQ ID NO: 433929 - DNA, 20 bp, mouse
gagtctgggcgtgagagtga

SEQ ID NO: 433930 - DNA, 20 bp, mouse
gaccagctccctcacctccg

SEQ ID NO: 433931 - DNA, 20 bp, mouse
gccggccgcacgacccagag

SEQ ID NO: 433932 - DNA, 20 bp, mouse
gtcacgcccagacttctcca

SEQ ID NO: 433933 - DNA, 20 bp, mouse
gctcgtcgcgcagtccccgg

SEQ ID NO: 433934 - DNA, 20 bp, mouse
gcggaggcggctgtagcgtc

SEQ ID NO: 433935 - DNA, 20 bp, mouse
gtgcaggacaggcccgcagg

SEQ ID NO: 433936 - DNA, 20 bp, mouse
gcatcctggcgagcataggt

SEQ ID NO: 433937 - DNA, 20 bp, mouse
gtgagcatcctggcgagcat

SEQ ID NO: 433938 - DNA, 20 bp, mouse
gtggcagtgcctgtagggac

SEQ ID NO: 433939 - DNA, 20 bp, mouse
gcagttctggaagtagcagg

SEQ ID NO: 433940 - DNA, 20 bp, mouse
gagcgtagtgttgagcatcc

SEQ ID NO: 433941 - DNA, 20 bp, mouse
gtccagaactgcccaagagg

SEQ ID NO: 433942 - DNA, 20 bp, mouse
gttctggaagtagcaggcgg

SEQ ID NO: 433943 - DNA, 20 bp, mouse
ggcctgtagggacgggtcag

SEQ ID NO: 433944 - DNA, 20 bp, mouse
ggctgctggcagtgcctgta

SEQ ID NO: 433945 - DNA, 20 bp, mouse
ggcactgccagcagccctaa

SEQ ID NO: 433946 - DNA, 20 bp, mouse
gtaaggctgtgaccgaggat

SEQ ID NO: 433947 - DNA, 20 bp, mouse
gccgaggattggctgttgaa

SEQ ID NO: 433948 - DNA, 20 bp, mouse
gcgctctaaggctgtgaccg

SEQ ID NO: 433949 - DNA, 20 bp, mouse
gggccgggccacctggatca

SEQ ID NO: 433950 - DNA, 20 bp, mouse
gaggtaggtaggccacggtc

SEQ ID NO: 433951 - DNA, 20 bp, mouse
gactgtggccgtgatccagg

SEQ ID NO: 433952 - DNA, 20 bp, mouse
gggctcggcttctcgctcta

SEQ ID NO: 433953 - DNA, 20 bp, mouse
ggcagctaaggcaaccaggt

SEQ ID NO: 433954 - DNA, 20 bp, mouse
ggaagcccctaagtggatct

SEQ ID NO: 433955 - DNA, 20 bp, mouse
ggatcacaaaggccaagcgg

SEQ ID NO: 433956 - DNA, 20 bp, mouse
gtgagaaggagcgcatcctg

SEQ ID NO: 433957 - DNA, 20 bp, mouse
gccctgctccggcttgtccg

SEQ ID NO: 433958 - DNA, 20 bp, mouse
gtccggcttgtccgaggcaa

SEQ ID NO: 433959 - DNA, 20 bp, mouse
gaggcagcctaagactgctt

SEQ ID NO: 433960 - DNA, 20 bp, mouse
ggaagaggaagcagcccacg

SEQ ID NO: 433961 - DNA, 20 bp, mouse
gcgggtcctccgtggagaag

SEQ ID NO: 433962 - DNA, 20 bp, mouse
gtgctgtcggcacagagccg

SEQ ID NO: 433963 - DNA, 20 bp, mouse
gcagcgaagagagcgaggta

SEQ ID NO: 433964 - DNA, 20 bp, mouse
gcacgaggaacagggttccc

SEQ ID NO: 433965 - DNA, 20 bp, mouse
gtccagccactaagatgaga

SEQ ID NO: 433966 - DNA, 20 bp, mouse
gctcaccggagggtgaacac

SEQ ID NO: 433967 - DNA, 20 bp, mouse
ggcatgagcagactgaacac

SEQ ID NO: 433968 - DNA, 20 bp, mouse
gcccaccgcgctctcaccgg

SEQ ID NO: 433969 - DNA, 20 bp, mouse
gggaaacccctgccaagcca

SEQ ID NO: 433970 - DNA, 20 bp, mouse
ggcgcggtgggagcacgccg

SEQ ID NO: 433971 - DNA, 20 bp, mouse
gaggtgaggtccaggaccat

SEQ ID NO: 433972 - DNA, 20 bp, mouse
gcagaaccgggaccccatag

SEQ ID NO: 433973 - DNA, 20 bp, mouse
ggtgggagcacgccgtggct

SEQ ID NO: 433974 - DNA, 20 bp, mouse
ggcacgccgtggcttggcag

SEQ ID NO: 433975 - DNA, 20 bp, mouse
gtcaccctccggtgagagcg

SEQ ID NO: 433976 - DNA, 20 bp, mouse
gtaggagctgaagcaggtaa

SEQ ID NO: 433977 - DNA, 20 bp, mouse
gcctaggcttctgggcacct

SEQ ID NO: 433978 - DNA, 20 bp, mouse
gcacctgggcagcagcgtga

SEQ ID NO: 433979 - DNA, 20 bp, mouse
ggggtcactgcaccagatag

SEQ ID NO: 433980 - DNA, 20 bp, mouse
gctgggcagcagcgtgaagg

SEQ ID NO: 433981 - DNA, 20 bp, mouse
gtggatagaccaccactgaa

SEQ ID NO: 433982 - DNA, 20 bp, mouse
ggagctgcctggatggaact

SEQ ID NO: 433983 - DNA, 20 bp, mouse
gtgtggtggctgatgatgag

SEQ ID NO: 433984 - DNA, 20 bp, mouse
gtgagcggcacacctgtcac

SEQ ID NO: 433985 - DNA, 20 bp, mouse
gccactgaagggataaagac

SEQ ID NO: 433986 - DNA, 20 bp, mouse
gatgcccaggaccctgaggg

SEQ ID NO: 433987 - DNA, 20 bp, mouse
gatgatgcccaggaccctga

SEQ ID NO: 433988 - DNA, 20 bp, mouse
gtaagtgagcatccagagac

SEQ ID NO: 433989 - DNA, 20 bp, mouse
ggaacgatgccaccagtctc

SEQ ID NO: 433990 - DNA, 20 bp, mouse
ggactggtggcatcgttcat

SEQ ID NO: 433991 - DNA, 20 bp, mouse
gaggaactttacctccctca

SEQ ID NO: 433992 - DNA, 20 bp, mouse
ggttcattggaacaagctct

SEQ ID NO: 433993 - DNA, 20 bp, mouse
gaagaaggcagggccagacc

SEQ ID NO: 433994 - DNA, 20 bp, mouse
ggtaaaaagccaatccaaga

SEQ ID NO: 433995 - DNA, 20 bp, mouse
ggacctgggtgatattctta

SEQ ID NO: 433996 - DNA, 20 bp, mouse
gttcttggtgggccagaaca

SEQ ID NO: 433997 - DNA, 20 bp, mouse
gctggaactcctgagattct

SEQ ID NO: 433998 - DNA, 20 bp, mouse
gacatggtgcccagaatctc

SEQ ID NO: 433999 - DNA, 20 bp, mouse
gaagaccaggagagacaaca

SEQ ID NO: 434000 - DNA, 20 bp, mouse
ggagccaaacagcgtctacc

SEQ ID NO: 434001 - DNA, 20 bp, mouse
gcctgtggccccacccacat

SEQ ID NO: 434002 - DNA, 20 bp, mouse
gagagcaaagacctccatgg

SEQ ID NO: 434003 - DNA, 20 bp, mouse
ggtcttgaggtccttcttgg

SEQ ID NO: 434004 - DNA, 20 bp, mouse
gggcacgctccagagcaatc

SEQ ID NO: 434005 - DNA, 20 bp, mouse
ggcggtcttgaggtccttct

SEQ ID NO: 434006 - DNA, 20 bp, mouse
ggcagtaagctttcaggaca

SEQ ID NO: 434007 - DNA, 20 bp, mouse
gttgtgaccccaaacatgat

SEQ ID NO: 434008 - DNA, 20 bp, mouse
gacacacgaactaataataa

SEQ ID NO: 434009 - DNA, 20 bp, mouse
ggagagagaagaacttcctc

SEQ ID NO: 434010 - DNA, 20 bp, mouse
gtcacaggcagtaagctttc

SEQ ID NO: 434011 - DNA, 20 bp, mouse
ggtatgtatatacaaacctt

SEQ ID NO: 434012 - DNA, 20 bp, mouse
ggatagttctatcacgtcag

SEQ ID NO: 434013 - DNA, 20 bp, mouse
gccagtcagcctggaacttg

SEQ ID NO: 434014 - DNA, 20 bp, mouse
ggggagcacaagtcatgcat

SEQ ID NO: 434015 - DNA, 20 bp, mouse
gtgaactatgcagctaatgc

SEQ ID NO: 434016 - DNA, 20 bp, mouse
ggtcatgggtagtagcaata

SEQ ID NO: 434017 - DNA, 20 bp, mouse
gtgttgtctcggaatgggat

SEQ ID NO: 434018 - DNA, 20 bp, mouse
gcagtctgcacccggaagcg

SEQ ID NO: 434019 - DNA, 20 bp, mouse
gtaaggaagaatattgaatc

SEQ ID NO: 434020 - DNA, 20 bp, mouse
gcgggttgttgtctcggaat

SEQ ID NO: 434021 - DNA, 20 bp, mouse
gccgcccgcagtctgtaggg

SEQ ID NO: 434022 - DNA, 20 bp, mouse
gcgcttgcgcagtctgcacc

SEQ ID NO: 434023 - DNA, 20 bp, mouse
gttgaatcgggttgttgtct

SEQ ID NO: 434024 - DNA, 20 bp, mouse
gcgcaagttgctaggacggg

SEQ ID NO: 434025 - DNA, 20 bp, mouse
ggacccgcccgcagtctgta

SEQ ID NO: 434026 - DNA, 20 bp, mouse
gctgtaggagtgcacgacac

SEQ ID NO: 434027 - DNA, 20 bp, mouse
gggcggcaaacacaacttgt

SEQ ID NO: 434028 - DNA, 20 bp, mouse
gacacaacttgtgggtacag

SEQ ID NO: 434029 - DNA, 20 bp, mouse
gccgcccgcagtctgtaggg

SEQ ID NO: 434030 - DNA, 20 bp, mouse
ggggcgttccggaaaaggga

SEQ ID NO: 434031 - DNA, 20 bp, mouse
gacagagatggggtatgggt

SEQ ID NO: 434032 - DNA, 20 bp, mouse
gcgcagggcgttccggaaaa

SEQ ID NO: 434033 - DNA, 20 bp, mouse
gggcggagcctgactttccc

SEQ ID NO: 434034 - DNA, 20 bp, mouse
gatggccttccgacgccagg

SEQ ID NO: 434035 - DNA, 20 bp, mouse
gaacttgtgggtacagcggc

SEQ ID NO: 434036 - DNA, 20 bp, mouse
gcatctgtacttacatggat

SEQ ID NO: 434037 - DNA, 20 bp, mouse
gccaattgcatgttcaaata

SEQ ID NO: 434038 - DNA, 20 bp, mouse
gtcaaatagggtacacagcg

SEQ ID NO: 434039 - DNA, 20 bp, mouse
gtcttataggcaactggtac

SEQ ID NO: 434040 - DNA, 20 bp, mouse
gtgtcactctgaatgaccca

SEQ ID NO: 434041 - DNA, 20 bp, mouse
ggaacacagctgattaaatg

SEQ ID NO: 434042 - DNA, 20 bp, mouse
gtatgtttatacagtatctt

SEQ ID NO: 434043 - DNA, 20 bp, mouse
gtgaacatgcaattggtcac

SEQ ID NO: 434044 - DNA, 20 bp, mouse
ggtttatacagtatctttgg

SEQ ID NO: 434045 - DNA, 20 bp, mouse
gtactgtataaacatatata

SEQ ID NO: 434046 - DNA, 20 bp, mouse
gggctcaggctcccggctca

SEQ ID NO: 434047 - DNA, 20 bp, mouse
gccccagcaggctcctgcgg

SEQ ID NO: 434048 - DNA, 20 bp, mouse
ggcgaggcccatgcgctcag

SEQ ID NO: 434049 - DNA, 20 bp, mouse
gccgcccccgcacttccggg

SEQ ID NO: 434050 - DNA, 20 bp, mouse
ggcgccgcccggaagtgcgg

SEQ ID NO: 434051 - DNA, 20 bp, mouse
ggcaagcgcttccctgagcc

SEQ ID NO: 434052 - DNA, 20 bp, mouse
ggctccagcccgaccccagc

SEQ ID NO: 434053 - DNA, 20 bp, mouse
ggcagtcccgccccacacca

SEQ ID NO: 434054 - DNA, 20 bp, mouse
ggtgagtagtgggagccgac

SEQ ID NO: 434055 - DNA, 20 bp, mouse
gcgcagagcgccgccaaaac

SEQ ID NO: 434056 - DNA, 20 bp, mouse
gaacatgaggagtctcgcgg

SEQ ID NO: 434057 - DNA, 20 bp, mouse
ggaagcgcccggaggacatt

SEQ ID NO: 434058 - DNA, 20 bp, mouse
gcccgggcgtggggaacatg

SEQ ID NO: 434059 - DNA, 20 bp, mouse
gcccggccggctttcaaccc

SEQ ID NO: 434060 - DNA, 20 bp, mouse
gggcgcaccaaatgtcctcc

SEQ ID NO: 434061 - DNA, 20 bp, mouse
gtcccccgctggactcgcag

SEQ ID NO: 434062 - DNA, 20 bp, mouse
ggagtgcgccagcggatcaa

SEQ ID NO: 434063 - DNA, 20 bp, mouse
gtggtgcgcctagtgactgc

SEQ ID NO: 434064 - DNA, 20 bp, mouse
ggggaacatgaggagtctcg

SEQ ID NO: 434065 - DNA, 20 bp, mouse
gagcaggccggggtagtaga

SEQ ID NO: 434066 - DNA, 20 bp, mouse
gtggcacagcgggagcccct

SEQ ID NO: 434067 - DNA, 20 bp, mouse
gaggagttgagccagccgag

SEQ ID NO: 434068 - DNA, 20 bp, mouse
gccgggaaggcggctagctg

SEQ ID NO: 434069 - DNA, 20 bp, mouse
gcactgcccgcctggcacag

SEQ ID NO: 434070 - DNA, 20 bp, mouse
gcccataagggtgagtgatg

SEQ ID NO: 434071 - DNA, 20 bp, mouse
gggaaggcggctagctgcgg

SEQ ID NO: 434072 - DNA, 20 bp, mouse
gggcacctcgctaggaaagg

SEQ ID NO: 434073 - DNA, 20 bp, mouse
gatcccaggagcccaggggt

SEQ ID NO: 434074 - DNA, 20 bp, mouse
ggggctcccgctgtgccagg

SEQ ID NO: 434075 - DNA, 20 bp, mouse
gcgccggctgatgcgatcca

SEQ ID NO: 434076 - DNA, 20 bp, mouse
gtgcgtcctgcagaagcttt

SEQ ID NO: 434077 - DNA, 20 bp, mouse
gcttcattgctagacaggga

SEQ ID NO: 434078 - DNA, 20 bp, mouse
gtgccagggcaactgaactg

SEQ ID NO: 434079 - DNA, 20 bp, mouse
gggggcttcattgctagaca

SEQ ID NO: 434080 - DNA, 20 bp, mouse
gttgccctggcatttctgag

SEQ ID NO: 434081 - DNA, 20 bp, mouse
ggtccacagttcagttgccc

SEQ ID NO: 434082 - DNA, 20 bp, mouse
gcattaactcttcgtgctcc

SEQ ID NO: 434083 - DNA, 20 bp, mouse
gcagcagctgcccctctgcc

SEQ ID NO: 434084 - DNA, 20 bp, mouse
gacaccactcagaaatgcca

SEQ ID NO: 434085 - DNA, 20 bp, mouse
gttgggagggggcatgtttt

SEQ ID NO: 434086 - DNA, 20 bp, mouse
gaggacaggcaccattgcta

SEQ ID NO: 434087 - DNA, 20 bp, mouse
gctgtgtagactgttctccc

SEQ ID NO: 434088 - DNA, 20 bp, mouse
gccgggcactaccgtagcaa

SEQ ID NO: 434089 - DNA, 20 bp, mouse
gacagtctacacaggaaatg

SEQ ID NO: 434090 - DNA, 20 bp, mouse
gtggtgagtgggcaaaacta

SEQ ID NO: 434091 - DNA, 20 bp, mouse
gggaatcccaggtacatgaa

SEQ ID NO: 434092 - DNA, 20 bp, mouse
gccctaagtactggatatat

SEQ ID NO: 434093 - DNA, 20 bp, mouse
gaatctgagaacgactggtg

SEQ ID NO: 434094 - DNA, 20 bp, mouse
gggcaaaactaaggaagatt

SEQ ID NO: 434095 - DNA, 20 bp, mouse
gcagtctcctgaaagactgc

SEQ ID NO: 434096 - DNA, 20 bp, mouse
gtgtccgcaggggcgagcgg

SEQ ID NO: 434097 - DNA, 20 bp, mouse
gagccacccggggccccacg

SEQ ID NO: 434098 - DNA, 20 bp, mouse
gaataaaacgctgtccgcag

SEQ ID NO: 434099 - DNA, 20 bp, mouse
gccgccgccgctcgcccctg

SEQ ID NO: 434100 - DNA, 20 bp, mouse
gggacagcggaggaggcacc

SEQ ID NO: 434101 - DNA, 20 bp, mouse
gctggcgcggcctccgccgt

SEQ ID NO: 434102 - DNA, 20 bp, mouse
gagcccacggcgaccttccg

SEQ ID NO: 434103 - DNA, 20 bp, mouse
ggggccggcgtgacggacag

SEQ ID NO: 434104 - DNA, 20 bp, mouse
gccggcgtgacggacagcgg

SEQ ID NO: 434105 - DNA, 20 bp, mouse
ggccgcccgaatggagccca

SEQ ID NO: 434106 - DNA, 20 bp, mouse
ggcacccagcctgtgcgcag

SEQ ID NO: 434107 - DNA, 20 bp, mouse
gggcctagagggttctagaa

SEQ ID NO: 434108 - DNA, 20 bp, mouse
gaggtgtcgccgctgcgcac

SEQ ID NO: 434109 - DNA, 20 bp, mouse
ggagccgcggcggaagacat

SEQ ID NO: 434110 - DNA, 20 bp, mouse
gtcgccgctgcgcacaggct

SEQ ID NO: 434111 - DNA, 20 bp, mouse
gtcacagaggaaccgagcag

SEQ ID NO: 434112 - DNA, 20 bp, mouse
gccgctgccccgctcagggg

SEQ ID NO: 434113 - DNA, 20 bp, mouse
gaggggcggcgaggcctaga

SEQ ID NO: 434114 - DNA, 20 bp, mouse
gccgctagagcgccacttag

SEQ ID NO: 434115 - DNA, 20 bp, mouse
gccgcagtcaggggccctgg

SEQ ID NO: 434116 - DNA, 20 bp, mouse
ggagttgagccagagagtgt

SEQ ID NO: 434117 - DNA, 20 bp, mouse
ggcagagcagcagagcgaga

SEQ ID NO: 434118 - DNA, 20 bp, mouse
gaccgccttcccacactctc

SEQ ID NO: 434119 - DNA, 20 bp, mouse
gtaggctgcggggacgacgt

SEQ ID NO: 434120 - DNA, 20 bp, mouse
gtctggctcaactctcgccg

SEQ ID NO: 434121 - DNA, 20 bp, mouse
gccgaactggagaaatggag

SEQ ID NO: 434122 - DNA, 20 bp, mouse
gggcactgcggggacaccga

SEQ ID NO: 434123 - DNA, 20 bp, mouse
ggaaaggcgcgaactgggtg

SEQ ID NO: 434124 - DNA, 20 bp, mouse
ggctgctctgcggagtgacg

SEQ ID NO: 434125 - DNA, 20 bp, mouse
ggtgtttccgtttttctctc

SEQ ID NO: 434126 - DNA, 20 bp, mouse
gtgatcgcggggcagaaaga

SEQ ID NO: 434127 - DNA, 20 bp, mouse
gcagaaagagggcgaagggt

SEQ ID NO: 434128 - DNA, 20 bp, mouse
ggcctggagattagtcacca

SEQ ID NO: 434129 - DNA, 20 bp, mouse
gggtcctagctgtgatcgcg

SEQ ID NO: 434130 - DNA, 20 bp, mouse
gggcgaagggtaggttgatg

SEQ ID NO: 434131 - DNA, 20 bp, mouse
gctgccccgcgatcacagct

SEQ ID NO: 434132 - DNA, 20 bp, mouse
ggccatggtgactaatctcc

SEQ ID NO: 434133 - DNA, 20 bp, mouse
gcggggcagaaagagggcga

SEQ ID NO: 434134 - DNA, 20 bp, mouse
gggcttatcaaggactctgt

SEQ ID NO: 434135 - DNA, 20 bp, mouse
gcaggcttcaggaggtgact

SEQ ID NO: 434136 - DNA, 20 bp, mouse
gtgtgaacaccgggacacag

SEQ ID NO: 434137 - DNA, 20 bp, mouse
gactagggtccactgtgtcc

SEQ ID NO: 434138 - DNA, 20 bp, mouse
gtgttcgggaacagaagctc

SEQ ID NO: 434139 - DNA, 20 bp, mouse
gctcagacttgctgtagacc

SEQ ID NO: 434140 - DNA, 20 bp, mouse
gcccggtgttcacaagagtc

SEQ ID NO: 434141 - DNA, 20 bp, mouse
ggggaacagaagctcaggag

SEQ ID NO: 434142 - DNA, 20 bp, mouse
gaggacagaataaatctagt

SEQ ID NO: 434143 - DNA, 20 bp, mouse
gcatgtttaagtatatgtcg

SEQ ID NO: 434144 - DNA, 20 bp, mouse
gccatgtctgtgaattgcag

SEQ ID NO: 434145 - DNA, 20 bp, mouse
ggacaccattcactcctaag

SEQ ID NO: 434146 - DNA, 20 bp, mouse
gacactcctgcagctcgcac

SEQ ID NO: 434147 - DNA, 20 bp, mouse
gcccgtccagtgcgagctgc

SEQ ID NO: 434148 - DNA, 20 bp, mouse
ggtctgctaaatgctttacc

SEQ ID NO: 434149 - DNA, 20 bp, mouse
gctggacggggtgctgagga

SEQ ID NO: 434150 - DNA, 20 bp, mouse
gcgcactggacggggtgctg

SEQ ID NO: 434151 - DNA, 20 bp, mouse
gtaaatgacagtcataggtc

SEQ ID NO: 434152 - DNA, 20 bp, mouse
gtgatctaaatgacagtcat

SEQ ID NO: 434153 - DNA, 20 bp, mouse
gtcctgcagctcgcactgga

SEQ ID NO: 434154 - DNA, 20 bp, mouse
gaggccagaaggggaatcat

SEQ ID NO: 434155 - DNA, 20 bp, mouse
gatggggtcaaacaggacag

SEQ ID NO: 434156 - DNA, 20 bp, mouse
gtctgagtaactatataggt

SEQ ID NO: 434157 - DNA, 20 bp, mouse
ggactaatacaattgctgtt

SEQ ID NO: 434158 - DNA, 20 bp, mouse
gataggctctctcttaacac

SEQ ID NO: 434159 - DNA, 20 bp, mouse
ggagctacaggcccaggaac

SEQ ID NO: 434160 - DNA, 20 bp, mouse
gtagcagtgatcctaggctt

SEQ ID NO: 434161 - DNA, 20 bp, mouse
ggcctgtagctcctaagcct

SEQ ID NO: 434162 - DNA, 20 bp, mouse
gtgaccttagcagtgatcct

SEQ ID NO: 434163 - DNA, 20 bp, mouse
gctaaggtcactgcagaaat

SEQ ID NO: 434164 - DNA, 20 bp, mouse
ggcttaggagctacaggccc

SEQ ID NO: 434165 - DNA, 20 bp, mouse
gctctctcttaacacagggt

SEQ ID NO: 434166 - DNA, 20 bp, mouse
ggcaggacagcgatgaacct

SEQ ID NO: 434167 - DNA, 20 bp, mouse
gtcccgagcacggatgcagg

SEQ ID NO: 434168 - DNA, 20 bp, mouse
gcaaagaggggtcccgagca

SEQ ID NO: 434169 - DNA, 20 bp, mouse
gtcctcctgcatccgtgctc

SEQ ID NO: 434170 - DNA, 20 bp, mouse
gcaacagagcgctgtggccc

SEQ ID NO: 434171 - DNA, 20 bp, mouse
ggattacgacagtgtgaagc

SEQ ID NO: 434172 - DNA, 20 bp, mouse
gactagattcttcgattttc

SEQ ID NO: 434173 - DNA, 20 bp, mouse
gtctagaatccggaaaaagt

SEQ ID NO: 434174 - DNA, 20 bp, mouse
gtctcagctggtctagaatc

SEQ ID NO: 434175 - DNA, 20 bp, mouse
gtctaatgccggtgaagaaa

SEQ ID NO: 434176 - DNA, 20 bp, mouse
gatgggtaaagccaagaaga

SEQ ID NO: 434177 - DNA, 20 bp, mouse
gcaatctgaggtgggatctc

SEQ ID NO: 434178 - DNA, 20 bp, mouse
gcttaccctcacggatccat

SEQ ID NO: 434179 - DNA, 20 bp, mouse
gtttacccatggatccgtga

SEQ ID NO: 434180 - DNA, 20 bp, mouse
gcccagcagcctaggctcct

SEQ ID NO: 434181 - DNA, 20 bp, mouse
gctgacagtcccaggagcct

SEQ ID NO: 434182 - DNA, 20 bp, mouse
gaagcaagcttggcgagggt

SEQ ID NO: 434183 - DNA, 20 bp, mouse
gccctaagcaagcttggcga

SEQ ID NO: 434184 - DNA, 20 bp, mouse
gtccatgtccacaactcctg

SEQ ID NO: 434185 - DNA, 20 bp, mouse
ggaaggctggattgccgatt

SEQ ID NO: 434186 - DNA, 20 bp, mouse
gtggcctgcctgctccctcc

SEQ ID NO: 434187 - DNA, 20 bp, mouse
gcaaggaggctctactgcta

SEQ ID NO: 434188 - DNA, 20 bp, mouse
ggatggaaccgcatgcaagg

SEQ ID NO: 434189 - DNA, 20 bp, mouse
gttgctagccaggagggagc

SEQ ID NO: 434190 - DNA, 20 bp, mouse
gaacgacttgctagccagga

SEQ ID NO: 434191 - DNA, 20 bp, mouse
gagtagagcctccttgcatg

SEQ ID NO: 434192 - DNA, 20 bp, mouse
ggaagatggaaccgcatgca

SEQ ID NO: 434193 - DNA, 20 bp, mouse
gtgccaggaaagagagagtg

SEQ ID NO: 434194 - DNA, 20 bp, mouse
gactgactagacaggcaata

SEQ ID NO: 434195 - DNA, 20 bp, mouse
gtccctcactctctctttcc

SEQ ID NO: 434196 - DNA, 20 bp, mouse
gctattcagggccaacaatt

SEQ ID NO: 434197 - DNA, 20 bp, mouse
gggccctgaatagacttgca

SEQ ID NO: 434198 - DNA, 20 bp, mouse
gtgccttgcaagtctattca

SEQ ID NO: 434199 - DNA, 20 bp, mouse
gtgtgtgggcctagtgatct

SEQ ID NO: 434200 - DNA, 20 bp, mouse
ggaaaagctattgctgggtc

SEQ ID NO: 434201 - DNA, 20 bp, mouse
ggctacaggcaggtgtgtgt

SEQ ID NO: 434202 - DNA, 20 bp, mouse
gatttggaaaagctattgct

SEQ ID NO: 434203 - DNA, 20 bp, mouse
ggcactgctgctcttctaac

SEQ ID NO: 434204 - DNA, 20 bp, mouse
gcagcagtgctcttaacagt

SEQ ID NO: 434205 - DNA, 20 bp, mouse
ggctctttgtgaaacataca

SEQ ID NO: 434206 - DNA, 20 bp, mouse
gcacgtggacacctacctgt

SEQ ID NO: 434207 - DNA, 20 bp, mouse
gcaagcctcctcccacaggt

SEQ ID NO: 434208 - DNA, 20 bp, mouse
gcccccaagcctcctcccac

SEQ ID NO: 434209 - DNA, 20 bp, mouse
ggtggacacctacctgtggg

SEQ ID NO: 434210 - DNA, 20 bp, mouse
ggaccaagtccgctagatag

SEQ ID NO: 434211 - DNA, 20 bp, mouse
gagctgctcaaggaaatgaa

SEQ ID NO: 434212 - DNA, 20 bp, mouse
gtgtaacaatcaagaacacg

SEQ ID NO: 434213 - DNA, 20 bp, mouse
gatgggagcagaagtcatac

SEQ ID NO: 434214 - DNA, 20 bp, mouse
gtgccttctcctctatctag

SEQ ID NO: 434215 - DNA, 20 bp, mouse
ggaaggcaccgttcttaaaa

SEQ ID NO: 434216 - DNA, 20 bp, mouse
gccatggggaggtctcacca

SEQ ID NO: 434217 - DNA, 20 bp, mouse
gtccattcgccgctttctgt

SEQ ID NO: 434218 - DNA, 20 bp, mouse
gaagcctcataacacagtgg

SEQ ID NO: 434219 - DNA, 20 bp, mouse
gccgtccagtggccatgggg

SEQ ID NO: 434220 - DNA, 20 bp, mouse
gaggtctcaccagggtggct

SEQ ID NO: 434221 - DNA, 20 bp, mouse
ggcccacagaaagcggcgaa

SEQ ID NO: 434222 - DNA, 20 bp, mouse
ggagccgtccagtggccatg

SEQ ID NO: 434223 - DNA, 20 bp, mouse
gggctctctaggctgctacc

SEQ ID NO: 434224 - DNA, 20 bp, mouse
gcctgaaaggtaggttctca

SEQ ID NO: 434225 - DNA, 20 bp, mouse
gcactggagatggaactgcc

SEQ ID NO: 434226 - DNA, 20 bp, mouse
gactatgggacaagagagca

SEQ ID NO: 434227 - DNA, 20 bp, mouse
gcttacaggcaccgaaggag

SEQ ID NO: 434228 - DNA, 20 bp, mouse
ggctgcagaaggggagacag

SEQ ID NO: 434229 - DNA, 20 bp, mouse
ggaacagatggaacacaccg

SEQ ID NO: 434230 - DNA, 20 bp, mouse
gcaggcaagagaagatagtc

SEQ ID NO: 434231 - DNA, 20 bp, mouse
gccttgctccacaggcctcc

SEQ ID NO: 434232 - DNA, 20 bp, mouse
gaggagcacacggttagctc

SEQ ID NO: 434233 - DNA, 20 bp, mouse
gaaggccaagttcagagacg

SEQ ID NO: 434234 - DNA, 20 bp, mouse
gtaatcagaactaagagaga

SEQ ID NO: 434235 - DNA, 20 bp, mouse
gactctggccgggaggcctg

SEQ ID NO: 434236 - DNA, 20 bp, mouse
gttcatgacagaaaccttat

SEQ ID NO: 434237 - DNA, 20 bp, mouse
gtaggctgtttgactggata

SEQ ID NO: 434238 - DNA, 20 bp, mouse
gtccagtcaaacagcctata

SEQ ID NO: 434239 - DNA, 20 bp, mouse
gaacgtgcgaagggactaga

SEQ ID NO: 434240 - DNA, 20 bp, mouse
gtctcctgggactcttacta

SEQ ID NO: 434241 - DNA, 20 bp, mouse
gaaccctgtcggaggcacat

SEQ ID NO: 434242 - DNA, 20 bp, mouse
gcggacagctagggaacggg

SEQ ID NO: 434243 - DNA, 20 bp, mouse
gactagggtaaccctgtcgg

SEQ ID NO: 434244 - DNA, 20 bp, mouse
gagggactagatggacgcca

SEQ ID NO: 434245 - DNA, 20 bp, mouse
gcttactagggtaaccctgt

SEQ ID NO: 434246 - DNA, 20 bp, mouse
ggaacagctggaaagatatc

SEQ ID NO: 434247 - DNA, 20 bp, mouse
gggacagggtcggaacatga

SEQ ID NO: 434248 - DNA, 20 bp, mouse
gagcaccaggagaaggacca

SEQ ID NO: 434249 - DNA, 20 bp, mouse
gcctcttcagagaggacagt

SEQ ID NO: 434250 - DNA, 20 bp, mouse
gatcaggttgcactatttaa

SEQ ID NO: 434251 - DNA, 20 bp, mouse
gtctttatggattaactaga

SEQ ID NO: 434252 - DNA, 20 bp, mouse
gtatggattaactagaaggt

SEQ ID NO: 434253 - DNA, 20 bp, mouse
gagccacactccgtccgatg

SEQ ID NO: 434254 - DNA, 20 bp, mouse
ggtcctggcagtgacagccg

SEQ ID NO: 434255 - DNA, 20 bp, mouse
gtggtcgatgtgtcttgtag

SEQ ID NO: 434256 - DNA, 20 bp, mouse
gaggcggcgctcacattccg

SEQ ID NO: 434257 - DNA, 20 bp, mouse
ggctccgagcggccgaggta

SEQ ID NO: 434258 - DNA, 20 bp, mouse
gccccgcggtgagggctcca

SEQ ID NO: 434259 - DNA, 20 bp, mouse
gcggccctcagagcgcccag

SEQ ID NO: 434260 - DNA, 20 bp, mouse
ggaagaagccgccacagccc

SEQ ID NO: 434261 - DNA, 20 bp, mouse
ggggcggccctgtccagtca

SEQ ID NO: 434262 - DNA, 20 bp, mouse
gctccctggagccctcaccg

SEQ ID NO: 434263 - DNA, 20 bp, mouse
ggcgcccaggggccgcccat

SEQ ID NO: 434264 - DNA, 20 bp, mouse
gtcacattccggggctgtgg

SEQ ID NO: 434265 - DNA, 20 bp, mouse
gtcgcggcaagcggaagtca

SEQ ID NO: 434266 - DNA, 20 bp, mouse
gaaccgcaggaaacggagca

SEQ ID NO: 434267 - DNA, 20 bp, mouse
gtcctggttgagtgcttgaa

SEQ ID NO: 434268 - DNA, 20 bp, mouse
gtacagctgggtcccccaag

SEQ ID NO: 434269 - DNA, 20 bp, mouse
gtgccgtgctccgtttcctg

SEQ ID NO: 434270 - DNA, 20 bp, mouse
gaccattcaagcactcaacc

SEQ ID NO: 434271 - DNA, 20 bp, mouse
ggatgctgtggattgtgcac

SEQ ID NO: 434272 - DNA, 20 bp, mouse
gttcctgcggttggatgctg

SEQ ID NO: 434273 - DNA, 20 bp, mouse
gatccacagcatccaaccgc

SEQ ID NO: 434274 - DNA, 20 bp, mouse
gtgtgaggtcctagccactt

SEQ ID NO: 434275 - DNA, 20 bp, mouse
gtttccgggtgcggtggtgt

SEQ ID NO: 434276 - DNA, 20 bp, mouse
gccgggagaagacctcctag

SEQ ID NO: 434277 - DNA, 20 bp, mouse
gtgagcgacgtgagagcagg

SEQ ID NO: 434278 - DNA, 20 bp, mouse
gtcgctcacgttctccccgg

SEQ ID NO: 434279 - DNA, 20 bp, mouse
gacgtcgctcacgttctccc

SEQ ID NO: 434280 - DNA, 20 bp, mouse
gcctcgaaggccacgctggg

SEQ ID NO: 434281 - DNA, 20 bp, mouse
ggagcctcgaaggccacgct

SEQ ID NO: 434282 - DNA, 20 bp, mouse
gtggtgtacagagtgtacta

SEQ ID NO: 434283 - DNA, 20 bp, mouse
gacgtgagcgacgtgagagc

SEQ ID NO: 434284 - DNA, 20 bp, mouse
gtggccttcgaggctcccct

SEQ ID NO: 434285 - DNA, 20 bp, mouse
gccttcgaggctcccctagg

SEQ ID NO: 434286 - DNA, 20 bp, mouse
gtaggtgcgcacacagctgg

SEQ ID NO: 434287 - DNA, 20 bp, mouse
gccttccccgggctgtccca

SEQ ID NO: 434288 - DNA, 20 bp, mouse
ggatgtcaggcgtgcagtct

SEQ ID NO: 434289 - DNA, 20 bp, mouse
gtcggcaaccccccttcccc

SEQ ID NO: 434290 - DNA, 20 bp, mouse
gcagctggaggaagcagcgc

SEQ ID NO: 434291 - DNA, 20 bp, mouse
gtctgggcgctgcacgactg

SEQ ID NO: 434292 - DNA, 20 bp, mouse
gcgtgcagcgcccagatgtc

SEQ ID NO: 434293 - DNA, 20 bp, mouse
gaagccggccgggctcgagt

SEQ ID NO: 434294 - DNA, 20 bp, mouse
gcacggcgacgcggaccccg

SEQ ID NO: 434295 - DNA, 20 bp, mouse
ggtctaggtgcgcacacagc

SEQ ID NO: 434296 - DNA, 20 bp, mouse
gttgggtaattagttagctt

SEQ ID NO: 434297 - DNA, 20 bp, mouse
ggctggaagttctgcctccc

SEQ ID NO: 434298 - DNA, 20 bp, mouse
gtaaccatgctcaactggtt

SEQ ID NO: 434299 - DNA, 20 bp, mouse
gcttctgtatccatagtatt

SEQ ID NO: 434300 - DNA, 20 bp, mouse
gctggtactttggaggtagg

SEQ ID NO: 434301 - DNA, 20 bp, mouse
gtacccaaaccagttgagca

SEQ ID NO: 434302 - DNA, 20 bp, mouse
gtttctggtactttggaggt

SEQ ID NO: 434303 - DNA, 20 bp, mouse
gagagaactatgcaattggt

SEQ ID NO: 434304 - DNA, 20 bp, mouse
gatccataaccatgctcaac

SEQ ID NO: 434305 - DNA, 20 bp, mouse
ggcatgattgcagtccatgt

SEQ ID NO: 434306 - DNA, 20 bp, mouse
ggaagacatgggggtggtca

SEQ ID NO: 434307 - DNA, 20 bp, mouse
gaatgtaggacaggccgatg

SEQ ID NO: 434308 - DNA, 20 bp, mouse
gggccgatgaggcgtccccc

SEQ ID NO: 434309 - DNA, 20 bp, mouse
ggtcctgggggacgcctcat

SEQ ID NO: 434310 - DNA, 20 bp, mouse
gaccttctcagaagacatgg

SEQ ID NO: 434311 - DNA, 20 bp, mouse
gttctcagaagacatggggg

SEQ ID NO: 434312 - DNA, 20 bp, mouse
gggcttcattccaggaatgt

SEQ ID NO: 434313 - DNA, 20 bp, mouse
gcattccaggaatgtaggac

SEQ ID NO: 434314 - DNA, 20 bp, mouse
ggggggtggtcagggttctg

SEQ ID NO: 434315 - DNA, 20 bp, mouse
gttcctggaatgaagcctac

SEQ ID NO: 434316 - DNA, 20 bp, mouse
gatccagctcacctcggtgg

SEQ ID NO: 434317 - DNA, 20 bp, mouse
gaacacagaaacccccaccg

SEQ ID NO: 434318 - DNA, 20 bp, mouse
gcgcctctgtgggaaaggag

SEQ ID NO: 434319 - DNA, 20 bp, mouse
gacccaccgagatgatgatt

SEQ ID NO: 434320 - DNA, 20 bp, mouse
ggactcagatgggaccaccg

SEQ ID NO: 434321 - DNA, 20 bp, mouse
ggagctggtacccgaggtgt

SEQ ID NO: 434322 - DNA, 20 bp, mouse
gcgaggtgagctggatggcc

SEQ ID NO: 434323 - DNA, 20 bp, mouse
gaatgggtgttcggcaagct

SEQ ID NO: 434324 - DNA, 20 bp, mouse
ggagggatggtatcacacag

SEQ ID NO: 434325 - DNA, 20 bp, mouse
gtcatcaaagaagtaacggg

SEQ ID NO: 434326 - DNA, 20 bp, mouse
ggagctggatcataaggtgg

SEQ ID NO: 434327 - DNA, 20 bp, mouse
gcgcctggagctggatcata

SEQ ID NO: 434328 - DNA, 20 bp, mouse
ggatccagctccaggcggta

SEQ ID NO: 434329 - DNA, 20 bp, mouse
gctggagctggatcataagg

SEQ ID NO: 434330 - DNA, 20 bp, mouse
gccgccaggctagaggtcaa

SEQ ID NO: 434331 - DNA, 20 bp, mouse
gtcgcggagccggcgagaag

SEQ ID NO: 434332 - DNA, 20 bp, mouse
ggctccaggcggtaggggac

SEQ ID NO: 434333 - DNA, 20 bp, mouse
gggggcagtggcatcctcgc

SEQ ID NO: 434334 - DNA, 20 bp, mouse
gccccgacgcaggatccagc

SEQ ID NO: 434335 - DNA, 20 bp, mouse
gatcctcgctggcatctctt

SEQ ID NO: 434336 - DNA, 20 bp, mouse
gccgtcgggaaggagaacta

SEQ ID NO: 434337 - DNA, 20 bp, mouse
gctactcggcgcttcagtcg

SEQ ID NO: 434338 - DNA, 20 bp, mouse
gcgtctctcgggaaaggagt

SEQ ID NO: 434339 - DNA, 20 bp, mouse
ggacaagcaccagaaagacc

SEQ ID NO: 434340 - DNA, 20 bp, mouse
ggcctcaaagctgtaagcag

SEQ ID NO: 434341 - DNA, 20 bp, mouse
gtcagcgctgaagatgggga

SEQ ID NO: 434342 - DNA, 20 bp, mouse
ggtcgtcagcatggctcgct

SEQ ID NO: 434343 - DNA, 20 bp, mouse
gtaggggctcccgccagcag

SEQ ID NO: 434344 - DNA, 20 bp, mouse
ggggctgcgtctctcgggaa

SEQ ID NO: 434345 - DNA, 20 bp, mouse
gacggtcagcgctgaagatg

SEQ ID NO: 434346 - DNA, 20 bp, mouse
ggcgcccgtggtacccgcaa

SEQ ID NO: 434347 - DNA, 20 bp, mouse
gcgtggtacccgcaacggtg

SEQ ID NO: 434348 - DNA, 20 bp, mouse
ggctgcgccgcgagagagag

SEQ ID NO: 434349 - DNA, 20 bp, mouse
gccgaggcggggagacggtt

SEQ ID NO: 434350 - DNA, 20 bp, mouse
gctcgcggcgccccgctcca

SEQ ID NO: 434351 - DNA, 20 bp, mouse
ggcgcacgggaggtgagtgc

SEQ ID NO: 434352 - DNA, 20 bp, mouse
gagcgcgggccgcaccgttg

SEQ ID NO: 434353 - DNA, 20 bp, mouse
ggccccgagaccaggcgcgg

SEQ ID NO: 434354 - DNA, 20 bp, mouse
gccagccccgagaccaggcg

SEQ ID NO: 434355 - DNA, 20 bp, mouse
ggaatctgggccacttggag

SEQ ID NO: 434356 - DNA, 20 bp, mouse
gcggagacaacgccaggcgt

SEQ ID NO: 434357 - DNA, 20 bp, mouse
gcgctcgtggtgcggatcta

SEQ ID NO: 434358 - DNA, 20 bp, mouse
gtgggcgcgaacactcctgg

SEQ ID NO: 434359 - DNA, 20 bp, mouse
ggagcggcggagacaacgcc

SEQ ID NO: 434360 - DNA, 20 bp, mouse
gcgaggagggctgaacgggt

SEQ ID NO: 434361 - DNA, 20 bp, mouse
ggcgtgggcgcgaacactcc

SEQ ID NO: 434362 - DNA, 20 bp, mouse
ggggaaggccacgcacgcgg

SEQ ID NO: 434363 - DNA, 20 bp, mouse
gcgtcccggccaatagcgag

SEQ ID NO: 434364 - DNA, 20 bp, mouse
gacggagccagaggtgccag

SEQ ID NO: 434365 - DNA, 20 bp, mouse
gtgcagggacgcggactgaa

SEQ ID NO: 434366 - DNA, 20 bp, mouse
gtccttcaaggactattatc

SEQ ID NO: 434367 - DNA, 20 bp, mouse
gcagcatgctgagacgagga

SEQ ID NO: 434368 - DNA, 20 bp, mouse
gttcaaggactattatctgg

SEQ ID NO: 434369 - DNA, 20 bp, mouse
gaagtcagcatgctgagacg

SEQ ID NO: 434370 - DNA, 20 bp, mouse
gctagaagctccacccgatg

SEQ ID NO: 434371 - DNA, 20 bp, mouse
ggataatcagtcagctggtt

SEQ ID NO: 434372 - DNA, 20 bp, mouse
gttatgttgtaaataagcac

SEQ ID NO: 434373 - DNA, 20 bp, mouse
gctagcaggcagcattaatc

SEQ ID NO: 434374 - DNA, 20 bp, mouse
gattctaaactgggccccta

SEQ ID NO: 434375 - DNA, 20 bp, mouse
gggagggataatcagtcagc

SEQ ID NO: 434376 - DNA, 20 bp, mouse
gcacaacggtcaatacatag

SEQ ID NO: 434377 - DNA, 20 bp, mouse
gagccagtgtaggatgaagt

SEQ ID NO: 434378 - DNA, 20 bp, mouse
gaacggcttggagccagtgt

SEQ ID NO: 434379 - DNA, 20 bp, mouse
gtgccagagaggagttggtt

SEQ ID NO: 434380 - DNA, 20 bp, mouse
gagagaggagttggtttggt

SEQ ID NO: 434381 - DNA, 20 bp, mouse
gtgatgcaacaacacaagtg

SEQ ID NO: 434382 - DNA, 20 bp, mouse
gctcaagacaatggcttcaa

SEQ ID NO: 434383 - DNA, 20 bp, mouse
gattcctgccagagaggagt

SEQ ID NO: 434384 - DNA, 20 bp, mouse
gttgattttgcagagttctg

SEQ ID NO: 434385 - DNA, 20 bp, mouse
gtactttcttccaaacctgc

SEQ ID NO: 434386 - DNA, 20 bp, mouse
ggcaggcagcagtttaaatg

SEQ ID NO: 434387 - DNA, 20 bp, mouse
gccgttcttccgtgctgcac

SEQ ID NO: 434388 - DNA, 20 bp, mouse
gagctgccaggcaaccacga

SEQ ID NO: 434389 - DNA, 20 bp, mouse
gaggcaaccacgacggagaa

SEQ ID NO: 434390 - DNA, 20 bp, mouse
gttgcctggcagctgcagga

SEQ ID NO: 434391 - DNA, 20 bp, mouse
gcattacagaccaaaacccc

SEQ ID NO: 434392 - DNA, 20 bp, mouse
gagcgctattactagaaata

SEQ ID NO: 434393 - DNA, 20 bp, mouse
gtactgtgaaaagcaatcac

SEQ ID NO: 434394 - DNA, 20 bp, mouse
gccccgacagatggacactt

SEQ ID NO: 434395 - DNA, 20 bp, mouse
ggcttcaatgcatcaactgt

SEQ ID NO: 434396 - DNA, 20 bp, mouse
gcaccacagctggccccgga

SEQ ID NO: 434397 - DNA, 20 bp, mouse
gagggaaacgaagccttccg

SEQ ID NO: 434398 - DNA, 20 bp, mouse
gcgcgccggaagaggctgag

SEQ ID NO: 434399 - DNA, 20 bp, mouse
ggcgtgccgcagagacctgt

SEQ ID NO: 434400 - DNA, 20 bp, mouse
gtccgcgtgcacgctagcta

SEQ ID NO: 434401 - DNA, 20 bp, mouse
gctcctggcggtcctactac

SEQ ID NO: 434402 - DNA, 20 bp, mouse
ggaccgccaggaggacgcgc

SEQ ID NO: 434403 - DNA, 20 bp, mouse
gggcccaccacagctggccc

SEQ ID NO: 434404 - DNA, 20 bp, mouse
gcagatgctgtcgtgcaatg

SEQ ID NO: 434405 - DNA, 20 bp, mouse
gagctgctgctgaggagacg

SEQ ID NO: 434406 - DNA, 20 bp, mouse
ggtcctgctggagctgagaa

SEQ ID NO: 434407 - DNA, 20 bp, mouse
gctccagcaggacgacggta

SEQ ID NO: 434408 - DNA, 20 bp, mouse
gcggcccgaaggctctgtcc

SEQ ID NO: 434409 - DNA, 20 bp, mouse
gggggacgcaggcggcccga

SEQ ID NO: 434410 - DNA, 20 bp, mouse
gggtaaggaattgctgcggg

SEQ ID NO: 434411 - DNA, 20 bp, mouse
ggtcccttctcagctccagc

SEQ ID NO: 434412 - DNA, 20 bp, mouse
gcgacggtaaggaattgctg

SEQ ID NO: 434413 - DNA, 20 bp, mouse
gccagaagcacaacttcctt

SEQ ID NO: 434414 - DNA, 20 bp, mouse
gggaagttgtgcttctgggt

SEQ ID NO: 434415 - DNA, 20 bp, mouse
gtggcctggacagagccttc

SEQ ID NO: 434416 - DNA, 20 bp, mouse
gccgcgcctgcgctcctcgg

SEQ ID NO: 434417 - DNA, 20 bp, mouse
gggtattccggcgcgcttgg

SEQ ID NO: 434418 - DNA, 20 bp, mouse
ggcctaggcccagcgccacc

SEQ ID NO: 434419 - DNA, 20 bp, mouse
gccgcagcatgaaggtattc

SEQ ID NO: 434420 - DNA, 20 bp, mouse
ggcagaacgccaggccgcct

SEQ ID NO: 434421 - DNA, 20 bp, mouse
gcgcgccaggtacaacagag

SEQ ID NO: 434422 - DNA, 20 bp, mouse
gccggtgccgccaagcgcgc

SEQ ID NO: 434423 - DNA, 20 bp, mouse
gcacgtggctggcaccggag

SEQ ID NO: 434424 - DNA, 20 bp, mouse
gcgtccgcgcctgcgctcct

SEQ ID NO: 434425 - DNA, 20 bp, mouse
gtgcgggcgagaggccgccg

SEQ ID NO: 434426 - DNA, 20 bp, mouse
ggcgggaggccgcatcccgg

SEQ ID NO: 434427 - DNA, 20 bp, mouse
gcgcagctcggctccgggaa

SEQ ID NO: 434428 - DNA, 20 bp, mouse
gggccgcatcccggaggcag

SEQ ID NO: 434429 - DNA, 20 bp, mouse
gcgagggtggcgccactaga

SEQ ID NO: 434430 - DNA, 20 bp, mouse
gagaggctccgcgcccttcc

SEQ ID NO: 434431 - DNA, 20 bp, mouse
gagcgcgggaggccgcatcc

SEQ ID NO: 434432 - DNA, 20 bp, mouse
gcgtccgcgcagctcggctc

SEQ ID NO: 434433 - DNA, 20 bp, mouse
ggagaagggtcaggcgcgca

SEQ ID NO: 434434 - DNA, 20 bp, mouse
ggtgccccggcggaaggagg

SEQ ID NO: 434435 - DNA, 20 bp, mouse
ggcagggcgtccgcgcagct

SEQ ID NO: 434436 - DNA, 20 bp, mouse
gcggcgatcggagccccaag

SEQ ID NO: 434437 - DNA, 20 bp, mouse
gcggccggagcccagccgag

SEQ ID NO: 434438 - DNA, 20 bp, mouse
gcggccgggccgggatggct

SEQ ID NO: 434439 - DNA, 20 bp, mouse
gggcgccggacactgacctg

SEQ ID NO: 434440 - DNA, 20 bp, mouse
gagccgagcgggccagcgcg

SEQ ID NO: 434441 - DNA, 20 bp, mouse
ggctatgaagtggcccccga

SEQ ID NO: 434442 - DNA, 20 bp, mouse
gcaggcagcggccagaaccc

SEQ ID NO: 434443 - DNA, 20 bp, mouse
ggccgcgcgcccagccatcc

SEQ ID NO: 434444 - DNA, 20 bp, mouse
gcgccgagggcaccacgcgc

SEQ ID NO: 434445 - DNA, 20 bp, mouse
gggccagcgcgtggtgccct

SEQ ID NO: 434446 - DNA, 20 bp, mouse
ggccgggagaggttccgaga

SEQ ID NO: 434447 - DNA, 20 bp, mouse
gcagcgacgcgggacaggag

SEQ ID NO: 434448 - DNA, 20 bp, mouse
ggagaaggagagagcggcac

SEQ ID NO: 434449 - DNA, 20 bp, mouse
gagctcccgttcgagcgccg

SEQ ID NO: 434450 - DNA, 20 bp, mouse
gcgatcccgggtggacaccg

SEQ ID NO: 434451 - DNA, 20 bp, mouse
gtctgccgcggcgctcgaac

SEQ ID NO: 434452 - DNA, 20 bp, mouse
ggcgctcgaacgggagctta

SEQ ID NO: 434453 - DNA, 20 bp, mouse
ggggcaagctagaactccag

SEQ ID NO: 434454 - DNA, 20 bp, mouse
ggatcttgctgtctggagcc

SEQ ID NO: 434455 - DNA, 20 bp, mouse
gacgcgggacaggagcggca

SEQ ID NO: 434456 - DNA, 20 bp, mouse
gcgttcccgggaactagtaa

SEQ ID NO: 434457 - DNA, 20 bp, mouse
ggagctgcaccagagcgtag

SEQ ID NO: 434458 - DNA, 20 bp, mouse
ggcgatcgacaccaggaagt

SEQ ID NO: 434459 - DNA, 20 bp, mouse
ggccgcgccccgccttcccc

SEQ ID NO: 434460 - DNA, 20 bp, mouse
gctagtggcgtccctcccac

SEQ ID NO: 434461 - DNA, 20 bp, mouse
gctgcaccagagcgtagagg

SEQ ID NO: 434462 - DNA, 20 bp, mouse
gactagccggaagtggtccc

SEQ ID NO: 434463 - DNA, 20 bp, mouse
gggctcccttactagttccc

SEQ ID NO: 434464 - DNA, 20 bp, mouse
gggatgagacccgcagacag

SEQ ID NO: 434465 - DNA, 20 bp, mouse
ggggactctgagcgacacct

SEQ ID NO: 434466 - DNA, 20 bp, mouse
ggcacgaagcagggaccacc

SEQ ID NO: 434467 - DNA, 20 bp, mouse
ggggaggctgcggtaaatcc

SEQ ID NO: 434468 - DNA, 20 bp, mouse
gggtaaatccgggcttgcgg

SEQ ID NO: 434469 - DNA, 20 bp, mouse
gaagtccggacaggtgtagt

SEQ ID NO: 434470 - DNA, 20 bp, mouse
ggctggcagaggctacggcc

SEQ ID NO: 434471 - DNA, 20 bp, mouse
gtgtagtaggttgtccacac

SEQ ID NO: 434472 - DNA, 20 bp, mouse
ggcgctccagaagtccggac

SEQ ID NO: 434473 - DNA, 20 bp, mouse
gcagctggtagaaggcgcat

SEQ ID NO: 434474 - DNA, 20 bp, mouse
ggcatctagaacgcctccgg

SEQ ID NO: 434475 - DNA, 20 bp, mouse
ggggatcccggcacgaagca

SEQ ID NO: 434476 - DNA, 20 bp, mouse
gcggcccggcggggtctggg

SEQ ID NO: 434477 - DNA, 20 bp, mouse
gccgccgcggcaacaagtgc

SEQ ID NO: 434478 - DNA, 20 bp, mouse
ggagccgcccagaccccgcc

SEQ ID NO: 434479 - DNA, 20 bp, mouse
gggtgtccctagacaaggta

SEQ ID NO: 434480 - DNA, 20 bp, mouse
gagacaaggtagggccgggt

SEQ ID NO: 434481 - DNA, 20 bp, mouse
gccatgcgcaatgcgcggac

SEQ ID NO: 434482 - DNA, 20 bp, mouse
gacctcccggatatcctcac

SEQ ID NO: 434483 - DNA, 20 bp, mouse
ggcgcatggagcgagagcgg

SEQ ID NO: 434484 - DNA, 20 bp, mouse
ggctccagcacttgttgccg

SEQ ID NO: 434485 - DNA, 20 bp, mouse
gaccggtgaggatatccggg

SEQ ID NO: 434486 - DNA, 20 bp, mouse
ggagaacagggaagaagcgg

SEQ ID NO: 434487 - DNA, 20 bp, mouse
gggaagctcgactcactgga

SEQ ID NO: 434488 - DNA, 20 bp, mouse
gactaggaagctcgactcac

SEQ ID NO: 434489 - DNA, 20 bp, mouse
gacagggaagaagcggagga

SEQ ID NO: 434490 - DNA, 20 bp, mouse
gcagccccggccatactcct

SEQ ID NO: 434491 - DNA, 20 bp, mouse
gagtgccagggtctcgggtg

SEQ ID NO: 434492 - DNA, 20 bp, mouse
gaccgccttgagctggctct

SEQ ID NO: 434493 - DNA, 20 bp, mouse
gtcgcggcgtctaagagacc

SEQ ID NO: 434494 - DNA, 20 bp, mouse
gcgcgggctccagacaaccc

SEQ ID NO: 434495 - DNA, 20 bp, mouse
gctgggcgaccgccttgagc

SEQ ID NO: 434496 - DNA, 20 bp, mouse
ggactgtgtgagcctagctc

SEQ ID NO: 434497 - DNA, 20 bp, mouse
ggggagagagcacccgagct

SEQ ID NO: 434498 - DNA, 20 bp, mouse
gacatagtcgaagccctgtg

SEQ ID NO: 434499 - DNA, 20 bp, mouse
ggggcaaggacttagctgaa

SEQ ID NO: 434500 - DNA, 20 bp, mouse
gcgggtgctctctccccaca

SEQ ID NO: 434501 - DNA, 20 bp, mouse
gtgaaggagcgcataccagc

SEQ ID NO: 434502 - DNA, 20 bp, mouse
gggaggtgttaacaactgtt

SEQ ID NO: 434503 - DNA, 20 bp, mouse
ggctcacacagtccctgttt

SEQ ID NO: 434504 - DNA, 20 bp, mouse
gtgttaacaactgttaggtt

SEQ ID NO: 434505 - DNA, 20 bp, mouse
gagtgccaagaactgctggt

SEQ ID NO: 434506 - DNA, 20 bp, mouse
gaagcgaggaagctagggca

SEQ ID NO: 434507 - DNA, 20 bp, mouse
gggctagagccggctgagag

SEQ ID NO: 434508 - DNA, 20 bp, mouse
ggctccaagagagaccccgc

SEQ ID NO: 434509 - DNA, 20 bp, mouse
gcggctctagccggctccag

SEQ ID NO: 434510 - DNA, 20 bp, mouse
ggctccagcggggtctctct

SEQ ID NO: 434511 - DNA, 20 bp, mouse
ggaggctgaacacaggggaa

SEQ ID NO: 434512 - DNA, 20 bp, mouse
ggtcctcctagaagccctgg

SEQ ID NO: 434513 - DNA, 20 bp, mouse
gtgcagcgggcactttgggt

SEQ ID NO: 434514 - DNA, 20 bp, mouse
gttcccccagggcttctagg

SEQ ID NO: 434515 - DNA, 20 bp, mouse
gagaggggcgggcctgatta

SEQ ID NO: 434516 - DNA, 20 bp, mouse
gtcctggtctgggatggcac

SEQ ID NO: 434517 - DNA, 20 bp, mouse
gaaacgcacaaggtaagatg

SEQ ID NO: 434518 - DNA, 20 bp, mouse
ggcaagggttgtcctggtct

SEQ ID NO: 434519 - DNA, 20 bp, mouse
gggaacccagtgtgtagcaa

SEQ ID NO: 434520 - DNA, 20 bp, mouse
gaactaagccactctcacag

SEQ ID NO: 434521 - DNA, 20 bp, mouse
gtaccttgtgcgtttgagag

SEQ ID NO: 434522 - DNA, 20 bp, mouse
gtaagccactctcacagggg

SEQ ID NO: 434523 - DNA, 20 bp, mouse
ggctgttgccaggacttaca

SEQ ID NO: 434524 - DNA, 20 bp, mouse
ggaagaggccagacaccaag

SEQ ID NO: 434525 - DNA, 20 bp, mouse
gcgcacaaggtaagatgggg

SEQ ID NO: 434526 - DNA, 20 bp, mouse
ggacatggcggcccggtcca

SEQ ID NO: 434527 - DNA, 20 bp, mouse
gccggtccagggcagctgag

SEQ ID NO: 434528 - DNA, 20 bp, mouse
ggtgagtcggggtcccggtg

SEQ ID NO: 434529 - DNA, 20 bp, mouse
gatcacagctctgagcgccg

SEQ ID NO: 434530 - DNA, 20 bp, mouse
ggcagggcgcgccgccggag

SEQ ID NO: 434531 - DNA, 20 bp, mouse
gcacaggagggaagagggac

SEQ ID NO: 434532 - DNA, 20 bp, mouse
gcccgggaggaggtgaagct

SEQ ID NO: 434533 - DNA, 20 bp, mouse
gccggggccgcagactgcaa

SEQ ID NO: 434534 - DNA, 20 bp, mouse
gccacagagacatggcggcc

SEQ ID NO: 434535 - DNA, 20 bp, mouse
ggcgagggtggcgggagatg

SEQ ID NO: 434536 - DNA, 20 bp, mouse
gagctgcgaggagggagtcc

SEQ ID NO: 434537 - DNA, 20 bp, mouse
gcgaggagggagtccgggca

SEQ ID NO: 434538 - DNA, 20 bp, mouse
gcgaggacccccagagctgg

SEQ ID NO: 434539 - DNA, 20 bp, mouse
gacccgaggacccccagagc

SEQ ID NO: 434540 - DNA, 20 bp, mouse
gccgggcagggctttacccg

SEQ ID NO: 434541 - DNA, 20 bp, mouse
ggggactcctgaagagacag

SEQ ID NO: 434542 - DNA, 20 bp, mouse
gtggcggaagctggacccag

SEQ ID NO: 434543 - DNA, 20 bp, mouse
ggggctgggccgacagcttg

SEQ ID NO: 434544 - DNA, 20 bp, mouse
gttgaggacgcacagctgcg

SEQ ID NO: 434545 - DNA, 20 bp, mouse
gccgcgctgcaagtctggag

SEQ ID NO: 434546 - DNA, 20 bp, mouse
gccaagggcagccatgaccc

SEQ ID NO: 434547 - DNA, 20 bp, mouse
gttggctcaagccggggtca

SEQ ID NO: 434548 - DNA, 20 bp, mouse
gatgcagcgttggcaggaag

SEQ ID NO: 434549 - DNA, 20 bp, mouse
ggcgtagagcaggagtccga

SEQ ID NO: 434550 - DNA, 20 bp, mouse
gtagagcaggagtccgaggg

SEQ ID NO: 434551 - DNA, 20 bp, mouse
gacacagctggaggatcacg

SEQ ID NO: 434552 - DNA, 20 bp, mouse
gcactcacgcttgaccgcgg

SEQ ID NO: 434553 - DNA, 20 bp, mouse
gctgcatttggctcaagccg

SEQ ID NO: 434554 - DNA, 20 bp, mouse
gcgtcaccctgtccagactt

SEQ ID NO: 434555 - DNA, 20 bp, mouse
gcttgagccaaatgcagcgt

SEQ ID NO: 434556 - DNA, 20 bp, mouse
ggtgcatgcgttggcctcct

SEQ ID NO: 434557 - DNA, 20 bp, mouse
gtgcaatcgcagtcctgcct

SEQ ID NO: 434558 - DNA, 20 bp, mouse
gaacccgtggcagcgtacag

SEQ ID NO: 434559 - DNA, 20 bp, mouse
ggagcttgctgtgcatgcgt

SEQ ID NO: 434560 - DNA, 20 bp, mouse
ggactgcgattgcaggaaaa

SEQ ID NO: 434561 - DNA, 20 bp, mouse
gcaggaggcgatgcacagac

SEQ ID NO: 434562 - DNA, 20 bp, mouse
ggctgaggttcccgaacccg

SEQ ID NO: 434563 - DNA, 20 bp, mouse
gggagacaagatgactaccg

SEQ ID NO: 434564 - DNA, 20 bp, mouse
gaacagaagaaggcacaaga

SEQ ID NO: 434565 - DNA, 20 bp, mouse
ggtgggaaccctccaagctg

SEQ ID NO: 434566 - DNA, 20 bp, mouse
gagggtcctgaggtagtgtt

SEQ ID NO: 434567 - DNA, 20 bp, mouse
gcagcccctgaaaacaaaca

SEQ ID NO: 434568 - DNA, 20 bp, mouse
gcagagagggcgaggtgaag

SEQ ID NO: 434569 - DNA, 20 bp, mouse
gagggctgcttagggtcctg

SEQ ID NO: 434570 - DNA, 20 bp, mouse
ggtcccgaggaaaggcagag

SEQ ID NO: 434571 - DNA, 20 bp, mouse
gccctaagcagccctgaact

SEQ ID NO: 434572 - DNA, 20 bp, mouse
gccagaggcagccaacgact

SEQ ID NO: 434573 - DNA, 20 bp, mouse
ggacccgcgcggacccagga

SEQ ID NO: 434574 - DNA, 20 bp, mouse
ggcgagcgagaagcgagcag

SEQ ID NO: 434575 - DNA, 20 bp, mouse
ggggaaggagggtgtcgacc

SEQ ID NO: 434576 - DNA, 20 bp, mouse
gctcttgtccttcgccacta

SEQ ID NO: 434577 - DNA, 20 bp, mouse
gagagggaaaaggagggtaa

SEQ ID NO: 434578 - DNA, 20 bp, mouse
gaagaagaaaggaagaaatg

SEQ ID NO: 434579 - DNA, 20 bp, mouse
ggaaatgagggagagggaaa

SEQ ID NO: 434580 - DNA, 20 bp, mouse
gagggaactggagtacctag

SEQ ID NO: 434581 - DNA, 20 bp, mouse
gaaaggaagaaatgagggag

SEQ ID NO: 434582 - DNA, 20 bp, mouse
gaatattgatcgggaaggaa

SEQ ID NO: 434583 - DNA, 20 bp, mouse
gcctgggaacacggaagtgt

SEQ ID NO: 434584 - DNA, 20 bp, mouse
gactggagtacctagaggaa

SEQ ID NO: 434585 - DNA, 20 bp, mouse
ggaataggacagccaacagt

SEQ ID NO: 434586 - DNA, 20 bp, mouse
gtgctcaggacagggttgag

SEQ ID NO: 434587 - DNA, 20 bp, mouse
ggttccaagctcaccgagag

SEQ ID NO: 434588 - DNA, 20 bp, mouse
gcatcctggaccaggtagtg

SEQ ID NO: 434589 - DNA, 20 bp, mouse
ggaactcccaccctgaacgg

SEQ ID NO: 434590 - DNA, 20 bp, mouse
ggagcggcagtgctcaggac

SEQ ID NO: 434591 - DNA, 20 bp, mouse
gaccgagagcggcagtgctc

SEQ ID NO: 434592 - DNA, 20 bp, mouse
gggcaggcccgagacaaaca

SEQ ID NO: 434593 - DNA, 20 bp, mouse
gcacttcccccgttcagggt

SEQ ID NO: 434594 - DNA, 20 bp, mouse
ggtgcacgcggccccctcgg

SEQ ID NO: 434595 - DNA, 20 bp, mouse
gcggcgaggtcgagcgaggg

SEQ ID NO: 434596 - DNA, 20 bp, mouse
gaatgggggtggcgaagcag

SEQ ID NO: 434597 - DNA, 20 bp, mouse
ggtgaggcagatgaactacg

SEQ ID NO: 434598 - DNA, 20 bp, mouse
gcgtacaccctctcagaccc

SEQ ID NO: 434599 - DNA, 20 bp, mouse
ggctattcgcagagatcgtg

SEQ ID NO: 434600 - DNA, 20 bp, mouse
gagccattaaggctctgtat

SEQ ID NO: 434601 - DNA, 20 bp, mouse
gcggcctgcgtgatcctgtg

SEQ ID NO: 434602 - DNA, 20 bp, mouse
gctgggatgtccgaggaacc

SEQ ID NO: 434603 - DNA, 20 bp, mouse
ggagcgtggccagcgcccgg

SEQ ID NO: 434604 - DNA, 20 bp, mouse
gactacgcggcacagcccaa

SEQ ID NO: 434605 - DNA, 20 bp, mouse
gcacagcccaacggcgacga

SEQ ID NO: 434606 - DNA, 20 bp, mouse
gaggatccacaggactgcac

SEQ ID NO: 434607 - DNA, 20 bp, mouse
ggtctctctctccctgagaa

SEQ ID NO: 434608 - DNA, 20 bp, mouse
gaggacagagggaaaaaacc

SEQ ID NO: 434609 - DNA, 20 bp, mouse
gttagcagctcctgcagaac

SEQ ID NO: 434610 - DNA, 20 bp, mouse
gacttgttgcaggcagcggc

SEQ ID NO: 434611 - DNA, 20 bp, mouse
gctgcaggagctgctaagga

SEQ ID NO: 434612 - DNA, 20 bp, mouse
gagagcagggctgtagctgg

SEQ ID NO: 434613 - DNA, 20 bp, mouse
gttcagagcagggctgtagc

SEQ ID NO: 434614 - DNA, 20 bp, mouse
gtggggctctgtgcttgtga

SEQ ID NO: 434615 - DNA, 20 bp, mouse
ggtgagggcagagtacatgg

SEQ ID NO: 434616 - DNA, 20 bp, mouse
gtgacttgcccagtgacagg

SEQ ID NO: 434617 - DNA, 20 bp, mouse
gcagtgacttgcccagtgac

SEQ ID NO: 434618 - DNA, 20 bp, mouse
ggctgcaggaagttcaaggg

SEQ ID NO: 434619 - DNA, 20 bp, mouse
ggtgacaggaggtaagaaag

SEQ ID NO: 434620 - DNA, 20 bp, mouse
gccaacctactacagcacaa

SEQ ID NO: 434621 - DNA, 20 bp, mouse
gtctctaagccaggaaccag

SEQ ID NO: 434622 - DNA, 20 bp, mouse
gggtgctgcaggctcaccag

SEQ ID NO: 434623 - DNA, 20 bp, mouse
gtaagaaaggggtcctcaaa

SEQ ID NO: 434624 - DNA, 20 bp, mouse
gagcgccggcccaaggtcag

SEQ ID NO: 434625 - DNA, 20 bp, mouse
gggggtgaacttctaggtgg

SEQ ID NO: 434626 - DNA, 20 bp, mouse
gctgcggtgtgagagccggg

SEQ ID NO: 434627 - DNA, 20 bp, mouse
gcgcgctcccaggcagccga

SEQ ID NO: 434628 - DNA, 20 bp, mouse
gcgacaaagcggggaagccc

SEQ ID NO: 434629 - DNA, 20 bp, mouse
ggtacctgcgcgagcctcgg

SEQ ID NO: 434630 - DNA, 20 bp, mouse
ggtccgcaggcgggaggagt

SEQ ID NO: 434631 - DNA, 20 bp, mouse
gtgcgctgcggtgtgagagc

SEQ ID NO: 434632 - DNA, 20 bp, mouse
gagggagcccgacagtgtcg

SEQ ID NO: 434633 - DNA, 20 bp, mouse
gtgtgcgtagcgaggctcag

SEQ ID NO: 434634 - DNA, 20 bp, mouse
ggctgcctgggagcgcgacg

SEQ ID NO: 434635 - DNA, 20 bp, mouse
gaggctcgcgcaggtaccca

SEQ ID NO: 434636 - DNA, 20 bp, mouse
gccctgggccggaggaacgt

SEQ ID NO: 434637 - DNA, 20 bp, mouse
gccaggtagtgagtgtccct

SEQ ID NO: 434638 - DNA, 20 bp, mouse
gctgctcgcgtccagacctg

SEQ ID NO: 434639 - DNA, 20 bp, mouse
ggcgagctgcgatgacttcc

SEQ ID NO: 434640 - DNA, 20 bp, mouse
ggtagtgagtgtccctgggc

SEQ ID NO: 434641 - DNA, 20 bp, mouse
gggaggaacaggtgtaacgg

SEQ ID NO: 434642 - DNA, 20 bp, mouse
gagcgtctgagacgggagag

SEQ ID NO: 434643 - DNA, 20 bp, mouse
gagactgcctaccgcaggtc

SEQ ID NO: 434644 - DNA, 20 bp, mouse
gccggcgcagcgtctgagac

SEQ ID NO: 434645 - DNA, 20 bp, mouse
ggcgggatgtctagccagga

SEQ ID NO: 434646 - DNA, 20 bp, mouse
gcaggggccggagggcaact

SEQ ID NO: 434647 - DNA, 20 bp, mouse
gctccagcgctctgcccagg

SEQ ID NO: 434648 - DNA, 20 bp, mouse
gagcctcctgggcagagcgc

SEQ ID NO: 434649 - DNA, 20 bp, mouse
gagcaagcaagcgcaggggc

SEQ ID NO: 434650 - DNA, 20 bp, mouse
gcccgctggagagcgacccg

SEQ ID NO: 434651 - DNA, 20 bp, mouse
ggcgcacagccagtctcccc

SEQ ID NO: 434652 - DNA, 20 bp, mouse
gccgggccggaacgacgggt

SEQ ID NO: 434653 - DNA, 20 bp, mouse
gggctctcctagttgccctc

SEQ ID NO: 434654 - DNA, 20 bp, mouse
ggcgcttgcttgctgcagtt

SEQ ID NO: 434655 - DNA, 20 bp, mouse
gtccccgggtcgctctccag

SEQ ID NO: 434656 - DNA, 20 bp, mouse
ggagcgtgagcagccgggag

SEQ ID NO: 434657 - DNA, 20 bp, mouse
gatcgcggcgccacaatcag

SEQ ID NO: 434658 - DNA, 20 bp, mouse
gctcaggccgcggtcggggt

SEQ ID NO: 434659 - DNA, 20 bp, mouse
gcggcgggagcggctccttg

SEQ ID NO: 434660 - DNA, 20 bp, mouse
gtggatgctgctcggtcccg

SEQ ID NO: 434661 - DNA, 20 bp, mouse
gggattcggccactactccc

SEQ ID NO: 434662 - DNA, 20 bp, mouse
gccgagcagcatccacgctg

SEQ ID NO: 434663 - DNA, 20 bp, mouse
gccttcttcaccgggaacca

SEQ ID NO: 434664 - DNA, 20 bp, mouse
gccggctgctcacgctcctc

SEQ ID NO: 434665 - DNA, 20 bp, mouse
gcacgctcctctggacgccg

SEQ ID NO: 434666 - DNA, 20 bp, mouse
ggtcccgcggccaggggtgt

SEQ ID NO: 434667 - DNA, 20 bp, mouse
gctaggacctagcgcagcac

SEQ ID NO: 434668 - DNA, 20 bp, mouse
gaccacagcgatcgaaggag

SEQ ID NO: 434669 - DNA, 20 bp, mouse
ggatcgaaggaggggccggg

SEQ ID NO: 434670 - DNA, 20 bp, mouse
gaggagactccgaccaactg

SEQ ID NO: 434671 - DNA, 20 bp, mouse
ggcgcagcaccggccgcctg

SEQ ID NO: 434672 - DNA, 20 bp, mouse
gaagccgcggcgggaagatg

SEQ ID NO: 434673 - DNA, 20 bp, mouse
gttcgtgagcagttcctggg

SEQ ID NO: 434674 - DNA, 20 bp, mouse
gccagagaggtaatagacga

SEQ ID NO: 434675 - DNA, 20 bp, mouse
gtccaaagtcccgcggccag

SEQ ID NO: 434676 - DNA, 20 bp, mouse
ggcccggcagacccacggac

SEQ ID NO: 434677 - DNA, 20 bp, mouse
ggcgctacggctcctcggag

SEQ ID NO: 434678 - DNA, 20 bp, mouse
ggcggggcccggcagaccca

SEQ ID NO: 434679 - DNA, 20 bp, mouse
gcggcagacccacggaccgg

SEQ ID NO: 434680 - DNA, 20 bp, mouse
ggaggagccgtagcgcggga

SEQ ID NO: 434681 - DNA, 20 bp, mouse
gccacggaccggcggaccga

SEQ ID NO: 434682 - DNA, 20 bp, mouse
gcggcagcgcagtggtccgt

SEQ ID NO: 434683 - DNA, 20 bp, mouse
gcgagccgccccgggaggca

SEQ ID NO: 434684 - DNA, 20 bp, mouse
ggagccgtagcgcgggaggg

SEQ ID NO: 434685 - DNA, 20 bp, mouse
gcgagcgctgcgagagagga

SEQ ID NO: 434686 - DNA, 20 bp, mouse
gcaccgccacccggacaacc

SEQ ID NO: 434687 - DNA, 20 bp, mouse
gccgggtggcggtgacgacg

SEQ ID NO: 434688 - DNA, 20 bp, mouse
gggagcagaccaggtatggt

SEQ ID NO: 434689 - DNA, 20 bp, mouse
ggatacctgcccggttgtcc

SEQ ID NO: 434690 - DNA, 20 bp, mouse
ggtccccagcccaccatacc

SEQ ID NO: 434691 - DNA, 20 bp, mouse
gccagcgcccgcttccaaga

SEQ ID NO: 434692 - DNA, 20 bp, mouse
gcaagcgcaagagaccgggg

SEQ ID NO: 434693 - DNA, 20 bp, mouse
gtgacgacggggagcagacc

SEQ ID NO: 434694 - DNA, 20 bp, mouse
gacctgcccggttgtccggg

SEQ ID NO: 434695 - DNA, 20 bp, mouse
ggggcaagcgcaagagaccg

SEQ ID NO: 434696 - DNA, 20 bp, mouse
gctgcagagccgcctcccgg

SEQ ID NO: 434697 - DNA, 20 bp, mouse
gtccacgagcgcgatccccg

SEQ ID NO: 434698 - DNA, 20 bp, mouse
ggccaccgggaggccgcccg

SEQ ID NO: 434699 - DNA, 20 bp, mouse
gcgggaggccgcccggggaa

SEQ ID NO: 434700 - DNA, 20 bp, mouse
gcgcctgcgccgccgggagg

SEQ ID NO: 434701 - DNA, 20 bp, mouse
gcggcaggacagcagcgccg

SEQ ID NO: 434702 - DNA, 20 bp, mouse
ggtcctgccggccgagcgag

SEQ ID NO: 434703 - DNA, 20 bp, mouse
ggccccggggatcgcgctcg

SEQ ID NO: 434704 - DNA, 20 bp, mouse
gctcccggtggccgcgtccg

SEQ ID NO: 434705 - DNA, 20 bp, mouse
gtccacgggatggtgccggg

SEQ ID NO: 434706 - DNA, 20 bp, mouse
gcccaggcggcggaccggag

SEQ ID NO: 434707 - DNA, 20 bp, mouse
gcatgtggcccggcccgcgg

SEQ ID NO: 434708 - DNA, 20 bp, mouse
gcgggccgggccacatgagg

SEQ ID NO: 434709 - DNA, 20 bp, mouse
ggcggctgaaagcggcgagg

SEQ ID NO: 434710 - DNA, 20 bp, mouse
gcgggccacatgaggcggga

SEQ ID NO: 434711 - DNA, 20 bp, mouse
gggagggggccgacgaccag

SEQ ID NO: 434712 - DNA, 20 bp, mouse
ggcggcggccgaggcccagg

SEQ ID NO: 434713 - DNA, 20 bp, mouse
ggcggcgcgcgaagcccgga

SEQ ID NO: 434714 - DNA, 20 bp, mouse
gtgtggcgcccggcataggt

SEQ ID NO: 434715 - DNA, 20 bp, mouse
gccgcagcgggaagaggcgt

SEQ ID NO: 434716 - DNA, 20 bp, mouse
gcgcctggcgagttgtggac

SEQ ID NO: 434717 - DNA, 20 bp, mouse
ggcgccccgagacccctgca

SEQ ID NO: 434718 - DNA, 20 bp, mouse
ggagccttgcaggggtctcg

SEQ ID NO: 434719 - DNA, 20 bp, mouse
gtggcgagttgtggaccggc

SEQ ID NO: 434720 - DNA, 20 bp, mouse
ggcggagcccgagggagagg

SEQ ID NO: 434721 - DNA, 20 bp, mouse
ggccgcggagcccgagggag

SEQ ID NO: 434722 - DNA, 20 bp, mouse
gaggggtctcggggcgcaca

SEQ ID NO: 434723 - DNA, 20 bp, mouse
gcggggcgcacagggctgtc

SEQ ID NO: 434724 - DNA, 20 bp, mouse
gctgtcgggattgtcctcgt

SEQ ID NO: 434725 - DNA, 20 bp, mouse
gagcggagcgcaggccaggg

SEQ ID NO: 434726 - DNA, 20 bp, mouse
gctccgggagggcaacatcg

SEQ ID NO: 434727 - DNA, 20 bp, mouse
gcgggacacagcaggacatg

SEQ ID NO: 434728 - DNA, 20 bp, mouse
gcgggagggcaacatcgtgg

SEQ ID NO: 434729 - DNA, 20 bp, mouse
gcagctgcgccgctttcctc

SEQ ID NO: 434730 - DNA, 20 bp, mouse
gcgcgtaggctgggcaggcc

SEQ ID NO: 434731 - DNA, 20 bp, mouse
gcatcgtggcgggacacagc

SEQ ID NO: 434732 - DNA, 20 bp, mouse
gcggagacgccgcgtaggct

SEQ ID NO: 434733 - DNA, 20 bp, mouse
gaaagcggcgcagctgccct

SEQ ID NO: 434734 - DNA, 20 bp, mouse
gagagaaccacaaacactca

SEQ ID NO: 434735 - DNA, 20 bp, mouse
gtgcgccgctttcctccggg

SEQ ID NO: 434736 - DNA, 20 bp, mouse
gtcagctgaagtccatagag

SEQ ID NO: 434737 - DNA, 20 bp, mouse
gtcgcgtgtaacccatgaga

SEQ ID NO: 434738 - DNA, 20 bp, mouse
gcgtgtaacccatgagaggg

SEQ ID NO: 434739 - DNA, 20 bp, mouse
ggagggaggaagcttggggt

SEQ ID NO: 434740 - DNA, 20 bp, mouse
ggctcttagattcatcagtc

SEQ ID NO: 434741 - DNA, 20 bp, mouse
gtggctcagggcaggacaaa

SEQ ID NO: 434742 - DNA, 20 bp, mouse
gagacgttcgctacttcaaa

SEQ ID NO: 434743 - DNA, 20 bp, mouse
gcttcccaaaaaattgtatt

SEQ ID NO: 434744 - DNA, 20 bp, mouse
gccatgagagggaggaagct

SEQ ID NO: 434745 - DNA, 20 bp, mouse
gtagtctactgaaaagacaa

SEQ ID NO: 434746 - DNA, 20 bp, mouse
gtccccggacggaggaggtg

SEQ ID NO: 434747 - DNA, 20 bp, mouse
ggtctctccccggacggagg

SEQ ID NO: 434748 - DNA, 20 bp, mouse
gcagcagaggcagcaaccgg

SEQ ID NO: 434749 - DNA, 20 bp, mouse
gcccgcggtctctccccgga

SEQ ID NO: 434750 - DNA, 20 bp, mouse
ggggccccgcggtctctccc

SEQ ID NO: 434751 - DNA, 20 bp, mouse
gcagaggcagcaaccggagg

SEQ ID NO: 434752 - DNA, 20 bp, mouse
gtccgtccggggagagaccg

SEQ ID NO: 434753 - DNA, 20 bp, mouse
ggagagaccgcggggcccga

SEQ ID NO: 434754 - DNA, 20 bp, mouse
gcaggagaagctgtccgggg

SEQ ID NO: 434755 - DNA, 20 bp, mouse
ggccacagctaaggcctcgg

SEQ ID NO: 434756 - DNA, 20 bp, mouse
gggcggagctgcagataaag

SEQ ID NO: 434757 - DNA, 20 bp, mouse
gagctctggggactcgaggg

SEQ ID NO: 434758 - DNA, 20 bp, mouse
gtcgcaggcacacgcgccgt

SEQ ID NO: 434759 - DNA, 20 bp, mouse
gttatctgcagctccgccaa

SEQ ID NO: 434760 - DNA, 20 bp, mouse
gtgacagccgctgggtacct

SEQ ID NO: 434761 - DNA, 20 bp, mouse
gtaggcctcttggtccgctc

SEQ ID NO: 434762 - DNA, 20 bp, mouse
gctctggcagcgcgctggtg

SEQ ID NO: 434763 - DNA, 20 bp, mouse
gcaggcacacgcgccgttgg

SEQ ID NO: 434764 - DNA, 20 bp, mouse
gccgagctctggggactcga

SEQ ID NO: 434765 - DNA, 20 bp, mouse
gcaccacccactccaagagg

SEQ ID NO: 434766 - DNA, 20 bp, mouse
ggccaagacaaaaaagagag

SEQ ID NO: 434767 - DNA, 20 bp, mouse
gaagttgcagcggacacccg

SEQ ID NO: 434768 - DNA, 20 bp, mouse
gtcaagcatgctcactagag

SEQ ID NO: 434769 - DNA, 20 bp, mouse
ggacacccggggtgcctctc

SEQ ID NO: 434770 - DNA, 20 bp, mouse
gtgaacgaccgtatgaaagg

SEQ ID NO: 434771 - DNA, 20 bp, mouse
ggcgcccggcttgagagtgt

SEQ ID NO: 434772 - DNA, 20 bp, mouse
gcgctcacgggggccgggtg

SEQ ID NO: 434773 - DNA, 20 bp, mouse
ggcgcggggcgcgctcacgg

SEQ ID NO: 434774 - DNA, 20 bp, mouse
ggcccggaagtccgagttga

SEQ ID NO: 434775 - DNA, 20 bp, mouse
gaagcagaagcgcgaggagg

SEQ ID NO: 434776 - DNA, 20 bp, mouse
gcgcggccgggaccgagcag

SEQ ID NO: 434777 - DNA, 20 bp, mouse
gcgggaccgagcagcggtga

SEQ ID NO: 434778 - DNA, 20 bp, mouse
gacgctcgagggttccgcgg

SEQ ID NO: 434779 - DNA, 20 bp, mouse
gccgcggaggagccctttcc

SEQ ID NO: 434780 - DNA, 20 bp, mouse
gccgacgctcgagggttccg

SEQ ID NO: 434781 - DNA, 20 bp, mouse
gcgagcagcggtgaggggtg

SEQ ID NO: 434782 - DNA, 20 bp, mouse
gaggagccctttcccggcgg

SEQ ID NO: 434783 - DNA, 20 bp, mouse
gcgggtgggccggcggactc

SEQ ID NO: 434784 - DNA, 20 bp, mouse
ggtccgccggcccacccgcc

SEQ ID NO: 434785 - DNA, 20 bp, mouse
ggaaggagcgcgcatggaaa

SEQ ID NO: 434786 - DNA, 20 bp, mouse
gtcccggcccatcagtgcaa

SEQ ID NO: 434787 - DNA, 20 bp, mouse
gcactgatgggccgggagac

SEQ ID NO: 434788 - DNA, 20 bp, mouse
gctgcagccattgcactgat

SEQ ID NO: 434789 - DNA, 20 bp, mouse
gctgcccggtgatcatgagc

SEQ ID NO: 434790 - DNA, 20 bp, mouse
gatcatgagcaggaagacgc

SEQ ID NO: 434791 - DNA, 20 bp, mouse
gcgcggaacctaacccccag

SEQ ID NO: 434792 - DNA, 20 bp, mouse
ggggcaggtagagagcgcac

SEQ ID NO: 434793 - DNA, 20 bp, mouse
gaggttccgcgcgacagaca

SEQ ID NO: 434794 - DNA, 20 bp, mouse
ggccattgcactgatgggcc

SEQ ID NO: 434795 - DNA, 20 bp, mouse
gcagctgggaacttaccgga

SEQ ID NO: 434796 - DNA, 20 bp, mouse
gcgcctggaagggcccggga

SEQ ID NO: 434797 - DNA, 20 bp, mouse
ggttgccccagcaacagtcg

SEQ ID NO: 434798 - DNA, 20 bp, mouse
gggggcaccccaggagagcg

SEQ ID NO: 434799 - DNA, 20 bp, mouse
ggcaacagtcggggcacccc

SEQ ID NO: 434800 - DNA, 20 bp, mouse
gggagcgagactagtctcga

SEQ ID NO: 434801 - DNA, 20 bp, mouse
ggcacgcagggcgggctcag

SEQ ID NO: 434802 - DNA, 20 bp, mouse
ggatctccctccgcctggaa

SEQ ID NO: 434803 - DNA, 20 bp, mouse
gccgggcccttccaggcgga

SEQ ID NO: 434804 - DNA, 20 bp, mouse
gggtgccccgactgttgctg

SEQ ID NO: 434805 - DNA, 20 bp, mouse
gctcggggatggtagttcac

SEQ ID NO: 434806 - DNA, 20 bp, mouse
gctgttgacgcacccctcta

SEQ ID NO: 434807 - DNA, 20 bp, mouse
gctacggagccaagatctgt

SEQ ID NO: 434808 - DNA, 20 bp, mouse
ggggctgtgccaacagatct

SEQ ID NO: 434809 - DNA, 20 bp, mouse
gagatcttggctccgtagag

SEQ ID NO: 434810 - DNA, 20 bp, mouse
gtcttagcatggctccgcag

SEQ ID NO: 434811 - DNA, 20 bp, mouse
gaacagggcacgggaatgtt

SEQ ID NO: 434812 - DNA, 20 bp, mouse
gtacgagcatgtcacatgag

SEQ ID NO: 434813 - DNA, 20 bp, mouse
ggggtgcgtcaacagggcac

SEQ ID NO: 434814 - DNA, 20 bp, mouse
gtaagtagcgctaacaggta

SEQ ID NO: 434815 - DNA, 20 bp, mouse
gtgggtttatacgagaccca

SEQ ID NO: 434816 - DNA, 20 bp, mouse
gggtataagatggctaatca

SEQ ID NO: 434817 - DNA, 20 bp, mouse
gtcttataccaaccaagtaa

SEQ ID NO: 434818 - DNA, 20 bp, mouse
gatgagccagaggggttcca

SEQ ID NO: 434819 - DNA, 20 bp, mouse
gaggttccatggaacccctc

SEQ ID NO: 434820 - DNA, 20 bp, mouse
gaagtgaagctataatctaa

SEQ ID NO: 434821 - DNA, 20 bp, mouse
gactgcggcctttacttggt

SEQ ID NO: 434822 - DNA, 20 bp, mouse
gtaaaggtggagctataata

SEQ ID NO: 434823 - DNA, 20 bp, mouse
gcaggtaagaggatctctca

SEQ ID NO: 434824 - DNA, 20 bp, mouse
gtgaagctataatctaaagg

SEQ ID NO: 434825 - DNA, 20 bp, mouse
ggttgagtcatgagccagag

SEQ ID NO: 434826 - DNA, 20 bp, mouse
gatctcgctgtctttacctt

SEQ ID NO: 434827 - DNA, 20 bp, mouse
gtctggttataggaagttct

SEQ ID NO: 434828 - DNA, 20 bp, mouse
ggttctgtagaaaacgatcc

SEQ ID NO: 434829 - DNA, 20 bp, mouse
gggatttgggttctggttat

SEQ ID NO: 434830 - DNA, 20 bp, mouse
gtcaacatgaagcgcacaag

SEQ ID NO: 434831 - DNA, 20 bp, mouse
ggaaagaatcatcgttctaa

SEQ ID NO: 434832 - DNA, 20 bp, mouse
ggcacgtccctcttgctttt

SEQ ID NO: 434833 - DNA, 20 bp, mouse
gggaaggaagctggcaggga

SEQ ID NO: 434834 - DNA, 20 bp, mouse
gtgtggattgatataagctg

SEQ ID NO: 434835 - DNA, 20 bp, mouse
gtgaaatcccaaaagcaaga

SEQ ID NO: 434836 - DNA, 20 bp, mouse
gcccacaagggccctcgatg

SEQ ID NO: 434837 - DNA, 20 bp, mouse
gcttcagcgcccggcggcaa

SEQ ID NO: 434838 - DNA, 20 bp, mouse
gcgaggcgtcgccacatcga

SEQ ID NO: 434839 - DNA, 20 bp, mouse
gagccttcttcagcgcccgg

SEQ ID NO: 434840 - DNA, 20 bp, mouse
gagactggaagacagcgacc

SEQ ID NO: 434841 - DNA, 20 bp, mouse
gagcgacctggagaagcaaa

SEQ ID NO: 434842 - DNA, 20 bp, mouse
ggtaaggctgctaagtaagg

SEQ ID NO: 434843 - DNA, 20 bp, mouse
gagggtaaggctgctaagta

SEQ ID NO: 434844 - DNA, 20 bp, mouse
ggccacatcgagggcccttg

SEQ ID NO: 434845 - DNA, 20 bp, mouse
ggcggacgcctcgctgacaa

SEQ ID NO: 434846 - DNA, 20 bp, mouse
gagatgtttacgatgtgcaa

SEQ ID NO: 434847 - DNA, 20 bp, mouse
gaacatcttcaaatgcataa

SEQ ID NO: 434848 - DNA, 20 bp, mouse
gagatagctgggacatgtaa

SEQ ID NO: 434849 - DNA, 20 bp, mouse
gaagcctatgcacgacacag

SEQ ID NO: 434850 - DNA, 20 bp, mouse
gataagggaacaacacataa

SEQ ID NO: 434851 - DNA, 20 bp, mouse
gtatggatttgaagatagct

SEQ ID NO: 434852 - DNA, 20 bp, mouse
gtccagtatggtttctttta

SEQ ID NO: 434853 - DNA, 20 bp, mouse
gtccataaaagaaaccatac

SEQ ID NO: 434854 - DNA, 20 bp, mouse
gaggtaactgtgtcgtgcat

SEQ ID NO: 434855 - DNA, 20 bp, mouse
gaggccactgtgtcgtgcat

SEQ ID NO: 434856 - DNA, 20 bp, mouse
gtacaagtagctaccttcaa

SEQ ID NO: 434857 - DNA, 20 bp, mouse
gagcgagagaactcgagtta

SEQ ID NO: 434858 - DNA, 20 bp, mouse
gcttctagaagtggccacag

SEQ ID NO: 434859 - DNA, 20 bp, mouse
gcactcgtcacagccatagg

SEQ ID NO: 434860 - DNA, 20 bp, mouse
gcgctttctgatgagatcat

SEQ ID NO: 434861 - DNA, 20 bp, mouse
gtcctccgggataaggacga

SEQ ID NO: 434862 - DNA, 20 bp, mouse
gtccgggataaggacgaggg

SEQ ID NO: 434863 - DNA, 20 bp, mouse
ggtagctaccttcaaaggcc

SEQ ID NO: 434864 - DNA, 20 bp, mouse
gatcattggctgtggacgtg

SEQ ID NO: 434865 - DNA, 20 bp, mouse
gtggggacctgagtggcacc

SEQ ID NO: 434866 - DNA, 20 bp, mouse
gctcacgcaccggcacctca

SEQ ID NO: 434867 - DNA, 20 bp, mouse
gcgcctcagcgtgcgagtcg

SEQ ID NO: 434868 - DNA, 20 bp, mouse
gctggagaccggccacgggg

SEQ ID NO: 434869 - DNA, 20 bp, mouse
gacctcccaccctcacgcac

SEQ ID NO: 434870 - DNA, 20 bp, mouse
gctgcggggtgagagccgtg

SEQ ID NO: 434871 - DNA, 20 bp, mouse
ggacctcgactcgcacgctg

SEQ ID NO: 434872 - DNA, 20 bp, mouse
gccacgagtgtgagggtgag

SEQ ID NO: 434873 - DNA, 20 bp, mouse
ggtatggtgctaccagaggg

SEQ ID NO: 434874 - DNA, 20 bp, mouse
gggtgagagccgtgaggtgc

SEQ ID NO: 434875 - DNA, 20 bp, mouse
gggtgccggtgcgtgagggt

SEQ ID NO: 434876 - DNA, 20 bp, mouse
gaggcgggaggagcccgaga

SEQ ID NO: 434877 - DNA, 20 bp, mouse
gagcagccgccgggcgagga

SEQ ID NO: 434878 - DNA, 20 bp, mouse
gtgcgggcccgcgccctctc

SEQ ID NO: 434879 - DNA, 20 bp, mouse
gctaagaaggggccattcag

SEQ ID NO: 434880 - DNA, 20 bp, mouse
ggccgccgggcgaggagggt

SEQ ID NO: 434881 - DNA, 20 bp, mouse
ggcggctgctgtccccgagg

SEQ ID NO: 434882 - DNA, 20 bp, mouse
gggccccagtcactcacatg

SEQ ID NO: 434883 - DNA, 20 bp, mouse
gtcgggctcctcccgcctcg

SEQ ID NO: 434884 - DNA, 20 bp, mouse
gagcagaacgcggacgggag

SEQ ID NO: 434885 - DNA, 20 bp, mouse
ggcccgcatgtgagtgactg

SEQ ID NO: 434886 - DNA, 20 bp, mouse
gcccaccccccgcaccggag

SEQ ID NO: 434887 - DNA, 20 bp, mouse
ggctgccgctggaacctccc

SEQ ID NO: 434888 - DNA, 20 bp, mouse
ggttcccccaccccccgcac

SEQ ID NO: 434889 - DNA, 20 bp, mouse
gctggaacctcccgggtccg

SEQ ID NO: 434890 - DNA, 20 bp, mouse
ggaagccactccggtgcggg

SEQ ID NO: 434891 - DNA, 20 bp, mouse
gcagcgcagcgggcatggag

SEQ ID NO: 434892 - DNA, 20 bp, mouse
ggagagagccgcaacggagg

SEQ ID NO: 434893 - DNA, 20 bp, mouse
ggactatggggcccaggtgg

SEQ ID NO: 434894 - DNA, 20 bp, mouse
gctgcgctacggcctgtccg

SEQ ID NO: 434895 - DNA, 20 bp, mouse
gctcaaacgcgactcagccc

SEQ ID NO: 434896 - DNA, 20 bp, mouse
gctcctgacccagctcgata

SEQ ID NO: 434897 - DNA, 20 bp, mouse
gacgccgaggagatcccgac

SEQ ID NO: 434898 - DNA, 20 bp, mouse
gagagcggtgggaaaccggt

SEQ ID NO: 434899 - DNA, 20 bp, mouse
gggagtcggcggtgtgtcgt

SEQ ID NO: 434900 - DNA, 20 bp, mouse
ggccgactccacagagcggt

SEQ ID NO: 434901 - DNA, 20 bp, mouse
gaaaccggtcgggatctcct

SEQ ID NO: 434902 - DNA, 20 bp, mouse
gtcccaccgctctgtggagt

SEQ ID NO: 434903 - DNA, 20 bp, mouse
gctacgccgcggctcgggaa

SEQ ID NO: 434904 - DNA, 20 bp, mouse
ggcgcgagcgagcggtgagt

SEQ ID NO: 434905 - DNA, 20 bp, mouse
gccacagagcggtgggaaac

SEQ ID NO: 434906 - DNA, 20 bp, mouse
gtctgcgcgccggaagagag

SEQ ID NO: 434907 - DNA, 20 bp, mouse
gtaacgcagcgccaagggtc

SEQ ID NO: 434908 - DNA, 20 bp, mouse
gcatagcggaaccagaccct

SEQ ID NO: 434909 - DNA, 20 bp, mouse
gcgccacgcagaggctccta

SEQ ID NO: 434910 - DNA, 20 bp, mouse
gttaccagacgcgtagtcca

SEQ ID NO: 434911 - DNA, 20 bp, mouse
gtagggataaggccacatcg

SEQ ID NO: 434912 - DNA, 20 bp, mouse
gaccggccagcgccacgcag

SEQ ID NO: 434913 - DNA, 20 bp, mouse
gcccggtaccgccctctagt

SEQ ID NO: 434914 - DNA, 20 bp, mouse
ggctgactcggagtcggagg

SEQ ID NO: 434915 - DNA, 20 bp, mouse
gcaagcatgccgggagtcgg

SEQ ID NO: 434916 - DNA, 20 bp, mouse
gagagggctcggggaaactg

SEQ ID NO: 434917 - DNA, 20 bp, mouse
gaaagccagggtccccgcgt

SEQ ID NO: 434918 - DNA, 20 bp, mouse
gcagatggagtctccaggtg

SEQ ID NO: 434919 - DNA, 20 bp, mouse
gtcgcggtgagagatcttcg

SEQ ID NO: 434920 - DNA, 20 bp, mouse
gaagcgcggacacaaagcca

SEQ ID NO: 434921 - DNA, 20 bp, mouse
gtggagcagagggggaactt

SEQ ID NO: 434922 - DNA, 20 bp, mouse
gcaaaggcaggctggagact

SEQ ID NO: 434923 - DNA, 20 bp, mouse
gggttagccaagagggctcg

SEQ ID NO: 434924 - DNA, 20 bp, mouse
gtgggagggacgcgaggccc

SEQ ID NO: 434925 - DNA, 20 bp, mouse
ggcggaggcgcccaagccgg

SEQ ID NO: 434926 - DNA, 20 bp, mouse
gatggtacctgtcatcccca

SEQ ID NO: 434927 - DNA, 20 bp, mouse
gtcagcatcctggggatagt

SEQ ID NO: 434928 - DNA, 20 bp, mouse
gtcagcatcctgggaatgat

SEQ ID NO: 434929 - DNA, 20 bp, mouse
ggcatcagtatcctcaggct

SEQ ID NO: 434930 - DNA, 20 bp, mouse
gagagagagagtggacatgc

SEQ ID NO: 434931 - DNA, 20 bp, mouse
ggatgcccatgcaggagtga

SEQ ID NO: 434932 - DNA, 20 bp, mouse
gtcctccctcactcctgcat

SEQ ID NO: 434933 - DNA, 20 bp, mouse
gaatcagggatgcagaaaga

SEQ ID NO: 434934 - DNA, 20 bp, mouse
gggttgctcatttgcgctga

SEQ ID NO: 434935 - DNA, 20 bp, mouse
ggatggtacccatcattccc

SEQ ID NO: 434936 - DNA, 20 bp, mouse
gcccccggggaaccagcgac

SEQ ID NO: 434937 - DNA, 20 bp, mouse
ggcatgaggaggacaccgag

SEQ ID NO: 434938 - DNA, 20 bp, mouse
ggcgcgcgcccgggacaccc

SEQ ID NO: 434939 - DNA, 20 bp, mouse
ggaggcgaggtcgggagacg

SEQ ID NO: 434940 - DNA, 20 bp, mouse
ggcgcacgaggtttcacttc

SEQ ID NO: 434941 - DNA, 20 bp, mouse
ggggctggaaaagcatgagg

SEQ ID NO: 434942 - DNA, 20 bp, mouse
gttccggtcgctggttcccc

SEQ ID NO: 434943 - DNA, 20 bp, mouse
gaacaagccaggcgcgggga

SEQ ID NO: 434944 - DNA, 20 bp, mouse
gcggacgccccaacacctga

SEQ ID NO: 434945 - DNA, 20 bp, mouse
ggcttgtgaggctgagtgag

SEQ ID NO: 434946 - DNA, 20 bp, mouse
gatggcagcgccgaagacgg

SEQ ID NO: 434947 - DNA, 20 bp, mouse
ggatctggacccttcttcca

SEQ ID NO: 434948 - DNA, 20 bp, mouse
gcggcgctgccatggaagaa

SEQ ID NO: 434949 - DNA, 20 bp, mouse
gtccatggcagcgccgaaga

SEQ ID NO: 434950 - DNA, 20 bp, mouse
gagacggaggctccgctgag

SEQ ID NO: 434951 - DNA, 20 bp, mouse
ggcaagactctagcacctaa

SEQ ID NO: 434952 - DNA, 20 bp, mouse
gcccaggacacgcaaagaag

SEQ ID NO: 434953 - DNA, 20 bp, mouse
ggctgggctagggtcctcag

SEQ ID NO: 434954 - DNA, 20 bp, mouse
gagagctccagctcttcccg

SEQ ID NO: 434955 - DNA, 20 bp, mouse
gagctcttcccggggcgatt

SEQ ID NO: 434956 - DNA, 20 bp, mouse
ggactcgctgaacttgagga

SEQ ID NO: 434957 - DNA, 20 bp, mouse
ggctgacgctgcgagcctac

SEQ ID NO: 434958 - DNA, 20 bp, mouse
gtcagcgagtcggtccaacg

SEQ ID NO: 434959 - DNA, 20 bp, mouse
gcgaactgctccgtgcacag

SEQ ID NO: 434960 - DNA, 20 bp, mouse
gcactgcaggctcccatcgg

SEQ ID NO: 434961 - DNA, 20 bp, mouse
ggatctgaggcccgaaagag

SEQ ID NO: 434962 - DNA, 20 bp, mouse
ggaccgactcgctgaacttg

SEQ ID NO: 434963 - DNA, 20 bp, mouse
gctacgggcgccgctgtgca

SEQ ID NO: 434964 - DNA, 20 bp, mouse
gaggcagcagcacggatctg

SEQ ID NO: 434965 - DNA, 20 bp, mouse
gggccccgatagcgaaacct

SEQ ID NO: 434966 - DNA, 20 bp, mouse
gcggacaacgagggacttgt

SEQ ID NO: 434967 - DNA, 20 bp, mouse
ggcacctatgcggacaacga

SEQ ID NO: 434968 - DNA, 20 bp, mouse
gggacttgtaggagaatgag

SEQ ID NO: 434969 - DNA, 20 bp, mouse
gagaagtccggaagttcgag

SEQ ID NO: 434970 - DNA, 20 bp, mouse
gtgtaggacacgcacctatg

SEQ ID NO: 434971 - DNA, 20 bp, mouse
gtcggaacccgaaaagttgt

SEQ ID NO: 434972 - DNA, 20 bp, mouse
gagtctgcggaacagaagtc

SEQ ID NO: 434973 - DNA, 20 bp, mouse
gagtccctcgttgtccgcat

SEQ ID NO: 434974 - DNA, 20 bp, mouse
gtgacccgcacagggctcgg

SEQ ID NO: 434975 - DNA, 20 bp, mouse
gcgcacagggctcggcgggt

SEQ ID NO: 434976 - DNA, 20 bp, mouse
gggcggtccagacttcatct

SEQ ID NO: 434977 - DNA, 20 bp, mouse
gcgcggagcggcaagtccgg

SEQ ID NO: 434978 - DNA, 20 bp, mouse
ggatctatctgactgttcta

SEQ ID NO: 434979 - DNA, 20 bp, mouse
gcggacaccgagatgaagtc

SEQ ID NO: 434980 - DNA, 20 bp, mouse
gggcggcggcggcctagaca

SEQ ID NO: 434981 - DNA, 20 bp, mouse
ggaccgtgtagagggagcga

SEQ ID NO: 434982 - DNA, 20 bp, mouse
ggtcagatagatcgctggtc

SEQ ID NO: 434983 - DNA, 20 bp, mouse
ggaacagtcagatagatcgc

SEQ ID NO: 434984 - DNA, 20 bp, mouse
gtcacggagtctgcgcggag

SEQ ID NO: 434985 - DNA, 20 bp, mouse
gagatcgctggtcaggcagg

SEQ ID NO: 434986 - DNA, 20 bp, mouse
gagaccagcgaagcagccca

SEQ ID NO: 434987 - DNA, 20 bp, mouse
gagcccagggcacttgagag

SEQ ID NO: 434988 - DNA, 20 bp, mouse
gtccccgtggagccggccta

SEQ ID NO: 434989 - DNA, 20 bp, mouse
gcccggcgagacgcacccgg

SEQ ID NO: 434990 - DNA, 20 bp, mouse
gaccctgagtcgggaagacg

SEQ ID NO: 434991 - DNA, 20 bp, mouse
gagcaggtacgcaggatccc

SEQ ID NO: 434992 - DNA, 20 bp, mouse
ggccgcagcaccatgatgcc

SEQ ID NO: 434993 - DNA, 20 bp, mouse
ggctggtctgagccctaggc

SEQ ID NO: 434994 - DNA, 20 bp, mouse
gtcgtcgctttgggccctcg

SEQ ID NO: 434995 - DNA, 20 bp, mouse
gatgcccggcgagacgcacc

SEQ ID NO: 434996 - DNA, 20 bp, mouse
gaggagaaacctggaggcaa

SEQ ID NO: 434997 - DNA, 20 bp, mouse
gctgtatccgcccaacagta

SEQ ID NO: 434998 - DNA, 20 bp, mouse
gccaacagtaaggagaaacc

SEQ ID NO: 434999 - DNA, 20 bp, mouse
gtcctgggaatccccaacag

SEQ ID NO: 435000 - DNA, 20 bp, mouse
gagtgctgaggccacacctc

SEQ ID NO: 435001 - DNA, 20 bp, mouse
ggcggttagtagcaggggtg

SEQ ID NO: 435002 - DNA, 20 bp, mouse
gctatctacggaggctaaga

SEQ ID NO: 435003 - DNA, 20 bp, mouse
gagtcttctgggtcattcct

SEQ ID NO: 435004 - DNA, 20 bp, mouse
gcagacagtgcagctatcta

SEQ ID NO: 435005 - DNA, 20 bp, mouse
gcccaacagtggtgtaggaa

SEQ ID NO: 435006 - DNA, 20 bp, mouse
gttctggtcagacagaacag

SEQ ID NO: 435007 - DNA, 20 bp, mouse
ggcagcgttcagaaccacag

SEQ ID NO: 435008 - DNA, 20 bp, mouse
ggactgaggactgtccgtgg

SEQ ID NO: 435009 - DNA, 20 bp, mouse
gcctccaggttgagacccaa

SEQ ID NO: 435010 - DNA, 20 bp, mouse
gcttggaggctccaaacaaa

SEQ ID NO: 435011 - DNA, 20 bp, mouse
gaacaggggctcagagctcc

SEQ ID NO: 435012 - DNA, 20 bp, mouse
gcccagtgcctcctccccca

SEQ ID NO: 435013 - DNA, 20 bp, mouse
gagacgtgggcccggaccca

SEQ ID NO: 435014 - DNA, 20 bp, mouse
gggactgtccgtgggggagg

SEQ ID NO: 435015 - DNA, 20 bp, mouse
gaaacaaagggtttttggtg

SEQ ID NO: 435016 - DNA, 20 bp, mouse
ggaagaactagccaaactgg

SEQ ID NO: 435017 - DNA, 20 bp, mouse
gcgctagcgcggacaaccgg

SEQ ID NO: 435018 - DNA, 20 bp, mouse
gtagcgcggacaaccggtgg

SEQ ID NO: 435019 - DNA, 20 bp, mouse
gctctgctctgcctccagtt

SEQ ID NO: 435020 - DNA, 20 bp, mouse
gggttacgaccactgcccgg

SEQ ID NO: 435021 - DNA, 20 bp, mouse
gagccataggggcgattgag

SEQ ID NO: 435022 - DNA, 20 bp, mouse
ggctacaggtagagccatag

SEQ ID NO: 435023 - DNA, 20 bp, mouse
ggcaggtccagcaccgccac

SEQ ID NO: 435024 - DNA, 20 bp, mouse
gccgcggtgtcaggagacga

SEQ ID NO: 435025 - DNA, 20 bp, mouse
gtggctctacctgtagccga

SEQ ID NO: 435026 - DNA, 20 bp, mouse
ggcgtcgcggcggcgaaggt

SEQ ID NO: 435027 - DNA, 20 bp, mouse
gtcccaggcgcagacggagg

SEQ ID NO: 435028 - DNA, 20 bp, mouse
ggccgggaggcgcgtcgcgg

SEQ ID NO: 435029 - DNA, 20 bp, mouse
ggagctcccagaggcccgca

SEQ ID NO: 435030 - DNA, 20 bp, mouse
gcatccgcgagtgccaggag

SEQ ID NO: 435031 - DNA, 20 bp, mouse
gctccccgccgggcgccggg

SEQ ID NO: 435032 - DNA, 20 bp, mouse
gggaggggtcgactccacgg

SEQ ID NO: 435033 - DNA, 20 bp, mouse
gtgtgggcagacgcaagtcc

SEQ ID NO: 435034 - DNA, 20 bp, mouse
gctgcgaggccggaggctga

SEQ ID NO: 435035 - DNA, 20 bp, mouse
ggctgtagtatctccccgcc

SEQ ID NO: 435036 - DNA, 20 bp, mouse
gagcgggttcatgctgccaa

SEQ ID NO: 435037 - DNA, 20 bp, mouse
gcggaagccggaaggagtgt

SEQ ID NO: 435038 - DNA, 20 bp, mouse
ggcagcatgaacccgctgtg

SEQ ID NO: 435039 - DNA, 20 bp, mouse
gttagcgacgaagctgcctt

SEQ ID NO: 435040 - DNA, 20 bp, mouse
gaaggagtgtgggagacagt

SEQ ID NO: 435041 - DNA, 20 bp, mouse
gtcccggcgacgccaggttg

SEQ ID NO: 435042 - DNA, 20 bp, mouse
gtggttgctctggtttctcc

SEQ ID NO: 435043 - DNA, 20 bp, mouse
gcgcatgcgcatcctagcta

SEQ ID NO: 435044 - DNA, 20 bp, mouse
gaccagcctgaggctcctta

SEQ ID NO: 435045 - DNA, 20 bp, mouse
gctctggtttctcctggcgg

SEQ ID NO: 435046 - DNA, 20 bp, mouse
ggatgtacagggctagacag

SEQ ID NO: 435047 - DNA, 20 bp, mouse
gcctggcctaggggactgga

SEQ ID NO: 435048 - DNA, 20 bp, mouse
gaaggaaggtaggatgtaca

SEQ ID NO: 435049 - DNA, 20 bp, mouse
ggctggggccagactgtctg

SEQ ID NO: 435050 - DNA, 20 bp, mouse
gagtgagagcagccctacaa

SEQ ID NO: 435051 - DNA, 20 bp, mouse
gggtagactgcctggcctag

SEQ ID NO: 435052 - DNA, 20 bp, mouse
ggggccagactgtctggggc

SEQ ID NO: 435053 - DNA, 20 bp, mouse
gctacccccaagccttgcat

SEQ ID NO: 435054 - DNA, 20 bp, mouse
gtggtgctggacctgggatt

SEQ ID NO: 435055 - DNA, 20 bp, mouse
gagggctgctctcactgtcc

SEQ ID NO: 435056 - DNA, 20 bp, mouse
gacgctgctcggcgccgggg

SEQ ID NO: 435057 - DNA, 20 bp, mouse
ggagccagttaagaaagtag

SEQ ID NO: 435058 - DNA, 20 bp, mouse
ggaggcgggtggagcacttc

SEQ ID NO: 435059 - DNA, 20 bp, mouse
ggagcagcgtctacaacccg

SEQ ID NO: 435060 - DNA, 20 bp, mouse
gtgctcggcgccggggaggc

SEQ ID NO: 435061 - DNA, 20 bp, mouse
gtagacgctgctcggcgccg

SEQ ID NO: 435062 - DNA, 20 bp, mouse
gctcaggtggtgggttcccg

SEQ ID NO: 435063 - DNA, 20 bp, mouse
gcccttccgcgagctaatca

SEQ ID NO: 435064 - DNA, 20 bp, mouse
gagtgctccacccgcctccc

SEQ ID NO: 435065 - DNA, 20 bp, mouse
ggagcgacggctcaggtggt

SEQ ID NO: 435066 - DNA, 20 bp, mouse
gccctattgtgtgcagaagg

SEQ ID NO: 435067 - DNA, 20 bp, mouse
gatgctgtggccagtcgact

SEQ ID NO: 435068 - DNA, 20 bp, mouse
gagggtcctgggcacacaat

SEQ ID NO: 435069 - DNA, 20 bp, mouse
gactggccacagcataccca

SEQ ID NO: 435070 - DNA, 20 bp, mouse
ggattccacaccacttaact

SEQ ID NO: 435071 - DNA, 20 bp, mouse
gctggggatttgcttgtggt

SEQ ID NO: 435072 - DNA, 20 bp, mouse
ggttcctggcacaggtagtg

SEQ ID NO: 435073 - DNA, 20 bp, mouse
gtcccagctgccaagttaag

SEQ ID NO: 435074 - DNA, 20 bp, mouse
gctacctgtgccaggaaccc

SEQ ID NO: 435075 - DNA, 20 bp, mouse
gctctggtggccagggttcc

SEQ ID NO: 435076 - DNA, 20 bp, mouse
gacagcgacgaagaccaaag

SEQ ID NO: 435077 - DNA, 20 bp, mouse
gtgcgggagagcgtgacctt

SEQ ID NO: 435078 - DNA, 20 bp, mouse
gtgcagagaatgaccggaac

SEQ ID NO: 435079 - DNA, 20 bp, mouse
ggggtccccgcagggcaatg

SEQ ID NO: 435080 - DNA, 20 bp, mouse
gacttgattgaagccggaac

SEQ ID NO: 435081 - DNA, 20 bp, mouse
gcgtttctggttatcctaac

SEQ ID NO: 435082 - DNA, 20 bp, mouse
gaactggatgttaaccagtt

SEQ ID NO: 435083 - DNA, 20 bp, mouse
gacctggaacgcagatgcac

SEQ ID NO: 435084 - DNA, 20 bp, mouse
gtgggcacgttgagcgaatg

SEQ ID NO: 435085 - DNA, 20 bp, mouse
gtacatggaagcattagctt

SEQ ID NO: 435086 - DNA, 20 bp, mouse
ggcagagccacaccggaggg

SEQ ID NO: 435087 - DNA, 20 bp, mouse
gacctgcagagccacaccgg

SEQ ID NO: 435088 - DNA, 20 bp, mouse
ggcgttgcctccctccggtg

SEQ ID NO: 435089 - DNA, 20 bp, mouse
gggccagctgaagtcgcgag

SEQ ID NO: 435090 - DNA, 20 bp, mouse
gtgtacgcgttgcctccctc

SEQ ID NO: 435091 - DNA, 20 bp, mouse
gcgtcgggccacaggaggta

SEQ ID NO: 435092 - DNA, 20 bp, mouse
ggctgggccgagaaagtcag

SEQ ID NO: 435093 - DNA, 20 bp, mouse
gttctcggcccagcactcgt

SEQ ID NO: 435094 - DNA, 20 bp, mouse
gcggggagccacctcttgaa

SEQ ID NO: 435095 - DNA, 20 bp, mouse
gggctctgaactatacaagg

SEQ ID NO: 435096 - DNA, 20 bp, mouse
ggggtgctcagagggtccag

SEQ ID NO: 435097 - DNA, 20 bp, mouse
gggatcggggagccctcacc

SEQ ID NO: 435098 - DNA, 20 bp, mouse
ggggagccctcacccggcag

SEQ ID NO: 435099 - DNA, 20 bp, mouse
gcgcctcctcaggagctcga

SEQ ID NO: 435100 - DNA, 20 bp, mouse
ggccaagctggcgccaccag

SEQ ID NO: 435101 - DNA, 20 bp, mouse
gcagagggtccaggggatcg

SEQ ID NO: 435102 - DNA, 20 bp, mouse
gtcctgcctctgccgggtga

SEQ ID NO: 435103 - DNA, 20 bp, mouse
gcgctcctggactagaggga

SEQ ID NO: 435104 - DNA, 20 bp, mouse
gctgagtgacgtcaccgggt

SEQ ID NO: 435105 - DNA, 20 bp, mouse
ggagctcgagggtgctcaga

SEQ ID NO: 435106 - DNA, 20 bp, mouse
gagcccaggccacaatgaag

SEQ ID NO: 435107 - DNA, 20 bp, mouse
ggtaacagcatcaaaactta

SEQ ID NO: 435108 - DNA, 20 bp, mouse
gtgggcccctcggaactgtc

SEQ ID NO: 435109 - DNA, 20 bp, mouse
gtccctgagactgggcccct

SEQ ID NO: 435110 - DNA, 20 bp, mouse
ggtatccagacagttccgag

SEQ ID NO: 435111 - DNA, 20 bp, mouse
gctgggagagaggctggtag

SEQ ID NO: 435112 - DNA, 20 bp, mouse
gagtcctagacttggagccc

SEQ ID NO: 435113 - DNA, 20 bp, mouse
gagcgacaagctggaaccat

SEQ ID NO: 435114 - DNA, 20 bp, mouse
ggggcccagtctcagggatt

SEQ ID NO: 435115 - DNA, 20 bp, mouse
gtgtgatggcgtgcacccca

SEQ ID NO: 435116 - DNA, 20 bp, mouse
gccgcagcggccatctcgag

SEQ ID NO: 435117 - DNA, 20 bp, mouse
gggagcgtgagcgagttgag

SEQ ID NO: 435118 - DNA, 20 bp, mouse
gcatctcgagcggcgtggga

SEQ ID NO: 435119 - DNA, 20 bp, mouse
gcggccatctcgagcggcgt

SEQ ID NO: 435120 - DNA, 20 bp, mouse
ggcacccggccgcaccgcag

SEQ ID NO: 435121 - DNA, 20 bp, mouse
gcgctccgctcggccttccc

SEQ ID NO: 435122 - DNA, 20 bp, mouse
gtgagcgagttgagcggcct

SEQ ID NO: 435123 - DNA, 20 bp, mouse
gggctcacgtgggacggggt

SEQ ID NO: 435124 - DNA, 20 bp, mouse
gaggtccggcctggatagtg

SEQ ID NO: 435125 - DNA, 20 bp, mouse
gccggcgggcgggctcacgt

SEQ ID NO: 435126 - DNA, 20 bp, mouse
ggctgcagcagcaaaggacg

SEQ ID NO: 435127 - DNA, 20 bp, mouse
gggacgtggcatcctctccc

SEQ ID NO: 435128 - DNA, 20 bp, mouse
gggagagagcttaccagtct

SEQ ID NO: 435129 - DNA, 20 bp, mouse
gtgccctccagctgaagaaa

SEQ ID NO: 435130 - DNA, 20 bp, mouse
gctccagctgaagaaagggc

SEQ ID NO: 435131 - DNA, 20 bp, mouse
ggaaaagtgaactcatgtgt

SEQ ID NO: 435132 - DNA, 20 bp, mouse
gtatgaaaagggacactcgc

SEQ ID NO: 435133 - DNA, 20 bp, mouse
gaaaagggacactcgccggg

SEQ ID NO: 435134 - DNA, 20 bp, mouse
gagggcaagacctgtttatc

SEQ ID NO: 435135 - DNA, 20 bp, mouse
gccttggagacccaatggaa

SEQ ID NO: 435136 - DNA, 20 bp, mouse
ggtcagaaggagacttaccc

SEQ ID NO: 435137 - DNA, 20 bp, mouse
gatgagtggtgcaacaagga

SEQ ID NO: 435138 - DNA, 20 bp, mouse
gaacaaggagggctataaag

SEQ ID NO: 435139 - DNA, 20 bp, mouse
gcaggatgagtggtgcaaca

SEQ ID NO: 435140 - DNA, 20 bp, mouse
gtgttggagtccagggttgg

SEQ ID NO: 435141 - DNA, 20 bp, mouse
ggtgggcgcttggaagtcaa

SEQ ID NO: 435142 - DNA, 20 bp, mouse
gacacaggccggtggaggat

SEQ ID NO: 435143 - DNA, 20 bp, mouse
gagtacgtcgggcatttcag

SEQ ID NO: 435144 - DNA, 20 bp, mouse
gggagagtgaggagccataa

SEQ ID NO: 435145 - DNA, 20 bp, mouse
gcatcagtgagcgaagccag

SEQ ID NO: 435146 - DNA, 20 bp, mouse
gaaagcggcagcgacaacaa

SEQ ID NO: 435147 - DNA, 20 bp, mouse
gccggcggcagaatacaaag

SEQ ID NO: 435148 - DNA, 20 bp, mouse
gcaggagccaagttagatgt

SEQ ID NO: 435149 - DNA, 20 bp, mouse
gggggggagcccgaacccgg

SEQ ID NO: 435150 - DNA, 20 bp, mouse
gcggaggagccatgacagca

SEQ ID NO: 435151 - DNA, 20 bp, mouse
gcgagaccgccctgctgtca

SEQ ID NO: 435152 - DNA, 20 bp, mouse
gggcgtccgtcacactgggt

SEQ ID NO: 435153 - DNA, 20 bp, mouse
gggcggggggagcccgaacc

SEQ ID NO: 435154 - DNA, 20 bp, mouse
gcagtagcacaccaggcggg

SEQ ID NO: 435155 - DNA, 20 bp, mouse
gactgcgagcgggatagtgg

SEQ ID NO: 435156 - DNA, 20 bp, mouse
gagtccgtgactaggggaaa

SEQ ID NO: 435157 - DNA, 20 bp, mouse
gggtaaaggacgcattgtct

SEQ ID NO: 435158 - DNA, 20 bp, mouse
gctaccgtttcccctagtca

SEQ ID NO: 435159 - DNA, 20 bp, mouse
gcgcgtcgtagacgagaaaa

SEQ ID NO: 435160 - DNA, 20 bp, mouse
gcagggctgaccctctgaca

SEQ ID NO: 435161 - DNA, 20 bp, mouse
gacgtttagtccgtgactag

SEQ ID NO: 435162 - DNA, 20 bp, mouse
gtccccgggacctctaggaa

SEQ ID NO: 435163 - DNA, 20 bp, mouse
gcggcgaacgtagcgctgaa

SEQ ID NO: 435164 - DNA, 20 bp, mouse
gggtcccggggaaccacttc

SEQ ID NO: 435165 - DNA, 20 bp, mouse
gtccattcctagaggtcccg

SEQ ID NO: 435166 - DNA, 20 bp, mouse
ggcgatggcgaagatatcgg

SEQ ID NO: 435167 - DNA, 20 bp, mouse
gggcgggccgagcagttccg

SEQ ID NO: 435168 - DNA, 20 bp, mouse
gctggcgatggcgaagatat

SEQ ID NO: 435169 - DNA, 20 bp, mouse
gcccggtgttgatccagtcc

SEQ ID NO: 435170 - DNA, 20 bp, mouse
gatcaacaccggggagtcgg

SEQ ID NO: 435171 - DNA, 20 bp, mouse
gcgagcagttccggggcggg

SEQ ID NO: 435172 - DNA, 20 bp, mouse
gtccgccggcccccccaccc

SEQ ID NO: 435173 - DNA, 20 bp, mouse
gctcactcctcgcgccccat

SEQ ID NO: 435174 - DNA, 20 bp, mouse
ggtgttgatccagtccgggt

SEQ ID NO: 435175 - DNA, 20 bp, mouse
ggggttggcgatgctggcga

SEQ ID NO: 435176 - DNA, 20 bp, mouse
gctgctgtacaggaggcgta

SEQ ID NO: 435177 - DNA, 20 bp, mouse
gagctccggagatgagatgg

SEQ ID NO: 435178 - DNA, 20 bp, mouse
gacaggaggcgtagggcgct

SEQ ID NO: 435179 - DNA, 20 bp, mouse
ggggaaatggggaaaagctc

SEQ ID NO: 435180 - DNA, 20 bp, mouse
gaccaaggaacctgctgtac

SEQ ID NO: 435181 - DNA, 20 bp, mouse
gaaggaacctgctgtacagg

SEQ ID NO: 435182 - DNA, 20 bp, mouse
gaaggcacaggcacacctag

SEQ ID NO: 435183 - DNA, 20 bp, mouse
gacggggtgcgcacctggag

SEQ ID NO: 435184 - DNA, 20 bp, mouse
gaaaagctccggagatgaga

SEQ ID NO: 435185 - DNA, 20 bp, mouse
gcgggcgacagcagcaggtt

SEQ ID NO: 435186 - DNA, 20 bp, mouse
ggcagcgcgaaaagaggcag

SEQ ID NO: 435187 - DNA, 20 bp, mouse
gcggcagggacaacacaccc

SEQ ID NO: 435188 - DNA, 20 bp, mouse
gttctgaggagcagacaccc

SEQ ID NO: 435189 - DNA, 20 bp, mouse
gaatgggagcagtaagctgt

SEQ ID NO: 435190 - DNA, 20 bp, mouse
ggatttagcagcgcgaaaag

SEQ ID NO: 435191 - DNA, 20 bp, mouse
ggagcagtaagctgtcggca

SEQ ID NO: 435192 - DNA, 20 bp, mouse
ggtctgctcctcagaaggta

SEQ ID NO: 435193 - DNA, 20 bp, mouse
gcctcagaaggtagggtatg

SEQ ID NO: 435194 - DNA, 20 bp, mouse
ggggtatggggctctggtat

SEQ ID NO: 435195 - DNA, 20 bp, mouse
gaaggggtgcctgttaagat

SEQ ID NO: 435196 - DNA, 20 bp, mouse
gggaagggggcgagattgat

SEQ ID NO: 435197 - DNA, 20 bp, mouse
gtagagagcacacttctctg

SEQ ID NO: 435198 - DNA, 20 bp, mouse
gagcgtgagagcgtcagcag

SEQ ID NO: 435199 - DNA, 20 bp, mouse
gagaatggtaacatgaacag

SEQ ID NO: 435200 - DNA, 20 bp, mouse
ggcaggagacagccagcggg

SEQ ID NO: 435201 - DNA, 20 bp, mouse
gttcctccaagtgcagtcct

SEQ ID NO: 435202 - DNA, 20 bp, mouse
gttcccaggactgcacttgg

SEQ ID NO: 435203 - DNA, 20 bp, mouse
gcttcacggcaagggacgga

SEQ ID NO: 435204 - DNA, 20 bp, mouse
gagtcacggccggaaggtag

SEQ ID NO: 435205 - DNA, 20 bp, mouse
gggcgcgcggaggatgagtg

SEQ ID NO: 435206 - DNA, 20 bp, mouse
gtaagaacgtgcacccagag

SEQ ID NO: 435207 - DNA, 20 bp, mouse
gcgcagcggaaactgagaga

SEQ ID NO: 435208 - DNA, 20 bp, mouse
gagcccgggcggcttagacg

SEQ ID NO: 435209 - DNA, 20 bp, mouse
gccggccgtgtcagactcaa

SEQ ID NO: 435210 - DNA, 20 bp, mouse
gagcgtctttaagaccgcag

SEQ ID NO: 435211 - DNA, 20 bp, mouse
gtggtgccttccctttaagg

SEQ ID NO: 435212 - DNA, 20 bp, mouse
ggtgtagtctgcagacctgg

SEQ ID NO: 435213 - DNA, 20 bp, mouse
gacccgccggcccgagccca

SEQ ID NO: 435214 - DNA, 20 bp, mouse
gtgtaggtctgtatgtccgg

SEQ ID NO: 435215 - DNA, 20 bp, mouse
gtagagtagggaactatgtc

SEQ ID NO: 435216 - DNA, 20 bp, mouse
gtccttgtgaaggatcgaca

SEQ ID NO: 435217 - DNA, 20 bp, mouse
gtcgacaaggaaccaggaag

SEQ ID NO: 435218 - DNA, 20 bp, mouse
ggaaggatcgacaaggaacc

SEQ ID NO: 435219 - DNA, 20 bp, mouse
gtccgaggcaaagaaagtac

SEQ ID NO: 435220 - DNA, 20 bp, mouse
gctcgtgttgggtcaggact

SEQ ID NO: 435221 - DNA, 20 bp, mouse
gcggcaagattagtgagctt

SEQ ID NO: 435222 - DNA, 20 bp, mouse
gtccttgtcgatccttcaca

SEQ ID NO: 435223 - DNA, 20 bp, mouse
gaagattagtgagcttagga

SEQ ID NO: 435224 - DNA, 20 bp, mouse
ggagtacagattcaccttga

SEQ ID NO: 435225 - DNA, 20 bp, mouse
gaggtgaatctgtactctca

SEQ ID NO: 435226 - DNA, 20 bp, mouse
gggccagtggcacacagagg

SEQ ID NO: 435227 - DNA, 20 bp, mouse
gtgccagcggagctgttcgg

SEQ ID NO: 435228 - DNA, 20 bp, mouse
ggggggccagtggcacacag

SEQ ID NO: 435229 - DNA, 20 bp, mouse
gaccgtgccggtccaaaggg

SEQ ID NO: 435230 - DNA, 20 bp, mouse
ggcccagggcgtcttggtgg

SEQ ID NO: 435231 - DNA, 20 bp, mouse
gagtgaggtttagggagctg

SEQ ID NO: 435232 - DNA, 20 bp, mouse
gccgcgagagaaacaaggag

SEQ ID NO: 435233 - DNA, 20 bp, mouse
ggaaagccgcgagagaaaca

SEQ ID NO: 435234 - DNA, 20 bp, mouse
gggacaccgaggtccacgga

SEQ ID NO: 435235 - DNA, 20 bp, mouse
gcgcagcgggtgtctgccag

SEQ ID NO: 435236 - DNA, 20 bp, mouse
gggcagccctgagcaatggt

SEQ ID NO: 435237 - DNA, 20 bp, mouse
gcacaggccgggatggacag

SEQ ID NO: 435238 - DNA, 20 bp, mouse
gcagcctactccccactcac

SEQ ID NO: 435239 - DNA, 20 bp, mouse
ggagaaaggctgaccgtaga

SEQ ID NO: 435240 - DNA, 20 bp, mouse
gcatgcctggcactcagtgt

SEQ ID NO: 435241 - DNA, 20 bp, mouse
gagacggctttaatggtatc

SEQ ID NO: 435242 - DNA, 20 bp, mouse
gacagcttagacggctttaa

SEQ ID NO: 435243 - DNA, 20 bp, mouse
gtatcatggctggctcggag

SEQ ID NO: 435244 - DNA, 20 bp, mouse
gtggctggctcggagcggtt

SEQ ID NO: 435245 - DNA, 20 bp, mouse
gtctcctctaactcatacac

SEQ ID NO: 435246 - DNA, 20 bp, mouse
gatcaagtagacggcatata

SEQ ID NO: 435247 - DNA, 20 bp, mouse
ggtggctactatcaagtaga

SEQ ID NO: 435248 - DNA, 20 bp, mouse
ggctaagataaaagtacctg

SEQ ID NO: 435249 - DNA, 20 bp, mouse
gcgtgggccggaaggctgag

SEQ ID NO: 435250 - DNA, 20 bp, mouse
gttcttgcgtcagctattgt

SEQ ID NO: 435251 - DNA, 20 bp, mouse
gcagtggagagccacacgag

SEQ ID NO: 435252 - DNA, 20 bp, mouse
gccccttctgaagagtgcag

SEQ ID NO: 435253 - DNA, 20 bp, mouse
gagaaaacactgggtggcaa

SEQ ID NO: 435254 - DNA, 20 bp, mouse
gtccactgcactcttcagaa

SEQ ID NO: 435255 - DNA, 20 bp, mouse
gctcaacaaggacaaaggct

SEQ ID NO: 435256 - DNA, 20 bp, mouse
gcagcaaatactatgcaaag

SEQ ID NO: 435257 - DNA, 20 bp, mouse
ggaggttgtgaaaagctgtc

SEQ ID NO: 435258 - DNA, 20 bp, mouse
ggacaacggggaaacaggta

SEQ ID NO: 435259 - DNA, 20 bp, mouse
gtcagagcatgattctgtgt

SEQ ID NO: 435260 - DNA, 20 bp, mouse
gctggaaaggtgactactca

SEQ ID NO: 435261 - DNA, 20 bp, mouse
gtctgtgtaggcgatgctat

SEQ ID NO: 435262 - DNA, 20 bp, mouse
gaggtgactactcatggctg

SEQ ID NO: 435263 - DNA, 20 bp, mouse
gggggaaacaggtagggtag

SEQ ID NO: 435264 - DNA, 20 bp, mouse
gagtgaatagtggcagttgg

SEQ ID NO: 435265 - DNA, 20 bp, mouse
gctttccagatgacttaaaa

SEQ ID NO: 435266 - DNA, 20 bp, mouse
gggctgtgcgcagtagggta

SEQ ID NO: 435267 - DNA, 20 bp, mouse
gccagaggctgtgcgcagta

SEQ ID NO: 435268 - DNA, 20 bp, mouse
ggtagggtagggactgtgtc

SEQ ID NO: 435269 - DNA, 20 bp, mouse
gtgtctgaccaggcagaccc

SEQ ID NO: 435270 - DNA, 20 bp, mouse
gaggtgaacactgtctgacc

SEQ ID NO: 435271 - DNA, 20 bp, mouse
gactgtgtctggtgagtgtt

SEQ ID NO: 435272 - DNA, 20 bp, mouse
gctcttaccgagcaggagga

SEQ ID NO: 435273 - DNA, 20 bp, mouse
gcctgcgaaaggagtcctcc

SEQ ID NO: 435274 - DNA, 20 bp, mouse
gcgcacagcctctggttcct

SEQ ID NO: 435275 - DNA, 20 bp, mouse
gggtactgctaccgactggg

SEQ ID NO: 435276 - DNA, 20 bp, mouse
gcagcgccagaccaggagtg

SEQ ID NO: 435277 - DNA, 20 bp, mouse
ggtctggcgctgctgggtct

SEQ ID NO: 435278 - DNA, 20 bp, mouse
ggaaaccagagaaacgaacc

SEQ ID NO: 435279 - DNA, 20 bp, mouse
gagcgcccgcactcctggtc

SEQ ID NO: 435280 - DNA, 20 bp, mouse
gctgcgagtccagacaccgg

SEQ ID NO: 435281 - DNA, 20 bp, mouse
gtccagacaccggaggaccg

SEQ ID NO: 435282 - DNA, 20 bp, mouse
gagtgcgggcgctgaatgac

SEQ ID NO: 435283 - DNA, 20 bp, mouse
gcagggagccacgggaccgg

SEQ ID NO: 435284 - DNA, 20 bp, mouse
ggcagcgggacacaccagcc

SEQ ID NO: 435285 - DNA, 20 bp, mouse
ggaggagcgctgccagggtg

SEQ ID NO: 435286 - DNA, 20 bp, mouse
ggtgtgagcggtgagggagt

SEQ ID NO: 435287 - DNA, 20 bp, mouse
gttgtactcccgggtgtgag

SEQ ID NO: 435288 - DNA, 20 bp, mouse
gtcccgggtgtgagcggtga

SEQ ID NO: 435289 - DNA, 20 bp, mouse
gtgtcctgagactatggatt

SEQ ID NO: 435290 - DNA, 20 bp, mouse
gatggattaggacactgaca

SEQ ID NO: 435291 - DNA, 20 bp, mouse
gtgtccctgtcctgagacta

SEQ ID NO: 435292 - DNA, 20 bp, mouse
gtgtcctaatccatagtctc

SEQ ID NO: 435293 - DNA, 20 bp, mouse
gctgtaaagcccacaagaat

SEQ ID NO: 435294 - DNA, 20 bp, mouse
gcttccactgatgggtctgt

SEQ ID NO: 435295 - DNA, 20 bp, mouse
gaagatgcgacagcaatgct

SEQ ID NO: 435296 - DNA, 20 bp, mouse
gtgttccaccggcaccgggg

SEQ ID NO: 435297 - DNA, 20 bp, mouse
gagtgcgagcggagccacgt

SEQ ID NO: 435298 - DNA, 20 bp, mouse
gtggcgcgcaggtcgcatgg

SEQ ID NO: 435299 - DNA, 20 bp, mouse
gccggtgccggtggaacagg

SEQ ID NO: 435300 - DNA, 20 bp, mouse
gcaccggtgggaggagacct

SEQ ID NO: 435301 - DNA, 20 bp, mouse
ggcgagcggagccacgtggg

SEQ ID NO: 435302 - DNA, 20 bp, mouse
gtcacagcctcacctacctg

SEQ ID NO: 435303 - DNA, 20 bp, mouse
gccagcaccgcctgttccac

SEQ ID NO: 435304 - DNA, 20 bp, mouse
gcggcacactagggaagaag

SEQ ID NO: 435305 - DNA, 20 bp, mouse
ggtcgtaagagaagataccc

SEQ ID NO: 435306 - DNA, 20 bp, mouse
ggcaccctccagttaacaaa

SEQ ID NO: 435307 - DNA, 20 bp, mouse
ggaatccatggtgagaggag

SEQ ID NO: 435308 - DNA, 20 bp, mouse
gctgagaaacatagaatcca

SEQ ID NO: 435309 - DNA, 20 bp, mouse
gacatagaatccatggtgag

SEQ ID NO: 435310 - DNA, 20 bp, mouse
gggaggtcatgacttgatag

SEQ ID NO: 435311 - DNA, 20 bp, mouse
gaggggctgaacggcaagct

SEQ ID NO: 435312 - DNA, 20 bp, mouse
ggattccctttgttaactgg

SEQ ID NO: 435313 - DNA, 20 bp, mouse
ggtgtcaatgcaagaagttt

SEQ ID NO: 435314 - DNA, 20 bp, mouse
gtctaacatagtaaatcaaa

SEQ ID NO: 435315 - DNA, 20 bp, mouse
gctaggtttaagtatgatgg

SEQ ID NO: 435316 - DNA, 20 bp, mouse
gcggccgctgcgtgccccta

SEQ ID NO: 435317 - DNA, 20 bp, mouse
gccgccagcatcttccctag

SEQ ID NO: 435318 - DNA, 20 bp, mouse
gttagctaagagatgcgcca

SEQ ID NO: 435319 - DNA, 20 bp, mouse
gcttccctaggggcacgcag

SEQ ID NO: 435320 - DNA, 20 bp, mouse
gcacggcttcggcttcagca

SEQ ID NO: 435321 - DNA, 20 bp, mouse
gccgcggagcaggggccaat

SEQ ID NO: 435322 - DNA, 20 bp, mouse
gacgaggcgttcccttaaca

SEQ ID NO: 435323 - DNA, 20 bp, mouse
gtcggtgaggtgtgctatcc

SEQ ID NO: 435324 - DNA, 20 bp, mouse
gcatggttaccgcggagcag

SEQ ID NO: 435325 - DNA, 20 bp, mouse
gaacacaacaggttcagacg

SEQ ID NO: 435326 - DNA, 20 bp, mouse
ggggcactgagcaagatggt

SEQ ID NO: 435327 - DNA, 20 bp, mouse
gatgctggcctggctggagt

SEQ ID NO: 435328 - DNA, 20 bp, mouse
gtggagtcggcagtgcaagt

SEQ ID NO: 435329 - DNA, 20 bp, mouse
gtcggcagtgcaagtcggac

SEQ ID NO: 435330 - DNA, 20 bp, mouse
gtcttactggccagtttctt

SEQ ID NO: 435331 - DNA, 20 bp, mouse
gaggagggcactgagcaaga

SEQ ID NO: 435332 - DNA, 20 bp, mouse
gctcaggttacctcgccagg

SEQ ID NO: 435333 - DNA, 20 bp, mouse
ggtgctggtctgccctctaa

SEQ ID NO: 435334 - DNA, 20 bp, mouse
ggcatccagcgaactttagc

SEQ ID NO: 435335 - DNA, 20 bp, mouse
gtattgtcagtacttggata

SEQ ID NO: 435336 - DNA, 20 bp, mouse
gtccacaaagggagccaaaa

SEQ ID NO: 435337 - DNA, 20 bp, mouse
gtgagagagagaatctctgg

SEQ ID NO: 435338 - DNA, 20 bp, mouse
gaccttgcatctttccacaa

SEQ ID NO: 435339 - DNA, 20 bp, mouse
ggaagcaatgcagccttcgg

SEQ ID NO: 435340 - DNA, 20 bp, mouse
ggtagcttcaaaaggacaca

SEQ ID NO: 435341 - DNA, 20 bp, mouse
gtaccggttagcgtgagaga

SEQ ID NO: 435342 - DNA, 20 bp, mouse
gcagggctccatacctccga

SEQ ID NO: 435343 - DNA, 20 bp, mouse
ggaggtgtcatcccatatcc

SEQ ID NO: 435344 - DNA, 20 bp, mouse
gagatgcaaggtgctttaat

SEQ ID NO: 435345 - DNA, 20 bp, mouse
gtcaggattaactcttaccc

SEQ ID NO: 435346 - DNA, 20 bp, mouse
gccaacagaacacccgagca

SEQ ID NO: 435347 - DNA, 20 bp, mouse
gcaagtcagagccagaaact

SEQ ID NO: 435348 - DNA, 20 bp, mouse
ggagcatggcaggattttgt

SEQ ID NO: 435349 - DNA, 20 bp, mouse
gggctgtgaccaggatgcgg

SEQ ID NO: 435350 - DNA, 20 bp, mouse
gcagaacacccgagcatggc

SEQ ID NO: 435351 - DNA, 20 bp, mouse
gagccagaaactggggcaag

SEQ ID NO: 435352 - DNA, 20 bp, mouse
gagcagtgtattccagagtg

SEQ ID NO: 435353 - DNA, 20 bp, mouse
gagtgagcatcagtcccgga

SEQ ID NO: 435354 - DNA, 20 bp, mouse
gcgtgtaacggaagctcatg

SEQ ID NO: 435355 - DNA, 20 bp, mouse
gacacggttgtactgatagt

SEQ ID NO: 435356 - DNA, 20 bp, mouse
gctcttaagtgactacacta

SEQ ID NO: 435357 - DNA, 20 bp, mouse
gctctgaaagagctgttcct

SEQ ID NO: 435358 - DNA, 20 bp, mouse
gcagagggcttaccttgata

SEQ ID NO: 435359 - DNA, 20 bp, mouse
gtcaggagatgccaaagagt

SEQ ID NO: 435360 - DNA, 20 bp, mouse
gcagcctgggagatctgcag

SEQ ID NO: 435361 - DNA, 20 bp, mouse
gcctctgaggtcacaatcag

SEQ ID NO: 435362 - DNA, 20 bp, mouse
gactacactagggttgatcc

SEQ ID NO: 435363 - DNA, 20 bp, mouse
gggcactcaggatcatggcc

SEQ ID NO: 435364 - DNA, 20 bp, mouse
gcatggtcacatcccactca

SEQ ID NO: 435365 - DNA, 20 bp, mouse
gagaggtgattagatggtaa

SEQ ID NO: 435366 - DNA, 20 bp, mouse
ggaagacaaagggagtgagg

SEQ ID NO: 435367 - DNA, 20 bp, mouse
gggtaagctgcttgcattaa

SEQ ID NO: 435368 - DNA, 20 bp, mouse
gtaagggctaaaattagggt

SEQ ID NO: 435369 - DNA, 20 bp, mouse
gctgggagcagcccccccaa

SEQ ID NO: 435370 - DNA, 20 bp, mouse
ggcattaagggctaaaatta

SEQ ID NO: 435371 - DNA, 20 bp, mouse
gcttctggaggctctagtca

SEQ ID NO: 435372 - DNA, 20 bp, mouse
gtcactccctttgtcttctg

SEQ ID NO: 435373 - DNA, 20 bp, mouse
gtgactggacccctttgggg

SEQ ID NO: 435374 - DNA, 20 bp, mouse
gccgtggagctagcagataa

SEQ ID NO: 435375 - DNA, 20 bp, mouse
gctgactgtccttcttctgg

SEQ ID NO: 435376 - DNA, 20 bp, mouse
gcctcagctaggagcatctg

SEQ ID NO: 435377 - DNA, 20 bp, mouse
gagcagagcatcacaccacg

SEQ ID NO: 435378 - DNA, 20 bp, mouse
gtgcatgctgcagcatctgt

SEQ ID NO: 435379 - DNA, 20 bp, mouse
ggctgaggaagagtgccgcg

SEQ ID NO: 435380 - DNA, 20 bp, mouse
gaaaaaaaagcaagcgtctg

SEQ ID NO: 435381 - DNA, 20 bp, mouse
ggatgggtctcactctctgg

SEQ ID NO: 435382 - DNA, 20 bp, mouse
gtctctgggggtgtcctcca

SEQ ID NO: 435383 - DNA, 20 bp, mouse
gccccaacttgggcaaactc

SEQ ID NO: 435384 - DNA, 20 bp, mouse
gcactcccgcaacagacccc

SEQ ID NO: 435385 - DNA, 20 bp, mouse
ggtgcatagctgtgggtcac

SEQ ID NO: 435386 - DNA, 20 bp, mouse
gagctagctctggtgttcag

SEQ ID NO: 435387 - DNA, 20 bp, mouse
gtagttaggtgtaggttcag

SEQ ID NO: 435388 - DNA, 20 bp, mouse
gtagtgggaagagctaggct

SEQ ID NO: 435389 - DNA, 20 bp, mouse
ggcttggccacagctagctc

SEQ ID NO: 435390 - DNA, 20 bp, mouse
gggtggtaggactgatagtt

SEQ ID NO: 435391 - DNA, 20 bp, mouse
gaggactgatagttaggtgt

SEQ ID NO: 435392 - DNA, 20 bp, mouse
gtctcttggtgcctccacaa

SEQ ID NO: 435393 - DNA, 20 bp, mouse
ggcaggtaaggcgacaggaa

SEQ ID NO: 435394 - DNA, 20 bp, mouse
ggtggaggcaccaagagaca

SEQ ID NO: 435395 - DNA, 20 bp, mouse
ggccagatgcctgccggcgg

SEQ ID NO: 435396 - DNA, 20 bp, mouse
gatggctgcaggggaagtag

SEQ ID NO: 435397 - DNA, 20 bp, mouse
ggtagaggacagcaggtact

SEQ ID NO: 435398 - DNA, 20 bp, mouse
gtccttggaaatgaggtgac

SEQ ID NO: 435399 - DNA, 20 bp, mouse
gcccagcactgtctagaaaa

SEQ ID NO: 435400 - DNA, 20 bp, mouse
gtgtctgaggcagactgcta

SEQ ID NO: 435401 - DNA, 20 bp, mouse
gggagttctcctcctctgga

SEQ ID NO: 435402 - DNA, 20 bp, mouse
gaggctgctttagggatcta

SEQ ID NO: 435403 - DNA, 20 bp, mouse
gggcttcaccagcgaaggaa

SEQ ID NO: 435404 - DNA, 20 bp, mouse
gctcgaggagcctacctgaa

SEQ ID NO: 435405 - DNA, 20 bp, mouse
ggcctacctgaaaggagccc

SEQ ID NO: 435406 - DNA, 20 bp, mouse
ggataaccgagagatgtgga

SEQ ID NO: 435407 - DNA, 20 bp, mouse
ggagggatgagtaggaaagt

SEQ ID NO: 435408 - DNA, 20 bp, mouse
gtaggaaagtcggataatga

SEQ ID NO: 435409 - DNA, 20 bp, mouse
gtcctactcatccctcccct

SEQ ID NO: 435410 - DNA, 20 bp, mouse
gcctatcaagagctgtacca

SEQ ID NO: 435411 - DNA, 20 bp, mouse
gaacagagctgggacccagt

SEQ ID NO: 435412 - DNA, 20 bp, mouse
gtcaagagctgtaccaaggt

SEQ ID NO: 435413 - DNA, 20 bp, mouse
ggatccatatgtatataccg

SEQ ID NO: 435414 - DNA, 20 bp, mouse
gaggtcccaaccttaatcct

SEQ ID NO: 435415 - DNA, 20 bp, mouse
ggagtaacactagtaaccaa

SEQ ID NO: 435416 - DNA, 20 bp, mouse
gagggaggcgctaggaccca

SEQ ID NO: 435417 - DNA, 20 bp, mouse
gtcaaacctgctcaaaatag

SEQ ID NO: 435418 - DNA, 20 bp, mouse
ggaacagaaccacttcgcag

SEQ ID NO: 435419 - DNA, 20 bp, mouse
gaagtctgtggccaaagtcc

SEQ ID NO: 435420 - DNA, 20 bp, mouse
gtcaaaatagtggactgcaa

SEQ ID NO: 435421 - DNA, 20 bp, mouse
gttgatggaacgtggtactt

SEQ ID NO: 435422 - DNA, 20 bp, mouse
gtgcctcatgctcttctacc

SEQ ID NO: 435423 - DNA, 20 bp, mouse
ggcagtccactattttgagc

SEQ ID NO: 435424 - DNA, 20 bp, mouse
ggaccaggtagaagagcatg

SEQ ID NO: 435425 - DNA, 20 bp, mouse
gtcatcaatatccaaggcca

SEQ ID NO: 435426 - DNA, 20 bp, mouse
gcgagtgcggcgaccggtgg

SEQ ID NO: 435427 - DNA, 20 bp, mouse
gctgcgtccgacgggttctc

SEQ ID NO: 435428 - DNA, 20 bp, mouse
gaccggtcgccgcactcggg

SEQ ID NO: 435429 - DNA, 20 bp, mouse
gcagacccaccgcccgagtg

SEQ ID NO: 435430 - DNA, 20 bp, mouse
gatcccgcccgagaacccgt

SEQ ID NO: 435431 - DNA, 20 bp, mouse
gtcgggcggtgggtctgacc

SEQ ID NO: 435432 - DNA, 20 bp, mouse
ggactgcgaggctcccggga

SEQ ID NO: 435433 - DNA, 20 bp, mouse
gcgtccgacgggttctcggg

SEQ ID NO: 435434 - DNA, 20 bp, mouse
ggacgtcagcccgccgccac

SEQ ID NO: 435435 - DNA, 20 bp, mouse
ggcttcgcaggccccgggga

SEQ ID NO: 435436 - DNA, 20 bp, mouse
gaaaggctgagatgctggtg

SEQ ID NO: 435437 - DNA, 20 bp, mouse
ggagttgcgcatgcgcggag

SEQ ID NO: 435438 - DNA, 20 bp, mouse
ggagggagaaggggcatacg

SEQ ID NO: 435439 - DNA, 20 bp, mouse
gcgcatgcgcaactcctctc

SEQ ID NO: 435440 - DNA, 20 bp, mouse
gccaggaccccggattctag

SEQ ID NO: 435441 - DNA, 20 bp, mouse
gtctggtcacccatgaacga

SEQ ID NO: 435442 - DNA, 20 bp, mouse
gcacccatgaacgaaggaag

SEQ ID NO: 435443 - DNA, 20 bp, mouse
gccggggtcctggggagttg

SEQ ID NO: 435444 - DNA, 20 bp, mouse
ggggtgcactgatttgagaa

SEQ ID NO: 435445 - DNA, 20 bp, mouse
gactctattccgagagagga

SEQ ID NO: 435446 - DNA, 20 bp, mouse
ggacgcgcgccgcagactta

SEQ ID NO: 435447 - DNA, 20 bp, mouse
ggaagcccgccttaagtctg

SEQ ID NO: 435448 - DNA, 20 bp, mouse
ggcgcgccgcagacttaagg

SEQ ID NO: 435449 - DNA, 20 bp, mouse
gcagctcagtgaccaggata

SEQ ID NO: 435450 - DNA, 20 bp, mouse
gccccgaatgctcccagcta

SEQ ID NO: 435451 - DNA, 20 bp, mouse
gcagcgctggaggcgcgggt

SEQ ID NO: 435452 - DNA, 20 bp, mouse
gacctggagctgaggttgag

SEQ ID NO: 435453 - DNA, 20 bp, mouse
gctgtccgcttgtcaggctg

SEQ ID NO: 435454 - DNA, 20 bp, mouse
gggcgtggccacgctgggta

SEQ ID NO: 435455 - DNA, 20 bp, mouse
ggctgatgggaaaaggtcag

SEQ ID NO: 435456 - DNA, 20 bp, mouse
gtcaggtgggactgagactg

SEQ ID NO: 435457 - DNA, 20 bp, mouse
gtgagctccaactgtcaggt

SEQ ID NO: 435458 - DNA, 20 bp, mouse
gtgagactggggcaaggctg

SEQ ID NO: 435459 - DNA, 20 bp, mouse
ggcaaggctgaggtctagac

SEQ ID NO: 435460 - DNA, 20 bp, mouse
gctcagtcccacctgacagt

SEQ ID NO: 435461 - DNA, 20 bp, mouse
gtaggtgaccaggttaggag

SEQ ID NO: 435462 - DNA, 20 bp, mouse
ggccgcagttcgaacaccaa

SEQ ID NO: 435463 - DNA, 20 bp, mouse
ggaccctaacaagctctagg

SEQ ID NO: 435464 - DNA, 20 bp, mouse
gtcctgtaggtgaccaggtt

SEQ ID NO: 435465 - DNA, 20 bp, mouse
ggctgggggtcagttggtca

SEQ ID NO: 435466 - DNA, 20 bp, mouse
gctgtacctagtaatcacaa

SEQ ID NO: 435467 - DNA, 20 bp, mouse
ggaaaacccttgtgattact

SEQ ID NO: 435468 - DNA, 20 bp, mouse
gccttcagcactgatccagg

SEQ ID NO: 435469 - DNA, 20 bp, mouse
gaaggcaatgaagaccctcc

SEQ ID NO: 435470 - DNA, 20 bp, mouse
gttgccttcagcactgatcc

SEQ ID NO: 435471 - DNA, 20 bp, mouse
gactatgtgatgctaagact

SEQ ID NO: 435472 - DNA, 20 bp, mouse
gatgaaaactaacttggata

SEQ ID NO: 435473 - DNA, 20 bp, mouse
ggacacttgtatgtatatga

SEQ ID NO: 435474 - DNA, 20 bp, mouse
gccaagttagttttcatcat

SEQ ID NO: 435475 - DNA, 20 bp, mouse
gtttggaaactttccttgtg

SEQ ID NO: 435476 - DNA, 20 bp, mouse
gtagaaagagaagatctgac

SEQ ID NO: 435477 - DNA, 20 bp, mouse
ggagtagctgatctaatcct

SEQ ID NO: 435478 - DNA, 20 bp, mouse
gtccaggcctgttaacagac

SEQ ID NO: 435479 - DNA, 20 bp, mouse
gcagactggtaaaacaacct

SEQ ID NO: 435480 - DNA, 20 bp, mouse
gaccagtctgttaacaggcc

SEQ ID NO: 435481 - DNA, 20 bp, mouse
gcaaaagagaacggaaaatt

SEQ ID NO: 435482 - DNA, 20 bp, mouse
gcagagagaggaaagacgac

SEQ ID NO: 435483 - DNA, 20 bp, mouse
ggttttaccagtctgttaac

SEQ ID NO: 435484 - DNA, 20 bp, mouse
gcagccccctaagtccagaa

SEQ ID NO: 435485 - DNA, 20 bp, mouse
gaatttggcacgttctacga

SEQ ID NO: 435486 - DNA, 20 bp, mouse
gctgctcagggactgtacgg

SEQ ID NO: 435487 - DNA, 20 bp, mouse
ggagctggacacgccgcctg

SEQ ID NO: 435488 - DNA, 20 bp, mouse
gcatggtgtagtcctgccac

SEQ ID NO: 435489 - DNA, 20 bp, mouse
ggggattctaacaagcccga

SEQ ID NO: 435490 - DNA, 20 bp, mouse
ggcgctgctcagggactgta

SEQ ID NO: 435491 - DNA, 20 bp, mouse
gccgcactccttcagttagg

SEQ ID NO: 435492 - DNA, 20 bp, mouse
gtggacacgccgcctgtggc

SEQ ID NO: 435493 - DNA, 20 bp, mouse
gcctgtgggacgcttcatcg

SEQ ID NO: 435494 - DNA, 20 bp, mouse
gccatggtggacagttccag

SEQ ID NO: 435495 - DNA, 20 bp, mouse
gcagcggcggtatttcacta

SEQ ID NO: 435496 - DNA, 20 bp, mouse
ggggagatcctcatagacaa

SEQ ID NO: 435497 - DNA, 20 bp, mouse
gaggatctccctgatactca

SEQ ID NO: 435498 - DNA, 20 bp, mouse
gtatgagaccctgagtatca

SEQ ID NO: 435499 - DNA, 20 bp, mouse
gactctgctcttgagagagt

SEQ ID NO: 435500 - DNA, 20 bp, mouse
ggagctatggcagaaaccta

SEQ ID NO: 435501 - DNA, 20 bp, mouse
gattcgagaggaaactaggt

SEQ ID NO: 435502 - DNA, 20 bp, mouse
gctcaagagcagagtcttga

SEQ ID NO: 435503 - DNA, 20 bp, mouse
ggcttctcagaggaatcagt

SEQ ID NO: 435504 - DNA, 20 bp, mouse
gaagccacatatttcctggg

SEQ ID NO: 435505 - DNA, 20 bp, mouse
ggtagattcgagaggaaact

SEQ ID NO: 435506 - DNA, 20 bp, mouse
gctctggctgggctccgcac

SEQ ID NO: 435507 - DNA, 20 bp, mouse
ggctccgcacaggaagcggg

SEQ ID NO: 435508 - DNA, 20 bp, mouse
ggatccggaagaggagtggt

SEQ ID NO: 435509 - DNA, 20 bp, mouse
gtggccgctagaaagctcaa

SEQ ID NO: 435510 - DNA, 20 bp, mouse
gaggtgatccggaagaggag

SEQ ID NO: 435511 - DNA, 20 bp, mouse
gcggccaggcacttgcagag

SEQ ID NO: 435512 - DNA, 20 bp, mouse
ggcacaggaagcgggcggcc

SEQ ID NO: 435513 - DNA, 20 bp, mouse
ggccccgctctgcaagtgcc

SEQ ID NO: 435514 - DNA, 20 bp, mouse
ggtgggtagtctccacggag

SEQ ID NO: 435515 - DNA, 20 bp, mouse
gtcggggtgggtagtctcca

SEQ ID NO: 435516 - DNA, 20 bp, mouse
ggcccagctatgtacatccc

SEQ ID NO: 435517 - DNA, 20 bp, mouse
ggagctatgggggctcacct

SEQ ID NO: 435518 - DNA, 20 bp, mouse
gtgtcttgatagagctatgg

SEQ ID NO: 435519 - DNA, 20 bp, mouse
gcctgtgcccacgggaccag

SEQ ID NO: 435520 - DNA, 20 bp, mouse
ggaacagtcgggtgacctcc

SEQ ID NO: 435521 - DNA, 20 bp, mouse
ggcatgtcttgatagagcta

SEQ ID NO: 435522 - DNA, 20 bp, mouse
gatgcagagatggcttggta

SEQ ID NO: 435523 - DNA, 20 bp, mouse
gctactccttgggcacatgg

SEQ ID NO: 435524 - DNA, 20 bp, mouse
gcattcttgagggagctgaa

SEQ ID NO: 435525 - DNA, 20 bp, mouse
ggctacaaagaatctctcta

SEQ ID NO: 435526 - DNA, 20 bp, mouse
gccccgcggtgcagctaggg

SEQ ID NO: 435527 - DNA, 20 bp, mouse
gtcccgcggaggtgaagcct

SEQ ID NO: 435528 - DNA, 20 bp, mouse
gtcaggctctgcctagtggg

SEQ ID NO: 435529 - DNA, 20 bp, mouse
gccgccccgcggtgcagcta

SEQ ID NO: 435530 - DNA, 20 bp, mouse
gcggagacacgcagcgtccc

SEQ ID NO: 435531 - DNA, 20 bp, mouse
ggcttggtgcctagaaccta

SEQ ID NO: 435532 - DNA, 20 bp, mouse
gcctagggaagggcagagcg

SEQ ID NO: 435533 - DNA, 20 bp, mouse
gcagagcgcggtacgaccct

SEQ ID NO: 435534 - DNA, 20 bp, mouse
ggctgcgtgtctccgccccg

SEQ ID NO: 435535 - DNA, 20 bp, mouse
ggccagggtggcgggaactg

SEQ ID NO: 435536 - DNA, 20 bp, mouse
gaacaactcaagggaaggtg

SEQ ID NO: 435537 - DNA, 20 bp, mouse
gactcttgccgagcagctga

SEQ ID NO: 435538 - DNA, 20 bp, mouse
gttttcaacaactcaaggga

SEQ ID NO: 435539 - DNA, 20 bp, mouse
gtcagttttcaacaactcaa

SEQ ID NO: 435540 - DNA, 20 bp, mouse
ggatgatgtgggattctata

SEQ ID NO: 435541 - DNA, 20 bp, mouse
gagagactaacaagaagttg

SEQ ID NO: 435542 - DNA, 20 bp, mouse
gacttgaggtctgtatctgt

SEQ ID NO: 435543 - DNA, 20 bp, mouse
ggacatgtggctttgcactt

SEQ ID NO: 435544 - DNA, 20 bp, mouse
gtgatgagtctctagacgtg

SEQ ID NO: 435545 - DNA, 20 bp, mouse
gtgggattctataggggcat

SEQ ID NO: 435546 - DNA, 20 bp, mouse
gcgccagcggagcttcttcg

SEQ ID NO: 435547 - DNA, 20 bp, mouse
gaccgcagccttagcgccag

SEQ ID NO: 435548 - DNA, 20 bp, mouse
gagaagctccgctggcgcta

SEQ ID NO: 435549 - DNA, 20 bp, mouse
gtccgctggcgctaaggctg

SEQ ID NO: 435550 - DNA, 20 bp, mouse
gactctgcacagccagaaag

SEQ ID NO: 435551 - DNA, 20 bp, mouse
gagcgaggagagtaggcgca

SEQ ID NO: 435552 - DNA, 20 bp, mouse
gttccgcgaagaagctccgc

SEQ ID NO: 435553 - DNA, 20 bp, mouse
gttggagggcccaaactgtg

SEQ ID NO: 435554 - DNA, 20 bp, mouse
gtcttcttcggcccaccctg

SEQ ID NO: 435555 - DNA, 20 bp, mouse
gaggcctgggaaggcaacac

SEQ ID NO: 435556 - DNA, 20 bp, mouse
ggctggagcccgggaaggaa

SEQ ID NO: 435557 - DNA, 20 bp, mouse
gtgtggctctgcaccccaaa

SEQ ID NO: 435558 - DNA, 20 bp, mouse
ggcgcccctttgaaccactt

SEQ ID NO: 435559 - DNA, 20 bp, mouse
gagcagttgggccccacctg

SEQ ID NO: 435560 - DNA, 20 bp, mouse
gcaatgagacctcgcaccca

SEQ ID NO: 435561 - DNA, 20 bp, mouse
gcctagcacccaggatccaa

SEQ ID NO: 435562 - DNA, 20 bp, mouse
gatccccaagtggttcaaag

SEQ ID NO: 435563 - DNA, 20 bp, mouse
gggaggaaggctaacccaga

SEQ ID NO: 435564 - DNA, 20 bp, mouse
ggacatgatgttgcgcgggg

SEQ ID NO: 435565 - DNA, 20 bp, mouse
gttgaaccacttggggatgg

SEQ ID NO: 435566 - DNA, 20 bp, mouse
gggattcgttcgtctctcgg

SEQ ID NO: 435567 - DNA, 20 bp, mouse
ggggacggcgttccaagctg

SEQ ID NO: 435568 - DNA, 20 bp, mouse
gagaatgtcgcaggacgatg

SEQ ID NO: 435569 - DNA, 20 bp, mouse
gatgtcgcaggacgatgcgg

SEQ ID NO: 435570 - DNA, 20 bp, mouse
gcaccgaaggcagctcccga

SEQ ID NO: 435571 - DNA, 20 bp, mouse
gctctcaaagcctgctggga

SEQ ID NO: 435572 - DNA, 20 bp, mouse
gtcccaggctgcccgcgtca

SEQ ID NO: 435573 - DNA, 20 bp, mouse
gttcgttcgtctctcggggg

SEQ ID NO: 435574 - DNA, 20 bp, mouse
gcaggctgcccgcgtcaggg

SEQ ID NO: 435575 - DNA, 20 bp, mouse
gtcgcaggacgatgcggagg

SEQ ID NO: 435576 - DNA, 20 bp, mouse
gagctagaagagcaacttcc

SEQ ID NO: 435577 - DNA, 20 bp, mouse
gcgggcgtgggaatgaagga

SEQ ID NO: 435578 - DNA, 20 bp, mouse
gctggaaagtaggaagtcta

SEQ ID NO: 435579 - DNA, 20 bp, mouse
ggcggaccaacagacactca

SEQ ID NO: 435580 - DNA, 20 bp, mouse
gcttccgggcgtgggaatga

SEQ ID NO: 435581 - DNA, 20 bp, mouse
gggtgacgccccaaacgtag

SEQ ID NO: 435582 - DNA, 20 bp, mouse
gaagagcaacttccgggcgt

SEQ ID NO: 435583 - DNA, 20 bp, mouse
ggagcgatcaagtcccacct

SEQ ID NO: 435584 - DNA, 20 bp, mouse
gcgcctgaaactgaggtctg

SEQ ID NO: 435585 - DNA, 20 bp, mouse
gtctggctgtgctagaggtg

SEQ ID NO: 435586 - DNA, 20 bp, mouse
gagtcccgagggacgttgag

SEQ ID NO: 435587 - DNA, 20 bp, mouse
gccgcggcaccatgagccag

SEQ ID NO: 435588 - DNA, 20 bp, mouse
ggtacacagagcagtcccga

SEQ ID NO: 435589 - DNA, 20 bp, mouse
gatggtgccgcggcgcgtgt

SEQ ID NO: 435590 - DNA, 20 bp, mouse
gccgtcggggcgccttccca

SEQ ID NO: 435591 - DNA, 20 bp, mouse
gcctaggagccaacccgtcg

SEQ ID NO: 435592 - DNA, 20 bp, mouse
ggcggacccgacacgcgccg

SEQ ID NO: 435593 - DNA, 20 bp, mouse
ggaggaccggggaccaaggg

SEQ ID NO: 435594 - DNA, 20 bp, mouse
gtctgtgtacccacactcct

SEQ ID NO: 435595 - DNA, 20 bp, mouse
gacccggtttgtgcagatgg

SEQ ID NO: 435596 - DNA, 20 bp, mouse
gagaggaaacctgaaggaac

SEQ ID NO: 435597 - DNA, 20 bp, mouse
gtgatgctacagaaatatat

SEQ ID NO: 435598 - DNA, 20 bp, mouse
gagagagagagacaggctct

SEQ ID NO: 435599 - DNA, 20 bp, mouse
gcagaaatatatcggtgatg

SEQ ID NO: 435600 - DNA, 20 bp, mouse
gccagttgagcactgcagat

SEQ ID NO: 435601 - DNA, 20 bp, mouse
ggctgcaccaggcagttatc

SEQ ID NO: 435602 - DNA, 20 bp, mouse
gtccaagtcccagctgcacc

SEQ ID NO: 435603 - DNA, 20 bp, mouse
ggtgctcaactggtatgtac

SEQ ID NO: 435604 - DNA, 20 bp, mouse
gctgcagcctgataactgcc

SEQ ID NO: 435605 - DNA, 20 bp, mouse
gcagtgaagaggaaacctga

SEQ ID NO: 435606 - DNA, 20 bp, mouse
gtgcgcaactcgcggacctg

SEQ ID NO: 435607 - DNA, 20 bp, mouse
gccgcgagtgggaagagcga

SEQ ID NO: 435608 - DNA, 20 bp, mouse
gagttgcgcaacaggctcgg

SEQ ID NO: 435609 - DNA, 20 bp, mouse
ggcccccccaaaaaaaccaa

SEQ ID NO: 435610 - DNA, 20 bp, mouse
gaagagcgagggcagacccg

SEQ ID NO: 435611 - DNA, 20 bp, mouse
ggagcctgttgcgcaactcg

SEQ ID NO: 435612 - DNA, 20 bp, mouse
gtcgcgtggctgtggagtgt

SEQ ID NO: 435613 - DNA, 20 bp, mouse
ggttgggtcagaagtctata

SEQ ID NO: 435614 - DNA, 20 bp, mouse
gatcgccagcgccacgaggg

SEQ ID NO: 435615 - DNA, 20 bp, mouse
gcggctggagcgcacttgga

SEQ ID NO: 435616 - DNA, 20 bp, mouse
ggtgttctgaggatcgagtg

SEQ ID NO: 435617 - DNA, 20 bp, mouse
gttctgaggatcgagtgagg

SEQ ID NO: 435618 - DNA, 20 bp, mouse
gagcctgcccgagcctcctg

SEQ ID NO: 435619 - DNA, 20 bp, mouse
gaggagtgggctctcatgga

SEQ ID NO: 435620 - DNA, 20 bp, mouse
gggcggagaaccacagagag

SEQ ID NO: 435621 - DNA, 20 bp, mouse
gatcgaggacatgtgttctg

SEQ ID NO: 435622 - DNA, 20 bp, mouse
gaacaaagcggtgtcgatcg

SEQ ID NO: 435623 - DNA, 20 bp, mouse
gcttctgagtaagcctcagg

SEQ ID NO: 435624 - DNA, 20 bp, mouse
gctcacagccaaagcaaggg

SEQ ID NO: 435625 - DNA, 20 bp, mouse
gcttctcacagccaaagcaa

SEQ ID NO: 435626 - DNA, 20 bp, mouse
gctgggccggagagcagtag

SEQ ID NO: 435627 - DNA, 20 bp, mouse
ggggagcagcgaaaaggcaa

SEQ ID NO: 435628 - DNA, 20 bp, mouse
ggtagcggggagcagcgaaa

SEQ ID NO: 435629 - DNA, 20 bp, mouse
ggcaccagccgctccacaca

SEQ ID NO: 435630 - DNA, 20 bp, mouse
ggctccccgctactgctctc

SEQ ID NO: 435631 - DNA, 20 bp, mouse
ggctccacacagggtcgctt

SEQ ID NO: 435632 - DNA, 20 bp, mouse
gggccgtggccaagctccct

SEQ ID NO: 435633 - DNA, 20 bp, mouse
gacacagggtcgcttggggt

SEQ ID NO: 435634 - DNA, 20 bp, mouse
gcaggtgcctgtggaacctg

SEQ ID NO: 435635 - DNA, 20 bp, mouse
gtgcctgtggaacctgagga

SEQ ID NO: 435636 - DNA, 20 bp, mouse
gacggggaggcagaagacta

SEQ ID NO: 435637 - DNA, 20 bp, mouse
gaccgggaatcagaagtccc

SEQ ID NO: 435638 - DNA, 20 bp, mouse
gagaagtcccgggcacctaa

SEQ ID NO: 435639 - DNA, 20 bp, mouse
gcccggtcctgtgacgtgag

SEQ ID NO: 435640 - DNA, 20 bp, mouse
gttttacgtgtgggacgggg

SEQ ID NO: 435641 - DNA, 20 bp, mouse
gccggggccgctcacgtcac

SEQ ID NO: 435642 - DNA, 20 bp, mouse
gaaaggccgaggcttccgtt

SEQ ID NO: 435643 - DNA, 20 bp, mouse
gaggcatctccgaggtccaa

SEQ ID NO: 435644 - DNA, 20 bp, mouse
gtcccacacgtaaaatcccg

SEQ ID NO: 435645 - DNA, 20 bp, mouse
gacttcaggcccagggatgt

SEQ ID NO: 435646 - DNA, 20 bp, mouse
gctcctcgctcaaggaagca

SEQ ID NO: 435647 - DNA, 20 bp, mouse
gatggggaccaggtgagacc

SEQ ID NO: 435648 - DNA, 20 bp, mouse
gctggtccccatgaataaca

SEQ ID NO: 435649 - DNA, 20 bp, mouse
gacctgcctggagagatctt

SEQ ID NO: 435650 - DNA, 20 bp, mouse
gcccgcgccttgttattcat

SEQ ID NO: 435651 - DNA, 20 bp, mouse
gtgtttgcccggactgagga

SEQ ID NO: 435652 - DNA, 20 bp, mouse
gctggagttgggaaccggat

SEQ ID NO: 435653 - DNA, 20 bp, mouse
gcagtccgggccccgaatct

SEQ ID NO: 435654 - DNA, 20 bp, mouse
gtgggaaccggattggaaca

SEQ ID NO: 435655 - DNA, 20 bp, mouse
gccggacccggatggaagtt

SEQ ID NO: 435656 - DNA, 20 bp, mouse
ggtctgcaagagcagatgcc

SEQ ID NO: 435657 - DNA, 20 bp, mouse
gaccatgtggctctacatgg

SEQ ID NO: 435658 - DNA, 20 bp, mouse
gtgctcttgcagactgctgt

SEQ ID NO: 435659 - DNA, 20 bp, mouse
gcagactgctgtaggcgttg

SEQ ID NO: 435660 - DNA, 20 bp, mouse
ggctgcatgtcggaaggagg

SEQ ID NO: 435661 - DNA, 20 bp, mouse
ggtccccaaaggattcctgg

SEQ ID NO: 435662 - DNA, 20 bp, mouse
gaggcctgtgtagtccccaa

SEQ ID NO: 435663 - DNA, 20 bp, mouse
gtctacatggtggcgctact

SEQ ID NO: 435664 - DNA, 20 bp, mouse
gttggctgcatgtcggaagg

SEQ ID NO: 435665 - DNA, 20 bp, mouse
gtcatcacaggctgtggctc

SEQ ID NO: 435666 - DNA, 20 bp, mouse
gagcgatgcactctgctggg

SEQ ID NO: 435667 - DNA, 20 bp, mouse
ggaaagcgatgcactctgct

SEQ ID NO: 435668 - DNA, 20 bp, mouse
gttaaagtttgttggggact

SEQ ID NO: 435669 - DNA, 20 bp, mouse
gagactcactccatggactg

SEQ ID NO: 435670 - DNA, 20 bp, mouse
gtcaggttagactcactcca

SEQ ID NO: 435671 - DNA, 20 bp, mouse
gcagctgggtgttgttttgt

SEQ ID NO: 435672 - DNA, 20 bp, mouse
gcttgctgaatgtctcagct

SEQ ID NO: 435673 - DNA, 20 bp, mouse
gttctacagggcaggactag

SEQ ID NO: 435674 - DNA, 20 bp, mouse
gttcagcaagcctcagtcca

SEQ ID NO: 435675 - DNA, 20 bp, mouse
ggtaatctacagaaattctc

SEQ ID NO: 435676 - DNA, 20 bp, mouse
gctcgggtcccgggatgggg

SEQ ID NO: 435677 - DNA, 20 bp, mouse
gtatgctgagggcctcacct

SEQ ID NO: 435678 - DNA, 20 bp, mouse
gatcccgggacccgagggat

SEQ ID NO: 435679 - DNA, 20 bp, mouse
gcgggacccgagggatgggg

SEQ ID NO: 435680 - DNA, 20 bp, mouse
gtgcaggcaggcgaccgcag

SEQ ID NO: 435681 - DNA, 20 bp, mouse
gcgcccgtcggagccagagg

SEQ ID NO: 435682 - DNA, 20 bp, mouse
gcctcaccgcccccccatcc

SEQ ID NO: 435683 - DNA, 20 bp, mouse
gtcccagcaggagccttctc

SEQ ID NO: 435684 - DNA, 20 bp, mouse
gaccagcggggccagcaggg

SEQ ID NO: 435685 - DNA, 20 bp, mouse
gggccaggggatcggagaag

SEQ ID NO: 435686 - DNA, 20 bp, mouse
gtcccttggttaaccagaca

SEQ ID NO: 435687 - DNA, 20 bp, mouse
ggccctgtctggttaaccaa

SEQ ID NO: 435688 - DNA, 20 bp, mouse
gggggtcactgacccaggtt

SEQ ID NO: 435689 - DNA, 20 bp, mouse
gaataggtgctgacagcggg

SEQ ID NO: 435690 - DNA, 20 bp, mouse
gggcatccaccaatcaagag

SEQ ID NO: 435691 - DNA, 20 bp, mouse
gccatggcaacagcctccct

SEQ ID NO: 435692 - DNA, 20 bp, mouse
gtcctaaggtggtccaagtg

SEQ ID NO: 435693 - DNA, 20 bp, mouse
gagatgctctgaggagtggg

SEQ ID NO: 435694 - DNA, 20 bp, mouse
gccgtcttaccagcaagaat

SEQ ID NO: 435695 - DNA, 20 bp, mouse
ggcagggcagccagttgagg

SEQ ID NO: 435696 - DNA, 20 bp, mouse
gcttatctccgaaatatctg

SEQ ID NO: 435697 - DNA, 20 bp, mouse
gacctaatcacactttttac

SEQ ID NO: 435698 - DNA, 20 bp, mouse
gcccattccctcagatattt

SEQ ID NO: 435699 - DNA, 20 bp, mouse
gtcatcaagatgagtctcgg

SEQ ID NO: 435700 - DNA, 20 bp, mouse
gtgcaaagcactgagactcg

SEQ ID NO: 435701 - DNA, 20 bp, mouse
gcaggagctctaaggactga

SEQ ID NO: 435702 - DNA, 20 bp, mouse
ggctgaaggtgaattcatac

SEQ ID NO: 435703 - DNA, 20 bp, mouse
gttcccacagtcttaacgca

SEQ ID NO: 435704 - DNA, 20 bp, mouse
gtccgaaatatctgagggaa

SEQ ID NO: 435705 - DNA, 20 bp, mouse
gggccctgcgttaagactgt

SEQ ID NO: 435706 - DNA, 20 bp, mouse
ggagagctgcaagtgagtag

SEQ ID NO: 435707 - DNA, 20 bp, mouse
ggtctgaagaaggagtgcag

SEQ ID NO: 435708 - DNA, 20 bp, mouse
gtcggcccggcaagatccag

SEQ ID NO: 435709 - DNA, 20 bp, mouse
gagtgcaggggtgcgctgag

SEQ ID NO: 435710 - DNA, 20 bp, mouse
gggcggcacgggtctgaaga

SEQ ID NO: 435711 - DNA, 20 bp, mouse
ggctcctactcccgcagcta

SEQ ID NO: 435712 - DNA, 20 bp, mouse
gagggtacagaggaccggga

SEQ ID NO: 435713 - DNA, 20 bp, mouse
gagacatccccagcccgggg

SEQ ID NO: 435714 - DNA, 20 bp, mouse
gctgcaagtgagtaggggcg

SEQ ID NO: 435715 - DNA, 20 bp, mouse
gcaagatccagaggcacctg

SEQ ID NO: 435716 - DNA, 20 bp, mouse
gctcggcggggctcccgacg

SEQ ID NO: 435717 - DNA, 20 bp, mouse
gcggtctctgctcgcctcag

SEQ ID NO: 435718 - DNA, 20 bp, mouse
ggcgtcagctggagcaccca

SEQ ID NO: 435719 - DNA, 20 bp, mouse
ggtctgcgggacgacaggcc

SEQ ID NO: 435720 - DNA, 20 bp, mouse
ggtcgtcccgcagacgtgac

SEQ ID NO: 435721 - DNA, 20 bp, mouse
gcgggcaccagtcacgtctg

SEQ ID NO: 435722 - DNA, 20 bp, mouse
gcccggtgcggaccgcggag

SEQ ID NO: 435723 - DNA, 20 bp, mouse
gcgcctcagaggcttcagcc

SEQ ID NO: 435724 - DNA, 20 bp, mouse
gcccaggcgcgtgcgctcgg

SEQ ID NO: 435725 - DNA, 20 bp, mouse
gagctggagcacccacggtg

SEQ ID NO: 435726 - DNA, 20 bp, mouse
gtcatcaagactatgtacgg

SEQ ID NO: 435727 - DNA, 20 bp, mouse
gaagtcatcaagactatgta

SEQ ID NO: 435728 - DNA, 20 bp, mouse
gtaagagcttggggaatgac

SEQ ID NO: 435729 - DNA, 20 bp, mouse
gtccccaagctcttaacaca

SEQ ID NO: 435730 - DNA, 20 bp, mouse
gcaaaatttgatttatactt

SEQ ID NO: 435731 - DNA, 20 bp, mouse
ggccctgtgttaagagcttg

SEQ ID NO: 435732 - DNA, 20 bp, mouse
gcagtttctccattagctga

SEQ ID NO: 435733 - DNA, 20 bp, mouse
gatgtacggaggtgtttcag

SEQ ID NO: 435734 - DNA, 20 bp, mouse
gacttggccaattttactct

SEQ ID NO: 435735 - DNA, 20 bp, mouse
gttcagtaaagagtgtgact

SEQ ID NO: 435736 - DNA, 20 bp, mouse
gtgtatccttgacaaaaccg

SEQ ID NO: 435737 - DNA, 20 bp, mouse
gtccttgacaaaaccgggga

SEQ ID NO: 435738 - DNA, 20 bp, mouse
ggtacaattaaatttgtggt

SEQ ID NO: 435739 - DNA, 20 bp, mouse
gagatgatgctgtccttccc

SEQ ID NO: 435740 - DNA, 20 bp, mouse
gtttttccatggatcactga

SEQ ID NO: 435741 - DNA, 20 bp, mouse
gaaatttgtggtaggaatcc

SEQ ID NO: 435742 - DNA, 20 bp, mouse
gtttgagagtgtggactacc

SEQ ID NO: 435743 - DNA, 20 bp, mouse
gggatggctgggttttagaa

SEQ ID NO: 435744 - DNA, 20 bp, mouse
gcatggtacaattaaatttg

SEQ ID NO: 435745 - DNA, 20 bp, mouse
gctgccaaggcatgtgcact

SEQ ID NO: 435746 - DNA, 20 bp, mouse
gatctagactaggctggtgg

SEQ ID NO: 435747 - DNA, 20 bp, mouse
gtgagccaagtcccagatgg

SEQ ID NO: 435748 - DNA, 20 bp, mouse
gctaggctggtggaggaaaa

SEQ ID NO: 435749 - DNA, 20 bp, mouse
gcagatgccacaggagttac

SEQ ID NO: 435750 - DNA, 20 bp, mouse
gacaggagttacgggcatga

SEQ ID NO: 435751 - DNA, 20 bp, mouse
gacggccatctagactaggc

SEQ ID NO: 435752 - DNA, 20 bp, mouse
gtagatggccgtccaccatc

SEQ ID NO: 435753 - DNA, 20 bp, mouse
gagcaaaaggaggacaagat

SEQ ID NO: 435754 - DNA, 20 bp, mouse
gctgggacttggctcacaac

SEQ ID NO: 435755 - DNA, 20 bp, mouse
gaagggatctgccaaatgag

SEQ ID NO: 435756 - DNA, 20 bp, mouse
gaggataagctgcataggaa

SEQ ID NO: 435757 - DNA, 20 bp, mouse
gtcctcaaccagatataagt

SEQ ID NO: 435758 - DNA, 20 bp, mouse
ggactattcggtcagagctg

SEQ ID NO: 435759 - DNA, 20 bp, mouse
gctagagaaggaggccctgt

SEQ ID NO: 435760 - DNA, 20 bp, mouse
ggcatctgtgctgaccgaca

SEQ ID NO: 435761 - DNA, 20 bp, mouse
gggttcagcctacttatatc

SEQ ID NO: 435762 - DNA, 20 bp, mouse
gagctgcataggaaaggcag

SEQ ID NO: 435763 - DNA, 20 bp, mouse
gtacagtgttgtcagagcct

SEQ ID NO: 435764 - DNA, 20 bp, mouse
ggagcacaccacgttcctga

SEQ ID NO: 435765 - DNA, 20 bp, mouse
gtcggtcagcacagatgccc

SEQ ID NO: 435766 - DNA, 20 bp, mouse
ggcaccgcggccagtcaatc

SEQ ID NO: 435767 - DNA, 20 bp, mouse
gctctgtagcctgggcaccg

SEQ ID NO: 435768 - DNA, 20 bp, mouse
gccgggtcgaagttagacca

SEQ ID NO: 435769 - DNA, 20 bp, mouse
gtcctggccggaagtttgtg

SEQ ID NO: 435770 - DNA, 20 bp, mouse
gaaacttccggccaggaaga

SEQ ID NO: 435771 - DNA, 20 bp, mouse
gtcctagagtcctgattgac

SEQ ID NO: 435772 - DNA, 20 bp, mouse
gtccagtggctcccacacct

SEQ ID NO: 435773 - DNA, 20 bp, mouse
ggcagcgccgcacaaacttc

SEQ ID NO: 435774 - DNA, 20 bp, mouse
ggtttccctagggaccggac

SEQ ID NO: 435775 - DNA, 20 bp, mouse
gcatttcccagaaggtgtct

SEQ ID NO: 435776 - DNA, 20 bp, mouse
ggctgggagctggattatgg

SEQ ID NO: 435777 - DNA, 20 bp, mouse
gctcccagctcccagcacct

SEQ ID NO: 435778 - DNA, 20 bp, mouse
gcagggactccgggctccta

SEQ ID NO: 435779 - DNA, 20 bp, mouse
gggtccaggcggcggagagt

SEQ ID NO: 435780 - DNA, 20 bp, mouse
ggagcagccgacgcagccgt

SEQ ID NO: 435781 - DNA, 20 bp, mouse
gtgcagcttggggaccgaca

SEQ ID NO: 435782 - DNA, 20 bp, mouse
ggacgacgatggcgatccag

SEQ ID NO: 435783 - DNA, 20 bp, mouse
ggcacgagaggagacgacga

SEQ ID NO: 435784 - DNA, 20 bp, mouse
gcgggctcctacggctgcgt

SEQ ID NO: 435785 - DNA, 20 bp, mouse
gcagttcccggtccaggcgg

SEQ ID NO: 435786 - DNA, 20 bp, mouse
gctcgcactggagcctgtca

SEQ ID NO: 435787 - DNA, 20 bp, mouse
ggagcccccgctgcggggat

SEQ ID NO: 435788 - DNA, 20 bp, mouse
gagcgcgcccatccccgcag

SEQ ID NO: 435789 - DNA, 20 bp, mouse
gactcgccgagcccccgctg

SEQ ID NO: 435790 - DNA, 20 bp, mouse
gagtgcgagggccagaccat

SEQ ID NO: 435791 - DNA, 20 bp, mouse
gagttggcagtagccctgac

SEQ ID NO: 435792 - DNA, 20 bp, mouse
ggacccctccgcagaaggta

SEQ ID NO: 435793 - DNA, 20 bp, mouse
gtcggcccggggcaactcgg

SEQ ID NO: 435794 - DNA, 20 bp, mouse
ggccccgccccggccggcta

SEQ ID NO: 435795 - DNA, 20 bp, mouse
ggtctgcgagcgcggttctg

SEQ ID NO: 435796 - DNA, 20 bp, mouse
gacttaccggagccgagacg

SEQ ID NO: 435797 - DNA, 20 bp, mouse
gcaccgcccgagccacttac

SEQ ID NO: 435798 - DNA, 20 bp, mouse
ggactgcaggcggcaagcgg

SEQ ID NO: 435799 - DNA, 20 bp, mouse
gctccggtaagtggctcggg

SEQ ID NO: 435800 - DNA, 20 bp, mouse
ggtcgggccgcgccgcgtct

SEQ ID NO: 435801 - DNA, 20 bp, mouse
gccgcgccgcgtctcggctc

SEQ ID NO: 435802 - DNA, 20 bp, mouse
gggagaggaacggagcgcag

SEQ ID NO: 435803 - DNA, 20 bp, mouse
ggacccccggaaaggacgga

SEQ ID NO: 435804 - DNA, 20 bp, mouse
gcggtgacccccggaaagga

SEQ ID NO: 435805 - DNA, 20 bp, mouse
gcaggcggcaagcggcggtc

SEQ ID NO: 435806 - DNA, 20 bp, mouse
ggccgcggggctggctgctg

SEQ ID NO: 435807 - DNA, 20 bp, mouse
gtcactgagagcaggcggag

SEQ ID NO: 435808 - DNA, 20 bp, mouse
gggaggggatgcgcatcaca

SEQ ID NO: 435809 - DNA, 20 bp, mouse
gagccccgcggccgcgcacc

SEQ ID NO: 435810 - DNA, 20 bp, mouse
gagcccggtgcgcggccgcg

SEQ ID NO: 435811 - DNA, 20 bp, mouse
gcgcaggggcgaccgcagcc

SEQ ID NO: 435812 - DNA, 20 bp, mouse
gagccgagcggaggacgcgg

SEQ ID NO: 435813 - DNA, 20 bp, mouse
gtcccggccgccggcgtggt

SEQ ID NO: 435814 - DNA, 20 bp, mouse
gcccccttcccggactcggg

SEQ ID NO: 435815 - DNA, 20 bp, mouse
gtcctggggtcactgagagc

SEQ ID NO: 435816 - DNA, 20 bp, mouse
gccgcccgggtgcggaagaa

SEQ ID NO: 435817 - DNA, 20 bp, mouse
gagggacggggcgcccagga

SEQ ID NO: 435818 - DNA, 20 bp, mouse
ggggcctctgctgccaggat

SEQ ID NO: 435819 - DNA, 20 bp, mouse
gcccaggaaggcgagccgtg

SEQ ID NO: 435820 - DNA, 20 bp, mouse
gccgggtgcggaagaaggga

SEQ ID NO: 435821 - DNA, 20 bp, mouse
ggcgagccgtggggctccag

SEQ ID NO: 435822 - DNA, 20 bp, mouse
gagcgtacgcacacctatcc

SEQ ID NO: 435823 - DNA, 20 bp, mouse
gcaggatggccgcccgggtg

SEQ ID NO: 435824 - DNA, 20 bp, mouse
gcgtgtgcaggagccagcga

SEQ ID NO: 435825 - DNA, 20 bp, mouse
ggggcgcccttagaactgga

SEQ ID NO: 435826 - DNA, 20 bp, mouse
gggcatgaccgatccaccag

SEQ ID NO: 435827 - DNA, 20 bp, mouse
ggcggaactggtgagtagtg

SEQ ID NO: 435828 - DNA, 20 bp, mouse
ggcgtttgttcacagcgcag

SEQ ID NO: 435829 - DNA, 20 bp, mouse
gcagcgcagcggtggctacc

SEQ ID NO: 435830 - DNA, 20 bp, mouse
gcgcgcagcctgggtcccag

SEQ ID NO: 435831 - DNA, 20 bp, mouse
ggaggtgaccaagatcgagg

SEQ ID NO: 435832 - DNA, 20 bp, mouse
ggcgtggcgagtagatgggg

SEQ ID NO: 435833 - DNA, 20 bp, mouse
gcagaggaacgctgagaggg

SEQ ID NO: 435834 - DNA, 20 bp, mouse
gctggctgcactgcgcacag

SEQ ID NO: 435835 - DNA, 20 bp, mouse
gcggcgaccgcgaggcgacc

SEQ ID NO: 435836 - DNA, 20 bp, mouse
gcggcgtccgcgggcagcag

SEQ ID NO: 435837 - DNA, 20 bp, mouse
ggcctgggccatgagctccg

SEQ ID NO: 435838 - DNA, 20 bp, mouse
gcggcagaagcggccctcgt

SEQ ID NO: 435839 - DNA, 20 bp, mouse
gtcagcggcgcccgtggtga

SEQ ID NO: 435840 - DNA, 20 bp, mouse
ggtcggccatggaagacgag

SEQ ID NO: 435841 - DNA, 20 bp, mouse
gccgtggtgacggcgacgtg

SEQ ID NO: 435842 - DNA, 20 bp, mouse
gttggcgctgatcttcgcct

SEQ ID NO: 435843 - DNA, 20 bp, mouse
gcccccggagctcatggccc

SEQ ID NO: 435844 - DNA, 20 bp, mouse
ggcagactggcgagcgagtg

SEQ ID NO: 435845 - DNA, 20 bp, mouse
ggggggtcctcggcgtccgc

SEQ ID NO: 435846 - DNA, 20 bp, mouse
gggacacatcggctacacag

SEQ ID NO: 435847 - DNA, 20 bp, mouse
gcgcccggggcgcagagcta

SEQ ID NO: 435848 - DNA, 20 bp, mouse
gtcacgaggtcgtggagtgc

SEQ ID NO: 435849 - DNA, 20 bp, mouse
gagctagggcgcgggtcacg

SEQ ID NO: 435850 - DNA, 20 bp, mouse
gctgggttagggtccgcccg

SEQ ID NO: 435851 - DNA, 20 bp, mouse
ggccggcttcccggacacat

SEQ ID NO: 435852 - DNA, 20 bp, mouse
gggcgcgggtcacgaggtcg

SEQ ID NO: 435853 - DNA, 20 bp, mouse
gtcaccttagggccctcggg

SEQ ID NO: 435854 - DNA, 20 bp, mouse
gtgcatcatgggcgattggg

SEQ ID NO: 435855 - DNA, 20 bp, mouse
gcggcgctcatgctgggtta

SEQ ID NO: 435856 - DNA, 20 bp, mouse
gagcgcctcagggccgacat

SEQ ID NO: 435857 - DNA, 20 bp, mouse
ggtaagaagggccgtcactg

SEQ ID NO: 435858 - DNA, 20 bp, mouse
gccgtagcccgagcgcctca

SEQ ID NO: 435859 - DNA, 20 bp, mouse
ggcggcagcggagcccatgt

SEQ ID NO: 435860 - DNA, 20 bp, mouse
ggtagtagcggccgtaagaa

SEQ ID NO: 435861 - DNA, 20 bp, mouse
gtcccccgggcccgtagtag

SEQ ID NO: 435862 - DNA, 20 bp, mouse
gcgggctacggccccagtga

SEQ ID NO: 435863 - DNA, 20 bp, mouse
ggcaatgggacggtcgtggg

SEQ ID NO: 435864 - DNA, 20 bp, mouse
gggagcccatgtcggccctg

SEQ ID NO: 435865 - DNA, 20 bp, mouse
gtgcccaggcgcctcccgag

SEQ ID NO: 435866 - DNA, 20 bp, mouse
ggacaacgctgcggaagtgt

SEQ ID NO: 435867 - DNA, 20 bp, mouse
ggaggacggcgacaacgctg

SEQ ID NO: 435868 - DNA, 20 bp, mouse
gaacgctgcggaagtgtagg

SEQ ID NO: 435869 - DNA, 20 bp, mouse
gcctcgccccacgctcacct

SEQ ID NO: 435870 - DNA, 20 bp, mouse
ggctgcggaagtgtaggtgg

SEQ ID NO: 435871 - DNA, 20 bp, mouse
gaccgcagcggtgcccccag

SEQ ID NO: 435872 - DNA, 20 bp, mouse
gtcccggctaggtctgaccc

SEQ ID NO: 435873 - DNA, 20 bp, mouse
gcctccgccggccccttcac

SEQ ID NO: 435874 - DNA, 20 bp, mouse
gtgtaggtggcggggcgcga

SEQ ID NO: 435875 - DNA, 20 bp, mouse
gcgggcccgctctgcgagga

SEQ ID NO: 435876 - DNA, 20 bp, mouse
ggagggagccgaccacccgg

SEQ ID NO: 435877 - DNA, 20 bp, mouse
ggtcccccgggcgacgacgg

SEQ ID NO: 435878 - DNA, 20 bp, mouse
gccgggccggccgagatggg

SEQ ID NO: 435879 - DNA, 20 bp, mouse
gtgggagggagccgaccacc

SEQ ID NO: 435880 - DNA, 20 bp, mouse
gaggcgcagtgcggtccccc

SEQ ID NO: 435881 - DNA, 20 bp, mouse
gggtaccgtggggacgtcgg

SEQ ID NO: 435882 - DNA, 20 bp, mouse
ggcggtcccccgggcgacga

SEQ ID NO: 435883 - DNA, 20 bp, mouse
gcaagaccgcggacactcac

SEQ ID NO: 435884 - DNA, 20 bp, mouse
gcgaacagtgagtttctggg

SEQ ID NO: 435885 - DNA, 20 bp, mouse
gttgctggaataccgaggag

SEQ ID NO: 435886 - DNA, 20 bp, mouse
gctagcgagcccatccagag

SEQ ID NO: 435887 - DNA, 20 bp, mouse
gtttgagagccgctctggat

SEQ ID NO: 435888 - DNA, 20 bp, mouse
gctcgctagagtcgttgttg

SEQ ID NO: 435889 - DNA, 20 bp, mouse
ggcaggtttgagagccgctc

SEQ ID NO: 435890 - DNA, 20 bp, mouse
gagcaaggacgcattacggg

SEQ ID NO: 435891 - DNA, 20 bp, mouse
gtcaaacctgcagcccggcg

SEQ ID NO: 435892 - DNA, 20 bp, mouse
gtattagtatgcagggcccg

SEQ ID NO: 435893 - DNA, 20 bp, mouse
ggcccggcgcggcgagccac

SEQ ID NO: 435894 - DNA, 20 bp, mouse
gatcataacggattttaaaa

SEQ ID NO: 435895 - DNA, 20 bp, mouse
gcgttcagcaagagcctcgc

SEQ ID NO: 435896 - DNA, 20 bp, mouse
gtggccgggctggaatccgg

SEQ ID NO: 435897 - DNA, 20 bp, mouse
gggcggctggaaccccccgg

SEQ ID NO: 435898 - DNA, 20 bp, mouse
gccggacgggcgagcagcgg

SEQ ID NO: 435899 - DNA, 20 bp, mouse
gggaaccgcgagcggcgtag

SEQ ID NO: 435900 - DNA, 20 bp, mouse
gccctggccgggctggaatc

SEQ ID NO: 435901 - DNA, 20 bp, mouse
gcggacggctagggccggac

SEQ ID NO: 435902 - DNA, 20 bp, mouse
ggctctcggggagtttgtgg

SEQ ID NO: 435903 - DNA, 20 bp, mouse
gcctagctcaccgggacgag

SEQ ID NO: 435904 - DNA, 20 bp, mouse
gccgggggcgctcaattccc

SEQ ID NO: 435905 - DNA, 20 bp, mouse
gagccccgggaagggacgga

SEQ ID NO: 435906 - DNA, 20 bp, mouse
ggcaggcgagaggaccggag

SEQ ID NO: 435907 - DNA, 20 bp, mouse
gcagcaggaaagccaagagt

SEQ ID NO: 435908 - DNA, 20 bp, mouse
ggcccccaggaagggaaaaa

SEQ ID NO: 435909 - DNA, 20 bp, mouse
gtgctctcctccaggagcag

SEQ ID NO: 435910 - DNA, 20 bp, mouse
gcaggggagtggctgcatct

SEQ ID NO: 435911 - DNA, 20 bp, mouse
gggcgagaggaccggagcgg

SEQ ID NO: 435912 - DNA, 20 bp, mouse
ggagaaggagtgcgacgctc

SEQ ID NO: 435913 - DNA, 20 bp, mouse
gggcaggagtcggctgtctt

SEQ ID NO: 435914 - DNA, 20 bp, mouse
gggagccagagactgcatta

SEQ ID NO: 435915 - DNA, 20 bp, mouse
gagagcacagtcccaactct

SEQ ID NO: 435916 - DNA, 20 bp, mouse
gcgcgcgccgggccgagtga

SEQ ID NO: 435917 - DNA, 20 bp, mouse
gccaccgaaccggattcctc

SEQ ID NO: 435918 - DNA, 20 bp, mouse
gcggcgcgcgctgcgggcag

SEQ ID NO: 435919 - DNA, 20 bp, mouse
gggttcgcgggagactaagg

SEQ ID NO: 435920 - DNA, 20 bp, mouse
gcggagcggccggaggaatc

SEQ ID NO: 435921 - DNA, 20 bp, mouse
ggccgccgctgccaccgaac

SEQ ID NO: 435922 - DNA, 20 bp, mouse
gcggccggaggaatccggtt

SEQ ID NO: 435923 - DNA, 20 bp, mouse
gccgggccgagtgacggccg

SEQ ID NO: 435924 - DNA, 20 bp, mouse
gtgacggccgaggcgggacg

SEQ ID NO: 435925 - DNA, 20 bp, mouse
gatgcggcaccggcgatcag

SEQ ID NO: 435926 - DNA, 20 bp, mouse
ggagctgggggtaaaatcct

SEQ ID NO: 435927 - DNA, 20 bp, mouse
gatcctgggctggcgacgtc

SEQ ID NO: 435928 - DNA, 20 bp, mouse
gtttgaatgccgggcgagga

SEQ ID NO: 435929 - DNA, 20 bp, mouse
ggcgcgcctccctcctcgcc

SEQ ID NO: 435930 - DNA, 20 bp, mouse
gcgggaagctgtttgaatgc

SEQ ID NO: 435931 - DNA, 20 bp, mouse
gctggctggggcggcgtgtt

SEQ ID NO: 435932 - DNA, 20 bp, mouse
gcctccctgccaggtactga

SEQ ID NO: 435933 - DNA, 20 bp, mouse
gcgcggcgctcgctctcccc

SEQ ID NO: 435934 - DNA, 20 bp, mouse
ggctgtttgaatgccgggcg

SEQ ID NO: 435935 - DNA, 20 bp, mouse
gacgagatagtaaagctgtg

SEQ ID NO: 435936 - DNA, 20 bp, mouse
gacaccacagaccagagcag

SEQ ID NO: 435937 - DNA, 20 bp, mouse
gcgcggccacctgtgaccaa

SEQ ID NO: 435938 - DNA, 20 bp, mouse
gtccggacgccaggacagac

SEQ ID NO: 435939 - DNA, 20 bp, mouse
ggtactgagggagcgcgcgg

SEQ ID NO: 435940 - DNA, 20 bp, mouse
ggcccaggccctgaacatct

SEQ ID NO: 435941 - DNA, 20 bp, mouse
gggagggaccgagatgttca

SEQ ID NO: 435942 - DNA, 20 bp, mouse
gtcaggcccgagcagggcac

SEQ ID NO: 435943 - DNA, 20 bp, mouse
gcggcgggcgtaaggaccct

SEQ ID NO: 435944 - DNA, 20 bp, mouse
gacgctcggaggagatgcac

SEQ ID NO: 435945 - DNA, 20 bp, mouse
ggagctcggacaggttggat

SEQ ID NO: 435946 - DNA, 20 bp, mouse
gctgggacgagcaaagggac

SEQ ID NO: 435947 - DNA, 20 bp, mouse
gaggtagacgtagcctgcca

SEQ ID NO: 435948 - DNA, 20 bp, mouse
gcggtctgtaaggagctgcg

SEQ ID NO: 435949 - DNA, 20 bp, mouse
ggacgtagcctgccaaggct

SEQ ID NO: 435950 - DNA, 20 bp, mouse
gactccgcccgcctcaggtg

SEQ ID NO: 435951 - DNA, 20 bp, mouse
gtgcggcgcttcggtctgta

SEQ ID NO: 435952 - DNA, 20 bp, mouse
gtgctcgtcccagccttggc

SEQ ID NO: 435953 - DNA, 20 bp, mouse
gcctttgctcgtcccagcct

SEQ ID NO: 435954 - DNA, 20 bp, mouse
gcggagacttgggaactcca

SEQ ID NO: 435955 - DNA, 20 bp, mouse
gcatggctgcagcctccggg

SEQ ID NO: 435956 - DNA, 20 bp, mouse
gggtggtgctggcaccaagg

SEQ ID NO: 435957 - DNA, 20 bp, mouse
gcaaggaggcaggtggctag

SEQ ID NO: 435958 - DNA, 20 bp, mouse
gctggcaccaaggaggcagg

SEQ ID NO: 435959 - DNA, 20 bp, mouse
ggcagaggtggctgtagagt

SEQ ID NO: 435960 - DNA, 20 bp, mouse
gccaggctgggctcaagtgt

SEQ ID NO: 435961 - DNA, 20 bp, mouse
ggaaggtggtgctggcacca

SEQ ID NO: 435962 - DNA, 20 bp, mouse
gagtgctctggacaggcagc

SEQ ID NO: 435963 - DNA, 20 bp, mouse
gccactatgaggtagaaagt

SEQ ID NO: 435964 - DNA, 20 bp, mouse
gtgccccgtgcccagtgctc

SEQ ID NO: 435965 - DNA, 20 bp, mouse
ggtgccagcaccaccttcca

SEQ ID NO: 435966 - DNA, 20 bp, mouse
ggcactagctggggacaccg

SEQ ID NO: 435967 - DNA, 20 bp, mouse
gggctcagtaacctacaggt

SEQ ID NO: 435968 - DNA, 20 bp, mouse
ggagcgtagtgcagaagcca

SEQ ID NO: 435969 - DNA, 20 bp, mouse
gaaacgcgcagggtaggggt

SEQ ID NO: 435970 - DNA, 20 bp, mouse
gaccgtggacagggcttcgg

SEQ ID NO: 435971 - DNA, 20 bp, mouse
ggttgctgtcgcactagctg

SEQ ID NO: 435972 - DNA, 20 bp, mouse
gaggctctgagctaagtaaa

SEQ ID NO: 435973 - DNA, 20 bp, mouse
gtacaggtgggtgcagggac

SEQ ID NO: 435974 - DNA, 20 bp, mouse
ggtctctaccagcacggtag

SEQ ID NO: 435975 - DNA, 20 bp, mouse
gcggacgcgaccgccccctc

SEQ ID NO: 435976 - DNA, 20 bp, mouse
gtgggccaagaggcaacccg

SEQ ID NO: 435977 - DNA, 20 bp, mouse
gtggcaggaactggtatcag

SEQ ID NO: 435978 - DNA, 20 bp, mouse
gaggcctgactggcaggaac

SEQ ID NO: 435979 - DNA, 20 bp, mouse
gccaaggtttcaggcctgac

SEQ ID NO: 435980 - DNA, 20 bp, mouse
gggagctgggacctcctcta

SEQ ID NO: 435981 - DNA, 20 bp, mouse
ggcaattctggcccagggtg

SEQ ID NO: 435982 - DNA, 20 bp, mouse
gaccagaaccgggcaggaag

SEQ ID NO: 435983 - DNA, 20 bp, mouse
gcaaagtcgcgaggtttcct

SEQ ID NO: 435984 - DNA, 20 bp, mouse
ggccagaattgcccaggatt

SEQ ID NO: 435985 - DNA, 20 bp, mouse
gactggtatcagtggattca

SEQ ID NO: 435986 - DNA, 20 bp, mouse
ggcgcacaagccacgaacag

SEQ ID NO: 435987 - DNA, 20 bp, mouse
gcaagccacgaacagcggac

SEQ ID NO: 435988 - DNA, 20 bp, mouse
ggtgtaggcgttgctctctg

SEQ ID NO: 435989 - DNA, 20 bp, mouse
gggacccgcgcgctcctcgg

SEQ ID NO: 435990 - DNA, 20 bp, mouse
gacgaacagcggacgggaac

SEQ ID NO: 435991 - DNA, 20 bp, mouse
gcgggagcgcgaggcgtcaa

SEQ ID NO: 435992 - DNA, 20 bp, mouse
gggcgagaggacgaccgccg

SEQ ID NO: 435993 - DNA, 20 bp, mouse
gcgccgggcgctatttacgg

SEQ ID NO: 435994 - DNA, 20 bp, mouse
gagcaacgcctacaccagcc

SEQ ID NO: 435995 - DNA, 20 bp, mouse
gggctgcactacgacccccg

SEQ ID NO: 435996 - DNA, 20 bp, mouse
ggaggctccggctctggtaa

SEQ ID NO: 435997 - DNA, 20 bp, mouse
gcgcttctcacgctcaccgg

SEQ ID NO: 435998 - DNA, 20 bp, mouse
gtcgtagcttgaggtctggg

SEQ ID NO: 435999 - DNA, 20 bp, mouse
gcttgaggtctgggcgggag

SEQ ID NO: 436000 - DNA, 20 bp, mouse
gtcacgctcaccggaggctc

SEQ ID NO: 436001 - DNA, 20 bp, mouse
ggtctcgtagcttgaggtct

SEQ ID NO: 436002 - DNA, 20 bp, mouse
ggacccggaagcggaagtcg

SEQ ID NO: 436003 - DNA, 20 bp, mouse
gaggccggcagcccgagtga

SEQ ID NO: 436004 - DNA, 20 bp, mouse
ggaggagccgttaccagagc

SEQ ID NO: 436005 - DNA, 20 bp, mouse
gtcaccggaggctccggctc

SEQ ID NO: 436006 - DNA, 20 bp, mouse
gttcttactgggatctgtaa

SEQ ID NO: 436007 - DNA, 20 bp, mouse
gtcacccggtgcacttggtc

SEQ ID NO: 436008 - DNA, 20 bp, mouse
gcagtagcaggcttcttact

SEQ ID NO: 436009 - DNA, 20 bp, mouse
gcacttggtcaggcagtagc

SEQ ID NO: 436010 - DNA, 20 bp, mouse
gactgcctgaccaagtgcac

SEQ ID NO: 436011 - DNA, 20 bp, mouse
gtactgggatctgtaacggc

SEQ ID NO: 436012 - DNA, 20 bp, mouse
gagggatccctcaagagcat

SEQ ID NO: 436013 - DNA, 20 bp, mouse
ggtgatggctggaggcagtt

SEQ ID NO: 436014 - DNA, 20 bp, mouse
gctgcctccagccatcacct

SEQ ID NO: 436015 - DNA, 20 bp, mouse
gcaaggtatcagtactcacc

SEQ ID NO: 436016 - DNA, 20 bp, mouse
gtggagcctgggagctgcag

SEQ ID NO: 436017 - DNA, 20 bp, mouse
gccctagtgccagaagccac

SEQ ID NO: 436018 - DNA, 20 bp, mouse
gttgcgggaggttggagcct

SEQ ID NO: 436019 - DNA, 20 bp, mouse
gctgcagggccacagaccat

SEQ ID NO: 436020 - DNA, 20 bp, mouse
gcggaactaaaggtctgcag

SEQ ID NO: 436021 - DNA, 20 bp, mouse
gggtctgcaggggaagttgc

SEQ ID NO: 436022 - DNA, 20 bp, mouse
gccacaggaagcattgcggg

SEQ ID NO: 436023 - DNA, 20 bp, mouse
ggcaggggaagttgcaggca

SEQ ID NO: 436024 - DNA, 20 bp, mouse
gcccagggcaaactgtctac

SEQ ID NO: 436025 - DNA, 20 bp, mouse
gaagccacaggaagcattgc

SEQ ID NO: 436026 - DNA, 20 bp, mouse
gggagctgcaattaccgtgt

SEQ ID NO: 436027 - DNA, 20 bp, mouse
ggagaattccgcagcccaca

SEQ ID NO: 436028 - DNA, 20 bp, mouse
gcagtcctgagagacttggg

SEQ ID NO: 436029 - DNA, 20 bp, mouse
ggtggaggcgcgaccggctg

SEQ ID NO: 436030 - DNA, 20 bp, mouse
gattctcgtggtgtttgtcg

SEQ ID NO: 436031 - DNA, 20 bp, mouse
ggcaattaccgtgtgggctg

SEQ ID NO: 436032 - DNA, 20 bp, mouse
ggctcagtcctgagagactt

SEQ ID NO: 436033 - DNA, 20 bp, mouse
gtgtcggggagctgcgataa

SEQ ID NO: 436034 - DNA, 20 bp, mouse
gcgcccggcgctcctgtcac

SEQ ID NO: 436035 - DNA, 20 bp, mouse
ggggggagtggaggcgcgac

SEQ ID NO: 436036 - DNA, 20 bp, mouse
gggctgagaagccctaaggg

SEQ ID NO: 436037 - DNA, 20 bp, mouse
gcggggctgagaagccctaa

SEQ ID NO: 436038 - DNA, 20 bp, mouse
gggagcgcccaccgccctta

SEQ ID NO: 436039 - DNA, 20 bp, mouse
gctggagagtgacccaggta

SEQ ID NO: 436040 - DNA, 20 bp, mouse
ggagaagccctaagggcggt

SEQ ID NO: 436041 - DNA, 20 bp, mouse
gccggcgcgggcgagtgacg

SEQ ID NO: 436042 - DNA, 20 bp, mouse
gccctcggcgacagctgggt

SEQ ID NO: 436043 - DNA, 20 bp, mouse
gtgggtgggacgacaagaag

SEQ ID NO: 436044 - DNA, 20 bp, mouse
gcttccgtgagagcgagcag

SEQ ID NO: 436045 - DNA, 20 bp, mouse
gcctccggagggccgagaaa

SEQ ID NO: 436046 - DNA, 20 bp, mouse
gcggctcggaggctgaaacg

SEQ ID NO: 436047 - DNA, 20 bp, mouse
ggcggagtctctgaattggt

SEQ ID NO: 436048 - DNA, 20 bp, mouse
gcgcacgcagcaggatccgg

SEQ ID NO: 436049 - DNA, 20 bp, mouse
gtcggacgcctccggctcgg

SEQ ID NO: 436050 - DNA, 20 bp, mouse
gacgcggtaaaactcagaga

SEQ ID NO: 436051 - DNA, 20 bp, mouse
gtggtcggacgcctccggct

SEQ ID NO: 436052 - DNA, 20 bp, mouse
gactcagagatggaaggacc

SEQ ID NO: 436053 - DNA, 20 bp, mouse
gggtaaaactcagagatgga

SEQ ID NO: 436054 - DNA, 20 bp, mouse
ggatccggcggtgaccagcg

SEQ ID NO: 436055 - DNA, 20 bp, mouse
gcatggagccggctaccgac

SEQ ID NO: 436056 - DNA, 20 bp, mouse
gtcgcccggaagagactgtc

SEQ ID NO: 436057 - DNA, 20 bp, mouse
ggcaccaggccgcgaggtac

SEQ ID NO: 436058 - DNA, 20 bp, mouse
gtctggagaccagtacctcg

SEQ ID NO: 436059 - DNA, 20 bp, mouse
ggtctccagacagtctcttc

SEQ ID NO: 436060 - DNA, 20 bp, mouse
ggatgctgcaccaggccgcg

SEQ ID NO: 436061 - DNA, 20 bp, mouse
gctgctagagtagggtgcac

SEQ ID NO: 436062 - DNA, 20 bp, mouse
gctgcagcccctgagcctgg

SEQ ID NO: 436063 - DNA, 20 bp, mouse
gaggatgtccctgatcagaa

SEQ ID NO: 436064 - DNA, 20 bp, mouse
ggctcttcaccagcctcgcc

SEQ ID NO: 436065 - DNA, 20 bp, mouse
gagggtgcacaggccgcgag

SEQ ID NO: 436066 - DNA, 20 bp, mouse
ggcgcgggcgcaggagaccg

SEQ ID NO: 436067 - DNA, 20 bp, mouse
gggcgcaggagaccgcggac

SEQ ID NO: 436068 - DNA, 20 bp, mouse
ggcaggagaccgcggacagg

SEQ ID NO: 436069 - DNA, 20 bp, mouse
gccgccgccgccccgggagg

SEQ ID NO: 436070 - DNA, 20 bp, mouse
gagcagcgaaggagcaagcg

SEQ ID NO: 436071 - DNA, 20 bp, mouse
gtcgggcagtgggcagaccc

SEQ ID NO: 436072 - DNA, 20 bp, mouse
ggccgggcgccgcctgtccg

SEQ ID NO: 436073 - DNA, 20 bp, mouse
gaagccaacgcgcggggcag

SEQ ID NO: 436074 - DNA, 20 bp, mouse
gcccactgcccgatcccggg

SEQ ID NO: 436075 - DNA, 20 bp, mouse
ggcaggtgcagcgaccgcta

SEQ ID NO: 436076 - DNA, 20 bp, mouse
ggcccgcggctaggaagcga

SEQ ID NO: 436077 - DNA, 20 bp, mouse
gacgcagtcccgggtccgac

SEQ ID NO: 436078 - DNA, 20 bp, mouse
gtagccgcgggcgcatcccc

SEQ ID NO: 436079 - DNA, 20 bp, mouse
gcgcggctaggaagcgacgg

SEQ ID NO: 436080 - DNA, 20 bp, mouse
gcccgggagccgcgatgcag

SEQ ID NO: 436081 - DNA, 20 bp, mouse
gggagtgcgcgaagagaggt

SEQ ID NO: 436082 - DNA, 20 bp, mouse
ggccgctgcacgtacccagg

SEQ ID NO: 436083 - DNA, 20 bp, mouse
gtcccctggccgctgcatcg

SEQ ID NO: 436084 - DNA, 20 bp, mouse
gggtgatccgcacagccctc

SEQ ID NO: 436085 - DNA, 20 bp, mouse
gggctcggccagtcggaccc

SEQ ID NO: 436086 - DNA, 20 bp, mouse
gggaggcgcgcaaagcagag

SEQ ID NO: 436087 - DNA, 20 bp, mouse
gcgctcctcggcagccagag

SEQ ID NO: 436088 - DNA, 20 bp, mouse
gaagatgctgctcggcgggt

SEQ ID NO: 436089 - DNA, 20 bp, mouse
ggcactgccacgcggaactg

SEQ ID NO: 436090 - DNA, 20 bp, mouse
gagtcaaagatgctgctcgg

SEQ ID NO: 436091 - DNA, 20 bp, mouse
gcagctgcggtgtcccaaaa

SEQ ID NO: 436092 - DNA, 20 bp, mouse
gagactcgcccgccagtggt

SEQ ID NO: 436093 - DNA, 20 bp, mouse
gaaccgctgggcgatatagt

SEQ ID NO: 436094 - DNA, 20 bp, mouse
gagcagaggcgaccgcacac

SEQ ID NO: 436095 - DNA, 20 bp, mouse
gcgacgggcacacagagtag

SEQ ID NO: 436096 - DNA, 20 bp, mouse
gcccggagcgtggagcgagt

SEQ ID NO: 436097 - DNA, 20 bp, mouse
gctctctcccggctcgacgg

SEQ ID NO: 436098 - DNA, 20 bp, mouse
gtctctctctcccggctcga

SEQ ID NO: 436099 - DNA, 20 bp, mouse
gggccgggtgtagacacagt

SEQ ID NO: 436100 - DNA, 20 bp, mouse
ggccgaagctgtccacctgg

SEQ ID NO: 436101 - DNA, 20 bp, mouse
gcggtggccttagggaccca

SEQ ID NO: 436102 - DNA, 20 bp, mouse
ggaggcaccgcgctcaccca

SEQ ID NO: 436103 - DNA, 20 bp, mouse
ggcaaaggctctctctctcc

SEQ ID NO: 436104 - DNA, 20 bp, mouse
gggtggcccggagtccgcgg

SEQ ID NO: 436105 - DNA, 20 bp, mouse
ggaagcctagggttctccaa

SEQ ID NO: 436106 - DNA, 20 bp, mouse
gtctgcacccgagagagagg

SEQ ID NO: 436107 - DNA, 20 bp, mouse
ggcagcgagatgtccctgtg

SEQ ID NO: 436108 - DNA, 20 bp, mouse
gccctctgcacccgagagag

SEQ ID NO: 436109 - DNA, 20 bp, mouse
gcagagggactgctccccac

SEQ ID NO: 436110 - DNA, 20 bp, mouse
gggacgcaggggtctgtcag

SEQ ID NO: 436111 - DNA, 20 bp, mouse
gctgcgtcctcctctctctc

SEQ ID NO: 436112 - DNA, 20 bp, mouse
gcactgctgtcggagctgtg

SEQ ID NO: 436113 - DNA, 20 bp, mouse
ggaggcatctgggacggtgt

SEQ ID NO: 436114 - DNA, 20 bp, mouse
gtcctggggtggtagaagag

SEQ ID NO: 436115 - DNA, 20 bp, mouse
gccccctagcagtcaagaag

SEQ ID NO: 436116 - DNA, 20 bp, mouse
gccacagagttgcatggctt

SEQ ID NO: 436117 - DNA, 20 bp, mouse
ggcttaggcaaggggaaaag

SEQ ID NO: 436118 - DNA, 20 bp, mouse
ggactgagacagtgagtaca

SEQ ID NO: 436119 - DNA, 20 bp, mouse
gctactcccacagagttgca

SEQ ID NO: 436120 - DNA, 20 bp, mouse
ggactaggaaagaaacgcta

SEQ ID NO: 436121 - DNA, 20 bp, mouse
gggaggggacagctgctgag

SEQ ID NO: 436122 - DNA, 20 bp, mouse
gtcacggtttagttcctcct

SEQ ID NO: 436123 - DNA, 20 bp, mouse
gagttgcatggcttaggcaa

SEQ ID NO: 436124 - DNA, 20 bp, mouse
gctatggaggcccaaggaag

SEQ ID NO: 436125 - DNA, 20 bp, mouse
ggcctccataggtcactggg

SEQ ID NO: 436126 - DNA, 20 bp, mouse
ggtccgcgctatggggacag

SEQ ID NO: 436127 - DNA, 20 bp, mouse
gggcgaggcggcacctggac

SEQ ID NO: 436128 - DNA, 20 bp, mouse
gggaccagacgccgccgcag

SEQ ID NO: 436129 - DNA, 20 bp, mouse
gcacggagaagaccccgagt

SEQ ID NO: 436130 - DNA, 20 bp, mouse
ggaggcggcacctggaccgg

SEQ ID NO: 436131 - DNA, 20 bp, mouse
gggcgtctggtccagtggga

SEQ ID NO: 436132 - DNA, 20 bp, mouse
ggccggaggaccgtccacgg

SEQ ID NO: 436133 - DNA, 20 bp, mouse
gccggtggcgccagtgggca

SEQ ID NO: 436134 - DNA, 20 bp, mouse
gggggacagcgggagcctca

SEQ ID NO: 436135 - DNA, 20 bp, mouse
gagagaccgtccgcgctatg

SEQ ID NO: 436136 - DNA, 20 bp, mouse
gaggcagcggcagtgatgga

SEQ ID NO: 436137 - DNA, 20 bp, mouse
gccgctcccaagctgctccc

SEQ ID NO: 436138 - DNA, 20 bp, mouse
gctcgccgggtgcgccccgg

SEQ ID NO: 436139 - DNA, 20 bp, mouse
gcgggtccggggagcagctt

SEQ ID NO: 436140 - DNA, 20 bp, mouse
gcctctcgccgggtgcgccc

SEQ ID NO: 436141 - DNA, 20 bp, mouse
gcggcagtgatggacgggtc

SEQ ID NO: 436142 - DNA, 20 bp, mouse
gcagcttgggagcggcggtg

SEQ ID NO: 436143 - DNA, 20 bp, mouse
gcaaagccggaggggtccta

SEQ ID NO: 436144 - DNA, 20 bp, mouse
gctcgggcgggagcaggctg

SEQ ID NO: 436145 - DNA, 20 bp, mouse
gcactgccgctgcctctcgc

SEQ ID NO: 436146 - DNA, 20 bp, mouse
gacttcccgggagcgcggag

SEQ ID NO: 436147 - DNA, 20 bp, mouse
gagtagctcagaaacttccc

SEQ ID NO: 436148 - DNA, 20 bp, mouse
gcggagaggcggggaagtgc

SEQ ID NO: 436149 - DNA, 20 bp, mouse
gagaggcggggaagtgccgg

SEQ ID NO: 436150 - DNA, 20 bp, mouse
ggcaagtgctcgcaggtgag

SEQ ID NO: 436151 - DNA, 20 bp, mouse
gccgcgggcgcctcacaatg

SEQ ID NO: 436152 - DNA, 20 bp, mouse
gcggcggccgggagagactc

SEQ ID NO: 436153 - DNA, 20 bp, mouse
ggacagactgggcaccccgg

SEQ ID NO: 436154 - DNA, 20 bp, mouse
gtcctcgtgggaaggtgcgg

SEQ ID NO: 436155 - DNA, 20 bp, mouse
gcgtgctcgacgcatccccg

SEQ ID NO: 436156 - DNA, 20 bp, mouse
gactcctctccagcgggcac

SEQ ID NO: 436157 - DNA, 20 bp, mouse
gcctctccagcgggcacggg

SEQ ID NO: 436158 - DNA, 20 bp, mouse
gacgcctcgaggggagaaaa

SEQ ID NO: 436159 - DNA, 20 bp, mouse
gggagaggagtcgtgactgg

SEQ ID NO: 436160 - DNA, 20 bp, mouse
gctcacgccgatctccgccg

SEQ ID NO: 436161 - DNA, 20 bp, mouse
ggagagggcggcgcgaactc

SEQ ID NO: 436162 - DNA, 20 bp, mouse
ggcggtcccgccagctctga

SEQ ID NO: 436163 - DNA, 20 bp, mouse
gtgaagagcggctcctctcc

SEQ ID NO: 436164 - DNA, 20 bp, mouse
gtgcgctggcccggcagcgg

SEQ ID NO: 436165 - DNA, 20 bp, mouse
gctagcgctgcgcagcagag

SEQ ID NO: 436166 - DNA, 20 bp, mouse
ggaggacgagcgctcaggga

SEQ ID NO: 436167 - DNA, 20 bp, mouse
gaaaggggcaggagccaccc

SEQ ID NO: 436168 - DNA, 20 bp, mouse
gtgagcgctcgtcctcaccc

SEQ ID NO: 436169 - DNA, 20 bp, mouse
ggcgctcgtcctcacccggg

SEQ ID NO: 436170 - DNA, 20 bp, mouse
gcctccaggcccggggtcca

SEQ ID NO: 436171 - DNA, 20 bp, mouse
ggggggggcggcgcttaaag

SEQ ID NO: 436172 - DNA, 20 bp, mouse
gtccagggccggaataggag

SEQ ID NO: 436173 - DNA, 20 bp, mouse
gcccgaggccggcggcggag

SEQ ID NO: 436174 - DNA, 20 bp, mouse
gggaggcgaaacccagaccg

SEQ ID NO: 436175 - DNA, 20 bp, mouse
gcgggcgcagaggacagggg

SEQ ID NO: 436176 - DNA, 20 bp, mouse
ggagcgagcggcggaagacg

SEQ ID NO: 436177 - DNA, 20 bp, mouse
ggggcggcgcgggtaaacag

SEQ ID NO: 436178 - DNA, 20 bp, mouse
gctaatcagagagcgagcgg

SEQ ID NO: 436179 - DNA, 20 bp, mouse
ggaactaatcagagagcgag

SEQ ID NO: 436180 - DNA, 20 bp, mouse
ggtctagggagttggagtgg

SEQ ID NO: 436181 - DNA, 20 bp, mouse
gcttaacccgcacccgggaa

SEQ ID NO: 436182 - DNA, 20 bp, mouse
gagcggcgggcgcctcggga

SEQ ID NO: 436183 - DNA, 20 bp, mouse
ggggtcccgactagagtccc

SEQ ID NO: 436184 - DNA, 20 bp, mouse
gtagaagagaaataaggagg

SEQ ID NO: 436185 - DNA, 20 bp, mouse
gtcccgactagagtcccggg

SEQ ID NO: 436186 - DNA, 20 bp, mouse
gtgccgggaggcctgagacg

SEQ ID NO: 436187 - DNA, 20 bp, mouse
gtgcgagcggggagcccagg

SEQ ID NO: 436188 - DNA, 20 bp, mouse
ggcatagagccacatgcgag

SEQ ID NO: 436189 - DNA, 20 bp, mouse
gcccgggggcatgaacactc

SEQ ID NO: 436190 - DNA, 20 bp, mouse
gcggggcccggggatctgcc

SEQ ID NO: 436191 - DNA, 20 bp, mouse
gccggagaaaggaggcgatg

SEQ ID NO: 436192 - DNA, 20 bp, mouse
gtcaatagcaacccactcgg

SEQ ID NO: 436193 - DNA, 20 bp, mouse
gtgggctccccgctcgcatg

SEQ ID NO: 436194 - DNA, 20 bp, mouse
gggcccggggatctgccggg

SEQ ID NO: 436195 - DNA, 20 bp, mouse
gggcctcccggcagatcccc

SEQ ID NO: 436196 - DNA, 20 bp, mouse
gcagcagagcggtctggaaa

SEQ ID NO: 436197 - DNA, 20 bp, mouse
gaggcaacagcagagcggtc

SEQ ID NO: 436198 - DNA, 20 bp, mouse
gcctacagggaacctcagag

SEQ ID NO: 436199 - DNA, 20 bp, mouse
gcctccgtaagtatacttac

SEQ ID NO: 436200 - DNA, 20 bp, mouse
gggagaggaggcaccccctg

SEQ ID NO: 436201 - DNA, 20 bp, mouse
ggctgttgcctggggtaacg

SEQ ID NO: 436202 - DNA, 20 bp, mouse
ggcacctgtaagtatactta

SEQ ID NO: 436203 - DNA, 20 bp, mouse
ggttctaggtaagcgatcag

SEQ ID NO: 436204 - DNA, 20 bp, mouse
gcctggccggccctgctgta

SEQ ID NO: 436205 - DNA, 20 bp, mouse
gtttggttccccgttacccc

SEQ ID NO: 436206 - DNA, 20 bp, mouse
gtattgtagagatcaggttc

SEQ ID NO: 436207 - DNA, 20 bp, mouse
ggtccctctacccagcagta

SEQ ID NO: 436208 - DNA, 20 bp, mouse
ggtcctagcaggtggctgat

SEQ ID NO: 436209 - DNA, 20 bp, mouse
gagtgttaattatagtaggc

SEQ ID NO: 436210 - DNA, 20 bp, mouse
gatgcactgtgccatcctaa

SEQ ID NO: 436211 - DNA, 20 bp, mouse
gatcctatcagccacctgct

SEQ ID NO: 436212 - DNA, 20 bp, mouse
ggtctctcagccatactgct

SEQ ID NO: 436213 - DNA, 20 bp, mouse
gactgatttgtcctagcagg

SEQ ID NO: 436214 - DNA, 20 bp, mouse
gcaatactgcaagtggactc

SEQ ID NO: 436215 - DNA, 20 bp, mouse
gaaagctcggaaacttctcc

SEQ ID NO: 436216 - DNA, 20 bp, mouse
ggagctgagaggttaagtcc

SEQ ID NO: 436217 - DNA, 20 bp, mouse
gatggctgcggcgtcttcat

SEQ ID NO: 436218 - DNA, 20 bp, mouse
gaaggaagcggtgaggatcc

SEQ ID NO: 436219 - DNA, 20 bp, mouse
gaaggcgacgcctgggaaaa

SEQ ID NO: 436220 - DNA, 20 bp, mouse
gtgagggaaaggaagcggtg

SEQ ID NO: 436221 - DNA, 20 bp, mouse
gttcatcggattctgacagc

SEQ ID NO: 436222 - DNA, 20 bp, mouse
gtgacagcgggcgagctgag

SEQ ID NO: 436223 - DNA, 20 bp, mouse
ggagcagcggtggaagttct

SEQ ID NO: 436224 - DNA, 20 bp, mouse
ggagtctctagacatatcta

SEQ ID NO: 436225 - DNA, 20 bp, mouse
ggcaccatctattcatctga

SEQ ID NO: 436226 - DNA, 20 bp, mouse
ggcgtcccaggggtcggtga

SEQ ID NO: 436227 - DNA, 20 bp, mouse
ggagatgcgcgcctagtgga

SEQ ID NO: 436228 - DNA, 20 bp, mouse
gcccatggcgtcccaggggt

SEQ ID NO: 436229 - DNA, 20 bp, mouse
ggccgccgtcaccgacccct

SEQ ID NO: 436230 - DNA, 20 bp, mouse
gtcccaggggtcggtgacgg

SEQ ID NO: 436231 - DNA, 20 bp, mouse
gcttacccatggcgtcccag

SEQ ID NO: 436232 - DNA, 20 bp, mouse
gcgccatgggtaaggaacca

SEQ ID NO: 436233 - DNA, 20 bp, mouse
gaccgacccctgggacgcca

SEQ ID NO: 436234 - DNA, 20 bp, mouse
gaccgctgcgtggggcccga

SEQ ID NO: 436235 - DNA, 20 bp, mouse
gaggtccacggcctcaggat

SEQ ID NO: 436236 - DNA, 20 bp, mouse
gggagggtcgtggaccctag

SEQ ID NO: 436237 - DNA, 20 bp, mouse
ggatccgcgcgtggtgagga

SEQ ID NO: 436238 - DNA, 20 bp, mouse
gtggagcccgagaggtgggt

SEQ ID NO: 436239 - DNA, 20 bp, mouse
ggcgctcaagcaggcgggac

SEQ ID NO: 436240 - DNA, 20 bp, mouse
gtgcagatccgcgcgtggtg

SEQ ID NO: 436241 - DNA, 20 bp, mouse
gcgcgtggtgaggagggtcg

SEQ ID NO: 436242 - DNA, 20 bp, mouse
ggccagcctgggaccgagga

SEQ ID NO: 436243 - DNA, 20 bp, mouse
gggtcgtggaccctaggggc

SEQ ID NO: 436244 - DNA, 20 bp, mouse
gcggcggcatggagcccgag

SEQ ID NO: 436245 - DNA, 20 bp, mouse
gctgggaccgaggacggcgt

SEQ ID NO: 436246 - DNA, 20 bp, mouse
gccctatggccaccatgcgg

SEQ ID NO: 436247 - DNA, 20 bp, mouse
ggcatgatggcgccagctag

SEQ ID NO: 436248 - DNA, 20 bp, mouse
ggcgccctatggccaccatg

SEQ ID NO: 436249 - DNA, 20 bp, mouse
ggtcccgtcgtagcgcccta

SEQ ID NO: 436250 - DNA, 20 bp, mouse
gggccatagggcgctacgac

SEQ ID NO: 436251 - DNA, 20 bp, mouse
ggctccagtcccatcaaagt

SEQ ID NO: 436252 - DNA, 20 bp, mouse
ggaatcctggaggcaagcag

SEQ ID NO: 436253 - DNA, 20 bp, mouse
gtacagtggaggaagcgggt

SEQ ID NO: 436254 - DNA, 20 bp, mouse
gaccttgcccgcttgggtgg

SEQ ID NO: 436255 - DNA, 20 bp, mouse
gaccggttgccaggcaatgc

SEQ ID NO: 436256 - DNA, 20 bp, mouse
gtaagcggggagattctcgg

SEQ ID NO: 436257 - DNA, 20 bp, mouse
gtggtaagcggggagattct

SEQ ID NO: 436258 - DNA, 20 bp, mouse
ggagattctcggaggcttag

SEQ ID NO: 436259 - DNA, 20 bp, mouse
ggatggctgaagtgaagctt

SEQ ID NO: 436260 - DNA, 20 bp, mouse
ggctgaagtgaagcttggga

SEQ ID NO: 436261 - DNA, 20 bp, mouse
gccggtcgcgaagcggtggg

SEQ ID NO: 436262 - DNA, 20 bp, mouse
gcttccggtcgcgaagcggt

SEQ ID NO: 436263 - DNA, 20 bp, mouse
ggccacgacgctccgccctg

SEQ ID NO: 436264 - DNA, 20 bp, mouse
gtggtcgcccgggaaacggt

SEQ ID NO: 436265 - DNA, 20 bp, mouse
ggcctcagggcggagcgtcg

SEQ ID NO: 436266 - DNA, 20 bp, mouse
ggcacagacatggtgaccga

SEQ ID NO: 436267 - DNA, 20 bp, mouse
gatccacagtggctgctcgg

SEQ ID NO: 436268 - DNA, 20 bp, mouse
gtcgccgatgaaatccacag

SEQ ID NO: 436269 - DNA, 20 bp, mouse
gaacacgtccagcacagaca

SEQ ID NO: 436270 - DNA, 20 bp, mouse
gcgccgccgagcagccactg

SEQ ID NO: 436271 - DNA, 20 bp, mouse
gggagggtcacagccttgat

SEQ ID NO: 436272 - DNA, 20 bp, mouse
ggcagggccgaagaccgcag

SEQ ID NO: 436273 - DNA, 20 bp, mouse
gtctgtgctggacgtgttgt

SEQ ID NO: 436274 - DNA, 20 bp, mouse
gtttcatcggcgagctccct

SEQ ID NO: 436275 - DNA, 20 bp, mouse
ggtgctggacgtgttgtggg

SEQ ID NO: 436276 - DNA, 20 bp, mouse
gctagtggtgggctctccga

SEQ ID NO: 436277 - DNA, 20 bp, mouse
gcgctgtggaagccttccct

SEQ ID NO: 436278 - DNA, 20 bp, mouse
gggccggctcgtcagtctag

SEQ ID NO: 436279 - DNA, 20 bp, mouse
gtggtgggctctccgaggga

SEQ ID NO: 436280 - DNA, 20 bp, mouse
gcggctcgtcagtctagtgg

SEQ ID NO: 436281 - DNA, 20 bp, mouse
ggacgagccggcctgcgtca

SEQ ID NO: 436282 - DNA, 20 bp, mouse
gccatggcggccgcacggag

SEQ ID NO: 436283 - DNA, 20 bp, mouse
gcggtcgagaccactgggag

SEQ ID NO: 436284 - DNA, 20 bp, mouse
gcccagtgggagtgacaggg

SEQ ID NO: 436285 - DNA, 20 bp, mouse
gtggcggccgcacggagagg

SEQ ID NO: 436286 - DNA, 20 bp, mouse
ggattcaggctggagtgggg

SEQ ID NO: 436287 - DNA, 20 bp, mouse
gaccagggagactgtaagag

SEQ ID NO: 436288 - DNA, 20 bp, mouse
gagcaacacaagctccgcgg

SEQ ID NO: 436289 - DNA, 20 bp, mouse
gtatgacaacagggcgaagg

SEQ ID NO: 436290 - DNA, 20 bp, mouse
gcaacagggcgaaggcggtt

SEQ ID NO: 436291 - DNA, 20 bp, mouse
gagagggtgcaggggatctt

SEQ ID NO: 436292 - DNA, 20 bp, mouse
gagtccggatgctcacagag

SEQ ID NO: 436293 - DNA, 20 bp, mouse
ggtaaaatgctatgacaaca

SEQ ID NO: 436294 - DNA, 20 bp, mouse
ggtggggaggtgtcttccgc

SEQ ID NO: 436295 - DNA, 20 bp, mouse
ggcgaaggcggtttggattc

SEQ ID NO: 436296 - DNA, 20 bp, mouse
ggcagtgtacagtggagcgg

SEQ ID NO: 436297 - DNA, 20 bp, mouse
ggccctcagcggccagtcag

SEQ ID NO: 436298 - DNA, 20 bp, mouse
gccagtcaggggctctctat

SEQ ID NO: 436299 - DNA, 20 bp, mouse
gtctctatgggaaagtggag

SEQ ID NO: 436300 - DNA, 20 bp, mouse
gcagtggagcggaggcagcg

SEQ ID NO: 436301 - DNA, 20 bp, mouse
gctcctgccgcggagtcctc

SEQ ID NO: 436302 - DNA, 20 bp, mouse
gcggcggctcgcaagtgagt

SEQ ID NO: 436303 - DNA, 20 bp, mouse
ggcggcggcggcagccggta

SEQ ID NO: 436304 - DNA, 20 bp, mouse
gggggctctctatgggaaag

SEQ ID NO: 436305 - DNA, 20 bp, mouse
ggtgtgtggctcgccctcag

SEQ ID NO: 436306 - DNA, 20 bp, mouse
ggagtagcccgacagcagga

SEQ ID NO: 436307 - DNA, 20 bp, mouse
ggccgccactgcagggaaca

SEQ ID NO: 436308 - DNA, 20 bp, mouse
gtccatgttccctgcagtgg

SEQ ID NO: 436309 - DNA, 20 bp, mouse
gagccctgcgcgggcgtcag

SEQ ID NO: 436310 - DNA, 20 bp, mouse
gagtcactgccgccactgca

SEQ ID NO: 436311 - DNA, 20 bp, mouse
gccccagggatcacaatcta

SEQ ID NO: 436312 - DNA, 20 bp, mouse
ggcggcggagagcctcgccc

SEQ ID NO: 436313 - DNA, 20 bp, mouse
gagccacagcagccctgcgc

SEQ ID NO: 436314 - DNA, 20 bp, mouse
gatctagggattccccagta

SEQ ID NO: 436315 - DNA, 20 bp, mouse
gcagtgactgagcccgggcg

SEQ ID NO: 436316 - DNA, 20 bp, mouse
ggcagccgcagccgagactg

SEQ ID NO: 436317 - DNA, 20 bp, mouse
gtgcgccgcagtctcggctg

SEQ ID NO: 436318 - DNA, 20 bp, mouse
gacgtgcggtgtgcgcggag

SEQ ID NO: 436319 - DNA, 20 bp, mouse
ggaccccaggaagctacggt

SEQ ID NO: 436320 - DNA, 20 bp, mouse
gggcgcgcgggacccagaca

SEQ ID NO: 436321 - DNA, 20 bp, mouse
gggacctcgcaaggtgagtg

SEQ ID NO: 436322 - DNA, 20 bp, mouse
gcccggaacccgcacagaga

SEQ ID NO: 436323 - DNA, 20 bp, mouse
gagcaagcaagcgaccgata

SEQ ID NO: 436324 - DNA, 20 bp, mouse
gcaggagccaggggacgtct

SEQ ID NO: 436325 - DNA, 20 bp, mouse
ggcgcggaggggacctcgca

SEQ ID NO: 436326 - DNA, 20 bp, mouse
ggggcacgcggagcgatcgg

SEQ ID NO: 436327 - DNA, 20 bp, mouse
gggcgggtaagcctgacggg

SEQ ID NO: 436328 - DNA, 20 bp, mouse
gccggacgcgaggtcagcag

SEQ ID NO: 436329 - DNA, 20 bp, mouse
gggcggcgggtaagcctgac

SEQ ID NO: 436330 - DNA, 20 bp, mouse
ggcggggcacgcggagcgat

SEQ ID NO: 436331 - DNA, 20 bp, mouse
gacgtgcgcgcgcaggcggg

SEQ ID NO: 436332 - DNA, 20 bp, mouse
gcacgcggagcgatcggcgg

SEQ ID NO: 436333 - DNA, 20 bp, mouse
gccggagttaggcgaactcc

SEQ ID NO: 436334 - DNA, 20 bp, mouse
gacgatgacaatccaatggg

SEQ ID NO: 436335 - DNA, 20 bp, mouse
gggcccggctgaggtcacac

SEQ ID NO: 436336 - DNA, 20 bp, mouse
gtgcggtggggcgtgcgagt

SEQ ID NO: 436337 - DNA, 20 bp, mouse
ggagtttggtagttgcggtg

SEQ ID NO: 436338 - DNA, 20 bp, mouse
gtaggtggagcgggactcta

SEQ ID NO: 436339 - DNA, 20 bp, mouse
gcgaggagctgggcctacct

SEQ ID NO: 436340 - DNA, 20 bp, mouse
gcggagtttagggcaggatc

SEQ ID NO: 436341 - DNA, 20 bp, mouse
gccctcatgaagggactggg

SEQ ID NO: 436342 - DNA, 20 bp, mouse
gctaggggacgcgaggacag

SEQ ID NO: 436343 - DNA, 20 bp, mouse
gggtgagagtttggtagttg

SEQ ID NO: 436344 - DNA, 20 bp, mouse
gggctgaagctcggtaagct

SEQ ID NO: 436345 - DNA, 20 bp, mouse
gtaagctgggtccgcatgca

SEQ ID NO: 436346 - DNA, 20 bp, mouse
gaaagcagccggcaggacag

SEQ ID NO: 436347 - DNA, 20 bp, mouse
ggagcggccggactgtccgg

SEQ ID NO: 436348 - DNA, 20 bp, mouse
gcgcaggcctgggccatcgg

SEQ ID NO: 436349 - DNA, 20 bp, mouse
ggaacgccgggaccccgcgc

SEQ ID NO: 436350 - DNA, 20 bp, mouse
ggcaggacagcggagaacgc

SEQ ID NO: 436351 - DNA, 20 bp, mouse
gccccggagccctgcagcag

SEQ ID NO: 436352 - DNA, 20 bp, mouse
ggtctgagaagccggctctg

SEQ ID NO: 436353 - DNA, 20 bp, mouse
ggggctagctcgggctcggt

SEQ ID NO: 436354 - DNA, 20 bp, mouse
gagtcccagaggctctcaag

SEQ ID NO: 436355 - DNA, 20 bp, mouse
gccgggcccactagtcccag

SEQ ID NO: 436356 - DNA, 20 bp, mouse
gtgaggcgcgggcggtacgc

SEQ ID NO: 436357 - DNA, 20 bp, mouse
gctgagacgtgaggcgcggg

SEQ ID NO: 436358 - DNA, 20 bp, mouse
gcgggcggagcgaagtggac

SEQ ID NO: 436359 - DNA, 20 bp, mouse
gtgggctgcggggactcgaa

SEQ ID NO: 436360 - DNA, 20 bp, mouse
gtgaagtacctggtgagtgt

SEQ ID NO: 436361 - DNA, 20 bp, mouse
gcggctgagacgtgaggcgc

SEQ ID NO: 436362 - DNA, 20 bp, mouse
gcgaaaggcggaccgaggga

SEQ ID NO: 436363 - DNA, 20 bp, mouse
gcatggtgctccccggccag

SEQ ID NO: 436364 - DNA, 20 bp, mouse
ggggagcaccatgaagtacc

SEQ ID NO: 436365 - DNA, 20 bp, mouse
gggcagcgcggcctctggcc

SEQ ID NO: 436366 - DNA, 20 bp, mouse
ggccaggcagcagccggagc

SEQ ID NO: 436367 - DNA, 20 bp, mouse
gagtccgaccgagggagctc

SEQ ID NO: 436368 - DNA, 20 bp, mouse
gaggctgaacaggaacgcac

SEQ ID NO: 436369 - DNA, 20 bp, mouse
gcggctgctgcctggccggg

SEQ ID NO: 436370 - DNA, 20 bp, mouse
gccgaccgagggagctcagg

SEQ ID NO: 436371 - DNA, 20 bp, mouse
gggcggaggagagccagacg

SEQ ID NO: 436372 - DNA, 20 bp, mouse
gtccgagagcagctgcggtg

SEQ ID NO: 436373 - DNA, 20 bp, mouse
gaagaggctggtgcggctgg

SEQ ID NO: 436374 - DNA, 20 bp, mouse
gtccgcgggcgtccgccaag

SEQ ID NO: 436375 - DNA, 20 bp, mouse
gcgggcgtccgccaagaggc

SEQ ID NO: 436376 - DNA, 20 bp, mouse
gctccctgccaccggcccat

SEQ ID NO: 436377 - DNA, 20 bp, mouse
ggaagccccggcccaggaca

SEQ ID NO: 436378 - DNA, 20 bp, mouse
ggagtcccaggcagaagccc

SEQ ID NO: 436379 - DNA, 20 bp, mouse
gaggtggtgagggtgccaat

SEQ ID NO: 436380 - DNA, 20 bp, mouse
gctgcctacgcggaatgtag

SEQ ID NO: 436381 - DNA, 20 bp, mouse
gcaggcagaagccccggccc

SEQ ID NO: 436382 - DNA, 20 bp, mouse
gaaatccttgtcctgggccg

SEQ ID NO: 436383 - DNA, 20 bp, mouse
gaagccgaaatccttgtcct

SEQ ID NO: 436384 - DNA, 20 bp, mouse
gagaggctcctgccgtgcca

SEQ ID NO: 436385 - DNA, 20 bp, mouse
gtgccaatgggccggtggca

SEQ ID NO: 436386 - DNA, 20 bp, mouse
gctgcagctagtctgagact

SEQ ID NO: 436387 - DNA, 20 bp, mouse
gcagggtcctgcgtcttcag

SEQ ID NO: 436388 - DNA, 20 bp, mouse
gcaactgttggaaactgtgg

SEQ ID NO: 436389 - DNA, 20 bp, mouse
gaagtcggtgggagtatctt

SEQ ID NO: 436390 - DNA, 20 bp, mouse
gagcagtggagggtcatcac

SEQ ID NO: 436391 - DNA, 20 bp, mouse
gcagttacctggtaagtcgg

SEQ ID NO: 436392 - DNA, 20 bp, mouse
gcagcaaccgctgaagacgc

SEQ ID NO: 436393 - DNA, 20 bp, mouse
gaaggacccgaggagacagg

SEQ ID NO: 436394 - DNA, 20 bp, mouse
gaggcagttacctggtaagt

SEQ ID NO: 436395 - DNA, 20 bp, mouse
gcaacagttggttctgctca

SEQ ID NO: 436396 - DNA, 20 bp, mouse
gggcttggtagccggagagg

SEQ ID NO: 436397 - DNA, 20 bp, mouse
ggcccgtgcccgccatcgcg

SEQ ID NO: 436398 - DNA, 20 bp, mouse
gcctagtgccgcgcgatggc

SEQ ID NO: 436399 - DNA, 20 bp, mouse
ggaggctgcgcagactcaga

SEQ ID NO: 436400 - DNA, 20 bp, mouse
gttggtagccggagaggtgg

SEQ ID NO: 436401 - DNA, 20 bp, mouse
gcatagccttggtcaaaata

SEQ ID NO: 436402 - DNA, 20 bp, mouse
ggaagcctagtgccgcgcga

SEQ ID NO: 436403 - DNA, 20 bp, mouse
gagctcaggtagttcttggt

SEQ ID NO: 436404 - DNA, 20 bp, mouse
gcgcagtggaattagaaccg

SEQ ID NO: 436405 - DNA, 20 bp, mouse
gtaagaacgagaacaggcca

SEQ ID NO: 436406 - DNA, 20 bp, mouse
ggacccgccagccctctcac

SEQ ID NO: 436407 - DNA, 20 bp, mouse
ggagcggccggtgagagggc

SEQ ID NO: 436408 - DNA, 20 bp, mouse
gggcggagcggccggtgaga

SEQ ID NO: 436409 - DNA, 20 bp, mouse
gggagaacagcgtttaccgg

SEQ ID NO: 436410 - DNA, 20 bp, mouse
ggctggagaacagcgtttac

SEQ ID NO: 436411 - DNA, 20 bp, mouse
gacagcgtttaccggcggag

SEQ ID NO: 436412 - DNA, 20 bp, mouse
gcgggtctttggcttagggg

SEQ ID NO: 436413 - DNA, 20 bp, mouse
gctttggcttaggggaggtt

SEQ ID NO: 436414 - DNA, 20 bp, mouse
ggtccagctacccctttctt

SEQ ID NO: 436415 - DNA, 20 bp, mouse
gtgctagccgtcaatcacga

SEQ ID NO: 436416 - DNA, 20 bp, mouse
gcagcaagcacccggcgcag

SEQ ID NO: 436417 - DNA, 20 bp, mouse
gcgggtgaaagaggtacgat

SEQ ID NO: 436418 - DNA, 20 bp, mouse
gagagccaccagcaagcacc

SEQ ID NO: 436419 - DNA, 20 bp, mouse
gttggcgtggcgggtgaaag

SEQ ID NO: 436420 - DNA, 20 bp, mouse
gctgcgtggcgaaaggcgag

SEQ ID NO: 436421 - DNA, 20 bp, mouse
gtcgccacgcaggtacctgg

SEQ ID NO: 436422 - DNA, 20 bp, mouse
gcccgcggggactcactcgg

SEQ ID NO: 436423 - DNA, 20 bp, mouse
gacagcccgggactgcagtt

SEQ ID NO: 436424 - DNA, 20 bp, mouse
gactgcacgcacccgcaacg

SEQ ID NO: 436425 - DNA, 20 bp, mouse
ggcgggagcgtgggaatacg

SEQ ID NO: 436426 - DNA, 20 bp, mouse
ggcacagccgcctcctccag

SEQ ID NO: 436427 - DNA, 20 bp, mouse
ggcggctgtgcagtgacacg

SEQ ID NO: 436428 - DNA, 20 bp, mouse
ggacacgtggcgctcagggt

SEQ ID NO: 436429 - DNA, 20 bp, mouse
gaaatgtgagtctcctctgg

SEQ ID NO: 436430 - DNA, 20 bp, mouse
gtgcaaatgtgagtctcctc

SEQ ID NO: 436431 - DNA, 20 bp, mouse
gcgtggcgctcagggtcggt

SEQ ID NO: 436432 - DNA, 20 bp, mouse
gtcccgcctagggagcatgt

SEQ ID NO: 436433 - DNA, 20 bp, mouse
gggtcgtggctccggctcct

SEQ ID NO: 436434 - DNA, 20 bp, mouse
gcagtgacacgtggcgctca

SEQ ID NO: 436435 - DNA, 20 bp, mouse
gaccaggacaagaaccggag

SEQ ID NO: 436436 - DNA, 20 bp, mouse
ggctgcagccacactaggac

SEQ ID NO: 436437 - DNA, 20 bp, mouse
gagccgcacacaccggatca

SEQ ID NO: 436438 - DNA, 20 bp, mouse
gactaggacaggtgggtgcg

SEQ ID NO: 436439 - DNA, 20 bp, mouse
gaacgggcgggcggcagaat

SEQ ID NO: 436440 - DNA, 20 bp, mouse
gccccttgggaagaaagacg

SEQ ID NO: 436441 - DNA, 20 bp, mouse
gcgtggccggccggcgctgg

SEQ ID NO: 436442 - DNA, 20 bp, mouse
gagcggaacccgaggcacag

SEQ ID NO: 436443 - DNA, 20 bp, mouse
gagccatgatccggtgtgtg

SEQ ID NO: 436444 - DNA, 20 bp, mouse
gtgctgggcagcggaacccg

SEQ ID NO: 436445 - DNA, 20 bp, mouse
gcccccagagcccccagcgc

SEQ ID NO: 436446 - DNA, 20 bp, mouse
gaccggcgacatggcatcta

SEQ ID NO: 436447 - DNA, 20 bp, mouse
gtctaaggctaagaagcgag

SEQ ID NO: 436448 - DNA, 20 bp, mouse
gcgcagtgtgaccggcgaca

SEQ ID NO: 436449 - DNA, 20 bp, mouse
gaggctaagaagcgagcggt

SEQ ID NO: 436450 - DNA, 20 bp, mouse
gagcctggctgtgtagaagg

SEQ ID NO: 436451 - DNA, 20 bp, mouse
gtcctcctcccgctggcccg

SEQ ID NO: 436452 - DNA, 20 bp, mouse
gaagcccgcagtgggaacct

SEQ ID NO: 436453 - DNA, 20 bp, mouse
gaaggtggagagcggctgta

SEQ ID NO: 436454 - DNA, 20 bp, mouse
gcgcgcaggcgcagtgtgac

SEQ ID NO: 436455 - DNA, 20 bp, mouse
ggaacgtaatgggagatgtg

SEQ ID NO: 436456 - DNA, 20 bp, mouse
gacgggacattgtcaagagg

SEQ ID NO: 436457 - DNA, 20 bp, mouse
ggtggaggaagagcatccgg

SEQ ID NO: 436458 - DNA, 20 bp, mouse
gaccgagggacagagcgtga

SEQ ID NO: 436459 - DNA, 20 bp, mouse
ggagcgtgatggccgcagac

SEQ ID NO: 436460 - DNA, 20 bp, mouse
gccggttccgccccaaccga

SEQ ID NO: 436461 - DNA, 20 bp, mouse
ggctgccgaagaagctccgg

SEQ ID NO: 436462 - DNA, 20 bp, mouse
gtcccgagggtcccgagaag

SEQ ID NO: 436463 - DNA, 20 bp, mouse
gtcaagagggggcgttggag

SEQ ID NO: 436464 - DNA, 20 bp, mouse
gcgagaagaggccgatccta

SEQ ID NO: 436465 - DNA, 20 bp, mouse
ggccatcacgctctgtccct

SEQ ID NO: 436466 - DNA, 20 bp, mouse
gtcagagtcctgcaattcac

SEQ ID NO: 436467 - DNA, 20 bp, mouse
gtgtcagggactagtcccaa

SEQ ID NO: 436468 - DNA, 20 bp, mouse
ggcgagaagccactacctcg

SEQ ID NO: 436469 - DNA, 20 bp, mouse
ggtcctgcaattcacaggca

SEQ ID NO: 436470 - DNA, 20 bp, mouse
gattactgcagcaaaggatg

SEQ ID NO: 436471 - DNA, 20 bp, mouse
gcaatgctttggggacgcgc

SEQ ID NO: 436472 - DNA, 20 bp, mouse
ggtgtttgtggtgctccctt

SEQ ID NO: 436473 - DNA, 20 bp, mouse
gtcctgaagcctgcctgcaa

SEQ ID NO: 436474 - DNA, 20 bp, mouse
gctgtcctgttcccttgtca

SEQ ID NO: 436475 - DNA, 20 bp, mouse
gtggcaatcttgcaatgctt

SEQ ID NO: 436476 - DNA, 20 bp, mouse
gagcagcctggcgcaggcca

SEQ ID NO: 436477 - DNA, 20 bp, mouse
ggtctgcggccaagatctgg

SEQ ID NO: 436478 - DNA, 20 bp, mouse
ggatgtctgcggccaagatc

SEQ ID NO: 436479 - DNA, 20 bp, mouse
gagatctggaggccgagccg

SEQ ID NO: 436480 - DNA, 20 bp, mouse
ggtctatcctgtgagaaagg

SEQ ID NO: 436481 - DNA, 20 bp, mouse
gctcctgttgggacgatctg

SEQ ID NO: 436482 - DNA, 20 bp, mouse
gcctggcgcaggccacggct

SEQ ID NO: 436483 - DNA, 20 bp, mouse
ggacatcactatcgccatct

SEQ ID NO: 436484 - DNA, 20 bp, mouse
ggagacaccgcgggctgtga

SEQ ID NO: 436485 - DNA, 20 bp, mouse
gaaccccagatcgtcccaac

SEQ ID NO: 436486 - DNA, 20 bp, mouse
gctgcggtgcctgagaactg

SEQ ID NO: 436487 - DNA, 20 bp, mouse
gtgagaactggggatggcgg

SEQ ID NO: 436488 - DNA, 20 bp, mouse
gcccacgctgccggcaggga

SEQ ID NO: 436489 - DNA, 20 bp, mouse
gacccagagtccctgcagta

SEQ ID NO: 436490 - DNA, 20 bp, mouse
gcgaggacacggcccagaag

SEQ ID NO: 436491 - DNA, 20 bp, mouse
gaccatactgcagggactct

SEQ ID NO: 436492 - DNA, 20 bp, mouse
gaccctcaggccctagcaga

SEQ ID NO: 436493 - DNA, 20 bp, mouse
gctgaagggaagaatcacca

SEQ ID NO: 436494 - DNA, 20 bp, mouse
ggagggaggagctaagacgc

SEQ ID NO: 436495 - DNA, 20 bp, mouse
gaaggcttcctgcaacccgg

SEQ ID NO: 436496 - DNA, 20 bp, mouse
gtaagtgacccagcagaggg

SEQ ID NO: 436497 - DNA, 20 bp, mouse
gctgctgggtcacttagtct

SEQ ID NO: 436498 - DNA, 20 bp, mouse
gttaccgcgaggccagacgc

SEQ ID NO: 436499 - DNA, 20 bp, mouse
gccgggttcgagcggaaccg

SEQ ID NO: 436500 - DNA, 20 bp, mouse
gtatagcacccgacaggcaa

SEQ ID NO: 436501 - DNA, 20 bp, mouse
gagcgggtcgactgctcccg

SEQ ID NO: 436502 - DNA, 20 bp, mouse
gagaggggggagctccagtg

SEQ ID NO: 436503 - DNA, 20 bp, mouse
gcagccggggagggcgaagg

SEQ ID NO: 436504 - DNA, 20 bp, mouse
gagctccagtggggaactct

SEQ ID NO: 436505 - DNA, 20 bp, mouse
ggcaatggtgaccccaaagt

SEQ ID NO: 436506 - DNA, 20 bp, mouse
gatcaggctgtgacttcggg

SEQ ID NO: 436507 - DNA, 20 bp, mouse
ggccaccccgcccagactaa

SEQ ID NO: 436508 - DNA, 20 bp, mouse
gggactaggaacagaagcgg

SEQ ID NO: 436509 - DNA, 20 bp, mouse
gggccggctcacggacgagg

SEQ ID NO: 436510 - DNA, 20 bp, mouse
gcggctcacggacgaggagg

SEQ ID NO: 436511 - DNA, 20 bp, mouse
gaggcccgagcccttagtct

SEQ ID NO: 436512 - DNA, 20 bp, mouse
gaggaacagaagcgggggaa

SEQ ID NO: 436513 - DNA, 20 bp, mouse
gacagaagcgggggaacggc

SEQ ID NO: 436514 - DNA, 20 bp, mouse
ggctcccgcaccgtccctca

SEQ ID NO: 436515 - DNA, 20 bp, mouse
gaacggccggctcacggacg

SEQ ID NO: 436516 - DNA, 20 bp, mouse
gtgagctgcaagttcaagtg

SEQ ID NO: 436517 - DNA, 20 bp, mouse
gcttgaacttgcagctcagg

SEQ ID NO: 436518 - DNA, 20 bp, mouse
gcctgacgttcaagttcgca

SEQ ID NO: 436519 - DNA, 20 bp, mouse
ggcttgcggcgagacatggt

SEQ ID NO: 436520 - DNA, 20 bp, mouse
ggagagccgggttagaaaga

SEQ ID NO: 436521 - DNA, 20 bp, mouse
gaattgtgggagagccgtca

SEQ ID NO: 436522 - DNA, 20 bp, mouse
gacgacggctcggttcacat

SEQ ID NO: 436523 - DNA, 20 bp, mouse
gaacttgaacgtcaggagtc

SEQ ID NO: 436524 - DNA, 20 bp, mouse
ggcgcagggaagatgaattg

SEQ ID NO: 436525 - DNA, 20 bp, mouse
gggcggcggcgtgcggacga

SEQ ID NO: 436526 - DNA, 20 bp, mouse
gaggtaccggcgggaaggaa

SEQ ID NO: 436527 - DNA, 20 bp, mouse
ggccggatacagagcagacg

SEQ ID NO: 436528 - DNA, 20 bp, mouse
gttacagcccggccaggtac

SEQ ID NO: 436529 - DNA, 20 bp, mouse
gttcccgccggtacctggcc

SEQ ID NO: 436530 - DNA, 20 bp, mouse
gcagcccggccaggtaccgg

SEQ ID NO: 436531 - DNA, 20 bp, mouse
gacggtgtgaagttacagcc

SEQ ID NO: 436532 - DNA, 20 bp, mouse
ggtcccagaagagacccaag

SEQ ID NO: 436533 - DNA, 20 bp, mouse
ggacactggactaggagact

SEQ ID NO: 436534 - DNA, 20 bp, mouse
gccggggaggacactggact

SEQ ID NO: 436535 - DNA, 20 bp, mouse
ggctgtcccggggaggacac

SEQ ID NO: 436536 - DNA, 20 bp, mouse
gcgagagctcccggagaacc

SEQ ID NO: 436537 - DNA, 20 bp, mouse
gggagctctcggtctctctg

SEQ ID NO: 436538 - DNA, 20 bp, mouse
ggattgcaacgtgaagatgg

SEQ ID NO: 436539 - DNA, 20 bp, mouse
gcagtgcgcccgggtcggtg

SEQ ID NO: 436540 - DNA, 20 bp, mouse
gcccagaaagagccgaacca

SEQ ID NO: 436541 - DNA, 20 bp, mouse
gaggctggcgccggccggag

SEQ ID NO: 436542 - DNA, 20 bp, mouse
gagtcccccagagcctcgga

SEQ ID NO: 436543 - DNA, 20 bp, mouse
ggcagaggcaccaacccggg

SEQ ID NO: 436544 - DNA, 20 bp, mouse
ggacccctccgaggctctgg

SEQ ID NO: 436545 - DNA, 20 bp, mouse
gggtcggtgcgggcgtggac

SEQ ID NO: 436546 - DNA, 20 bp, mouse
gctgcggctggggagggcct

SEQ ID NO: 436547 - DNA, 20 bp, mouse
ggccgccgccgccaacaccg

SEQ ID NO: 436548 - DNA, 20 bp, mouse
gcgccgcgcagcccgttcca

SEQ ID NO: 436549 - DNA, 20 bp, mouse
ggcgcggcgcaagcacgagg

SEQ ID NO: 436550 - DNA, 20 bp, mouse
gggcctgggcacctcggtgt

SEQ ID NO: 436551 - DNA, 20 bp, mouse
gtgacggctgcggctgggga

SEQ ID NO: 436552 - DNA, 20 bp, mouse
ggcagcccgttccacggtga

SEQ ID NO: 436553 - DNA, 20 bp, mouse
gccagccgcagccgtcaccg

SEQ ID NO: 436554 - DNA, 20 bp, mouse
gggcacctcggtgttggcgg

SEQ ID NO: 436555 - DNA, 20 bp, mouse
gcgcagccgtcaccgtggaa

SEQ ID NO: 436556 - DNA, 20 bp, mouse
ggcctccttggcctctaggt

SEQ ID NO: 436557 - DNA, 20 bp, mouse
ggcccacctagaggccaagg

SEQ ID NO: 436558 - DNA, 20 bp, mouse
gaagatggcatcattaactg

SEQ ID NO: 436559 - DNA, 20 bp, mouse
gcacaggagaatggatacgg

SEQ ID NO: 436560 - DNA, 20 bp, mouse
gatacggcggaatggaggtt

SEQ ID NO: 436561 - DNA, 20 bp, mouse
gaatggatacggcggaatgg

SEQ ID NO: 436562 - DNA, 20 bp, mouse
gctcttgcggaagttttttg

SEQ ID NO: 436563 - DNA, 20 bp, mouse
ggagaatggatacggcggaa

SEQ ID NO: 436564 - DNA, 20 bp, mouse
ggcactctgcatgctttgct

SEQ ID NO: 436565 - DNA, 20 bp, mouse
gtttttttctagtgaagaat

SEQ ID NO: 436566 - DNA, 20 bp, mouse
ggtcatccaagtatgacttt

SEQ ID NO: 436567 - DNA, 20 bp, mouse
ggaaaatggcatcattaatt

SEQ ID NO: 436568 - DNA, 20 bp, mouse
gtcttgtggaagtttttttg

SEQ ID NO: 436569 - DNA, 20 bp, mouse
gatatggcagaatggagact

SEQ ID NO: 436570 - DNA, 20 bp, mouse
gtctccgttcagaaggaagt

SEQ ID NO: 436571 - DNA, 20 bp, mouse
gacaaacaagtttccagttt

SEQ ID NO: 436572 - DNA, 20 bp, mouse
gtggaaaaagagtttgaaaa

SEQ ID NO: 436573 - DNA, 20 bp, mouse
gtggcatcattaattgggga

SEQ ID NO: 436574 - DNA, 20 bp, mouse
gatgaattctgccccaaaac

SEQ ID NO: 436575 - DNA, 20 bp, mouse
ggagaatggatatggcagaa

SEQ ID NO: 436576 - DNA, 20 bp, mouse
ggcctccttggcctctaggt

SEQ ID NO: 436577 - DNA, 20 bp, mouse
gcgtactcagacatcttccc

SEQ ID NO: 436578 - DNA, 20 bp, mouse
ggcccacctagaggccaagg

SEQ ID NO: 436579 - DNA, 20 bp, mouse
gaagatggcatcattaactg

SEQ ID NO: 436580 - DNA, 20 bp, mouse
gcacaggagaatggatacgg

SEQ ID NO: 436581 - DNA, 20 bp, mouse
gatacggcggaatggaggtt

SEQ ID NO: 436582 - DNA, 20 bp, mouse
gaatggatacggcggaatgg

SEQ ID NO: 436583 - DNA, 20 bp, mouse
ggagaatggatacggcggaa

SEQ ID NO: 436584 - DNA, 20 bp, mouse
gctcttgtggaagttttttg

SEQ ID NO: 436585 - DNA, 20 bp, mouse
gtttttttctagtgaagaat

SEQ ID NO: 436586 - DNA, 20 bp, mouse
gagcaagcaggtacaacccc

SEQ ID NO: 436587 - DNA, 20 bp, mouse
gagcaggtacaacccccgga

SEQ ID NO: 436588 - DNA, 20 bp, mouse
ggatacaaaagaccttccgg

SEQ ID NO: 436589 - DNA, 20 bp, mouse
ggtatcataggtcggggagg

SEQ ID NO: 436590 - DNA, 20 bp, mouse
gatctccggcgacagcaagc

SEQ ID NO: 436591 - DNA, 20 bp, mouse
gtttgtatcataggtcgggg

SEQ ID NO: 436592 - DNA, 20 bp, mouse
gtcttttgtatcataggtcg

SEQ ID NO: 436593 - DNA, 20 bp, mouse
gggaaggtcttttgtatcat

SEQ ID NO: 436594 - DNA, 20 bp, mouse
ggtctgagtccgggttctaa

SEQ ID NO: 436595 - DNA, 20 bp, mouse
gctacattcaaatctatctc

SEQ ID NO: 436596 - DNA, 20 bp, mouse
gtttcccctgaagagaccgg

SEQ ID NO: 436597 - DNA, 20 bp, mouse
ggttcccccggtctcttcag

SEQ ID NO: 436598 - DNA, 20 bp, mouse
ggctgccgcggcaccggaag

SEQ ID NO: 436599 - DNA, 20 bp, mouse
gcagcgcctgtcaggcacag

SEQ ID NO: 436600 - DNA, 20 bp, mouse
gctgctcgtgctgaatctcc

SEQ ID NO: 436601 - DNA, 20 bp, mouse
gctgaatctcccggagaagc

SEQ ID NO: 436602 - DNA, 20 bp, mouse
gccactgggcctatgaaggg

SEQ ID NO: 436603 - DNA, 20 bp, mouse
ggtgcgcgccagaaagggac

SEQ ID NO: 436604 - DNA, 20 bp, mouse
ggccaatccgcgggtcgagt

SEQ ID NO: 436605 - DNA, 20 bp, mouse
gggccccccacggctctctg

SEQ ID NO: 436606 - DNA, 20 bp, mouse
gactgcatgaacgcactaga

SEQ ID NO: 436607 - DNA, 20 bp, mouse
gaggccgcctcgacagacgt

SEQ ID NO: 436608 - DNA, 20 bp, mouse
ggaccgggtgcaggagccaa

SEQ ID NO: 436609 - DNA, 20 bp, mouse
ggggtgcaggagccaaagga

SEQ ID NO: 436610 - DNA, 20 bp, mouse
gctgcgagtcggccatcctt

SEQ ID NO: 436611 - DNA, 20 bp, mouse
gtgcagtgggtcctgcgagt

SEQ ID NO: 436612 - DNA, 20 bp, mouse
gccgcctcgacagacgtggg

SEQ ID NO: 436613 - DNA, 20 bp, mouse
gcacccggtccaacctcagt

SEQ ID NO: 436614 - DNA, 20 bp, mouse
ggcggtggctctggggtgtc

SEQ ID NO: 436615 - DNA, 20 bp, mouse
gggccaggagcatcaccagt

SEQ ID NO: 436616 - DNA, 20 bp, mouse
gggctgcaggaatccggtga

SEQ ID NO: 436617 - DNA, 20 bp, mouse
gaatccggtgacggcgacga

SEQ ID NO: 436618 - DNA, 20 bp, mouse
gtggaacacagctcgcagag

SEQ ID NO: 436619 - DNA, 20 bp, mouse
gggtgacggcgacgatggca

SEQ ID NO: 436620 - DNA, 20 bp, mouse
ggcctgcgccccgggagtcg

SEQ ID NO: 436621 - DNA, 20 bp, mouse
ggaggtggtgtgaatccaag

SEQ ID NO: 436622 - DNA, 20 bp, mouse
gccgcagagctccaaccagc

SEQ ID NO: 436623 - DNA, 20 bp, mouse
ggctggtgacccagtgcctg

SEQ ID NO: 436624 - DNA, 20 bp, mouse
gctttcacttcgctccccgc

SEQ ID NO: 436625 - DNA, 20 bp, mouse
ggtgtcgcacgtgcgggtgg

SEQ ID NO: 436626 - DNA, 20 bp, mouse
gaggcggaggatgatcccgg

SEQ ID NO: 436627 - DNA, 20 bp, mouse
ggcgcggcgcgcgaaacctt

SEQ ID NO: 436628 - DNA, 20 bp, mouse
gagcgtggcggagggcggac

SEQ ID NO: 436629 - DNA, 20 bp, mouse
ggctccccggcggagcgtgg

SEQ ID NO: 436630 - DNA, 20 bp, mouse
gcctccgccacgctccgccg

SEQ ID NO: 436631 - DNA, 20 bp, mouse
ggaaaccttcggctccccgg

SEQ ID NO: 436632 - DNA, 20 bp, mouse
gcctctggcccgcgctgcac

SEQ ID NO: 436633 - DNA, 20 bp, mouse
gcggaggatgatcccggcgg

SEQ ID NO: 436634 - DNA, 20 bp, mouse
gcgctccgccggggagccga

SEQ ID NO: 436635 - DNA, 20 bp, mouse
gcaacacgccgcgctcggaa

SEQ ID NO: 436636 - DNA, 20 bp, mouse
ggcgtgcaccgggagacccc

SEQ ID NO: 436637 - DNA, 20 bp, mouse
gccgtgtcggcccagtgcgc

SEQ ID NO: 436638 - DNA, 20 bp, mouse
gggagtggaactcacctggg

SEQ ID NO: 436639 - DNA, 20 bp, mouse
gttggcgctgctagctgaga

SEQ ID NO: 436640 - DNA, 20 bp, mouse
gtcgaagaccgtagagaata

SEQ ID NO: 436641 - DNA, 20 bp, mouse
ggtctcccggtgcacgccag

SEQ ID NO: 436642 - DNA, 20 bp, mouse
gagtagttccctattctcta

SEQ ID NO: 436643 - DNA, 20 bp, mouse
gttactgagtctaagaaagg

SEQ ID NO: 436644 - DNA, 20 bp, mouse
gggttgtgtccccgtcgcac

SEQ ID NO: 436645 - DNA, 20 bp, mouse
ggactgctcggtgaaaagtg

SEQ ID NO: 436646 - DNA, 20 bp, mouse
gcggggtgcaggagcgacag

SEQ ID NO: 436647 - DNA, 20 bp, mouse
gacctcaccgtccaacatgg

SEQ ID NO: 436648 - DNA, 20 bp, mouse
gggcagcaggggcttcccac

SEQ ID NO: 436649 - DNA, 20 bp, mouse
gatggcggcggcggtagatt

SEQ ID NO: 436650 - DNA, 20 bp, mouse
gccagggcgcgggagagacc

SEQ ID NO: 436651 - DNA, 20 bp, mouse
ggtgacctcaccgtccaaca

SEQ ID NO: 436652 - DNA, 20 bp, mouse
gggcggtagattaggttcgc

SEQ ID NO: 436653 - DNA, 20 bp, mouse
ggagaccaccgagctgacca

SEQ ID NO: 436654 - DNA, 20 bp, mouse
gtcaccgtccaacatggcgg

SEQ ID NO: 436655 - DNA, 20 bp, mouse
gcgggagagaccgggcctga

SEQ ID NO: 436656 - DNA, 20 bp, mouse
gctgagaggaaaccttccac

SEQ ID NO: 436657 - DNA, 20 bp, mouse
gggaaaccttccacaggtct

SEQ ID NO: 436658 - DNA, 20 bp, mouse
gacctgagaagcctgtgcct

SEQ ID NO: 436659 - DNA, 20 bp, mouse
gccctgaatgtgcaactgag

SEQ ID NO: 436660 - DNA, 20 bp, mouse
gaggtttgggaccacatctg

SEQ ID NO: 436661 - DNA, 20 bp, mouse
gcctagatgccagtcccaga

SEQ ID NO: 436662 - DNA, 20 bp, mouse
gtctctacgccctctgggac

SEQ ID NO: 436663 - DNA, 20 bp, mouse
gtctaggttgcatttaccaa

SEQ ID NO: 436664 - DNA, 20 bp, mouse
gcacatctgaggcttaagaa

SEQ ID NO: 436665 - DNA, 20 bp, mouse
gagacctgacctgaagccag

SEQ ID NO: 436666 - DNA, 20 bp, mouse
gtgccagattaggccaggag

SEQ ID NO: 436667 - DNA, 20 bp, mouse
gagacactcaggccaagagt

SEQ ID NO: 436668 - DNA, 20 bp, mouse
ggagaggccatttaactagt

SEQ ID NO: 436669 - DNA, 20 bp, mouse
ggtgccgatgttcttcatgg

SEQ ID NO: 436670 - DNA, 20 bp, mouse
ggtagggttaagctaaagtg

SEQ ID NO: 436671 - DNA, 20 bp, mouse
gggcctctcctggcctaatc

SEQ ID NO: 436672 - DNA, 20 bp, mouse
gtggtgggttttgccagatt

SEQ ID NO: 436673 - DNA, 20 bp, mouse
gcttaaccctactagttaaa

SEQ ID NO: 436674 - DNA, 20 bp, mouse
gacagtcactaagattctaa

SEQ ID NO: 436675 - DNA, 20 bp, mouse
gcagggcaaaaccctccctc

SEQ ID NO: 436676 - DNA, 20 bp, mouse
gttaggaagcaataagaggt

SEQ ID NO: 436677 - DNA, 20 bp, mouse
gagcaggaagttagagaacc

SEQ ID NO: 436678 - DNA, 20 bp, mouse
gccaattaggaagcaataag

SEQ ID NO: 436679 - DNA, 20 bp, mouse
gaggtaaggctcctaatctg

SEQ ID NO: 436680 - DNA, 20 bp, mouse
gtgaggtggtgattacaggt

SEQ ID NO: 436681 - DNA, 20 bp, mouse
ggatgaaccatgctcaggta

SEQ ID NO: 436682 - DNA, 20 bp, mouse
gttgctcctcaaaagtccga

SEQ ID NO: 436683 - DNA, 20 bp, mouse
gaactagaggaagcagactc

SEQ ID NO: 436684 - DNA, 20 bp, mouse
ggttagcagcgtgggatagt

SEQ ID NO: 436685 - DNA, 20 bp, mouse
ggtctaaaatgaaaaaccct

SEQ ID NO: 436686 - DNA, 20 bp, mouse
ggccaggttaaggaatctca

SEQ ID NO: 436687 - DNA, 20 bp, mouse
gccgcccgccagccaggtta

SEQ ID NO: 436688 - DNA, 20 bp, mouse
gtcaggccgcagccgggatc

SEQ ID NO: 436689 - DNA, 20 bp, mouse
ggcagccgggatccggaatc

SEQ ID NO: 436690 - DNA, 20 bp, mouse
gcacgggtcaggccgcagcc

SEQ ID NO: 436691 - DNA, 20 bp, mouse
gggggttggagaccagctaa

SEQ ID NO: 436692 - DNA, 20 bp, mouse
ggaatccggttgtttcctgg

SEQ ID NO: 436693 - DNA, 20 bp, mouse
gctctagccgggaggatgaa

SEQ ID NO: 436694 - DNA, 20 bp, mouse
ggaggtaggggcccagtccc

SEQ ID NO: 436695 - DNA, 20 bp, mouse
gttggagaccagctaagggt

SEQ ID NO: 436696 - DNA, 20 bp, mouse
gcggcgagctcggcacggga

SEQ ID NO: 436697 - DNA, 20 bp, mouse
gcgtgcggcgagctcggcac

SEQ ID NO: 436698 - DNA, 20 bp, mouse
gcgagctcggcacgggaagg

SEQ ID NO: 436699 - DNA, 20 bp, mouse
ggtcccttcagttcagtcgg

SEQ ID NO: 436700 - DNA, 20 bp, mouse
gcgcacgccccggcgtctcc

SEQ ID NO: 436701 - DNA, 20 bp, mouse
gacgggaaggcggtctcgcc

SEQ ID NO: 436702 - DNA, 20 bp, mouse
gccctggacgccctgcgcag

SEQ ID NO: 436703 - DNA, 20 bp, mouse
gccgagctcgccgcacgccc

SEQ ID NO: 436704 - DNA, 20 bp, mouse
gtgccgccgactgaactgaa

SEQ ID NO: 436705 - DNA, 20 bp, mouse
gtggcccccgcggggcatcg

SEQ ID NO: 436706 - DNA, 20 bp, mouse
ggaactggggttcttagaag

SEQ ID NO: 436707 - DNA, 20 bp, mouse
gctacagtgggagagacgtg

SEQ ID NO: 436708 - DNA, 20 bp, mouse
gggtgatgcaagaagtttct

SEQ ID NO: 436709 - DNA, 20 bp, mouse
gagcaacagcaataatcacc

SEQ ID NO: 436710 - DNA, 20 bp, mouse
ggagacgtggggctgatctt

SEQ ID NO: 436711 - DNA, 20 bp, mouse
gtgcaagaagtttctaggaa

SEQ ID NO: 436712 - DNA, 20 bp, mouse
ggcaataatcacctggtgtc

SEQ ID NO: 436713 - DNA, 20 bp, mouse
gcggcacagcctccccgagg

SEQ ID NO: 436714 - DNA, 20 bp, mouse
gtgatcatgagcagcggcgg

SEQ ID NO: 436715 - DNA, 20 bp, mouse
ggaaacaacaccgggcaggg

SEQ ID NO: 436716 - DNA, 20 bp, mouse
gtcttacccctgtcccgcag

SEQ ID NO: 436717 - DNA, 20 bp, mouse
ggagtcgcgtagatgggtgt

SEQ ID NO: 436718 - DNA, 20 bp, mouse
gagagaagccgcagcccctg

SEQ ID NO: 436719 - DNA, 20 bp, mouse
gcagaaatctgataccctca

SEQ ID NO: 436720 - DNA, 20 bp, mouse
gactaaccccaagccctctt

SEQ ID NO: 436721 - DNA, 20 bp, mouse
gctgcggcttctcttctcga

SEQ ID NO: 436722 - DNA, 20 bp, mouse
gcggcttctcttctcgaggg

SEQ ID NO: 436723 - DNA, 20 bp, mouse
gtggtcccccaggtaaagtc

SEQ ID NO: 436724 - DNA, 20 bp, mouse
gatctgataccctcagggtt

SEQ ID NO: 436725 - DNA, 20 bp, mouse
gacgctcgccctccaagcgg

SEQ ID NO: 436726 - DNA, 20 bp, mouse
gtccccgccagaaccatgtc

SEQ ID NO: 436727 - DNA, 20 bp, mouse
ggagtgtggcgagcaggacc

SEQ ID NO: 436728 - DNA, 20 bp, mouse
gaccggcgccaagcacacct

SEQ ID NO: 436729 - DNA, 20 bp, mouse
gtgtggcgagcaggacccgg

SEQ ID NO: 436730 - DNA, 20 bp, mouse
gcagtgcgcaagcgccgggg

SEQ ID NO: 436731 - DNA, 20 bp, mouse
gccggacccagcgcgtagag

SEQ ID NO: 436732 - DNA, 20 bp, mouse
gctgcccgacatggttctgg

SEQ ID NO: 436733 - DNA, 20 bp, mouse
ggtcggttcgagccgagacc

SEQ ID NO: 436734 - DNA, 20 bp, mouse
gagagagcgagcaggcgcct

SEQ ID NO: 436735 - DNA, 20 bp, mouse
ggtgagagagcgggcgagtg

SEQ ID NO: 436736 - DNA, 20 bp, mouse
gaccgaacggccggacatgg

SEQ ID NO: 436737 - DNA, 20 bp, mouse
gggacagtgctcccaagacg

SEQ ID NO: 436738 - DNA, 20 bp, mouse
gtgcggtggcagcgggtgga

SEQ ID NO: 436739 - DNA, 20 bp, mouse
ggaacggccggacatggcgg

SEQ ID NO: 436740 - DNA, 20 bp, mouse
gcggaccgaacggccggaca

SEQ ID NO: 436741 - DNA, 20 bp, mouse
gatacaggaacaggcaggat

SEQ ID NO: 436742 - DNA, 20 bp, mouse
ggggtggacggcgacgcgtg

SEQ ID NO: 436743 - DNA, 20 bp, mouse
gggtctcggcccggaccgaa

SEQ ID NO: 436744 - DNA, 20 bp, mouse
gtgacgtgctgcggtggcag

SEQ ID NO: 436745 - DNA, 20 bp, mouse
gcggaggggttgctgacgtg

SEQ ID NO: 436746 - DNA, 20 bp, mouse
gccccggcccgtccccggag

SEQ ID NO: 436747 - DNA, 20 bp, mouse
ggccgggacagagcccgtgg

SEQ ID NO: 436748 - DNA, 20 bp, mouse
ggcagcgggccaggaaaggg

SEQ ID NO: 436749 - DNA, 20 bp, mouse
gggtcttaggaagccaggcg

SEQ ID NO: 436750 - DNA, 20 bp, mouse
gcggccaactcccggaggga

SEQ ID NO: 436751 - DNA, 20 bp, mouse
gggggcagcgggccaggaaa

SEQ ID NO: 436752 - DNA, 20 bp, mouse
ggtccccggagcggcccggg

SEQ ID NO: 436753 - DNA, 20 bp, mouse
gccacaggccgccccgccac

SEQ ID NO: 436754 - DNA, 20 bp, mouse
ggagcacagctggtgggcgg

SEQ ID NO: 436755 - DNA, 20 bp, mouse
gcctgtggtccggcgatctc

SEQ ID NO: 436756 - DNA, 20 bp, mouse
gcactcccgcaggcacacat

SEQ ID NO: 436757 - DNA, 20 bp, mouse
ggcgcagcgtctccccccgg

SEQ ID NO: 436758 - DNA, 20 bp, mouse
gcagcgtctccccccggcgg

SEQ ID NO: 436759 - DNA, 20 bp, mouse
ggcagcgcagcgtctccccc

SEQ ID NO: 436760 - DNA, 20 bp, mouse
ggggaggcaccggcggacaa

SEQ ID NO: 436761 - DNA, 20 bp, mouse
gggcgccgtcccactcccgc

SEQ ID NO: 436762 - DNA, 20 bp, mouse
gggagctatgggagagaccg

SEQ ID NO: 436763 - DNA, 20 bp, mouse
gggaaagggggaggcaccgg

SEQ ID NO: 436764 - DNA, 20 bp, mouse
gtgagtctggaggaacctgt

SEQ ID NO: 436765 - DNA, 20 bp, mouse
gagagaccggggcatctctc

SEQ ID NO: 436766 - DNA, 20 bp, mouse
gggcagcgcaggggatcccg

SEQ ID NO: 436767 - DNA, 20 bp, mouse
ggcttattcaggctggggag

SEQ ID NO: 436768 - DNA, 20 bp, mouse
gcggagtggaggggcgagct

SEQ ID NO: 436769 - DNA, 20 bp, mouse
gagagccccgatgcttattc

SEQ ID NO: 436770 - DNA, 20 bp, mouse
gccagatcgcagcccccggg

SEQ ID NO: 436771 - DNA, 20 bp, mouse
gtgcagcggccccggatccg

SEQ ID NO: 436772 - DNA, 20 bp, mouse
ggctaggctccggcagcgca

SEQ ID NO: 436773 - DNA, 20 bp, mouse
ggggcctcggggaaagtgaa

SEQ ID NO: 436774 - DNA, 20 bp, mouse
gctgtctaggcgcttattgt

SEQ ID NO: 436775 - DNA, 20 bp, mouse
ggggctgcgatctggaccct

SEQ ID NO: 436776 - DNA, 20 bp, mouse
ggagaggaagaccatagagg

SEQ ID NO: 436777 - DNA, 20 bp, mouse
ggagccgagctagcgcgacg

SEQ ID NO: 436778 - DNA, 20 bp, mouse
gggaaggccacgccccaagt

SEQ ID NO: 436779 - DNA, 20 bp, mouse
gcgccccaagtcggaagtga

SEQ ID NO: 436780 - DNA, 20 bp, mouse
gtatggtcttcctctccttc

SEQ ID NO: 436781 - DNA, 20 bp, mouse
gggagaaagccgaggcgaca

SEQ ID NO: 436782 - DNA, 20 bp, mouse
gccgaggcgacagggcggtt

SEQ ID NO: 436783 - DNA, 20 bp, mouse
gctgacgcgtggtgacgggt

SEQ ID NO: 436784 - DNA, 20 bp, mouse
gcggcgccttccagacccga

SEQ ID NO: 436785 - DNA, 20 bp, mouse
ggtcccagccgaggccgtgg

SEQ ID NO: 436786 - DNA, 20 bp, mouse
gggaagagacggagtgtaca

SEQ ID NO: 436787 - DNA, 20 bp, mouse
gcaccggtcagcttggggaa

SEQ ID NO: 436788 - DNA, 20 bp, mouse
gcagaagcaccggtcagctt

SEQ ID NO: 436789 - DNA, 20 bp, mouse
ggggaccaaggatgatgtca

SEQ ID NO: 436790 - DNA, 20 bp, mouse
gcagttcaggccaaagtgac

SEQ ID NO: 436791 - DNA, 20 bp, mouse
gaagcctggaaacccatata

SEQ ID NO: 436792 - DNA, 20 bp, mouse
gtctccatggaaccggtgag

SEQ ID NO: 436793 - DNA, 20 bp, mouse
ggaagtctcacctgtcactt

SEQ ID NO: 436794 - DNA, 20 bp, mouse
ggagacttctgtatttagat

SEQ ID NO: 436795 - DNA, 20 bp, mouse
gacggtaactcggtgtccac

SEQ ID NO: 436796 - DNA, 20 bp, mouse
gtgccacaggaagaaccctg

SEQ ID NO: 436797 - DNA, 20 bp, mouse
gtgcaggcagcacaccacag

SEQ ID NO: 436798 - DNA, 20 bp, mouse
ggaaccctgcggtgtcaaga

SEQ ID NO: 436799 - DNA, 20 bp, mouse
gcaccgcagggttcttcctg

SEQ ID NO: 436800 - DNA, 20 bp, mouse
gttaactcagttcttaactc

SEQ ID NO: 436801 - DNA, 20 bp, mouse
gatttacttaatcaggccag

SEQ ID NO: 436802 - DNA, 20 bp, mouse
gggcgatggtacactgccac

SEQ ID NO: 436803 - DNA, 20 bp, mouse
ggtgtaccatcgcccaggta

SEQ ID NO: 436804 - DNA, 20 bp, mouse
gagaggggagtcccctacct

SEQ ID NO: 436805 - DNA, 20 bp, mouse
ggatgagtacaccaatcctg

SEQ ID NO: 436806 - DNA, 20 bp, mouse
gagctcccagcggcaaggtg

SEQ ID NO: 436807 - DNA, 20 bp, mouse
gagctgcgctccgggccgaa

SEQ ID NO: 436808 - DNA, 20 bp, mouse
ggcctgagctcccagcggca

SEQ ID NO: 436809 - DNA, 20 bp, mouse
gccccctcggccgaagagct

SEQ ID NO: 436810 - DNA, 20 bp, mouse
ggtgaggcagagctgcgctc

SEQ ID NO: 436811 - DNA, 20 bp, mouse
gttccggcgcgtctccccct

SEQ ID NO: 436812 - DNA, 20 bp, mouse
ggagcacgcgagccgccggg

SEQ ID NO: 436813 - DNA, 20 bp, mouse
ggaacggcgaccgagctctt

SEQ ID NO: 436814 - DNA, 20 bp, mouse
gtggccaagtcgtccctccg

SEQ ID NO: 436815 - DNA, 20 bp, mouse
ggaccccgagggcagcagag

SEQ ID NO: 436816 - DNA, 20 bp, mouse
gccgcggcgctgccagtgtg

SEQ ID NO: 436817 - DNA, 20 bp, mouse
ggcggcggcggtcggactct

SEQ ID NO: 436818 - DNA, 20 bp, mouse
gctaggaactgagaggaaga

SEQ ID NO: 436819 - DNA, 20 bp, mouse
gcgcggcgagcgaaagagtg

SEQ ID NO: 436820 - DNA, 20 bp, mouse
gccgggtcggctccgcaggg

SEQ ID NO: 436821 - DNA, 20 bp, mouse
ggcgggtggtggttcaaaga

SEQ ID NO: 436822 - DNA, 20 bp, mouse
gggagctgtcccgaagggag

SEQ ID NO: 436823 - DNA, 20 bp, mouse
gaagggaagaggaacggaca

SEQ ID NO: 436824 - DNA, 20 bp, mouse
gaaagccagggagtcaaaag

SEQ ID NO: 436825 - DNA, 20 bp, mouse
ggcggagccgacccgggaac

SEQ ID NO: 436826 - DNA, 20 bp, mouse
gaagcgggcgaagcgggagt

SEQ ID NO: 436827 - DNA, 20 bp, mouse
ggggcgaagcgggagtagga

SEQ ID NO: 436828 - DNA, 20 bp, mouse
ggcttcgcccgcttcccggg

SEQ ID NO: 436829 - DNA, 20 bp, mouse
gcccgagccggactcagata

SEQ ID NO: 436830 - DNA, 20 bp, mouse
gcggtgcagcgtctccacga

SEQ ID NO: 436831 - DNA, 20 bp, mouse
gctccacaccgcccgggaag

SEQ ID NO: 436832 - DNA, 20 bp, mouse
ggtgtcctccgggagcccag

SEQ ID NO: 436833 - DNA, 20 bp, mouse
gtcacctgggcagagccccc

SEQ ID NO: 436834 - DNA, 20 bp, mouse
ggctcccggaggacacgtgg

SEQ ID NO: 436835 - DNA, 20 bp, mouse
gggctctgcccaggtgaagg

SEQ ID NO: 436836 - DNA, 20 bp, mouse
ggcaggcgctccgctcgaca

SEQ ID NO: 436837 - DNA, 20 bp, mouse
ggagagctggccgtgtcgag

SEQ ID NO: 436838 - DNA, 20 bp, mouse
gggagccccgcacacaatag

SEQ ID NO: 436839 - DNA, 20 bp, mouse
gccccgctccgcagctttcc

SEQ ID NO: 436840 - DNA, 20 bp, mouse
gtgcccggaaagctgcggag

SEQ ID NO: 436841 - DNA, 20 bp, mouse
gggtgaggtgggaggctcgg

SEQ ID NO: 436842 - DNA, 20 bp, mouse
gcaggaaggggaggaccggg

SEQ ID NO: 436843 - DNA, 20 bp, mouse
ggcactcagcgctgcaggaa

SEQ ID NO: 436844 - DNA, 20 bp, mouse
gtgcagcgctgagtgcgggc

SEQ ID NO: 436845 - DNA, 20 bp, mouse
gcctcacctgcggcccccgg

SEQ ID NO: 436846 - DNA, 20 bp, mouse
gctcgcgcttccaggaacgt

SEQ ID NO: 436847 - DNA, 20 bp, mouse
ggcgagcaggtctgtgtata

SEQ ID NO: 436848 - DNA, 20 bp, mouse
ggtctgtgtatagggtgtcc

SEQ ID NO: 436849 - DNA, 20 bp, mouse
gtgtgagggccagagagtca

SEQ ID NO: 436850 - DNA, 20 bp, mouse
gccaggcagaggagtggcag

SEQ ID NO: 436851 - DNA, 20 bp, mouse
ggtcagggttcgggagccgg

SEQ ID NO: 436852 - DNA, 20 bp, mouse
ggccgctgacgaagatctcc

SEQ ID NO: 436853 - DNA, 20 bp, mouse
ggccaggagatcttcgtcag

SEQ ID NO: 436854 - DNA, 20 bp, mouse
gcgagccttagcggaggtca

SEQ ID NO: 436855 - DNA, 20 bp, mouse
ggcagtggagaagtgttgca

SEQ ID NO: 436856 - DNA, 20 bp, mouse
ggtgtgtgtaaggcacatcc

SEQ ID NO: 436857 - DNA, 20 bp, mouse
gagagggtcttggagagcct

SEQ ID NO: 436858 - DNA, 20 bp, mouse
gctcccgacccctaaaaccg

SEQ ID NO: 436859 - DNA, 20 bp, mouse
gacatccgggtgtcagaagc

SEQ ID NO: 436860 - DNA, 20 bp, mouse
ggcagccctaacgcacgcac

SEQ ID NO: 436861 - DNA, 20 bp, mouse
gcaggaggccgcggttttag

SEQ ID NO: 436862 - DNA, 20 bp, mouse
gagagggagggtcttcaccg

SEQ ID NO: 436863 - DNA, 20 bp, mouse
ggagggtcttcaccgcggta

SEQ ID NO: 436864 - DNA, 20 bp, mouse
gaggccgcggttttaggggt

SEQ ID NO: 436865 - DNA, 20 bp, mouse
gcgcgcacggaggaaacgag

SEQ ID NO: 436866 - DNA, 20 bp, mouse
gagcccggagagatttccct

SEQ ID NO: 436867 - DNA, 20 bp, mouse
gtgcccagggaaatctctcc

SEQ ID NO: 436868 - DNA, 20 bp, mouse
gcaccctgcggggagtaaga

SEQ ID NO: 436869 - DNA, 20 bp, mouse
ggaagcagacacatcaagcc

SEQ ID NO: 436870 - DNA, 20 bp, mouse
gtgcttccagtgctttaccg

SEQ ID NO: 436871 - DNA, 20 bp, mouse
gagggtgtaataagtgccca

SEQ ID NO: 436872 - DNA, 20 bp, mouse
gcggggagtaagagggctcg

SEQ ID NO: 436873 - DNA, 20 bp, mouse
gggcctcagtgcactggcta

SEQ ID NO: 436874 - DNA, 20 bp, mouse
gagccctcttactccccgca

SEQ ID NO: 436875 - DNA, 20 bp, mouse
gagaagaggcctcagtgcac

SEQ ID NO: 436876 - DNA, 20 bp, mouse
gcagtcctccagattccttc

SEQ ID NO: 436877 - DNA, 20 bp, mouse
ggtttacttaggacagatac

SEQ ID NO: 436878 - DNA, 20 bp, mouse
gtttgtctcctgaaggaatc

SEQ ID NO: 436879 - DNA, 20 bp, mouse
gacagggtggggtttagagt

SEQ ID NO: 436880 - DNA, 20 bp, mouse
gctcggcgatatggagaaga

SEQ ID NO: 436881 - DNA, 20 bp, mouse
gttcacgagccagtttactt

SEQ ID NO: 436882 - DNA, 20 bp, mouse
gagcagtctcaaggcaacat

SEQ ID NO: 436883 - DNA, 20 bp, mouse
gatgcatcttcagttagtgt

SEQ ID NO: 436884 - DNA, 20 bp, mouse
gtggaacagttgtctttctt

SEQ ID NO: 436885 - DNA, 20 bp, mouse
gggagggggggtaacagggt

SEQ ID NO: 436886 - DNA, 20 bp, mouse
gaggaggccaagcccagctg

SEQ ID NO: 436887 - DNA, 20 bp, mouse
gggcctgggacgccatccac

SEQ ID NO: 436888 - DNA, 20 bp, mouse
gtctgggatagaccacagct

SEQ ID NO: 436889 - DNA, 20 bp, mouse
gagacagtgatgacaaaccc

SEQ ID NO: 436890 - DNA, 20 bp, mouse
gtatatataagcattgagta

SEQ ID NO: 436891 - DNA, 20 bp, mouse
gcctcgcaggaggtgatgtt

SEQ ID NO: 436892 - DNA, 20 bp, mouse
gtgtagcttcagcgaggcct

SEQ ID NO: 436893 - DNA, 20 bp, mouse
gccttctgggcagagaacgt

SEQ ID NO: 436894 - DNA, 20 bp, mouse
ggaaggctgtagcttcagcg

SEQ ID NO: 436895 - DNA, 20 bp, mouse
ggaagaaggacaggactaaa

SEQ ID NO: 436896 - DNA, 20 bp, mouse
ggagctcacagcttcagctg

SEQ ID NO: 436897 - DNA, 20 bp, mouse
gtggagacagctgtcttagg

SEQ ID NO: 436898 - DNA, 20 bp, mouse
gcttaggaggtttctgtcct

SEQ ID NO: 436899 - DNA, 20 bp, mouse
gacggcctggcagaagagat

SEQ ID NO: 436900 - DNA, 20 bp, mouse
gtgtgtccagagagctgccc

SEQ ID NO: 436901 - DNA, 20 bp, mouse
gaaccagaggctgggtatag

SEQ ID NO: 436902 - DNA, 20 bp, mouse
gggagcctgaagcaatttgg

SEQ ID NO: 436903 - DNA, 20 bp, mouse
gtgctaagagacctgctcta

SEQ ID NO: 436904 - DNA, 20 bp, mouse
gttcttgttgacttacggcc

SEQ ID NO: 436905 - DNA, 20 bp, mouse
gttgttaaatccctaaccag

SEQ ID NO: 436906 - DNA, 20 bp, mouse
gctcaggggagtggatagta

SEQ ID NO: 436907 - DNA, 20 bp, mouse
gtccctcggtccaggttcag

SEQ ID NO: 436908 - DNA, 20 bp, mouse
gctgaggagcgaagctggag

SEQ ID NO: 436909 - DNA, 20 bp, mouse
ggctgttgggaaggcgtgtc

SEQ ID NO: 436910 - DNA, 20 bp, mouse
ggatagtagggctgttggga

SEQ ID NO: 436911 - DNA, 20 bp, mouse
ggagccggttctgtgttgta

SEQ ID NO: 436912 - DNA, 20 bp, mouse
ggccgctgaacctggaccga

SEQ ID NO: 436913 - DNA, 20 bp, mouse
gtgtgttgtagggagtccct

SEQ ID NO: 436914 - DNA, 20 bp, mouse
ggtagggagtccctcggtcc

SEQ ID NO: 436915 - DNA, 20 bp, mouse
gagtggatagtagggctgtt

SEQ ID NO: 436916 - DNA, 20 bp, mouse
gcagcgggtgcgccccggca

SEQ ID NO: 436917 - DNA, 20 bp, mouse
gcccggcacggcagcagcga

SEQ ID NO: 436918 - DNA, 20 bp, mouse
gccagccagcgggtgcgccc

SEQ ID NO: 436919 - DNA, 20 bp, mouse
gctccaagcccgggagtccc

SEQ ID NO: 436920 - DNA, 20 bp, mouse
gccgctggctggctgtcgca

SEQ ID NO: 436921 - DNA, 20 bp, mouse
gtcgtcccgggacagcggag

SEQ ID NO: 436922 - DNA, 20 bp, mouse
gcgcgtgcgcccgggaaagt

SEQ ID NO: 436923 - DNA, 20 bp, mouse
gagaaagcgcacggggccca

SEQ ID NO: 436924 - DNA, 20 bp, mouse
ggctctcggatccccggcag

SEQ ID NO: 436925 - DNA, 20 bp, mouse
gcacaaagctctcggatccc

SEQ ID NO: 436926 - DNA, 20 bp, mouse
ggtgtggcagggtcatgaag

SEQ ID NO: 436927 - DNA, 20 bp, mouse
gtggcagggtcatgaagagg

SEQ ID NO: 436928 - DNA, 20 bp, mouse
gggaggcggtggcgggagag

SEQ ID NO: 436929 - DNA, 20 bp, mouse
gcggagggggcgcaaaactg

SEQ ID NO: 436930 - DNA, 20 bp, mouse
gggcctggtgtagggaccag

SEQ ID NO: 436931 - DNA, 20 bp, mouse
gcgtgccctgcggaacatgg

SEQ ID NO: 436932 - DNA, 20 bp, mouse
gaggcgtgccctgcggaaca

SEQ ID NO: 436933 - DNA, 20 bp, mouse
ggagtcagctccgaagccag

SEQ ID NO: 436934 - DNA, 20 bp, mouse
gccacgctggggattgggag

SEQ ID NO: 436935 - DNA, 20 bp, mouse
gtgcctgcagtggattccgg

SEQ ID NO: 436936 - DNA, 20 bp, mouse
gccgggtcattgctgagatg

SEQ ID NO: 436937 - DNA, 20 bp, mouse
ggcgccaccgagctgagacc

SEQ ID NO: 436938 - DNA, 20 bp, mouse
gtgctgagatggggacgcgg

SEQ ID NO: 436939 - DNA, 20 bp, mouse
gctccccggtctcagctcgg

SEQ ID NO: 436940 - DNA, 20 bp, mouse
gcctcttgggccctcctcgg

SEQ ID NO: 436941 - DNA, 20 bp, mouse
gatggggacgcggaggaggt

SEQ ID NO: 436942 - DNA, 20 bp, mouse
gcattgctgagatggggacg

SEQ ID NO: 436943 - DNA, 20 bp, mouse
gcggctccccggtctcagct

SEQ ID NO: 436944 - DNA, 20 bp, mouse
ggcagggccccggagaccgc

SEQ ID NO: 436945 - DNA, 20 bp, mouse
gtcagcaatgacccgggccg

SEQ ID NO: 436946 - DNA, 20 bp, mouse
ggaccgggcgatgggaactc

SEQ ID NO: 436947 - DNA, 20 bp, mouse
gcgggcgatgggaactctgg

SEQ ID NO: 436948 - DNA, 20 bp, mouse
gtcttcagctacttcccggt

SEQ ID NO: 436949 - DNA, 20 bp, mouse
gtagctgaagaccgggcgat

SEQ ID NO: 436950 - DNA, 20 bp, mouse
gccggggcagagcccagcta

SEQ ID NO: 436951 - DNA, 20 bp, mouse
gtggaggtctcgctccgggg

SEQ ID NO: 436952 - DNA, 20 bp, mouse
gagtcttcagctagccgacc

SEQ ID NO: 436953 - DNA, 20 bp, mouse
gctctggaggtctcgctccg

SEQ ID NO: 436954 - DNA, 20 bp, mouse
gtctcccgagcggggaaacg

SEQ ID NO: 436955 - DNA, 20 bp, mouse
gccaagaggacccgcttccg

SEQ ID NO: 436956 - DNA, 20 bp, mouse
ggagccggggccatgtggac

SEQ ID NO: 436957 - DNA, 20 bp, mouse
ggcgcagagccggggccatg

SEQ ID NO: 436958 - DNA, 20 bp, mouse
gccggggccatgtggacggg

SEQ ID NO: 436959 - DNA, 20 bp, mouse
gcgccggccacccgtccaca

SEQ ID NO: 436960 - DNA, 20 bp, mouse
gctctgcgcgcccgagcccg

SEQ ID NO: 436961 - DNA, 20 bp, mouse
gcggctctgcggcctctcca

SEQ ID NO: 436962 - DNA, 20 bp, mouse
gcagggccgccccccgaacg

SEQ ID NO: 436963 - DNA, 20 bp, mouse
gctctcgggtactcaccgcc

SEQ ID NO: 436964 - DNA, 20 bp, mouse
gcgggccccggcgccaccca

SEQ ID NO: 436965 - DNA, 20 bp, mouse
gccgcccggcgaagccggcc

SEQ ID NO: 436966 - DNA, 20 bp, mouse
ggccgcccccagccagtcgg

SEQ ID NO: 436967 - DNA, 20 bp, mouse
gaggggcgcgcggcacaatg

SEQ ID NO: 436968 - DNA, 20 bp, mouse
gagcgcgcagggcctggccg

SEQ ID NO: 436969 - DNA, 20 bp, mouse
gggccccgccgactggctgg

SEQ ID NO: 436970 - DNA, 20 bp, mouse
gcccgccgcccccagccagt

SEQ ID NO: 436971 - DNA, 20 bp, mouse
gtgagtgtgggccccggtcg

SEQ ID NO: 436972 - DNA, 20 bp, mouse
gccggggcggccccgccgac

SEQ ID NO: 436973 - DNA, 20 bp, mouse
gcccgccgactggctggggg

SEQ ID NO: 436974 - DNA, 20 bp, mouse
gtggggcgcgacgagcccgt

SEQ ID NO: 436975 - DNA, 20 bp, mouse
ggcctccgcgcgggctggaa

SEQ ID NO: 436976 - DNA, 20 bp, mouse
gctcggctgtggacgtgagg

SEQ ID NO: 436977 - DNA, 20 bp, mouse
gtgtggacgtgaggcggcag

SEQ ID NO: 436978 - DNA, 20 bp, mouse
ggtccacagccgagagagcc

SEQ ID NO: 436979 - DNA, 20 bp, mouse
gcaggctcggcgacaggcag

SEQ ID NO: 436980 - DNA, 20 bp, mouse
gcagggtccgagctttggaa

SEQ ID NO: 436981 - DNA, 20 bp, mouse
ggctcggcgacaggcagcgg

SEQ ID NO: 436982 - DNA, 20 bp, mouse
ggcgtcccggtggggacagg

SEQ ID NO: 436983 - DNA, 20 bp, mouse
ggtccgcagggtccgagctt

SEQ ID NO: 436984 - DNA, 20 bp, mouse
gcggtggggacaggtggaag

SEQ ID NO: 436985 - DNA, 20 bp, mouse
ggcccgaggggacccggtgg

SEQ ID NO: 436986 - DNA, 20 bp, mouse
gagtcgcgcacgcacgacac

SEQ ID NO: 436987 - DNA, 20 bp, mouse
gctgggcgcggaaaagggag

SEQ ID NO: 436988 - DNA, 20 bp, mouse
ggaggtggggacccctagag

SEQ ID NO: 436989 - DNA, 20 bp, mouse
gagcgcgccccagtcccgag

SEQ ID NO: 436990 - DNA, 20 bp, mouse
gcccaaggagtcggaacggg

SEQ ID NO: 436991 - DNA, 20 bp, mouse
gcaccatgtacgcctttgtg

SEQ ID NO: 436992 - DNA, 20 bp, mouse
gagagaagcaaggaagacaa

SEQ ID NO: 436993 - DNA, 20 bp, mouse
gcgtacatggtgggcgccgg

SEQ ID NO: 436994 - DNA, 20 bp, mouse
gccaggcgagagcagccgat

SEQ ID NO: 436995 - DNA, 20 bp, mouse
ggtagcagacgttgtcctcc

SEQ ID NO: 436996 - DNA, 20 bp, mouse
gaccgaaccgacctgctgga

SEQ ID NO: 436997 - DNA, 20 bp, mouse
gttacacaggcgaaacccgg

SEQ ID NO: 436998 - DNA, 20 bp, mouse
gcgccaggccacgcgccggg

SEQ ID NO: 436999 - DNA, 20 bp, mouse
ggccctccagcaggtcggtt

SEQ ID NO: 437000 - DNA, 20 bp, mouse
gcctccgggcgggctcaggg

SEQ ID NO: 437001 - DNA, 20 bp, mouse
gcgcgcgccctccagcaggt

SEQ ID NO: 437002 - DNA, 20 bp, mouse
ggcctccagcagaaggtccg

SEQ ID NO: 437003 - DNA, 20 bp, mouse
gggcccgccaggccacgcgc

SEQ ID NO: 437004 - DNA, 20 bp, mouse
gcgtggcagagctcacgtct

SEQ ID NO: 437005 - DNA, 20 bp, mouse
gctgctggaggccgacgtca

SEQ ID NO: 437006 - DNA, 20 bp, mouse
gtgctcgccgcggcccgcct

SEQ ID NO: 437007 - DNA, 20 bp, mouse
ggcgcggcaggagactgagg

SEQ ID NO: 437008 - DNA, 20 bp, mouse
ggctggggcgcggagctgtg

SEQ ID NO: 437009 - DNA, 20 bp, mouse
ggtcgcctaagacaccgggg

SEQ ID NO: 437010 - DNA, 20 bp, mouse
gccgggccggcagcttacct

SEQ ID NO: 437011 - DNA, 20 bp, mouse
gagcccggccccgctcccaa

SEQ ID NO: 437012 - DNA, 20 bp, mouse
gggcatgaaggggcaccgag

SEQ ID NO: 437013 - DNA, 20 bp, mouse
gagctgtggggtgctcgccg

SEQ ID NO: 437014 - DNA, 20 bp, mouse
gagagcgaggcggcatgaag

SEQ ID NO: 437015 - DNA, 20 bp, mouse
gttcctctccgagaactcca

SEQ ID NO: 437016 - DNA, 20 bp, mouse
gctggtagagagtcatgtca

SEQ ID NO: 437017 - DNA, 20 bp, mouse
gccagagggctagagagcat

SEQ ID NO: 437018 - DNA, 20 bp, mouse
gggagcaagcagagcacata

SEQ ID NO: 437019 - DNA, 20 bp, mouse
gcccaggtaaccctcctcca

SEQ ID NO: 437020 - DNA, 20 bp, mouse
gcagagcacatagggctgat

SEQ ID NO: 437021 - DNA, 20 bp, mouse
gagcccacggcaagtcactg

SEQ ID NO: 437022 - DNA, 20 bp, mouse
gcaggtgacactggtgctca

SEQ ID NO: 437023 - DNA, 20 bp, mouse
gtgaaccaggactaggaccc

SEQ ID NO: 437024 - DNA, 20 bp, mouse
ggcctacagagtgggagctc

SEQ ID NO: 437025 - DNA, 20 bp, mouse
gaggtcccgggtcctagtcc

SEQ ID NO: 437026 - DNA, 20 bp, mouse
gcagagtggaaggctaggag

SEQ ID NO: 437027 - DNA, 20 bp, mouse
gtggccgtacagggacacaa

SEQ ID NO: 437028 - DNA, 20 bp, mouse
gcccaaagcctgccagtcca

SEQ ID NO: 437029 - DNA, 20 bp, mouse
ggccacaggtgagaagggcc

SEQ ID NO: 437030 - DNA, 20 bp, mouse
gggaggctgctggacagact

SEQ ID NO: 437031 - DNA, 20 bp, mouse
gtggttccttgtcagaggaa

SEQ ID NO: 437032 - DNA, 20 bp, mouse
gaggctttgggcaggactcc

SEQ ID NO: 437033 - DNA, 20 bp, mouse
gtaaatggccctggactggc

SEQ ID NO: 437034 - DNA, 20 bp, mouse
ggagagtgggcaacaagagg

SEQ ID NO: 437035 - DNA, 20 bp, mouse
gggacagagactaaaaggga

SEQ ID NO: 437036 - DNA, 20 bp, mouse
gccacagcagcaggagaact

SEQ ID NO: 437037 - DNA, 20 bp, mouse
gagctggtcaccagtgaggg

SEQ ID NO: 437038 - DNA, 20 bp, mouse
gcaccagtgagggtggaagc

SEQ ID NO: 437039 - DNA, 20 bp, mouse
gggaagccggcacctcttca

SEQ ID NO: 437040 - DNA, 20 bp, mouse
gcgatctgccgtccctgaag

SEQ ID NO: 437041 - DNA, 20 bp, mouse
gtccaggcaggccccgtcaa

SEQ ID NO: 437042 - DNA, 20 bp, mouse
gctgagggtgaaggagtgaa

SEQ ID NO: 437043 - DNA, 20 bp, mouse
gagtaggtgacaccacagaa

SEQ ID NO: 437044 - DNA, 20 bp, mouse
gtcggacagagcctgaactg

SEQ ID NO: 437045 - DNA, 20 bp, mouse
gccctggactcactacacgc

SEQ ID NO: 437046 - DNA, 20 bp, mouse
gctgatgtcgtggcgctctg

SEQ ID NO: 437047 - DNA, 20 bp, mouse
gagccctgggactgaagccg

SEQ ID NO: 437048 - DNA, 20 bp, mouse
gggccagggtcacccgacct

SEQ ID NO: 437049 - DNA, 20 bp, mouse
gtgggactgaagccgaggtc

SEQ ID NO: 437050 - DNA, 20 bp, mouse
gtgttgctcttaggagccct

SEQ ID NO: 437051 - DNA, 20 bp, mouse
ggagtcgggagcagggttgt

SEQ ID NO: 437052 - DNA, 20 bp, mouse
gagtgagtaggaaagggcca

SEQ ID NO: 437053 - DNA, 20 bp, mouse
gggttgtgggaggagactac

SEQ ID NO: 437054 - DNA, 20 bp, mouse
ggcaaaaagttgttgctctt

SEQ ID NO: 437055 - DNA, 20 bp, mouse
gtccgagtgacgacataaac

SEQ ID NO: 437056 - DNA, 20 bp, mouse
gccctgagtgggaccctgga

SEQ ID NO: 437057 - DNA, 20 bp, mouse
gggaattcgcagcacagcaa

SEQ ID NO: 437058 - DNA, 20 bp, mouse
gcgcagcacagcaacggacg

SEQ ID NO: 437059 - DNA, 20 bp, mouse
gaggcggaaccggaagaccc

SEQ ID NO: 437060 - DNA, 20 bp, mouse
gaattccctgagtgggaccc

SEQ ID NO: 437061 - DNA, 20 bp, mouse
ggtgctgcgaattccctgag

SEQ ID NO: 437062 - DNA, 20 bp, mouse
gggagggcgcgatggcagat

SEQ ID NO: 437063 - DNA, 20 bp, mouse
gcgatggcagattggactcg

SEQ ID NO: 437064 - DNA, 20 bp, mouse
gggacgtggcaccagtaccc

SEQ ID NO: 437065 - DNA, 20 bp, mouse
gattagcccggaggcggaac

SEQ ID NO: 437066 - DNA, 20 bp, mouse
gagacccagggtcggcgtgg

SEQ ID NO: 437067 - DNA, 20 bp, mouse
gatccctccacgccgaccct

SEQ ID NO: 437068 - DNA, 20 bp, mouse
gggtctcccccccccatgca

SEQ ID NO: 437069 - DNA, 20 bp, mouse
gggcatccctgcatgggggg

SEQ ID NO: 437070 - DNA, 20 bp, mouse
gcatgggggggggagaccca

SEQ ID NO: 437071 - DNA, 20 bp, mouse
gggggggggagacccagggt

SEQ ID NO: 437072 - DNA, 20 bp, mouse
gccccggcatccctgcatgg

SEQ ID NO: 437073 - DNA, 20 bp, mouse
gcctggtgtgcgcagcggcg

SEQ ID NO: 437074 - DNA, 20 bp, mouse
gggctggagagagtgagcga

SEQ ID NO: 437075 - DNA, 20 bp, mouse
gagcccgccatccctaacgg

SEQ ID NO: 437076 - DNA, 20 bp, mouse
gtcgtgggcggccctgtagg

SEQ ID NO: 437077 - DNA, 20 bp, mouse
gagatcgtgggcggccctgt

SEQ ID NO: 437078 - DNA, 20 bp, mouse
ggcaccggcctcccgaacag

SEQ ID NO: 437079 - DNA, 20 bp, mouse
ggcagccccgggtcacgtga

SEQ ID NO: 437080 - DNA, 20 bp, mouse
gaagggacgcccgggctcag

SEQ ID NO: 437081 - DNA, 20 bp, mouse
gcgggcttggcagtgacgca

SEQ ID NO: 437082 - DNA, 20 bp, mouse
gaggcgagcgggacaggtaa

SEQ ID NO: 437083 - DNA, 20 bp, mouse
gcagggccctcacgtgaccc

SEQ ID NO: 437084 - DNA, 20 bp, mouse
gaagcccgctccccctgttc

SEQ ID NO: 437085 - DNA, 20 bp, mouse
gcccgctccccctgttcggg

SEQ ID NO: 437086 - DNA, 20 bp, mouse
gctgcatcggggggacccag

SEQ ID NO: 437087 - DNA, 20 bp, mouse
gctccacgccgaccacccct

SEQ ID NO: 437088 - DNA, 20 bp, mouse
ggacccaggggtggtcggcg

SEQ ID NO: 437089 - DNA, 20 bp, mouse
gcatcggggggacccagggg

SEQ ID NO: 437090 - DNA, 20 bp, mouse
gggggggacccaggggtggt

SEQ ID NO: 437091 - DNA, 20 bp, mouse
gcctggtgtgcgcagcggca

SEQ ID NO: 437092 - DNA, 20 bp, mouse
gccggcatccctgcatcggg

SEQ ID NO: 437093 - DNA, 20 bp, mouse
gggtggtcggcgtggaggga

SEQ ID NO: 437094 - DNA, 20 bp, mouse
ggtgtgcgcagcggcacggc

SEQ ID NO: 437095 - DNA, 20 bp, mouse
gaccccggcatccctgcatc

SEQ ID NO: 437096 - DNA, 20 bp, mouse
ggaaccgacaagtgtctctg

SEQ ID NO: 437097 - DNA, 20 bp, mouse
gatcttggctattgtcggta

SEQ ID NO: 437098 - DNA, 20 bp, mouse
gttaccccagagacacttgt

SEQ ID NO: 437099 - DNA, 20 bp, mouse
ggtcagcttggaggttcaac

SEQ ID NO: 437100 - DNA, 20 bp, mouse
gagatatgcagtcagcttgg

SEQ ID NO: 437101 - DNA, 20 bp, mouse
gttggctgtaaactcagaag

SEQ ID NO: 437102 - DNA, 20 bp, mouse
gaagtggtatagctgggtag

SEQ ID NO: 437103 - DNA, 20 bp, mouse
gccaagatatgcagtcagct

SEQ ID NO: 437104 - DNA, 20 bp, mouse
ggtgtggatttagattcctt

SEQ ID NO: 437105 - DNA, 20 bp, mouse
gtagcattttgcacaaggaa

SEQ ID NO: 437106 - DNA, 20 bp, mouse
gcaggaccccgcggaagtag

SEQ ID NO: 437107 - DNA, 20 bp, mouse
gcccgcggaagtagaggaca

SEQ ID NO: 437108 - DNA, 20 bp, mouse
gctagtggcgaggtgagctt

SEQ ID NO: 437109 - DNA, 20 bp, mouse
gctcacctcgccactagtcc

SEQ ID NO: 437110 - DNA, 20 bp, mouse
gacttccgcggggtcctggc

SEQ ID NO: 437111 - DNA, 20 bp, mouse
gtccgcggggtcctggcagg

SEQ ID NO: 437112 - DNA, 20 bp, mouse
ggtgggtcttcgcctcgtaa

SEQ ID NO: 437113 - DNA, 20 bp, mouse
gggcgaggtgagcttcggca

SEQ ID NO: 437114 - DNA, 20 bp, mouse
gggtaccaggactagtggcg

SEQ ID NO: 437115 - DNA, 20 bp, mouse
ggtgtggggtggtaatggtc

SEQ ID NO: 437116 - DNA, 20 bp, mouse
gggcctggaagacgtagctg

SEQ ID NO: 437117 - DNA, 20 bp, mouse
gctggaagacgtagctgcgg

SEQ ID NO: 437118 - DNA, 20 bp, mouse
ggcgctcgtagcgctcctgg

SEQ ID NO: 437119 - DNA, 20 bp, mouse
gtgactgcacggaggatcag

SEQ ID NO: 437120 - DNA, 20 bp, mouse
ggcgccacgccggcctgcgg

SEQ ID NO: 437121 - DNA, 20 bp, mouse
gtacagctcccgggtggaag

SEQ ID NO: 437122 - DNA, 20 bp, mouse
gacgtagctgcggcggtaca

SEQ ID NO: 437123 - DNA, 20 bp, mouse
ggcggtacatggctcccgga

SEQ ID NO: 437124 - DNA, 20 bp, mouse
gggcacggttagggagactg

SEQ ID NO: 437125 - DNA, 20 bp, mouse
gtgctcgcccaggcgctgga

SEQ ID NO: 437126 - DNA, 20 bp, mouse
gtgctggagttggttcccga

SEQ ID NO: 437127 - DNA, 20 bp, mouse
gactcctacatagaccccag

SEQ ID NO: 437128 - DNA, 20 bp, mouse
ggcaggtttacagggtccag

SEQ ID NO: 437129 - DNA, 20 bp, mouse
gatgtaggagtcgcacccag

SEQ ID NO: 437130 - DNA, 20 bp, mouse
gctactgttgaggacctggg

SEQ ID NO: 437131 - DNA, 20 bp, mouse
gtccagagaggcccatgacc

SEQ ID NO: 437132 - DNA, 20 bp, mouse
gcacccagtggtggcatagg

SEQ ID NO: 437133 - DNA, 20 bp, mouse
gcctgctccgggcccagaaa

SEQ ID NO: 437134 - DNA, 20 bp, mouse
ggtgcccctggggtctatgt

SEQ ID NO: 437135 - DNA, 20 bp, mouse
ggaggcccatgaccaggctg

SEQ ID NO: 437136 - DNA, 20 bp, mouse
gcatggtgtctgctaggtct

SEQ ID NO: 437137 - DNA, 20 bp, mouse
gggagacagggtgatggcca

SEQ ID NO: 437138 - DNA, 20 bp, mouse
gagggtgatggccaaggcta

SEQ ID NO: 437139 - DNA, 20 bp, mouse
gcacccagtcagaagccaag

SEQ ID NO: 437140 - DNA, 20 bp, mouse
gaatccccttggcttctgac

SEQ ID NO: 437141 - DNA, 20 bp, mouse
gcctggcagggccttagcct

SEQ ID NO: 437142 - DNA, 20 bp, mouse
gacacaaggtcaggtaattc

SEQ ID NO: 437143 - DNA, 20 bp, mouse
gggctctggccacttaccca

SEQ ID NO: 437144 - DNA, 20 bp, mouse
gtctgggccaagctgctgtg

SEQ ID NO: 437145 - DNA, 20 bp, mouse
gcatgagggagacaacaggg

SEQ ID NO: 437146 - DNA, 20 bp, mouse
gaatgctactggatgctgga

SEQ ID NO: 437147 - DNA, 20 bp, mouse
gcatccagtagcatttatat

SEQ ID NO: 437148 - DNA, 20 bp, mouse
ggtctgacaaaggtactagc

SEQ ID NO: 437149 - DNA, 20 bp, mouse
gaggaaaagtggggacaccc

SEQ ID NO: 437150 - DNA, 20 bp, mouse
gacacccaggcagaaggcaa

SEQ ID NO: 437151 - DNA, 20 bp, mouse
ggctctctgatgtaagcagg

SEQ ID NO: 437152 - DNA, 20 bp, mouse
gccaaggccgaggccctgcc

SEQ ID NO: 437153 - DNA, 20 bp, mouse
gagggtgagggccaaggccg

SEQ ID NO: 437154 - DNA, 20 bp, mouse
gaaggtactagcaggaagcc

SEQ ID NO: 437155 - DNA, 20 bp, mouse
ggactcagggccgctgggct

SEQ ID NO: 437156 - DNA, 20 bp, mouse
gctgtggagagacttattct

SEQ ID NO: 437157 - DNA, 20 bp, mouse
ggactcagggccggtgggcg

SEQ ID NO: 437158 - DNA, 20 bp, mouse
gcctttgtcagactcagggc

SEQ ID NO: 437159 - DNA, 20 bp, mouse
gggtcagaatcagaggcaac

SEQ ID NO: 437160 - DNA, 20 bp, mouse
gttacagatgccacgcccac

SEQ ID NO: 437161 - DNA, 20 bp, mouse
gagaatcagaggcaacagga

SEQ ID NO: 437162 - DNA, 20 bp, mouse
gtgtcagactcagggccggt

SEQ ID NO: 437163 - DNA, 20 bp, mouse
gggggacagggtgtgggcca

SEQ ID NO: 437164 - DNA, 20 bp, mouse
gacagacagagagattcctg

SEQ ID NO: 437165 - DNA, 20 bp, mouse
gctcctgcatgcatgttgaa

SEQ ID NO: 437166 - DNA, 20 bp, mouse
gtccaggaataagtctccac

SEQ ID NO: 437167 - DNA, 20 bp, mouse
gtcctgtggagacttattcc

SEQ ID NO: 437168 - DNA, 20 bp, mouse
gcatgcaggaatctctttcc

SEQ ID NO: 437169 - DNA, 20 bp, mouse
ggttctgaacatccccatat

SEQ ID NO: 437170 - DNA, 20 bp, mouse
gaattggaggcgacaaattg

SEQ ID NO: 437171 - DNA, 20 bp, mouse
gtcagggcagctagctggta

SEQ ID NO: 437172 - DNA, 20 bp, mouse
ggtaaggttcccaggtaagt

SEQ ID NO: 437173 - DNA, 20 bp, mouse
ggctagctggtaaggttccc

SEQ ID NO: 437174 - DNA, 20 bp, mouse
gtcagaactcatcgcagtca

SEQ ID NO: 437175 - DNA, 20 bp, mouse
gaggctgaaaaaggagaccc

SEQ ID NO: 437176 - DNA, 20 bp, mouse
gtgctcccggttggccctga

SEQ ID NO: 437177 - DNA, 20 bp, mouse
gggagcagctgctcgctcct

SEQ ID NO: 437178 - DNA, 20 bp, mouse
gagagggagacagaggcggt

SEQ ID NO: 437179 - DNA, 20 bp, mouse
gtctgtccgtcagggccaac

SEQ ID NO: 437180 - DNA, 20 bp, mouse
ggcgagcagctgctcccggt

SEQ ID NO: 437181 - DNA, 20 bp, mouse
gctcgctcctgggcagttcg

SEQ ID NO: 437182 - DNA, 20 bp, mouse
gcaggtgcaggctgcttagt

SEQ ID NO: 437183 - DNA, 20 bp, mouse
gctgggcagttcgtggagag

SEQ ID NO: 437184 - DNA, 20 bp, mouse
gggggcggcaagactagatg

SEQ ID NO: 437185 - DNA, 20 bp, mouse
gcgtgagcaggccctacctg

SEQ ID NO: 437186 - DNA, 20 bp, mouse
ggtatccgcaaagtgcccaa

SEQ ID NO: 437187 - DNA, 20 bp, mouse
ggcccgctgaacacgccctt

SEQ ID NO: 437188 - DNA, 20 bp, mouse
gtggattcgtagttctacca

SEQ ID NO: 437189 - DNA, 20 bp, mouse
gtgcccaagggcgtgttcag

SEQ ID NO: 437190 - DNA, 20 bp, mouse
gatctccaagaaccacctgg

SEQ ID NO: 437191 - DNA, 20 bp, mouse
ggtagttctaccagggagct

SEQ ID NO: 437192 - DNA, 20 bp, mouse
gcacgcccttgggcactttg

SEQ ID NO: 437193 - DNA, 20 bp, mouse
ggttgggaggaatctccacc

SEQ ID NO: 437194 - DNA, 20 bp, mouse
gtacatctccaagaaccacc

SEQ ID NO: 437195 - DNA, 20 bp, mouse
gtcccaaagaccaagaatag

SEQ ID NO: 437196 - DNA, 20 bp, mouse
ggcgcagaggctgcccacgg

SEQ ID NO: 437197 - DNA, 20 bp, mouse
gttcgaggccgtacgcgcag

SEQ ID NO: 437198 - DNA, 20 bp, mouse
ggaatccccaggtaaaccaa

SEQ ID NO: 437199 - DNA, 20 bp, mouse
gacgtgtccttgtcccccgt

SEQ ID NO: 437200 - DNA, 20 bp, mouse
gtacgcgcagaggctgccca

SEQ ID NO: 437201 - DNA, 20 bp, mouse
gcgtacggcctcgaatcccc

SEQ ID NO: 437202 - DNA, 20 bp, mouse
ggtccacgtggtagaactgg

SEQ ID NO: 437203 - DNA, 20 bp, mouse
gcccgcagccccgcccgtgg

SEQ ID NO: 437204 - DNA, 20 bp, mouse
gcccaggtaaaccaaggggt

SEQ ID NO: 437205 - DNA, 20 bp, mouse
gtgcacgcaggacagctcac

SEQ ID NO: 437206 - DNA, 20 bp, mouse
gagcttggacgaggcagaag

SEQ ID NO: 437207 - DNA, 20 bp, mouse
gagcaagagccatcagtcag

SEQ ID NO: 437208 - DNA, 20 bp, mouse
gctgctggtccactgactga

SEQ ID NO: 437209 - DNA, 20 bp, mouse
gcgctgcagcatgacctcgg

SEQ ID NO: 437210 - DNA, 20 bp, mouse
gaggaggagcagcttggacg

SEQ ID NO: 437211 - DNA, 20 bp, mouse
ggccgagccttggaccgtgt

SEQ ID NO: 437212 - DNA, 20 bp, mouse
gcggtgtaggcggcactaag

SEQ ID NO: 437213 - DNA, 20 bp, mouse
gggacataggccatgctccg

SEQ ID NO: 437214 - DNA, 20 bp, mouse
gttgctggctggacactctc

SEQ ID NO: 437215 - DNA, 20 bp, mouse
gaaagcgcgagcggcccaca

SEQ ID NO: 437216 - DNA, 20 bp, mouse
ggcaggggctgcgcaggatg

SEQ ID NO: 437217 - DNA, 20 bp, mouse
ggtttggtgcagagacgtag

SEQ ID NO: 437218 - DNA, 20 bp, mouse
gtggtgcagagacgtagggg

SEQ ID NO: 437219 - DNA, 20 bp, mouse
ggtgtgtcgagggctccgag

SEQ ID NO: 437220 - DNA, 20 bp, mouse
gcaagcacagctcacctcga

SEQ ID NO: 437221 - DNA, 20 bp, mouse
gcaccgcgcacactccaggg

SEQ ID NO: 437222 - DNA, 20 bp, mouse
gtcggagaccccaggcggtg

SEQ ID NO: 437223 - DNA, 20 bp, mouse
gtccgagtggtcgcacactg

SEQ ID NO: 437224 - DNA, 20 bp, mouse
ggcgcacggcccaggtgtcc

SEQ ID NO: 437225 - DNA, 20 bp, mouse
gctcgcgcgcaaagcggtgg

SEQ ID NO: 437226 - DNA, 20 bp, mouse
gcagccgccgccacagacgg

SEQ ID NO: 437227 - DNA, 20 bp, mouse
ggcgggattggactcagagg

SEQ ID NO: 437228 - DNA, 20 bp, mouse
gggcgcgggattggactcag

SEQ ID NO: 437229 - DNA, 20 bp, mouse
gatttcccaggtctgaagac

SEQ ID NO: 437230 - DNA, 20 bp, mouse
gggctgctaaggctcaccat

SEQ ID NO: 437231 - DNA, 20 bp, mouse
gggccgcggcccctcatggt

SEQ ID NO: 437232 - DNA, 20 bp, mouse
gcgtagagcaggcgcgggat

SEQ ID NO: 437233 - DNA, 20 bp, mouse
ggggtccggaaatctcttga

SEQ ID NO: 437234 - DNA, 20 bp, mouse
gcggtgcgtagagcaggcgc

SEQ ID NO: 437235 - DNA, 20 bp, mouse
ggtgggaggctggtctcgga

SEQ ID NO: 437236 - DNA, 20 bp, mouse
gtggtgagaaggcgcaggaa

SEQ ID NO: 437237 - DNA, 20 bp, mouse
gtgagaaggcgcaggaaggg

SEQ ID NO: 437238 - DNA, 20 bp, mouse
ggccacgcgccttggtgaga

SEQ ID NO: 437239 - DNA, 20 bp, mouse
gccgcgacggtggagagcag

SEQ ID NO: 437240 - DNA, 20 bp, mouse
ggaagggtggccggccggag

SEQ ID NO: 437241 - DNA, 20 bp, mouse
gggcctgcgcgtggcctctc

SEQ ID NO: 437242 - DNA, 20 bp, mouse
gatacgagtgggaggtagag

SEQ ID NO: 437243 - DNA, 20 bp, mouse
gcagctgtctgtcagtcccc

SEQ ID NO: 437244 - DNA, 20 bp, mouse
gcgaagccaatacgagtggg

SEQ ID NO: 437245 - DNA, 20 bp, mouse
gagagcagcggcgagcagag

SEQ ID NO: 437246 - DNA, 20 bp, mouse
gcctggaagggaggatccga

SEQ ID NO: 437247 - DNA, 20 bp, mouse
gagcgggagccagaagccgt

SEQ ID NO: 437248 - DNA, 20 bp, mouse
gcttagtagagtctgagaaa

SEQ ID NO: 437249 - DNA, 20 bp, mouse
gaggatccgagggtctcaag

SEQ ID NO: 437250 - DNA, 20 bp, mouse
gggagcacggagacctgtca

SEQ ID NO: 437251 - DNA, 20 bp, mouse
ggcatctctgagagtatagg

SEQ ID NO: 437252 - DNA, 20 bp, mouse
gtgcagacaggagcgcacag

SEQ ID NO: 437253 - DNA, 20 bp, mouse
ggaggtgtcgcttcagttgg

SEQ ID NO: 437254 - DNA, 20 bp, mouse
gtgtcgcggaacacaaggtt

SEQ ID NO: 437255 - DNA, 20 bp, mouse
gtgggcaggcaggtaggagg

SEQ ID NO: 437256 - DNA, 20 bp, mouse
gcgcgcgcgggtgtgcgaga

SEQ ID NO: 437257 - DNA, 20 bp, mouse
ggcgcacacacgcactgcgc

SEQ ID NO: 437258 - DNA, 20 bp, mouse
gcgaccgtcccacagattac

SEQ ID NO: 437259 - DNA, 20 bp, mouse
gtgtcctgtaatctgtggga

SEQ ID NO: 437260 - DNA, 20 bp, mouse
gcgcctggagagattttggg

SEQ ID NO: 437261 - DNA, 20 bp, mouse
gggcagagcccctcccggaa

SEQ ID NO: 437262 - DNA, 20 bp, mouse
gagagcccctcccggaatgg

SEQ ID NO: 437263 - DNA, 20 bp, mouse
gagaaacctccaaatcgaaa

SEQ ID NO: 437264 - DNA, 20 bp, mouse
gccgttgcgaatatctgtct

SEQ ID NO: 437265 - DNA, 20 bp, mouse
gcgagcgagcacggggcgga

SEQ ID NO: 437266 - DNA, 20 bp, mouse
gggcagtgttaggtcaaaag

SEQ ID NO: 437267 - DNA, 20 bp, mouse
gcagcagcacagactttgct

SEQ ID NO: 437268 - DNA, 20 bp, mouse
gggggtgctgcactcatgaa

SEQ ID NO: 437269 - DNA, 20 bp, mouse
gcactccacagataggtcca

SEQ ID NO: 437270 - DNA, 20 bp, mouse
gtccacagataggtccaagg

SEQ ID NO: 437271 - DNA, 20 bp, mouse
gccttctagttggcagtgtt

SEQ ID NO: 437272 - DNA, 20 bp, mouse
gaagctgctcatggatccag

SEQ ID NO: 437273 - DNA, 20 bp, mouse
gtgccaactagaaggatgct

SEQ ID NO: 437274 - DNA, 20 bp, mouse
gtccaccttggacctatctg

SEQ ID NO: 437275 - DNA, 20 bp, mouse
gctgcgcttgctgacattgg

SEQ ID NO: 437276 - DNA, 20 bp, mouse
ggggacccgcgcctgtacag

SEQ ID NO: 437277 - DNA, 20 bp, mouse
gggaagcactcgagccaaga

SEQ ID NO: 437278 - DNA, 20 bp, mouse
gctgtacagcggcggcgaca

SEQ ID NO: 437279 - DNA, 20 bp, mouse
ggtacaggcgcgggtcccgg

SEQ ID NO: 437280 - DNA, 20 bp, mouse
gacccgcgcctgtacagcgg

SEQ ID NO: 437281 - DNA, 20 bp, mouse
gtgactgacactcaccttct

SEQ ID NO: 437282 - DNA, 20 bp, mouse
ggcggcgacatggcaccagc

SEQ ID NO: 437283 - DNA, 20 bp, mouse
gagcgcagcgcctccaggac

SEQ ID NO: 437284 - DNA, 20 bp, mouse
gtggaaactgacaggaacac

SEQ ID NO: 437285 - DNA, 20 bp, mouse
gcaggtcgcctgactctcct

SEQ ID NO: 437286 - DNA, 20 bp, mouse
ggcggcgcgccgagccacat

SEQ ID NO: 437287 - DNA, 20 bp, mouse
ggccccggccccggccgatg

SEQ ID NO: 437288 - DNA, 20 bp, mouse
gtgcgaggccatggtgcgag

SEQ ID NO: 437289 - DNA, 20 bp, mouse
gcgaggccatgctccaaggt

SEQ ID NO: 437290 - DNA, 20 bp, mouse
gggggcacgagctagcgctg

SEQ ID NO: 437291 - DNA, 20 bp, mouse
gggactgagagacgatcctg

SEQ ID NO: 437292 - DNA, 20 bp, mouse
gggctccgaggacgatctgg

SEQ ID NO: 437293 - DNA, 20 bp, mouse
ggggagaggattaggagcag

SEQ ID NO: 437294 - DNA, 20 bp, mouse
ggccggctccgaggacgatc

SEQ ID NO: 437295 - DNA, 20 bp, mouse
gctgagagacgatcctgtgg

SEQ ID NO: 437296 - DNA, 20 bp, mouse
gcctcccacggagcattggg

SEQ ID NO: 437297 - DNA, 20 bp, mouse
ggcagggcccagcaagcagg

SEQ ID NO: 437298 - DNA, 20 bp, mouse
gagtgacgcggcctgagaca

SEQ ID NO: 437299 - DNA, 20 bp, mouse
ggccgcagggcccagcaagc

SEQ ID NO: 437300 - DNA, 20 bp, mouse
gccaccgcccaatgctccgt

SEQ ID NO: 437301 - DNA, 20 bp, mouse
ggcggtggaccgcagtgacg

SEQ ID NO: 437302 - DNA, 20 bp, mouse
gcagcctcccacggagcatt

SEQ ID NO: 437303 - DNA, 20 bp, mouse
gtacacggccggaagcactg

SEQ ID NO: 437304 - DNA, 20 bp, mouse
ggacgcggcctgagacatgg

SEQ ID NO: 437305 - DNA, 20 bp, mouse
gcgcgtggccgccatgtctc

SEQ ID NO: 437306 - DNA, 20 bp, mouse
gcagtggtgggaggtaccag

SEQ ID NO: 437307 - DNA, 20 bp, mouse
gagcggcggctaagagggcc

SEQ ID NO: 437308 - DNA, 20 bp, mouse
ggcccggcttgtgggagcca

SEQ ID NO: 437309 - DNA, 20 bp, mouse
gcaggcggccgagtatggac

SEQ ID NO: 437310 - DNA, 20 bp, mouse
gaccttggctcccacaagcc

SEQ ID NO: 437311 - DNA, 20 bp, mouse
gaccacgcgtgagaagatcc

SEQ ID NO: 437312 - DNA, 20 bp, mouse
gagatccaggcggccgagta

SEQ ID NO: 437313 - DNA, 20 bp, mouse
ggctgcgcgccgaggtgaag

SEQ ID NO: 437314 - DNA, 20 bp, mouse
ggacgcgcgcggaacactgg

SEQ ID NO: 437315 - DNA, 20 bp, mouse
gtgttccgcgcgcgtcaggg

SEQ ID NO: 437316 - DNA, 20 bp, mouse
gggcgagcacgaggaaaggt

SEQ ID NO: 437317 - DNA, 20 bp, mouse
gtagagcgccgggccgagtg

SEQ ID NO: 437318 - DNA, 20 bp, mouse
gcccgggcgagcacgaggaa

SEQ ID NO: 437319 - DNA, 20 bp, mouse
ggagcacgaggaaaggtagg

SEQ ID NO: 437320 - DNA, 20 bp, mouse
gccgctgcgccggtaccggg

SEQ ID NO: 437321 - DNA, 20 bp, mouse
gggcgaacgggctaaggcaa

SEQ ID NO: 437322 - DNA, 20 bp, mouse
gtgcggagccacactcggcc

SEQ ID NO: 437323 - DNA, 20 bp, mouse
gaggtttgcggagccacact

SEQ ID NO: 437324 - DNA, 20 bp, mouse
gggtaggtggagtagagcgc

SEQ ID NO: 437325 - DNA, 20 bp, mouse
gtgggggcgcccagtagggt

SEQ ID NO: 437326 - DNA, 20 bp, mouse
gcccagccgagagggtgttc

SEQ ID NO: 437327 - DNA, 20 bp, mouse
gctctcggctgggacgccgg

SEQ ID NO: 437328 - DNA, 20 bp, mouse
gaactgcccgaacaccctct

SEQ ID NO: 437329 - DNA, 20 bp, mouse
gccctagaaccaggacacaa

SEQ ID NO: 437330 - DNA, 20 bp, mouse
gcagcctggccgccctactg

SEQ ID NO: 437331 - DNA, 20 bp, mouse
gacgccggtggcggagtcgg

SEQ ID NO: 437332 - DNA, 20 bp, mouse
ggctgtgcgtccatgcactg

SEQ ID NO: 437333 - DNA, 20 bp, mouse
gtcggctgggacgccggtgg

SEQ ID NO: 437334 - DNA, 20 bp, mouse
ggcgcccccgactccgccac

SEQ ID NO: 437335 - DNA, 20 bp, mouse
ggcgcggcactgccacagta

SEQ ID NO: 437336 - DNA, 20 bp, mouse
ggcgcactagaacagctcag

SEQ ID NO: 437337 - DNA, 20 bp, mouse
gagtgcgcggcgtggagcca

SEQ ID NO: 437338 - DNA, 20 bp, mouse
ggaacagctcaggggactga

SEQ ID NO: 437339 - DNA, 20 bp, mouse
gtgagcaacgcggggatcca

SEQ ID NO: 437340 - DNA, 20 bp, mouse
ggtgaccagctagatcccag

SEQ ID NO: 437341 - DNA, 20 bp, mouse
gggcgaggccggcgccagga

SEQ ID NO: 437342 - DNA, 20 bp, mouse
ggcgcccaggtagggagaag

SEQ ID NO: 437343 - DNA, 20 bp, mouse
gcctacctgggcgccagcag

SEQ ID NO: 437344 - DNA, 20 bp, mouse
gctgacccgagcgcaggaga

SEQ ID NO: 437345 - DNA, 20 bp, mouse
gacccttggactccacggta

SEQ ID NO: 437346 - DNA, 20 bp, mouse
ggcccccgcagccggcagga

SEQ ID NO: 437347 - DNA, 20 bp, mouse
gtggccgacgtgggagagaa

SEQ ID NO: 437348 - DNA, 20 bp, mouse
gtggcagagggcaaggcggg

SEQ ID NO: 437349 - DNA, 20 bp, mouse
gaggctgcctaccttctcct

SEQ ID NO: 437350 - DNA, 20 bp, mouse
gctgcatctgcttggcgaag

SEQ ID NO: 437351 - DNA, 20 bp, mouse
gggcgacaggaaggaacgaa

SEQ ID NO: 437352 - DNA, 20 bp, mouse
gaggggcctctagaaaccac

SEQ ID NO: 437353 - DNA, 20 bp, mouse
ggtttctagaggcccctgag

SEQ ID NO: 437354 - DNA, 20 bp, mouse
gtgtcctagcgcaaaggcaa

SEQ ID NO: 437355 - DNA, 20 bp, mouse
gctctagaaaccacaggtcc

SEQ ID NO: 437356 - DNA, 20 bp, mouse
gctccgggagagcaccgagg

SEQ ID NO: 437357 - DNA, 20 bp, mouse
gggaaatgcgatgggagaaa

SEQ ID NO: 437358 - DNA, 20 bp, mouse
gagcctccgggagagcaccg

SEQ ID NO: 437359 - DNA, 20 bp, mouse
gaggctaagggatcctcctc

SEQ ID NO: 437360 - DNA, 20 bp, mouse
ggcggtgtagagatgcccac

SEQ ID NO: 437361 - DNA, 20 bp, mouse
gcctggagactggccgaatc

SEQ ID NO: 437362 - DNA, 20 bp, mouse
ggcctcttccgggcataagg

SEQ ID NO: 437363 - DNA, 20 bp, mouse
gtctctcggccagactcccg

SEQ ID NO: 437364 - DNA, 20 bp, mouse
ggaggctcccggaaccgctt

SEQ ID NO: 437365 - DNA, 20 bp, mouse
gggttctcgaggatcacttc

SEQ ID NO: 437366 - DNA, 20 bp, mouse
gtggaaagggccttaaacac

SEQ ID NO: 437367 - DNA, 20 bp, mouse
gaattataacagacttatag

SEQ ID NO: 437368 - DNA, 20 bp, mouse
gcaactgcagcagtcagctc

SEQ ID NO: 437369 - DNA, 20 bp, mouse
gacatttctataagacgctg

SEQ ID NO: 437370 - DNA, 20 bp, mouse
ggatatatacagagtcaagg

SEQ ID NO: 437371 - DNA, 20 bp, mouse
gcatgatatatacagagtca

SEQ ID NO: 437372 - DNA, 20 bp, mouse
gaacagacttatagtggaaa

SEQ ID NO: 437373 - DNA, 20 bp, mouse
gctttataaaatgcagtctt

SEQ ID NO: 437374 - DNA, 20 bp, mouse
gactacagtattcactgtaa

SEQ ID NO: 437375 - DNA, 20 bp, mouse
gatacagtattctctaaagt

SEQ ID NO: 437376 - DNA, 20 bp, mouse
gccagccagggtccccgtag

SEQ ID NO: 437377 - DNA, 20 bp, mouse
gagtggctcgaggatcaccg

SEQ ID NO: 437378 - DNA, 20 bp, mouse
gtgatcctcgagccactacg

SEQ ID NO: 437379 - DNA, 20 bp, mouse
gagggctccggggaactcca

SEQ ID NO: 437380 - DNA, 20 bp, mouse
gtgccacccccggagatcag

SEQ ID NO: 437381 - DNA, 20 bp, mouse
gccttcggatctagtcaccc

SEQ ID NO: 437382 - DNA, 20 bp, mouse
gcgcgcgtggggatccagcc

SEQ ID NO: 437383 - DNA, 20 bp, mouse
ggggagggcgacctacaggt

SEQ ID NO: 437384 - DNA, 20 bp, mouse
ggtggccaccaagggtgagg

SEQ ID NO: 437385 - DNA, 20 bp, mouse
gcaggcgagggtgccacccc

SEQ ID NO: 437386 - DNA, 20 bp, mouse
gagcgccggagctcccatga

SEQ ID NO: 437387 - DNA, 20 bp, mouse
ggttgtggtgacgccatcat

SEQ ID NO: 437388 - DNA, 20 bp, mouse
ggtcgtcttggcggaggttg

SEQ ID NO: 437389 - DNA, 20 bp, mouse
gatcccgggtcacacaacta

SEQ ID NO: 437390 - DNA, 20 bp, mouse
ggaggcccggaggctaacag

SEQ ID NO: 437391 - DNA, 20 bp, mouse
gtcctgcgtttgagtcgtct

SEQ ID NO: 437392 - DNA, 20 bp, mouse
gaacagtacgaagcgagggt

SEQ ID NO: 437393 - DNA, 20 bp, mouse
gacagtgggaagaggcccgg

SEQ ID NO: 437394 - DNA, 20 bp, mouse
ggtttgagtcgtcttggcgg

SEQ ID NO: 437395 - DNA, 20 bp, mouse
gggcgatgcggtagttcttg

SEQ ID NO: 437396 - DNA, 20 bp, mouse
gagcgcaggccggaagatgg

SEQ ID NO: 437397 - DNA, 20 bp, mouse
gtcccgggactgtcactgag

SEQ ID NO: 437398 - DNA, 20 bp, mouse
gctgtggtgctgcacctccc

SEQ ID NO: 437399 - DNA, 20 bp, mouse
gaagcgccgggtggtaggag

SEQ ID NO: 437400 - DNA, 20 bp, mouse
gagccgctcagtgacagtcc

SEQ ID NO: 437401 - DNA, 20 bp, mouse
gggaccatcaaagtcatcga

SEQ ID NO: 437402 - DNA, 20 bp, mouse
ggagaggctgtgcagcccgt

SEQ ID NO: 437403 - DNA, 20 bp, mouse
gggcggccggggtctccgag

SEQ ID NO: 437404 - DNA, 20 bp, mouse
ggcgttaagcgccgggtggt

SEQ ID NO: 437405 - DNA, 20 bp, mouse
gccgagctgctcctccgcgg

SEQ ID NO: 437406 - DNA, 20 bp, mouse
gagcctctgggaaggactag

SEQ ID NO: 437407 - DNA, 20 bp, mouse
gcaagctgctagatgctcag

SEQ ID NO: 437408 - DNA, 20 bp, mouse
gtccatggggcctgagagta

SEQ ID NO: 437409 - DNA, 20 bp, mouse
gagaggcagtggcggtgtcc

SEQ ID NO: 437410 - DNA, 20 bp, mouse
gcctggcctctctcagaaag

SEQ ID NO: 437411 - DNA, 20 bp, mouse
gggcccagaactaagccaca

SEQ ID NO: 437412 - DNA, 20 bp, mouse
ggcaggaacaccacagcctc

SEQ ID NO: 437413 - DNA, 20 bp, mouse
ggctggcaggcacataacaa

SEQ ID NO: 437414 - DNA, 20 bp, mouse
ggaagaggaagaatcctctg

SEQ ID NO: 437415 - DNA, 20 bp, mouse
ggctggaacggtacaacacc

SEQ ID NO: 437416 - DNA, 20 bp, mouse
gtctctgaggagagatgtaa

SEQ ID NO: 437417 - DNA, 20 bp, mouse
ggggtcgagctgagtctctg

SEQ ID NO: 437418 - DNA, 20 bp, mouse
gcgcgcccctggaaggatct

SEQ ID NO: 437419 - DNA, 20 bp, mouse
gagaaagctcggcctgaggg

SEQ ID NO: 437420 - DNA, 20 bp, mouse
gtcgacccagatccttccag

SEQ ID NO: 437421 - DNA, 20 bp, mouse
gtacgcgctagggactggag

SEQ ID NO: 437422 - DNA, 20 bp, mouse
gcagtgacggcgctacggag

SEQ ID NO: 437423 - DNA, 20 bp, mouse
gctcaggccgagctttcttc

SEQ ID NO: 437424 - DNA, 20 bp, mouse
gaccccgccgcgcccctgga

SEQ ID NO: 437425 - DNA, 20 bp, mouse
gctgaggggggtgcatccgt

SEQ ID NO: 437426 - DNA, 20 bp, mouse
gaccaacgccgcaggagctg

SEQ ID NO: 437427 - DNA, 20 bp, mouse
ggtcatctgacgccagacaa

SEQ ID NO: 437428 - DNA, 20 bp, mouse
gaaccccggaacccacccaa

SEQ ID NO: 437429 - DNA, 20 bp, mouse
gctccactagaagacgaagg

SEQ ID NO: 437430 - DNA, 20 bp, mouse
ggacagtggcggcagtgcca

SEQ ID NO: 437431 - DNA, 20 bp, mouse
gcccaggttgggacgaaaag

SEQ ID NO: 437432 - DNA, 20 bp, mouse
gccccggagggctaacatgg

SEQ ID NO: 437433 - DNA, 20 bp, mouse
gcacccccaaggcccaggtt

SEQ ID NO: 437434 - DNA, 20 bp, mouse
gcggaacccacccaagggac

SEQ ID NO: 437435 - DNA, 20 bp, mouse
ggtggggctcgcaggtatcg

SEQ ID NO: 437436 - DNA, 20 bp, mouse
ggcggtctgatcacaacagg

SEQ ID NO: 437437 - DNA, 20 bp, mouse
gtgcttcttagggctgttca

SEQ ID NO: 437438 - DNA, 20 bp, mouse
gccctaagaagcagctcagt

SEQ ID NO: 437439 - DNA, 20 bp, mouse
gctccagaagacttgactgg

SEQ ID NO: 437440 - DNA, 20 bp, mouse
gtcccactgagctgcttctt

SEQ ID NO: 437441 - DNA, 20 bp, mouse
gagtctccagaagacttgac

SEQ ID NO: 437442 - DNA, 20 bp, mouse
gtggttgaagaactttctag

SEQ ID NO: 437443 - DNA, 20 bp, mouse
gtagcggcaaccagaagctc

SEQ ID NO: 437444 - DNA, 20 bp, mouse
gacttctggctcctcagccc

SEQ ID NO: 437445 - DNA, 20 bp, mouse
gatggcggtctgatcacaac

SEQ ID NO: 437446 - DNA, 20 bp, mouse
gcgcgacgtaagcctgagtg

SEQ ID NO: 437447 - DNA, 20 bp, mouse
gtcggcgcgcggagtttgga

SEQ ID NO: 437448 - DNA, 20 bp, mouse
gagcctgagtgaggtgagtt

SEQ ID NO: 437449 - DNA, 20 bp, mouse
ggggcgcaggagggccgtgt

SEQ ID NO: 437450 - DNA, 20 bp, mouse
gccagaccggagtagagacc

SEQ ID NO: 437451 - DNA, 20 bp, mouse
gaggcttacgtcgcgccggg

SEQ ID NO: 437452 - DNA, 20 bp, mouse
ggcgcgcggagtttggatgg

SEQ ID NO: 437453 - DNA, 20 bp, mouse
gtgtggcgagaagcccagac

SEQ ID NO: 437454 - DNA, 20 bp, mouse
gagcgaggctcggagaacct

SEQ ID NO: 437455 - DNA, 20 bp, mouse
gggcctcgggctctgttagt

SEQ ID NO: 437456 - DNA, 20 bp, mouse
gggtccggccagctaggcag

SEQ ID NO: 437457 - DNA, 20 bp, mouse
ggaaccaggtccggccagct

SEQ ID NO: 437458 - DNA, 20 bp, mouse
gaaggaaacccgctcaatgg

SEQ ID NO: 437459 - DNA, 20 bp, mouse
gcgcttagggtgcgagaacc

SEQ ID NO: 437460 - DNA, 20 bp, mouse
gtctctcggccaccattgag

SEQ ID NO: 437461 - DNA, 20 bp, mouse
gagtccgctgcctagctggc

SEQ ID NO: 437462 - DNA, 20 bp, mouse
gttccttcttccggcgctta

SEQ ID NO: 437463 - DNA, 20 bp, mouse
gtcacgccgccgggcctcac

SEQ ID NO: 437464 - DNA, 20 bp, mouse
ggcggacccgtgaggcccgg

SEQ ID NO: 437465 - DNA, 20 bp, mouse
gaagaaggaaacccgctcaa

SEQ ID NO: 437466 - DNA, 20 bp, mouse
gcctggggagcagcatggta

SEQ ID NO: 437467 - DNA, 20 bp, mouse
ggcgctggaggagccctaga

SEQ ID NO: 437468 - DNA, 20 bp, mouse
ggagcagcatggtaaggctc

SEQ ID NO: 437469 - DNA, 20 bp, mouse
ggatgtgtcgctgtccaggg

SEQ ID NO: 437470 - DNA, 20 bp, mouse
gtcgcagaagtcagttccag

SEQ ID NO: 437471 - DNA, 20 bp, mouse
gacttctgcgagcaacccac

SEQ ID NO: 437472 - DNA, 20 bp, mouse
gccagtggcttgagttcttg

SEQ ID NO: 437473 - DNA, 20 bp, mouse
ggctgctccccaggaagtcc

SEQ ID NO: 437474 - DNA, 20 bp, mouse
ggggctcctccagcgctcag

SEQ ID NO: 437475 - DNA, 20 bp, mouse
gggagctgctgacacccccc

SEQ ID NO: 437476 - DNA, 20 bp, mouse
gagttcctgcagccttaggg

SEQ ID NO: 437477 - DNA, 20 bp, mouse
gcgggtaacctcccagatca

SEQ ID NO: 437478 - DNA, 20 bp, mouse
gacctcccagatcaaggaga

SEQ ID NO: 437479 - DNA, 20 bp, mouse
gtccagttcctgcagcctta

SEQ ID NO: 437480 - DNA, 20 bp, mouse
gggtggcgcagggacccgag

SEQ ID NO: 437481 - DNA, 20 bp, mouse
gagcgggcgacccgagtgcc

SEQ ID NO: 437482 - DNA, 20 bp, mouse
gtctggaagaagctaggccg

SEQ ID NO: 437483 - DNA, 20 bp, mouse
ggacccctccctaaggctgc

SEQ ID NO: 437484 - DNA, 20 bp, mouse
ggcctgggcgggattgaggg

SEQ ID NO: 437485 - DNA, 20 bp, mouse
gagtggtgccaaggggacca

SEQ ID NO: 437486 - DNA, 20 bp, mouse
gacagggtagtacctcgagg

SEQ ID NO: 437487 - DNA, 20 bp, mouse
gccggaagcagccttgggtc

SEQ ID NO: 437488 - DNA, 20 bp, mouse
gaggctgcttccggttctaa

SEQ ID NO: 437489 - DNA, 20 bp, mouse
gggtggcaggaggagaacga

SEQ ID NO: 437490 - DNA, 20 bp, mouse
gggcaggaggagaacgaagg

SEQ ID NO: 437491 - DNA, 20 bp, mouse
ggcgggagcccaagtcggga

SEQ ID NO: 437492 - DNA, 20 bp, mouse
ggacctgtctaccgcagtca

SEQ ID NO: 437493 - DNA, 20 bp, mouse
gaggcggcgggagcccaagt

SEQ ID NO: 437494 - DNA, 20 bp, mouse
gcatctggcaaggtgtgggt

SEQ ID NO: 437495 - DNA, 20 bp, mouse
gccgcatctccatccacaca

SEQ ID NO: 437496 - DNA, 20 bp, mouse
gcccggaaggaaggccatac

SEQ ID NO: 437497 - DNA, 20 bp, mouse
gtccgaggctccgagcccaa

SEQ ID NO: 437498 - DNA, 20 bp, mouse
ggctcggagcctcggagacc

SEQ ID NO: 437499 - DNA, 20 bp, mouse
gaggccataccgggtctccg

SEQ ID NO: 437500 - DNA, 20 bp, mouse
ggccaccgacaccagagtcc

SEQ ID NO: 437501 - DNA, 20 bp, mouse
ggccaggcagcggacccctt

SEQ ID NO: 437502 - DNA, 20 bp, mouse
gagaccggctcacttccgcc

SEQ ID NO: 437503 - DNA, 20 bp, mouse
gtccgggactctggtgtcgg

SEQ ID NO: 437504 - DNA, 20 bp, mouse
gccccttgggctcggagcct

SEQ ID NO: 437505 - DNA, 20 bp, mouse
gccttccgggactctggtgt

SEQ ID NO: 437506 - DNA, 20 bp, mouse
gtctcgagacagggttccga

SEQ ID NO: 437507 - DNA, 20 bp, mouse
gcgagacagggttccgacgg

SEQ ID NO: 437508 - DNA, 20 bp, mouse
ggtagagacctctcgagaca

SEQ ID NO: 437509 - DNA, 20 bp, mouse
gcgagaggtctctaccgagg

SEQ ID NO: 437510 - DNA, 20 bp, mouse
gtggaggaaggacccgccgt

SEQ ID NO: 437511 - DNA, 20 bp, mouse
gctggaggcgtagcccgagg

SEQ ID NO: 437512 - DNA, 20 bp, mouse
gcccaacggctcggcctcct

SEQ ID NO: 437513 - DNA, 20 bp, mouse
ggaagcggccgagcgggcca

SEQ ID NO: 437514 - DNA, 20 bp, mouse
gcgctccacgcggcgcccaa

SEQ ID NO: 437515 - DNA, 20 bp, mouse
gccaaggtggacgagttcgt

SEQ ID NO: 437516 - DNA, 20 bp, mouse
gaactggtcgggatgagtgg

SEQ ID NO: 437517 - DNA, 20 bp, mouse
gcggaactggtcgggatgag

SEQ ID NO: 437518 - DNA, 20 bp, mouse
ggcggcgtcgcacgctacag

SEQ ID NO: 437519 - DNA, 20 bp, mouse
gcgccgtggacgccgcgggt

SEQ ID NO: 437520 - DNA, 20 bp, mouse
gcgtgcgacgccgcccaggg

SEQ ID NO: 437521 - DNA, 20 bp, mouse
gtggtcgggatgagtggcgg

SEQ ID NO: 437522 - DNA, 20 bp, mouse
ggaccagttccgcccacccg

SEQ ID NO: 437523 - DNA, 20 bp, mouse
gtcgcacgctacaggggtct

SEQ ID NO: 437524 - DNA, 20 bp, mouse
ggcgcaggcacggaccttta

SEQ ID NO: 437525 - DNA, 20 bp, mouse
gtagcgtgcgacgccgccca

SEQ ID NO: 437526 - DNA, 20 bp, mouse
gctgcgtgaggcgagtgctg

SEQ ID NO: 437527 - DNA, 20 bp, mouse
gtaaggaccccgtctggagg

SEQ ID NO: 437528 - DNA, 20 bp, mouse
gccgcactgggcgctgcgtg

SEQ ID NO: 437529 - DNA, 20 bp, mouse
gggaccccgtctggaggcgg

SEQ ID NO: 437530 - DNA, 20 bp, mouse
gacaggggccgggttcgagt

SEQ ID NO: 437531 - DNA, 20 bp, mouse
gccgtaaggaccccgtctgg

SEQ ID NO: 437532 - DNA, 20 bp, mouse
ggctgtcggaaggccccgta

SEQ ID NO: 437533 - DNA, 20 bp, mouse
ggccccgtaaggaccccgtc

SEQ ID NO: 437534 - DNA, 20 bp, mouse
ggagccaccgcctccagacg

SEQ ID NO: 437535 - DNA, 20 bp, mouse
gaggccggcgagcccacgcc

SEQ ID NO: 437536 - DNA, 20 bp, mouse
gagctcgtgagccgctggta

SEQ ID NO: 437537 - DNA, 20 bp, mouse
gccagagctcaccttaccag

SEQ ID NO: 437538 - DNA, 20 bp, mouse
gggtgagctctggccgggag

SEQ ID NO: 437539 - DNA, 20 bp, mouse
gctgctgggacgctgcaatt

SEQ ID NO: 437540 - DNA, 20 bp, mouse
gcaatttgggcgcgctgaag

SEQ ID NO: 437541 - DNA, 20 bp, mouse
gggtaaggtgagctctggcc

SEQ ID NO: 437542 - DNA, 20 bp, mouse
ggccttggcctcccgtctca

SEQ ID NO: 437543 - DNA, 20 bp, mouse
ggagcgcacgaccctgagac

SEQ ID NO: 437544 - DNA, 20 bp, mouse
ggcggaagctcgtgagccgc

SEQ ID NO: 437545 - DNA, 20 bp, mouse
gccccggtccggcctgcgaa

SEQ ID NO: 437546 - DNA, 20 bp, mouse
gagatgtcaacactgtaagg

SEQ ID NO: 437547 - DNA, 20 bp, mouse
ggaggaaaccgtggtgtgat

SEQ ID NO: 437548 - DNA, 20 bp, mouse
gagctaagaagaggaaaccg

SEQ ID NO: 437549 - DNA, 20 bp, mouse
gttggggcgcgaactctcta

SEQ ID NO: 437550 - DNA, 20 bp, mouse
gcccacagccgtgagcaagt

SEQ ID NO: 437551 - DNA, 20 bp, mouse
gtttagatgtcaacactgta

SEQ ID NO: 437552 - DNA, 20 bp, mouse
ggaggccaagatgagtactg

SEQ ID NO: 437553 - DNA, 20 bp, mouse
gcacggctgtgggtgataga

SEQ ID NO: 437554 - DNA, 20 bp, mouse
ggagcaagtgggtagcttag

SEQ ID NO: 437555 - DNA, 20 bp, mouse
gagagaggttcgggatcttg

SEQ ID NO: 437556 - DNA, 20 bp, mouse
gaggacgcgcgggaacacag

SEQ ID NO: 437557 - DNA, 20 bp, mouse
gggaaaagctgagaactccg

SEQ ID NO: 437558 - DNA, 20 bp, mouse
gggccgggcggagaccacac

SEQ ID NO: 437559 - DNA, 20 bp, mouse
gatgctgcggggtccagggc

SEQ ID NO: 437560 - DNA, 20 bp, mouse
ggggcggagaccacacgggg

SEQ ID NO: 437561 - DNA, 20 bp, mouse
ggaacacagtggctgcgagg

SEQ ID NO: 437562 - DNA, 20 bp, mouse
gtcctcgacccagaaggagg

SEQ ID NO: 437563 - DNA, 20 bp, mouse
gggccagcaagtggtcacgg

SEQ ID NO: 437564 - DNA, 20 bp, mouse
ggagaactccgaggacgcgc

SEQ ID NO: 437565 - DNA, 20 bp, mouse
gtcctcctcgacccagaagg

SEQ ID NO: 437566 - DNA, 20 bp, mouse
ggaggcgctgcgtgtcaggg

SEQ ID NO: 437567 - DNA, 20 bp, mouse
gctgcgtgtcagggaggctt

SEQ ID NO: 437568 - DNA, 20 bp, mouse
gagcgaggcgctgcgtgtca

SEQ ID NO: 437569 - DNA, 20 bp, mouse
ggttggcttccgagtgccag

SEQ ID NO: 437570 - DNA, 20 bp, mouse
gcagggaggcttgggcgggt

SEQ ID NO: 437571 - DNA, 20 bp, mouse
gtcctgacagggacaaactt

SEQ ID NO: 437572 - DNA, 20 bp, mouse
ggacagggtctactatgtat

SEQ ID NO: 437573 - DNA, 20 bp, mouse
gccgagtttaaaaggagagg

SEQ ID NO: 437574 - DNA, 20 bp, mouse
gggaagaggctcctcctgac

SEQ ID NO: 437575 - DNA, 20 bp, mouse
gacttgggctcatactcctg

SEQ ID NO: 437576 - DNA, 20 bp, mouse
ggaggccacggcacaccgcg

SEQ ID NO: 437577 - DNA, 20 bp, mouse
ggggtgaccacggggagttg

SEQ ID NO: 437578 - DNA, 20 bp, mouse
ggactgctgcaggcgcgagc

SEQ ID NO: 437579 - DNA, 20 bp, mouse
ggtttgcgggatgcccggag

SEQ ID NO: 437580 - DNA, 20 bp, mouse
gaggcgcgagctggcgcggg

SEQ ID NO: 437581 - DNA, 20 bp, mouse
gaataccgcgcggtgtgccg

SEQ ID NO: 437582 - DNA, 20 bp, mouse
gaccgggctgcggtgggagg

SEQ ID NO: 437583 - DNA, 20 bp, mouse
ggcctccgggtgtaactgtg

SEQ ID NO: 437584 - DNA, 20 bp, mouse
ggcgctcaccgggctgcggt

SEQ ID NO: 437585 - DNA, 20 bp, mouse
gtccgctccccacttcccgg

SEQ ID NO: 437586 - DNA, 20 bp, mouse
gcggcgcgaggcgatctgag

SEQ ID NO: 437587 - DNA, 20 bp, mouse
ggcggaggcgctgacagcgt

SEQ ID NO: 437588 - DNA, 20 bp, mouse
gccggccccgcagaataata

SEQ ID NO: 437589 - DNA, 20 bp, mouse
gtgcacggctgaaggcagag

SEQ ID NO: 437590 - DNA, 20 bp, mouse
gcctacgtacccggaaagag

SEQ ID NO: 437591 - DNA, 20 bp, mouse
gggaggcggcggctgcgccg

SEQ ID NO: 437592 - DNA, 20 bp, mouse
gtccgggtacgtaggaggcg

SEQ ID NO: 437593 - DNA, 20 bp, mouse
gggcggcggctgcgccgagg

SEQ ID NO: 437594 - DNA, 20 bp, mouse
gcagagatcgggagagacaa

SEQ ID NO: 437595 - DNA, 20 bp, mouse
ggagggtggaaaaaaatgca

SEQ ID NO: 437596 - DNA, 20 bp, mouse
ggggagcgctgaaggcgaag

SEQ ID NO: 437597 - DNA, 20 bp, mouse
gggagcggggcgacggggaa

SEQ ID NO: 437598 - DNA, 20 bp, mouse
gacgcgggagcggggcgacg

SEQ ID NO: 437599 - DNA, 20 bp, mouse
gagcgctgaaggcgaagggg

SEQ ID NO: 437600 - DNA, 20 bp, mouse
gaagggagcgaccgagagga

SEQ ID NO: 437601 - DNA, 20 bp, mouse
gacctacgacctgggcgagg

SEQ ID NO: 437602 - DNA, 20 bp, mouse
gtggcggtcgcgcccggacg

SEQ ID NO: 437603 - DNA, 20 bp, mouse
ggcgacccccggctccccca

SEQ ID NO: 437604 - DNA, 20 bp, mouse
gccacgccgggcatgctggc

SEQ ID NO: 437605 - DNA, 20 bp, mouse
gttgtagttgaggagctccg

SEQ ID NO: 437606 - DNA, 20 bp, mouse
gggcagaagacggcgctcag

SEQ ID NO: 437607 - DNA, 20 bp, mouse
gtcagctcccaggccaacct

SEQ ID NO: 437608 - DNA, 20 bp, mouse
gagaagccgagtgagccacc

SEQ ID NO: 437609 - DNA, 20 bp, mouse
gctgctcaaggcccataatg

SEQ ID NO: 437610 - DNA, 20 bp, mouse
gctcccaggccaacctagga

SEQ ID NO: 437611 - DNA, 20 bp, mouse
gcagagagtcatggggtctc

SEQ ID NO: 437612 - DNA, 20 bp, mouse
gaggaaggcttaactcccct

SEQ ID NO: 437613 - DNA, 20 bp, mouse
gactgccagttacagcccag

SEQ ID NO: 437614 - DNA, 20 bp, mouse
ggagttaagccttcctaggt

SEQ ID NO: 437615 - DNA, 20 bp, mouse
gaactcccctgggctgtaac

SEQ ID NO: 437616 - DNA, 20 bp, mouse
gaggagaagaggcccattcc

SEQ ID NO: 437617 - DNA, 20 bp, mouse
gagacaggctaaagtaaccg

SEQ ID NO: 437618 - DNA, 20 bp, mouse
gtaaagtaaccgaggagaag

SEQ ID NO: 437619 - DNA, 20 bp, mouse
gggcctgcacccaatctaat

SEQ ID NO: 437620 - DNA, 20 bp, mouse
gtgggtgcaggccaggttcc

SEQ ID NO: 437621 - DNA, 20 bp, mouse
gcccaatctaataggttaaa

SEQ ID NO: 437622 - DNA, 20 bp, mouse
ggaggcccattccaggaacc

SEQ ID NO: 437623 - DNA, 20 bp, mouse
gctcccacaggaagtaagat

SEQ ID NO: 437624 - DNA, 20 bp, mouse
gtaagatagggtctgccagt

SEQ ID NO: 437625 - DNA, 20 bp, mouse
ggggtcgtcagcaaggaggg

SEQ ID NO: 437626 - DNA, 20 bp, mouse
ggtgcgagcagggctctgcg

SEQ ID NO: 437627 - DNA, 20 bp, mouse
gggcagggcgaggactccgg

SEQ ID NO: 437628 - DNA, 20 bp, mouse
gagcagggctctgcgcggca

SEQ ID NO: 437629 - DNA, 20 bp, mouse
ggtccggggctgccaatccc

SEQ ID NO: 437630 - DNA, 20 bp, mouse
ggctgtgggaagcgcagcgg

SEQ ID NO: 437631 - DNA, 20 bp, mouse
gccgtctaagaagcactagg

SEQ ID NO: 437632 - DNA, 20 bp, mouse
gggactggcacgacacgggt

SEQ ID NO: 437633 - DNA, 20 bp, mouse
gccgggagaagctagagtcg

SEQ ID NO: 437634 - DNA, 20 bp, mouse
gcgagggactggcacgacac

SEQ ID NO: 437635 - DNA, 20 bp, mouse
gggcgcagcgaagatctggg

SEQ ID NO: 437636 - DNA, 20 bp, mouse
gtcgggacgcgcggaatgtg

SEQ ID NO: 437637 - DNA, 20 bp, mouse
gacgcgcggaatgtgaggcg

SEQ ID NO: 437638 - DNA, 20 bp, mouse
gcgcgagcgtcggtgcgcag

SEQ ID NO: 437639 - DNA, 20 bp, mouse
gcggccagggctgcgcgctc

SEQ ID NO: 437640 - DNA, 20 bp, mouse
gctcggatgcccaagtcgga

SEQ ID NO: 437641 - DNA, 20 bp, mouse
gcgctcgcgcgcgcgaaggg

SEQ ID NO: 437642 - DNA, 20 bp, mouse
gtcggccagcgactcctcca

SEQ ID NO: 437643 - DNA, 20 bp, mouse
ggctgcgcgctcgggacgcg

SEQ ID NO: 437644 - DNA, 20 bp, mouse
gccaagtcggagggcagcgg

SEQ ID NO: 437645 - DNA, 20 bp, mouse
ggcggccgaccgtcttcgag

SEQ ID NO: 437646 - DNA, 20 bp, mouse
gcctctggctcgccttccta

SEQ ID NO: 437647 - DNA, 20 bp, mouse
gtgctccagctgccttagga

SEQ ID NO: 437648 - DNA, 20 bp, mouse
gaggcgagccagaggctaga

SEQ ID NO: 437649 - DNA, 20 bp, mouse
ggcctggagcgaagtaacca

SEQ ID NO: 437650 - DNA, 20 bp, mouse
ggagttctccctctagcctc

SEQ ID NO: 437651 - DNA, 20 bp, mouse
gcctccagaagagagaagcc

SEQ ID NO: 437652 - DNA, 20 bp, mouse
gagccagaaccagaagggta

SEQ ID NO: 437653 - DNA, 20 bp, mouse
ggccggagggcggaaggtct

SEQ ID NO: 437654 - DNA, 20 bp, mouse
gagtctcaggtggcacggaa

SEQ ID NO: 437655 - DNA, 20 bp, mouse
ggctccaggcttctctcttc

SEQ ID NO: 437656 - DNA, 20 bp, mouse
gcccggaagctaggtgagtt

SEQ ID NO: 437657 - DNA, 20 bp, mouse
ggaggcctggcccggaagct

SEQ ID NO: 437658 - DNA, 20 bp, mouse
gtgcagcgcagcggcgtctt

SEQ ID NO: 437659 - DNA, 20 bp, mouse
gggacggagaccagatactc

SEQ ID NO: 437660 - DNA, 20 bp, mouse
ggtgggaaggcaagagcgcg

SEQ ID NO: 437661 - DNA, 20 bp, mouse
gaggctgggttgcagcgcag

SEQ ID NO: 437662 - DNA, 20 bp, mouse
gagcagggcaacctggagag

SEQ ID NO: 437663 - DNA, 20 bp, mouse
gagatgtgagagggtggtgc

SEQ ID NO: 437664 - DNA, 20 bp, mouse
gacgagaatcccatcaggga

SEQ ID NO: 437665 - DNA, 20 bp, mouse
gcagtctctggccctcgacc

SEQ ID NO: 437666 - DNA, 20 bp, mouse
gcttagatctctcttgaaga

SEQ ID NO: 437667 - DNA, 20 bp, mouse
gtgttggaattagatttgtc

SEQ ID NO: 437668 - DNA, 20 bp, mouse
gggaattaactgtaagaagg

SEQ ID NO: 437669 - DNA, 20 bp, mouse
ggagattgaatggatttaca

SEQ ID NO: 437670 - DNA, 20 bp, mouse
gggtggaattaactgtaaga

SEQ ID NO: 437671 - DNA, 20 bp, mouse
gctgatctgcaccttggtgt

SEQ ID NO: 437672 - DNA, 20 bp, mouse
gtctacgctgatctgcacct

SEQ ID NO: 437673 - DNA, 20 bp, mouse
gagatgttcaagttatcact

SEQ ID NO: 437674 - DNA, 20 bp, mouse
gatgtaagcacagccctgct

SEQ ID NO: 437675 - DNA, 20 bp, mouse
gaattcacataggaatgcat

SEQ ID NO: 437676 - DNA, 20 bp, mouse
gccgggagcgcagtgcgcag

SEQ ID NO: 437677 - DNA, 20 bp, mouse
gtcccggccgccgccaacgt

SEQ ID NO: 437678 - DNA, 20 bp, mouse
ggagcgcagtgcgcagaggc

SEQ ID NO: 437679 - DNA, 20 bp, mouse
gcgcagcagaaagcccacgt

SEQ ID NO: 437680 - DNA, 20 bp, mouse
gacggtgcccgaaggcggag

SEQ ID NO: 437681 - DNA, 20 bp, mouse
ggcgcgcggagattccgagg

SEQ ID NO: 437682 - DNA, 20 bp, mouse
ggaactcggaacgcaggctg

SEQ ID NO: 437683 - DNA, 20 bp, mouse
ggagagacggtgcccgaagg

SEQ ID NO: 437684 - DNA, 20 bp, mouse
gcgaggcgatgagagagacg

SEQ ID NO: 437685 - DNA, 20 bp, mouse
ggaggcgcgcggagattccg

SEQ ID NO: 437686 - DNA, 20 bp, mouse
gccgcactcgccaggacgca

SEQ ID NO: 437687 - DNA, 20 bp, mouse
gctcgccaggacgcacggca

SEQ ID NO: 437688 - DNA, 20 bp, mouse
gcggagcgcagcaagaacag

SEQ ID NO: 437689 - DNA, 20 bp, mouse
gccgggccagaactgagtaa

SEQ ID NO: 437690 - DNA, 20 bp, mouse
gctggcgagtgcgggccgag

SEQ ID NO: 437691 - DNA, 20 bp, mouse
gcggctctacgcgcgatccg

SEQ ID NO: 437692 - DNA, 20 bp, mouse
ggcgcctccgcagccaggag

SEQ ID NO: 437693 - DNA, 20 bp, mouse
gctgcaggcgagcttcaagg

SEQ ID NO: 437694 - DNA, 20 bp, mouse
gcggagagcgagtgccggag

SEQ ID NO: 437695 - DNA, 20 bp, mouse
ggccccaggtggcagcggag

SEQ ID NO: 437696 - DNA, 20 bp, mouse
gtctgagggacctaccgacg

SEQ ID NO: 437697 - DNA, 20 bp, mouse
gagagcaacgtgggctctca

SEQ ID NO: 437698 - DNA, 20 bp, mouse
gaggcgatcgccgcgtcggt

SEQ ID NO: 437699 - DNA, 20 bp, mouse
ggtccgcaggaggactttgg

SEQ ID NO: 437700 - DNA, 20 bp, mouse
ggagcccgaccagctaccag

SEQ ID NO: 437701 - DNA, 20 bp, mouse
gagtgtccgcaggaggactt

SEQ ID NO: 437702 - DNA, 20 bp, mouse
gaggctcagagccctatcct

SEQ ID NO: 437703 - DNA, 20 bp, mouse
gagccgcctggtgcacccgt

SEQ ID NO: 437704 - DNA, 20 bp, mouse
gccagacggggaggaccaga

SEQ ID NO: 437705 - DNA, 20 bp, mouse
gcccgtaggtgggaacgaac

SEQ ID NO: 437706 - DNA, 20 bp, mouse
gtctgcgggacctacaggct

SEQ ID NO: 437707 - DNA, 20 bp, mouse
gaacgtgggcccgcgcggta

SEQ ID NO: 437708 - DNA, 20 bp, mouse
ggttgctctgcgggacctac

SEQ ID NO: 437709 - DNA, 20 bp, mouse
gagccaggcccagtagccat

SEQ ID NO: 437710 - DNA, 20 bp, mouse
gagagcaacgtgggcccgcg

SEQ ID NO: 437711 - DNA, 20 bp, mouse
gtgcgcgtccgggactccta

SEQ ID NO: 437712 - DNA, 20 bp, mouse
gccagtagccataggagtcc

SEQ ID NO: 437713 - DNA, 20 bp, mouse
ggtagggaatagcgagtgtc

SEQ ID NO: 437714 - DNA, 20 bp, mouse
gggttctagtccccgaaagt

SEQ ID NO: 437715 - DNA, 20 bp, mouse
ggtgccatgacggatgacag

SEQ ID NO: 437716 - DNA, 20 bp, mouse
gagcagcggctgccgagcag

SEQ ID NO: 437717 - DNA, 20 bp, mouse
ggtcacctggagggaatccc

SEQ ID NO: 437718 - DNA, 20 bp, mouse
gagcggctgccgagcagagg

SEQ ID NO: 437719 - DNA, 20 bp, mouse
gcggcgtgccgggagacagt

SEQ ID NO: 437720 - DNA, 20 bp, mouse
ggccggctcagaagcgacag

SEQ ID NO: 437721 - DNA, 20 bp, mouse
gccgcgtcgccgcctctgct

SEQ ID NO: 437722 - DNA, 20 bp, mouse
gccgctgctcgcagtcaaaa

SEQ ID NO: 437723 - DNA, 20 bp, mouse
gctggcagaccggggatgag

SEQ ID NO: 437724 - DNA, 20 bp, mouse
ggtcgcccgggattccctcc

SEQ ID NO: 437725 - DNA, 20 bp, mouse
gtccttcctgacaggtaggg

SEQ ID NO: 437726 - DNA, 20 bp, mouse
ggcgcgagacgacgactgta

SEQ ID NO: 437727 - DNA, 20 bp, mouse
gggccgcgcgaggggcgacc

SEQ ID NO: 437728 - DNA, 20 bp, mouse
gggccgctgcacgccgaggg

SEQ ID NO: 437729 - DNA, 20 bp, mouse
gccgggccgctgcacgccga

SEQ ID NO: 437730 - DNA, 20 bp, mouse
ggactgtacggccgcgcgag

SEQ ID NO: 437731 - DNA, 20 bp, mouse
gggaggccggcgaagtttgg

SEQ ID NO: 437732 - DNA, 20 bp, mouse
gcggctgaggcggcagagat

SEQ ID NO: 437733 - DNA, 20 bp, mouse
ggcgaggggcgaccgggccc

SEQ ID NO: 437734 - DNA, 20 bp, mouse
gctccgccctcggcgtgcag

SEQ ID NO: 437735 - DNA, 20 bp, mouse
gtctcccgcaggccccgcgg

SEQ ID NO: 437736 - DNA, 20 bp, mouse
gggcgtggtgctcgtagtga

SEQ ID NO: 437737 - DNA, 20 bp, mouse
gggacccgggacctgggaag

SEQ ID NO: 437738 - DNA, 20 bp, mouse
ggctcgtagtgagggcgcgg

SEQ ID NO: 437739 - DNA, 20 bp, mouse
gcggcggcggcagaagttgc

SEQ ID NO: 437740 - DNA, 20 bp, mouse
gcgcggaggacccgggacct

SEQ ID NO: 437741 - DNA, 20 bp, mouse
gggtgctcgtagtgagggcg

SEQ ID NO: 437742 - DNA, 20 bp, mouse
ggggacaggagctacggcgg

SEQ ID NO: 437743 - DNA, 20 bp, mouse
gccgccgcttcccaggtccc

SEQ ID NO: 437744 - DNA, 20 bp, mouse
ggagcgggacacccggacag

SEQ ID NO: 437745 - DNA, 20 bp, mouse
gggacccgctgggagagcca

SEQ ID NO: 437746 - DNA, 20 bp, mouse
gcggcaaggcagctacgtag

SEQ ID NO: 437747 - DNA, 20 bp, mouse
gtgacacagacctgtgccat

SEQ ID NO: 437748 - DNA, 20 bp, mouse
gcaggcaaggaagaaaacag

SEQ ID NO: 437749 - DNA, 20 bp, mouse
gcctcgccggagtattacca

SEQ ID NO: 437750 - DNA, 20 bp, mouse
gtcagagctctctctgccca

SEQ ID NO: 437751 - DNA, 20 bp, mouse
gttctccgtgtgtctcggca

SEQ ID NO: 437752 - DNA, 20 bp, mouse
ggctgccttgccgagacaca

SEQ ID NO: 437753 - DNA, 20 bp, mouse
ggaacaccgtggtaatactc

SEQ ID NO: 437754 - DNA, 20 bp, mouse
gagacacacggagaaacacg

SEQ ID NO: 437755 - DNA, 20 bp, mouse
gttggctgctctgcatcagt

SEQ ID NO: 437756 - DNA, 20 bp, mouse
gacgagggaaataattgcag

SEQ ID NO: 437757 - DNA, 20 bp, mouse
gtgtccatggggaagacgca

SEQ ID NO: 437758 - DNA, 20 bp, mouse
ggctccctgcgtcttcccca

SEQ ID NO: 437759 - DNA, 20 bp, mouse
gggacggcccatagcagcca

SEQ ID NO: 437760 - DNA, 20 bp, mouse
gtctcggctccccaaattga

SEQ ID NO: 437761 - DNA, 20 bp, mouse
gaaattgaaggcatgtccat

SEQ ID NO: 437762 - DNA, 20 bp, mouse
gaattgcaggggtttcttct

SEQ ID NO: 437763 - DNA, 20 bp, mouse
ggtcctgctggtcagcacta

SEQ ID NO: 437764 - DNA, 20 bp, mouse
ggcagccagggcacccgaaa

SEQ ID NO: 437765 - DNA, 20 bp, mouse
gtgatatcgtgaaactacga

SEQ ID NO: 437766 - DNA, 20 bp, mouse
gccgaaccgggaagccgacg

SEQ ID NO: 437767 - DNA, 20 bp, mouse
ggcgaaagcactcggactca

SEQ ID NO: 437768 - DNA, 20 bp, mouse
gctgggagcagcctgtcggg

SEQ ID NO: 437769 - DNA, 20 bp, mouse
ggcagcctgtcgggaggtcg

SEQ ID NO: 437770 - DNA, 20 bp, mouse
ggtcgaggaccgaccgaacc

SEQ ID NO: 437771 - DNA, 20 bp, mouse
gcggtcctcgacctcccgac

SEQ ID NO: 437772 - DNA, 20 bp, mouse
gtcgtgcttgcgggctggag

SEQ ID NO: 437773 - DNA, 20 bp, mouse
gcggggctcgcgaaagcact

SEQ ID NO: 437774 - DNA, 20 bp, mouse
gcagcccgcaagcacgacgc

SEQ ID NO: 437775 - DNA, 20 bp, mouse
ggtgctcccgggagtgtgga

SEQ ID NO: 437776 - DNA, 20 bp, mouse
gctggagagaggacagcccg

SEQ ID NO: 437777 - DNA, 20 bp, mouse
gcctgcaagaacgcaacctc

SEQ ID NO: 437778 - DNA, 20 bp, mouse
gctggctgttgggtcagaaa

SEQ ID NO: 437779 - DNA, 20 bp, mouse
ggagcagcttcgcttcaccg

SEQ ID NO: 437780 - DNA, 20 bp, mouse
gtccaggcaccacaacatct

SEQ ID NO: 437781 - DNA, 20 bp, mouse
gttcaccgtggtggacccca

SEQ ID NO: 437782 - DNA, 20 bp, mouse
gggtttggacccagatgttg

SEQ ID NO: 437783 - DNA, 20 bp, mouse
gtctcgctaggcacctaatc

SEQ ID NO: 437784 - DNA, 20 bp, mouse
gtctgagaggctgcctgatt

SEQ ID NO: 437785 - DNA, 20 bp, mouse
ggagacagaaggagcccaaa

SEQ ID NO: 437786 - DNA, 20 bp, mouse
gacgtggaggggcatggtcg

SEQ ID NO: 437787 - DNA, 20 bp, mouse
gtccctgggggcgaaagaca

SEQ ID NO: 437788 - DNA, 20 bp, mouse
gcgtttggaggcgacccgga

SEQ ID NO: 437789 - DNA, 20 bp, mouse
gtccacgtgagcctcgctaa

SEQ ID NO: 437790 - DNA, 20 bp, mouse
gcgagtcatagtccaggtcg

SEQ ID NO: 437791 - DNA, 20 bp, mouse
gggcgacccggaggggtgca

SEQ ID NO: 437792 - DNA, 20 bp, mouse
gtcgcccccagggaccacga

SEQ ID NO: 437793 - DNA, 20 bp, mouse
ggccgttagcgaggctcacg

SEQ ID NO: 437794 - DNA, 20 bp, mouse
gtcaccgtcgtggtccctgg

SEQ ID NO: 437795 - DNA, 20 bp, mouse
ggtcgcggcgttgcgtttgg

SEQ ID NO: 437796 - DNA, 20 bp, mouse
ggggaaggccggctccgcag

SEQ ID NO: 437797 - DNA, 20 bp, mouse
gcagcgaggtgacccgtgag

SEQ ID NO: 437798 - DNA, 20 bp, mouse
gggcggtcgccgagccgggg

SEQ ID NO: 437799 - DNA, 20 bp, mouse
gcggcgcgcgtcccctgccc

SEQ ID NO: 437800 - DNA, 20 bp, mouse
ggacggccagagcgtggatg

SEQ ID NO: 437801 - DNA, 20 bp, mouse
gcgcacagcggagacctcgg

SEQ ID NO: 437802 - DNA, 20 bp, mouse
gacgcggagcggcccgggca

SEQ ID NO: 437803 - DNA, 20 bp, mouse
ggggtcacctcgctgcgacc

SEQ ID NO: 437804 - DNA, 20 bp, mouse
gcatcccgggaggagagtcg

SEQ ID NO: 437805 - DNA, 20 bp, mouse
gccccctgcgcaggagaagt

SEQ ID NO: 437806 - DNA, 20 bp, mouse
ggcagacgcaagcggagagg

SEQ ID NO: 437807 - DNA, 20 bp, mouse
ggacgcaagcggagaggagg

SEQ ID NO: 437808 - DNA, 20 bp, mouse
gagtgcagacgcaagcggag

SEQ ID NO: 437809 - DNA, 20 bp, mouse
gtaccaagtgcagacgcaag

SEQ ID NO: 437810 - DNA, 20 bp, mouse
gacttggtagggacagaccc

SEQ ID NO: 437811 - DNA, 20 bp, mouse
gctaagaggagaccaagagg

SEQ ID NO: 437812 - DNA, 20 bp, mouse
ggacaaccagcatgccgaga

SEQ ID NO: 437813 - DNA, 20 bp, mouse
gtggtagggacagacccggg

SEQ ID NO: 437814 - DNA, 20 bp, mouse
gtggccccaagttctcgagg

SEQ ID NO: 437815 - DNA, 20 bp, mouse
gactggccgccgctcaccta

SEQ ID NO: 437816 - DNA, 20 bp, mouse
gatccggacgtggacatcct

SEQ ID NO: 437817 - DNA, 20 bp, mouse
ggataagcgccttcacctct

SEQ ID NO: 437818 - DNA, 20 bp, mouse
ggcgtgttagggtaactcag

SEQ ID NO: 437819 - DNA, 20 bp, mouse
gcgtagccgcatttccaaca

SEQ ID NO: 437820 - DNA, 20 bp, mouse
gagccgccatgttggaaatg

SEQ ID NO: 437821 - DNA, 20 bp, mouse
gccctaagttagggaccctg

SEQ ID NO: 437822 - DNA, 20 bp, mouse
gaatctcttggttacagatc

SEQ ID NO: 437823 - DNA, 20 bp, mouse
ggaaatgcggctacggcgag

SEQ ID NO: 437824 - DNA, 20 bp, mouse
gggttccaggatggctccta

SEQ ID NO: 437825 - DNA, 20 bp, mouse
gtacagccgagaatgcgggt

SEQ ID NO: 437826 - DNA, 20 bp, mouse
ggggcgtacgcactgaatcc

SEQ ID NO: 437827 - DNA, 20 bp, mouse
gatcttagttgcagtccggg

SEQ ID NO: 437828 - DNA, 20 bp, mouse
gcgtctccacagccgaccaa

SEQ ID NO: 437829 - DNA, 20 bp, mouse
ggaagtgaccacctccggac

SEQ ID NO: 437830 - DNA, 20 bp, mouse
gactgcaactaagatcgtcc

SEQ ID NO: 437831 - DNA, 20 bp, mouse
ggggctacggcacagccgga

SEQ ID NO: 437832 - DNA, 20 bp, mouse
gttcagtgcgtacgccccgg

SEQ ID NO: 437833 - DNA, 20 bp, mouse
gcaagccgtgctcaccccgg

SEQ ID NO: 437834 - DNA, 20 bp, mouse
gagatcgtccgggaaaagct

SEQ ID NO: 437835 - DNA, 20 bp, mouse
gacgatcttagttgcagtcc

SEQ ID NO: 437836 - DNA, 20 bp, mouse
ggcctggcctcagaactgag

SEQ ID NO: 437837 - DNA, 20 bp, mouse
gctgggaggcggtcaccgag

SEQ ID NO: 437838 - DNA, 20 bp, mouse
gcctgcgccgctcagttctg

SEQ ID NO: 437839 - DNA, 20 bp, mouse
gttctgaggccaggcgacac

SEQ ID NO: 437840 - DNA, 20 bp, mouse
ggcccgaacccaactgcgac

SEQ ID NO: 437841 - DNA, 20 bp, mouse
ggaggctcaccacccagccc

SEQ ID NO: 437842 - DNA, 20 bp, mouse
gcactggactgagggacaag

SEQ ID NO: 437843 - DNA, 20 bp, mouse
gtggaggccgcgatgcagtt

SEQ ID NO: 437844 - DNA, 20 bp, mouse
ggccaggcgacactggactg

SEQ ID NO: 437845 - DNA, 20 bp, mouse
ggctgcaccgaactgcatcg

SEQ ID NO: 437846 - DNA, 20 bp, mouse
gtgcgcagacgcagaaaagg

SEQ ID NO: 437847 - DNA, 20 bp, mouse
gaggcgcacgcaactcgggg

SEQ ID NO: 437848 - DNA, 20 bp, mouse
gtgtgttgctgctcgagagc

SEQ ID NO: 437849 - DNA, 20 bp, mouse
gcggaggcgcacgcaactcg

SEQ ID NO: 437850 - DNA, 20 bp, mouse
gggagcagacgacagctcat

SEQ ID NO: 437851 - DNA, 20 bp, mouse
gcgtgcggcggggacaccgg

SEQ ID NO: 437852 - DNA, 20 bp, mouse
gaactcggggtggcaagcgg

SEQ ID NO: 437853 - DNA, 20 bp, mouse
gccaccgcgaccctaaacct

SEQ ID NO: 437854 - DNA, 20 bp, mouse
gacggggccgccgggctcag

SEQ ID NO: 437855 - DNA, 20 bp, mouse
gccccccgcccgcacggcgg

SEQ ID NO: 437856 - DNA, 20 bp, mouse
gcctagaaagtagaggtcct

SEQ ID NO: 437857 - DNA, 20 bp, mouse
gcctaggagagaaaaaggga

SEQ ID NO: 437858 - DNA, 20 bp, mouse
ggcccttcagccatactctc

SEQ ID NO: 437859 - DNA, 20 bp, mouse
gtcatgaagtccggagagta

SEQ ID NO: 437860 - DNA, 20 bp, mouse
gtccggagagtatggctgaa

SEQ ID NO: 437861 - DNA, 20 bp, mouse
ggggaaggaacaacttcaca

SEQ ID NO: 437862 - DNA, 20 bp, mouse
gctgaagggcgtgggaccac

SEQ ID NO: 437863 - DNA, 20 bp, mouse
gcaacttcacaaggtacgtt

SEQ ID NO: 437864 - DNA, 20 bp, mouse
ggagtatggctgaagggcgt

SEQ ID NO: 437865 - DNA, 20 bp, mouse
gctagggttttcatgaagtc

SEQ ID NO: 437866 - DNA, 20 bp, mouse
ggcctgactggagccagaga

SEQ ID NO: 437867 - DNA, 20 bp, mouse
ggggacttgaggaggatagg

SEQ ID NO: 437868 - DNA, 20 bp, mouse
gtggcagggaacgccctctc

SEQ ID NO: 437869 - DNA, 20 bp, mouse
gcacaggaaagtaaagagtt

SEQ ID NO: 437870 - DNA, 20 bp, mouse
gctgtgtcctgtgggacttg

SEQ ID NO: 437871 - DNA, 20 bp, mouse
gtggggaccaggcaagaaac

SEQ ID NO: 437872 - DNA, 20 bp, mouse
gcaggaaggcctggctggca

SEQ ID NO: 437873 - DNA, 20 bp, mouse
gtgaggaagccaggaaggcc

SEQ ID NO: 437874 - DNA, 20 bp, mouse
ggaagagagacgttagaagg

SEQ ID NO: 437875 - DNA, 20 bp, mouse
gagctgctgcttttgctcta

SEQ ID NO: 437876 - DNA, 20 bp, mouse
gcggcggcagcaggcgggca

SEQ ID NO: 437877 - DNA, 20 bp, mouse
gcgcacccaatccctccata

SEQ ID NO: 437878 - DNA, 20 bp, mouse
gtcttccatatggagggatt

SEQ ID NO: 437879 - DNA, 20 bp, mouse
gcagaagttgcggccggagg

SEQ ID NO: 437880 - DNA, 20 bp, mouse
gaaagcgtcttccatatgga

SEQ ID NO: 437881 - DNA, 20 bp, mouse
gcaaaaaagcgtcttccata

SEQ ID NO: 437882 - DNA, 20 bp, mouse
gcacagcgcggtgacacaag

SEQ ID NO: 437883 - DNA, 20 bp, mouse
gtaccgctcgaagaggggag

SEQ ID NO: 437884 - DNA, 20 bp, mouse
gtggagggattgggtgcgct

SEQ ID NO: 437885 - DNA, 20 bp, mouse
ggacacacaccacggcagag

SEQ ID NO: 437886 - DNA, 20 bp, mouse
gacggaggcggcagggtggg

SEQ ID NO: 437887 - DNA, 20 bp, mouse
gtgagctgcgggtctcccgg

SEQ ID NO: 437888 - DNA, 20 bp, mouse
ggcgacggaggcggcagggt

SEQ ID NO: 437889 - DNA, 20 bp, mouse
gggcggcgacggaggcggca

SEQ ID NO: 437890 - DNA, 20 bp, mouse
gaggcttcgggaccgtccgg

SEQ ID NO: 437891 - DNA, 20 bp, mouse
gcggcgagcggggagcgcct

SEQ ID NO: 437892 - DNA, 20 bp, mouse
gctggccgacgtggacacta

SEQ ID NO: 437893 - DNA, 20 bp, mouse
gccccactcgagcccccgga

SEQ ID NO: 437894 - DNA, 20 bp, mouse
gagcctcgggggaccaaggg

SEQ ID NO: 437895 - DNA, 20 bp, mouse
ggagcccggagtaaaacaaa

SEQ ID NO: 437896 - DNA, 20 bp, mouse
ggccgcctgagggaagccaa

SEQ ID NO: 437897 - DNA, 20 bp, mouse
ggcaggcgctccgaggaagg

SEQ ID NO: 437898 - DNA, 20 bp, mouse
gcatcccgttggcttccctc

SEQ ID NO: 437899 - DNA, 20 bp, mouse
gcccgttggcttccctcagg

SEQ ID NO: 437900 - DNA, 20 bp, mouse
gcacaggtcccgccgcctga

SEQ ID NO: 437901 - DNA, 20 bp, mouse
gcgggcaggcgctccgagga

SEQ ID NO: 437902 - DNA, 20 bp, mouse
gagccaacgggatgttgtta

SEQ ID NO: 437903 - DNA, 20 bp, mouse
gttccgtaacaacatcccgt

SEQ ID NO: 437904 - DNA, 20 bp, mouse
gagcggatctagagcaaccc

SEQ ID NO: 437905 - DNA, 20 bp, mouse
ggatgttgttacggaaccag

SEQ ID NO: 437906 - DNA, 20 bp, mouse
ggagcgcgcgggaagaccgg

SEQ ID NO: 437907 - DNA, 20 bp, mouse
gtgcgagcgcgcgggaagac

SEQ ID NO: 437908 - DNA, 20 bp, mouse
ggggtctagaccgccggaga

SEQ ID NO: 437909 - DNA, 20 bp, mouse
gcgccccgcgcgccatgagg

SEQ ID NO: 437910 - DNA, 20 bp, mouse
gtccttaggaccccactcgt

SEQ ID NO: 437911 - DNA, 20 bp, mouse
gtacgcctcccgcacccctc

SEQ ID NO: 437912 - DNA, 20 bp, mouse
gtcccatggtgctacatcca

SEQ ID NO: 437913 - DNA, 20 bp, mouse
gtggtcccgaggggtgcggg

SEQ ID NO: 437914 - DNA, 20 bp, mouse
ggccctggatgtagcaccat

SEQ ID NO: 437915 - DNA, 20 bp, mouse
ggtcctggtcccgaggggtg

SEQ ID NO: 437916 - DNA, 20 bp, mouse
gggctgcgcagcaagtacaa

SEQ ID NO: 437917 - DNA, 20 bp, mouse
ggtctctccgaaccctaggg

SEQ ID NO: 437918 - DNA, 20 bp, mouse
gcggttgttagatcaagcgg

SEQ ID NO: 437919 - DNA, 20 bp, mouse
gatcgtctctccgaacccta

SEQ ID NO: 437920 - DNA, 20 bp, mouse
ggtacaaaggtaccacccta

SEQ ID NO: 437921 - DNA, 20 bp, mouse
gaaggtaccaccctagggtt

SEQ ID NO: 437922 - DNA, 20 bp, mouse
gcgtggtccgaccggaaatt

SEQ ID NO: 437923 - DNA, 20 bp, mouse
ggatcaagcggtggtacagc

SEQ ID NO: 437924 - DNA, 20 bp, mouse
gccagagcgctaggcactaa

SEQ ID NO: 437925 - DNA, 20 bp, mouse
ggccggtagcggagagacaa

SEQ ID NO: 437926 - DNA, 20 bp, mouse
ggtgagggcggaaagcgagg

SEQ ID NO: 437927 - DNA, 20 bp, mouse
gccataaccacagcccggcg

SEQ ID NO: 437928 - DNA, 20 bp, mouse
gtcctagcgggcagaagacc

SEQ ID NO: 437929 - DNA, 20 bp, mouse
ggtcctgccgcagcttctcg

SEQ ID NO: 437930 - DNA, 20 bp, mouse
gtcttctgcccgctaggagg

SEQ ID NO: 437931 - DNA, 20 bp, mouse
ggcggtggggaaggactcct

SEQ ID NO: 437932 - DNA, 20 bp, mouse
gcgtaggaggcgggccgcta

SEQ ID NO: 437933 - DNA, 20 bp, mouse
ggtgcaaagaacctcgcctc

SEQ ID NO: 437934 - DNA, 20 bp, mouse
ggccactgctccagagacac

SEQ ID NO: 437935 - DNA, 20 bp, mouse
gccaagtgctgggaattcaa

SEQ ID NO: 437936 - DNA, 20 bp, mouse
gccggctgcaccgtgacctc

SEQ ID NO: 437937 - DNA, 20 bp, mouse
ggccccgccggctcaccccg

SEQ ID NO: 437938 - DNA, 20 bp, mouse
gtgcccggcgacgcagcccg

SEQ ID NO: 437939 - DNA, 20 bp, mouse
gcgcggctcccgcgcagcag

SEQ ID NO: 437940 - DNA, 20 bp, mouse
gggtgcagccggaaagacgc

SEQ ID NO: 437941 - DNA, 20 bp, mouse
gatcgcaccgggtgtgctgg

SEQ ID NO: 437942 - DNA, 20 bp, mouse
gacacccggtgcgatgcaga

SEQ ID NO: 437943 - DNA, 20 bp, mouse
gtggtaagcatacaattgta

SEQ ID NO: 437944 - DNA, 20 bp, mouse
ggacctcgggctgcgtcgcc

SEQ ID NO: 437945 - DNA, 20 bp, mouse
gtacagagagtcaaggtcag

SEQ ID NO: 437946 - DNA, 20 bp, mouse
gcggtggcgggaaccctcaa

SEQ ID NO: 437947 - DNA, 20 bp, mouse
gcaggcaaacccgccagcag

SEQ ID NO: 437948 - DNA, 20 bp, mouse
gaggggaaggagcaccgagg

SEQ ID NO: 437949 - DNA, 20 bp, mouse
ggaggcggccagcgcgtggt

SEQ ID NO: 437950 - DNA, 20 bp, mouse
ggcgtggtaggtgccgttga

SEQ ID NO: 437951 - DNA, 20 bp, mouse
gccgaggggaaggagcaccg

SEQ ID NO: 437952 - DNA, 20 bp, mouse
ggccagcgagaaattttgtc

SEQ ID NO: 437953 - DNA, 20 bp, mouse
gaccgaggcggtgactgcga

SEQ ID NO: 437954 - DNA, 20 bp, mouse
gttcccgccaccgctgctgg

SEQ ID NO: 437955 - DNA, 20 bp, mouse
gaagcagagggtccagacta

SEQ ID NO: 437956 - DNA, 20 bp, mouse
ggcgatgccggtgacatgtg

SEQ ID NO: 437957 - DNA, 20 bp, mouse
ggcgcggcgcagcatggcgg

SEQ ID NO: 437958 - DNA, 20 bp, mouse
gggtaagccccacatgtcac

SEQ ID NO: 437959 - DNA, 20 bp, mouse
gagtagatcggtagccggcg

SEQ ID NO: 437960 - DNA, 20 bp, mouse
gcagcccagactggacgatc

SEQ ID NO: 437961 - DNA, 20 bp, mouse
ggagcctgatcgtccagtct

SEQ ID NO: 437962 - DNA, 20 bp, mouse
ggcagcgtgtagtgtcgtgt

SEQ ID NO: 437963 - DNA, 20 bp, mouse
gcaggcacttggcaagacca

SEQ ID NO: 437964 - DNA, 20 bp, mouse
ggcacttggcaagaccaggg

SEQ ID NO: 437965 - DNA, 20 bp, mouse
ggcggcagtagatcggtagc

SEQ ID NO: 437966 - DNA, 20 bp, mouse
gagaacgtacctacactcgt

SEQ ID NO: 437967 - DNA, 20 bp, mouse
gccacgttgcccacgagtgt

SEQ ID NO: 437968 - DNA, 20 bp, mouse
gaagagtcggcgcctggcgt

SEQ ID NO: 437969 - DNA, 20 bp, mouse
gagggcgcctggacactgaa

SEQ ID NO: 437970 - DNA, 20 bp, mouse
gcctggcgtgggcatctgca

SEQ ID NO: 437971 - DNA, 20 bp, mouse
gagtgtaggtacgttctccg

SEQ ID NO: 437972 - DNA, 20 bp, mouse
ggagctcacaggtacgtctg

SEQ ID NO: 437973 - DNA, 20 bp, mouse
gcgaagcaggagtccaggcc

SEQ ID NO: 437974 - DNA, 20 bp, mouse
ggagcggtccacctcgaagc

SEQ ID NO: 437975 - DNA, 20 bp, mouse
ggacaggctggacccaggtg

SEQ ID NO: 437976 - DNA, 20 bp, mouse
gtgtagcgatgaatcctcac

SEQ ID NO: 437977 - DNA, 20 bp, mouse
ggcacggcgttaccgaggac

SEQ ID NO: 437978 - DNA, 20 bp, mouse
gaccagtagcagccggtcct

SEQ ID NO: 437979 - DNA, 20 bp, mouse
gagagctggggtactcggga

SEQ ID NO: 437980 - DNA, 20 bp, mouse
gcgtgctgcagacgccagtg

SEQ ID NO: 437981 - DNA, 20 bp, mouse
gaccgaggaccggctgctac

SEQ ID NO: 437982 - DNA, 20 bp, mouse
gctgcagcacggcgttaccg

SEQ ID NO: 437983 - DNA, 20 bp, mouse
gggagggtctcgcttgaagc

SEQ ID NO: 437984 - DNA, 20 bp, mouse
gtgtagcctagaagccaaaa

SEQ ID NO: 437985 - DNA, 20 bp, mouse
gggaaactaccagtagcagc

SEQ ID NO: 437986 - DNA, 20 bp, mouse
gcttgtgcgacctggagcta

SEQ ID NO: 437987 - DNA, 20 bp, mouse
ggccgccgggcgaactgttg

SEQ ID NO: 437988 - DNA, 20 bp, mouse
gagttcgcccggcggcccag

SEQ ID NO: 437989 - DNA, 20 bp, mouse
gccaggtcgcacaagctcca

SEQ ID NO: 437990 - DNA, 20 bp, mouse
ggtgcacagggaaggaactg

SEQ ID NO: 437991 - DNA, 20 bp, mouse
gttgcggtcgccatagctcc

SEQ ID NO: 437992 - DNA, 20 bp, mouse
gaggagcagccgcaaccgct

SEQ ID NO: 437993 - DNA, 20 bp, mouse
gaccgcaacagttcgcccgg

SEQ ID NO: 437994 - DNA, 20 bp, mouse
ggcacgtagaacctaacccc

SEQ ID NO: 437995 - DNA, 20 bp, mouse
gcccggcggcccagcggttg

SEQ ID NO: 437996 - DNA, 20 bp, mouse
gagacctctaggctccactg

SEQ ID NO: 437997 - DNA, 20 bp, mouse
ggcccaggtcatgtcctcta

SEQ ID NO: 437998 - DNA, 20 bp, mouse
gcatgctcgcacagacctct

SEQ ID NO: 437999 - DNA, 20 bp, mouse
gctgccccagtggagcctag

SEQ ID NO: 438000 - DNA, 20 bp, mouse
gactggggcagcccctggac

SEQ ID NO: 438001 - DNA, 20 bp, mouse
gatggccacgaagccagggt

SEQ ID NO: 438002 - DNA, 20 bp, mouse
gtgcggttccccatcaacgt

SEQ ID NO: 438003 - DNA, 20 bp, mouse
gctggtccccaacgttgatg

SEQ ID NO: 438004 - DNA, 20 bp, mouse
gaaaccacaaggcctcggat

SEQ ID NO: 438005 - DNA, 20 bp, mouse
ggctccactggggcagcccc

SEQ ID NO: 438006 - DNA, 20 bp, mouse
gctgctacctggagcatctg

SEQ ID NO: 438007 - DNA, 20 bp, mouse
gtggagcatctgtggagagg

SEQ ID NO: 438008 - DNA, 20 bp, mouse
gaggccaggtctctcactgt

SEQ ID NO: 438009 - DNA, 20 bp, mouse
gcttggcaaagtgataggag

SEQ ID NO: 438010 - DNA, 20 bp, mouse
ggagagggtgacattgatag

SEQ ID NO: 438011 - DNA, 20 bp, mouse
gctccaggtagcagaaggcc

SEQ ID NO: 438012 - DNA, 20 bp, mouse
ggtgacattgatagaggagt

SEQ ID NO: 438013 - DNA, 20 bp, mouse
gtaggctggtgctggaagac

SEQ ID NO: 438014 - DNA, 20 bp, mouse
gccagtccctgtccccgtca

SEQ ID NO: 438015 - DNA, 20 bp, mouse
ggatgagggccgagcaggtc

SEQ ID NO: 438016 - DNA, 20 bp, mouse
gctcctgtggactctcagat

SEQ ID NO: 438017 - DNA, 20 bp, mouse
gacgatctcctgggattcta

SEQ ID NO: 438018 - DNA, 20 bp, mouse
gttcccatctgagagtccac

SEQ ID NO: 438019 - DNA, 20 bp, mouse
gctccccagagagcacatct

SEQ ID NO: 438020 - DNA, 20 bp, mouse
gaacctagatgtgctctctg

SEQ ID NO: 438021 - DNA, 20 bp, mouse
ggactgtgctgctccaagtt

SEQ ID NO: 438022 - DNA, 20 bp, mouse
ggagatagctatttccccta

SEQ ID NO: 438023 - DNA, 20 bp, mouse
gttggagcagcacagtccct

SEQ ID NO: 438024 - DNA, 20 bp, mouse
gctccaagtttggtggagaa

SEQ ID NO: 438025 - DNA, 20 bp, mouse
gtgtgctgctccaagtttgg

SEQ ID NO: 438026 - DNA, 20 bp, mouse
ggtccatgtgagctaaccct

SEQ ID NO: 438027 - DNA, 20 bp, mouse
ggctgtccccagcatgctgt

SEQ ID NO: 438028 - DNA, 20 bp, mouse
gctgtgggaggtggtgcaaa

SEQ ID NO: 438029 - DNA, 20 bp, mouse
gcaaggctagcaatccgagg

SEQ ID NO: 438030 - DNA, 20 bp, mouse
ggggcaaggctagcaatccg

SEQ ID NO: 438031 - DNA, 20 bp, mouse
gtatggccacccagatcgat

SEQ ID NO: 438032 - DNA, 20 bp, mouse
gcaatccgaggaggagaacc

SEQ ID NO: 438033 - DNA, 20 bp, mouse
ggtccaggccaaggctgctt

SEQ ID NO: 438034 - DNA, 20 bp, mouse
gcttacagctgtctttggac

SEQ ID NO: 438035 - DNA, 20 bp, mouse
gccacctcccacagcatgct

SEQ ID NO: 438036 - DNA, 20 bp, mouse
gagtggtgtagcagaggatt

SEQ ID NO: 438037 - DNA, 20 bp, mouse
gagcctcctgctacccagag

SEQ ID NO: 438038 - DNA, 20 bp, mouse
gtgtagcagaggattgggtc

SEQ ID NO: 438039 - DNA, 20 bp, mouse
gtcctctgctacaccactct

SEQ ID NO: 438040 - DNA, 20 bp, mouse
gcagcagaaacaggtagaag

SEQ ID NO: 438041 - DNA, 20 bp, mouse
gcaccactctgggtagcagg

SEQ ID NO: 438042 - DNA, 20 bp, mouse
gccccagtgacaacaccatc

SEQ ID NO: 438043 - DNA, 20 bp, mouse
gacactaacactcttatcaa

SEQ ID NO: 438044 - DNA, 20 bp, mouse
gtaacaaggttaccatcact

SEQ ID NO: 438045 - DNA, 20 bp, mouse
gtctctggagtttctactta

SEQ ID NO: 438046 - DNA, 20 bp, mouse
gctagccacttaggacatgt

SEQ ID NO: 438047 - DNA, 20 bp, mouse
ggagacctacatgtcctaag

SEQ ID NO: 438048 - DNA, 20 bp, mouse
gtcttgtgcctctgaagtga

SEQ ID NO: 438049 - DNA, 20 bp, mouse
gctctatgcagacatttcca

SEQ ID NO: 438050 - DNA, 20 bp, mouse
gcaacagacaccatactcga

SEQ ID NO: 438051 - DNA, 20 bp, mouse
gggggtacaggaaacttacc

SEQ ID NO: 438052 - DNA, 20 bp, mouse
gggtcccagggtggcctgaa

SEQ ID NO: 438053 - DNA, 20 bp, mouse
gagaagaacacttaaatagt

SEQ ID NO: 438054 - DNA, 20 bp, mouse
gcgagggagataaagagctc

SEQ ID NO: 438055 - DNA, 20 bp, mouse
gttgctgtcttaaggtccca

SEQ ID NO: 438056 - DNA, 20 bp, mouse
ggagagaagtcgcttcgctt

SEQ ID NO: 438057 - DNA, 20 bp, mouse
gagggcccaggccccagaac

SEQ ID NO: 438058 - DNA, 20 bp, mouse
ggcagtctctcacctcgggg

SEQ ID NO: 438059 - DNA, 20 bp, mouse
ggttggacacagccaccccg

SEQ ID NO: 438060 - DNA, 20 bp, mouse
ggggtggctgtgtccaaccg

SEQ ID NO: 438061 - DNA, 20 bp, mouse
ggtctcagaggttccacggt

SEQ ID NO: 438062 - DNA, 20 bp, mouse
ggattgcagtctctcacctc

SEQ ID NO: 438063 - DNA, 20 bp, mouse
gctgcggtggcactgtcagg

SEQ ID NO: 438064 - DNA, 20 bp, mouse
gtctcaaggacggagagact

SEQ ID NO: 438065 - DNA, 20 bp, mouse
gagactaggaaggcactgga

SEQ ID NO: 438066 - DNA, 20 bp, mouse
gggcttctagaccctcctca

SEQ ID NO: 438067 - DNA, 20 bp, mouse
gtctagaagcctggacagtc

SEQ ID NO: 438068 - DNA, 20 bp, mouse
gaagatggaagcatgagaca

SEQ ID NO: 438069 - DNA, 20 bp, mouse
gcacattcaggtaaaccgtg

SEQ ID NO: 438070 - DNA, 20 bp, mouse
ggtctctaaacccaccaccc

SEQ ID NO: 438071 - DNA, 20 bp, mouse
ggaagcctggacagtcggga

SEQ ID NO: 438072 - DNA, 20 bp, mouse
gagtcgggaaggttcctcac

SEQ ID NO: 438073 - DNA, 20 bp, mouse
gattcaggtaaaccgtgagg

SEQ ID NO: 438074 - DNA, 20 bp, mouse
gggaaccttcccgactgtcc

SEQ ID NO: 438075 - DNA, 20 bp, mouse
ggtttgaagtccctagactg

SEQ ID NO: 438076 - DNA, 20 bp, mouse
gtggtctgcttggaaggcaa

SEQ ID NO: 438077 - DNA, 20 bp, mouse
gcagctcattcctacctcag

SEQ ID NO: 438078 - DNA, 20 bp, mouse
gttccaagcagaccatctcg

SEQ ID NO: 438079 - DNA, 20 bp, mouse
ggctgtcttcagaacctctg

SEQ ID NO: 438080 - DNA, 20 bp, mouse
gtcttcagaacctctgaggt

SEQ ID NO: 438081 - DNA, 20 bp, mouse
ggcagaagatggcatcccct

SEQ ID NO: 438082 - DNA, 20 bp, mouse
gactggactgtagggtacta

SEQ ID NO: 438083 - DNA, 20 bp, mouse
gcaggcggagtcagttgcaa

SEQ ID NO: 438084 - DNA, 20 bp, mouse
gtagctgaaacccatcaata

SEQ ID NO: 438085 - DNA, 20 bp, mouse
gcatggtccgcaggctgcag

SEQ ID NO: 438086 - DNA, 20 bp, mouse
gcccctgggctcaggtacag

SEQ ID NO: 438087 - DNA, 20 bp, mouse
ggatgggaccgggtcacctg

SEQ ID NO: 438088 - DNA, 20 bp, mouse
gctgtggaggggattaggat

SEQ ID NO: 438089 - DNA, 20 bp, mouse
gacacagtcagtctgtggag

SEQ ID NO: 438090 - DNA, 20 bp, mouse
ggaggcctaggagcacttgg

SEQ ID NO: 438091 - DNA, 20 bp, mouse
gccttctgtgagagacccta

SEQ ID NO: 438092 - DNA, 20 bp, mouse
gaggctggtaaggtggcccc

SEQ ID NO: 438093 - DNA, 20 bp, mouse
ggcctctgtacctgagccca

SEQ ID NO: 438094 - DNA, 20 bp, mouse
ggggaacccacttacagagc

SEQ ID NO: 438095 - DNA, 20 bp, mouse
ggggttctcgctgtatgaca

SEQ ID NO: 438096 - DNA, 20 bp, mouse
gagtgagggagggtgttctg

SEQ ID NO: 438097 - DNA, 20 bp, mouse
ggaggagacggagtgaggga

SEQ ID NO: 438098 - DNA, 20 bp, mouse
gggtgttctgtggcagcgga

SEQ ID NO: 438099 - DNA, 20 bp, mouse
ggtccctgacagaagagctt

SEQ ID NO: 438100 - DNA, 20 bp, mouse
gctcacggacacccggggaa

SEQ ID NO: 438101 - DNA, 20 bp, mouse
gtcaggtagacacccacacc

SEQ ID NO: 438102 - DNA, 20 bp, mouse
gaaccacaggtgatgagatg

SEQ ID NO: 438103 - DNA, 20 bp, mouse
gacaccgggcaggagtctca

SEQ ID NO: 438104 - DNA, 20 bp, mouse
gctgctgtagagaccatcac

SEQ ID NO: 438105 - DNA, 20 bp, mouse
gacacccgtgtggccatcaa

SEQ ID NO: 438106 - DNA, 20 bp, mouse
ggtgctgccccaagcccgag

SEQ ID NO: 438107 - DNA, 20 bp, mouse
ggcactgctgttatgctggg

SEQ ID NO: 438108 - DNA, 20 bp, mouse
gtcactcccctggccagccg

SEQ ID NO: 438109 - DNA, 20 bp, mouse
gactgctcatggcaagaggg

SEQ ID NO: 438110 - DNA, 20 bp, mouse
ggaggaggcaagggagacac

SEQ ID NO: 438111 - DNA, 20 bp, mouse
gtgagtgtgggttgcccctc

SEQ ID NO: 438112 - DNA, 20 bp, mouse
gtggtaaatggacaccagag

SEQ ID NO: 438113 - DNA, 20 bp, mouse
ggggcccacaccagccaaag

SEQ ID NO: 438114 - DNA, 20 bp, mouse
ggctgtgggcagctggtaaa

SEQ ID NO: 438115 - DNA, 20 bp, mouse
gtgcttcagagcctgcgccc

SEQ ID NO: 438116 - DNA, 20 bp, mouse
ggttgtggatgagacactca

SEQ ID NO: 438117 - DNA, 20 bp, mouse
ggccttccccaagcttggca

SEQ ID NO: 438118 - DNA, 20 bp, mouse
gtggatacccgaaaccctat

SEQ ID NO: 438119 - DNA, 20 bp, mouse
ggggtttcgggtatccaagt

SEQ ID NO: 438120 - DNA, 20 bp, mouse
gcctctgtggctgcatccag

SEQ ID NO: 438121 - DNA, 20 bp, mouse
ggcgggtagggcccatatct

SEQ ID NO: 438122 - DNA, 20 bp, mouse
gggcttcctcctcacagaac

SEQ ID NO: 438123 - DNA, 20 bp, mouse
gttgaagatggtgtgttcag

SEQ ID NO: 438124 - DNA, 20 bp, mouse
ggggtcgaagacctagatat

SEQ ID NO: 438125 - DNA, 20 bp, mouse
gagataagagcgtctgactg

SEQ ID NO: 438126 - DNA, 20 bp, mouse
gaaaatgggacactgagtac

SEQ ID NO: 438127 - DNA, 20 bp, mouse
gaagacattgggtctaccat

SEQ ID NO: 438128 - DNA, 20 bp, mouse
gtgcttaagtgcaagacatt

SEQ ID NO: 438129 - DNA, 20 bp, mouse
gactccaagaaacatcaatc

SEQ ID NO: 438130 - DNA, 20 bp, mouse
ggacagcaaaccttcaacaa

SEQ ID NO: 438131 - DNA, 20 bp, mouse
gatgggatgggggataacaa

SEQ ID NO: 438132 - DNA, 20 bp, mouse
ggtgggaaatctagtcagta

SEQ ID NO: 438133 - DNA, 20 bp, mouse
gttaccttgccccttgttga

SEQ ID NO: 438134 - DNA, 20 bp, mouse
gaagacagggaatgtaccat

SEQ ID NO: 438135 - DNA, 20 bp, mouse
gaccattggcatcactttac

SEQ ID NO: 438136 - DNA, 20 bp, mouse
gggcttaagtgcaggacatt

SEQ ID NO: 438137 - DNA, 20 bp, mouse
ggggtgtaccatgggatggg

SEQ ID NO: 438138 - DNA, 20 bp, mouse
gtcctgcacttaagccacag

SEQ ID NO: 438139 - DNA, 20 bp, mouse
gaggacattgggtgtaccat

SEQ ID NO: 438140 - DNA, 20 bp, mouse
ggctctgaaatattcctctg

SEQ ID NO: 438141 - DNA, 20 bp, mouse
gtcctctgtggcttaagtgc

SEQ ID NO: 438142 - DNA, 20 bp, mouse
gaaaaggggacacatgtttc

SEQ ID NO: 438143 - DNA, 20 bp, mouse
gaaaatgggaaacttagtgc

SEQ ID NO: 438144 - DNA, 20 bp, mouse
gctccagtatgctgacctga

SEQ ID NO: 438145 - DNA, 20 bp, mouse
gactcccagaaacatccatc

SEQ ID NO: 438146 - DNA, 20 bp, mouse
gcccaggatgagtccaaagc

SEQ ID NO: 438147 - DNA, 20 bp, mouse
gcaaaggtgaagggaattga

SEQ ID NO: 438148 - DNA, 20 bp, mouse
gttcacctggaaccctccta

SEQ ID NO: 438149 - DNA, 20 bp, mouse
gcccagcacagaaaatccct

SEQ ID NO: 438150 - DNA, 20 bp, mouse
gcagagcagagggatcacaa

SEQ ID NO: 438151 - DNA, 20 bp, mouse
gggattcttacctcaagccc

SEQ ID NO: 438152 - DNA, 20 bp, mouse
ggtcctgaccacaatgactg

SEQ ID NO: 438153 - DNA, 20 bp, mouse
gactcctgcttcaaaggtga

SEQ ID NO: 438154 - DNA, 20 bp, mouse
gtgaaggtactctccagctt

SEQ ID NO: 438155 - DNA, 20 bp, mouse
gacctggaaccctcctaggg

SEQ ID NO: 438156 - DNA, 20 bp, mouse
gattggaccagtggacttgg

SEQ ID NO: 438157 - DNA, 20 bp, mouse
gtggctcgctgtccgggaac

SEQ ID NO: 438158 - DNA, 20 bp, mouse
gacagcgcttaggggacacc

SEQ ID NO: 438159 - DNA, 20 bp, mouse
gtcccggacagcgagccacc

SEQ ID NO: 438160 - DNA, 20 bp, mouse
gtaagcgctgtccggcctgg

SEQ ID NO: 438161 - DNA, 20 bp, mouse
ggcctggtggctcgctgtcc

SEQ ID NO: 438162 - DNA, 20 bp, mouse
gcggctgcctccaagtccac

SEQ ID NO: 438163 - DNA, 20 bp, mouse
gctggtccaatgctgtgaga

SEQ ID NO: 438164 - DNA, 20 bp, mouse
gcacccctggcacagattag

SEQ ID NO: 438165 - DNA, 20 bp, mouse
gcagattagaggagtgccag

SEQ ID NO: 438166 - DNA, 20 bp, mouse
gccccagtcaccgagcgaga

SEQ ID NO: 438167 - DNA, 20 bp, mouse
gggctgcaggcgatccggag

SEQ ID NO: 438168 - DNA, 20 bp, mouse
gaattgccggggccccgctc

SEQ ID NO: 438169 - DNA, 20 bp, mouse
ggccgcggctccgacatgag

SEQ ID NO: 438170 - DNA, 20 bp, mouse
gcgcctccggacccataggg

SEQ ID NO: 438171 - DNA, 20 bp, mouse
gatggcggctgcaggcgatc

SEQ ID NO: 438172 - DNA, 20 bp, mouse
gtgactgggggaaccgacag

SEQ ID NO: 438173 - DNA, 20 bp, mouse
gtcctgcggccgccccccct

SEQ ID NO: 438174 - DNA, 20 bp, mouse
gccccgccggcccctcatgt

SEQ ID NO: 438175 - DNA, 20 bp, mouse
ggcgatccggagcggggccc

SEQ ID NO: 438176 - DNA, 20 bp, mouse
gagatggcggcgctgagtgg

SEQ ID NO: 438177 - DNA, 20 bp, mouse
gccggctcgcgcttcgaaga

SEQ ID NO: 438178 - DNA, 20 bp, mouse
gcgaagatggcggcgctgag

SEQ ID NO: 438179 - DNA, 20 bp, mouse
gaagcgcgagccgggccgag

SEQ ID NO: 438180 - DNA, 20 bp, mouse
gccattcctgaagaggtgag

SEQ ID NO: 438181 - DNA, 20 bp, mouse
gtggcggcgctgagtggcgg

SEQ ID NO: 438182 - DNA, 20 bp, mouse
gtgacgcgcgagcactgggg

SEQ ID NO: 438183 - DNA, 20 bp, mouse
gtccgcagccgaagaggccg

SEQ ID NO: 438184 - DNA, 20 bp, mouse
ggacccggccattcctgaag

SEQ ID NO: 438185 - DNA, 20 bp, mouse
ggcgaggagctacaagacag

SEQ ID NO: 438186 - DNA, 20 bp, mouse
gggcaggctgcgcgcgacgg

SEQ ID NO: 438187 - DNA, 20 bp, mouse
ggcggaagcggaggttgttg

SEQ ID NO: 438188 - DNA, 20 bp, mouse
gaggccgagcggcccgcggt

SEQ ID NO: 438189 - DNA, 20 bp, mouse
ggctcggcgtgggccccggt

SEQ ID NO: 438190 - DNA, 20 bp, mouse
ggaggccgccgactcaccgg

SEQ ID NO: 438191 - DNA, 20 bp, mouse
gcgagggcgacgtcgagcag

SEQ ID NO: 438192 - DNA, 20 bp, mouse
ggcagtcagacagaccggtg

SEQ ID NO: 438193 - DNA, 20 bp, mouse
ggctgaagccgaagtcggtg

SEQ ID NO: 438194 - DNA, 20 bp, mouse
gagcccagccggggaccgag

SEQ ID NO: 438195 - DNA, 20 bp, mouse
ggtcagagacggcggccgac

SEQ ID NO: 438196 - DNA, 20 bp, mouse
gcggggtggagatcctggta

SEQ ID NO: 438197 - DNA, 20 bp, mouse
gaggcgcacgcaggccgggg

SEQ ID NO: 438198 - DNA, 20 bp, mouse
gttagacaccggaacctcag

SEQ ID NO: 438199 - DNA, 20 bp, mouse
gggtggagatcctggtaagg

SEQ ID NO: 438200 - DNA, 20 bp, mouse
gcggagttcgagcttcggcc

SEQ ID NO: 438201 - DNA, 20 bp, mouse
gcttcggccaggcagtctaa

SEQ ID NO: 438202 - DNA, 20 bp, mouse
gcagcgggcgaggcgcacgc

SEQ ID NO: 438203 - DNA, 20 bp, mouse
gtagctgcgagaacagtcag

SEQ ID NO: 438204 - DNA, 20 bp, mouse
ggctcgaactccgccttacc

SEQ ID NO: 438205 - DNA, 20 bp, mouse
gccgtagcggagggatgcgg

SEQ ID NO: 438206 - DNA, 20 bp, mouse
ggacggagaagccccaagag

SEQ ID NO: 438207 - DNA, 20 bp, mouse
gggatccagcacctctcttg

SEQ ID NO: 438208 - DNA, 20 bp, mouse
gccgctgcccgtgcagccag

SEQ ID NO: 438209 - DNA, 20 bp, mouse
gtacttccaagcgccgagga

SEQ ID NO: 438210 - DNA, 20 bp, mouse
ggaagccccaagagaggtgc

SEQ ID NO: 438211 - DNA, 20 bp, mouse
gacacgtcagcggaagggaa

SEQ ID NO: 438212 - DNA, 20 bp, mouse
gctgattaggaaagtacctg

SEQ ID NO: 438213 - DNA, 20 bp, mouse
gtccgtacttccaagcgccg

SEQ ID NO: 438214 - DNA, 20 bp, mouse
gtacctggggcggaaccaaa

SEQ ID NO: 438215 - DNA, 20 bp, mouse
gcaaacaggactcttgggaa

SEQ ID NO: 438216 - DNA, 20 bp, mouse
gcgcagcggtagctgactga

SEQ ID NO: 438217 - DNA, 20 bp, mouse
gatccggcgactgcagaacg

SEQ ID NO: 438218 - DNA, 20 bp, mouse
gacccgctccgctcccgcag

SEQ ID NO: 438219 - DNA, 20 bp, mouse
gtcagctaccgctgcgggag

SEQ ID NO: 438220 - DNA, 20 bp, mouse
ggtgtcaggcgcgtccctca

SEQ ID NO: 438221 - DNA, 20 bp, mouse
gcctcacggcctcacgaccc

SEQ ID NO: 438222 - DNA, 20 bp, mouse
gagcgcacgcccgccacacc

SEQ ID NO: 438223 - DNA, 20 bp, mouse
gaggtcgactggctcctccg

SEQ ID NO: 438224 - DNA, 20 bp, mouse
gccggcgcgtccagagtccg

SEQ ID NO: 438225 - DNA, 20 bp, mouse
ggagccgagacacacacgtt

SEQ ID NO: 438226 - DNA, 20 bp, mouse
gcgcccttggcggacgtgag

SEQ ID NO: 438227 - DNA, 20 bp, mouse
gaggcggctgggaggccata

SEQ ID NO: 438228 - DNA, 20 bp, mouse
gctgcgtctgagcgccgggt

SEQ ID NO: 438229 - DNA, 20 bp, mouse
gttccgctcacgtccgccaa

SEQ ID NO: 438230 - DNA, 20 bp, mouse
gagccgctgtgcgcccttgg

SEQ ID NO: 438231 - DNA, 20 bp, mouse
gcacagcggctcgtccaacc

SEQ ID NO: 438232 - DNA, 20 bp, mouse
ggggcggagcctcaagctaa

SEQ ID NO: 438233 - DNA, 20 bp, mouse
gacgagccgctgtgcgccct

SEQ ID NO: 438234 - DNA, 20 bp, mouse
gggagcctcaagctaagggc

SEQ ID NO: 438235 - DNA, 20 bp, mouse
gcaataccctgtgttcctgg

SEQ ID NO: 438236 - DNA, 20 bp, mouse
gcccggccgggcggaggacg

SEQ ID NO: 438237 - DNA, 20 bp, mouse
gtggggagcgagcagcgcct

SEQ ID NO: 438238 - DNA, 20 bp, mouse
gcccagcgaagcaaacaatg

SEQ ID NO: 438239 - DNA, 20 bp, mouse
ggctgctcggacgcctgccg

SEQ ID NO: 438240 - DNA, 20 bp, mouse
gcccgaaggtgagtgtctga

SEQ ID NO: 438241 - DNA, 20 bp, mouse
gcggcacggccggctgaggc

SEQ ID NO: 438242 - DNA, 20 bp, mouse
ggccgcggctcctccgccaa

SEQ ID NO: 438243 - DNA, 20 bp, mouse
gggagccggagggaccgaga

SEQ ID NO: 438244 - DNA, 20 bp, mouse
gcaggcgccatgtttggagg

SEQ ID NO: 438245 - DNA, 20 bp, mouse
gcggccgcgccggctcacgg

SEQ ID NO: 438246 - DNA, 20 bp, mouse
gtaccgagaggcgagtgggg

SEQ ID NO: 438247 - DNA, 20 bp, mouse
gtcgtaccgagaggcgagtg

SEQ ID NO: 438248 - DNA, 20 bp, mouse
gtctcggtacgagttcagca

SEQ ID NO: 438249 - DNA, 20 bp, mouse
ggtcccccccactcgcctct

SEQ ID NO: 438250 - DNA, 20 bp, mouse
ggagaccccagacctcgcta

SEQ ID NO: 438251 - DNA, 20 bp, mouse
ggccctcgtggccgtagggg

SEQ ID NO: 438252 - DNA, 20 bp, mouse
ggcgaccacaggcgcaaggg

SEQ ID NO: 438253 - DNA, 20 bp, mouse
gggggcgaccacaggcgcaa

SEQ ID NO: 438254 - DNA, 20 bp, mouse
ggggggacgggggcgaccac

SEQ ID NO: 438255 - DNA, 20 bp, mouse
gggatccaggagccacgggg

SEQ ID NO: 438256 - DNA, 20 bp, mouse
gcggtcagcgccagggagga

SEQ ID NO: 438257 - DNA, 20 bp, mouse
gtggcgctgaccgatggaag

SEQ ID NO: 438258 - DNA, 20 bp, mouse
ggatggaagaggcgctccgt

SEQ ID NO: 438259 - DNA, 20 bp, mouse
ggacgccccccgcccccatc

SEQ ID NO: 438260 - DNA, 20 bp, mouse
gccatcggtcagcgccaggg

SEQ ID NO: 438261 - DNA, 20 bp, mouse
gccccatctcgccccagcgt

SEQ ID NO: 438262 - DNA, 20 bp, mouse
gggaggactcccagcccgat

SEQ ID NO: 438263 - DNA, 20 bp, mouse
gcccccgcccccatcgggct

SEQ ID NO: 438264 - DNA, 20 bp, mouse
gactgtctagccagccccgg

SEQ ID NO: 438265 - DNA, 20 bp, mouse
gggcagggtatgagcccccg

SEQ ID NO: 438266 - DNA, 20 bp, mouse
gcggggccggcgagccaaag

SEQ ID NO: 438267 - DNA, 20 bp, mouse
gcgcgcggccggctcctctt

SEQ ID NO: 438268 - DNA, 20 bp, mouse
gcgcgcgggccgggagcaga

SEQ ID NO: 438269 - DNA, 20 bp, mouse
ggacgcgccggagctgtaca

SEQ ID NO: 438270 - DNA, 20 bp, mouse
gaaggcgtacttggcctagg

SEQ ID NO: 438271 - DNA, 20 bp, mouse
ggcatcgcggccgcgcacaa

SEQ ID NO: 438272 - DNA, 20 bp, mouse
gccgccgcccagagtgtaca

SEQ ID NO: 438273 - DNA, 20 bp, mouse
ggcgcacagcgcaaggcgga

SEQ ID NO: 438274 - DNA, 20 bp, mouse
gaaaaaggcgtacttggcct

SEQ ID NO: 438275 - DNA, 20 bp, mouse
gtctattatgctgccggggc

SEQ ID NO: 438276 - DNA, 20 bp, mouse
gagccgaggaaccgaagcag

SEQ ID NO: 438277 - DNA, 20 bp, mouse
gcgaggaaccgaagcagtgg

SEQ ID NO: 438278 - DNA, 20 bp, mouse
gatcagtgcgctggcggcgg

SEQ ID NO: 438279 - DNA, 20 bp, mouse
gggaaccgaagcagtggcgg

SEQ ID NO: 438280 - DNA, 20 bp, mouse
ggcagccgccgccactgctt

SEQ ID NO: 438281 - DNA, 20 bp, mouse
gtcgcggccgcgaaggacac

SEQ ID NO: 438282 - DNA, 20 bp, mouse
ggacatcagtgcgctggcgg

SEQ ID NO: 438283 - DNA, 20 bp, mouse
gggcctagcgtctcaggtga

SEQ ID NO: 438284 - DNA, 20 bp, mouse
gttctgctctcccgcagccg

SEQ ID NO: 438285 - DNA, 20 bp, mouse
gtcggccgccgccgccccaa

SEQ ID NO: 438286 - DNA, 20 bp, mouse
ggaccgaagcgcgacaccag

SEQ ID NO: 438287 - DNA, 20 bp, mouse
gctggggcccggtcggacat

SEQ ID NO: 438288 - DNA, 20 bp, mouse
gccagtggcgagagggcgag

SEQ ID NO: 438289 - DNA, 20 bp, mouse
gaggtcaccgagctctccac

SEQ ID NO: 438290 - DNA, 20 bp, mouse
gcttctacgagggtgaggag

SEQ ID NO: 438291 - DNA, 20 bp, mouse
gcgagaggccggcaaaccag

SEQ ID NO: 438292 - DNA, 20 bp, mouse
gctcaccctcgtagaagtgg

SEQ ID NO: 438293 - DNA, 20 bp, mouse
gcggaccgccacttctacga

SEQ ID NO: 438294 - DNA, 20 bp, mouse
ggcgcgacaccagtggcgag

SEQ ID NO: 438295 - DNA, 20 bp, mouse
ggcaaaccagcgggaaagag

SEQ ID NO: 438296 - DNA, 20 bp, mouse
gcgggacaggcagtgagtat

SEQ ID NO: 438297 - DNA, 20 bp, mouse
gaaaggccttgactataaaa

SEQ ID NO: 438298 - DNA, 20 bp, mouse
gggccttgactataaaaggg

SEQ ID NO: 438299 - DNA, 20 bp, mouse
ggaagacgtcgaagccaaga

SEQ ID NO: 438300 - DNA, 20 bp, mouse
ggcgcctagccctcccacaa

SEQ ID NO: 438301 - DNA, 20 bp, mouse
ggctagtctcaactctacaa

SEQ ID NO: 438302 - DNA, 20 bp, mouse
ggtcccgaaagcgacaggaa

SEQ ID NO: 438303 - DNA, 20 bp, mouse
gtcgaagccaagatggcgac

SEQ ID NO: 438304 - DNA, 20 bp, mouse
ggacagacgcggggaactct

SEQ ID NO: 438305 - DNA, 20 bp, mouse
ggcttcgacgtcttcaacgt

SEQ ID NO: 438306 - DNA, 20 bp, mouse
gcccatggctgagatagcac

SEQ ID NO: 438307 - DNA, 20 bp, mouse
gcacgggatccggtgagaag

SEQ ID NO: 438308 - DNA, 20 bp, mouse
gaccggcagccgcttctcac

SEQ ID NO: 438309 - DNA, 20 bp, mouse
gctggcgcaggtcgagctac

SEQ ID NO: 438310 - DNA, 20 bp, mouse
ggctgagatagcacgggatc

SEQ ID NO: 438311 - DNA, 20 bp, mouse
gtcagagaggaggtacatag

SEQ ID NO: 438312 - DNA, 20 bp, mouse
ggtgggatccgcaccttcgt

SEQ ID NO: 438313 - DNA, 20 bp, mouse
gccaggtagtggacaatcgt

SEQ ID NO: 438314 - DNA, 20 bp, mouse
gcgaaggcgctacttccgac

SEQ ID NO: 438315 - DNA, 20 bp, mouse
gcaagaagcacaaggcggaa

SEQ ID NO: 438316 - DNA, 20 bp, mouse
gcggccaccggtggagaacc

SEQ ID NO: 438317 - DNA, 20 bp, mouse
ggagagctggcggccaccgg

SEQ ID NO: 438318 - DNA, 20 bp, mouse
gctgctgacagccgccatcc

SEQ ID NO: 438319 - DNA, 20 bp, mouse
gtcgcgggtgagtcccataa

SEQ ID NO: 438320 - DNA, 20 bp, mouse
ggtcgctcccggttctccac

SEQ ID NO: 438321 - DNA, 20 bp, mouse
gccatccgggcgagagctgg

SEQ ID NO: 438322 - DNA, 20 bp, mouse
ggctcccggttctccaccgg

SEQ ID NO: 438323 - DNA, 20 bp, mouse
gtgaggcccagcgctcatgg

SEQ ID NO: 438324 - DNA, 20 bp, mouse
gccgccatccgggcgagagc

SEQ ID NO: 438325 - DNA, 20 bp, mouse
gccataaaggcgccagtcgc

SEQ ID NO: 438326 - DNA, 20 bp, mouse
gagtaaccggcgactagacg

SEQ ID NO: 438327 - DNA, 20 bp, mouse
gcggcgactagacggggtac

SEQ ID NO: 438328 - DNA, 20 bp, mouse
ggagaagcctcagatcttgg

SEQ ID NO: 438329 - DNA, 20 bp, mouse
gcttaagtccgatcagtaac

SEQ ID NO: 438330 - DNA, 20 bp, mouse
gctagtcgccggttactgat

SEQ ID NO: 438331 - DNA, 20 bp, mouse
gcgcaggtcggtgcgtcggt

SEQ ID NO: 438332 - DNA, 20 bp, mouse
gcagcccgggtccaggtacc

SEQ ID NO: 438333 - DNA, 20 bp, mouse
ggcactaggccagagctccc

SEQ ID NO: 438334 - DNA, 20 bp, mouse
gagggaatccgcgtgctgtg

SEQ ID NO: 438335 - DNA, 20 bp, mouse
ggagggcgaccggcacaggc

SEQ ID NO: 438336 - DNA, 20 bp, mouse
ggagagtgcggcgcagacgg

SEQ ID NO: 438337 - DNA, 20 bp, mouse
gcggagagcggactgctgag

SEQ ID NO: 438338 - DNA, 20 bp, mouse
ggagggccgcgggcggagag

SEQ ID NO: 438339 - DNA, 20 bp, mouse
gagttcgtggagaacagcgg

SEQ ID NO: 438340 - DNA, 20 bp, mouse
gagtgcggcgcagacggagg

SEQ ID NO: 438341 - DNA, 20 bp, mouse
gtgcagttcgtggagaacag

SEQ ID NO: 438342 - DNA, 20 bp, mouse
gcccgcggctccaccatgac

SEQ ID NO: 438343 - DNA, 20 bp, mouse
gcggcgtacgggactcggag

SEQ ID NO: 438344 - DNA, 20 bp, mouse
gtcgtcctgtgacagaccgt

SEQ ID NO: 438345 - DNA, 20 bp, mouse
gcagacgcggcccgtcatgg

SEQ ID NO: 438346 - DNA, 20 bp, mouse
gctgggcagcggcaataaag

SEQ ID NO: 438347 - DNA, 20 bp, mouse
ggggctgcggtaccgccgtc

SEQ ID NO: 438348 - DNA, 20 bp, mouse
ggtcggtcggtccagggctg

SEQ ID NO: 438349 - DNA, 20 bp, mouse
gcatctcgtcggtcggtcca

SEQ ID NO: 438350 - DNA, 20 bp, mouse
gcagcggcaataaagtggag

SEQ ID NO: 438351 - DNA, 20 bp, mouse
ggggagtttgtgcctgacgg

SEQ ID NO: 438352 - DNA, 20 bp, mouse
gctcggaggagccgcaatcc

SEQ ID NO: 438353 - DNA, 20 bp, mouse
gcgaccgacgagatgccgaa

SEQ ID NO: 438354 - DNA, 20 bp, mouse
gccgggcagcggcttccgtt

SEQ ID NO: 438355 - DNA, 20 bp, mouse
gcttccgttcggcatctcgt

SEQ ID NO: 438356 - DNA, 20 bp, mouse
gttcggcccggcggggatgg

SEQ ID NO: 438357 - DNA, 20 bp, mouse
gtccttcggcccggcgggga

SEQ ID NO: 438358 - DNA, 20 bp, mouse
gcgggcagctcggcccagtg

SEQ ID NO: 438359 - DNA, 20 bp, mouse
gcctgtgacgaggtaggggt

SEQ ID NO: 438360 - DNA, 20 bp, mouse
gcccacctgtgacgaggtag

SEQ ID NO: 438361 - DNA, 20 bp, mouse
gcggctcgcttccttcggcc

SEQ ID NO: 438362 - DNA, 20 bp, mouse
gagcggcgacggcggtgtcc

SEQ ID NO: 438363 - DNA, 20 bp, mouse
gtgcgggcccacctgtgacg

SEQ ID NO: 438364 - DNA, 20 bp, mouse
gcgcttccttcggcccggcg

SEQ ID NO: 438365 - DNA, 20 bp, mouse
gcggcccggctcgcttcctt

SEQ ID NO: 438366 - DNA, 20 bp, mouse
gtcctcccctggccgaacat

SEQ ID NO: 438367 - DNA, 20 bp, mouse
gacccgggtccggggctcct

SEQ ID NO: 438368 - DNA, 20 bp, mouse
gcgcaacccggcccggaccc

SEQ ID NO: 438369 - DNA, 20 bp, mouse
ggcccatgttcggccagggg

SEQ ID NO: 438370 - DNA, 20 bp, mouse
gacgcgcgcgcgcccatgtt

SEQ ID NO: 438371 - DNA, 20 bp, mouse
gtgcgcgcggctcagaaggt

SEQ ID NO: 438372 - DNA, 20 bp, mouse
gagggtcgcggggctgaaag

SEQ ID NO: 438373 - DNA, 20 bp, mouse
gggcagcagcacccgcaacc

SEQ ID NO: 438374 - DNA, 20 bp, mouse
ggtgagcagcctcttcggag

SEQ ID NO: 438375 - DNA, 20 bp, mouse
gtcccaggagccccggaccc

SEQ ID NO: 438376 - DNA, 20 bp, mouse
gtgctgctctccagccccta

SEQ ID NO: 438377 - DNA, 20 bp, mouse
gctctccagcccctatggca

SEQ ID NO: 438378 - DNA, 20 bp, mouse
ggcctcggggtatgcagagt

SEQ ID NO: 438379 - DNA, 20 bp, mouse
gcttctggcttagagactca

SEQ ID NO: 438380 - DNA, 20 bp, mouse
ggccccatgcgagaactgac

SEQ ID NO: 438381 - DNA, 20 bp, mouse
gggtagagacttacctcagc

SEQ ID NO: 438382 - DNA, 20 bp, mouse
gagtcagccagggaaacctc

SEQ ID NO: 438383 - DNA, 20 bp, mouse
gcagcccctatggcagggtt

SEQ ID NO: 438384 - DNA, 20 bp, mouse
gcggccagtactgtgccctc

SEQ ID NO: 438385 - DNA, 20 bp, mouse
gcataccccgaggcttgaag

SEQ ID NO: 438386 - DNA, 20 bp, mouse
gccgcggctgcgaactgatc

SEQ ID NO: 438387 - DNA, 20 bp, mouse
ggcggggactcggagcgagg

SEQ ID NO: 438388 - DNA, 20 bp, mouse
gaggagaagagcgcaggcaa

SEQ ID NO: 438389 - DNA, 20 bp, mouse
gaggcggctggcgaatggag

SEQ ID NO: 438390 - DNA, 20 bp, mouse
gtgtcctcgggaccagccaa

SEQ ID NO: 438391 - DNA, 20 bp, mouse
ggcgaactgatctggcacag

SEQ ID NO: 438392 - DNA, 20 bp, mouse
gaccagccaaggggacttta

SEQ ID NO: 438393 - DNA, 20 bp, mouse
ggcggggactgcaggcgtgg

SEQ ID NO: 438394 - DNA, 20 bp, mouse
ggagcgaggcggctggcgaa

SEQ ID NO: 438395 - DNA, 20 bp, mouse
gactgatctggcacaggggg

SEQ ID NO: 438396 - DNA, 20 bp, mouse
gaggtgacactggttaggta

SEQ ID NO: 438397 - DNA, 20 bp, mouse
gcactggttaggtacggacc

SEQ ID NO: 438398 - DNA, 20 bp, mouse
gggaccgggaagccggagtg

SEQ ID NO: 438399 - DNA, 20 bp, mouse
gaggcaggcggattccatcc

SEQ ID NO: 438400 - DNA, 20 bp, mouse
gtaggtacggaccgggaagc

SEQ ID NO: 438401 - DNA, 20 bp, mouse
gtgagctcgacgggttccgg

SEQ ID NO: 438402 - DNA, 20 bp, mouse
gttatcttaagacactcatc

SEQ ID NO: 438403 - DNA, 20 bp, mouse
gcaggtcctcaggcagccga

SEQ ID NO: 438404 - DNA, 20 bp, mouse
ggtggagcagcgagcatccc

SEQ ID NO: 438405 - DNA, 20 bp, mouse
ggtcgcacgcggcgtgggag

SEQ ID NO: 438406 - DNA, 20 bp, mouse
gctgggtaacccaagagaac

SEQ ID NO: 438407 - DNA, 20 bp, mouse
gacatcctttcacttctctt

SEQ ID NO: 438408 - DNA, 20 bp, mouse
gtggtgagctgcaggaaagt

SEQ ID NO: 438409 - DNA, 20 bp, mouse
ggaaaggatgtgttgtaaac

SEQ ID NO: 438410 - DNA, 20 bp, mouse
gaacactcagtagttcctgg

SEQ ID NO: 438411 - DNA, 20 bp, mouse
gataaagaaatacttaccag

SEQ ID NO: 438412 - DNA, 20 bp, mouse
gttcctggtggcatctaatc

SEQ ID NO: 438413 - DNA, 20 bp, mouse
gtgaaagtcacttattccag

SEQ ID NO: 438414 - DNA, 20 bp, mouse
gtctgagaatggttaacagt

SEQ ID NO: 438415 - DNA, 20 bp, mouse
gagagcagcagcactgattt

SEQ ID NO: 438416 - DNA, 20 bp, mouse
gtaatcagtgtgacacagtg

SEQ ID NO: 438417 - DNA, 20 bp, mouse
ggcacagacgttcgctgtct

SEQ ID NO: 438418 - DNA, 20 bp, mouse
gtagtagcctggctggtcca

SEQ ID NO: 438419 - DNA, 20 bp, mouse
gtgggttctggggacgtgga

SEQ ID NO: 438420 - DNA, 20 bp, mouse
ggtgtgtcttggagattccg

SEQ ID NO: 438421 - DNA, 20 bp, mouse
ggaggcttagatatagccta

SEQ ID NO: 438422 - DNA, 20 bp, mouse
gaggagagtgaggttcacaa

SEQ ID NO: 438423 - DNA, 20 bp, mouse
gccgcagggctgagagcgag

SEQ ID NO: 438424 - DNA, 20 bp, mouse
gtgctggtgcgggagtgcga

SEQ ID NO: 438425 - DNA, 20 bp, mouse
gttctgtgagggaaattgac

SEQ ID NO: 438426 - DNA, 20 bp, mouse
gccgacgctgccaggtacca

SEQ ID NO: 438427 - DNA, 20 bp, mouse
ggggaggagtggctgtacct

SEQ ID NO: 438428 - DNA, 20 bp, mouse
ggcgtcggaacagccggtga

SEQ ID NO: 438429 - DNA, 20 bp, mouse
ggcggagtgcagcctggaga

SEQ ID NO: 438430 - DNA, 20 bp, mouse
gtacgaaagtcctccctcac

SEQ ID NO: 438431 - DNA, 20 bp, mouse
ggtggctgtaccttggtacc

SEQ ID NO: 438432 - DNA, 20 bp, mouse
gctggcagcgtcggaacagc

SEQ ID NO: 438433 - DNA, 20 bp, mouse
gcagcccagccagagctgga

SEQ ID NO: 438434 - DNA, 20 bp, mouse
gggcgctgcggagtgcagcc

SEQ ID NO: 438435 - DNA, 20 bp, mouse
ggctctcgggctctatggtg

SEQ ID NO: 438436 - DNA, 20 bp, mouse
gacgcggcgaggcgagatgg

SEQ ID NO: 438437 - DNA, 20 bp, mouse
ggtgcaggcagcgaccgacg

SEQ ID NO: 438438 - DNA, 20 bp, mouse
gccgacgcggcgaggcgaga

SEQ ID NO: 438439 - DNA, 20 bp, mouse
gggcggcgaccaagagaaag

SEQ ID NO: 438440 - DNA, 20 bp, mouse
ggcttcggtggcccaaaggt

SEQ ID NO: 438441 - DNA, 20 bp, mouse
ggatcggaaggcagagcgag

SEQ ID NO: 438442 - DNA, 20 bp, mouse
gcgaccaagagaaagcggcg

SEQ ID NO: 438443 - DNA, 20 bp, mouse
gccaagagaaagcggcgtgg

SEQ ID NO: 438444 - DNA, 20 bp, mouse
gggctaccatagagatcgga

SEQ ID NO: 438445 - DNA, 20 bp, mouse
gaagcggcgtggaggcttgg

SEQ ID NO: 438446 - DNA, 20 bp, mouse
ggtgcagcgggagattcacc

SEQ ID NO: 438447 - DNA, 20 bp, mouse
gcgggagattcaccaggact

SEQ ID NO: 438448 - DNA, 20 bp, mouse
ggccgccatggcgggacaag

SEQ ID NO: 438449 - DNA, 20 bp, mouse
gcttcctcaggcggccgcca

SEQ ID NO: 438450 - DNA, 20 bp, mouse
gacaagaggatccggtgcag

SEQ ID NO: 438451 - DNA, 20 bp, mouse
gggatcctcttgtcccgcca

SEQ ID NO: 438452 - DNA, 20 bp, mouse
gctcaggcggccgccatggc

SEQ ID NO: 438453 - DNA, 20 bp, mouse
gtcctcttgtcccgccatgg

SEQ ID NO: 438454 - DNA, 20 bp, mouse
gtcaccaggactgggcgaac

SEQ ID NO: 438455 - DNA, 20 bp, mouse
gtgcgcagtcactcttcctc

SEQ ID NO: 438456 - DNA, 20 bp, mouse
ggcactgttccggagatcaa

SEQ ID NO: 438457 - DNA, 20 bp, mouse
gctgttccggagatcaacgg

SEQ ID NO: 438458 - DNA, 20 bp, mouse
gcggagagctgtccgaccca

SEQ ID NO: 438459 - DNA, 20 bp, mouse
ggcctcacgtccaggactcc

SEQ ID NO: 438460 - DNA, 20 bp, mouse
gcgccgccgccgttgatctc

SEQ ID NO: 438461 - DNA, 20 bp, mouse
gttccggagatcaacggcgg

SEQ ID NO: 438462 - DNA, 20 bp, mouse
gcggcgttcacaccctgggt

SEQ ID NO: 438463 - DNA, 20 bp, mouse
gtccgagggtggatcgaggt

SEQ ID NO: 438464 - DNA, 20 bp, mouse
gcggaagcgtcgacacctcc

SEQ ID NO: 438465 - DNA, 20 bp, mouse
gggcggcggcgttcacaccc

SEQ ID NO: 438466 - DNA, 20 bp, mouse
gggcgcgcccttcaccgaag

SEQ ID NO: 438467 - DNA, 20 bp, mouse
gtcggtggccgggtgggtcg

SEQ ID NO: 438468 - DNA, 20 bp, mouse
gccactgccgcttcggtgaa

SEQ ID NO: 438469 - DNA, 20 bp, mouse
ggaggacaccgagagctcgt

SEQ ID NO: 438470 - DNA, 20 bp, mouse
gggtttcggatccagctcgg

SEQ ID NO: 438471 - DNA, 20 bp, mouse
gtggactacgcggagaacga

SEQ ID NO: 438472 - DNA, 20 bp, mouse
gagcccggccactgccgctt

SEQ ID NO: 438473 - DNA, 20 bp, mouse
ggcctgcgggttaggttgtg

SEQ ID NO: 438474 - DNA, 20 bp, mouse
gccgaacgccccgacccacc

SEQ ID NO: 438475 - DNA, 20 bp, mouse
ggggggtggggaggagtcga

SEQ ID NO: 438476 - DNA, 20 bp, mouse
gggagtcctccagcgagaca

SEQ ID NO: 438477 - DNA, 20 bp, mouse
gctcttcctgctgaaggaaa

SEQ ID NO: 438478 - DNA, 20 bp, mouse
gagcgagacaaggaaggcgc

SEQ ID NO: 438479 - DNA, 20 bp, mouse
gtcgcgatcaggccttaggg

SEQ ID NO: 438480 - DNA, 20 bp, mouse
ggactcggtaggacacccgg

SEQ ID NO: 438481 - DNA, 20 bp, mouse
gcccctggatggtagtcagt

SEQ ID NO: 438482 - DNA, 20 bp, mouse
gtagtcagtgggaggatcga

SEQ ID NO: 438483 - DNA, 20 bp, mouse
gggggacctcagagtccgta

SEQ ID NO: 438484 - DNA, 20 bp, mouse
ggctagagcggccggaagtg

SEQ ID NO: 438485 - DNA, 20 bp, mouse
gctggatggtagtcagtggg

SEQ ID NO: 438486 - DNA, 20 bp, mouse
gagcagcggcgagaccgtgg

SEQ ID NO: 438487 - DNA, 20 bp, mouse
gaccgtggcggcaaaggctg

SEQ ID NO: 438488 - DNA, 20 bp, mouse
gaacagcagcggcgagaccg

SEQ ID NO: 438489 - DNA, 20 bp, mouse
ggcaaaggctgtggcagcgg

SEQ ID NO: 438490 - DNA, 20 bp, mouse
gtgccgccgggacaatgggg

SEQ ID NO: 438491 - DNA, 20 bp, mouse
gggcgagaccgtggcggcaa

SEQ ID NO: 438492 - DNA, 20 bp, mouse
ggcaccggcgggaccaggag

SEQ ID NO: 438493 - DNA, 20 bp, mouse
ggggctcctggaggcggcac

SEQ ID NO: 438494 - DNA, 20 bp, mouse
gcggtgccgccgggacaatg

SEQ ID NO: 438495 - DNA, 20 bp, mouse
gggtagtgccagtggagaag

SEQ ID NO: 438496 - DNA, 20 bp, mouse
ggcccggccgcctctcccgg

SEQ ID NO: 438497 - DNA, 20 bp, mouse
gccccctcctcccccgggag

SEQ ID NO: 438498 - DNA, 20 bp, mouse
gggcggctgaggtaaaatgg

SEQ ID NO: 438499 - DNA, 20 bp, mouse
gcgggcccggggagacggag

SEQ ID NO: 438500 - DNA, 20 bp, mouse
gctcggccgggctccgtggc

SEQ ID NO: 438501 - DNA, 20 bp, mouse
gcccggggagacggagcgga

SEQ ID NO: 438502 - DNA, 20 bp, mouse
gaagctaggggcccggccgg

SEQ ID NO: 438503 - DNA, 20 bp, mouse
gacggagcggagggccggag

SEQ ID NO: 438504 - DNA, 20 bp, mouse
gtcccccgggagaggcggcc

SEQ ID NO: 438505 - DNA, 20 bp, mouse
gcgcctctcccgggggagga

SEQ ID NO: 438506 - DNA, 20 bp, mouse
gtagtgaaggcagagtgtgc

SEQ ID NO: 438507 - DNA, 20 bp, mouse
gtggaaattaaagtctgatt

SEQ ID NO: 438508 - DNA, 20 bp, mouse
ggtggatgcaacccactacc

SEQ ID NO: 438509 - DNA, 20 bp, mouse
gatgctgggatcatttcagt

SEQ ID NO: 438510 - DNA, 20 bp, mouse
gccagcataagtgatataga

SEQ ID NO: 438511 - DNA, 20 bp, mouse
ggatgaggatagcatttccg

SEQ ID NO: 438512 - DNA, 20 bp, mouse
gtgccgggatgtgaaattag

SEQ ID NO: 438513 - DNA, 20 bp, mouse
gaggtctccgaaagccaggc

SEQ ID NO: 438514 - DNA, 20 bp, mouse
gacagaagtgagccggatga

SEQ ID NO: 438515 - DNA, 20 bp, mouse
gcttgaaaaagactttgatg

SEQ ID NO: 438516 - DNA, 20 bp, mouse
gccggagagaaaggacgagg

SEQ ID NO: 438517 - DNA, 20 bp, mouse
ggtgccggagagaaaggacg

SEQ ID NO: 438518 - DNA, 20 bp, mouse
ggtcagcgtgccggagagaa

SEQ ID NO: 438519 - DNA, 20 bp, mouse
ggaaaggacgaggtggcggg

SEQ ID NO: 438520 - DNA, 20 bp, mouse
gtcggtgggccgcagagctg

SEQ ID NO: 438521 - DNA, 20 bp, mouse
gcggaggagagagggcgcgt

SEQ ID NO: 438522 - DNA, 20 bp, mouse
gtccaggggcctgacccccc

SEQ ID NO: 438523 - DNA, 20 bp, mouse
gccggtcgggccgggaccaa

SEQ ID NO: 438524 - DNA, 20 bp, mouse
ggcccctggaatcagcatgg

SEQ ID NO: 438525 - DNA, 20 bp, mouse
gagagaaaggacgaggtggc

SEQ ID NO: 438526 - DNA, 20 bp, mouse
gccgccgggtcctctcagag

SEQ ID NO: 438527 - DNA, 20 bp, mouse
gggctcggaggcactcgaag

SEQ ID NO: 438528 - DNA, 20 bp, mouse
gccgcggcccggcctcgtac

SEQ ID NO: 438529 - DNA, 20 bp, mouse
ggcggctcggctgctcgtct

SEQ ID NO: 438530 - DNA, 20 bp, mouse
gcccagcgcacgcccgtccg

SEQ ID NO: 438531 - DNA, 20 bp, mouse
gtcggctgagtggctcggtt

SEQ ID NO: 438532 - DNA, 20 bp, mouse
gaggcagagcggcattcccg

SEQ ID NO: 438533 - DNA, 20 bp, mouse
gcatcgacggggaaggacgg

SEQ ID NO: 438534 - DNA, 20 bp, mouse
ggcagtatgtggggccctac

SEQ ID NO: 438535 - DNA, 20 bp, mouse
gccgggagcgatgacatcga

SEQ ID NO: 438536 - DNA, 20 bp, mouse
gcgcggcgcgcacggcatgg

SEQ ID NO: 438537 - DNA, 20 bp, mouse
ggaagtcgcgcgggaccgag

SEQ ID NO: 438538 - DNA, 20 bp, mouse
gggcgcgcacggcatggcgg

SEQ ID NO: 438539 - DNA, 20 bp, mouse
gggcgtacccccagctcctc

SEQ ID NO: 438540 - DNA, 20 bp, mouse
ggggcgagcgagcgaaccgg

SEQ ID NO: 438541 - DNA, 20 bp, mouse
ggcgaacaagtggagcgcgt

SEQ ID NO: 438542 - DNA, 20 bp, mouse
gagctctgcggggagaagac

SEQ ID NO: 438543 - DNA, 20 bp, mouse
gcatcgagtcgggtaagaca

SEQ ID NO: 438544 - DNA, 20 bp, mouse
gccgcgcaccgacgcgtccg

SEQ ID NO: 438545 - DNA, 20 bp, mouse
ggcgacacgggccagctgag

SEQ ID NO: 438546 - DNA, 20 bp, mouse
gcttgggctagaatatctat

SEQ ID NO: 438547 - DNA, 20 bp, mouse
gtattctagcccaagagctg

SEQ ID NO: 438548 - DNA, 20 bp, mouse
gcccctcgggaaaaggatgg

SEQ ID NO: 438549 - DNA, 20 bp, mouse
gtccgagagagaccgaaact

SEQ ID NO: 438550 - DNA, 20 bp, mouse
gactgggacgaagagtgcgg

SEQ ID NO: 438551 - DNA, 20 bp, mouse
gtacccagatcgaagccggt

SEQ ID NO: 438552 - DNA, 20 bp, mouse
ggcgggactcccaagcatgg

SEQ ID NO: 438553 - DNA, 20 bp, mouse
gtacccaccggcttcgatct

SEQ ID NO: 438554 - DNA, 20 bp, mouse
gtcccagtttcggtctctct

SEQ ID NO: 438555 - DNA, 20 bp, mouse
gtggtgaagcccccatgctt

SEQ ID NO: 438556 - DNA, 20 bp, mouse
gcgcggcgaggcagactcac

SEQ ID NO: 438557 - DNA, 20 bp, mouse
ggtacaccagatcgccaccg

SEQ ID NO: 438558 - DNA, 20 bp, mouse
gatattgcctgggcagcgag

SEQ ID NO: 438559 - DNA, 20 bp, mouse
ggcccacccctggggtaatg

SEQ ID NO: 438560 - DNA, 20 bp, mouse
gtgcctgggcagcgagaggc

SEQ ID NO: 438561 - DNA, 20 bp, mouse
ggctgcggcgcccacccctg

SEQ ID NO: 438562 - DNA, 20 bp, mouse
gaccgcattaccccaggggt

SEQ ID NO: 438563 - DNA, 20 bp, mouse
gcagttgggcggggcttcct

SEQ ID NO: 438564 - DNA, 20 bp, mouse
ggtacaccgcattaccccag

SEQ ID NO: 438565 - DNA, 20 bp, mouse
ggcagaggaaagaaactctt

SEQ ID NO: 438566 - DNA, 20 bp, mouse
gagcggcgagaaccacacaa

SEQ ID NO: 438567 - DNA, 20 bp, mouse
gccagggacagcagccccgg

SEQ ID NO: 438568 - DNA, 20 bp, mouse
gcagccaatgcccaagatgg

SEQ ID NO: 438569 - DNA, 20 bp, mouse
gacacaagggcgagcagggt

SEQ ID NO: 438570 - DNA, 20 bp, mouse
gtctcgggccacctcccccc

SEQ ID NO: 438571 - DNA, 20 bp, mouse
gcggcagccaatgcccaaga

SEQ ID NO: 438572 - DNA, 20 bp, mouse
ggaggccgtggggcgggaca

SEQ ID NO: 438573 - DNA, 20 bp, mouse
gcctccatgcgggtacgaac

SEQ ID NO: 438574 - DNA, 20 bp, mouse
ggagcccgttagacattgta

SEQ ID NO: 438575 - DNA, 20 bp, mouse
gtagctccaggtgagcaccc

SEQ ID NO: 438576 - DNA, 20 bp, mouse
gtgctggcaagatggcggaa

SEQ ID NO: 438577 - DNA, 20 bp, mouse
gagcccccaacgccagaaag

SEQ ID NO: 438578 - DNA, 20 bp, mouse
ggtgccgtgtcggaagtcaa

SEQ ID NO: 438579 - DNA, 20 bp, mouse
gttccgctttctggcgttgg

SEQ ID NO: 438580 - DNA, 20 bp, mouse
ggtcaaaggtcggtaaatag

SEQ ID NO: 438581 - DNA, 20 bp, mouse
gtgatgtcatgctggcaaga

SEQ ID NO: 438582 - DNA, 20 bp, mouse
gcgtgtcggaagtcaaaggt

SEQ ID NO: 438583 - DNA, 20 bp, mouse
gcggcagcctgtccccaaca

SEQ ID NO: 438584 - DNA, 20 bp, mouse
gaggctgggctggagtcgcc

SEQ ID NO: 438585 - DNA, 20 bp, mouse
gaatagtggtgatgtcatgc

SEQ ID NO: 438586 - DNA, 20 bp, mouse
gttgatccctgggaagtgag

SEQ ID NO: 438587 - DNA, 20 bp, mouse
gtgcaagatggggtgagtac

SEQ ID NO: 438588 - DNA, 20 bp, mouse
ggtgagaggacatgcaagat

SEQ ID NO: 438589 - DNA, 20 bp, mouse
gctcaaaagaaaacattcag

SEQ ID NO: 438590 - DNA, 20 bp, mouse
gattcaggggattgatccct

SEQ ID NO: 438591 - DNA, 20 bp, mouse
ggaatcaaaacccggaagag

SEQ ID NO: 438592 - DNA, 20 bp, mouse
gaaactgcaacacgacttcc

SEQ ID NO: 438593 - DNA, 20 bp, mouse
gttaatggagaatcaaaacc

SEQ ID NO: 438594 - DNA, 20 bp, mouse
ggtcttggttccactcttcc

SEQ ID NO: 438595 - DNA, 20 bp, mouse
ggcatgtcctctcacttccc

SEQ ID NO: 438596 - DNA, 20 bp, mouse
gcctggacgaggcgacatgg

SEQ ID NO: 438597 - DNA, 20 bp, mouse
gtggccgctcaagagcgtga

SEQ ID NO: 438598 - DNA, 20 bp, mouse
ggctcctggacgaggcgaca

SEQ ID NO: 438599 - DNA, 20 bp, mouse
gtggccttcacgctcttgag

SEQ ID NO: 438600 - DNA, 20 bp, mouse
gggacgaggcgacatggcgg

SEQ ID NO: 438601 - DNA, 20 bp, mouse
gtgcgcggcgggtaagagcg

SEQ ID NO: 438602 - DNA, 20 bp, mouse
gccacctcgatgcccagtcg

SEQ ID NO: 438603 - DNA, 20 bp, mouse
gccctggagagacaaatcaa

SEQ ID NO: 438604 - DNA, 20 bp, mouse
gtagcctcgactgggcatcg

SEQ ID NO: 438605 - DNA, 20 bp, mouse
gcgaggcttggagattgtgg

SEQ ID NO: 438606 - DNA, 20 bp, mouse
gccagaccagagcctccggg

SEQ ID NO: 438607 - DNA, 20 bp, mouse
gggcggcagctgcggtggag

SEQ ID NO: 438608 - DNA, 20 bp, mouse
ggcccgggccggcggctccc

SEQ ID NO: 438609 - DNA, 20 bp, mouse
gcggctgtgcgagccgagct

SEQ ID NO: 438610 - DNA, 20 bp, mouse
gcgccagctagtgctgaagg

SEQ ID NO: 438611 - DNA, 20 bp, mouse
gctgccgccatctcccagct

SEQ ID NO: 438612 - DNA, 20 bp, mouse
ggagagtgtgagcgccgccc

SEQ ID NO: 438613 - DNA, 20 bp, mouse
ggggaccggaccgagaccag

SEQ ID NO: 438614 - DNA, 20 bp, mouse
ggacccagaccagagcctcc

SEQ ID NO: 438615 - DNA, 20 bp, mouse
ggagctgtggtccgaatctg

SEQ ID NO: 438616 - DNA, 20 bp, mouse
gacagctgggcccacagggg

SEQ ID NO: 438617 - DNA, 20 bp, mouse
gggcaggtgacacgcttcag

SEQ ID NO: 438618 - DNA, 20 bp, mouse
gtgccactctcctcccctgt

SEQ ID NO: 438619 - DNA, 20 bp, mouse
gacgatcgaccccaggtcta

SEQ ID NO: 438620 - DNA, 20 bp, mouse
gagaaggtgccgtagacctg

SEQ ID NO: 438621 - DNA, 20 bp, mouse
gcagggctggttagccacca

SEQ ID NO: 438622 - DNA, 20 bp, mouse
ggcagcgtcatggtgatcgg

SEQ ID NO: 438623 - DNA, 20 bp, mouse
gagctctgaacatgggacag

SEQ ID NO: 438624 - DNA, 20 bp, mouse
ggcctcttcctgctatccct

SEQ ID NO: 438625 - DNA, 20 bp, mouse
gtgattgtagctctgaacat

SEQ ID NO: 438626 - DNA, 20 bp, mouse
ggggccatgttcctgctgtc

SEQ ID NO: 438627 - DNA, 20 bp, mouse
gcatgttcctgctgtcaggt

SEQ ID NO: 438628 - DNA, 20 bp, mouse
gactgaaaaggctgtgaaac

SEQ ID NO: 438629 - DNA, 20 bp, mouse
gaatagaacacacgaagtca

SEQ ID NO: 438630 - DNA, 20 bp, mouse
gagaacacacgaagtcaggg

SEQ ID NO: 438631 - DNA, 20 bp, mouse
gttctacttgaaaactgaaa

SEQ ID NO: 438632 - DNA, 20 bp, mouse
gcatatggcaatgatgtact

SEQ ID NO: 438633 - DNA, 20 bp, mouse
gcagcctttggattttctat

SEQ ID NO: 438634 - DNA, 20 bp, mouse
gagggtggcctctcccctac

SEQ ID NO: 438635 - DNA, 20 bp, mouse
gactctgagatttcctgtag

SEQ ID NO: 438636 - DNA, 20 bp, mouse
ggcctgcagatggcacacac

SEQ ID NO: 438637 - DNA, 20 bp, mouse
gtatgagctgaatgcaggtg

SEQ ID NO: 438638 - DNA, 20 bp, mouse
gctcatacatgtagacagct

SEQ ID NO: 438639 - DNA, 20 bp, mouse
gaggaggtgagggttataag

SEQ ID NO: 438640 - DNA, 20 bp, mouse
gtcctgtgtgtgccatctgc

SEQ ID NO: 438641 - DNA, 20 bp, mouse
gcgtatgagtaccgagacca

SEQ ID NO: 438642 - DNA, 20 bp, mouse
ggagaccaaggctccgtcat

SEQ ID NO: 438643 - DNA, 20 bp, mouse
ggatgagccatcttgtgcac

SEQ ID NO: 438644 - DNA, 20 bp, mouse
gtgcaggtgaggtgaaaaag

SEQ ID NO: 438645 - DNA, 20 bp, mouse
gttcagtgttcactcaacaa

SEQ ID NO: 438646 - DNA, 20 bp, mouse
gtccgtcccggagacatccg

SEQ ID NO: 438647 - DNA, 20 bp, mouse
gtcggacccggactccgtcc

SEQ ID NO: 438648 - DNA, 20 bp, mouse
gtccgcggatgtctccggga

SEQ ID NO: 438649 - DNA, 20 bp, mouse
gcacctgtcgcaggtaccga

SEQ ID NO: 438650 - DNA, 20 bp, mouse
gcggctctcggccatgtccg

SEQ ID NO: 438651 - DNA, 20 bp, mouse
gtgtctccgggacggagtcc

SEQ ID NO: 438652 - DNA, 20 bp, mouse
gcatgtccgcggatgtctcc

SEQ ID NO: 438653 - DNA, 20 bp, mouse
gcgcgatccggactgaggag

SEQ ID NO: 438654 - DNA, 20 bp, mouse
gaccgaagcaggggtccgag

SEQ ID NO: 438655 - DNA, 20 bp, mouse
gggagtccgggtccgagtcc

SEQ ID NO: 438656 - DNA, 20 bp, mouse
gttgctgacagtgcttctgg

SEQ ID NO: 438657 - DNA, 20 bp, mouse
gtcttgatggctgtccaggg

SEQ ID NO: 438658 - DNA, 20 bp, mouse
gtcttcttgatggctgtcca

SEQ ID NO: 438659 - DNA, 20 bp, mouse
ggggaggcctgttgtctctg

SEQ ID NO: 438660 - DNA, 20 bp, mouse
ggcaagagcgcggtggacag

SEQ ID NO: 438661 - DNA, 20 bp, mouse
gatgctctggaggtgaggag

SEQ ID NO: 438662 - DNA, 20 bp, mouse
gccacagccacagagacaac

SEQ ID NO: 438663 - DNA, 20 bp, mouse
gccctgtgggtgtagaggtg

SEQ ID NO: 438664 - DNA, 20 bp, mouse
gagacagtgaaaaggcagaa

SEQ ID NO: 438665 - DNA, 20 bp, mouse
gagagcgcggtggacagggg

SEQ ID NO: 438666 - DNA, 20 bp, mouse
gtcccccccatctcatccat

SEQ ID NO: 438667 - DNA, 20 bp, mouse
gtgcccatggatgagatggg

SEQ ID NO: 438668 - DNA, 20 bp, mouse
gctaggatcgacggatcaca

SEQ ID NO: 438669 - DNA, 20 bp, mouse
gccgtgcccatggatgagat

SEQ ID NO: 438670 - DNA, 20 bp, mouse
gggcagatagtgatagaaag

SEQ ID NO: 438671 - DNA, 20 bp, mouse
gcagcgtggcctgtagagac

SEQ ID NO: 438672 - DNA, 20 bp, mouse
gggcccccagccactgccgg

SEQ ID NO: 438673 - DNA, 20 bp, mouse
gtaagggcgtggcctggaaa

SEQ ID NO: 438674 - DNA, 20 bp, mouse
gatgggggggaagcaaggat

SEQ ID NO: 438675 - DNA, 20 bp, mouse
gatggggcagccaccggcag

SEQ ID NO: 438676 - DNA, 20 bp, mouse
gtacggacctgggctatccc

SEQ ID NO: 438677 - DNA, 20 bp, mouse
gacctaccccggcgctggag

SEQ ID NO: 438678 - DNA, 20 bp, mouse
gtcagatcccggcagctata

SEQ ID NO: 438679 - DNA, 20 bp, mouse
gggcaagaagacaagcgccg

SEQ ID NO: 438680 - DNA, 20 bp, mouse
gcaagcgccggggatagccc

SEQ ID NO: 438681 - DNA, 20 bp, mouse
gccggcagctatacggacct

SEQ ID NO: 438682 - DNA, 20 bp, mouse
gcaggggccacttccctcaa

SEQ ID NO: 438683 - DNA, 20 bp, mouse
ggcctctccagcgccggggt

SEQ ID NO: 438684 - DNA, 20 bp, mouse
gcagctgctcctgatcgccc

SEQ ID NO: 438685 - DNA, 20 bp, mouse
gacacagaaccaacctaccc

SEQ ID NO: 438686 - DNA, 20 bp, mouse
gtcccacacacgggcggagg

SEQ ID NO: 438687 - DNA, 20 bp, mouse
gccagggtcccacacacggg

SEQ ID NO: 438688 - DNA, 20 bp, mouse
ggcgaccagggtcccacaca

SEQ ID NO: 438689 - DNA, 20 bp, mouse
gtctgcgtcagcagagagcg

SEQ ID NO: 438690 - DNA, 20 bp, mouse
gtgtgggaccctggtcgctg

SEQ ID NO: 438691 - DNA, 20 bp, mouse
gtcgctgcggagacgagctc

SEQ ID NO: 438692 - DNA, 20 bp, mouse
ggacccgcaccacttcaaac

SEQ ID NO: 438693 - DNA, 20 bp, mouse
gagggaagcctcggaagtct

SEQ ID NO: 438694 - DNA, 20 bp, mouse
gctcgtctccgcagcgacca

SEQ ID NO: 438695 - DNA, 20 bp, mouse
ggggggcacccggtttgaag

SEQ ID NO: 438696 - DNA, 20 bp, mouse
gggcggtgccggcctcgggg

SEQ ID NO: 438697 - DNA, 20 bp, mouse
gggacgtggaaggacctcga

SEQ ID NO: 438698 - DNA, 20 bp, mouse
gcctttcccggaaggcaggg

SEQ ID NO: 438699 - DNA, 20 bp, mouse
gacggcaagggagtctgtag

SEQ ID NO: 438700 - DNA, 20 bp, mouse
gccatggtcgagccgccccg

SEQ ID NO: 438701 - DNA, 20 bp, mouse
gggtcgagccgccccgaggc

SEQ ID NO: 438702 - DNA, 20 bp, mouse
gcggaagcgcctttcccgga

SEQ ID NO: 438703 - DNA, 20 bp, mouse
gttcccggaaggcagggggg

SEQ ID NO: 438704 - DNA, 20 bp, mouse
ggacctcgagggcacggcaa

SEQ ID NO: 438705 - DNA, 20 bp, mouse
gacagcggctcgcgctgcag

SEQ ID NO: 438706 - DNA, 20 bp, mouse
gctgccggggcggctctggt

SEQ ID NO: 438707 - DNA, 20 bp, mouse
gtgtgaggcggccgctccac

SEQ ID NO: 438708 - DNA, 20 bp, mouse
ggtaggcgcagccggtggag

SEQ ID NO: 438709 - DNA, 20 bp, mouse
ggtctcgcgagaagcagcta

SEQ ID NO: 438710 - DNA, 20 bp, mouse
gggcctgcaacctgccgggg

SEQ ID NO: 438711 - DNA, 20 bp, mouse
gctctggtaggcgcagccgg

SEQ ID NO: 438712 - DNA, 20 bp, mouse
gctcacacctagcaccggag

SEQ ID NO: 438713 - DNA, 20 bp, mouse
ggcgcctaccagagccgccc

SEQ ID NO: 438714 - DNA, 20 bp, mouse
gccactgaaccggacccctc

SEQ ID NO: 438715 - DNA, 20 bp, mouse
ggccggcctgcaacctgccg

SEQ ID NO: 438716 - DNA, 20 bp, mouse
ggacactgactcagccgtgt

SEQ ID NO: 438717 - DNA, 20 bp, mouse
gaagtctggacaggtgaggt

SEQ ID NO: 438718 - DNA, 20 bp, mouse
gagcatccttgggcattact

SEQ ID NO: 438719 - DNA, 20 bp, mouse
ggagctgaattaatatttag

SEQ ID NO: 438720 - DNA, 20 bp, mouse
gctgaattaatatttagagg

SEQ ID NO: 438721 - DNA, 20 bp, mouse
gctaccctggcatacactaa

SEQ ID NO: 438722 - DNA, 20 bp, mouse
ggtagagagagggaagctaa

SEQ ID NO: 438723 - DNA, 20 bp, mouse
gaggattacacagtagagag

SEQ ID NO: 438724 - DNA, 20 bp, mouse
gatacaagaatgaatatgag

SEQ ID NO: 438725 - DNA, 20 bp, mouse
gactgttcagaagaatcttg

SEQ ID NO: 438726 - DNA, 20 bp, mouse
gacagcgctttagtgcgggg

SEQ ID NO: 438727 - DNA, 20 bp, mouse
gcgggagctcaagagaaccg

SEQ ID NO: 438728 - DNA, 20 bp, mouse
gggagtcggggccagagcga

SEQ ID NO: 438729 - DNA, 20 bp, mouse
ggctacagcgctttagtgcg

SEQ ID NO: 438730 - DNA, 20 bp, mouse
gaccacgggaagatacacgg

SEQ ID NO: 438731 - DNA, 20 bp, mouse
gggcgggctacgggctcccc

SEQ ID NO: 438732 - DNA, 20 bp, mouse
gtacggccgccgcagctcgg

SEQ ID NO: 438733 - DNA, 20 bp, mouse
ggtcaccacgggaagataca

SEQ ID NO: 438734 - DNA, 20 bp, mouse
gcatccgtctggtcccaggg

SEQ ID NO: 438735 - DNA, 20 bp, mouse
gtgaaaggcgcgggtcctgg

SEQ ID NO: 438736 - DNA, 20 bp, mouse
gagcatcgccgtaggagaag

SEQ ID NO: 438737 - DNA, 20 bp, mouse
ggggctcaccccttctccta

SEQ ID NO: 438738 - DNA, 20 bp, mouse
gcccagcaaagcatcgccgt

SEQ ID NO: 438739 - DNA, 20 bp, mouse
gcccacggggacggtcacag

SEQ ID NO: 438740 - DNA, 20 bp, mouse
gggtacccacaactaccccc

SEQ ID NO: 438741 - DNA, 20 bp, mouse
gggactgcagaactgtaagt

SEQ ID NO: 438742 - DNA, 20 bp, mouse
gtagctccaccagggcaagg

SEQ ID NO: 438743 - DNA, 20 bp, mouse
gcaaggggtcacccagtgat

SEQ ID NO: 438744 - DNA, 20 bp, mouse
gctcggaaccaagggagagt

SEQ ID NO: 438745 - DNA, 20 bp, mouse
gttcctcaccagaggaccaa

SEQ ID NO: 438746 - DNA, 20 bp, mouse
gtgtccctaagtccactgga

SEQ ID NO: 438747 - DNA, 20 bp, mouse
ggctctgtccctaagtccac

SEQ ID NO: 438748 - DNA, 20 bp, mouse
gcatagagctggccaggagg

SEQ ID NO: 438749 - DNA, 20 bp, mouse
gtgtccctccagtggactta

SEQ ID NO: 438750 - DNA, 20 bp, mouse
gcagccagccccagagaaca

SEQ ID NO: 438751 - DNA, 20 bp, mouse
gctggtaaggaaaaaggtaa

SEQ ID NO: 438752 - DNA, 20 bp, mouse
gcgagtgaccagtcccacca

SEQ ID NO: 438753 - DNA, 20 bp, mouse
gccccaggacccaggcttgc

SEQ ID NO: 438754 - DNA, 20 bp, mouse
gggaaaaaggtaagggttgg

SEQ ID NO: 438755 - DNA, 20 bp, mouse
gtctgcctggacccagctgt

SEQ ID NO: 438756 - DNA, 20 bp, mouse
gacttagcttgcctgggagg

SEQ ID NO: 438757 - DNA, 20 bp, mouse
ggtgaggtgtcagttctaac

SEQ ID NO: 438758 - DNA, 20 bp, mouse
gcccctgctctgggaggtgt

SEQ ID NO: 438759 - DNA, 20 bp, mouse
gacaggagtagcgcagcctc

SEQ ID NO: 438760 - DNA, 20 bp, mouse
gtgtggggctgccccctccc

SEQ ID NO: 438761 - DNA, 20 bp, mouse
gggacccagagaagaagctg

SEQ ID NO: 438762 - DNA, 20 bp, mouse
gagtctgagggccctagtgc

SEQ ID NO: 438763 - DNA, 20 bp, mouse
gtcccgggagaggctggtgg

SEQ ID NO: 438764 - DNA, 20 bp, mouse
ggggccctcagactcatctt

SEQ ID NO: 438765 - DNA, 20 bp, mouse
ggctcagacttagcttgcct

SEQ ID NO: 438766 - DNA, 20 bp, mouse
gccgcgccgcagcgacaaga

SEQ ID NO: 438767 - DNA, 20 bp, mouse
gcgccggccccgacccccgg

SEQ ID NO: 438768 - DNA, 20 bp, mouse
gcgcgcgtcttgcccgccgg

SEQ ID NO: 438769 - DNA, 20 bp, mouse
ggaggagccaacgggaggac

SEQ ID NO: 438770 - DNA, 20 bp, mouse
gcgcgttagcactgggaccc

SEQ ID NO: 438771 - DNA, 20 bp, mouse
ggcgggggcggagccacgga

SEQ ID NO: 438772 - DNA, 20 bp, mouse
ggaggtagtccgggccatgg

SEQ ID NO: 438773 - DNA, 20 bp, mouse
gttgtgagcgtagagaggag

SEQ ID NO: 438774 - DNA, 20 bp, mouse
ggcagcgacaagatggcggc

SEQ ID NO: 438775 - DNA, 20 bp, mouse
gcggcggccgcgttagcact

SEQ ID NO: 438776 - DNA, 20 bp, mouse
gcgagcccagcgagtcagta

SEQ ID NO: 438777 - DNA, 20 bp, mouse
ggccggccggtgaagttgtg

SEQ ID NO: 438778 - DNA, 20 bp, mouse
gcagcgagtcagtacggccg

SEQ ID NO: 438779 - DNA, 20 bp, mouse
ggtggtgaatggatcgggag

SEQ ID NO: 438780 - DNA, 20 bp, mouse
gagttgtgtggtgaatggat

SEQ ID NO: 438781 - DNA, 20 bp, mouse
ggagtcagtacggccgcggc

SEQ ID NO: 438782 - DNA, 20 bp, mouse
gcaacttcaccggccggccg

SEQ ID NO: 438783 - DNA, 20 bp, mouse
gattcaccacacaacttcac

SEQ ID NO: 438784 - DNA, 20 bp, mouse
ggaaaaccaggaatcatgat

SEQ ID NO: 438785 - DNA, 20 bp, mouse
gggcgcttgctttctgaatt

SEQ ID NO: 438786 - DNA, 20 bp, mouse
gggcccggtccaggaactca

SEQ ID NO: 438787 - DNA, 20 bp, mouse
gcgctccgcaggcccggtcc

SEQ ID NO: 438788 - DNA, 20 bp, mouse
gtggtcggagctgcgagagg

SEQ ID NO: 438789 - DNA, 20 bp, mouse
gacctggtcggagctgcgag

SEQ ID NO: 438790 - DNA, 20 bp, mouse
gaactcagggatccagagcc

SEQ ID NO: 438791 - DNA, 20 bp, mouse
gatccctgagttcctggacc

SEQ ID NO: 438792 - DNA, 20 bp, mouse
gcgggagtggccgaacgagg

SEQ ID NO: 438793 - DNA, 20 bp, mouse
gcggcccacgggaccctacg

SEQ ID NO: 438794 - DNA, 20 bp, mouse
gtggccacgcagaaagctga

SEQ ID NO: 438795 - DNA, 20 bp, mouse
ggcgcaccgagagcacctag

SEQ ID NO: 438796 - DNA, 20 bp, mouse
gggcgccgcagcagtgggta

SEQ ID NO: 438797 - DNA, 20 bp, mouse
ggcccatgcaggcaggcgag

SEQ ID NO: 438798 - DNA, 20 bp, mouse
gccgcagcagtgggtacggg

SEQ ID NO: 438799 - DNA, 20 bp, mouse
ggagccgcgggctcggtgag

SEQ ID NO: 438800 - DNA, 20 bp, mouse
gacgccggcgccgcagcagt

SEQ ID NO: 438801 - DNA, 20 bp, mouse
gggcgcagccgagagcacga

SEQ ID NO: 438802 - DNA, 20 bp, mouse
ggggctcggtgaggggtgtg

SEQ ID NO: 438803 - DNA, 20 bp, mouse
gggcgcagcaccgaccagtg

SEQ ID NO: 438804 - DNA, 20 bp, mouse
ggccccggcagtagcgaaga

SEQ ID NO: 438805 - DNA, 20 bp, mouse
ggccggggcgggctccgcac

SEQ ID NO: 438806 - DNA, 20 bp, mouse
gccctcccctctcctgtcag

SEQ ID NO: 438807 - DNA, 20 bp, mouse
ggagtcaaaatggcgacggg

SEQ ID NO: 438808 - DNA, 20 bp, mouse
gtaggctccgggaccactcc

SEQ ID NO: 438809 - DNA, 20 bp, mouse
gcggagcctaagccactgac

SEQ ID NO: 438810 - DNA, 20 bp, mouse
gctccctgtcggagtcaaaa

SEQ ID NO: 438811 - DNA, 20 bp, mouse
gcgacggggggaacctggag

SEQ ID NO: 438812 - DNA, 20 bp, mouse
gcctaagccactgacaggag

SEQ ID NO: 438813 - DNA, 20 bp, mouse
ggcggtcccagcagcagtcg

SEQ ID NO: 438814 - DNA, 20 bp, mouse
gcgagggacactcacctcgg

SEQ ID NO: 438815 - DNA, 20 bp, mouse
ggactccgacagggagcagg

SEQ ID NO: 438816 - DNA, 20 bp, mouse
gcatgtcggccgcagaaccc

SEQ ID NO: 438817 - DNA, 20 bp, mouse
ggctccacagtgggccatgt

SEQ ID NO: 438818 - DNA, 20 bp, mouse
ggaactcagaagggccaccg

SEQ ID NO: 438819 - DNA, 20 bp, mouse
ggcctggcaccggggttctg

SEQ ID NO: 438820 - DNA, 20 bp, mouse
gaggccgcgctggaccggta

SEQ ID NO: 438821 - DNA, 20 bp, mouse
gccgcgctggaccggtacgg

SEQ ID NO: 438822 - DNA, 20 bp, mouse
gtgccccggggaactcagaa

SEQ ID NO: 438823 - DNA, 20 bp, mouse
gtggcccactgtggagcggg

SEQ ID NO: 438824 - DNA, 20 bp, mouse
gcggccgacatggcccactg

SEQ ID NO: 438825 - DNA, 20 bp, mouse
gctcgggaacgcccccgtac

SEQ ID NO: 438826 - DNA, 20 bp, mouse
gtcgctgagggacatcgtcg

SEQ ID NO: 438827 - DNA, 20 bp, mouse
gctggcggaagagacgtgtg

SEQ ID NO: 438828 - DNA, 20 bp, mouse
ggcggaagagacgtgtgtgg

SEQ ID NO: 438829 - DNA, 20 bp, mouse
gaggccccaactctcacgag

SEQ ID NO: 438830 - DNA, 20 bp, mouse
ggacgtgtgtggcggcttct

SEQ ID NO: 438831 - DNA, 20 bp, mouse
gcaactctcacgagcggtcc

SEQ ID NO: 438832 - DNA, 20 bp, mouse
ggaggcggggtcgctgctgg

SEQ ID NO: 438833 - DNA, 20 bp, mouse
gcccggaaccagcggccgag

SEQ ID NO: 438834 - DNA, 20 bp, mouse
ggcgacggcggcggtcgagg

SEQ ID NO: 438835 - DNA, 20 bp, mouse
gcacgaggcggggtcgctgc

SEQ ID NO: 438836 - DNA, 20 bp, mouse
gcagagcagggaaacacccg

SEQ ID NO: 438837 - DNA, 20 bp, mouse
ggcagcctgcctacagagca

SEQ ID NO: 438838 - DNA, 20 bp, mouse
gagcagggaaacacccgggg

SEQ ID NO: 438839 - DNA, 20 bp, mouse
gctgggccctggcaccgaga

SEQ ID NO: 438840 - DNA, 20 bp, mouse
ggagctgacactgctacccg

SEQ ID NO: 438841 - DNA, 20 bp, mouse
ggtatactcgaggcccaggg

SEQ ID NO: 438842 - DNA, 20 bp, mouse
gaactaatccctgagccagg

SEQ ID NO: 438843 - DNA, 20 bp, mouse
gtgggcctcgagtataccca

SEQ ID NO: 438844 - DNA, 20 bp, mouse
ggcttagtttcgcttcctcc

SEQ ID NO: 438845 - DNA, 20 bp, mouse
gggaagcgaaactaagcagc

SEQ ID NO: 438846 - DNA, 20 bp, mouse
gagcaggaggcgggacgagc

SEQ ID NO: 438847 - DNA, 20 bp, mouse
gacctgcttcgcataggacg

SEQ ID NO: 438848 - DNA, 20 bp, mouse
gctagtggaggacaaaacca

SEQ ID NO: 438849 - DNA, 20 bp, mouse
gtcgtcccgcctcctgctga

SEQ ID NO: 438850 - DNA, 20 bp, mouse
ggagggtgactgcagagacc

SEQ ID NO: 438851 - DNA, 20 bp, mouse
ggagtccggaaaagactgac

SEQ ID NO: 438852 - DNA, 20 bp, mouse
gtccaatcagcgggaagccc

SEQ ID NO: 438853 - DNA, 20 bp, mouse
ggcgagcatcctcagagatt

SEQ ID NO: 438854 - DNA, 20 bp, mouse
gtttcttacctgcttcgcat

SEQ ID NO: 438855 - DNA, 20 bp, mouse
gagctcagtccggtatggag

SEQ ID NO: 438856 - DNA, 20 bp, mouse
gcacccaggcggactctcgg

SEQ ID NO: 438857 - DNA, 20 bp, mouse
gttccgccgagagggagaga

SEQ ID NO: 438858 - DNA, 20 bp, mouse
gtcccggcaggagcgaggca

SEQ ID NO: 438859 - DNA, 20 bp, mouse
gggaaagcgatgcgacggac

SEQ ID NO: 438860 - DNA, 20 bp, mouse
gcgcccccgagagtccgcct

SEQ ID NO: 438861 - DNA, 20 bp, mouse
ggctgaggaaagcgatgcga

SEQ ID NO: 438862 - DNA, 20 bp, mouse
gcggacgggcgctcccaccc

SEQ ID NO: 438863 - DNA, 20 bp, mouse
gacgggcgctcccacccagg

SEQ ID NO: 438864 - DNA, 20 bp, mouse
gcgccctctctccctctcgg

SEQ ID NO: 438865 - DNA, 20 bp, mouse
gaggccgtggacgccggcgt

SEQ ID NO: 438866 - DNA, 20 bp, mouse
ggcacgcggcaagagcaaga

SEQ ID NO: 438867 - DNA, 20 bp, mouse
ggtcctccaacaccagcacg

SEQ ID NO: 438868 - DNA, 20 bp, mouse
gagacagagaaagaccgcgg

SEQ ID NO: 438869 - DNA, 20 bp, mouse
ggtctcacctgcagcgggga

SEQ ID NO: 438870 - DNA, 20 bp, mouse
gccgctgcaggtgagacccc

SEQ ID NO: 438871 - DNA, 20 bp, mouse
gtcttgccgcgtgctggtgt

SEQ ID NO: 438872 - DNA, 20 bp, mouse
gctgcaggtgagacccccgg

SEQ ID NO: 438873 - DNA, 20 bp, mouse
gcggcgggcccgccacccca

SEQ ID NO: 438874 - DNA, 20 bp, mouse
gttacgggcggcgcagctgg

SEQ ID NO: 438875 - DNA, 20 bp, mouse
gcgggcctgtcggttacggg

SEQ ID NO: 438876 - DNA, 20 bp, mouse
gcaactctcgggatcctcgg

SEQ ID NO: 438877 - DNA, 20 bp, mouse
ggaggctaccgagctggagg

SEQ ID NO: 438878 - DNA, 20 bp, mouse
gtccagctcggtagcctccg

SEQ ID NO: 438879 - DNA, 20 bp, mouse
ggacggccgagaggaagcga

SEQ ID NO: 438880 - DNA, 20 bp, mouse
gagctggaaatgcaactctc

SEQ ID NO: 438881 - DNA, 20 bp, mouse
gatgcaactctcgggatcct

SEQ ID NO: 438882 - DNA, 20 bp, mouse
ggccgcctccgcctccagct

SEQ ID NO: 438883 - DNA, 20 bp, mouse
ggacagagagagacgagcga

SEQ ID NO: 438884 - DNA, 20 bp, mouse
gtcctcggaggctaccgagc

SEQ ID NO: 438885 - DNA, 20 bp, mouse
gggctctcgcccagacccga

SEQ ID NO: 438886 - DNA, 20 bp, mouse
gcgcagcccggggaaagtcc

SEQ ID NO: 438887 - DNA, 20 bp, mouse
gttcccgtggctcataccgg

SEQ ID NO: 438888 - DNA, 20 bp, mouse
gcagccaccggtatgagcca

SEQ ID NO: 438889 - DNA, 20 bp, mouse
gctcttcccgtggctcatac

SEQ ID NO: 438890 - DNA, 20 bp, mouse
gccgggcagagcccgagagg

SEQ ID NO: 438891 - DNA, 20 bp, mouse
gcgctccaggacgcactgac

SEQ ID NO: 438892 - DNA, 20 bp, mouse
gctggagaggaaacccacgg

SEQ ID NO: 438893 - DNA, 20 bp, mouse
ggcgatctccgggagcatgt

SEQ ID NO: 438894 - DNA, 20 bp, mouse
gagtccgggcagagcccgag

SEQ ID NO: 438895 - DNA, 20 bp, mouse
ggaccggtgagcacacgtcg

SEQ ID NO: 438896 - DNA, 20 bp, mouse
ggcggagcgcgcggccgaca

SEQ ID NO: 438897 - DNA, 20 bp, mouse
gtcccgacgcggcccacggg

SEQ ID NO: 438898 - DNA, 20 bp, mouse
gcgggcctcgagccccccgt

SEQ ID NO: 438899 - DNA, 20 bp, mouse
gggctcgaggcccggaagaa

SEQ ID NO: 438900 - DNA, 20 bp, mouse
gggcgaacgcagtcccgacg

SEQ ID NO: 438901 - DNA, 20 bp, mouse
gcagtcccgacgcggcccac

SEQ ID NO: 438902 - DNA, 20 bp, mouse
gagggcaggcctggcataag

SEQ ID NO: 438903 - DNA, 20 bp, mouse
gatcgcggcggagggaggtt

SEQ ID NO: 438904 - DNA, 20 bp, mouse
ggtcggagtcggggacgcgg

SEQ ID NO: 438905 - DNA, 20 bp, mouse
ggggactgcgttcgccctgt

SEQ ID NO: 438906 - DNA, 20 bp, mouse
gaataggtatgggtcagagt

SEQ ID NO: 438907 - DNA, 20 bp, mouse
gctctggtctctacaaaaag

SEQ ID NO: 438908 - DNA, 20 bp, mouse
gaacctcaccaaataggtat

SEQ ID NO: 438909 - DNA, 20 bp, mouse
ggtccctaacctcaccaaat

SEQ ID NO: 438910 - DNA, 20 bp, mouse
gcatgctctactctccaggt

SEQ ID NO: 438911 - DNA, 20 bp, mouse
gggaccgccgttggaaaatg

SEQ ID NO: 438912 - DNA, 20 bp, mouse
gtaagtatgttcttaaaagg

SEQ ID NO: 438913 - DNA, 20 bp, mouse
ggacccatacctatttggtg

SEQ ID NO: 438914 - DNA, 20 bp, mouse
gctagcatgctctactctcc

SEQ ID NO: 438915 - DNA, 20 bp, mouse
ggcaatagttaactactaga

SEQ ID NO: 438916 - DNA, 20 bp, mouse
ggtcgtgagatgccaggact

SEQ ID NO: 438917 - DNA, 20 bp, mouse
gtctctgaagactctggacc

SEQ ID NO: 438918 - DNA, 20 bp, mouse
gtgagtggctgcgaaagggt

SEQ ID NO: 438919 - DNA, 20 bp, mouse
gggccacacggtctcagctg

SEQ ID NO: 438920 - DNA, 20 bp, mouse
gtcctccagcagtagatata

SEQ ID NO: 438921 - DNA, 20 bp, mouse
gtactgctggaggacgctca

SEQ ID NO: 438922 - DNA, 20 bp, mouse
ggatgggaatgagacactac

SEQ ID NO: 438923 - DNA, 20 bp, mouse
gagtcccaccttccaagtcc

SEQ ID NO: 438924 - DNA, 20 bp, mouse
gggcagcctcgtggtaacag

SEQ ID NO: 438925 - DNA, 20 bp, mouse
gcgacgggccagatagtatc

SEQ ID NO: 438926 - DNA, 20 bp, mouse
gtcaaatcaggagacctggt

SEQ ID NO: 438927 - DNA, 20 bp, mouse
ggctccagaggcccagatgg

SEQ ID NO: 438928 - DNA, 20 bp, mouse
ggacagtgtgagtagtccga

SEQ ID NO: 438929 - DNA, 20 bp, mouse
gccagctctgaagatctcta

SEQ ID NO: 438930 - DNA, 20 bp, mouse
ggaggagtcccaagcatggc

SEQ ID NO: 438931 - DNA, 20 bp, mouse
gcccagcacgtgtcaggtaa

SEQ ID NO: 438932 - DNA, 20 bp, mouse
gaaccgaggagtcccaagca

SEQ ID NO: 438933 - DNA, 20 bp, mouse
ggctctgaagatctctaggg

SEQ ID NO: 438934 - DNA, 20 bp, mouse
gctactaagaggaatggtaa

SEQ ID NO: 438935 - DNA, 20 bp, mouse
ggacagtgcctgccatgctt

SEQ ID NO: 438936 - DNA, 20 bp, mouse
gagggctgcttgtcaccccg

SEQ ID NO: 438937 - DNA, 20 bp, mouse
gcacagtgatcaagtgaaaa

SEQ ID NO: 438938 - DNA, 20 bp, mouse
gctctcaggagggtgatctc

SEQ ID NO: 438939 - DNA, 20 bp, mouse
gagctctctctttggccccg

SEQ ID NO: 438940 - DNA, 20 bp, mouse
gttctgaagagctctctctt

SEQ ID NO: 438941 - DNA, 20 bp, mouse
gccgatttcgacagacccag

SEQ ID NO: 438942 - DNA, 20 bp, mouse
gtcgacagacccagaggaaa

SEQ ID NO: 438943 - DNA, 20 bp, mouse
gccattctggaggcagtcga

SEQ ID NO: 438944 - DNA, 20 bp, mouse
ggaccagacgtacagaggaa

SEQ ID NO: 438945 - DNA, 20 bp, mouse
gtggaggaccagacgtacag

SEQ ID NO: 438946 - DNA, 20 bp, mouse
ggactcgcgacagcagacct

SEQ ID NO: 438947 - DNA, 20 bp, mouse
gtcgcgacagcagacctcgg

SEQ ID NO: 438948 - DNA, 20 bp, mouse
gacgcggaatgggtcctccg

SEQ ID NO: 438949 - DNA, 20 bp, mouse
gcaggggctgtaggaatagg

SEQ ID NO: 438950 - DNA, 20 bp, mouse
gcccagcactttgcaagtaa

SEQ ID NO: 438951 - DNA, 20 bp, mouse
gacaaactgctacagtagag

SEQ ID NO: 438952 - DNA, 20 bp, mouse
ggggtagggtgtcacaacac

SEQ ID NO: 438953 - DNA, 20 bp, mouse
ggagtacagggaaggcgagg

SEQ ID NO: 438954 - DNA, 20 bp, mouse
ggtgagacttgcacgcggaa

SEQ ID NO: 438955 - DNA, 20 bp, mouse
gcagttaattctagaaggta

SEQ ID NO: 438956 - DNA, 20 bp, mouse
gctctaaagccagagcctgg

SEQ ID NO: 438957 - DNA, 20 bp, mouse
gagtgcactgaggatccctg

SEQ ID NO: 438958 - DNA, 20 bp, mouse
ggacacacaatgctgccccc

SEQ ID NO: 438959 - DNA, 20 bp, mouse
gctttctcctagactcctcc

SEQ ID NO: 438960 - DNA, 20 bp, mouse
gctgtccagacggtgagtga

SEQ ID NO: 438961 - DNA, 20 bp, mouse
ggctttagagtttctcctgg

SEQ ID NO: 438962 - DNA, 20 bp, mouse
ggatgttctcagtggcaagg

SEQ ID NO: 438963 - DNA, 20 bp, mouse
gcaccgtctggacagagctg

SEQ ID NO: 438964 - DNA, 20 bp, mouse
ggttctctgagtccaatgta

SEQ ID NO: 438965 - DNA, 20 bp, mouse
gagggtccaggagtgcactg

SEQ ID NO: 438966 - DNA, 20 bp, mouse
gcctcccagcgatatgagag

SEQ ID NO: 438967 - DNA, 20 bp, mouse
gaagcaggcagccggctcag

SEQ ID NO: 438968 - DNA, 20 bp, mouse
gaggacacactagatatgaa

SEQ ID NO: 438969 - DNA, 20 bp, mouse
gtaactcttaccttcggtaa

SEQ ID NO: 438970 - DNA, 20 bp, mouse
ggctccatcttggcttacta

SEQ ID NO: 438971 - DNA, 20 bp, mouse
ggccatatgccccttaggga

SEQ ID NO: 438972 - DNA, 20 bp, mouse
gtggaggcgcgccattaaag

SEQ ID NO: 438973 - DNA, 20 bp, mouse
gtagtgtgtcctgtaggcaa

SEQ ID NO: 438974 - DNA, 20 bp, mouse
gcatccaacccaaaatatgg

SEQ ID NO: 438975 - DNA, 20 bp, mouse
ggtaggcaagggctcttgtg

SEQ ID NO: 438976 - DNA, 20 bp, mouse
gggcagagttgagtccccga

SEQ ID NO: 438977 - DNA, 20 bp, mouse
gcgagggtcagtctaaaatg

SEQ ID NO: 438978 - DNA, 20 bp, mouse
gttgaatggtgtcaatctgt

SEQ ID NO: 438979 - DNA, 20 bp, mouse
ggtaaatgtgctgctctgac

SEQ ID NO: 438980 - DNA, 20 bp, mouse
ggcgtgaaggaagatttgaa

SEQ ID NO: 438981 - DNA, 20 bp, mouse
gggaggagtcaactaagatg

SEQ ID NO: 438982 - DNA, 20 bp, mouse
gaaagtgaaactcagaagga

SEQ ID NO: 438983 - DNA, 20 bp, mouse
gggaaagagcaacaggtgag

SEQ ID NO: 438984 - DNA, 20 bp, mouse
gccggcattggctatagagt

SEQ ID NO: 438985 - DNA, 20 bp, mouse
gccctaaaggaaagagcaac

SEQ ID NO: 438986 - DNA, 20 bp, mouse
gccagtgctgcaattactca

SEQ ID NO: 438987 - DNA, 20 bp, mouse
gctctgtaggtcagatgtac

SEQ ID NO: 438988 - DNA, 20 bp, mouse
gcccaggtagggtctggtta

SEQ ID NO: 438989 - DNA, 20 bp, mouse
gttgtatgccagatttctat

SEQ ID NO: 438990 - DNA, 20 bp, mouse
gattagtcacacaatgtaaa

SEQ ID NO: 438991 - DNA, 20 bp, mouse
gtgtgactaataaaaatatc

SEQ ID NO: 438992 - DNA, 20 bp, mouse
ggtgttggggaggactgagt

SEQ ID NO: 438993 - DNA, 20 bp, mouse
gctggaatattgtaagtcct

SEQ ID NO: 438994 - DNA, 20 bp, mouse
gtgactctgcttttcccacc

SEQ ID NO: 438995 - DNA, 20 bp, mouse
gaccaggacagactcacgtg

SEQ ID NO: 438996 - DNA, 20 bp, mouse
gctcgatgtctaagggtcac

SEQ ID NO: 438997 - DNA, 20 bp, mouse
gtcattggctcgatgtctaa

SEQ ID NO: 438998 - DNA, 20 bp, mouse
ggagccaatgactctccctt

SEQ ID NO: 438999 - DNA, 20 bp, mouse
ggaggcagatcaataacctg

SEQ ID NO: 439000 - DNA, 20 bp, mouse
gggacacgcaagtcacttcg

SEQ ID NO: 439001 - DNA, 20 bp, mouse
gcagctgtataaggacgaac

SEQ ID NO: 439002 - DNA, 20 bp, mouse
gcaatgctgtctctgaggag

SEQ ID NO: 439003 - DNA, 20 bp, mouse
gaacctggggaggagttaag

SEQ ID NO: 439004 - DNA, 20 bp, mouse
gctcctcaaaactctgagaa

SEQ ID NO: 439005 - DNA, 20 bp, mouse
gttgtcagtgttgggtagta

SEQ ID NO: 439006 - DNA, 20 bp, mouse
gaatcaccccctttagaggg

SEQ ID NO: 439007 - DNA, 20 bp, mouse
gtctcacctccctctaaagg

SEQ ID NO: 439008 - DNA, 20 bp, mouse
gcagaggagccagcctgaat

SEQ ID NO: 439009 - DNA, 20 bp, mouse
gagaagatccaagcggtaga

SEQ ID NO: 439010 - DNA, 20 bp, mouse
gcctaggggaagcacagcat

SEQ ID NO: 439011 - DNA, 20 bp, mouse
gcacaatcaccccctttaga

SEQ ID NO: 439012 - DNA, 20 bp, mouse
gccaagcggtagagggatgc

SEQ ID NO: 439013 - DNA, 20 bp, mouse
gcaatctcacctccctctaa

SEQ ID NO: 439014 - DNA, 20 bp, mouse
gaggggaagcacagcatagg

SEQ ID NO: 439015 - DNA, 20 bp, mouse
gcaaccaaaccaccagaact

SEQ ID NO: 439016 - DNA, 20 bp, mouse
gctgcggcctggcacgaaag

SEQ ID NO: 439017 - DNA, 20 bp, mouse
gacgaaaggggcggccccgg

SEQ ID NO: 439018 - DNA, 20 bp, mouse
ggagagcagacccagtagtc

SEQ ID NO: 439019 - DNA, 20 bp, mouse
gcataatcgcccggactact

SEQ ID NO: 439020 - DNA, 20 bp, mouse
gctgggtctgctctccgccg

SEQ ID NO: 439021 - DNA, 20 bp, mouse
gacccgctcaccgcaggagg

SEQ ID NO: 439022 - DNA, 20 bp, mouse
ggcgattatggacccggcag

SEQ ID NO: 439023 - DNA, 20 bp, mouse
gcagtggcgaggcggaggga

SEQ ID NO: 439024 - DNA, 20 bp, mouse
ggtccgggcgattatggacc

SEQ ID NO: 439025 - DNA, 20 bp, mouse
gggtgcaggagggtacagag

SEQ ID NO: 439026 - DNA, 20 bp, mouse
gcggcggccttcgagactcg

SEQ ID NO: 439027 - DNA, 20 bp, mouse
gtcggggttaggggctgatg

SEQ ID NO: 439028 - DNA, 20 bp, mouse
gggctgatggggagtttggt

SEQ ID NO: 439029 - DNA, 20 bp, mouse
gcttcgagactcggggttag

SEQ ID NO: 439030 - DNA, 20 bp, mouse
ggtctactcgagtgacccgg

SEQ ID NO: 439031 - DNA, 20 bp, mouse
gcaccaggcctcagccaagg

SEQ ID NO: 439032 - DNA, 20 bp, mouse
gtggtgcagcgaacccgctg

SEQ ID NO: 439033 - DNA, 20 bp, mouse
gagcgaacccgctgaggaag

SEQ ID NO: 439034 - DNA, 20 bp, mouse
gtgatggggagtttggtcgg

SEQ ID NO: 439035 - DNA, 20 bp, mouse
gcgcggggaattcgaatcgc

SEQ ID NO: 439036 - DNA, 20 bp, mouse
gtcgccagccgagcacccag

SEQ ID NO: 439037 - DNA, 20 bp, mouse
ggcggaggcgaggtaaggac

SEQ ID NO: 439038 - DNA, 20 bp, mouse
gggcggcccgtgcgtgatgg

SEQ ID NO: 439039 - DNA, 20 bp, mouse
ggctattctgagaaggaatc

SEQ ID NO: 439040 - DNA, 20 bp, mouse
gtgaggaggctattctgaga

SEQ ID NO: 439041 - DNA, 20 bp, mouse
gtcacgcccccatcacgcac

SEQ ID NO: 439042 - DNA, 20 bp, mouse
gccagccagggggcaagact

SEQ ID NO: 439043 - DNA, 20 bp, mouse
ggcgtgatgggggcgtgagg

SEQ ID NO: 439044 - DNA, 20 bp, mouse
gaggataaaggtctgcggaa

SEQ ID NO: 439045 - DNA, 20 bp, mouse
gaagggcgagagcaagtatt

SEQ ID NO: 439046 - DNA, 20 bp, mouse
gtgctcggagggaagcggat

SEQ ID NO: 439047 - DNA, 20 bp, mouse
ggagggaagcggatcggtag

SEQ ID NO: 439048 - DNA, 20 bp, mouse
gttgcctgcgagtgctcgga

SEQ ID NO: 439049 - DNA, 20 bp, mouse
gcgttgcttaggcggacagg

SEQ ID NO: 439050 - DNA, 20 bp, mouse
ggaagcggatcggtagtggc

SEQ ID NO: 439051 - DNA, 20 bp, mouse
gcggccggcctggatcaagg

SEQ ID NO: 439052 - DNA, 20 bp, mouse
gcggtgcagaaacgttgctt

SEQ ID NO: 439053 - DNA, 20 bp, mouse
ggcaggcaaagcggagaagg

SEQ ID NO: 439054 - DNA, 20 bp, mouse
gcaaagcggagaaggcggag

SEQ ID NO: 439055 - DNA, 20 bp, mouse
gcgagcactcgcaggcaaag

SEQ ID NO: 439056 - DNA, 20 bp, mouse
gggagctgccgccatggcag

SEQ ID NO: 439057 - DNA, 20 bp, mouse
gcgcttcagatactcagctt

SEQ ID NO: 439058 - DNA, 20 bp, mouse
gcaccgcgcgggccaggacg

SEQ ID NO: 439059 - DNA, 20 bp, mouse
gagtggcggagctgccgcca

SEQ ID NO: 439060 - DNA, 20 bp, mouse
gcaaggaaggcgctgctcag

SEQ ID NO: 439061 - DNA, 20 bp, mouse
gacttgtctgggacagatgc

SEQ ID NO: 439062 - DNA, 20 bp, mouse
gcctgagctcgggccggggt

SEQ ID NO: 439063 - DNA, 20 bp, mouse
ggaggtgtcgcgctgcccgg

SEQ ID NO: 439064 - DNA, 20 bp, mouse
gtctgaagcgttacttgtct

SEQ ID NO: 439065 - DNA, 20 bp, mouse
gggcttggaaggaggtcccg

SEQ ID NO: 439066 - DNA, 20 bp, mouse
gcgagcagagaaacactcac

SEQ ID NO: 439067 - DNA, 20 bp, mouse
gccggaaactcaagcaccta

SEQ ID NO: 439068 - DNA, 20 bp, mouse
ggaagttacggaagggacag

SEQ ID NO: 439069 - DNA, 20 bp, mouse
ggtaaccattgccaaagata

SEQ ID NO: 439070 - DNA, 20 bp, mouse
ggaagagtttgtcgccggag

SEQ ID NO: 439071 - DNA, 20 bp, mouse
gccggccccgagagcctctc

SEQ ID NO: 439072 - DNA, 20 bp, mouse
gcaagagcgaagttacggaa

SEQ ID NO: 439073 - DNA, 20 bp, mouse
gcgtagaagagcgggaaaag

SEQ ID NO: 439074 - DNA, 20 bp, mouse
gcccggaagagaaaacgacg

SEQ ID NO: 439075 - DNA, 20 bp, mouse
gttattgacggcttccgctc

SEQ ID NO: 439076 - DNA, 20 bp, mouse
gtggctggacgggctcgcgg

SEQ ID NO: 439077 - DNA, 20 bp, mouse
ggcgatcgcgcgggaaagtt

SEQ ID NO: 439078 - DNA, 20 bp, mouse
gcgcgtcctagagaaacggg

SEQ ID NO: 439079 - DNA, 20 bp, mouse
ggtcaaagcctccgcgaacg

SEQ ID NO: 439080 - DNA, 20 bp, mouse
gggcgggtccccaggcagcg

SEQ ID NO: 439081 - DNA, 20 bp, mouse
ggcgcgcgcaaagtttgcga

SEQ ID NO: 439082 - DNA, 20 bp, mouse
ggccggggccgcgctgcctg

SEQ ID NO: 439083 - DNA, 20 bp, mouse
gggcgcgggcaggcgaaggg

SEQ ID NO: 439084 - DNA, 20 bp, mouse
ggcggctgcaaggacgacgc

SEQ ID NO: 439085 - DNA, 20 bp, mouse
ggggaaagttgggcacggag

SEQ ID NO: 439086 - DNA, 20 bp, mouse
gtcacacgtgtgaacctggt

SEQ ID NO: 439087 - DNA, 20 bp, mouse
gggcttcacacgtgtgaacc

SEQ ID NO: 439088 - DNA, 20 bp, mouse
gcacagcgcaagcgcagtat

SEQ ID NO: 439089 - DNA, 20 bp, mouse
gcgcggggacccgagaaaaa

SEQ ID NO: 439090 - DNA, 20 bp, mouse
ggcggctgggtgagtgacaa

SEQ ID NO: 439091 - DNA, 20 bp, mouse
gcaaattcaaggtgacacgt

SEQ ID NO: 439092 - DNA, 20 bp, mouse
ggggcgtgaggtcgaagagg

SEQ ID NO: 439093 - DNA, 20 bp, mouse
ggggcactgtgatctctcag

SEQ ID NO: 439094 - DNA, 20 bp, mouse
ggacccgagaaaaacggcgg

SEQ ID NO: 439095 - DNA, 20 bp, mouse
gctgggtgagtgacaagggg

SEQ ID NO: 439096 - DNA, 20 bp, mouse
gtcagctcgagggactgcaa

SEQ ID NO: 439097 - DNA, 20 bp, mouse
ggctccccaaatgagatggt

SEQ ID NO: 439098 - DNA, 20 bp, mouse
gcggagctccccaaatgaga

SEQ ID NO: 439099 - DNA, 20 bp, mouse
gggactgcaagggtccctcg

SEQ ID NO: 439100 - DNA, 20 bp, mouse
ggggagctccgggaccgcga

SEQ ID NO: 439101 - DNA, 20 bp, mouse
gccagcaagcaactgatcgg

SEQ ID NO: 439102 - DNA, 20 bp, mouse
gctccccactccccattctg

SEQ ID NO: 439103 - DNA, 20 bp, mouse
gtcagctagtctcagctcga

SEQ ID NO: 439104 - DNA, 20 bp, mouse
gcaagggtccctcgcggtcc

SEQ ID NO: 439105 - DNA, 20 bp, mouse
gaatgagatggtgggcacga

SEQ ID NO: 439106 - DNA, 20 bp, mouse
gaccgggcggacgctgaagg

SEQ ID NO: 439107 - DNA, 20 bp, mouse
ggccaggcctggacaccggg

SEQ ID NO: 439108 - DNA, 20 bp, mouse
gcgccccgccgggataaccc

SEQ ID NO: 439109 - DNA, 20 bp, mouse
gccgcagctgcggtagcgcg

SEQ ID NO: 439110 - DNA, 20 bp, mouse
gctatttcaccatcctaggt

SEQ ID NO: 439111 - DNA, 20 bp, mouse
ggacaccgggcggacgctga

SEQ ID NO: 439112 - DNA, 20 bp, mouse
gggcctggcccgggttatcc

SEQ ID NO: 439113 - DNA, 20 bp, mouse
gaagccaggagggtctgtct

SEQ ID NO: 439114 - DNA, 20 bp, mouse
ggcccctgggtcctgaacat

SEQ ID NO: 439115 - DNA, 20 bp, mouse
gtccgcccggtgtccaggcc

SEQ ID NO: 439116 - DNA, 20 bp, mouse
ggtgggaagcggcccctcaa

SEQ ID NO: 439117 - DNA, 20 bp, mouse
ggcgttagttccggtcgcag

SEQ ID NO: 439118 - DNA, 20 bp, mouse
gccggccggggcgcacacgg

SEQ ID NO: 439119 - DNA, 20 bp, mouse
ggcgcagcgccggggaagag

SEQ ID NO: 439120 - DNA, 20 bp, mouse
gcacccaacagaggccgcgg

SEQ ID NO: 439121 - DNA, 20 bp, mouse
gcgccctcccgcgaaagcag

SEQ ID NO: 439122 - DNA, 20 bp, mouse
ggcgctgtctcctctgcgac

SEQ ID NO: 439123 - DNA, 20 bp, mouse
gcctcgcccgccctccagag

SEQ ID NO: 439124 - DNA, 20 bp, mouse
gccaccgcaggcgacagggt

SEQ ID NO: 439125 - DNA, 20 bp, mouse
gacggcgcgccgctcttccc

SEQ ID NO: 439126 - DNA, 20 bp, mouse
gtggctgaggcagacaatgg

SEQ ID NO: 439127 - DNA, 20 bp, mouse
gcgacgacgcgcgagactgg

SEQ ID NO: 439128 - DNA, 20 bp, mouse
ggagcgacgacgcgcgagac

SEQ ID NO: 439129 - DNA, 20 bp, mouse
gggaaggcaaccgccccagg

SEQ ID NO: 439130 - DNA, 20 bp, mouse
gggtaagaggtgatcaggtg

SEQ ID NO: 439131 - DNA, 20 bp, mouse
gacctcttacctgtccaagg

SEQ ID NO: 439132 - DNA, 20 bp, mouse
gcaggaggcggagctacacc

SEQ ID NO: 439133 - DNA, 20 bp, mouse
gagaggaaggcaaccgcccc

SEQ ID NO: 439134 - DNA, 20 bp, mouse
gggctcctctatgaagagga

SEQ ID NO: 439135 - DNA, 20 bp, mouse
gaagcatgtgccacctgggg

SEQ ID NO: 439136 - DNA, 20 bp, mouse
gtgagagtcatataacacaa

SEQ ID NO: 439137 - DNA, 20 bp, mouse
gaagtcgagacagtggaaca

SEQ ID NO: 439138 - DNA, 20 bp, mouse
gtctcaagttacagaacagt

SEQ ID NO: 439139 - DNA, 20 bp, mouse
gtaagatgaagtcgagacag

SEQ ID NO: 439140 - DNA, 20 bp, mouse
gaaggagcttgagtcagatc

SEQ ID NO: 439141 - DNA, 20 bp, mouse
gtcccattccaggtgaaggg

SEQ ID NO: 439142 - DNA, 20 bp, mouse
gactttgtagaaagaggttt

SEQ ID NO: 439143 - DNA, 20 bp, mouse
gtagtcccattccaggtgaa

SEQ ID NO: 439144 - DNA, 20 bp, mouse
ggagaatagaaatagtcctg

SEQ ID NO: 439145 - DNA, 20 bp, mouse
gatagaaatagtcctgtggt

SEQ ID NO: 439146 - DNA, 20 bp, mouse
gagaatgtggccgcctagtg

SEQ ID NO: 439147 - DNA, 20 bp, mouse
gtacgcactgccccactagg

SEQ ID NO: 439148 - DNA, 20 bp, mouse
gagttacgcactgccccact

SEQ ID NO: 439149 - DNA, 20 bp, mouse
gcttccggtgtggaagaatg

SEQ ID NO: 439150 - DNA, 20 bp, mouse
gcctggcgtgtgacagaggg

SEQ ID NO: 439151 - DNA, 20 bp, mouse
gcggccacattcttccacac

SEQ ID NO: 439152 - DNA, 20 bp, mouse
gaggggactgcggaatccat

SEQ ID NO: 439153 - DNA, 20 bp, mouse
gaggagacctgaggggactg

SEQ ID NO: 439154 - DNA, 20 bp, mouse
gtgtgcgcgggattacgatg

SEQ ID NO: 439155 - DNA, 20 bp, mouse
ggtgtgatccgcttccggtg

SEQ ID NO: 439156 - DNA, 20 bp, mouse
ggacagaacaggtgtgcagt

SEQ ID NO: 439157 - DNA, 20 bp, mouse
ggctttcccagttctcaccg

SEQ ID NO: 439158 - DNA, 20 bp, mouse
ggtatttgtaatgacagaac

SEQ ID NO: 439159 - DNA, 20 bp, mouse
ggcggcaggaagagagaacg

SEQ ID NO: 439160 - DNA, 20 bp, mouse
gaacttgagctgtacggagt

SEQ ID NO: 439161 - DNA, 20 bp, mouse
gttaatcctttgactcgtta

SEQ ID NO: 439162 - DNA, 20 bp, mouse
gttgatctgtaagtggtcac

SEQ ID NO: 439163 - DNA, 20 bp, mouse
gtgacgcagagcctcaggga

SEQ ID NO: 439164 - DNA, 20 bp, mouse
gaaataccttaacgagtcaa

SEQ ID NO: 439165 - DNA, 20 bp, mouse
gctcatagcatacctaccga

SEQ ID NO: 439166 - DNA, 20 bp, mouse
gccggaagcaggcctggcgt

SEQ ID NO: 439167 - DNA, 20 bp, mouse
gggcgtaggctggagcttgg

SEQ ID NO: 439168 - DNA, 20 bp, mouse
gctgcccgcgcggagaggac

SEQ ID NO: 439169 - DNA, 20 bp, mouse
ggtaggctggagcttggggg

SEQ ID NO: 439170 - DNA, 20 bp, mouse
gcgggagcgcaggccgaacc

SEQ ID NO: 439171 - DNA, 20 bp, mouse
gccgaacccggaagcaggcc

SEQ ID NO: 439172 - DNA, 20 bp, mouse
gggtatttccgaagccacgg

SEQ ID NO: 439173 - DNA, 20 bp, mouse
gcctctccgcgcgggcagtt

SEQ ID NO: 439174 - DNA, 20 bp, mouse
ggaggccgtgctgcaccgag

SEQ ID NO: 439175 - DNA, 20 bp, mouse
ggcaggccgaacccggaagc

SEQ ID NO: 439176 - DNA, 20 bp, mouse
gtggagactcgagtaccctg

SEQ ID NO: 439177 - DNA, 20 bp, mouse
gacctgcctgagctattcag

SEQ ID NO: 439178 - DNA, 20 bp, mouse
gtgagctatgagctatgact

SEQ ID NO: 439179 - DNA, 20 bp, mouse
gcaggggctgctgtacagat

SEQ ID NO: 439180 - DNA, 20 bp, mouse
gccatgaagaccaaagcctc

SEQ ID NO: 439181 - DNA, 20 bp, mouse
gcacactcacactcacggta

SEQ ID NO: 439182 - DNA, 20 bp, mouse
ggctacctgaggcctgatgg

SEQ ID NO: 439183 - DNA, 20 bp, mouse
gtagctcagttcagaccagt

SEQ ID NO: 439184 - DNA, 20 bp, mouse
gaggctcaaattaaattatt

SEQ ID NO: 439185 - DNA, 20 bp, mouse
gcgtgctccagacgcggcag

SEQ ID NO: 439186 - DNA, 20 bp, mouse
gctaccccggatggtcaggt

SEQ ID NO: 439187 - DNA, 20 bp, mouse
gggttggcctccacagagta

SEQ ID NO: 439188 - DNA, 20 bp, mouse
gctcccgccttactctgtgg

SEQ ID NO: 439189 - DNA, 20 bp, mouse
gggaatcagaagtcactggt

SEQ ID NO: 439190 - DNA, 20 bp, mouse
gggagaccgcaggcgggtgt

SEQ ID NO: 439191 - DNA, 20 bp, mouse
gggagctaccccggatggtc

SEQ ID NO: 439192 - DNA, 20 bp, mouse
ggagtaaggcgggagaccgc

SEQ ID NO: 439193 - DNA, 20 bp, mouse
gccacacccacacccgcctg

SEQ ID NO: 439194 - DNA, 20 bp, mouse
gcaggcggagctaccccgga

SEQ ID NO: 439195 - DNA, 20 bp, mouse
gaaggcgggagaccgcaggc

SEQ ID NO: 439196 - DNA, 20 bp, mouse
gttcgccctgataggagata

SEQ ID NO: 439197 - DNA, 20 bp, mouse
gtaggccctatctcctatca

SEQ ID NO: 439198 - DNA, 20 bp, mouse
ggagatagggcctaaggacc

SEQ ID NO: 439199 - DNA, 20 bp, mouse
ggtagcctgggacgaaccca

SEQ ID NO: 439200 - DNA, 20 bp, mouse
ggttcgcaggatagtctcta

SEQ ID NO: 439201 - DNA, 20 bp, mouse
gtcccaagctgcgaggcctt

SEQ ID NO: 439202 - DNA, 20 bp, mouse
gtacatgagccctggtcctt

SEQ ID NO: 439203 - DNA, 20 bp, mouse
gctcccaggcggcatcgcgg

SEQ ID NO: 439204 - DNA, 20 bp, mouse
gcagggcttgtagaaagcgt

SEQ ID NO: 439205 - DNA, 20 bp, mouse
gttggttcattcgccctgat

SEQ ID NO: 439206 - DNA, 20 bp, mouse
gacgctgaccggccgagggt

SEQ ID NO: 439207 - DNA, 20 bp, mouse
gcggcgacagcggcaactcg

SEQ ID NO: 439208 - DNA, 20 bp, mouse
gcgcagtctgggacgctgac

SEQ ID NO: 439209 - DNA, 20 bp, mouse
gatgctgcgcgacgcagtct

SEQ ID NO: 439210 - DNA, 20 bp, mouse
gacaccgccaccggccgagt

SEQ ID NO: 439211 - DNA, 20 bp, mouse
gccgccgagcgtgacagaca

SEQ ID NO: 439212 - DNA, 20 bp, mouse
gccgccaccggccgagtcgg

SEQ ID NO: 439213 - DNA, 20 bp, mouse
ggcgtcgcgcagcatcgcgt

SEQ ID NO: 439214 - DNA, 20 bp, mouse
ggcgcgcagagcagcctctt

SEQ ID NO: 439215 - DNA, 20 bp, mouse
gggcgaagaacgctctccga

SEQ ID NO: 439216 - DNA, 20 bp, mouse
gctgcctagagcatcagatg

SEQ ID NO: 439217 - DNA, 20 bp, mouse
ggagcacactgacaggggtg

SEQ ID NO: 439218 - DNA, 20 bp, mouse
gaggcaggccagctccgcac

SEQ ID NO: 439219 - DNA, 20 bp, mouse
gctggaagaaaaggcccgtg

SEQ ID NO: 439220 - DNA, 20 bp, mouse
gggcagggagcacactgaca

SEQ ID NO: 439221 - DNA, 20 bp, mouse
ggtggtaggtggctaggtgg

SEQ ID NO: 439222 - DNA, 20 bp, mouse
gtcaccccatctgatgctct

SEQ ID NO: 439223 - DNA, 20 bp, mouse
gtacagctgtctagcaggtg

SEQ ID NO: 439224 - DNA, 20 bp, mouse
ggcaggtgtggtaggtggct

SEQ ID NO: 439225 - DNA, 20 bp, mouse
gggaacaatatcacatagag

SEQ ID NO: 439226 - DNA, 20 bp, mouse
gactgcaagggaccctgaac

SEQ ID NO: 439227 - DNA, 20 bp, mouse
gtccaggcaccgccccgctt

SEQ ID NO: 439228 - DNA, 20 bp, mouse
gggaccctgaactgggttca

SEQ ID NO: 439229 - DNA, 20 bp, mouse
gtctaccctgaacccagttc

SEQ ID NO: 439230 - DNA, 20 bp, mouse
gccctaagcggggcggtgcc

SEQ ID NO: 439231 - DNA, 20 bp, mouse
gctggctggttaggatagga

SEQ ID NO: 439232 - DNA, 20 bp, mouse
gaccgccccgcttagggtta

SEQ ID NO: 439233 - DNA, 20 bp, mouse
gcttcccagagactcagagg

SEQ ID NO: 439234 - DNA, 20 bp, mouse
gtcccctacacagactgcaa

SEQ ID NO: 439235 - DNA, 20 bp, mouse
gcagcagagtaggaaaagtc

SEQ ID NO: 439236 - DNA, 20 bp, mouse
gactgcaagggaccctgaac

SEQ ID NO: 439237 - DNA, 20 bp, mouse
gggaccctgaactgggttca

SEQ ID NO: 439238 - DNA, 20 bp, mouse
gtctaccctgaacccagttc

SEQ ID NO: 439239 - DNA, 20 bp, mouse
gtgggccttggacccagccc

SEQ ID NO: 439240 - DNA, 20 bp, mouse
ggccttggacccagcccggg

SEQ ID NO: 439241 - DNA, 20 bp, mouse
gtactagggccgcccgggct

SEQ ID NO: 439242 - DNA, 20 bp, mouse
gcttcccagagactcagagg

SEQ ID NO: 439243 - DNA, 20 bp, mouse
gtcccctacacagactgcaa

SEQ ID NO: 439244 - DNA, 20 bp, mouse
ggaaccccctctgagtctct

SEQ ID NO: 439245 - DNA, 20 bp, mouse
gccctgaaggagttctctct

SEQ ID NO: 439246 - DNA, 20 bp, mouse
gctgcaatgcctgacatctc

SEQ ID NO: 439247 - DNA, 20 bp, mouse
ggtctctggacagagagaac

SEQ ID NO: 439248 - DNA, 20 bp, mouse
gactggccacctgagatgtc

SEQ ID NO: 439249 - DNA, 20 bp, mouse
gcaatgcctgacatctcagg

SEQ ID NO: 439250 - DNA, 20 bp, mouse
gcccaggactgagacatgtg

SEQ ID NO: 439251 - DNA, 20 bp, mouse
gcaagagatagggaaccagg

SEQ ID NO: 439252 - DNA, 20 bp, mouse
gtctccctaaacactgtctc

SEQ ID NO: 439253 - DNA, 20 bp, mouse
gctgtccagagacagtgttt

SEQ ID NO: 439254 - DNA, 20 bp, mouse
gacaaatgagctggaagaag

SEQ ID NO: 439255 - DNA, 20 bp, mouse
gtccattactgcaagagata

SEQ ID NO: 439256 - DNA, 20 bp, mouse
gtgagaggacagctgacctt

SEQ ID NO: 439257 - DNA, 20 bp, mouse
gggagccgatctcattactg

SEQ ID NO: 439258 - DNA, 20 bp, mouse
gaggacagctgacctttgga

SEQ ID NO: 439259 - DNA, 20 bp, mouse
gagaccctggagggaatctc

SEQ ID NO: 439260 - DNA, 20 bp, mouse
gtggagaaaataatgtgtcc

SEQ ID NO: 439261 - DNA, 20 bp, mouse
gcgatctcattactgaggcc

SEQ ID NO: 439262 - DNA, 20 bp, mouse
gaagctggtgttagatcagg

SEQ ID NO: 439263 - DNA, 20 bp, mouse
gaagatgactgccgtcgcca

SEQ ID NO: 439264 - DNA, 20 bp, mouse
gagcccccgccccgcctgag

SEQ ID NO: 439265 - DNA, 20 bp, mouse
gtcagctgtcctctcaggcg

SEQ ID NO: 439266 - DNA, 20 bp, mouse
gcgcccgagggagctgactg

SEQ ID NO: 439267 - DNA, 20 bp, mouse
gtcgggagtgtgagctgttg

SEQ ID NO: 439268 - DNA, 20 bp, mouse
gatcctccagggccttcttg

SEQ ID NO: 439269 - DNA, 20 bp, mouse
ggctcgccacaagaaggccc

SEQ ID NO: 439270 - DNA, 20 bp, mouse
ggtcacagctcgccacaaga

SEQ ID NO: 439271 - DNA, 20 bp, mouse
gaacttccaagaggcctgta

SEQ ID NO: 439272 - DNA, 20 bp, mouse
gttccccagtcagctccctc

SEQ ID NO: 439273 - DNA, 20 bp, mouse
ggcgaaggtggtccagtctg

SEQ ID NO: 439274 - DNA, 20 bp, mouse
gcgtgctggctggcacccga

SEQ ID NO: 439275 - DNA, 20 bp, mouse
ggagtgtgagctgttgtgga

SEQ ID NO: 439276 - DNA, 20 bp, mouse
gggagccccgggtgtactag

SEQ ID NO: 439277 - DNA, 20 bp, mouse
ggccgagagggtagggacat

SEQ ID NO: 439278 - DNA, 20 bp, mouse
ggtacctgagagcgatgctg

SEQ ID NO: 439279 - DNA, 20 bp, mouse
gcctggtgtaatcctatcca

SEQ ID NO: 439280 - DNA, 20 bp, mouse
ggatgctgaggaccgtggat

SEQ ID NO: 439281 - DNA, 20 bp, mouse
gtcgctctcaggtacgagtg

SEQ ID NO: 439282 - DNA, 20 bp, mouse
gctgtcagccctggccgaga

SEQ ID NO: 439283 - DNA, 20 bp, mouse
gctctctgagagtctgggac

SEQ ID NO: 439284 - DNA, 20 bp, mouse
gtcgggcggcagcactgaga

SEQ ID NO: 439285 - DNA, 20 bp, mouse
gaaacgcgatcatcctcggg

SEQ ID NO: 439286 - DNA, 20 bp, mouse
ggagagtgtagagcaatgga

SEQ ID NO: 439287 - DNA, 20 bp, mouse
gctctacactctccaaagac

SEQ ID NO: 439288 - DNA, 20 bp, mouse
gacgctctgtcagcactggg

SEQ ID NO: 439289 - DNA, 20 bp, mouse
gtttggagagtgtagagcaa

SEQ ID NO: 439290 - DNA, 20 bp, mouse
ggaccagtgaatgtacccag

SEQ ID NO: 439291 - DNA, 20 bp, mouse
gggcccctgggtacattcac

SEQ ID NO: 439292 - DNA, 20 bp, mouse
ggtttttccttaggtactga

SEQ ID NO: 439293 - DNA, 20 bp, mouse
gaggggccactcacagctgt

SEQ ID NO: 439294 - DNA, 20 bp, mouse
ggcactggggggttgccgtg

SEQ ID NO: 439295 - DNA, 20 bp, mouse
gcagaggcaggaggacaagc

SEQ ID NO: 439296 - DNA, 20 bp, mouse
ggtcgaggaccgggaggtat

SEQ ID NO: 439297 - DNA, 20 bp, mouse
gtggcgctgcgaggtttctg

SEQ ID NO: 439298 - DNA, 20 bp, mouse
ggcggggttcagctccacta

SEQ ID NO: 439299 - DNA, 20 bp, mouse
gccgctcgcacggcacggca

SEQ ID NO: 439300 - DNA, 20 bp, mouse
gaggaccgcagcgcctggct

SEQ ID NO: 439301 - DNA, 20 bp, mouse
gagcatgccgaccagcagga

SEQ ID NO: 439302 - DNA, 20 bp, mouse
gccactaaggtccagaaaac

SEQ ID NO: 439303 - DNA, 20 bp, mouse
gcgtggggcagtcgaggacc

SEQ ID NO: 439304 - DNA, 20 bp, mouse
ggtcaccacatagactacca

SEQ ID NO: 439305 - DNA, 20 bp, mouse
gtcccgagcccggcatgtcg

SEQ ID NO: 439306 - DNA, 20 bp, mouse
ggcttaccagacacagacgc

SEQ ID NO: 439307 - DNA, 20 bp, mouse
gtcatgcctgatgcagatga

SEQ ID NO: 439308 - DNA, 20 bp, mouse
ggcgccaccacgcctttaat

SEQ ID NO: 439309 - DNA, 20 bp, mouse
gtaagtgccgattaaaggcg

SEQ ID NO: 439310 - DNA, 20 bp, mouse
ggtctacaacgtgaaggtcc

SEQ ID NO: 439311 - DNA, 20 bp, mouse
gaaaatgtctccaatgggga

SEQ ID NO: 439312 - DNA, 20 bp, mouse
gtgctaaaatgtctccaatg

SEQ ID NO: 439313 - DNA, 20 bp, mouse
gtctaataagtgccgattaa

SEQ ID NO: 439314 - DNA, 20 bp, mouse
gaaactctaataagtgattt

SEQ ID NO: 439315 - DNA, 20 bp, mouse
gataagtgattttggcccca

SEQ ID NO: 439316 - DNA, 20 bp, mouse
ggcccggctccgaagcaagg

SEQ ID NO: 439317 - DNA, 20 bp, mouse
ggagctcggcggcatcatga

SEQ ID NO: 439318 - DNA, 20 bp, mouse
gtcggcggcatcatgacggt

SEQ ID NO: 439319 - DNA, 20 bp, mouse
ggcccttctccagagctcgg

SEQ ID NO: 439320 - DNA, 20 bp, mouse
gaggcggcgagcagcttagt

SEQ ID NO: 439321 - DNA, 20 bp, mouse
ggctgctcgccgccttgctt

SEQ ID NO: 439322 - DNA, 20 bp, mouse
gggcgcccggctccgaagca

SEQ ID NO: 439323 - DNA, 20 bp, mouse
ggagaagggcccaggctatg

SEQ ID NO: 439324 - DNA, 20 bp, mouse
gaggcgacaagcccaagaag

SEQ ID NO: 439325 - DNA, 20 bp, mouse
ggagcgctacgactccctgg

SEQ ID NO: 439326 - DNA, 20 bp, mouse
gacacaccgggaaccctctc

SEQ ID NO: 439327 - DNA, 20 bp, mouse
gcccggtgtgtacttatttg

SEQ ID NO: 439328 - DNA, 20 bp, mouse
ggaagaggatgtgataccat

SEQ ID NO: 439329 - DNA, 20 bp, mouse
ggaagaaatttggaaagtaa

SEQ ID NO: 439330 - DNA, 20 bp, mouse
gatagttttattacctgaga

SEQ ID NO: 439331 - DNA, 20 bp, mouse
ggctaaaacttgaaacctta

SEQ ID NO: 439332 - DNA, 20 bp, mouse
gcgacaacattgaagaaatt

SEQ ID NO: 439333 - DNA, 20 bp, mouse
gattcaaagctctctgttgg

SEQ ID NO: 439334 - DNA, 20 bp, mouse
gcttcaatgttgtcgggcat

SEQ ID NO: 439335 - DNA, 20 bp, mouse
gagaccaacaacagaagcta

SEQ ID NO: 439336 - DNA, 20 bp, mouse
gtcccggagacaggcgtcca

SEQ ID NO: 439337 - DNA, 20 bp, mouse
gaccgggagagacgcacggg

SEQ ID NO: 439338 - DNA, 20 bp, mouse
gacgaccgggagagacgcac

SEQ ID NO: 439339 - DNA, 20 bp, mouse
gacgcctgtctccgggaaat

SEQ ID NO: 439340 - DNA, 20 bp, mouse
gaccgtggacgcctgtctcc

SEQ ID NO: 439341 - DNA, 20 bp, mouse
gcgatgatgacgccatgaca

SEQ ID NO: 439342 - DNA, 20 bp, mouse
ggcaggcagaagccgtgtca

SEQ ID NO: 439343 - DNA, 20 bp, mouse
ggcacaatacctcaataccg

SEQ ID NO: 439344 - DNA, 20 bp, mouse
gcatcgtgcgacctatttcc

SEQ ID NO: 439345 - DNA, 20 bp, mouse
gtgaaaggcaacgttaacag

SEQ ID NO: 439346 - DNA, 20 bp, mouse
ggacaaagctgacggtccaa

SEQ ID NO: 439347 - DNA, 20 bp, mouse
gaaagctgacggtccaacgg

SEQ ID NO: 439348 - DNA, 20 bp, mouse
gggttcactcagtcaacgaa

SEQ ID NO: 439349 - DNA, 20 bp, mouse
gccaacggcggcgggcactc

SEQ ID NO: 439350 - DNA, 20 bp, mouse
gcgccgccgggagatgatct

SEQ ID NO: 439351 - DNA, 20 bp, mouse
gcaggccgcgcggtcgggag

SEQ ID NO: 439352 - DNA, 20 bp, mouse
gcagctccagacaaagctga

SEQ ID NO: 439353 - DNA, 20 bp, mouse
gcgccgggagatgatctggg

SEQ ID NO: 439354 - DNA, 20 bp, mouse
gactcagtcaacgaagggca

SEQ ID NO: 439355 - DNA, 20 bp, mouse
gggagctggtcggttatggt

SEQ ID NO: 439356 - DNA, 20 bp, mouse
gaccaggctgctctagacgc

SEQ ID NO: 439357 - DNA, 20 bp, mouse
gaggctgctctagacgcagg

SEQ ID NO: 439358 - DNA, 20 bp, mouse
ggcaggcggtatcctctcgt

SEQ ID NO: 439359 - DNA, 20 bp, mouse
ggttccgagcgtaacagagt

SEQ ID NO: 439360 - DNA, 20 bp, mouse
gcgcatctagaacggctcca

SEQ ID NO: 439361 - DNA, 20 bp, mouse
gcattaatgacaccaacgag

SEQ ID NO: 439362 - DNA, 20 bp, mouse
gcacgaggcttggacgtgag

SEQ ID NO: 439363 - DNA, 20 bp, mouse
gagggccctggccttcccag

SEQ ID NO: 439364 - DNA, 20 bp, mouse
gaggcccactctgttacgct

SEQ ID NO: 439365 - DNA, 20 bp, mouse
gattaatgacggagcaacag

SEQ ID NO: 439366 - DNA, 20 bp, mouse
gcagtttgatcggaccacgg

SEQ ID NO: 439367 - DNA, 20 bp, mouse
gcaggtgagaccaagcctga

SEQ ID NO: 439368 - DNA, 20 bp, mouse
ggctgaggctgcgggagagt

SEQ ID NO: 439369 - DNA, 20 bp, mouse
gagaccaagcctgagggaga

SEQ ID NO: 439370 - DNA, 20 bp, mouse
gggaccactctggagaactg

SEQ ID NO: 439371 - DNA, 20 bp, mouse
gcagagtggtcccccaaggt

SEQ ID NO: 439372 - DNA, 20 bp, mouse
gtctccagagtggtccccca

SEQ ID NO: 439373 - DNA, 20 bp, mouse
gatccagtttgatcggacca

SEQ ID NO: 439374 - DNA, 20 bp, mouse
ggtgggacacccgtcagcaa

SEQ ID NO: 439375 - DNA, 20 bp, mouse
gctggagcatccagtttgat

SEQ ID NO: 439376 - DNA, 20 bp, mouse
gcttctaggccggacagcag

SEQ ID NO: 439377 - DNA, 20 bp, mouse
gtacacaggtgagcaggacg

SEQ ID NO: 439378 - DNA, 20 bp, mouse
gagcaggacggggcagggag

SEQ ID NO: 439379 - DNA, 20 bp, mouse
gctgggaatccactgctgtc

SEQ ID NO: 439380 - DNA, 20 bp, mouse
gcccagacttccgctttctg

SEQ ID NO: 439381 - DNA, 20 bp, mouse
gggtgttctgtgatgcttct

SEQ ID NO: 439382 - DNA, 20 bp, mouse
gctctagagtgaactagggt

SEQ ID NO: 439383 - DNA, 20 bp, mouse
gacaccaggattccatacac

SEQ ID NO: 439384 - DNA, 20 bp, mouse
gtcacctgtgtatggaatcc

SEQ ID NO: 439385 - DNA, 20 bp, mouse
gaggctctctagagtgaact

SEQ ID NO: 439386 - DNA, 20 bp, mouse
gcagcagagggagcatcgcg

SEQ ID NO: 439387 - DNA, 20 bp, mouse
gcgcacgcgcagggaaccgg

SEQ ID NO: 439388 - DNA, 20 bp, mouse
ggggcacgcaacgcagcaga

SEQ ID NO: 439389 - DNA, 20 bp, mouse
ggcggacacgtgcagaggga

SEQ ID NO: 439390 - DNA, 20 bp, mouse
gtgcagagggaaggacgacc

SEQ ID NO: 439391 - DNA, 20 bp, mouse
gctgggccgggatggcggtt

SEQ ID NO: 439392 - DNA, 20 bp, mouse
ggctctgcacacggaaggta

SEQ ID NO: 439393 - DNA, 20 bp, mouse
gggtggccgcactccgacta

SEQ ID NO: 439394 - DNA, 20 bp, mouse
gggcagcgcgcgaggtcaca

SEQ ID NO: 439395 - DNA, 20 bp, mouse
ggctgcaggagatgccgaag

SEQ ID NO: 439396 - DNA, 20 bp, mouse
ggcctcacctgagggtgtaa

SEQ ID NO: 439397 - DNA, 20 bp, mouse
gagggtcccagcctcacctg

SEQ ID NO: 439398 - DNA, 20 bp, mouse
gtcccttacaccctcaggtg

SEQ ID NO: 439399 - DNA, 20 bp, mouse
gacaggacgtctctgtgatt

SEQ ID NO: 439400 - DNA, 20 bp, mouse
gtgaagtcccttacaccctc

SEQ ID NO: 439401 - DNA, 20 bp, mouse
gaggatgaagggctacggaa

SEQ ID NO: 439402 - DNA, 20 bp, mouse
ggcaggcaaagtccacatgg

SEQ ID NO: 439403 - DNA, 20 bp, mouse
gcaacgaccatcctgaggag

SEQ ID NO: 439404 - DNA, 20 bp, mouse
gggttcaggagggtacctga

SEQ ID NO: 439405 - DNA, 20 bp, mouse
gactcgctcgcactgcagca

SEQ ID NO: 439406 - DNA, 20 bp, mouse
ggtcgggcagcgcagcggga

SEQ ID NO: 439407 - DNA, 20 bp, mouse
ggcagcgggagggaagcacg

SEQ ID NO: 439408 - DNA, 20 bp, mouse
gggaagcacgaggccggagc

SEQ ID NO: 439409 - DNA, 20 bp, mouse
gcgggagggaagcacgaggc

SEQ ID NO: 439410 - DNA, 20 bp, mouse
gcgggaggccgcgttcagtc

SEQ ID NO: 439411 - DNA, 20 bp, mouse
gagcatcaccacgcccgcgg

SEQ ID NO: 439412 - DNA, 20 bp, mouse
gggagcccagcagccggctc

SEQ ID NO: 439413 - DNA, 20 bp, mouse
gggaggagctaggcgctagg

SEQ ID NO: 439414 - DNA, 20 bp, mouse
ggctggtgcagggcccccag

SEQ ID NO: 439415 - DNA, 20 bp, mouse
gccggcgcgcggtccgacgg

SEQ ID NO: 439416 - DNA, 20 bp, mouse
gcccgggaaccagctagtag

SEQ ID NO: 439417 - DNA, 20 bp, mouse
ggttcggcgggacgcgggat

SEQ ID NO: 439418 - DNA, 20 bp, mouse
gggattggcggggcttggca

SEQ ID NO: 439419 - DNA, 20 bp, mouse
gcgcatgacgaggggctcac

SEQ ID NO: 439420 - DNA, 20 bp, mouse
ggcccgacacgcatgacgag

SEQ ID NO: 439421 - DNA, 20 bp, mouse
gtgctctgctgggattggcg

SEQ ID NO: 439422 - DNA, 20 bp, mouse
gctgggtaccccctccgccc

SEQ ID NO: 439423 - DNA, 20 bp, mouse
gggaatgctgggtctcagtg

SEQ ID NO: 439424 - DNA, 20 bp, mouse
gcaccgctctggaactgatc

SEQ ID NO: 439425 - DNA, 20 bp, mouse
gtcagtgcggcgtccggtgt

SEQ ID NO: 439426 - DNA, 20 bp, mouse
gctctcgttcagcttttcgg

SEQ ID NO: 439427 - DNA, 20 bp, mouse
gaagcaaccgcagccctcta

SEQ ID NO: 439428 - DNA, 20 bp, mouse
gtggcaattcgcaggatccg

SEQ ID NO: 439429 - DNA, 20 bp, mouse
gtgaacgcagaattctgcct

SEQ ID NO: 439430 - DNA, 20 bp, mouse
gtccggacgagcgcagcagg

SEQ ID NO: 439431 - DNA, 20 bp, mouse
gcgcaccccccaaccctaga

SEQ ID NO: 439432 - DNA, 20 bp, mouse
gaccgcagccctctagggtt

SEQ ID NO: 439433 - DNA, 20 bp, mouse
gccgcggctcagagaagctc

SEQ ID NO: 439434 - DNA, 20 bp, mouse
ggcgcgccggagcaatttat

SEQ ID NO: 439435 - DNA, 20 bp, mouse
ggcagccctctagggttggg

SEQ ID NO: 439436 - DNA, 20 bp, mouse
gagcaccatggccaccccga

SEQ ID NO: 439437 - DNA, 20 bp, mouse
ggcccgccacccgcttgcgg

SEQ ID NO: 439438 - DNA, 20 bp, mouse
gtggcacctggaggtaagga

SEQ ID NO: 439439 - DNA, 20 bp, mouse
ggctggccctggccgcgtca

SEQ ID NO: 439440 - DNA, 20 bp, mouse
gcccgaggccaaggccccga

SEQ ID NO: 439441 - DNA, 20 bp, mouse
gaccattgcgcccaaaagtg

SEQ ID NO: 439442 - DNA, 20 bp, mouse
gctgtgcaccagtagcggga

SEQ ID NO: 439443 - DNA, 20 bp, mouse
gggaggtaaggaaggcaccg

SEQ ID NO: 439444 - DNA, 20 bp, mouse
ggagagctgtgcaccagtag

SEQ ID NO: 439445 - DNA, 20 bp, mouse
gagccgccgcaagcgggtgg

SEQ ID NO: 439446 - DNA, 20 bp, mouse
gtggtttctctcagaagtag

SEQ ID NO: 439447 - DNA, 20 bp, mouse
gaggtctctttggccagaaa

SEQ ID NO: 439448 - DNA, 20 bp, mouse
gtggggttggcgctttgtat

SEQ ID NO: 439449 - DNA, 20 bp, mouse
gccacgaagacggagctcag

SEQ ID NO: 439450 - DNA, 20 bp, mouse
gcctccccgagagccctgag

SEQ ID NO: 439451 - DNA, 20 bp, mouse
gcacaactcacatctggctg

SEQ ID NO: 439452 - DNA, 20 bp, mouse
gttctaggctaggtcaggag

SEQ ID NO: 439453 - DNA, 20 bp, mouse
gttggccagaaacggaaacg

SEQ ID NO: 439454 - DNA, 20 bp, mouse
gaaagcactaggagcggtct

SEQ ID NO: 439455 - DNA, 20 bp, mouse
gtcagctggaaggaggtagg

SEQ ID NO: 439456 - DNA, 20 bp, mouse
gaggcaggactgaacaccac

SEQ ID NO: 439457 - DNA, 20 bp, mouse
ggtgcaccgagccacatcca

SEQ ID NO: 439458 - DNA, 20 bp, mouse
gaccaccggagcagcgacgt

SEQ ID NO: 439459 - DNA, 20 bp, mouse
gccccactctctgtcctgag

SEQ ID NO: 439460 - DNA, 20 bp, mouse
ggggctgtaatgcccgaggg

SEQ ID NO: 439461 - DNA, 20 bp, mouse
gagccagagatgccggcccc

SEQ ID NO: 439462 - DNA, 20 bp, mouse
gaggcactcccgcccatgac

SEQ ID NO: 439463 - DNA, 20 bp, mouse
gcagcgacgtcggatggccc

SEQ ID NO: 439464 - DNA, 20 bp, mouse
gccgggatggggatagacat

SEQ ID NO: 439465 - DNA, 20 bp, mouse
gatgctgcaggcgcgagatg

SEQ ID NO: 439466 - DNA, 20 bp, mouse
gtcgcagggaagcttgacag

SEQ ID NO: 439467 - DNA, 20 bp, mouse
gcatttgcctgaggcgacca

SEQ ID NO: 439468 - DNA, 20 bp, mouse
gaatcgacaagagtctcgca

SEQ ID NO: 439469 - DNA, 20 bp, mouse
gcgggaggcagcgcatctgg

SEQ ID NO: 439470 - DNA, 20 bp, mouse
gagggaagcttgacaggggc

SEQ ID NO: 439471 - DNA, 20 bp, mouse
ggaggtaccgtggtcgcctc

SEQ ID NO: 439472 - DNA, 20 bp, mouse
gtgtcaagatgaatacatgg

SEQ ID NO: 439473 - DNA, 20 bp, mouse
ggtcgcctcaggcaaatgcc

SEQ ID NO: 439474 - DNA, 20 bp, mouse
gctcaggcaaatgccaggtt

SEQ ID NO: 439475 - DNA, 20 bp, mouse
ggcagagccaagctaaaact

SEQ ID NO: 439476 - DNA, 20 bp, mouse
gcgagtggggaccccggcaa

SEQ ID NO: 439477 - DNA, 20 bp, mouse
ggtggggaccccggcaaggg

SEQ ID NO: 439478 - DNA, 20 bp, mouse
ggtttagccggcgacgagtg

SEQ ID NO: 439479 - DNA, 20 bp, mouse
gcccgccaccagccaggtga

SEQ ID NO: 439480 - DNA, 20 bp, mouse
ggctcacgcctcccttgccg

SEQ ID NO: 439481 - DNA, 20 bp, mouse
gctgaagcggagaaacgcaa

SEQ ID NO: 439482 - DNA, 20 bp, mouse
gccaggtgagggcagcccgg

SEQ ID NO: 439483 - DNA, 20 bp, mouse
gcttcagagggaggggtgga

SEQ ID NO: 439484 - DNA, 20 bp, mouse
gcggggtccccactcgtcgc

SEQ ID NO: 439485 - DNA, 20 bp, mouse
gcccgcgctgcggcttgacc

SEQ ID NO: 439486 - DNA, 20 bp, mouse
gggacaggggctgcctggta

SEQ ID NO: 439487 - DNA, 20 bp, mouse
gggagtcagtcagcaaggac

SEQ ID NO: 439488 - DNA, 20 bp, mouse
gtgcctggtaggggtaggag

SEQ ID NO: 439489 - DNA, 20 bp, mouse
gaagaactgggaacaaggaa

SEQ ID NO: 439490 - DNA, 20 bp, mouse
gtggtttcctctaggagtct

SEQ ID NO: 439491 - DNA, 20 bp, mouse
gctcatggtggtgaccccgg

SEQ ID NO: 439492 - DNA, 20 bp, mouse
gtcagaggccaagaactcca

SEQ ID NO: 439493 - DNA, 20 bp, mouse
gaagcctgggcgccagctag

SEQ ID NO: 439494 - DNA, 20 bp, mouse
ggcagaggaggagggtaagt

SEQ ID NO: 439495 - DNA, 20 bp, mouse
ggcaagaagtggcctcatgg

SEQ ID NO: 439496 - DNA, 20 bp, mouse
gaggagccagaggccgtccg

SEQ ID NO: 439497 - DNA, 20 bp, mouse
gcagtcgtaggcctaggggt

SEQ ID NO: 439498 - DNA, 20 bp, mouse
ggccctcctagctcagtcgt

SEQ ID NO: 439499 - DNA, 20 bp, mouse
ggcctacgactgagctagga

SEQ ID NO: 439500 - DNA, 20 bp, mouse
gtcaactcacagaccccgga

SEQ ID NO: 439501 - DNA, 20 bp, mouse
gggtggccagcagtgcaggg

SEQ ID NO: 439502 - DNA, 20 bp, mouse
gtagctcagtcgtaggccta

SEQ ID NO: 439503 - DNA, 20 bp, mouse
gaagttatcatcacagacat

SEQ ID NO: 439504 - DNA, 20 bp, mouse
ggcttgaggccgcaggatga

SEQ ID NO: 439505 - DNA, 20 bp, mouse
gaagctcaactcacagaccc

SEQ ID NO: 439506 - DNA, 20 bp, mouse
gttctgcaaaccccagacgg

SEQ ID NO: 439507 - DNA, 20 bp, mouse
ggatgtgaagcaagggtctc

SEQ ID NO: 439508 - DNA, 20 bp, mouse
ggcgatggctgcagagagac

SEQ ID NO: 439509 - DNA, 20 bp, mouse
gtaatggtttctaaattcat

SEQ ID NO: 439510 - DNA, 20 bp, mouse
gctacttgtaaggagatgga

SEQ ID NO: 439511 - DNA, 20 bp, mouse
gtgggcagtgggctaatgta

SEQ ID NO: 439512 - DNA, 20 bp, mouse
gtagaagttggcaagtgcct

SEQ ID NO: 439513 - DNA, 20 bp, mouse
gacaacaacttacctttcct

SEQ ID NO: 439514 - DNA, 20 bp, mouse
gtgataaagtccaaacagaa

SEQ ID NO: 439515 - DNA, 20 bp, mouse
gacctttcctgggcattgct

SEQ ID NO: 439516 - DNA, 20 bp, mouse
ggctcaggtaagtgcactaa

SEQ ID NO: 439517 - DNA, 20 bp, mouse
ggagcccaggagttgcaggc

SEQ ID NO: 439518 - DNA, 20 bp, mouse
gagtgcacttacctgagccc

SEQ ID NO: 439519 - DNA, 20 bp, mouse
gtcctggcactgtgcaaaca

SEQ ID NO: 439520 - DNA, 20 bp, mouse
gattcagcacccgggttctg

SEQ ID NO: 439521 - DNA, 20 bp, mouse
ggttctgaggtagccacgtg

SEQ ID NO: 439522 - DNA, 20 bp, mouse
ggttccaggacagacagcct

SEQ ID NO: 439523 - DNA, 20 bp, mouse
gcagggctttataccacacg

SEQ ID NO: 439524 - DNA, 20 bp, mouse
gttacacagtgtgacattac

SEQ ID NO: 439525 - DNA, 20 bp, mouse
gtccctgtttgcacagtgcc

SEQ ID NO: 439526 - DNA, 20 bp, mouse
gagggggtgaccattcccgg

SEQ ID NO: 439527 - DNA, 20 bp, mouse
ggctctggagctggcagtat

SEQ ID NO: 439528 - DNA, 20 bp, mouse
gttcaggcactgtaagttga

SEQ ID NO: 439529 - DNA, 20 bp, mouse
gggaaagaggagttgggcat

SEQ ID NO: 439530 - DNA, 20 bp, mouse
gaaagaatacggaaagaaaa

SEQ ID NO: 439531 - DNA, 20 bp, mouse
gggagagagaaacacatgtg

SEQ ID NO: 439532 - DNA, 20 bp, mouse
ggggtctgagaaatacacgt

SEQ ID NO: 439533 - DNA, 20 bp, mouse
gctgagaaatacacgtgggg

SEQ ID NO: 439534 - DNA, 20 bp, mouse
gaagggaggaaagaggagtt

SEQ ID NO: 439535 - DNA, 20 bp, mouse
gatggaaggggaataagaag

SEQ ID NO: 439536 - DNA, 20 bp, mouse
gaggcactctaagctgaagg

SEQ ID NO: 439537 - DNA, 20 bp, mouse
gaagggaggagataggagtt

SEQ ID NO: 439538 - DNA, 20 bp, mouse
gttcaggcactctaagctga

SEQ ID NO: 439539 - DNA, 20 bp, mouse
ggataggagttgggcataag

SEQ ID NO: 439540 - DNA, 20 bp, mouse
gcttcttcttcttcataata

SEQ ID NO: 439541 - DNA, 20 bp, mouse
ggaatgaagcatttgcataa

SEQ ID NO: 439542 - DNA, 20 bp, mouse
ggctggcagtatggaaagaa

SEQ ID NO: 439543 - DNA, 20 bp, mouse
gaaaggaaagaaaatagaag

SEQ ID NO: 439544 - DNA, 20 bp, mouse
gtgaaacatttctccaggaa

SEQ ID NO: 439545 - DNA, 20 bp, mouse
gatagaaggggaataagaac

SEQ ID NO: 439546 - DNA, 20 bp, mouse
gagaggcctggtcccagagc

SEQ ID NO: 439547 - DNA, 20 bp, mouse
ggcctctgaaccctgacatc

SEQ ID NO: 439548 - DNA, 20 bp, mouse
gtgctcatgcagcttgtggt

SEQ ID NO: 439549 - DNA, 20 bp, mouse
gtaggctgttctccagctct

SEQ ID NO: 439550 - DNA, 20 bp, mouse
gtccaggagggggttaggaa

SEQ ID NO: 439551 - DNA, 20 bp, mouse
ggttctccagctctgggacc

SEQ ID NO: 439552 - DNA, 20 bp, mouse
ggaaccctgacatctggaac

SEQ ID NO: 439553 - DNA, 20 bp, mouse
gctgaggcaggaagccatct

SEQ ID NO: 439554 - DNA, 20 bp, mouse
gtggaactggctagagtgct

SEQ ID NO: 439555 - DNA, 20 bp, mouse
gagggaggaaggcaggacat

SEQ ID NO: 439556 - DNA, 20 bp, mouse
gtgttcccatcagctcctga

SEQ ID NO: 439557 - DNA, 20 bp, mouse
ggttaccttcaggagctgat

SEQ ID NO: 439558 - DNA, 20 bp, mouse
gatcaaagcttctctcttta

SEQ ID NO: 439559 - DNA, 20 bp, mouse
gtcacacagcagtgtttcag

SEQ ID NO: 439560 - DNA, 20 bp, mouse
gcaaggaaccatgtacagta

SEQ ID NO: 439561 - DNA, 20 bp, mouse
ggacacgggttctcacatgt

SEQ ID NO: 439562 - DNA, 20 bp, mouse
gtggccggccgtgtggtgat

SEQ ID NO: 439563 - DNA, 20 bp, mouse
gaaccatgtacagtaaggtt

SEQ ID NO: 439564 - DNA, 20 bp, mouse
gctccaaaccttactgtaca

SEQ ID NO: 439565 - DNA, 20 bp, mouse
gtctgcatcctatcaccaca

SEQ ID NO: 439566 - DNA, 20 bp, mouse
gcagtagaacggagagctag

SEQ ID NO: 439567 - DNA, 20 bp, mouse
gaccaggccagatgagagag

SEQ ID NO: 439568 - DNA, 20 bp, mouse
gcagaggggccatggtctcc

SEQ ID NO: 439569 - DNA, 20 bp, mouse
ggcgggtgtgggaaagaacc

SEQ ID NO: 439570 - DNA, 20 bp, mouse
gagctctggctgacactggt

SEQ ID NO: 439571 - DNA, 20 bp, mouse
ggctctccgttctactgtcc

SEQ ID NO: 439572 - DNA, 20 bp, mouse
gcagccaggcctgcgggtgt

SEQ ID NO: 439573 - DNA, 20 bp, mouse
gggtccagttcacaagtcaa

SEQ ID NO: 439574 - DNA, 20 bp, mouse
gggcaaggggatggtaccag

SEQ ID NO: 439575 - DNA, 20 bp, mouse
gctcgctcgctagaggggag

SEQ ID NO: 439576 - DNA, 20 bp, mouse
ggcaggaaacaaagcaatgt

SEQ ID NO: 439577 - DNA, 20 bp, mouse
ggacatacttaattgagata

SEQ ID NO: 439578 - DNA, 20 bp, mouse
gtggctattgcctggaccat

SEQ ID NO: 439579 - DNA, 20 bp, mouse
ggcatgtacatgatctagat

SEQ ID NO: 439580 - DNA, 20 bp, mouse
gcggtgaagtgtaacacatc

SEQ ID NO: 439581 - DNA, 20 bp, mouse
ggtgattgttgtctatatgg

SEQ ID NO: 439582 - DNA, 20 bp, mouse
gatattgaacaatcgtacct

SEQ ID NO: 439583 - DNA, 20 bp, mouse
gtagatcatgtacatgccca

SEQ ID NO: 439584 - DNA, 20 bp, mouse
gaaattataatatttctgca

SEQ ID NO: 439585 - DNA, 20 bp, mouse
ggttgtgattgttgtctata

SEQ ID NO: 439586 - DNA, 20 bp, mouse
gagtggcagggcctcaggtg

SEQ ID NO: 439587 - DNA, 20 bp, mouse
gttcctgtccagggctacaa

SEQ ID NO: 439588 - DNA, 20 bp, mouse
ggtccagggctacaaaggca

SEQ ID NO: 439589 - DNA, 20 bp, mouse
gtctattcggttcctgtcca

SEQ ID NO: 439590 - DNA, 20 bp, mouse
gccggggtctagaatctccg

SEQ ID NO: 439591 - DNA, 20 bp, mouse
gcctaacaggacgcttacgg

SEQ ID NO: 439592 - DNA, 20 bp, mouse
gtgggaacccggaagtggca

SEQ ID NO: 439593 - DNA, 20 bp, mouse
gcggtccctgtccttctatt

SEQ ID NO: 439594 - DNA, 20 bp, mouse
gcagggaagctcactgcgcc

SEQ ID NO: 439595 - DNA, 20 bp, mouse
gtagaaggacagggaccgaa

SEQ ID NO: 439596 - DNA, 20 bp, mouse
gcacccgcgaccgctctaca

SEQ ID NO: 439597 - DNA, 20 bp, mouse
ggcgggtgtgggtagaggac

SEQ ID NO: 439598 - DNA, 20 bp, mouse
gcggtcgcgggtgtgggtag

SEQ ID NO: 439599 - DNA, 20 bp, mouse
ggggccctgtagagcggtcg

SEQ ID NO: 439600 - DNA, 20 bp, mouse
gcccggaagccgtgagctgg

SEQ ID NO: 439601 - DNA, 20 bp, mouse
gcacggctgctgcaaaccgc

SEQ ID NO: 439602 - DNA, 20 bp, mouse
gggagagagccctgatccaa

SEQ ID NO: 439603 - DNA, 20 bp, mouse
gtgtagcagcggctaccccg

SEQ ID NO: 439604 - DNA, 20 bp, mouse
gcgagtcaggagagtggcca

SEQ ID NO: 439605 - DNA, 20 bp, mouse
gcaggactctttgtgctggg

SEQ ID NO: 439606 - DNA, 20 bp, mouse
gggccgcgatcaccagaaag

SEQ ID NO: 439607 - DNA, 20 bp, mouse
gtgtgtcagttgctcggtgg

SEQ ID NO: 439608 - DNA, 20 bp, mouse
gagttgtgtcagttgctcgg

SEQ ID NO: 439609 - DNA, 20 bp, mouse
ggagcgcgctgtggactccg

SEQ ID NO: 439610 - DNA, 20 bp, mouse
gcgatcaccagaaaggggac

SEQ ID NO: 439611 - DNA, 20 bp, mouse
gtgaggacgcggacctaggg

SEQ ID NO: 439612 - DNA, 20 bp, mouse
ggcaatgctgaatatcgcaa

SEQ ID NO: 439613 - DNA, 20 bp, mouse
gccagggtcgccgagaggtg

SEQ ID NO: 439614 - DNA, 20 bp, mouse
gaagggaccggagggtacgt

SEQ ID NO: 439615 - DNA, 20 bp, mouse
ggtcagttgctcggtggagg

SEQ ID NO: 439616 - DNA, 20 bp, mouse
ggccgcgggcgggacaaccc

SEQ ID NO: 439617 - DNA, 20 bp, mouse
gggagccaaacgcgggacag

SEQ ID NO: 439618 - DNA, 20 bp, mouse
gcgcgcggttgggaagtgca

SEQ ID NO: 439619 - DNA, 20 bp, mouse
ggttgggaagtgcaaggcaa

SEQ ID NO: 439620 - DNA, 20 bp, mouse
ggacatccgccggtacgcag

SEQ ID NO: 439621 - DNA, 20 bp, mouse
gcgcgcctgggagccaaacg

SEQ ID NO: 439622 - DNA, 20 bp, mouse
gggaagctgctccccacgcg

SEQ ID NO: 439623 - DNA, 20 bp, mouse
gctgctccccacgcgcggtt

SEQ ID NO: 439624 - DNA, 20 bp, mouse
gacaacccgggcggcaagct

SEQ ID NO: 439625 - DNA, 20 bp, mouse
gggcggagccggatgagcta

SEQ ID NO: 439626 - DNA, 20 bp, mouse
gccagcctgcagagataccg

SEQ ID NO: 439627 - DNA, 20 bp, mouse
ggccgctcagagctagagga

SEQ ID NO: 439628 - DNA, 20 bp, mouse
ggccccgccggacccgggca

SEQ ID NO: 439629 - DNA, 20 bp, mouse
ggcgtgggcgagctcccccg

SEQ ID NO: 439630 - DNA, 20 bp, mouse
gcgagccccggtatctctgc

SEQ ID NO: 439631 - DNA, 20 bp, mouse
gatggagaagaggtcctccg

SEQ ID NO: 439632 - DNA, 20 bp, mouse
gactggtcctggaatctcgg

SEQ ID NO: 439633 - DNA, 20 bp, mouse
ggagcatggatccggactgg

SEQ ID NO: 439634 - DNA, 20 bp, mouse
gggtgccggcccgcgagccc

SEQ ID NO: 439635 - DNA, 20 bp, mouse
gggccggcaccggctccggg

SEQ ID NO: 439636 - DNA, 20 bp, mouse
gcaggctcgggatgaaacaa

SEQ ID NO: 439637 - DNA, 20 bp, mouse
gtgacgaagggcccaggctc

SEQ ID NO: 439638 - DNA, 20 bp, mouse
gacggaagagagactaacta

SEQ ID NO: 439639 - DNA, 20 bp, mouse
ggccgtgggcgcaaaaagag

SEQ ID NO: 439640 - DNA, 20 bp, mouse
gtggcgggagcgtacagctt

SEQ ID NO: 439641 - DNA, 20 bp, mouse
gaaagggctaaagaattcta

SEQ ID NO: 439642 - DNA, 20 bp, mouse
gggaaagcggtgccaaaaga

SEQ ID NO: 439643 - DNA, 20 bp, mouse
ggggcgccgctgggaagcct

SEQ ID NO: 439644 - DNA, 20 bp, mouse
ggcctgagggtcgataaatg

SEQ ID NO: 439645 - DNA, 20 bp, mouse
gtcgggatgaaacaacggaa

SEQ ID NO: 439646 - DNA, 20 bp, mouse
gctcttggaactagggacag

SEQ ID NO: 439647 - DNA, 20 bp, mouse
gtttccaacccggagaaacg

SEQ ID NO: 439648 - DNA, 20 bp, mouse
gtggcatctgactagagaca

SEQ ID NO: 439649 - DNA, 20 bp, mouse
gaagcccggaccagctatcc

SEQ ID NO: 439650 - DNA, 20 bp, mouse
gatctgactagagacagggt

SEQ ID NO: 439651 - DNA, 20 bp, mouse
gctgggtctaacacccagga

SEQ ID NO: 439652 - DNA, 20 bp, mouse
gggagaaattcaaaagagcg

SEQ ID NO: 439653 - DNA, 20 bp, mouse
gtggcccgaagctctctaga

SEQ ID NO: 439654 - DNA, 20 bp, mouse
gggcgcaagttagaagacaa

SEQ ID NO: 439655 - DNA, 20 bp, mouse
gccacctgggtctaacaccc

SEQ ID NO: 439656 - DNA, 20 bp, mouse
ggacgtgtagttcacagcta

SEQ ID NO: 439657 - DNA, 20 bp, mouse
ggagaaggcaggctcaggag

SEQ ID NO: 439658 - DNA, 20 bp, mouse
gctagtcgcaggaacgaagc

SEQ ID NO: 439659 - DNA, 20 bp, mouse
ggctgggtccgactagtcgc

SEQ ID NO: 439660 - DNA, 20 bp, mouse
gggaagtacccacaaatcta

SEQ ID NO: 439661 - DNA, 20 bp, mouse
gcttccagagggtcaaagaa

SEQ ID NO: 439662 - DNA, 20 bp, mouse
gttgggctcctgaagtccag

SEQ ID NO: 439663 - DNA, 20 bp, mouse
gggtcaaagaagggatccac

SEQ ID NO: 439664 - DNA, 20 bp, mouse
ggcagtgcggcagcgggaag

SEQ ID NO: 439665 - DNA, 20 bp, mouse
gagcttatgcccgagcgtgg

SEQ ID NO: 439666 - DNA, 20 bp, mouse
gggcgcgcggccgcaatcgg

SEQ ID NO: 439667 - DNA, 20 bp, mouse
gggcgcagctgcgagcgagg

SEQ ID NO: 439668 - DNA, 20 bp, mouse
gggccgcaatcggaggaata

SEQ ID NO: 439669 - DNA, 20 bp, mouse
gcggaggaatacggcttggt

SEQ ID NO: 439670 - DNA, 20 bp, mouse
gccggcgcacagggagtcgg

SEQ ID NO: 439671 - DNA, 20 bp, mouse
gcaatcggaggaatacggct

SEQ ID NO: 439672 - DNA, 20 bp, mouse
gaggaatacggcttggtggg

SEQ ID NO: 439673 - DNA, 20 bp, mouse
gcgaactggcggggaatcgg

SEQ ID NO: 439674 - DNA, 20 bp, mouse
ggcggagctaggctacagcc

SEQ ID NO: 439675 - DNA, 20 bp, mouse
gggccgggcccagctcgcgt

SEQ ID NO: 439676 - DNA, 20 bp, mouse
gcggcctggctgagaagcta

SEQ ID NO: 439677 - DNA, 20 bp, mouse
gtgagaagctagggataaag

SEQ ID NO: 439678 - DNA, 20 bp, mouse
ggaagctagggataaagagg

SEQ ID NO: 439679 - DNA, 20 bp, mouse
ggacaagcagggccagtcca

SEQ ID NO: 439680 - DNA, 20 bp, mouse
gaggccgcagccacagagca

SEQ ID NO: 439681 - DNA, 20 bp, mouse
gaggagacaagagttaggtg

SEQ ID NO: 439682 - DNA, 20 bp, mouse
gagattcccttctttcgatg

SEQ ID NO: 439683 - DNA, 20 bp, mouse
gcgaaagaagggaatctcct

SEQ ID NO: 439684 - DNA, 20 bp, mouse
gctgtgcctcatcgaaagaa

SEQ ID NO: 439685 - DNA, 20 bp, mouse
ggctgaccagtagacaagca

SEQ ID NO: 439686 - DNA, 20 bp, mouse
gggctctctgcagcacgtca

SEQ ID NO: 439687 - DNA, 20 bp, mouse
gctgcagcacgtcaggggta

SEQ ID NO: 439688 - DNA, 20 bp, mouse
gggatgctgactggacttgg

SEQ ID NO: 439689 - DNA, 20 bp, mouse
ggcgggatgctgactggact

SEQ ID NO: 439690 - DNA, 20 bp, mouse
gtctgcaggaatcctaggag

SEQ ID NO: 439691 - DNA, 20 bp, mouse
gctggccggcgcccttcctc

SEQ ID NO: 439692 - DNA, 20 bp, mouse
gagcttccccggcatcacgg

SEQ ID NO: 439693 - DNA, 20 bp, mouse
gcggcgccccgtgctctggg

SEQ ID NO: 439694 - DNA, 20 bp, mouse
ggagccggggaccgcgggaa

SEQ ID NO: 439695 - DNA, 20 bp, mouse
gattccggagaagcagccgg

SEQ ID NO: 439696 - DNA, 20 bp, mouse
ggaagctggtcccatagtga

SEQ ID NO: 439697 - DNA, 20 bp, mouse
gtccctgtctccccccaagt

SEQ ID NO: 439698 - DNA, 20 bp, mouse
gggctggagaccagatactg

SEQ ID NO: 439699 - DNA, 20 bp, mouse
gactcctaggtgactcacct

SEQ ID NO: 439700 - DNA, 20 bp, mouse
gccccaagtgggtgactcct

SEQ ID NO: 439701 - DNA, 20 bp, mouse
gtggaaggaatgaaggggta

SEQ ID NO: 439702 - DNA, 20 bp, mouse
gacccacttggggggagaca

SEQ ID NO: 439703 - DNA, 20 bp, mouse
gagcagtagcactagtagct

SEQ ID NO: 439704 - DNA, 20 bp, mouse
gaggctctggaggccactcc

SEQ ID NO: 439705 - DNA, 20 bp, mouse
gtagccgctggctctttata

SEQ ID NO: 439706 - DNA, 20 bp, mouse
gaggctgcggatcaacaatc

SEQ ID NO: 439707 - DNA, 20 bp, mouse
gcgctcgcccgtcctgacga

SEQ ID NO: 439708 - DNA, 20 bp, mouse
ggggcgccgggggcctgact

SEQ ID NO: 439709 - DNA, 20 bp, mouse
gcctgactcggtggtgagtg

SEQ ID NO: 439710 - DNA, 20 bp, mouse
gcagcacctagaacgattgg

SEQ ID NO: 439711 - DNA, 20 bp, mouse
ggggcgagcgtggctctcga

SEQ ID NO: 439712 - DNA, 20 bp, mouse
gcaccaccgagtcaggcccc

SEQ ID NO: 439713 - DNA, 20 bp, mouse
gcggctgccttcgtcaggac

SEQ ID NO: 439714 - DNA, 20 bp, mouse
gcgccgggggcctgactcgg

SEQ ID NO: 439715 - DNA, 20 bp, mouse
ggctgggactcggacgaata

SEQ ID NO: 439716 - DNA, 20 bp, mouse
gatcaagtggagaaacggtc

SEQ ID NO: 439717 - DNA, 20 bp, mouse
ggtgtcaacacgtgatcaag

SEQ ID NO: 439718 - DNA, 20 bp, mouse
gacgtgatcaagtggagaaa

SEQ ID NO: 439719 - DNA, 20 bp, mouse
ggcggctgcaaggaaacatc

SEQ ID NO: 439720 - DNA, 20 bp, mouse
gctgggtgagtggcgggaag

SEQ ID NO: 439721 - DNA, 20 bp, mouse
gacaagttcggggacaatct

SEQ ID NO: 439722 - DNA, 20 bp, mouse
ggccagatggtcctggtgct

SEQ ID NO: 439723 - DNA, 20 bp, mouse
ggtggtaatgcactcctgga

SEQ ID NO: 439724 - DNA, 20 bp, mouse
gttccggaagttaatcaatc

SEQ ID NO: 439725 - DNA, 20 bp, mouse
gtctctaactggcaatctga

SEQ ID NO: 439726 - DNA, 20 bp, mouse
gcgcttgagtacagtcctga

SEQ ID NO: 439727 - DNA, 20 bp, mouse
gagtacagtcctgagggaag

SEQ ID NO: 439728 - DNA, 20 bp, mouse
gacgccagggcggacctcca

SEQ ID NO: 439729 - DNA, 20 bp, mouse
ggggcgggcggtcaaaatgg

SEQ ID NO: 439730 - DNA, 20 bp, mouse
gggagaagccgaggtaaccg

SEQ ID NO: 439731 - DNA, 20 bp, mouse
gaggactgtactcaagcgac

SEQ ID NO: 439732 - DNA, 20 bp, mouse
gaaggggcgggcggtcaaaa

SEQ ID NO: 439733 - DNA, 20 bp, mouse
ggcgagtgtcgggactgtgg

SEQ ID NO: 439734 - DNA, 20 bp, mouse
ggcgtgtgacgtagtagggt

SEQ ID NO: 439735 - DNA, 20 bp, mouse
ggccccggtgagggaaacgg

SEQ ID NO: 439736 - DNA, 20 bp, mouse
ggcccgagcgaggcggaggt

SEQ ID NO: 439737 - DNA, 20 bp, mouse
ggaggtgggtaatggcgccg

SEQ ID NO: 439738 - DNA, 20 bp, mouse
gcagcctggcggcccgagcg

SEQ ID NO: 439739 - DNA, 20 bp, mouse
ggtgagcactgcaggtgccc

SEQ ID NO: 439740 - DNA, 20 bp, mouse
gcagggagctgaataaatga

SEQ ID NO: 439741 - DNA, 20 bp, mouse
ggcagtgctcaccgtagccc

SEQ ID NO: 439742 - DNA, 20 bp, mouse
gggcggaagccgcagcctgg

SEQ ID NO: 439743 - DNA, 20 bp, mouse
gaaatccctgagccactggg

SEQ ID NO: 439744 - DNA, 20 bp, mouse
gcagacagccgggtccagag

SEQ ID NO: 439745 - DNA, 20 bp, mouse
gcgttcgcgcccgcaggaaa

SEQ ID NO: 439746 - DNA, 20 bp, mouse
gagaatcggcagttgaggac

SEQ ID NO: 439747 - DNA, 20 bp, mouse
gcagagagaatcggcagttg

SEQ ID NO: 439748 - DNA, 20 bp, mouse
gaaacctcaagcacgacagg

SEQ ID NO: 439749 - DNA, 20 bp, mouse
gttgctggcctatataaacc

SEQ ID NO: 439750 - DNA, 20 bp, mouse
ggacaaacctcaagcacgac

SEQ ID NO: 439751 - DNA, 20 bp, mouse
gaaccctagactgtattact

SEQ ID NO: 439752 - DNA, 20 bp, mouse
gaggttgacaatgaaggctg

SEQ ID NO: 439753 - DNA, 20 bp, mouse
gtgccaattcactaactaaa

SEQ ID NO: 439754 - DNA, 20 bp, mouse
gcagtctagggttctttatc

SEQ ID NO: 439755 - DNA, 20 bp, mouse
gatataggccagcaagtttc

SEQ ID NO: 439756 - DNA, 20 bp, mouse
ggaccgctgaagacagaggg

SEQ ID NO: 439757 - DNA, 20 bp, mouse
gcggcgaccgctgaagacag

SEQ ID NO: 439758 - DNA, 20 bp, mouse
gcgctgacaggccggctcgt

SEQ ID NO: 439759 - DNA, 20 bp, mouse
gagggacttcaagcaggcgg

SEQ ID NO: 439760 - DNA, 20 bp, mouse
gagcagggacttcaagcagg

SEQ ID NO: 439761 - DNA, 20 bp, mouse
gagccaccctctgtcttcag

SEQ ID NO: 439762 - DNA, 20 bp, mouse
gcaggaggggaccgaaggag

SEQ ID NO: 439763 - DNA, 20 bp, mouse
gttgtggggccggaagatgg

SEQ ID NO: 439764 - DNA, 20 bp, mouse
gtcggtggtcgctgacaggc

SEQ ID NO: 439765 - DNA, 20 bp, mouse
ggaaaacaggaggggaccga

SEQ ID NO: 439766 - DNA, 20 bp, mouse
ggctcgcagatcatcagtcc

SEQ ID NO: 439767 - DNA, 20 bp, mouse
ggatggaatccaaaggctcc

SEQ ID NO: 439768 - DNA, 20 bp, mouse
ggccaccaacaaatcctgtc

SEQ ID NO: 439769 - DNA, 20 bp, mouse
gcattttggctggaccagac

SEQ ID NO: 439770 - DNA, 20 bp, mouse
gcatagagccttggatggtt

SEQ ID NO: 439771 - DNA, 20 bp, mouse
ggcacttcactacttcattt

SEQ ID NO: 439772 - DNA, 20 bp, mouse
ggcctgctgattatgtacaa

SEQ ID NO: 439773 - DNA, 20 bp, mouse
gatgaagtagtgaagtgcat

SEQ ID NO: 439774 - DNA, 20 bp, mouse
gagagtcttacatagagcct

SEQ ID NO: 439775 - DNA, 20 bp, mouse
gaaaatttgggaaagttggg

SEQ ID NO: 439776 - DNA, 20 bp, mouse
gtggctggaggattcaggaa

SEQ ID NO: 439777 - DNA, 20 bp, mouse
gtgtacccccaccgacaggg

SEQ ID NO: 439778 - DNA, 20 bp, mouse
gctcccttctgatcaaccta

SEQ ID NO: 439779 - DNA, 20 bp, mouse
ggggacccccctgtcggtgg

SEQ ID NO: 439780 - DNA, 20 bp, mouse
gaatttggggacccccctgt

SEQ ID NO: 439781 - DNA, 20 bp, mouse
gccaggggtgagggagagcg

SEQ ID NO: 439782 - DNA, 20 bp, mouse
gaggaaaggtcagacctgtc

SEQ ID NO: 439783 - DNA, 20 bp, mouse
gggagcttgttatgtgacat

SEQ ID NO: 439784 - DNA, 20 bp, mouse
gtttgtgtgggccaggggtg

SEQ ID NO: 439785 - DNA, 20 bp, mouse
gcttgttatgtgacataggc

SEQ ID NO: 439786 - DNA, 20 bp, mouse
gatgcaaggatcacttgcgt

SEQ ID NO: 439787 - DNA, 20 bp, mouse
ggctactgagcacttgggtg

SEQ ID NO: 439788 - DNA, 20 bp, mouse
ggcagagaaagactctgtgg

SEQ ID NO: 439789 - DNA, 20 bp, mouse
gcacttgggtggggcattgt

SEQ ID NO: 439790 - DNA, 20 bp, mouse
gaataataaatagaacacag

SEQ ID NO: 439791 - DNA, 20 bp, mouse
ggcttaaccagaaacttgtg

SEQ ID NO: 439792 - DNA, 20 bp, mouse
gcagttgagtatgacggaca

SEQ ID NO: 439793 - DNA, 20 bp, mouse
gtttttgatggagcaagtac

SEQ ID NO: 439794 - DNA, 20 bp, mouse
gtatgatcaactctcatctt

SEQ ID NO: 439795 - DNA, 20 bp, mouse
gcttgtgtgggtggaatgca

SEQ ID NO: 439796 - DNA, 20 bp, mouse
gcagccttcctgcagagggt

SEQ ID NO: 439797 - DNA, 20 bp, mouse
gttgccaaccctctgcagga

SEQ ID NO: 439798 - DNA, 20 bp, mouse
gaggaaggctgtggcgtaga

SEQ ID NO: 439799 - DNA, 20 bp, mouse
ggccacagccttcctgcaga

SEQ ID NO: 439800 - DNA, 20 bp, mouse
gaaggagcagggtagacgaa

SEQ ID NO: 439801 - DNA, 20 bp, mouse
gggtagacgaaaggttccta

SEQ ID NO: 439802 - DNA, 20 bp, mouse
ggagatgtgggcctttgagg

SEQ ID NO: 439803 - DNA, 20 bp, mouse
gctccttgccaaccctctgc

SEQ ID NO: 439804 - DNA, 20 bp, mouse
gtaaggcagcttgagactgg

SEQ ID NO: 439805 - DNA, 20 bp, mouse
ggatggagtgggagggtcaa

SEQ ID NO: 439806 - DNA, 20 bp, mouse
gcacaaagaacccaaactgg

SEQ ID NO: 439807 - DNA, 20 bp, mouse
gatccacaaagaacccaaac

SEQ ID NO: 439808 - DNA, 20 bp, mouse
gtcgtgatcccatcccgcag

SEQ ID NO: 439809 - DNA, 20 bp, mouse
gtggatagccgggagaggag

SEQ ID NO: 439810 - DNA, 20 bp, mouse
gcgggagaggagaggagcgt

SEQ ID NO: 439811 - DNA, 20 bp, mouse
ggttgcagtccccaccagtt

SEQ ID NO: 439812 - DNA, 20 bp, mouse
gaacaataggagctgggact

SEQ ID NO: 439813 - DNA, 20 bp, mouse
ggtgcagggaacagaaggac

SEQ ID NO: 439814 - DNA, 20 bp, mouse
gcctcctgcactgcaaggga

SEQ ID NO: 439815 - DNA, 20 bp, mouse
gtacaataggatgagtatag

SEQ ID NO: 439816 - DNA, 20 bp, mouse
gacagtgtcgccccgagaga

SEQ ID NO: 439817 - DNA, 20 bp, mouse
gggtcgcagtggccggacta

SEQ ID NO: 439818 - DNA, 20 bp, mouse
ggcgccatctcccctctctc

SEQ ID NO: 439819 - DNA, 20 bp, mouse
gaagtcctgaagggtcgcag

SEQ ID NO: 439820 - DNA, 20 bp, mouse
gaggcgccaagtcgcaccct

SEQ ID NO: 439821 - DNA, 20 bp, mouse
gaccggcccagggtgcgact

SEQ ID NO: 439822 - DNA, 20 bp, mouse
gggccgcggtaagtcctgaa

SEQ ID NO: 439823 - DNA, 20 bp, mouse
gggacaggaactggtaatac

SEQ ID NO: 439824 - DNA, 20 bp, mouse
ggccacgagcccagaagcag

SEQ ID NO: 439825 - DNA, 20 bp, mouse
gggggagatggcgcctgacg

SEQ ID NO: 439826 - DNA, 20 bp, mouse
ggctggttaccacagaaccc

SEQ ID NO: 439827 - DNA, 20 bp, mouse
gggagccaggacatggtgag

SEQ ID NO: 439828 - DNA, 20 bp, mouse
ggaatccactcaccatgtcc

SEQ ID NO: 439829 - DNA, 20 bp, mouse
ggtgaggagagctgactcca

SEQ ID NO: 439830 - DNA, 20 bp, mouse
ggttctgtggtaaccagcga

SEQ ID NO: 439831 - DNA, 20 bp, mouse
gggcggcctcaccaagatgt

SEQ ID NO: 439832 - DNA, 20 bp, mouse
gtgggctggaggtagagatc

SEQ ID NO: 439833 - DNA, 20 bp, mouse
gtcctgccccggcctcttga

SEQ ID NO: 439834 - DNA, 20 bp, mouse
gctgaagagttctagaagtt

SEQ ID NO: 439835 - DNA, 20 bp, mouse
gaccagcgacggatgcctga

SEQ ID NO: 439836 - DNA, 20 bp, mouse
gctgcatctgaagaacagat

SEQ ID NO: 439837 - DNA, 20 bp, mouse
gaggtcaccgttacaaggga

SEQ ID NO: 439838 - DNA, 20 bp, mouse
gccggaggtcaccgttacaa

SEQ ID NO: 439839 - DNA, 20 bp, mouse
gtcaccgttacaagggaagg

SEQ ID NO: 439840 - DNA, 20 bp, mouse
gcctggatgtgagctcccgg

SEQ ID NO: 439841 - DNA, 20 bp, mouse
ggataggtgtgtaagaccca

SEQ ID NO: 439842 - DNA, 20 bp, mouse
gcctggtacagaggcacggt

SEQ ID NO: 439843 - DNA, 20 bp, mouse
gtaagacccaagggtccaga

SEQ ID NO: 439844 - DNA, 20 bp, mouse
gttacaagggaaggcggctc

SEQ ID NO: 439845 - DNA, 20 bp, mouse
gtggctcagtagtagagcta

SEQ ID NO: 439846 - DNA, 20 bp, mouse
gcaggttcctgagcacaact

SEQ ID NO: 439847 - DNA, 20 bp, mouse
gagtagtatgaaggacgctt

SEQ ID NO: 439848 - DNA, 20 bp, mouse
ggtgtttcccagtagtatga

SEQ ID NO: 439849 - DNA, 20 bp, mouse
gtacagtcccaaaaccctaa

SEQ ID NO: 439850 - DNA, 20 bp, mouse
gtatcttatgggtgtcccag

SEQ ID NO: 439851 - DNA, 20 bp, mouse
gtaaatctcaaaataaccaa

SEQ ID NO: 439852 - DNA, 20 bp, mouse
gaatcgacctagttgtgctc

SEQ ID NO: 439853 - DNA, 20 bp, mouse
gccagacacatagctaacct

SEQ ID NO: 439854 - DNA, 20 bp, mouse
gcccagcctacaattagcag

SEQ ID NO: 439855 - DNA, 20 bp, mouse
gtgtcccagaggctctaaaa

SEQ ID NO: 439856 - DNA, 20 bp, mouse
gggcaggccctgcacctccc

SEQ ID NO: 439857 - DNA, 20 bp, mouse
gggtgtgctaagtccgggag

SEQ ID NO: 439858 - DNA, 20 bp, mouse
gggaggggtgaagcatgccc

SEQ ID NO: 439859 - DNA, 20 bp, mouse
gagacctgcctgggagtgga

SEQ ID NO: 439860 - DNA, 20 bp, mouse
gtggacggtgtgctaagtcc

SEQ ID NO: 439861 - DNA, 20 bp, mouse
ggcgcacagacaccagcggg

SEQ ID NO: 439862 - DNA, 20 bp, mouse
gagcatgcccgggaggtgca

SEQ ID NO: 439863 - DNA, 20 bp, mouse
ggagtgcggttgcctgggta

SEQ ID NO: 439864 - DNA, 20 bp, mouse
gtgcctgcgacggccgagtg

SEQ ID NO: 439865 - DNA, 20 bp, mouse
gtgaagcgcacagacaccag

SEQ ID NO: 439866 - DNA, 20 bp, mouse
ggaggtggagagcattctgg

SEQ ID NO: 439867 - DNA, 20 bp, mouse
gcaagggaggcaaaagacca

SEQ ID NO: 439868 - DNA, 20 bp, mouse
gaagaccaaggtgagcgagg

SEQ ID NO: 439869 - DNA, 20 bp, mouse
gagtagtttgcgagcaaggg

SEQ ID NO: 439870 - DNA, 20 bp, mouse
gctctctcattgtctcgggt

SEQ ID NO: 439871 - DNA, 20 bp, mouse
gtgtagtagtttgcgagcaa

SEQ ID NO: 439872 - DNA, 20 bp, mouse
gtggagttcgcaggagacgg

SEQ ID NO: 439873 - DNA, 20 bp, mouse
gacggtggaagccccccaga

SEQ ID NO: 439874 - DNA, 20 bp, mouse
gtgcccaaaggggtccggag

SEQ ID NO: 439875 - DNA, 20 bp, mouse
gatgaggaagaggcacctaa

SEQ ID NO: 439876 - DNA, 20 bp, mouse
gcgccagagaaggcttccaa

SEQ ID NO: 439877 - DNA, 20 bp, mouse
gcagagaaggcttccaaggg

SEQ ID NO: 439878 - DNA, 20 bp, mouse
gtagaagagagatggactgt

SEQ ID NO: 439879 - DNA, 20 bp, mouse
gggtgaaaggtcgccagaga

SEQ ID NO: 439880 - DNA, 20 bp, mouse
gggctttatgaagcaagcag

SEQ ID NO: 439881 - DNA, 20 bp, mouse
gcagaaagcaaaagggtgaa

SEQ ID NO: 439882 - DNA, 20 bp, mouse
gagggaggtgagcttgcagc

SEQ ID NO: 439883 - DNA, 20 bp, mouse
gggtagtggagatgtaacct

SEQ ID NO: 439884 - DNA, 20 bp, mouse
ggagaaggccaagaacacaa

SEQ ID NO: 439885 - DNA, 20 bp, mouse
gatgcttggcagaccaaaga

SEQ ID NO: 439886 - DNA, 20 bp, mouse
gcagagcaggacagactgtg

SEQ ID NO: 439887 - DNA, 20 bp, mouse
gaagcaatacaggaacacaa

SEQ ID NO: 439888 - DNA, 20 bp, mouse
gttcatctgtaaagacaggc

SEQ ID NO: 439889 - DNA, 20 bp, mouse
gagttgaaggcacctcaaag

SEQ ID NO: 439890 - DNA, 20 bp, mouse
gcaagatgtggaaaacgtgg

SEQ ID NO: 439891 - DNA, 20 bp, mouse
gtatgccgtagaagtaacaa

SEQ ID NO: 439892 - DNA, 20 bp, mouse
gggcacccttgttacttcta

SEQ ID NO: 439893 - DNA, 20 bp, mouse
gaagaaagacccattcactt

SEQ ID NO: 439894 - DNA, 20 bp, mouse
ggagcaagatgtggaaaacg

SEQ ID NO: 439895 - DNA, 20 bp, mouse
gttatcttacctgcatgctt

SEQ ID NO: 439896 - DNA, 20 bp, mouse
gacaggggtagtcggaggag

SEQ ID NO: 439897 - DNA, 20 bp, mouse
gatggcggcagacgggacag

SEQ ID NO: 439898 - DNA, 20 bp, mouse
gacgggacaggggtagtcgg

SEQ ID NO: 439899 - DNA, 20 bp, mouse
gaacggagcccacgtcatgg

SEQ ID NO: 439900 - DNA, 20 bp, mouse
gtcggaggaggggctgtcgg

SEQ ID NO: 439901 - DNA, 20 bp, mouse
gcagacgggacaggggtagt

SEQ ID NO: 439902 - DNA, 20 bp, mouse
gcatcctgcaaaccgtcctt

SEQ ID NO: 439903 - DNA, 20 bp, mouse
ggcggcggcctgcccaagga

SEQ ID NO: 439904 - DNA, 20 bp, mouse
gcggcaggcgttaaacctaa

SEQ ID NO: 439905 - DNA, 20 bp, mouse
ggagccaccaagaaagccga

SEQ ID NO: 439906 - DNA, 20 bp, mouse
gtctccgggcgcgtctccgg

SEQ ID NO: 439907 - DNA, 20 bp, mouse
gcgcccggagaaaaaagttt

SEQ ID NO: 439908 - DNA, 20 bp, mouse
gccgccgccggagacgcgcc

SEQ ID NO: 439909 - DNA, 20 bp, mouse
gggcggccgcccccgcgcat

SEQ ID NO: 439910 - DNA, 20 bp, mouse
gccggagaaaaaagtttggg

SEQ ID NO: 439911 - DNA, 20 bp, mouse
ggcctcgcgggctaagaaag

SEQ ID NO: 439912 - DNA, 20 bp, mouse
gggcaaacggcgcaagaaga

SEQ ID NO: 439913 - DNA, 20 bp, mouse
gcagctggctgaggggcaaa

SEQ ID NO: 439914 - DNA, 20 bp, mouse
ggtgccttcagctggctgag

SEQ ID NO: 439915 - DNA, 20 bp, mouse
gatgggcgccgcgctgcagg

SEQ ID NO: 439916 - DNA, 20 bp, mouse
gcggctcccgcactcatcat

SEQ ID NO: 439917 - DNA, 20 bp, mouse
ggcccgcagccccggcaggg

SEQ ID NO: 439918 - DNA, 20 bp, mouse
gcggcacaagcacccaagcg

SEQ ID NO: 439919 - DNA, 20 bp, mouse
ggaggaggactgcgcagcac

SEQ ID NO: 439920 - DNA, 20 bp, mouse
gtcttgctgcctccctgccg

SEQ ID NO: 439921 - DNA, 20 bp, mouse
gcgaagcggcccgcaggtag

SEQ ID NO: 439922 - DNA, 20 bp, mouse
gggctggctgggccgcgctt

SEQ ID NO: 439923 - DNA, 20 bp, mouse
gcccgcccgcgggtatgagt

SEQ ID NO: 439924 - DNA, 20 bp, mouse
gagttgcccatgatgagtgc

SEQ ID NO: 439925 - DNA, 20 bp, mouse
ggcctggtgggcgtgagagt

SEQ ID NO: 439926 - DNA, 20 bp, mouse
gcagccgccgcactagatgg

SEQ ID NO: 439927 - DNA, 20 bp, mouse
ggtagtgttcccagcgctag

SEQ ID NO: 439928 - DNA, 20 bp, mouse
gcgcgagacggagacgcgga

SEQ ID NO: 439929 - DNA, 20 bp, mouse
gctcgggcgccgaaactcag

SEQ ID NO: 439930 - DNA, 20 bp, mouse
gtgtccgcgagacggagacg

SEQ ID NO: 439931 - DNA, 20 bp, mouse
gggccccgcgcatggagcag

SEQ ID NO: 439932 - DNA, 20 bp, mouse
gcagtgagcgggagcagcgg

SEQ ID NO: 439933 - DNA, 20 bp, mouse
ggagacggagacgcggaggg

SEQ ID NO: 439934 - DNA, 20 bp, mouse
ggagcccgctctgcacgcgg

SEQ ID NO: 439935 - DNA, 20 bp, mouse
gtgcgactgccgctagcgct

SEQ ID NO: 439936 - DNA, 20 bp, mouse
gccctccgcgctgcctgtca

SEQ ID NO: 439937 - DNA, 20 bp, mouse
gacgcccactgctgctgtgg

SEQ ID NO: 439938 - DNA, 20 bp, mouse
gggcgagcgagcgagcggtt

SEQ ID NO: 439939 - DNA, 20 bp, mouse
gaggcgccgtcgcccgccct

SEQ ID NO: 439940 - DNA, 20 bp, mouse
gcgagcgagcggttggggag

SEQ ID NO: 439941 - DNA, 20 bp, mouse
gagcctggctcggaagggac

SEQ ID NO: 439942 - DNA, 20 bp, mouse
gcgggcgacggcgccttgac

SEQ ID NO: 439943 - DNA, 20 bp, mouse
gctggcgcgccggagaggtg

SEQ ID NO: 439944 - DNA, 20 bp, mouse
gacgggcgcggagcctccgg

SEQ ID NO: 439945 - DNA, 20 bp, mouse
ggccttgacaggcagcgcgg

SEQ ID NO: 439946 - DNA, 20 bp, mouse
gcaggcgtcactttcaggag

SEQ ID NO: 439947 - DNA, 20 bp, mouse
gcctgaaagtgacgcctggt

SEQ ID NO: 439948 - DNA, 20 bp, mouse
gatggaggccatgaccttga

SEQ ID NO: 439949 - DNA, 20 bp, mouse
ggaggtgagtggttagagat

SEQ ID NO: 439950 - DNA, 20 bp, mouse
ggggtctggatctgcccacc

SEQ ID NO: 439951 - DNA, 20 bp, mouse
gagggaacattataagaagc

SEQ ID NO: 439952 - DNA, 20 bp, mouse
ggagaaggcaggctctcggg

SEQ ID NO: 439953 - DNA, 20 bp, mouse
gtagtggcttctctgagctg

SEQ ID NO: 439954 - DNA, 20 bp, mouse
gatttctcatgtgaaggtaa

SEQ ID NO: 439955 - DNA, 20 bp, mouse
gctctctatggtctctttag

SEQ ID NO: 439956 - DNA, 20 bp, mouse
gctaggaacagtgtcaccag

SEQ ID NO: 439957 - DNA, 20 bp, mouse
gccatgtagctcagattgac

SEQ ID NO: 439958 - DNA, 20 bp, mouse
ggcccagatttgctttttag

SEQ ID NO: 439959 - DNA, 20 bp, mouse
gcacacatgccaatgactca

SEQ ID NO: 439960 - DNA, 20 bp, mouse
ggaggacattgggtggtatg

SEQ ID NO: 439961 - DNA, 20 bp, mouse
ggctagttccaggcccgtct

SEQ ID NO: 439962 - DNA, 20 bp, mouse
gcaggtgtttaacttacctc

SEQ ID NO: 439963 - DNA, 20 bp, mouse
gtatgttgcccagacgggcc

SEQ ID NO: 439964 - DNA, 20 bp, mouse
ggccaatgactcaaggattc

SEQ ID NO: 439965 - DNA, 20 bp, mouse
gagatttgctttttagaggt

SEQ ID NO: 439966 - DNA, 20 bp, mouse
ggctcccctaaacaacaccg

SEQ ID NO: 439967 - DNA, 20 bp, mouse
ggctccgctggaaacctgaa

SEQ ID NO: 439968 - DNA, 20 bp, mouse
gattcctcggtgttgtttag

SEQ ID NO: 439969 - DNA, 20 bp, mouse
gacaccgaggaattgtggcc

SEQ ID NO: 439970 - DNA, 20 bp, mouse
gcgctggctgagggaacccg

SEQ ID NO: 439971 - DNA, 20 bp, mouse
gagggaacccgaggcgcggt

SEQ ID NO: 439972 - DNA, 20 bp, mouse
ggccgggaagcgggtcgcat

SEQ ID NO: 439973 - DNA, 20 bp, mouse
gcagcggccgcatgggacag

SEQ ID NO: 439974 - DNA, 20 bp, mouse
ggcggagcacggcttagggt

SEQ ID NO: 439975 - DNA, 20 bp, mouse
gaaacaacaccgaggaattg

SEQ ID NO: 439976 - DNA, 20 bp, mouse
gacttacctgatcgggacac

SEQ ID NO: 439977 - DNA, 20 bp, mouse
gatcatattcagacaaggga

SEQ ID NO: 439978 - DNA, 20 bp, mouse
gagagaaacactaggtatct

SEQ ID NO: 439979 - DNA, 20 bp, mouse
gtgtcaccagtgtcccgatc

SEQ ID NO: 439980 - DNA, 20 bp, mouse
ggctgagggacttacctgat

SEQ ID NO: 439981 - DNA, 20 bp, mouse
gtatgccaggcaatcttatg

SEQ ID NO: 439982 - DNA, 20 bp, mouse
gatgcaacctagtctagtct

SEQ ID NO: 439983 - DNA, 20 bp, mouse
gatataaattttttacttgc

SEQ ID NO: 439984 - DNA, 20 bp, mouse
gacagatcatattcagacaa

SEQ ID NO: 439985 - DNA, 20 bp, mouse
gcagcaggcagagaaacact

SEQ ID NO: 439986 - DNA, 20 bp, mouse
gcccagcctggatatatcta

SEQ ID NO: 439987 - DNA, 20 bp, mouse
ggctatgaggctccatctac

SEQ ID NO: 439988 - DNA, 20 bp, mouse
ggacactagttggtgacttc

SEQ ID NO: 439989 - DNA, 20 bp, mouse
gctcttgtgcagttacccca

SEQ ID NO: 439990 - DNA, 20 bp, mouse
gttggtggcatggcaccctg

SEQ ID NO: 439991 - DNA, 20 bp, mouse
gtactaatccagcggaggag

SEQ ID NO: 439992 - DNA, 20 bp, mouse
gagaaggtgaaccagtaagt

SEQ ID NO: 439993 - DNA, 20 bp, mouse
gcttctggatgagatgtttg

SEQ ID NO: 439994 - DNA, 20 bp, mouse
gcatattgttactaatccag

SEQ ID NO: 439995 - DNA, 20 bp, mouse
gcttttacatagacactagt

SEQ ID NO: 439996 - DNA, 20 bp, mouse
gacagaaaatatgaagatag

SEQ ID NO: 439997 - DNA, 20 bp, mouse
gataggggctcaggtttgga

SEQ ID NO: 439998 - DNA, 20 bp, mouse
gacatcccagagtagcacag

SEQ ID NO: 439999 - DNA, 20 bp, mouse
ggaagataggggctcaggtt

SEQ ID NO: 440000 - DNA, 20 bp, mouse
ggctcaggtttggagggcac

SEQ ID NO: 440001 - DNA, 20 bp, mouse
gggagatccagtgtgattcg

SEQ ID NO: 440002 - DNA, 20 bp, mouse
gcacaggcatgtggcagagt

SEQ ID NO: 440003 - DNA, 20 bp, mouse
gaaccatcctcgaatcacac

SEQ ID NO: 440004 - DNA, 20 bp, mouse
gaatatgaagataggggctc

SEQ ID NO: 440005 - DNA, 20 bp, mouse
gatccagtgtgattcgagga

SEQ ID NO: 440006 - DNA, 20 bp, mouse
ggaactggctgtcaagagca

SEQ ID NO: 440007 - DNA, 20 bp, mouse
gcagcatggccaacctgcta

SEQ ID NO: 440008 - DNA, 20 bp, mouse
gccaacctgctacggacagt

SEQ ID NO: 440009 - DNA, 20 bp, mouse
gacaggacagcgaggtggag

SEQ ID NO: 440010 - DNA, 20 bp, mouse
ggttggccatgctgtctcca

SEQ ID NO: 440011 - DNA, 20 bp, mouse
ggctacggacagtaggtgac

SEQ ID NO: 440012 - DNA, 20 bp, mouse
ggtcctttggcccagcgaac

SEQ ID NO: 440013 - DNA, 20 bp, mouse
ggcttggcgggattggtcca

SEQ ID NO: 440014 - DNA, 20 bp, mouse
gggagctgcgtgcaatgtgg

SEQ ID NO: 440015 - DNA, 20 bp, mouse
gtgctcagaaggtaaaatct

SEQ ID NO: 440016 - DNA, 20 bp, mouse
gtcctcctggggagccctgg

SEQ ID NO: 440017 - DNA, 20 bp, mouse
gcccaaggcaaagatggcaa

SEQ ID NO: 440018 - DNA, 20 bp, mouse
gcaagcctccagggctcccc

SEQ ID NO: 440019 - DNA, 20 bp, mouse
gaatgctttgcaagcctcca

SEQ ID NO: 440020 - DNA, 20 bp, mouse
gagggcttaacagcaaagta

SEQ ID NO: 440021 - DNA, 20 bp, mouse
gcctttgcagccggaggaca

SEQ ID NO: 440022 - DNA, 20 bp, mouse
gagcattcctttgcagccgg

SEQ ID NO: 440023 - DNA, 20 bp, mouse
gaaggtgatggccatgcctg

SEQ ID NO: 440024 - DNA, 20 bp, mouse
ggcaaagatggcaagggcta

SEQ ID NO: 440025 - DNA, 20 bp, mouse
ggaaatcctgggtgttgtat

SEQ ID NO: 440026 - DNA, 20 bp, mouse
ggaaccttcgcaaggtcaga

SEQ ID NO: 440027 - DNA, 20 bp, mouse
gcgcaaggtcagacggtaag

SEQ ID NO: 440028 - DNA, 20 bp, mouse
gtcagcaccgaaccttcgca

SEQ ID NO: 440029 - DNA, 20 bp, mouse
gaagctacggagtcccgcga

SEQ ID NO: 440030 - DNA, 20 bp, mouse
gtgttcctttgactgtcagg

SEQ ID NO: 440031 - DNA, 20 bp, mouse
gctttccgcctgacagtcaa

SEQ ID NO: 440032 - DNA, 20 bp, mouse
gacgaccgcgactcctccat

SEQ ID NO: 440033 - DNA, 20 bp, mouse
ggggaggaagctacgctgca

SEQ ID NO: 440034 - DNA, 20 bp, mouse
gccgcgactcctccatagga

SEQ ID NO: 440035 - DNA, 20 bp, mouse
gtacggagtcccgcgacggg

SEQ ID NO: 440036 - DNA, 20 bp, mouse
gcttgtcaagccaaaaaaaa

SEQ ID NO: 440037 - DNA, 20 bp, mouse
gaaaaaaggtctgaagtact

SEQ ID NO: 440038 - DNA, 20 bp, mouse
gaagttcctggacgttgata

SEQ ID NO: 440039 - DNA, 20 bp, mouse
gttttggcttgacaagaata

SEQ ID NO: 440040 - DNA, 20 bp, mouse
ggatggccatatcaacgtcc

SEQ ID NO: 440041 - DNA, 20 bp, mouse
gctctcacatgaggaactga

SEQ ID NO: 440042 - DNA, 20 bp, mouse
gccttgaccagaatggtgat

SEQ ID NO: 440043 - DNA, 20 bp, mouse
gggtgcagaccaagatggga

SEQ ID NO: 440044 - DNA, 20 bp, mouse
gaagaaggcttgtccaagat

SEQ ID NO: 440045 - DNA, 20 bp, mouse
gggcaagaacctctcacatg

SEQ ID NO: 440046 - DNA, 20 bp, mouse
gtcttctacgggagaggggg

SEQ ID NO: 440047 - DNA, 20 bp, mouse
gcagccctgggtggacaaag

SEQ ID NO: 440048 - DNA, 20 bp, mouse
gggtagggatgaggggtaga

SEQ ID NO: 440049 - DNA, 20 bp, mouse
gttttcttctacgggagagg

SEQ ID NO: 440050 - DNA, 20 bp, mouse
gacccagggctgggagacaa

SEQ ID NO: 440051 - DNA, 20 bp, mouse
ggagggacgcttggccacga

SEQ ID NO: 440052 - DNA, 20 bp, mouse
gccacgagggctgaggatgg

SEQ ID NO: 440053 - DNA, 20 bp, mouse
gggagctgaagacagggccg

SEQ ID NO: 440054 - DNA, 20 bp, mouse
gtggccacgagggctgagga

SEQ ID NO: 440055 - DNA, 20 bp, mouse
gtatctggggaatggcccca

SEQ ID NO: 440056 - DNA, 20 bp, mouse
gtcctcatggccaggtataa

SEQ ID NO: 440057 - DNA, 20 bp, mouse
ggactctacacaatagccta

SEQ ID NO: 440058 - DNA, 20 bp, mouse
ggagtcttgctgtggaggtc

SEQ ID NO: 440059 - DNA, 20 bp, mouse
ggcctacggcttgaattaca

SEQ ID NO: 440060 - DNA, 20 bp, mouse
gattacagggctaaaattga

SEQ ID NO: 440061 - DNA, 20 bp, mouse
gtgtctgcttgagcaatgta

SEQ ID NO: 440062 - DNA, 20 bp, mouse
ggccctgtaattcaagccgt

SEQ ID NO: 440063 - DNA, 20 bp, mouse
ggggattaactcaaataaga

SEQ ID NO: 440064 - DNA, 20 bp, mouse
ggttaaataagccatgtaca

SEQ ID NO: 440065 - DNA, 20 bp, mouse
gccttcttattccttgtaca

SEQ ID NO: 440066 - DNA, 20 bp, mouse
gcagcgcgaggaccatgacg

SEQ ID NO: 440067 - DNA, 20 bp, mouse
gctgttgctgcagagacggt

SEQ ID NO: 440068 - DNA, 20 bp, mouse
ggtcctcgcgctgcaaccat

SEQ ID NO: 440069 - DNA, 20 bp, mouse
gacagcagcgccggccgcta

SEQ ID NO: 440070 - DNA, 20 bp, mouse
gggttctgttgctgcagaga

SEQ ID NO: 440071 - DNA, 20 bp, mouse
ggcgccggccgctacggaag

SEQ ID NO: 440072 - DNA, 20 bp, mouse
ggacggtcggctgtcgccga

SEQ ID NO: 440073 - DNA, 20 bp, mouse
gaagcgagcgccgaaagcgg

SEQ ID NO: 440074 - DNA, 20 bp, mouse
gcagaaccccgcttccgtag

SEQ ID NO: 440075 - DNA, 20 bp, mouse
ggaagacttcttccccgtca

SEQ ID NO: 440076 - DNA, 20 bp, mouse
gcgcggcctgagagagtctg

SEQ ID NO: 440077 - DNA, 20 bp, mouse
gaaggctgagacaacctcag

SEQ ID NO: 440078 - DNA, 20 bp, mouse
gtgcgggcggaggacaacgg

SEQ ID NO: 440079 - DNA, 20 bp, mouse
gagctgcgggcggaggacaa

SEQ ID NO: 440080 - DNA, 20 bp, mouse
gccgagcgagcagcccgagg

SEQ ID NO: 440081 - DNA, 20 bp, mouse
gggcccccggagcctagtac

SEQ ID NO: 440082 - DNA, 20 bp, mouse
gtgaagccccagactctctc

SEQ ID NO: 440083 - DNA, 20 bp, mouse
gggaccgagcgagcagcccg

SEQ ID NO: 440084 - DNA, 20 bp, mouse
ggtacgggcgaggacaaggg

SEQ ID NO: 440085 - DNA, 20 bp, mouse
gctagtacgggcgaggacaa

SEQ ID NO: 440086 - DNA, 20 bp, mouse
ggcagccacacacctaccgc

SEQ ID NO: 440087 - DNA, 20 bp, mouse
gaggcacttcgctggagtgg

SEQ ID NO: 440088 - DNA, 20 bp, mouse
gtctgcccgcggtaggtgtg

SEQ ID NO: 440089 - DNA, 20 bp, mouse
gagcgctctctgcccgcggt

SEQ ID NO: 440090 - DNA, 20 bp, mouse
gacactcccagagccggaaa

SEQ ID NO: 440091 - DNA, 20 bp, mouse
ggtgaggcacttcgctggag

SEQ ID NO: 440092 - DNA, 20 bp, mouse
ggccaagtgaggcacttcgc

SEQ ID NO: 440093 - DNA, 20 bp, mouse
ggcgcagcgctctctgcccg

SEQ ID NO: 440094 - DNA, 20 bp, mouse
gagcaactctcggaaaccaa

SEQ ID NO: 440095 - DNA, 20 bp, mouse
gtggctgccgagaacccgat

SEQ ID NO: 440096 - DNA, 20 bp, mouse
ggtcgagttccggggagcaa

SEQ ID NO: 440097 - DNA, 20 bp, mouse
gagcgagaagaagccagcgt

SEQ ID NO: 440098 - DNA, 20 bp, mouse
gagccaggctcgagacccga

SEQ ID NO: 440099 - DNA, 20 bp, mouse
gagacgccggtcgagttccg

SEQ ID NO: 440100 - DNA, 20 bp, mouse
ggcccggtggcgcctagggt

SEQ ID NO: 440101 - DNA, 20 bp, mouse
ggctcgagacccgaaggcac

SEQ ID NO: 440102 - DNA, 20 bp, mouse
gaactcgaccggcgtctcca

SEQ ID NO: 440103 - DNA, 20 bp, mouse
gaaggacgcaccgaaaggga

SEQ ID NO: 440104 - DNA, 20 bp, mouse
gcctcgcccggtggcgccta

SEQ ID NO: 440105 - DNA, 20 bp, mouse
gtgcggtgaaggtgaacgaa

SEQ ID NO: 440106 - DNA, 20 bp, mouse
ggttattgcaaagagcgctc

SEQ ID NO: 440107 - DNA, 20 bp, mouse
gccgcaggcggagaccgcag

SEQ ID NO: 440108 - DNA, 20 bp, mouse
ggggctcctggccggccggt

SEQ ID NO: 440109 - DNA, 20 bp, mouse
gacgccccagacggacacaa

SEQ ID NO: 440110 - DNA, 20 bp, mouse
gccccagacggacacaatgg

SEQ ID NO: 440111 - DNA, 20 bp, mouse
gagcggcgcccgaacgccca

SEQ ID NO: 440112 - DNA, 20 bp, mouse
gccggtacccgagaagcgag

SEQ ID NO: 440113 - DNA, 20 bp, mouse
gaggcggtcctaccctcccg

SEQ ID NO: 440114 - DNA, 20 bp, mouse
gctccgtgccgcgcgatcac

SEQ ID NO: 440115 - DNA, 20 bp, mouse
gtaacacagtatcacgtgtg

SEQ ID NO: 440116 - DNA, 20 bp, mouse
gccggccgcccggaacccgc

SEQ ID NO: 440117 - DNA, 20 bp, mouse
ggcggcggcgcactcgagca

SEQ ID NO: 440118 - DNA, 20 bp, mouse
ggcgcctcgcgggcctcggt

SEQ ID NO: 440119 - DNA, 20 bp, mouse
ggggagtccccgcgcctccg

SEQ ID NO: 440120 - DNA, 20 bp, mouse
gggcagcgccaaaggtgagt

SEQ ID NO: 440121 - DNA, 20 bp, mouse
gccaatgggcagctgcgcgg

SEQ ID NO: 440122 - DNA, 20 bp, mouse
ggagccccgggtccggcccc

SEQ ID NO: 440123 - DNA, 20 bp, mouse
gaggtgagtgggctggacgg

SEQ ID NO: 440124 - DNA, 20 bp, mouse
gcctggctggcagccccggg

SEQ ID NO: 440125 - DNA, 20 bp, mouse
ggggccgggggccggacccg

SEQ ID NO: 440126 - DNA, 20 bp, mouse
gcggcgctgcagatctgggg

SEQ ID NO: 440127 - DNA, 20 bp, mouse
gagaggctgcgctgtcacat

SEQ ID NO: 440128 - DNA, 20 bp, mouse
gggctgcgctgtcacatggg

SEQ ID NO: 440129 - DNA, 20 bp, mouse
gcacatgggcggcggcgacg

SEQ ID NO: 440130 - DNA, 20 bp, mouse
ggcaatgtgcgagctcatcg

SEQ ID NO: 440131 - DNA, 20 bp, mouse
ggtggtgcggggcccccgga

SEQ ID NO: 440132 - DNA, 20 bp, mouse
gtgcgctgtcacatgggcgg

SEQ ID NO: 440133 - DNA, 20 bp, mouse
gcatttaagcggccagggga

SEQ ID NO: 440134 - DNA, 20 bp, mouse
gaagacgtcgctgctcaagg

SEQ ID NO: 440135 - DNA, 20 bp, mouse
gcggccggcgctgcagatct

SEQ ID NO: 440136 - DNA, 20 bp, mouse
gggttgggaagcactctagg

SEQ ID NO: 440137 - DNA, 20 bp, mouse
ggaagagcccgagtcctcta

SEQ ID NO: 440138 - DNA, 20 bp, mouse
gggatcagcgaggagcccca

SEQ ID NO: 440139 - DNA, 20 bp, mouse
ggaaggttgggaagcactct

SEQ ID NO: 440140 - DNA, 20 bp, mouse
gtaccggagggcccaacaga

SEQ ID NO: 440141 - DNA, 20 bp, mouse
ggatttcaaagatggattat

SEQ ID NO: 440142 - DNA, 20 bp, mouse
ggcagtgcctgaggatggac

SEQ ID NO: 440143 - DNA, 20 bp, mouse
gccggtagggccatggatgt

SEQ ID NO: 440144 - DNA, 20 bp, mouse
gactggagtctccttcaggg

SEQ ID NO: 440145 - DNA, 20 bp, mouse
gtgagccaccgacctacagg

SEQ ID NO: 440146 - DNA, 20 bp, mouse
gccccccaaggaccaaagtg

SEQ ID NO: 440147 - DNA, 20 bp, mouse
ggagaagcaagggcactcca

SEQ ID NO: 440148 - DNA, 20 bp, mouse
gacggtgtcgatgggagtgt

SEQ ID NO: 440149 - DNA, 20 bp, mouse
gagtcctgttatcttctcca

SEQ ID NO: 440150 - DNA, 20 bp, mouse
gtgagacgctggcctggcgg

SEQ ID NO: 440151 - DNA, 20 bp, mouse
gttgccatggagaagataac

SEQ ID NO: 440152 - DNA, 20 bp, mouse
gacaatgtacagctggttcc

SEQ ID NO: 440153 - DNA, 20 bp, mouse
gaagcagcaagcacccccca

SEQ ID NO: 440154 - DNA, 20 bp, mouse
gagagccctggctagaggac

SEQ ID NO: 440155 - DNA, 20 bp, mouse
gtcctgaggcctcagagccc

SEQ ID NO: 440156 - DNA, 20 bp, mouse
gagatctctcacagggactg

SEQ ID NO: 440157 - DNA, 20 bp, mouse
ggctgtcacagatctctcac

SEQ ID NO: 440158 - DNA, 20 bp, mouse
gagatgcaggcaggacccat

SEQ ID NO: 440159 - DNA, 20 bp, mouse
gggatggtgcagagaatgat

SEQ ID NO: 440160 - DNA, 20 bp, mouse
ggaaaattctacttagacag

SEQ ID NO: 440161 - DNA, 20 bp, mouse
gctgctgcaaggaagtagga

SEQ ID NO: 440162 - DNA, 20 bp, mouse
gggaagatcaagggggtctg

SEQ ID NO: 440163 - DNA, 20 bp, mouse
gcagaagcagaggggtatag

SEQ ID NO: 440164 - DNA, 20 bp, mouse
gaatgataggaagatcaagg

SEQ ID NO: 440165 - DNA, 20 bp, mouse
gttgcctgctgcaaggaagt

SEQ ID NO: 440166 - DNA, 20 bp, mouse
ggagtgaggagtgcaggcgg

SEQ ID NO: 440167 - DNA, 20 bp, mouse
ggcgagcgagtgaggagtgc

SEQ ID NO: 440168 - DNA, 20 bp, mouse
gatcccaacgaaggagccgg

SEQ ID NO: 440169 - DNA, 20 bp, mouse
gccgagccaagaggccggag

SEQ ID NO: 440170 - DNA, 20 bp, mouse
gccggccgggatcccaacga

SEQ ID NO: 440171 - DNA, 20 bp, mouse
ggggcagccgcaccagcgag

SEQ ID NO: 440172 - DNA, 20 bp, mouse
ggcggtccgagccaagaggc

SEQ ID NO: 440173 - DNA, 20 bp, mouse
gtgccgccggctccttcgtt

SEQ ID NO: 440174 - DNA, 20 bp, mouse
gcgcagcggtccgagccaag

SEQ ID NO: 440175 - DNA, 20 bp, mouse
ggcgcaggggcgctaggtcc

SEQ ID NO: 440176 - DNA, 20 bp, mouse
ggggatgccactaagcccag

SEQ ID NO: 440177 - DNA, 20 bp, mouse
gcgatccatcttcagccatg

SEQ ID NO: 440178 - DNA, 20 bp, mouse
gtcttcagccatggggcaga

SEQ ID NO: 440179 - DNA, 20 bp, mouse
gggaggtcgagaataaattt

SEQ ID NO: 440180 - DNA, 20 bp, mouse
ggacaacagtaaaacaccaa

SEQ ID NO: 440181 - DNA, 20 bp, mouse
gtaaatgactgcacaccgga

SEQ ID NO: 440182 - DNA, 20 bp, mouse
gggcagtactcccttgccca

SEQ ID NO: 440183 - DNA, 20 bp, mouse
gaaagaaacagtaccaactg

SEQ ID NO: 440184 - DNA, 20 bp, mouse
gctctcacagatctttcctc

SEQ ID NO: 440185 - DNA, 20 bp, mouse
gtagttgaaaaatcaccatc

SEQ ID NO: 440186 - DNA, 20 bp, mouse
ggcctggcccaccttctctc

SEQ ID NO: 440187 - DNA, 20 bp, mouse
gacaggagccgccggcaagg

SEQ ID NO: 440188 - DNA, 20 bp, mouse
gtctattgaagccggagaga

SEQ ID NO: 440189 - DNA, 20 bp, mouse
ggaggaagctctattgaagc

SEQ ID NO: 440190 - DNA, 20 bp, mouse
gcacccgggctgtgtcagag

SEQ ID NO: 440191 - DNA, 20 bp, mouse
gattgaagccggagagaagg

SEQ ID NO: 440192 - DNA, 20 bp, mouse
gggcatcaggccgctcggag

SEQ ID NO: 440193 - DNA, 20 bp, mouse
gtccgggccacggtaggtag

SEQ ID NO: 440194 - DNA, 20 bp, mouse
gggcatcggcgggcagaaag

SEQ ID NO: 440195 - DNA, 20 bp, mouse
gcagaggggcaccttccaga

SEQ ID NO: 440196 - DNA, 20 bp, mouse
gccccgccggcacaggaaga

SEQ ID NO: 440197 - DNA, 20 bp, mouse
ggcgcagcgtttagcatgag

SEQ ID NO: 440198 - DNA, 20 bp, mouse
ggatcagggccgcaacaact

SEQ ID NO: 440199 - DNA, 20 bp, mouse
gcgtttagcatgagcggctc

SEQ ID NO: 440200 - DNA, 20 bp, mouse
gcgccaggcggcacagccag

SEQ ID NO: 440201 - DNA, 20 bp, mouse
ggtccaccgccggaactcga

SEQ ID NO: 440202 - DNA, 20 bp, mouse
ggtaagccatcgagttccgg

SEQ ID NO: 440203 - DNA, 20 bp, mouse
gccgaggcagggccgggaag

SEQ ID NO: 440204 - DNA, 20 bp, mouse
gttgttgcggccctgatcag

SEQ ID NO: 440205 - DNA, 20 bp, mouse
gctggcgggagtgctaggag

SEQ ID NO: 440206 - DNA, 20 bp, mouse
gggcggagccgggaagtgta

SEQ ID NO: 440207 - DNA, 20 bp, mouse
ggagccggagcgcagcgtgg

SEQ ID NO: 440208 - DNA, 20 bp, mouse
gggcgggcggctgagagcac

SEQ ID NO: 440209 - DNA, 20 bp, mouse
ggtgccaccacgctgcgctc

SEQ ID NO: 440210 - DNA, 20 bp, mouse
gaagaaagcggcggggaaaa

SEQ ID NO: 440211 - DNA, 20 bp, mouse
gatcaccgctgcagcggcag

SEQ ID NO: 440212 - DNA, 20 bp, mouse
gtccggctccgtacacttcc

SEQ ID NO: 440213 - DNA, 20 bp, mouse
ggggcggctgagagcaccgg

SEQ ID NO: 440214 - DNA, 20 bp, mouse
ggaaaggaaagaaagcggcg

SEQ ID NO: 440215 - DNA, 20 bp, mouse
gctcccggcgaggagggaga

SEQ ID NO: 440216 - DNA, 20 bp, mouse
gagcgcggctcgggacatgc

SEQ ID NO: 440217 - DNA, 20 bp, mouse
gagggcctcgggttacgcgg

SEQ ID NO: 440218 - DNA, 20 bp, mouse
gcgggacatgccggcagagg

SEQ ID NO: 440219 - DNA, 20 bp, mouse
gagaggcggtgaccccgggc

SEQ ID NO: 440220 - DNA, 20 bp, mouse
ggctcgggacatgccggcag

SEQ ID NO: 440221 - DNA, 20 bp, mouse
ggccccgcagaggaaaaaag

SEQ ID NO: 440222 - DNA, 20 bp, mouse
gggacggcccggccgagccg

SEQ ID NO: 440223 - DNA, 20 bp, mouse
ggcgcccggcctcagctcgg

SEQ ID NO: 440224 - DNA, 20 bp, mouse
gcaaagggcctcgggttacg

SEQ ID NO: 440225 - DNA, 20 bp, mouse
ggcgagcgctgcggaagcca

SEQ ID NO: 440226 - DNA, 20 bp, mouse
gaggtccaggcagctcgctg

SEQ ID NO: 440227 - DNA, 20 bp, mouse
gcgagggcgcggcgcgccaa

SEQ ID NO: 440228 - DNA, 20 bp, mouse
gctccgcggcccggcaccga

SEQ ID NO: 440229 - DNA, 20 bp, mouse
gcggctaggctaggagccct

SEQ ID NO: 440230 - DNA, 20 bp, mouse
gcaggcagctcgctgcggct

SEQ ID NO: 440231 - DNA, 20 bp, mouse
gagctcgctgcggctaggct

SEQ ID NO: 440232 - DNA, 20 bp, mouse
gcgggtgcggtagcagctgg

SEQ ID NO: 440233 - DNA, 20 bp, mouse
gacaggacccgctggcccgg

SEQ ID NO: 440234 - DNA, 20 bp, mouse
ggcccggcggcagacccccc

SEQ ID NO: 440235 - DNA, 20 bp, mouse
ggaagcggaccatgactccc

SEQ ID NO: 440236 - DNA, 20 bp, mouse
gaggctctggtaatccacca

SEQ ID NO: 440237 - DNA, 20 bp, mouse
ggagatgactaagtcctctg

SEQ ID NO: 440238 - DNA, 20 bp, mouse
ggtcatctcaggcttctccg

SEQ ID NO: 440239 - DNA, 20 bp, mouse
gctaagtcctctgtggccgt

SEQ ID NO: 440240 - DNA, 20 bp, mouse
gatctcaggcttctccgtgg

SEQ ID NO: 440241 - DNA, 20 bp, mouse
gtcacagccaatgagtgaca

SEQ ID NO: 440242 - DNA, 20 bp, mouse
gctctggaaggagacacact

SEQ ID NO: 440243 - DNA, 20 bp, mouse
ggcagagctgtgcttcggag

SEQ ID NO: 440244 - DNA, 20 bp, mouse
gcacatccaaataaaaggat

SEQ ID NO: 440245 - DNA, 20 bp, mouse
ggactccaaatctctcctgg

SEQ ID NO: 440246 - DNA, 20 bp, mouse
gcgcggtcccgagccagcgg

SEQ ID NO: 440247 - DNA, 20 bp, mouse
gcgtccccggatgtgagctc

SEQ ID NO: 440248 - DNA, 20 bp, mouse
ggcccgcggtcccgagccag

SEQ ID NO: 440249 - DNA, 20 bp, mouse
gcagccggagctcacatccg

SEQ ID NO: 440250 - DNA, 20 bp, mouse
gtagcggagggacaccgtgg

SEQ ID NO: 440251 - DNA, 20 bp, mouse
ggatatgggaggttacggat

SEQ ID NO: 440252 - DNA, 20 bp, mouse
gggccgggcgggcaccacca

SEQ ID NO: 440253 - DNA, 20 bp, mouse
gacgcgccccccggactcca

SEQ ID NO: 440254 - DNA, 20 bp, mouse
gtgtccctccgctagaggag

SEQ ID NO: 440255 - DNA, 20 bp, mouse
ggcgcgccgtggagtccggg

SEQ ID NO: 440256 - DNA, 20 bp, mouse
gaacacccgcacacaacaag

SEQ ID NO: 440257 - DNA, 20 bp, mouse
gaggatggctcgcttcgggg

SEQ ID NO: 440258 - DNA, 20 bp, mouse
ggggagagggaagtcatggt

SEQ ID NO: 440259 - DNA, 20 bp, mouse
gaccagagcaggaaccgaca

SEQ ID NO: 440260 - DNA, 20 bp, mouse
gcattccatcgggtgagggg

SEQ ID NO: 440261 - DNA, 20 bp, mouse
ggtacaaccccataccagtc

SEQ ID NO: 440262 - DNA, 20 bp, mouse
gccctgcgcctgtgtggata

SEQ ID NO: 440263 - DNA, 20 bp, mouse
gtcggggaggcggtggtcgt

SEQ ID NO: 440264 - DNA, 20 bp, mouse
gacccgatggaatgcaaagg

SEQ ID NO: 440265 - DNA, 20 bp, mouse
gggctcaggcgatggagact

SEQ ID NO: 440266 - DNA, 20 bp, mouse
gtcacttcaagggtcttcag

SEQ ID NO: 440267 - DNA, 20 bp, mouse
gcggaatctgaagtcgggaa

SEQ ID NO: 440268 - DNA, 20 bp, mouse
gggatgtcggaatctgaagt

SEQ ID NO: 440269 - DNA, 20 bp, mouse
ggctattgaggataacacat

SEQ ID NO: 440270 - DNA, 20 bp, mouse
gatccaggtgggcaattggt

SEQ ID NO: 440271 - DNA, 20 bp, mouse
gatggtccttatatctcctg

SEQ ID NO: 440272 - DNA, 20 bp, mouse
gactcccagagaggtctctg

SEQ ID NO: 440273 - DNA, 20 bp, mouse
gaggttgtgcaattgagatt

SEQ ID NO: 440274 - DNA, 20 bp, mouse
gagagcccagggtcacttca

SEQ ID NO: 440275 - DNA, 20 bp, mouse
gatcctcctcaggagatata

SEQ ID NO: 440276 - DNA, 20 bp, mouse
gcctccggccgagacgcgga

SEQ ID NO: 440277 - DNA, 20 bp, mouse
ggctgcgccgagggaagagg

SEQ ID NO: 440278 - DNA, 20 bp, mouse
gtcctcctccggccgagacg

SEQ ID NO: 440279 - DNA, 20 bp, mouse
gcggtgaagcagcccccgag

SEQ ID NO: 440280 - DNA, 20 bp, mouse
gtgaagcagcccccgagagg

SEQ ID NO: 440281 - DNA, 20 bp, mouse
ggtggcgccggcgacagcta

SEQ ID NO: 440282 - DNA, 20 bp, mouse
gggagtgagggatccagctg

SEQ ID NO: 440283 - DNA, 20 bp, mouse
ggcagctggagcaggatcta

SEQ ID NO: 440284 - DNA, 20 bp, mouse
gggagcccccgggaacccag

SEQ ID NO: 440285 - DNA, 20 bp, mouse
gcccggctccacgccagaga

SEQ ID NO: 440286 - DNA, 20 bp, mouse
gggcgcggccgagccagaga

SEQ ID NO: 440287 - DNA, 20 bp, mouse
gtgtgcgcggacgggctcca

SEQ ID NO: 440288 - DNA, 20 bp, mouse
ggaccgcaggcacgggccgg

SEQ ID NO: 440289 - DNA, 20 bp, mouse
ggggcgcggaccgcaggcac

SEQ ID NO: 440290 - DNA, 20 bp, mouse
gcgcacagcgcaggaaactt

SEQ ID NO: 440291 - DNA, 20 bp, mouse
gtggccagcggcgtccctgt

SEQ ID NO: 440292 - DNA, 20 bp, mouse
gaccggagcgaggtgagatg

SEQ ID NO: 440293 - DNA, 20 bp, mouse
ggaaacttcggagtgagcag

SEQ ID NO: 440294 - DNA, 20 bp, mouse
ggctcgctccctctctggct

SEQ ID NO: 440295 - DNA, 20 bp, mouse
ggcgagagctggtgccgggt

SEQ ID NO: 440296 - DNA, 20 bp, mouse
ggccggagcgccaggcggtg

SEQ ID NO: 440297 - DNA, 20 bp, mouse
ggtgcggggacgtgcggcgg

SEQ ID NO: 440298 - DNA, 20 bp, mouse
gccggactcgaggcgcaaag

SEQ ID NO: 440299 - DNA, 20 bp, mouse
gaaggggctgcgcgcgacgg

SEQ ID NO: 440300 - DNA, 20 bp, mouse
gcggcagggcaggtgcgggg

SEQ ID NO: 440301 - DNA, 20 bp, mouse
gcccgcaccgcctggcgctc

SEQ ID NO: 440302 - DNA, 20 bp, mouse
ggtcccgggcagagatgcgg

SEQ ID NO: 440303 - DNA, 20 bp, mouse
gcagctgatcccggaatctg

SEQ ID NO: 440304 - DNA, 20 bp, mouse
gccgcggcagggcaggtgcg

SEQ ID NO: 440305 - DNA, 20 bp, mouse
gcacgtccatgccaaggtag

SEQ ID NO: 440306 - DNA, 20 bp, mouse
gtcaggtccagtccccaagg

SEQ ID NO: 440307 - DNA, 20 bp, mouse
gcagcaggataggctcagtc

SEQ ID NO: 440308 - DNA, 20 bp, mouse
gctgcctgcctcagcaggat

SEQ ID NO: 440309 - DNA, 20 bp, mouse
gtccccagtgcccccacctt

SEQ ID NO: 440310 - DNA, 20 bp, mouse
ggactctacagaaccccctg

SEQ ID NO: 440311 - DNA, 20 bp, mouse
gtgatgcaggccttcctcag

SEQ ID NO: 440312 - DNA, 20 bp, mouse
gtggggtgagggcggctcca

SEQ ID NO: 440313 - DNA, 20 bp, mouse
gaaggcctgcatcagcatcg

SEQ ID NO: 440314 - DNA, 20 bp, mouse
gtcctcaggccctcgtcctg

SEQ ID NO: 440315 - DNA, 20 bp, mouse
gtgaggcaggcagacgggtc

SEQ ID NO: 440316 - DNA, 20 bp, mouse
gtcgcctgcgccgccatcaa

SEQ ID NO: 440317 - DNA, 20 bp, mouse
gaggcagccgtggcacggag

SEQ ID NO: 440318 - DNA, 20 bp, mouse
gccacagtcgcccttgatgg

SEQ ID NO: 440319 - DNA, 20 bp, mouse
ggcggcggagctgcacgagg

SEQ ID NO: 440320 - DNA, 20 bp, mouse
ggaccgcggataaatcaggg

SEQ ID NO: 440321 - DNA, 20 bp, mouse
gaagtcggcgggcccaggtt

SEQ ID NO: 440322 - DNA, 20 bp, mouse
gggcgaccgcggataaatca

SEQ ID NO: 440323 - DNA, 20 bp, mouse
gacgtgacgggcgaagggaa

SEQ ID NO: 440324 - DNA, 20 bp, mouse
gtggctgccgctccgtgcca

SEQ ID NO: 440325 - DNA, 20 bp, mouse
ggctgggagccagagcgcgc

SEQ ID NO: 440326 - DNA, 20 bp, mouse
gcccggagtggagagtggag

SEQ ID NO: 440327 - DNA, 20 bp, mouse
ggggacctgcgctcaaatag

SEQ ID NO: 440328 - DNA, 20 bp, mouse
gaagcgccgcaggtccgagc

SEQ ID NO: 440329 - DNA, 20 bp, mouse
ggggagggagcgacagggga

SEQ ID NO: 440330 - DNA, 20 bp, mouse
gggcggcgccggcaggttgg

SEQ ID NO: 440331 - DNA, 20 bp, mouse
gtgctgctgggggaagctgt

SEQ ID NO: 440332 - DNA, 20 bp, mouse
gatgagggagggagcgacag

SEQ ID NO: 440333 - DNA, 20 bp, mouse
ggcggtaaaagcaacagagg

SEQ ID NO: 440334 - DNA, 20 bp, mouse
gctgtaggcagaggcgccgg

SEQ ID NO: 440335 - DNA, 20 bp, mouse
gaaagcgcttggagccagcg

SEQ ID NO: 440336 - DNA, 20 bp, mouse
gacccagtggcgggagacta

SEQ ID NO: 440337 - DNA, 20 bp, mouse
gagcgcccgagagagacccg

SEQ ID NO: 440338 - DNA, 20 bp, mouse
gcccggcccggccatcctgg

SEQ ID NO: 440339 - DNA, 20 bp, mouse
ggggcgcgcgagaggcagga

SEQ ID NO: 440340 - DNA, 20 bp, mouse
gcagtggcgggagactaggg

SEQ ID NO: 440341 - DNA, 20 bp, mouse
gggcgccccgggtctctctc

SEQ ID NO: 440342 - DNA, 20 bp, mouse
ggcgctagccgcccctcccg

SEQ ID NO: 440343 - DNA, 20 bp, mouse
gcccggggagtcccaacacc

SEQ ID NO: 440344 - DNA, 20 bp, mouse
gtgttgggactccccgggag

SEQ ID NO: 440345 - DNA, 20 bp, mouse
gggcggtgggcgagcgcgct

SEQ ID NO: 440346 - DNA, 20 bp, mouse
gtgctgccacaggaactcct

SEQ ID NO: 440347 - DNA, 20 bp, mouse
gccaccccaggtgatcaaag

SEQ ID NO: 440348 - DNA, 20 bp, mouse
gcccaggtgatcaaagggga

SEQ ID NO: 440349 - DNA, 20 bp, mouse
ggcatgcccaggagttcctg

SEQ ID NO: 440350 - DNA, 20 bp, mouse
gatgttgcccccagctgcag

SEQ ID NO: 440351 - DNA, 20 bp, mouse
gtggtctggcccctcacggt

SEQ ID NO: 440352 - DNA, 20 bp, mouse
gccaagaccacagtggacgg

SEQ ID NO: 440353 - DNA, 20 bp, mouse
ggcagcagccacaggatgat

SEQ ID NO: 440354 - DNA, 20 bp, mouse
ggaaggaaaggctctctcag

SEQ ID NO: 440355 - DNA, 20 bp, mouse
gctctcagaggctggctaga

SEQ ID NO: 440356 - DNA, 20 bp, mouse
gagcacagcgcgagccggga

SEQ ID NO: 440357 - DNA, 20 bp, mouse
ggccgggagggcaagcaagg

SEQ ID NO: 440358 - DNA, 20 bp, mouse
gggagatgctgaaccttcag

SEQ ID NO: 440359 - DNA, 20 bp, mouse
gcgagccgggagggcaagca

SEQ ID NO: 440360 - DNA, 20 bp, mouse
gagtctcccagctggacctc

SEQ ID NO: 440361 - DNA, 20 bp, mouse
ggatgctgaaccttcagggg

SEQ ID NO: 440362 - DNA, 20 bp, mouse
ggaccggaggatcctctcca

SEQ ID NO: 440363 - DNA, 20 bp, mouse
gtgcagccggaggtccagct

SEQ ID NO: 440364 - DNA, 20 bp, mouse
ggccgccttgcttgccctcc

SEQ ID NO: 440365 - DNA, 20 bp, mouse
ggcggcgagcgtgcagccgg

SEQ ID NO: 440366 - DNA, 20 bp, mouse
gggcagggcccaggcactga

SEQ ID NO: 440367 - DNA, 20 bp, mouse
gccactaccagggtccggct

SEQ ID NO: 440368 - DNA, 20 bp, mouse
gcggctgggcacctccatcc

SEQ ID NO: 440369 - DNA, 20 bp, mouse
gccccagctcaccactacca

SEQ ID NO: 440370 - DNA, 20 bp, mouse
gactgagggcgccgggatgg

SEQ ID NO: 440371 - DNA, 20 bp, mouse
gggcactgagggcgccggga

SEQ ID NO: 440372 - DNA, 20 bp, mouse
ggaggtgcccagccggaccc

SEQ ID NO: 440373 - DNA, 20 bp, mouse
gccctaggccggcagggccc

SEQ ID NO: 440374 - DNA, 20 bp, mouse
gggccacccctaggccggca

SEQ ID NO: 440375 - DNA, 20 bp, mouse
gggagaaaggccctcctcag

SEQ ID NO: 440376 - DNA, 20 bp, mouse
gagagccccagagggagaag

SEQ ID NO: 440377 - DNA, 20 bp, mouse
gctgggagtgagagccccag

SEQ ID NO: 440378 - DNA, 20 bp, mouse
gctgcagctgcggaagataa

SEQ ID NO: 440379 - DNA, 20 bp, mouse
gttctgaaaagagccaaggg

SEQ ID NO: 440380 - DNA, 20 bp, mouse
gaaggtgctaggattctcca

SEQ ID NO: 440381 - DNA, 20 bp, mouse
gcttagagcatggatagcaa

SEQ ID NO: 440382 - DNA, 20 bp, mouse
gcatgaaggccacctggatc

SEQ ID NO: 440383 - DNA, 20 bp, mouse
ggacatctgtgtaagcgaga

SEQ ID NO: 440384 - DNA, 20 bp, mouse
gattgcatgagagggagcta

SEQ ID NO: 440385 - DNA, 20 bp, mouse
gttcagaagcctgatccagg

SEQ ID NO: 440386 - DNA, 20 bp, mouse
gagtcgggaaggtgggtccc

SEQ ID NO: 440387 - DNA, 20 bp, mouse
gccggggcggcggggaagaa

SEQ ID NO: 440388 - DNA, 20 bp, mouse
ggcacgcgagtcgggaaggt

SEQ ID NO: 440389 - DNA, 20 bp, mouse
ggggcgcacgcgagtcggga

SEQ ID NO: 440390 - DNA, 20 bp, mouse
gaaccgggcgcacgcgagtc

SEQ ID NO: 440391 - DNA, 20 bp, mouse
ggcggggaagaagggcggag

SEQ ID NO: 440392 - DNA, 20 bp, mouse
gagccaggggggacccgccg

SEQ ID NO: 440393 - DNA, 20 bp, mouse
ggtgggtccccggcacctcc

SEQ ID NO: 440394 - DNA, 20 bp, mouse
gctattgttgtgggagccgg

SEQ ID NO: 440395 - DNA, 20 bp, mouse
gtcccgggagggggtcaggt

SEQ ID NO: 440396 - DNA, 20 bp, mouse
gccccagagacatgcagacc

SEQ ID NO: 440397 - DNA, 20 bp, mouse
gtttatgctctgtattggag

SEQ ID NO: 440398 - DNA, 20 bp, mouse
gtattcgttcacatcataca

SEQ ID NO: 440399 - DNA, 20 bp, mouse
ggagaggcagataaaatgcc

SEQ ID NO: 440400 - DNA, 20 bp, mouse
gaccagtctgtgcttgagga

SEQ ID NO: 440401 - DNA, 20 bp, mouse
gcatggagttgaagactcgg

SEQ ID NO: 440402 - DNA, 20 bp, mouse
gtgccaggtctgcatgtctc

SEQ ID NO: 440403 - DNA, 20 bp, mouse
gcaattcctgtggatttacc

SEQ ID NO: 440404 - DNA, 20 bp, mouse
gtacaaattgtcatacatgg

SEQ ID NO: 440405 - DNA, 20 bp, mouse
gaaatccacaggaattgata

SEQ ID NO: 440406 - DNA, 20 bp, mouse
gcaggcagctagctagatgg

SEQ ID NO: 440407 - DNA, 20 bp, mouse
gtcccaggcagctagctaga

SEQ ID NO: 440408 - DNA, 20 bp, mouse
ggctagctagatggtggcag

SEQ ID NO: 440409 - DNA, 20 bp, mouse
ggttgaggtgtgggtgctct

SEQ ID NO: 440410 - DNA, 20 bp, mouse
gagcggtgcagatcctccag

SEQ ID NO: 440411 - DNA, 20 bp, mouse
gcatggcggtcgttgaggtg

SEQ ID NO: 440412 - DNA, 20 bp, mouse
ggagctaaggtagaaaacta

SEQ ID NO: 440413 - DNA, 20 bp, mouse
gccccaaggccagcccactc

SEQ ID NO: 440414 - DNA, 20 bp, mouse
ggcccagtggtcagtcacca

SEQ ID NO: 440415 - DNA, 20 bp, mouse
gttgtgcacggcaacccgag

SEQ ID NO: 440416 - DNA, 20 bp, mouse
gagcgctcattccggaactg

SEQ ID NO: 440417 - DNA, 20 bp, mouse
gcagggagcgcacagagtgg

SEQ ID NO: 440418 - DNA, 20 bp, mouse
gtgtggaacaggagtccggg

SEQ ID NO: 440419 - DNA, 20 bp, mouse
ggactcctgttccacagttc

SEQ ID NO: 440420 - DNA, 20 bp, mouse
gccccggccagcgctcattc

SEQ ID NO: 440421 - DNA, 20 bp, mouse
gccacggcgacgcagtaggt

SEQ ID NO: 440422 - DNA, 20 bp, mouse
ggcgcagggagcgcacagag

SEQ ID NO: 440423 - DNA, 20 bp, mouse
ggctgggaggaaggcgtagc

SEQ ID NO: 440424 - DNA, 20 bp, mouse
gtggacagctccccacgacc

SEQ ID NO: 440425 - DNA, 20 bp, mouse
gagcaccacggcgacgcagt

SEQ ID NO: 440426 - DNA, 20 bp, mouse
gcacagccccgagagactca

SEQ ID NO: 440427 - DNA, 20 bp, mouse
gtcacacaccagacctctct

SEQ ID NO: 440428 - DNA, 20 bp, mouse
gaccctcccgagggccatag

SEQ ID NO: 440429 - DNA, 20 bp, mouse
ggagggccatagaggactcg

SEQ ID NO: 440430 - DNA, 20 bp, mouse
ggtgatgtggaccaaccccc

SEQ ID NO: 440431 - DNA, 20 bp, mouse
gcccaggaatcctctgaccg

SEQ ID NO: 440432 - DNA, 20 bp, mouse
ggtcctctatggccctcggg

SEQ ID NO: 440433 - DNA, 20 bp, mouse
gcagttccccgagtcctcta

SEQ ID NO: 440434 - DNA, 20 bp, mouse
gggagcccgcaccctcccga

SEQ ID NO: 440435 - DNA, 20 bp, mouse
gtctgaccgcggcagtgatg

SEQ ID NO: 440436 - DNA, 20 bp, mouse
ggaggcgcggcggcgagtga

SEQ ID NO: 440437 - DNA, 20 bp, mouse
gctcaaactccgaggcgcgg

SEQ ID NO: 440438 - DNA, 20 bp, mouse
ggggctcaaactccgaggcg

SEQ ID NO: 440439 - DNA, 20 bp, mouse
ggcgcggggctcaaactccg

SEQ ID NO: 440440 - DNA, 20 bp, mouse
gcggcgggcggcggactatg

SEQ ID NO: 440441 - DNA, 20 bp, mouse
gccggagcgcaggcacgccc

SEQ ID NO: 440442 - DNA, 20 bp, mouse
gggtcgcatcgcaccatggt

SEQ ID NO: 440443 - DNA, 20 bp, mouse
gagggctgcgcgggctacgc

SEQ ID NO: 440444 - DNA, 20 bp, mouse
gctggagtacagccagtagt

SEQ ID NO: 440445 - DNA, 20 bp, mouse
gccgcggtcgcatcgcacca

SEQ ID NO: 440446 - DNA, 20 bp, mouse
gcgcctggaaggtcccttgt

SEQ ID NO: 440447 - DNA, 20 bp, mouse
gcagagcagctccggcggac

SEQ ID NO: 440448 - DNA, 20 bp, mouse
gagctccggcggaccggacg

SEQ ID NO: 440449 - DNA, 20 bp, mouse
ggggcgtccggcaagcagcg

SEQ ID NO: 440450 - DNA, 20 bp, mouse
gcaccgcgcgcagcccacaa

SEQ ID NO: 440451 - DNA, 20 bp, mouse
gaccggacggggcgggcgtc

SEQ ID NO: 440452 - DNA, 20 bp, mouse
gctctgcgccagctaccgtg

SEQ ID NO: 440453 - DNA, 20 bp, mouse
ggcccctggctactcagtta

SEQ ID NO: 440454 - DNA, 20 bp, mouse
gtagtccagtgttccagcgg

SEQ ID NO: 440455 - DNA, 20 bp, mouse
gtccggcggaccggacgggg

SEQ ID NO: 440456 - DNA, 20 bp, mouse
gctgtgcagcgggtcctaag

SEQ ID NO: 440457 - DNA, 20 bp, mouse
gtggcctaaggatgctacca

SEQ ID NO: 440458 - DNA, 20 bp, mouse
ggcagggcctagactttcaa

SEQ ID NO: 440459 - DNA, 20 bp, mouse
gaaaaagctaggctactctg

SEQ ID NO: 440460 - DNA, 20 bp, mouse
gctggctcagaatttgagaa

SEQ ID NO: 440461 - DNA, 20 bp, mouse
gatatagtttagatttcttc

SEQ ID NO: 440462 - DNA, 20 bp, mouse
ggggcttatgcacatgaacg

SEQ ID NO: 440463 - DNA, 20 bp, mouse
gtcagctcccctcttttcaa

SEQ ID NO: 440464 - DNA, 20 bp, mouse
gaagccctggtagcatcctt

SEQ ID NO: 440465 - DNA, 20 bp, mouse
ggactttcaaaggaagtagt

SEQ ID NO: 440466 - DNA, 20 bp, mouse
gcgcccgcggcctcactcag

SEQ ID NO: 440467 - DNA, 20 bp, mouse
gagccgggagcagggaccag

SEQ ID NO: 440468 - DNA, 20 bp, mouse
gtaagagcgaggggagggtc

SEQ ID NO: 440469 - DNA, 20 bp, mouse
gcggctgcgtccgctgagtg

SEQ ID NO: 440470 - DNA, 20 bp, mouse
gcgggcaccggagaccccgg

SEQ ID NO: 440471 - DNA, 20 bp, mouse
gccgcctagagcctacccag

SEQ ID NO: 440472 - DNA, 20 bp, mouse
gctaatgcggaggaggggag

SEQ ID NO: 440473 - DNA, 20 bp, mouse
gtacctctctcagggctggg

SEQ ID NO: 440474 - DNA, 20 bp, mouse
gcgtccgctgagtgaggccg

SEQ ID NO: 440475 - DNA, 20 bp, mouse
ggcgcgggcaccggagaccc

SEQ ID NO: 440476 - DNA, 20 bp, mouse
ggggccgtgggccaccaccg

SEQ ID NO: 440477 - DNA, 20 bp, mouse
ggctggggggatcacagcac

SEQ ID NO: 440478 - DNA, 20 bp, mouse
gaccaccggggcagcggagg

SEQ ID NO: 440479 - DNA, 20 bp, mouse
gttcaccactggcaaccggg

SEQ ID NO: 440480 - DNA, 20 bp, mouse
gctgtgatccccccagccgc

SEQ ID NO: 440481 - DNA, 20 bp, mouse
gggcctcaaggggccagagg

SEQ ID NO: 440482 - DNA, 20 bp, mouse
gccgagaagaaggaccctgg

SEQ ID NO: 440483 - DNA, 20 bp, mouse
gtgggccaccaccggggcag

SEQ ID NO: 440484 - DNA, 20 bp, mouse
gacggaccaccccatcgtgg

SEQ ID NO: 440485 - DNA, 20 bp, mouse
gagaagctggggggcctcaa

SEQ ID NO: 440486 - DNA, 20 bp, mouse
gcgagaggagagggattggg

SEQ ID NO: 440487 - DNA, 20 bp, mouse
ggcggtcaggatatgagggt

SEQ ID NO: 440488 - DNA, 20 bp, mouse
gttgggcggtcaggatatga

SEQ ID NO: 440489 - DNA, 20 bp, mouse
ggggagcctccgagaggaga

SEQ ID NO: 440490 - DNA, 20 bp, mouse
ggaaacagatccagagaggg

SEQ ID NO: 440491 - DNA, 20 bp, mouse
ggcagggtctgagtggcaga

SEQ ID NO: 440492 - DNA, 20 bp, mouse
gaggggagctgctgagggat

SEQ ID NO: 440493 - DNA, 20 bp, mouse
ggggtagctcggagcttggg

SEQ ID NO: 440494 - DNA, 20 bp, mouse
ggggaagtggtcggggagca

SEQ ID NO: 440495 - DNA, 20 bp, mouse
ggctgggtaaagtgcggagc

SEQ ID NO: 440496 - DNA, 20 bp, mouse
gcacggtctgtgggtcgcag

SEQ ID NO: 440497 - DNA, 20 bp, mouse
ggcgggccgccaaatgggtc

SEQ ID NO: 440498 - DNA, 20 bp, mouse
ggtctgtgggtcgcaggggt

SEQ ID NO: 440499 - DNA, 20 bp, mouse
gaaggcgacgggaacacgag

SEQ ID NO: 440500 - DNA, 20 bp, mouse
ggctcgcgctcacggtctgt

SEQ ID NO: 440501 - DNA, 20 bp, mouse
ggcgagtagcgtgcttaggg

SEQ ID NO: 440502 - DNA, 20 bp, mouse
ggcgagagtcccgacccatt

SEQ ID NO: 440503 - DNA, 20 bp, mouse
ggcgcaggtgagcgtcctgg

SEQ ID NO: 440504 - DNA, 20 bp, mouse
gccctctaaccgggactcca

SEQ ID NO: 440505 - DNA, 20 bp, mouse
gacgcaagcggcgcagccga

SEQ ID NO: 440506 - DNA, 20 bp, mouse
gaggaaccgctgactgaggt

SEQ ID NO: 440507 - DNA, 20 bp, mouse
ggagtgcccacctcagtcag

SEQ ID NO: 440508 - DNA, 20 bp, mouse
gccggaggaaccgctgactg

SEQ ID NO: 440509 - DNA, 20 bp, mouse
gactgaggtgggcactcccg

SEQ ID NO: 440510 - DNA, 20 bp, mouse
gggtgcggcggaaaatccag

SEQ ID NO: 440511 - DNA, 20 bp, mouse
ggtcaagacgactccgccgg

SEQ ID NO: 440512 - DNA, 20 bp, mouse
gttctgagaggcagccgcaa

SEQ ID NO: 440513 - DNA, 20 bp, mouse
gtctgcgctcccaggcccgg

SEQ ID NO: 440514 - DNA, 20 bp, mouse
gcaggcccgggggctgaggt

SEQ ID NO: 440515 - DNA, 20 bp, mouse
ggggcgatgtgaactcgagg

SEQ ID NO: 440516 - DNA, 20 bp, mouse
ggcagcgagctccacagacc

SEQ ID NO: 440517 - DNA, 20 bp, mouse
gccacagacccggcgcgaca

SEQ ID NO: 440518 - DNA, 20 bp, mouse
gccggcgctgcgacgctcgt

SEQ ID NO: 440519 - DNA, 20 bp, mouse
gcgggagccgagaagacctc

SEQ ID NO: 440520 - DNA, 20 bp, mouse
gggccgcgggcccgcgacgg

SEQ ID NO: 440521 - DNA, 20 bp, mouse
ggcccgccctccgcacgaga

SEQ ID NO: 440522 - DNA, 20 bp, mouse
gcctcgggtctgacgcgcga

SEQ ID NO: 440523 - DNA, 20 bp, mouse
gcagacccggcgcgacacgg

SEQ ID NO: 440524 - DNA, 20 bp, mouse
ggccgcggctggaaggtcgg

SEQ ID NO: 440525 - DNA, 20 bp, mouse
gcctcaggcaatggagagag

SEQ ID NO: 440526 - DNA, 20 bp, mouse
gtcgggtcggagctgagaca

SEQ ID NO: 440527 - DNA, 20 bp, mouse
ggcttcagctcactacgctt

SEQ ID NO: 440528 - DNA, 20 bp, mouse
gctggtgttggaggacgggt

SEQ ID NO: 440529 - DNA, 20 bp, mouse
gcagggctgagttcaggcaa

SEQ ID NO: 440530 - DNA, 20 bp, mouse
ggcgccggagttggtccacg

SEQ ID NO: 440531 - DNA, 20 bp, mouse
ggggctggaggtatcgactc

SEQ ID NO: 440532 - DNA, 20 bp, mouse
gctcactacgcttagggctc

SEQ ID NO: 440533 - DNA, 20 bp, mouse
gaccagggccgccatcgggt

SEQ ID NO: 440534 - DNA, 20 bp, mouse
ggcgcggggcgctggagagc

SEQ ID NO: 440535 - DNA, 20 bp, mouse
gtccccagcagtcgacacag

SEQ ID NO: 440536 - DNA, 20 bp, mouse
gctgaggcaggtgcccgaca

SEQ ID NO: 440537 - DNA, 20 bp, mouse
gagcggatcccagtgtgcgg

SEQ ID NO: 440538 - DNA, 20 bp, mouse
gagccaccgccgccagtctg

SEQ ID NO: 440539 - DNA, 20 bp, mouse
gccgagcggatcccagtgtg

SEQ ID NO: 440540 - DNA, 20 bp, mouse
ggcacagcactcgccatgtc

SEQ ID NO: 440541 - DNA, 20 bp, mouse
ggccggagccggagccctgg

SEQ ID NO: 440542 - DNA, 20 bp, mouse
gtcccagtgtgcggcggcag

SEQ ID NO: 440543 - DNA, 20 bp, mouse
gtcgggcacctgcctcagac

SEQ ID NO: 440544 - DNA, 20 bp, mouse
gaggagccgtagctatggaa

SEQ ID NO: 440545 - DNA, 20 bp, mouse
gagcgtggcaaggaaagtcg

SEQ ID NO: 440546 - DNA, 20 bp, mouse
gtagcgagcaccagacacaa

SEQ ID NO: 440547 - DNA, 20 bp, mouse
gggtaggtcacggaagggag

SEQ ID NO: 440548 - DNA, 20 bp, mouse
ggagtgggtaggtcacggaa

SEQ ID NO: 440549 - DNA, 20 bp, mouse
gggcgagggctgcaaggagt

SEQ ID NO: 440550 - DNA, 20 bp, mouse
gtagcagcgcttggtagcgg

SEQ ID NO: 440551 - DNA, 20 bp, mouse
gtggtagcagcgcttggtag

SEQ ID NO: 440552 - DNA, 20 bp, mouse
ggctcgggtgtcagagtcct

SEQ ID NO: 440553 - DNA, 20 bp, mouse
gtcggggaaggtgcaggcga

SEQ ID NO: 440554 - DNA, 20 bp, mouse
gacctgcctgagcaacctcc

SEQ ID NO: 440555 - DNA, 20 bp, mouse
ggacacccgagcgcgagcgg

SEQ ID NO: 440556 - DNA, 20 bp, mouse
gcaaaggggcaaccccggag

SEQ ID NO: 440557 - DNA, 20 bp, mouse
gccggcgtcgctgtccaaag

SEQ ID NO: 440558 - DNA, 20 bp, mouse
ggccgaggcgggtaccggga

SEQ ID NO: 440559 - DNA, 20 bp, mouse
gctgtccaaaggggcaaccc

SEQ ID NO: 440560 - DNA, 20 bp, mouse
gatgctggaggagctcccgg

SEQ ID NO: 440561 - DNA, 20 bp, mouse
gggagcggcttccaagcccg

SEQ ID NO: 440562 - DNA, 20 bp, mouse
gcagtcgccgggattaaata

SEQ ID NO: 440563 - DNA, 20 bp, mouse
gtccctcccggtacccgcct

SEQ ID NO: 440564 - DNA, 20 bp, mouse
gtggcgagcctagatctccg

SEQ ID NO: 440565 - DNA, 20 bp, mouse
gtcgggtgtggagcaaaggg

SEQ ID NO: 440566 - DNA, 20 bp, mouse
ggaggtgcaggtgccgggcc

SEQ ID NO: 440567 - DNA, 20 bp, mouse
ggccgcggcggggccaggta

SEQ ID NO: 440568 - DNA, 20 bp, mouse
gtcgacggcgcgggaggtgc

SEQ ID NO: 440569 - DNA, 20 bp, mouse
gccgggcccggcgcttccag

SEQ ID NO: 440570 - DNA, 20 bp, mouse
ggcgcagtgggcggagcaga

SEQ ID NO: 440571 - DNA, 20 bp, mouse
gagagggcgggactggactc

SEQ ID NO: 440572 - DNA, 20 bp, mouse
gtggatcggggtgacgaggg

SEQ ID NO: 440573 - DNA, 20 bp, mouse
gtgacagctgggtcgcctgg

SEQ ID NO: 440574 - DNA, 20 bp, mouse
ggccaggagcccagagccgc

SEQ ID NO: 440575 - DNA, 20 bp, mouse
gcaccaaggcgcgcagtggg

SEQ ID NO: 440576 - DNA, 20 bp, mouse
gctggaggcgccttcttcag

SEQ ID NO: 440577 - DNA, 20 bp, mouse
ggtgcacccgaggtgggcaa

SEQ ID NO: 440578 - DNA, 20 bp, mouse
gcatctgcagccgctgaaga

SEQ ID NO: 440579 - DNA, 20 bp, mouse
ggcgtgtgtgcacccgaggt

SEQ ID NO: 440580 - DNA, 20 bp, mouse
gaagggtcggctgtccgggt

SEQ ID NO: 440581 - DNA, 20 bp, mouse
gcactcggcatcttttctgg

SEQ ID NO: 440582 - DNA, 20 bp, mouse
gagcggctgcagatggcatc

SEQ ID NO: 440583 - DNA, 20 bp, mouse
gcgggcggaggaagcagtcg

SEQ ID NO: 440584 - DNA, 20 bp, mouse
ggcagacccaggagcgcgag

SEQ ID NO: 440585 - DNA, 20 bp, mouse
ggacccaggagcgcgagggg

SEQ ID NO: 440586 - DNA, 20 bp, mouse
gccgcggccgcagaacgaaa

SEQ ID NO: 440587 - DNA, 20 bp, mouse
gggtccgcgggaacctaggt

SEQ ID NO: 440588 - DNA, 20 bp, mouse
gctggccgcggcaaacactc

SEQ ID NO: 440589 - DNA, 20 bp, mouse
gcgcagaacgaaagggaaag

SEQ ID NO: 440590 - DNA, 20 bp, mouse
gcgcgggtccgcgggaacct

SEQ ID NO: 440591 - DNA, 20 bp, mouse
gcgacgtgtccggaaagccc

SEQ ID NO: 440592 - DNA, 20 bp, mouse
gaacctaggtcggtgcgccg

SEQ ID NO: 440593 - DNA, 20 bp, mouse
gggccgcggcgcaccgacct

SEQ ID NO: 440594 - DNA, 20 bp, mouse
ggaggagagccgcgaggtgt

SEQ ID NO: 440595 - DNA, 20 bp, mouse
gtcttccagcgaggaggagt

SEQ ID NO: 440596 - DNA, 20 bp, mouse
gatggtggagcaagaacgaa

SEQ ID NO: 440597 - DNA, 20 bp, mouse
gcctatgaccgtaaacgcca

SEQ ID NO: 440598 - DNA, 20 bp, mouse
gtccagaggaagaaggtcag

SEQ ID NO: 440599 - DNA, 20 bp, mouse
gtccggaggacgtcacactg

SEQ ID NO: 440600 - DNA, 20 bp, mouse
ggcacaccggctccgcggga

SEQ ID NO: 440601 - DNA, 20 bp, mouse
gggtgtgccgggaggaaacc

SEQ ID NO: 440602 - DNA, 20 bp, mouse
gccagttggtgccctcggtg

SEQ ID NO: 440603 - DNA, 20 bp, mouse
gatgaccgtaaacgccatgg

SEQ ID NO: 440604 - DNA, 20 bp, mouse
gagtcttcaggagcagccgg

SEQ ID NO: 440605 - DNA, 20 bp, mouse
gggagcaagaacgaaaggct

SEQ ID NO: 440606 - DNA, 20 bp, mouse
gcccgaacggagcagcaccg

SEQ ID NO: 440607 - DNA, 20 bp, mouse
gtgcggggtgcggagaactc

SEQ ID NO: 440608 - DNA, 20 bp, mouse
gactccggaggacgcccgaa

SEQ ID NO: 440609 - DNA, 20 bp, mouse
gggggtgcggagaactccgg

SEQ ID NO: 440610 - DNA, 20 bp, mouse
ggcgcgaacctcgggcgaga

SEQ ID NO: 440611 - DNA, 20 bp, mouse
gtgcgcggagcgcgaacctc

SEQ ID NO: 440612 - DNA, 20 bp, mouse
gtcgggcgagagggctgcgc

SEQ ID NO: 440613 - DNA, 20 bp, mouse
gatgatgggtaggcagtcag

SEQ ID NO: 440614 - DNA, 20 bp, mouse
gatggggacgggtcttgcaa

SEQ ID NO: 440615 - DNA, 20 bp, mouse
gtccgcggtgctgctccgtt

SEQ ID NO: 440616 - DNA, 20 bp, mouse
gtgacagcgcgctgagagag

SEQ ID NO: 440617 - DNA, 20 bp, mouse
gaggcttaagatctccggag

SEQ ID NO: 440618 - DNA, 20 bp, mouse
gcgcgagaaccagagccaag

SEQ ID NO: 440619 - DNA, 20 bp, mouse
gcggccaggtgcaggtaagg

SEQ ID NO: 440620 - DNA, 20 bp, mouse
ggagagaggcttaagatctc

SEQ ID NO: 440621 - DNA, 20 bp, mouse
gtgctgctgcgggccagcca

SEQ ID NO: 440622 - DNA, 20 bp, mouse
gctctcagcgcgctgtcact

SEQ ID NO: 440623 - DNA, 20 bp, mouse
gcagccatggcgagccgctc

SEQ ID NO: 440624 - DNA, 20 bp, mouse
gtctccggagcggctcgcca

SEQ ID NO: 440625 - DNA, 20 bp, mouse
gggcatggctcaatgcgggt

SEQ ID NO: 440626 - DNA, 20 bp, mouse
ggagcctgcggggatcctga

SEQ ID NO: 440627 - DNA, 20 bp, mouse
gccaggcagtgcttgcgaag

SEQ ID NO: 440628 - DNA, 20 bp, mouse
gaagcggtgactcttgatcc

SEQ ID NO: 440629 - DNA, 20 bp, mouse
gaggcacaggagccactgcc

SEQ ID NO: 440630 - DNA, 20 bp, mouse
gagcagctgcaggcgctggg

SEQ ID NO: 440631 - DNA, 20 bp, mouse
gtgcaggcgctgggaggcac

SEQ ID NO: 440632 - DNA, 20 bp, mouse
gtgactcttgatcctggcag

SEQ ID NO: 440633 - DNA, 20 bp, mouse
ggctccatcaggatccccgc

SEQ ID NO: 440634 - DNA, 20 bp, mouse
gttagggctcacctggtgag

SEQ ID NO: 440635 - DNA, 20 bp, mouse
gctaggactaatgactaacg

SEQ ID NO: 440636 - DNA, 20 bp, mouse
gctcacctgctagcccgtgt

SEQ ID NO: 440637 - DNA, 20 bp, mouse
gactctcgctgttccaacac

SEQ ID NO: 440638 - DNA, 20 bp, mouse
ggcacagacgcgcctagata

SEQ ID NO: 440639 - DNA, 20 bp, mouse
gaagctgggcgaccctatct

SEQ ID NO: 440640 - DNA, 20 bp, mouse
gagcacacacacacggctgt

SEQ ID NO: 440641 - DNA, 20 bp, mouse
ggtgctgctgagtagtcgta

SEQ ID NO: 440642 - DNA, 20 bp, mouse
ggcctgtaatccgcatcctt

SEQ ID NO: 440643 - DNA, 20 bp, mouse
gtgttccaacacgggctagc

SEQ ID NO: 440644 - DNA, 20 bp, mouse
gccaccttccctcaaggagg

SEQ ID NO: 440645 - DNA, 20 bp, mouse
gatccaagtagagtggggtg

SEQ ID NO: 440646 - DNA, 20 bp, mouse
ggaacagctgatccgtccgt

SEQ ID NO: 440647 - DNA, 20 bp, mouse
gcgtaagcccaccctcagtt

SEQ ID NO: 440648 - DNA, 20 bp, mouse
gacttggcctaactgagggt

SEQ ID NO: 440649 - DNA, 20 bp, mouse
gttgttgttggtgaaaggtg

SEQ ID NO: 440650 - DNA, 20 bp, mouse
ggtccgtggggtaagaaact

SEQ ID NO: 440651 - DNA, 20 bp, mouse
gggccaagtttcttacccca

SEQ ID NO: 440652 - DNA, 20 bp, mouse
gtgagggtgggcttacgcgg

SEQ ID NO: 440653 - DNA, 20 bp, mouse
gtccgactataggaggggag

SEQ ID NO: 440654 - DNA, 20 bp, mouse
gagaaacttggcctaactga

SEQ ID NO: 440655 - DNA, 20 bp, mouse
gagcactccgactataggag

SEQ ID NO: 440656 - DNA, 20 bp, mouse
gtcctggtgagtaccttaag

SEQ ID NO: 440657 - DNA, 20 bp, mouse
gagcgctgggaaaggcgggt

SEQ ID NO: 440658 - DNA, 20 bp, mouse
ggcctgtagaccctgtctca

SEQ ID NO: 440659 - DNA, 20 bp, mouse
gggctcaattgcacccctta

SEQ ID NO: 440660 - DNA, 20 bp, mouse
gtcgtctctgacaggagtca

SEQ ID NO: 440661 - DNA, 20 bp, mouse
gaccttgagacagggtctac

SEQ ID NO: 440662 - DNA, 20 bp, mouse
gagccctggaaggccatggt

SEQ ID NO: 440663 - DNA, 20 bp, mouse
gtgctgctggctgctgttcc

SEQ ID NO: 440664 - DNA, 20 bp, mouse
ggcactagcgctgggaaagg

SEQ ID NO: 440665 - DNA, 20 bp, mouse
gtccagagaccagacctgtt

SEQ ID NO: 440666 - DNA, 20 bp, mouse
gggcaggcactgctaaggtg

SEQ ID NO: 440667 - DNA, 20 bp, mouse
gttcatctcggagcgagcag

SEQ ID NO: 440668 - DNA, 20 bp, mouse
ggccagccgcccaagactct

SEQ ID NO: 440669 - DNA, 20 bp, mouse
gtctcggagcgagcagcggc

SEQ ID NO: 440670 - DNA, 20 bp, mouse
ggcagtccgcccagagtctt

SEQ ID NO: 440671 - DNA, 20 bp, mouse
gtgcaggcaggggatgccaa

SEQ ID NO: 440672 - DNA, 20 bp, mouse
ggctctgctccccaaagcgc

SEQ ID NO: 440673 - DNA, 20 bp, mouse
gcaagactgcaaagcaaaat

SEQ ID NO: 440674 - DNA, 20 bp, mouse
gaggtgaggctcccgcgctt

SEQ ID NO: 440675 - DNA, 20 bp, mouse
gccgggaaaaggaccttgcc

SEQ ID NO: 440676 - DNA, 20 bp, mouse
gacttctgccttaggaccgg

SEQ ID NO: 440677 - DNA, 20 bp, mouse
gtgcaggcagcgtgaggtcc

SEQ ID NO: 440678 - DNA, 20 bp, mouse
gtgcacttctgccttaggac

SEQ ID NO: 440679 - DNA, 20 bp, mouse
gagtgcacgctgcgaagaga

SEQ ID NO: 440680 - DNA, 20 bp, mouse
ggtttcccggaggcgaggtg

SEQ ID NO: 440681 - DNA, 20 bp, mouse
gctgcacaagagtttcccgg

SEQ ID NO: 440682 - DNA, 20 bp, mouse
gggcttgttctgagtagatg

SEQ ID NO: 440683 - DNA, 20 bp, mouse
gacgatgtgagcgggctata

SEQ ID NO: 440684 - DNA, 20 bp, mouse
gcagcgtgcacttctgcctt

SEQ ID NO: 440685 - DNA, 20 bp, mouse
gtgtgggaatagtctcagga

SEQ ID NO: 440686 - DNA, 20 bp, mouse
gacccagcaagagagcaagc

SEQ ID NO: 440687 - DNA, 20 bp, mouse
gcagcaggacatccctcctt

SEQ ID NO: 440688 - DNA, 20 bp, mouse
gactttgtctcttacctcta

SEQ ID NO: 440689 - DNA, 20 bp, mouse
ggtcctgctgtctgaaagca

SEQ ID NO: 440690 - DNA, 20 bp, mouse
ggggcagcaacttcttccca

SEQ ID NO: 440691 - DNA, 20 bp, mouse
gagcaacttcttcccaagga

SEQ ID NO: 440692 - DNA, 20 bp, mouse
gtccgccttcagggaagctg

SEQ ID NO: 440693 - DNA, 20 bp, mouse
gcaggcaacattcctggcta

SEQ ID NO: 440694 - DNA, 20 bp, mouse
ggaagaagttgctgccctag

SEQ ID NO: 440695 - DNA, 20 bp, mouse
gggtcaggaagtccaggcgc

SEQ ID NO: 440696 - DNA, 20 bp, mouse
gacacgggccatattatctg

SEQ ID NO: 440697 - DNA, 20 bp, mouse
ggacccaagtgttaacacaa

SEQ ID NO: 440698 - DNA, 20 bp, mouse
ggtccctgtgacgaaagtct

SEQ ID NO: 440699 - DNA, 20 bp, mouse
ggcgcctggaggtcagagtg

SEQ ID NO: 440700 - DNA, 20 bp, mouse
gtccctttgtgttaacactt

SEQ ID NO: 440701 - DNA, 20 bp, mouse
gtaggggacctggcgcctgg

SEQ ID NO: 440702 - DNA, 20 bp, mouse
gatttcggccacagataata

SEQ ID NO: 440703 - DNA, 20 bp, mouse
ggcatgtccgcagctggtct

SEQ ID NO: 440704 - DNA, 20 bp, mouse
gttagcggatccgggtccca

SEQ ID NO: 440705 - DNA, 20 bp, mouse
ggtgactgaggtaggggacc

SEQ ID NO: 440706 - DNA, 20 bp, mouse
gggatccccacggaacacaa

SEQ ID NO: 440707 - DNA, 20 bp, mouse
ggttgtagccgggtaagcag

SEQ ID NO: 440708 - DNA, 20 bp, mouse
gttcatgaaggactcttggt

SEQ ID NO: 440709 - DNA, 20 bp, mouse
ggccattcatgaaggactct

SEQ ID NO: 440710 - DNA, 20 bp, mouse
gacagccacccagacgacag

SEQ ID NO: 440711 - DNA, 20 bp, mouse
gttggttggattgcaagaac

SEQ ID NO: 440712 - DNA, 20 bp, mouse
gccacagatgccattcatga

SEQ ID NO: 440713 - DNA, 20 bp, mouse
gatccatgctagctgaagag

SEQ ID NO: 440714 - DNA, 20 bp, mouse
ggcagggtacccgagccagt

SEQ ID NO: 440715 - DNA, 20 bp, mouse
ggaacacaatggataagttt

SEQ ID NO: 440716 - DNA, 20 bp, mouse
gtcttctgcctggcgccagg

SEQ ID NO: 440717 - DNA, 20 bp, mouse
ggaagagggagggctgctga

SEQ ID NO: 440718 - DNA, 20 bp, mouse
gaggctgtttttccattctc

SEQ ID NO: 440719 - DNA, 20 bp, mouse
gcggcgcgaggcagaaacag

SEQ ID NO: 440720 - DNA, 20 bp, mouse
gctgcaaccagccctaggta

SEQ ID NO: 440721 - DNA, 20 bp, mouse
gagagaaagaaacagtggcg

SEQ ID NO: 440722 - DNA, 20 bp, mouse
gccctccagatagtctctag

SEQ ID NO: 440723 - DNA, 20 bp, mouse
gaagggcccctccttaccta

SEQ ID NO: 440724 - DNA, 20 bp, mouse
ggctgggcccggatcctacg

SEQ ID NO: 440725 - DNA, 20 bp, mouse
ggcgtctacagatgaagtgc

SEQ ID NO: 440726 - DNA, 20 bp, mouse
ggctcggagtcggtgatgaa

SEQ ID NO: 440727 - DNA, 20 bp, mouse
gcgactccgagctggactgg

SEQ ID NO: 440728 - DNA, 20 bp, mouse
gcgtggctacagtcatggat

SEQ ID NO: 440729 - DNA, 20 bp, mouse
gggacagttgaagtcaaggg

SEQ ID NO: 440730 - DNA, 20 bp, mouse
gcgagctggactggaggtgc

SEQ ID NO: 440731 - DNA, 20 bp, mouse
ggtccacgtggctacagtca

SEQ ID NO: 440732 - DNA, 20 bp, mouse
gcaccgactccgagctggac

SEQ ID NO: 440733 - DNA, 20 bp, mouse
gccggccagcagggcaccgg

SEQ ID NO: 440734 - DNA, 20 bp, mouse
gattgaccaagagaccacag

SEQ ID NO: 440735 - DNA, 20 bp, mouse
ggaggtgctggaagagcatc

SEQ ID NO: 440736 - DNA, 20 bp, mouse
ggccgcccgacttcgagtaa

SEQ ID NO: 440737 - DNA, 20 bp, mouse
ggccgttactcgaagtcggg

SEQ ID NO: 440738 - DNA, 20 bp, mouse
gacttcgagtaacggcacca

SEQ ID NO: 440739 - DNA, 20 bp, mouse
gcaggctcgcgctacggcag

SEQ ID NO: 440740 - DNA, 20 bp, mouse
gggcacacaggctcgcgcta

SEQ ID NO: 440741 - DNA, 20 bp, mouse
gggtaggttgggatcggcag

SEQ ID NO: 440742 - DNA, 20 bp, mouse
gagaggcgcccaaaactcag

SEQ ID NO: 440743 - DNA, 20 bp, mouse
ggctgggagtctcgtgtccg

SEQ ID NO: 440744 - DNA, 20 bp, mouse
gagaagcggaggcacctcgg

SEQ ID NO: 440745 - DNA, 20 bp, mouse
gggaagaacggagcaggcga

SEQ ID NO: 440746 - DNA, 20 bp, mouse
gcagtgactgcggagaaagg

SEQ ID NO: 440747 - DNA, 20 bp, mouse
ggcagacacgcaagagagaa

SEQ ID NO: 440748 - DNA, 20 bp, mouse
ggtggagcgagcgagtcgag

SEQ ID NO: 440749 - DNA, 20 bp, mouse
gggaggagaattagtccgag

SEQ ID NO: 440750 - DNA, 20 bp, mouse
gatgaggcggagggatctgg

SEQ ID NO: 440751 - DNA, 20 bp, mouse
gactgtcctcgccagaggga

SEQ ID NO: 440752 - DNA, 20 bp, mouse
gggtctcccggagagttggg

SEQ ID NO: 440753 - DNA, 20 bp, mouse
gagcgagtcgagcggttgtc

SEQ ID NO: 440754 - DNA, 20 bp, mouse
gtggcgaggacagttctgag

SEQ ID NO: 440755 - DNA, 20 bp, mouse
gaagggaacccaagaggaca

SEQ ID NO: 440756 - DNA, 20 bp, mouse
gctgacgcgaagggatccgt

SEQ ID NO: 440757 - DNA, 20 bp, mouse
gctgcgggcaaagagtgtgg

SEQ ID NO: 440758 - DNA, 20 bp, mouse
ggcgctgcgggcaaagagtg

SEQ ID NO: 440759 - DNA, 20 bp, mouse
ggcgcgctcccgctgcactg

SEQ ID NO: 440760 - DNA, 20 bp, mouse
ggtaggaagccgcagtgcag

SEQ ID NO: 440761 - DNA, 20 bp, mouse
gccttcgcgtcaggctcgtg

SEQ ID NO: 440762 - DNA, 20 bp, mouse
gggagcgcgcgagccgtctg

SEQ ID NO: 440763 - DNA, 20 bp, mouse
gtggcgagcgaaccctggga

SEQ ID NO: 440764 - DNA, 20 bp, mouse
ggaagtcccaagggccgcat

SEQ ID NO: 440765 - DNA, 20 bp, mouse
gatcgaggttactctggcgg

SEQ ID NO: 440766 - DNA, 20 bp, mouse
gaagaaagggcacagagcag

SEQ ID NO: 440767 - DNA, 20 bp, mouse
gggcaagaacctcccagaga

SEQ ID NO: 440768 - DNA, 20 bp, mouse
ggaggaggtcgctgagttcc

SEQ ID NO: 440769 - DNA, 20 bp, mouse
ggatggccatatcagcgtcg

SEQ ID NO: 440770 - DNA, 20 bp, mouse
gcacagagcaggggagctgc

SEQ ID NO: 440771 - DNA, 20 bp, mouse
gaggaaagcttgtccaagtt

SEQ ID NO: 440772 - DNA, 20 bp, mouse
gttaggcgagtccctttccc

SEQ ID NO: 440773 - DNA, 20 bp, mouse
gaagttcctcgacgctgata

SEQ ID NO: 440774 - DNA, 20 bp, mouse
gccatagagaagtacaagaa

SEQ ID NO: 440775 - DNA, 20 bp, mouse
gggcgagtccctttcccagg

SEQ ID NO: 440776 - DNA, 20 bp, mouse
ggcttccaagcgctagctgt

SEQ ID NO: 440777 - DNA, 20 bp, mouse
gaggtggagactgcaagggg

SEQ ID NO: 440778 - DNA, 20 bp, mouse
gggccatgctagcagatcgt

SEQ ID NO: 440779 - DNA, 20 bp, mouse
gtagcagatcgtgggtgatg

SEQ ID NO: 440780 - DNA, 20 bp, mouse
gaggaactcggggaagtcca

SEQ ID NO: 440781 - DNA, 20 bp, mouse
ggtggcagatgtggccagtc

SEQ ID NO: 440782 - DNA, 20 bp, mouse
ggtgggtgatgtggcagatg

SEQ ID NO: 440783 - DNA, 20 bp, mouse
gactgcaaggggcggctgtc

SEQ ID NO: 440784 - DNA, 20 bp, mouse
gacagtgcccaattcttggg

SEQ ID NO: 440785 - DNA, 20 bp, mouse
gttggaagcctagaccagac

SEQ ID NO: 440786 - DNA, 20 bp, mouse
gcctgaggatggtgagtgag

SEQ ID NO: 440787 - DNA, 20 bp, mouse
gctcaggctccccttactcc

SEQ ID NO: 440788 - DNA, 20 bp, mouse
gaactcagttccaggagtaa

SEQ ID NO: 440789 - DNA, 20 bp, mouse
gtaggaaggaaggccccgag

SEQ ID NO: 440790 - DNA, 20 bp, mouse
gggctgtgccggaaggaggt

SEQ ID NO: 440791 - DNA, 20 bp, mouse
gggacagctggcccacccac

SEQ ID NO: 440792 - DNA, 20 bp, mouse
gagaaagaacagtcaagagg

SEQ ID NO: 440793 - DNA, 20 bp, mouse
gcttggggccaggtgctgtg

SEQ ID NO: 440794 - DNA, 20 bp, mouse
gcacctggccccaagcctgt

SEQ ID NO: 440795 - DNA, 20 bp, mouse
ggaaggaaggccccgagggg

SEQ ID NO: 440796 - DNA, 20 bp, mouse
gagagaacaacccacctggt

SEQ ID NO: 440797 - DNA, 20 bp, mouse
gtcatagggagataagaccc

SEQ ID NO: 440798 - DNA, 20 bp, mouse
gggagagagaacaacccacc

SEQ ID NO: 440799 - DNA, 20 bp, mouse
gcctggaagctcggataaaa

SEQ ID NO: 440800 - DNA, 20 bp, mouse
gaagctagtgccaaccaggt

SEQ ID NO: 440801 - DNA, 20 bp, mouse
gtgtaggctgctgagattca

SEQ ID NO: 440802 - DNA, 20 bp, mouse
gtgagattcatggtcctcat

SEQ ID NO: 440803 - DNA, 20 bp, mouse
gggtcccccagaaagctaag

SEQ ID NO: 440804 - DNA, 20 bp, mouse
gtgctcctgatagggtgagc

SEQ ID NO: 440805 - DNA, 20 bp, mouse
gccccttcctgctcctgata

SEQ ID NO: 440806 - DNA, 20 bp, mouse
gacatgcacgctgcacacac

SEQ ID NO: 440807 - DNA, 20 bp, mouse
gcacaggcagacacacgcgg

SEQ ID NO: 440808 - DNA, 20 bp, mouse
gtcatctggaggaaccgggg

SEQ ID NO: 440809 - DNA, 20 bp, mouse
ggctcccgggcgcagcgagg

SEQ ID NO: 440810 - DNA, 20 bp, mouse
gggcctctcaaccagagtgg

SEQ ID NO: 440811 - DNA, 20 bp, mouse
gcgcaacctgaggaacgcct

SEQ ID NO: 440812 - DNA, 20 bp, mouse
ggtgggagccggctacggag

SEQ ID NO: 440813 - DNA, 20 bp, mouse
ggctgcgcccgggagcccag

SEQ ID NO: 440814 - DNA, 20 bp, mouse
gtcttcatctggaggaaccg

SEQ ID NO: 440815 - DNA, 20 bp, mouse
gcaggctccagcctcggtgg

SEQ ID NO: 440816 - DNA, 20 bp, mouse
gggagcatggcgggccgagg

SEQ ID NO: 440817 - DNA, 20 bp, mouse
gaagcaggagcggcaccgaa

SEQ ID NO: 440818 - DNA, 20 bp, mouse
gagcggcaccgaaaggagca

SEQ ID NO: 440819 - DNA, 20 bp, mouse
gcgagggggcggcggcacac

SEQ ID NO: 440820 - DNA, 20 bp, mouse
ggcaccgaaaggagcatggc

SEQ ID NO: 440821 - DNA, 20 bp, mouse
gtcttcaggcagcggctctg

SEQ ID NO: 440822 - DNA, 20 bp, mouse
gtgtggccccagagggacta

SEQ ID NO: 440823 - DNA, 20 bp, mouse
gacagtgttggccctctgaa

SEQ ID NO: 440824 - DNA, 20 bp, mouse
ggcctgaagatcgtcttaaa

SEQ ID NO: 440825 - DNA, 20 bp, mouse
gcgcggccctagtccctctg

SEQ ID NO: 440826 - DNA, 20 bp, mouse
gtcctcctggaagtacacag

SEQ ID NO: 440827 - DNA, 20 bp, mouse
ggaagtcgcacgtgcagcta

SEQ ID NO: 440828 - DNA, 20 bp, mouse
ggcacgtgcagctatggtct

SEQ ID NO: 440829 - DNA, 20 bp, mouse
gttgcgcccgtcaagcggta

SEQ ID NO: 440830 - DNA, 20 bp, mouse
ggccacgcgcagcacacaga

SEQ ID NO: 440831 - DNA, 20 bp, mouse
ggagcgctggaggaaccgct

SEQ ID NO: 440832 - DNA, 20 bp, mouse
gattggtggactgcacccag

SEQ ID NO: 440833 - DNA, 20 bp, mouse
ggttcctccagcgctctgtg

SEQ ID NO: 440834 - DNA, 20 bp, mouse
gggcgtccgtaccgcttgac

SEQ ID NO: 440835 - DNA, 20 bp, mouse
gctcatcggggaagttctat

SEQ ID NO: 440836 - DNA, 20 bp, mouse
gagttactgttcccttggtg

SEQ ID NO: 440837 - DNA, 20 bp, mouse
gcagtaacttgatctgtctg

SEQ ID NO: 440838 - DNA, 20 bp, mouse
gttggtggggcaggatgctt

SEQ ID NO: 440839 - DNA, 20 bp, mouse
ggctttgcttcaatgtcttc

SEQ ID NO: 440840 - DNA, 20 bp, mouse
gtgtatgtgcagaaacagta

SEQ ID NO: 440841 - DNA, 20 bp, mouse
ggatcaagttactgttccct

SEQ ID NO: 440842 - DNA, 20 bp, mouse
gcattgaagcaaagctctga

SEQ ID NO: 440843 - DNA, 20 bp, mouse
ggagtgcgcactaatgtcac

SEQ ID NO: 440844 - DNA, 20 bp, mouse
gaagaagccaatcagatgca

SEQ ID NO: 440845 - DNA, 20 bp, mouse
gttgtaggacctgatatttg

SEQ ID NO: 440846 - DNA, 20 bp, mouse
ggatggaaaataagcccctg

SEQ ID NO: 440847 - DNA, 20 bp, mouse
gcctgacaggacataaatag

SEQ ID NO: 440848 - DNA, 20 bp, mouse
gttgctagtctcttccctga

SEQ ID NO: 440849 - DNA, 20 bp, mouse
gttgggagggtgcggttgta

SEQ ID NO: 440850 - DNA, 20 bp, mouse
gctatagtcacaaaagtaga

SEQ ID NO: 440851 - DNA, 20 bp, mouse
gacccccgcgaatgcagtgt

SEQ ID NO: 440852 - DNA, 20 bp, mouse
gcacagatggatggacaaaa

SEQ ID NO: 440853 - DNA, 20 bp, mouse
ggatggatggacaaaacggt

SEQ ID NO: 440854 - DNA, 20 bp, mouse
gcgtagaacttaattagcaa

SEQ ID NO: 440855 - DNA, 20 bp, mouse
gttgagcagctcctcctgac

SEQ ID NO: 440856 - DNA, 20 bp, mouse
gccgcagccacggtatcctg

SEQ ID NO: 440857 - DNA, 20 bp, mouse
gtccacgccgcaggataccg

SEQ ID NO: 440858 - DNA, 20 bp, mouse
gcgtggctgcggctcaccca

SEQ ID NO: 440859 - DNA, 20 bp, mouse
gccgggaaaggtaagttctg

SEQ ID NO: 440860 - DNA, 20 bp, mouse
ggcgcgggagctcactccct

SEQ ID NO: 440861 - DNA, 20 bp, mouse
gtcccagggacactgagtgg

SEQ ID NO: 440862 - DNA, 20 bp, mouse
gtcctgcggcgtggagctcc

SEQ ID NO: 440863 - DNA, 20 bp, mouse
ggagctgcgggacagcaagt

SEQ ID NO: 440864 - DNA, 20 bp, mouse
gtgagtggaggaacccgggg

SEQ ID NO: 440865 - DNA, 20 bp, mouse
gccgggccctgcgccctcct

SEQ ID NO: 440866 - DNA, 20 bp, mouse
gacgcagtcgcgggaggaca

SEQ ID NO: 440867 - DNA, 20 bp, mouse
gcagggatgcagtgtagatg

SEQ ID NO: 440868 - DNA, 20 bp, mouse
gggatgcagtgtagatgcgg

SEQ ID NO: 440869 - DNA, 20 bp, mouse
gaaacgtggaaatggctcac

SEQ ID NO: 440870 - DNA, 20 bp, mouse
gtgctgcaggacgcagtcgc

SEQ ID NO: 440871 - DNA, 20 bp, mouse
gtctagtggagaccacagga

SEQ ID NO: 440872 - DNA, 20 bp, mouse
ggacctctcgggacagttgg

SEQ ID NO: 440873 - DNA, 20 bp, mouse
ggggccaacctgacttctag

SEQ ID NO: 440874 - DNA, 20 bp, mouse
gaggggttgagagtctatgt

SEQ ID NO: 440875 - DNA, 20 bp, mouse
gggagccagcccacaaggag

SEQ ID NO: 440876 - DNA, 20 bp, mouse
gctggctgcgagggccgagg

SEQ ID NO: 440877 - DNA, 20 bp, mouse
gaactgaccaggcacagacg

SEQ ID NO: 440878 - DNA, 20 bp, mouse
ggctaggcctgaccatggaa

SEQ ID NO: 440879 - DNA, 20 bp, mouse
ggaccaggcacagacgcggc

SEQ ID NO: 440880 - DNA, 20 bp, mouse
ggcctcggggctggctgcga

SEQ ID NO: 440881 - DNA, 20 bp, mouse
gctaaagggcctgggacggg

SEQ ID NO: 440882 - DNA, 20 bp, mouse
gcacctaaagggcctgggac

SEQ ID NO: 440883 - DNA, 20 bp, mouse
gagtcgctggcgctcggctg

SEQ ID NO: 440884 - DNA, 20 bp, mouse
gctgcggctgccccgcctcg

SEQ ID NO: 440885 - DNA, 20 bp, mouse
ggccccgctgcacagagccg

SEQ ID NO: 440886 - DNA, 20 bp, mouse
gtagagccagggagggaccg

SEQ ID NO: 440887 - DNA, 20 bp, mouse
gtgccgaagaggaagctctg

SEQ ID NO: 440888 - DNA, 20 bp, mouse
gagaggcaggaagtctttgc

SEQ ID NO: 440889 - DNA, 20 bp, mouse
ggcagactaatgctgtaggg

SEQ ID NO: 440890 - DNA, 20 bp, mouse
gcgggtggaagtagcatcgg

SEQ ID NO: 440891 - DNA, 20 bp, mouse
ggcagtagaaattagagcca

SEQ ID NO: 440892 - DNA, 20 bp, mouse
gctgccatggcccgggagaa

SEQ ID NO: 440893 - DNA, 20 bp, mouse
gcagcgggtggaagtagcat

SEQ ID NO: 440894 - DNA, 20 bp, mouse
gcgagggttgcgctggggaa

SEQ ID NO: 440895 - DNA, 20 bp, mouse
gtcggtggcggcagcagcgt

SEQ ID NO: 440896 - DNA, 20 bp, mouse
gacccaggggctcacaagaa

SEQ ID NO: 440897 - DNA, 20 bp, mouse
gaacaggctgtcttacccag

SEQ ID NO: 440898 - DNA, 20 bp, mouse
ggctggccaagatcacagac

SEQ ID NO: 440899 - DNA, 20 bp, mouse
gccccaggaagcacctacta

SEQ ID NO: 440900 - DNA, 20 bp, mouse
gagctgtatgaggccctagt

SEQ ID NO: 440901 - DNA, 20 bp, mouse
gctggctcttgtagtctcaa

SEQ ID NO: 440902 - DNA, 20 bp, mouse
gctcacagacctgtaggagc

SEQ ID NO: 440903 - DNA, 20 bp, mouse
gtagacgagttaggtcccag

SEQ ID NO: 440904 - DNA, 20 bp, mouse
ggtttattgttaaagcactg

SEQ ID NO: 440905 - DNA, 20 bp, mouse
gtctcaagggtaagttgtaa

SEQ ID NO: 440906 - DNA, 20 bp, mouse
ggcgctgcccccagaactag

SEQ ID NO: 440907 - DNA, 20 bp, mouse
gctgagtgcaaacggagaac

SEQ ID NO: 440908 - DNA, 20 bp, mouse
ggagtggcccctagttctgg

SEQ ID NO: 440909 - DNA, 20 bp, mouse
gtgcactcaggagcacgggc

SEQ ID NO: 440910 - DNA, 20 bp, mouse
gaggagcacgggcaggcgag

SEQ ID NO: 440911 - DNA, 20 bp, mouse
gagggagtcctagagagcat

SEQ ID NO: 440912 - DNA, 20 bp, mouse
gccaagctcgtcagtcaagc

SEQ ID NO: 440913 - DNA, 20 bp, mouse
gccgtgctcctgagtgcaaa

SEQ ID NO: 440914 - DNA, 20 bp, mouse
ggaaagtgagtcacacctca

SEQ ID NO: 440915 - DNA, 20 bp, mouse
gcatggggatcagtctcctt

SEQ ID NO: 440916 - DNA, 20 bp, mouse
gaaacgggtgcaggtcaccg

SEQ ID NO: 440917 - DNA, 20 bp, mouse
gcccagaacccaaggcacgg

SEQ ID NO: 440918 - DNA, 20 bp, mouse
gggcagggccgtaagcactg

SEQ ID NO: 440919 - DNA, 20 bp, mouse
gagagaggagcggcacccgg

SEQ ID NO: 440920 - DNA, 20 bp, mouse
gcgtgcgctcggctgcgctc

SEQ ID NO: 440921 - DNA, 20 bp, mouse
gtggcggtggcgatcgggct

SEQ ID NO: 440922 - DNA, 20 bp, mouse
gtcgtatagctggtactcgt

SEQ ID NO: 440923 - DNA, 20 bp, mouse
ggcgggcgcgggagacacct

SEQ ID NO: 440924 - DNA, 20 bp, mouse
gctcccgctcgcgggcacgg

SEQ ID NO: 440925 - DNA, 20 bp, mouse
gagggccgtaagcactgcgg

SEQ ID NO: 440926 - DNA, 20 bp, mouse
gtgcggccccgtggagagga

SEQ ID NO: 440927 - DNA, 20 bp, mouse
gtcgttccagcgggcagagg

SEQ ID NO: 440928 - DNA, 20 bp, mouse
ggccttgcggccccgtggag

SEQ ID NO: 440929 - DNA, 20 bp, mouse
gccgcgctccctcctctcca

SEQ ID NO: 440930 - DNA, 20 bp, mouse
ggcaaggctgggaacccgcg

SEQ ID NO: 440931 - DNA, 20 bp, mouse
gacccagccggtcgttccag

SEQ ID NO: 440932 - DNA, 20 bp, mouse
gcggtcgttccagcgggcag

SEQ ID NO: 440933 - DNA, 20 bp, mouse
gtcccagccttgcggccccg

SEQ ID NO: 440934 - DNA, 20 bp, mouse
gctcaacgcagcgcccggag

SEQ ID NO: 440935 - DNA, 20 bp, mouse
ggggccgagggctcccgaag

SEQ ID NO: 440936 - DNA, 20 bp, mouse
gggtgactgtgcaccgacgt

SEQ ID NO: 440937 - DNA, 20 bp, mouse
gtactggcgggcggacgcgg

SEQ ID NO: 440938 - DNA, 20 bp, mouse
ggcggtggtggccatactgg

SEQ ID NO: 440939 - DNA, 20 bp, mouse
ggtgcagcccgcgccgacgt

SEQ ID NO: 440940 - DNA, 20 bp, mouse
gccatactggcgggcggacg

SEQ ID NO: 440941 - DNA, 20 bp, mouse
gctgctgcagggcgcggagg

SEQ ID NO: 440942 - DNA, 20 bp, mouse
gtcctcttgctccctcggcc

SEQ ID NO: 440943 - DNA, 20 bp, mouse
ggcgccccggagcagtcccg

SEQ ID NO: 440944 - DNA, 20 bp, mouse
ggcgcggcggccccccaccc

SEQ ID NO: 440945 - DNA, 20 bp, mouse
gcgccgggacgcctggacca

SEQ ID NO: 440946 - DNA, 20 bp, mouse
gcagagggaggcagggacga

SEQ ID NO: 440947 - DNA, 20 bp, mouse
gatagagggtcggagaagga

SEQ ID NO: 440948 - DNA, 20 bp, mouse
gctagggagaatgccagccc

SEQ ID NO: 440949 - DNA, 20 bp, mouse
gagaaaccgagagggcgacg

SEQ ID NO: 440950 - DNA, 20 bp, mouse
gaaagcgaggcgccagagga

SEQ ID NO: 440951 - DNA, 20 bp, mouse
gagggagggaagaaaccgag

SEQ ID NO: 440952 - DNA, 20 bp, mouse
gagcagcctgcgagctgcta

SEQ ID NO: 440953 - DNA, 20 bp, mouse
gtgtcggaggtgctgcccta

SEQ ID NO: 440954 - DNA, 20 bp, mouse
ggcgtccgggggctccgagg

SEQ ID NO: 440955 - DNA, 20 bp, mouse
ggagggcgcgggaccgaggt

SEQ ID NO: 440956 - DNA, 20 bp, mouse
gcgggctagggactgcggcg

SEQ ID NO: 440957 - DNA, 20 bp, mouse
gagggactgcggcggggcac

SEQ ID NO: 440958 - DNA, 20 bp, mouse
gccgggcgggctagggactg

SEQ ID NO: 440959 - DNA, 20 bp, mouse
ggacatggcgggcaccgggc

SEQ ID NO: 440960 - DNA, 20 bp, mouse
gcagaggctagctgccggac

SEQ ID NO: 440961 - DNA, 20 bp, mouse
gtgtccgagatcctacccta

SEQ ID NO: 440962 - DNA, 20 bp, mouse
gagatcggccgagccaagag

SEQ ID NO: 440963 - DNA, 20 bp, mouse
gacgggcagaggctagctgc

SEQ ID NO: 440964 - DNA, 20 bp, mouse
ggcgggcaccgggcgggcta

SEQ ID NO: 440965 - DNA, 20 bp, mouse
gttgccagcgaagaaggagt

SEQ ID NO: 440966 - DNA, 20 bp, mouse
ggcggctcgagctccggcag

SEQ ID NO: 440967 - DNA, 20 bp, mouse
gcggccggcggctcgagctc

SEQ ID NO: 440968 - DNA, 20 bp, mouse
gaccgaggagcagggcgagg

SEQ ID NO: 440969 - DNA, 20 bp, mouse
gagtcagagctgggacggta

SEQ ID NO: 440970 - DNA, 20 bp, mouse
gtagctgcgacacctcccga

SEQ ID NO: 440971 - DNA, 20 bp, mouse
gggcgtcttccggagtcccg

SEQ ID NO: 440972 - DNA, 20 bp, mouse
ggcaacacgggagcgagagg

SEQ ID NO: 440973 - DNA, 20 bp, mouse
gcatcttcgccgcgggactc

SEQ ID NO: 440974 - DNA, 20 bp, mouse
gcctgcaacacgggagcgag

SEQ ID NO: 440975 - DNA, 20 bp, mouse
gtggcggtgaccgaggagca

SEQ ID NO: 440976 - DNA, 20 bp, mouse
gtacaaggccgggtctacgt

SEQ ID NO: 440977 - DNA, 20 bp, mouse
gcacctggcgacagtctctg

SEQ ID NO: 440978 - DNA, 20 bp, mouse
ggatcctagcccggcaaggc

SEQ ID NO: 440979 - DNA, 20 bp, mouse
gcggctgctgacccctacct

SEQ ID NO: 440980 - DNA, 20 bp, mouse
ggagccgggcgatcctagcc

SEQ ID NO: 440981 - DNA, 20 bp, mouse
gtggcgacagtctctgcggt

SEQ ID NO: 440982 - DNA, 20 bp, mouse
ggggcgatcctagcccggca

SEQ ID NO: 440983 - DNA, 20 bp, mouse
gtgtagaagggtggtctaca

SEQ ID NO: 440984 - DNA, 20 bp, mouse
gcagccaacgggctgtagaa

SEQ ID NO: 440985 - DNA, 20 bp, mouse
gtagcccggcaaggcgggca

SEQ ID NO: 440986 - DNA, 20 bp, mouse
gccaatcagcaaggagcccg

SEQ ID NO: 440987 - DNA, 20 bp, mouse
gagggacgcaacctccccgt

SEQ ID NO: 440988 - DNA, 20 bp, mouse
ggcccgggcggctcctcccg

SEQ ID NO: 440989 - DNA, 20 bp, mouse
ggtccggttcggctctccac

SEQ ID NO: 440990 - DNA, 20 bp, mouse
gtccacgggaggagccgccc

SEQ ID NO: 440991 - DNA, 20 bp, mouse
gctcccgtggagagccgaac

SEQ ID NO: 440992 - DNA, 20 bp, mouse
gcaggtgagctggcccgagg

SEQ ID NO: 440993 - DNA, 20 bp, mouse
ggacccaaagacccacgggg

SEQ ID NO: 440994 - DNA, 20 bp, mouse
gcccagaggcgggccccgag

SEQ ID NO: 440995 - DNA, 20 bp, mouse
gtccgggacccaaagaccca

SEQ ID NO: 440996 - DNA, 20 bp, mouse
gcagagctgactggacccgg

SEQ ID NO: 440997 - DNA, 20 bp, mouse
gtcctgactggggagagccg

SEQ ID NO: 440998 - DNA, 20 bp, mouse
gtgactggggagagccgtgg

SEQ ID NO: 440999 - DNA, 20 bp, mouse
ggtcctgacagggaagaagt

SEQ ID NO: 441000 - DNA, 20 bp, mouse
gagttggcaggtcctgactg

SEQ ID NO: 441001 - DNA, 20 bp, mouse
gctccagagctgactggacc

SEQ ID NO: 441002 - DNA, 20 bp, mouse
gccggaggttgcgtccgcca

SEQ ID NO: 441003 - DNA, 20 bp, mouse
gcagcttctgcgacaggtaa

SEQ ID NO: 441004 - DNA, 20 bp, mouse
gggcgtcacaggtcctgaca

SEQ ID NO: 441005 - DNA, 20 bp, mouse
ggagatggagtcgcaggtcg

SEQ ID NO: 441006 - DNA, 20 bp, mouse
gggaggttctggagtcgaag

SEQ ID NO: 441007 - DNA, 20 bp, mouse
ggagcgactggcgatgctgg

SEQ ID NO: 441008 - DNA, 20 bp, mouse
gaatccgctccgggcacgcg

SEQ ID NO: 441009 - DNA, 20 bp, mouse
gctgccccgcgtgcccggag

SEQ ID NO: 441010 - DNA, 20 bp, mouse
gatcaccgcgaggactctgg

SEQ ID NO: 441011 - DNA, 20 bp, mouse
gcggcgggcagaatccgctc

SEQ ID NO: 441012 - DNA, 20 bp, mouse
gtccgctgccagagagcgac

SEQ ID NO: 441013 - DNA, 20 bp, mouse
gtgcaggtgcggagcaggga

SEQ ID NO: 441014 - DNA, 20 bp, mouse
gcgcggggattctctaacca

SEQ ID NO: 441015 - DNA, 20 bp, mouse
gagagagcgactggcgatgc

SEQ ID NO: 441016 - DNA, 20 bp, mouse
gtagatcaggctgacggtaa

SEQ ID NO: 441017 - DNA, 20 bp, mouse
gcggctccatgctttctcta

SEQ ID NO: 441018 - DNA, 20 bp, mouse
gcggtgcctgcggccacgga

SEQ ID NO: 441019 - DNA, 20 bp, mouse
gtaaaggcaaggatgactta

SEQ ID NO: 441020 - DNA, 20 bp, mouse
ggagcactgcgagccaactt

SEQ ID NO: 441021 - DNA, 20 bp, mouse
gccaaggagcagagacgcgt

SEQ ID NO: 441022 - DNA, 20 bp, mouse
ggctttcacaggcccgggag

SEQ ID NO: 441023 - DNA, 20 bp, mouse
gcaggctgacggtaaaggca

SEQ ID NO: 441024 - DNA, 20 bp, mouse
gcagctgtgaggtaacctgg

SEQ ID NO: 441025 - DNA, 20 bp, mouse
gacaggcccgggagcggctc

SEQ ID NO: 441026 - DNA, 20 bp, mouse
gaccgccacagccacaggga

SEQ ID NO: 441027 - DNA, 20 bp, mouse
gtagtgaccgccacagccac

SEQ ID NO: 441028 - DNA, 20 bp, mouse
gtcctgagccccaaggggtg

SEQ ID NO: 441029 - DNA, 20 bp, mouse
gcagggaggggacgtccctc

SEQ ID NO: 441030 - DNA, 20 bp, mouse
gggaaccatgcagttccaga

SEQ ID NO: 441031 - DNA, 20 bp, mouse
gggcctggaggaggcagtct

SEQ ID NO: 441032 - DNA, 20 bp, mouse
gacgtccctctggaactgca

SEQ ID NO: 441033 - DNA, 20 bp, mouse
gcgtcccctccctgtggctg

SEQ ID NO: 441034 - DNA, 20 bp, mouse
gaggatccaggtccaggaga

SEQ ID NO: 441035 - DNA, 20 bp, mouse
ggccacagcaagtatcccaa

SEQ ID NO: 441036 - DNA, 20 bp, mouse
gggcaagcgccggccgagga

SEQ ID NO: 441037 - DNA, 20 bp, mouse
gggcggcggccgtgaagtaa

SEQ ID NO: 441038 - DNA, 20 bp, mouse
gcggtgcgagcacgggccgg

SEQ ID NO: 441039 - DNA, 20 bp, mouse
gtgcgagcacgggccggggg

SEQ ID NO: 441040 - DNA, 20 bp, mouse
gccgctggaccgctacgacg

SEQ ID NO: 441041 - DNA, 20 bp, mouse
gcggtccagcggcaccaggt

SEQ ID NO: 441042 - DNA, 20 bp, mouse
ggcctgccccgcgccttcct

SEQ ID NO: 441043 - DNA, 20 bp, mouse
gcgccggccgaggaaggcgc

SEQ ID NO: 441044 - DNA, 20 bp, mouse
gtgccgccgaaggctggagg

SEQ ID NO: 441045 - DNA, 20 bp, mouse
ggcgcacggcccttacttca

SEQ ID NO: 441046 - DNA, 20 bp, mouse
gaggcgtccggccacgggag

SEQ ID NO: 441047 - DNA, 20 bp, mouse
gcggaaaaccgcagcgacgg

SEQ ID NO: 441048 - DNA, 20 bp, mouse
ggagagggcccggaatgctc

SEQ ID NO: 441049 - DNA, 20 bp, mouse
gagccggaaaaccgcagcga

SEQ ID NO: 441050 - DNA, 20 bp, mouse
gttccggctgcggcactgga

SEQ ID NO: 441051 - DNA, 20 bp, mouse
gtacgaggacaagcccgata

SEQ ID NO: 441052 - DNA, 20 bp, mouse
gcagctcagggccaaggcag

SEQ ID NO: 441053 - DNA, 20 bp, mouse
gagcctggacgatcacgtcg

SEQ ID NO: 441054 - DNA, 20 bp, mouse
gggagcgaggcgtccggcca

SEQ ID NO: 441055 - DNA, 20 bp, mouse
ggcacgccccgcctcactca

SEQ ID NO: 441056 - DNA, 20 bp, mouse
ggcggcaacccgattcgggg

SEQ ID NO: 441057 - DNA, 20 bp, mouse
ggcctccgccaccccgaatc

SEQ ID NO: 441058 - DNA, 20 bp, mouse
ggcggcggcaacccgattcg

SEQ ID NO: 441059 - DNA, 20 bp, mouse
gttagtaacagcagcagccg

SEQ ID NO: 441060 - DNA, 20 bp, mouse
gggcgccgctgaaccaggtg

SEQ ID NO: 441061 - DNA, 20 bp, mouse
gtcgaccgcacctggttcag

SEQ ID NO: 441062 - DNA, 20 bp, mouse
gttctctcgagccaaggcgg

SEQ ID NO: 441063 - DNA, 20 bp, mouse
gcgcagggtccgggccactg

SEQ ID NO: 441064 - DNA, 20 bp, mouse
gggctcgagagaaatcgtac

SEQ ID NO: 441065 - DNA, 20 bp, mouse
gcgggtccgcgcgctctgat

SEQ ID NO: 441066 - DNA, 20 bp, mouse
gcggggtcccggtcgcgagg

SEQ ID NO: 441067 - DNA, 20 bp, mouse
gggtcccggtcgcgaggagg

SEQ ID NO: 441068 - DNA, 20 bp, mouse
gaggcgcgcgctcggggtcc

SEQ ID NO: 441069 - DNA, 20 bp, mouse
ggggccgcgccggacatccc

SEQ ID NO: 441070 - DNA, 20 bp, mouse
gtcctcctcctcctcgcgac

SEQ ID NO: 441071 - DNA, 20 bp, mouse
gcggtacgaggcgcgcgctc

SEQ ID NO: 441072 - DNA, 20 bp, mouse
gggagcgcggccgagtcctg

SEQ ID NO: 441073 - DNA, 20 bp, mouse
ggtggcgcgcggaggggaaa

SEQ ID NO: 441074 - DNA, 20 bp, mouse
gccggcccgcgagtcacctc

SEQ ID NO: 441075 - DNA, 20 bp, mouse
ggccccgggccctcacgctc

SEQ ID NO: 441076 - DNA, 20 bp, mouse
gtgtcagccggcgctagggg

SEQ ID NO: 441077 - DNA, 20 bp, mouse
gccccgggaggtaagagcca

SEQ ID NO: 441078 - DNA, 20 bp, mouse
gccgtcacccgcgggacccc

SEQ ID NO: 441079 - DNA, 20 bp, mouse
gtcacccgcgggaccccggg

SEQ ID NO: 441080 - DNA, 20 bp, mouse
gcttacctcccggggtcccg

SEQ ID NO: 441081 - DNA, 20 bp, mouse
gtaggcgcagggccccttca

SEQ ID NO: 441082 - DNA, 20 bp, mouse
gccgctgccgccgtcacccg

SEQ ID NO: 441083 - DNA, 20 bp, mouse
gggccctggctcttacctcc

SEQ ID NO: 441084 - DNA, 20 bp, mouse
ggaggagaaccgggatccgg

SEQ ID NO: 441085 - DNA, 20 bp, mouse
gccgctgtcagccggcgcta

SEQ ID NO: 441086 - DNA, 20 bp, mouse
ggagcgagtgcggagggagt

SEQ ID NO: 441087 - DNA, 20 bp, mouse
gccctagggagcgagtgcgg

SEQ ID NO: 441088 - DNA, 20 bp, mouse
gtcatgggcggcgggacgga

SEQ ID NO: 441089 - DNA, 20 bp, mouse
gttgccctagggagcgagtg

SEQ ID NO: 441090 - DNA, 20 bp, mouse
gcggcccgaacgcaagtgtc

SEQ ID NO: 441091 - DNA, 20 bp, mouse
gggggcgccgagctcatggg

SEQ ID NO: 441092 - DNA, 20 bp, mouse
ggctttggcctcttgcccta

SEQ ID NO: 441093 - DNA, 20 bp, mouse
gaggccgagagtgagtgacg

SEQ ID NO: 441094 - DNA, 20 bp, mouse
gcccgccctcctagcgaagg

SEQ ID NO: 441095 - DNA, 20 bp, mouse
ggcccccgccctcctagcga

SEQ ID NO: 441096 - DNA, 20 bp, mouse
ggcgcagccagcatgagtac

SEQ ID NO: 441097 - DNA, 20 bp, mouse
gagcaggctggagatgtaga

SEQ ID NO: 441098 - DNA, 20 bp, mouse
ggattcgacccgcaaccccg

SEQ ID NO: 441099 - DNA, 20 bp, mouse
gctggagatgtagaaggcac

SEQ ID NO: 441100 - DNA, 20 bp, mouse
gaaggcaccggtactcatgc

SEQ ID NO: 441101 - DNA, 20 bp, mouse
gagagaccgggcagaagtgt

SEQ ID NO: 441102 - DNA, 20 bp, mouse
ggcccaggcgaagaggccgg

SEQ ID NO: 441103 - DNA, 20 bp, mouse
gcgagtcccgagcccccaca

SEQ ID NO: 441104 - DNA, 20 bp, mouse
gcgggtcgaatcgaatatgg

SEQ ID NO: 441105 - DNA, 20 bp, mouse
gcaaaggcgggaagaggctg

SEQ ID NO: 441106 - DNA, 20 bp, mouse
gacctgcgtagggccggaca

SEQ ID NO: 441107 - DNA, 20 bp, mouse
ggccctcagtgggtgagtga

SEQ ID NO: 441108 - DNA, 20 bp, mouse
gccggccctacgcaggtagg

SEQ ID NO: 441109 - DNA, 20 bp, mouse
gcccagaacacagcgaggga

SEQ ID NO: 441110 - DNA, 20 bp, mouse
ggctgccgcctacctgcgta

SEQ ID NO: 441111 - DNA, 20 bp, mouse
gaccgtcactcacccactga

SEQ ID NO: 441112 - DNA, 20 bp, mouse
ggccctgtccggccctacgc

SEQ ID NO: 441113 - DNA, 20 bp, mouse
gcccactgagggcctggctc

SEQ ID NO: 441114 - DNA, 20 bp, mouse
gggtctcccacacaagccag

SEQ ID NO: 441115 - DNA, 20 bp, mouse
gaggccccagaacacagcga

SEQ ID NO: 441116 - DNA, 20 bp, mouse
gcgtgctgcagtggagacag

SEQ ID NO: 441117 - DNA, 20 bp, mouse
gccgaggcctcttagttctg

SEQ ID NO: 441118 - DNA, 20 bp, mouse
gcacgtgccgcagaactaag

SEQ ID NO: 441119 - DNA, 20 bp, mouse
gtctgcggcacgtgacggtc

SEQ ID NO: 441120 - DNA, 20 bp, mouse
gaactaagaggcctcggcta

SEQ ID NO: 441121 - DNA, 20 bp, mouse
gcgcgcggcggccgtagccg

SEQ ID NO: 441122 - DNA, 20 bp, mouse
gtgtaggctcgacgactgag

SEQ ID NO: 441123 - DNA, 20 bp, mouse
gcgaatggcgcaggcctggg

SEQ ID NO: 441124 - DNA, 20 bp, mouse
ggagagcggccgggttagag

SEQ ID NO: 441125 - DNA, 20 bp, mouse
gggtcgggcgggctttcgaa

SEQ ID NO: 441126 - DNA, 20 bp, mouse
gtcgcagtccggaggtgagg

SEQ ID NO: 441127 - DNA, 20 bp, mouse
gtcttgccggaagtggagag

SEQ ID NO: 441128 - DNA, 20 bp, mouse
gtgatcgcagtccggaggtg

SEQ ID NO: 441129 - DNA, 20 bp, mouse
ggcggctgatcgcagtccgg

SEQ ID NO: 441130 - DNA, 20 bp, mouse
ggaactcttaaggtgagggt

SEQ ID NO: 441131 - DNA, 20 bp, mouse
gggcggaactcttaaggtga

SEQ ID NO: 441132 - DNA, 20 bp, mouse
gaggtgaggcggaactctta

SEQ ID NO: 441133 - DNA, 20 bp, mouse
gagagcggctgatcgcagtc

SEQ ID NO: 441134 - DNA, 20 bp, mouse
gtcgcgcgaagaccgctggg

SEQ ID NO: 441135 - DNA, 20 bp, mouse
gccagtgagggcccggaagt

SEQ ID NO: 441136 - DNA, 20 bp, mouse
gtgctgtagagctcaggtcc

SEQ ID NO: 441137 - DNA, 20 bp, mouse
ggccagggcgcggggaagaa

SEQ ID NO: 441138 - DNA, 20 bp, mouse
gagcaggtcaggctggaacg

SEQ ID NO: 441139 - DNA, 20 bp, mouse
gaggtcaggctggaacgcgg

SEQ ID NO: 441140 - DNA, 20 bp, mouse
gagagctcaggtcctggctt

SEQ ID NO: 441141 - DNA, 20 bp, mouse
gtcaggctggaacgcggagg

SEQ ID NO: 441142 - DNA, 20 bp, mouse
gcacccagatgtgaggacaa

SEQ ID NO: 441143 - DNA, 20 bp, mouse
gccatctcccaccctaccag

SEQ ID NO: 441144 - DNA, 20 bp, mouse
gcaccgggcctgcgggagga

SEQ ID NO: 441145 - DNA, 20 bp, mouse
ggctctacagcaggtcaggc

SEQ ID NO: 441146 - DNA, 20 bp, mouse
gcccgtggagaggtaaaact

SEQ ID NO: 441147 - DNA, 20 bp, mouse
gttagaagctagctatcgag

SEQ ID NO: 441148 - DNA, 20 bp, mouse
gggaagggctctgtagagaa

SEQ ID NO: 441149 - DNA, 20 bp, mouse
ggaagaaaaggcccgtggag

SEQ ID NO: 441150 - DNA, 20 bp, mouse
gggcagcccagtggcgaaga

SEQ ID NO: 441151 - DNA, 20 bp, mouse
gtttgagaagaaaaggcccg

SEQ ID NO: 441152 - DNA, 20 bp, mouse
gcagctgcagagtcttgagt

SEQ ID NO: 441153 - DNA, 20 bp, mouse
gctagggtccgggaacaggt

SEQ ID NO: 441154 - DNA, 20 bp, mouse
gaggactctcatgagtgggt

SEQ ID NO: 441155 - DNA, 20 bp, mouse
gggactaggactctcatgag

SEQ ID NO: 441156 - DNA, 20 bp, mouse
ggagattgctgcggtccctg

SEQ ID NO: 441157 - DNA, 20 bp, mouse
gctcagggcagggcccaacc

SEQ ID NO: 441158 - DNA, 20 bp, mouse
ggccggccagagagagggta

SEQ ID NO: 441159 - DNA, 20 bp, mouse
ggcaccgccggccagagaga

SEQ ID NO: 441160 - DNA, 20 bp, mouse
gggagtttgggagattgctg

SEQ ID NO: 441161 - DNA, 20 bp, mouse
ggccctccgggaaggtactg

SEQ ID NO: 441162 - DNA, 20 bp, mouse
gcggagggcgacatagggtg

SEQ ID NO: 441163 - DNA, 20 bp, mouse
gccaggcaggtaggataggg

SEQ ID NO: 441164 - DNA, 20 bp, mouse
gcttccccaggtaagaagtt

SEQ ID NO: 441165 - DNA, 20 bp, mouse
gtggcccagctacagcggac

SEQ ID NO: 441166 - DNA, 20 bp, mouse
gctgcaccagtaggtctccc

SEQ ID NO: 441167 - DNA, 20 bp, mouse
gccgcgcactcgctcccggg

SEQ ID NO: 441168 - DNA, 20 bp, mouse
gagccgggttacctagacaa

SEQ ID NO: 441169 - DNA, 20 bp, mouse
ggggcggcgaccgagtccac

SEQ ID NO: 441170 - DNA, 20 bp, mouse
gcagcgacgtatgctgggaa

SEQ ID NO: 441171 - DNA, 20 bp, mouse
ggaggacagaagcaatcgaa

SEQ ID NO: 441172 - DNA, 20 bp, mouse
gcctcccgaaactgggccag

SEQ ID NO: 441173 - DNA, 20 bp, mouse
gtaaaagagcgaggagtccg

SEQ ID NO: 441174 - DNA, 20 bp, mouse
ggagtccacgggccgcagat

SEQ ID NO: 441175 - DNA, 20 bp, mouse
gaagagcgaggagtccgagg

SEQ ID NO: 441176 - DNA, 20 bp, mouse
gatgctgaactactcaggta

SEQ ID NO: 441177 - DNA, 20 bp, mouse
ggctaggtgctagctgttct

SEQ ID NO: 441178 - DNA, 20 bp, mouse
ggagtagttcagcatcctga

SEQ ID NO: 441179 - DNA, 20 bp, mouse
gcccctgaggcctcagactg

SEQ ID NO: 441180 - DNA, 20 bp, mouse
gaactgtcaaggactgtgct

SEQ ID NO: 441181 - DNA, 20 bp, mouse
gccagacagctatgacggag

SEQ ID NO: 441182 - DNA, 20 bp, mouse
gactcaggtaaggcactcac

SEQ ID NO: 441183 - DNA, 20 bp, mouse
gtgcaggggaatctatagga

SEQ ID NO: 441184 - DNA, 20 bp, mouse
gcaagaaccttcaactgtca

SEQ ID NO: 441185 - DNA, 20 bp, mouse
ggggaatctataggagggac

SEQ ID NO: 441186 - DNA, 20 bp, mouse
gatccagctggtggacgacg

SEQ ID NO: 441187 - DNA, 20 bp, mouse
gagagtgtccgaatggcgag

SEQ ID NO: 441188 - DNA, 20 bp, mouse
gtgtgcccagagtgtccgaa

SEQ ID NO: 441189 - DNA, 20 bp, mouse
gatggcgagtggcaacagga

SEQ ID NO: 441190 - DNA, 20 bp, mouse
gtggacgacggggccgggac

SEQ ID NO: 441191 - DNA, 20 bp, mouse
ggactcagagaaggccaaag

SEQ ID NO: 441192 - DNA, 20 bp, mouse
gccgaatggcgagtggcaac

SEQ ID NO: 441193 - DNA, 20 bp, mouse
gtgggacctgggtctgatgg

SEQ ID NO: 441194 - DNA, 20 bp, mouse
gagaggccccatgtaaagtg

SEQ ID NO: 441195 - DNA, 20 bp, mouse
gtccaggcaagctcttcgga

SEQ ID NO: 441196 - DNA, 20 bp, mouse
gtcctttggagggaatacaa

SEQ ID NO: 441197 - DNA, 20 bp, mouse
gaggcctggagagaggtaga

SEQ ID NO: 441198 - DNA, 20 bp, mouse
gattccctccaaaggaacag

SEQ ID NO: 441199 - DNA, 20 bp, mouse
ggctatgatgcaggattcag

SEQ ID NO: 441200 - DNA, 20 bp, mouse
gtcccttgtattccctccaa

SEQ ID NO: 441201 - DNA, 20 bp, mouse
gggagggaatacaagggaac

SEQ ID NO: 441202 - DNA, 20 bp, mouse
gaggtttctgggaagcacat

SEQ ID NO: 441203 - DNA, 20 bp, mouse
gctctcaggctctggaccga

SEQ ID NO: 441204 - DNA, 20 bp, mouse
ggaggacacaggtgaagtgc

SEQ ID NO: 441205 - DNA, 20 bp, mouse
gaagcacataggttcatgaa

SEQ ID NO: 441206 - DNA, 20 bp, mouse
gggacggcgggcgctagcta

SEQ ID NO: 441207 - DNA, 20 bp, mouse
gccggctgggcgccacgcta

SEQ ID NO: 441208 - DNA, 20 bp, mouse
gagcgtaaggcgtagcgggt

SEQ ID NO: 441209 - DNA, 20 bp, mouse
gcggcgggcgctagctacgg

SEQ ID NO: 441210 - DNA, 20 bp, mouse
ggaagcagcgtaaggcgtag

SEQ ID NO: 441211 - DNA, 20 bp, mouse
gacgctacggaagcagcgta

SEQ ID NO: 441212 - DNA, 20 bp, mouse
gaggcgccgccggctcgcta

SEQ ID NO: 441213 - DNA, 20 bp, mouse
gttcgaccggagggcaccaa

SEQ ID NO: 441214 - DNA, 20 bp, mouse
gcctagtgccggccctcagt

SEQ ID NO: 441215 - DNA, 20 bp, mouse
gggtaggccgggcgggacgg

SEQ ID NO: 441216 - DNA, 20 bp, mouse
gtgctgcggggatgattcac

SEQ ID NO: 441217 - DNA, 20 bp, mouse
gggagaaaggggtcgcggag

SEQ ID NO: 441218 - DNA, 20 bp, mouse
ggcgcactgcacggagaaag

SEQ ID NO: 441219 - DNA, 20 bp, mouse
gccaggactacgagacgctg

SEQ ID NO: 441220 - DNA, 20 bp, mouse
gcggcccaggcgcttcccgc

SEQ ID NO: 441221 - DNA, 20 bp, mouse
gtgcggggatgattcaccgg

SEQ ID NO: 441222 - DNA, 20 bp, mouse
gcccgaccgtgaggactacg

SEQ ID NO: 441223 - DNA, 20 bp, mouse
gaatggaagcggcccacggt

SEQ ID NO: 441224 - DNA, 20 bp, mouse
gggggcacggcactcggctg

SEQ ID NO: 441225 - DNA, 20 bp, mouse
ggggcgctgcagcggactgc

SEQ ID NO: 441226 - DNA, 20 bp, mouse
gagacgcagtttctacctag

SEQ ID NO: 441227 - DNA, 20 bp, mouse
gtcagcagcgcacttgccag

SEQ ID NO: 441228 - DNA, 20 bp, mouse
gctggaggtggacacccaag

SEQ ID NO: 441229 - DNA, 20 bp, mouse
gagagcgataggttttcctg

SEQ ID NO: 441230 - DNA, 20 bp, mouse
gcactctcttcttctccctc

SEQ ID NO: 441231 - DNA, 20 bp, mouse
gactgtggccccaaggacgg

SEQ ID NO: 441232 - DNA, 20 bp, mouse
gactatgaccctagagcgat

SEQ ID NO: 441233 - DNA, 20 bp, mouse
gttcagctaccttcaaggaa

SEQ ID NO: 441234 - DNA, 20 bp, mouse
ggctcaaggcaagaccaccg

SEQ ID NO: 441235 - DNA, 20 bp, mouse
gcatggcaggcaactttgga

SEQ ID NO: 441236 - DNA, 20 bp, mouse
gctgcggggagatgataccc

SEQ ID NO: 441237 - DNA, 20 bp, mouse
gcccggcagcccgcaggcgg

SEQ ID NO: 441238 - DNA, 20 bp, mouse
gcgggacagactgaagcccg

SEQ ID NO: 441239 - DNA, 20 bp, mouse
gcatctccccgcagagtccc

SEQ ID NO: 441240 - DNA, 20 bp, mouse
ggggatgcagagcacagtgc

SEQ ID NO: 441241 - DNA, 20 bp, mouse
gccagcccgcgccacagcct

SEQ ID NO: 441242 - DNA, 20 bp, mouse
gtaccccggcagcccgcagg

SEQ ID NO: 441243 - DNA, 20 bp, mouse
gggagcacgaatccgagcag

SEQ ID NO: 441244 - DNA, 20 bp, mouse
ggtgctcccaaggcacgcac

SEQ ID NO: 441245 - DNA, 20 bp, mouse
gggttggaacttggaccccc

SEQ ID NO: 441246 - DNA, 20 bp, mouse
gtggccgaacagacttagtg

SEQ ID NO: 441247 - DNA, 20 bp, mouse
gcagacttagtggggttacc

SEQ ID NO: 441248 - DNA, 20 bp, mouse
ggacgaaccctaacattaat

SEQ ID NO: 441249 - DNA, 20 bp, mouse
gtaaccccactaagtctgtt

SEQ ID NO: 441250 - DNA, 20 bp, mouse
gagggttcctgagctaactc

SEQ ID NO: 441251 - DNA, 20 bp, mouse
gtccttggatgcagagtgat

SEQ ID NO: 441252 - DNA, 20 bp, mouse
gaccaagctctgctcacagg

SEQ ID NO: 441253 - DNA, 20 bp, mouse
gaagctctgctcacaggggg

SEQ ID NO: 441254 - DNA, 20 bp, mouse
gcttaacctggaaactattt

SEQ ID NO: 441255 - DNA, 20 bp, mouse
gaaatgagttggaatctggg

SEQ ID NO: 441256 - DNA, 20 bp, mouse
gagggcggcggaagagatga

SEQ ID NO: 441257 - DNA, 20 bp, mouse
ggagctcgcagtcctccggg

SEQ ID NO: 441258 - DNA, 20 bp, mouse
gtcggagctcgcagtcctcc

SEQ ID NO: 441259 - DNA, 20 bp, mouse
gctacctcagacccgcccgg

SEQ ID NO: 441260 - DNA, 20 bp, mouse
ggggcgggtctgaggtagtg

SEQ ID NO: 441261 - DNA, 20 bp, mouse
gcacgaaggccgctactctg

SEQ ID NO: 441262 - DNA, 20 bp, mouse
gagtcctccgggcgggtctg

SEQ ID NO: 441263 - DNA, 20 bp, mouse
gggcggagcaaggacgcgag

SEQ ID NO: 441264 - DNA, 20 bp, mouse
gtgcgagctccgagcagccc

SEQ ID NO: 441265 - DNA, 20 bp, mouse
ggccagccgcgcgaactgca

SEQ ID NO: 441266 - DNA, 20 bp, mouse
gtgtcacctacaggacgcac

SEQ ID NO: 441267 - DNA, 20 bp, mouse
gaggcaggccatggcagccc

SEQ ID NO: 441268 - DNA, 20 bp, mouse
ggcctgcctgtgcgtcctgt

SEQ ID NO: 441269 - DNA, 20 bp, mouse
gtaaagggcagcatccccat

SEQ ID NO: 441270 - DNA, 20 bp, mouse
gcaggctctgcagaaactca

SEQ ID NO: 441271 - DNA, 20 bp, mouse
gacctacaggacgcacaggc

SEQ ID NO: 441272 - DNA, 20 bp, mouse
gatggaagcgacccacggta

SEQ ID NO: 441273 - DNA, 20 bp, mouse
ggctacagggatcttggacc

SEQ ID NO: 441274 - DNA, 20 bp, mouse
ggacccacggtaaggcaata

SEQ ID NO: 441275 - DNA, 20 bp, mouse
gctgtaggtgacaggaaagc

SEQ ID NO: 441276 - DNA, 20 bp, mouse
gtcagggaccgatgcaggta

SEQ ID NO: 441277 - DNA, 20 bp, mouse
ggatagtcctggcatccccg

SEQ ID NO: 441278 - DNA, 20 bp, mouse
gggcctctcgctgtagaaca

SEQ ID NO: 441279 - DNA, 20 bp, mouse
gtggcctcagggaccgatgc

SEQ ID NO: 441280 - DNA, 20 bp, mouse
gtccacacaaaggggacctg

SEQ ID NO: 441281 - DNA, 20 bp, mouse
gggctgtggctgtggcctca

SEQ ID NO: 441282 - DNA, 20 bp, mouse
gggtgtggccagatacactg

SEQ ID NO: 441283 - DNA, 20 bp, mouse
gcagccacagccagtccccg

SEQ ID NO: 441284 - DNA, 20 bp, mouse
gaaacggccaggggtgagta

SEQ ID NO: 441285 - DNA, 20 bp, mouse
gcagcttccccgcagcttag

SEQ ID NO: 441286 - DNA, 20 bp, mouse
gcagcaggcgagcaagaccg

SEQ ID NO: 441287 - DNA, 20 bp, mouse
gcctcccgaaccggacacag

SEQ ID NO: 441288 - DNA, 20 bp, mouse
gcccgaaccggacacagcgg

SEQ ID NO: 441289 - DNA, 20 bp, mouse
gccggatctacagggtgcag

SEQ ID NO: 441290 - DNA, 20 bp, mouse
ggtctcacttacggatccgg

SEQ ID NO: 441291 - DNA, 20 bp, mouse
ggagcaagaccgcggaccgc

SEQ ID NO: 441292 - DNA, 20 bp, mouse
gcggtcctaggaccccccaa

SEQ ID NO: 441293 - DNA, 20 bp, mouse
gcccgtctcacttacggatc

SEQ ID NO: 441294 - DNA, 20 bp, mouse
gacagcggaggccctgcagc

SEQ ID NO: 441295 - DNA, 20 bp, mouse
ggagtgtcccgtctcactta

SEQ ID NO: 441296 - DNA, 20 bp, mouse
ggtgcactactctgactctg

SEQ ID NO: 441297 - DNA, 20 bp, mouse
gcctggaaggtgcagatcgg

SEQ ID NO: 441298 - DNA, 20 bp, mouse
ggtcaggcaagagcaggcgg

SEQ ID NO: 441299 - DNA, 20 bp, mouse
ggtgacagctgctgcaatcc

SEQ ID NO: 441300 - DNA, 20 bp, mouse
gtcgcaaaggcgatcctgga

SEQ ID NO: 441301 - DNA, 20 bp, mouse
ggtcacacctgctcgctaac

SEQ ID NO: 441302 - DNA, 20 bp, mouse
gcagctggctggacccgaca

SEQ ID NO: 441303 - DNA, 20 bp, mouse
gcaggcgggggcaacatcgg

SEQ ID NO: 441304 - DNA, 20 bp, mouse
gctggctggacccgacatgg

SEQ ID NO: 441305 - DNA, 20 bp, mouse
ggagcaggcgggggcaacat

SEQ ID NO: 441306 - DNA, 20 bp, mouse
gagaccagcaagtcaggaga

SEQ ID NO: 441307 - DNA, 20 bp, mouse
ggcaagtcaggagacggacg

SEQ ID NO: 441308 - DNA, 20 bp, mouse
gcactcccggaggaaccgga

SEQ ID NO: 441309 - DNA, 20 bp, mouse
ggacggacggggagagacgc

SEQ ID NO: 441310 - DNA, 20 bp, mouse
ggccgctggacgtctggagt

SEQ ID NO: 441311 - DNA, 20 bp, mouse
gatctttagaccgagaagag

SEQ ID NO: 441312 - DNA, 20 bp, mouse
gtcccggaggaaccggacgg

SEQ ID NO: 441313 - DNA, 20 bp, mouse
gcagggccaggggtggagaa

SEQ ID NO: 441314 - DNA, 20 bp, mouse
gccaccagccacagcggaag

SEQ ID NO: 441315 - DNA, 20 bp, mouse
gggttcctccgggagtgagg

SEQ ID NO: 441316 - DNA, 20 bp, mouse
gtgggcgcgagcagcggagt

SEQ ID NO: 441317 - DNA, 20 bp, mouse
gctgggtgcactgtcggcgg

SEQ ID NO: 441318 - DNA, 20 bp, mouse
ggccttgagggggacagctt

SEQ ID NO: 441319 - DNA, 20 bp, mouse
gagttgcgcgcgccttgagg

SEQ ID NO: 441320 - DNA, 20 bp, mouse
gagttggctgggtgcactgt

SEQ ID NO: 441321 - DNA, 20 bp, mouse
gacagcttgggcgcgagcag

SEQ ID NO: 441322 - DNA, 20 bp, mouse
gagtagaggagccccagtca

SEQ ID NO: 441323 - DNA, 20 bp, mouse
ggcccaagctgtccccctca

SEQ ID NO: 441324 - DNA, 20 bp, mouse
ggcgagcagcggagttggct

SEQ ID NO: 441325 - DNA, 20 bp, mouse
gaggcgcgcgcaacttatgt

SEQ ID NO: 441326 - DNA, 20 bp, mouse
ggaagttggagagggccagg

SEQ ID NO: 441327 - DNA, 20 bp, mouse
gagtacagattcgggcccag

SEQ ID NO: 441328 - DNA, 20 bp, mouse
ggcctagcaaccagagactc

SEQ ID NO: 441329 - DNA, 20 bp, mouse
gacagattcgggcccagagg

SEQ ID NO: 441330 - DNA, 20 bp, mouse
gactagcagacaaacccacc

SEQ ID NO: 441331 - DNA, 20 bp, mouse
gctggaagctgtataaacca

SEQ ID NO: 441332 - DNA, 20 bp, mouse
ggtgtttgtccagactgtag

SEQ ID NO: 441333 - DNA, 20 bp, mouse
ggttgctaggcaactggagt

SEQ ID NO: 441334 - DNA, 20 bp, mouse
gccaagggtaagctttcaga

SEQ ID NO: 441335 - DNA, 20 bp, mouse
gattactggggaagttggag

SEQ ID NO: 441336 - DNA, 20 bp, mouse
ggagggagacacaggaccat

SEQ ID NO: 441337 - DNA, 20 bp, mouse
gggaggagactagagtcccc

SEQ ID NO: 441338 - DNA, 20 bp, mouse
gcaaaggaagacaggtaaga

SEQ ID NO: 441339 - DNA, 20 bp, mouse
ggtagccgcaggctgcttca

SEQ ID NO: 441340 - DNA, 20 bp, mouse
gtgcactgagagtctaggga

SEQ ID NO: 441341 - DNA, 20 bp, mouse
gctgcttcacggtgaaactc

SEQ ID NO: 441342 - DNA, 20 bp, mouse
gactctggacttctggccct

SEQ ID NO: 441343 - DNA, 20 bp, mouse
gaagagcacagctggtcccc

SEQ ID NO: 441344 - DNA, 20 bp, mouse
ggtctagggatggcttcgtc

SEQ ID NO: 441345 - DNA, 20 bp, mouse
gtttgtgcactgagagtcta

SEQ ID NO: 441346 - DNA, 20 bp, mouse
gaactggctggagatctgga

SEQ ID NO: 441347 - DNA, 20 bp, mouse
gagcgcggtggccgactgag

SEQ ID NO: 441348 - DNA, 20 bp, mouse
gtcctgggccgccgagtcca

SEQ ID NO: 441349 - DNA, 20 bp, mouse
gtctgtctaggctgagtcct

SEQ ID NO: 441350 - DNA, 20 bp, mouse
ggggaatcctgggatagtgg

SEQ ID NO: 441351 - DNA, 20 bp, mouse
gacccggagtcgggaatcct

SEQ ID NO: 441352 - DNA, 20 bp, mouse
ggatctccagccagttcccc

SEQ ID NO: 441353 - DNA, 20 bp, mouse
ggtcgggaatcctgggatag

SEQ ID NO: 441354 - DNA, 20 bp, mouse
gggccgggaaggaagctgag

SEQ ID NO: 441355 - DNA, 20 bp, mouse
ggactaggtagcccctcagt

SEQ ID NO: 441356 - DNA, 20 bp, mouse
gtccttctggcgacagaccg

SEQ ID NO: 441357 - DNA, 20 bp, mouse
gcgacagaccgtggcgctgg

SEQ ID NO: 441358 - DNA, 20 bp, mouse
ggaggagcagttgtccgatg

SEQ ID NO: 441359 - DNA, 20 bp, mouse
ggcacctaccttctcctcat

SEQ ID NO: 441360 - DNA, 20 bp, mouse
gagaaggaagatggcggatc

SEQ ID NO: 441361 - DNA, 20 bp, mouse
ggcacacaccctacaaggag

SEQ ID NO: 441362 - DNA, 20 bp, mouse
gcagttgtccgatgaggaga

SEQ ID NO: 441363 - DNA, 20 bp, mouse
gcaccctacaaggagcggag

SEQ ID NO: 441364 - DNA, 20 bp, mouse
ggcccggctcctcaccgccg

SEQ ID NO: 441365 - DNA, 20 bp, mouse
ggagaaggtaggtgccgcgg

SEQ ID NO: 441366 - DNA, 20 bp, mouse
gtatgctggtctatgaagaa

SEQ ID NO: 441367 - DNA, 20 bp, mouse
gaatgagtaacaccttgaat

SEQ ID NO: 441368 - DNA, 20 bp, mouse
gtgaaatgaagggtgctcac

SEQ ID NO: 441369 - DNA, 20 bp, mouse
gcgctgagtgacatggccag

SEQ ID NO: 441370 - DNA, 20 bp, mouse
ggggtgagaaaacggtccat

SEQ ID NO: 441371 - DNA, 20 bp, mouse
ggggataccttgcccattca

SEQ ID NO: 441372 - DNA, 20 bp, mouse
gagcagacagagatcgtcaa

SEQ ID NO: 441373 - DNA, 20 bp, mouse
ggcctgcgcactcaccctga

SEQ ID NO: 441374 - DNA, 20 bp, mouse
ggtaacaccttgaatgggca

SEQ ID NO: 441375 - DNA, 20 bp, mouse
gcacattgtggtgagacagg

SEQ ID NO: 441376 - DNA, 20 bp, mouse
ggcggcgacggtccctgtcc

SEQ ID NO: 441377 - DNA, 20 bp, mouse
gagccacagacgccgggaca

SEQ ID NO: 441378 - DNA, 20 bp, mouse
ggtccctgtcccggcgtctg

SEQ ID NO: 441379 - DNA, 20 bp, mouse
gccactccggacccgaagag

SEQ ID NO: 441380 - DNA, 20 bp, mouse
gacttgcagggagaagaact

SEQ ID NO: 441381 - DNA, 20 bp, mouse
ggttcactcttgggcacccg

SEQ ID NO: 441382 - DNA, 20 bp, mouse
ggcccggcccgggaagggtg

SEQ ID NO: 441383 - DNA, 20 bp, mouse
ggacccgcccggcccgggaa

SEQ ID NO: 441384 - DNA, 20 bp, mouse
ggggggagagccacagacgc

SEQ ID NO: 441385 - DNA, 20 bp, mouse
gccggggaagtggaagcgca

SEQ ID NO: 441386 - DNA, 20 bp, mouse
ggaaaatggcaagtgcagac

SEQ ID NO: 441387 - DNA, 20 bp, mouse
gtttattcatatctgttaaa

SEQ ID NO: 441388 - DNA, 20 bp, mouse
gggggatatggaagcgaaaa

SEQ ID NO: 441389 - DNA, 20 bp, mouse
gcatgaagcatgctgtgaaa

SEQ ID NO: 441390 - DNA, 20 bp, mouse
ggaagcatgctgtgaaatgg

SEQ ID NO: 441391 - DNA, 20 bp, mouse
gatgcttcatgtcaagtatc

SEQ ID NO: 441392 - DNA, 20 bp, mouse
gcaacctaaataagagaaaa

SEQ ID NO: 441393 - DNA, 20 bp, mouse
gcaagtgcagactggggata

SEQ ID NO: 441394 - DNA, 20 bp, mouse
gagatcttaagtgacaccat

SEQ ID NO: 441395 - DNA, 20 bp, mouse
gttgccattttctcttattt

SEQ ID NO: 441396 - DNA, 20 bp, mouse
ggagcagggagggtcaacgg

SEQ ID NO: 441397 - DNA, 20 bp, mouse
gatggaccccgggatactct

SEQ ID NO: 441398 - DNA, 20 bp, mouse
ggctgaccgagagtatcccg

SEQ ID NO: 441399 - DNA, 20 bp, mouse
gggaaggcgtcgggatccgt

SEQ ID NO: 441400 - DNA, 20 bp, mouse
ggagcaggagagggacgaaa

SEQ ID NO: 441401 - DNA, 20 bp, mouse
gctctaagtccgggtaccag

SEQ ID NO: 441402 - DNA, 20 bp, mouse
gcaacggacactctaagtcc

SEQ ID NO: 441403 - DNA, 20 bp, mouse
gcgcgcgcgccggcttgctg

SEQ ID NO: 441404 - DNA, 20 bp, mouse
gaccatgccccggtgaaggg

SEQ ID NO: 441405 - DNA, 20 bp, mouse
gggagggcggcgaggacata

SEQ ID NO: 441406 - DNA, 20 bp, mouse
gcccagaagggaggccctat

SEQ ID NO: 441407 - DNA, 20 bp, mouse
gcgttcaccaggccccagaa

SEQ ID NO: 441408 - DNA, 20 bp, mouse
gggagcagttatgagctcct

SEQ ID NO: 441409 - DNA, 20 bp, mouse
ggccctatgggaacagaaat

SEQ ID NO: 441410 - DNA, 20 bp, mouse
gcggtgctgagtctgagcgg

SEQ ID NO: 441411 - DNA, 20 bp, mouse
gccttttaaagatgggaaca

SEQ ID NO: 441412 - DNA, 20 bp, mouse
gcctgtgcgctgtggggaag

SEQ ID NO: 441413 - DNA, 20 bp, mouse
gcccacagcgcacaggctcc

SEQ ID NO: 441414 - DNA, 20 bp, mouse
gagctgaaggaagaaaacga

SEQ ID NO: 441415 - DNA, 20 bp, mouse
ggcttcagctccacatccac

SEQ ID NO: 441416 - DNA, 20 bp, mouse
gtggcaccgagagggacccg

SEQ ID NO: 441417 - DNA, 20 bp, mouse
gctggttgagagcgaagaag

SEQ ID NO: 441418 - DNA, 20 bp, mouse
ggcgaagaaggggtgtgcat

SEQ ID NO: 441419 - DNA, 20 bp, mouse
ggccggccccgggtccctct

SEQ ID NO: 441420 - DNA, 20 bp, mouse
gctggaagtcccaagaggag

SEQ ID NO: 441421 - DNA, 20 bp, mouse
ggggcgatcgcagcttcggg

SEQ ID NO: 441422 - DNA, 20 bp, mouse
ggtgtgcattggcaccgaga

SEQ ID NO: 441423 - DNA, 20 bp, mouse
gccaggctggaagtcccaag

SEQ ID NO: 441424 - DNA, 20 bp, mouse
gctctgggccgcactgggag

SEQ ID NO: 441425 - DNA, 20 bp, mouse
gatcctctgagggagggaca

SEQ ID NO: 441426 - DNA, 20 bp, mouse
ggggcgctcggagctggcag

SEQ ID NO: 441427 - DNA, 20 bp, mouse
gccactcactcggagctgtg

SEQ ID NO: 441428 - DNA, 20 bp, mouse
gcacagtgtgcacttagcct

SEQ ID NO: 441429 - DNA, 20 bp, mouse
gtagactcgtggctgcctgt

SEQ ID NO: 441430 - DNA, 20 bp, mouse
gacgtgcacgtcttggtccc

SEQ ID NO: 441431 - DNA, 20 bp, mouse
gtgtgcactgagccatgcct

SEQ ID NO: 441432 - DNA, 20 bp, mouse
gcgttggttgtgtagactcg

SEQ ID NO: 441433 - DNA, 20 bp, mouse
ggcattaaaaagcagcctac

SEQ ID NO: 441434 - DNA, 20 bp, mouse
gacaaccaacgtgcacgtct

SEQ ID NO: 441435 - DNA, 20 bp, mouse
gcttaaggatcaccaacagg

SEQ ID NO: 441436 - DNA, 20 bp, mouse
gggctctccatcgaggacca

SEQ ID NO: 441437 - DNA, 20 bp, mouse
gtccatcgaggaccatggcg

SEQ ID NO: 441438 - DNA, 20 bp, mouse
gtgccacaggctctccatcg

SEQ ID NO: 441439 - DNA, 20 bp, mouse
ggtcctcgatggagagcctg

SEQ ID NO: 441440 - DNA, 20 bp, mouse
ggggggtacggcgagcacaa

SEQ ID NO: 441441 - DNA, 20 bp, mouse
gctctctccagagtggacgg

SEQ ID NO: 441442 - DNA, 20 bp, mouse
gtccacagtgtccctgccac

SEQ ID NO: 441443 - DNA, 20 bp, mouse
ggagcgcgggcttccagagg

SEQ ID NO: 441444 - DNA, 20 bp, mouse
ggtctctgaaaggatgggta

SEQ ID NO: 441445 - DNA, 20 bp, mouse
gacactgtggacctgtggca

SEQ ID NO: 441446 - DNA, 20 bp, mouse
ggagattacgaagggacata

SEQ ID NO: 441447 - DNA, 20 bp, mouse
gtacgaagggacatacggag

SEQ ID NO: 441448 - DNA, 20 bp, mouse
ggaagttgctggccagtaag

SEQ ID NO: 441449 - DNA, 20 bp, mouse
ggtggtgtggagattacgaa

SEQ ID NO: 441450 - DNA, 20 bp, mouse
gtgctggccagtaagtggtg

SEQ ID NO: 441451 - DNA, 20 bp, mouse
ggagccaccttaaaagcggg

SEQ ID NO: 441452 - DNA, 20 bp, mouse
gggatcctggctgcagatgg

SEQ ID NO: 441453 - DNA, 20 bp, mouse
gtaatctccacaccacttac

SEQ ID NO: 441454 - DNA, 20 bp, mouse
gctgtctctgcagacttcca

SEQ ID NO: 441455 - DNA, 20 bp, mouse
ggccatgtgtacttatgtgg

SEQ ID NO: 441456 - DNA, 20 bp, mouse
gactccggagaactgcaaag

SEQ ID NO: 441457 - DNA, 20 bp, mouse
gatgctgcagtggctgactc

SEQ ID NO: 441458 - DNA, 20 bp, mouse
gtacagccaggctacttaga

SEQ ID NO: 441459 - DNA, 20 bp, mouse
gggaggagacgcactgacaa

SEQ ID NO: 441460 - DNA, 20 bp, mouse
ggagaactgcaaagtggatg

SEQ ID NO: 441461 - DNA, 20 bp, mouse
gaaggctgctctgcattcat

SEQ ID NO: 441462 - DNA, 20 bp, mouse
gcggcacaggtggactccag

SEQ ID NO: 441463 - DNA, 20 bp, mouse
gggatgaggaatgtacagcc

SEQ ID NO: 441464 - DNA, 20 bp, mouse
gtcattggtaggtgaactag

SEQ ID NO: 441465 - DNA, 20 bp, mouse
gggtaggtgaactagaggtc

SEQ ID NO: 441466 - DNA, 20 bp, mouse
gacactgcaggaccgctaga

SEQ ID NO: 441467 - DNA, 20 bp, mouse
gtctgctctgccccaatcac

SEQ ID NO: 441468 - DNA, 20 bp, mouse
ggtgcttgctgtatccccag

SEQ ID NO: 441469 - DNA, 20 bp, mouse
gatggtcacgccggtgattg

SEQ ID NO: 441470 - DNA, 20 bp, mouse
gttgctgtatccccagtggt

SEQ ID NO: 441471 - DNA, 20 bp, mouse
gtgaccatgtcccaccactg

SEQ ID NO: 441472 - DNA, 20 bp, mouse
gtatccccagtggtgggaca

SEQ ID NO: 441473 - DNA, 20 bp, mouse
gcgccagggacgtaccagag

SEQ ID NO: 441474 - DNA, 20 bp, mouse
gacgtaccagagcggagacc

SEQ ID NO: 441475 - DNA, 20 bp, mouse
ggaagttgtcgtccgtctag

SEQ ID NO: 441476 - DNA, 20 bp, mouse
gcagcgctgagaaacacgaa

SEQ ID NO: 441477 - DNA, 20 bp, mouse
gtagccccactccttagcca

SEQ ID NO: 441478 - DNA, 20 bp, mouse
gaacaggagcaagaaagagc

SEQ ID NO: 441479 - DNA, 20 bp, mouse
gtgaccatggctaaggagtg

SEQ ID NO: 441480 - DNA, 20 bp, mouse
ggaaacacgaaaggtgacca

SEQ ID NO: 441481 - DNA, 20 bp, mouse
gcgaaaggtgaccatggcta

SEQ ID NO: 441482 - DNA, 20 bp, mouse
gtgagcttcaggttcctccg

SEQ ID NO: 441483 - DNA, 20 bp, mouse
gctggccccactcaccattg

SEQ ID NO: 441484 - DNA, 20 bp, mouse
gccggaccccaagctcaaag

SEQ ID NO: 441485 - DNA, 20 bp, mouse
ggaactcttggagaccttgc

SEQ ID NO: 441486 - DNA, 20 bp, mouse
gtggtgattgaccctaggct

SEQ ID NO: 441487 - DNA, 20 bp, mouse
ggagctgcatggtgcttgag

SEQ ID NO: 441488 - DNA, 20 bp, mouse
ggaaagacgctgcccagcct

SEQ ID NO: 441489 - DNA, 20 bp, mouse
gatgatcgcgacgcctaggg

SEQ ID NO: 441490 - DNA, 20 bp, mouse
gtcaccaatgaagccaccct

SEQ ID NO: 441491 - DNA, 20 bp, mouse
ggcctcccgcggacacgtgt

SEQ ID NO: 441492 - DNA, 20 bp, mouse
gacgcctagggtggcttcat

SEQ ID NO: 441493 - DNA, 20 bp, mouse
gagcatgatcgcgacgccta

SEQ ID NO: 441494 - DNA, 20 bp, mouse
ggacctggttgtgtgagcgg

SEQ ID NO: 441495 - DNA, 20 bp, mouse
gggcaaacccaggagaacca

SEQ ID NO: 441496 - DNA, 20 bp, mouse
gtcagggccacctcagagtt

SEQ ID NO: 441497 - DNA, 20 bp, mouse
gccaaagcaagggcatacag

SEQ ID NO: 441498 - DNA, 20 bp, mouse
gagagatgcacctaactctg

SEQ ID NO: 441499 - DNA, 20 bp, mouse
gcttggctctgagcagcacg

SEQ ID NO: 441500 - DNA, 20 bp, mouse
ggatgcacctaactctgagg

SEQ ID NO: 441501 - DNA, 20 bp, mouse
gtctgagcagcacggggtag

SEQ ID NO: 441502 - DNA, 20 bp, mouse
gcccaggtgagatttaatgg

SEQ ID NO: 441503 - DNA, 20 bp, mouse
gggtggccctgaccaaagca

SEQ ID NO: 441504 - DNA, 20 bp, mouse
ggatggctaagggcttgcgg

SEQ ID NO: 441505 - DNA, 20 bp, mouse
ggaggtattgcaaataacta

SEQ ID NO: 441506 - DNA, 20 bp, mouse
gtgggaagctaacttgccag

SEQ ID NO: 441507 - DNA, 20 bp, mouse
ggagcggagtgggaacctca

SEQ ID NO: 441508 - DNA, 20 bp, mouse
ggtcaggcccgctggaactg

SEQ ID NO: 441509 - DNA, 20 bp, mouse
ggcttcccaggaccagctac

SEQ ID NO: 441510 - DNA, 20 bp, mouse
gttaagtgctgttggagaaa

SEQ ID NO: 441511 - DNA, 20 bp, mouse
gagtagccagtagctggtcc

SEQ ID NO: 441512 - DNA, 20 bp, mouse
ggaggagcagtcccttgtga

SEQ ID NO: 441513 - DNA, 20 bp, mouse
gagcacttaacaagtgccac

SEQ ID NO: 441514 - DNA, 20 bp, mouse
gaggcaacatgccctcacaa

SEQ ID NO: 441515 - DNA, 20 bp, mouse
gtagtagagaaagggggcta

SEQ ID NO: 441516 - DNA, 20 bp, mouse
gtggatgcccaggaagaaca

SEQ ID NO: 441517 - DNA, 20 bp, mouse
gacgctcaccagggccctca

SEQ ID NO: 441518 - DNA, 20 bp, mouse
gagggacaccacgctcacca

SEQ ID NO: 441519 - DNA, 20 bp, mouse
ggctacagcatctgccatga

SEQ ID NO: 441520 - DNA, 20 bp, mouse
ggcatctgccatgagggccc

SEQ ID NO: 441521 - DNA, 20 bp, mouse
ggtagccctgaatgcaggac

SEQ ID NO: 441522 - DNA, 20 bp, mouse
gagcaggtggaccccgacag

SEQ ID NO: 441523 - DNA, 20 bp, mouse
gtgaatgcaggacaggttct

SEQ ID NO: 441524 - DNA, 20 bp, mouse
gtgaatagctccaatcactg

SEQ ID NO: 441525 - DNA, 20 bp, mouse
ggtggtgtccctgttcttcc

SEQ ID NO: 441526 - DNA, 20 bp, mouse
gagcttggtgaactatgaga

SEQ ID NO: 441527 - DNA, 20 bp, mouse
gagctcaggggcttcaagga

SEQ ID NO: 441528 - DNA, 20 bp, mouse
gcccatcgacgtgaagacgg

SEQ ID NO: 441529 - DNA, 20 bp, mouse
gaactatgagaaggagaacc

SEQ ID NO: 441530 - DNA, 20 bp, mouse
gatcgacgtgaagacggagg

SEQ ID NO: 441531 - DNA, 20 bp, mouse
gagttcactatgactaacaa

SEQ ID NO: 441532 - DNA, 20 bp, mouse
gaccaagctcaggggcttca

SEQ ID NO: 441533 - DNA, 20 bp, mouse
gacgctaggcaaccccgggg

SEQ ID NO: 441534 - DNA, 20 bp, mouse
gtgactaacaacggacacac

SEQ ID NO: 441535 - DNA, 20 bp, mouse
ggtatagccagccctccccg

SEQ ID NO: 441536 - DNA, 20 bp, mouse
gacagagcgagcggacagaa

SEQ ID NO: 441537 - DNA, 20 bp, mouse
ggagccgcagacagagcgag

SEQ ID NO: 441538 - DNA, 20 bp, mouse
gctggccgtagccccaacag

SEQ ID NO: 441539 - DNA, 20 bp, mouse
gacaagagagaggtccgggt

SEQ ID NO: 441540 - DNA, 20 bp, mouse
gcgagcggacagaacggagc

SEQ ID NO: 441541 - DNA, 20 bp, mouse
gttaagaggctgctccaccg

SEQ ID NO: 441542 - DNA, 20 bp, mouse
gtgtccgctcgctctgtctg

SEQ ID NO: 441543 - DNA, 20 bp, mouse
ggccgtagccccaacagtgg

SEQ ID NO: 441544 - DNA, 20 bp, mouse
gctgtctgcggctccggcta

SEQ ID NO: 441545 - DNA, 20 bp, mouse
gccagctgggtgagaaccag

SEQ ID NO: 441546 - DNA, 20 bp, mouse
gcactcaggcagccacggag

SEQ ID NO: 441547 - DNA, 20 bp, mouse
gtgcgacacgggtgcgggag

SEQ ID NO: 441548 - DNA, 20 bp, mouse
gtgaagctcaggtcagccat

SEQ ID NO: 441549 - DNA, 20 bp, mouse
gcatgggcagctctgcgaca

SEQ ID NO: 441550 - DNA, 20 bp, mouse
ggggactgccacgctcagtg

SEQ ID NO: 441551 - DNA, 20 bp, mouse
gagcgcgagaggcagcggtc

SEQ ID NO: 441552 - DNA, 20 bp, mouse
gcagccacggaggggcaagt

SEQ ID NO: 441553 - DNA, 20 bp, mouse
gcagtccccgcgagcgcgag

SEQ ID NO: 441554 - DNA, 20 bp, mouse
ggcaggtgcgaacagcactc

SEQ ID NO: 441555 - DNA, 20 bp, mouse
gagctctgcgacacgggtgc

SEQ ID NO: 441556 - DNA, 20 bp, mouse
gagctgtgcagtaggggctg

SEQ ID NO: 441557 - DNA, 20 bp, mouse
gtaggggctggggtcgacaa

SEQ ID NO: 441558 - DNA, 20 bp, mouse
gggaggccatgcagctgact

SEQ ID NO: 441559 - DNA, 20 bp, mouse
gggtgtcccaggacacactg

SEQ ID NO: 441560 - DNA, 20 bp, mouse
gcccaggacacactgtggac

SEQ ID NO: 441561 - DNA, 20 bp, mouse
ggaggcggatccacccgatg

SEQ ID NO: 441562 - DNA, 20 bp, mouse
gcagcagcagctgtgcagta

SEQ ID NO: 441563 - DNA, 20 bp, mouse
gcagctgactggggtgtccc

SEQ ID NO: 441564 - DNA, 20 bp, mouse
ggacaccccagtcagctgca

SEQ ID NO: 441565 - DNA, 20 bp, mouse
gcaggtgcatcctcttcact

SEQ ID NO: 441566 - DNA, 20 bp, mouse
ggagccatcttcagccccgg

SEQ ID NO: 441567 - DNA, 20 bp, mouse
gctgccgccggggctgaaga

SEQ ID NO: 441568 - DNA, 20 bp, mouse
ggagtcagctgtactgcgtg

SEQ ID NO: 441569 - DNA, 20 bp, mouse
gggacctgggcaggaatacc

SEQ ID NO: 441570 - DNA, 20 bp, mouse
gagctgtactgcgtggggag

SEQ ID NO: 441571 - DNA, 20 bp, mouse
gccagagccatcttcagccc

SEQ ID NO: 441572 - DNA, 20 bp, mouse
gacagctgactctgccgccg

SEQ ID NO: 441573 - DNA, 20 bp, mouse
gggtgctcacgctcacgtgt

SEQ ID NO: 441574 - DNA, 20 bp, mouse
gtagatgcaactgcaaggcc

SEQ ID NO: 441575 - DNA, 20 bp, mouse
ggcaccacgtggatctagag

SEQ ID NO: 441576 - DNA, 20 bp, mouse
ggcacagagccgggagctca

SEQ ID NO: 441577 - DNA, 20 bp, mouse
gtcctccccgcactcaccac

SEQ ID NO: 441578 - DNA, 20 bp, mouse
gtgcgggcgacaagcacggt

SEQ ID NO: 441579 - DNA, 20 bp, mouse
ggcggagccaatgaccccga

SEQ ID NO: 441580 - DNA, 20 bp, mouse
gcgtcggccgagcacagagc

SEQ ID NO: 441581 - DNA, 20 bp, mouse
ggcagcgcccgtggtgagtg

SEQ ID NO: 441582 - DNA, 20 bp, mouse
gacgggcgggacagcagcgt

SEQ ID NO: 441583 - DNA, 20 bp, mouse
gcgcgggcgacgcccaggtg

SEQ ID NO: 441584 - DNA, 20 bp, mouse
ggcccgtggtgagtgcgggg

SEQ ID NO: 441585 - DNA, 20 bp, mouse
gagcagcgtggggacgtgaa

SEQ ID NO: 441586 - DNA, 20 bp, mouse
ggatcagaaaactcaagggg

SEQ ID NO: 441587 - DNA, 20 bp, mouse
gctggcgcctcgcatcccta

SEQ ID NO: 441588 - DNA, 20 bp, mouse
gggtgacccgtagggatgcg

SEQ ID NO: 441589 - DNA, 20 bp, mouse
gtgtgctgtagggacagcag

SEQ ID NO: 441590 - DNA, 20 bp, mouse
gctgggccttggtgacccgt

SEQ ID NO: 441591 - DNA, 20 bp, mouse
ggcccggccgcacctacctg

SEQ ID NO: 441592 - DNA, 20 bp, mouse
gtgaggctgccaccctccct

SEQ ID NO: 441593 - DNA, 20 bp, mouse
ggggtcaccaaggcccaggg

SEQ ID NO: 441594 - DNA, 20 bp, mouse
gtgtggagcatgagcacccc

SEQ ID NO: 441595 - DNA, 20 bp, mouse
gcttagggaaggtagcatgg

SEQ ID NO: 441596 - DNA, 20 bp, mouse
gctgtagcagtgatggtcgg

SEQ ID NO: 441597 - DNA, 20 bp, mouse
gctgggctgtacagcaagtg

SEQ ID NO: 441598 - DNA, 20 bp, mouse
gggaggctcagtcttaggct

SEQ ID NO: 441599 - DNA, 20 bp, mouse
gtggtcggaggctcagtctt

SEQ ID NO: 441600 - DNA, 20 bp, mouse
ggtcctgtagcagtgatggt

SEQ ID NO: 441601 - DNA, 20 bp, mouse
gaagtgaggagcaggtttga

SEQ ID NO: 441602 - DNA, 20 bp, mouse
gtcctgtcctgtagcagtga

SEQ ID NO: 441603 - DNA, 20 bp, mouse
gcagggtcccagctgttctg

SEQ ID NO: 441604 - DNA, 20 bp, mouse
gtcatctgggatcttcccac

SEQ ID NO: 441605 - DNA, 20 bp, mouse
gagccagaggggctgacggg

SEQ ID NO: 441606 - DNA, 20 bp, mouse
gactccagccagctacaagg

SEQ ID NO: 441607 - DNA, 20 bp, mouse
gcagactccagccagctaca

SEQ ID NO: 441608 - DNA, 20 bp, mouse
ggtgtgacctgtcgggacaa

SEQ ID NO: 441609 - DNA, 20 bp, mouse
ggtctgtaggctgccatccc

SEQ ID NO: 441610 - DNA, 20 bp, mouse
gtgagctcgtgtgacctgtc

SEQ ID NO: 441611 - DNA, 20 bp, mouse
gcggtttgcaccggccagat

SEQ ID NO: 441612 - DNA, 20 bp, mouse
gcctctggtgagtaacttgc

SEQ ID NO: 441613 - DNA, 20 bp, mouse
ggagtctggtgtctccaatc

SEQ ID NO: 441614 - DNA, 20 bp, mouse
gtgcccagagctgcttcttc

SEQ ID NO: 441615 - DNA, 20 bp, mouse
gttcggggcctccttgtagc

SEQ ID NO: 441616 - DNA, 20 bp, mouse
gcaacagagagtacaaacac

SEQ ID NO: 441617 - DNA, 20 bp, mouse
gaaatacctgttgttggaga

SEQ ID NO: 441618 - DNA, 20 bp, mouse
gaatctatgttaacaaagaa

SEQ ID NO: 441619 - DNA, 20 bp, mouse
gcacagaccgagagtgctcc

SEQ ID NO: 441620 - DNA, 20 bp, mouse
ggatagagtccggatcttgt

SEQ ID NO: 441621 - DNA, 20 bp, mouse
gctttgccctctccaacaac

SEQ ID NO: 441622 - DNA, 20 bp, mouse
gagtcagcccggagcactct

SEQ ID NO: 441623 - DNA, 20 bp, mouse
gcgtcaaaaatacctgttgt

SEQ ID NO: 441624 - DNA, 20 bp, mouse
gccactgtggacgctgactc

SEQ ID NO: 441625 - DNA, 20 bp, mouse
gtcagaaatcaggctccgag

SEQ ID NO: 441626 - DNA, 20 bp, mouse
ggggttccctaactggagaa

SEQ ID NO: 441627 - DNA, 20 bp, mouse
gtctgggttatggacatacc

SEQ ID NO: 441628 - DNA, 20 bp, mouse
gttccctaactggagaaggg

SEQ ID NO: 441629 - DNA, 20 bp, mouse
gggagcgcgtaagtacctac

SEQ ID NO: 441630 - DNA, 20 bp, mouse
gtaacccagacagcatctgc

SEQ ID NO: 441631 - DNA, 20 bp, mouse
ggctccacccttctccagtt

SEQ ID NO: 441632 - DNA, 20 bp, mouse
gtgtggaggggttccctaac

SEQ ID NO: 441633 - DNA, 20 bp, mouse
gtagctctcacaagaccctg

SEQ ID NO: 441634 - DNA, 20 bp, mouse
gcagccacatggtccagcac

SEQ ID NO: 441635 - DNA, 20 bp, mouse
ggctcagtccctaaccccag

SEQ ID NO: 441636 - DNA, 20 bp, mouse
gcggcctcggagccaagacg

SEQ ID NO: 441637 - DNA, 20 bp, mouse
ggagtccgccgtaagcagaa

SEQ ID NO: 441638 - DNA, 20 bp, mouse
gcgcattgtgctggtctcca

SEQ ID NO: 441639 - DNA, 20 bp, mouse
gagactactcaacctcgtct

SEQ ID NO: 441640 - DNA, 20 bp, mouse
gctgcgctgcgcctccagga

SEQ ID NO: 441641 - DNA, 20 bp, mouse
ggagccccacaacgcgagag

SEQ ID NO: 441642 - DNA, 20 bp, mouse
gttctcccttctgcttacgg

SEQ ID NO: 441643 - DNA, 20 bp, mouse
gcaacctcgtcttggctccg

SEQ ID NO: 441644 - DNA, 20 bp, mouse
ggtcacctcctgaccctccc

SEQ ID NO: 441645 - DNA, 20 bp, mouse
ggcgcagggacagcgcacag

SEQ ID NO: 441646 - DNA, 20 bp, mouse
gggacgtgtcgccaggtaag

SEQ ID NO: 441647 - DNA, 20 bp, mouse
gaccatcacgcccatcccta

SEQ ID NO: 441648 - DNA, 20 bp, mouse
gggctggtcctgggacccta

SEQ ID NO: 441649 - DNA, 20 bp, mouse
ggaacgagaaggccccacag

SEQ ID NO: 441650 - DNA, 20 bp, mouse
gtggaggtgctggagactcg

SEQ ID NO: 441651 - DNA, 20 bp, mouse
gcgactggagcacgtcccgg

SEQ ID NO: 441652 - DNA, 20 bp, mouse
gtccccaaggggagacgggt

SEQ ID NO: 441653 - DNA, 20 bp, mouse
ggggcgactggagcacgtcc

SEQ ID NO: 441654 - DNA, 20 bp, mouse
gcgactgcaagaaaagatcg

SEQ ID NO: 441655 - DNA, 20 bp, mouse
gaccctagggatgggcgtga

SEQ ID NO: 441656 - DNA, 20 bp, mouse
gggcgcggattgccacacag

SEQ ID NO: 441657 - DNA, 20 bp, mouse
gaggcgtgaacggccatccg

SEQ ID NO: 441658 - DNA, 20 bp, mouse
gtggcaatccgcgcctgcgg

SEQ ID NO: 441659 - DNA, 20 bp, mouse
ggccatgggagtccgctgtg

SEQ ID NO: 441660 - DNA, 20 bp, mouse
gggggaggtaagatcgatcc

SEQ ID NO: 441661 - DNA, 20 bp, mouse
ggaagtgcgctggaccgcca

SEQ ID NO: 441662 - DNA, 20 bp, mouse
ggcagccccacaggcgtgaa

SEQ ID NO: 441663 - DNA, 20 bp, mouse
ggccacacagcggactccca

SEQ ID NO: 441664 - DNA, 20 bp, mouse
ggatcgatccgggcgtcccg

SEQ ID NO: 441665 - DNA, 20 bp, mouse
gtaggcccccaataactcgg

SEQ ID NO: 441666 - DNA, 20 bp, mouse
gcctggagccggacctaaga

SEQ ID NO: 441667 - DNA, 20 bp, mouse
ggcgcccgcctcctcactat

SEQ ID NO: 441668 - DNA, 20 bp, mouse
gccaccgagccggcccgtgg

SEQ ID NO: 441669 - DNA, 20 bp, mouse
gtccctcaggcgccaggagg

SEQ ID NO: 441670 - DNA, 20 bp, mouse
gcgcgtcgccgatagtgagg

SEQ ID NO: 441671 - DNA, 20 bp, mouse
ggccggacctaagatggcag

SEQ ID NO: 441672 - DNA, 20 bp, mouse
ggtgcgcgccggaccagacg

SEQ ID NO: 441673 - DNA, 20 bp, mouse
ggcgagcgcaagcacgacgg

SEQ ID NO: 441674 - DNA, 20 bp, mouse
ggccgctgccatcttaggtc

SEQ ID NO: 441675 - DNA, 20 bp, mouse
ggaccttggagcccgaagag

SEQ ID NO: 441676 - DNA, 20 bp, mouse
gaggctggtgagcagaaaca

SEQ ID NO: 441677 - DNA, 20 bp, mouse
ggcattgctggtgtaaccag

SEQ ID NO: 441678 - DNA, 20 bp, mouse
gcaagggagttctgcactga

SEQ ID NO: 441679 - DNA, 20 bp, mouse
gacctgctgttggcagcaac

SEQ ID NO: 441680 - DNA, 20 bp, mouse
gcaccatcttggaggtagag

SEQ ID NO: 441681 - DNA, 20 bp, mouse
gtggggcagggataagacat

SEQ ID NO: 441682 - DNA, 20 bp, mouse
ggggctccttgaagtcttaa

SEQ ID NO: 441683 - DNA, 20 bp, mouse
gcccgctcatccccactccc

SEQ ID NO: 441684 - DNA, 20 bp, mouse
gggtggtggtggggtgacca

SEQ ID NO: 441685 - DNA, 20 bp, mouse
gccctggctcccatggggca

SEQ ID NO: 441686 - DNA, 20 bp, mouse
gaccctgccaaggacactga

SEQ ID NO: 441687 - DNA, 20 bp, mouse
gctgccaaggacactgaggg

SEQ ID NO: 441688 - DNA, 20 bp, mouse
gaggtggcgcttctggagca

SEQ ID NO: 441689 - DNA, 20 bp, mouse
gggcctggaagaggaggcgc

SEQ ID NO: 441690 - DNA, 20 bp, mouse
ggcctccagggccagcacag

SEQ ID NO: 441691 - DNA, 20 bp, mouse
gaggacactgagggtggcgc

SEQ ID NO: 441692 - DNA, 20 bp, mouse
ggcgctggctcagtgtggcc

SEQ ID NO: 441693 - DNA, 20 bp, mouse
gcagggcgccacctcatgga

SEQ ID NO: 441694 - DNA, 20 bp, mouse
ggcaccactataccctgcca

SEQ ID NO: 441695 - DNA, 20 bp, mouse
gtgagtgtggagcagcgtgg

SEQ ID NO: 441696 - DNA, 20 bp, mouse
gggaggaacctgccatcact

SEQ ID NO: 441697 - DNA, 20 bp, mouse
gcactgggaatcaagacccg

SEQ ID NO: 441698 - DNA, 20 bp, mouse
gagattctggaaggcgtctg

SEQ ID NO: 441699 - DNA, 20 bp, mouse
gcgacagcggtggaacgagt

SEQ ID NO: 441700 - DNA, 20 bp, mouse
gtgggcagcatggtccaagg

SEQ ID NO: 441701 - DNA, 20 bp, mouse
gtcctccgcggagcagggtg

SEQ ID NO: 441702 - DNA, 20 bp, mouse
gaccagccagggctctagag

SEQ ID NO: 441703 - DNA, 20 bp, mouse
ggtacaagcatggcccgagt

SEQ ID NO: 441704 - DNA, 20 bp, mouse
gggttgcatcagattctgga

SEQ ID NO: 441705 - DNA, 20 bp, mouse
gcaaacctcaccctgctccg

SEQ ID NO: 441706 - DNA, 20 bp, mouse
ggcgcgcccgcagcatattg

SEQ ID NO: 441707 - DNA, 20 bp, mouse
ggacagatccagcgaacagg

SEQ ID NO: 441708 - DNA, 20 bp, mouse
gccgagcgggccactatcag

SEQ ID NO: 441709 - DNA, 20 bp, mouse
gggggacagatccagcgaac

SEQ ID NO: 441710 - DNA, 20 bp, mouse
ggcgtgcgccgggagaggca

SEQ ID NO: 441711 - DNA, 20 bp, mouse
gcccggagcagcagagcgcc

SEQ ID NO: 441712 - DNA, 20 bp, mouse
gctggtgcgtgcgccgggag

SEQ ID NO: 441713 - DNA, 20 bp, mouse
ggcggaaggcaagatcctgc

SEQ ID NO: 441714 - DNA, 20 bp, mouse
gggcggagccccatgaggaa

SEQ ID NO: 441715 - DNA, 20 bp, mouse
gacgctcgggagaccacgtc

SEQ ID NO: 441716 - DNA, 20 bp, mouse
gggtagcagtagcagcaggg

SEQ ID NO: 441717 - DNA, 20 bp, mouse
ggcgaggaggtccagaacca

SEQ ID NO: 441718 - DNA, 20 bp, mouse
gtgcggctgctacccctcct

SEQ ID NO: 441719 - DNA, 20 bp, mouse
gcagtgcccgagcagcgagg

SEQ ID NO: 441720 - DNA, 20 bp, mouse
gtcgtgggacgcatcatcca

SEQ ID NO: 441721 - DNA, 20 bp, mouse
gtgcagctcggcgtcctcct

SEQ ID NO: 441722 - DNA, 20 bp, mouse
gaaaggtagcagtagcagca

SEQ ID NO: 441723 - DNA, 20 bp, mouse
ggaggggtagcagccgcagg

SEQ ID NO: 441724 - DNA, 20 bp, mouse
gacgcaaagcaaggaccctg

SEQ ID NO: 441725 - DNA, 20 bp, mouse
gagtccagtgggggaacccg

SEQ ID NO: 441726 - DNA, 20 bp, mouse
gtggtaagccaggaaagtga

SEQ ID NO: 441727 - DNA, 20 bp, mouse
gtgcagagcaggaacgctca

SEQ ID NO: 441728 - DNA, 20 bp, mouse
gggcttaccatgacagaagc

SEQ ID NO: 441729 - DNA, 20 bp, mouse
ggggcagtgcgatccagagg

SEQ ID NO: 441730 - DNA, 20 bp, mouse
gcaggggcagtgcgatccag

SEQ ID NO: 441731 - DNA, 20 bp, mouse
gaagtgggaatgtacatcac

SEQ ID NO: 441732 - DNA, 20 bp, mouse
gaacactgggagttgtgagt

SEQ ID NO: 441733 - DNA, 20 bp, mouse
gaaagttcctgcttctgtca

SEQ ID NO: 441734 - DNA, 20 bp, mouse
gtaatcaagctattaagggt

SEQ ID NO: 441735 - DNA, 20 bp, mouse
gcctgtctccctcactttcc

SEQ ID NO: 441736 - DNA, 20 bp, mouse
gtgcgtaaggagctgaccag

SEQ ID NO: 441737 - DNA, 20 bp, mouse
gcgcgcttcccaggacacgg

SEQ ID NO: 441738 - DNA, 20 bp, mouse
gcagcgcgcttcccaggaca

SEQ ID NO: 441739 - DNA, 20 bp, mouse
gccgccggtccgccatctta

SEQ ID NO: 441740 - DNA, 20 bp, mouse
gtctccgtaagatggcggac

SEQ ID NO: 441741 - DNA, 20 bp, mouse
ggccgttctccgtaagatgg

SEQ ID NO: 441742 - DNA, 20 bp, mouse
gacggaggacgaggaatccg

SEQ ID NO: 441743 - DNA, 20 bp, mouse
ggtggccgttctccgtaaga

SEQ ID NO: 441744 - DNA, 20 bp, mouse
gtgcggcgggtggagagcgg

SEQ ID NO: 441745 - DNA, 20 bp, mouse
gtacggagaacggccaccgc

SEQ ID NO: 441746 - DNA, 20 bp, mouse
gcgctgcccgcaggtgtcgg

SEQ ID NO: 441747 - DNA, 20 bp, mouse
ggagccaccggcctcatggt

SEQ ID NO: 441748 - DNA, 20 bp, mouse
gtccgagagtcgaaggccag

SEQ ID NO: 441749 - DNA, 20 bp, mouse
ggggtcgcgagtaccagcgc

SEQ ID NO: 441750 - DNA, 20 bp, mouse
gggctcccgccgcagggaag

SEQ ID NO: 441751 - DNA, 20 bp, mouse
gcgccggcctgctgtctcag

SEQ ID NO: 441752 - DNA, 20 bp, mouse
gcggcgctgcccgcaggtgt

SEQ ID NO: 441753 - DNA, 20 bp, mouse
ggcaccaccagcacgaagga

SEQ ID NO: 441754 - DNA, 20 bp, mouse
gaagcgggagaagccggcgc

SEQ ID NO: 441755 - DNA, 20 bp, mouse
gctcgcgacccgatgcctca

SEQ ID NO: 441756 - DNA, 20 bp, mouse
ggaggtgacgtccgactcca

SEQ ID NO: 441757 - DNA, 20 bp, mouse
gatacttcagggacgttgag

SEQ ID NO: 441758 - DNA, 20 bp, mouse
gagcatgcgcatcactaggg

SEQ ID NO: 441759 - DNA, 20 bp, mouse
gaagtcaagcaggtggtcgg

SEQ ID NO: 441760 - DNA, 20 bp, mouse
gcacctgcttgacttgtctg

SEQ ID NO: 441761 - DNA, 20 bp, mouse
gcacgaccccgggaatggag

SEQ ID NO: 441762 - DNA, 20 bp, mouse
ggacaagtcaagcaggtggt

SEQ ID NO: 441763 - DNA, 20 bp, mouse
gtcaagcaggtggtcggtgg

SEQ ID NO: 441764 - DNA, 20 bp, mouse
ggttagatttgaatacttca

SEQ ID NO: 441765 - DNA, 20 bp, mouse
ggacgacacgaccccgggaa

SEQ ID NO: 441766 - DNA, 20 bp, mouse
gggcgcctggggcaccggca

SEQ ID NO: 441767 - DNA, 20 bp, mouse
gcatggaggaaccaagatgg

SEQ ID NO: 441768 - DNA, 20 bp, mouse
ggccttccccgtgccctcgt

SEQ ID NO: 441769 - DNA, 20 bp, mouse
gggcaggaggcagaccccac

SEQ ID NO: 441770 - DNA, 20 bp, mouse
ggttggggggaggccgacga

SEQ ID NO: 441771 - DNA, 20 bp, mouse
gtaggccagagccgccatct

SEQ ID NO: 441772 - DNA, 20 bp, mouse
gtgtcatggaggaaccaaga

SEQ ID NO: 441773 - DNA, 20 bp, mouse
gcggctctggcctacaacct

SEQ ID NO: 441774 - DNA, 20 bp, mouse
gggaggccgacgagggcacg

SEQ ID NO: 441775 - DNA, 20 bp, mouse
ggctcctcacgctgaagtag

SEQ ID NO: 441776 - DNA, 20 bp, mouse
ggccgcggcagcaccatgga

SEQ ID NO: 441777 - DNA, 20 bp, mouse
gtcgtcgcgaagggaggtgg

SEQ ID NO: 441778 - DNA, 20 bp, mouse
gggcagctcgggctacaggg

SEQ ID NO: 441779 - DNA, 20 bp, mouse
ggcggcagcaccatggaggg

SEQ ID NO: 441780 - DNA, 20 bp, mouse
gggatcgtcgcgaagggagg

SEQ ID NO: 441781 - DNA, 20 bp, mouse
ggagggaggatcgtcgcgaa

SEQ ID NO: 441782 - DNA, 20 bp, mouse
gggaggatcgtcgcgaaggg

SEQ ID NO: 441783 - DNA, 20 bp, mouse
ggcggcagccggcagaggaa

SEQ ID NO: 441784 - DNA, 20 bp, mouse
gcgcgacgatcctccctcca

SEQ ID NO: 441785 - DNA, 20 bp, mouse
gatccgcgctggggaccagg

SEQ ID NO: 441786 - DNA, 20 bp, mouse
ggcgggctgacggaggtcag

SEQ ID NO: 441787 - DNA, 20 bp, mouse
gccgggaggcggctcagacg

SEQ ID NO: 441788 - DNA, 20 bp, mouse
ggacccaggcgtccgggagg

SEQ ID NO: 441789 - DNA, 20 bp, mouse
gccgagcccgaacccacgga

SEQ ID NO: 441790 - DNA, 20 bp, mouse
ggcctcgagaaacctctcct

SEQ ID NO: 441791 - DNA, 20 bp, mouse
ggagcccgagcccgaaccca

SEQ ID NO: 441792 - DNA, 20 bp, mouse
gggccggcgcgggctgacgg

SEQ ID NO: 441793 - DNA, 20 bp, mouse
ggccgcccagcgccctccgt

SEQ ID NO: 441794 - DNA, 20 bp, mouse
gagccgcctcccggacgcct

SEQ ID NO: 441795 - DNA, 20 bp, mouse
gacgcctgggtccgctcccg

SEQ ID NO: 441796 - DNA, 20 bp, mouse
ggcgtccgaggaatagatag

SEQ ID NO: 441797 - DNA, 20 bp, mouse
ggccgaccccgggaacaaag

SEQ ID NO: 441798 - DNA, 20 bp, mouse
gcagccagccggacccccgg

SEQ ID NO: 441799 - DNA, 20 bp, mouse
ggcacagccagccggacccc

SEQ ID NO: 441800 - DNA, 20 bp, mouse
gcgccgagccggccttggaa

SEQ ID NO: 441801 - DNA, 20 bp, mouse
gtagaggagaacgaaaaggg

SEQ ID NO: 441802 - DNA, 20 bp, mouse
gtgctcagtctcaggcactc

SEQ ID NO: 441803 - DNA, 20 bp, mouse
ggagctgcgccgcgctagag

SEQ ID NO: 441804 - DNA, 20 bp, mouse
gcccagataaggccgacccc

SEQ ID NO: 441805 - DNA, 20 bp, mouse
gcaaagcggcaagagggacc

SEQ ID NO: 441806 - DNA, 20 bp, mouse
ggtgtagaaaagaaacgcca

SEQ ID NO: 441807 - DNA, 20 bp, mouse
gagagaaaactcaccagcca

SEQ ID NO: 441808 - DNA, 20 bp, mouse
gtctctggccagggtcagaa

SEQ ID NO: 441809 - DNA, 20 bp, mouse
gagaaaagaaacgccatggc

SEQ ID NO: 441810 - DNA, 20 bp, mouse
gaatggcaggatacaagtaa

SEQ ID NO: 441811 - DNA, 20 bp, mouse
gcaaaaaacgatggcaacaa

SEQ ID NO: 441812 - DNA, 20 bp, mouse
gagttccctctgtctaacta

SEQ ID NO: 441813 - DNA, 20 bp, mouse
gagagtccctagttagacag

SEQ ID NO: 441814 - DNA, 20 bp, mouse
gtaactccagaaactaatga

SEQ ID NO: 441815 - DNA, 20 bp, mouse
gacaataagtcatttggaaa

SEQ ID NO: 441816 - DNA, 20 bp, mouse
gcaggagtcctgcacagcca

SEQ ID NO: 441817 - DNA, 20 bp, mouse
gagaaaggactcacccgcca

SEQ ID NO: 441818 - DNA, 20 bp, mouse
gtgcgtgcagatactctcaa

SEQ ID NO: 441819 - DNA, 20 bp, mouse
gtcacccgccatggctgtgc

SEQ ID NO: 441820 - DNA, 20 bp, mouse
ggtgttgagggagttacata

SEQ ID NO: 441821 - DNA, 20 bp, mouse
ggagctgtttgtaagttgag

SEQ ID NO: 441822 - DNA, 20 bp, mouse
gcccacagctgtaaatgctg

SEQ ID NO: 441823 - DNA, 20 bp, mouse
gcctctagtcagtgagtcaa

SEQ ID NO: 441824 - DNA, 20 bp, mouse
gacaggaaaatactaaaagg

SEQ ID NO: 441825 - DNA, 20 bp, mouse
gcttcccagaaacataccaa

SEQ ID NO: 441826 - DNA, 20 bp, mouse
gtagtcacggacaggatctc

SEQ ID NO: 441827 - DNA, 20 bp, mouse
gtactgctctagtcacggac

SEQ ID NO: 441828 - DNA, 20 bp, mouse
gtgactggcaaagccctcac

SEQ ID NO: 441829 - DNA, 20 bp, mouse
gtcgtgctgctctccaagaa

SEQ ID NO: 441830 - DNA, 20 bp, mouse
gttccgtgcccgccccttct

SEQ ID NO: 441831 - DNA, 20 bp, mouse
gtcagggctgacagaatggg

SEQ ID NO: 441832 - DNA, 20 bp, mouse
ggctgacagaatgggtggag

SEQ ID NO: 441833 - DNA, 20 bp, mouse
gctgcttctacagccggtga

SEQ ID NO: 441834 - DNA, 20 bp, mouse
ggacaagaaagggcctgtgt

SEQ ID NO: 441835 - DNA, 20 bp, mouse
gccatcagggctgacagaat

SEQ ID NO: 441836 - DNA, 20 bp, mouse
gaggactgcgacctcccgct

SEQ ID NO: 441837 - DNA, 20 bp, mouse
gcacaggaaggggctgatgg

SEQ ID NO: 441838 - DNA, 20 bp, mouse
gggtggtgcgtgtgcagccc

SEQ ID NO: 441839 - DNA, 20 bp, mouse
gtgtgcagcccgggaaaagc

SEQ ID NO: 441840 - DNA, 20 bp, mouse
gtggaaatggcggcgccgag

SEQ ID NO: 441841 - DNA, 20 bp, mouse
gaatggcggcgccgagcggg

SEQ ID NO: 441842 - DNA, 20 bp, mouse
gcgcaggcgagaagtagcgc

SEQ ID NO: 441843 - DNA, 20 bp, mouse
ggtcgcagtcctccctgcac

SEQ ID NO: 441844 - DNA, 20 bp, mouse
ggcctggtgccgcgtgtaca

SEQ ID NO: 441845 - DNA, 20 bp, mouse
ggctgatggcggctgacagg

SEQ ID NO: 441846 - DNA, 20 bp, mouse
gcggggagcttggaacggta

SEQ ID NO: 441847 - DNA, 20 bp, mouse
gatcaaagcgcagtgtcctg

SEQ ID NO: 441848 - DNA, 20 bp, mouse
gttgcagtgttggtgctggt

SEQ ID NO: 441849 - DNA, 20 bp, mouse
ggagctgagaacccagaccc

SEQ ID NO: 441850 - DNA, 20 bp, mouse
gagcgcagtgtcctgcggcg

SEQ ID NO: 441851 - DNA, 20 bp, mouse
gaagcctggaggcaacacaa

SEQ ID NO: 441852 - DNA, 20 bp, mouse
gttgctcaggcaaacactga

SEQ ID NO: 441853 - DNA, 20 bp, mouse
gcttaaaggcggagtcaggg

SEQ ID NO: 441854 - DNA, 20 bp, mouse
ggctgctgcagttgcagtgt

SEQ ID NO: 441855 - DNA, 20 bp, mouse
ggggaaacgggcaatctggg

SEQ ID NO: 441856 - DNA, 20 bp, mouse
gtcacggtgcgaaagaactg

SEQ ID NO: 441857 - DNA, 20 bp, mouse
gctcatggctggtgagtctg

SEQ ID NO: 441858 - DNA, 20 bp, mouse
ggggggctcttcctgaatag

SEQ ID NO: 441859 - DNA, 20 bp, mouse
ggagtaaaatgaaagttact

SEQ ID NO: 441860 - DNA, 20 bp, mouse
ggcatttccttagcataggg

SEQ ID NO: 441861 - DNA, 20 bp, mouse
gccggaaaggactgtttatt

SEQ ID NO: 441862 - DNA, 20 bp, mouse
gtgaggctttttctcatggc

SEQ ID NO: 441863 - DNA, 20 bp, mouse
ggattactgtactgccggaa

SEQ ID NO: 441864 - DNA, 20 bp, mouse
gtgggcatttccttagcata

SEQ ID NO: 441865 - DNA, 20 bp, mouse
gttcgcaaagtctaaattct

SEQ ID NO: 441866 - DNA, 20 bp, mouse
gtcagggctaggacaccggt

SEQ ID NO: 441867 - DNA, 20 bp, mouse
gtggacgagcggaggcctca

SEQ ID NO: 441868 - DNA, 20 bp, mouse
ggacaccggtgggagctcgc

SEQ ID NO: 441869 - DNA, 20 bp, mouse
ggctcgcgggcaggtaagtg

SEQ ID NO: 441870 - DNA, 20 bp, mouse
gcctaaccaaggccagacct

SEQ ID NO: 441871 - DNA, 20 bp, mouse
ggaaacgggtggacgagcgg

SEQ ID NO: 441872 - DNA, 20 bp, mouse
gccgtgccccacgcacgcac

SEQ ID NO: 441873 - DNA, 20 bp, mouse
gggggctggcaggaaacggg

SEQ ID NO: 441874 - DNA, 20 bp, mouse
gttaaacagccgggaagcag

SEQ ID NO: 441875 - DNA, 20 bp, mouse
gcagtcctagcagtccccgg

SEQ ID NO: 441876 - DNA, 20 bp, mouse
gggcggcggccaggagccca

SEQ ID NO: 441877 - DNA, 20 bp, mouse
gcgtcctccgcaagggtcga

SEQ ID NO: 441878 - DNA, 20 bp, mouse
gctgccctcgacccttgcgg

SEQ ID NO: 441879 - DNA, 20 bp, mouse
gcagcgtccgtcctccgcaa

SEQ ID NO: 441880 - DNA, 20 bp, mouse
ggcccaagttaccgttccca

SEQ ID NO: 441881 - DNA, 20 bp, mouse
gcaagttaccgttcccacgg

SEQ ID NO: 441882 - DNA, 20 bp, mouse
gccctggtccagaagaccaa

SEQ ID NO: 441883 - DNA, 20 bp, mouse
ggaaggagctcgcggaagag

SEQ ID NO: 441884 - DNA, 20 bp, mouse
gggaggacggacgctgccgt

SEQ ID NO: 441885 - DNA, 20 bp, mouse
gaagctgccctcgacccttg

SEQ ID NO: 441886 - DNA, 20 bp, mouse
gaagcagcctatggcctcta

SEQ ID NO: 441887 - DNA, 20 bp, mouse
ggaactggcgggagctctta

SEQ ID NO: 441888 - DNA, 20 bp, mouse
gatcctggtgccagccctag

SEQ ID NO: 441889 - DNA, 20 bp, mouse
gtggcgggagctcttaaggc

SEQ ID NO: 441890 - DNA, 20 bp, mouse
gcagaaagcgaagcagccta

SEQ ID NO: 441891 - DNA, 20 bp, mouse
gatcattagaggtggcatcc

SEQ ID NO: 441892 - DNA, 20 bp, mouse
gcagcgggccgagatcccac

SEQ ID NO: 441893 - DNA, 20 bp, mouse
ggagctcccgccagttctgg

SEQ ID NO: 441894 - DNA, 20 bp, mouse
ggttccacgccggctcacag

SEQ ID NO: 441895 - DNA, 20 bp, mouse
gaggaagtgtcctccagaac

SEQ ID NO: 441896 - DNA, 20 bp, mouse
gcggccgggtaagttcctga

SEQ ID NO: 441897 - DNA, 20 bp, mouse
gaggccctcaggaacttacc

SEQ ID NO: 441898 - DNA, 20 bp, mouse
ggagcgtaagccatcccagg

SEQ ID NO: 441899 - DNA, 20 bp, mouse
gagccccgcgacaggccctc

SEQ ID NO: 441900 - DNA, 20 bp, mouse
ggcgcctggcgtccggacag

SEQ ID NO: 441901 - DNA, 20 bp, mouse
ggtcgggcgatcagtgacag

SEQ ID NO: 441902 - DNA, 20 bp, mouse
gggacttgggagacacgggt

SEQ ID NO: 441903 - DNA, 20 bp, mouse
ggtagggacttgggagacac

SEQ ID NO: 441904 - DNA, 20 bp, mouse
gagttcctgagggcctgtcg

SEQ ID NO: 441905 - DNA, 20 bp, mouse
gagctcggcagtagggactt

SEQ ID NO: 441906 - DNA, 20 bp, mouse
gtgccggtccgcctcgtcca

SEQ ID NO: 441907 - DNA, 20 bp, mouse
gaagggcaggagctccgtag

SEQ ID NO: 441908 - DNA, 20 bp, mouse
gcgccatggacgaggcggac

SEQ ID NO: 441909 - DNA, 20 bp, mouse
gcggaagcggacagaacccg

SEQ ID NO: 441910 - DNA, 20 bp, mouse
gcggctcgccatggacgagg

SEQ ID NO: 441911 - DNA, 20 bp, mouse
gggcggaccggcagctcctg

SEQ ID NO: 441912 - DNA, 20 bp, mouse
gcagctcctgcggcgatgca

SEQ ID NO: 441913 - DNA, 20 bp, mouse
gccctggaggcgctatgtgg

SEQ ID NO: 441914 - DNA, 20 bp, mouse
gtcccgcaatcggctcgcca

SEQ ID NO: 441915 - DNA, 20 bp, mouse
gggaacccgagggccggaag

SEQ ID NO: 441916 - DNA, 20 bp, mouse
gtgagttaggggctccaggt

SEQ ID NO: 441917 - DNA, 20 bp, mouse
gctgtcggtagctctcatgg

SEQ ID NO: 441918 - DNA, 20 bp, mouse
gccccctggacccctaacct

SEQ ID NO: 441919 - DNA, 20 bp, mouse
gaatagggagaggtgcccct

SEQ ID NO: 441920 - DNA, 20 bp, mouse
gagagctaccgacaggatgg

SEQ ID NO: 441921 - DNA, 20 bp, mouse
ggatacagaatcctgagtta

SEQ ID NO: 441922 - DNA, 20 bp, mouse
ggagccccccgaggacgaca

SEQ ID NO: 441923 - DNA, 20 bp, mouse
gagccaagagaaaaagggtc

SEQ ID NO: 441924 - DNA, 20 bp, mouse
gaggggtccagggggaagat

SEQ ID NO: 441925 - DNA, 20 bp, mouse
gtgtcctctgtccactgctc

SEQ ID NO: 441926 - DNA, 20 bp, mouse
gctacacagctgcaggacca

SEQ ID NO: 441927 - DNA, 20 bp, mouse
gcctgcagctgtgtagtcgt

SEQ ID NO: 441928 - DNA, 20 bp, mouse
gcctgagcggggcagaagag

SEQ ID NO: 441929 - DNA, 20 bp, mouse
ggtgggctcagaacaaactg

SEQ ID NO: 441930 - DNA, 20 bp, mouse
gggaaggttcttagagatgt

SEQ ID NO: 441931 - DNA, 20 bp, mouse
gtacgatgggaaagaccgag

SEQ ID NO: 441932 - DNA, 20 bp, mouse
gaacaggaatatgggaacaa

SEQ ID NO: 441933 - DNA, 20 bp, mouse
ggtctccagaatagagatca

SEQ ID NO: 441934 - DNA, 20 bp, mouse
ggttcttagagatgttggtg

SEQ ID NO: 441935 - DNA, 20 bp, mouse
ggaggctgctttcacctcct

SEQ ID NO: 441936 - DNA, 20 bp, mouse
gggctgacctgagagatcga

SEQ ID NO: 441937 - DNA, 20 bp, mouse
ggccggagcgcacagctcaa

SEQ ID NO: 441938 - DNA, 20 bp, mouse
gagggagcctgggagattcc

SEQ ID NO: 441939 - DNA, 20 bp, mouse
gcaggctccctcgatctctc

SEQ ID NO: 441940 - DNA, 20 bp, mouse
gcgtcagagggtctgctggg

SEQ ID NO: 441941 - DNA, 20 bp, mouse
gggagattccaggcgggcta

SEQ ID NO: 441942 - DNA, 20 bp, mouse
gttccaggcgggctagggca

SEQ ID NO: 441943 - DNA, 20 bp, mouse
ggcgaacagggaactttaga

SEQ ID NO: 441944 - DNA, 20 bp, mouse
gacccgacaggtggcctagg

SEQ ID NO: 441945 - DNA, 20 bp, mouse
gggcgagagcaggcaagggg

SEQ ID NO: 441946 - DNA, 20 bp, mouse
ggaggcaccagcatcagaga

SEQ ID NO: 441947 - DNA, 20 bp, mouse
gctcacatcacagccatgag

SEQ ID NO: 441948 - DNA, 20 bp, mouse
gccaatcagtcactcacctt

SEQ ID NO: 441949 - DNA, 20 bp, mouse
gatcagagagggtgcgccca

SEQ ID NO: 441950 - DNA, 20 bp, mouse
gctgatgctggtgcctctca

SEQ ID NO: 441951 - DNA, 20 bp, mouse
gagcgcccaaaggaacacga

SEQ ID NO: 441952 - DNA, 20 bp, mouse
gtcccaggagctggattcta

SEQ ID NO: 441953 - DNA, 20 bp, mouse
ggaacacgaaggcagttcat

SEQ ID NO: 441954 - DNA, 20 bp, mouse
gggcgcaccctctctgatgc

SEQ ID NO: 441955 - DNA, 20 bp, mouse
gggtctctaatgaacacgaa

SEQ ID NO: 441956 - DNA, 20 bp, mouse
ggccaagcagagtgtcatcg

SEQ ID NO: 441957 - DNA, 20 bp, mouse
ggacccggctgacaccgcac

SEQ ID NO: 441958 - DNA, 20 bp, mouse
gccggcagctgtgtcctgtg

SEQ ID NO: 441959 - DNA, 20 bp, mouse
ggttctcgagaggttcccag

SEQ ID NO: 441960 - DNA, 20 bp, mouse
gttcccagcggagcaagtca

SEQ ID NO: 441961 - DNA, 20 bp, mouse
gacacagctgccgggtggga

SEQ ID NO: 441962 - DNA, 20 bp, mouse
gggagcgggacagctcagtg

SEQ ID NO: 441963 - DNA, 20 bp, mouse
gccagaagttggagggtcaa

SEQ ID NO: 441964 - DNA, 20 bp, mouse
gccgggtgggagggcacaag

SEQ ID NO: 441965 - DNA, 20 bp, mouse
gcacctcgggacaggaggag

SEQ ID NO: 441966 - DNA, 20 bp, mouse
gcaagtgcaggtaagagact

SEQ ID NO: 441967 - DNA, 20 bp, mouse
gagaggtggagggcttgaag

SEQ ID NO: 441968 - DNA, 20 bp, mouse
gctcttacctgcacttgggg

SEQ ID NO: 441969 - DNA, 20 bp, mouse
gccgtacagccggagttggg

SEQ ID NO: 441970 - DNA, 20 bp, mouse
gcgccccaataggcccgcag

SEQ ID NO: 441971 - DNA, 20 bp, mouse
gataggcccgcagaggtgga

SEQ ID NO: 441972 - DNA, 20 bp, mouse
gcggctgtacgggaggtagg

SEQ ID NO: 441973 - DNA, 20 bp, mouse
gctgcaagcggcaaccccgg

SEQ ID NO: 441974 - DNA, 20 bp, mouse
gccaaagccgccccaagtgc

SEQ ID NO: 441975 - DNA, 20 bp, mouse
gcggcgcccgcagtgaccag

SEQ ID NO: 441976 - DNA, 20 bp, mouse
ggggtcccgactgtccgaca

SEQ ID NO: 441977 - DNA, 20 bp, mouse
gtgcggaacgtgagacagca

SEQ ID NO: 441978 - DNA, 20 bp, mouse
gcgactgtccgacatggtgt

SEQ ID NO: 441979 - DNA, 20 bp, mouse
gtgtgggcggcggcgagtaa

SEQ ID NO: 441980 - DNA, 20 bp, mouse
ggccactcgagcgcagccag

SEQ ID NO: 441981 - DNA, 20 bp, mouse
gcaagattgccttctccggg

SEQ ID NO: 441982 - DNA, 20 bp, mouse
gggacgcagcggtctccacc

SEQ ID NO: 441983 - DNA, 20 bp, mouse
gccctctccgcagaatggaa

SEQ ID NO: 441984 - DNA, 20 bp, mouse
gagcctcacgagaatgtggg

SEQ ID NO: 441985 - DNA, 20 bp, mouse
gccttgggtggcctgcgctg

SEQ ID NO: 441986 - DNA, 20 bp, mouse
gcagagctccctggaagccg

SEQ ID NO: 441987 - DNA, 20 bp, mouse
gcttgaggggatcccgagaa

SEQ ID NO: 441988 - DNA, 20 bp, mouse
gtggaagccggggctgtggt

SEQ ID NO: 441989 - DNA, 20 bp, mouse
gtaacccaaagtcccttctc

SEQ ID NO: 441990 - DNA, 20 bp, mouse
gtgcataggccaaaccaagg

SEQ ID NO: 441991 - DNA, 20 bp, mouse
gcctggaacaaagacagctc

SEQ ID NO: 441992 - DNA, 20 bp, mouse
ggatcccgagaagggacttt

SEQ ID NO: 441993 - DNA, 20 bp, mouse
gggagctctgactcttctct

SEQ ID NO: 441994 - DNA, 20 bp, mouse
gtcctgctgataggaatgat

SEQ ID NO: 441995 - DNA, 20 bp, mouse
gcattcctatcagcaggaca

SEQ ID NO: 441996 - DNA, 20 bp, mouse
ggcctccgccacagccagac

SEQ ID NO: 441997 - DNA, 20 bp, mouse
gtccgccacagccagaccgg

SEQ ID NO: 441998 - DNA, 20 bp, mouse
gaggcggaggggtgaagtca

SEQ ID NO: 441999 - DNA, 20 bp, mouse
gccccaatgccccggaggga

SEQ ID NO: 442000 - DNA, 20 bp, mouse
gtcccaccgaccccccgtcc

SEQ ID NO: 442001 - DNA, 20 bp, mouse
gggggtcggtgggaagtagg

SEQ ID NO: 442002 - DNA, 20 bp, mouse
gtggcggaggcctggacggg

SEQ ID NO: 442003 - DNA, 20 bp, mouse
gggtgaagtcagggctgagt

SEQ ID NO: 442004 - DNA, 20 bp, mouse
gacgcccgccggtctggctg

SEQ ID NO: 442005 - DNA, 20 bp, mouse
ggcccgcgaaagggctggag

SEQ ID NO: 442006 - DNA, 20 bp, mouse
gttcaggtgccaaggacctt

SEQ ID NO: 442007 - DNA, 20 bp, mouse
gtgccaaggaccttaggcag

SEQ ID NO: 442008 - DNA, 20 bp, mouse
gcacctctgcctaaggtcct

SEQ ID NO: 442009 - DNA, 20 bp, mouse
gtatctgtatgataaaagtg

SEQ ID NO: 442010 - DNA, 20 bp, mouse
gggcagcagcaagggaccct

SEQ ID NO: 442011 - DNA, 20 bp, mouse
gttggcacctgaattctacg

SEQ ID NO: 442012 - DNA, 20 bp, mouse
ggcccgacttgactcgtaca

SEQ ID NO: 442013 - DNA, 20 bp, mouse
gatgttaggagatgagtgaa

SEQ ID NO: 442014 - DNA, 20 bp, mouse
gttctacgaggcagcagcaa

SEQ ID NO: 442015 - DNA, 20 bp, mouse
gaagcagagaacccttccca

SEQ ID NO: 442016 - DNA, 20 bp, mouse
gctgtgatctcaccacaagg

SEQ ID NO: 442017 - DNA, 20 bp, mouse
gactgctcgtagcaaagaag

SEQ ID NO: 442018 - DNA, 20 bp, mouse
gcgagctggcatcctagggt

SEQ ID NO: 442019 - DNA, 20 bp, mouse
ggctacggaagggaccgagg

SEQ ID NO: 442020 - DNA, 20 bp, mouse
gagcctatgaactcctgggt

SEQ ID NO: 442021 - DNA, 20 bp, mouse
gccgccgagctggcatccta

SEQ ID NO: 442022 - DNA, 20 bp, mouse
gagggcagagagctacggaa

SEQ ID NO: 442023 - DNA, 20 bp, mouse
gaaggtagagagcctcgtcg

SEQ ID NO: 442024 - DNA, 20 bp, mouse
gctcccaaggaaggtcttca

SEQ ID NO: 442025 - DNA, 20 bp, mouse
gcggcggcagcgccacgacg

SEQ ID NO: 442026 - DNA, 20 bp, mouse
gattggctcttaccaaagtt

SEQ ID NO: 442027 - DNA, 20 bp, mouse
ggtacttagtagcagctgat

SEQ ID NO: 442028 - DNA, 20 bp, mouse
gactctacacagaagaaata

SEQ ID NO: 442029 - DNA, 20 bp, mouse
gacagaagaaatatgggtaa

SEQ ID NO: 442030 - DNA, 20 bp, mouse
gtttaattgaatgtcttcct

SEQ ID NO: 442031 - DNA, 20 bp, mouse
gcagacatttgggtaaattg

SEQ ID NO: 442032 - DNA, 20 bp, mouse
gcttgtttgtctcagacatt

SEQ ID NO: 442033 - DNA, 20 bp, mouse
gcaaagttaggtagactgct

SEQ ID NO: 442034 - DNA, 20 bp, mouse
gtagagaagaaacaaggcta

SEQ ID NO: 442035 - DNA, 20 bp, mouse
gtcacttgcagctattccat

SEQ ID NO: 442036 - DNA, 20 bp, mouse
gagtgtgtgagccctgacca

SEQ ID NO: 442037 - DNA, 20 bp, mouse
ggcagtggccaccatggtca

SEQ ID NO: 442038 - DNA, 20 bp, mouse
gcccagttaggcagttgtac

SEQ ID NO: 442039 - DNA, 20 bp, mouse
gttgatgctagcagcagcag

SEQ ID NO: 442040 - DNA, 20 bp, mouse
ggcagcaatccaacccagtt

SEQ ID NO: 442041 - DNA, 20 bp, mouse
gtcaacaccagcatcttgcc

SEQ ID NO: 442042 - DNA, 20 bp, mouse
ggacactttctcaagcttgg

SEQ ID NO: 442043 - DNA, 20 bp, mouse
gctgggaggtttatgacagg

SEQ ID NO: 442044 - DNA, 20 bp, mouse
gctgctgggaggtttatgac

SEQ ID NO: 442045 - DNA, 20 bp, mouse
gggtttatgacaggaggaat

SEQ ID NO: 442046 - DNA, 20 bp, mouse
gagtcccctgaggggcacag

SEQ ID NO: 442047 - DNA, 20 bp, mouse
gacttggcgaagagtaggtt

SEQ ID NO: 442048 - DNA, 20 bp, mouse
gcctgaggggcacagtggta

SEQ ID NO: 442049 - DNA, 20 bp, mouse
gtgggcggggaaccttttga

SEQ ID NO: 442050 - DNA, 20 bp, mouse
gcggggcaaggagtgttagt

SEQ ID NO: 442051 - DNA, 20 bp, mouse
ggcggggaaccttttgaggg

SEQ ID NO: 442052 - DNA, 20 bp, mouse
gccgcccctgctctttctcc

SEQ ID NO: 442053 - DNA, 20 bp, mouse
gtcttttctgttcccgttct

SEQ ID NO: 442054 - DNA, 20 bp, mouse
gcggagccaagtcccctgag

SEQ ID NO: 442055 - DNA, 20 bp, mouse
ggagggacttggcgaagagt

SEQ ID NO: 442056 - DNA, 20 bp, mouse
gccccaccgtaccagtcact

SEQ ID NO: 442057 - DNA, 20 bp, mouse
gtgactggtacggtggggcg

SEQ ID NO: 442058 - DNA, 20 bp, mouse
gagggcgtggcctgaaggat

SEQ ID NO: 442059 - DNA, 20 bp, mouse
gggagagaattgtttaccag

SEQ ID NO: 442060 - DNA, 20 bp, mouse
ggagttgagaaggagagggg

SEQ ID NO: 442061 - DNA, 20 bp, mouse
gggtaaagagagagccaaat

SEQ ID NO: 442062 - DNA, 20 bp, mouse
gggggagttgagaaggagag

SEQ ID NO: 442063 - DNA, 20 bp, mouse
gctctttaccgaaccccctc

SEQ ID NO: 442064 - DNA, 20 bp, mouse
gttgtttaccagagggggtt

SEQ ID NO: 442065 - DNA, 20 bp, mouse
ggccatcctaggggatgatg

SEQ ID NO: 442066 - DNA, 20 bp, mouse
gagcttcaacctcgaaggaa

SEQ ID NO: 442067 - DNA, 20 bp, mouse
gagtcagcctggctgtgcgg

SEQ ID NO: 442068 - DNA, 20 bp, mouse
gcaggggagggcggcaacag

SEQ ID NO: 442069 - DNA, 20 bp, mouse
gttgctagcttcaacctcga

SEQ ID NO: 442070 - DNA, 20 bp, mouse
ggctttttaagaggacggag

SEQ ID NO: 442071 - DNA, 20 bp, mouse
ggggcaaccggccaagccag

SEQ ID NO: 442072 - DNA, 20 bp, mouse
gggagggcggcaacagcggt

SEQ ID NO: 442073 - DNA, 20 bp, mouse
gctctctgcctggtaccgag

SEQ ID NO: 442074 - DNA, 20 bp, mouse
gctgccatggccttgttgtt

SEQ ID NO: 442075 - DNA, 20 bp, mouse
gagcttgggagagtacactg

SEQ ID NO: 442076 - DNA, 20 bp, mouse
gcacgcgccagcatgtctgg

SEQ ID NO: 442077 - DNA, 20 bp, mouse
gggcaaatacgtagactccg

SEQ ID NO: 442078 - DNA, 20 bp, mouse
gccgaggtaggcttgggtga

SEQ ID NO: 442079 - DNA, 20 bp, mouse
ggtagactccgaggtaggct

SEQ ID NO: 442080 - DNA, 20 bp, mouse
ggctctgaggaggtttccct

SEQ ID NO: 442081 - DNA, 20 bp, mouse
gagccacgcgccagcatgtc

SEQ ID NO: 442082 - DNA, 20 bp, mouse
gcttttggagaggagaccaa

SEQ ID NO: 442083 - DNA, 20 bp, mouse
gccagcccgtacctactggg

SEQ ID NO: 442084 - DNA, 20 bp, mouse
gcagccctaagcctcccagt

SEQ ID NO: 442085 - DNA, 20 bp, mouse
gagtggaagatagcaaaagc

SEQ ID NO: 442086 - DNA, 20 bp, mouse
gtgcaacgccagccacgatg

SEQ ID NO: 442087 - DNA, 20 bp, mouse
gatggggctggagaccgaga

SEQ ID NO: 442088 - DNA, 20 bp, mouse
gtgagcgccacgggaagggg

SEQ ID NO: 442089 - DNA, 20 bp, mouse
ggtagtcaacgccactgtgg

SEQ ID NO: 442090 - DNA, 20 bp, mouse
ggtggctggcgttgcaagag

SEQ ID NO: 442091 - DNA, 20 bp, mouse
ggcagaagcactctaagaag

SEQ ID NO: 442092 - DNA, 20 bp, mouse
ggctgggctatcactcatct

SEQ ID NO: 442093 - DNA, 20 bp, mouse
gcaaggctgggagcgggaac

SEQ ID NO: 442094 - DNA, 20 bp, mouse
gacgccagccacgatggggc

SEQ ID NO: 442095 - DNA, 20 bp, mouse
gagctgcacatcggccttct

SEQ ID NO: 442096 - DNA, 20 bp, mouse
ggtatcgttgatagtcctgg

SEQ ID NO: 442097 - DNA, 20 bp, mouse
gaggctggggctccttcagg

SEQ ID NO: 442098 - DNA, 20 bp, mouse
gggctctgatcgcctcctga

SEQ ID NO: 442099 - DNA, 20 bp, mouse
gggaggcgatcagagccttg

SEQ ID NO: 442100 - DNA, 20 bp, mouse
gctcttcggtcatcattgtg

SEQ ID NO: 442101 - DNA, 20 bp, mouse
ggcgatcagagccttgtggc

SEQ ID NO: 442102 - DNA, 20 bp, mouse
ggggcagaaagaccaagctt

SEQ ID NO: 442103 - DNA, 20 bp, mouse
gggtcatcattgtgaggctg

SEQ ID NO: 442104 - DNA, 20 bp, mouse
ggccggcagcggcaccagtc

SEQ ID NO: 442105 - DNA, 20 bp, mouse
gctggtatcgttgatagtcc

SEQ ID NO: 442106 - DNA, 20 bp, mouse
ggcggcgcgcggcctaacgg

SEQ ID NO: 442107 - DNA, 20 bp, mouse
ggcgcgcggcctaacggcgg

SEQ ID NO: 442108 - DNA, 20 bp, mouse
ggcgtgccggggctgtctgg

SEQ ID NO: 442109 - DNA, 20 bp, mouse
gctctcgcggacagtccata

SEQ ID NO: 442110 - DNA, 20 bp, mouse
gggggcggcgcgcggcctaa

SEQ ID NO: 442111 - DNA, 20 bp, mouse
gccccgcccccagacagccc

SEQ ID NO: 442112 - DNA, 20 bp, mouse
gctgcaaagcctcccgccta

SEQ ID NO: 442113 - DNA, 20 bp, mouse
gctgctgctccataggcggg

SEQ ID NO: 442114 - DNA, 20 bp, mouse
gccgccaggcctgagctcca

SEQ ID NO: 442115 - DNA, 20 bp, mouse
gctttgcagaggccccccgg

SEQ ID NO: 442116 - DNA, 20 bp, mouse
ggccgaggccgaaaccaccc

SEQ ID NO: 442117 - DNA, 20 bp, mouse
gggcagcagagccgaaagca

SEQ ID NO: 442118 - DNA, 20 bp, mouse
gagcccgcacgctgcccggg

SEQ ID NO: 442119 - DNA, 20 bp, mouse
gaaagcgaggacccccggga

SEQ ID NO: 442120 - DNA, 20 bp, mouse
ggatcgcccccaagttatgg

SEQ ID NO: 442121 - DNA, 20 bp, mouse
gacagcggcggtgttgaaca

SEQ ID NO: 442122 - DNA, 20 bp, mouse
gcgggactcggtgagacgcg

SEQ ID NO: 442123 - DNA, 20 bp, mouse
ggtgttgaacagggcagggg

SEQ ID NO: 442124 - DNA, 20 bp, mouse
gcggcaaagtagggtgacag

SEQ ID NO: 442125 - DNA, 20 bp, mouse
gcacgctgcccgggtggttt

SEQ ID NO: 442126 - DNA, 20 bp, mouse
gtggagcctccaaggaacag

SEQ ID NO: 442127 - DNA, 20 bp, mouse
gccggctgtagtgactagaa

SEQ ID NO: 442128 - DNA, 20 bp, mouse
gccgtgcctctgttccttgg

SEQ ID NO: 442129 - DNA, 20 bp, mouse
gcactacagccggcagagct

SEQ ID NO: 442130 - DNA, 20 bp, mouse
gagtgccccactctccagag

SEQ ID NO: 442131 - DNA, 20 bp, mouse
gcgtggggtctggagagaac

SEQ ID NO: 442132 - DNA, 20 bp, mouse
gaagaccccggggtcccgag

SEQ ID NO: 442133 - DNA, 20 bp, mouse
gggccacaacccagctctgc

SEQ ID NO: 442134 - DNA, 20 bp, mouse
gcactcctctcgggaccccg

SEQ ID NO: 442135 - DNA, 20 bp, mouse
gggttgtggccctggacgga

SEQ ID NO: 442136 - DNA, 20 bp, mouse
ggtggcctcccgctccaggg

SEQ ID NO: 442137 - DNA, 20 bp, mouse
gaggcgggcggcggtagcgt

SEQ ID NO: 442138 - DNA, 20 bp, mouse
gcaacggctgaggcgggcgg

SEQ ID NO: 442139 - DNA, 20 bp, mouse
gggcggcggtagcgtgggtt

SEQ ID NO: 442140 - DNA, 20 bp, mouse
gcagcaccggagcccgccag

SEQ ID NO: 442141 - DNA, 20 bp, mouse
gtcagcctccctggagcggg

SEQ ID NO: 442142 - DNA, 20 bp, mouse
gggacggccggcaacggctg

SEQ ID NO: 442143 - DNA, 20 bp, mouse
gggccggcaacggctgaggc

SEQ ID NO: 442144 - DNA, 20 bp, mouse
gtcctccccgggcccactcg

SEQ ID NO: 442145 - DNA, 20 bp, mouse
ggcgcgtcgtcccggaccag

SEQ ID NO: 442146 - DNA, 20 bp, mouse
gggagccgggcgagaaggag

SEQ ID NO: 442147 - DNA, 20 bp, mouse
gtcggccgcgagcgagggaa

SEQ ID NO: 442148 - DNA, 20 bp, mouse
gcgagcgagggaatggagcc

SEQ ID NO: 442149 - DNA, 20 bp, mouse
gggagggtcgggagcccgct

SEQ ID NO: 442150 - DNA, 20 bp, mouse
gcctctccggcaaccaccgc

SEQ ID NO: 442151 - DNA, 20 bp, mouse
gcgcctccctctcactccct

SEQ ID NO: 442152 - DNA, 20 bp, mouse
gcgccggcgctcgcagccca

SEQ ID NO: 442153 - DNA, 20 bp, mouse
gcccgctcggccgcgagcga

SEQ ID NO: 442154 - DNA, 20 bp, mouse
gctccctgggctgcgagcgc

SEQ ID NO: 442155 - DNA, 20 bp, mouse
gtcgtcgagtgagccccggg

SEQ ID NO: 442156 - DNA, 20 bp, mouse
ggcagtcccgcgccacactc

SEQ ID NO: 442157 - DNA, 20 bp, mouse
ggccgcggtgacccgagtag

SEQ ID NO: 442158 - DNA, 20 bp, mouse
ggtcccgcgccacactcggg

SEQ ID NO: 442159 - DNA, 20 bp, mouse
gccgcagcgcccgccggagg

SEQ ID NO: 442160 - DNA, 20 bp, mouse
gggaggaggagaccactcac

SEQ ID NO: 442161 - DNA, 20 bp, mouse
ggaaggagccaccgagatct

SEQ ID NO: 442162 - DNA, 20 bp, mouse
ggatcacgcgtggctcggga

SEQ ID NO: 442163 - DNA, 20 bp, mouse
gcggtgacccgagtagagga

SEQ ID NO: 442164 - DNA, 20 bp, mouse
gagctgggcgcgggccatca

SEQ ID NO: 442165 - DNA, 20 bp, mouse
gggattgggaagccaggacg

SEQ ID NO: 442166 - DNA, 20 bp, mouse
ggagggacccatggctgcgg

SEQ ID NO: 442167 - DNA, 20 bp, mouse
gcagccatgggtccctcggg

SEQ ID NO: 442168 - DNA, 20 bp, mouse
gaggccagggaagaccccga

SEQ ID NO: 442169 - DNA, 20 bp, mouse
gggcggcagccccgcgaggg

SEQ ID NO: 442170 - DNA, 20 bp, mouse
gagccccgcgagggtggcag

SEQ ID NO: 442171 - DNA, 20 bp, mouse
gcccagtcccaagccacccg

SEQ ID NO: 442172 - DNA, 20 bp, mouse
ggccccgctgccaccctcgc

SEQ ID NO: 442173 - DNA, 20 bp, mouse
ggcgcagctacttggagagg

SEQ ID NO: 442174 - DNA, 20 bp, mouse
gaagaccccgagggtcccgg

SEQ ID NO: 442175 - DNA, 20 bp, mouse
gaccgcgcagctacttggag

SEQ ID NO: 442176 - DNA, 20 bp, mouse
gagtcccacacgagccacgg

SEQ ID NO: 442177 - DNA, 20 bp, mouse
ggatcacactggtaaggagg

SEQ ID NO: 442178 - DNA, 20 bp, mouse
gcacactggtaaggaggcgg

SEQ ID NO: 442179 - DNA, 20 bp, mouse
gtgccccgcgagccgaatca

SEQ ID NO: 442180 - DNA, 20 bp, mouse
gcccggcctaccctccggag

SEQ ID NO: 442181 - DNA, 20 bp, mouse
ggcagccgcccgaagccgag

SEQ ID NO: 442182 - DNA, 20 bp, mouse
gggtcccgaaacgagctcag

SEQ ID NO: 442183 - DNA, 20 bp, mouse
ggccgaatcatggatcacac

SEQ ID NO: 442184 - DNA, 20 bp, mouse
ggccacgggggcaagaaact

SEQ ID NO: 442185 - DNA, 20 bp, mouse
gatggatcacactggtaagg

SEQ ID NO: 442186 - DNA, 20 bp, mouse
gagcggcgagtgcggacagg

SEQ ID NO: 442187 - DNA, 20 bp, mouse
gagcagcggcgagtgcggac

SEQ ID NO: 442188 - DNA, 20 bp, mouse
ggtagtggcccgggaggcgt

SEQ ID NO: 442189 - DNA, 20 bp, mouse
gtgcgcacagagctgaggag

SEQ ID NO: 442190 - DNA, 20 bp, mouse
gcaataattcagagcggcgg

SEQ ID NO: 442191 - DNA, 20 bp, mouse
gctgcatcaataattcagag

SEQ ID NO: 442192 - DNA, 20 bp, mouse
gagaggcgtagtggcccggg

SEQ ID NO: 442193 - DNA, 20 bp, mouse
ggagcgcgcgccgggcacaa

SEQ ID NO: 442194 - DNA, 20 bp, mouse
gggcggcaacagcggggacc

SEQ ID NO: 442195 - DNA, 20 bp, mouse
gcatcaataattcagagcgg

SEQ ID NO: 442196 - DNA, 20 bp, mouse
gagtcacaggggactccaca

SEQ ID NO: 442197 - DNA, 20 bp, mouse
gtccgttcaagatcaagact

SEQ ID NO: 442198 - DNA, 20 bp, mouse
gttcaagatcaagacttgga

SEQ ID NO: 442199 - DNA, 20 bp, mouse
gacccgagcgggtagcaagt

SEQ ID NO: 442200 - DNA, 20 bp, mouse
gagctcggagctggcaacta

SEQ ID NO: 442201 - DNA, 20 bp, mouse
gggcttggcaaggtgctacg

SEQ ID NO: 442202 - DNA, 20 bp, mouse
gtagcgggaggaggacacct

SEQ ID NO: 442203 - DNA, 20 bp, mouse
gactattccggacccgaagg

SEQ ID NO: 442204 - DNA, 20 bp, mouse
gggtgctacggggaagtcac

SEQ ID NO: 442205 - DNA, 20 bp, mouse
ggacgggcgagtaccgatgt

SEQ ID NO: 442206 - DNA, 20 bp, mouse
ggaggcacctagcaaggatg

SEQ ID NO: 442207 - DNA, 20 bp, mouse
gtccagggtcagaagcacca

SEQ ID NO: 442208 - DNA, 20 bp, mouse
gagcaaggatggggacggaa

SEQ ID NO: 442209 - DNA, 20 bp, mouse
gtgagcccacccagcctcca

SEQ ID NO: 442210 - DNA, 20 bp, mouse
gccagggccaaggacagctt

SEQ ID NO: 442211 - DNA, 20 bp, mouse
ggaggcacccccaggacgag

SEQ ID NO: 442212 - DNA, 20 bp, mouse
gggctgggtgggctcaagaa

SEQ ID NO: 442213 - DNA, 20 bp, mouse
gctgaccctggaggctgggt

SEQ ID NO: 442214 - DNA, 20 bp, mouse
gccctgggagaggcaccccc

SEQ ID NO: 442215 - DNA, 20 bp, mouse
gtgaagccttgaagcagagg

SEQ ID NO: 442216 - DNA, 20 bp, mouse
ggcagggacgcgggaaccca

SEQ ID NO: 442217 - DNA, 20 bp, mouse
ggcgcaggaacaaattacag

SEQ ID NO: 442218 - DNA, 20 bp, mouse
gcggagggacagcgccgaga

SEQ ID NO: 442219 - DNA, 20 bp, mouse
gctgtccgagggactctggt

SEQ ID NO: 442220 - DNA, 20 bp, mouse
gcagcgtgcagtgcagccgg

SEQ ID NO: 442221 - DNA, 20 bp, mouse
gcgcgggaacccagggcagt

SEQ ID NO: 442222 - DNA, 20 bp, mouse
gcctagccatggacataacc

SEQ ID NO: 442223 - DNA, 20 bp, mouse
gccaggctcgagggttacgt

SEQ ID NO: 442224 - DNA, 20 bp, mouse
gtagcgcgcgggtgccctct

SEQ ID NO: 442225 - DNA, 20 bp, mouse
ggcagggcgcctactgccct

SEQ ID NO: 442226 - DNA, 20 bp, mouse
gactctccagcagcctcgag

SEQ ID NO: 442227 - DNA, 20 bp, mouse
gcgtcggagaccaaggaact

SEQ ID NO: 442228 - DNA, 20 bp, mouse
ggcgcaaactctgcctctcg

SEQ ID NO: 442229 - DNA, 20 bp, mouse
ggggaggccgtcggagacca

SEQ ID NO: 442230 - DNA, 20 bp, mouse
gcatggctgcgtgagaaggg

SEQ ID NO: 442231 - DNA, 20 bp, mouse
gacgggtctgctggaagaca

SEQ ID NO: 442232 - DNA, 20 bp, mouse
gtggttcaagaccggttcac

SEQ ID NO: 442233 - DNA, 20 bp, mouse
ggcgtgagaagggaggccgt

SEQ ID NO: 442234 - DNA, 20 bp, mouse
ggacgaggagcggggccaaa

SEQ ID NO: 442235 - DNA, 20 bp, mouse
gtggtgaccggtgctaacaa

SEQ ID NO: 442236 - DNA, 20 bp, mouse
ggtgaggtgtgagcagggaa

SEQ ID NO: 442237 - DNA, 20 bp, mouse
gttcttccgaagcaagagat

SEQ ID NO: 442238 - DNA, 20 bp, mouse
gctcttgcttcggaagaagc

SEQ ID NO: 442239 - DNA, 20 bp, mouse
gccctgtcaccagggccctc

SEQ ID NO: 442240 - DNA, 20 bp, mouse
ggagtgtgagcaggggaatg

SEQ ID NO: 442241 - DNA, 20 bp, mouse
ggggaaagagggtgtgagct

SEQ ID NO: 442242 - DNA, 20 bp, mouse
gaagtgtgagcagtgcagtg

SEQ ID NO: 442243 - DNA, 20 bp, mouse
ggtgattgtgagcaaggaag

SEQ ID NO: 442244 - DNA, 20 bp, mouse
gaggtgagtgtgagcgggga

SEQ ID NO: 442245 - DNA, 20 bp, mouse
ggagtgtgaacagggaaaga

SEQ ID NO: 442246 - DNA, 20 bp, mouse
gtcacgcgtggtcaaaaccg

SEQ ID NO: 442247 - DNA, 20 bp, mouse
gtggcgtaggactagattct

SEQ ID NO: 442248 - DNA, 20 bp, mouse
ggtggtcaaaaccgtggcgt

SEQ ID NO: 442249 - DNA, 20 bp, mouse
gaggactagattctgggacc

SEQ ID NO: 442250 - DNA, 20 bp, mouse
gggacacacggaccacctga

SEQ ID NO: 442251 - DNA, 20 bp, mouse
gctcctcagaggggagggac

SEQ ID NO: 442252 - DNA, 20 bp, mouse
gcgcgtggccctggtaactg

SEQ ID NO: 442253 - DNA, 20 bp, mouse
gtggtaactggggctaacaa

SEQ ID NO: 442254 - DNA, 20 bp, mouse
gagccggcccggccatcagg

SEQ ID NO: 442255 - DNA, 20 bp, mouse
gctgggcagcgggtcacgcg

SEQ ID NO: 442256 - DNA, 20 bp, mouse
gcccagctaatggcccagaa

SEQ ID NO: 442257 - DNA, 20 bp, mouse
gtgttgaaaggagagcatac

SEQ ID NO: 442258 - DNA, 20 bp, mouse
gcgagctcggcggtatgtac

SEQ ID NO: 442259 - DNA, 20 bp, mouse
gataccgccgagctcgccgg

SEQ ID NO: 442260 - DNA, 20 bp, mouse
gggcgcaaacccgggtacat

SEQ ID NO: 442261 - DNA, 20 bp, mouse
ggcccagaagggttaccgtc

SEQ ID NO: 442262 - DNA, 20 bp, mouse
gggaccgcggaccagcaaga

SEQ ID NO: 442263 - DNA, 20 bp, mouse
ggcccgtggactggaactca

SEQ ID NO: 442264 - DNA, 20 bp, mouse
gatggggcacgagcgatctg

SEQ ID NO: 442265 - DNA, 20 bp, mouse
gcgcacggcgaggacacttc

SEQ ID NO: 442266 - DNA, 20 bp, mouse
ggccggagctcacctagact

SEQ ID NO: 442267 - DNA, 20 bp, mouse
gctcagatcccagggaaggg

SEQ ID NO: 442268 - DNA, 20 bp, mouse
gatggagagcacgctcggac

SEQ ID NO: 442269 - DNA, 20 bp, mouse
gagactcggacgcgggaaaa

SEQ ID NO: 442270 - DNA, 20 bp, mouse
ggatcccagctcagatccca

SEQ ID NO: 442271 - DNA, 20 bp, mouse
gcgcggcgtgggagtcagtg

SEQ ID NO: 442272 - DNA, 20 bp, mouse
gctaggatggagagcacgct

SEQ ID NO: 442273 - DNA, 20 bp, mouse
ggctgcgcgtccaggtacag

SEQ ID NO: 442274 - DNA, 20 bp, mouse
gaacgtggagccgggttcta

SEQ ID NO: 442275 - DNA, 20 bp, mouse
ggctcacctagactcggacg

SEQ ID NO: 442276 - DNA, 20 bp, mouse
ggtcactggtgtcctgctgg

SEQ ID NO: 442277 - DNA, 20 bp, mouse
gcctgctgtgaaaactgtgg

SEQ ID NO: 442278 - DNA, 20 bp, mouse
ggtcgcggaaacgcgactgg

SEQ ID NO: 442279 - DNA, 20 bp, mouse
gttccgcgacaggattcagt

SEQ ID NO: 442280 - DNA, 20 bp, mouse
gggagtcactggtgtcctgc

SEQ ID NO: 442281 - DNA, 20 bp, mouse
gcgccgactgaatcctgtcg

SEQ ID NO: 442282 - DNA, 20 bp, mouse
gggcggcagctctttagttc

SEQ ID NO: 442283 - DNA, 20 bp, mouse
ggcggaagaagagtacgcgg

SEQ ID NO: 442284 - DNA, 20 bp, mouse
gcctgtcgcggaaacgcgac

SEQ ID NO: 442285 - DNA, 20 bp, mouse
ggtacttaggtaattaaggg

SEQ ID NO: 442286 - DNA, 20 bp, mouse
ggcgggccgcgcagagtgag

SEQ ID NO: 442287 - DNA, 20 bp, mouse
ggtaccgcaggccccgctaa

SEQ ID NO: 442288 - DNA, 20 bp, mouse
ggtcgaccgtcccgctgaag

SEQ ID NO: 442289 - DNA, 20 bp, mouse
gcagcgcccgagagtccgag

SEQ ID NO: 442290 - DNA, 20 bp, mouse
ggcgctgctacgaggtgaag

SEQ ID NO: 442291 - DNA, 20 bp, mouse
ggcggagaccgaggaatggg

SEQ ID NO: 442292 - DNA, 20 bp, mouse
ggtacgccgcttcagcggga

SEQ ID NO: 442293 - DNA, 20 bp, mouse
gctgaggggagggccgttag

SEQ ID NO: 442294 - DNA, 20 bp, mouse
gtgctacgaggtgaagaggc

SEQ ID NO: 442295 - DNA, 20 bp, mouse
gctgcggtacgccgcttcag

SEQ ID NO: 442296 - DNA, 20 bp, mouse
gttgctcaggatgcactcgg

SEQ ID NO: 442297 - DNA, 20 bp, mouse
gtgtgtgcagcagtgagccg

SEQ ID NO: 442298 - DNA, 20 bp, mouse
ggcagtgagccggggtctgc

SEQ ID NO: 442299 - DNA, 20 bp, mouse
gcgcgcaccggagactcact

SEQ ID NO: 442300 - DNA, 20 bp, mouse
gccctgcggagagataagag

SEQ ID NO: 442301 - DNA, 20 bp, mouse
gcagagtcctctgggtcccg

SEQ ID NO: 442302 - DNA, 20 bp, mouse
gcgggaaggcggccgcgcac

SEQ ID NO: 442303 - DNA, 20 bp, mouse
gcgccctgctcgctccccgt

SEQ ID NO: 442304 - DNA, 20 bp, mouse
ggcaccggagactcacttgg

SEQ ID NO: 442305 - DNA, 20 bp, mouse
gcgcttgctcaggatgcact

SEQ ID NO: 442306 - DNA, 20 bp, mouse
gagccacatccgaggggagg

SEQ ID NO: 442307 - DNA, 20 bp, mouse
gaggcgggcaggaaggaccg

SEQ ID NO: 442308 - DNA, 20 bp, mouse
gagacgcagagaggcctccg

SEQ ID NO: 442309 - DNA, 20 bp, mouse
ggggaggctgcgagccccgt

SEQ ID NO: 442310 - DNA, 20 bp, mouse
gaccggctggggcctcgctg

SEQ ID NO: 442311 - DNA, 20 bp, mouse
gttcagccacatccgagggg

SEQ ID NO: 442312 - DNA, 20 bp, mouse
gcctccgcggggagaaacaa

SEQ ID NO: 442313 - DNA, 20 bp, mouse
gccgcggggagaaacaaagg

SEQ ID NO: 442314 - DNA, 20 bp, mouse
gccgcgcctcccccatccgg

SEQ ID NO: 442315 - DNA, 20 bp, mouse
gtcccatctcccccacgcac

SEQ ID NO: 442316 - DNA, 20 bp, mouse
ggcgagcgcgagctgagagc

SEQ ID NO: 442317 - DNA, 20 bp, mouse
gagccggcgggtgcaggcag

SEQ ID NO: 442318 - DNA, 20 bp, mouse
gagcgcgagctgagagccgg

SEQ ID NO: 442319 - DNA, 20 bp, mouse
gcgccgctgcctgcacccgc

SEQ ID NO: 442320 - DNA, 20 bp, mouse
ggctgagagccggcgggtgc

SEQ ID NO: 442321 - DNA, 20 bp, mouse
gccaacagctggcagctcca

SEQ ID NO: 442322 - DNA, 20 bp, mouse
gaactgagcccgggccgccg

SEQ ID NO: 442323 - DNA, 20 bp, mouse
gcgctcagacaactgagccc

SEQ ID NO: 442324 - DNA, 20 bp, mouse
gcggatacgcaaggtagggg

SEQ ID NO: 442325 - DNA, 20 bp, mouse
gaagcggatacgcaaggtag

SEQ ID NO: 442326 - DNA, 20 bp, mouse
gggcattgcgcagaaggcgg

SEQ ID NO: 442327 - DNA, 20 bp, mouse
gcgcagggaaggatccgttt

SEQ ID NO: 442328 - DNA, 20 bp, mouse
ggttggcattgcgcagaagg

SEQ ID NO: 442329 - DNA, 20 bp, mouse
gggcctgcacggttcctctg

SEQ ID NO: 442330 - DNA, 20 bp, mouse
gcggttcctctgtggtaaag

SEQ ID NO: 442331 - DNA, 20 bp, mouse
gggttgcgcaggcgcaggga

SEQ ID NO: 442332 - DNA, 20 bp, mouse
gggcccaaggaccgatcggt

SEQ ID NO: 442333 - DNA, 20 bp, mouse
gactcacgctaaggcctgca

SEQ ID NO: 442334 - DNA, 20 bp, mouse
gcgcctgcgcaaccaatcct

SEQ ID NO: 442335 - DNA, 20 bp, mouse
gccagccaataggacaactg

SEQ ID NO: 442336 - DNA, 20 bp, mouse
gcgggagcagggagtattat

SEQ ID NO: 442337 - DNA, 20 bp, mouse
gacagctccatcttgctcag

SEQ ID NO: 442338 - DNA, 20 bp, mouse
gagatggagctgtctgcagt

SEQ ID NO: 442339 - DNA, 20 bp, mouse
ggtaggcgagcgggtcttcg

SEQ ID NO: 442340 - DNA, 20 bp, mouse
gctgtctgcagtaggcgagc

SEQ ID NO: 442341 - DNA, 20 bp, mouse
gaggcggcaagaagacacct

SEQ ID NO: 442342 - DNA, 20 bp, mouse
gaagatgcagggacgcgagg

SEQ ID NO: 442343 - DNA, 20 bp, mouse
gagggagtattatgggctgt

SEQ ID NO: 442344 - DNA, 20 bp, mouse
gcaccaccgcggggaacaca

SEQ ID NO: 442345 - DNA, 20 bp, mouse
ggggcaggggcacaccgcga

SEQ ID NO: 442346 - DNA, 20 bp, mouse
gaccctctgggcgctttcag

SEQ ID NO: 442347 - DNA, 20 bp, mouse
ggcggcgtgagggaacacta

SEQ ID NO: 442348 - DNA, 20 bp, mouse
gagtgggcccaggaccggac

SEQ ID NO: 442349 - DNA, 20 bp, mouse
gcgcgcgcgcacccgctctc

SEQ ID NO: 442350 - DNA, 20 bp, mouse
gctgcgcgcgatgctcggga

SEQ ID NO: 442351 - DNA, 20 bp, mouse
gctctactggccctacatag

SEQ ID NO: 442352 - DNA, 20 bp, mouse
gggaaggtgaggctgctcgg

SEQ ID NO: 442353 - DNA, 20 bp, mouse
gctgacagctccatgcgggg

SEQ ID NO: 442354 - DNA, 20 bp, mouse
ggggcgagtgggcccaggac

SEQ ID NO: 442355 - DNA, 20 bp, mouse
gcgttgcgcaggttcaaaaa

SEQ ID NO: 442356 - DNA, 20 bp, mouse
gtcctggaagcggctgaggg

SEQ ID NO: 442357 - DNA, 20 bp, mouse
ggtcaacatggagctctcgg

SEQ ID NO: 442358 - DNA, 20 bp, mouse
ggggaagcggcgagtcaaca

SEQ ID NO: 442359 - DNA, 20 bp, mouse
gtgctcctggaagcggctga

SEQ ID NO: 442360 - DNA, 20 bp, mouse
gatggagctctcggcggtgg

SEQ ID NO: 442361 - DNA, 20 bp, mouse
ggtcagcgggagagtattat

SEQ ID NO: 442362 - DNA, 20 bp, mouse
gggaggagaactgacgtcag

SEQ ID NO: 442363 - DNA, 20 bp, mouse
gaacatggagctctcggcgg

SEQ ID NO: 442364 - DNA, 20 bp, mouse
ggtgcagggctgcaagtcta

SEQ ID NO: 442365 - DNA, 20 bp, mouse
gggagcctgggccctggtga

SEQ ID NO: 442366 - DNA, 20 bp, mouse
gagacaggtacctctgggag

SEQ ID NO: 442367 - DNA, 20 bp, mouse
ggaaagctgcaggctagctc

SEQ ID NO: 442368 - DNA, 20 bp, mouse
ggcggtcgcggcggttgacg

SEQ ID NO: 442369 - DNA, 20 bp, mouse
gttcgcagacaggtacctct

SEQ ID NO: 442370 - DNA, 20 bp, mouse
ggcatcccacccaccactac

SEQ ID NO: 442371 - DNA, 20 bp, mouse
ggttaggagaagaccttcaa

SEQ ID NO: 442372 - DNA, 20 bp, mouse
gcggatatccgtgccagtag

SEQ ID NO: 442373 - DNA, 20 bp, mouse
gaggtacctgtctgcgaagc

SEQ ID NO: 442374 - DNA, 20 bp, mouse
ggcaggctagctcgggattc

SEQ ID NO: 442375 - DNA, 20 bp, mouse
gggattccggcttcgcagac

SEQ ID NO: 442376 - DNA, 20 bp, mouse
gcctcacctggaagatgtgg

SEQ ID NO: 442377 - DNA, 20 bp, mouse
ggtcaggaaacagtctactg

SEQ ID NO: 442378 - DNA, 20 bp, mouse
gaggtgaggaacaactcaca

SEQ ID NO: 442379 - DNA, 20 bp, mouse
gatacctctcctgccatcga

SEQ ID NO: 442380 - DNA, 20 bp, mouse
ggtgccataacccagaaatg

SEQ ID NO: 442381 - DNA, 20 bp, mouse
gacaactcacaaggaatgtc

SEQ ID NO: 442382 - DNA, 20 bp, mouse
gaggtgttgtgagaagagtt

SEQ ID NO: 442383 - DNA, 20 bp, mouse
gtaagtatgggtctaggcta

SEQ ID NO: 442384 - DNA, 20 bp, mouse
gaactcatggagcgagtctc

SEQ ID NO: 442385 - DNA, 20 bp, mouse
gttcctagccaactactgat

SEQ ID NO: 442386 - DNA, 20 bp, mouse
gggcgcggaggagggactca

SEQ ID NO: 442387 - DNA, 20 bp, mouse
ggcgcggcggctggattcgt

SEQ ID NO: 442388 - DNA, 20 bp, mouse
gtccccgcgagtgtgaggaa

SEQ ID NO: 442389 - DNA, 20 bp, mouse
gtacccctcggtgggtagag

SEQ ID NO: 442390 - DNA, 20 bp, mouse
ggaaggccaaggcggaagct

SEQ ID NO: 442391 - DNA, 20 bp, mouse
gcaaactcgagaatcccggg

SEQ ID NO: 442392 - DNA, 20 bp, mouse
gggccaaggcggaagctggg

SEQ ID NO: 442393 - DNA, 20 bp, mouse
gttggccttcaggagcgcgg

SEQ ID NO: 442394 - DNA, 20 bp, mouse
gtgggcaggtacccctcggt

SEQ ID NO: 442395 - DNA, 20 bp, mouse
gatggaccccaggcaccccc

SEQ ID NO: 442396 - DNA, 20 bp, mouse
gccgcggcggagacagccac

SEQ ID NO: 442397 - DNA, 20 bp, mouse
gcctgggcgggagcttcctg

SEQ ID NO: 442398 - DNA, 20 bp, mouse
ggaagctcccgcccaggagg

SEQ ID NO: 442399 - DNA, 20 bp, mouse
ggctttccgcggcccccggg

SEQ ID NO: 442400 - DNA, 20 bp, mouse
gggggccgcggaaagctagg

SEQ ID NO: 442401 - DNA, 20 bp, mouse
gtccggagcgggaatcaaca

SEQ ID NO: 442402 - DNA, 20 bp, mouse
gtgcgggagtgaaggagctc

SEQ ID NO: 442403 - DNA, 20 bp, mouse
ggctcccgcccaggaggcgg

SEQ ID NO: 442404 - DNA, 20 bp, mouse
ggcggatccgaaccaaaacc

SEQ ID NO: 442405 - DNA, 20 bp, mouse
ggggcacgtggcatacctcg

SEQ ID NO: 442406 - DNA, 20 bp, mouse
gtagaaatgagcgaaagggt

SEQ ID NO: 442407 - DNA, 20 bp, mouse
gatatggctgcagcttccca

SEQ ID NO: 442408 - DNA, 20 bp, mouse
ggtaagagaggttactccct

SEQ ID NO: 442409 - DNA, 20 bp, mouse
gctctcactgcaccagggag

SEQ ID NO: 442410 - DNA, 20 bp, mouse
gatgagcgaaagggtgggct

SEQ ID NO: 442411 - DNA, 20 bp, mouse
gttttttaaaccctgagata

SEQ ID NO: 442412 - DNA, 20 bp, mouse
gcttttagaaatgagcgaaa

SEQ ID NO: 442413 - DNA, 20 bp, mouse
gagagaggctctctgtgaac

SEQ ID NO: 442414 - DNA, 20 bp, mouse
gactgctccggggaagggga

SEQ ID NO: 442415 - DNA, 20 bp, mouse
gttctctggcttgacacaac

SEQ ID NO: 442416 - DNA, 20 bp, mouse
gaactcctgcagagaggtgg

SEQ ID NO: 442417 - DNA, 20 bp, mouse
gggagacaggagttaatctt

SEQ ID NO: 442418 - DNA, 20 bp, mouse
gcttacagggatgtttccag

SEQ ID NO: 442419 - DNA, 20 bp, mouse
gacagggatgtttccagcgg

SEQ ID NO: 442420 - DNA, 20 bp, mouse
ggctgagggcaaacagacct

SEQ ID NO: 442421 - DNA, 20 bp, mouse
gggaactgagttaccttaca

SEQ ID NO: 442422 - DNA, 20 bp, mouse
ggagagcagctctttaataa

SEQ ID NO: 442423 - DNA, 20 bp, mouse
gagactagactgccggctga

SEQ ID NO: 442424 - DNA, 20 bp, mouse
gggcaaacagacctgggcgg

SEQ ID NO: 442425 - DNA, 20 bp, mouse
ggagagcactggaaaagaag

SEQ ID NO: 442426 - DNA, 20 bp, mouse
ggttaacccgggccagactc

SEQ ID NO: 442427 - DNA, 20 bp, mouse
gccagactcaggtgaaggtc

SEQ ID NO: 442428 - DNA, 20 bp, mouse
gccgggccagactcaggtga

SEQ ID NO: 442429 - DNA, 20 bp, mouse
ggcatgcgcctgagcttgac

SEQ ID NO: 442430 - DNA, 20 bp, mouse
ggagcttgacgggtttgaaa

SEQ ID NO: 442431 - DNA, 20 bp, mouse
gtagggagcgagtgatgtgg

SEQ ID NO: 442432 - DNA, 20 bp, mouse
gctgaccggctgccaacgaa

SEQ ID NO: 442433 - DNA, 20 bp, mouse
gtggcccggcccagtcgaag

SEQ ID NO: 442434 - DNA, 20 bp, mouse
gcagcgaagtcaaggtaacc

SEQ ID NO: 442435 - DNA, 20 bp, mouse
gtggcagccggtcagcggag

SEQ ID NO: 442436 - DNA, 20 bp, mouse
ggccagggccacgacaccag

SEQ ID NO: 442437 - DNA, 20 bp, mouse
ggaggcgtttccggtggtgg

SEQ ID NO: 442438 - DNA, 20 bp, mouse
gcggaagagagaccactggt

SEQ ID NO: 442439 - DNA, 20 bp, mouse
gccacccgagagagacggag

SEQ ID NO: 442440 - DNA, 20 bp, mouse
gggagaggcgtttccggtgg

SEQ ID NO: 442441 - DNA, 20 bp, mouse
gagagggaggtaccatatcc

SEQ ID NO: 442442 - DNA, 20 bp, mouse
gagtggcagcttccgaccag

SEQ ID NO: 442443 - DNA, 20 bp, mouse
gagtggtctctcttccggag

SEQ ID NO: 442444 - DNA, 20 bp, mouse
gaggcccccaacccacctgc

SEQ ID NO: 442445 - DNA, 20 bp, mouse
gtccggagaggcgtttccgg

SEQ ID NO: 442446 - DNA, 20 bp, mouse
gagaggcggcggcaccatcg

SEQ ID NO: 442447 - DNA, 20 bp, mouse
ggcaccatcggggaagctcg

SEQ ID NO: 442448 - DNA, 20 bp, mouse
gctcctccccggctcggaag

SEQ ID NO: 442449 - DNA, 20 bp, mouse
gcctccctgggcacagcgca

SEQ ID NO: 442450 - DNA, 20 bp, mouse
gaagccgcgagcttccccga

SEQ ID NO: 442451 - DNA, 20 bp, mouse
gccagctcgtcctccctcta

SEQ ID NO: 442452 - DNA, 20 bp, mouse
ggaagctcgcggcttcttct

SEQ ID NO: 442453 - DNA, 20 bp, mouse
gggccacctgccctagaggg

SEQ ID NO: 442454 - DNA, 20 bp, mouse
gagctgggtgcgatcaggac

SEQ ID NO: 442455 - DNA, 20 bp, mouse
gcgaggaccgcgacaggtaa

SEQ ID NO: 442456 - DNA, 20 bp, mouse
gaagaggccgagccctagat

SEQ ID NO: 442457 - DNA, 20 bp, mouse
gggcggaagtagcccatcta

SEQ ID NO: 442458 - DNA, 20 bp, mouse
gctgtcgcccagtctttaaa

SEQ ID NO: 442459 - DNA, 20 bp, mouse
gaccttgggagagtggacgt

SEQ ID NO: 442460 - DNA, 20 bp, mouse
ggcaaatgcttggggatcct

SEQ ID NO: 442461 - DNA, 20 bp, mouse
gtagggctcggcctctttaa

SEQ ID NO: 442462 - DNA, 20 bp, mouse
gaaagactgggcgacagcct

SEQ ID NO: 442463 - DNA, 20 bp, mouse
gcgtgtgttgaagttagcta

SEQ ID NO: 442464 - DNA, 20 bp, mouse
gaaggacccacagagactat

SEQ ID NO: 442465 - DNA, 20 bp, mouse
gtgtgtgccctttaaagact

SEQ ID NO: 442466 - DNA, 20 bp, mouse
gtgcattccgccaggaaccc

SEQ ID NO: 442467 - DNA, 20 bp, mouse
ggtccctggccttagtccgg

SEQ ID NO: 442468 - DNA, 20 bp, mouse
gaggtcgctaggtgtcgccg

SEQ ID NO: 442469 - DNA, 20 bp, mouse
gtgcgtccctggccttagtc

SEQ ID NO: 442470 - DNA, 20 bp, mouse
ggcacatggtcggaccacag

SEQ ID NO: 442471 - DNA, 20 bp, mouse
gtcctggcggaatgcactcg

SEQ ID NO: 442472 - DNA, 20 bp, mouse
ggacctccggactaaggcca

SEQ ID NO: 442473 - DNA, 20 bp, mouse
gcctagcgacctccggacta

SEQ ID NO: 442474 - DNA, 20 bp, mouse
gggaccacagcggagactgt

SEQ ID NO: 442475 - DNA, 20 bp, mouse
gcaggagaagcgcccgtact

SEQ ID NO: 442476 - DNA, 20 bp, mouse
gacttgcgttcgaaggttcg

SEQ ID NO: 442477 - DNA, 20 bp, mouse
ggtctcgcacttgcgttcga

SEQ ID NO: 442478 - DNA, 20 bp, mouse
gagtgcgagactaccctgtg

SEQ ID NO: 442479 - DNA, 20 bp, mouse
ggcgggaacaggcgaatccc

SEQ ID NO: 442480 - DNA, 20 bp, mouse
gcctgtgaggaaacgttcca

SEQ ID NO: 442481 - DNA, 20 bp, mouse
gcaagcagcgcgggaacgaa

SEQ ID NO: 442482 - DNA, 20 bp, mouse
gcgcgccctggacgggaagg

SEQ ID NO: 442483 - DNA, 20 bp, mouse
gaagtacccggcatgcgcag

SEQ ID NO: 442484 - DNA, 20 bp, mouse
gacgcgcacgcgccctggac

SEQ ID NO: 442485 - DNA, 20 bp, mouse
gggcgcacgcgcaagcccca

SEQ ID NO: 442486 - DNA, 20 bp, mouse
gacgtccgaactgctgctct

SEQ ID NO: 442487 - DNA, 20 bp, mouse
gccctcccccggcctcccga

SEQ ID NO: 442488 - DNA, 20 bp, mouse
ggccccggcccgaggtgagt

SEQ ID NO: 442489 - DNA, 20 bp, mouse
gacgtccggaatcccagccc

SEQ ID NO: 442490 - DNA, 20 bp, mouse
gccccactcacctcgggccg

SEQ ID NO: 442491 - DNA, 20 bp, mouse
gtggaagccgggtcccgtgg

SEQ ID NO: 442492 - DNA, 20 bp, mouse
gctcggagccgctcacgcga

SEQ ID NO: 442493 - DNA, 20 bp, mouse
gctaagtgggactaaaaagt

SEQ ID NO: 442494 - DNA, 20 bp, mouse
ggcgggaggtcatcgcgaca

SEQ ID NO: 442495 - DNA, 20 bp, mouse
ggaatcccagccccggcccg

SEQ ID NO: 442496 - DNA, 20 bp, mouse
gttgcgagggcgatgcacta

SEQ ID NO: 442497 - DNA, 20 bp, mouse
gaggtgttctaccagatccg

SEQ ID NO: 442498 - DNA, 20 bp, mouse
gtctcgagaaaccccggatc

SEQ ID NO: 442499 - DNA, 20 bp, mouse
gggagtccaagactgggtga

SEQ ID NO: 442500 - DNA, 20 bp, mouse
gggtttctcgagagaaagca

SEQ ID NO: 442501 - DNA, 20 bp, mouse
gggtcacgtgggcagactgg

SEQ ID NO: 442502 - DNA, 20 bp, mouse
gtcactcatgatcagcccta

SEQ ID NO: 442503 - DNA, 20 bp, mouse
gctcgacagagaaatgggtc

SEQ ID NO: 442504 - DNA, 20 bp, mouse
ggactggtggcgccgttgct

SEQ ID NO: 442505 - DNA, 20 bp, mouse
gagagattgttgcctagcaa

SEQ ID NO: 442506 - DNA, 20 bp, mouse
ggaggacgaagtggaatggg

SEQ ID NO: 442507 - DNA, 20 bp, mouse
ggcggccgaaaggccagaca

SEQ ID NO: 442508 - DNA, 20 bp, mouse
gcaggaagcgacggagaatg

SEQ ID NO: 442509 - DNA, 20 bp, mouse
gacaggcgctcgggcagagt

SEQ ID NO: 442510 - DNA, 20 bp, mouse
gtttcggccgcaggaagcga

SEQ ID NO: 442511 - DNA, 20 bp, mouse
ggcaactacgggccaatgag

SEQ ID NO: 442512 - DNA, 20 bp, mouse
ggggatggctgcggaagaag

SEQ ID NO: 442513 - DNA, 20 bp, mouse
gtttgtggtgtctaacctgg

SEQ ID NO: 442514 - DNA, 20 bp, mouse
gccgcaatcgccgggccccc

SEQ ID NO: 442515 - DNA, 20 bp, mouse
gaggctgagagcagacgcgc

SEQ ID NO: 442516 - DNA, 20 bp, mouse
gctcctcggagaatggacag

SEQ ID NO: 442517 - DNA, 20 bp, mouse
gcattctccgaggagatcgc

SEQ ID NO: 442518 - DNA, 20 bp, mouse
gtctagccaccagtaaagag

SEQ ID NO: 442519 - DNA, 20 bp, mouse
gcggtggaagggagcaacac

SEQ ID NO: 442520 - DNA, 20 bp, mouse
gagatcgcgggcactaaata

SEQ ID NO: 442521 - DNA, 20 bp, mouse
ggaagggagcaacacaggca

SEQ ID NO: 442522 - DNA, 20 bp, mouse
ggtgtgtggttagggctggg

SEQ ID NO: 442523 - DNA, 20 bp, mouse
gaaagagtggtgtgtggtta

SEQ ID NO: 442524 - DNA, 20 bp, mouse
gggtccagtacactgtcctt

SEQ ID NO: 442525 - DNA, 20 bp, mouse
gagtggtgtgtggttagggc

SEQ ID NO: 442526 - DNA, 20 bp, mouse
gcaaacggcgggcctcacct

SEQ ID NO: 442527 - DNA, 20 bp, mouse
gactccagccccgggaccga

SEQ ID NO: 442528 - DNA, 20 bp, mouse
gtggcggagcgcggagacgt

SEQ ID NO: 442529 - DNA, 20 bp, mouse
gtcttcctggagcccaggtg

SEQ ID NO: 442530 - DNA, 20 bp, mouse
ggccccgggaccgacggcag

SEQ ID NO: 442531 - DNA, 20 bp, mouse
gggaagaggcgccccaggct

SEQ ID NO: 442532 - DNA, 20 bp, mouse
gaatcaggcctgccgagcct

SEQ ID NO: 442533 - DNA, 20 bp, mouse
gccgggaccgacggcagtgg

SEQ ID NO: 442534 - DNA, 20 bp, mouse
gcaccagtaagcgggcgtag

SEQ ID NO: 442535 - DNA, 20 bp, mouse
gctggagtccgtgcgcgggt

SEQ ID NO: 442536 - DNA, 20 bp, mouse
gcccggcgtgcgattctggt

SEQ ID NO: 442537 - DNA, 20 bp, mouse
ggccccagaatactcaacac

SEQ ID NO: 442538 - DNA, 20 bp, mouse
gtagtcgcgcctagaagcta

SEQ ID NO: 442539 - DNA, 20 bp, mouse
gggcccagcgctggaacgcg

SEQ ID NO: 442540 - DNA, 20 bp, mouse
gccaagaagcgacccctccg

SEQ ID NO: 442541 - DNA, 20 bp, mouse
gacctgcgagagctgctgga

SEQ ID NO: 442542 - DNA, 20 bp, mouse
gcgctggaacgcggggtacc

SEQ ID NO: 442543 - DNA, 20 bp, mouse
ggggaaccaccgaacctcgg

SEQ ID NO: 442544 - DNA, 20 bp, mouse
gacggccggaggcccagcgc

SEQ ID NO: 442545 - DNA, 20 bp, mouse
ggactcagcccccccgatgt

SEQ ID NO: 442546 - DNA, 20 bp, mouse
ggaggccagcgagaggaaca

SEQ ID NO: 442547 - DNA, 20 bp, mouse
gaacgttggaggccagcgag

SEQ ID NO: 442548 - DNA, 20 bp, mouse
gcccgagcgtcctgtatcta

SEQ ID NO: 442549 - DNA, 20 bp, mouse
ggtgaaaaaaccgggagtag

SEQ ID NO: 442550 - DNA, 20 bp, mouse
ggagtggtcaagtagagctg

SEQ ID NO: 442551 - DNA, 20 bp, mouse
gttgcatgagttctaaacgt

SEQ ID NO: 442552 - DNA, 20 bp, mouse
gggtcaagtagagctgagga

SEQ ID NO: 442553 - DNA, 20 bp, mouse
gcatgagttctaaacgttgg

SEQ ID NO: 442554 - DNA, 20 bp, mouse
gcgttccttgttcctctcgc

SEQ ID NO: 442555 - DNA, 20 bp, mouse
gaaggaagccttaaaacgaa

SEQ ID NO: 442556 - DNA, 20 bp, mouse
ggggctatagcagccggatg

SEQ ID NO: 442557 - DNA, 20 bp, mouse
gacccagacatagcccgctc

SEQ ID NO: 442558 - DNA, 20 bp, mouse
gtcccgagcgggctatgtct

SEQ ID NO: 442559 - DNA, 20 bp, mouse
gtacagaccgcaggacacag

SEQ ID NO: 442560 - DNA, 20 bp, mouse
ggaggccgcgagagcttggt

SEQ ID NO: 442561 - DNA, 20 bp, mouse
gcaggctcgggagcctcggg

SEQ ID NO: 442562 - DNA, 20 bp, mouse
gaggagctctgtccggcagg

SEQ ID NO: 442563 - DNA, 20 bp, mouse
gaggatgcgtcgttaatgcc

SEQ ID NO: 442564 - DNA, 20 bp, mouse
gtccgcaccccgacaggtgg

SEQ ID NO: 442565 - DNA, 20 bp, mouse
gccgcggccaccacctgtcg

SEQ ID NO: 442566 - DNA, 20 bp, mouse
gaggaaactagaaagcacgg

SEQ ID NO: 442567 - DNA, 20 bp, mouse
gcaaccagcactctgcgtct

SEQ ID NO: 442568 - DNA, 20 bp, mouse
gggaggaacccagccaggtc

SEQ ID NO: 442569 - DNA, 20 bp, mouse
ggtgtgtgcagggaaactcg

SEQ ID NO: 442570 - DNA, 20 bp, mouse
gatctcaggtgtgtcccagg

SEQ ID NO: 442571 - DNA, 20 bp, mouse
gtctttgggatggtggcgac

SEQ ID NO: 442572 - DNA, 20 bp, mouse
ggtacatcttcaagtctctt

SEQ ID NO: 442573 - DNA, 20 bp, mouse
gggaaagggtgcgggtgtaa

SEQ ID NO: 442574 - DNA, 20 bp, mouse
gtggctgggttcctccacct

SEQ ID NO: 442575 - DNA, 20 bp, mouse
gggacacacctgagatgcag

SEQ ID NO: 442576 - DNA, 20 bp, mouse
ggggatgctgcggctagaag

SEQ ID NO: 442577 - DNA, 20 bp, mouse
gcttggggcaaggcagttgg

SEQ ID NO: 442578 - DNA, 20 bp, mouse
gactaggcaacgggatgctg

SEQ ID NO: 442579 - DNA, 20 bp, mouse
gcggcagagctgaatgcttg

SEQ ID NO: 442580 - DNA, 20 bp, mouse
gcagagggcgcgctatgatc

SEQ ID NO: 442581 - DNA, 20 bp, mouse
gccggtaagaacgatccggg

SEQ ID NO: 442582 - DNA, 20 bp, mouse
gatgcttggggcaaggcagt

SEQ ID NO: 442583 - DNA, 20 bp, mouse
ggaggctgtcctctagaggg

SEQ ID NO: 442584 - DNA, 20 bp, mouse
ggagctgaatgcttggggca

SEQ ID NO: 442585 - DNA, 20 bp, mouse
ggccccggtaagaacgatcc

SEQ ID NO: 442586 - DNA, 20 bp, mouse
gggcgcaagtcggccggagg

SEQ ID NO: 442587 - DNA, 20 bp, mouse
gcagctggcggagccagaga

SEQ ID NO: 442588 - DNA, 20 bp, mouse
gagtggcgcaagtcggccgg

SEQ ID NO: 442589 - DNA, 20 bp, mouse
gtacctcaagtggcgcaagt

SEQ ID NO: 442590 - DNA, 20 bp, mouse
gtcaagtggcgcaagtcggc

SEQ ID NO: 442591 - DNA, 20 bp, mouse
gaggcctcggtgcaattgag

SEQ ID NO: 442592 - DNA, 20 bp, mouse
gcggccacgcctgattccgg

SEQ ID NO: 442593 - DNA, 20 bp, mouse
ggtcggccggaggcggcagc

SEQ ID NO: 442594 - DNA, 20 bp, mouse
gctccgccagctgccgcctc

SEQ ID NO: 442595 - DNA, 20 bp, mouse
gcctctgccagtcagaactc

SEQ ID NO: 442596 - DNA, 20 bp, mouse
gccgaaccgctggaccactg

SEQ ID NO: 442597 - DNA, 20 bp, mouse
gagcgtgggagaacgcccac

SEQ ID NO: 442598 - DNA, 20 bp, mouse
ggcttcgcgctcctccccag

SEQ ID NO: 442599 - DNA, 20 bp, mouse
gagcggttcggaacagtgtg

SEQ ID NO: 442600 - DNA, 20 bp, mouse
gtctcgacgaggaaacatgg

SEQ ID NO: 442601 - DNA, 20 bp, mouse
ggcgcgggatcggctcccgt

SEQ ID NO: 442602 - DNA, 20 bp, mouse
ggagtctcgacgaggaaaca

SEQ ID NO: 442603 - DNA, 20 bp, mouse
gacgccgcaacaggtaaccg

SEQ ID NO: 442604 - DNA, 20 bp, mouse
gagcaaggccggagcctccg

SEQ ID NO: 442605 - DNA, 20 bp, mouse
gccgcaacaggtaaccgcgg

SEQ ID NO: 442606 - DNA, 20 bp, mouse
gaagcgggacagcttactga

SEQ ID NO: 442607 - DNA, 20 bp, mouse
gggtcgcggccgaagtgaag

SEQ ID NO: 442608 - DNA, 20 bp, mouse
ggcaacgcgcctcagggtcg

SEQ ID NO: 442609 - DNA, 20 bp, mouse
gagggcgccatgagtctctg

SEQ ID NO: 442610 - DNA, 20 bp, mouse
gaagctgtcccgcttcactt

SEQ ID NO: 442611 - DNA, 20 bp, mouse
ggtctaggcaacgcgcctca

SEQ ID NO: 442612 - DNA, 20 bp, mouse
gcacttcggccgcgaccctg

SEQ ID NO: 442613 - DNA, 20 bp, mouse
gtcaggtactggcaccgtga

SEQ ID NO: 442614 - DNA, 20 bp, mouse
ggtgatcactgactcccagg

SEQ ID NO: 442615 - DNA, 20 bp, mouse
gcctgtccgggttccatcag

SEQ ID NO: 442616 - DNA, 20 bp, mouse
gagagtggagctacagcgac

SEQ ID NO: 442617 - DNA, 20 bp, mouse
gggagctacagcgactggtc

SEQ ID NO: 442618 - DNA, 20 bp, mouse
gagcggtggagctcctgcaa

SEQ ID NO: 442619 - DNA, 20 bp, mouse
ggaagggtcgaggctcagag

SEQ ID NO: 442620 - DNA, 20 bp, mouse
gggagcataggtaggatcaa

SEQ ID NO: 442621 - DNA, 20 bp, mouse
gaaagagccaggggagtcaa

SEQ ID NO: 442622 - DNA, 20 bp, mouse
ggccaggggagtcaagggag

SEQ ID NO: 442623 - DNA, 20 bp, mouse
gagtagtccttgaagggtcg

SEQ ID NO: 442624 - DNA, 20 bp, mouse
gccagaagacgggcctgagt

SEQ ID NO: 442625 - DNA, 20 bp, mouse
gtgttgtagtctggttactg

SEQ ID NO: 442626 - DNA, 20 bp, mouse
gtccgcgcgtgtcccaagac

SEQ ID NO: 442627 - DNA, 20 bp, mouse
ggcggtccaggctctgcgag

SEQ ID NO: 442628 - DNA, 20 bp, mouse
gcgcagagcctggaccgcca

SEQ ID NO: 442629 - DNA, 20 bp, mouse
ggcaagtgagagccaaccct

SEQ ID NO: 442630 - DNA, 20 bp, mouse
gccccccttggagagtggat

SEQ ID NO: 442631 - DNA, 20 bp, mouse
gtggccgcgcagtgattcgg

SEQ ID NO: 442632 - DNA, 20 bp, mouse
gtgggacacgcgcggatggg

SEQ ID NO: 442633 - DNA, 20 bp, mouse
gatcgtgacccggaagtcaa

SEQ ID NO: 442634 - DNA, 20 bp, mouse
gggctgggccatggcggtcc

SEQ ID NO: 442635 - DNA, 20 bp, mouse
gtcaagatccgcccttaggg

SEQ ID NO: 442636 - DNA, 20 bp, mouse
ggtctctgctgtgcttctag

SEQ ID NO: 442637 - DNA, 20 bp, mouse
gtaagcaggtgaggtctcca

SEQ ID NO: 442638 - DNA, 20 bp, mouse
gtgtgcggtagagctttaaa

SEQ ID NO: 442639 - DNA, 20 bp, mouse
gaggattccagttctctgtg

SEQ ID NO: 442640 - DNA, 20 bp, mouse
ggtcagccagatatcctgag

SEQ ID NO: 442641 - DNA, 20 bp, mouse
gagcagagactctggtaagc

SEQ ID NO: 442642 - DNA, 20 bp, mouse
ggctctaccgcacagagaac

SEQ ID NO: 442643 - DNA, 20 bp, mouse
gctttccccgccccatacag

SEQ ID NO: 442644 - DNA, 20 bp, mouse
gagccagatatcctgagtgg

SEQ ID NO: 442645 - DNA, 20 bp, mouse
gatacttaccggggccacat

SEQ ID NO: 442646 - DNA, 20 bp, mouse
gctcagaggcaggtaatcgt

SEQ ID NO: 442647 - DNA, 20 bp, mouse
gtagaaggcgtgaggttggg

SEQ ID NO: 442648 - DNA, 20 bp, mouse
gcggagtggagggttctaga

SEQ ID NO: 442649 - DNA, 20 bp, mouse
gtcagcggcctccctctgag

SEQ ID NO: 442650 - DNA, 20 bp, mouse
gtaatcgtgggtagcgttgg

SEQ ID NO: 442651 - DNA, 20 bp, mouse
gctgggcggtccggagtgga

SEQ ID NO: 442652 - DNA, 20 bp, mouse
gaggtaatcgtgggtagcgt

SEQ ID NO: 442653 - DNA, 20 bp, mouse
gttctagaaggcgtgaggtt

SEQ ID NO: 442654 - DNA, 20 bp, mouse
gggcccgcgaaggccggtgg

SEQ ID NO: 442655 - DNA, 20 bp, mouse
ggtctctgggcggtccggag

SEQ ID NO: 442656 - DNA, 20 bp, mouse
ggcgcgaggcagaagtgaaa

SEQ ID NO: 442657 - DNA, 20 bp, mouse
gcctagaggaagaggcgctg

SEQ ID NO: 442658 - DNA, 20 bp, mouse
gtgctcactgagcctgcgcg

SEQ ID NO: 442659 - DNA, 20 bp, mouse
gggcgctgcggcggaaagaa

SEQ ID NO: 442660 - DNA, 20 bp, mouse
gtgtcttacggccaatccaa

SEQ ID NO: 442661 - DNA, 20 bp, mouse
gctctgggccagtgggaagg

SEQ ID NO: 442662 - DNA, 20 bp, mouse
ggccaatccaagggagacaa

SEQ ID NO: 442663 - DNA, 20 bp, mouse
gcggcgctgacctctgagat

SEQ ID NO: 442664 - DNA, 20 bp, mouse
gagaggaagaggcgctgcgg

SEQ ID NO: 442665 - DNA, 20 bp, mouse
gggagtgagagctgcgggta

SEQ ID NO: 442666 - DNA, 20 bp, mouse
gcccctaggttcgcgctcag

SEQ ID NO: 442667 - DNA, 20 bp, mouse
gcgcccctcacctttaactc

SEQ ID NO: 442668 - DNA, 20 bp, mouse
ggtcctgagttaaaggtgag

SEQ ID NO: 442669 - DNA, 20 bp, mouse
ggcgcaggtggggtccgtag

SEQ ID NO: 442670 - DNA, 20 bp, mouse
gaacggacgtcctgagttaa

SEQ ID NO: 442671 - DNA, 20 bp, mouse
gcaaacgcggcccagaggta

SEQ ID NO: 442672 - DNA, 20 bp, mouse
gaggccgaaagggatgtagt

SEQ ID NO: 442673 - DNA, 20 bp, mouse
gatgtcgtcaggtcagacag

SEQ ID NO: 442674 - DNA, 20 bp, mouse
gcaggtcagacaggggtcag

SEQ ID NO: 442675 - DNA, 20 bp, mouse
ggcgcgcgcccaggaacgag

SEQ ID NO: 442676 - DNA, 20 bp, mouse
gaggctgccatccagcacta

SEQ ID NO: 442677 - DNA, 20 bp, mouse
gccaatgccctagtgctgga

SEQ ID NO: 442678 - DNA, 20 bp, mouse
gtatagggtagcgataggag

SEQ ID NO: 442679 - DNA, 20 bp, mouse
gggaggaccctgagaatata

SEQ ID NO: 442680 - DNA, 20 bp, mouse
gagggtagcgataggagggg

SEQ ID NO: 442681 - DNA, 20 bp, mouse
gtgggaggatcaggggacca

SEQ ID NO: 442682 - DNA, 20 bp, mouse
gaagaacagttgtctcgtcc

SEQ ID NO: 442683 - DNA, 20 bp, mouse
gtgagtaccagcgagcaatg

SEQ ID NO: 442684 - DNA, 20 bp, mouse
gttgtactgccaggaaagct

SEQ ID NO: 442685 - DNA, 20 bp, mouse
gggaggggtggtgttcagta

SEQ ID NO: 442686 - DNA, 20 bp, mouse
ggcaagagagcatgggatgg

SEQ ID NO: 442687 - DNA, 20 bp, mouse
ggcatactccttgaatcccc

SEQ ID NO: 442688 - DNA, 20 bp, mouse
gagtcactctccttgacctg

SEQ ID NO: 442689 - DNA, 20 bp, mouse
ggacagcaggcagctactag

SEQ ID NO: 442690 - DNA, 20 bp, mouse
gtaaggtgtggtgttggcgg

SEQ ID NO: 442691 - DNA, 20 bp, mouse
gaagacagtggtggcgatga

SEQ ID NO: 442692 - DNA, 20 bp, mouse
gatatgtatttagaatagta

SEQ ID NO: 442693 - DNA, 20 bp, mouse
gaccttgggaacatttgctc

SEQ ID NO: 442694 - DNA, 20 bp, mouse
gaaccaaatgccggcgggaa

SEQ ID NO: 442695 - DNA, 20 bp, mouse
gccaagaaaccaaatgccgg

SEQ ID NO: 442696 - DNA, 20 bp, mouse
gtcagcgcccgggcctcagg

SEQ ID NO: 442697 - DNA, 20 bp, mouse
gtcaccgtggaggccgcctg

SEQ ID NO: 442698 - DNA, 20 bp, mouse
gtcccttccgggcgcctcac

SEQ ID NO: 442699 - DNA, 20 bp, mouse
gtcccgtgaggcgcccggaa

SEQ ID NO: 442700 - DNA, 20 bp, mouse
gctgacccggaactgctgag

SEQ ID NO: 442701 - DNA, 20 bp, mouse
ggccgtgcaggcgacctcgg

SEQ ID NO: 442702 - DNA, 20 bp, mouse
gaggcccgggcgctgaggcg

SEQ ID NO: 442703 - DNA, 20 bp, mouse
gtggaggccgcctgaggccc

SEQ ID NO: 442704 - DNA, 20 bp, mouse
gctcggcgctcgaaccccag

SEQ ID NO: 442705 - DNA, 20 bp, mouse
gccacggcccgcggggagag

SEQ ID NO: 442706 - DNA, 20 bp, mouse
gccgggggaagaggtaggaa

SEQ ID NO: 442707 - DNA, 20 bp, mouse
gcggtgccgggggaagaggt

SEQ ID NO: 442708 - DNA, 20 bp, mouse
ggaagaggtaggaacggctg

SEQ ID NO: 442709 - DNA, 20 bp, mouse
gcagtcatggggaaccacgt

SEQ ID NO: 442710 - DNA, 20 bp, mouse
ggagccggtgccgggggaag

SEQ ID NO: 442711 - DNA, 20 bp, mouse
gcccagcgtgccccgcaacc

SEQ ID NO: 442712 - DNA, 20 bp, mouse
gggtaggaacggctgtggcg

SEQ ID NO: 442713 - DNA, 20 bp, mouse
gggaacggctgtggcgcggg

SEQ ID NO: 442714 - DNA, 20 bp, mouse
ggcgcaggcgcagaagctcg

SEQ ID NO: 442715 - DNA, 20 bp, mouse
gccggcctcggaccctaggt

SEQ ID NO: 442716 - DNA, 20 bp, mouse
gaggatcgccaggtccgggt

SEQ ID NO: 442717 - DNA, 20 bp, mouse
ggcacggaggcacggatact

SEQ ID NO: 442718 - DNA, 20 bp, mouse
gccaccgcaggggacccgaa

SEQ ID NO: 442719 - DNA, 20 bp, mouse
gccgctggcccacccggacc

SEQ ID NO: 442720 - DNA, 20 bp, mouse
gctaacatccggttgcacgg

SEQ ID NO: 442721 - DNA, 20 bp, mouse
ggactgcacgaccaccgcag

SEQ ID NO: 442722 - DNA, 20 bp, mouse
gaggcacggatactgggctc

SEQ ID NO: 442723 - DNA, 20 bp, mouse
gggacaccgggaacccgcgg

SEQ ID NO: 442724 - DNA, 20 bp, mouse
gccgaaaggatcgccaggtc

SEQ ID NO: 442725 - DNA, 20 bp, mouse
gagcccgcgcgccccttcag

SEQ ID NO: 442726 - DNA, 20 bp, mouse
gagcctgcgggccaggacgg

SEQ ID NO: 442727 - DNA, 20 bp, mouse
ggccacagcccgccacggga

SEQ ID NO: 442728 - DNA, 20 bp, mouse
gaacagcctgcgggccagga

SEQ ID NO: 442729 - DNA, 20 bp, mouse
gcgccacgggagggcgttag

SEQ ID NO: 442730 - DNA, 20 bp, mouse
gtgcgggccaggacggaggt

SEQ ID NO: 442731 - DNA, 20 bp, mouse
ggtacagccacagcccgcca

SEQ ID NO: 442732 - DNA, 20 bp, mouse
ggcctcccaggagaagagtt

SEQ ID NO: 442733 - DNA, 20 bp, mouse
gcagacggaggagattgggg

SEQ ID NO: 442734 - DNA, 20 bp, mouse
gagcaggccaggtcagacgg

SEQ ID NO: 442735 - DNA, 20 bp, mouse
gcgagagcgctcggcacccg

SEQ ID NO: 442736 - DNA, 20 bp, mouse
gtggcaacacgtctgaggta

SEQ ID NO: 442737 - DNA, 20 bp, mouse
gcaacacgtctgaggtaggg

SEQ ID NO: 442738 - DNA, 20 bp, mouse
gctgcgccctgtaaacgcgg

SEQ ID NO: 442739 - DNA, 20 bp, mouse
gcactcacgcgagccaggag

SEQ ID NO: 442740 - DNA, 20 bp, mouse
ggggtggcagcaacgctgat

SEQ ID NO: 442741 - DNA, 20 bp, mouse
gggcggtggcaacacgtctg

SEQ ID NO: 442742 - DNA, 20 bp, mouse
gcgcctgcgccctgtaaacg

SEQ ID NO: 442743 - DNA, 20 bp, mouse
gttggcacctcacttacccc

SEQ ID NO: 442744 - DNA, 20 bp, mouse
gcgccctgtaaacgcggcgg

SEQ ID NO: 442745 - DNA, 20 bp, mouse
gtacctactctagaagtcca

SEQ ID NO: 442746 - DNA, 20 bp, mouse
gcaggtggatagggatgtgg

SEQ ID NO: 442747 - DNA, 20 bp, mouse
gagcttgcggcaggtggata

SEQ ID NO: 442748 - DNA, 20 bp, mouse
gagtctaggagtggagcttg

SEQ ID NO: 442749 - DNA, 20 bp, mouse
gctttcagacagtctaggag

SEQ ID NO: 442750 - DNA, 20 bp, mouse
ggggttctggtgagcatcta

SEQ ID NO: 442751 - DNA, 20 bp, mouse
gttctggtgagcatctaggg

SEQ ID NO: 442752 - DNA, 20 bp, mouse
gtggtgagcatctagggagg

SEQ ID NO: 442753 - DNA, 20 bp, mouse
gtcaggtgaacagctgtgag

SEQ ID NO: 442754 - DNA, 20 bp, mouse
ggagtggagcttgcggcagg

SEQ ID NO: 442755 - DNA, 20 bp, mouse
gtggtactgtggagactctg

SEQ ID NO: 442756 - DNA, 20 bp, mouse
gcacatgccggcgtcgggaa

SEQ ID NO: 442757 - DNA, 20 bp, mouse
ggcgcagccgcggtaagtgg

SEQ ID NO: 442758 - DNA, 20 bp, mouse
gatgccggcgtcgggaaggg

SEQ ID NO: 442759 - DNA, 20 bp, mouse
gagccttcctccacttaccg

SEQ ID NO: 442760 - DNA, 20 bp, mouse
ggcttcggggtctgtcttaa

SEQ ID NO: 442761 - DNA, 20 bp, mouse
gagccgcggtaagtggagga

SEQ ID NO: 442762 - DNA, 20 bp, mouse
gccggcgtcgggaagggcgg

SEQ ID NO: 442763 - DNA, 20 bp, mouse
ggaagcgcagccgcggtaag

SEQ ID NO: 442764 - DNA, 20 bp, mouse
gccgagcgaggaccgagcca

SEQ ID NO: 442765 - DNA, 20 bp, mouse
gccgaactaggaaccaagag

SEQ ID NO: 442766 - DNA, 20 bp, mouse
gaggcgtgacgtcagggaga

SEQ ID NO: 442767 - DNA, 20 bp, mouse
gggagagggcaggtaggtac

SEQ ID NO: 442768 - DNA, 20 bp, mouse
gtggtggaggcgtgacgtca

SEQ ID NO: 442769 - DNA, 20 bp, mouse
ggtaggtacggggtgaggac

SEQ ID NO: 442770 - DNA, 20 bp, mouse
gcggtccgcgacggcaacgg

SEQ ID NO: 442771 - DNA, 20 bp, mouse
gggtgaggaccggtccgcga

SEQ ID NO: 442772 - DNA, 20 bp, mouse
gctcccgtgccaggacgcag

SEQ ID NO: 442773 - DNA, 20 bp, mouse
gcgtgccaggacgcagtggt

SEQ ID NO: 442774 - DNA, 20 bp, mouse
gtccgcgacggcaacggggg

SEQ ID NO: 442775 - DNA, 20 bp, mouse
gaccagcccggaagcacacc

SEQ ID NO: 442776 - DNA, 20 bp, mouse
ggacagccggctacaacaca

SEQ ID NO: 442777 - DNA, 20 bp, mouse
gtccacgtgacgactcacta

SEQ ID NO: 442778 - DNA, 20 bp, mouse
gttgtagccggctgtctggt

SEQ ID NO: 442779 - DNA, 20 bp, mouse
gcgtaggcttaagttatagt

SEQ ID NO: 442780 - DNA, 20 bp, mouse
ggccatagtgagtcgtcacg

SEQ ID NO: 442781 - DNA, 20 bp, mouse
gagtcgaggtcggatctagg

SEQ ID NO: 442782 - DNA, 20 bp, mouse
gaccaccagtgaggacgagg

SEQ ID NO: 442783 - DNA, 20 bp, mouse
gaaggaaggctgacccaggc

SEQ ID NO: 442784 - DNA, 20 bp, mouse
gccgccgccaccaaggaact

SEQ ID NO: 442785 - DNA, 20 bp, mouse
gagagacaattaccctgcct

SEQ ID NO: 442786 - DNA, 20 bp, mouse
gagccggaagcacccaactc

SEQ ID NO: 442787 - DNA, 20 bp, mouse
gtccgcgccttgccagagtt

SEQ ID NO: 442788 - DNA, 20 bp, mouse
ggcgccttggagcttcggag

SEQ ID NO: 442789 - DNA, 20 bp, mouse
gacccaactctggcaaggcg

SEQ ID NO: 442790 - DNA, 20 bp, mouse
gcgccggccggggtaggtag

SEQ ID NO: 442791 - DNA, 20 bp, mouse
gcttccggctgctcgccaag

SEQ ID NO: 442792 - DNA, 20 bp, mouse
gcccgcccggccactaccac

SEQ ID NO: 442793 - DNA, 20 bp, mouse
ggtctcctagcactgctggc

SEQ ID NO: 442794 - DNA, 20 bp, mouse
gctgcaccgccggccggggt

SEQ ID NO: 442795 - DNA, 20 bp, mouse
gcagccccttggcgagcagc

SEQ ID NO: 442796 - DNA, 20 bp, mouse
ggacctgcttgagataggga

SEQ ID NO: 442797 - DNA, 20 bp, mouse
gctgttcttggagggtaagg

SEQ ID NO: 442798 - DNA, 20 bp, mouse
gatagagacaagtaacagta

SEQ ID NO: 442799 - DNA, 20 bp, mouse
gtgcttgagatagggaggga

SEQ ID NO: 442800 - DNA, 20 bp, mouse
gcagtaaggctgttcttgga

SEQ ID NO: 442801 - DNA, 20 bp, mouse
gggctctggtaggacactat

SEQ ID NO: 442802 - DNA, 20 bp, mouse
ggctgggaagaggctctggt

SEQ ID NO: 442803 - DNA, 20 bp, mouse
gggtccctcagtagctgagg

SEQ ID NO: 442804 - DNA, 20 bp, mouse
gggaggtagcctgtatgggg

SEQ ID NO: 442805 - DNA, 20 bp, mouse
gatgggtccctcagtagctg

SEQ ID NO: 442806 - DNA, 20 bp, mouse
ggcggcgggagcagccatgg

SEQ ID NO: 442807 - DNA, 20 bp, mouse
gctcccggtccccggcccgg

SEQ ID NO: 442808 - DNA, 20 bp, mouse
gcggtggaggccagggtgaa

SEQ ID NO: 442809 - DNA, 20 bp, mouse
ggcggcttctgctcgggagg

SEQ ID NO: 442810 - DNA, 20 bp, mouse
gcgctgggaagggacaaccc

SEQ ID NO: 442811 - DNA, 20 bp, mouse
gcagtaccaggagcacctgg

SEQ ID NO: 442812 - DNA, 20 bp, mouse
ggggctggagagactaactg

SEQ ID NO: 442813 - DNA, 20 bp, mouse
gaaggaaggagagccgtagg

SEQ ID NO: 442814 - DNA, 20 bp, mouse
gcagtatccggtggaggcca

SEQ ID NO: 442815 - DNA, 20 bp, mouse
ggatggagagcagtatccgg

SEQ ID NO: 442816 - DNA, 20 bp, mouse
gaggcctgggaacatagcac

SEQ ID NO: 442817 - DNA, 20 bp, mouse
gggtagtcatggcgaggcct

SEQ ID NO: 442818 - DNA, 20 bp, mouse
gaggctcgggacagccgcag

SEQ ID NO: 442819 - DNA, 20 bp, mouse
ggcctggggtagtcatggcg

SEQ ID NO: 442820 - DNA, 20 bp, mouse
gtaaccagtgctatgttccc

SEQ ID NO: 442821 - DNA, 20 bp, mouse
gccatgtgttgaatgaacgg

SEQ ID NO: 442822 - DNA, 20 bp, mouse
gtgtcccgagcctctaagac

SEQ ID NO: 442823 - DNA, 20 bp, mouse
gcgcggtcggccggtcttag

SEQ ID NO: 442824 - DNA, 20 bp, mouse
gttcgtgcaggacgcgcctg

SEQ ID NO: 442825 - DNA, 20 bp, mouse
gcatagcactggttactgcg

SEQ ID NO: 442826 - DNA, 20 bp, mouse
gaagccaccgggacaggata

SEQ ID NO: 442827 - DNA, 20 bp, mouse
gcgcagggtggtcaagccac

SEQ ID NO: 442828 - DNA, 20 bp, mouse
gctaccatatcctgtcccgg

SEQ ID NO: 442829 - DNA, 20 bp, mouse
gtgaatggcgctctcaaggg

SEQ ID NO: 442830 - DNA, 20 bp, mouse
gctcaccatggagcgcaggg

SEQ ID NO: 442831 - DNA, 20 bp, mouse
gagactcaccatggagcgca

SEQ ID NO: 442832 - DNA, 20 bp, mouse
gtggtgaatggcgctctcaa

SEQ ID NO: 442833 - DNA, 20 bp, mouse
gccactaccatatcctgtcc

SEQ ID NO: 442834 - DNA, 20 bp, mouse
gttgaccaccctgcgctcca

SEQ ID NO: 442835 - DNA, 20 bp, mouse
gcgggttcacagtcacgtca

SEQ ID NO: 442836 - DNA, 20 bp, mouse
gccacgcccaggcggagagt

SEQ ID NO: 442837 - DNA, 20 bp, mouse
gagtctgttgcgcacgccca

SEQ ID NO: 442838 - DNA, 20 bp, mouse
gctcagaagagcccaggcgt

SEQ ID NO: 442839 - DNA, 20 bp, mouse
gtctcgaccgggccaggtga

SEQ ID NO: 442840 - DNA, 20 bp, mouse
gcctctcccactctccgcct

SEQ ID NO: 442841 - DNA, 20 bp, mouse
ggctccaggttccgacccga

SEQ ID NO: 442842 - DNA, 20 bp, mouse
gaggaggctatgagtcccgg

SEQ ID NO: 442843 - DNA, 20 bp, mouse
gtgcgcacgcccagggctcc

SEQ ID NO: 442844 - DNA, 20 bp, mouse
ggggtcggaacctggagccc

SEQ ID NO: 442845 - DNA, 20 bp, mouse
gggaggtccggacatctcgg

SEQ ID NO: 442846 - DNA, 20 bp, mouse
ggcgttccctgaaagagtcc

SEQ ID NO: 442847 - DNA, 20 bp, mouse
gggctaccgggactctttca

SEQ ID NO: 442848 - DNA, 20 bp, mouse
gatgtcagaaggcttccacg

SEQ ID NO: 442849 - DNA, 20 bp, mouse
ggagccccccagccacacag

SEQ ID NO: 442850 - DNA, 20 bp, mouse
gaggcttccacgaggctacc

SEQ ID NO: 442851 - DNA, 20 bp, mouse
ggctacagagctgacagtgg

SEQ ID NO: 442852 - DNA, 20 bp, mouse
gaagagtcccggtagcctcg

SEQ ID NO: 442853 - DNA, 20 bp, mouse
gacggctacagagctgacag

SEQ ID NO: 442854 - DNA, 20 bp, mouse
ggcagacagcatcactacca

SEQ ID NO: 442855 - DNA, 20 bp, mouse
ggtctgctggtcatgtcaga

SEQ ID NO: 442856 - DNA, 20 bp, mouse
gtggagtgcgacgggaagcg

SEQ ID NO: 442857 - DNA, 20 bp, mouse
gagtgcgacgggaagcgggg

SEQ ID NO: 442858 - DNA, 20 bp, mouse
gcgtcgcactccacgcccgt

SEQ ID NO: 442859 - DNA, 20 bp, mouse
gcagctagccggaagtctcg

SEQ ID NO: 442860 - DNA, 20 bp, mouse
gtggtgagtcctggcgccca

SEQ ID NO: 442861 - DNA, 20 bp, mouse
gcggctgtctgctgaagtcc

SEQ ID NO: 442862 - DNA, 20 bp, mouse
gaagtctcgtggtcttactg

SEQ ID NO: 442863 - DNA, 20 bp, mouse
gggagccgctgaagagcgaa

SEQ ID NO: 442864 - DNA, 20 bp, mouse
ggtcctggcgcccacgggcg

SEQ ID NO: 442865 - DNA, 20 bp, mouse
gttgcagacgcgggagccca

SEQ ID NO: 442866 - DNA, 20 bp, mouse
gccacaaggccaccacggga

SEQ ID NO: 442867 - DNA, 20 bp, mouse
gattcccacaaggccaccac

SEQ ID NO: 442868 - DNA, 20 bp, mouse
gaggctcaaccgtcccgtgg

SEQ ID NO: 442869 - DNA, 20 bp, mouse
gaggaggctcaaccgtcccg

SEQ ID NO: 442870 - DNA, 20 bp, mouse
ggctaggcgcagagacctct

SEQ ID NO: 442871 - DNA, 20 bp, mouse
ggccatgttctcttttcagg

SEQ ID NO: 442872 - DNA, 20 bp, mouse
gccttgtgggaattatggct

SEQ ID NO: 442873 - DNA, 20 bp, mouse
ggggtgaggatattactcag

SEQ ID NO: 442874 - DNA, 20 bp, mouse
gagaaataagggctgctata

SEQ ID NO: 442875 - DNA, 20 bp, mouse
ggagcttccacaaattacct

SEQ ID NO: 442876 - DNA, 20 bp, mouse
gggacgcgactcttaggaga

SEQ ID NO: 442877 - DNA, 20 bp, mouse
gccccagggaccaaaacaca

SEQ ID NO: 442878 - DNA, 20 bp, mouse
gtaccaaggacgcgactctt

SEQ ID NO: 442879 - DNA, 20 bp, mouse
ggttttgaagtgagacccca

SEQ ID NO: 442880 - DNA, 20 bp, mouse
gggatcaggaccaaaagaaa

SEQ ID NO: 442881 - DNA, 20 bp, mouse
ggtggttactttggatacca

SEQ ID NO: 442882 - DNA, 20 bp, mouse
gtaagtgggagttcccttaa

SEQ ID NO: 442883 - DNA, 20 bp, mouse
ggacgggataaactcagctg

SEQ ID NO: 442884 - DNA, 20 bp, mouse
ggctaaggtctcttgtgagg

SEQ ID NO: 442885 - DNA, 20 bp, mouse
gaaactaatgtggattccct

SEQ ID NO: 442886 - DNA, 20 bp, mouse
gctgcccccagtgtctaaaa

SEQ ID NO: 442887 - DNA, 20 bp, mouse
gcagcccgggcgccgaaatc

SEQ ID NO: 442888 - DNA, 20 bp, mouse
gtcgcccttttagacactgg

SEQ ID NO: 442889 - DNA, 20 bp, mouse
gccgaggagatcagaaaact

SEQ ID NO: 442890 - DNA, 20 bp, mouse
gtgactggcagtctgaactg

SEQ ID NO: 442891 - DNA, 20 bp, mouse
gtttttctgatcgccagccc

SEQ ID NO: 442892 - DNA, 20 bp, mouse
ggaattagtgagtgtaacaa

SEQ ID NO: 442893 - DNA, 20 bp, mouse
gtgccgctgaggcaaagcac

SEQ ID NO: 442894 - DNA, 20 bp, mouse
gacaggtggagaggttaatg

SEQ ID NO: 442895 - DNA, 20 bp, mouse
gaacagcgtcaggatgacgg

SEQ ID NO: 442896 - DNA, 20 bp, mouse
gtagagggccaggagaaggt

SEQ ID NO: 442897 - DNA, 20 bp, mouse
ggatttcagagccctctccc

SEQ ID NO: 442898 - DNA, 20 bp, mouse
gtagcctccggcgcgggagg

SEQ ID NO: 442899 - DNA, 20 bp, mouse
gggagtattaggggattccc

SEQ ID NO: 442900 - DNA, 20 bp, mouse
gcgggctgcacagatctcaa

SEQ ID NO: 442901 - DNA, 20 bp, mouse
gggcttgtccccagcgtcaa

SEQ ID NO: 442902 - DNA, 20 bp, mouse
gttaggggattcccgggaga

SEQ ID NO: 442903 - DNA, 20 bp, mouse
ggtgtctgtagcctccggcg

SEQ ID NO: 442904 - DNA, 20 bp, mouse
gagagggctctgaaatcggg

SEQ ID NO: 442905 - DNA, 20 bp, mouse
gtggggggaaggagtattag

SEQ ID NO: 442906 - DNA, 20 bp, mouse
gtccgcggaggctgacgtgg

SEQ ID NO: 442907 - DNA, 20 bp, mouse
ggcgcagcccggagagggcc

SEQ ID NO: 442908 - DNA, 20 bp, mouse
ggaggttcctggccctctcc

SEQ ID NO: 442909 - DNA, 20 bp, mouse
gtcctccgcggaggctgacg

SEQ ID NO: 442910 - DNA, 20 bp, mouse
gcggcggcgacaggagcagg

SEQ ID NO: 442911 - DNA, 20 bp, mouse
gccgcaggcccgaacgtgag

SEQ ID NO: 442912 - DNA, 20 bp, mouse
ggcggaggctcggaggttcc

SEQ ID NO: 442913 - DNA, 20 bp, mouse
gtgaggccggggctccggat

SEQ ID NO: 442914 - DNA, 20 bp, mouse
ggaccgagagcgactggcag

SEQ ID NO: 442915 - DNA, 20 bp, mouse
gcgatcggaccgagagcgac

SEQ ID NO: 442916 - DNA, 20 bp, mouse
gtgtgagacggaccggatcg

SEQ ID NO: 442917 - DNA, 20 bp, mouse
gtccgcgggctgctacgcaa

SEQ ID NO: 442918 - DNA, 20 bp, mouse
ggtctgtgtgtgagacggac

SEQ ID NO: 442919 - DNA, 20 bp, mouse
gtcctttgcgtagcagcccg

SEQ ID NO: 442920 - DNA, 20 bp, mouse
gtagaaggaacggagatgag

SEQ ID NO: 442921 - DNA, 20 bp, mouse
gcctgcccagaggtgagcat

SEQ ID NO: 442922 - DNA, 20 bp, mouse
ggagatgaaagcctgcccag

SEQ ID NO: 442923 - DNA, 20 bp, mouse
gacacagactcaaactccgc

SEQ ID NO: 442924 - DNA, 20 bp, mouse
ggaggctccaacagttggat

SEQ ID NO: 442925 - DNA, 20 bp, mouse
gcctggagcctgccgcgatc

SEQ ID NO: 442926 - DNA, 20 bp, mouse
gcggcacgcaggcgcacccg

SEQ ID NO: 442927 - DNA, 20 bp, mouse
gcgcaggcgcacccgaggtg

SEQ ID NO: 442928 - DNA, 20 bp, mouse
gacccgaggtgaggcatgcc

SEQ ID NO: 442929 - DNA, 20 bp, mouse
gagggtccctccccaagtgg

SEQ ID NO: 442930 - DNA, 20 bp, mouse
gtcccggcatgcctcacctc

SEQ ID NO: 442931 - DNA, 20 bp, mouse
gccagcagggccctccactt

SEQ ID NO: 442932 - DNA, 20 bp, mouse
ggccagggtccctccccaag

SEQ ID NO: 442933 - DNA, 20 bp, mouse
gccgggaaaactacacttcc

SEQ ID NO: 442934 - DNA, 20 bp, mouse
gcgggctgttggatgaatca

SEQ ID NO: 442935 - DNA, 20 bp, mouse
gctgaggtgggcggcttagg

SEQ ID NO: 442936 - DNA, 20 bp, mouse
gtcctaaacgctggttccct

SEQ ID NO: 442937 - DNA, 20 bp, mouse
gagtgcattcccagagccta

SEQ ID NO: 442938 - DNA, 20 bp, mouse
gtgggcagccgcgaccacca

SEQ ID NO: 442939 - DNA, 20 bp, mouse
ggcctagggaaccagcgttt

SEQ ID NO: 442940 - DNA, 20 bp, mouse
gtgctaagaggcccgcagcc

SEQ ID NO: 442941 - DNA, 20 bp, mouse
gcctactcagaagacctggt

SEQ ID NO: 442942 - DNA, 20 bp, mouse
ggcaaccgggagatgctaag

SEQ ID NO: 442943 - DNA, 20 bp, mouse
gacgctggttccctaggctc

SEQ ID NO: 442944 - DNA, 20 bp, mouse
gtaggagaataactacaagt

SEQ ID NO: 442945 - DNA, 20 bp, mouse
gcgccctcttccaaagccaa

SEQ ID NO: 442946 - DNA, 20 bp, mouse
gactgggattcgaatctcca

SEQ ID NO: 442947 - DNA, 20 bp, mouse
ggaatctccagggaagagct

SEQ ID NO: 442948 - DNA, 20 bp, mouse
ggagactggatgtcgcgcct

SEQ ID NO: 442949 - DNA, 20 bp, mouse
gcgcacccgaaggactttgc

SEQ ID NO: 442950 - DNA, 20 bp, mouse
gaccagctacccgcacccga

SEQ ID NO: 442951 - DNA, 20 bp, mouse
ggttgggcctcagaggacag

SEQ ID NO: 442952 - DNA, 20 bp, mouse
gtacgttccaagctcttccc

SEQ ID NO: 442953 - DNA, 20 bp, mouse
gaggcccaacagacgcgcag

SEQ ID NO: 442954 - DNA, 20 bp, mouse
ggacagcggaacgccatggt

SEQ ID NO: 442955 - DNA, 20 bp, mouse
gctggggctaaggcccacca

SEQ ID NO: 442956 - DNA, 20 bp, mouse
ggaggagagtacacaagttg

SEQ ID NO: 442957 - DNA, 20 bp, mouse
gaacagaaagtcttgcaggt

SEQ ID NO: 442958 - DNA, 20 bp, mouse
gtctctgggacccttaggga

SEQ ID NO: 442959 - DNA, 20 bp, mouse
ggaagctgactgctgcacat

SEQ ID NO: 442960 - DNA, 20 bp, mouse
gtgatcccagccctccctaa

SEQ ID NO: 442961 - DNA, 20 bp, mouse
gacgaagggaagacctatgt

SEQ ID NO: 442962 - DNA, 20 bp, mouse
gatcccgctgtcctgacgaa

SEQ ID NO: 442963 - DNA, 20 bp, mouse
gggatgccacctaaaaccaa

SEQ ID NO: 442964 - DNA, 20 bp, mouse
ggtaagatgcactgggagac

SEQ ID NO: 442965 - DNA, 20 bp, mouse
gctgggaaatgacatgtcat

SEQ ID NO: 442966 - DNA, 20 bp, mouse
gctaaagaggcaaggtggaa

SEQ ID NO: 442967 - DNA, 20 bp, mouse
gcagtagtggaggtatatag

SEQ ID NO: 442968 - DNA, 20 bp, mouse
ggcccagagagcagtagtgg

SEQ ID NO: 442969 - DNA, 20 bp, mouse
gggagcccagagagcagtag

SEQ ID NO: 442970 - DNA, 20 bp, mouse
gctttagtgaatcctgacgg

SEQ ID NO: 442971 - DNA, 20 bp, mouse
gaccttcagggggtgagtca

SEQ ID NO: 442972 - DNA, 20 bp, mouse
gagaggcaaggtggaagggc

SEQ ID NO: 442973 - DNA, 20 bp, mouse
gattcactaaagaggcaagg

SEQ ID NO: 442974 - DNA, 20 bp, mouse
gggagactcgagggtcaaga

SEQ ID NO: 442975 - DNA, 20 bp, mouse
gagctgcaggagctggggat

SEQ ID NO: 442976 - DNA, 20 bp, mouse
gtcttcgtaaggagagaccc

SEQ ID NO: 442977 - DNA, 20 bp, mouse
gcagctcaagggtcttcgta

SEQ ID NO: 442978 - DNA, 20 bp, mouse
gcacgcaagcgcactccgag

SEQ ID NO: 442979 - DNA, 20 bp, mouse
ggacccgggcgccatccact

SEQ ID NO: 442980 - DNA, 20 bp, mouse
gctccgagtggatggcgccc

SEQ ID NO: 442981 - DNA, 20 bp, mouse
ggcagggcgtacctggagtc

SEQ ID NO: 442982 - DNA, 20 bp, mouse
gttcctgaggaagccggtca

SEQ ID NO: 442983 - DNA, 20 bp, mouse
gctgccatgaaagtcgccac

SEQ ID NO: 442984 - DNA, 20 bp, mouse
gctggcaggtgatgttaccg

SEQ ID NO: 442985 - DNA, 20 bp, mouse
gctgaggaagccggtcacgg

SEQ ID NO: 442986 - DNA, 20 bp, mouse
gggagcctcagacgctctgg

SEQ ID NO: 442987 - DNA, 20 bp, mouse
gctcggagcctcagacgctc

SEQ ID NO: 442988 - DNA, 20 bp, mouse
gtgtagtaagtgggactcta

SEQ ID NO: 442989 - DNA, 20 bp, mouse
gacttcctccagagcgtctg

SEQ ID NO: 442990 - DNA, 20 bp, mouse
gtagagttgcgaggcattct

SEQ ID NO: 442991 - DNA, 20 bp, mouse
ggagggaagttcagagtcag

SEQ ID NO: 442992 - DNA, 20 bp, mouse
gcctcagctctgtgtctgtc

SEQ ID NO: 442993 - DNA, 20 bp, mouse
gctcccaacttagagttgcg

SEQ ID NO: 442994 - DNA, 20 bp, mouse
gcgaggaaccggccagagtc

SEQ ID NO: 442995 - DNA, 20 bp, mouse
gtacgccgttgccaaggcag

SEQ ID NO: 442996 - DNA, 20 bp, mouse
ggcaagcccggtctgacggt

SEQ ID NO: 442997 - DNA, 20 bp, mouse
gccgcgcagctaccttacca

SEQ ID NO: 442998 - DNA, 20 bp, mouse
gcacccgaccggccacctcg

SEQ ID NO: 442999 - DNA, 20 bp, mouse
ggagcgcaagcccggtctga

SEQ ID NO: 443000 - DNA, 20 bp, mouse
gcagggagctcgaggcctcg

SEQ ID NO: 443001 - DNA, 20 bp, mouse
gcgccgccaaccgtcagacc

SEQ ID NO: 443002 - DNA, 20 bp, mouse
gggttggcggcgaggaactt

SEQ ID NO: 443003 - DNA, 20 bp, mouse
gcgcctcggggtacagggaa

SEQ ID NO: 443004 - DNA, 20 bp, mouse
gagcccggtctgacggttgg

SEQ ID NO: 443005 - DNA, 20 bp, mouse
gcttgcgctccgcagaagca

SEQ ID NO: 443006 - DNA, 20 bp, mouse
gccaacgatggtgtcctcag

SEQ ID NO: 443007 - DNA, 20 bp, mouse
gaccatcgttggaaaacgag

SEQ ID NO: 443008 - DNA, 20 bp, mouse
gaacttcagcgtcacagctg

SEQ ID NO: 443009 - DNA, 20 bp, mouse
gttctctgtgactccacctt

SEQ ID NO: 443010 - DNA, 20 bp, mouse
gctgatgggagagcatgaac

SEQ ID NO: 443011 - DNA, 20 bp, mouse
gatcgttggaaaacgagggg

SEQ ID NO: 443012 - DNA, 20 bp, mouse
gtgttagattgacagaacaa

SEQ ID NO: 443013 - DNA, 20 bp, mouse
gaacgggcgtggcttatggg

SEQ ID NO: 443014 - DNA, 20 bp, mouse
gaaggttggggaccttctgg

SEQ ID NO: 443015 - DNA, 20 bp, mouse
gctgaagttttgatcccctg

SEQ ID NO: 443016 - DNA, 20 bp, mouse
ggccggtcactaccgacagg

SEQ ID NO: 443017 - DNA, 20 bp, mouse
gcagcctggccgggtcgtgg

SEQ ID NO: 443018 - DNA, 20 bp, mouse
gggtggctagcactgaacaa

SEQ ID NO: 443019 - DNA, 20 bp, mouse
ggaagccggtcactaccgac

SEQ ID NO: 443020 - DNA, 20 bp, mouse
ggcctcctgtcggtagtgac

SEQ ID NO: 443021 - DNA, 20 bp, mouse
gagtgctagccaccacgacc

SEQ ID NO: 443022 - DNA, 20 bp, mouse
gacaaggggctgcctcctgt

SEQ ID NO: 443023 - DNA, 20 bp, mouse
gggccagcctggccgggtcg

SEQ ID NO: 443024 - DNA, 20 bp, mouse
ggcaagagggcggaaaacca

SEQ ID NO: 443025 - DNA, 20 bp, mouse
gtagccaccacgacccggcc

SEQ ID NO: 443026 - DNA, 20 bp, mouse
gggcaggactggcacttgag

SEQ ID NO: 443027 - DNA, 20 bp, mouse
gaggctgtgacagcagcaat

SEQ ID NO: 443028 - DNA, 20 bp, mouse
gcctactgcatagatctctt

SEQ ID NO: 443029 - DNA, 20 bp, mouse
gcagtaggaaatctgaaggc

SEQ ID NO: 443030 - DNA, 20 bp, mouse
gcatccaaagaaatcagggt

SEQ ID NO: 443031 - DNA, 20 bp, mouse
ggttcccaccctgatttctt

SEQ ID NO: 443032 - DNA, 20 bp, mouse
gtggatgatggactacagac

SEQ ID NO: 443033 - DNA, 20 bp, mouse
gcagtttgctcgttctgggt

SEQ ID NO: 443034 - DNA, 20 bp, mouse
gcatgtatatatggtaccac

SEQ ID NO: 443035 - DNA, 20 bp, mouse
ggacccaaagcggcttaggc

SEQ ID NO: 443036 - DNA, 20 bp, mouse
gctgtggtctccgcaagaag

SEQ ID NO: 443037 - DNA, 20 bp, mouse
gggagaccacaggcaataga

SEQ ID NO: 443038 - DNA, 20 bp, mouse
gagtttcccgggtggcgctg

SEQ ID NO: 443039 - DNA, 20 bp, mouse
gcaagagttcaaactctggt

SEQ ID NO: 443040 - DNA, 20 bp, mouse
ggagttcaaactctggtagg

SEQ ID NO: 443041 - DNA, 20 bp, mouse
ggcggactcagtttcccggg

SEQ ID NO: 443042 - DNA, 20 bp, mouse
gccgggtggcgctgcggcac

SEQ ID NO: 443043 - DNA, 20 bp, mouse
gcgctcaagagttcaaactc

SEQ ID NO: 443044 - DNA, 20 bp, mouse
gggaaagtgggaatatatta

SEQ ID NO: 443045 - DNA, 20 bp, mouse
ggcccgcgggtatctgagtg

SEQ ID NO: 443046 - DNA, 20 bp, mouse
gtggtgtcgctcaggaggtg

SEQ ID NO: 443047 - DNA, 20 bp, mouse
gggctgtgaagggaggtgaa

SEQ ID NO: 443048 - DNA, 20 bp, mouse
ggaggtgaagggtcacgatg

SEQ ID NO: 443049 - DNA, 20 bp, mouse
ggtgcgtagtgcgacttaat

SEQ ID NO: 443050 - DNA, 20 bp, mouse
gggagagactcggagactaa

SEQ ID NO: 443051 - DNA, 20 bp, mouse
ggacgtcgagggtcagatgg

SEQ ID NO: 443052 - DNA, 20 bp, mouse
gtgaagggtcacgatgagga

SEQ ID NO: 443053 - DNA, 20 bp, mouse
gggaggaagcgagggcgacg

SEQ ID NO: 443054 - DNA, 20 bp, mouse
gggcgacgtggctttgggag

SEQ ID NO: 443055 - DNA, 20 bp, mouse
gtggagctaataagactcca

SEQ ID NO: 443056 - DNA, 20 bp, mouse
gcgcgcgggaggtcttgcaa

SEQ ID NO: 443057 - DNA, 20 bp, mouse
gaggcctcccacgatctgaa

SEQ ID NO: 443058 - DNA, 20 bp, mouse
gccacggagacactttcgag

SEQ ID NO: 443059 - DNA, 20 bp, mouse
gctaggtggtacacagggga

SEQ ID NO: 443060 - DNA, 20 bp, mouse
gccaggtcttaagctctagg

SEQ ID NO: 443061 - DNA, 20 bp, mouse
gggaggtcttgcaatgggag

SEQ ID NO: 443062 - DNA, 20 bp, mouse
gaagctctaggtggtacaca

SEQ ID NO: 443063 - DNA, 20 bp, mouse
gtacacaggggaaggtcgcg

SEQ ID NO: 443064 - DNA, 20 bp, mouse
ggactcagcgaggaccacag

SEQ ID NO: 443065 - DNA, 20 bp, mouse
gtgaagtgagtgggccctgt

SEQ ID NO: 443066 - DNA, 20 bp, mouse
ggccctgggtggacaggatc

SEQ ID NO: 443067 - DNA, 20 bp, mouse
gtggctgcagagatccggtg

SEQ ID NO: 443068 - DNA, 20 bp, mouse
gtgaggaccccggccctggg

SEQ ID NO: 443069 - DNA, 20 bp, mouse
gtcccgatcctgtccaccca

SEQ ID NO: 443070 - DNA, 20 bp, mouse
gtcgggagtctgttcagtct

SEQ ID NO: 443071 - DNA, 20 bp, mouse
gagagatccggtgaggaccc

SEQ ID NO: 443072 - DNA, 20 bp, mouse
gacgtaggatcctagcaaga

SEQ ID NO: 443073 - DNA, 20 bp, mouse
gaccgcaagggtgaacgaaa

SEQ ID NO: 443074 - DNA, 20 bp, mouse
gagcggtcgcaaaaccgcaa

SEQ ID NO: 443075 - DNA, 20 bp, mouse
gcggtgaggaccccggccct

SEQ ID NO: 443076 - DNA, 20 bp, mouse
gcaaaagagaaaaggcggac

SEQ ID NO: 443077 - DNA, 20 bp, mouse
gtccatggccgattactcag

SEQ ID NO: 443078 - DNA, 20 bp, mouse
gcctggcgatttagcagact

SEQ ID NO: 443079 - DNA, 20 bp, mouse
gcctccccgccaccagatca

SEQ ID NO: 443080 - DNA, 20 bp, mouse
gattggccggctgactccgg

SEQ ID NO: 443081 - DNA, 20 bp, mouse
gaacatacatttgaaggacc

SEQ ID NO: 443082 - DNA, 20 bp, mouse
gcggccaatgcagaatcgtt

SEQ ID NO: 443083 - DNA, 20 bp, mouse
ggccgccagtggccaggggt

SEQ ID NO: 443084 - DNA, 20 bp, mouse
gtgcattggccggctgactc

SEQ ID NO: 443085 - DNA, 20 bp, mouse
gtaagggccgccagtggcca

SEQ ID NO: 443086 - DNA, 20 bp, mouse
gcttgtgggaaaagttgtca

SEQ ID NO: 443087 - DNA, 20 bp, mouse
gctacatcccagaacaaaca

SEQ ID NO: 443088 - DNA, 20 bp, mouse
gagctagcgaggtgagctgt

SEQ ID NO: 443089 - DNA, 20 bp, mouse
gtgtcaaggtgtagctagcg

SEQ ID NO: 443090 - DNA, 20 bp, mouse
gagaaaaagaaggtccccag

SEQ ID NO: 443091 - DNA, 20 bp, mouse
gatgtagccaacttgcccgg

SEQ ID NO: 443092 - DNA, 20 bp, mouse
ggtctgaccgtgtttgttct

SEQ ID NO: 443093 - DNA, 20 bp, mouse
ggacagagtgccctcaggac

SEQ ID NO: 443094 - DNA, 20 bp, mouse
gatgtaggatattgacacca

SEQ ID NO: 443095 - DNA, 20 bp, mouse
gttggtggtcctgtacacta

SEQ ID NO: 443096 - DNA, 20 bp, mouse
gggaaagccgatggactcta

SEQ ID NO: 443097 - DNA, 20 bp, mouse
gaggatggagaaagtctacg

SEQ ID NO: 443098 - DNA, 20 bp, mouse
gatggactctagggccagga

SEQ ID NO: 443099 - DNA, 20 bp, mouse
gggagaaagagtgacaactg

SEQ ID NO: 443100 - DNA, 20 bp, mouse
gtacgaggtgaagtttacaa

SEQ ID NO: 443101 - DNA, 20 bp, mouse
gagggaggcggagaaagtcg

SEQ ID NO: 443102 - DNA, 20 bp, mouse
gttacaacggccacttccgg

SEQ ID NO: 443103 - DNA, 20 bp, mouse
ggaacacgcgacgaggctct

SEQ ID NO: 443104 - DNA, 20 bp, mouse
gtgttccgggcccccggaag

SEQ ID NO: 443105 - DNA, 20 bp, mouse
ggggcccggaacacgcgacg

SEQ ID NO: 443106 - DNA, 20 bp, mouse
gggaagatgcctgtggtcag

SEQ ID NO: 443107 - DNA, 20 bp, mouse
gtgcgctggacacacgtgag

SEQ ID NO: 443108 - DNA, 20 bp, mouse
ggtcgccagcccctgaccac

SEQ ID NO: 443109 - DNA, 20 bp, mouse
gcttctcgcgagatcagtgg

SEQ ID NO: 443110 - DNA, 20 bp, mouse
gccccaggggaagatgcctg

SEQ ID NO: 443111 - DNA, 20 bp, mouse
gagctccctcgctcccccag

SEQ ID NO: 443112 - DNA, 20 bp, mouse
ggcccagtggagccccatgg

SEQ ID NO: 443113 - DNA, 20 bp, mouse
ggacacacgtgaggggacga

SEQ ID NO: 443114 - DNA, 20 bp, mouse
ggatgcctgtggtcaggggc

SEQ ID NO: 443115 - DNA, 20 bp, mouse
gaacgccgaaggccccccgg

SEQ ID NO: 443116 - DNA, 20 bp, mouse
ggatcccgcgagtccagagc

SEQ ID NO: 443117 - DNA, 20 bp, mouse
gtcacctgctctggactcgc

SEQ ID NO: 443118 - DNA, 20 bp, mouse
ggcatagggtgacaaagtga

SEQ ID NO: 443119 - DNA, 20 bp, mouse
ggaagtagtatcacctgctc

SEQ ID NO: 443120 - DNA, 20 bp, mouse
gtagactaggagtagaatag

SEQ ID NO: 443121 - DNA, 20 bp, mouse
gtcagtagctgacttcagct

SEQ ID NO: 443122 - DNA, 20 bp, mouse
gggcaggcgaaggaaagcca

SEQ ID NO: 443123 - DNA, 20 bp, mouse
gtggttgctaaacaaccaaa

SEQ ID NO: 443124 - DNA, 20 bp, mouse
ggggccaaggcagctcacct

SEQ ID NO: 443125 - DNA, 20 bp, mouse
gagtagaataggggtagaaa

SEQ ID NO: 443126 - DNA, 20 bp, mouse
ggactcgtagggtctgactg

SEQ ID NO: 443127 - DNA, 20 bp, mouse
ggtctctgcggggaaagggt

SEQ ID NO: 443128 - DNA, 20 bp, mouse
ggtcttgggactggacgcct

SEQ ID NO: 443129 - DNA, 20 bp, mouse
gccccacccggcagcagaac

SEQ ID NO: 443130 - DNA, 20 bp, mouse
gaagctgaggagggtctctg

SEQ ID NO: 443131 - DNA, 20 bp, mouse
gtgggggtggcggactcgta

SEQ ID NO: 443132 - DNA, 20 bp, mouse
ggttgtcccacgcaagtcag

SEQ ID NO: 443133 - DNA, 20 bp, mouse
gaggaggctgtaacgtccaa

SEQ ID NO: 443134 - DNA, 20 bp, mouse
gcctgtgagtaaggaagctg

SEQ ID NO: 443135 - DNA, 20 bp, mouse
gcttgcgtgggacaacaact

SEQ ID NO: 443136 - DNA, 20 bp, mouse
gacgctcctggacccccgag

SEQ ID NO: 443137 - DNA, 20 bp, mouse
gttgttgacaaacccctcgg

SEQ ID NO: 443138 - DNA, 20 bp, mouse
gcagcaccaggcgaagtgag

SEQ ID NO: 443139 - DNA, 20 bp, mouse
gcaagatggccatacgctcc

SEQ ID NO: 443140 - DNA, 20 bp, mouse
gcagaccaccatctccaagg

SEQ ID NO: 443141 - DNA, 20 bp, mouse
gttcttgttgacaaacccct

SEQ ID NO: 443142 - DNA, 20 bp, mouse
gggtttgtggagaccgaggc

SEQ ID NO: 443143 - DNA, 20 bp, mouse
ggggtttgtcaacaagaagt

SEQ ID NO: 443144 - DNA, 20 bp, mouse
gtgtcaacaagaagttggtg

SEQ ID NO: 443145 - DNA, 20 bp, mouse
gacttcccccttggagatgg

SEQ ID NO: 443146 - DNA, 20 bp, mouse
ggccctccgcgtgccctcaa

SEQ ID NO: 443147 - DNA, 20 bp, mouse
gacggagtcggcccaggtgg

SEQ ID NO: 443148 - DNA, 20 bp, mouse
gtgggccgactccgtctcta

SEQ ID NO: 443149 - DNA, 20 bp, mouse
gaggaaaccaccacgccgaa

SEQ ID NO: 443150 - DNA, 20 bp, mouse
ggtccacaaaagcctgacag

SEQ ID NO: 443151 - DNA, 20 bp, mouse
ggtcctggtggccgccacct

SEQ ID NO: 443152 - DNA, 20 bp, mouse
gggacgttagcccttcggcg

SEQ ID NO: 443153 - DNA, 20 bp, mouse
ggtttccttagagacggagt

SEQ ID NO: 443154 - DNA, 20 bp, mouse
ggagacggagtcggcccagg

SEQ ID NO: 443155 - DNA, 20 bp, mouse
gccgcgtgccctcaacggcg

SEQ ID NO: 443156 - DNA, 20 bp, mouse
ggagatggatgcagaggcga

SEQ ID NO: 443157 - DNA, 20 bp, mouse
gaggagcagcgagagacctg

SEQ ID NO: 443158 - DNA, 20 bp, mouse
gcgccggggagagcagcgag

SEQ ID NO: 443159 - DNA, 20 bp, mouse
gagcagctcccagaatggag

SEQ ID NO: 443160 - DNA, 20 bp, mouse
ggagacctgcggtaccttgg

SEQ ID NO: 443161 - DNA, 20 bp, mouse
gggtaccttggcggtagagg

SEQ ID NO: 443162 - DNA, 20 bp, mouse
gccagacgctacctacccgg

SEQ ID NO: 443163 - DNA, 20 bp, mouse
gtgcggtaccttggcggtag

SEQ ID NO: 443164 - DNA, 20 bp, mouse
gcgagagacctgcggtacct

SEQ ID NO: 443165 - DNA, 20 bp, mouse
ggtctcccatggagagacgc

SEQ ID NO: 443166 - DNA, 20 bp, mouse
ggtgagtagcgggacctgtg

SEQ ID NO: 443167 - DNA, 20 bp, mouse
gaggccactagaaggtccat

SEQ ID NO: 443168 - DNA, 20 bp, mouse
gtccatgggtcaagccccac

SEQ ID NO: 443169 - DNA, 20 bp, mouse
ggagaggctcgagccagtaa

SEQ ID NO: 443170 - DNA, 20 bp, mouse
gtggcctctgcacagaaggg

SEQ ID NO: 443171 - DNA, 20 bp, mouse
gcaagtgaaagctggcatag

SEQ ID NO: 443172 - DNA, 20 bp, mouse
gtagtggcctctgcacagaa

SEQ ID NO: 443173 - DNA, 20 bp, mouse
gtgacccatggaccttctag

SEQ ID NO: 443174 - DNA, 20 bp, mouse
gggcatagagggtgagtagc

SEQ ID NO: 443175 - DNA, 20 bp, mouse
gtaacaggtgaaccgccacc

SEQ ID NO: 443176 - DNA, 20 bp, mouse
gactctcgcagcccacgaca

SEQ ID NO: 443177 - DNA, 20 bp, mouse
ggagaaccagcgaacctccg

SEQ ID NO: 443178 - DNA, 20 bp, mouse
gaagcctctgactctcgatg

SEQ ID NO: 443179 - DNA, 20 bp, mouse
gcccgggaggcgggtcccaa

SEQ ID NO: 443180 - DNA, 20 bp, mouse
gtcagaggcttccatgtcgt

SEQ ID NO: 443181 - DNA, 20 bp, mouse
gggttagcgtccccagacca

SEQ ID NO: 443182 - DNA, 20 bp, mouse
gtgggctgcgagagtgtccc

SEQ ID NO: 443183 - DNA, 20 bp, mouse
gtagggagtagagcaaagtc

SEQ ID NO: 443184 - DNA, 20 bp, mouse
gaggcttccgagcgcagagg

SEQ ID NO: 443185 - DNA, 20 bp, mouse
gtgccgcggcggttcgaact

SEQ ID NO: 443186 - DNA, 20 bp, mouse
ggtccggaagaaggcctcag

SEQ ID NO: 443187 - DNA, 20 bp, mouse
gaggcaacggtgacaccccg

SEQ ID NO: 443188 - DNA, 20 bp, mouse
ggcttcaggagcaggccccg

SEQ ID NO: 443189 - DNA, 20 bp, mouse
gcaccaggagagcccctcag

SEQ ID NO: 443190 - DNA, 20 bp, mouse
gagctctgacaacgaggcaa

SEQ ID NO: 443191 - DNA, 20 bp, mouse
gctgcctgtggaagatgcag

SEQ ID NO: 443192 - DNA, 20 bp, mouse
ggcctcagtagtgggaagtc

SEQ ID NO: 443193 - DNA, 20 bp, mouse
gacccagcacccgggtgcca

SEQ ID NO: 443194 - DNA, 20 bp, mouse
gcagaggcgcgctgttgcca

SEQ ID NO: 443195 - DNA, 20 bp, mouse
gagggagaggataaacgtcg

SEQ ID NO: 443196 - DNA, 20 bp, mouse
gcagctgcaggcacctccac

SEQ ID NO: 443197 - DNA, 20 bp, mouse
ggctgaagcggccgcaacga

SEQ ID NO: 443198 - DNA, 20 bp, mouse
ggcggccgcaacgatggtga

SEQ ID NO: 443199 - DNA, 20 bp, mouse
ggctccggcggagccggtgg

SEQ ID NO: 443200 - DNA, 20 bp, mouse
gtcagctccggcggagccgg

SEQ ID NO: 443201 - DNA, 20 bp, mouse
gggtaacgcgtcagctccgg

SEQ ID NO: 443202 - DNA, 20 bp, mouse
gcgcaacgatggtgagggtc

SEQ ID NO: 443203 - DNA, 20 bp, mouse
gtatggtaacgcgtcagctc

SEQ ID NO: 443204 - DNA, 20 bp, mouse
gactcagctcaagaggatgg

SEQ ID NO: 443205 - DNA, 20 bp, mouse
gttgcggccgcttcagctgc

SEQ ID NO: 443206 - DNA, 20 bp, mouse
gtaactccggggctgggtct

SEQ ID NO: 443207 - DNA, 20 bp, mouse
gcgccgcgccgagagcagcg

SEQ ID NO: 443208 - DNA, 20 bp, mouse
gaggaccagatcagagaaat

SEQ ID NO: 443209 - DNA, 20 bp, mouse
gctccgcgctgctctcggcg

SEQ ID NO: 443210 - DNA, 20 bp, mouse
gtaaggttcccgggtaatgg

SEQ ID NO: 443211 - DNA, 20 bp, mouse
ggttagaattaactccacca

SEQ ID NO: 443212 - DNA, 20 bp, mouse
gggagttaattctaactccg

SEQ ID NO: 443213 - DNA, 20 bp, mouse
ggtgccgcgcgaggaacatt

SEQ ID NO: 443214 - DNA, 20 bp, mouse
gtagagtgtaagcagggagg

SEQ ID NO: 443215 - DNA, 20 bp, mouse
gcccggatgtgagcaattgg

SEQ ID NO: 443216 - DNA, 20 bp, mouse
gcgcgccccgcccagtccaa

SEQ ID NO: 443217 - DNA, 20 bp, mouse
gtagggtgaaccccgcgtgg

SEQ ID NO: 443218 - DNA, 20 bp, mouse
gcggtagggccgggtctcag

SEQ ID NO: 443219 - DNA, 20 bp, mouse
ggcgctgcggtcccgcggaa

SEQ ID NO: 443220 - DNA, 20 bp, mouse
gagcccgctgcccttggact

SEQ ID NO: 443221 - DNA, 20 bp, mouse
ggaaagcagctccaacccgg

SEQ ID NO: 443222 - DNA, 20 bp, mouse
gccgcccagtccaagggcag

SEQ ID NO: 443223 - DNA, 20 bp, mouse
gccgcgcagcgagcacacct

SEQ ID NO: 443224 - DNA, 20 bp, mouse
ggaagtgaggagactcgact

SEQ ID NO: 443225 - DNA, 20 bp, mouse
gcctagctccccccttccgc

SEQ ID NO: 443226 - DNA, 20 bp, mouse
gatcagatctacaggcccgg

SEQ ID NO: 443227 - DNA, 20 bp, mouse
gccccgggcatggcctgcat

SEQ ID NO: 443228 - DNA, 20 bp, mouse
ggcctgtagatctgatcagg

SEQ ID NO: 443229 - DNA, 20 bp, mouse
ggcatggcctgcatgggtcg

SEQ ID NO: 443230 - DNA, 20 bp, mouse
gacccatgcaggccatgccc

SEQ ID NO: 443231 - DNA, 20 bp, mouse
gcacagtgctggggagtccc

SEQ ID NO: 443232 - DNA, 20 bp, mouse
ggcctcctgatcagatctac

SEQ ID NO: 443233 - DNA, 20 bp, mouse
gggagctaaacagagagcaa

SEQ ID NO: 443234 - DNA, 20 bp, mouse
gaatagggttagggacctgg

SEQ ID NO: 443235 - DNA, 20 bp, mouse
ggaggaggtgggagtccggt

SEQ ID NO: 443236 - DNA, 20 bp, mouse
gcatgatcctggtagaagag

SEQ ID NO: 443237 - DNA, 20 bp, mouse
ggtccgccggaagtgtcctg

SEQ ID NO: 443238 - DNA, 20 bp, mouse
gggacgaccaggcagccgag

SEQ ID NO: 443239 - DNA, 20 bp, mouse
ggcgaagcttgagataccgc

SEQ ID NO: 443240 - DNA, 20 bp, mouse
gccggggccaggggacgacc

SEQ ID NO: 443241 - DNA, 20 bp, mouse
gtgagataccgccggcgcga

SEQ ID NO: 443242 - DNA, 20 bp, mouse
gaggtgcgggcagaacgcta

SEQ ID NO: 443243 - DNA, 20 bp, mouse
gggccaagcagggaaccaga

SEQ ID NO: 443244 - DNA, 20 bp, mouse
gaggtgcccgcggaaggacg

SEQ ID NO: 443245 - DNA, 20 bp, mouse
ggagtcgccactcttctacc

SEQ ID NO: 443246 - DNA, 20 bp, mouse
gcgtggcttcgcttacggaa

SEQ ID NO: 443247 - DNA, 20 bp, mouse
ggccacgcacaggttattcg

SEQ ID NO: 443248 - DNA, 20 bp, mouse
gcgtaagcgaagccacgcac

SEQ ID NO: 443249 - DNA, 20 bp, mouse
gtccccgaataacctgtgcg

SEQ ID NO: 443250 - DNA, 20 bp, mouse
gaagttctcctgcttcatag

SEQ ID NO: 443251 - DNA, 20 bp, mouse
gcagggctctgccctaccag

SEQ ID NO: 443252 - DNA, 20 bp, mouse
gtccttgtcatagaagtatc

SEQ ID NO: 443253 - DNA, 20 bp, mouse
gtgccctgaaggactcgtca

SEQ ID NO: 443254 - DNA, 20 bp, mouse
gagccggggctgcgacacac

SEQ ID NO: 443255 - DNA, 20 bp, mouse
gctgtcacacagagcccagg

SEQ ID NO: 443256 - DNA, 20 bp, mouse
ggcgttcaaagcctccgcca

SEQ ID NO: 443257 - DNA, 20 bp, mouse
gtgacccaggcagacgagct

SEQ ID NO: 443258 - DNA, 20 bp, mouse
ggctcttgatgcagccctgg

SEQ ID NO: 443259 - DNA, 20 bp, mouse
gtacataccggagggagaaa

SEQ ID NO: 443260 - DNA, 20 bp, mouse
ggagcccagctcgtctgcct

SEQ ID NO: 443261 - DNA, 20 bp, mouse
gtgaatgaggcaaagtccag

SEQ ID NO: 443262 - DNA, 20 bp, mouse
gatgacccatctacactcag

SEQ ID NO: 443263 - DNA, 20 bp, mouse
gtgcggaagggaaatgaatg

SEQ ID NO: 443264 - DNA, 20 bp, mouse
gccggagggagaaaaggctg

SEQ ID NO: 443265 - DNA, 20 bp, mouse
gacacgagggacctttccag

SEQ ID NO: 443266 - DNA, 20 bp, mouse
gcaggtcagtagaaccccaa

SEQ ID NO: 443267 - DNA, 20 bp, mouse
ggacccagtaagagacctga

SEQ ID NO: 443268 - DNA, 20 bp, mouse
gctgctgaggtcctctccag

SEQ ID NO: 443269 - DNA, 20 bp, mouse
gctactgacctggaagtttg

SEQ ID NO: 443270 - DNA, 20 bp, mouse
gctggcatggaacagctggg

SEQ ID NO: 443271 - DNA, 20 bp, mouse
gccctctcggaagtaaagtg

SEQ ID NO: 443272 - DNA, 20 bp, mouse
ggacctggaagtttggggtc

SEQ ID NO: 443273 - DNA, 20 bp, mouse
gctttccttaggcacatctc

SEQ ID NO: 443274 - DNA, 20 bp, mouse
gaggcggatcacagtcgctc

SEQ ID NO: 443275 - DNA, 20 bp, mouse
gtctctctcctcaggggaac

SEQ ID NO: 443276 - DNA, 20 bp, mouse
gagagtcacagaggcttcat

SEQ ID NO: 443277 - DNA, 20 bp, mouse
gagccagaggcctacctgca

SEQ ID NO: 443278 - DNA, 20 bp, mouse
gggtcagtctccttgcaggt

SEQ ID NO: 443279 - DNA, 20 bp, mouse
ggacctatccagagtcacag

SEQ ID NO: 443280 - DNA, 20 bp, mouse
gccacggatgctgtagccag

SEQ ID NO: 443281 - DNA, 20 bp, mouse
gctccttgcaggtaggcctc

SEQ ID NO: 443282 - DNA, 20 bp, mouse
gagcctctgtgactctggat

SEQ ID NO: 443283 - DNA, 20 bp, mouse
gtctcggtcagtctccttgc

SEQ ID NO: 443284 - DNA, 20 bp, mouse
gaagggaaggagcagatgaa

SEQ ID NO: 443285 - DNA, 20 bp, mouse
gacctccagccagcaccggt

SEQ ID NO: 443286 - DNA, 20 bp, mouse
gtgcccgagaaccgcggacg

SEQ ID NO: 443287 - DNA, 20 bp, mouse
gagcgcctgcccgagaaccg

SEQ ID NO: 443288 - DNA, 20 bp, mouse
gtcaagggtctccactccga

SEQ ID NO: 443289 - DNA, 20 bp, mouse
gagagcgcggcgagcagcag

SEQ ID NO: 443290 - DNA, 20 bp, mouse
gagccgtgcacccagctctc

SEQ ID NO: 443291 - DNA, 20 bp, mouse
gctccggagagctgggtgca

SEQ ID NO: 443292 - DNA, 20 bp, mouse
gagctctccggagcgcgtgc

SEQ ID NO: 443293 - DNA, 20 bp, mouse
ggagccgagcgccccgtccg

SEQ ID NO: 443294 - DNA, 20 bp, mouse
gcgccccgtccgcggttctc

SEQ ID NO: 443295 - DNA, 20 bp, mouse
gctgccagctgccgtcggag

SEQ ID NO: 443296 - DNA, 20 bp, mouse
gggccgcgcgcagggcacaa

SEQ ID NO: 443297 - DNA, 20 bp, mouse
gagtggggttgccatgacag

SEQ ID NO: 443298 - DNA, 20 bp, mouse
gtggcaaccccactcagcgg

SEQ ID NO: 443299 - DNA, 20 bp, mouse
ggaagagcaggtccgtcccc

SEQ ID NO: 443300 - DNA, 20 bp, mouse
ggcccgagcgaaaggactgt

SEQ ID NO: 443301 - DNA, 20 bp, mouse
gtgctcggcccggtaacggt

SEQ ID NO: 443302 - DNA, 20 bp, mouse
gtccgtccccgggctgaggt

SEQ ID NO: 443303 - DNA, 20 bp, mouse
gtggctgggaccttcgggga

SEQ ID NO: 443304 - DNA, 20 bp, mouse
ggccagcgcgcagaaggagc

SEQ ID NO: 443305 - DNA, 20 bp, mouse
gaccgcgcgaaggagctcac

SEQ ID NO: 443306 - DNA, 20 bp, mouse
gaccccgggaaccttcagaa

SEQ ID NO: 443307 - DNA, 20 bp, mouse
gctgggcaggtaattgcggt

SEQ ID NO: 443308 - DNA, 20 bp, mouse
gcgggcgtttggaaactgct

SEQ ID NO: 443309 - DNA, 20 bp, mouse
gactgctgggcaggtaattg

SEQ ID NO: 443310 - DNA, 20 bp, mouse
ggtcaggaagaatcggggag

SEQ ID NO: 443311 - DNA, 20 bp, mouse
gtggcagtcaggaagaatcg

SEQ ID NO: 443312 - DNA, 20 bp, mouse
ggggcggagtctctgagtga

SEQ ID NO: 443313 - DNA, 20 bp, mouse
gggtaattgcggtaggtgag

SEQ ID NO: 443314 - DNA, 20 bp, mouse
gtgctaaacacgggacaccg

SEQ ID NO: 443315 - DNA, 20 bp, mouse
gccagcgacaaacctgagcc

SEQ ID NO: 443316 - DNA, 20 bp, mouse
gaccccacttcaccctcctg

SEQ ID NO: 443317 - DNA, 20 bp, mouse
gaggttagggaacggattcc

SEQ ID NO: 443318 - DNA, 20 bp, mouse
gtaagcaggaggttagggaa

SEQ ID NO: 443319 - DNA, 20 bp, mouse
gcccaggactgggcagaaca

SEQ ID NO: 443320 - DNA, 20 bp, mouse
gcctgtactttcccaggact

SEQ ID NO: 443321 - DNA, 20 bp, mouse
gcagaagtgggagatcctgt

SEQ ID NO: 443322 - DNA, 20 bp, mouse
gccatggcccagaaactcta

SEQ ID NO: 443323 - DNA, 20 bp, mouse
gaagtgggagatcctgtggg

SEQ ID NO: 443324 - DNA, 20 bp, mouse
gatgggacgacagaagacaa

SEQ ID NO: 443325 - DNA, 20 bp, mouse
gactctgcccccaagaggat

SEQ ID NO: 443326 - DNA, 20 bp, mouse
gcgggtgcacggagccggag

SEQ ID NO: 443327 - DNA, 20 bp, mouse
gccggagaggcagcccgcca

SEQ ID NO: 443328 - DNA, 20 bp, mouse
gaacttggcgggcctgatgc

SEQ ID NO: 443329 - DNA, 20 bp, mouse
gagttgctgcagctcagaga

SEQ ID NO: 443330 - DNA, 20 bp, mouse
gtgctcgggccgtttgaact

SEQ ID NO: 443331 - DNA, 20 bp, mouse
gcttgcagcgggcgaggtaa

SEQ ID NO: 443332 - DNA, 20 bp, mouse
gaggggagacaacagggaca

SEQ ID NO: 443333 - DNA, 20 bp, mouse
gggtaacgggtgcacggagc

SEQ ID NO: 443334 - DNA, 20 bp, mouse
gccggaagcccggcttgcag

SEQ ID NO: 443335 - DNA, 20 bp, mouse
gaccttgctctcggactcac

SEQ ID NO: 443336 - DNA, 20 bp, mouse
gtctgacgccatgggagatg

SEQ ID NO: 443337 - DNA, 20 bp, mouse
gcacggcagtctgacgccat

SEQ ID NO: 443338 - DNA, 20 bp, mouse
gagctggtgctgttacagca

SEQ ID NO: 443339 - DNA, 20 bp, mouse
gggagaaagaagagcgaggc

SEQ ID NO: 443340 - DNA, 20 bp, mouse
gcaacaaaccacatctccca

SEQ ID NO: 443341 - DNA, 20 bp, mouse
gtggatctctgtgggcccag

SEQ ID NO: 443342 - DNA, 20 bp, mouse
gctacaacagaaatttctgg

SEQ ID NO: 443343 - DNA, 20 bp, mouse
gtgtagccacagaatactaa

SEQ ID NO: 443344 - DNA, 20 bp, mouse
gagtcccctttagtattctg

SEQ ID NO: 443345 - DNA, 20 bp, mouse
gtagaacggttggctgggga

SEQ ID NO: 443346 - DNA, 20 bp, mouse
gaacttacccagagcctgag

SEQ ID NO: 443347 - DNA, 20 bp, mouse
gcagcatcccctcaggctct

SEQ ID NO: 443348 - DNA, 20 bp, mouse
gaggctctgggtaagttctc

SEQ ID NO: 443349 - DNA, 20 bp, mouse
gccacatgacgcaggaaaat

SEQ ID NO: 443350 - DNA, 20 bp, mouse
gctatccaatagctatagga

SEQ ID NO: 443351 - DNA, 20 bp, mouse
gggcaagaagggggtagcat

SEQ ID NO: 443352 - DNA, 20 bp, mouse
gttcctaggatgcacaaggt

SEQ ID NO: 443353 - DNA, 20 bp, mouse
gcagaaatccatgaaaccac

SEQ ID NO: 443354 - DNA, 20 bp, mouse
gagctattggatagtgctag

SEQ ID NO: 443355 - DNA, 20 bp, mouse
gagcttgggccacatgacgc

SEQ ID NO: 443356 - DNA, 20 bp, mouse
gcagttcaggaccagaagac

SEQ ID NO: 443357 - DNA, 20 bp, mouse
gggagcaagctgagtgcacg

SEQ ID NO: 443358 - DNA, 20 bp, mouse
gcttgctccgaagcctcggt

SEQ ID NO: 443359 - DNA, 20 bp, mouse
gcttggcacaccacaccctg

SEQ ID NO: 443360 - DNA, 20 bp, mouse
gactggagaattgccgaccg

SEQ ID NO: 443361 - DNA, 20 bp, mouse
ggaattgccgaccgaggctt

SEQ ID NO: 443362 - DNA, 20 bp, mouse
gctgagtgcacgcggctggt

SEQ ID NO: 443363 - DNA, 20 bp, mouse
ggagaagctggggtgttagg

SEQ ID NO: 443364 - DNA, 20 bp, mouse
gtagcgtcgggagctctaac

SEQ ID NO: 443365 - DNA, 20 bp, mouse
gtcagcttgctccgaagcct

SEQ ID NO: 443366 - DNA, 20 bp, mouse
gtccaggctcccttcatcct

SEQ ID NO: 443367 - DNA, 20 bp, mouse
gaagcggttcccaggatgaa

SEQ ID NO: 443368 - DNA, 20 bp, mouse
ggcttgggcctggtagtaag

SEQ ID NO: 443369 - DNA, 20 bp, mouse
gctggtagtaagcggttccc

SEQ ID NO: 443370 - DNA, 20 bp, mouse
gccacactcgggaggagggg

SEQ ID NO: 443371 - DNA, 20 bp, mouse
gtcccaggatgaagggagcc

SEQ ID NO: 443372 - DNA, 20 bp, mouse
gccagatcggcgcttgggcc

SEQ ID NO: 443373 - DNA, 20 bp, mouse
ggatgaagggagcctggagc

SEQ ID NO: 443374 - DNA, 20 bp, mouse
gcgtgttcggttggccagat

SEQ ID NO: 443375 - DNA, 20 bp, mouse
gacccgcagccaggctagga

SEQ ID NO: 443376 - DNA, 20 bp, mouse
gggctgcgagctccagggaa

SEQ ID NO: 443377 - DNA, 20 bp, mouse
gccgcggaatacagacggtt

SEQ ID NO: 443378 - DNA, 20 bp, mouse
gggcttggctgcgagctcca

SEQ ID NO: 443379 - DNA, 20 bp, mouse
gcatggcgtacgaggctcaa

SEQ ID NO: 443380 - DNA, 20 bp, mouse
gtagggccgcggaatacaga

SEQ ID NO: 443381 - DNA, 20 bp, mouse
gtccagggaacggttttggg

SEQ ID NO: 443382 - DNA, 20 bp, mouse
gaggggagagacgaccagag

SEQ ID NO: 443383 - DNA, 20 bp, mouse
ggaatacagacggttaggct

SEQ ID NO: 443384 - DNA, 20 bp, mouse
ggccacccaaaaccgttccc

SEQ ID NO: 443385 - DNA, 20 bp, mouse
ggatcctggaggatcaggtg

SEQ ID NO: 443386 - DNA, 20 bp, mouse
ggcctagcaacgagagatgg

SEQ ID NO: 443387 - DNA, 20 bp, mouse
ggtagcctagcaacgagaga

SEQ ID NO: 443388 - DNA, 20 bp, mouse
ggccggaggaccaggctgac

SEQ ID NO: 443389 - DNA, 20 bp, mouse
gacccgtcagcctggtcctc

SEQ ID NO: 443390 - DNA, 20 bp, mouse
gatggcggagccggaggacc

SEQ ID NO: 443391 - DNA, 20 bp, mouse
gagcgtgggttgggtagtgt

SEQ ID NO: 443392 - DNA, 20 bp, mouse
gagcagaaagccccgagcag

SEQ ID NO: 443393 - DNA, 20 bp, mouse
gacggatgcgcaggaccctg

SEQ ID NO: 443394 - DNA, 20 bp, mouse
gaggctacgccatcaacatc

SEQ ID NO: 443395 - DNA, 20 bp, mouse
ggctgacgggtaagccccgc

SEQ ID NO: 443396 - DNA, 20 bp, mouse
gggagccggacggtccgcga

SEQ ID NO: 443397 - DNA, 20 bp, mouse
gggcgaaccgaggagccgga

SEQ ID NO: 443398 - DNA, 20 bp, mouse
gggcacccacgcctcgggaa

SEQ ID NO: 443399 - DNA, 20 bp, mouse
gcggggctggaggcgaaccg

SEQ ID NO: 443400 - DNA, 20 bp, mouse
gggtagcccgggaaactcgg

SEQ ID NO: 443401 - DNA, 20 bp, mouse
ggctacctcaacctttcccg

SEQ ID NO: 443402 - DNA, 20 bp, mouse
gcacgcctcgggaaaggttg

SEQ ID NO: 443403 - DNA, 20 bp, mouse
gtggaggcgaaccgaggagc

SEQ ID NO: 443404 - DNA, 20 bp, mouse
gcgaggcgtgggtgccctcg

SEQ ID NO: 443405 - DNA, 20 bp, mouse
gggtgccctcgcggaccgtc

SEQ ID NO: 443406 - DNA, 20 bp, mouse
gcacagcagaaaccagctag

SEQ ID NO: 443407 - DNA, 20 bp, mouse
gctgtaggagaggaaagacc

SEQ ID NO: 443408 - DNA, 20 bp, mouse
gccggctacagtatggggag

SEQ ID NO: 443409 - DNA, 20 bp, mouse
ggtaggccaccggggctgtt

SEQ ID NO: 443410 - DNA, 20 bp, mouse
gtgatgggggcccagagtca

SEQ ID NO: 443411 - DNA, 20 bp, mouse
gagtttgggcatgatggaag

SEQ ID NO: 443412 - DNA, 20 bp, mouse
gagctacctaacagccccgg

SEQ ID NO: 443413 - DNA, 20 bp, mouse
gtagctgccaccatgagttt

SEQ ID NO: 443414 - DNA, 20 bp, mouse
gaaccaggcagcttgttgct

SEQ ID NO: 443415 - DNA, 20 bp, mouse
gtactgtagccggaagtatt

SEQ ID NO: 443416 - DNA, 20 bp, mouse
gtgtccaggccagaggttat

SEQ ID NO: 443417 - DNA, 20 bp, mouse
gcggctggcccgctacatgg

SEQ ID NO: 443418 - DNA, 20 bp, mouse
gcagaggttatgggctgaga

SEQ ID NO: 443419 - DNA, 20 bp, mouse
gttcaaactgagggatcagt

SEQ ID NO: 443420 - DNA, 20 bp, mouse
gctgagggatcagtgggctt

SEQ ID NO: 443421 - DNA, 20 bp, mouse
gctgaatagctggcttccga

SEQ ID NO: 443422 - DNA, 20 bp, mouse
gtgtgtaagtgtaaccgggg

SEQ ID NO: 443423 - DNA, 20 bp, mouse
gcagtcggctcaagaaggcc

SEQ ID NO: 443424 - DNA, 20 bp, mouse
ggcttgggtcactgaatagc

SEQ ID NO: 443425 - DNA, 20 bp, mouse
gaagctttgggcccagtata

SEQ ID NO: 443426 - DNA, 20 bp, mouse
gggagacacctgtgcaacaa

SEQ ID NO: 443427 - DNA, 20 bp, mouse
ggcttctgggagttccagac

SEQ ID NO: 443428 - DNA, 20 bp, mouse
gccctcggcttgtgctaagg

SEQ ID NO: 443429 - DNA, 20 bp, mouse
gagtccctcggcttgtgcta

SEQ ID NO: 443430 - DNA, 20 bp, mouse
gaggcggaaatactcctccc

SEQ ID NO: 443431 - DNA, 20 bp, mouse
ggccgagggactgtcctgtc

SEQ ID NO: 443432 - DNA, 20 bp, mouse
gccctctcttggaccactca

SEQ ID NO: 443433 - DNA, 20 bp, mouse
ggccaccttagcacaagccg

SEQ ID NO: 443434 - DNA, 20 bp, mouse
ggtcactgccattgttgcac

SEQ ID NO: 443435 - DNA, 20 bp, mouse
gcagataggtctcccctcca

SEQ ID NO: 443436 - DNA, 20 bp, mouse
gaagtggccgcggcagtcct

SEQ ID NO: 443437 - DNA, 20 bp, mouse
gctgccgcggccacttcgct

SEQ ID NO: 443438 - DNA, 20 bp, mouse
gcagtcctcggtgaaggcga

SEQ ID NO: 443439 - DNA, 20 bp, mouse
gatggcggcgcccagcgaag

SEQ ID NO: 443440 - DNA, 20 bp, mouse
gcactgcggtaggcaccctc

SEQ ID NO: 443441 - DNA, 20 bp, mouse
ggcccgacaggcactgcggt

SEQ ID NO: 443442 - DNA, 20 bp, mouse
gcgcggcccgacaggcactg

SEQ ID NO: 443443 - DNA, 20 bp, mouse
gccttcaccgaggactgccg

SEQ ID NO: 443444 - DNA, 20 bp, mouse
ggcagagaggataccctgca

SEQ ID NO: 443445 - DNA, 20 bp, mouse
gcccagtggcgcggcccgac

SEQ ID NO: 443446 - DNA, 20 bp, mouse
gctgtacgcattctacgtaa

SEQ ID NO: 443447 - DNA, 20 bp, mouse
gacgcattctacgtaacgga

SEQ ID NO: 443448 - DNA, 20 bp, mouse
gctggcacggtcacaccgac

SEQ ID NO: 443449 - DNA, 20 bp, mouse
gtgcagcctcgggtgcaggt

SEQ ID NO: 443450 - DNA, 20 bp, mouse
ggtgaccgtgccaggccgag

SEQ ID NO: 443451 - DNA, 20 bp, mouse
gagcagaaaaggatggacag

SEQ ID NO: 443452 - DNA, 20 bp, mouse
gaggtcgcaaagataatctg

SEQ ID NO: 443453 - DNA, 20 bp, mouse
gaccaccggccggacttaaa

SEQ ID NO: 443454 - DNA, 20 bp, mouse
ggtcaccgctcggcctggca

SEQ ID NO: 443455 - DNA, 20 bp, mouse
gacttagtcaccgctcggcc

SEQ ID NO: 443456 - DNA, 20 bp, mouse
ggccgggcgtgaaggaaggt

SEQ ID NO: 443457 - DNA, 20 bp, mouse
gcgaggcccagcggccgcca

SEQ ID NO: 443458 - DNA, 20 bp, mouse
ggccagccagacactagact

SEQ ID NO: 443459 - DNA, 20 bp, mouse
ggcgtccacagggcagaaca

SEQ ID NO: 443460 - DNA, 20 bp, mouse
ggcgtgaaggaaggtaggtc

SEQ ID NO: 443461 - DNA, 20 bp, mouse
gaggccgcgcggccaggcga

SEQ ID NO: 443462 - DNA, 20 bp, mouse
gtctacatcaagcgtccaca

SEQ ID NO: 443463 - DNA, 20 bp, mouse
gaaggtaggtcgggactcgc

SEQ ID NO: 443464 - DNA, 20 bp, mouse
gggtggcgttccgagtggag

SEQ ID NO: 443465 - DNA, 20 bp, mouse
gcactcggaacgccaccccc

SEQ ID NO: 443466 - DNA, 20 bp, mouse
gcggtcaggggtcaattgag

SEQ ID NO: 443467 - DNA, 20 bp, mouse
gctttctgctggagcctaat

SEQ ID NO: 443468 - DNA, 20 bp, mouse
gaggcaattcaggtacgggg

SEQ ID NO: 443469 - DNA, 20 bp, mouse
gcaattgagtggcagacgcg

SEQ ID NO: 443470 - DNA, 20 bp, mouse
gggcttaggcaattcaggta

SEQ ID NO: 443471 - DNA, 20 bp, mouse
gtgaattgcctaagcctatt

SEQ ID NO: 443472 - DNA, 20 bp, mouse
ggataggagatggcagaagt

SEQ ID NO: 443473 - DNA, 20 bp, mouse
gcaagtggcgggcacgagat

SEQ ID NO: 443474 - DNA, 20 bp, mouse
ggctggagcctaataggctt

SEQ ID NO: 443475 - DNA, 20 bp, mouse
gggtcagcacccgcccctga

SEQ ID NO: 443476 - DNA, 20 bp, mouse
gtcagcggatggggaccccg

SEQ ID NO: 443477 - DNA, 20 bp, mouse
gggagtctgggctctctact

SEQ ID NO: 443478 - DNA, 20 bp, mouse
gctatgcctgaccccatgag

SEQ ID NO: 443479 - DNA, 20 bp, mouse
ggccccgaaggcaggaactt

SEQ ID NO: 443480 - DNA, 20 bp, mouse
gtcctactctgggcaatggg

SEQ ID NO: 443481 - DNA, 20 bp, mouse
gtccatctcctcagcggatg

SEQ ID NO: 443482 - DNA, 20 bp, mouse
gcaaggggccctggttccca

SEQ ID NO: 443483 - DNA, 20 bp, mouse
gctgaggagatggatgagga

SEQ ID NO: 443484 - DNA, 20 bp, mouse
ggaaaacaggggcccggatt

SEQ ID NO: 443485 - DNA, 20 bp, mouse
gtgcccagagtaggaaaaca

SEQ ID NO: 443486 - DNA, 20 bp, mouse
gcagcgtcaggcaggttagg

SEQ ID NO: 443487 - DNA, 20 bp, mouse
ggaacatcaaaggcagcgtc

SEQ ID NO: 443488 - DNA, 20 bp, mouse
ggcagtccacacctggccag

SEQ ID NO: 443489 - DNA, 20 bp, mouse
gaacacaaagctctgaagtt

SEQ ID NO: 443490 - DNA, 20 bp, mouse
ggctctgaagttaggctgct

SEQ ID NO: 443491 - DNA, 20 bp, mouse
gggaaagaactccagtacat

SEQ ID NO: 443492 - DNA, 20 bp, mouse
gtcacatcattgaatacctg

SEQ ID NO: 443493 - DNA, 20 bp, mouse
gcagatgaggatcacaggaa

SEQ ID NO: 443494 - DNA, 20 bp, mouse
gaccgtaagaagcccttgtt

SEQ ID NO: 443495 - DNA, 20 bp, mouse
gatcaaaggcagcgtcaggc

SEQ ID NO: 443496 - DNA, 20 bp, mouse
gccgcgtcgaccaggtccag

SEQ ID NO: 443497 - DNA, 20 bp, mouse
gagcggagacgggaacaaga

SEQ ID NO: 443498 - DNA, 20 bp, mouse
gccgggcaggcagtgagtga

SEQ ID NO: 443499 - DNA, 20 bp, mouse
gcaagatggcgatcccgggc

SEQ ID NO: 443500 - DNA, 20 bp, mouse
gcccggttggatgcgctcag

SEQ ID NO: 443501 - DNA, 20 bp, mouse
ggaccaggtccagcggagac

SEQ ID NO: 443502 - DNA, 20 bp, mouse
gtgatggggaagttagggtc

SEQ ID NO: 443503 - DNA, 20 bp, mouse
ggtgagtgatggggaagtta

SEQ ID NO: 443504 - DNA, 20 bp, mouse
ggctggggagtaagaagcca

SEQ ID NO: 443505 - DNA, 20 bp, mouse
ggcatctgccagggagaacg

SEQ ID NO: 443506 - DNA, 20 bp, mouse
gggttcgggcgggagagtgc

SEQ ID NO: 443507 - DNA, 20 bp, mouse
gccgcgctgtaggttcgggc

SEQ ID NO: 443508 - DNA, 20 bp, mouse
gtggcccgcgctgtaggttc

SEQ ID NO: 443509 - DNA, 20 bp, mouse
ggtgctggcgctcggaatcc

SEQ ID NO: 443510 - DNA, 20 bp, mouse
gagctgcgccagctgggacc

SEQ ID NO: 443511 - DNA, 20 bp, mouse
gtgtgccaggacggtcccag

SEQ ID NO: 443512 - DNA, 20 bp, mouse
gtcccagctggcgcagctct

SEQ ID NO: 443513 - DNA, 20 bp, mouse
ggctcggaatcctggagacc

SEQ ID NO: 443514 - DNA, 20 bp, mouse
gtggagacccgggtcccagc

SEQ ID NO: 443515 - DNA, 20 bp, mouse
ggcgcgtgtggctaatcacg

SEQ ID NO: 443516 - DNA, 20 bp, mouse
gtgcccgggcatgatgaagg

SEQ ID NO: 443517 - DNA, 20 bp, mouse
gcagcccccatgacctccaa

SEQ ID NO: 443518 - DNA, 20 bp, mouse
ggcctgcccgggcatgatga

SEQ ID NO: 443519 - DNA, 20 bp, mouse
gtcctcgtgttcgttcaata

SEQ ID NO: 443520 - DNA, 20 bp, mouse
gggaggtgccggaggctcac

SEQ ID NO: 443521 - DNA, 20 bp, mouse
gaacctcatcacctggaact

SEQ ID NO: 443522 - DNA, 20 bp, mouse
ggagctctgaagctgtgggt

SEQ ID NO: 443523 - DNA, 20 bp, mouse
gactgggacgtggggacaaa

SEQ ID NO: 443524 - DNA, 20 bp, mouse
ggaatgacccggtgagcctc

SEQ ID NO: 443525 - DNA, 20 bp, mouse
gggcatgatgaaggcggagg

SEQ ID NO: 443526 - DNA, 20 bp, mouse
ggacttggcgagcttaggaa

SEQ ID NO: 443527 - DNA, 20 bp, mouse
gttcgcggccgtcttccaag

SEQ ID NO: 443528 - DNA, 20 bp, mouse
gcggtccgccacttggaaga

SEQ ID NO: 443529 - DNA, 20 bp, mouse
ggcggccgtcttccaagtgg

SEQ ID NO: 443530 - DNA, 20 bp, mouse
gctcccaccgtggaaaaaga

SEQ ID NO: 443531 - DNA, 20 bp, mouse
gccgccagcacgctctcagg

SEQ ID NO: 443532 - DNA, 20 bp, mouse
gttccaagtggcggaccgga

SEQ ID NO: 443533 - DNA, 20 bp, mouse
gccacgcgccgcaaaccctc

SEQ ID NO: 443534 - DNA, 20 bp, mouse
gtcgggcccgccgaagtcga

SEQ ID NO: 443535 - DNA, 20 bp, mouse
gccccggaggatgagcgtca

SEQ ID NO: 443536 - DNA, 20 bp, mouse
ggcggcggcggagaaagaga

SEQ ID NO: 443537 - DNA, 20 bp, mouse
gtgagctcctccaggcggaa

SEQ ID NO: 443538 - DNA, 20 bp, mouse
gcctgctcggcgacctcggg

SEQ ID NO: 443539 - DNA, 20 bp, mouse
ggcggcggcgggaagtcggg

SEQ ID NO: 443540 - DNA, 20 bp, mouse
gagcgcgagcgagagcgaca

SEQ ID NO: 443541 - DNA, 20 bp, mouse
gagcgagagcgacacggacg

SEQ ID NO: 443542 - DNA, 20 bp, mouse
gcgtcctgctcggcgacctc

SEQ ID NO: 443543 - DNA, 20 bp, mouse
gccgccatggctgggcgagt

SEQ ID NO: 443544 - DNA, 20 bp, mouse
gctggggcccggggacgcag

SEQ ID NO: 443545 - DNA, 20 bp, mouse
gctcagagcgcggcgcgggc

SEQ ID NO: 443546 - DNA, 20 bp, mouse
gccctcggccagcgagacga

SEQ ID NO: 443547 - DNA, 20 bp, mouse
gccagcgagacgagggagta

SEQ ID NO: 443548 - DNA, 20 bp, mouse
gtaaggcgggccccaccatg

SEQ ID NO: 443549 - DNA, 20 bp, mouse
gcaaggccgagccccatggt

SEQ ID NO: 443550 - DNA, 20 bp, mouse
ggtctcgctggccgagggtg

SEQ ID NO: 443551 - DNA, 20 bp, mouse
gcgagacgagggagtaaggc

SEQ ID NO: 443552 - DNA, 20 bp, mouse
gtaaccgagcgtgccctact

SEQ ID NO: 443553 - DNA, 20 bp, mouse
ggcctgctcgggcctagcaa

SEQ ID NO: 443554 - DNA, 20 bp, mouse
gtagacaaaagccccaccct

SEQ ID NO: 443555 - DNA, 20 bp, mouse
gggcttaaaactgccaagta

SEQ ID NO: 443556 - DNA, 20 bp, mouse
ggtgaagatcgagtccgtgg

SEQ ID NO: 443557 - DNA, 20 bp, mouse
gggcggagctgaaacttcgg

SEQ ID NO: 443558 - DNA, 20 bp, mouse
gctcgtgaagatcgagtccg

SEQ ID NO: 443559 - DNA, 20 bp, mouse
gaagtgagaaggccggatgt

SEQ ID NO: 443560 - DNA, 20 bp, mouse
gaggtgaagagcgagtacgc

SEQ ID NO: 443561 - DNA, 20 bp, mouse
gtgagaaggccggatgtggg

SEQ ID NO: 443562 - DNA, 20 bp, mouse
ggtgggcggagctgaaactt

SEQ ID NO: 443563 - DNA, 20 bp, mouse
gaagagcgagtacgcgggtg

SEQ ID NO: 443564 - DNA, 20 bp, mouse
gtctagtgcagtattcggta

SEQ ID NO: 443565 - DNA, 20 bp, mouse
gagtacgcgggtgtgggcgc

SEQ ID NO: 443566 - DNA, 20 bp, mouse
gcataggcgcacggccgcag

SEQ ID NO: 443567 - DNA, 20 bp, mouse
ggtcacctccgagacgccat

SEQ ID NO: 443568 - DNA, 20 bp, mouse
gaggcgcacggccgcagcgg

SEQ ID NO: 443569 - DNA, 20 bp, mouse
gtctgagggcgcgccgtcct

SEQ ID NO: 443570 - DNA, 20 bp, mouse
gcgcgcatgcgtagctctga

SEQ ID NO: 443571 - DNA, 20 bp, mouse
gtgcgcctatggcgtctcgg

SEQ ID NO: 443572 - DNA, 20 bp, mouse
ggagcgctgctgttgaacgt

SEQ ID NO: 443573 - DNA, 20 bp, mouse
gtagctgggacccagcgacg

SEQ ID NO: 443574 - DNA, 20 bp, mouse
ggcgccgccgccccgggaca

SEQ ID NO: 443575 - DNA, 20 bp, mouse
gagcgacgaggcacgagcac

SEQ ID NO: 443576 - DNA, 20 bp, mouse
gcgggagccgcgggagccgt

SEQ ID NO: 443577 - DNA, 20 bp, mouse
gagccgtgggtggtaagtta

SEQ ID NO: 443578 - DNA, 20 bp, mouse
gctcccgcggctcccggtag

SEQ ID NO: 443579 - DNA, 20 bp, mouse
gccgcggctcccggtagtgg

SEQ ID NO: 443580 - DNA, 20 bp, mouse
gcacacgagccgccactacc

SEQ ID NO: 443581 - DNA, 20 bp, mouse
ggagccgcgggagccgtggg

SEQ ID NO: 443582 - DNA, 20 bp, mouse
gtaccctaacttaccaccca

SEQ ID NO: 443583 - DNA, 20 bp, mouse
gggcggctcgtgtgtctaag

SEQ ID NO: 443584 - DNA, 20 bp, mouse
gctctgctcatccccggcag

SEQ ID NO: 443585 - DNA, 20 bp, mouse
gttaccacccacggctcccg

SEQ ID NO: 443586 - DNA, 20 bp, mouse
gagctcggccggccaagccc

SEQ ID NO: 443587 - DNA, 20 bp, mouse
gagggctcgcggggacccgg

SEQ ID NO: 443588 - DNA, 20 bp, mouse
gcgtgccgcggcgcaaggcg

SEQ ID NO: 443589 - DNA, 20 bp, mouse
gcctccggggaaggagacga

SEQ ID NO: 443590 - DNA, 20 bp, mouse
ggcgcgcgccgagcccgcag

SEQ ID NO: 443591 - DNA, 20 bp, mouse
gccggggaaggagacgaggg

SEQ ID NO: 443592 - DNA, 20 bp, mouse
gcagcaggcgctgtccggct

SEQ ID NO: 443593 - DNA, 20 bp, mouse
ggcagctcgggatcctgggt

SEQ ID NO: 443594 - DNA, 20 bp, mouse
ggagacgagggcggcagcag

SEQ ID NO: 443595 - DNA, 20 bp, mouse
gagaggtgaggaccttccgg

SEQ ID NO: 443596 - DNA, 20 bp, mouse
ggggatcggggaacctcgga

SEQ ID NO: 443597 - DNA, 20 bp, mouse
gcgacaggtgagagcctagg

SEQ ID NO: 443598 - DNA, 20 bp, mouse
ggcctccggaagaggacttg

SEQ ID NO: 443599 - DNA, 20 bp, mouse
gcgccaccaggctccctccg

SEQ ID NO: 443600 - DNA, 20 bp, mouse
gcttggggatcggggaacct

SEQ ID NO: 443601 - DNA, 20 bp, mouse
gcccgccctcatcaccccct

SEQ ID NO: 443602 - DNA, 20 bp, mouse
ggaagaggacttggggatcg

SEQ ID NO: 443603 - DNA, 20 bp, mouse
gagagcctagggggtgatga

SEQ ID NO: 443604 - DNA, 20 bp, mouse
gctggcaccgcctccggaag

SEQ ID NO: 443605 - DNA, 20 bp, mouse
gccaagggagaagggttcag

SEQ ID NO: 443606 - DNA, 20 bp, mouse
gctccacgccaagagtgctc

SEQ ID NO: 443607 - DNA, 20 bp, mouse
gcgtggaggacagaggtcta

SEQ ID NO: 443608 - DNA, 20 bp, mouse
gcgcctgagcactcttggcg

SEQ ID NO: 443609 - DNA, 20 bp, mouse
gttctggagctaaggtaatg

SEQ ID NO: 443610 - DNA, 20 bp, mouse
gtagacagggagggaccttc

SEQ ID NO: 443611 - DNA, 20 bp, mouse
ggagggaccttctggagcta

SEQ ID NO: 443612 - DNA, 20 bp, mouse
gcccaaggcacccctgtccg

SEQ ID NO: 443613 - DNA, 20 bp, mouse
gggctcgtagcagcaggcag

SEQ ID NO: 443614 - DNA, 20 bp, mouse
ggaaaaacttcccatagaca

SEQ ID NO: 443615 - DNA, 20 bp, mouse
ggcgacacccgactcccagc

SEQ ID NO: 443616 - DNA, 20 bp, mouse
ggcggcggggccatgaacct

SEQ ID NO: 443617 - DNA, 20 bp, mouse
ggatgctccagctcagtacg

SEQ ID NO: 443618 - DNA, 20 bp, mouse
gcgagatgctcggggagcta

SEQ ID NO: 443619 - DNA, 20 bp, mouse
gaagtgacctgagcgagctg

SEQ ID NO: 443620 - DNA, 20 bp, mouse
gcagcccagcgagtccccgc

SEQ ID NO: 443621 - DNA, 20 bp, mouse
ggtccccgccggcttacccc

SEQ ID NO: 443622 - DNA, 20 bp, mouse
gaagccggcggggactcgct

SEQ ID NO: 443623 - DNA, 20 bp, mouse
gtgaacctggggtaagccgg

SEQ ID NO: 443624 - DNA, 20 bp, mouse
ggtgttggagcgccccggag

SEQ ID NO: 443625 - DNA, 20 bp, mouse
gtggggctggaccgagtctg

SEQ ID NO: 443626 - DNA, 20 bp, mouse
gaaggacgcagcgaactgtg

SEQ ID NO: 443627 - DNA, 20 bp, mouse
ggcccaaccagagaaccggt

SEQ ID NO: 443628 - DNA, 20 bp, mouse
gcagaggcgcgagagaaacg

SEQ ID NO: 443629 - DNA, 20 bp, mouse
gacagcctgatccacctaac

SEQ ID NO: 443630 - DNA, 20 bp, mouse
gcaggctgtattggggacaa

SEQ ID NO: 443631 - DNA, 20 bp, mouse
ggggagtagcttctaatggt

SEQ ID NO: 443632 - DNA, 20 bp, mouse
gggttgaggcccagtctctg

SEQ ID NO: 443633 - DNA, 20 bp, mouse
gacccaccggttctctggtt

SEQ ID NO: 443634 - DNA, 20 bp, mouse
gtggaaaactgccagttagg

SEQ ID NO: 443635 - DNA, 20 bp, mouse
gggtggatcaggctgtattg

SEQ ID NO: 443636 - DNA, 20 bp, mouse
gcaggtaaggaccggatcct

SEQ ID NO: 443637 - DNA, 20 bp, mouse
ggcgatctggcagagagccc

SEQ ID NO: 443638 - DNA, 20 bp, mouse
gtgctcgggctccggcgatc

SEQ ID NO: 443639 - DNA, 20 bp, mouse
gcttggagggcgctcagagg

SEQ ID NO: 443640 - DNA, 20 bp, mouse
gcaggctcgcctaccttgga

SEQ ID NO: 443641 - DNA, 20 bp, mouse
ggtgggtgggagtcttagag

SEQ ID NO: 443642 - DNA, 20 bp, mouse
gccttggcgcgggtcaccca

SEQ ID NO: 443643 - DNA, 20 bp, mouse
gtgaggatcgctgccaaggg

SEQ ID NO: 443644 - DNA, 20 bp, mouse
ggctctggttttgtgactga

SEQ ID NO: 443645 - DNA, 20 bp, mouse
gggcagctaagtgctcagtt

SEQ ID NO: 443646 - DNA, 20 bp, mouse
ggggacgcgcgaagcaggat

SEQ ID NO: 443647 - DNA, 20 bp, mouse
ggcgcggctgcagctccggg

SEQ ID NO: 443648 - DNA, 20 bp, mouse
gggttgagagtcacagccag

SEQ ID NO: 443649 - DNA, 20 bp, mouse
ggatgggctgcaggcaaagc

SEQ ID NO: 443650 - DNA, 20 bp, mouse
gaccgggagcccgcacacgg

SEQ ID NO: 443651 - DNA, 20 bp, mouse
gcccaagggctgctagacac

SEQ ID NO: 443652 - DNA, 20 bp, mouse
ggccggcgcggctgcagctc

SEQ ID NO: 443653 - DNA, 20 bp, mouse
gccagcgggacgcgcgaagc

SEQ ID NO: 443654 - DNA, 20 bp, mouse
gggtaccgggagcccgcaca

SEQ ID NO: 443655 - DNA, 20 bp, mouse
gagcgcgcagagaaggtacc

SEQ ID NO: 443656 - DNA, 20 bp, mouse
gtgtgctgaaagggaaaggg

SEQ ID NO: 443657 - DNA, 20 bp, mouse
gcaggcgcgtgccctgtggt

SEQ ID NO: 443658 - DNA, 20 bp, mouse
ggtggtaacaaccgaccaca

SEQ ID NO: 443659 - DNA, 20 bp, mouse
gcagatgtcagtttgtactg

SEQ ID NO: 443660 - DNA, 20 bp, mouse
ggttaccaccctgggcgcaa

SEQ ID NO: 443661 - DNA, 20 bp, mouse
gatctgtgctgaaagggaaa

SEQ ID NO: 443662 - DNA, 20 bp, mouse
gtcttaagaggagagcaggt

SEQ ID NO: 443663 - DNA, 20 bp, mouse
gctggggcagagctgttgtc

SEQ ID NO: 443664 - DNA, 20 bp, mouse
gctgctgaggctgttggaag

SEQ ID NO: 443665 - DNA, 20 bp, mouse
gtggaagtggtcttactggg

SEQ ID NO: 443666 - DNA, 20 bp, mouse
gaagtatataaggtaatgat

SEQ ID NO: 443667 - DNA, 20 bp, mouse
gtaaggtaatgataggaaac

SEQ ID NO: 443668 - DNA, 20 bp, mouse
gtctgctgggttacaaagac

SEQ ID NO: 443669 - DNA, 20 bp, mouse
gagggaaggttactctgcct

SEQ ID NO: 443670 - DNA, 20 bp, mouse
ggctgtccagatatctgcct

SEQ ID NO: 443671 - DNA, 20 bp, mouse
gaggtcaacaacagagacca

SEQ ID NO: 443672 - DNA, 20 bp, mouse
ggagtaaccttccctaactc

SEQ ID NO: 443673 - DNA, 20 bp, mouse
ggatatagacaagcagtagt

SEQ ID NO: 443674 - DNA, 20 bp, mouse
gtccctaactcgggtttcta

SEQ ID NO: 443675 - DNA, 20 bp, mouse
gtttccttcaccttcaaggt

SEQ ID NO: 443676 - DNA, 20 bp, mouse
ggcccgcggctccaacctac

SEQ ID NO: 443677 - DNA, 20 bp, mouse
gggcggccatgttggagcgg

SEQ ID NO: 443678 - DNA, 20 bp, mouse
gtcgggcggactgggatcag

SEQ ID NO: 443679 - DNA, 20 bp, mouse
gcgcctccgccgctccaaca

SEQ ID NO: 443680 - DNA, 20 bp, mouse
ggcgcagcaggcggccatgt

SEQ ID NO: 443681 - DNA, 20 bp, mouse
gcggcgcagaggtgcgtcct

SEQ ID NO: 443682 - DNA, 20 bp, mouse
gtgccgccctgtggcctcat

SEQ ID NO: 443683 - DNA, 20 bp, mouse
gtcctcagaacccccagggt

SEQ ID NO: 443684 - DNA, 20 bp, mouse
gtccccgcggcggcgccggt

SEQ ID NO: 443685 - DNA, 20 bp, mouse
ggggttctgaggatcctgtc

SEQ ID NO: 443686 - DNA, 20 bp, mouse
gagccgggcgcggacaggga

SEQ ID NO: 443687 - DNA, 20 bp, mouse
gctgtccgcgcccggctcgg

SEQ ID NO: 443688 - DNA, 20 bp, mouse
gacaggctagcagcgccggg

SEQ ID NO: 443689 - DNA, 20 bp, mouse
gtgcgcagcaaggacgtcta

SEQ ID NO: 443690 - DNA, 20 bp, mouse
ggacggcgggcggtcccgag

SEQ ID NO: 443691 - DNA, 20 bp, mouse
gggctacggagcggaaggag

SEQ ID NO: 443692 - DNA, 20 bp, mouse
gtcgctggccggaagcacgg

SEQ ID NO: 443693 - DNA, 20 bp, mouse
gagcacaggctagcagcgcc

SEQ ID NO: 443694 - DNA, 20 bp, mouse
gaggcgagaaaagtagcgag

SEQ ID NO: 443695 - DNA, 20 bp, mouse
gagcgccgccgagccgggcg

SEQ ID NO: 443696 - DNA, 20 bp, mouse
ggtcttcgctgaggtaaatc

SEQ ID NO: 443697 - DNA, 20 bp, mouse
ggcgaccttggtaagaaact

SEQ ID NO: 443698 - DNA, 20 bp, mouse
gctgaggtccagggcgacct

SEQ ID NO: 443699 - DNA, 20 bp, mouse
gcactgagcggtcttcgctg

SEQ ID NO: 443700 - DNA, 20 bp, mouse
ggtcagcacgaggatttggt

SEQ ID NO: 443701 - DNA, 20 bp, mouse
ggaagtctagacccacctga

SEQ ID NO: 443702 - DNA, 20 bp, mouse
gcagcagacctgatgggtgg

SEQ ID NO: 443703 - DNA, 20 bp, mouse
gggtgggacacctgaggtcc

SEQ ID NO: 443704 - DNA, 20 bp, mouse
gaccaaccagcagacctgat

SEQ ID NO: 443705 - DNA, 20 bp, mouse
gacccatcaggtctgctggt

SEQ ID NO: 443706 - DNA, 20 bp, mouse
gagcagccagtactgagcgg

SEQ ID NO: 443707 - DNA, 20 bp, mouse
gcgtcgccgccgctcagtac

SEQ ID NO: 443708 - DNA, 20 bp, mouse
gagcccggccccgctcatga

SEQ ID NO: 443709 - DNA, 20 bp, mouse
ggagctgaggggccgagccc

SEQ ID NO: 443710 - DNA, 20 bp, mouse
ggcggcgacgccttcatgag

SEQ ID NO: 443711 - DNA, 20 bp, mouse
gacctgaagcgggagaataa

SEQ ID NO: 443712 - DNA, 20 bp, mouse
ggctcggcccctcagctccg

SEQ ID NO: 443713 - DNA, 20 bp, mouse
gtccggcgcgccggttccca

SEQ ID NO: 443714 - DNA, 20 bp, mouse
ggccgcgccccgggagcctg

SEQ ID NO: 443715 - DNA, 20 bp, mouse
ggttcagcgaagcacagaag

SEQ ID NO: 443716 - DNA, 20 bp, mouse
gctcaccaagtgctaacccc

SEQ ID NO: 443717 - DNA, 20 bp, mouse
gttggtgagtgtggatttca

SEQ ID NO: 443718 - DNA, 20 bp, mouse
ggttgcgttgttggacgcca

SEQ ID NO: 443719 - DNA, 20 bp, mouse
ggagtgtggatttcagggaa

SEQ ID NO: 443720 - DNA, 20 bp, mouse
ggagctcgtgagcgattggt

SEQ ID NO: 443721 - DNA, 20 bp, mouse
gggttagcacttggtgagtg

SEQ ID NO: 443722 - DNA, 20 bp, mouse
gccttccgcactgattacta

SEQ ID NO: 443723 - DNA, 20 bp, mouse
gcagtgcggaagggagctac

SEQ ID NO: 443724 - DNA, 20 bp, mouse
gcgaagcttaagcaagtggg

SEQ ID NO: 443725 - DNA, 20 bp, mouse
gctacaggagactaaaccta

SEQ ID NO: 443726 - DNA, 20 bp, mouse
gaagacccgactagacgtgg

SEQ ID NO: 443727 - DNA, 20 bp, mouse
gtccgccggccgtcatggaa

SEQ ID NO: 443728 - DNA, 20 bp, mouse
gacccgactagacgtggcgg

SEQ ID NO: 443729 - DNA, 20 bp, mouse
gaaagctccgccggccgtca

SEQ ID NO: 443730 - DNA, 20 bp, mouse
gaccgccgccacgtctagtc

SEQ ID NO: 443731 - DNA, 20 bp, mouse
gggcgccgcgacctctctcg

SEQ ID NO: 443732 - DNA, 20 bp, mouse
gcgcgacctctctcgaggag

SEQ ID NO: 443733 - DNA, 20 bp, mouse
ggcagtacctctgctctccg

SEQ ID NO: 443734 - DNA, 20 bp, mouse
gcgctcccttccatgacggc

SEQ ID NO: 443735 - DNA, 20 bp, mouse
ggagggcgcagaactttgac

SEQ ID NO: 443736 - DNA, 20 bp, mouse
gcaactcgaagtgggacccc

SEQ ID NO: 443737 - DNA, 20 bp, mouse
gggctcaggaggcctaggtg

SEQ ID NO: 443738 - DNA, 20 bp, mouse
gccatagaggaaagaagttc

SEQ ID NO: 443739 - DNA, 20 bp, mouse
gccaggacagccccttccct

SEQ ID NO: 443740 - DNA, 20 bp, mouse
ggaagtgggacccctggctt

SEQ ID NO: 443741 - DNA, 20 bp, mouse
gaggcctaggtgtggtgtgg

SEQ ID NO: 443742 - DNA, 20 bp, mouse
gaggaggcctaggtgtggtg

SEQ ID NO: 443743 - DNA, 20 bp, mouse
gctaggtgcccagaagcact

SEQ ID NO: 443744 - DNA, 20 bp, mouse
ggtcctggctcaggaggcct

SEQ ID NO: 443745 - DNA, 20 bp, mouse
gagggctgtagggttgtggt

SEQ ID NO: 443746 - DNA, 20 bp, mouse
gcacagggacgagctggtgt

SEQ ID NO: 443747 - DNA, 20 bp, mouse
gacaggggctctgggttcca

SEQ ID NO: 443748 - DNA, 20 bp, mouse
gccaggagccgaccaccgga

SEQ ID NO: 443749 - DNA, 20 bp, mouse
gggggctctgggttccaggg

SEQ ID NO: 443750 - DNA, 20 bp, mouse
ggaccttggcctctccaccc

SEQ ID NO: 443751 - DNA, 20 bp, mouse
gttccagggtggagaggcca

SEQ ID NO: 443752 - DNA, 20 bp, mouse
gcgccccaggagccgaccac

SEQ ID NO: 443753 - DNA, 20 bp, mouse
gcagtcaggcgtcgtggtct

SEQ ID NO: 443754 - DNA, 20 bp, mouse
ggagctggtgtgggcctgac

SEQ ID NO: 443755 - DNA, 20 bp, mouse
gccgcccgactgggcagatg

SEQ ID NO: 443756 - DNA, 20 bp, mouse
ggacgtcggggacactccag

SEQ ID NO: 443757 - DNA, 20 bp, mouse
gtccagaggatcaggcaatc

SEQ ID NO: 443758 - DNA, 20 bp, mouse
gagacggaaggaagccccag

SEQ ID NO: 443759 - DNA, 20 bp, mouse
ggacatctttgcagacgtcg

SEQ ID NO: 443760 - DNA, 20 bp, mouse
gggggacactccagaggatc

SEQ ID NO: 443761 - DNA, 20 bp, mouse
gcaggcaatcgggagacgga

SEQ ID NO: 443762 - DNA, 20 bp, mouse
gtggaggccttaaggcctgt

SEQ ID NO: 443763 - DNA, 20 bp, mouse
ggatctggacgtgttagtgg

SEQ ID NO: 443764 - DNA, 20 bp, mouse
ggtctgcaaagatgtcgatc

SEQ ID NO: 443765 - DNA, 20 bp, mouse
gaaggtgcccacaggcctta

SEQ ID NO: 443766 - DNA, 20 bp, mouse
gctcggccagactgcaggag

SEQ ID NO: 443767 - DNA, 20 bp, mouse
gctgggaaaactccacagaa

SEQ ID NO: 443768 - DNA, 20 bp, mouse
gagggactcggccagactgc

SEQ ID NO: 443769 - DNA, 20 bp, mouse
gaagggtgataagaagttct

SEQ ID NO: 443770 - DNA, 20 bp, mouse
gccctgtggcaaccaaggac

SEQ ID NO: 443771 - DNA, 20 bp, mouse
gagagtctgtgaacctggag

SEQ ID NO: 443772 - DNA, 20 bp, mouse
gtaccttctggtccagtggg

SEQ ID NO: 443773 - DNA, 20 bp, mouse
gtccatgtactgagagggga

SEQ ID NO: 443774 - DNA, 20 bp, mouse
ggctcggaaacaaagggact

SEQ ID NO: 443775 - DNA, 20 bp, mouse
gtgtctgcaaagcagcccca

SEQ ID NO: 443776 - DNA, 20 bp, mouse
ggagggcctcctgcagatgg

SEQ ID NO: 443777 - DNA, 20 bp, mouse
gtcctgcagatggagggtgg

SEQ ID NO: 443778 - DNA, 20 bp, mouse
ggcctcctgcagatggaggg

SEQ ID NO: 443779 - DNA, 20 bp, mouse
gagcgagggcctcctgcaga

SEQ ID NO: 443780 - DNA, 20 bp, mouse
gacgcccacccaaacagcga

SEQ ID NO: 443781 - DNA, 20 bp, mouse
ggagggttgctgaactaaga

SEQ ID NO: 443782 - DNA, 20 bp, mouse
gtgctgaactaagaaggcct

SEQ ID NO: 443783 - DNA, 20 bp, mouse
gttcagccatccctttccca

SEQ ID NO: 443784 - DNA, 20 bp, mouse
gccagatcaccggggaggga

SEQ ID NO: 443785 - DNA, 20 bp, mouse
ggaggccctcgctgtttggg

SEQ ID NO: 443786 - DNA, 20 bp, mouse
ggagaccgaggcgctttgaa

SEQ ID NO: 443787 - DNA, 20 bp, mouse
gttgaaaggtgagaactaga

SEQ ID NO: 443788 - DNA, 20 bp, mouse
gcagggtctgagacactcgt

SEQ ID NO: 443789 - DNA, 20 bp, mouse
gcactacactagcagactga

SEQ ID NO: 443790 - DNA, 20 bp, mouse
gctagagggtggctgcctac

SEQ ID NO: 443791 - DNA, 20 bp, mouse
gagtctgctagtgtagtggt

SEQ ID NO: 443792 - DNA, 20 bp, mouse
ggaaagagctgcggagacac

SEQ ID NO: 443793 - DNA, 20 bp, mouse
gagagctgcggagacaccgg

SEQ ID NO: 443794 - DNA, 20 bp, mouse
ggctgtgtacccacagataa

SEQ ID NO: 443795 - DNA, 20 bp, mouse
gtgacaggtcgcaacactga

SEQ ID NO: 443796 - DNA, 20 bp, mouse
ggagtggtgaaagaggggca

SEQ ID NO: 443797 - DNA, 20 bp, mouse
gtctccagagtggtgaaaga

SEQ ID NO: 443798 - DNA, 20 bp, mouse
ggtttagggcggctaaaacc

SEQ ID NO: 443799 - DNA, 20 bp, mouse
ggtgaaagaggggcacggct

SEQ ID NO: 443800 - DNA, 20 bp, mouse
gtcggagcgttgttcctgag

SEQ ID NO: 443801 - DNA, 20 bp, mouse
gagggcggctaaaaccaggc

SEQ ID NO: 443802 - DNA, 20 bp, mouse
gcggttaagaactgttgaga

SEQ ID NO: 443803 - DNA, 20 bp, mouse
gggagacagggatacctgcc

SEQ ID NO: 443804 - DNA, 20 bp, mouse
gctgcgctaggacaccctga

SEQ ID NO: 443805 - DNA, 20 bp, mouse
ggctccgagggaaaaaccag

SEQ ID NO: 443806 - DNA, 20 bp, mouse
gcccgggaacacccacacag

SEQ ID NO: 443807 - DNA, 20 bp, mouse
ggcggtggcgccatagaccc

SEQ ID NO: 443808 - DNA, 20 bp, mouse
gcgccatagacccaggaccc

SEQ ID NO: 443809 - DNA, 20 bp, mouse
ggggaacacccacacagcgg

SEQ ID NO: 443810 - DNA, 20 bp, mouse
gacagaggacatcgctgcgg

SEQ ID NO: 443811 - DNA, 20 bp, mouse
gttcccgggtcctgggtcta

SEQ ID NO: 443812 - DNA, 20 bp, mouse
gacatagcgctccacctggg

SEQ ID NO: 443813 - DNA, 20 bp, mouse
gtgacgagccgccgctgtgt

SEQ ID NO: 443814 - DNA, 20 bp, mouse
ggggacatagcgctccacct

SEQ ID NO: 443815 - DNA, 20 bp, mouse
gagaaagtttgccgacacag

SEQ ID NO: 443816 - DNA, 20 bp, mouse
gaggagctcagggtccggtt

SEQ ID NO: 443817 - DNA, 20 bp, mouse
gaggctccgctgctacccta

SEQ ID NO: 443818 - DNA, 20 bp, mouse
gtgcaaaggccaaacccgaa

SEQ ID NO: 443819 - DNA, 20 bp, mouse
gtctgctgctagggacgatt

SEQ ID NO: 443820 - DNA, 20 bp, mouse
gctggctagctgtagtccta

SEQ ID NO: 443821 - DNA, 20 bp, mouse
gaggacagcagctcgcccta

SEQ ID NO: 443822 - DNA, 20 bp, mouse
gtggatctgagcgaaggaga

SEQ ID NO: 443823 - DNA, 20 bp, mouse
gcagctgcgcggagctttct

SEQ ID NO: 443824 - DNA, 20 bp, mouse
ggctcgccctagggtagcag

SEQ ID NO: 443825 - DNA, 20 bp, mouse
ggagcacagggatgcgggtg

SEQ ID NO: 443826 - DNA, 20 bp, mouse
gctctggctccgaggaccgt

SEQ ID NO: 443827 - DNA, 20 bp, mouse
ggcagtggaagaggcagcgt

SEQ ID NO: 443828 - DNA, 20 bp, mouse
gctccgaggaccgtaggcag

SEQ ID NO: 443829 - DNA, 20 bp, mouse
ggcccgggtcggagcctgag

SEQ ID NO: 443830 - DNA, 20 bp, mouse
gaggcaaccggcccgaggag

SEQ ID NO: 443831 - DNA, 20 bp, mouse
ggcctctcaggctccgaccc

SEQ ID NO: 443832 - DNA, 20 bp, mouse
gctgcctcttccactgccta

SEQ ID NO: 443833 - DNA, 20 bp, mouse
gaggctctggagcccctcct

SEQ ID NO: 443834 - DNA, 20 bp, mouse
gggtcctcggagccagagcc

SEQ ID NO: 443835 - DNA, 20 bp, mouse
gctcgggccggttgcctctc

SEQ ID NO: 443836 - DNA, 20 bp, mouse
gcgcgcacgcctcaggactg

SEQ ID NO: 443837 - DNA, 20 bp, mouse
ggactgaggaaccgggaccg

SEQ ID NO: 443838 - DNA, 20 bp, mouse
ggcccgagctcggagagccg

SEQ ID NO: 443839 - DNA, 20 bp, mouse
gcctcccgcggccccctctg

SEQ ID NO: 443840 - DNA, 20 bp, mouse
gaccgggaccgtggctgcgt

SEQ ID NO: 443841 - DNA, 20 bp, mouse
ggcggccgccgacgcagcca

SEQ ID NO: 443842 - DNA, 20 bp, mouse
gtcccggttcctcagtcctg

SEQ ID NO: 443843 - DNA, 20 bp, mouse
gggctctcgggtgaccccag

SEQ ID NO: 443844 - DNA, 20 bp, mouse
ggccatggcgaagcccccgg

SEQ ID NO: 443845 - DNA, 20 bp, mouse
ggggaccgtggctgcgtcgg

SEQ ID NO: 443846 - DNA, 20 bp, mouse
ggccgccggctgcgcctcag

SEQ ID NO: 443847 - DNA, 20 bp, mouse
gacagttccgaaggctacag

SEQ ID NO: 443848 - DNA, 20 bp, mouse
gcgcctcagcggcgtatcca

SEQ ID NO: 443849 - DNA, 20 bp, mouse
gagaggctacacgtgagcca

SEQ ID NO: 443850 - DNA, 20 bp, mouse
gagccatggatacgccgctg

SEQ ID NO: 443851 - DNA, 20 bp, mouse
gaaggcgccgacagttccga

SEQ ID NO: 443852 - DNA, 20 bp, mouse
gagacgatgggtccccacaa

SEQ ID NO: 443853 - DNA, 20 bp, mouse
gtctaggaccgggtgatccg

SEQ ID NO: 443854 - DNA, 20 bp, mouse
gtctcccggacctcagccag

SEQ ID NO: 443855 - DNA, 20 bp, mouse
gcgagtctgacgtcatatga

SEQ ID NO: 443856 - DNA, 20 bp, mouse
gaagatggaaccacacagtc

SEQ ID NO: 443857 - DNA, 20 bp, mouse
gcggaaccacctggtaaaga

SEQ ID NO: 443858 - DNA, 20 bp, mouse
gggtcaggttcctgactgtg

SEQ ID NO: 443859 - DNA, 20 bp, mouse
gtagccgcttggacacttgg

SEQ ID NO: 443860 - DNA, 20 bp, mouse
gccaggtggttccggctgag

SEQ ID NO: 443861 - DNA, 20 bp, mouse
gtcagcaaccggtggtaaat

SEQ ID NO: 443862 - DNA, 20 bp, mouse
gaggaggcttcgccttgctg

SEQ ID NO: 443863 - DNA, 20 bp, mouse
gcagcggactcagcaaccgg

SEQ ID NO: 443864 - DNA, 20 bp, mouse
gggacgccaaatggttacta

SEQ ID NO: 443865 - DNA, 20 bp, mouse
gcggctagcaagcagcgggc

SEQ ID NO: 443866 - DNA, 20 bp, mouse
ggcgtcgctgaggcacacgg

SEQ ID NO: 443867 - DNA, 20 bp, mouse
gctcctccgccgccctctgg

SEQ ID NO: 443868 - DNA, 20 bp, mouse
gctcctccagagggcggcgg

SEQ ID NO: 443869 - DNA, 20 bp, mouse
ggtctgcacccggtgaggag

SEQ ID NO: 443870 - DNA, 20 bp, mouse
ggagcgtccgggcgtcgctg

SEQ ID NO: 443871 - DNA, 20 bp, mouse
gtctggaggagctagggtaa

SEQ ID NO: 443872 - DNA, 20 bp, mouse
ggcgcggcagcggagcgtcc

SEQ ID NO: 443873 - DNA, 20 bp, mouse
gggaggctggagcgcggcag

SEQ ID NO: 443874 - DNA, 20 bp, mouse
gggagctagggtaacggcct

SEQ ID NO: 443875 - DNA, 20 bp, mouse
gcgggcgtcgctgaggcaca

SEQ ID NO: 443876 - DNA, 20 bp, mouse
gtgtagtccctgtcacgctg

SEQ ID NO: 443877 - DNA, 20 bp, mouse
gcagctacacctgctctgag

SEQ ID NO: 443878 - DNA, 20 bp, mouse
ggaagctggtctgggaactg

SEQ ID NO: 443879 - DNA, 20 bp, mouse
gcccttggccccctccatgt

SEQ ID NO: 443880 - DNA, 20 bp, mouse
gcctgacccccaacatggag

SEQ ID NO: 443881 - DNA, 20 bp, mouse
gcacctgctctgagaggaag

SEQ ID NO: 443882 - DNA, 20 bp, mouse
ggtagctgccacagcgtgac

SEQ ID NO: 443883 - DNA, 20 bp, mouse
gacctgggtgagggtcaggt

SEQ ID NO: 443884 - DNA, 20 bp, mouse
gcctctgagcctgggcccct

SEQ ID NO: 443885 - DNA, 20 bp, mouse
gtgtatagcatcagcagggg

SEQ ID NO: 443886 - DNA, 20 bp, mouse
gcggcgggcgcgggagacaa

SEQ ID NO: 443887 - DNA, 20 bp, mouse
ggcggccgcgccgcacaaag

SEQ ID NO: 443888 - DNA, 20 bp, mouse
gctgccggagccgctttgtg

SEQ ID NO: 443889 - DNA, 20 bp, mouse
gcgctcacccaggtcaccag

SEQ ID NO: 443890 - DNA, 20 bp, mouse
gaagcggctccggcagccgg

SEQ ID NO: 443891 - DNA, 20 bp, mouse
gaccgcggttcgggaagggt

SEQ ID NO: 443892 - DNA, 20 bp, mouse
gggcgcgggagacaaaggcg

SEQ ID NO: 443893 - DNA, 20 bp, mouse
gacgtctcagacgcacagga

SEQ ID NO: 443894 - DNA, 20 bp, mouse
gcctgggtgagcgctcggag

SEQ ID NO: 443895 - DNA, 20 bp, mouse
ggcgccgcacaaagcggctc

SEQ ID NO: 443896 - DNA, 20 bp, mouse
gcaccccccgacgagatctt

SEQ ID NO: 443897 - DNA, 20 bp, mouse
gagcgcgtctatgccgcagg

SEQ ID NO: 443898 - DNA, 20 bp, mouse
ggaggagaagactcttagga

SEQ ID NO: 443899 - DNA, 20 bp, mouse
gctcctcagacagtccccta

SEQ ID NO: 443900 - DNA, 20 bp, mouse
ggcggcatagacgcgctctg

SEQ ID NO: 443901 - DNA, 20 bp, mouse
gcagcgttccagggcctcgt

SEQ ID NO: 443902 - DNA, 20 bp, mouse
gaagatctggcagcgttcca

SEQ ID NO: 443903 - DNA, 20 bp, mouse
ggttgagcagttctaagatc

SEQ ID NO: 443904 - DNA, 20 bp, mouse
gttttcctaagatctcgtcg

SEQ ID NO: 443905 - DNA, 20 bp, mouse
gaaccttaggggactgtctg

SEQ ID NO: 443906 - DNA, 20 bp, mouse
gggttgggcggtgaacacgt

SEQ ID NO: 443907 - DNA, 20 bp, mouse
gccgggagctgtggacgcga

SEQ ID NO: 443908 - DNA, 20 bp, mouse
gacctgtcccggagaccccg

SEQ ID NO: 443909 - DNA, 20 bp, mouse
gggagctgtggacgcgaagg

SEQ ID NO: 443910 - DNA, 20 bp, mouse
gctccgggacaggtgaccgg

SEQ ID NO: 443911 - DNA, 20 bp, mouse
ggaagtgacgagtgaggccc

SEQ ID NO: 443912 - DNA, 20 bp, mouse
gcagacaccgcggggtctcc

SEQ ID NO: 443913 - DNA, 20 bp, mouse
gcccctcaagcgacacatgt

SEQ ID NO: 443914 - DNA, 20 bp, mouse
gacgcgaaggcggacgaagc

SEQ ID NO: 443915 - DNA, 20 bp, mouse
gcaggggtggagctaagggg

SEQ ID NO: 443916 - DNA, 20 bp, mouse
gcaggaaccgccaaatccag

SEQ ID NO: 443917 - DNA, 20 bp, mouse
gagccccgcaggtcagcaag

SEQ ID NO: 443918 - DNA, 20 bp, mouse
ggcggggctccgagactatg

SEQ ID NO: 443919 - DNA, 20 bp, mouse
gggttcctgcgccctgacgg

SEQ ID NO: 443920 - DNA, 20 bp, mouse
gcagcggctcctcatagtct

SEQ ID NO: 443921 - DNA, 20 bp, mouse
gtatgaggagccgctggatt

SEQ ID NO: 443922 - DNA, 20 bp, mouse
gtcctgcgccctgacggcgg

SEQ ID NO: 443923 - DNA, 20 bp, mouse
gcgggtggctctgcgcgggt

SEQ ID NO: 443924 - DNA, 20 bp, mouse
gcgcgagctccggggatggt

SEQ ID NO: 443925 - DNA, 20 bp, mouse
gaccaactcaagccgagagg

SEQ ID NO: 443926 - DNA, 20 bp, mouse
gtggacgccgggtggtgtgt

SEQ ID NO: 443927 - DNA, 20 bp, mouse
gggcccaggaacccacgttc

SEQ ID NO: 443928 - DNA, 20 bp, mouse
ggcgtccaggacatcctcac

SEQ ID NO: 443929 - DNA, 20 bp, mouse
ggggcagcccacacaccacc

SEQ ID NO: 443930 - DNA, 20 bp, mouse
ggtgtgggctgcccgaacgt

SEQ ID NO: 443931 - DNA, 20 bp, mouse
gtacgcaaccacccccctcc

SEQ ID NO: 443932 - DNA, 20 bp, mouse
ggccgagacccggacccaga

SEQ ID NO: 443933 - DNA, 20 bp, mouse
gtgcccgaacgtgggttcct

SEQ ID NO: 443934 - DNA, 20 bp, mouse
gtgggccagcagtcaccggg

SEQ ID NO: 443935 - DNA, 20 bp, mouse
gtcctgggccagcagtcacc

SEQ ID NO: 443936 - DNA, 20 bp, mouse
ggacgacgcgccactccctg

SEQ ID NO: 443937 - DNA, 20 bp, mouse
gtgcggctgcggcagggcaa

SEQ ID NO: 443938 - DNA, 20 bp, mouse
gactccctgcggctgcggca

SEQ ID NO: 443939 - DNA, 20 bp, mouse
gggtctgctagtgatgggag

SEQ ID NO: 443940 - DNA, 20 bp, mouse
ggcccatgggcagggacggt

SEQ ID NO: 443941 - DNA, 20 bp, mouse
gacgggatgcgacgaccggg

SEQ ID NO: 443942 - DNA, 20 bp, mouse
gcggatcgatgctctttctg

SEQ ID NO: 443943 - DNA, 20 bp, mouse
gcggacgggatgcgacgacc

SEQ ID NO: 443944 - DNA, 20 bp, mouse
gtgggaggggaggacccggg

SEQ ID NO: 443945 - DNA, 20 bp, mouse
gaccgcggcgagcgctcgga

SEQ ID NO: 443946 - DNA, 20 bp, mouse
gatccgggtggggtgcaaag

SEQ ID NO: 443947 - DNA, 20 bp, mouse
gaccgaactgtgatccgggt

SEQ ID NO: 443948 - DNA, 20 bp, mouse
gggccctaggtaccctggag

SEQ ID NO: 443949 - DNA, 20 bp, mouse
ggagggccagggactcccgg

SEQ ID NO: 443950 - DNA, 20 bp, mouse
ggatgtggagccggagagag

SEQ ID NO: 443951 - DNA, 20 bp, mouse
gaagcggaaacttccttcac

SEQ ID NO: 443952 - DNA, 20 bp, mouse
gccccacccggatcacagtt

SEQ ID NO: 443953 - DNA, 20 bp, mouse
ggagctgacactaccacagc

SEQ ID NO: 443954 - DNA, 20 bp, mouse
gacagcaggtcggagaaccg

SEQ ID NO: 443955 - DNA, 20 bp, mouse
gtacaaccgaactgtgatcc

SEQ ID NO: 443956 - DNA, 20 bp, mouse
gcagcgaacaagcgaagaag

SEQ ID NO: 443957 - DNA, 20 bp, mouse
gagaagcggtcctcagtcta

SEQ ID NO: 443958 - DNA, 20 bp, mouse
gggacaggaagcgaaaatgt

SEQ ID NO: 443959 - DNA, 20 bp, mouse
gagaaactccccgtagactg

SEQ ID NO: 443960 - DNA, 20 bp, mouse
gttaggaagtggcgacactg

SEQ ID NO: 443961 - DNA, 20 bp, mouse
gggaagcgaaaatgtcggaa

SEQ ID NO: 443962 - DNA, 20 bp, mouse
gcgacactgaggcgctgaat

SEQ ID NO: 443963 - DNA, 20 bp, mouse
ggcacgcgcgtcttccagtc

SEQ ID NO: 443964 - DNA, 20 bp, mouse
gcttcgcttgttcgctggac

SEQ ID NO: 443965 - DNA, 20 bp, mouse
gcaaaagccgggaagaactg

SEQ ID NO: 443966 - DNA, 20 bp, mouse
ggccactacggggacatcga

SEQ ID NO: 443967 - DNA, 20 bp, mouse
ggcatcagccggcctcagag

SEQ ID NO: 443968 - DNA, 20 bp, mouse
ggccctcgatgtccccgtag

SEQ ID NO: 443969 - DNA, 20 bp, mouse
gagagccggagccgacgcaa

SEQ ID NO: 443970 - DNA, 20 bp, mouse
gggggccggcgggtcgaaaa

SEQ ID NO: 443971 - DNA, 20 bp, mouse
ggccggagccgacgcaaggg

SEQ ID NO: 443972 - DNA, 20 bp, mouse
ggccggcctcagagcggggc

SEQ ID NO: 443973 - DNA, 20 bp, mouse
gaggtttcccggggcaacca

SEQ ID NO: 443974 - DNA, 20 bp, mouse
gacaggccagagaagccgaa

SEQ ID NO: 443975 - DNA, 20 bp, mouse
gaaaatggacagccactacg

SEQ ID NO: 443976 - DNA, 20 bp, mouse
gagacctgttatggaggcgg

SEQ ID NO: 443977 - DNA, 20 bp, mouse
gtggcttccggagcccgctg

SEQ ID NO: 443978 - DNA, 20 bp, mouse
gagctgcagaggtgacggag

SEQ ID NO: 443979 - DNA, 20 bp, mouse
gctgccaccgcctccataac

SEQ ID NO: 443980 - DNA, 20 bp, mouse
gaagtacctgcgggtaccta

SEQ ID NO: 443981 - DNA, 20 bp, mouse
gttgaagagacctgttatgg

SEQ ID NO: 443982 - DNA, 20 bp, mouse
gcttccggagcccgctgtgg

SEQ ID NO: 443983 - DNA, 20 bp, mouse
ggtgttgaagagacctgtta

SEQ ID NO: 443984 - DNA, 20 bp, mouse
gtaaccgccacagcgggctc

SEQ ID NO: 443985 - DNA, 20 bp, mouse
gaacacagtaaccgccacag

SEQ ID NO: 443986 - DNA, 20 bp, mouse
gtgaagcacctgggttgaga

SEQ ID NO: 443987 - DNA, 20 bp, mouse
gcggcgacggtgaagcacct

SEQ ID NO: 443988 - DNA, 20 bp, mouse
gccgctcagtccggccagga

SEQ ID NO: 443989 - DNA, 20 bp, mouse
gagcacctgggttgagaggg

SEQ ID NO: 443990 - DNA, 20 bp, mouse
gtgctcctccctctcaaccc

SEQ ID NO: 443991 - DNA, 20 bp, mouse
gtaccccacccaacccacct

SEQ ID NO: 443992 - DNA, 20 bp, mouse
ggagcgggcacgggcagtgt

SEQ ID NO: 443993 - DNA, 20 bp, mouse
gcacctgggcaagacaaccc

SEQ ID NO: 443994 - DNA, 20 bp, mouse
gccagctctagcctcggcag

SEQ ID NO: 443995 - DNA, 20 bp, mouse
ggtgcccgctcagtccggcc

SEQ ID NO: 443996 - DNA, 20 bp, mouse
gtgtaaggggcgtggcaaga

SEQ ID NO: 443997 - DNA, 20 bp, mouse
gtgggtgtggcgtctagact

SEQ ID NO: 443998 - DNA, 20 bp, mouse
gaaggggcgtggcaagaggg

SEQ ID NO: 443999 - DNA, 20 bp, mouse
gtgtgtgcgggagagaagtg

SEQ ID NO: 444000 - DNA, 20 bp, mouse
ggtcaggaccctgaactctg

SEQ ID NO: 444001 - DNA, 20 bp, mouse
gcgcatgcgtgatctgggtg

SEQ ID NO: 444002 - DNA, 20 bp, mouse
gcggatctcgcgctgggtaa

SEQ ID NO: 444003 - DNA, 20 bp, mouse
ggctgggtaaggggcgttcg

SEQ ID NO: 444004 - DNA, 20 bp, mouse
gaagtgggggagacaggaca

SEQ ID NO: 444005 - DNA, 20 bp, mouse
ggttcggggagagtcagttg

SEQ ID NO: 444006 - DNA, 20 bp, mouse
ggattcgtagcaggtaccgg

SEQ ID NO: 444007 - DNA, 20 bp, mouse
gcctggaaaagtctgccctc

SEQ ID NO: 444008 - DNA, 20 bp, mouse
ggaagattcgtagcaggtac

SEQ ID NO: 444009 - DNA, 20 bp, mouse
gtcccacgcccactcctctc

SEQ ID NO: 444010 - DNA, 20 bp, mouse
ggagacagaagattcgtagc

SEQ ID NO: 444011 - DNA, 20 bp, mouse
ggtttcatggtgcttcttgt

SEQ ID NO: 444012 - DNA, 20 bp, mouse
ggtgatctcagagcagaacg

SEQ ID NO: 444013 - DNA, 20 bp, mouse
ggtgatgtagagttcatcgg

SEQ ID NO: 444014 - DNA, 20 bp, mouse
gatctcagagcagaacgtgg

SEQ ID NO: 444015 - DNA, 20 bp, mouse
gtacctgagcccagccacgg

SEQ ID NO: 444016 - DNA, 20 bp, mouse
gtggcgagttccagcggaga

SEQ ID NO: 444017 - DNA, 20 bp, mouse
gaagttgagggcaggcggga

SEQ ID NO: 444018 - DNA, 20 bp, mouse
gagctgatttccccatccaa

SEQ ID NO: 444019 - DNA, 20 bp, mouse
gtcagccagctacttacctt

SEQ ID NO: 444020 - DNA, 20 bp, mouse
gtgcagtccagctaagttga

SEQ ID NO: 444021 - DNA, 20 bp, mouse
gatggggaaatcagctggct

SEQ ID NO: 444022 - DNA, 20 bp, mouse
ggtccagctaagttgagggc

SEQ ID NO: 444023 - DNA, 20 bp, mouse
gcagctacttacctttggat

SEQ ID NO: 444024 - DNA, 20 bp, mouse
gggactgcagccttctccgc

SEQ ID NO: 444025 - DNA, 20 bp, mouse
gctttctagctgtcaaggga

SEQ ID NO: 444026 - DNA, 20 bp, mouse
gaggggagagatccaggtgt

SEQ ID NO: 444027 - DNA, 20 bp, mouse
gcagcattctcagaccatct

SEQ ID NO: 444028 - DNA, 20 bp, mouse
gccagcccgagttcacaggg

SEQ ID NO: 444029 - DNA, 20 bp, mouse
gcaagcatttgcactcctgt

SEQ ID NO: 444030 - DNA, 20 bp, mouse
ggtgcaaatgcttgcccaga

SEQ ID NO: 444031 - DNA, 20 bp, mouse
ggtgctggcgagctggtgaa

SEQ ID NO: 444032 - DNA, 20 bp, mouse
gaacctgccgtggaggagca

SEQ ID NO: 444033 - DNA, 20 bp, mouse
gtgaaggctgaggttgatcc

SEQ ID NO: 444034 - DNA, 20 bp, mouse
gcaaatgcaacctgccgtgg

SEQ ID NO: 444035 - DNA, 20 bp, mouse
gaggtaggtgccagaggcta

SEQ ID NO: 444036 - DNA, 20 bp, mouse
ggagctgagtgggacttcac

SEQ ID NO: 444037 - DNA, 20 bp, mouse
gagcttagttggagctgagt

SEQ ID NO: 444038 - DNA, 20 bp, mouse
gcagtgagaagggcttaggg

SEQ ID NO: 444039 - DNA, 20 bp, mouse
gtcctggtccctgcaagctg

SEQ ID NO: 444040 - DNA, 20 bp, mouse
gcggaaccgggaccagaggt

SEQ ID NO: 444041 - DNA, 20 bp, mouse
ggaggagggagacacccggg

SEQ ID NO: 444042 - DNA, 20 bp, mouse
gtccgcggaaccgggaccag

SEQ ID NO: 444043 - DNA, 20 bp, mouse
ggagcaggtggaaccggtgc

SEQ ID NO: 444044 - DNA, 20 bp, mouse
gccgcgggagcaggtggaac

SEQ ID NO: 444045 - DNA, 20 bp, mouse
gactaagctagctccagcac

SEQ ID NO: 444046 - DNA, 20 bp, mouse
gggctccaccagacattcgg

SEQ ID NO: 444047 - DNA, 20 bp, mouse
gttcggcggttgctctagag

SEQ ID NO: 444048 - DNA, 20 bp, mouse
gccagggaggggagatgtat

SEQ ID NO: 444049 - DNA, 20 bp, mouse
ggcaaccgccgaatgtctgg

SEQ ID NO: 444050 - DNA, 20 bp, mouse
gagagcaaccgccgaatgtc

SEQ ID NO: 444051 - DNA, 20 bp, mouse
gaaaagctcagtacagggtg

SEQ ID NO: 444052 - DNA, 20 bp, mouse
gcttggctccaccagacatt

SEQ ID NO: 444053 - DNA, 20 bp, mouse
gagtgcttgggcccagggag

SEQ ID NO: 444054 - DNA, 20 bp, mouse
ggagcttacctagacatcat

SEQ ID NO: 444055 - DNA, 20 bp, mouse
gaccatgaaacccactgcca

SEQ ID NO: 444056 - DNA, 20 bp, mouse
ggctgtggagctctgcatgg

SEQ ID NO: 444057 - DNA, 20 bp, mouse
ggtggagctctgcatggtgg

SEQ ID NO: 444058 - DNA, 20 bp, mouse
gagcaggaatagaagcgctg

SEQ ID NO: 444059 - DNA, 20 bp, mouse
ggctttatagggagcagagt

SEQ ID NO: 444060 - DNA, 20 bp, mouse
ggattagaggggacttacct

SEQ ID NO: 444061 - DNA, 20 bp, mouse
gtgcttggatctcagcctct

SEQ ID NO: 444062 - DNA, 20 bp, mouse
gagtagtcatgagaaaggat

SEQ ID NO: 444063 - DNA, 20 bp, mouse
ggctccctataaagctagtc

SEQ ID NO: 444064 - DNA, 20 bp, mouse
gtctcccgactagctttata

SEQ ID NO: 444065 - DNA, 20 bp, mouse
ggcacaaggtcatgaaggag

SEQ ID NO: 444066 - DNA, 20 bp, mouse
gggtggtagctatgagcagg

SEQ ID NO: 444067 - DNA, 20 bp, mouse
gacttcgaaatgaaagctag

SEQ ID NO: 444068 - DNA, 20 bp, mouse
gaatacctgaggactgatgg

SEQ ID NO: 444069 - DNA, 20 bp, mouse
gctggtccagccaatacctg

SEQ ID NO: 444070 - DNA, 20 bp, mouse
gaatgaaagctagaggagtc

SEQ ID NO: 444071 - DNA, 20 bp, mouse
ggatggtggtagctatgagc

SEQ ID NO: 444072 - DNA, 20 bp, mouse
gggaatgtgctgagagatcg

SEQ ID NO: 444073 - DNA, 20 bp, mouse
gaagagactcgggttacaag

SEQ ID NO: 444074 - DNA, 20 bp, mouse
ggctaccaccatcagtcctc

SEQ ID NO: 444075 - DNA, 20 bp, mouse
gggtgtcacgaaacatcaca

SEQ ID NO: 444076 - DNA, 20 bp, mouse
gcaatgctgggcaccaagac

SEQ ID NO: 444077 - DNA, 20 bp, mouse
gctcatggtaccaaaagctg

SEQ ID NO: 444078 - DNA, 20 bp, mouse
gagcatctgaagtgacctca

SEQ ID NO: 444079 - DNA, 20 bp, mouse
ggccgggcacagacaggata

SEQ ID NO: 444080 - DNA, 20 bp, mouse
gcttaacaggggtcaccagg

SEQ ID NO: 444081 - DNA, 20 bp, mouse
ggtaccaaaagctgaggtga

SEQ ID NO: 444082 - DNA, 20 bp, mouse
gtgctcctgtggccaccccc

SEQ ID NO: 444083 - DNA, 20 bp, mouse
ggccagagctggtaagagcc

SEQ ID NO: 444084 - DNA, 20 bp, mouse
gttcacccacacagagacca

SEQ ID NO: 444085 - DNA, 20 bp, mouse
ggtaagagccgggcacagac

SEQ ID NO: 444086 - DNA, 20 bp, mouse
ggtgcagagagccagacggg

SEQ ID NO: 444087 - DNA, 20 bp, mouse
gagagagccagacgggagga

SEQ ID NO: 444088 - DNA, 20 bp, mouse
gcaggcccagaagcatgaca

SEQ ID NO: 444089 - DNA, 20 bp, mouse
gagtgagagttggctggtgc

SEQ ID NO: 444090 - DNA, 20 bp, mouse
gaagataaggagcataaaga

SEQ ID NO: 444091 - DNA, 20 bp, mouse
gtggaacaggaactatatga

SEQ ID NO: 444092 - DNA, 20 bp, mouse
gatcaaacagaggcttgggt

SEQ ID NO: 444093 - DNA, 20 bp, mouse
ggtgatagcatagtctcaca

SEQ ID NO: 444094 - DNA, 20 bp, mouse
gccaggttcccaaatactga

SEQ ID NO: 444095 - DNA, 20 bp, mouse
gaaatactgagggaagtaac

SEQ ID NO: 444096 - DNA, 20 bp, mouse
ggagcacaggagcactcgca

SEQ ID NO: 444097 - DNA, 20 bp, mouse
gagctgagaatggcctgcgg

SEQ ID NO: 444098 - DNA, 20 bp, mouse
gcaactcctggagctgagaa

SEQ ID NO: 444099 - DNA, 20 bp, mouse
gggagcactcgcagggcact

SEQ ID NO: 444100 - DNA, 20 bp, mouse
gcactgagtacatcaactcc

SEQ ID NO: 444101 - DNA, 20 bp, mouse
gtcctctggaccatatctag

SEQ ID NO: 444102 - DNA, 20 bp, mouse
gagggctggtgctggagcac

SEQ ID NO: 444103 - DNA, 20 bp, mouse
gtgaggacagcagcatgcta

SEQ ID NO: 444104 - DNA, 20 bp, mouse
gcagtacccatgccaaagca

SEQ ID NO: 444105 - DNA, 20 bp, mouse
gctcagggaacccctagata

SEQ ID NO: 444106 - DNA, 20 bp, mouse
ggacgagagccaccaggagt

SEQ ID NO: 444107 - DNA, 20 bp, mouse
gaccaggagtgggacacgca

SEQ ID NO: 444108 - DNA, 20 bp, mouse
gacgaggacacataacatca

SEQ ID NO: 444109 - DNA, 20 bp, mouse
gaagaaggacgagagccacc

SEQ ID NO: 444110 - DNA, 20 bp, mouse
gaccctgcgtgtcccactcc

SEQ ID NO: 444111 - DNA, 20 bp, mouse
gaccaggcttgagtcaggga

SEQ ID NO: 444112 - DNA, 20 bp, mouse
gcaggtgtctaatgaccaga

SEQ ID NO: 444113 - DNA, 20 bp, mouse
gggtcattagacacctgacg

SEQ ID NO: 444114 - DNA, 20 bp, mouse
gaggtaccaggcttgagtca

SEQ ID NO: 444115 - DNA, 20 bp, mouse
gaaagccaaagtgagtccag

SEQ ID NO: 444116 - DNA, 20 bp, mouse
ggtgcctgacctccagaaca

SEQ ID NO: 444117 - DNA, 20 bp, mouse
gaccagtgggagggagatcg

SEQ ID NO: 444118 - DNA, 20 bp, mouse
gagctcagagttcaaagctg

SEQ ID NO: 444119 - DNA, 20 bp, mouse
gctgacctccagaacatggc

SEQ ID NO: 444120 - DNA, 20 bp, mouse
gcgcgcaggctaccaggaga

SEQ ID NO: 444121 - DNA, 20 bp, mouse
ggctggtttggcacagtgaa

SEQ ID NO: 444122 - DNA, 20 bp, mouse
gggacgtgcagcaagatgag

SEQ ID NO: 444123 - DNA, 20 bp, mouse
gtaagtggctggggtatgac

SEQ ID NO: 444124 - DNA, 20 bp, mouse
gaagagatcctggagatatg

SEQ ID NO: 444125 - DNA, 20 bp, mouse
gcccagaagtctcacctatg

SEQ ID NO: 444126 - DNA, 20 bp, mouse
gccagctctcaggaccagaa

SEQ ID NO: 444127 - DNA, 20 bp, mouse
gctcaggaccagaaaggcat

SEQ ID NO: 444128 - DNA, 20 bp, mouse
gggcaatacacgctacaagc

SEQ ID NO: 444129 - DNA, 20 bp, mouse
ggccagttcactgatcccat

SEQ ID NO: 444130 - DNA, 20 bp, mouse
gtagctaaggacaatacctt

SEQ ID NO: 444131 - DNA, 20 bp, mouse
gctttttctgactacagcag

SEQ ID NO: 444132 - DNA, 20 bp, mouse
ggagacactgaagagttcaa

SEQ ID NO: 444133 - DNA, 20 bp, mouse
ggcccaaaccggggcaaggt

SEQ ID NO: 444134 - DNA, 20 bp, mouse
gcagtgtctcttgggaggtt

SEQ ID NO: 444135 - DNA, 20 bp, mouse
gtgtagcgtgtattgcctat

SEQ ID NO: 444136 - DNA, 20 bp, mouse
ggcccagtggagtcgcgaag

SEQ ID NO: 444137 - DNA, 20 bp, mouse
gggtggaccaaggcgcccag

SEQ ID NO: 444138 - DNA, 20 bp, mouse
ggccacttcgcgactccact

SEQ ID NO: 444139 - DNA, 20 bp, mouse
ggctggcgatggccgcggag

SEQ ID NO: 444140 - DNA, 20 bp, mouse
gggccgcggagagggtgagt

SEQ ID NO: 444141 - DNA, 20 bp, mouse
gcgtcgtccgcggtggacca

SEQ ID NO: 444142 - DNA, 20 bp, mouse
ggtccagacggcgtccactg

SEQ ID NO: 444143 - DNA, 20 bp, mouse
gctccaactcaccctctccg

SEQ ID NO: 444144 - DNA, 20 bp, mouse
ggtcgcgaagtggctggcga

SEQ ID NO: 444145 - DNA, 20 bp, mouse
ggttggagcctggcccgcag

SEQ ID NO: 444146 - DNA, 20 bp, mouse
gagacaggaggagcttcagg

SEQ ID NO: 444147 - DNA, 20 bp, mouse
gagaaccagctacatacatg

SEQ ID NO: 444148 - DNA, 20 bp, mouse
gacatgtggcaacaccaagc

SEQ ID NO: 444149 - DNA, 20 bp, mouse
gtcactggtgcagctcttgt

SEQ ID NO: 444150 - DNA, 20 bp, mouse
gacagactgggcctcaagat

SEQ ID NO: 444151 - DNA, 20 bp, mouse
ggatggtcttgtcagacagg

SEQ ID NO: 444152 - DNA, 20 bp, mouse
ggctgctcccacctaaaaac

SEQ ID NO: 444153 - DNA, 20 bp, mouse
gcaggcagaggaagggccgt

SEQ ID NO: 444154 - DNA, 20 bp, mouse
gacatcattgagcaagggac

SEQ ID NO: 444155 - DNA, 20 bp, mouse
gcccacctaaaaacaggcag

SEQ ID NO: 444156 - DNA, 20 bp, mouse
gcgtttccggggcggagcca

SEQ ID NO: 444157 - DNA, 20 bp, mouse
gtaacggtccgtttccgggg

SEQ ID NO: 444158 - DNA, 20 bp, mouse
gacatgtccggggctccgaa

SEQ ID NO: 444159 - DNA, 20 bp, mouse
gctcaatcgcgacatgtccg

SEQ ID NO: 444160 - DNA, 20 bp, mouse
gcaggaaccgttcggagccc

SEQ ID NO: 444161 - DNA, 20 bp, mouse
gtgagtggaggcgggagaag

SEQ ID NO: 444162 - DNA, 20 bp, mouse
gtccggggcggagccaggga

SEQ ID NO: 444163 - DNA, 20 bp, mouse
ggccctccctggctccgccc

SEQ ID NO: 444164 - DNA, 20 bp, mouse
gtgttaacggtccgtttccg

SEQ ID NO: 444165 - DNA, 20 bp, mouse
ggtggaggcgggagaagcgg

SEQ ID NO: 444166 - DNA, 20 bp, mouse
gctgagtgagcatgatggag

SEQ ID NO: 444167 - DNA, 20 bp, mouse
gaaggaaggaagaaacctct

SEQ ID NO: 444168 - DNA, 20 bp, mouse
gctaggctgagtgagcatga

SEQ ID NO: 444169 - DNA, 20 bp, mouse
gaagcaacagtaacagcggg

SEQ ID NO: 444170 - DNA, 20 bp, mouse
ggcaaggctggagaacaata

SEQ ID NO: 444171 - DNA, 20 bp, mouse
gtcagaagcaacagtaacag

SEQ ID NO: 444172 - DNA, 20 bp, mouse
gtacagcagctagtgctgga

SEQ ID NO: 444173 - DNA, 20 bp, mouse
gatagggccacacttcagag

SEQ ID NO: 444174 - DNA, 20 bp, mouse
gagtaacagcgggaggctgc

SEQ ID NO: 444175 - DNA, 20 bp, mouse
gggactgagggcagagttag

SEQ ID NO: 444176 - DNA, 20 bp, mouse
ggagtcattgccagactcag

SEQ ID NO: 444177 - DNA, 20 bp, mouse
gcaggtgaggctgtgggatc

SEQ ID NO: 444178 - DNA, 20 bp, mouse
gccgcctgacccactgagtc

SEQ ID NO: 444179 - DNA, 20 bp, mouse
gatgactcaggtgaggctgt

SEQ ID NO: 444180 - DNA, 20 bp, mouse
ggatcaggaagtaaatctaa

SEQ ID NO: 444181 - DNA, 20 bp, mouse
gacctcagaaggtgagttgg

SEQ ID NO: 444182 - DNA, 20 bp, mouse
gccaaacgatcggagagcaa

SEQ ID NO: 444183 - DNA, 20 bp, mouse
gctccttccagccccaactt

SEQ ID NO: 444184 - DNA, 20 bp, mouse
gcttccagccccaacttagg

SEQ ID NO: 444185 - DNA, 20 bp, mouse
gtaaatctaaaggtgtcctt

SEQ ID NO: 444186 - DNA, 20 bp, mouse
gttgtcagcagaacagaaaa

SEQ ID NO: 444187 - DNA, 20 bp, mouse
ggagctccttaagaatccca

SEQ ID NO: 444188 - DNA, 20 bp, mouse
gtgccttagaccagagactg

SEQ ID NO: 444189 - DNA, 20 bp, mouse
ggagtctacactgctacagg

SEQ ID NO: 444190 - DNA, 20 bp, mouse
gcacctgctcaacatcatga

SEQ ID NO: 444191 - DNA, 20 bp, mouse
gacttggttgcagagtgtca

SEQ ID NO: 444192 - DNA, 20 bp, mouse
ggtagcagtgtagactcaca

SEQ ID NO: 444193 - DNA, 20 bp, mouse
ggaccttcatgatgttgagc

SEQ ID NO: 444194 - DNA, 20 bp, mouse
gcatatgccccttctcttat

SEQ ID NO: 444195 - DNA, 20 bp, mouse
ggccagccctgggattctta

SEQ ID NO: 444196 - DNA, 20 bp, mouse
ggcacagagctgggactgca

SEQ ID NO: 444197 - DNA, 20 bp, mouse
ggcttgggcaggggaaccag

SEQ ID NO: 444198 - DNA, 20 bp, mouse
gggaagactggactaggtgg

SEQ ID NO: 444199 - DNA, 20 bp, mouse
gcatggtgttgctcggggtt

SEQ ID NO: 444200 - DNA, 20 bp, mouse
ggagcttcatggtgttgctc

SEQ ID NO: 444201 - DNA, 20 bp, mouse
ggaaggcagccacgagcaag

SEQ ID NO: 444202 - DNA, 20 bp, mouse
gggttaggtttgcacagagc

SEQ ID NO: 444203 - DNA, 20 bp, mouse
gtggggtcagctcaatagtc

SEQ ID NO: 444204 - DNA, 20 bp, mouse
gtacttggtgctgagaaccc

SEQ ID NO: 444205 - DNA, 20 bp, mouse
ggtgctgtgctgatctgagt

SEQ ID NO: 444206 - DNA, 20 bp, mouse
ggagatcttcatggtacccg

SEQ ID NO: 444207 - DNA, 20 bp, mouse
gtacccgcggcagaggctgt

SEQ ID NO: 444208 - DNA, 20 bp, mouse
gtgcagagcaccccttgcag

SEQ ID NO: 444209 - DNA, 20 bp, mouse
gttcatggtacccgcggcag

SEQ ID NO: 444210 - DNA, 20 bp, mouse
gtgcagtgaggatgatggtg

SEQ ID NO: 444211 - DNA, 20 bp, mouse
gtctcccacagcctctgccg

SEQ ID NO: 444212 - DNA, 20 bp, mouse
ggtctcagagtcctctgcaa

SEQ ID NO: 444213 - DNA, 20 bp, mouse
gctaatggcaggatcctctg

SEQ ID NO: 444214 - DNA, 20 bp, mouse
gtggaaagaaggggaggtct

SEQ ID NO: 444215 - DNA, 20 bp, mouse
gttggcatcgaggcagagtg

SEQ ID NO: 444216 - DNA, 20 bp, mouse
gagggcaggccagagaatca

SEQ ID NO: 444217 - DNA, 20 bp, mouse
gcagagcctaaaggctacag

SEQ ID NO: 444218 - DNA, 20 bp, mouse
gactggaggggagctagaga

SEQ ID NO: 444219 - DNA, 20 bp, mouse
gggacccaaggacagccaca

SEQ ID NO: 444220 - DNA, 20 bp, mouse
gggatggaatatttccagga

SEQ ID NO: 444221 - DNA, 20 bp, mouse
gtgagccctctcaacccagg

SEQ ID NO: 444222 - DNA, 20 bp, mouse
gtaggagtaaaattataagt

SEQ ID NO: 444223 - DNA, 20 bp, mouse
gagggtagcagtcttgcagg

SEQ ID NO: 444224 - DNA, 20 bp, mouse
gtatccttgtggctgtcctt

SEQ ID NO: 444225 - DNA, 20 bp, mouse
gtccatccttgacatggtga

SEQ ID NO: 444226 - DNA, 20 bp, mouse
gagcgtggcagagatcctca

SEQ ID NO: 444227 - DNA, 20 bp, mouse
ggtggcagagatcctcatgg

SEQ ID NO: 444228 - DNA, 20 bp, mouse
gagcagcaggcacagaagcg

SEQ ID NO: 444229 - DNA, 20 bp, mouse
ggcatgctctgggaaacagg

SEQ ID NO: 444230 - DNA, 20 bp, mouse
gtccaagtgtgggcccaacc

SEQ ID NO: 444231 - DNA, 20 bp, mouse
ggccagcaaatgtgagacta

SEQ ID NO: 444232 - DNA, 20 bp, mouse
gctctgggaaacaggaggca

SEQ ID NO: 444233 - DNA, 20 bp, mouse
gacctggttgggcccacact

SEQ ID NO: 444234 - DNA, 20 bp, mouse
gggagaagaggcccaatgtc

SEQ ID NO: 444235 - DNA, 20 bp, mouse
ggaagaggcccaatgtctgg

SEQ ID NO: 444236 - DNA, 20 bp, mouse
gctagcagagttagattgag

SEQ ID NO: 444237 - DNA, 20 bp, mouse
ggagagggcagtatcggtag

SEQ ID NO: 444238 - DNA, 20 bp, mouse
gtggcccagtcagcttctct

SEQ ID NO: 444239 - DNA, 20 bp, mouse
ggatggacagactgagagta

SEQ ID NO: 444240 - DNA, 20 bp, mouse
gtgaggagatggcccagaag

SEQ ID NO: 444241 - DNA, 20 bp, mouse
gtctaactctgctagtctgg

SEQ ID NO: 444242 - DNA, 20 bp, mouse
gaacaaggagagggcagtat

SEQ ID NO: 444243 - DNA, 20 bp, mouse
ggatggcccagaagtggctg

SEQ ID NO: 444244 - DNA, 20 bp, mouse
gaagccagtgtgtcaaagct

SEQ ID NO: 444245 - DNA, 20 bp, mouse
gatctcctcaaacaaggaga

SEQ ID NO: 444246 - DNA, 20 bp, mouse
gaaggcttcatcttcttagt

SEQ ID NO: 444247 - DNA, 20 bp, mouse
gatccaggggctatagccag

SEQ ID NO: 444248 - DNA, 20 bp, mouse
gtccatcccagacagagcaa

SEQ ID NO: 444249 - DNA, 20 bp, mouse
gcttagtgggcagacccagc

SEQ ID NO: 444250 - DNA, 20 bp, mouse
gcacatggtgagtcctgtgg

SEQ ID NO: 444251 - DNA, 20 bp, mouse
gaggggctatagccagaggc

SEQ ID NO: 444252 - DNA, 20 bp, mouse
gtcacacatggtgagtcctg

SEQ ID NO: 444253 - DNA, 20 bp, mouse
gttggggggagttccagaag

SEQ ID NO: 444254 - DNA, 20 bp, mouse
gtaaatagcaagaccgggcc

SEQ ID NO: 444255 - DNA, 20 bp, mouse
ggtttgacttccaaaaaggg

SEQ ID NO: 444256 - DNA, 20 bp, mouse
ggcccagagcgagcatgtag

SEQ ID NO: 444257 - DNA, 20 bp, mouse
ggccgcacgcggcgacatgg

SEQ ID NO: 444258 - DNA, 20 bp, mouse
ggcacgcggcgacatggagg

SEQ ID NO: 444259 - DNA, 20 bp, mouse
ggcagggacagcggtcaggt

SEQ ID NO: 444260 - DNA, 20 bp, mouse
gcgctggcagtggggctccc

SEQ ID NO: 444261 - DNA, 20 bp, mouse
ggccgctacatgctcgctct

SEQ ID NO: 444262 - DNA, 20 bp, mouse
gtcgccgcgtgcggcccccg

SEQ ID NO: 444263 - DNA, 20 bp, mouse
ggccgtctggagcaggccgg

SEQ ID NO: 444264 - DNA, 20 bp, mouse
gatgtagcggccgctggcag

SEQ ID NO: 444265 - DNA, 20 bp, mouse
gaaggcgcggcacttcctcc

SEQ ID NO: 444266 - DNA, 20 bp, mouse
gtctctgaaggtggatacag

SEQ ID NO: 444267 - DNA, 20 bp, mouse
gaggagggtggcaggacaag

SEQ ID NO: 444268 - DNA, 20 bp, mouse
gaagaggagcagtttcacca

SEQ ID NO: 444269 - DNA, 20 bp, mouse
gggttgggaaatgtctctga

SEQ ID NO: 444270 - DNA, 20 bp, mouse
gctcagtagacgtatgacag

SEQ ID NO: 444271 - DNA, 20 bp, mouse
ggagaggccccagcctggat

SEQ ID NO: 444272 - DNA, 20 bp, mouse
ggatacagaggtgagcaacg

SEQ ID NO: 444273 - DNA, 20 bp, mouse
gctaagactgaagcttagac

SEQ ID NO: 444274 - DNA, 20 bp, mouse
ggatgtccgtctggctgtca

SEQ ID NO: 444275 - DNA, 20 bp, mouse
gtgtttcttggacattctgg

SEQ ID NO: 444276 - DNA, 20 bp, mouse
gggagaggagagattccagg

SEQ ID NO: 444277 - DNA, 20 bp, mouse
gctgggtcgaaagtcctcag

SEQ ID NO: 444278 - DNA, 20 bp, mouse
ggggccgtgcgcggagggag

SEQ ID NO: 444279 - DNA, 20 bp, mouse
gcccggagaggagagattcc

SEQ ID NO: 444280 - DNA, 20 bp, mouse
gggttgcagagagagccgga

SEQ ID NO: 444281 - DNA, 20 bp, mouse
gagcaagcgcaccccggccg

SEQ ID NO: 444282 - DNA, 20 bp, mouse
ggtggcgagcgcactagccg

SEQ ID NO: 444283 - DNA, 20 bp, mouse
ggctagtgcgctcgccactg

SEQ ID NO: 444284 - DNA, 20 bp, mouse
ggggccggttccagcagcct

SEQ ID NO: 444285 - DNA, 20 bp, mouse
gcaatgtgggcagacaatcc

SEQ ID NO: 444286 - DNA, 20 bp, mouse
gcggccgacccgcggagcag

SEQ ID NO: 444287 - DNA, 20 bp, mouse
gcgggaggagcgtagagccc

SEQ ID NO: 444288 - DNA, 20 bp, mouse
gcgcgcagctcgcggctcct

SEQ ID NO: 444289 - DNA, 20 bp, mouse
ggaccctggcggccgacccg

SEQ ID NO: 444290 - DNA, 20 bp, mouse
ggtcccgcgctgctccggag

SEQ ID NO: 444291 - DNA, 20 bp, mouse
gctacaagaccagcagccgg

SEQ ID NO: 444292 - DNA, 20 bp, mouse
gcagcctctgctccgcgggt

SEQ ID NO: 444293 - DNA, 20 bp, mouse
gcaagactcgacgggtaata

SEQ ID NO: 444294 - DNA, 20 bp, mouse
gaagggcggtctacacgggt

SEQ ID NO: 444295 - DNA, 20 bp, mouse
ggccgccgacagaaccggac

SEQ ID NO: 444296 - DNA, 20 bp, mouse
gagaccgcgggatcccggag

SEQ ID NO: 444297 - DNA, 20 bp, mouse
gcgggccgctcgctcctcat

SEQ ID NO: 444298 - DNA, 20 bp, mouse
gctggccaatgaggagcgag

SEQ ID NO: 444299 - DNA, 20 bp, mouse
gtcgcggcgggagaagaccg

SEQ ID NO: 444300 - DNA, 20 bp, mouse
gtgccacgaactggccaatg

SEQ ID NO: 444301 - DNA, 20 bp, mouse
gcggggtttaaacctaagcc

SEQ ID NO: 444302 - DNA, 20 bp, mouse
gcgtagacagctctccggga

SEQ ID NO: 444303 - DNA, 20 bp, mouse
gatggcgctcagggtcacta

SEQ ID NO: 444304 - DNA, 20 bp, mouse
gctgaggacccaccttatgg

SEQ ID NO: 444305 - DNA, 20 bp, mouse
gccaggcgctgcggtgatcg

SEQ ID NO: 444306 - DNA, 20 bp, mouse
gacgcgaaatctgtcttgag

SEQ ID NO: 444307 - DNA, 20 bp, mouse
gcaccacgcatgcgccctgg

SEQ ID NO: 444308 - DNA, 20 bp, mouse
gccttcacttgagctaggaa

SEQ ID NO: 444309 - DNA, 20 bp, mouse
gcgaaatctgtcttgagtgg

SEQ ID NO: 444310 - DNA, 20 bp, mouse
gtcgcgtggccaagccgcca

SEQ ID NO: 444311 - DNA, 20 bp, mouse
ggggcgcattaccttactgg

SEQ ID NO: 444312 - DNA, 20 bp, mouse
gggcaagtcacacaagatga

SEQ ID NO: 444313 - DNA, 20 bp, mouse
gacatcgccacaaggtagcc

SEQ ID NO: 444314 - DNA, 20 bp, mouse
ggacttgcccggctaccttg

SEQ ID NO: 444315 - DNA, 20 bp, mouse
ggtatctagaaacgcagcaa

SEQ ID NO: 444316 - DNA, 20 bp, mouse
gacggtgtcgcagaccggag

SEQ ID NO: 444317 - DNA, 20 bp, mouse
gggtctgcgacaccgttggg

SEQ ID NO: 444318 - DNA, 20 bp, mouse
gggggccctgaccctcccaa

SEQ ID NO: 444319 - DNA, 20 bp, mouse
ggacaccgttgggagggtca

SEQ ID NO: 444320 - DNA, 20 bp, mouse
gagggccgccctggcaagtg

SEQ ID NO: 444321 - DNA, 20 bp, mouse
gcgggctacccggcaggaca

SEQ ID NO: 444322 - DNA, 20 bp, mouse
gccgggcggtggacgcggag

SEQ ID NO: 444323 - DNA, 20 bp, mouse
ggccctggcaagtgcggacg

SEQ ID NO: 444324 - DNA, 20 bp, mouse
gtgaatcgcggaccgggcgg

SEQ ID NO: 444325 - DNA, 20 bp, mouse
ggcgccgctgacgcactatt

SEQ ID NO: 444326 - DNA, 20 bp, mouse
gggcctcagcaacggagtaa

SEQ ID NO: 444327 - DNA, 20 bp, mouse
gagcataacggcctcagcaa

SEQ ID NO: 444328 - DNA, 20 bp, mouse
gactagaagctcacgcgcgg

SEQ ID NO: 444329 - DNA, 20 bp, mouse
ggttactagaagctcacgcg

SEQ ID NO: 444330 - DNA, 20 bp, mouse
gtcagcaacggagtaacggc

SEQ ID NO: 444331 - DNA, 20 bp, mouse
gggagtaacggccggcctcg

SEQ ID NO: 444332 - DNA, 20 bp, mouse
ggccgttatgctaagacaga

SEQ ID NO: 444333 - DNA, 20 bp, mouse
gaccgtctgtcttagcataa

SEQ ID NO: 444334 - DNA, 20 bp, mouse
gaactgctgcctgctcgaga

SEQ ID NO: 444335 - DNA, 20 bp, mouse
gcggaggcggttatgccgcg

SEQ ID NO: 444336 - DNA, 20 bp, mouse
ggactgtgctcctaccagac

SEQ ID NO: 444337 - DNA, 20 bp, mouse
gccacagccaccgcagccgg

SEQ ID NO: 444338 - DNA, 20 bp, mouse
gtgctcctaccagactggct

SEQ ID NO: 444339 - DNA, 20 bp, mouse
gagcgaccatagacacagtc

SEQ ID NO: 444340 - DNA, 20 bp, mouse
gcagccagcaaagcggcccg

SEQ ID NO: 444341 - DNA, 20 bp, mouse
ggccaggatggaaaccccga

SEQ ID NO: 444342 - DNA, 20 bp, mouse
gaccggcgtcaaggcgacga

SEQ ID NO: 444343 - DNA, 20 bp, mouse
ggtcgtccggactgtgtcta

SEQ ID NO: 444344 - DNA, 20 bp, mouse
ggatggaaaccccgagggat

SEQ ID NO: 444345 - DNA, 20 bp, mouse
gagggagggctcacccgcag

SEQ ID NO: 444346 - DNA, 20 bp, mouse
gagaccggcagtacagcgcg

SEQ ID NO: 444347 - DNA, 20 bp, mouse
gtgcgccgacagccctctgg

SEQ ID NO: 444348 - DNA, 20 bp, mouse
gctccgcgcgctccggagac

SEQ ID NO: 444349 - DNA, 20 bp, mouse
ggagggctgtggtctcggtt

SEQ ID NO: 444350 - DNA, 20 bp, mouse
gcgagccatgctcaagacgg

SEQ ID NO: 444351 - DNA, 20 bp, mouse
gtactgcgccgacagccctc

SEQ ID NO: 444352 - DNA, 20 bp, mouse
gggtctcggttgggctccgg

SEQ ID NO: 444353 - DNA, 20 bp, mouse
gctgcctcgcgctgtactgc

SEQ ID NO: 444354 - DNA, 20 bp, mouse
gacgcacttgaagtaagata

SEQ ID NO: 444355 - DNA, 20 bp, mouse
gctacagactccgcgcgctc

SEQ ID NO: 444356 - DNA, 20 bp, mouse
gtgggcgagcggagcctcaa

SEQ ID NO: 444357 - DNA, 20 bp, mouse
ggagagccgggcagttcgga

SEQ ID NO: 444358 - DNA, 20 bp, mouse
gagggccgcctgactcgcac

SEQ ID NO: 444359 - DNA, 20 bp, mouse
gggaaggaccggtgcgagtc

SEQ ID NO: 444360 - DNA, 20 bp, mouse
gagagtggaaggtgggcgag

SEQ ID NO: 444361 - DNA, 20 bp, mouse
ggcagtgacgcaagctggaa

SEQ ID NO: 444362 - DNA, 20 bp, mouse
gtacagtcgggaccgagtgg

SEQ ID NO: 444363 - DNA, 20 bp, mouse
ggtcactgcctgagcgagag

SEQ ID NO: 444364 - DNA, 20 bp, mouse
ggcgagtcaggcggcccttg

SEQ ID NO: 444365 - DNA, 20 bp, mouse
gtgaggagagccgggcagtt

SEQ ID NO: 444366 - DNA, 20 bp, mouse
gggtgtcagagaccagaccc

SEQ ID NO: 444367 - DNA, 20 bp, mouse
gccggccacagacagaccag

SEQ ID NO: 444368 - DNA, 20 bp, mouse
ggagggggcgggtgagacaa

SEQ ID NO: 444369 - DNA, 20 bp, mouse
gagcgaagcaggcacgagaa

SEQ ID NO: 444370 - DNA, 20 bp, mouse
gactcaccgagcttagaagg

SEQ ID NO: 444371 - DNA, 20 bp, mouse
gtgtttgggtgcccaggaaa

SEQ ID NO: 444372 - DNA, 20 bp, mouse
gtgtagagcagaccccaagg

SEQ ID NO: 444373 - DNA, 20 bp, mouse
gtgcccccaagcctacctct

SEQ ID NO: 444374 - DNA, 20 bp, mouse
gcgggtgagacaaaggcgct

SEQ ID NO: 444375 - DNA, 20 bp, mouse
gagcaggtgggtgggttcag

SEQ ID NO: 444376 - DNA, 20 bp, mouse
gccagaggcggagcaaggaa

SEQ ID NO: 444377 - DNA, 20 bp, mouse
ggccggagctgctccagagg

SEQ ID NO: 444378 - DNA, 20 bp, mouse
gttcagcaccggaagtactg

SEQ ID NO: 444379 - DNA, 20 bp, mouse
gcgccatcgcaggctctctc

SEQ ID NO: 444380 - DNA, 20 bp, mouse
gagtgccggagctgctccag

SEQ ID NO: 444381 - DNA, 20 bp, mouse
ggatgtagggcatcaggtca

SEQ ID NO: 444382 - DNA, 20 bp, mouse
ggtactgcggcggggccaaa

SEQ ID NO: 444383 - DNA, 20 bp, mouse
gctgtcgagctcgccatcgc

SEQ ID NO: 444384 - DNA, 20 bp, mouse
gtcaagtgcggagaatgggt

SEQ ID NO: 444385 - DNA, 20 bp, mouse
ggaagcccaggagacagcgg

SEQ ID NO: 444386 - DNA, 20 bp, mouse
gacagccagcgcggtgtagg

SEQ ID NO: 444387 - DNA, 20 bp, mouse
gtcgacagccagcgcggtgt

SEQ ID NO: 444388 - DNA, 20 bp, mouse
gaccgcgctggctgtcgagc

SEQ ID NO: 444389 - DNA, 20 bp, mouse
ggccggctcgacagccagcg

SEQ ID NO: 444390 - DNA, 20 bp, mouse
gccggacgcctgggagtcgt

SEQ ID NO: 444391 - DNA, 20 bp, mouse
gtgagagacgggtcaggggt

SEQ ID NO: 444392 - DNA, 20 bp, mouse
gccccgagctgatacctcag

SEQ ID NO: 444393 - DNA, 20 bp, mouse
gggaccgggtccgaccagac

SEQ ID NO: 444394 - DNA, 20 bp, mouse
gcaggaggccgacggcgagc

SEQ ID NO: 444395 - DNA, 20 bp, mouse
gcgggtcacccggtcccctg

SEQ ID NO: 444396 - DNA, 20 bp, mouse
gttgtcaggaggccaagcag

SEQ ID NO: 444397 - DNA, 20 bp, mouse
ggagctaagggaaccacgtc

SEQ ID NO: 444398 - DNA, 20 bp, mouse
gggagtgtcaggctacggtt

SEQ ID NO: 444399 - DNA, 20 bp, mouse
ggaaccccaagtctcctcag

SEQ ID NO: 444400 - DNA, 20 bp, mouse
ggcgccgggccccctcacgg

SEQ ID NO: 444401 - DNA, 20 bp, mouse
gcacgtctggcgggagccat

SEQ ID NO: 444402 - DNA, 20 bp, mouse
gttcgcgccgggccccctca

SEQ ID NO: 444403 - DNA, 20 bp, mouse
gtctggcggtgaggaggtat

SEQ ID NO: 444404 - DNA, 20 bp, mouse
gggaggagcacggtccagga

SEQ ID NO: 444405 - DNA, 20 bp, mouse
gaggggcatgcgggagctaa

SEQ ID NO: 444406 - DNA, 20 bp, mouse
ggcttgagagcggtctaaag

SEQ ID NO: 444407 - DNA, 20 bp, mouse
ggcgcgggcgcgcttgagag

SEQ ID NO: 444408 - DNA, 20 bp, mouse
gggtctaaagcggcagtgga

SEQ ID NO: 444409 - DNA, 20 bp, mouse
ggagcggtctaaagcggcag

SEQ ID NO: 444410 - DNA, 20 bp, mouse
gggagctcggcgatggggag

SEQ ID NO: 444411 - DNA, 20 bp, mouse
ggctcggcgatggggagcgg

SEQ ID NO: 444412 - DNA, 20 bp, mouse
gtggagggagctcggcgatg

SEQ ID NO: 444413 - DNA, 20 bp, mouse
ggagcggcggtggtgagtgc

SEQ ID NO: 444414 - DNA, 20 bp, mouse
ggccctgtccggactcttgt

SEQ ID NO: 444415 - DNA, 20 bp, mouse
ggtgcacttgccccaggcgc

SEQ ID NO: 444416 - DNA, 20 bp, mouse
gtgcgcgctgaccccgagga

SEQ ID NO: 444417 - DNA, 20 bp, mouse
gtcgctgcgcgctgaccccg

SEQ ID NO: 444418 - DNA, 20 bp, mouse
gccccgaggaaggcagtact

SEQ ID NO: 444419 - DNA, 20 bp, mouse
ggaaggactgcgccgggcag

SEQ ID NO: 444420 - DNA, 20 bp, mouse
gggaaggcagtacttggtca

SEQ ID NO: 444421 - DNA, 20 bp, mouse
gggactgggaggcatgacat

SEQ ID NO: 444422 - DNA, 20 bp, mouse
gctgtcggatcggggacgtg

SEQ ID NO: 444423 - DNA, 20 bp, mouse
ggggcagtgggggaacaagc

SEQ ID NO: 444424 - DNA, 20 bp, mouse
gctagtctgcgcctagagag

SEQ ID NO: 444425 - DNA, 20 bp, mouse
gacctaagccctggatacag

SEQ ID NO: 444426 - DNA, 20 bp, mouse
gattctgaggccattatcat

SEQ ID NO: 444427 - DNA, 20 bp, mouse
gttgagtcggcccatgataa

SEQ ID NO: 444428 - DNA, 20 bp, mouse
gcagaatgactgcaagatta

SEQ ID NO: 444429 - DNA, 20 bp, mouse
gagtagctaggagtgcatgt

SEQ ID NO: 444430 - DNA, 20 bp, mouse
gggcttgaaactaattgagt

SEQ ID NO: 444431 - DNA, 20 bp, mouse
ggtttcaagccgcagacctt

SEQ ID NO: 444432 - DNA, 20 bp, mouse
gttagtctaactcagttctt

SEQ ID NO: 444433 - DNA, 20 bp, mouse
gcaactgcccacctagctgt

SEQ ID NO: 444434 - DNA, 20 bp, mouse
gtttgtgcatgtgccagagg

SEQ ID NO: 444435 - DNA, 20 bp, mouse
gttaagagatcaaattgcag

SEQ ID NO: 444436 - DNA, 20 bp, mouse
gaggaggtggcggtgcaggg

SEQ ID NO: 444437 - DNA, 20 bp, mouse
gccgcccggcctcacagccc

SEQ ID NO: 444438 - DNA, 20 bp, mouse
gcgtgacgccggggccgaca

SEQ ID NO: 444439 - DNA, 20 bp, mouse
ggaggagcaagatgcagccg

SEQ ID NO: 444440 - DNA, 20 bp, mouse
ggagcagtagcctaatactt

SEQ ID NO: 444441 - DNA, 20 bp, mouse
gaggccctagaggaaagcgg

SEQ ID NO: 444442 - DNA, 20 bp, mouse
gcacggtgagtgggcctccc

SEQ ID NO: 444443 - DNA, 20 bp, mouse
gaccaaacccagagccaccc

SEQ ID NO: 444444 - DNA, 20 bp, mouse
gtgcatcttgctcctcagcg

SEQ ID NO: 444445 - DNA, 20 bp, mouse
gcggccccggcgtcacggac

SEQ ID NO: 444446 - DNA, 20 bp, mouse
ggcggccctgcggcccgtga

SEQ ID NO: 444447 - DNA, 20 bp, mouse
ggctcgtggtcgctgtctct

SEQ ID NO: 444448 - DNA, 20 bp, mouse
ggaggtcccaggtttagggt

SEQ ID NO: 444449 - DNA, 20 bp, mouse
gggagggagggcacacacat

SEQ ID NO: 444450 - DNA, 20 bp, mouse
gagacagcgaccacgagcga

SEQ ID NO: 444451 - DNA, 20 bp, mouse
ggcgcgttggccgtcgctcg

SEQ ID NO: 444452 - DNA, 20 bp, mouse
ggcgtccgcggtctgggcgg

SEQ ID NO: 444453 - DNA, 20 bp, mouse
gctgtgcccaccctaaacct

SEQ ID NO: 444454 - DNA, 20 bp, mouse
gcaggagaggtcccaggttt

SEQ ID NO: 444455 - DNA, 20 bp, mouse
ggtagccctcacgggccgca

SEQ ID NO: 444456 - DNA, 20 bp, mouse
gcctcggaggcgtttccctc

SEQ ID NO: 444457 - DNA, 20 bp, mouse
gccctcggcgaacctttcct

SEQ ID NO: 444458 - DNA, 20 bp, mouse
gctggagtgggagctcgcgg

SEQ ID NO: 444459 - DNA, 20 bp, mouse
gagcggggcgcgcgggacca

SEQ ID NO: 444460 - DNA, 20 bp, mouse
gccgtgcgcgccgctggagt

SEQ ID NO: 444461 - DNA, 20 bp, mouse
gccgctggagtgggagctcg

SEQ ID NO: 444462 - DNA, 20 bp, mouse
gcgaggggaccggtcctcgg

SEQ ID NO: 444463 - DNA, 20 bp, mouse
gggagcgtacgaaaaagcgc

SEQ ID NO: 444464 - DNA, 20 bp, mouse
gtcctcggcgcgcggcagcg

SEQ ID NO: 444465 - DNA, 20 bp, mouse
ggcgccgctcccccgaggac

SEQ ID NO: 444466 - DNA, 20 bp, mouse
gcagctagggcccagcaccc

SEQ ID NO: 444467 - DNA, 20 bp, mouse
ggaagcccccgcctcagcta

SEQ ID NO: 444468 - DNA, 20 bp, mouse
gccgcccattgttaaaggac

SEQ ID NO: 444469 - DNA, 20 bp, mouse
gccccggcgctggctttgta

SEQ ID NO: 444470 - DNA, 20 bp, mouse
gctgccggtcctttaacaat

SEQ ID NO: 444471 - DNA, 20 bp, mouse
gtgggccctagctgaggcgg

SEQ ID NO: 444472 - DNA, 20 bp, mouse
gtgctgggccctagctgagg

SEQ ID NO: 444473 - DNA, 20 bp, mouse
gtgtacggcgagccgcctgc

SEQ ID NO: 444474 - DNA, 20 bp, mouse
ggcaccgcagacccccaggg

SEQ ID NO: 444475 - DNA, 20 bp, mouse
gtccgggtaagaaaccgcgt

SEQ ID NO: 444476 - DNA, 20 bp, mouse
gcgggaccgagcgcacgcag

SEQ ID NO: 444477 - DNA, 20 bp, mouse
gggaccgggcggccatcgga

SEQ ID NO: 444478 - DNA, 20 bp, mouse
gcggcccgaactgcgagccg

SEQ ID NO: 444479 - DNA, 20 bp, mouse
gggatgtgcgagcaggacaa

SEQ ID NO: 444480 - DNA, 20 bp, mouse
gcgtgcgctcggtcccgccg

SEQ ID NO: 444481 - DNA, 20 bp, mouse
gcccgaactgcgagccgcgg

SEQ ID NO: 444482 - DNA, 20 bp, mouse
gcaattccccgagcgaggga

SEQ ID NO: 444483 - DNA, 20 bp, mouse
gcgggcgggacgggctgcag

SEQ ID NO: 444484 - DNA, 20 bp, mouse
ggagtctggccccggctcga

SEQ ID NO: 444485 - DNA, 20 bp, mouse
ggcacgcgaggccagggacc

SEQ ID NO: 444486 - DNA, 20 bp, mouse
gggaaggagagacgtcgctg

SEQ ID NO: 444487 - DNA, 20 bp, mouse
gcaccaggagcgcagacggt

SEQ ID NO: 444488 - DNA, 20 bp, mouse
gtcttggaggtggaatgtcg

SEQ ID NO: 444489 - DNA, 20 bp, mouse
ggacagggtcgggtcctctg

SEQ ID NO: 444490 - DNA, 20 bp, mouse
gaagccgtgggtgaccgggt

SEQ ID NO: 444491 - DNA, 20 bp, mouse
gcaggagcgcagacggtggg

SEQ ID NO: 444492 - DNA, 20 bp, mouse
gctggaagctgacctcgcag

SEQ ID NO: 444493 - DNA, 20 bp, mouse
gagaccgacccggtcaccca

SEQ ID NO: 444494 - DNA, 20 bp, mouse
gtagccgaggaataaaaggg

SEQ ID NO: 444495 - DNA, 20 bp, mouse
gcattagcggcgcaccccag

SEQ ID NO: 444496 - DNA, 20 bp, mouse
ggtggagctcgctggaacta

SEQ ID NO: 444497 - DNA, 20 bp, mouse
gcagcggtcgaggtcgggtg

SEQ ID NO: 444498 - DNA, 20 bp, mouse
gcgaccggagggatcctgat

SEQ ID NO: 444499 - DNA, 20 bp, mouse
gggcgaccgcctgtattcgg

SEQ ID NO: 444500 - DNA, 20 bp, mouse
gcggcggcagcggtcgaggt

SEQ ID NO: 444501 - DNA, 20 bp, mouse
ggtcgaggtcgggtgaggcc

SEQ ID NO: 444502 - DNA, 20 bp, mouse
gctcctccgggatcagcgag

SEQ ID NO: 444503 - DNA, 20 bp, mouse
ggaccactcgctgatcccgg

SEQ ID NO: 444504 - DNA, 20 bp, mouse
gacgctggttagtctcgctt

SEQ ID NO: 444505 - DNA, 20 bp, mouse
gcgacgacgaccacgaccgg

SEQ ID NO: 444506 - DNA, 20 bp, mouse
gggaagggcccgagaagagt

SEQ ID NO: 444507 - DNA, 20 bp, mouse
gagggcccgagaagagtcgg

SEQ ID NO: 444508 - DNA, 20 bp, mouse
gagtcggcggcacaaaatgg

SEQ ID NO: 444509 - DNA, 20 bp, mouse
gaagagtcggcggcacaaaa

SEQ ID NO: 444510 - DNA, 20 bp, mouse
ggcagccgccctgacgggaa

SEQ ID NO: 444511 - DNA, 20 bp, mouse
ggagctcgcagcccacgacg

SEQ ID NO: 444512 - DNA, 20 bp, mouse
gaagagcaggccgccgacgc

SEQ ID NO: 444513 - DNA, 20 bp, mouse
gtctcgggcccttcccgtca

SEQ ID NO: 444514 - DNA, 20 bp, mouse
gagcggcctcgacgtcgata

SEQ ID NO: 444515 - DNA, 20 bp, mouse
gcccgccgagccggaagagc

SEQ ID NO: 444516 - DNA, 20 bp, mouse
gtctacgacgcccggagcgt

SEQ ID NO: 444517 - DNA, 20 bp, mouse
ggcgctacccgattgtaaca

SEQ ID NO: 444518 - DNA, 20 bp, mouse
ggggtaaccatgttacaatc

SEQ ID NO: 444519 - DNA, 20 bp, mouse
gtccgggcgtcgtagacgct

SEQ ID NO: 444520 - DNA, 20 bp, mouse
ggcccgggctggcagggcaa

SEQ ID NO: 444521 - DNA, 20 bp, mouse
ggagagctgcgaggaagatc

SEQ ID NO: 444522 - DNA, 20 bp, mouse
gcgtcggcgcgagagctgcg

SEQ ID NO: 444523 - DNA, 20 bp, mouse
gacagacgcccgagtctccc

SEQ ID NO: 444524 - DNA, 20 bp, mouse
ggccgtccgagctggagctg

SEQ ID NO: 444525 - DNA, 20 bp, mouse
gacgcgttcagcggccgcag

SEQ ID NO: 444526 - DNA, 20 bp, mouse
gcttcccagcgtcaccggag

SEQ ID NO: 444527 - DNA, 20 bp, mouse
gttggttgaagcactatgga

SEQ ID NO: 444528 - DNA, 20 bp, mouse
gtgcttcaaccaagaggcag

SEQ ID NO: 444529 - DNA, 20 bp, mouse
gttcaaccaagaggcagcgg

SEQ ID NO: 444530 - DNA, 20 bp, mouse
gtgttcgcgcgagggaagtg

SEQ ID NO: 444531 - DNA, 20 bp, mouse
ggagcacttcccagcgtcac

SEQ ID NO: 444532 - DNA, 20 bp, mouse
gcgtcgcagtagtctcggca

SEQ ID NO: 444533 - DNA, 20 bp, mouse
gagacaggagaggtacgagt

SEQ ID NO: 444534 - DNA, 20 bp, mouse
ggaagaacaacaacaagcgg

SEQ ID NO: 444535 - DNA, 20 bp, mouse
gcctcttggttgaagcacta

SEQ ID NO: 444536 - DNA, 20 bp, mouse
gcacccggcgagcgcgacca

SEQ ID NO: 444537 - DNA, 20 bp, mouse
ggagcgcgaccagggcgtgt

SEQ ID NO: 444538 - DNA, 20 bp, mouse
gggaggaagtgtcatggcgt

SEQ ID NO: 444539 - DNA, 20 bp, mouse
gatccgcttccactccgcag

SEQ ID NO: 444540 - DNA, 20 bp, mouse
gccgtggagcttcttctcgc

SEQ ID NO: 444541 - DNA, 20 bp, mouse
gccgagccgccgctgcggag

SEQ ID NO: 444542 - DNA, 20 bp, mouse
ggtgtcatggcgtcgggccg

SEQ ID NO: 444543 - DNA, 20 bp, mouse
gccagggcgtgtgggacgca

SEQ ID NO: 444544 - DNA, 20 bp, mouse
gttctcgctggttctttact

SEQ ID NO: 444545 - DNA, 20 bp, mouse
ggacactaggcccggtcacc

SEQ ID NO: 444546 - DNA, 20 bp, mouse
gcgctgaacaagaacacggt

SEQ ID NO: 444547 - DNA, 20 bp, mouse
gctcctccgccgcaaaccag

SEQ ID NO: 444548 - DNA, 20 bp, mouse
gaccccgccgcggccatggc

SEQ ID NO: 444549 - DNA, 20 bp, mouse
gtgaacaagaacacggtggg

SEQ ID NO: 444550 - DNA, 20 bp, mouse
gtgcgcggcgccacccgcca

SEQ ID NO: 444551 - DNA, 20 bp, mouse
gccgccgcggccatggcggg

SEQ ID NO: 444552 - DNA, 20 bp, mouse
ggggcccgggtcagcagcga

SEQ ID NO: 444553 - DNA, 20 bp, mouse
ggccgcccgcgccccgtgga

SEQ ID NO: 444554 - DNA, 20 bp, mouse
ggctgaggccgtagcagctg

SEQ ID NO: 444555 - DNA, 20 bp, mouse
gacctcagccgtgaggacac

SEQ ID NO: 444556 - DNA, 20 bp, mouse
ggagatgcccgaaggtgagg

SEQ ID NO: 444557 - DNA, 20 bp, mouse
gcgcagactagtccgctgtg

SEQ ID NO: 444558 - DNA, 20 bp, mouse
gctagcggccttcagttcgg

SEQ ID NO: 444559 - DNA, 20 bp, mouse
gcggctagcggccttcagtt

SEQ ID NO: 444560 - DNA, 20 bp, mouse
gggcagccccgggcagagcg

SEQ ID NO: 444561 - DNA, 20 bp, mouse
ggcgagggcggcgaccagcc

SEQ ID NO: 444562 - DNA, 20 bp, mouse
gcggggcagggctccggcct

SEQ ID NO: 444563 - DNA, 20 bp, mouse
gcggagccctgccccgggct

SEQ ID NO: 444564 - DNA, 20 bp, mouse
gctgggagacgcagccactg

SEQ ID NO: 444565 - DNA, 20 bp, mouse
ggcggccttcagttcggagg

SEQ ID NO: 444566 - DNA, 20 bp, mouse
ggcctgagggacccgtaata

SEQ ID NO: 444567 - DNA, 20 bp, mouse
gtctaggctgaggtgagacc

SEQ ID NO: 444568 - DNA, 20 bp, mouse
gtgagggacccgtaatatgg

SEQ ID NO: 444569 - DNA, 20 bp, mouse
gccgtaatatggcggggagg

SEQ ID NO: 444570 - DNA, 20 bp, mouse
ggacccgtaatatggcgggg

SEQ ID NO: 444571 - DNA, 20 bp, mouse
gcggaagtaccggccctgag

SEQ ID NO: 444572 - DNA, 20 bp, mouse
gatcccgcgttgccgcctga

SEQ ID NO: 444573 - DNA, 20 bp, mouse
gcacctcagcctagacccgt

SEQ ID NO: 444574 - DNA, 20 bp, mouse
gaggcggcaacgcgggatcc

SEQ ID NO: 444575 - DNA, 20 bp, mouse
gcagcgcaggatgcttcact

SEQ ID NO: 444576 - DNA, 20 bp, mouse
ggacagctggcgcggtcggg

SEQ ID NO: 444577 - DNA, 20 bp, mouse
gggtgacagctggcgcggtc

SEQ ID NO: 444578 - DNA, 20 bp, mouse
gtggagcgcggacgccgcca

SEQ ID NO: 444579 - DNA, 20 bp, mouse
ggtcttcgggtaagaccctg

SEQ ID NO: 444580 - DNA, 20 bp, mouse
gtggcgcggtcgggcggaag

SEQ ID NO: 444581 - DNA, 20 bp, mouse
gacgccgccacggtgacagc

SEQ ID NO: 444582 - DNA, 20 bp, mouse
gcgaggtcgcccgaggacca

SEQ ID NO: 444583 - DNA, 20 bp, mouse
gcgctggtaaggacccggag

SEQ ID NO: 444584 - DNA, 20 bp, mouse
gcggaagaggcgctgtcttc

SEQ ID NO: 444585 - DNA, 20 bp, mouse
gcagctgcacctgaatcccg

SEQ ID NO: 444586 - DNA, 20 bp, mouse
gtccctacacaattcttgta

SEQ ID NO: 444587 - DNA, 20 bp, mouse
ggccctacaagaattgtgta

SEQ ID NO: 444588 - DNA, 20 bp, mouse
gaaagttccagtcttctcag

SEQ ID NO: 444589 - DNA, 20 bp, mouse
gtgcctttcacagtacctgg

SEQ ID NO: 444590 - DNA, 20 bp, mouse
ggagcactgtagtgcttcat

SEQ ID NO: 444591 - DNA, 20 bp, mouse
ggcactacagtgctcaccag

SEQ ID NO: 444592 - DNA, 20 bp, mouse
gttcaaggtcccaacctagt

SEQ ID NO: 444593 - DNA, 20 bp, mouse
gcaacctagtaggaagttct

SEQ ID NO: 444594 - DNA, 20 bp, mouse
gaagccaagaacttcctact

SEQ ID NO: 444595 - DNA, 20 bp, mouse
gtgccgccaggtactgtgaa

SEQ ID NO: 444596 - DNA, 20 bp, mouse
gacagagcaggtgggagtcg

SEQ ID NO: 444597 - DNA, 20 bp, mouse
gccaagcccacagagcaggt

SEQ ID NO: 444598 - DNA, 20 bp, mouse
gtccccatctctggctacaa

SEQ ID NO: 444599 - DNA, 20 bp, mouse
ggggaccaagcccacagagc

SEQ ID NO: 444600 - DNA, 20 bp, mouse
gctctaacagtagggtgggg

SEQ ID NO: 444601 - DNA, 20 bp, mouse
gaacccttgtagccagagat

SEQ ID NO: 444602 - DNA, 20 bp, mouse
gtgtgctctaacagtagggt

SEQ ID NO: 444603 - DNA, 20 bp, mouse
ggcttgaagtctagggtcca

SEQ ID NO: 444604 - DNA, 20 bp, mouse
gcttcaagcttaggctaaag

SEQ ID NO: 444605 - DNA, 20 bp, mouse
gagcctaagcttgaagtcta

SEQ ID NO: 444606 - DNA, 20 bp, mouse
gtggcaactgtgttgtagga

SEQ ID NO: 444607 - DNA, 20 bp, mouse
gttcttggcaactgtgttgt

SEQ ID NO: 444608 - DNA, 20 bp, mouse
gccagacatgaagtcattct

SEQ ID NO: 444609 - DNA, 20 bp, mouse
gtgcttcagcataaatgtga

SEQ ID NO: 444610 - DNA, 20 bp, mouse
gccagaaaggtaatgtggag

SEQ ID NO: 444611 - DNA, 20 bp, mouse
gcctgtagaagagtttacaa

SEQ ID NO: 444612 - DNA, 20 bp, mouse
gggtgctcatacaacacaag

SEQ ID NO: 444613 - DNA, 20 bp, mouse
ggggttgactatatcatgaa

SEQ ID NO: 444614 - DNA, 20 bp, mouse
ggatgaacaccagggagtac

SEQ ID NO: 444615 - DNA, 20 bp, mouse
gtctcagggcaaacacgaca

SEQ ID NO: 444616 - DNA, 20 bp, mouse
gatgatggcactgctatctc

SEQ ID NO: 444617 - DNA, 20 bp, mouse
ggatagcagtgccatcataa

SEQ ID NO: 444618 - DNA, 20 bp, mouse
gaatcacaactcaccaggta

SEQ ID NO: 444619 - DNA, 20 bp, mouse
gttctcagtaacagatctgg

SEQ ID NO: 444620 - DNA, 20 bp, mouse
gatcataaaggagccatacc

SEQ ID NO: 444621 - DNA, 20 bp, mouse
gcagatctggaggtgcaaac

SEQ ID NO: 444622 - DNA, 20 bp, mouse
gcatttccgcactgccacta

SEQ ID NO: 444623 - DNA, 20 bp, mouse
ggccaggagtgttatatgtt

SEQ ID NO: 444624 - DNA, 20 bp, mouse
gggaaaaatcacaactcacc

SEQ ID NO: 444625 - DNA, 20 bp, mouse
gttggagatgcataaagaca

SEQ ID NO: 444626 - DNA, 20 bp, mouse
ggttactactggactcataa

SEQ ID NO: 444627 - DNA, 20 bp, mouse
gggacttagcaaaattcacc

SEQ ID NO: 444628 - DNA, 20 bp, mouse
ggtgaaacttaagttactac

SEQ ID NO: 444629 - DNA, 20 bp, mouse
gctctctattggaatcaaga

SEQ ID NO: 444630 - DNA, 20 bp, mouse
ggataggctttcagaactct

SEQ ID NO: 444631 - DNA, 20 bp, mouse
gaaaaagaagaaacggtacc

SEQ ID NO: 444632 - DNA, 20 bp, mouse
gttggaatcaagagggctct

SEQ ID NO: 444633 - DNA, 20 bp, mouse
gtgtgcagtaaataacaaaa

SEQ ID NO: 444634 - DNA, 20 bp, mouse
gctatacaccacctctctat

SEQ ID NO: 444635 - DNA, 20 bp, mouse
gcggaagaactgtaacaagt

SEQ ID NO: 444636 - DNA, 20 bp, mouse
gtaggcacaagcacacacgt

SEQ ID NO: 444637 - DNA, 20 bp, mouse
ggtggagacagggacattcg

SEQ ID NO: 444638 - DNA, 20 bp, mouse
gaggatcctagaagcagcaa

SEQ ID NO: 444639 - DNA, 20 bp, mouse
gcctgcagcagcgcagccac

SEQ ID NO: 444640 - DNA, 20 bp, mouse
gtgcttcatagactgtcctc

SEQ ID NO: 444641 - DNA, 20 bp, mouse
ggcagcaaaggtgctttgaa

SEQ ID NO: 444642 - DNA, 20 bp, mouse
ggggacattcgcgggacctg

SEQ ID NO: 444643 - DNA, 20 bp, mouse
gcttttcttacaacctcctt

SEQ ID NO: 444644 - DNA, 20 bp, mouse
gaggcggcctgcctgcagac

SEQ ID NO: 444645 - DNA, 20 bp, mouse
ggcaggtgcctgtggcttcg

SEQ ID NO: 444646 - DNA, 20 bp, mouse
gcagctctcctagccagagg

SEQ ID NO: 444647 - DNA, 20 bp, mouse
ggtacagctctcctagccag

SEQ ID NO: 444648 - DNA, 20 bp, mouse
ggagctaactagtcaagcaa

SEQ ID NO: 444649 - DNA, 20 bp, mouse
gtaccagagtctcttgtagg

SEQ ID NO: 444650 - DNA, 20 bp, mouse
gacggatgtctcacctcctc

SEQ ID NO: 444651 - DNA, 20 bp, mouse
ggagtctcttgtagggggaa

SEQ ID NO: 444652 - DNA, 20 bp, mouse
gacttaccagagtctcttgt

SEQ ID NO: 444653 - DNA, 20 bp, mouse
gcagtttcttgcagagaggg

SEQ ID NO: 444654 - DNA, 20 bp, mouse
gaggatatacacgtgaccca

SEQ ID NO: 444655 - DNA, 20 bp, mouse
gtgctgacagatgtcctctc

SEQ ID NO: 444656 - DNA, 20 bp, mouse
ggaatagtcctcacattctt

SEQ ID NO: 444657 - DNA, 20 bp, mouse
gcctgcctcagtggttatcc

SEQ ID NO: 444658 - DNA, 20 bp, mouse
ggtcctcacattcttaggac

SEQ ID NO: 444659 - DNA, 20 bp, mouse
gaccatagggacctactatg

SEQ ID NO: 444660 - DNA, 20 bp, mouse
gtggtgtgcccacgtcccat

SEQ ID NO: 444661 - DNA, 20 bp, mouse
gagcagtgctcattgagaga

SEQ ID NO: 444662 - DNA, 20 bp, mouse
gaaccacgtaacataaccat

SEQ ID NO: 444663 - DNA, 20 bp, mouse
gacactttcctatgggacgt

SEQ ID NO: 444664 - DNA, 20 bp, mouse
gtctcggacattctcaccta

SEQ ID NO: 444665 - DNA, 20 bp, mouse
gtccacatagtaggtcccta

SEQ ID NO: 444666 - DNA, 20 bp, mouse
gtaaggtatctaccccagga

SEQ ID NO: 444667 - DNA, 20 bp, mouse
ggtggtaaggtatctacccc

SEQ ID NO: 444668 - DNA, 20 bp, mouse
ggcttgttcttcaccctcct

SEQ ID NO: 444669 - DNA, 20 bp, mouse
ggggtctccacacctgtgag

SEQ ID NO: 444670 - DNA, 20 bp, mouse
gaccctggccctggtcacag

SEQ ID NO: 444671 - DNA, 20 bp, mouse
gtttcagcgctgcaaactgg

SEQ ID NO: 444672 - DNA, 20 bp, mouse
gaaacagaacacttgtggta

SEQ ID NO: 444673 - DNA, 20 bp, mouse
gagaatagcaagaacagaca

SEQ ID NO: 444674 - DNA, 20 bp, mouse
gcctgggtgcttagagactt

SEQ ID NO: 444675 - DNA, 20 bp, mouse
gaatgttccaacccacaaac

SEQ ID NO: 444676 - DNA, 20 bp, mouse
gctctccagctagccctctc

SEQ ID NO: 444677 - DNA, 20 bp, mouse
gggggctgtagaaatcacac

SEQ ID NO: 444678 - DNA, 20 bp, mouse
gtacagcccccagagcacca

SEQ ID NO: 444679 - DNA, 20 bp, mouse
gcctgccagagagggctagc

SEQ ID NO: 444680 - DNA, 20 bp, mouse
gcccagagcaccatggaccc

SEQ ID NO: 444681 - DNA, 20 bp, mouse
gtggatgccaagacagacac

SEQ ID NO: 444682 - DNA, 20 bp, mouse
gggcagttggtgtgaactgg

SEQ ID NO: 444683 - DNA, 20 bp, mouse
gcagggcagttggtgtgaac

SEQ ID NO: 444684 - DNA, 20 bp, mouse
gcacttcctccctgccagag

SEQ ID NO: 444685 - DNA, 20 bp, mouse
ggcatcaaggtcagtctacc

SEQ ID NO: 444686 - DNA, 20 bp, mouse
gagcacagcaagcagacatg

SEQ ID NO: 444687 - DNA, 20 bp, mouse
gcagacatgtggcagaggag

SEQ ID NO: 444688 - DNA, 20 bp, mouse
ggcaagcagacatgtggcag

SEQ ID NO: 444689 - DNA, 20 bp, mouse
gctctgaaacctcagaagaa

SEQ ID NO: 444690 - DNA, 20 bp, mouse
gcctctgagccctaacccca

SEQ ID NO: 444691 - DNA, 20 bp, mouse
gtgagcgagcctttcttctg

SEQ ID NO: 444692 - DNA, 20 bp, mouse
gtagggctcagaggcagtgc

SEQ ID NO: 444693 - DNA, 20 bp, mouse
gaaaggctcgctcagataat

SEQ ID NO: 444694 - DNA, 20 bp, mouse
gaagggctgaaagctctcac

SEQ ID NO: 444695 - DNA, 20 bp, mouse
gttggtaagaatcatccttg

SEQ ID NO: 444696 - DNA, 20 bp, mouse
gtgcagagtctgggtctgta

SEQ ID NO: 444697 - DNA, 20 bp, mouse
ggggatgagaaggcttctgt

SEQ ID NO: 444698 - DNA, 20 bp, mouse
ggactctgcacttcccctcc

SEQ ID NO: 444699 - DNA, 20 bp, mouse
ggaaggatctactcaccagg

SEQ ID NO: 444700 - DNA, 20 bp, mouse
ggaggaccactgcagctgcc

SEQ ID NO: 444701 - DNA, 20 bp, mouse
gccctctcggaacacagtga

SEQ ID NO: 444702 - DNA, 20 bp, mouse
gagggaaggatctactcacc

SEQ ID NO: 444703 - DNA, 20 bp, mouse
gatggctcaggcttcttgta

SEQ ID NO: 444704 - DNA, 20 bp, mouse
gttgctagaaagttccagta

SEQ ID NO: 444705 - DNA, 20 bp, mouse
gcaagaagcctgagccatac

SEQ ID NO: 444706 - DNA, 20 bp, mouse
gggtgcggtgccgtctacag

SEQ ID NO: 444707 - DNA, 20 bp, mouse
gggctccagcaggtgcaggg

SEQ ID NO: 444708 - DNA, 20 bp, mouse
ggggaacctgctgtcccggg

SEQ ID NO: 444709 - DNA, 20 bp, mouse
ggcggggaacctgctgtccc

SEQ ID NO: 444710 - DNA, 20 bp, mouse
gcggtcccgagtccgaactg

SEQ ID NO: 444711 - DNA, 20 bp, mouse
gacctgctggagccacagtt

SEQ ID NO: 444712 - DNA, 20 bp, mouse
ggacagaacgccaccccgag

SEQ ID NO: 444713 - DNA, 20 bp, mouse
ggtctacagaggtgtgaaag

SEQ ID NO: 444714 - DNA, 20 bp, mouse
gcagagaccaggccctgacg

SEQ ID NO: 444715 - DNA, 20 bp, mouse
gcgagctcgggacatggaga

SEQ ID NO: 444716 - DNA, 20 bp, mouse
gtggaggacagctggctaag

SEQ ID NO: 444717 - DNA, 20 bp, mouse
ggacccggagaagccagaga

SEQ ID NO: 444718 - DNA, 20 bp, mouse
gcttatccgaggcagcctgg

SEQ ID NO: 444719 - DNA, 20 bp, mouse
gtatcactggaagcaggcgt

SEQ ID NO: 444720 - DNA, 20 bp, mouse
gaggcagcctggaggacagc

SEQ ID NO: 444721 - DNA, 20 bp, mouse
gaaacttgggataccgggag

SEQ ID NO: 444722 - DNA, 20 bp, mouse
ggggttagtgtccttatccg

SEQ ID NO: 444723 - DNA, 20 bp, mouse
gaagtcaaacttgggatacc

SEQ ID NO: 444724 - DNA, 20 bp, mouse
gccctggatggtagatcatg

SEQ ID NO: 444725 - DNA, 20 bp, mouse
ggtgaaagctgtgtctggac

SEQ ID NO: 444726 - DNA, 20 bp, mouse
gcagcagcggcggctcactg

SEQ ID NO: 444727 - DNA, 20 bp, mouse
gtcgtccctcggcgccgacc

SEQ ID NO: 444728 - DNA, 20 bp, mouse
gaccagggcgcagtcagacc

SEQ ID NO: 444729 - DNA, 20 bp, mouse
gggatccgcgcgcacgacca

SEQ ID NO: 444730 - DNA, 20 bp, mouse
gcgaccgggcgagctgtgcc

SEQ ID NO: 444731 - DNA, 20 bp, mouse
gctcgcccggtcggcgccga

SEQ ID NO: 444732 - DNA, 20 bp, mouse
gcggcggctcactgaggcga

SEQ ID NO: 444733 - DNA, 20 bp, mouse
ggcgggagcgcggaatgaat

SEQ ID NO: 444734 - DNA, 20 bp, mouse
gcatgtatcagagcccgcgg

SEQ ID NO: 444735 - DNA, 20 bp, mouse
ggctagcgccggggagcaac

SEQ ID NO: 444736 - DNA, 20 bp, mouse
gaggccgcaccgaaccggta

SEQ ID NO: 444737 - DNA, 20 bp, mouse
gtgcctaggccgcaccgaac

SEQ ID NO: 444738 - DNA, 20 bp, mouse
gtctctggaccctaccggtt

SEQ ID NO: 444739 - DNA, 20 bp, mouse
gggaccctaccggttcggtg

SEQ ID NO: 444740 - DNA, 20 bp, mouse
gggacggagatgcccctcac

SEQ ID NO: 444741 - DNA, 20 bp, mouse
gaggatggcttcgaagtcgg

SEQ ID NO: 444742 - DNA, 20 bp, mouse
gccacaaagtagagttgtgt

SEQ ID NO: 444743 - DNA, 20 bp, mouse
ggttggtctctggaccctac

SEQ ID NO: 444744 - DNA, 20 bp, mouse
gtgtaagggaagcaaggcca

SEQ ID NO: 444745 - DNA, 20 bp, mouse
gctctactttgtgggatggg

SEQ ID NO: 444746 - DNA, 20 bp, mouse
gagtccgtcgcacccgtagg

SEQ ID NO: 444747 - DNA, 20 bp, mouse
ggcgcggagcaggcagtcgg

SEQ ID NO: 444748 - DNA, 20 bp, mouse
gacgggtgcgacggactcag

SEQ ID NO: 444749 - DNA, 20 bp, mouse
gtgctccgcgctgccgccta

SEQ ID NO: 444750 - DNA, 20 bp, mouse
gctgccgcctacgggtgcga

SEQ ID NO: 444751 - DNA, 20 bp, mouse
ggcacccgtaggcggcagcg

SEQ ID NO: 444752 - DNA, 20 bp, mouse
ggtgaagccgagctgtccga

SEQ ID NO: 444753 - DNA, 20 bp, mouse
gcacccagtccggcccccag

SEQ ID NO: 444754 - DNA, 20 bp, mouse
gtgcgacggactcagaggcg

SEQ ID NO: 444755 - DNA, 20 bp, mouse
gcccgcgcggagggcgccga

SEQ ID NO: 444756 - DNA, 20 bp, mouse
gcgctcccggcggcaggagg

SEQ ID NO: 444757 - DNA, 20 bp, mouse
ggacagcggccgagccggag

SEQ ID NO: 444758 - DNA, 20 bp, mouse
ggcacaccgccgcccacccg

SEQ ID NO: 444759 - DNA, 20 bp, mouse
gttctgagcgaggatgggag

SEQ ID NO: 444760 - DNA, 20 bp, mouse
gactgactgcgaagctctgg

SEQ ID NO: 444761 - DNA, 20 bp, mouse
gcgagccggggagagtcacc

SEQ ID NO: 444762 - DNA, 20 bp, mouse
gcagctccaaggtagcgacg

SEQ ID NO: 444763 - DNA, 20 bp, mouse
gcccgacgcggcgtccactc

SEQ ID NO: 444764 - DNA, 20 bp, mouse
gctgcgggctggtcccgacg

SEQ ID NO: 444765 - DNA, 20 bp, mouse
gaggtagcgacgcggtgcag

SEQ ID NO: 444766 - DNA, 20 bp, mouse
ggcgctcccgcaggccgagg

SEQ ID NO: 444767 - DNA, 20 bp, mouse
ggcgcggcgtcggtgaagtc

SEQ ID NO: 444768 - DNA, 20 bp, mouse
ggcaggcggctggacagacc

SEQ ID NO: 444769 - DNA, 20 bp, mouse
gccgcccgaggatgggagag

SEQ ID NO: 444770 - DNA, 20 bp, mouse
gtggacagaccgggatgtga

SEQ ID NO: 444771 - DNA, 20 bp, mouse
gcaggccgaggaggcgatgc

SEQ ID NO: 444772 - DNA, 20 bp, mouse
ggtagtgcgagggccctgga

SEQ ID NO: 444773 - DNA, 20 bp, mouse
ggacctgcccgcccgaggat

SEQ ID NO: 444774 - DNA, 20 bp, mouse
gaggcagttccgtcacatcc

SEQ ID NO: 444775 - DNA, 20 bp, mouse
ggcagccagcatcgcctcct

SEQ ID NO: 444776 - DNA, 20 bp, mouse
gtcccggcgcggattgtgag

SEQ ID NO: 444777 - DNA, 20 bp, mouse
gtccgacggattccgcgtag

SEQ ID NO: 444778 - DNA, 20 bp, mouse
gaggctcaccatggttccga

SEQ ID NO: 444779 - DNA, 20 bp, mouse
ggcggaatccgtcggaacca

SEQ ID NO: 444780 - DNA, 20 bp, mouse
gtcctctacgcggaatccgt

SEQ ID NO: 444781 - DNA, 20 bp, mouse
ggcccggcccgagccatgtg

SEQ ID NO: 444782 - DNA, 20 bp, mouse
gcaatccgcgccgggaagcc

SEQ ID NO: 444783 - DNA, 20 bp, mouse
ggcccgagccatgtgcggag

SEQ ID NO: 444784 - DNA, 20 bp, mouse
ggcggggcggcaggacacag

SEQ ID NO: 444785 - DNA, 20 bp, mouse
gagccccgccccgaagaggg

SEQ ID NO: 444786 - DNA, 20 bp, mouse
gactggacggtggcccatca

SEQ ID NO: 444787 - DNA, 20 bp, mouse
ggggaatcggcagaaccttc

SEQ ID NO: 444788 - DNA, 20 bp, mouse
gcaaaagaaggcgacaggag

SEQ ID NO: 444789 - DNA, 20 bp, mouse
gagaccactggaaggcacga

SEQ ID NO: 444790 - DNA, 20 bp, mouse
ggagcacgagcactggacgg

SEQ ID NO: 444791 - DNA, 20 bp, mouse
gtccaaggcgaaaagaccac

SEQ ID NO: 444792 - DNA, 20 bp, mouse
gaggcacgagggccgagtca

SEQ ID NO: 444793 - DNA, 20 bp, mouse
gagactagcgactccgagag

SEQ ID NO: 444794 - DNA, 20 bp, mouse
gtcggtccatccctccgtag

SEQ ID NO: 444795 - DNA, 20 bp, mouse
gacgagggccgagtcatggc

SEQ ID NO: 444796 - DNA, 20 bp, mouse
gttcgtggaggaggcggtca

SEQ ID NO: 444797 - DNA, 20 bp, mouse
gctttctggaaggttcgtgg

SEQ ID NO: 444798 - DNA, 20 bp, mouse
gccggcttgctgtggagtaa

SEQ ID NO: 444799 - DNA, 20 bp, mouse
gtcaggaggacggatggaca

SEQ ID NO: 444800 - DNA, 20 bp, mouse
gggcgaccgggtgatacctt

SEQ ID NO: 444801 - DNA, 20 bp, mouse
gggaaggttcgtggaggagg

SEQ ID NO: 444802 - DNA, 20 bp, mouse
gagctcggcgtcccacaatg

SEQ ID NO: 444803 - DNA, 20 bp, mouse
ggcgtctgcgcgggttcagg

SEQ ID NO: 444804 - DNA, 20 bp, mouse
gcggcttccgccttctctcc

SEQ ID NO: 444805 - DNA, 20 bp, mouse
ggcgggttcaggaggacgga

SEQ ID NO: 444806 - DNA, 20 bp, mouse
gtcgaaggcgagggtcccca

SEQ ID NO: 444807 - DNA, 20 bp, mouse
gtaaccagcggggaccactc

SEQ ID NO: 444808 - DNA, 20 bp, mouse
gctctcgcgagagggaggtg

SEQ ID NO: 444809 - DNA, 20 bp, mouse
ggtccccacggacgccatgg

SEQ ID NO: 444810 - DNA, 20 bp, mouse
gggtccccgctggttactgg

SEQ ID NO: 444811 - DNA, 20 bp, mouse
ggcgctcctccagtaaccag

SEQ ID NO: 444812 - DNA, 20 bp, mouse
gagggtccccacggacgcca

SEQ ID NO: 444813 - DNA, 20 bp, mouse
gcgttctagttcgtccacca

SEQ ID NO: 444814 - DNA, 20 bp, mouse
gcgtccaccatggcgtccgt

SEQ ID NO: 444815 - DNA, 20 bp, mouse
gcgcgaagccgcgggatgaa

SEQ ID NO: 444816 - DNA, 20 bp, mouse
gggagctaggccagccatgg

SEQ ID NO: 444817 - DNA, 20 bp, mouse
gcccggagctaggccagcca

SEQ ID NO: 444818 - DNA, 20 bp, mouse
ggctaggccagccatggcgg

SEQ ID NO: 444819 - DNA, 20 bp, mouse
gtgggatgcagcccagacat

SEQ ID NO: 444820 - DNA, 20 bp, mouse
ggtaaagaccctaaatccga

SEQ ID NO: 444821 - DNA, 20 bp, mouse
gcgctagcgcgaaggcctgg

SEQ ID NO: 444822 - DNA, 20 bp, mouse
gagggtctttaccgccgcca

SEQ ID NO: 444823 - DNA, 20 bp, mouse
gctaaatccgaaggccgagg

SEQ ID NO: 444824 - DNA, 20 bp, mouse
gaccctaaatccgaaggccg

SEQ ID NO: 444825 - DNA, 20 bp, mouse
ggagaacaacgtgctctctg

SEQ ID NO: 444826 - DNA, 20 bp, mouse
gggcccacactcaggagtgt

SEQ ID NO: 444827 - DNA, 20 bp, mouse
gtggcgccagggttcggagt

SEQ ID NO: 444828 - DNA, 20 bp, mouse
ggggctggactgttgaacca

SEQ ID NO: 444829 - DNA, 20 bp, mouse
gacttgccgactccgaaccc

SEQ ID NO: 444830 - DNA, 20 bp, mouse
ggacaccccgcacactctag

SEQ ID NO: 444831 - DNA, 20 bp, mouse
gcgccgattggcccacactc

SEQ ID NO: 444832 - DNA, 20 bp, mouse
gacactcaggagtgtgggcg

SEQ ID NO: 444833 - DNA, 20 bp, mouse
gagcgcgcccttaggaccca

SEQ ID NO: 444834 - DNA, 20 bp, mouse
gctcctgagtgtgggccaat

SEQ ID NO: 444835 - DNA, 20 bp, mouse
gttcggagtcggcaagtttg

SEQ ID NO: 444836 - DNA, 20 bp, mouse
ggagacactcaccatcatct

SEQ ID NO: 444837 - DNA, 20 bp, mouse
ggaagccgcttccaagatga

SEQ ID NO: 444838 - DNA, 20 bp, mouse
gagggccgcagggtcgtgga

SEQ ID NO: 444839 - DNA, 20 bp, mouse
gtgttggcgagagccgaatg

SEQ ID NO: 444840 - DNA, 20 bp, mouse
gcgagcttctaggcgcacag

SEQ ID NO: 444841 - DNA, 20 bp, mouse
gggagcattgtgggcttggg

SEQ ID NO: 444842 - DNA, 20 bp, mouse
gcggcatcgcgagccccatt

SEQ ID NO: 444843 - DNA, 20 bp, mouse
gctgggaggtgcggaagtga

SEQ ID NO: 444844 - DNA, 20 bp, mouse
ggtggatggcagcggatgcg

SEQ ID NO: 444845 - DNA, 20 bp, mouse
gcgagacgttagcccgggag

SEQ ID NO: 444846 - DNA, 20 bp, mouse
ggcgcgtgagcggtggactg

SEQ ID NO: 444847 - DNA, 20 bp, mouse
ggagacgccgaggaagcaag

SEQ ID NO: 444848 - DNA, 20 bp, mouse
ggtggactgcggccgagcca

SEQ ID NO: 444849 - DNA, 20 bp, mouse
ggacgtgaagcgccatggct

SEQ ID NO: 444850 - DNA, 20 bp, mouse
ggtggcgtggagggactgta

SEQ ID NO: 444851 - DNA, 20 bp, mouse
gggctccatgccgcagacag

SEQ ID NO: 444852 - DNA, 20 bp, mouse
gggccgcgccgcgatcggga

SEQ ID NO: 444853 - DNA, 20 bp, mouse
gccggctcgctggaactggt

SEQ ID NO: 444854 - DNA, 20 bp, mouse
gcgctcgctccgagacgccg

SEQ ID NO: 444855 - DNA, 20 bp, mouse
gttggggacgtgaagcgcca

SEQ ID NO: 444856 - DNA, 20 bp, mouse
gcctgtgggtcaagtcccag

SEQ ID NO: 444857 - DNA, 20 bp, mouse
gctgaacaagcgaggcccct

SEQ ID NO: 444858 - DNA, 20 bp, mouse
ggcagaagccaaccggaagt

SEQ ID NO: 444859 - DNA, 20 bp, mouse
gatccttgggcgcaaagtgg

SEQ ID NO: 444860 - DNA, 20 bp, mouse
gcagccgctggggaagttct

SEQ ID NO: 444861 - DNA, 20 bp, mouse
ggcttgttcagactcagttt

SEQ ID NO: 444862 - DNA, 20 bp, mouse
gtggtttgtgtggcccggga

SEQ ID NO: 444863 - DNA, 20 bp, mouse
gttcatccttgggcgcaaag

SEQ ID NO: 444864 - DNA, 20 bp, mouse
gagacctagaacttccccag

SEQ ID NO: 444865 - DNA, 20 bp, mouse
gtcagttttggagatgggtc

SEQ ID NO: 444866 - DNA, 20 bp, mouse
gggaagtgcggtgttcccta

SEQ ID NO: 444867 - DNA, 20 bp, mouse
gggctagcgaggcggaagtg

SEQ ID NO: 444868 - DNA, 20 bp, mouse
gtaaggctgctgcctcggag

SEQ ID NO: 444869 - DNA, 20 bp, mouse
ggggccgccggctagcgagg

SEQ ID NO: 444870 - DNA, 20 bp, mouse
ggctgctgcctcggagcggg

SEQ ID NO: 444871 - DNA, 20 bp, mouse
gggacgggctgcggcatcag

SEQ ID NO: 444872 - DNA, 20 bp, mouse
ggcccggcccccgtttcggg

SEQ ID NO: 444873 - DNA, 20 bp, mouse
gagggagaggtaagccgaag

SEQ ID NO: 444874 - DNA, 20 bp, mouse
gaggggagcctcccgaaacg

SEQ ID NO: 444875 - DNA, 20 bp, mouse
gggacctccgttgccaggac

SEQ ID NO: 444876 - DNA, 20 bp, mouse
gggatgcatgccatctggac

SEQ ID NO: 444877 - DNA, 20 bp, mouse
gaaagctgtgccggtccaga

SEQ ID NO: 444878 - DNA, 20 bp, mouse
gacacacgaagaggcctcaa

SEQ ID NO: 444879 - DNA, 20 bp, mouse
gacacaggatgcatgccatc

SEQ ID NO: 444880 - DNA, 20 bp, mouse
gctgcccgaaaaagctgtgc

SEQ ID NO: 444881 - DNA, 20 bp, mouse
gccagtcacaaggatgcata

SEQ ID NO: 444882 - DNA, 20 bp, mouse
gtcatcaataagtaaaagat

SEQ ID NO: 444883 - DNA, 20 bp, mouse
gtccattgcccccagtcaca

SEQ ID NO: 444884 - DNA, 20 bp, mouse
gtcaagggttgcctgatgtt

SEQ ID NO: 444885 - DNA, 20 bp, mouse
gtacctaagtcacatccaca

SEQ ID NO: 444886 - DNA, 20 bp, mouse
gggcgggctgcagaccccac

SEQ ID NO: 444887 - DNA, 20 bp, mouse
gtggccaaccacaccccgca

SEQ ID NO: 444888 - DNA, 20 bp, mouse
gcctgtcccgcttcacacca

SEQ ID NO: 444889 - DNA, 20 bp, mouse
gagcccgcgctcctaccctg

SEQ ID NO: 444890 - DNA, 20 bp, mouse
ggcgctggccgccccagggt

SEQ ID NO: 444891 - DNA, 20 bp, mouse
gtgactgaggtgaccggagt

SEQ ID NO: 444892 - DNA, 20 bp, mouse
gcatctcggcgtctgcccgt

SEQ ID NO: 444893 - DNA, 20 bp, mouse
gcgcagggcgcgcacttggc

SEQ ID NO: 444894 - DNA, 20 bp, mouse
gcatgtgggacccgccaggg

SEQ ID NO: 444895 - DNA, 20 bp, mouse
ggtgcgcgccctgcggggtg

SEQ ID NO: 444896 - DNA, 20 bp, mouse
gcccagataggctccgagaa

SEQ ID NO: 444897 - DNA, 20 bp, mouse
ggctcctgaggagaaagtag

SEQ ID NO: 444898 - DNA, 20 bp, mouse
gtctggcttccaggttccac

SEQ ID NO: 444899 - DNA, 20 bp, mouse
gcagtttctttcctttacag

SEQ ID NO: 444900 - DNA, 20 bp, mouse
gaattggtcgaacaagcccg

SEQ ID NO: 444901 - DNA, 20 bp, mouse
gttacagcggtggtgttctc

SEQ ID NO: 444902 - DNA, 20 bp, mouse
gcgaacaagcccgtggaacc

SEQ ID NO: 444903 - DNA, 20 bp, mouse
gggacacggaagcagatctg

SEQ ID NO: 444904 - DNA, 20 bp, mouse
gaagtttgagcagcccagat

SEQ ID NO: 444905 - DNA, 20 bp, mouse
ggagccctgcgagctagacg

SEQ ID NO: 444906 - DNA, 20 bp, mouse
gcacggtaggagcgatcact

SEQ ID NO: 444907 - DNA, 20 bp, mouse
gaccctccggctatgcttca

SEQ ID NO: 444908 - DNA, 20 bp, mouse
ggctcctaccgtggctgccg

SEQ ID NO: 444909 - DNA, 20 bp, mouse
gcgctttgaaataccagccc

SEQ ID NO: 444910 - DNA, 20 bp, mouse
gggcagttagaaggccggag

SEQ ID NO: 444911 - DNA, 20 bp, mouse
gctccgtgaagcatagccgg

SEQ ID NO: 444912 - DNA, 20 bp, mouse
gagcatagccggagggtgtg

SEQ ID NO: 444913 - DNA, 20 bp, mouse
gcggcgtcgatcttccggaa

SEQ ID NO: 444914 - DNA, 20 bp, mouse
gggcggacctgcggtctcag

SEQ ID NO: 444915 - DNA, 20 bp, mouse
gggcctcagggacgcccagg

SEQ ID NO: 444916 - DNA, 20 bp, mouse
gagagctcaggccaccctaa

SEQ ID NO: 444917 - DNA, 20 bp, mouse
gctgactctactaccagcca

SEQ ID NO: 444918 - DNA, 20 bp, mouse
gtcatacccgttcccagata

SEQ ID NO: 444919 - DNA, 20 bp, mouse
gttgtacaggctccacctac

SEQ ID NO: 444920 - DNA, 20 bp, mouse
gcctcacaaactgtccctta

SEQ ID NO: 444921 - DNA, 20 bp, mouse
ggagacaataagatgccggt

SEQ ID NO: 444922 - DNA, 20 bp, mouse
gaagcaccaggcctccaagt

SEQ ID NO: 444923 - DNA, 20 bp, mouse
gtgggcctagaggaacgggg

SEQ ID NO: 444924 - DNA, 20 bp, mouse
gggagtgagtcagcagatgt

SEQ ID NO: 444925 - DNA, 20 bp, mouse
gtcactcctgctggcaacag

SEQ ID NO: 444926 - DNA, 20 bp, mouse
gagaggcctgctgggaacct

SEQ ID NO: 444927 - DNA, 20 bp, mouse
gagagcaaaaggccccgtgt

SEQ ID NO: 444928 - DNA, 20 bp, mouse
gagcccccagcttgagagca

SEQ ID NO: 444929 - DNA, 20 bp, mouse
gcttctcaaaggcaaaacta

SEQ ID NO: 444930 - DNA, 20 bp, mouse
gtgaggtaaagaggcctgct

SEQ ID NO: 444931 - DNA, 20 bp, mouse
gcttccttgctctcaagctg

SEQ ID NO: 444932 - DNA, 20 bp, mouse
ggggggagatctagaagggg

SEQ ID NO: 444933 - DNA, 20 bp, mouse
ggtatgctcatccttctcat

SEQ ID NO: 444934 - DNA, 20 bp, mouse
gactactcatgtcagatggt

SEQ ID NO: 444935 - DNA, 20 bp, mouse
gctcacgctgagtgtgttct

SEQ ID NO: 444936 - DNA, 20 bp, mouse
gaatagtatcaggagacaca

SEQ ID NO: 444937 - DNA, 20 bp, mouse
gagaaagtggatgaccacgg

SEQ ID NO: 444938 - DNA, 20 bp, mouse
gacgtctatgaaatagtatc

SEQ ID NO: 444939 - DNA, 20 bp, mouse
gcatcaagctttggaatggg

SEQ ID NO: 444940 - DNA, 20 bp, mouse
gggaatagcaaggggcatct

SEQ ID NO: 444941 - DNA, 20 bp, mouse
gggagagcgaggaatagcaa

SEQ ID NO: 444942 - DNA, 20 bp, mouse
gtgattggcataggagagcg

SEQ ID NO: 444943 - DNA, 20 bp, mouse
ggacagtgaatggatgtgat

SEQ ID NO: 444944 - DNA, 20 bp, mouse
gaaatcatcaagctttggaa

SEQ ID NO: 444945 - DNA, 20 bp, mouse
ggagatgttctgacagtgaa

SEQ ID NO: 444946 - DNA, 20 bp, mouse
gcttcagtggttatcagtat

SEQ ID NO: 444947 - DNA, 20 bp, mouse
gtacagtaagagcctctcca

SEQ ID NO: 444948 - DNA, 20 bp, mouse
gcagtggttatcagtatggg

SEQ ID NO: 444949 - DNA, 20 bp, mouse
ggcctcagctgcagcgataa

SEQ ID NO: 444950 - DNA, 20 bp, mouse
gaccaccagacatgaacaag

SEQ ID NO: 444951 - DNA, 20 bp, mouse
gcctgtctggtggcagggtc

SEQ ID NO: 444952 - DNA, 20 bp, mouse
gagctctacgtctccgtctg

SEQ ID NO: 444953 - DNA, 20 bp, mouse
gctgctgatgtgccgtggag

SEQ ID NO: 444954 - DNA, 20 bp, mouse
ggccaggctgtgacatacaa

SEQ ID NO: 444955 - DNA, 20 bp, mouse
ggggtctcttctcactctcg

SEQ ID NO: 444956 - DNA, 20 bp, mouse
gagcacggcgaggcaggtgg

SEQ ID NO: 444957 - DNA, 20 bp, mouse
gggcggcccagagcagtcgg

SEQ ID NO: 444958 - DNA, 20 bp, mouse
gcgagacgcagagcacggcg

SEQ ID NO: 444959 - DNA, 20 bp, mouse
gtgggctgaagacacaatgt

SEQ ID NO: 444960 - DNA, 20 bp, mouse
gggtggcggcccagagcagt

SEQ ID NO: 444961 - DNA, 20 bp, mouse
ggcggccgagacgcagagca

SEQ ID NO: 444962 - DNA, 20 bp, mouse
gcagagcacggcgaggcagg

SEQ ID NO: 444963 - DNA, 20 bp, mouse
ggcccagagcagtcggcggg

SEQ ID NO: 444964 - DNA, 20 bp, mouse
ggcagggacgcagtgctaga

SEQ ID NO: 444965 - DNA, 20 bp, mouse
ggcccacctggtagcacggt

SEQ ID NO: 444966 - DNA, 20 bp, mouse
ggggcgagtgtagtcaagaa

SEQ ID NO: 444967 - DNA, 20 bp, mouse
gggtcggcggacagctggtg

SEQ ID NO: 444968 - DNA, 20 bp, mouse
ggcgcgggggccgggactgg

SEQ ID NO: 444969 - DNA, 20 bp, mouse
ggtccgccgacccccagtcc

SEQ ID NO: 444970 - DNA, 20 bp, mouse
gaggatctgaccaggggccc

SEQ ID NO: 444971 - DNA, 20 bp, mouse
gcgacctctgcaggactcca

SEQ ID NO: 444972 - DNA, 20 bp, mouse
gcagagccaaacctgggcag

SEQ ID NO: 444973 - DNA, 20 bp, mouse
ggcacagtaggcttgtgaga

SEQ ID NO: 444974 - DNA, 20 bp, mouse
gcgggtgcggccatgagcgc

SEQ ID NO: 444975 - DNA, 20 bp, mouse
ggagctccagacctgtgcgg

SEQ ID NO: 444976 - DNA, 20 bp, mouse
gaaggccgtgacccccagaa

SEQ ID NO: 444977 - DNA, 20 bp, mouse
gaattcatgataccagtctg

SEQ ID NO: 444978 - DNA, 20 bp, mouse
gaccagtgctgacccttctg

SEQ ID NO: 444979 - DNA, 20 bp, mouse
ggaaatttccagccacagac

SEQ ID NO: 444980 - DNA, 20 bp, mouse
gagggtcctggagcgaggtt

SEQ ID NO: 444981 - DNA, 20 bp, mouse
ggagctgggacacctgggat

SEQ ID NO: 444982 - DNA, 20 bp, mouse
gaggttgggcaccctgatgt

SEQ ID NO: 444983 - DNA, 20 bp, mouse
gtcttacgcacagggtagca

SEQ ID NO: 444984 - DNA, 20 bp, mouse
gaagcagcgcacaggctgtg

SEQ ID NO: 444985 - DNA, 20 bp, mouse
gagagctgcccctcaggtgg

SEQ ID NO: 444986 - DNA, 20 bp, mouse
gaggcaatgaagtgctcaga

SEQ ID NO: 444987 - DNA, 20 bp, mouse
gtctaatagccctggcaatt

SEQ ID NO: 444988 - DNA, 20 bp, mouse
gtgagcagctcccagcattt

SEQ ID NO: 444989 - DNA, 20 bp, mouse
gcaacgggagatatcatcag

SEQ ID NO: 444990 - DNA, 20 bp, mouse
gatagccctggcaatttggc

SEQ ID NO: 444991 - DNA, 20 bp, mouse
gtcggcaactggccaagaag

SEQ ID NO: 444992 - DNA, 20 bp, mouse
gatcttagaaccgaaatgct

SEQ ID NO: 444993 - DNA, 20 bp, mouse
gtgggtagagacaaatagtt

SEQ ID NO: 444994 - DNA, 20 bp, mouse
gattgcctgccaaattgcca

SEQ ID NO: 444995 - DNA, 20 bp, mouse
gaatcacactctaatagccc

SEQ ID NO: 444996 - DNA, 20 bp, mouse
ggcagaagccgggtgcccca

SEQ ID NO: 444997 - DNA, 20 bp, mouse
gtactaaggtaagaaagagg

SEQ ID NO: 444998 - DNA, 20 bp, mouse
gtcctactaaggtaagaaag

SEQ ID NO: 444999 - DNA, 20 bp, mouse
gcatggtagccaggctccct

SEQ ID NO: 445000 - DNA, 20 bp, mouse
gtggggcctgcctcctacta

SEQ ID NO: 445001 - DNA, 20 bp, mouse
gccaccagtaaggacttctg

SEQ ID NO: 445002 - DNA, 20 bp, mouse
ggagctagggttgaaagtct

SEQ ID NO: 445003 - DNA, 20 bp, mouse
ggtgaggagtccgggaggca

SEQ ID NO: 445004 - DNA, 20 bp, mouse
gcttctgcgtggctgcgcag

SEQ ID NO: 445005 - DNA, 20 bp, mouse
ggaaaatggaggctccaaga

SEQ ID NO: 445006 - DNA, 20 bp, mouse
gccacagcaacagccatggt

SEQ ID NO: 445007 - DNA, 20 bp, mouse
ggcgcagaagtcggagccga

SEQ ID NO: 445008 - DNA, 20 bp, mouse
gcgctatgcggtacctacca

SEQ ID NO: 445009 - DNA, 20 bp, mouse
gtcccggcttgcaacaacag

SEQ ID NO: 445010 - DNA, 20 bp, mouse
gctttactctgctcccggac

SEQ ID NO: 445011 - DNA, 20 bp, mouse
ggtgcagagccagcaaaacc

SEQ ID NO: 445012 - DNA, 20 bp, mouse
ggaggagcaatgtatggctg

SEQ ID NO: 445013 - DNA, 20 bp, mouse
gtgcaaaggaagacatctgc

SEQ ID NO: 445014 - DNA, 20 bp, mouse
gcacacaatctagagaaggg

SEQ ID NO: 445015 - DNA, 20 bp, mouse
gaggaaagaacttagcgagt

SEQ ID NO: 445016 - DNA, 20 bp, mouse
gccacagcaacaggcacggt

SEQ ID NO: 445017 - DNA, 20 bp, mouse
gagtgcagaagtcggaaccc

SEQ ID NO: 445018 - DNA, 20 bp, mouse
gtaggaatgcccacagcaac

SEQ ID NO: 445019 - DNA, 20 bp, mouse
gtggtacacaaaggctctgg

SEQ ID NO: 445020 - DNA, 20 bp, mouse
gtccctgcttgcagcaacag

SEQ ID NO: 445021 - DNA, 20 bp, mouse
gcacagaaccgactagagag

SEQ ID NO: 445022 - DNA, 20 bp, mouse
gtgtcctgagctggatccac

SEQ ID NO: 445023 - DNA, 20 bp, mouse
gcaacctgtggatccagctc

SEQ ID NO: 445024 - DNA, 20 bp, mouse
gctttactctgctcccagcc

SEQ ID NO: 445025 - DNA, 20 bp, mouse
ggaccagcttatgttagcaa

SEQ ID NO: 445026 - DNA, 20 bp, mouse
gagaactcagagtcacccct

SEQ ID NO: 445027 - DNA, 20 bp, mouse
gagatgaaatgtaaattcct

SEQ ID NO: 445028 - DNA, 20 bp, mouse
gtcttccggagaccttggag

SEQ ID NO: 445029 - DNA, 20 bp, mouse
gtgaggtctcgggactacgg

SEQ ID NO: 445030 - DNA, 20 bp, mouse
ggcctctaatgtccactcca

SEQ ID NO: 445031 - DNA, 20 bp, mouse
gcgatgatgagaaacgacag

SEQ ID NO: 445032 - DNA, 20 bp, mouse
gtgaggtgcgatgggtaagg

SEQ ID NO: 445033 - DNA, 20 bp, mouse
ggttctttctgtcaggactg

SEQ ID NO: 445034 - DNA, 20 bp, mouse
gtgacccaagacaccccaga

SEQ ID NO: 445035 - DNA, 20 bp, mouse
gatgtccactccaaggtctc

SEQ ID NO: 445036 - DNA, 20 bp, mouse
gtgcggcccagagcaaggat

SEQ ID NO: 445037 - DNA, 20 bp, mouse
ggtagagtctgcctgtgcag

SEQ ID NO: 445038 - DNA, 20 bp, mouse
gggtctgagctcttccacga

SEQ ID NO: 445039 - DNA, 20 bp, mouse
ggctagacaccagcttctcg

SEQ ID NO: 445040 - DNA, 20 bp, mouse
gggctcggagctctgtaagg

SEQ ID NO: 445041 - DNA, 20 bp, mouse
ggcggagatatcctccatcg

SEQ ID NO: 445042 - DNA, 20 bp, mouse
ggaacgcgtgtatctagggt

SEQ ID NO: 445043 - DNA, 20 bp, mouse
gcggggaacgcgtgtatcta

SEQ ID NO: 445044 - DNA, 20 bp, mouse
gggatgggcagtctggtgag

SEQ ID NO: 445045 - DNA, 20 bp, mouse
gtccgcaacacctgtgagca

SEQ ID NO: 445046 - DNA, 20 bp, mouse
ggcacgcgagtggaaggagt

SEQ ID NO: 445047 - DNA, 20 bp, mouse
gggagttggcaggcaggacg

SEQ ID NO: 445048 - DNA, 20 bp, mouse
gccagactaaagcacgcgag

SEQ ID NO: 445049 - DNA, 20 bp, mouse
ggcgagtggaaggagttggc

SEQ ID NO: 445050 - DNA, 20 bp, mouse
gactaaagcacgcgagtgga

SEQ ID NO: 445051 - DNA, 20 bp, mouse
gcgcgtgctttagtctggct

SEQ ID NO: 445052 - DNA, 20 bp, mouse
gcatattaagagcactgcta

SEQ ID NO: 445053 - DNA, 20 bp, mouse
gtccctgcggatgggttaag

SEQ ID NO: 445054 - DNA, 20 bp, mouse
gaaccgtgaagcaaagacag

SEQ ID NO: 445055 - DNA, 20 bp, mouse
gggagatgaggaagcgacag

SEQ ID NO: 445056 - DNA, 20 bp, mouse
gctgctcgttgtcattggtt

SEQ ID NO: 445057 - DNA, 20 bp, mouse
gctgctctgctcgttgtcat

SEQ ID NO: 445058 - DNA, 20 bp, mouse
ggctctaaggccaatctcag

SEQ ID NO: 445059 - DNA, 20 bp, mouse
gccaatctcagtgggacatc

SEQ ID NO: 445060 - DNA, 20 bp, mouse
gacatcaggagaagaaaaac

SEQ ID NO: 445061 - DNA, 20 bp, mouse
gtaagaagagaattgctcta

SEQ ID NO: 445062 - DNA, 20 bp, mouse
gcacaagatgtgactgcaaa

SEQ ID NO: 445063 - DNA, 20 bp, mouse
gtgcaaagccataagagaat

SEQ ID NO: 445064 - DNA, 20 bp, mouse
gaatttaattcctattagaa

SEQ ID NO: 445065 - DNA, 20 bp, mouse
gtgacttatgcccttctaat

SEQ ID NO: 445066 - DNA, 20 bp, mouse
gcaaatcgtaaccctctgag

SEQ ID NO: 445067 - DNA, 20 bp, mouse
gatgcatctggagtggagtc

SEQ ID NO: 445068 - DNA, 20 bp, mouse
ggttatatgcctggaagtac

SEQ ID NO: 445069 - DNA, 20 bp, mouse
ggcctggaagtacaggaatc

SEQ ID NO: 445070 - DNA, 20 bp, mouse
gtggatctattgtaaagtgg

SEQ ID NO: 445071 - DNA, 20 bp, mouse
gagaaaagtcactcctaagt

SEQ ID NO: 445072 - DNA, 20 bp, mouse
gctagaatgttaaacttacc

SEQ ID NO: 445073 - DNA, 20 bp, mouse
gaacttcgtttcaggctaat

SEQ ID NO: 445074 - DNA, 20 bp, mouse
gcaactgtaaacatgaagca

SEQ ID NO: 445075 - DNA, 20 bp, mouse
gtttaacattctagaatgtt

SEQ ID NO: 445076 - DNA, 20 bp, mouse
ggatctgctctgctcgtcat

SEQ ID NO: 445077 - DNA, 20 bp, mouse
ggctctgctcgtcattggtt

SEQ ID NO: 445078 - DNA, 20 bp, mouse
gtaataggagacaaagtgag

SEQ ID NO: 445079 - DNA, 20 bp, mouse
gatctatttaggaatctaat

SEQ ID NO: 445080 - DNA, 20 bp, mouse
gtgcaaagctgtaagtggat

SEQ ID NO: 445081 - DNA, 20 bp, mouse
ggtgaagaactttcaataac

SEQ ID NO: 445082 - DNA, 20 bp, mouse
gtgacttatgccctttctat

SEQ ID NO: 445083 - DNA, 20 bp, mouse
gataaatgcaaagctgtaag

SEQ ID NO: 445084 - DNA, 20 bp, mouse
gttccatttaatgctagtaa

SEQ ID NO: 445085 - DNA, 20 bp, mouse
gatccattactagcattaaa

SEQ ID NO: 445086 - DNA, 20 bp, mouse
gcccgaagcgcacttcacag

SEQ ID NO: 445087 - DNA, 20 bp, mouse
ggtgggcagaagcaccaagt

SEQ ID NO: 445088 - DNA, 20 bp, mouse
gaggccacgcagatacagag

SEQ ID NO: 445089 - DNA, 20 bp, mouse
gtgagaatttcctatgccag

SEQ ID NO: 445090 - DNA, 20 bp, mouse
gatcagtgaagagcagttgt

SEQ ID NO: 445091 - DNA, 20 bp, mouse
gtccactgtgaagtgcgctt

SEQ ID NO: 445092 - DNA, 20 bp, mouse
gtctaggaggaccttataac

SEQ ID NO: 445093 - DNA, 20 bp, mouse
gtcatctctgcctctggcat

SEQ ID NO: 445094 - DNA, 20 bp, mouse
gaccaatgccaggcaggtga

SEQ ID NO: 445095 - DNA, 20 bp, mouse
gcttgggaggaggctctgga

SEQ ID NO: 445096 - DNA, 20 bp, mouse
ggagtgattctaaggaaatg

SEQ ID NO: 445097 - DNA, 20 bp, mouse
gacaccaggcactccatcaa

SEQ ID NO: 445098 - DNA, 20 bp, mouse
gagaggcagcttcgccctct

SEQ ID NO: 445099 - DNA, 20 bp, mouse
gagagcgtcagtcatatata

SEQ ID NO: 445100 - DNA, 20 bp, mouse
gtgtagtctctgtcagattc

SEQ ID NO: 445101 - DNA, 20 bp, mouse
gcacaggtaaaacagaatga

SEQ ID NO: 445102 - DNA, 20 bp, mouse
gggcactccatcaaaggctt

SEQ ID NO: 445103 - DNA, 20 bp, mouse
ggctctgggagcttggggaa

SEQ ID NO: 445104 - DNA, 20 bp, mouse
gttggggaaggggcacaaat

SEQ ID NO: 445105 - DNA, 20 bp, mouse
gctggattcagtagcttcac

SEQ ID NO: 445106 - DNA, 20 bp, mouse
ggagctaagaggctgcatct

SEQ ID NO: 445107 - DNA, 20 bp, mouse
gcagcattcccatgcaccag

SEQ ID NO: 445108 - DNA, 20 bp, mouse
gccgctgtcccctggtgcat

SEQ ID NO: 445109 - DNA, 20 bp, mouse
ggagcgctacgggaaggctg

SEQ ID NO: 445110 - DNA, 20 bp, mouse
ggcaggtacaacatggtggg

SEQ ID NO: 445111 - DNA, 20 bp, mouse
gggaatggagcgctacggga

SEQ ID NO: 445112 - DNA, 20 bp, mouse
gcatggttgccgctgtcccc

SEQ ID NO: 445113 - DNA, 20 bp, mouse
gtgcagcctcttagctccat

SEQ ID NO: 445114 - DNA, 20 bp, mouse
gcctcttagctccatgggtg

SEQ ID NO: 445115 - DNA, 20 bp, mouse
gcttcttgggaagatagagg

SEQ ID NO: 445116 - DNA, 20 bp, mouse
gcagcagtctctgacacagt

SEQ ID NO: 445117 - DNA, 20 bp, mouse
gaggaacacctgatacccag

SEQ ID NO: 445118 - DNA, 20 bp, mouse
gccaagcccagccttaccca

SEQ ID NO: 445119 - DNA, 20 bp, mouse
gcggagtcattcatctttca

SEQ ID NO: 445120 - DNA, 20 bp, mouse
gagatgaatgactccgcaga

SEQ ID NO: 445121 - DNA, 20 bp, mouse
gaggagggagcaatagtgga

SEQ ID NO: 445122 - DNA, 20 bp, mouse
ggcaccagatactccttcaa

SEQ ID NO: 445123 - DNA, 20 bp, mouse
gggcttggattctagagatg

SEQ ID NO: 445124 - DNA, 20 bp, mouse
ggtacagcaactgggctccc

SEQ ID NO: 445125 - DNA, 20 bp, mouse
ggaaggcagagtacagcaac

SEQ ID NO: 445126 - DNA, 20 bp, mouse
gtccgtgagggaggcctgag

SEQ ID NO: 445127 - DNA, 20 bp, mouse
gtgtgctctctcgaagtccc

SEQ ID NO: 445128 - DNA, 20 bp, mouse
gatcagaatgtctaggaagt

SEQ ID NO: 445129 - DNA, 20 bp, mouse
ggtctaggaagtgggcatta

SEQ ID NO: 445130 - DNA, 20 bp, mouse
gcttgtggcagagcctactc

SEQ ID NO: 445131 - DNA, 20 bp, mouse
ggactgtgggatctccgtga

SEQ ID NO: 445132 - DNA, 20 bp, mouse
gctcatggttactagtgcct

SEQ ID NO: 445133 - DNA, 20 bp, mouse
ggatgacctcccccagaagt

SEQ ID NO: 445134 - DNA, 20 bp, mouse
ggcccctcaggcctccctca

SEQ ID NO: 445135 - DNA, 20 bp, mouse
gagcctactcaggctctgac

SEQ ID NO: 445136 - DNA, 20 bp, mouse
gtacccagagagcccatctg

SEQ ID NO: 445137 - DNA, 20 bp, mouse
gtaagcaggaccaggcacca

SEQ ID NO: 445138 - DNA, 20 bp, mouse
gtgttgttctaagcaggacc

SEQ ID NO: 445139 - DNA, 20 bp, mouse
ggcaccacagatgggctctc

SEQ ID NO: 445140 - DNA, 20 bp, mouse
gctaggtacagaagtatcat

SEQ ID NO: 445141 - DNA, 20 bp, mouse
gtacaaatagtgctgttcct

SEQ ID NO: 445142 - DNA, 20 bp, mouse
gagctctgcttacttagatg

SEQ ID NO: 445143 - DNA, 20 bp, mouse
gctttggtcagaacctaggt

SEQ ID NO: 445144 - DNA, 20 bp, mouse
gaagactacactagaagtct

SEQ ID NO: 445145 - DNA, 20 bp, mouse
gacccagtacctggattctg

SEQ ID NO: 445146 - DNA, 20 bp, mouse
gagtcaagagaagcagagga

SEQ ID NO: 445147 - DNA, 20 bp, mouse
gaagagaagcagaggatggc

SEQ ID NO: 445148 - DNA, 20 bp, mouse
gctcaggggcagaggtgtca

SEQ ID NO: 445149 - DNA, 20 bp, mouse
gaccatgattctttgactga

SEQ ID NO: 445150 - DNA, 20 bp, mouse
ggccctgcacaaccgacaga

SEQ ID NO: 445151 - DNA, 20 bp, mouse
gagggagtcaagagaagcag

SEQ ID NO: 445152 - DNA, 20 bp, mouse
ggaggctgggtaccaactag

SEQ ID NO: 445153 - DNA, 20 bp, mouse
gaggtaccaggatgactcag

SEQ ID NO: 445154 - DNA, 20 bp, mouse
gtcccagggcagagggaagg

SEQ ID NO: 445155 - DNA, 20 bp, mouse
gtccatcagtcaaagaatca

SEQ ID NO: 445156 - DNA, 20 bp, mouse
gcagcctcaccatgattctt

SEQ ID NO: 445157 - DNA, 20 bp, mouse
ggggagtcaagagaagcaga

SEQ ID NO: 445158 - DNA, 20 bp, mouse
gctcaggggcagaggtgtcg

SEQ ID NO: 445159 - DNA, 20 bp, mouse
ggccctgcacaacggacaga

SEQ ID NO: 445160 - DNA, 20 bp, mouse
ggaggctgggtaccaactag

SEQ ID NO: 445161 - DNA, 20 bp, mouse
gcagccaaagaatcatggtg

SEQ ID NO: 445162 - DNA, 20 bp, mouse
gaggtaccaggatgactcag

SEQ ID NO: 445163 - DNA, 20 bp, mouse
gtccatcagccaaagaatca

SEQ ID NO: 445164 - DNA, 20 bp, mouse
gggccaggaccagatctctc

SEQ ID NO: 445165 - DNA, 20 bp, mouse
gtctttggctgatggaactc

SEQ ID NO: 445166 - DNA, 20 bp, mouse
ggatcctgaagatcgaacac

SEQ ID NO: 445167 - DNA, 20 bp, mouse
gcctgaagatcgaacacagg

SEQ ID NO: 445168 - DNA, 20 bp, mouse
gatcgaacacaggaggaaac

SEQ ID NO: 445169 - DNA, 20 bp, mouse
gagaacagggtagggatgag

SEQ ID NO: 445170 - DNA, 20 bp, mouse
gttactctcagatcctgcta

SEQ ID NO: 445171 - DNA, 20 bp, mouse
gaaggggacactgaacgaca

SEQ ID NO: 445172 - DNA, 20 bp, mouse
gggacactgaacgacaggga

SEQ ID NO: 445173 - DNA, 20 bp, mouse
gtgttctcgacaagtaaata

SEQ ID NO: 445174 - DNA, 20 bp, mouse
gcgggtgaagaggtagagca

SEQ ID NO: 445175 - DNA, 20 bp, mouse
gacccagaaagcctggaaag

SEQ ID NO: 445176 - DNA, 20 bp, mouse
gaaacagtgcttgctatcag

SEQ ID NO: 445177 - DNA, 20 bp, mouse
gccagtgctagccagaggct

SEQ ID NO: 445178 - DNA, 20 bp, mouse
gaactcccagtgctagccag

SEQ ID NO: 445179 - DNA, 20 bp, mouse
gctccttccctagacagtac

SEQ ID NO: 445180 - DNA, 20 bp, mouse
ggtatctgccaggaaaacat

SEQ ID NO: 445181 - DNA, 20 bp, mouse
gttacgcccaaagagcatca

SEQ ID NO: 445182 - DNA, 20 bp, mouse
gagagttggttccccaaaag

SEQ ID NO: 445183 - DNA, 20 bp, mouse
gactctccttgcagataagt

SEQ ID NO: 445184 - DNA, 20 bp, mouse
ggtgtctagaagcaacttta

SEQ ID NO: 445185 - DNA, 20 bp, mouse
gcagaagacttcttgacttc

SEQ ID NO: 445186 - DNA, 20 bp, mouse
gtggttgtcttaaggattcc

SEQ ID NO: 445187 - DNA, 20 bp, mouse
gttcttgcaagtacattaac

SEQ ID NO: 445188 - DNA, 20 bp, mouse
gcttgcaagaatacacttcc

SEQ ID NO: 445189 - DNA, 20 bp, mouse
gaaggaaagagcagtggcaa

SEQ ID NO: 445190 - DNA, 20 bp, mouse
gatgtttctgggactatatg

SEQ ID NO: 445191 - DNA, 20 bp, mouse
gaaccctaagtacaagtcct

SEQ ID NO: 445192 - DNA, 20 bp, mouse
gtgcctaggacttgtactta

SEQ ID NO: 445193 - DNA, 20 bp, mouse
gacctaggccctgggcaatg

SEQ ID NO: 445194 - DNA, 20 bp, mouse
gtcttagctgctttctgtgg

SEQ ID NO: 445195 - DNA, 20 bp, mouse
gcagcccatccactgaatat

SEQ ID NO: 445196 - DNA, 20 bp, mouse
gaggacagagcagactacgg

SEQ ID NO: 445197 - DNA, 20 bp, mouse
gcaggtgctcagatgtcaat

SEQ ID NO: 445198 - DNA, 20 bp, mouse
gtgagccctgaggagcagaa

SEQ ID NO: 445199 - DNA, 20 bp, mouse
gatcgaaatggcataatcag

SEQ ID NO: 445200 - DNA, 20 bp, mouse
gctgtcctgtggtgatgttg

SEQ ID NO: 445201 - DNA, 20 bp, mouse
gtgctcctcagggctcatca

SEQ ID NO: 445202 - DNA, 20 bp, mouse
gtgtggctggacaggcagtg

SEQ ID NO: 445203 - DNA, 20 bp, mouse
gttccaggtgactatcgaaa

SEQ ID NO: 445204 - DNA, 20 bp, mouse
gcacacactcaggcacccat

SEQ ID NO: 445205 - DNA, 20 bp, mouse
ggctcatcagggccaaggta

SEQ ID NO: 445206 - DNA, 20 bp, mouse
ggcctctgggtaccatccca

SEQ ID NO: 445207 - DNA, 20 bp, mouse
gagaggcagctatgcctggg

SEQ ID NO: 445208 - DNA, 20 bp, mouse
gtgtctgaggggcagcggag

SEQ ID NO: 445209 - DNA, 20 bp, mouse
gcaaagtcaacgggcagagt

SEQ ID NO: 445210 - DNA, 20 bp, mouse
ggcccctcagacacacggag

SEQ ID NO: 445211 - DNA, 20 bp, mouse
gtctgcgcggacgggagaag

SEQ ID NO: 445212 - DNA, 20 bp, mouse
ggcctctccgtgtgtctgag

SEQ ID NO: 445213 - DNA, 20 bp, mouse
gtcctgggaaccgcacgtgg

SEQ ID NO: 445214 - DNA, 20 bp, mouse
gcttcatcttctgcttccct

SEQ ID NO: 445215 - DNA, 20 bp, mouse
gccgctgcccctcagacaca

SEQ ID NO: 445216 - DNA, 20 bp, mouse
gccgagccgggccagtcggg

SEQ ID NO: 445217 - DNA, 20 bp, mouse
gtcgaggctccggcgtccag

SEQ ID NO: 445218 - DNA, 20 bp, mouse
gacacgctgggcctcctctg

SEQ ID NO: 445219 - DNA, 20 bp, mouse
gctccccctgtcaagagcag

SEQ ID NO: 445220 - DNA, 20 bp, mouse
gctgctggcctgggtggccg

SEQ ID NO: 445221 - DNA, 20 bp, mouse
gcaggggacctggcccagtg

SEQ ID NO: 445222 - DNA, 20 bp, mouse
gtggccgcggtgcccgcact

SEQ ID NO: 445223 - DNA, 20 bp, mouse
gctccggcgtccaggggacc

SEQ ID NO: 445224 - DNA, 20 bp, mouse
gcagctgctggggccgcacg

SEQ ID NO: 445225 - DNA, 20 bp, mouse
ggagcgcgtagcagctgctg

SEQ ID NO: 445226 - DNA, 20 bp, mouse
ggcagactgcgcggagctca

SEQ ID NO: 445227 - DNA, 20 bp, mouse
gggaggaggagagcacgggt

SEQ ID NO: 445228 - DNA, 20 bp, mouse
ggagtcgcgccgcgcgccga

SEQ ID NO: 445229 - DNA, 20 bp, mouse
ggcactggagacgcgtcctg

SEQ ID NO: 445230 - DNA, 20 bp, mouse
gtcaagtgccggctgcaagg

SEQ ID NO: 445231 - DNA, 20 bp, mouse
gtaccccagtgcctggccgg

SEQ ID NO: 445232 - DNA, 20 bp, mouse
ggcgccgcgcgccgacggag

SEQ ID NO: 445233 - DNA, 20 bp, mouse
ggagccgcacaggagggtgg

SEQ ID NO: 445234 - DNA, 20 bp, mouse
gccgggctctggcacagcta

SEQ ID NO: 445235 - DNA, 20 bp, mouse
gggcagggccggggaaacaa

SEQ ID NO: 445236 - DNA, 20 bp, mouse
gcacccaagtggagtcgcag

SEQ ID NO: 445237 - DNA, 20 bp, mouse
ggcttgtaccgagtcactgg

SEQ ID NO: 445238 - DNA, 20 bp, mouse
gagccactgcgactccactt

SEQ ID NO: 445239 - DNA, 20 bp, mouse
gataggagccaccagtgact

SEQ ID NO: 445240 - DNA, 20 bp, mouse
ggactcggtacaagcagttg

SEQ ID NO: 445241 - DNA, 20 bp, mouse
gggtggctcctatgtgctct

SEQ ID NO: 445242 - DNA, 20 bp, mouse
gggtcggtttaccacccaag

SEQ ID NO: 445243 - DNA, 20 bp, mouse
gtctccctgggcaggagcta

SEQ ID NO: 445244 - DNA, 20 bp, mouse
ggctcagaaaagatctccct

SEQ ID NO: 445245 - DNA, 20 bp, mouse
gactgcttgtaccgagtcac

SEQ ID NO: 445246 - DNA, 20 bp, mouse
ggcatcctagacctcgacag

SEQ ID NO: 445247 - DNA, 20 bp, mouse
gcaaccgggctgctactgag

SEQ ID NO: 445248 - DNA, 20 bp, mouse
gaggctgcacttgcacgtcg

SEQ ID NO: 445249 - DNA, 20 bp, mouse
gctagacctcgacagaggaa

SEQ ID NO: 445250 - DNA, 20 bp, mouse
gcatgctcaaagggactggg

SEQ ID NO: 445251 - DNA, 20 bp, mouse
gcctccggagatgcttcaag

SEQ ID NO: 445252 - DNA, 20 bp, mouse
gtccgtcctaaaaaggtcta

SEQ ID NO: 445253 - DNA, 20 bp, mouse
gatcttgtgggtaggtagct

SEQ ID NO: 445254 - DNA, 20 bp, mouse
gagtagcagcccggttgtct

SEQ ID NO: 445255 - DNA, 20 bp, mouse
gacgaaactaggcttcggtg

SEQ ID NO: 445256 - DNA, 20 bp, mouse
ggcggcggcaccaacagtgg

SEQ ID NO: 445257 - DNA, 20 bp, mouse
ggtctggccgggcctcgcgg

SEQ ID NO: 445258 - DNA, 20 bp, mouse
gaccaacagtggcggcgatt

SEQ ID NO: 445259 - DNA, 20 bp, mouse
gggagggagcggccaagcag

SEQ ID NO: 445260 - DNA, 20 bp, mouse
ggcgaggcccggccagactg

SEQ ID NO: 445261 - DNA, 20 bp, mouse
ggcccaatcgccgccactgt

SEQ ID NO: 445262 - DNA, 20 bp, mouse
gccgcgccgcgccgactccc

SEQ ID NO: 445263 - DNA, 20 bp, mouse
gcaaggagctgggaactccg

SEQ ID NO: 445264 - DNA, 20 bp, mouse
gcaggcgccgccgcacacaa

SEQ ID NO: 445265 - DNA, 20 bp, mouse
gctcgcccccggccccagtc

SEQ ID NO: 445266 - DNA, 20 bp, mouse
gtgccttgctcacagaggag

SEQ ID NO: 445267 - DNA, 20 bp, mouse
gctgtgagcaaggcagagtg

SEQ ID NO: 445268 - DNA, 20 bp, mouse
gggcagagagtcatagacct

SEQ ID NO: 445269 - DNA, 20 bp, mouse
gattgttctgatgagggcca

SEQ ID NO: 445270 - DNA, 20 bp, mouse
gagcccctcctctgtgagca

SEQ ID NO: 445271 - DNA, 20 bp, mouse
gcatcagaacaatgacactc

SEQ ID NO: 445272 - DNA, 20 bp, mouse
gtctgaatataaaagttctt

SEQ ID NO: 445273 - DNA, 20 bp, mouse
gtagaatcctgactgggcgg

SEQ ID NO: 445274 - DNA, 20 bp, mouse
gaagtagaatcctgactggg

SEQ ID NO: 445275 - DNA, 20 bp, mouse
ggtgacaccaccgcccagtc

SEQ ID NO: 445276 - DNA, 20 bp, mouse
ggccacgctcgagaacgcgg

SEQ ID NO: 445277 - DNA, 20 bp, mouse
gcgcgccacgctcgagaacg

SEQ ID NO: 445278 - DNA, 20 bp, mouse
ggaacgcggtggcaagccac

SEQ ID NO: 445279 - DNA, 20 bp, mouse
gggcccagtgtgaagagagt

SEQ ID NO: 445280 - DNA, 20 bp, mouse
gccgcacaaggaccgacgag

SEQ ID NO: 445281 - DNA, 20 bp, mouse
gccgcgtgcgaggagcccag

SEQ ID NO: 445282 - DNA, 20 bp, mouse
gagctggctgaggcacttgg

SEQ ID NO: 445283 - DNA, 20 bp, mouse
ggaagtcaggggctcccaga

SEQ ID NO: 445284 - DNA, 20 bp, mouse
gtgtgaagagagtcgggacc

SEQ ID NO: 445285 - DNA, 20 bp, mouse
gacgcgggtcggctccaatc

SEQ ID NO: 445286 - DNA, 20 bp, mouse
gctaggaacccagggtcagg

SEQ ID NO: 445287 - DNA, 20 bp, mouse
gcacctaggaacccagggtc

SEQ ID NO: 445288 - DNA, 20 bp, mouse
ggtgctcacctaggaaccca

SEQ ID NO: 445289 - DNA, 20 bp, mouse
gtacccgccggtgctcacct

SEQ ID NO: 445290 - DNA, 20 bp, mouse
ggggtcaggcggggaagaaa

SEQ ID NO: 445291 - DNA, 20 bp, mouse
gggtgccccggatgtaatac

SEQ ID NO: 445292 - DNA, 20 bp, mouse
gtccttggcgtacaaactaa

SEQ ID NO: 445293 - DNA, 20 bp, mouse
gcctctgtgagcactcgggt

SEQ ID NO: 445294 - DNA, 20 bp, mouse
ggttcctaggtgagcaccgg

SEQ ID NO: 445295 - DNA, 20 bp, mouse
gtaggggagtggtgacgtag

SEQ ID NO: 445296 - DNA, 20 bp, mouse
gccccagcgggactgaaccg

SEQ ID NO: 445297 - DNA, 20 bp, mouse
gctgccggtgacccgtgtgt

SEQ ID NO: 445298 - DNA, 20 bp, mouse
gtctcccacacacgggtcac

SEQ ID NO: 445299 - DNA, 20 bp, mouse
ggccacggctggacgctcca

SEQ ID NO: 445300 - DNA, 20 bp, mouse
gttcggggagatgcagtgtg

SEQ ID NO: 445301 - DNA, 20 bp, mouse
gaccgtggagcgtccagccg

SEQ ID NO: 445302 - DNA, 20 bp, mouse
gaggtagtgtctgcccggga

SEQ ID NO: 445303 - DNA, 20 bp, mouse
gcaggtggtaccagtatgag

SEQ ID NO: 445304 - DNA, 20 bp, mouse
gccagccgtggcctgcctgc

SEQ ID NO: 445305 - DNA, 20 bp, mouse
ggagactggccgtcccccag

SEQ ID NO: 445306 - DNA, 20 bp, mouse
gtcctctcttggccctggtg

SEQ ID NO: 445307 - DNA, 20 bp, mouse
gaggagagtagcacagctga

SEQ ID NO: 445308 - DNA, 20 bp, mouse
gatcagcatctgctccccag

SEQ ID NO: 445309 - DNA, 20 bp, mouse
gacatgtccttctcctctct

SEQ ID NO: 445310 - DNA, 20 bp, mouse
ggaaaggggaaatctatggg

SEQ ID NO: 445311 - DNA, 20 bp, mouse
gacttgaaaggggaaatcta

SEQ ID NO: 445312 - DNA, 20 bp, mouse
ggaaaggagaactaggcaag

SEQ ID NO: 445313 - DNA, 20 bp, mouse
gtattgggtttacttgaaag

SEQ ID NO: 445314 - DNA, 20 bp, mouse
gggggaaatctatgggaggt

SEQ ID NO: 445315 - DNA, 20 bp, mouse
gccatgcatatctgaaacca

SEQ ID NO: 445316 - DNA, 20 bp, mouse
ggagaacttgaacaagaagg

SEQ ID NO: 445317 - DNA, 20 bp, mouse
ggctgtctccagaaaactcc

SEQ ID NO: 445318 - DNA, 20 bp, mouse
gggagagaacttgaacaaga

SEQ ID NO: 445319 - DNA, 20 bp, mouse
ggaagtagctcagagtgcaa

SEQ ID NO: 445320 - DNA, 20 bp, mouse
ggaaaactccaggtcgctgc

SEQ ID NO: 445321 - DNA, 20 bp, mouse
gctggattccagcagcgacc

SEQ ID NO: 445322 - DNA, 20 bp, mouse
ggcttccaaggtgagtaggg

SEQ ID NO: 445323 - DNA, 20 bp, mouse
ggggctctgttacacacatc

SEQ ID NO: 445324 - DNA, 20 bp, mouse
ggaatccagatgtcagaagt

SEQ ID NO: 445325 - DNA, 20 bp, mouse
gccctcccccctgcaaaatt

SEQ ID NO: 445326 - DNA, 20 bp, mouse
gcagcaaatccaaatctcag

SEQ ID NO: 445327 - DNA, 20 bp, mouse
gagcgggatacccaaagccc

SEQ ID NO: 445328 - DNA, 20 bp, mouse
gtgggtatcccgctgagatt

SEQ ID NO: 445329 - DNA, 20 bp, mouse
gggtgtagagtggcaataga

SEQ ID NO: 445330 - DNA, 20 bp, mouse
gtgttcagctacggcctggg

SEQ ID NO: 445331 - DNA, 20 bp, mouse
gtcaaggagtgcagcaaagt

SEQ ID NO: 445332 - DNA, 20 bp, mouse
gcaggacctggggacgtgaa

SEQ ID NO: 445333 - DNA, 20 bp, mouse
gctgagatctccagggcttt

SEQ ID NO: 445334 - DNA, 20 bp, mouse
gccccacatttccctgaagg

SEQ ID NO: 445335 - DNA, 20 bp, mouse
gggcagctctccttaaacct

SEQ ID NO: 445336 - DNA, 20 bp, mouse
gtcgtcaacaaggacatgag

SEQ ID NO: 445337 - DNA, 20 bp, mouse
gatgagaggagacgaccatg

SEQ ID NO: 445338 - DNA, 20 bp, mouse
gcttgttgacgacagatgtc

SEQ ID NO: 445339 - DNA, 20 bp, mouse
gttcgtggagcagctagggt

SEQ ID NO: 445340 - DNA, 20 bp, mouse
ggtggtgagggcgaccaaga

SEQ ID NO: 445341 - DNA, 20 bp, mouse
gtggagcagctagggttgga

SEQ ID NO: 445342 - DNA, 20 bp, mouse
ggttctgtgttagagaaacc

SEQ ID NO: 445343 - DNA, 20 bp, mouse
gaacacagaacagaccgtct

SEQ ID NO: 445344 - DNA, 20 bp, mouse
gctcacagcagaacgggaga

SEQ ID NO: 445345 - DNA, 20 bp, mouse
gaacttgccttttcttttag

SEQ ID NO: 445346 - DNA, 20 bp, mouse
gtcgctggcaggctccacca

SEQ ID NO: 445347 - DNA, 20 bp, mouse
gggaccaggagacgcaggag

SEQ ID NO: 445348 - DNA, 20 bp, mouse
gaagtgccgagtgagagtga

SEQ ID NO: 445349 - DNA, 20 bp, mouse
gccacaggaccaggagacgc

SEQ ID NO: 445350 - DNA, 20 bp, mouse
gtgagggaaaccacaggacc

SEQ ID NO: 445351 - DNA, 20 bp, mouse
gttctcacaccgggtcacct

SEQ ID NO: 445352 - DNA, 20 bp, mouse
gtcacaccgggtcaccttgg

SEQ ID NO: 445353 - DNA, 20 bp, mouse
ggcatgtagcctgttctcgc

SEQ ID NO: 445354 - DNA, 20 bp, mouse
gaggctccaccaaggtgacc

SEQ ID NO: 445355 - DNA, 20 bp, mouse
gagcgggaagtggctaaagg

SEQ ID NO: 445356 - DNA, 20 bp, mouse
gggaccagaggcctcatggt

SEQ ID NO: 445357 - DNA, 20 bp, mouse
gtggtgctcccaggtgagag

SEQ ID NO: 445358 - DNA, 20 bp, mouse
gaggcctctggtcctgctat

SEQ ID NO: 445359 - DNA, 20 bp, mouse
gcaccaggcagccccatagc

SEQ ID NO: 445360 - DNA, 20 bp, mouse
ggcacccaccatgaggcctc

SEQ ID NO: 445361 - DNA, 20 bp, mouse
gcccaagggagaaagaccct

SEQ ID NO: 445362 - DNA, 20 bp, mouse
gactgcagttgcctgcaatt

SEQ ID NO: 445363 - DNA, 20 bp, mouse
gcagaagagctcccaattgc

SEQ ID NO: 445364 - DNA, 20 bp, mouse
gacctctgacccctctcacc

SEQ ID NO: 445365 - DNA, 20 bp, mouse
gttccctccacaccatgagg

SEQ ID NO: 445366 - DNA, 20 bp, mouse
gctgtccttggtggcaacag

SEQ ID NO: 445367 - DNA, 20 bp, mouse
gggttgagaaacacattgga

SEQ ID NO: 445368 - DNA, 20 bp, mouse
gctgtcctctgttgccacca

SEQ ID NO: 445369 - DNA, 20 bp, mouse
gactcactcatcagctttca

SEQ ID NO: 445370 - DNA, 20 bp, mouse
gtttaaattgattttggttt

SEQ ID NO: 445371 - DNA, 20 bp, mouse
gctacttacctgggaggaaa

SEQ ID NO: 445372 - DNA, 20 bp, mouse
gctaaagctcacaatggaat

SEQ ID NO: 445373 - DNA, 20 bp, mouse
ggaaaaggaagagcagagct

SEQ ID NO: 445374 - DNA, 20 bp, mouse
gctagggttgagaaacacat

SEQ ID NO: 445375 - DNA, 20 bp, mouse
gctcacaatggaatgggaga

SEQ ID NO: 445376 - DNA, 20 bp, mouse
gttaccggcgacgatggcag

SEQ ID NO: 445377 - DNA, 20 bp, mouse
gggaagcttaccggcgacga

SEQ ID NO: 445378 - DNA, 20 bp, mouse
ggcgaggacagcgctgcgtg

SEQ ID NO: 445379 - DNA, 20 bp, mouse
gtgaggtgaggatacagaca

SEQ ID NO: 445380 - DNA, 20 bp, mouse
gggcgacgatggcagtggcg

SEQ ID NO: 445381 - DNA, 20 bp, mouse
gactctccggggcgcggcag

SEQ ID NO: 445382 - DNA, 20 bp, mouse
ggcttcagagagccagaccc

SEQ ID NO: 445383 - DNA, 20 bp, mouse
gtgcgtggggcatgactgcg

SEQ ID NO: 445384 - DNA, 20 bp, mouse
ggggacaaaggccaaagcag

SEQ ID NO: 445385 - DNA, 20 bp, mouse
ggcgagctaaccgtcttggg

SEQ ID NO: 445386 - DNA, 20 bp, mouse
gtgagcggctgcggctggag

SEQ ID NO: 445387 - DNA, 20 bp, mouse
gcggctggagcggagcagtt

SEQ ID NO: 445388 - DNA, 20 bp, mouse
ggcgcgtccttctgactgag

SEQ ID NO: 445389 - DNA, 20 bp, mouse
gccgcagccgctcagtcaga

SEQ ID NO: 445390 - DNA, 20 bp, mouse
gagttcggctagctgttgga

SEQ ID NO: 445391 - DNA, 20 bp, mouse
gagtgtcaacgaccgatggg

SEQ ID NO: 445392 - DNA, 20 bp, mouse
gggcggcgcagccaatagtg

SEQ ID NO: 445393 - DNA, 20 bp, mouse
ggacagcgcaggaataaggg

SEQ ID NO: 445394 - DNA, 20 bp, mouse
gaggcgatgccagcgcgtgg

SEQ ID NO: 445395 - DNA, 20 bp, mouse
gagggacagcgcaggaataa

SEQ ID NO: 445396 - DNA, 20 bp, mouse
gctgcacacagcaagaacag

SEQ ID NO: 445397 - DNA, 20 bp, mouse
gacagcaagaacagcggcag

SEQ ID NO: 445398 - DNA, 20 bp, mouse
gtagcacagtgaatggtcct

SEQ ID NO: 445399 - DNA, 20 bp, mouse
ggtgcaggtaagtgttgcgg

SEQ ID NO: 445400 - DNA, 20 bp, mouse
gtagtgcagaaggcaacaca

SEQ ID NO: 445401 - DNA, 20 bp, mouse
gcattcactgtgctatgctg

SEQ ID NO: 445402 - DNA, 20 bp, mouse
gcctaaagtgagcttaatgg

SEQ ID NO: 445403 - DNA, 20 bp, mouse
gcccgagtcagtgacagtcg

SEQ ID NO: 445404 - DNA, 20 bp, mouse
gagtcagtgacagtcgagga

SEQ ID NO: 445405 - DNA, 20 bp, mouse
ggggtgggggtcttgaatag

SEQ ID NO: 445406 - DNA, 20 bp, mouse
gaccgagcgcatctccggag

SEQ ID NO: 445407 - DNA, 20 bp, mouse
gatgcgctcggtgcaggagg

SEQ ID NO: 445408 - DNA, 20 bp, mouse
gagagagctacccagcgcca

SEQ ID NO: 445409 - DNA, 20 bp, mouse
gcgcatctccggagcggtac

SEQ ID NO: 445410 - DNA, 20 bp, mouse
ggagcggtacaggagaatgc

SEQ ID NO: 445411 - DNA, 20 bp, mouse
gcctgcaccgagcgcatctc

SEQ ID NO: 445412 - DNA, 20 bp, mouse
gccccgcgcgcgtgtccctg

SEQ ID NO: 445413 - DNA, 20 bp, mouse
gctcggtgcaggaggcggcc

SEQ ID NO: 445414 - DNA, 20 bp, mouse
ggctggagcgcaggattccc

SEQ ID NO: 445415 - DNA, 20 bp, mouse
gaccgctccggagatgcgct

SEQ ID NO: 445416 - DNA, 20 bp, mouse
gaaatgtgtggagcaactgg

SEQ ID NO: 445417 - DNA, 20 bp, mouse
gtggtttcctagcctttcaa

SEQ ID NO: 445418 - DNA, 20 bp, mouse
gagctgccttctgaaatgtg

SEQ ID NO: 445419 - DNA, 20 bp, mouse
ggtgtggagcaactggtgga

SEQ ID NO: 445420 - DNA, 20 bp, mouse
gataagtagtgaggaattca

SEQ ID NO: 445421 - DNA, 20 bp, mouse
gtactatccagcaaaaatat

SEQ ID NO: 445422 - DNA, 20 bp, mouse
gtttcaaaggtaagttatat

SEQ ID NO: 445423 - DNA, 20 bp, mouse
gttatctcctctcagtgtaa

SEQ ID NO: 445424 - DNA, 20 bp, mouse
gtagtgaggaattcagggta

SEQ ID NO: 445425 - DNA, 20 bp, mouse
ggggtaggggttttctactg

SEQ ID NO: 445426 - DNA, 20 bp, mouse
gcaggccgcctagtacctag

SEQ ID NO: 445427 - DNA, 20 bp, mouse
gtgagaggcacaaaggaaac

SEQ ID NO: 445428 - DNA, 20 bp, mouse
ggaagaggtgttggccgcag

SEQ ID NO: 445429 - DNA, 20 bp, mouse
gcagagctggagccctacct

SEQ ID NO: 445430 - DNA, 20 bp, mouse
gtgaggctagggcggatcaa

SEQ ID NO: 445431 - DNA, 20 bp, mouse
gggacatcttcgcctagatg

SEQ ID NO: 445432 - DNA, 20 bp, mouse
ggccaacacctcttctgtct

SEQ ID NO: 445433 - DNA, 20 bp, mouse
gccagggcgagtgagatatc

SEQ ID NO: 445434 - DNA, 20 bp, mouse
ggaaagaggaagttccgggg

SEQ ID NO: 445435 - DNA, 20 bp, mouse
ggtcccaggacccacgtgag

SEQ ID NO: 445436 - DNA, 20 bp, mouse
gccattgggctcccgaagac

SEQ ID NO: 445437 - DNA, 20 bp, mouse
gaggtctgtccccagacacc

SEQ ID NO: 445438 - DNA, 20 bp, mouse
gctgggctttcctagagagg

SEQ ID NO: 445439 - DNA, 20 bp, mouse
gctagcctgggccagtcttc

SEQ ID NO: 445440 - DNA, 20 bp, mouse
gggctcccgaagactggccc

SEQ ID NO: 445441 - DNA, 20 bp, mouse
gaaattcatagttagccatt

SEQ ID NO: 445442 - DNA, 20 bp, mouse
gcagaaaagtgcttcgtggt

SEQ ID NO: 445443 - DNA, 20 bp, mouse
gagtgcgcagcgggacaccg

SEQ ID NO: 445444 - DNA, 20 bp, mouse
gggatcagctggaagccgaa

SEQ ID NO: 445445 - DNA, 20 bp, mouse
gctgaggccgcgctcactcc

SEQ ID NO: 445446 - DNA, 20 bp, mouse
gcggaggatagtgctaaccc

SEQ ID NO: 445447 - DNA, 20 bp, mouse
ggccacaggatgatcagcca

SEQ ID NO: 445448 - DNA, 20 bp, mouse
gggaatcatgcaacaaatag

SEQ ID NO: 445449 - DNA, 20 bp, mouse
gcctccgccaacagactcat

SEQ ID NO: 445450 - DNA, 20 bp, mouse
gtggaggatggacccgtgag

SEQ ID NO: 445451 - DNA, 20 bp, mouse
ggtcactgggagaagtccac

SEQ ID NO: 445452 - DNA, 20 bp, mouse
gtttgttgcatgattccctc

SEQ ID NO: 445453 - DNA, 20 bp, mouse
ggctgtgttccatcttccag

SEQ ID NO: 445454 - DNA, 20 bp, mouse
ggaggcctcccttaccttgg

SEQ ID NO: 445455 - DNA, 20 bp, mouse
gggcctagggacatacaata

SEQ ID NO: 445456 - DNA, 20 bp, mouse
gcaccagacgcagacagggg

SEQ ID NO: 445457 - DNA, 20 bp, mouse
gaggcaccagacgcagacag

SEQ ID NO: 445458 - DNA, 20 bp, mouse
gtagtaggatgaaggagagt

SEQ ID NO: 445459 - DNA, 20 bp, mouse
ggagtggggggcacttcaca

SEQ ID NO: 445460 - DNA, 20 bp, mouse
gctggtgccttcttcagaaa

SEQ ID NO: 445461 - DNA, 20 bp, mouse
gcctcctagctggtgagtag

SEQ ID NO: 445462 - DNA, 20 bp, mouse
ggtagagagagcattctgag

SEQ ID NO: 445463 - DNA, 20 bp, mouse
gtgcggtggaacactttctg

SEQ ID NO: 445464 - DNA, 20 bp, mouse
gtgcctcccctgtctgcgtc

SEQ ID NO: 445465 - DNA, 20 bp, mouse
gagtgcagctggtgcctcag

SEQ ID NO: 445466 - DNA, 20 bp, mouse
gggagggcaggagaaccgag

SEQ ID NO: 445467 - DNA, 20 bp, mouse
gggcccctccggagctggaa

SEQ ID NO: 445468 - DNA, 20 bp, mouse
gtacccaggcctgcagtgag

SEQ ID NO: 445469 - DNA, 20 bp, mouse
gcgccattccagctccggag

SEQ ID NO: 445470 - DNA, 20 bp, mouse
ggaaccgagtggcacctgag

SEQ ID NO: 445471 - DNA, 20 bp, mouse
gcagtgagtggagcttgaac

SEQ ID NO: 445472 - DNA, 20 bp, mouse
gtgagtggagcttgaactgg

SEQ ID NO: 445473 - DNA, 20 bp, mouse
ggctggaatggcgggtaccc

SEQ ID NO: 445474 - DNA, 20 bp, mouse
gaccacgtggatccaagggg

SEQ ID NO: 445475 - DNA, 20 bp, mouse
gggtcctgcgtgggcccctc

SEQ ID NO: 445476 - DNA, 20 bp, mouse
gtgggtggctgggtggctaa

SEQ ID NO: 445477 - DNA, 20 bp, mouse
ggaagaagctgtgagcaggg

SEQ ID NO: 445478 - DNA, 20 bp, mouse
ggctgctgcacaggctgtct

SEQ ID NO: 445479 - DNA, 20 bp, mouse
ggctggtgcagctggagtaa

SEQ ID NO: 445480 - DNA, 20 bp, mouse
gctgtgctgggaagaaccac

SEQ ID NO: 445481 - DNA, 20 bp, mouse
gggtgacgatagctcaaggt

SEQ ID NO: 445482 - DNA, 20 bp, mouse
gagaagcaaagagactgaca

SEQ ID NO: 445483 - DNA, 20 bp, mouse
gaagagagatcaccaggaag

SEQ ID NO: 445484 - DNA, 20 bp, mouse
gagcagggaggcagagttat

SEQ ID NO: 445485 - DNA, 20 bp, mouse
ggacaggtgacgatagctca

SEQ ID NO: 445486 - DNA, 20 bp, mouse
gcaagactctcttcttcact

SEQ ID NO: 445487 - DNA, 20 bp, mouse
gtctttcaaggagctggaag

SEQ ID NO: 445488 - DNA, 20 bp, mouse
gttcctggggtggttcaagg

SEQ ID NO: 445489 - DNA, 20 bp, mouse
gcccgttctaagaggaatac

SEQ ID NO: 445490 - DNA, 20 bp, mouse
ggcagaggagcctcacgacc

SEQ ID NO: 445491 - DNA, 20 bp, mouse
ggggcaggcaaagatgagaa

SEQ ID NO: 445492 - DNA, 20 bp, mouse
gagtggggagtggaaagctg

SEQ ID NO: 445493 - DNA, 20 bp, mouse
gaggcagctgggacatggtg

SEQ ID NO: 445494 - DNA, 20 bp, mouse
ggaagaatgcaaagtcagag

SEQ ID NO: 445495 - DNA, 20 bp, mouse
gttcactctgcttcttgcac

SEQ ID NO: 445496 - DNA, 20 bp, mouse
gaggcaaagacaccatcgca

SEQ ID NO: 445497 - DNA, 20 bp, mouse
gcccatagcgcgcacagccg

SEQ ID NO: 445498 - DNA, 20 bp, mouse
gtcagaagagccaaatcaca

SEQ ID NO: 445499 - DNA, 20 bp, mouse
gaagcggcggttagtaggat

SEQ ID NO: 445500 - DNA, 20 bp, mouse
gactaaccgccgcttccagt

SEQ ID NO: 445501 - DNA, 20 bp, mouse
gtgttccacgaagcccacag

SEQ ID NO: 445502 - DNA, 20 bp, mouse
gcacaggggaaccttaggga

SEQ ID NO: 445503 - DNA, 20 bp, mouse
gcctgctaggagtcccgccc

SEQ ID NO: 445504 - DNA, 20 bp, mouse
ggggactttggagtgacttg

SEQ ID NO: 445505 - DNA, 20 bp, mouse
ggggcttagagagtgagaga

SEQ ID NO: 445506 - DNA, 20 bp, mouse
gggtgtcttctgaccaagaa

SEQ ID NO: 445507 - DNA, 20 bp, mouse
gcaaccttcccccagatccg

SEQ ID NO: 445508 - DNA, 20 bp, mouse
gcttcatagaagattggata

SEQ ID NO: 445509 - DNA, 20 bp, mouse
gagtccagttgccacggatc

SEQ ID NO: 445510 - DNA, 20 bp, mouse
gattccaagatcttagtcag

SEQ ID NO: 445511 - DNA, 20 bp, mouse
gggttcttattgatctagga

SEQ ID NO: 445512 - DNA, 20 bp, mouse
gttctgtcccagggaaatag

SEQ ID NO: 445513 - DNA, 20 bp, mouse
gcaaagtggccgccttactc

SEQ ID NO: 445514 - DNA, 20 bp, mouse
gttagctaattaaggcttgt

SEQ ID NO: 445515 - DNA, 20 bp, mouse
gcatgagaagactgtcaaag

SEQ ID NO: 445516 - DNA, 20 bp, mouse
ggtggggagaagggcaacga

SEQ ID NO: 445517 - DNA, 20 bp, mouse
gcctctggaaaagggtcgtg

SEQ ID NO: 445518 - DNA, 20 bp, mouse
gggtgaatggaacctgtcac

SEQ ID NO: 445519 - DNA, 20 bp, mouse
ggaagggcaacgagggtgaa

SEQ ID NO: 445520 - DNA, 20 bp, mouse
ggcagcccccagccagtgac

SEQ ID NO: 445521 - DNA, 20 bp, mouse
gaaaagggtcgtggggagaa

SEQ ID NO: 445522 - DNA, 20 bp, mouse
gccagggcgattcaacccag

SEQ ID NO: 445523 - DNA, 20 bp, mouse
gtctagtcgcctctggaaaa

SEQ ID NO: 445524 - DNA, 20 bp, mouse
ggcgtgctggatgaaacgga

SEQ ID NO: 445525 - DNA, 20 bp, mouse
gggaacctgtcactggctgg

SEQ ID NO: 445526 - DNA, 20 bp, mouse
gcagtctggtaacatgacgg

SEQ ID NO: 445527 - DNA, 20 bp, mouse
ggcgttgagtctggcataag

SEQ ID NO: 445528 - DNA, 20 bp, mouse
ggacaggggtgcgttgagtc

SEQ ID NO: 445529 - DNA, 20 bp, mouse
gtttcagtctggtaacatga

SEQ ID NO: 445530 - DNA, 20 bp, mouse
gaccctaagagggctctacc

SEQ ID NO: 445531 - DNA, 20 bp, mouse
ggctcttccttctgcgacag

SEQ ID NO: 445532 - DNA, 20 bp, mouse
gtcctggtagagccctctta

SEQ ID NO: 445533 - DNA, 20 bp, mouse
ggcctcagcatagacgccca

SEQ ID NO: 445534 - DNA, 20 bp, mouse
gtaggcagtagttaaggggt

SEQ ID NO: 445535 - DNA, 20 bp, mouse
gctggtacgatccaggagag

SEQ ID NO: 445536 - DNA, 20 bp, mouse
gtgcacagccggacacttgg

SEQ ID NO: 445537 - DNA, 20 bp, mouse
ggtgcttcataaaacaggga

SEQ ID NO: 445538 - DNA, 20 bp, mouse
gtcctcctgggaaaagagat

SEQ ID NO: 445539 - DNA, 20 bp, mouse
ggggcagcagtagcagttcc

SEQ ID NO: 445540 - DNA, 20 bp, mouse
gatgctcgcagcgggactgg

SEQ ID NO: 445541 - DNA, 20 bp, mouse
gggcatggccagctgggaaa

SEQ ID NO: 445542 - DNA, 20 bp, mouse
ggggcgcctgcccttcaatc

SEQ ID NO: 445543 - DNA, 20 bp, mouse
ggttttgcttcctgattgaa

SEQ ID NO: 445544 - DNA, 20 bp, mouse
gaacgggacctggggaggtg

SEQ ID NO: 445545 - DNA, 20 bp, mouse
ggcatggtagcacccagccc

SEQ ID NO: 445546 - DNA, 20 bp, mouse
ggcagccagcagcacttcgt

SEQ ID NO: 445547 - DNA, 20 bp, mouse
ggggaggcttagggtcacag

SEQ ID NO: 445548 - DNA, 20 bp, mouse
gagcagaaggccattatcca

SEQ ID NO: 445549 - DNA, 20 bp, mouse
gtgagcccagagtcagacct

SEQ ID NO: 445550 - DNA, 20 bp, mouse
gagcacttcgtgggagtcca

SEQ ID NO: 445551 - DNA, 20 bp, mouse
gagcgttcccagcaggtatg

SEQ ID NO: 445552 - DNA, 20 bp, mouse
gctcatgtgcaatagcaggg

SEQ ID NO: 445553 - DNA, 20 bp, mouse
gcagagccccgcggagaatg

SEQ ID NO: 445554 - DNA, 20 bp, mouse
gaggatgctccgggcagagt

SEQ ID NO: 445555 - DNA, 20 bp, mouse
gctccgggcagagtaggctg

SEQ ID NO: 445556 - DNA, 20 bp, mouse
gaaagcagccaggttcaaag

SEQ ID NO: 445557 - DNA, 20 bp, mouse
gctgcaggccactttgaacc

SEQ ID NO: 445558 - DNA, 20 bp, mouse
gggatctaggagggcctata

SEQ ID NO: 445559 - DNA, 20 bp, mouse
gaaggaatgcaggttctcgg

SEQ ID NO: 445560 - DNA, 20 bp, mouse
gcagagcccaggaagatttc

SEQ ID NO: 445561 - DNA, 20 bp, mouse
gtggtagctgcagtgactct

SEQ ID NO: 445562 - DNA, 20 bp, mouse
gagctttgagagatgagttc

SEQ ID NO: 445563 - DNA, 20 bp, mouse
gacccttgccttctaccaca

SEQ ID NO: 445564 - DNA, 20 bp, mouse
ggaatgcaggttctcggtgg

SEQ ID NO: 445565 - DNA, 20 bp, mouse
gggtcgccaactggaaacca

SEQ ID NO: 445566 - DNA, 20 bp, mouse
gcaaatagacatagacttct

SEQ ID NO: 445567 - DNA, 20 bp, mouse
ggcacttcccttaggcaact

SEQ ID NO: 445568 - DNA, 20 bp, mouse
gaattcactgattatctttt

SEQ ID NO: 445569 - DNA, 20 bp, mouse
gattctacctgaagtactga

SEQ ID NO: 445570 - DNA, 20 bp, mouse
gtcactgattatcttttagg

SEQ ID NO: 445571 - DNA, 20 bp, mouse
gttagatcagcacttccctt

SEQ ID NO: 445572 - DNA, 20 bp, mouse
gtgtaagcttatgaatactt

SEQ ID NO: 445573 - DNA, 20 bp, mouse
gacatagacttctgggttac

SEQ ID NO: 445574 - DNA, 20 bp, mouse
gatacagtaagcaattcaag

SEQ ID NO: 445575 - DNA, 20 bp, mouse
gagctctaaatcagctaata

SEQ ID NO: 445576 - DNA, 20 bp, mouse
gaagagaccttgcccggctg

SEQ ID NO: 445577 - DNA, 20 bp, mouse
gcggccagcgggagggatgg

SEQ ID NO: 445578 - DNA, 20 bp, mouse
gacctggggctatgatccgt

SEQ ID NO: 445579 - DNA, 20 bp, mouse
gacagctgctcaattaactg

SEQ ID NO: 445580 - DNA, 20 bp, mouse
gagtcctaggcgcccgccca

SEQ ID NO: 445581 - DNA, 20 bp, mouse
gaacagctccagccgcagcc

SEQ ID NO: 445582 - DNA, 20 bp, mouse
ggcaaggtctcttctacctg

SEQ ID NO: 445583 - DNA, 20 bp, mouse
ggcggtgatggccgagtcct

SEQ ID NO: 445584 - DNA, 20 bp, mouse
gacctgcgccggtgagagac

SEQ ID NO: 445585 - DNA, 20 bp, mouse
gcctccgcgatcagagaccg

SEQ ID NO: 445586 - DNA, 20 bp, mouse
gcggccaccttgcagtctga

SEQ ID NO: 445587 - DNA, 20 bp, mouse
gctgccctcagactgcaagg

SEQ ID NO: 445588 - DNA, 20 bp, mouse
ggaaatcgctataacaaaaa

SEQ ID NO: 445589 - DNA, 20 bp, mouse
gccctggagtcaggcgctca

SEQ ID NO: 445590 - DNA, 20 bp, mouse
gtgcgtccgggctgtccctc

SEQ ID NO: 445591 - DNA, 20 bp, mouse
ggacttcactgagaggccag

SEQ ID NO: 445592 - DNA, 20 bp, mouse
ggtccgggctgtccctcggg

SEQ ID NO: 445593 - DNA, 20 bp, mouse
gtcggtctcccggggcctga

SEQ ID NO: 445594 - DNA, 20 bp, mouse
gcagtgaagtcggtctcccg

SEQ ID NO: 445595 - DNA, 20 bp, mouse
gcaatgcaaaccaaatccac

SEQ ID NO: 445596 - DNA, 20 bp, mouse
gagtgactgtgctcatgctc

SEQ ID NO: 445597 - DNA, 20 bp, mouse
gctggagcagagcctcgggt

SEQ ID NO: 445598 - DNA, 20 bp, mouse
gcactgggacccaactccac

SEQ ID NO: 445599 - DNA, 20 bp, mouse
ggggcgtggccagtggagtt

SEQ ID NO: 445600 - DNA, 20 bp, mouse
gcgcatgcgtccgggctggg

SEQ ID NO: 445601 - DNA, 20 bp, mouse
gatgcggtctgcagaaggag

SEQ ID NO: 445602 - DNA, 20 bp, mouse
ggctgacagtaattagcact

SEQ ID NO: 445603 - DNA, 20 bp, mouse
gtaactgactctgaggctgc

SEQ ID NO: 445604 - DNA, 20 bp, mouse
gtctgaaaagtgtatagtgc

SEQ ID NO: 445605 - DNA, 20 bp, mouse
ggaccgcattctctgagaga

SEQ ID NO: 445606 - DNA, 20 bp, mouse
ggagtggtgagacaggctgt

SEQ ID NO: 445607 - DNA, 20 bp, mouse
gtggtttgaacactagaata

SEQ ID NO: 445608 - DNA, 20 bp, mouse
gggcctcaggcagtggtatt

SEQ ID NO: 445609 - DNA, 20 bp, mouse
gcagaggaggcaagtgtctg

SEQ ID NO: 445610 - DNA, 20 bp, mouse
gaagatgcctgaatcaggat

SEQ ID NO: 445611 - DNA, 20 bp, mouse
gccagcatcaagttgaacaa

SEQ ID NO: 445612 - DNA, 20 bp, mouse
ggctaatcttgtcacagagg

SEQ ID NO: 445613 - DNA, 20 bp, mouse
gaaccaaataccactgcctg

SEQ ID NO: 445614 - DNA, 20 bp, mouse
gcaaatgaccaaaggcccag

SEQ ID NO: 445615 - DNA, 20 bp, mouse
gtcaaggcaaactccaaata

SEQ ID NO: 445616 - DNA, 20 bp, mouse
gagaacagaaagggcaccac

SEQ ID NO: 445617 - DNA, 20 bp, mouse
gagaggcgtgagacactcac

SEQ ID NO: 445618 - DNA, 20 bp, mouse
ggggtgagacaagccatcgg

SEQ ID NO: 445619 - DNA, 20 bp, mouse
gctgagaacaagaacagaaa

SEQ ID NO: 445620 - DNA, 20 bp, mouse
gcacgggtgagacaagccat

SEQ ID NO: 445621 - DNA, 20 bp, mouse
ggagacggttgtgccaccga

SEQ ID NO: 445622 - DNA, 20 bp, mouse
ggctactcacgcctgcccat

SEQ ID NO: 445623 - DNA, 20 bp, mouse
gccaggatggcacttcctat

SEQ ID NO: 445624 - DNA, 20 bp, mouse
gccctagcacgagctgtagg

SEQ ID NO: 445625 - DNA, 20 bp, mouse
ggagagagtgcgcagcacac

SEQ ID NO: 445626 - DNA, 20 bp, mouse
gcagggggcacgggagacgg

SEQ ID NO: 445627 - DNA, 20 bp, mouse
gacccgggggacgtccgtgg

SEQ ID NO: 445628 - DNA, 20 bp, mouse
gcggcgggcggagatctacc

SEQ ID NO: 445629 - DNA, 20 bp, mouse
gagccacccgcagaaggtgt

SEQ ID NO: 445630 - DNA, 20 bp, mouse
gtaggcgagtcagagtccag

SEQ ID NO: 445631 - DNA, 20 bp, mouse
ggagtccagaggacgcacgg

SEQ ID NO: 445632 - DNA, 20 bp, mouse
gagatggcaaaaccaggtaa

SEQ ID NO: 445633 - DNA, 20 bp, mouse
gggatcccgggacgcacgga

SEQ ID NO: 445634 - DNA, 20 bp, mouse
gtgcgtggtgggtactcggt

SEQ ID NO: 445635 - DNA, 20 bp, mouse
ggggaatcggcgctgtgcag

SEQ ID NO: 445636 - DNA, 20 bp, mouse
gagacacacagggagccgca

SEQ ID NO: 445637 - DNA, 20 bp, mouse
gctagcaagatcagacacac

SEQ ID NO: 445638 - DNA, 20 bp, mouse
gggaactggtgtagcctagc

SEQ ID NO: 445639 - DNA, 20 bp, mouse
gtaggtgtcatcgtgaagga

SEQ ID NO: 445640 - DNA, 20 bp, mouse
gctgaaagcccaaggaacag

SEQ ID NO: 445641 - DNA, 20 bp, mouse
gaaggatggcaggagagtaa

SEQ ID NO: 445642 - DNA, 20 bp, mouse
gccagggtgagggccaacag

SEQ ID NO: 445643 - DNA, 20 bp, mouse
gggcaaaggggattggattg

SEQ ID NO: 445644 - DNA, 20 bp, mouse
gaaggggattggattgagga

SEQ ID NO: 445645 - DNA, 20 bp, mouse
gcgagggtggaggtggtcca

SEQ ID NO: 445646 - DNA, 20 bp, mouse
gagtcgccagggaccttgag

SEQ ID NO: 445647 - DNA, 20 bp, mouse
ggtccctggcgactctcaag

SEQ ID NO: 445648 - DNA, 20 bp, mouse
ggaccacttgagagtcgcca

SEQ ID NO: 445649 - DNA, 20 bp, mouse
gctccagctacatctctccg

SEQ ID NO: 445650 - DNA, 20 bp, mouse
ggtccacggagagatgtagc

SEQ ID NO: 445651 - DNA, 20 bp, mouse
gagaatggagagattatcag

SEQ ID NO: 445652 - DNA, 20 bp, mouse
gtttttcccctcaaggtccc

SEQ ID NO: 445653 - DNA, 20 bp, mouse
gtgtggaatagagcggagaa

SEQ ID NO: 445654 - DNA, 20 bp, mouse
gttcagtgtcttgatctcgg

SEQ ID NO: 445655 - DNA, 20 bp, mouse
gctcttcacatctggagaga

SEQ ID NO: 445656 - DNA, 20 bp, mouse
gtaatgtgttgtagccagag

SEQ ID NO: 445657 - DNA, 20 bp, mouse
ggtagccagagtggctgatt

SEQ ID NO: 445658 - DNA, 20 bp, mouse
gagtcatgacgcccaaatcc

SEQ ID NO: 445659 - DNA, 20 bp, mouse
gccctgagaggaagaaacag

SEQ ID NO: 445660 - DNA, 20 bp, mouse
gtgagccaaatcagccactc

SEQ ID NO: 445661 - DNA, 20 bp, mouse
gggctcagatcacctggatt

SEQ ID NO: 445662 - DNA, 20 bp, mouse
gggccaacccttccccaggt

SEQ ID NO: 445663 - DNA, 20 bp, mouse
gcatctcacacacccacctg

SEQ ID NO: 445664 - DNA, 20 bp, mouse
gacggagctgggactattcc

SEQ ID NO: 445665 - DNA, 20 bp, mouse
gtcagggccaacccttcccc

SEQ ID NO: 445666 - DNA, 20 bp, mouse
gcccgctccagcgaacccag

SEQ ID NO: 445667 - DNA, 20 bp, mouse
gggcaagggcgaccttcctc

SEQ ID NO: 445668 - DNA, 20 bp, mouse
ggtgcagggatgccggagga

SEQ ID NO: 445669 - DNA, 20 bp, mouse
gttccgtgcagggatgccgg

SEQ ID NO: 445670 - DNA, 20 bp, mouse
gaggttctaagggcaggtca

SEQ ID NO: 445671 - DNA, 20 bp, mouse
gcatccctgcacggaagcag

SEQ ID NO: 445672 - DNA, 20 bp, mouse
gcagcagcagccatggccat

SEQ ID NO: 445673 - DNA, 20 bp, mouse
ggaaggtcgcccttgcccct

SEQ ID NO: 445674 - DNA, 20 bp, mouse
gtctaagggcaggtcaaggc

SEQ ID NO: 445675 - DNA, 20 bp, mouse
ggacatccccgaggttctaa

SEQ ID NO: 445676 - DNA, 20 bp, mouse
gccagggaggtgtgggccag

SEQ ID NO: 445677 - DNA, 20 bp, mouse
gagaactcaatgctgaagag

SEQ ID NO: 445678 - DNA, 20 bp, mouse
ggcagaggcgcccagggcta

SEQ ID NO: 445679 - DNA, 20 bp, mouse
gctgtgaagcagaggcgccc

SEQ ID NO: 445680 - DNA, 20 bp, mouse
gggatgaagacactctctgt

SEQ ID NO: 445681 - DNA, 20 bp, mouse
gctagcggacaaagcaggta

SEQ ID NO: 445682 - DNA, 20 bp, mouse
gcatctaaccatctaggaca

SEQ ID NO: 445683 - DNA, 20 bp, mouse
gaatgagttctgtggagtgg

SEQ ID NO: 445684 - DNA, 20 bp, mouse
ggacacttgcacattctcgt

SEQ ID NO: 445685 - DNA, 20 bp, mouse
ggtgagttccccatcttcat

SEQ ID NO: 445686 - DNA, 20 bp, mouse
gcgcctgtgggaaaaactag

SEQ ID NO: 445687 - DNA, 20 bp, mouse
gaggtcgcgttggtcatcca

SEQ ID NO: 445688 - DNA, 20 bp, mouse
gcagcagcagcagcgcctgt

SEQ ID NO: 445689 - DNA, 20 bp, mouse
gctgtgtcctccagaggtaa

SEQ ID NO: 445690 - DNA, 20 bp, mouse
gcagcgctcaaggtcactca

SEQ ID NO: 445691 - DNA, 20 bp, mouse
gaggtgatcttggggctcaa

SEQ ID NO: 445692 - DNA, 20 bp, mouse
gtagggcggttgcccagtat

SEQ ID NO: 445693 - DNA, 20 bp, mouse
gagagagcccttacctctgg

SEQ ID NO: 445694 - DNA, 20 bp, mouse
gagcagagagcccttacctc

SEQ ID NO: 445695 - DNA, 20 bp, mouse
ggttagagatgaggtcgcgt

SEQ ID NO: 445696 - DNA, 20 bp, mouse
gtgagggcttctagaccccc

SEQ ID NO: 445697 - DNA, 20 bp, mouse
gcactgggagacgatgccag

SEQ ID NO: 445698 - DNA, 20 bp, mouse
gggcagggtgatgcataacg

SEQ ID NO: 445699 - DNA, 20 bp, mouse
ggcatcgtctcccagtgagt

SEQ ID NO: 445700 - DNA, 20 bp, mouse
ggtgttgcggctgacaggag

SEQ ID NO: 445701 - DNA, 20 bp, mouse
gccaaactaaccgactcact

SEQ ID NO: 445702 - DNA, 20 bp, mouse
ggtagtgttggtcctaacag

SEQ ID NO: 445703 - DNA, 20 bp, mouse
gatctggtacctcaaggcta

SEQ ID NO: 445704 - DNA, 20 bp, mouse
ggccgtctgtagctagccac

SEQ ID NO: 445705 - DNA, 20 bp, mouse
gttggccacattacccaaac

SEQ ID NO: 445706 - DNA, 20 bp, mouse
gctctgagcccaaggaggtt

SEQ ID NO: 445707 - DNA, 20 bp, mouse
gtgagcccaaggaggtttgg

SEQ ID NO: 445708 - DNA, 20 bp, mouse
gttcgcccccaaacctcctt

SEQ ID NO: 445709 - DNA, 20 bp, mouse
ggagagaccgaaatgagaca

SEQ ID NO: 445710 - DNA, 20 bp, mouse
gctgggcacaggacagttag

SEQ ID NO: 445711 - DNA, 20 bp, mouse
gaacagccagtggcagggca

SEQ ID NO: 445712 - DNA, 20 bp, mouse
gatggaagacagcaccagtg

SEQ ID NO: 445713 - DNA, 20 bp, mouse
gaggagacaagctgcagccc

SEQ ID NO: 445714 - DNA, 20 bp, mouse
gtgtaactgtatgtcagcct

SEQ ID NO: 445715 - DNA, 20 bp, mouse
gctcatgggcagctatgacc

SEQ ID NO: 445716 - DNA, 20 bp, mouse
gtcgtaagatagagctactg

SEQ ID NO: 445717 - DNA, 20 bp, mouse
gtggagcttaggcacctcct

SEQ ID NO: 445718 - DNA, 20 bp, mouse
gtctagagccaatggagctt

SEQ ID NO: 445719 - DNA, 20 bp, mouse
ggagtgagagttctgaatca

SEQ ID NO: 445720 - DNA, 20 bp, mouse
gggccatgagggcaactcaa

SEQ ID NO: 445721 - DNA, 20 bp, mouse
gagcctggatggcatccacc

SEQ ID NO: 445722 - DNA, 20 bp, mouse
gtgctttggagaacatgatg

SEQ ID NO: 445723 - DNA, 20 bp, mouse
gtggaacagagtgtctttga

SEQ ID NO: 445724 - DNA, 20 bp, mouse
gagagttctgaatcagggtg

SEQ ID NO: 445725 - DNA, 20 bp, mouse
ggccatagcttcagatgctt

SEQ ID NO: 445726 - DNA, 20 bp, mouse
gtgagacgtagggtagagaa

SEQ ID NO: 445727 - DNA, 20 bp, mouse
gttgcggagaatgagacgta

SEQ ID NO: 445728 - DNA, 20 bp, mouse
ggaagggctggaggcctagc

SEQ ID NO: 445729 - DNA, 20 bp, mouse
gaagttgcggcgccacctgt

SEQ ID NO: 445730 - DNA, 20 bp, mouse
ggactctcgcgcctccggct

SEQ ID NO: 445731 - DNA, 20 bp, mouse
gtcggaggggcgggacctag

SEQ ID NO: 445732 - DNA, 20 bp, mouse
gaggacgcgctcgctcggac

SEQ ID NO: 445733 - DNA, 20 bp, mouse
gtagaggtctataaagagtg

SEQ ID NO: 445734 - DNA, 20 bp, mouse
gaccccacggtagccaggct

SEQ ID NO: 445735 - DNA, 20 bp, mouse
ggggccggagaactgcgttg

SEQ ID NO: 445736 - DNA, 20 bp, mouse
ggcgcagtcagactcgggtt

SEQ ID NO: 445737 - DNA, 20 bp, mouse
gaagcgcgtagccagaaccc

SEQ ID NO: 445738 - DNA, 20 bp, mouse
ggggcgccagctgaagacgc

SEQ ID NO: 445739 - DNA, 20 bp, mouse
gcaagctgcgcagtcagact

SEQ ID NO: 445740 - DNA, 20 bp, mouse
gtagggagttcgggactcgg

SEQ ID NO: 445741 - DNA, 20 bp, mouse
gtaacaggtgacagtcacag

SEQ ID NO: 445742 - DNA, 20 bp, mouse
gggacaggcccggggccaca

SEQ ID NO: 445743 - DNA, 20 bp, mouse
ggggtggcgggggaaaacgg

SEQ ID NO: 445744 - DNA, 20 bp, mouse
gcccccaggcttctcttacc

SEQ ID NO: 445745 - DNA, 20 bp, mouse
ggcttccgagcggaatgtga

SEQ ID NO: 445746 - DNA, 20 bp, mouse
gagctggaggccttgcgaca

SEQ ID NO: 445747 - DNA, 20 bp, mouse
ggcctagaaacaggagctgg

SEQ ID NO: 445748 - DNA, 20 bp, mouse
gcgtaccgcagcctagaaac

SEQ ID NO: 445749 - DNA, 20 bp, mouse
ggagcgctgcgacactgtcc

SEQ ID NO: 445750 - DNA, 20 bp, mouse
ggcctccagctcctgtttct

SEQ ID NO: 445751 - DNA, 20 bp, mouse
ggctgtgcaaggcaagtcgg

SEQ ID NO: 445752 - DNA, 20 bp, mouse
gcgggtagcaccgagcgatc

SEQ ID NO: 445753 - DNA, 20 bp, mouse
gatggcgatgcgggaggtga

SEQ ID NO: 445754 - DNA, 20 bp, mouse
gggcgctgtgcaaggcaagt

SEQ ID NO: 445755 - DNA, 20 bp, mouse
gagcacggcgcgcgcccagg

SEQ ID NO: 445756 - DNA, 20 bp, mouse
gcatggcccagcgccatctg

SEQ ID NO: 445757 - DNA, 20 bp, mouse
gcagaagactggagtctgac

SEQ ID NO: 445758 - DNA, 20 bp, mouse
gaaggaaccagatccacaga

SEQ ID NO: 445759 - DNA, 20 bp, mouse
gaacaaggttcagaactcac

SEQ ID NO: 445760 - DNA, 20 bp, mouse
gggtctcactctagttcagt

SEQ ID NO: 445761 - DNA, 20 bp, mouse
gtcagaactcacaggtttgt

SEQ ID NO: 445762 - DNA, 20 bp, mouse
gctcacaggtttgtaggcaa

SEQ ID NO: 445763 - DNA, 20 bp, mouse
gccagcgccatctgtggatc

SEQ ID NO: 445764 - DNA, 20 bp, mouse
gtaggacttcaatactaaca

SEQ ID NO: 445765 - DNA, 20 bp, mouse
gcgtttcagcagaatttcct

SEQ ID NO: 445766 - DNA, 20 bp, mouse
ggcaagcagacgcgtaagag

SEQ ID NO: 445767 - DNA, 20 bp, mouse
gtcattgctgaggaagaaag

SEQ ID NO: 445768 - DNA, 20 bp, mouse
gtgcacacgagagctgtcta

SEQ ID NO: 445769 - DNA, 20 bp, mouse
gacacgagagctgtctaggg

SEQ ID NO: 445770 - DNA, 20 bp, mouse
gagttctggaacacgtctac

SEQ ID NO: 445771 - DNA, 20 bp, mouse
gaccatctggggtccatcgt

SEQ ID NO: 445772 - DNA, 20 bp, mouse
gtcaagtccgtgctgcctac

SEQ ID NO: 445773 - DNA, 20 bp, mouse
gcaatgactgtgtaccctgg

SEQ ID NO: 445774 - DNA, 20 bp, mouse
ggaacacgtctacaggagtc

SEQ ID NO: 445775 - DNA, 20 bp, mouse
gagtgagagcgcagaaggga

SEQ ID NO: 445776 - DNA, 20 bp, mouse
ggcgacagaaagcgggtcaa

SEQ ID NO: 445777 - DNA, 20 bp, mouse
ggctggtggagagcacacca

SEQ ID NO: 445778 - DNA, 20 bp, mouse
ggaggggcccaggaacaggg

SEQ ID NO: 445779 - DNA, 20 bp, mouse
gggtcaagctagggctctag

SEQ ID NO: 445780 - DNA, 20 bp, mouse
gagaaagcgggtcaacggtg

SEQ ID NO: 445781 - DNA, 20 bp, mouse
gagcagcttaggtcaagcta

SEQ ID NO: 445782 - DNA, 20 bp, mouse
gcaggttcagcgacagaaag

SEQ ID NO: 445783 - DNA, 20 bp, mouse
ggacctaagctgcttgctgg

SEQ ID NO: 445784 - DNA, 20 bp, mouse
gcgggtcaacggtgaggcca

SEQ ID NO: 445785 - DNA, 20 bp, mouse
gctccaccagcaagcagctt

SEQ ID NO: 445786 - DNA, 20 bp, mouse
ggagaggtctgagacgccca

SEQ ID NO: 445787 - DNA, 20 bp, mouse
gtaggcagagaccctgaacc

SEQ ID NO: 445788 - DNA, 20 bp, mouse
gttcagttgacagagcactg

SEQ ID NO: 445789 - DNA, 20 bp, mouse
gacctctctgggtagtgaga

SEQ ID NO: 445790 - DNA, 20 bp, mouse
ggagccagcttgggcgggtg

SEQ ID NO: 445791 - DNA, 20 bp, mouse
ggtcaactgaaaggtaggtt

SEQ ID NO: 445792 - DNA, 20 bp, mouse
gagcaacaggaggaatagac

SEQ ID NO: 445793 - DNA, 20 bp, mouse
ggcgctgggctgtgagaaca

SEQ ID NO: 445794 - DNA, 20 bp, mouse
gggcaggtaagacccagagt

SEQ ID NO: 445795 - DNA, 20 bp, mouse
ggtaggttaggagccagctt

SEQ ID NO: 445796 - DNA, 20 bp, mouse
gaaccgactgagacacgctg

SEQ ID NO: 445797 - DNA, 20 bp, mouse
gagccgcagcgtgtctcagt

SEQ ID NO: 445798 - DNA, 20 bp, mouse
gggccgagcgccgtaaggag

SEQ ID NO: 445799 - DNA, 20 bp, mouse
gtgagacacgctgcggctag

SEQ ID NO: 445800 - DNA, 20 bp, mouse
gtccggggcggagagtgtcc

SEQ ID NO: 445801 - DNA, 20 bp, mouse
gctggcgcgcgcagtaccag

SEQ ID NO: 445802 - DNA, 20 bp, mouse
gtctcgggcctgagaacagg

SEQ ID NO: 445803 - DNA, 20 bp, mouse
gagaacaggtggcctcggag

SEQ ID NO: 445804 - DNA, 20 bp, mouse
gcccgagacggcgtccgggg

SEQ ID NO: 445805 - DNA, 20 bp, mouse
gacacgctgcggctaggggc

SEQ ID NO: 445806 - DNA, 20 bp, mouse
gcaccaggctgtgctctgaa

SEQ ID NO: 445807 - DNA, 20 bp, mouse
ggtcttcaggagctgagtca

SEQ ID NO: 445808 - DNA, 20 bp, mouse
ggaacctggaccttgacacc

SEQ ID NO: 445809 - DNA, 20 bp, mouse
ggtcaaggtccaggttccac

SEQ ID NO: 445810 - DNA, 20 bp, mouse
ggaggggctagactcccctg

SEQ ID NO: 445811 - DNA, 20 bp, mouse
gagcagcagccggtggaacc

SEQ ID NO: 445812 - DNA, 20 bp, mouse
gtcgggctccagcgagagaa

SEQ ID NO: 445813 - DNA, 20 bp, mouse
gtcctcctcactcttcacgg

SEQ ID NO: 445814 - DNA, 20 bp, mouse
gggggctgctgctgattcac

SEQ ID NO: 445815 - DNA, 20 bp, mouse
gcagcctggtgtcaaggtcc

SEQ ID NO: 445816 - DNA, 20 bp, mouse
gtgagctcttcgggagacaa

SEQ ID NO: 445817 - DNA, 20 bp, mouse
ggcatttctgtaatgatcac

SEQ ID NO: 445818 - DNA, 20 bp, mouse
gaatgctggcgtgagctctt

SEQ ID NO: 445819 - DNA, 20 bp, mouse
gtttttgagcacgaataggg

SEQ ID NO: 445820 - DNA, 20 bp, mouse
gtgcaggagtcgatcactga

SEQ ID NO: 445821 - DNA, 20 bp, mouse
gtggatcattataaagacaa

SEQ ID NO: 445822 - DNA, 20 bp, mouse
gaggtttttgagcacgaata

SEQ ID NO: 445823 - DNA, 20 bp, mouse
gtgtcagttagctgcttaag

SEQ ID NO: 445824 - DNA, 20 bp, mouse
gcagtcttgaagcatttcaa

SEQ ID NO: 445825 - DNA, 20 bp, mouse
ggaaggacaagctgttgcta

SEQ ID NO: 445826 - DNA, 20 bp, mouse
gcgtgccgcgccaccatgag

SEQ ID NO: 445827 - DNA, 20 bp, mouse
gggtctcaccaagcaggccg

SEQ ID NO: 445828 - DNA, 20 bp, mouse
gagcgtctggggttgataga

SEQ ID NO: 445829 - DNA, 20 bp, mouse
gacggaacggacagcgtctg

SEQ ID NO: 445830 - DNA, 20 bp, mouse
gccggctccgcgcaaccccg

SEQ ID NO: 445831 - DNA, 20 bp, mouse
ggtgtcacagggcattaggg

SEQ ID NO: 445832 - DNA, 20 bp, mouse
ggggcatctgacgcccctca

SEQ ID NO: 445833 - DNA, 20 bp, mouse
gccccgaggtctcaccaagc

SEQ ID NO: 445834 - DNA, 20 bp, mouse
ggccagtttggagactaaga

SEQ ID NO: 445835 - DNA, 20 bp, mouse
ggagccgggagggaactcgc

SEQ ID NO: 445836 - DNA, 20 bp, mouse
gggtggccaaggagaaaacg

SEQ ID NO: 445837 - DNA, 20 bp, mouse
gtggctgggagcaggcgcag

SEQ ID NO: 445838 - DNA, 20 bp, mouse
gtagcgcaggagggcccgag

SEQ ID NO: 445839 - DNA, 20 bp, mouse
gggagaaaacgaggcaaacg

SEQ ID NO: 445840 - DNA, 20 bp, mouse
gcgcctggctgacccgatgg

SEQ ID NO: 445841 - DNA, 20 bp, mouse
gggtcagccaggcggagaca

SEQ ID NO: 445842 - DNA, 20 bp, mouse
gctctggacaagggtggcca

SEQ ID NO: 445843 - DNA, 20 bp, mouse
ggagcgacccccaggccaca

SEQ ID NO: 445844 - DNA, 20 bp, mouse
gttcccaaggtacactccta

SEQ ID NO: 445845 - DNA, 20 bp, mouse
gggaggagcacagttagcgc

SEQ ID NO: 445846 - DNA, 20 bp, mouse
gcacccgcctcggaccgaca

SEQ ID NO: 445847 - DNA, 20 bp, mouse
ggctggtcgctgcagaggag

SEQ ID NO: 445848 - DNA, 20 bp, mouse
gggtgagctggtcgctgcag

SEQ ID NO: 445849 - DNA, 20 bp, mouse
ggtcgccggagtccactctg

SEQ ID NO: 445850 - DNA, 20 bp, mouse
ggggccatgtcggtccgagg

SEQ ID NO: 445851 - DNA, 20 bp, mouse
gggagcccgagcacgtccag

SEQ ID NO: 445852 - DNA, 20 bp, mouse
gacagcctcggtgagagcag

SEQ ID NO: 445853 - DNA, 20 bp, mouse
ggcacaggaggggcgttcct

SEQ ID NO: 445854 - DNA, 20 bp, mouse
ggcgaccagctcacccgcct

SEQ ID NO: 445855 - DNA, 20 bp, mouse
gcggtccgaggcgggtgagc

SEQ ID NO: 445856 - DNA, 20 bp, mouse
gttgcccggtcaggcatgat

SEQ ID NO: 445857 - DNA, 20 bp, mouse
gggttgttgacaggccgcag

SEQ ID NO: 445858 - DNA, 20 bp, mouse
gcaggacagcttgcccggtc

SEQ ID NO: 445859 - DNA, 20 bp, mouse
gaggccgcagaggtggccgt

SEQ ID NO: 445860 - DNA, 20 bp, mouse
ggttccttgaagctcgccta

SEQ ID NO: 445861 - DNA, 20 bp, mouse
gctgtgcggagacacaggac

SEQ ID NO: 445862 - DNA, 20 bp, mouse
gagaacaagcggttgttgac

SEQ ID NO: 445863 - DNA, 20 bp, mouse
gcgcagacgggcagcatgac

SEQ ID NO: 445864 - DNA, 20 bp, mouse
ggaacctatcatgcctgacc

SEQ ID NO: 445865 - DNA, 20 bp, mouse
gctggcaaggagaccaggga

SEQ ID NO: 445866 - DNA, 20 bp, mouse
gaccgcacggcggctgcgac

SEQ ID NO: 445867 - DNA, 20 bp, mouse
gcgcagcagcgactctaaaa

SEQ ID NO: 445868 - DNA, 20 bp, mouse
ggcctcagagcgcctgcaca

SEQ ID NO: 445869 - DNA, 20 bp, mouse
ggagtcgctgctgcgcgaag

SEQ ID NO: 445870 - DNA, 20 bp, mouse
gctgctgcgcgaagaggtgc

SEQ ID NO: 445871 - DNA, 20 bp, mouse
gctgcgcgcgatccaccgca

SEQ ID NO: 445872 - DNA, 20 bp, mouse
gtgacagcgcgggccgtcag

SEQ ID NO: 445873 - DNA, 20 bp, mouse
gcgcgcgatccaccgcacgg

SEQ ID NO: 445874 - DNA, 20 bp, mouse
gagggtgggcggcccggcag

SEQ ID NO: 445875 - DNA, 20 bp, mouse
gccacctcggagctatcctg

SEQ ID NO: 445876 - DNA, 20 bp, mouse
gggaaaggcggctattgacg

SEQ ID NO: 445877 - DNA, 20 bp, mouse
ggagcgagtcgagggaggta

SEQ ID NO: 445878 - DNA, 20 bp, mouse
gcagggttccgggagagggc

SEQ ID NO: 445879 - DNA, 20 bp, mouse
gccgcaggccttctactcag

SEQ ID NO: 445880 - DNA, 20 bp, mouse
ggcggtgggggtcctcggta

SEQ ID NO: 445881 - DNA, 20 bp, mouse
gtgcgcagggttccgggaga

SEQ ID NO: 445882 - DNA, 20 bp, mouse
gcggaaaagtgggtaccacg

SEQ ID NO: 445883 - DNA, 20 bp, mouse
ggaagtgctgcgcagggttc

SEQ ID NO: 445884 - DNA, 20 bp, mouse
gatctgagtccgcagagaag

SEQ ID NO: 445885 - DNA, 20 bp, mouse
gggtaaggcttcggaaaagt

SEQ ID NO: 445886 - DNA, 20 bp, mouse
ggcgcccgtggccactcgtg

SEQ ID NO: 445887 - DNA, 20 bp, mouse
ggcagcgggcaggactccgg

SEQ ID NO: 445888 - DNA, 20 bp, mouse
ggcggcagcgggcaggactc

SEQ ID NO: 445889 - DNA, 20 bp, mouse
gctagccccgcggacacctc

SEQ ID NO: 445890 - DNA, 20 bp, mouse
gcgcagagtccggatcacag

SEQ ID NO: 445891 - DNA, 20 bp, mouse
gctgccgcacgagtggccac

SEQ ID NO: 445892 - DNA, 20 bp, mouse
ggactccggaggtgtccgcg

SEQ ID NO: 445893 - DNA, 20 bp, mouse
ggctcccaaagtgatcatgg

SEQ ID NO: 445894 - DNA, 20 bp, mouse
gaggcagtcgcccaaggcgg

SEQ ID NO: 445895 - DNA, 20 bp, mouse
gcactcgtgcggcagcgggc

SEQ ID NO: 445896 - DNA, 20 bp, mouse
gcacggaacatccctcctgg

SEQ ID NO: 445897 - DNA, 20 bp, mouse
gccgtggcgtccgagctcag

SEQ ID NO: 445898 - DNA, 20 bp, mouse
gagccggtaggccccgagga

SEQ ID NO: 445899 - DNA, 20 bp, mouse
gccacggcagcagcgtccca

SEQ ID NO: 445900 - DNA, 20 bp, mouse
gcccgagccggtaggccccg

SEQ ID NO: 445901 - DNA, 20 bp, mouse
gacctgtacctggacatcac

SEQ ID NO: 445902 - DNA, 20 bp, mouse
gtaggccccgaggagggttg

SEQ ID NO: 445903 - DNA, 20 bp, mouse
gggaggcgcgagcctcgtgg

SEQ ID NO: 445904 - DNA, 20 bp, mouse
gagacgcagcgcgaggaccc

SEQ ID NO: 445905 - DNA, 20 bp, mouse
gtcgctcttacgcttcatgg

SEQ ID NO: 445906 - DNA, 20 bp, mouse
gaagggccgcgcccatgcat

SEQ ID NO: 445907 - DNA, 20 bp, mouse
gcgtttccgtgcccatgcat

SEQ ID NO: 445908 - DNA, 20 bp, mouse
gcatgggcacggaaacgccc

SEQ ID NO: 445909 - DNA, 20 bp, mouse
gtgatggccgaggtgatccg

SEQ ID NO: 445910 - DNA, 20 bp, mouse
gtgctgcttgtcacccgcca

SEQ ID NO: 445911 - DNA, 20 bp, mouse
ggggtgacaagcagcagact

SEQ ID NO: 445912 - DNA, 20 bp, mouse
gttggagtcatgagacggga

SEQ ID NO: 445913 - DNA, 20 bp, mouse
gggcacggaaacgccctggc

SEQ ID NO: 445914 - DNA, 20 bp, mouse
gaaaaacagtgaagtttaaa

SEQ ID NO: 445915 - DNA, 20 bp, mouse
gatgaccgcgacggacggac

SEQ ID NO: 445916 - DNA, 20 bp, mouse
gggcgcgcggaggctcgaga

SEQ ID NO: 445917 - DNA, 20 bp, mouse
ggtctggtccgggcggtggt

SEQ ID NO: 445918 - DNA, 20 bp, mouse
gggcgcgcggggtctggtcc

SEQ ID NO: 445919 - DNA, 20 bp, mouse
gtgggtccctcgacaccccg

SEQ ID NO: 445920 - DNA, 20 bp, mouse
gtcggagcggaagtgccgtg

SEQ ID NO: 445921 - DNA, 20 bp, mouse
gtggtccgggcggtggtcgg

SEQ ID NO: 445922 - DNA, 20 bp, mouse
gcgcgcccccggggtgtcga

SEQ ID NO: 445923 - DNA, 20 bp, mouse
gaagcccgccgaccaccgcc

SEQ ID NO: 445924 - DNA, 20 bp, mouse
gccagaccccgcgcgccaca

SEQ ID NO: 445925 - DNA, 20 bp, mouse
gccactcgagagcagcgcgg

SEQ ID NO: 445926 - DNA, 20 bp, mouse
gacgcgctgcgaggagctgg

SEQ ID NO: 445927 - DNA, 20 bp, mouse
gtgttcgggagagctgagta

SEQ ID NO: 445928 - DNA, 20 bp, mouse
ggggagagctgagtacggag

SEQ ID NO: 445929 - DNA, 20 bp, mouse
gctgagtacggagagggacc

SEQ ID NO: 445930 - DNA, 20 bp, mouse
ggagtttaagaacaacagtc

SEQ ID NO: 445931 - DNA, 20 bp, mouse
gaccgggctgctgcgagctg

SEQ ID NO: 445932 - DNA, 20 bp, mouse
ggtctggaaaagaacgcgtt

SEQ ID NO: 445933 - DNA, 20 bp, mouse
gagccaatgaacgctagcag

SEQ ID NO: 445934 - DNA, 20 bp, mouse
gagacaagctaaggacacgc

SEQ ID NO: 445935 - DNA, 20 bp, mouse
ggcctgacgaggctcccgga

SEQ ID NO: 445936 - DNA, 20 bp, mouse
gggaggagcgagggtctcgg

SEQ ID NO: 445937 - DNA, 20 bp, mouse
ggagggtctcgggggtagga

SEQ ID NO: 445938 - DNA, 20 bp, mouse
gtcctggagcgtattcccca

SEQ ID NO: 445939 - DNA, 20 bp, mouse
ggccttgcctctccccctca

SEQ ID NO: 445940 - DNA, 20 bp, mouse
ggaagccccatgggagggtt

SEQ ID NO: 445941 - DNA, 20 bp, mouse
ggcccggaggaagatccgga

SEQ ID NO: 445942 - DNA, 20 bp, mouse
gtggcctgtggcgggaccga

SEQ ID NO: 445943 - DNA, 20 bp, mouse
gctagcggtttgggaagtcg

SEQ ID NO: 445944 - DNA, 20 bp, mouse
gtccgtccggatcttcctcc

SEQ ID NO: 445945 - DNA, 20 bp, mouse
gcactcactcggagatggag

SEQ ID NO: 445946 - DNA, 20 bp, mouse
gaattcttcggtagtctcgg

SEQ ID NO: 445947 - DNA, 20 bp, mouse
gcagggcgctgagtacccag

SEQ ID NO: 445948 - DNA, 20 bp, mouse
ggatacgcccggcaccgccg

SEQ ID NO: 445949 - DNA, 20 bp, mouse
gacgcccggcaccgccgtgg

SEQ ID NO: 445950 - DNA, 20 bp, mouse
gccgcgacagtggatacgcc

SEQ ID NO: 445951 - DNA, 20 bp, mouse
gaaaatggctgcgaattctt

SEQ ID NO: 445952 - DNA, 20 bp, mouse
gccgcctctgacagaggtaa

SEQ ID NO: 445953 - DNA, 20 bp, mouse
ggcggctgcagctccgacaa

SEQ ID NO: 445954 - DNA, 20 bp, mouse
gcagcgccctgtcactggag

SEQ ID NO: 445955 - DNA, 20 bp, mouse
ggcgaattcttcggtagtct

SEQ ID NO: 445956 - DNA, 20 bp, mouse
ggccggctacggagcaagga

SEQ ID NO: 445957 - DNA, 20 bp, mouse
gcgtagccggctcgcagaga

SEQ ID NO: 445958 - DNA, 20 bp, mouse
gaggcgccaggcacaagcac

SEQ ID NO: 445959 - DNA, 20 bp, mouse
ggaagacggagcgggagtcc

SEQ ID NO: 445960 - DNA, 20 bp, mouse
gaacgctaaggccactttgg

SEQ ID NO: 445961 - DNA, 20 bp, mouse
gcgcggaccggcgagcgtag

SEQ ID NO: 445962 - DNA, 20 bp, mouse
gtcagagacgcggccgccac

SEQ ID NO: 445963 - DNA, 20 bp, mouse
gccggcgagcgtaggggact

SEQ ID NO: 445964 - DNA, 20 bp, mouse
ggctgcaagcgaagaacagg

SEQ ID NO: 445965 - DNA, 20 bp, mouse
gattaacgctaaggccactt

SEQ ID NO: 445966 - DNA, 20 bp, mouse
gagagtgagcctggggtgag

SEQ ID NO: 445967 - DNA, 20 bp, mouse
gcaggactgagagctgaacc

SEQ ID NO: 445968 - DNA, 20 bp, mouse
gccggcgcagacttctgcag

SEQ ID NO: 445969 - DNA, 20 bp, mouse
gccggagaggaggaagctgt

SEQ ID NO: 445970 - DNA, 20 bp, mouse
gcgtgctgggtggcattcag

SEQ ID NO: 445971 - DNA, 20 bp, mouse
gcgaatatataaggaggtgg

SEQ ID NO: 445972 - DNA, 20 bp, mouse
gagagtggtaaccggagagg

SEQ ID NO: 445973 - DNA, 20 bp, mouse
ggtaagagtggtaaccggag

SEQ ID NO: 445974 - DNA, 20 bp, mouse
gtgcaggggtacctccatcg

SEQ ID NO: 445975 - DNA, 20 bp, mouse
gatttttcgaatatataagg

SEQ ID NO: 445976 - DNA, 20 bp, mouse
gaggaacagaagcgattctt

SEQ ID NO: 445977 - DNA, 20 bp, mouse
gctctccggagatggcctga

SEQ ID NO: 445978 - DNA, 20 bp, mouse
gaggcaaagccaacagccag

SEQ ID NO: 445979 - DNA, 20 bp, mouse
gcagaatgacaagggatctg

SEQ ID NO: 445980 - DNA, 20 bp, mouse
gccgggaactgtgtccatcc

SEQ ID NO: 445981 - DNA, 20 bp, mouse
gggtggaggagcatcccggt

SEQ ID NO: 445982 - DNA, 20 bp, mouse
gagcatcccggtaggatgaa

SEQ ID NO: 445983 - DNA, 20 bp, mouse
gacagacgtcaggcaagctc

SEQ ID NO: 445984 - DNA, 20 bp, mouse
gagccgggcactggaaaggg

SEQ ID NO: 445985 - DNA, 20 bp, mouse
gtgtgtccatcccggaatct

SEQ ID NO: 445986 - DNA, 20 bp, mouse
gcgcgggagaagaggagcat

SEQ ID NO: 445987 - DNA, 20 bp, mouse
gagcctgggaggtgtagttt

SEQ ID NO: 445988 - DNA, 20 bp, mouse
gagcccaaactacacctccc

SEQ ID NO: 445989 - DNA, 20 bp, mouse
ggtagccaccgagttacgag

SEQ ID NO: 445990 - DNA, 20 bp, mouse
gggggcccctcgtaactcgg

SEQ ID NO: 445991 - DNA, 20 bp, mouse
ggtcctctttcccagctcca

SEQ ID NO: 445992 - DNA, 20 bp, mouse
gagttacgaggggcccccga

SEQ ID NO: 445993 - DNA, 20 bp, mouse
gcacgacggaagtccttcgg

SEQ ID NO: 445994 - DNA, 20 bp, mouse
gataatctggaacaaaacga

SEQ ID NO: 445995 - DNA, 20 bp, mouse
ggcggatcgcaaccataatc

SEQ ID NO: 445996 - DNA, 20 bp, mouse
gcaccagcgaccgttaccgg

SEQ ID NO: 445997 - DNA, 20 bp, mouse
gagggcccgcgactaccagg

SEQ ID NO: 445998 - DNA, 20 bp, mouse
gggctggagccgctacgggg

SEQ ID NO: 445999 - DNA, 20 bp, mouse
gtgtctcgctcggaagagct

SEQ ID NO: 446000 - DNA, 20 bp, mouse
gggccgggctggagccgcta

SEQ ID NO: 446001 - DNA, 20 bp, mouse
ggactgccgagagaccggca

SEQ ID NO: 446002 - DNA, 20 bp, mouse
ggaccgttaccgggggatgg

SEQ ID NO: 446003 - DNA, 20 bp, mouse
ggaggcctggcgccaagcct

SEQ ID NO: 446004 - DNA, 20 bp, mouse
gcctgaggcactgcagaaag

SEQ ID NO: 446005 - DNA, 20 bp, mouse
ggcagggctcgccgaaaggg

SEQ ID NO: 446006 - DNA, 20 bp, mouse
ggccgaagcgagcgccgggc

SEQ ID NO: 446007 - DNA, 20 bp, mouse
ggcagcggcgccagagcgag

SEQ ID NO: 446008 - DNA, 20 bp, mouse
gcgccacccggggaccccga

SEQ ID NO: 446009 - DNA, 20 bp, mouse
ggcgagcgccgggcgggcag

SEQ ID NO: 446010 - DNA, 20 bp, mouse
gccgggccgaagcgagcgcc

SEQ ID NO: 446011 - DNA, 20 bp, mouse
gagccttcggggtccccggg

SEQ ID NO: 446012 - DNA, 20 bp, mouse
gagagcgagtggagccttcg

SEQ ID NO: 446013 - DNA, 20 bp, mouse
ggcccgcccggcgctcgctt

SEQ ID NO: 446014 - DNA, 20 bp, mouse
gtgcggcgcgcaggcgcgtt

SEQ ID NO: 446015 - DNA, 20 bp, mouse
ggcgcaggcgcgttaggcgc

SEQ ID NO: 446016 - DNA, 20 bp, mouse
gtctccgggcggcgcagaga

SEQ ID NO: 446017 - DNA, 20 bp, mouse
gggtagaaatgttctccacc

SEQ ID NO: 446018 - DNA, 20 bp, mouse
gaccagcggtccggccatgg

SEQ ID NO: 446019 - DNA, 20 bp, mouse
gtggtgaggaaccagaaggt

SEQ ID NO: 446020 - DNA, 20 bp, mouse
ggtgaagccttcagggtctc

SEQ ID NO: 446021 - DNA, 20 bp, mouse
ggcgagctcgcaggacggac

SEQ ID NO: 446022 - DNA, 20 bp, mouse
gtcacagaaggtgctgctac

SEQ ID NO: 446023 - DNA, 20 bp, mouse
gaccgccatggccggaccgc

SEQ ID NO: 446024 - DNA, 20 bp, mouse
ggagctgggcaccagcggtc

SEQ ID NO: 446025 - DNA, 20 bp, mouse
gccagcgcgagctcgcagga

SEQ ID NO: 446026 - DNA, 20 bp, mouse
ggctgaacagggacccacaa

SEQ ID NO: 446027 - DNA, 20 bp, mouse
ggagccccgggagccagtcc

SEQ ID NO: 446028 - DNA, 20 bp, mouse
gcacggccgggcgctgaaca

SEQ ID NO: 446029 - DNA, 20 bp, mouse
gtcgcttcggaggcccggac

SEQ ID NO: 446030 - DNA, 20 bp, mouse
gcccggggctccacacggcc

SEQ ID NO: 446031 - DNA, 20 bp, mouse
gcgggcctccgaagcgaaga

SEQ ID NO: 446032 - DNA, 20 bp, mouse
gaggcccggactggctcccg

SEQ ID NO: 446033 - DNA, 20 bp, mouse
gccgctggcggcaccaggtg

SEQ ID NO: 446034 - DNA, 20 bp, mouse
ggccctgggcggaagcggaa

SEQ ID NO: 446035 - DNA, 20 bp, mouse
gaagggctagagagtccgct

SEQ ID NO: 446036 - DNA, 20 bp, mouse
gagtcctcgggaagctccag

SEQ ID NO: 446037 - DNA, 20 bp, mouse
gggaagctccaggggcccgg

SEQ ID NO: 446038 - DNA, 20 bp, mouse
gagctccaggggcccggtgg

SEQ ID NO: 446039 - DNA, 20 bp, mouse
ggttgccgggcccggaccag

SEQ ID NO: 446040 - DNA, 20 bp, mouse
gtccggtaccggagagtagt

SEQ ID NO: 446041 - DNA, 20 bp, mouse
gcggctgctccatgtcccac

SEQ ID NO: 446042 - DNA, 20 bp, mouse
gcggcaaccgccagcgccaa

SEQ ID NO: 446043 - DNA, 20 bp, mouse
gggtgcatcggcttcgccag

SEQ ID NO: 446044 - DNA, 20 bp, mouse
gacgcaggccgctctcacct

SEQ ID NO: 446045 - DNA, 20 bp, mouse
gggtttccccgccagtcctc

SEQ ID NO: 446046 - DNA, 20 bp, mouse
ggtatctgttgcagtcatgt

SEQ ID NO: 446047 - DNA, 20 bp, mouse
gctctgctaaggccaggcca

SEQ ID NO: 446048 - DNA, 20 bp, mouse
gtgctaaggccaggccaagg

SEQ ID NO: 446049 - DNA, 20 bp, mouse
gcagctctagctgcttcgta

SEQ ID NO: 446050 - DNA, 20 bp, mouse
ggtggactcggctccggagg

SEQ ID NO: 446051 - DNA, 20 bp, mouse
gaagctctctctgaccgtgg

SEQ ID NO: 446052 - DNA, 20 bp, mouse
gtagctgcttcgtatggctc

SEQ ID NO: 446053 - DNA, 20 bp, mouse
gaatcggattcggacagtga

SEQ ID NO: 446054 - DNA, 20 bp, mouse
gtaatcgtcaaggaggatgt

SEQ ID NO: 446055 - DNA, 20 bp, mouse
ggctccggaggtggcagtta

SEQ ID NO: 446056 - DNA, 20 bp, mouse
gtcccgcagggaggcttctc

SEQ ID NO: 446057 - DNA, 20 bp, mouse
gagtgctgccaacgccccgg

SEQ ID NO: 446058 - DNA, 20 bp, mouse
gcgcagtgctgccaacgccc

SEQ ID NO: 446059 - DNA, 20 bp, mouse
gacacgcgaaggggaccggg

SEQ ID NO: 446060 - DNA, 20 bp, mouse
gcgcagaagacgctcccgca

SEQ ID NO: 446061 - DNA, 20 bp, mouse
ggcactgcgcggggcctcct

SEQ ID NO: 446062 - DNA, 20 bp, mouse
gtcaggcgcgtgcccctgtc

SEQ ID NO: 446063 - DNA, 20 bp, mouse
gctcctcggctgccggacag

SEQ ID NO: 446064 - DNA, 20 bp, mouse
gcacctcagcttctccgccg

SEQ ID NO: 446065 - DNA, 20 bp, mouse
gcggcggcggcgagaggacc

SEQ ID NO: 446066 - DNA, 20 bp, mouse
gggctgaggcgcgggaggag

SEQ ID NO: 446067 - DNA, 20 bp, mouse
gctgagggcatctttcccga

SEQ ID NO: 446068 - DNA, 20 bp, mouse
gcgacggacgcaggcggctg

SEQ ID NO: 446069 - DNA, 20 bp, mouse
gctttcccgacggacgcagg

SEQ ID NO: 446070 - DNA, 20 bp, mouse
ggctgcgctgacgaattcag

SEQ ID NO: 446071 - DNA, 20 bp, mouse
ggtcctccgcggcaaaggga

SEQ ID NO: 446072 - DNA, 20 bp, mouse
gacgcaggcggctgaggcgc

SEQ ID NO: 446073 - DNA, 20 bp, mouse
ggtaacagtagacatcgtaa

SEQ ID NO: 446074 - DNA, 20 bp, mouse
gcgaattcagaggacgcggg

SEQ ID NO: 446075 - DNA, 20 bp, mouse
ggaaagatgccctcagccca

SEQ ID NO: 446076 - DNA, 20 bp, mouse
ggctggccgggctgaggtcg

SEQ ID NO: 446077 - DNA, 20 bp, mouse
ggcgacctgcaagccaacca

SEQ ID NO: 446078 - DNA, 20 bp, mouse
gcggcctaggccgacatctt

SEQ ID NO: 446079 - DNA, 20 bp, mouse
ggacatcttgggctccgtcc

SEQ ID NO: 446080 - DNA, 20 bp, mouse
gatcttgggctccgtcccgg

SEQ ID NO: 446081 - DNA, 20 bp, mouse
gtgtcgtcgcagcccggcct

SEQ ID NO: 446082 - DNA, 20 bp, mouse
ggcgctggccgcgccctggt

SEQ ID NO: 446083 - DNA, 20 bp, mouse
gtgcgggcggcgcctagggg

SEQ ID NO: 446084 - DNA, 20 bp, mouse
gttgcaggtcgcgggctggg

SEQ ID NO: 446085 - DNA, 20 bp, mouse
gagcaccgcgtacacccggc

SEQ ID NO: 446086 - DNA, 20 bp, mouse
gaagcccgcccccgacggac

SEQ ID NO: 446087 - DNA, 20 bp, mouse
gcgcggctgaaggtgaaggt

SEQ ID NO: 446088 - DNA, 20 bp, mouse
ggagccgcggctgaaggtga

SEQ ID NO: 446089 - DNA, 20 bp, mouse
ggcacctgcccgtccgtcgg

SEQ ID NO: 446090 - DNA, 20 bp, mouse
gcgccggccaatgggagccg

SEQ ID NO: 446091 - DNA, 20 bp, mouse
gcttcagccgcggctcccat

SEQ ID NO: 446092 - DNA, 20 bp, mouse
gagcgggctgtggagaccaa

SEQ ID NO: 446093 - DNA, 20 bp, mouse
gcctccaagcccgcccccga

SEQ ID NO: 446094 - DNA, 20 bp, mouse
gcaggtgcgcgccggccaat

SEQ ID NO: 446095 - DNA, 20 bp, mouse
gggtgaaggtgggaaggcgg

SEQ ID NO: 446096 - DNA, 20 bp, mouse
gtcgagcccggggggtccag

SEQ ID NO: 446097 - DNA, 20 bp, mouse
ggaccggcccagcgactctc

SEQ ID NO: 446098 - DNA, 20 bp, mouse
ggcccgcccctggacccccc

SEQ ID NO: 446099 - DNA, 20 bp, mouse
ggacgacacgaggtaatcgt

SEQ ID NO: 446100 - DNA, 20 bp, mouse
gtcgtgtcgtcgagcccggg

SEQ ID NO: 446101 - DNA, 20 bp, mouse
ggtgcgcggggccaatccgt

SEQ ID NO: 446102 - DNA, 20 bp, mouse
gtatactgggacgcgagcag

SEQ ID NO: 446103 - DNA, 20 bp, mouse
gcccccgccccgggatctgg

SEQ ID NO: 446104 - DNA, 20 bp, mouse
gtcagggcaccaaaaccgaa

SEQ ID NO: 446105 - DNA, 20 bp, mouse
gcgcgggcagcggaagggaa

SEQ ID NO: 446106 - DNA, 20 bp, mouse
gagctgtgcggctaggatag

SEQ ID NO: 446107 - DNA, 20 bp, mouse
ggctttgcccgcgctcctca

SEQ ID NO: 446108 - DNA, 20 bp, mouse
ggcctggctagcactctcca

SEQ ID NO: 446109 - DNA, 20 bp, mouse
ggcgctcctcaaggtgagtt

SEQ ID NO: 446110 - DNA, 20 bp, mouse
gcggctaggatagaggacca

SEQ ID NO: 446111 - DNA, 20 bp, mouse
gccagtcccaactcaccttg

SEQ ID NO: 446112 - DNA, 20 bp, mouse
gagggacacgggccgaagag

SEQ ID NO: 446113 - DNA, 20 bp, mouse
gcaggcctcccgcagctccc

SEQ ID NO: 446114 - DNA, 20 bp, mouse
ggagcgctgcgggaggtcat

SEQ ID NO: 446115 - DNA, 20 bp, mouse
gtaacactaaagctaaagat

SEQ ID NO: 446116 - DNA, 20 bp, mouse
ggcgcgcggcgtctcccggg

SEQ ID NO: 446117 - DNA, 20 bp, mouse
gcgacaacccagttccgcag

SEQ ID NO: 446118 - DNA, 20 bp, mouse
ggccgcgcgcacagtgtcgc

SEQ ID NO: 446119 - DNA, 20 bp, mouse
ggcgcgcagaaccagagggg

SEQ ID NO: 446120 - DNA, 20 bp, mouse
gactgcgcgcggcgtctccc

SEQ ID NO: 446121 - DNA, 20 bp, mouse
gggtgcgcgcagaaccagag

SEQ ID NO: 446122 - DNA, 20 bp, mouse
gggccctccgggcagaagct

SEQ ID NO: 446123 - DNA, 20 bp, mouse
gggcccgggtcgcctcccga

SEQ ID NO: 446124 - DNA, 20 bp, mouse
gtggccttggaagacttaga

SEQ ID NO: 446125 - DNA, 20 bp, mouse
gctgtgctcccagcggcagt

SEQ ID NO: 446126 - DNA, 20 bp, mouse
gaggcgccaagcacaccgag

SEQ ID NO: 446127 - DNA, 20 bp, mouse
gcggcaaggctggcgaccca

SEQ ID NO: 446128 - DNA, 20 bp, mouse
gcccgagcgcggaccaggtg

SEQ ID NO: 446129 - DNA, 20 bp, mouse
gagccagaggaaacaaacgc

SEQ ID NO: 446130 - DNA, 20 bp, mouse
gtcggagccccgggagccag

SEQ ID NO: 446131 - DNA, 20 bp, mouse
gtgcggctgtacgctcccct

SEQ ID NO: 446132 - DNA, 20 bp, mouse
gtgtgcttggcgcctcggca

SEQ ID NO: 446133 - DNA, 20 bp, mouse
gcaaacgccggcgctgccat

SEQ ID NO: 446134 - DNA, 20 bp, mouse
gtggcgacccatggcagcgc

SEQ ID NO: 446135 - DNA, 20 bp, mouse
ggagaaggtagaaagacccg

SEQ ID NO: 446136 - DNA, 20 bp, mouse
ggccctttgaagggattgta

SEQ ID NO: 446137 - DNA, 20 bp, mouse
gggtaagaaggaacttccgg

SEQ ID NO: 446138 - DNA, 20 bp, mouse
gtggggctgctgagacccaa

SEQ ID NO: 446139 - DNA, 20 bp, mouse
ggaggtgagaaggttgtagt

SEQ ID NO: 446140 - DNA, 20 bp, mouse
ggctgccatggcccccgaga

SEQ ID NO: 446141 - DNA, 20 bp, mouse
gaagcttcagcccctctcgg

SEQ ID NO: 446142 - DNA, 20 bp, mouse
gttgaagggattgtagggac

SEQ ID NO: 446143 - DNA, 20 bp, mouse
gaagggattgtagggacagg

SEQ ID NO: 446144 - DNA, 20 bp, mouse
gaggggctgaagcttattcc

SEQ ID NO: 446145 - DNA, 20 bp, mouse
gcccagaatctggcaacccc

SEQ ID NO: 446146 - DNA, 20 bp, mouse
gctccccggcgtccccactg

SEQ ID NO: 446147 - DNA, 20 bp, mouse
gcgcccggcgctcttacctg

SEQ ID NO: 446148 - DNA, 20 bp, mouse
gggagcccccgcccgcagtg

SEQ ID NO: 446149 - DNA, 20 bp, mouse
ggcgtccccactgcgggcgg

SEQ ID NO: 446150 - DNA, 20 bp, mouse
ggcccgcagtggggacgccg

SEQ ID NO: 446151 - DNA, 20 bp, mouse
gggaaggtgcgaagcgacag

SEQ ID NO: 446152 - DNA, 20 bp, mouse
gccctggctgcttctcggca

SEQ ID NO: 446153 - DNA, 20 bp, mouse
gacccactgcgacccaggat

SEQ ID NO: 446154 - DNA, 20 bp, mouse
gcgcaagccacggagaggca

SEQ ID NO: 446155 - DNA, 20 bp, mouse
gctgccctaaccccagggaa

SEQ ID NO: 446156 - DNA, 20 bp, mouse
ggagcaggcggcggagacaa

SEQ ID NO: 446157 - DNA, 20 bp, mouse
gcgccagagcctaggcggga

SEQ ID NO: 446158 - DNA, 20 bp, mouse
ggcccgaggcgccaagtgta

SEQ ID NO: 446159 - DNA, 20 bp, mouse
gcctaggctctggcgcgcag

SEQ ID NO: 446160 - DNA, 20 bp, mouse
gcaaaggcgacggtgagtga

SEQ ID NO: 446161 - DNA, 20 bp, mouse
ggcggcggagacaaaggcga

SEQ ID NO: 446162 - DNA, 20 bp, mouse
ggcagctgcgctccccgctt

SEQ ID NO: 446163 - DNA, 20 bp, mouse
gtggggctgcggactgactg

SEQ ID NO: 446164 - DNA, 20 bp, mouse
gagcgcagctgcttggtgtg

SEQ ID NO: 446165 - DNA, 20 bp, mouse
gtgcggactgactgaggctg

SEQ ID NO: 446166 - DNA, 20 bp, mouse
ggtcacgaacatagccacag

SEQ ID NO: 446167 - DNA, 20 bp, mouse
gagcggcggatacctagaac

SEQ ID NO: 446168 - DNA, 20 bp, mouse
gtagaactggcgctgagaca

SEQ ID NO: 446169 - DNA, 20 bp, mouse
gacgaacatagccacagcgg

SEQ ID NO: 446170 - DNA, 20 bp, mouse
gggagtcttgacgacctccg

SEQ ID NO: 446171 - DNA, 20 bp, mouse
gtacgagacggtccacaacc

SEQ ID NO: 446172 - DNA, 20 bp, mouse
gcgcaaggagttctacgaga

SEQ ID NO: 446173 - DNA, 20 bp, mouse
gacagggacgctaaactctg

SEQ ID NO: 446174 - DNA, 20 bp, mouse
ggagacacggacagccccgg

SEQ ID NO: 446175 - DNA, 20 bp, mouse
gtcgtggaatgggagtcacc

SEQ ID NO: 446176 - DNA, 20 bp, mouse
ggcgcgcaggtccgagacta

SEQ ID NO: 446177 - DNA, 20 bp, mouse
ggacctgcgcgcgacacgtc

SEQ ID NO: 446178 - DNA, 20 bp, mouse
gaggtccgagactagggtga

SEQ ID NO: 446179 - DNA, 20 bp, mouse
gaatcaaaccgcaggtgcca

SEQ ID NO: 446180 - DNA, 20 bp, mouse
gtcgggcgccttggcacctg

SEQ ID NO: 446181 - DNA, 20 bp, mouse
gcgcgacacgtcgggcgcct

SEQ ID NO: 446182 - DNA, 20 bp, mouse
gcggcagagtgtcccggcaa

SEQ ID NO: 446183 - DNA, 20 bp, mouse
ggacccccgcgggacagcca

SEQ ID NO: 446184 - DNA, 20 bp, mouse
gtggagactaatcaaaccgc

SEQ ID NO: 446185 - DNA, 20 bp, mouse
gtgtcccggcaagggagccg

SEQ ID NO: 446186 - DNA, 20 bp, mouse
ggctgctgtagaatttgtgg

SEQ ID NO: 446187 - DNA, 20 bp, mouse
gactttggcgggagacgaga

SEQ ID NO: 446188 - DNA, 20 bp, mouse
gggcgggagagtttttacgg

SEQ ID NO: 446189 - DNA, 20 bp, mouse
gcgagaaggctgaagtagag

SEQ ID NO: 446190 - DNA, 20 bp, mouse
ggggttgtgagctctagaag

SEQ ID NO: 446191 - DNA, 20 bp, mouse
gtctgaggctgggtcaggga

SEQ ID NO: 446192 - DNA, 20 bp, mouse
gtgtggcgggagagttttta

SEQ ID NO: 446193 - DNA, 20 bp, mouse
gcgaggtctggtgtccagag

SEQ ID NO: 446194 - DNA, 20 bp, mouse
gggctgaagtagagcggctt

SEQ ID NO: 446195 - DNA, 20 bp, mouse
ggaggaaacggtgtagggtg

SEQ ID NO: 446196 - DNA, 20 bp, mouse
gctcagtgggacgctcctga

SEQ ID NO: 446197 - DNA, 20 bp, mouse
gctcctgagggaagcgaccg

SEQ ID NO: 446198 - DNA, 20 bp, mouse
gctcgactggagccgaccga

SEQ ID NO: 446199 - DNA, 20 bp, mouse
gcctggcggcccggctcagt

SEQ ID NO: 446200 - DNA, 20 bp, mouse
gtgcgcactgagcttcccgt

SEQ ID NO: 446201 - DNA, 20 bp, mouse
gacagaagttaggacgtccg

SEQ ID NO: 446202 - DNA, 20 bp, mouse
gcgccctgggcgagtgcgta

SEQ ID NO: 446203 - DNA, 20 bp, mouse
gctcacggttcacagaagtt

SEQ ID NO: 446204 - DNA, 20 bp, mouse
ggaaaactgtcagaaactca

SEQ ID NO: 446205 - DNA, 20 bp, mouse
ggtccgcggtcgcttccctc

SEQ ID NO: 446206 - DNA, 20 bp, mouse
gtattcagatggaatccggg

SEQ ID NO: 446207 - DNA, 20 bp, mouse
ggttgttgactacttcacta

SEQ ID NO: 446208 - DNA, 20 bp, mouse
gtttcttctggagaaccccc

SEQ ID NO: 446209 - DNA, 20 bp, mouse
gcttgttaggactactgcaa

SEQ ID NO: 446210 - DNA, 20 bp, mouse
gaaacatctttatggaaagg

SEQ ID NO: 446211 - DNA, 20 bp, mouse
gaccaaacatctttatggaa

SEQ ID NO: 446212 - DNA, 20 bp, mouse
gatttattcagatggaatcc

SEQ ID NO: 446213 - DNA, 20 bp, mouse
ggttgactacttcactatgg

SEQ ID NO: 446214 - DNA, 20 bp, mouse
ggctaggaccgtgttttacg

SEQ ID NO: 446215 - DNA, 20 bp, mouse
gcaaataccaaacatcttta

SEQ ID NO: 446216 - DNA, 20 bp, mouse
gacaccacgtccggccgaag

SEQ ID NO: 446217 - DNA, 20 bp, mouse
gcagagagcaccagaggccg

SEQ ID NO: 446218 - DNA, 20 bp, mouse
gtggtgtgtctggtgtgcag

SEQ ID NO: 446219 - DNA, 20 bp, mouse
gtgaccgcttcggccggacg

SEQ ID NO: 446220 - DNA, 20 bp, mouse
ggagcaccagaggccgggga

SEQ ID NO: 446221 - DNA, 20 bp, mouse
gcggccggacgtggtgtgtc

SEQ ID NO: 446222 - DNA, 20 bp, mouse
gcggcgcagggagacctccg

SEQ ID NO: 446223 - DNA, 20 bp, mouse
ggaacgcgcagggtcctggg

SEQ ID NO: 446224 - DNA, 20 bp, mouse
ggtgtctggtgtgcagcggc

SEQ ID NO: 446225 - DNA, 20 bp, mouse
gaagtgaagcttgaccgctt

SEQ ID NO: 446226 - DNA, 20 bp, mouse
gtcgggcagaggtcgagctg

SEQ ID NO: 446227 - DNA, 20 bp, mouse
ggaagctgggaagatcgggt

SEQ ID NO: 446228 - DNA, 20 bp, mouse
gtggggtcagaggtccgaca

SEQ ID NO: 446229 - DNA, 20 bp, mouse
gcagaggtcgagctggggcc

SEQ ID NO: 446230 - DNA, 20 bp, mouse
gctagctggtgttcgggcag

SEQ ID NO: 446231 - DNA, 20 bp, mouse
ggtcgaacccatctccactg

SEQ ID NO: 446232 - DNA, 20 bp, mouse
gaacagagcagtcaggtctg

SEQ ID NO: 446233 - DNA, 20 bp, mouse
ggccagcactaggtgaacga

SEQ ID NO: 446234 - DNA, 20 bp, mouse
ggctggaagctgggaagatc

SEQ ID NO: 446235 - DNA, 20 bp, mouse
gttccagcagaggaacctcc

SEQ ID NO: 446236 - DNA, 20 bp, mouse
gatccgggtgcccgaaggag

SEQ ID NO: 446237 - DNA, 20 bp, mouse
gcgggtgcccgaaggagtgg

SEQ ID NO: 446238 - DNA, 20 bp, mouse
gcgccatggcgaccctttgt

SEQ ID NO: 446239 - DNA, 20 bp, mouse
gtgtgggcgctgaccgatcc

SEQ ID NO: 446240 - DNA, 20 bp, mouse
gatcggtcagcgcccacaaa

SEQ ID NO: 446241 - DNA, 20 bp, mouse
gcagaccccgccactccttc

SEQ ID NO: 446242 - DNA, 20 bp, mouse
gcacataccgagagccggag

SEQ ID NO: 446243 - DNA, 20 bp, mouse
ggccagctcgaaaggtgagg

SEQ ID NO: 446244 - DNA, 20 bp, mouse
ggcggccagctcgaaaggtg

SEQ ID NO: 446245 - DNA, 20 bp, mouse
gcgcccacaaagggtcgcca

SEQ ID NO: 446246 - DNA, 20 bp, mouse
gggttggcgcgagcctgagt

SEQ ID NO: 446247 - DNA, 20 bp, mouse
gcctgagtaggcgaccgcgg

SEQ ID NO: 446248 - DNA, 20 bp, mouse
ggagcctgagtaggcgaccg

SEQ ID NO: 446249 - DNA, 20 bp, mouse
gagcccgaccgtacacatgg

SEQ ID NO: 446250 - DNA, 20 bp, mouse
gaagcagcaaagttcccggt

SEQ ID NO: 446251 - DNA, 20 bp, mouse
gctccgccatgtgtacggtc

SEQ ID NO: 446252 - DNA, 20 bp, mouse
gtcgggctcagtctccgccg

SEQ ID NO: 446253 - DNA, 20 bp, mouse
gcggcgaacacgatcaggag

SEQ ID NO: 446254 - DNA, 20 bp, mouse
gagccggactaaggatacct

SEQ ID NO: 446255 - DNA, 20 bp, mouse
gctggtgagcacgggagcag

SEQ ID NO: 446256 - DNA, 20 bp, mouse
ggtacccgccgccaacatgg

SEQ ID NO: 446257 - DNA, 20 bp, mouse
gcccggagctcgggttgttc

SEQ ID NO: 446258 - DNA, 20 bp, mouse
gccgagctccgggacagagg

SEQ ID NO: 446259 - DNA, 20 bp, mouse
gagcgcgtgggacaagtgag

SEQ ID NO: 446260 - DNA, 20 bp, mouse
gaacccgagctccgggacag

SEQ ID NO: 446261 - DNA, 20 bp, mouse
gagtgagcggagctaacccg

SEQ ID NO: 446262 - DNA, 20 bp, mouse
ggcgcgccccgcctctgtcc

SEQ ID NO: 446263 - DNA, 20 bp, mouse
ggctaacccgcggagtcgga

SEQ ID NO: 446264 - DNA, 20 bp, mouse
ggcccgaacaacccgagctc

SEQ ID NO: 446265 - DNA, 20 bp, mouse
gcttggccttgagttatcct

SEQ ID NO: 446266 - DNA, 20 bp, mouse
ggccacgcgctcccaggtga

SEQ ID NO: 446267 - DNA, 20 bp, mouse
gcggcctgcagctccagaat

SEQ ID NO: 446268 - DNA, 20 bp, mouse
gagaaagcggccggggacca

SEQ ID NO: 446269 - DNA, 20 bp, mouse
gctgggggaaaccctcacct

SEQ ID NO: 446270 - DNA, 20 bp, mouse
gtgcagccggggctcaggtg

SEQ ID NO: 446271 - DNA, 20 bp, mouse
gggaccagcccggcaggaca

SEQ ID NO: 446272 - DNA, 20 bp, mouse
ggccctgcacgcggccaccc

SEQ ID NO: 446273 - DNA, 20 bp, mouse
ggagctggccacgcgctccc

SEQ ID NO: 446274 - DNA, 20 bp, mouse
gctgcaggccgggagctacg

SEQ ID NO: 446275 - DNA, 20 bp, mouse
gcagctccatcttccctgct

SEQ ID NO: 446276 - DNA, 20 bp, mouse
ggctccaactaagggacggg

SEQ ID NO: 446277 - DNA, 20 bp, mouse
gcacagctccaactaaggga

SEQ ID NO: 446278 - DNA, 20 bp, mouse
ggagccgcccgtcccttagt

SEQ ID NO: 446279 - DNA, 20 bp, mouse
gggtcccaaaacacagtctg

SEQ ID NO: 446280 - DNA, 20 bp, mouse
gcggctccgcgactgagacg

SEQ ID NO: 446281 - DNA, 20 bp, mouse
gccctcacagctccaactaa

SEQ ID NO: 446282 - DNA, 20 bp, mouse
gccgttgagtttgaattggg

SEQ ID NO: 446283 - DNA, 20 bp, mouse
gattgggtggcggttaaccg

SEQ ID NO: 446284 - DNA, 20 bp, mouse
gcgaccgcgagggtaagggg

SEQ ID NO: 446285 - DNA, 20 bp, mouse
gtaagggacgggcggctcct

SEQ ID NO: 446286 - DNA, 20 bp, mouse
ggggcgcctcggtctcccta

SEQ ID NO: 446287 - DNA, 20 bp, mouse
ggagtgggccatgactcggg

SEQ ID NO: 446288 - DNA, 20 bp, mouse
gtctccctagggcacgactg

SEQ ID NO: 446289 - DNA, 20 bp, mouse
gaggccacagtcgtgcccta

SEQ ID NO: 446290 - DNA, 20 bp, mouse
gtcgtgccctagggagaccg

SEQ ID NO: 446291 - DNA, 20 bp, mouse
gcgaggccactcgcagacac

SEQ ID NO: 446292 - DNA, 20 bp, mouse
gggaggtggcgcgtgttcag

SEQ ID NO: 446293 - DNA, 20 bp, mouse
ggagaacccgcaggccgagt

SEQ ID NO: 446294 - DNA, 20 bp, mouse
gcggccagggaggtgcctgg

SEQ ID NO: 446295 - DNA, 20 bp, mouse
gggccgagtgggccatgact

SEQ ID NO: 446296 - DNA, 20 bp, mouse
gactgcagaagagtcctgag

SEQ ID NO: 446297 - DNA, 20 bp, mouse
ggctggacacagctcccctc

SEQ ID NO: 446298 - DNA, 20 bp, mouse
ggagtctcgcgaaccagtga

SEQ ID NO: 446299 - DNA, 20 bp, mouse
ggctgtggacggctgatgac

SEQ ID NO: 446300 - DNA, 20 bp, mouse
gttcgcgagactcatttaca

SEQ ID NO: 446301 - DNA, 20 bp, mouse
ggcaggaaccgtgccttcac

SEQ ID NO: 446302 - DNA, 20 bp, mouse
gcagctcagagggacggaga

SEQ ID NO: 446303 - DNA, 20 bp, mouse
gtgtctgtcccgagaaccgt

SEQ ID NO: 446304 - DNA, 20 bp, mouse
ggctgtgtccagcagcaaat

SEQ ID NO: 446305 - DNA, 20 bp, mouse
gtcgcgaaccagtgaaggca

SEQ ID NO: 446306 - DNA, 20 bp, mouse
ggagtctagcagaagttctt

SEQ ID NO: 446307 - DNA, 20 bp, mouse
gcacagcgaagcggatcatg

SEQ ID NO: 446308 - DNA, 20 bp, mouse
gactgagctcgggtgcggtc

SEQ ID NO: 446309 - DNA, 20 bp, mouse
gagggaagcgggaccacagc

SEQ ID NO: 446310 - DNA, 20 bp, mouse
gcaaacactgagctcgggtg

SEQ ID NO: 446311 - DNA, 20 bp, mouse
gactcctgcccggcctaacc

SEQ ID NO: 446312 - DNA, 20 bp, mouse
gggcctgcctgtagaaggtg

SEQ ID NO: 446313 - DNA, 20 bp, mouse
ggtggtgtccggaagagtca

SEQ ID NO: 446314 - DNA, 20 bp, mouse
gctctctccaggtgcctctc

SEQ ID NO: 446315 - DNA, 20 bp, mouse
gtctcgggtaccccaatcta

SEQ ID NO: 446316 - DNA, 20 bp, mouse
ggagctgcagcactcgccat

SEQ ID NO: 446317 - DNA, 20 bp, mouse
gtgcagcactcgccatggga

SEQ ID NO: 446318 - DNA, 20 bp, mouse
gttagaccgaagtagaatca

SEQ ID NO: 446319 - DNA, 20 bp, mouse
ggttcctcacacggagagaa

SEQ ID NO: 446320 - DNA, 20 bp, mouse
ggggaaagccgttcctcaca

SEQ ID NO: 446321 - DNA, 20 bp, mouse
gccatgggaaggttagagac

SEQ ID NO: 446322 - DNA, 20 bp, mouse
gggttagagactggaagtgc

SEQ ID NO: 446323 - DNA, 20 bp, mouse
ggaagctgatgaaacaaggt

SEQ ID NO: 446324 - DNA, 20 bp, mouse
gtgctgggggtggacatatg

SEQ ID NO: 446325 - DNA, 20 bp, mouse
gcgtcacttttaactctgga

SEQ ID NO: 446326 - DNA, 20 bp, mouse
gcgaggagcagatgccgcgg

SEQ ID NO: 446327 - DNA, 20 bp, mouse
gcgctccgcggctcattccg

SEQ ID NO: 446328 - DNA, 20 bp, mouse
gccagctgaggggagcgtcg

SEQ ID NO: 446329 - DNA, 20 bp, mouse
gagtcccattcacaagtcgg

SEQ ID NO: 446330 - DNA, 20 bp, mouse
gcgcggccgccgccagctga

SEQ ID NO: 446331 - DNA, 20 bp, mouse
ggagaagccccatctagata

SEQ ID NO: 446332 - DNA, 20 bp, mouse
gcgctcccctcagctggcgg

SEQ ID NO: 446333 - DNA, 20 bp, mouse
gggccgaggagcagatgccg

SEQ ID NO: 446334 - DNA, 20 bp, mouse
ggcggccgcggaatgagccg

SEQ ID NO: 446335 - DNA, 20 bp, mouse
ggagccgcggagcgcgctag

SEQ ID NO: 446336 - DNA, 20 bp, mouse
gtcaatcaacacccacagag

SEQ ID NO: 446337 - DNA, 20 bp, mouse
gaggagcttggcataaacac

SEQ ID NO: 446338 - DNA, 20 bp, mouse
gtcgcgcggaatctctgcac

SEQ ID NO: 446339 - DNA, 20 bp, mouse
gaagctcctcgctgtctgaa

SEQ ID NO: 446340 - DNA, 20 bp, mouse
gcattctgcactgcagtaag

SEQ ID NO: 446341 - DNA, 20 bp, mouse
ggatcaaccataaacgggtg

SEQ ID NO: 446342 - DNA, 20 bp, mouse
gtaagtggctatctaaagca

SEQ ID NO: 446343 - DNA, 20 bp, mouse
gcttcagatcaaccataaac

SEQ ID NO: 446344 - DNA, 20 bp, mouse
gtactgcagtgcagaatgtc

SEQ ID NO: 446345 - DNA, 20 bp, mouse
gagggatatacggggtgagg

SEQ ID NO: 446346 - DNA, 20 bp, mouse
gaggcagagcctctcctcaa

SEQ ID NO: 446347 - DNA, 20 bp, mouse
ggactagaagaagcgcctgg

SEQ ID NO: 446348 - DNA, 20 bp, mouse
gacagggtgagcggagttct

SEQ ID NO: 446349 - DNA, 20 bp, mouse
ggcaggacgcacagggtgag

SEQ ID NO: 446350 - DNA, 20 bp, mouse
gtgggacagcaggacgcaca

SEQ ID NO: 446351 - DNA, 20 bp, mouse
ggccgccgtgcagatatacc

SEQ ID NO: 446352 - DNA, 20 bp, mouse
gcccgactagaagaagcgcc

SEQ ID NO: 446353 - DNA, 20 bp, mouse
ggccgggtatatctgcacgg

SEQ ID NO: 446354 - DNA, 20 bp, mouse
gcgtcctgctgtcccaggta

SEQ ID NO: 446355 - DNA, 20 bp, mouse
gctagccgggtatatctgca

SEQ ID NO: 446356 - DNA, 20 bp, mouse
gcgaggacaagtggccgact

SEQ ID NO: 446357 - DNA, 20 bp, mouse
gggacaagtggccgactggg

SEQ ID NO: 446358 - DNA, 20 bp, mouse
ggggcggccggtggaacggg

SEQ ID NO: 446359 - DNA, 20 bp, mouse
gactgggcggccggtggaac

SEQ ID NO: 446360 - DNA, 20 bp, mouse
gcggaagagccgaggacaag

SEQ ID NO: 446361 - DNA, 20 bp, mouse
ggaacccattgaggcagtgg

SEQ ID NO: 446362 - DNA, 20 bp, mouse
ggcaccaccgcccgttccac

SEQ ID NO: 446363 - DNA, 20 bp, mouse
gagcccaatgctctcagcgt

SEQ ID NO: 446364 - DNA, 20 bp, mouse
gagcagagcagaacccattg

SEQ ID NO: 446365 - DNA, 20 bp, mouse
gcccccacgctgagagcatt

SEQ ID NO: 446366 - DNA, 20 bp, mouse
gggcaaatttggcttaggtg

SEQ ID NO: 446367 - DNA, 20 bp, mouse
ggcttaggtggggcgaggca

SEQ ID NO: 446368 - DNA, 20 bp, mouse
gggtggacacttgagcaggt

SEQ ID NO: 446369 - DNA, 20 bp, mouse
gcccagatatctgaaggata

SEQ ID NO: 446370 - DNA, 20 bp, mouse
ggcaaggtggacacttgagc

SEQ ID NO: 446371 - DNA, 20 bp, mouse
gctcctggaaactggaccaa

SEQ ID NO: 446372 - DNA, 20 bp, mouse
gggaaactggaccaagggag

SEQ ID NO: 446373 - DNA, 20 bp, mouse
gcttgagcaggtaggcggtc

SEQ ID NO: 446374 - DNA, 20 bp, mouse
gcagtctggtatctggaggg

SEQ ID NO: 446375 - DNA, 20 bp, mouse
ggggcagtctggtatctgga

SEQ ID NO: 446376 - DNA, 20 bp, mouse
ggccgtggagacacttgctg

SEQ ID NO: 446377 - DNA, 20 bp, mouse
gaagtgtctccacggctgaa

SEQ ID NO: 446378 - DNA, 20 bp, mouse
gtgggtggatggcttaagaa

SEQ ID NO: 446379 - DNA, 20 bp, mouse
ggttgaggaagtgtctctta

SEQ ID NO: 446380 - DNA, 20 bp, mouse
gaacttctggaagaatactg

SEQ ID NO: 446381 - DNA, 20 bp, mouse
gccaaaagctaaggacacca

SEQ ID NO: 446382 - DNA, 20 bp, mouse
gcttacttactgaaaggtaa

SEQ ID NO: 446383 - DNA, 20 bp, mouse
ggcatttcttacttactgaa

SEQ ID NO: 446384 - DNA, 20 bp, mouse
gtttgtcgtccattcagccg

SEQ ID NO: 446385 - DNA, 20 bp, mouse
gtgtacacacttggcctcaa

SEQ ID NO: 446386 - DNA, 20 bp, mouse
gcacggtcctcggagagccc

SEQ ID NO: 446387 - DNA, 20 bp, mouse
gaatttatgagaagcacagg

SEQ ID NO: 446388 - DNA, 20 bp, mouse
gccggagcctgggctctccg

SEQ ID NO: 446389 - DNA, 20 bp, mouse
gcactgctgctcacggtcct

SEQ ID NO: 446390 - DNA, 20 bp, mouse
gcttgtgaaaagcatccagg

SEQ ID NO: 446391 - DNA, 20 bp, mouse
ggggcaagtcagccaaggta

SEQ ID NO: 446392 - DNA, 20 bp, mouse
ggctctgcccctgaagaagt

SEQ ID NO: 446393 - DNA, 20 bp, mouse
gctgagggtatccaattcag

SEQ ID NO: 446394 - DNA, 20 bp, mouse
gcttgccctaactgctggaa

SEQ ID NO: 446395 - DNA, 20 bp, mouse
ggctgacttgccctaactgc

SEQ ID NO: 446396 - DNA, 20 bp, mouse
gagcccagcacagtaatcca

SEQ ID NO: 446397 - DNA, 20 bp, mouse
gcttctcagcagaatctccg

SEQ ID NO: 446398 - DNA, 20 bp, mouse
ggtaagactgtgaggatcct

SEQ ID NO: 446399 - DNA, 20 bp, mouse
gcttgtcaggtttaactctt

SEQ ID NO: 446400 - DNA, 20 bp, mouse
gctccgtggattactgtgct

SEQ ID NO: 446401 - DNA, 20 bp, mouse
gagaactgatttgcttttac

SEQ ID NO: 446402 - DNA, 20 bp, mouse
gctgacaaggtaagactgtg

SEQ ID NO: 446403 - DNA, 20 bp, mouse
gacaaatcattagaacgcca

SEQ ID NO: 446404 - DNA, 20 bp, mouse
gttgaagtcagtacaagttt

SEQ ID NO: 446405 - DNA, 20 bp, mouse
ggcgttttggtatttcctaa

SEQ ID NO: 446406 - DNA, 20 bp, mouse
ggggccgagcgaggagccgg

SEQ ID NO: 446407 - DNA, 20 bp, mouse
ggctatccggcacatggagg

SEQ ID NO: 446408 - DNA, 20 bp, mouse
ggcagcggcgcggggaacaa

SEQ ID NO: 446409 - DNA, 20 bp, mouse
gcccgctatccggcacatgg

SEQ ID NO: 446410 - DNA, 20 bp, mouse
ggtaagcggaggtcccgggt

SEQ ID NO: 446411 - DNA, 20 bp, mouse
gaccaacagcagcgcggagt

SEQ ID NO: 446412 - DNA, 20 bp, mouse
gcggcggatggaggatacgg

SEQ ID NO: 446413 - DNA, 20 bp, mouse
ggccgactccgcgctgctgt

SEQ ID NO: 446414 - DNA, 20 bp, mouse
ggtgtggcacctcccttcct

SEQ ID NO: 446415 - DNA, 20 bp, mouse
gccggcacatggaggcggag

SEQ ID NO: 446416 - DNA, 20 bp, mouse
ggacggtgaccagaagaacc

SEQ ID NO: 446417 - DNA, 20 bp, mouse
gagacgtggagactccgtag

SEQ ID NO: 446418 - DNA, 20 bp, mouse
gtagaaaacgcgcgaaggag

SEQ ID NO: 446419 - DNA, 20 bp, mouse
ggcgcgctggtcttaaagga

SEQ ID NO: 446420 - DNA, 20 bp, mouse
ggagatgctggtgacctcaa

SEQ ID NO: 446421 - DNA, 20 bp, mouse
ggtcggcagggaggtcccct

SEQ ID NO: 446422 - DNA, 20 bp, mouse
gtaggcggcggagagttgag

SEQ ID NO: 446423 - DNA, 20 bp, mouse
ggacccgcggtacacgcagg

SEQ ID NO: 446424 - DNA, 20 bp, mouse
gagctggacacccgccacta

SEQ ID NO: 446425 - DNA, 20 bp, mouse
gcggcgactctccagagacg

SEQ ID NO: 446426 - DNA, 20 bp, mouse
gtggaggagcgagagagcga

SEQ ID NO: 446427 - DNA, 20 bp, mouse
gggctctggcgtccgctcgg

SEQ ID NO: 446428 - DNA, 20 bp, mouse
ggccttgggacgccagcaag

SEQ ID NO: 446429 - DNA, 20 bp, mouse
gtcacagccaggtccggctc

SEQ ID NO: 446430 - DNA, 20 bp, mouse
gtccggctctggcgtccgct

SEQ ID NO: 446431 - DNA, 20 bp, mouse
gtaagagcgcgcggcacccg

SEQ ID NO: 446432 - DNA, 20 bp, mouse
ggagtgtgcgtgtctgacta

SEQ ID NO: 446433 - DNA, 20 bp, mouse
gtgtgcgtgtctgactaggg

SEQ ID NO: 446434 - DNA, 20 bp, mouse
gggacaaccgatcgccgctg

SEQ ID NO: 446435 - DNA, 20 bp, mouse
gtcgccgctggggaaggctg

SEQ ID NO: 446436 - DNA, 20 bp, mouse
gtggagcaggtggcccgtgg

SEQ ID NO: 446437 - DNA, 20 bp, mouse
gtgctgtgggacgtgttccc

SEQ ID NO: 446438 - DNA, 20 bp, mouse
ggcagtgagcagggatcggg

SEQ ID NO: 446439 - DNA, 20 bp, mouse
gaagacacgatgcatggccc

SEQ ID NO: 446440 - DNA, 20 bp, mouse
gtcgcgccggcagcgagaag

SEQ ID NO: 446441 - DNA, 20 bp, mouse
gcgcgccgcgagatcagaag

SEQ ID NO: 446442 - DNA, 20 bp, mouse
gcgccggcagcgagaagcgg

SEQ ID NO: 446443 - DNA, 20 bp, mouse
ggccggcgcgaaggtctctc

SEQ ID NO: 446444 - DNA, 20 bp, mouse
gagttgatcgcggacttgag

SEQ ID NO: 446445 - DNA, 20 bp, mouse
gcagcaaagagcgggccccg

SEQ ID NO: 446446 - DNA, 20 bp, mouse
gctccgtcgctggctcccgg

SEQ ID NO: 446447 - DNA, 20 bp, mouse
gtgcccccgggagccagcga

SEQ ID NO: 446448 - DNA, 20 bp, mouse
ggcggccccggcgagaacaa

SEQ ID NO: 446449 - DNA, 20 bp, mouse
gccgcggcgccggcttggat

SEQ ID NO: 446450 - DNA, 20 bp, mouse
gaaggggcagagaggcggaa

SEQ ID NO: 446451 - DNA, 20 bp, mouse
ggctccgctgcaggtctgag

SEQ ID NO: 446452 - DNA, 20 bp, mouse
ggccccaagccgatccaagc

SEQ ID NO: 446453 - DNA, 20 bp, mouse
gcaagggagcgagacggagg

SEQ ID NO: 446454 - DNA, 20 bp, mouse
gagccagcgacggaggcggg

SEQ ID NO: 446455 - DNA, 20 bp, mouse
ggggtcgggaatcctcgcgg

SEQ ID NO: 446456 - DNA, 20 bp, mouse
gagccctgtggccacagatg

SEQ ID NO: 446457 - DNA, 20 bp, mouse
ggaaggtgggctgatgggta

SEQ ID NO: 446458 - DNA, 20 bp, mouse
gctggtgtccatgctaggga

SEQ ID NO: 446459 - DNA, 20 bp, mouse
ggagggcacagaacagtcct

SEQ ID NO: 446460 - DNA, 20 bp, mouse
ggactgtgcacagcatacat

SEQ ID NO: 446461 - DNA, 20 bp, mouse
ggacaaacgaaagcagggca

SEQ ID NO: 446462 - DNA, 20 bp, mouse
gaacctcatctgtggccaca

SEQ ID NO: 446463 - DNA, 20 bp, mouse
gtctctgacaaacgaaagca

SEQ ID NO: 446464 - DNA, 20 bp, mouse
gtctgtggccacagggctct

SEQ ID NO: 446465 - DNA, 20 bp, mouse
gaggtcaagtgtccaggctc

SEQ ID NO: 446466 - DNA, 20 bp, mouse
gagagcgcgccccaccgtcg

SEQ ID NO: 446467 - DNA, 20 bp, mouse
gaagctccataactgaaggg

SEQ ID NO: 446468 - DNA, 20 bp, mouse
gagaaggctgccgcgacggt

SEQ ID NO: 446469 - DNA, 20 bp, mouse
gaagaagctccataactgaa

SEQ ID NO: 446470 - DNA, 20 bp, mouse
gggtgagaaggctgccgcga

SEQ ID NO: 446471 - DNA, 20 bp, mouse
gccccaggactcccaagaat

SEQ ID NO: 446472 - DNA, 20 bp, mouse
ggggcgtcgggggaatctta

SEQ ID NO: 446473 - DNA, 20 bp, mouse
gcgatgaagcccgctcggta

SEQ ID NO: 446474 - DNA, 20 bp, mouse
ggaggctggagtgaccttgg

SEQ ID NO: 446475 - DNA, 20 bp, mouse
gagttatggagcttcttagt

SEQ ID NO: 446476 - DNA, 20 bp, mouse
gtccgggagccaggccaagt

SEQ ID NO: 446477 - DNA, 20 bp, mouse
gggagccaggccaagtgggc

SEQ ID NO: 446478 - DNA, 20 bp, mouse
ggcgaggccggcggacgcac

SEQ ID NO: 446479 - DNA, 20 bp, mouse
gagatcgcctgcgatcggag

SEQ ID NO: 446480 - DNA, 20 bp, mouse
gttccgagcgcgcggaacag

SEQ ID NO: 446481 - DNA, 20 bp, mouse
ggccaggccaagtgggccgg

SEQ ID NO: 446482 - DNA, 20 bp, mouse
gtcgcctgcgatcggagagg

SEQ ID NO: 446483 - DNA, 20 bp, mouse
gagcgcgcggaacagaggcg

SEQ ID NO: 446484 - DNA, 20 bp, mouse
gggaggcgagtactacacta

SEQ ID NO: 446485 - DNA, 20 bp, mouse
gcggcggacgcaccggccgg

SEQ ID NO: 446486 - DNA, 20 bp, mouse
gggccctggacagactgcag

SEQ ID NO: 446487 - DNA, 20 bp, mouse
gctccactgcagtctgtcca

SEQ ID NO: 446488 - DNA, 20 bp, mouse
gcagttgattgcctcaggag

SEQ ID NO: 446489 - DNA, 20 bp, mouse
gagccttctgctcacggaca

SEQ ID NO: 446490 - DNA, 20 bp, mouse
gtctccacaaagctcggccc

SEQ ID NO: 446491 - DNA, 20 bp, mouse
gcaggagtagagagggattt

SEQ ID NO: 446492 - DNA, 20 bp, mouse
ggccactgtaggactctcaa

SEQ ID NO: 446493 - DNA, 20 bp, mouse
gccatgagacaggagtagag

SEQ ID NO: 446494 - DNA, 20 bp, mouse
gcgtatgggatggccactgt

SEQ ID NO: 446495 - DNA, 20 bp, mouse
gtaccttgtccgtgagcaga

SEQ ID NO: 446496 - DNA, 20 bp, mouse
gacagagcagaagaccgtgg

SEQ ID NO: 446497 - DNA, 20 bp, mouse
ggagcagaagaccgtggtgg

SEQ ID NO: 446498 - DNA, 20 bp, mouse
ggatgctcctgcctccacca

SEQ ID NO: 446499 - DNA, 20 bp, mouse
ggaactgcagctctcgggat

SEQ ID NO: 446500 - DNA, 20 bp, mouse
gtctcgggatgggaaggtta

SEQ ID NO: 446501 - DNA, 20 bp, mouse
gtgcagctctcgggatggga

SEQ ID NO: 446502 - DNA, 20 bp, mouse
ggacaccctgccactcgccc

SEQ ID NO: 446503 - DNA, 20 bp, mouse
gcgagtggcagggtgtcccc

SEQ ID NO: 446504 - DNA, 20 bp, mouse
gagaagaccgtggtggaggc

SEQ ID NO: 446505 - DNA, 20 bp, mouse
ggcatcctgggcgagtggca

SEQ ID NO: 446506 - DNA, 20 bp, mouse
gaacgcgagggaagtagtca

SEQ ID NO: 446507 - DNA, 20 bp, mouse
ggacaccaggtgcaacgcga

SEQ ID NO: 446508 - DNA, 20 bp, mouse
gataaggccaaagaggtcta

SEQ ID NO: 446509 - DNA, 20 bp, mouse
gagacctctgcagaaagcgg

SEQ ID NO: 446510 - DNA, 20 bp, mouse
gtagaggacagcggtggaga

SEQ ID NO: 446511 - DNA, 20 bp, mouse
gtcctctaagaggtacccag

SEQ ID NO: 446512 - DNA, 20 bp, mouse
gttacctctgcatttgaagt

SEQ ID NO: 446513 - DNA, 20 bp, mouse
gtgaatgtggaactcaagta

SEQ ID NO: 446514 - DNA, 20 bp, mouse
gagttctcccgagatcctcc

SEQ ID NO: 446515 - DNA, 20 bp, mouse
gtgaagatgcacctgaccaa

SEQ ID NO: 446516 - DNA, 20 bp, mouse
gtcggcccagaattagtgga

SEQ ID NO: 446517 - DNA, 20 bp, mouse
gaattctgggccgagcgctc

SEQ ID NO: 446518 - DNA, 20 bp, mouse
ggctccgccactgtcacttt

SEQ ID NO: 446519 - DNA, 20 bp, mouse
gggcgcgtgggaattcctaa

SEQ ID NO: 446520 - DNA, 20 bp, mouse
gaggcatgaacgcgacccgg

SEQ ID NO: 446521 - DNA, 20 bp, mouse
ggagctgtggagcctggtgc

SEQ ID NO: 446522 - DNA, 20 bp, mouse
gaggtgcgtatggtgagtga

SEQ ID NO: 446523 - DNA, 20 bp, mouse
ggagaggcatgaacgcgacc

SEQ ID NO: 446524 - DNA, 20 bp, mouse
gaaatccatccactaattct

SEQ ID NO: 446525 - DNA, 20 bp, mouse
ggatagtacttactcaggtc

SEQ ID NO: 446526 - DNA, 20 bp, mouse
gtctgaaggtgaagataatg

SEQ ID NO: 446527 - DNA, 20 bp, mouse
ggtacagacactcagtatgt

SEQ ID NO: 446528 - DNA, 20 bp, mouse
gttgacaacagcacattaca

SEQ ID NO: 446529 - DNA, 20 bp, mouse
gaacagcacattacaaggaa

SEQ ID NO: 446530 - DNA, 20 bp, mouse
gtgtgctgttgtcaaccata

SEQ ID NO: 446531 - DNA, 20 bp, mouse
ggacactcagtatgtaggaa

SEQ ID NO: 446532 - DNA, 20 bp, mouse
gttgtcttcaactggtcatc

SEQ ID NO: 446533 - DNA, 20 bp, mouse
gcagattcactatccttctc

SEQ ID NO: 446534 - DNA, 20 bp, mouse
gtcctcttagaagagtatac

SEQ ID NO: 446535 - DNA, 20 bp, mouse
ggtactggacaggaaactgt

SEQ ID NO: 446536 - DNA, 20 bp, mouse
ggggcgctggatgagagcag

SEQ ID NO: 446537 - DNA, 20 bp, mouse
gggacctcggagcatgccct

SEQ ID NO: 446538 - DNA, 20 bp, mouse
ggcgcccagggcatgctccg

SEQ ID NO: 446539 - DNA, 20 bp, mouse
ggagagcagagggaacgttg

SEQ ID NO: 446540 - DNA, 20 bp, mouse
gcagcacccggcctcggcag

SEQ ID NO: 446541 - DNA, 20 bp, mouse
ggaggtccagcacccggcct

SEQ ID NO: 446542 - DNA, 20 bp, mouse
gacgttgtgggtgactgcgg

SEQ ID NO: 446543 - DNA, 20 bp, mouse
ggagtagcaagggccctgga

SEQ ID NO: 446544 - DNA, 20 bp, mouse
gccagttgcagacttcggga

SEQ ID NO: 446545 - DNA, 20 bp, mouse
ggaaagcctggccactgccg

SEQ ID NO: 446546 - DNA, 20 bp, mouse
gatgtacaccagtcacaggt

SEQ ID NO: 446547 - DNA, 20 bp, mouse
ggacggcgcccacctgtgac

SEQ ID NO: 446548 - DNA, 20 bp, mouse
ggtgttctgccggccccaga

SEQ ID NO: 446549 - DNA, 20 bp, mouse
gcacaggtgggcgccgtctg

SEQ ID NO: 446550 - DNA, 20 bp, mouse
gtctggacagcccctggaag

SEQ ID NO: 446551 - DNA, 20 bp, mouse
gagtatggagggaacaccaa

SEQ ID NO: 446552 - DNA, 20 bp, mouse
gagtgatgtacaccagtcac

SEQ ID NO: 446553 - DNA, 20 bp, mouse
gcccccagaagcagctgatc

SEQ ID NO: 446554 - DNA, 20 bp, mouse
gcccacccaggcttaccctc

SEQ ID NO: 446555 - DNA, 20 bp, mouse
gctggcatctggagtatgga

SEQ ID NO: 446556 - DNA, 20 bp, mouse
gtggtgtctagaataaatga

SEQ ID NO: 446557 - DNA, 20 bp, mouse
gcaacaaagtcaggagggaa

SEQ ID NO: 446558 - DNA, 20 bp, mouse
gcctgcctggcaacaaagtc

SEQ ID NO: 446559 - DNA, 20 bp, mouse
ggagagacgcagcaactctg

SEQ ID NO: 446560 - DNA, 20 bp, mouse
ggcagagcacggggctcaca

SEQ ID NO: 446561 - DNA, 20 bp, mouse
gaggctttggtggtaactaa

SEQ ID NO: 446562 - DNA, 20 bp, mouse
gcctgtgtgtacggccacag

SEQ ID NO: 446563 - DNA, 20 bp, mouse
gtaaatgagggctagaacac

SEQ ID NO: 446564 - DNA, 20 bp, mouse
gctcacagggctcttacctg

SEQ ID NO: 446565 - DNA, 20 bp, mouse
gagaagacatggtcactgtg

SEQ ID NO: 446566 - DNA, 20 bp, mouse
gaagagtctggaccaatgat

SEQ ID NO: 446567 - DNA, 20 bp, mouse
ggtacccggaagccatgtgc

SEQ ID NO: 446568 - DNA, 20 bp, mouse
gcgctactggtgtgagtacc

SEQ ID NO: 446569 - DNA, 20 bp, mouse
gcccggaagccatgtgccgg

SEQ ID NO: 446570 - DNA, 20 bp, mouse
gccgcagctggtagtcgagg

SEQ ID NO: 446571 - DNA, 20 bp, mouse
gtggaccaatgatgggccag

SEQ ID NO: 446572 - DNA, 20 bp, mouse
gaaatcccctggcccatcat

SEQ ID NO: 446573 - DNA, 20 bp, mouse
ggattctgtcacgaagacgg

SEQ ID NO: 446574 - DNA, 20 bp, mouse
gtggttgaggtgaaatcccc

SEQ ID NO: 446575 - DNA, 20 bp, mouse
gaagtggcaagacaagagtc

SEQ ID NO: 446576 - DNA, 20 bp, mouse
gagggccggagcccccatgg

SEQ ID NO: 446577 - DNA, 20 bp, mouse
gagcagggaaggccacagga

SEQ ID NO: 446578 - DNA, 20 bp, mouse
gaggagggccggagccccca

SEQ ID NO: 446579 - DNA, 20 bp, mouse
ggtgacagctgccgccatgg

SEQ ID NO: 446580 - DNA, 20 bp, mouse
ggtgagccatggcaacagca

SEQ ID NO: 446581 - DNA, 20 bp, mouse
gcaagctggatccttcttcc

SEQ ID NO: 446582 - DNA, 20 bp, mouse
ggcaggggcgaaggtcgcca

SEQ ID NO: 446583 - DNA, 20 bp, mouse
ggccctggaaccaagcaagc

SEQ ID NO: 446584 - DNA, 20 bp, mouse
gcaggtgacagctgccgcca

SEQ ID NO: 446585 - DNA, 20 bp, mouse
gtctgggccaaggtccccgg

SEQ ID NO: 446586 - DNA, 20 bp, mouse
gcgaggagcccctctaccag

SEQ ID NO: 446587 - DNA, 20 bp, mouse
gggtccggcccgctgctccg

SEQ ID NO: 446588 - DNA, 20 bp, mouse
gtgcgagtcctctggtagag

SEQ ID NO: 446589 - DNA, 20 bp, mouse
ggcgtgataatcacccgagt

SEQ ID NO: 446590 - DNA, 20 bp, mouse
gccagggccccgagcgaact

SEQ ID NO: 446591 - DNA, 20 bp, mouse
gagccgcttggaagtctcag

SEQ ID NO: 446592 - DNA, 20 bp, mouse
gcggtcggggaggatccctg

SEQ ID NO: 446593 - DNA, 20 bp, mouse
gacagagatctgcagtggtc

SEQ ID NO: 446594 - DNA, 20 bp, mouse
gctgtccagagggaaccgca

SEQ ID NO: 446595 - DNA, 20 bp, mouse
gggcgagaggccaggaggtt

SEQ ID NO: 446596 - DNA, 20 bp, mouse
gacgtcccggacagaagagt

SEQ ID NO: 446597 - DNA, 20 bp, mouse
gtccgggacgttaagaacat

SEQ ID NO: 446598 - DNA, 20 bp, mouse
gcatcggaagaaggagagag

SEQ ID NO: 446599 - DNA, 20 bp, mouse
gctccagaagccaggcgcag

SEQ ID NO: 446600 - DNA, 20 bp, mouse
ggagctgacgtctccagcag

SEQ ID NO: 446601 - DNA, 20 bp, mouse
ggccaggcgcagcggagctg

SEQ ID NO: 446602 - DNA, 20 bp, mouse
ggcacacctggccttccgat

SEQ ID NO: 446603 - DNA, 20 bp, mouse
ggctgatgcccggagctgaa

SEQ ID NO: 446604 - DNA, 20 bp, mouse
gacctgggccgagacgacaa

SEQ ID NO: 446605 - DNA, 20 bp, mouse
gggagcctactcttctgtcc

SEQ ID NO: 446606 - DNA, 20 bp, mouse
gtccgcgcagtccggaactg

SEQ ID NO: 446607 - DNA, 20 bp, mouse
ggcagtccggaactgcggtg

SEQ ID NO: 446608 - DNA, 20 bp, mouse
gacgccatacctctctgtcc

SEQ ID NO: 446609 - DNA, 20 bp, mouse
gggtatggcgtgagtcggac

SEQ ID NO: 446610 - DNA, 20 bp, mouse
gaggccatgcccgaccataa

SEQ ID NO: 446611 - DNA, 20 bp, mouse
gtagggcctcacctaagtcc

SEQ ID NO: 446612 - DNA, 20 bp, mouse
gatagggtaccccagacccc

SEQ ID NO: 446613 - DNA, 20 bp, mouse
ggatcccgggagctttaccg

SEQ ID NO: 446614 - DNA, 20 bp, mouse
gaggccctacccgtccacaa

SEQ ID NO: 446615 - DNA, 20 bp, mouse
gtggggccacaccgcagttc

SEQ ID NO: 446616 - DNA, 20 bp, mouse
gcgctggaagagggcggcag

SEQ ID NO: 446617 - DNA, 20 bp, mouse
gacgcctgcgcgctggaaga

SEQ ID NO: 446618 - DNA, 20 bp, mouse
gagcggcttgggcatggcag

SEQ ID NO: 446619 - DNA, 20 bp, mouse
gggcttgggcatggcagagg

SEQ ID NO: 446620 - DNA, 20 bp, mouse
gaagagggcggcagcggctt

SEQ ID NO: 446621 - DNA, 20 bp, mouse
gaccgaggacgagcgaccaa

SEQ ID NO: 446622 - DNA, 20 bp, mouse
gaagagtgggaggttcccgg

SEQ ID NO: 446623 - DNA, 20 bp, mouse
gacgccaggtgagacccccg

SEQ ID NO: 446624 - DNA, 20 bp, mouse
gtccagcgtcggagggggaa

SEQ ID NO: 446625 - DNA, 20 bp, mouse
gccacgccgcggcaaactcg

SEQ ID NO: 446626 - DNA, 20 bp, mouse
gccttcccagactccaggac

SEQ ID NO: 446627 - DNA, 20 bp, mouse
ggcggcgcaggggtgagtag

SEQ ID NO: 446628 - DNA, 20 bp, mouse
ggccagccgcgattcttcag

SEQ ID NO: 446629 - DNA, 20 bp, mouse
gggcggctgtagcggcgcag

SEQ ID NO: 446630 - DNA, 20 bp, mouse
gcgcagccggtcctggagtc

SEQ ID NO: 446631 - DNA, 20 bp, mouse
gcaagcgcgggactccgggg

SEQ ID NO: 446632 - DNA, 20 bp, mouse
gggcggggtcccacttctga

SEQ ID NO: 446633 - DNA, 20 bp, mouse
gtgggtgacaggtaagatca

SEQ ID NO: 446634 - DNA, 20 bp, mouse
ggttcagtcacgcaaacctg

SEQ ID NO: 446635 - DNA, 20 bp, mouse
ggaggaagtgacgacaatcc

SEQ ID NO: 446636 - DNA, 20 bp, mouse
gggagtgagatgtggctgtg

SEQ ID NO: 446637 - DNA, 20 bp, mouse
gtgtgagtgagtctgggcga

SEQ ID NO: 446638 - DNA, 20 bp, mouse
ggctgtgaggtgtcggtgtg

SEQ ID NO: 446639 - DNA, 20 bp, mouse
gccgaagagcccctagacgg

SEQ ID NO: 446640 - DNA, 20 bp, mouse
gagatgtggctgtgaggtgt

SEQ ID NO: 446641 - DNA, 20 bp, mouse
gaggcggaggctagcgaagg

SEQ ID NO: 446642 - DNA, 20 bp, mouse
gtagcgaagggggctccctc

SEQ ID NO: 446643 - DNA, 20 bp, mouse
gggcctgcgtagtcctcccg

SEQ ID NO: 446644 - DNA, 20 bp, mouse
gccgtcggccccacaggctc

SEQ ID NO: 446645 - DNA, 20 bp, mouse
gcaggcacgagggacaaagg

SEQ ID NO: 446646 - DNA, 20 bp, mouse
gcggcggcggcgacaccccg

SEQ ID NO: 446647 - DNA, 20 bp, mouse
gccgccgccacaggacgacg

SEQ ID NO: 446648 - DNA, 20 bp, mouse
gcaccccgcggcgctcggac

SEQ ID NO: 446649 - DNA, 20 bp, mouse
gcgtccacgtcgtcctgtgg

SEQ ID NO: 446650 - DNA, 20 bp, mouse
ggcgcgtccacgtcgtcctg

SEQ ID NO: 446651 - DNA, 20 bp, mouse
gcctgggcctggcgccccga

SEQ ID NO: 446652 - DNA, 20 bp, mouse
ggctgcgcgcagtgccctcg

SEQ ID NO: 446653 - DNA, 20 bp, mouse
gcgcgggaggatcctatcct

SEQ ID NO: 446654 - DNA, 20 bp, mouse
gtccatcgtcctgacgtcgg

SEQ ID NO: 446655 - DNA, 20 bp, mouse
gggcccgtccgagcgccgcg

SEQ ID NO: 446656 - DNA, 20 bp, mouse
ggcgcagcgcagacaacggc

SEQ ID NO: 446657 - DNA, 20 bp, mouse
gatgaggtcgcacatctggg

SEQ ID NO: 446658 - DNA, 20 bp, mouse
gggtgcccggagcacggagt

SEQ ID NO: 446659 - DNA, 20 bp, mouse
gtcaatgaggtcgcacatct

SEQ ID NO: 446660 - DNA, 20 bp, mouse
gaacgaagcccaggtcctgg

SEQ ID NO: 446661 - DNA, 20 bp, mouse
gcgcagacaacggcgggcga

SEQ ID NO: 446662 - DNA, 20 bp, mouse
ggatcgcccgcaggacactg

SEQ ID NO: 446663 - DNA, 20 bp, mouse
ggagtgggcgcggggactga

SEQ ID NO: 446664 - DNA, 20 bp, mouse
gaggagaggactccaggcta

SEQ ID NO: 446665 - DNA, 20 bp, mouse
gtctgggcggcgtagggccc

SEQ ID NO: 446666 - DNA, 20 bp, mouse
gctcccctccctccgaacgg

SEQ ID NO: 446667 - DNA, 20 bp, mouse
gcgcctcccctccctccgaa

SEQ ID NO: 446668 - DNA, 20 bp, mouse
gtaccaccgttcggagggag

SEQ ID NO: 446669 - DNA, 20 bp, mouse
gggtggtagcaactgcatcc

SEQ ID NO: 446670 - DNA, 20 bp, mouse
gagttgctaccaccgttcgg

SEQ ID NO: 446671 - DNA, 20 bp, mouse
gcacagcggacctaccggta

SEQ ID NO: 446672 - DNA, 20 bp, mouse
ggagtttagacctaccgcag

SEQ ID NO: 446673 - DNA, 20 bp, mouse
gtgcagttgctaccaccgtt

SEQ ID NO: 446674 - DNA, 20 bp, mouse
gtgcagggctgaactgtaga

SEQ ID NO: 446675 - DNA, 20 bp, mouse
gaggctcggtgcttccaggc

SEQ ID NO: 446676 - DNA, 20 bp, mouse
gggaatccgggtgttcacgg

SEQ ID NO: 446677 - DNA, 20 bp, mouse
gcccagagccccccagccag

SEQ ID NO: 446678 - DNA, 20 bp, mouse
ggccatggccgaagactact

SEQ ID NO: 446679 - DNA, 20 bp, mouse
gcgggcgcttgcgagcacgg

SEQ ID NO: 446680 - DNA, 20 bp, mouse
ggtgaacacccggattccag

SEQ ID NO: 446681 - DNA, 20 bp, mouse
gcaagcgcccgctggaatcc

SEQ ID NO: 446682 - DNA, 20 bp, mouse
gagagagccagccggaccct

SEQ ID NO: 446683 - DNA, 20 bp, mouse
ggaggacacgctcaccggag

SEQ ID NO: 446684 - DNA, 20 bp, mouse
gcccgcagtggccaagctca

SEQ ID NO: 446685 - DNA, 20 bp, mouse
ggggccgccgccggctgagg

SEQ ID NO: 446686 - DNA, 20 bp, mouse
gctcagacgaacgagagcgg

SEQ ID NO: 446687 - DNA, 20 bp, mouse
ggcactcagacgaacgagag

SEQ ID NO: 446688 - DNA, 20 bp, mouse
gtacccagcgcccggcagtc

SEQ ID NO: 446689 - DNA, 20 bp, mouse
gcgctccggggaacaggcgg

SEQ ID NO: 446690 - DNA, 20 bp, mouse
ggctcgctccggggaacagg

SEQ ID NO: 446691 - DNA, 20 bp, mouse
gcggaaggcgcgaggttggg

SEQ ID NO: 446692 - DNA, 20 bp, mouse
gactcccggccaccgagccg

SEQ ID NO: 446693 - DNA, 20 bp, mouse
gatcggctgcgaactctcag

SEQ ID NO: 446694 - DNA, 20 bp, mouse
ggccggcggccctcgcggag

SEQ ID NO: 446695 - DNA, 20 bp, mouse
gggatcgtgacgcctgtcag

SEQ ID NO: 446696 - DNA, 20 bp, mouse
ggaagctgtaacctgagctg

SEQ ID NO: 446697 - DNA, 20 bp, mouse
ggtgcaggaaggtgggtaag

SEQ ID NO: 446698 - DNA, 20 bp, mouse
ggggaggggtgcaggaaggt

SEQ ID NO: 446699 - DNA, 20 bp, mouse
gtaacctgagctgcgggaga

SEQ ID NO: 446700 - DNA, 20 bp, mouse
gacacgcgcagagtccgccg

SEQ ID NO: 446701 - DNA, 20 bp, mouse
ggagccggctcgccacgacc

SEQ ID NO: 446702 - DNA, 20 bp, mouse
gagagccagggtcccgagta

SEQ ID NO: 446703 - DNA, 20 bp, mouse
gagccgggcggtccttaaag

SEQ ID NO: 446704 - DNA, 20 bp, mouse
ggctcaggttacagcttctt

SEQ ID NO: 446705 - DNA, 20 bp, mouse
gctcccttctcccgcagctc

SEQ ID NO: 446706 - DNA, 20 bp, mouse
gtcagcaagggactcctcgg

SEQ ID NO: 446707 - DNA, 20 bp, mouse
gtgttggagaagtggagcgg

SEQ ID NO: 446708 - DNA, 20 bp, mouse
gtagagaaaccgggacgcgg

SEQ ID NO: 446709 - DNA, 20 bp, mouse
gagtgggacgcggcacctac

SEQ ID NO: 446710 - DNA, 20 bp, mouse
gctgaaggcggaccgcggag

SEQ ID NO: 446711 - DNA, 20 bp, mouse
gcggagctcccgggacgagg

SEQ ID NO: 446712 - DNA, 20 bp, mouse
ggccttgtagacatgcccgt

SEQ ID NO: 446713 - DNA, 20 bp, mouse
gaacctggtgggccgcgccg

SEQ ID NO: 446714 - DNA, 20 bp, mouse
gtccgctgcggagccccgga

SEQ ID NO: 446715 - DNA, 20 bp, mouse
gggcgcgaccggccagcggg

SEQ ID NO: 446716 - DNA, 20 bp, mouse
gaagttggacaaattgtcaa

SEQ ID NO: 446717 - DNA, 20 bp, mouse
gcggcagtcccagctcggga

SEQ ID NO: 446718 - DNA, 20 bp, mouse
gagcacggcagtcccagctc

SEQ ID NO: 446719 - DNA, 20 bp, mouse
gctcggagcggaggacctgg

SEQ ID NO: 446720 - DNA, 20 bp, mouse
gccgtctggagcagtggggg

SEQ ID NO: 446721 - DNA, 20 bp, mouse
ggcgggcccgacactcggag

SEQ ID NO: 446722 - DNA, 20 bp, mouse
gagggaaacgcgggaaggag

SEQ ID NO: 446723 - DNA, 20 bp, mouse
gggagagggcacgtacggag

SEQ ID NO: 446724 - DNA, 20 bp, mouse
gaggtggagaagattggaga

SEQ ID NO: 446725 - DNA, 20 bp, mouse
gagattggagagggcacgta

SEQ ID NO: 446726 - DNA, 20 bp, mouse
gactgccgaaggctgcggaa

SEQ ID NO: 446727 - DNA, 20 bp, mouse
ggagtgactgccgaaggctg

SEQ ID NO: 446728 - DNA, 20 bp, mouse
gctctacagggatccagcat

SEQ ID NO: 446729 - DNA, 20 bp, mouse
gtccctgtagagtaggatct

SEQ ID NO: 446730 - DNA, 20 bp, mouse
ggcgctagcagatctctaca

SEQ ID NO: 446731 - DNA, 20 bp, mouse
ggcccagatcctactctaca

SEQ ID NO: 446732 - DNA, 20 bp, mouse
gtggtgctatggccacgtcc

SEQ ID NO: 446733 - DNA, 20 bp, mouse
gagcacctttccgcagcctt

SEQ ID NO: 446734 - DNA, 20 bp, mouse
gcggaaaggtgctgcctaga

SEQ ID NO: 446735 - DNA, 20 bp, mouse
ggagcgcagtgggcatccct

SEQ ID NO: 446736 - DNA, 20 bp, mouse
gaccgcagccccccaaactt

SEQ ID NO: 446737 - DNA, 20 bp, mouse
gcaacttgccaaagtttggg

SEQ ID NO: 446738 - DNA, 20 bp, mouse
gcccgcaacttgccaaagtt

SEQ ID NO: 446739 - DNA, 20 bp, mouse
gctcgctcgctctcactcac

SEQ ID NO: 446740 - DNA, 20 bp, mouse
gcactcaccggcgttgaggg

SEQ ID NO: 446741 - DNA, 20 bp, mouse
gtctcactcaccggcgttga

SEQ ID NO: 446742 - DNA, 20 bp, mouse
gcgacacttgcggcgcgggg

SEQ ID NO: 446743 - DNA, 20 bp, mouse
gtggggggctgcggtccccg

SEQ ID NO: 446744 - DNA, 20 bp, mouse
gcgggccgcgccggcaaata

SEQ ID NO: 446745 - DNA, 20 bp, mouse
gtcaccggcgttgagggcgg

SEQ ID NO: 446746 - DNA, 20 bp, mouse
ggggctgaaggaggccaggg

SEQ ID NO: 446747 - DNA, 20 bp, mouse
gccggcacctgggctgaagg

SEQ ID NO: 446748 - DNA, 20 bp, mouse
gcccttcttccggaagacac

SEQ ID NO: 446749 - DNA, 20 bp, mouse
gcagtgtgagagagctgaga

SEQ ID NO: 446750 - DNA, 20 bp, mouse
gccggaagacaccggcacct

SEQ ID NO: 446751 - DNA, 20 bp, mouse
ggaagtaccccccatactgg

SEQ ID NO: 446752 - DNA, 20 bp, mouse
gccccgggagggattcaggg

SEQ ID NO: 446753 - DNA, 20 bp, mouse
gtatctccactcctccgggg

SEQ ID NO: 446754 - DNA, 20 bp, mouse
gaccccccgggagggattca

SEQ ID NO: 446755 - DNA, 20 bp, mouse
ggtttatctccactcctccg

SEQ ID NO: 446756 - DNA, 20 bp, mouse
ggccagccggccgctcctct

SEQ ID NO: 446757 - DNA, 20 bp, mouse
gccaaccccagaggagcggc

SEQ ID NO: 446758 - DNA, 20 bp, mouse
ggctggcggccgccgcactg

SEQ ID NO: 446759 - DNA, 20 bp, mouse
ggagcccggggtactgctgg

SEQ ID NO: 446760 - DNA, 20 bp, mouse
gtcccaactcctcagtgcgg

SEQ ID NO: 446761 - DNA, 20 bp, mouse
gtcctctggggttggctgtc

SEQ ID NO: 446762 - DNA, 20 bp, mouse
ggccgttggaggttagtcaa

SEQ ID NO: 446763 - DNA, 20 bp, mouse
gtcccttgactaacctccaa

SEQ ID NO: 446764 - DNA, 20 bp, mouse
ggacctcgactgcccggaca

SEQ ID NO: 446765 - DNA, 20 bp, mouse
gaggctcgtctagcaggccc

SEQ ID NO: 446766 - DNA, 20 bp, mouse
gcgggccagaccatagacac

SEQ ID NO: 446767 - DNA, 20 bp, mouse
gtacaccggggatcggtccc

SEQ ID NO: 446768 - DNA, 20 bp, mouse
gcctgcggcgccatacaccg

SEQ ID NO: 446769 - DNA, 20 bp, mouse
gagctcgcggcctgtgtcta

SEQ ID NO: 446770 - DNA, 20 bp, mouse
ggctgcccgggaccgatccc

SEQ ID NO: 446771 - DNA, 20 bp, mouse
gcacaggccgcgagctagag

SEQ ID NO: 446772 - DNA, 20 bp, mouse
gccgggcagctggacgcttc

SEQ ID NO: 446773 - DNA, 20 bp, mouse
ggctcggctaagagctctgg

SEQ ID NO: 446774 - DNA, 20 bp, mouse
gtgtatggcgccgcaggaac

SEQ ID NO: 446775 - DNA, 20 bp, mouse
ggccagcgacgcgcacgcgt

SEQ ID NO: 446776 - DNA, 20 bp, mouse
gtagaaccgagggcccgcag

SEQ ID NO: 446777 - DNA, 20 bp, mouse
gccctcggttctaagactcc

SEQ ID NO: 446778 - DNA, 20 bp, mouse
gcacctcctctgcaacgcca

SEQ ID NO: 446779 - DNA, 20 bp, mouse
gcagtgcgtggtgagcaggt

SEQ ID NO: 446780 - DNA, 20 bp, mouse
ggccgggagtcttagaaccg

SEQ ID NO: 446781 - DNA, 20 bp, mouse
gggccctggcgttgcagagg

SEQ ID NO: 446782 - DNA, 20 bp, mouse
gcggccgcggggacccctgc

SEQ ID NO: 446783 - DNA, 20 bp, mouse
gcccggccctggcgttgcag

SEQ ID NO: 446784 - DNA, 20 bp, mouse
ggttctaagactcccggccc

SEQ ID NO: 446785 - DNA, 20 bp, mouse
gagcctgccggtatagctga

SEQ ID NO: 446786 - DNA, 20 bp, mouse
ggcggcccgggtgctcgact

SEQ ID NO: 446787 - DNA, 20 bp, mouse
ggcagtcaggcaggctcccg

SEQ ID NO: 446788 - DNA, 20 bp, mouse
gggtgctcgactcggcgcgg

SEQ ID NO: 446789 - DNA, 20 bp, mouse
gggtgccgcagtggaagcac

SEQ ID NO: 446790 - DNA, 20 bp, mouse
ggccgcggcgcgcattgcgg

SEQ ID NO: 446791 - DNA, 20 bp, mouse
ggcagtggaagcacaggctg

SEQ ID NO: 446792 - DNA, 20 bp, mouse
gcacaggctggggctcgacg

SEQ ID NO: 446793 - DNA, 20 bp, mouse
gcgcggcgtctgcagaacct

SEQ ID NO: 446794 - DNA, 20 bp, mouse
ggcaatgcgcgccgcggccc

SEQ ID NO: 446795 - DNA, 20 bp, mouse
gcctgctgcggaggccactg

SEQ ID NO: 446796 - DNA, 20 bp, mouse
gccgccgcggcgcagcagag

SEQ ID NO: 446797 - DNA, 20 bp, mouse
gcccttggccgaggaagcag

SEQ ID NO: 446798 - DNA, 20 bp, mouse
ggcccgggcgcgcggacggg

SEQ ID NO: 446799 - DNA, 20 bp, mouse
gcctcggccaagaagaagaa

SEQ ID NO: 446800 - DNA, 20 bp, mouse
ggagccgctctgctgcgccg

SEQ ID NO: 446801 - DNA, 20 bp, mouse
gctgccggaggagaaaaaga

SEQ ID NO: 446802 - DNA, 20 bp, mouse
gctcacctggaagcgcctag

SEQ ID NO: 446803 - DNA, 20 bp, mouse
gaagaaggcgccgcccgcgg

SEQ ID NO: 446804 - DNA, 20 bp, mouse
ggcgcgccgccggccggcaa

SEQ ID NO: 446805 - DNA, 20 bp, mouse
gcggccgtccgtgctcatct

SEQ ID NO: 446806 - DNA, 20 bp, mouse
gacgcggaccttgcagttgt

SEQ ID NO: 446807 - DNA, 20 bp, mouse
gcttcacagggcaaatacta

SEQ ID NO: 446808 - DNA, 20 bp, mouse
ggtgtcctgcgggtgacccg

SEQ ID NO: 446809 - DNA, 20 bp, mouse
gagcggaggactcctgagaa

SEQ ID NO: 446810 - DNA, 20 bp, mouse
ggctaggagaaggtatcact

SEQ ID NO: 446811 - DNA, 20 bp, mouse
ggccaccgcgggtcacccgc

SEQ ID NO: 446812 - DNA, 20 bp, mouse
gcaaggtccgcgtccgaaac

SEQ ID NO: 446813 - DNA, 20 bp, mouse
gacctcggagaggggctacg

SEQ ID NO: 446814 - DNA, 20 bp, mouse
gctgtgacttggccaagagc

SEQ ID NO: 446815 - DNA, 20 bp, mouse
gctcacctcccacaactgca

SEQ ID NO: 446816 - DNA, 20 bp, mouse
gcagccccgcataatggatc

SEQ ID NO: 446817 - DNA, 20 bp, mouse
gcagcatacagttaacaagt

SEQ ID NO: 446818 - DNA, 20 bp, mouse
gttgtcgcagccccgcataa

SEQ ID NO: 446819 - DNA, 20 bp, mouse
gtccccagatccattatgcg

SEQ ID NO: 446820 - DNA, 20 bp, mouse
gggcaatggtgccttagtgt

SEQ ID NO: 446821 - DNA, 20 bp, mouse
gtgtggacaggcacatgatt

SEQ ID NO: 446822 - DNA, 20 bp, mouse
gacagttaacaagtgggcaa

SEQ ID NO: 446823 - DNA, 20 bp, mouse
ggacaggcacatgattagga

SEQ ID NO: 446824 - DNA, 20 bp, mouse
gtctcccggccacgcgtgaa

SEQ ID NO: 446825 - DNA, 20 bp, mouse
gcccgtggtggaactacttg

SEQ ID NO: 446826 - DNA, 20 bp, mouse
ggaagaagcgccgggaaaga

SEQ ID NO: 446827 - DNA, 20 bp, mouse
ggctgcggtttgaattccag

SEQ ID NO: 446828 - DNA, 20 bp, mouse
gccctgcctgggaccctcag

SEQ ID NO: 446829 - DNA, 20 bp, mouse
gctgagaacaagagctgggt

SEQ ID NO: 446830 - DNA, 20 bp, mouse
gttccgtaggaagaagcgcc

SEQ ID NO: 446831 - DNA, 20 bp, mouse
gggagtgagtcgccatcaac

SEQ ID NO: 446832 - DNA, 20 bp, mouse
gttcccggcgcttcttccta

SEQ ID NO: 446833 - DNA, 20 bp, mouse
ggaccccgccttgtttccgt

SEQ ID NO: 446834 - DNA, 20 bp, mouse
gcagccgccgccatctttcc

SEQ ID NO: 446835 - DNA, 20 bp, mouse
gatggactcggggatggaag

SEQ ID NO: 446836 - DNA, 20 bp, mouse
ggcctagcaccaatcctgag

SEQ ID NO: 446837 - DNA, 20 bp, mouse
gaagcacagccgctcaggat

SEQ ID NO: 446838 - DNA, 20 bp, mouse
gagagcacccgacagaggac

SEQ ID NO: 446839 - DNA, 20 bp, mouse
gggctcaagcacagccgctc

SEQ ID NO: 446840 - DNA, 20 bp, mouse
gacggcgacgtggctgaagg

SEQ ID NO: 446841 - DNA, 20 bp, mouse
gggggcagagcacccgacag

SEQ ID NO: 446842 - DNA, 20 bp, mouse
gtccgctgaagacggcgacg

SEQ ID NO: 446843 - DNA, 20 bp, mouse
gcaagctgctcggtaggaga

SEQ ID NO: 446844 - DNA, 20 bp, mouse
ggcacccgacagaggacggg

SEQ ID NO: 446845 - DNA, 20 bp, mouse
ggccgctcaggattggtgct

SEQ ID NO: 446846 - DNA, 20 bp, mouse
ggctcgtgcagtcttcacga

SEQ ID NO: 446847 - DNA, 20 bp, mouse
ggctaggcggagtttcgcag

SEQ ID NO: 446848 - DNA, 20 bp, mouse
gtgcagtcttcacgaaggag

SEQ ID NO: 446849 - DNA, 20 bp, mouse
gctcctccctctactcgcac

SEQ ID NO: 446850 - DNA, 20 bp, mouse
gccggtgactctgttagaca

SEQ ID NO: 446851 - DNA, 20 bp, mouse
ggcggcgcggcgactcggct

SEQ ID NO: 446852 - DNA, 20 bp, mouse
ggcgcggcgactcggctagg

SEQ ID NO: 446853 - DNA, 20 bp, mouse
gccgcgagtccgactccccg

SEQ ID NO: 446854 - DNA, 20 bp, mouse
gctggttgcctaatcgggcc

SEQ ID NO: 446855 - DNA, 20 bp, mouse
gtggcttcaggctgcgggtg

SEQ ID NO: 446856 - DNA, 20 bp, mouse
gcgagtgagaaaccagaccc

SEQ ID NO: 446857 - DNA, 20 bp, mouse
ggcgaccggaagtagctgtt

SEQ ID NO: 446858 - DNA, 20 bp, mouse
ggagggacaggtgaggcctg

SEQ ID NO: 446859 - DNA, 20 bp, mouse
gtaaattcctgcggggtgga

SEQ ID NO: 446860 - DNA, 20 bp, mouse
gtagcttgggtgcccgggtc

SEQ ID NO: 446861 - DNA, 20 bp, mouse
gagaagccctgattctggag

SEQ ID NO: 446862 - DNA, 20 bp, mouse
gccgcccacagcggaagtat

SEQ ID NO: 446863 - DNA, 20 bp, mouse
gaagtatgggcgggacccgt

SEQ ID NO: 446864 - DNA, 20 bp, mouse
gcctcacctgtccctctccg

SEQ ID NO: 446865 - DNA, 20 bp, mouse
gccagtcccctccagaatca

SEQ ID NO: 446866 - DNA, 20 bp, mouse
gcctctctcggaggagctac

SEQ ID NO: 446867 - DNA, 20 bp, mouse
gggagctaccggctgttgtg

SEQ ID NO: 446868 - DNA, 20 bp, mouse
gtggcgtcgctggtctgtcc

SEQ ID NO: 446869 - DNA, 20 bp, mouse
gcccgggagcgcggggacaa

SEQ ID NO: 446870 - DNA, 20 bp, mouse
gcacgcgctcacgaacactc

SEQ ID NO: 446871 - DNA, 20 bp, mouse
gagcgacgccacacaacagc

SEQ ID NO: 446872 - DNA, 20 bp, mouse
ggggcgccggggacatccag

SEQ ID NO: 446873 - DNA, 20 bp, mouse
gcgtcgctggtctgtccggg

SEQ ID NO: 446874 - DNA, 20 bp, mouse
gagaggacgagcgcggaaca

SEQ ID NO: 446875 - DNA, 20 bp, mouse
gagcccgcctcacgaggcga

SEQ ID NO: 446876 - DNA, 20 bp, mouse
gagtgtggcgggaccgggag

SEQ ID NO: 446877 - DNA, 20 bp, mouse
gcacactccaggcccctccg

SEQ ID NO: 446878 - DNA, 20 bp, mouse
gacctctaggggaggagtag

SEQ ID NO: 446879 - DNA, 20 bp, mouse
ggcctggagtgtggcgggac

SEQ ID NO: 446880 - DNA, 20 bp, mouse
ggccgcggccgagcaagacc

SEQ ID NO: 446881 - DNA, 20 bp, mouse
gaagtggcgcggccgcggag

SEQ ID NO: 446882 - DNA, 20 bp, mouse
ggccagagcggcagcagctt

SEQ ID NO: 446883 - DNA, 20 bp, mouse
ggctctgggcgacccgacgt

SEQ ID NO: 446884 - DNA, 20 bp, mouse
ggtggccgtggaggcggaag

SEQ ID NO: 446885 - DNA, 20 bp, mouse
gaggccggaagtggccgtgg

SEQ ID NO: 446886 - DNA, 20 bp, mouse
gaaactgcacagacttcaga

SEQ ID NO: 446887 - DNA, 20 bp, mouse
gctgtgcagtttcctggcag

SEQ ID NO: 446888 - DNA, 20 bp, mouse
gcatgcgcaaatcagcccgg

SEQ ID NO: 446889 - DNA, 20 bp, mouse
gtgaagtctgtgcagtttcc

SEQ ID NO: 446890 - DNA, 20 bp, mouse
ggagcatgcgcaaatcagcc

SEQ ID NO: 446891 - DNA, 20 bp, mouse
gccgcgacggtagaccggag

SEQ ID NO: 446892 - DNA, 20 bp, mouse
ggccacgccggcctctctcc

SEQ ID NO: 446893 - DNA, 20 bp, mouse
gttcacctgtccgaactgag

SEQ ID NO: 446894 - DNA, 20 bp, mouse
gtcgcagtttggaaaagact

SEQ ID NO: 446895 - DNA, 20 bp, mouse
ggtagcacaagtacattcac

SEQ ID NO: 446896 - DNA, 20 bp, mouse
gagaggcgcctcaggagtca

SEQ ID NO: 446897 - DNA, 20 bp, mouse
ggcgcctcaggagtcagggt

SEQ ID NO: 446898 - DNA, 20 bp, mouse
ggtgctagagctgggccgag

SEQ ID NO: 446899 - DNA, 20 bp, mouse
gcctcccaccctgactcctg

SEQ ID NO: 446900 - DNA, 20 bp, mouse
gagcagcctgcagctcggct

SEQ ID NO: 446901 - DNA, 20 bp, mouse
gctgggccgagaggcgcctc

SEQ ID NO: 446902 - DNA, 20 bp, mouse
gcaggctgctgtgctagagc

SEQ ID NO: 446903 - DNA, 20 bp, mouse
ggctggctggagcaccagga

SEQ ID NO: 446904 - DNA, 20 bp, mouse
gtgactgctgcgatccccat

SEQ ID NO: 446905 - DNA, 20 bp, mouse
gcaaccggcgcggttcccat

SEQ ID NO: 446906 - DNA, 20 bp, mouse
gcacctcgccaagtagccct

SEQ ID NO: 446907 - DNA, 20 bp, mouse
ggccttcgcctagggctact

SEQ ID NO: 446908 - DNA, 20 bp, mouse
gccgccggccgaaagccctc

SEQ ID NO: 446909 - DNA, 20 bp, mouse
gtggccaacgccttcgccta

SEQ ID NO: 446910 - DNA, 20 bp, mouse
gtagccctaggcgaaggcgt

SEQ ID NO: 446911 - DNA, 20 bp, mouse
ggccaagtagccctaggcga

SEQ ID NO: 446912 - DNA, 20 bp, mouse
ggagccgccccttgcagcta

SEQ ID NO: 446913 - DNA, 20 bp, mouse
gccaccctagctgcaagggg

SEQ ID NO: 446914 - DNA, 20 bp, mouse
ggaggtcgttgccttgacga

SEQ ID NO: 446915 - DNA, 20 bp, mouse
gtggccaccctagctgcaag

SEQ ID NO: 446916 - DNA, 20 bp, mouse
gcggcaaggtcggccaggag

SEQ ID NO: 446917 - DNA, 20 bp, mouse
gaggagagggcaggacgtat

SEQ ID NO: 446918 - DNA, 20 bp, mouse
gtgccccgagccggcaaggt

SEQ ID NO: 446919 - DNA, 20 bp, mouse
gggaccgtggctcctaacaa

SEQ ID NO: 446920 - DNA, 20 bp, mouse
gggccggcgggactacagga

SEQ ID NO: 446921 - DNA, 20 bp, mouse
ggccgggccggcgggactac

SEQ ID NO: 446922 - DNA, 20 bp, mouse
ggccggacgccctggcaacg

SEQ ID NO: 446923 - DNA, 20 bp, mouse
gacactgcgggtcccttgtt

SEQ ID NO: 446924 - DNA, 20 bp, mouse
gtgcaagtcccagccggccc

SEQ ID NO: 446925 - DNA, 20 bp, mouse
gcgccctcaccccgttgcca

SEQ ID NO: 446926 - DNA, 20 bp, mouse
ggatcaaacagactctatcc

SEQ ID NO: 446927 - DNA, 20 bp, mouse
gcctacaggaacttagtgat

SEQ ID NO: 446928 - DNA, 20 bp, mouse
gctgtaaacttacaatctcc

SEQ ID NO: 446929 - DNA, 20 bp, mouse
gtcttctcattatagattta

SEQ ID NO: 446930 - DNA, 20 bp, mouse
gtaagaactctattaatgtt

SEQ ID NO: 446931 - DNA, 20 bp, mouse
gataatgagaagatagccaa

SEQ ID NO: 446932 - DNA, 20 bp, mouse
ggagtcttttagatgagccc

SEQ ID NO: 446933 - DNA, 20 bp, mouse
gaggaattcgaaacagtccc

SEQ ID NO: 446934 - DNA, 20 bp, mouse
gtgaagggcttttgtcttcc

SEQ ID NO: 446935 - DNA, 20 bp, mouse
gacgagaggtcgatctgagt

SEQ ID NO: 446936 - DNA, 20 bp, mouse
gacggcggccgcgagagtga

SEQ ID NO: 446937 - DNA, 20 bp, mouse
ggagtcccccacctctatcg

SEQ ID NO: 446938 - DNA, 20 bp, mouse
ggcttccccgatagaggtgg

SEQ ID NO: 446939 - DNA, 20 bp, mouse
ggtgaaggcttccccgatag

SEQ ID NO: 446940 - DNA, 20 bp, mouse
gcatgagacggcctgacggg

SEQ ID NO: 446941 - DNA, 20 bp, mouse
ggccgctagggaaggtaaag

SEQ ID NO: 446942 - DNA, 20 bp, mouse
gagaggtgggggactcggca

SEQ ID NO: 446943 - DNA, 20 bp, mouse
ggaaggtaaagcggtgacgg

SEQ ID NO: 446944 - DNA, 20 bp, mouse
gcaacatgagacggcctgac

SEQ ID NO: 446945 - DNA, 20 bp, mouse
gcctgcacaaccgggagaca

SEQ ID NO: 446946 - DNA, 20 bp, mouse
gccgcggtgtcagagtctag

SEQ ID NO: 446947 - DNA, 20 bp, mouse
ggcgatatccagacattcag

SEQ ID NO: 446948 - DNA, 20 bp, mouse
gcgagaggtgtgagccgccg

SEQ ID NO: 446949 - DNA, 20 bp, mouse
ggtctaggggaattggagtc

SEQ ID NO: 446950 - DNA, 20 bp, mouse
gtgtcagagtctaggggaat

SEQ ID NO: 446951 - DNA, 20 bp, mouse
ggaatgtctggatatcgctg

SEQ ID NO: 446952 - DNA, 20 bp, mouse
gagagtcacaggtgtgtccg

SEQ ID NO: 446953 - DNA, 20 bp, mouse
gttcagaggtgagagcttcg

SEQ ID NO: 446954 - DNA, 20 bp, mouse
gtgggtctgagcgtccgtgg

SEQ ID NO: 446955 - DNA, 20 bp, mouse
gcgagggtcaggctatgtcg

SEQ ID NO: 446956 - DNA, 20 bp, mouse
gggcaactaaaaaaggaggg

SEQ ID NO: 446957 - DNA, 20 bp, mouse
gcaatatggcggtggaaggg

SEQ ID NO: 446958 - DNA, 20 bp, mouse
gagtcgggacaagggatgag

SEQ ID NO: 446959 - DNA, 20 bp, mouse
ggcccaatatggcggtggaa

SEQ ID NO: 446960 - DNA, 20 bp, mouse
gcatattgggcaactaaaaa

SEQ ID NO: 446961 - DNA, 20 bp, mouse
gtagttgcccaatatggcgg

SEQ ID NO: 446962 - DNA, 20 bp, mouse
gtcggagccgcgagtgagtc

SEQ ID NO: 446963 - DNA, 20 bp, mouse
gcgcgagtgagtcgggacaa

SEQ ID NO: 446964 - DNA, 20 bp, mouse
gttgggcaactaaaaaagga

SEQ ID NO: 446965 - DNA, 20 bp, mouse
ggaagcctcgagctgcgcgg

SEQ ID NO: 446966 - DNA, 20 bp, mouse
gaggcaggcaagctccgagg

SEQ ID NO: 446967 - DNA, 20 bp, mouse
gcgactgagagcaagcgaac

SEQ ID NO: 446968 - DNA, 20 bp, mouse
gcgagaaagaagggaacggg

SEQ ID NO: 446969 - DNA, 20 bp, mouse
gccgagtgcgctgtgctcga

SEQ ID NO: 446970 - DNA, 20 bp, mouse
gtgagagcaagcgaacaggc

SEQ ID NO: 446971 - DNA, 20 bp, mouse
gcgcgggcagcgagaaagaa

SEQ ID NO: 446972 - DNA, 20 bp, mouse
gtgctcgaggggtgccggct

SEQ ID NO: 446973 - DNA, 20 bp, mouse
ggtggtctacaggcccgaag

SEQ ID NO: 446974 - DNA, 20 bp, mouse
gctgctgcggaggtacacgt

SEQ ID NO: 446975 - DNA, 20 bp, mouse
gcgctgtgctcgaggggtgc

SEQ ID NO: 446976 - DNA, 20 bp, mouse
gcgctgctgtactccctcag

SEQ ID NO: 446977 - DNA, 20 bp, mouse
gacagtgaggccgccgctga

SEQ ID NO: 446978 - DNA, 20 bp, mouse
gtgctgtactccctcagcgg

SEQ ID NO: 446979 - DNA, 20 bp, mouse
gcacctcgcttgtcacagtg

SEQ ID NO: 446980 - DNA, 20 bp, mouse
gacagaagcacgcggagcca

SEQ ID NO: 446981 - DNA, 20 bp, mouse
gctgtgcgtgcagcttcgga

SEQ ID NO: 446982 - DNA, 20 bp, mouse
gtcaacgccgaaggggctgg

SEQ ID NO: 446983 - DNA, 20 bp, mouse
gggccgcccactccaagaga

SEQ ID NO: 446984 - DNA, 20 bp, mouse
gagcatgggtcgcaggttct

SEQ ID NO: 446985 - DNA, 20 bp, mouse
gacggtgaggctgaaggggt

SEQ ID NO: 446986 - DNA, 20 bp, mouse
gctggccagtctgtctgcag

SEQ ID NO: 446987 - DNA, 20 bp, mouse
ggaactcgaggagagccatc

SEQ ID NO: 446988 - DNA, 20 bp, mouse
ggacagactggccagggcgg

SEQ ID NO: 446989 - DNA, 20 bp, mouse
gcgcgaggaaagcgaactcg

SEQ ID NO: 446990 - DNA, 20 bp, mouse
gggccgtgtgcatgacgtgc

SEQ ID NO: 446991 - DNA, 20 bp, mouse
gtttaatgggtggctccggt

SEQ ID NO: 446992 - DNA, 20 bp, mouse
ggtcgtaccccgattcaggt

SEQ ID NO: 446993 - DNA, 20 bp, mouse
gtgcccgcacgtcatgcaca

SEQ ID NO: 446994 - DNA, 20 bp, mouse
gcgggcactgctggaagccg

SEQ ID NO: 446995 - DNA, 20 bp, mouse
ggtacgaccgaaagagttcg

SEQ ID NO: 446996 - DNA, 20 bp, mouse
ggcggaagtgggcggttcgt

SEQ ID NO: 446997 - DNA, 20 bp, mouse
ggtgtcagcgcggcctgcac

SEQ ID NO: 446998 - DNA, 20 bp, mouse
gctcccgagaacgcccctcc

SEQ ID NO: 446999 - DNA, 20 bp, mouse
gctcctggaggggcgttctc

SEQ ID NO: 447000 - DNA, 20 bp, mouse
gtcagcgcggcctgcaccgg

SEQ ID NO: 447001 - DNA, 20 bp, mouse
gcaagcgcacggagccccgg

SEQ ID NO: 447002 - DNA, 20 bp, mouse
gaaccccaaacaacagaaca

SEQ ID NO: 447003 - DNA, 20 bp, mouse
ggggcgagacggacaaacac

SEQ ID NO: 447004 - DNA, 20 bp, mouse
gggcggtggccggcggaagt

SEQ ID NO: 447005 - DNA, 20 bp, mouse
gctgcgctgcgagggcgaga

SEQ ID NO: 447006 - DNA, 20 bp, mouse
gctggtgcgatccttagcgg

SEQ ID NO: 447007 - DNA, 20 bp, mouse
gaccgagacccacccgacgg

SEQ ID NO: 447008 - DNA, 20 bp, mouse
ggggctggtgcgatccttag

SEQ ID NO: 447009 - DNA, 20 bp, mouse
gactaccgagacccacccga

SEQ ID NO: 447010 - DNA, 20 bp, mouse
gcgatccttagcggcggcag

SEQ ID NO: 447011 - DNA, 20 bp, mouse
gggcgaggccagcgccgcgg

SEQ ID NO: 447012 - DNA, 20 bp, mouse
gaactgctcggcgaagtcgg

SEQ ID NO: 447013 - DNA, 20 bp, mouse
gatgctaagaggggatcagt

SEQ ID NO: 447014 - DNA, 20 bp, mouse
gagagaaaagcgaggctcag

SEQ ID NO: 447015 - DNA, 20 bp, mouse
gcccgagggaatgctaagag

SEQ ID NO: 447016 - DNA, 20 bp, mouse
gagacgactcacgccgggta

SEQ ID NO: 447017 - DNA, 20 bp, mouse
gcgcctgggaaccgcaccgc

SEQ ID NO: 447018 - DNA, 20 bp, mouse
gggcacagacgactcacgcc

SEQ ID NO: 447019 - DNA, 20 bp, mouse
gcgccgggtagggagcccgc

SEQ ID NO: 447020 - DNA, 20 bp, mouse
gtagcttcggtgagcgtcct

SEQ ID NO: 447021 - DNA, 20 bp, mouse
gccggggacaagggcatgtt

SEQ ID NO: 447022 - DNA, 20 bp, mouse
ggtcgtctgtgccggcggtg

SEQ ID NO: 447023 - DNA, 20 bp, mouse
gagctactgggtctccagag

SEQ ID NO: 447024 - DNA, 20 bp, mouse
gcgtgagtcgtctgtgccgg

SEQ ID NO: 447025 - DNA, 20 bp, mouse
gtgccacagaccggggacaa

SEQ ID NO: 447026 - DNA, 20 bp, mouse
gaccggcacagtaccttcag

SEQ ID NO: 447027 - DNA, 20 bp, mouse
ggtagcagcagttgcttcag

SEQ ID NO: 447028 - DNA, 20 bp, mouse
gctgtccgcggcactgatag

SEQ ID NO: 447029 - DNA, 20 bp, mouse
gtcagcggaaaaagaagcaa

SEQ ID NO: 447030 - DNA, 20 bp, mouse
gtctgtagcggagaagggag

SEQ ID NO: 447031 - DNA, 20 bp, mouse
gctgctacggttgcctctga

SEQ ID NO: 447032 - DNA, 20 bp, mouse
ggacgcgcaagtgtctgtag

SEQ ID NO: 447033 - DNA, 20 bp, mouse
gagcggtcgccacagatccc

SEQ ID NO: 447034 - DNA, 20 bp, mouse
ggcagccgctgtcctgtccg

SEQ ID NO: 447035 - DNA, 20 bp, mouse
gctcggctccggaacccaac

SEQ ID NO: 447036 - DNA, 20 bp, mouse
gggaggctgacagaaggact

SEQ ID NO: 447037 - DNA, 20 bp, mouse
gtcctaatcaggctgcatga

SEQ ID NO: 447038 - DNA, 20 bp, mouse
ggcagcctgattaggagcaa

SEQ ID NO: 447039 - DNA, 20 bp, mouse
gtcaggctgcatgatggcat

SEQ ID NO: 447040 - DNA, 20 bp, mouse
ggccatcatgcagcctgatt

SEQ ID NO: 447041 - DNA, 20 bp, mouse
gctgattaggagcaaaggaa

SEQ ID NO: 447042 - DNA, 20 bp, mouse
gtgcaggttggtatccacag

SEQ ID NO: 447043 - DNA, 20 bp, mouse
gaggactgggatggttaatc

SEQ ID NO: 447044 - DNA, 20 bp, mouse
gtcgtcaggaccctaaagaa

SEQ ID NO: 447045 - DNA, 20 bp, mouse
gagttgctctaggtcccccc

SEQ ID NO: 447046 - DNA, 20 bp, mouse
ggcgagcgctggggtcgtac

SEQ ID NO: 447047 - DNA, 20 bp, mouse
gagcgctggggtcgtacggg

SEQ ID NO: 447048 - DNA, 20 bp, mouse
ggcggagggcgcaggctctg

SEQ ID NO: 447049 - DNA, 20 bp, mouse
ggagctagctgcgagcgctg

SEQ ID NO: 447050 - DNA, 20 bp, mouse
gctggggtcgtacgggcgga

SEQ ID NO: 447051 - DNA, 20 bp, mouse
gagggactgcggtgccacca

SEQ ID NO: 447052 - DNA, 20 bp, mouse
gtgcctctctcggtgacagg

SEQ ID NO: 447053 - DNA, 20 bp, mouse
gctctctcggtgacaggggg

SEQ ID NO: 447054 - DNA, 20 bp, mouse
gagggcgcaggctctgaggc

SEQ ID NO: 447055 - DNA, 20 bp, mouse
gccgggtcaggagacttgta

SEQ ID NO: 447056 - DNA, 20 bp, mouse
ggtcgtgaggcccctcaggt

SEQ ID NO: 447057 - DNA, 20 bp, mouse
gagggcggcggcactggtta

SEQ ID NO: 447058 - DNA, 20 bp, mouse
gctaaaggctgcgagggcgg

SEQ ID NO: 447059 - DNA, 20 bp, mouse
gggtgtcctaaaggctgcga

SEQ ID NO: 447060 - DNA, 20 bp, mouse
ggtcctaaaggctgcgaggg

SEQ ID NO: 447061 - DNA, 20 bp, mouse
gccactcaccggcttcatcg

SEQ ID NO: 447062 - DNA, 20 bp, mouse
gcccgtggcgaggatccttc

SEQ ID NO: 447063 - DNA, 20 bp, mouse
gttcgcgggcggtgtcctaa

SEQ ID NO: 447064 - DNA, 20 bp, mouse
gtggcgacccgcgatgaagc

SEQ ID NO: 447065 - DNA, 20 bp, mouse
gcggcactggttacggcgag

SEQ ID NO: 447066 - DNA, 20 bp, mouse
gactacagtaaggaaggtgt

SEQ ID NO: 447067 - DNA, 20 bp, mouse
gggcagcccccactacagta

SEQ ID NO: 447068 - DNA, 20 bp, mouse
gaccttccttactgtagtgg

SEQ ID NO: 447069 - DNA, 20 bp, mouse
ggcctcgtgaagccggaaag

SEQ ID NO: 447070 - DNA, 20 bp, mouse
gggaaggtgtgggtagttcc

SEQ ID NO: 447071 - DNA, 20 bp, mouse
gggccgagggctgactgtga

SEQ ID NO: 447072 - DNA, 20 bp, mouse
ggcctctttccggcttcacg

SEQ ID NO: 447073 - DNA, 20 bp, mouse
ggaagcaagtctcctcggtt

SEQ ID NO: 447074 - DNA, 20 bp, mouse
ggtgggtagttccgggtccc

SEQ ID NO: 447075 - DNA, 20 bp, mouse
gggctgactgtgaaggtgag

SEQ ID NO: 447076 - DNA, 20 bp, mouse
gactaaggactaggagtcac

SEQ ID NO: 447077 - DNA, 20 bp, mouse
gagggtgggtatcaaaacta

SEQ ID NO: 447078 - DNA, 20 bp, mouse
gggtatcaaaactaaggact

SEQ ID NO: 447079 - DNA, 20 bp, mouse
gtcaaagctctcgcaagggt

SEQ ID NO: 447080 - DNA, 20 bp, mouse
gacgctcaaagctctcgcaa

SEQ ID NO: 447081 - DNA, 20 bp, mouse
gaccagccagggcttcaagc

SEQ ID NO: 447082 - DNA, 20 bp, mouse
gatttggtcttgaccagcca

SEQ ID NO: 447083 - DNA, 20 bp, mouse
ggcttaaaaagggcccggga

SEQ ID NO: 447084 - DNA, 20 bp, mouse
gctggtcaagaccaaatctg

SEQ ID NO: 447085 - DNA, 20 bp, mouse
gagggcggactcctcagatt

SEQ ID NO: 447086 - DNA, 20 bp, mouse
gcgcggctcggtacgagacg

SEQ ID NO: 447087 - DNA, 20 bp, mouse
gtgctgtgcaggaggtctcg

SEQ ID NO: 447088 - DNA, 20 bp, mouse
ggcgcggcgcctctcacgcg

SEQ ID NO: 447089 - DNA, 20 bp, mouse
gccgcgcgagccgggcaccc

SEQ ID NO: 447090 - DNA, 20 bp, mouse
gtgcagagcgctggggtcta

SEQ ID NO: 447091 - DNA, 20 bp, mouse
gctctgcgcgcccaaggaag

SEQ ID NO: 447092 - DNA, 20 bp, mouse
ggagaggtgcgggggtccct

SEQ ID NO: 447093 - DNA, 20 bp, mouse
ggccctgcggagaggtgcgg

SEQ ID NO: 447094 - DNA, 20 bp, mouse
gcggtggctgcgatccgaac

SEQ ID NO: 447095 - DNA, 20 bp, mouse
gcactctgcggggattgaga

SEQ ID NO: 447096 - DNA, 20 bp, mouse
gggccacgcaggcgctctgg

SEQ ID NO: 447097 - DNA, 20 bp, mouse
gccagcgagccggaacacag

SEQ ID NO: 447098 - DNA, 20 bp, mouse
ggagtctccccaggtcaaca

SEQ ID NO: 447099 - DNA, 20 bp, mouse
ggaggcggaactagtactgt

SEQ ID NO: 447100 - DNA, 20 bp, mouse
gtctgggggtcccggagggg

SEQ ID NO: 447101 - DNA, 20 bp, mouse
ggcgctctgggggtcccgga

SEQ ID NO: 447102 - DNA, 20 bp, mouse
ggagacagtcccaggatagt

SEQ ID NO: 447103 - DNA, 20 bp, mouse
ggggaggtggtgagtttgcg

SEQ ID NO: 447104 - DNA, 20 bp, mouse
ggcggagccctgttgacctg

SEQ ID NO: 447105 - DNA, 20 bp, mouse
gggcgttagacacccagcac

SEQ ID NO: 447106 - DNA, 20 bp, mouse
gctgggaagaagtggatctt

SEQ ID NO: 447107 - DNA, 20 bp, mouse
gacagattactgggaagaag

SEQ ID NO: 447108 - DNA, 20 bp, mouse
gttggattttcgggaaaaca

SEQ ID NO: 447109 - DNA, 20 bp, mouse
gcaggaagacatgggtttct

SEQ ID NO: 447110 - DNA, 20 bp, mouse
gtggaaagacacagattact

SEQ ID NO: 447111 - DNA, 20 bp, mouse
gttggatttttgggaagtca

SEQ ID NO: 447112 - DNA, 20 bp, mouse
gcaggaagacattgattttc

SEQ ID NO: 447113 - DNA, 20 bp, mouse
gtgggaagtcatggattttc

SEQ ID NO: 447114 - DNA, 20 bp, mouse
gtcgggaaaacacggatttc

SEQ ID NO: 447115 - DNA, 20 bp, mouse
gtggattttcaggaagacat

SEQ ID NO: 447116 - DNA, 20 bp, mouse
gctagcgagcgcgccccggg

SEQ ID NO: 447117 - DNA, 20 bp, mouse
gcctgctgcccggcccaacg

SEQ ID NO: 447118 - DNA, 20 bp, mouse
gtagggcgccggcctttggg

SEQ ID NO: 447119 - DNA, 20 bp, mouse
gatgctggcagataacctag

SEQ ID NO: 447120 - DNA, 20 bp, mouse
ggctatcccgcgccgcccaa

SEQ ID NO: 447121 - DNA, 20 bp, mouse
gtgtcgccggggacgtccgg

SEQ ID NO: 447122 - DNA, 20 bp, mouse
ggccctagcgagcgcgcccc

SEQ ID NO: 447123 - DNA, 20 bp, mouse
gccggcccaacgtggcactt

SEQ ID NO: 447124 - DNA, 20 bp, mouse
gggccgaaacggcagggcgg

SEQ ID NO: 447125 - DNA, 20 bp, mouse
gcccggggcagcggccgaaa

SEQ ID NO: 447126 - DNA, 20 bp, mouse
gctagggcgtcagcagagtg

SEQ ID NO: 447127 - DNA, 20 bp, mouse
gccgggcggagatgcagcgg

SEQ ID NO: 447128 - DNA, 20 bp, mouse
gcagcagagtgcggatgcag

SEQ ID NO: 447129 - DNA, 20 bp, mouse
gcagagtgcggatgcagcgg

SEQ ID NO: 447130 - DNA, 20 bp, mouse
ggcggcggctccgggtgtcg

SEQ ID NO: 447131 - DNA, 20 bp, mouse
gggcagcggatggcgatcac

SEQ ID NO: 447132 - DNA, 20 bp, mouse
gccacccgggaccacctgca

SEQ ID NO: 447133 - DNA, 20 bp, mouse
gctcgcagcccgggacaatg

SEQ ID NO: 447134 - DNA, 20 bp, mouse
gcccgggtcccgccgaactg

SEQ ID NO: 447135 - DNA, 20 bp, mouse
gggcggcacaaagggcggag

SEQ ID NO: 447136 - DNA, 20 bp, mouse
gctgggacctagagttcagg

SEQ ID NO: 447137 - DNA, 20 bp, mouse
gggctgactgcaacagacag

SEQ ID NO: 447138 - DNA, 20 bp, mouse
gagaggacaacaagggatct

SEQ ID NO: 447139 - DNA, 20 bp, mouse
gtggctactgaaccacctca

SEQ ID NO: 447140 - DNA, 20 bp, mouse
gatacaggcaaaacacccag

SEQ ID NO: 447141 - DNA, 20 bp, mouse
gaggctagtcaggaagtcaa

SEQ ID NO: 447142 - DNA, 20 bp, mouse
gcatctgtcacggtgagtag

SEQ ID NO: 447143 - DNA, 20 bp, mouse
ggatctgggacctagagttc

SEQ ID NO: 447144 - DNA, 20 bp, mouse
ggccagaaagcagcctctct

SEQ ID NO: 447145 - DNA, 20 bp, mouse
gggcatgacccatagagttt

SEQ ID NO: 447146 - DNA, 20 bp, mouse
gacccggcgcggctccgcgg

SEQ ID NO: 447147 - DNA, 20 bp, mouse
gggtccgcacaccctgccgg

SEQ ID NO: 447148 - DNA, 20 bp, mouse
ggccggtccgcacaccctgc

SEQ ID NO: 447149 - DNA, 20 bp, mouse
gccgccaccccgcgagggag

SEQ ID NO: 447150 - DNA, 20 bp, mouse
gaggccgccggcagggtgtg

SEQ ID NO: 447151 - DNA, 20 bp, mouse
gagcgagcgctcgaggccgc

SEQ ID NO: 447152 - DNA, 20 bp, mouse
ggtctagcgccccgccaccg

SEQ ID NO: 447153 - DNA, 20 bp, mouse
ggctcgttgatgccgttctg

SEQ ID NO: 447154 - DNA, 20 bp, mouse
gggaacggcgcacctggcaa

SEQ ID NO: 447155 - DNA, 20 bp, mouse
ggccaccgcggagccgcgcc

SEQ ID NO: 447156 - DNA, 20 bp, mouse
ggcggccgctggggaaacag

SEQ ID NO: 447157 - DNA, 20 bp, mouse
gcctccggaggacaaggtag

SEQ ID NO: 447158 - DNA, 20 bp, mouse
gccccagcatgaccgaacta

SEQ ID NO: 447159 - DNA, 20 bp, mouse
gtggctcgcagcttcccggg

SEQ ID NO: 447160 - DNA, 20 bp, mouse
ggctagtggcgctgctgcag

SEQ ID NO: 447161 - DNA, 20 bp, mouse
ggctctccgggcaagggcgg

SEQ ID NO: 447162 - DNA, 20 bp, mouse
ggacgcacctccggaggaca

SEQ ID NO: 447163 - DNA, 20 bp, mouse
ggggttccaggcggagatgg

SEQ ID NO: 447164 - DNA, 20 bp, mouse
gccccgagtgagcagcacgg

SEQ ID NO: 447165 - DNA, 20 bp, mouse
gcatcgggaaggcctaggga

SEQ ID NO: 447166 - DNA, 20 bp, mouse
gccaggagaggccctaacaa

SEQ ID NO: 447167 - DNA, 20 bp, mouse
ggaggccacgctgtgcacaa

SEQ ID NO: 447168 - DNA, 20 bp, mouse
gcccatccggggtgcccgag

SEQ ID NO: 447169 - DNA, 20 bp, mouse
gcaccccggatggggagtgt

SEQ ID NO: 447170 - DNA, 20 bp, mouse
gtcctctcgggcaccccgga

SEQ ID NO: 447171 - DNA, 20 bp, mouse
gaaggccccagactcctacc

SEQ ID NO: 447172 - DNA, 20 bp, mouse
ggggagccagcatagatgag

SEQ ID NO: 447173 - DNA, 20 bp, mouse
gctgactgacagaagctcat

SEQ ID NO: 447174 - DNA, 20 bp, mouse
gtctgccaggtaggagtctg

SEQ ID NO: 447175 - DNA, 20 bp, mouse
ggaggccctaacaagggcat

SEQ ID NO: 447176 - DNA, 20 bp, mouse
gccgcggagtcgtaaggcca

SEQ ID NO: 447177 - DNA, 20 bp, mouse
gagtcgtaaggccagggcga

SEQ ID NO: 447178 - DNA, 20 bp, mouse
gcgacggcacgcatagaaat

SEQ ID NO: 447179 - DNA, 20 bp, mouse
gcccagggcattgctgacgt

SEQ ID NO: 447180 - DNA, 20 bp, mouse
gcttggcccgcggagtcgta

SEQ ID NO: 447181 - DNA, 20 bp, mouse
gacgtaggcagagggtacct

SEQ ID NO: 447182 - DNA, 20 bp, mouse
ggctcgcgcgccggaggtta

SEQ ID NO: 447183 - DNA, 20 bp, mouse
gcgcgcgggagtccccccag

SEQ ID NO: 447184 - DNA, 20 bp, mouse
gccccagaggacccttggtt

SEQ ID NO: 447185 - DNA, 20 bp, mouse
gggggtgagacagatcgact

SEQ ID NO: 447186 - DNA, 20 bp, mouse
ggcgagcgctcggctaacga

SEQ ID NO: 447187 - DNA, 20 bp, mouse
gtaacgacggcgcgtgcggg

SEQ ID NO: 447188 - DNA, 20 bp, mouse
gcggctaacgacggcgcgtg

SEQ ID NO: 447189 - DNA, 20 bp, mouse
ggtgcgggaggaagacgcgc

SEQ ID NO: 447190 - DNA, 20 bp, mouse
gagcagtcgcgcggccaacg

SEQ ID NO: 447191 - DNA, 20 bp, mouse
gctggtgctaggtccggaga

SEQ ID NO: 447192 - DNA, 20 bp, mouse
ggatgggtggggccggcgga

SEQ ID NO: 447193 - DNA, 20 bp, mouse
gtggtggtacgttcctcgct

SEQ ID NO: 447194 - DNA, 20 bp, mouse
gtgggctccggtgccaggtc

SEQ ID NO: 447195 - DNA, 20 bp, mouse
gtccggatgggtggggccgg

SEQ ID NO: 447196 - DNA, 20 bp, mouse
ggagcagtcgctggtcgtcg

SEQ ID NO: 447197 - DNA, 20 bp, mouse
gcagtcgctggtcgtcgggg

SEQ ID NO: 447198 - DNA, 20 bp, mouse
ggccgggcgcggcggctcca

SEQ ID NO: 447199 - DNA, 20 bp, mouse
gcctgcgcccaaggacgact

SEQ ID NO: 447200 - DNA, 20 bp, mouse
ggggccaggtgagcagtcgc

SEQ ID NO: 447201 - DNA, 20 bp, mouse
ggcgcagcccaggtcggagg

SEQ ID NO: 447202 - DNA, 20 bp, mouse
gcagggcccagcatgcgcgg

SEQ ID NO: 447203 - DNA, 20 bp, mouse
ggcatgcgcgggggaccctg

SEQ ID NO: 447204 - DNA, 20 bp, mouse
ggcggggcctgggtacacgg

SEQ ID NO: 447205 - DNA, 20 bp, mouse
gctgcggtcaccatgtacgt

SEQ ID NO: 447206 - DNA, 20 bp, mouse
gccagaggcgcgaggcgcag

SEQ ID NO: 447207 - DNA, 20 bp, mouse
gggagccgacggagcaccgt

SEQ ID NO: 447208 - DNA, 20 bp, mouse
gcgcagggggctagagataa

SEQ ID NO: 447209 - DNA, 20 bp, mouse
ggactccgcgagccaacctg

SEQ ID NO: 447210 - DNA, 20 bp, mouse
gaaacgttgaaggctgccag

SEQ ID NO: 447211 - DNA, 20 bp, mouse
gctggctgcacctcagccca

SEQ ID NO: 447212 - DNA, 20 bp, mouse
ggagccaccattgagaccgt

SEQ ID NO: 447213 - DNA, 20 bp, mouse
gaagctctgcaaggagccga

SEQ ID NO: 447214 - DNA, 20 bp, mouse
ggtctggggacaaacgttga

SEQ ID NO: 447215 - DNA, 20 bp, mouse
gcgcagtacccggactacgg

SEQ ID NO: 447216 - DNA, 20 bp, mouse
gagacgcaagagactatcaa

SEQ ID NO: 447217 - DNA, 20 bp, mouse
gagtagtccgagccgcgcag

SEQ ID NO: 447218 - DNA, 20 bp, mouse
ggaagcagtacagccggagt

SEQ ID NO: 447219 - DNA, 20 bp, mouse
ggcactctcaggagccctgg

SEQ ID NO: 447220 - DNA, 20 bp, mouse
gccggagtgggcacctctgg

SEQ ID NO: 447221 - DNA, 20 bp, mouse
gcgctgctagctcctctgcg

SEQ ID NO: 447222 - DNA, 20 bp, mouse
gtcacctggaaatttagggt

SEQ ID NO: 447223 - DNA, 20 bp, mouse
gacgtagtgtgggtaaactg

SEQ ID NO: 447224 - DNA, 20 bp, mouse
ggacctcaggatggcttaag

SEQ ID NO: 447225 - DNA, 20 bp, mouse
gcttcccggggcggactgta

SEQ ID NO: 447226 - DNA, 20 bp, mouse
gtgggcatgctcagtagccg

SEQ ID NO: 447227 - DNA, 20 bp, mouse
gggctgtgcggcgggatccg

SEQ ID NO: 447228 - DNA, 20 bp, mouse
gcaccggagaccgggagcca

SEQ ID NO: 447229 - DNA, 20 bp, mouse
gttgcactacaccggagacc

SEQ ID NO: 447230 - DNA, 20 bp, mouse
ggctcctcggaggccatggt

SEQ ID NO: 447231 - DNA, 20 bp, mouse
gaccggccgcccggagcgag

SEQ ID NO: 447232 - DNA, 20 bp, mouse
gatccgtggctcccggtctc

SEQ ID NO: 447233 - DNA, 20 bp, mouse
ggttgctccgccgggccggg

SEQ ID NO: 447234 - DNA, 20 bp, mouse
gaggtttttcggtcgcaagt

SEQ ID NO: 447235 - DNA, 20 bp, mouse
gcgcccgccaggggccggac

SEQ ID NO: 447236 - DNA, 20 bp, mouse
ggcttctggggacctttacg

SEQ ID NO: 447237 - DNA, 20 bp, mouse
ggcttctccgtacctcgtaa

SEQ ID NO: 447238 - DNA, 20 bp, mouse
gcgagcaagacgcgcacacc

SEQ ID NO: 447239 - DNA, 20 bp, mouse
gagccgagcgctacagtcac

SEQ ID NO: 447240 - DNA, 20 bp, mouse
gcaagttccgcagcctggca

SEQ ID NO: 447241 - DNA, 20 bp, mouse
gagggtggcggcggacccga

SEQ ID NO: 447242 - DNA, 20 bp, mouse
gtggggacctttacgaggta

SEQ ID NO: 447243 - DNA, 20 bp, mouse
ggaaggtagcggtcccgggg

SEQ ID NO: 447244 - DNA, 20 bp, mouse
ggggcggctgggggactcga

SEQ ID NO: 447245 - DNA, 20 bp, mouse
gcggctgggggactcgaggg

SEQ ID NO: 447246 - DNA, 20 bp, mouse
gacaaagggcaggttccctg

SEQ ID NO: 447247 - DNA, 20 bp, mouse
gagctcctttaagaaaagca

SEQ ID NO: 447248 - DNA, 20 bp, mouse
gctttgtctcctcccagggg

SEQ ID NO: 447249 - DNA, 20 bp, mouse
gtgagcatgttccaggcagc

SEQ ID NO: 447250 - DNA, 20 bp, mouse
gtgagcagtagtcctcccca

SEQ ID NO: 447251 - DNA, 20 bp, mouse
gtctgccctgcttttcttaa

SEQ ID NO: 447252 - DNA, 20 bp, mouse
gaggtatatgagcatgttcc

SEQ ID NO: 447253 - DNA, 20 bp, mouse
gtggcttaatccctgctgcc

SEQ ID NO: 447254 - DNA, 20 bp, mouse
gaagggcaggttccctgggg

SEQ ID NO: 447255 - DNA, 20 bp, mouse
ggagctttgtctcctcccag

SEQ ID NO: 447256 - DNA, 20 bp, mouse
gaagagcagggcagatacct

SEQ ID NO: 447257 - DNA, 20 bp, mouse
gggcagatacctgggcagcc

SEQ ID NO: 447258 - DNA, 20 bp, mouse
gcgagcttcctgttgccctc

SEQ ID NO: 447259 - DNA, 20 bp, mouse
gcaactctgctaagaagagc

SEQ ID NO: 447260 - DNA, 20 bp, mouse
ggagcgtgttccgggtagca

SEQ ID NO: 447261 - DNA, 20 bp, mouse
gtggcttagtccctgctacc

SEQ ID NO: 447262 - DNA, 20 bp, mouse
gagtatttgtgaatgtgaat

SEQ ID NO: 447263 - DNA, 20 bp, mouse
ggggacactgatttgtacac

SEQ ID NO: 447264 - DNA, 20 bp, mouse
gcaaatttctcagtgtagta

SEQ ID NO: 447265 - DNA, 20 bp, mouse
ggggtatgtgagcgtgttcc

SEQ ID NO: 447266 - DNA, 20 bp, mouse
gagagggagcatagagcacg

SEQ ID NO: 447267 - DNA, 20 bp, mouse
gcagagcttggaaacggcaa

SEQ ID NO: 447268 - DNA, 20 bp, mouse
ggcatagagcacgtggcagg

SEQ ID NO: 447269 - DNA, 20 bp, mouse
gtaaagaagacaagaccctt

SEQ ID NO: 447270 - DNA, 20 bp, mouse
gaatccctgaatctacccaa

SEQ ID NO: 447271 - DNA, 20 bp, mouse
ggagctaaagcttttcgcag

SEQ ID NO: 447272 - DNA, 20 bp, mouse
ggatgtccccaaccatgagt

SEQ ID NO: 447273 - DNA, 20 bp, mouse
gagacccttgggtagattca

SEQ ID NO: 447274 - DNA, 20 bp, mouse
gctgcaaagactctacctcc

SEQ ID NO: 447275 - DNA, 20 bp, mouse
gtcacatggacaactatatt

SEQ ID NO: 447276 - DNA, 20 bp, mouse
gcactgagggagcacggagc

SEQ ID NO: 447277 - DNA, 20 bp, mouse
gccgtgctccctcagtgaaa

SEQ ID NO: 447278 - DNA, 20 bp, mouse
ggagctgaaccttttcactg

SEQ ID NO: 447279 - DNA, 20 bp, mouse
gaggtgaggaggccattctt

SEQ ID NO: 447280 - DNA, 20 bp, mouse
gtctgaggattagcagccag

SEQ ID NO: 447281 - DNA, 20 bp, mouse
gaggagccttgggtagagtc

SEQ ID NO: 447282 - DNA, 20 bp, mouse
gcaaatcctgactctaccca

SEQ ID NO: 447283 - DNA, 20 bp, mouse
gttggacagccaccctctca

SEQ ID NO: 447284 - DNA, 20 bp, mouse
ggccattctttggtactgag

SEQ ID NO: 447285 - DNA, 20 bp, mouse
gaacttggaatagaaatcaa

SEQ ID NO: 447286 - DNA, 20 bp, mouse
ggaaggacagtggaactgac

SEQ ID NO: 447287 - DNA, 20 bp, mouse
gctgacaggagagttgagtg

SEQ ID NO: 447288 - DNA, 20 bp, mouse
gtcacagatgtagacagagc

SEQ ID NO: 447289 - DNA, 20 bp, mouse
ggaacctaggaatagaatca

SEQ ID NO: 447290 - DNA, 20 bp, mouse
gaacagaagcccctgccaag

SEQ ID NO: 447291 - DNA, 20 bp, mouse
gcaagaggtgcagtctttac

SEQ ID NO: 447292 - DNA, 20 bp, mouse
gaaaccatgattctattcct

SEQ ID NO: 447293 - DNA, 20 bp, mouse
ggaccattaagtcattgcaa

SEQ ID NO: 447294 - DNA, 20 bp, mouse
gacagacactgtcatggttg

SEQ ID NO: 447295 - DNA, 20 bp, mouse
gttgtccatgtgattgagtt

SEQ ID NO: 447296 - DNA, 20 bp, mouse
ggaacctggggatagtctta

SEQ ID NO: 447297 - DNA, 20 bp, mouse
gttgggaagtagacatagac

SEQ ID NO: 447298 - DNA, 20 bp, mouse
gcaggaggtacagactttac

SEQ ID NO: 447299 - DNA, 20 bp, mouse
gagctgaagcttttcacaga

SEQ ID NO: 447300 - DNA, 20 bp, mouse
gctgaagaagtcaagaacct

SEQ ID NO: 447301 - DNA, 20 bp, mouse
gaaaccctaagactatcccc

SEQ ID NO: 447302 - DNA, 20 bp, mouse
gggaattgaattgctgtctt

SEQ ID NO: 447303 - DNA, 20 bp, mouse
ggatttaatggtcatgctgt

SEQ ID NO: 447304 - DNA, 20 bp, mouse
gtctattgaagtcaatcgca

SEQ ID NO: 447305 - DNA, 20 bp, mouse
gagagggtacacagagcagg

SEQ ID NO: 447306 - DNA, 20 bp, mouse
gcacagggcagacaccagaa

SEQ ID NO: 447307 - DNA, 20 bp, mouse
gacaccagaacggcacacat

SEQ ID NO: 447308 - DNA, 20 bp, mouse
gtgaagcagagggtcctccc

SEQ ID NO: 447309 - DNA, 20 bp, mouse
gtgtgaggactgcaacagtc

SEQ ID NO: 447310 - DNA, 20 bp, mouse
ggctcccatgtgtgccgttc

SEQ ID NO: 447311 - DNA, 20 bp, mouse
gttgtgcccatcaggggctc

SEQ ID NO: 447312 - DNA, 20 bp, mouse
gtccagtgtttgtgcccatc

SEQ ID NO: 447313 - DNA, 20 bp, mouse
ggcacagccatgtgtcctat

SEQ ID NO: 447314 - DNA, 20 bp, mouse
gccctgatgggcacaaacac

SEQ ID NO: 447315 - DNA, 20 bp, mouse
gcccattccagagcccctga

SEQ ID NO: 447316 - DNA, 20 bp, mouse
gcgaaagatcccaggtccag

SEQ ID NO: 447317 - DNA, 20 bp, mouse
ggccaagcctcaaccaggaa

SEQ ID NO: 447318 - DNA, 20 bp, mouse
gtggaaccggggcggatcac

SEQ ID NO: 447319 - DNA, 20 bp, mouse
gtcagtctgccactggacct

SEQ ID NO: 447320 - DNA, 20 bp, mouse
gactgagccaagcctcaacc

SEQ ID NO: 447321 - DNA, 20 bp, mouse
ggcttggctcagtctgccac

SEQ ID NO: 447322 - DNA, 20 bp, mouse
ggaagggcctctgagcaact

SEQ ID NO: 447323 - DNA, 20 bp, mouse
gtcttggagatgcagggagt

SEQ ID NO: 447324 - DNA, 20 bp, mouse
gtgcagggagtgggctgaca

SEQ ID NO: 447325 - DNA, 20 bp, mouse
gtggtgtcccagttgctcag

SEQ ID NO: 447326 - DNA, 20 bp, mouse
gacctccaggggctaaagct

SEQ ID NO: 447327 - DNA, 20 bp, mouse
gcaagggtgagccacctcca

SEQ ID NO: 447328 - DNA, 20 bp, mouse
gagaacctgccgagctctgg

SEQ ID NO: 447329 - DNA, 20 bp, mouse
ggcctagctttagcccctgg

SEQ ID NO: 447330 - DNA, 20 bp, mouse
gtctcccctcttacccacaa

SEQ ID NO: 447331 - DNA, 20 bp, mouse
ggaagtccatggacttttct

SEQ ID NO: 447332 - DNA, 20 bp, mouse
gtcatgagcacatacatcta

SEQ ID NO: 447333 - DNA, 20 bp, mouse
ggatggaagcagcaggaaga

SEQ ID NO: 447334 - DNA, 20 bp, mouse
ggggtcctccagagctcggc

SEQ ID NO: 447335 - DNA, 20 bp, mouse
gcatctgtctatgtctctat

SEQ ID NO: 447336 - DNA, 20 bp, mouse
gagttcagtggggcatccag

SEQ ID NO: 447337 - DNA, 20 bp, mouse
gcaagcctggctgggtcccg

SEQ ID NO: 447338 - DNA, 20 bp, mouse
gagggctgagggacaagatg

SEQ ID NO: 447339 - DNA, 20 bp, mouse
gttaagagtgaagttcagtg

SEQ ID NO: 447340 - DNA, 20 bp, mouse
gacagtggaaggggatgata

SEQ ID NO: 447341 - DNA, 20 bp, mouse
gcactgagagccacaggctg

SEQ ID NO: 447342 - DNA, 20 bp, mouse
gaggctgggagacagtggaa

SEQ ID NO: 447343 - DNA, 20 bp, mouse
gcttcctgtagagatggcaa

SEQ ID NO: 447344 - DNA, 20 bp, mouse
gggaaggggatgatagggct

SEQ ID NO: 447345 - DNA, 20 bp, mouse
gatgtcaggactatgagggt

SEQ ID NO: 447346 - DNA, 20 bp, mouse
gctagcaggcagaagagaca

SEQ ID NO: 447347 - DNA, 20 bp, mouse
gaatgctgttctgtcagtgc

SEQ ID NO: 447348 - DNA, 20 bp, mouse
gaattctgctatgaaaagca

SEQ ID NO: 447349 - DNA, 20 bp, mouse
gcacctcccagattcacgtg

SEQ ID NO: 447350 - DNA, 20 bp, mouse
gacagcattgttagagtcac

SEQ ID NO: 447351 - DNA, 20 bp, mouse
gctgggaggtgcccttctct

SEQ ID NO: 447352 - DNA, 20 bp, mouse
gccagattcacgtggggtgg

SEQ ID NO: 447353 - DNA, 20 bp, mouse
gaagggcaggttccctggtt

SEQ ID NO: 447354 - DNA, 20 bp, mouse
gccccagtttggtttttatg

SEQ ID NO: 447355 - DNA, 20 bp, mouse
gctcccagattcacgtgggg

SEQ ID NO: 447356 - DNA, 20 bp, mouse
gagccaggagagggactacc

SEQ ID NO: 447357 - DNA, 20 bp, mouse
gtgccaggtagtccctctcc

SEQ ID NO: 447358 - DNA, 20 bp, mouse
ggggactacctggcacactg

SEQ ID NO: 447359 - DNA, 20 bp, mouse
gactttgctgggtggttggg

SEQ ID NO: 447360 - DNA, 20 bp, mouse
gcactgtccacgagcagcag

SEQ ID NO: 447361 - DNA, 20 bp, mouse
gagcatgaagacagctgtct

SEQ ID NO: 447362 - DNA, 20 bp, mouse
gtgcctggcctcagtgtgcc

SEQ ID NO: 447363 - DNA, 20 bp, mouse
gcagcaagctccatgagttc

SEQ ID NO: 447364 - DNA, 20 bp, mouse
gggacagtgatccttctctc

SEQ ID NO: 447365 - DNA, 20 bp, mouse
gtctcttgaagaaatgatga

SEQ ID NO: 447366 - DNA, 20 bp, mouse
gggccacctagctcaagagg

SEQ ID NO: 447367 - DNA, 20 bp, mouse
gagaggccacctagctcaag

SEQ ID NO: 447368 - DNA, 20 bp, mouse
gggaagtgctcctgcatgag

SEQ ID NO: 447369 - DNA, 20 bp, mouse
ggcaggatacaccccttgca

SEQ ID NO: 447370 - DNA, 20 bp, mouse
gaggggtgtatcctgctcac

SEQ ID NO: 447371 - DNA, 20 bp, mouse
gttcctcctcttgagctagg

SEQ ID NO: 447372 - DNA, 20 bp, mouse
gctactccaagactgtgtgt

SEQ ID NO: 447373 - DNA, 20 bp, mouse
ggaggggagagaaaatcctc

SEQ ID NO: 447374 - DNA, 20 bp, mouse
gatcacagctagaagagata

SEQ ID NO: 447375 - DNA, 20 bp, mouse
gtgaaggtctcctcagagtg

SEQ ID NO: 447376 - DNA, 20 bp, mouse
ggtagtggggtctatgccta

SEQ ID NO: 447377 - DNA, 20 bp, mouse
gaggaatagatcagtgcctt

SEQ ID NO: 447378 - DNA, 20 bp, mouse
gtgcttagtgtgcttcttgg

SEQ ID NO: 447379 - DNA, 20 bp, mouse
gagggcagaaggtacactga

SEQ ID NO: 447380 - DNA, 20 bp, mouse
gggaaactcagtagccatct

SEQ ID NO: 447381 - DNA, 20 bp, mouse
gaaagcttttttccagaggg

SEQ ID NO: 447382 - DNA, 20 bp, mouse
ggatttttatttgcagccat

SEQ ID NO: 447383 - DNA, 20 bp, mouse
gttttgcttagtgtgcttct

SEQ ID NO: 447384 - DNA, 20 bp, mouse
gaaaatcctgagtttcatct

SEQ ID NO: 447385 - DNA, 20 bp, mouse
gttcaggacagtactgagag

SEQ ID NO: 447386 - DNA, 20 bp, mouse
ggctcccatgtgtgctgtcc

SEQ ID NO: 447387 - DNA, 20 bp, mouse
gctttaaataaagagggatc

SEQ ID NO: 447388 - DNA, 20 bp, mouse
gtgtgaggactccaagagtc

SEQ ID NO: 447389 - DNA, 20 bp, mouse
gttgtacccatcaagggctc

SEQ ID NO: 447390 - DNA, 20 bp, mouse
gacaccaggacagcacacat

SEQ ID NO: 447391 - DNA, 20 bp, mouse
ggatccacagggcagacacc

SEQ ID NO: 447392 - DNA, 20 bp, mouse
gcagtgtttgtacccatcaa

SEQ ID NO: 447393 - DNA, 20 bp, mouse
gtctgacaggaagggactct

SEQ ID NO: 447394 - DNA, 20 bp, mouse
gccattccagagcccttgat

SEQ ID NO: 447395 - DNA, 20 bp, mouse
gatggctgtgccctgactct

SEQ ID NO: 447396 - DNA, 20 bp, mouse
ggccagttggggcactgggt

SEQ ID NO: 447397 - DNA, 20 bp, mouse
gcgcgggcgcgagccagttg

SEQ ID NO: 447398 - DNA, 20 bp, mouse
gaagtcggccgactccatgg

SEQ ID NO: 447399 - DNA, 20 bp, mouse
gccggcatggcgagcctcgg

SEQ ID NO: 447400 - DNA, 20 bp, mouse
gcagcaggagaaggccaagg

SEQ ID NO: 447401 - DNA, 20 bp, mouse
gcggctgtgctggaagaggt

SEQ ID NO: 447402 - DNA, 20 bp, mouse
gaaggcggccgggtcgatgt

SEQ ID NO: 447403 - DNA, 20 bp, mouse
gggaggtgactgctcatcgg

SEQ ID NO: 447404 - DNA, 20 bp, mouse
gcgacagcggcgccacgcgc

SEQ ID NO: 447405 - DNA, 20 bp, mouse
gggcgccacgcgcaggctgg

SEQ ID NO: 447406 - DNA, 20 bp, mouse
ggcacgggaccgggacgcag

SEQ ID NO: 447407 - DNA, 20 bp, mouse
gcgcgagcggctccaggtag

SEQ ID NO: 447408 - DNA, 20 bp, mouse
gccgagccgcgcacgggacc

SEQ ID NO: 447409 - DNA, 20 bp, mouse
gtagtcgtcggcgaagaggt

SEQ ID NO: 447410 - DNA, 20 bp, mouse
ggccgagcgggaggtttata

SEQ ID NO: 447411 - DNA, 20 bp, mouse
gagcaggcggtgcatgaacg

SEQ ID NO: 447412 - DNA, 20 bp, mouse
ggcaagaagccggccgacta

SEQ ID NO: 447413 - DNA, 20 bp, mouse
gcccgtgcgcggctcggact

SEQ ID NO: 447414 - DNA, 20 bp, mouse
ggtcggcgaagaggtcggag

SEQ ID NO: 447415 - DNA, 20 bp, mouse
gccccgtaggccaggcagtc

SEQ ID NO: 447416 - DNA, 20 bp, mouse
gaccagagagggcaaaccta

SEQ ID NO: 447417 - DNA, 20 bp, mouse
ggccacgtaggagttggtga

SEQ ID NO: 447418 - DNA, 20 bp, mouse
gagagaagccacgtaggagt

SEQ ID NO: 447419 - DNA, 20 bp, mouse
gtccgtcaccaactcctacg

SEQ ID NO: 447420 - DNA, 20 bp, mouse
gcccccagcacaggacccag

SEQ ID NO: 447421 - DNA, 20 bp, mouse
gatgagtgcgagcctcgggg

SEQ ID NO: 447422 - DNA, 20 bp, mouse
gagggcaaatctaggaccgg

SEQ ID NO: 447423 - DNA, 20 bp, mouse
gcgaggctcgcactcatagt

SEQ ID NO: 447424 - DNA, 20 bp, mouse
ggcaaacctagggcaaatct

SEQ ID NO: 447425 - DNA, 20 bp, mouse
ggaccccctgagaactcaag

SEQ ID NO: 447426 - DNA, 20 bp, mouse
gggcctcgcagcccgcgagt

SEQ ID NO: 447427 - DNA, 20 bp, mouse
ggcagcgcgcggacccgaag

SEQ ID NO: 447428 - DNA, 20 bp, mouse
gagcccgcgagtcggcgagg

SEQ ID NO: 447429 - DNA, 20 bp, mouse
gcgcagcccgcgagtcggcg

SEQ ID NO: 447430 - DNA, 20 bp, mouse
ggtggccgcggtggcggaac

SEQ ID NO: 447431 - DNA, 20 bp, mouse
gaagaggcggggaaaaccgg

SEQ ID NO: 447432 - DNA, 20 bp, mouse
gggagcgacggttacgaaac

SEQ ID NO: 447433 - DNA, 20 bp, mouse
ggccggaggcgcaggtaagg

SEQ ID NO: 447434 - DNA, 20 bp, mouse
ggccgcggtggcggaacggg

SEQ ID NO: 447435 - DNA, 20 bp, mouse
gcgcgggttgtagctcggag

SEQ ID NO: 447436 - DNA, 20 bp, mouse
gaacgccacaggttcctggt

SEQ ID NO: 447437 - DNA, 20 bp, mouse
gtcctggtcggccgacatgg

SEQ ID NO: 447438 - DNA, 20 bp, mouse
ggcttggcaaggaacgccac

SEQ ID NO: 447439 - DNA, 20 bp, mouse
gggttcctggtcggccgaca

SEQ ID NO: 447440 - DNA, 20 bp, mouse
gagctctcagagcaggtcgg

SEQ ID NO: 447441 - DNA, 20 bp, mouse
gtcacctgtttgggacgcca

SEQ ID NO: 447442 - DNA, 20 bp, mouse
gcagccctggcgtcccaaac

SEQ ID NO: 447443 - DNA, 20 bp, mouse
gggaagctctcagagcaggt

SEQ ID NO: 447444 - DNA, 20 bp, mouse
gttgggacgccagggctgct

SEQ ID NO: 447445 - DNA, 20 bp, mouse
gtaaagcggaagtaagctcc

SEQ ID NO: 447446 - DNA, 20 bp, mouse
gccgtcccgccgcggccgtg

SEQ ID NO: 447447 - DNA, 20 bp, mouse
gttatattgtatgggattgg

SEQ ID NO: 447448 - DNA, 20 bp, mouse
gagatgtgcccggaggaagg

SEQ ID NO: 447449 - DNA, 20 bp, mouse
ggctcaagcggccgctgctc

SEQ ID NO: 447450 - DNA, 20 bp, mouse
gcgctcgccccgtcccgccg

SEQ ID NO: 447451 - DNA, 20 bp, mouse
gctgagtggattatattgta

SEQ ID NO: 447452 - DNA, 20 bp, mouse
gtcggcgtgagctcaagcgg

SEQ ID NO: 447453 - DNA, 20 bp, mouse
gcgggacttcccaccaggag

SEQ ID NO: 447454 - DNA, 20 bp, mouse
ggcggtccgactcgctcaag

SEQ ID NO: 447455 - DNA, 20 bp, mouse
gcgctcggcgtgagctcaag

SEQ ID NO: 447456 - DNA, 20 bp, mouse
ggcgccgagaacccctaacc

SEQ ID NO: 447457 - DNA, 20 bp, mouse
ggccccgcagacaggcgcac

SEQ ID NO: 447458 - DNA, 20 bp, mouse
ggggcaccgggctcgagagt

SEQ ID NO: 447459 - DNA, 20 bp, mouse
gcggcgccgggcgccatctg

SEQ ID NO: 447460 - DNA, 20 bp, mouse
gtcgccgggttaggggttct

SEQ ID NO: 447461 - DNA, 20 bp, mouse
ggctgcgctcgccgggttag

SEQ ID NO: 447462 - DNA, 20 bp, mouse
gggaaggacgaagggttccg

SEQ ID NO: 447463 - DNA, 20 bp, mouse
ggcctgtctgcggggctcca

SEQ ID NO: 447464 - DNA, 20 bp, mouse
gccgcttcgggaaggacgaa

SEQ ID NO: 447465 - DNA, 20 bp, mouse
ggccctggagccccgcagac

SEQ ID NO: 447466 - DNA, 20 bp, mouse
gcaacctcgggctgacgagg

SEQ ID NO: 447467 - DNA, 20 bp, mouse
gctctctccccgtcaacctc

SEQ ID NO: 447468 - DNA, 20 bp, mouse
gggctgacgaggcggcagag

SEQ ID NO: 447469 - DNA, 20 bp, mouse
gagcccccccggaggaagag

SEQ ID NO: 447470 - DNA, 20 bp, mouse
gcgtcaacctcgggctgacg

SEQ ID NO: 447471 - DNA, 20 bp, mouse
ggtcctcggaggggctccag

SEQ ID NO: 447472 - DNA, 20 bp, mouse
ggttccagcagctggcgagg

SEQ ID NO: 447473 - DNA, 20 bp, mouse
ggctggcgaggaggcggcag

SEQ ID NO: 447474 - DNA, 20 bp, mouse
gaactcgcacccgggtcggg

SEQ ID NO: 447475 - DNA, 20 bp, mouse
gctgccgcctcgtcagcccg

SEQ ID NO: 447476 - DNA, 20 bp, mouse
gagaggcagacactcaccat

SEQ ID NO: 447477 - DNA, 20 bp, mouse
gaggagagaaggccgcctag

SEQ ID NO: 447478 - DNA, 20 bp, mouse
gcgctgccaagcagcaggtg

SEQ ID NO: 447479 - DNA, 20 bp, mouse
gagaacctccaggcgcccca

SEQ ID NO: 447480 - DNA, 20 bp, mouse
ggtaagccggaaccctacaa

SEQ ID NO: 447481 - DNA, 20 bp, mouse
ggtgagtgtctgcctctagg

SEQ ID NO: 447482 - DNA, 20 bp, mouse
gagggctgtagtcccttgta

SEQ ID NO: 447483 - DNA, 20 bp, mouse
ggcctggaggttctatttct

SEQ ID NO: 447484 - DNA, 20 bp, mouse
gctcaccatggggcgcctgg

SEQ ID NO: 447485 - DNA, 20 bp, mouse
gcagagcttggagtgctagt

SEQ ID NO: 447486 - DNA, 20 bp, mouse
ggaccagggaagcaaacacc

SEQ ID NO: 447487 - DNA, 20 bp, mouse
gcaggaagcgcaacatgttg

SEQ ID NO: 447488 - DNA, 20 bp, mouse
gctggtggggaactcccaag

SEQ ID NO: 447489 - DNA, 20 bp, mouse
gtccacctccctcagaactt

SEQ ID NO: 447490 - DNA, 20 bp, mouse
gtgcaggaggttgagtcaag

SEQ ID NO: 447491 - DNA, 20 bp, mouse
gcctttgctcaaggagagta

SEQ ID NO: 447492 - DNA, 20 bp, mouse
gctctccttgagcaaaggac

SEQ ID NO: 447493 - DNA, 20 bp, mouse
gagggctcggttcatggcaa

SEQ ID NO: 447494 - DNA, 20 bp, mouse
gagggaggtggacttgagca

SEQ ID NO: 447495 - DNA, 20 bp, mouse
ggcccaagttctgagggagg

SEQ ID NO: 447496 - DNA, 20 bp, mouse
gaggttacctccagccacca

SEQ ID NO: 447497 - DNA, 20 bp, mouse
gtggctggaggtaacctgtc

SEQ ID NO: 447498 - DNA, 20 bp, mouse
gccagggacacaccatgatc

SEQ ID NO: 447499 - DNA, 20 bp, mouse
gccagacctacagacgtcca

SEQ ID NO: 447500 - DNA, 20 bp, mouse
gctgctgctatctgccttgg

SEQ ID NO: 447501 - DNA, 20 bp, mouse
gagcagcagtgtcctgatca

SEQ ID NO: 447502 - DNA, 20 bp, mouse
gagaggggacagcagctcaa

SEQ ID NO: 447503 - DNA, 20 bp, mouse
gacactgctgctatctgcct

SEQ ID NO: 447504 - DNA, 20 bp, mouse
gtgtgtccctggacgtctgt

SEQ ID NO: 447505 - DNA, 20 bp, mouse
ggttcccagcttcaccagac

SEQ ID NO: 447506 - DNA, 20 bp, mouse
ggggtgattagaaagagatg

SEQ ID NO: 447507 - DNA, 20 bp, mouse
gatgtcaggcaggtgacggt

SEQ ID NO: 447508 - DNA, 20 bp, mouse
gcttctgtagaagtaggtat

SEQ ID NO: 447509 - DNA, 20 bp, mouse
gtagaaagagatgtggaacc

SEQ ID NO: 447510 - DNA, 20 bp, mouse
gccatcgggtacaatatggt

SEQ ID NO: 447511 - DNA, 20 bp, mouse
gtaggtatggggtgtcaccc

SEQ ID NO: 447512 - DNA, 20 bp, mouse
ggtacaatatggtcggccaa

SEQ ID NO: 447513 - DNA, 20 bp, mouse
gtgatgcagcaaggagacat

SEQ ID NO: 447514 - DNA, 20 bp, mouse
gtactatgtcaggcaggtga

SEQ ID NO: 447515 - DNA, 20 bp, mouse
gtggatgacctcctgactta

SEQ ID NO: 447516 - DNA, 20 bp, mouse
gtgctgaggccgaatcccgg

SEQ ID NO: 447517 - DNA, 20 bp, mouse
gtgttctgctctggcggcag

SEQ ID NO: 447518 - DNA, 20 bp, mouse
gcgctgctgaggccgaatcc

SEQ ID NO: 447519 - DNA, 20 bp, mouse
gttggggtgttctgctctgg

SEQ ID NO: 447520 - DNA, 20 bp, mouse
gtaacgggccgcgggatgaa

SEQ ID NO: 447521 - DNA, 20 bp, mouse
gcggccgccgcactcaccag

SEQ ID NO: 447522 - DNA, 20 bp, mouse
gctcggggccgggagagtgg

SEQ ID NO: 447523 - DNA, 20 bp, mouse
ggggacgcggaggctccccc

SEQ ID NO: 447524 - DNA, 20 bp, mouse
ggcagaacaccccaaaatgg

SEQ ID NO: 447525 - DNA, 20 bp, mouse
gagagcagaacaccccaaaa

SEQ ID NO: 447526 - DNA, 20 bp, mouse
gcctgctcaggattcagcca

SEQ ID NO: 447527 - DNA, 20 bp, mouse
gagcaggtctgaagcaatgt

SEQ ID NO: 447528 - DNA, 20 bp, mouse
ggaacacaaacttcaagccc

SEQ ID NO: 447529 - DNA, 20 bp, mouse
gtctttggagtgggtacagt

SEQ ID NO: 447530 - DNA, 20 bp, mouse
gtgaagcaatgtgggtgcac

SEQ ID NO: 447531 - DNA, 20 bp, mouse
gtgagaattttgggactggg

SEQ ID NO: 447532 - DNA, 20 bp, mouse
gattatcttgagcagatgcc

SEQ ID NO: 447533 - DNA, 20 bp, mouse
ggcatcaagatctttggagt

SEQ ID NO: 447534 - DNA, 20 bp, mouse
gtatagaagattgagaattt

SEQ ID NO: 447535 - DNA, 20 bp, mouse
gaaagatcagctcggaagag

SEQ ID NO: 447536 - DNA, 20 bp, mouse
ggcacagccaacaagatgaa

SEQ ID NO: 447537 - DNA, 20 bp, mouse
gtagggtcactcaggcgtca

SEQ ID NO: 447538 - DNA, 20 bp, mouse
ggtcactcaggcgtcagggt

SEQ ID NO: 447539 - DNA, 20 bp, mouse
gtcttaatggcatctgggtc

SEQ ID NO: 447540 - DNA, 20 bp, mouse
gcccagcaggcgggaattct

SEQ ID NO: 447541 - DNA, 20 bp, mouse
ggaaccaggagccagagtta

SEQ ID NO: 447542 - DNA, 20 bp, mouse
ggcatggggtagggtcactc

SEQ ID NO: 447543 - DNA, 20 bp, mouse
gtctggtagacagctccata

SEQ ID NO: 447544 - DNA, 20 bp, mouse
gcccgcctgctgggacaggt

SEQ ID NO: 447545 - DNA, 20 bp, mouse
gagcatgtggcgcatggggt

SEQ ID NO: 447546 - DNA, 20 bp, mouse
gccggctactcccgacacta

SEQ ID NO: 447547 - DNA, 20 bp, mouse
gaagcaggcagccctagtgt

SEQ ID NO: 447548 - DNA, 20 bp, mouse
gggccggagagcagagctcc

SEQ ID NO: 447549 - DNA, 20 bp, mouse
gtagggaagacacctccctg

SEQ ID NO: 447550 - DNA, 20 bp, mouse
gcccaggtgaccgggaaagc

SEQ ID NO: 447551 - DNA, 20 bp, mouse
gctccgggacccaggtgacc

SEQ ID NO: 447552 - DNA, 20 bp, mouse
ggagcagagctccgggaccc

SEQ ID NO: 447553 - DNA, 20 bp, mouse
gctctctcgttggcttccta

SEQ ID NO: 447554 - DNA, 20 bp, mouse
gcaggccggggaaccataca

SEQ ID NO: 447555 - DNA, 20 bp, mouse
gttcccggtcacctgggtcc

SEQ ID NO: 447556 - DNA, 20 bp, mouse
gaaggtgtaggaaaccaaag

SEQ ID NO: 447557 - DNA, 20 bp, mouse
ggcagcgccgggcatatgaa

SEQ ID NO: 447558 - DNA, 20 bp, mouse
ggccacgttagcaaacggac

SEQ ID NO: 447559 - DNA, 20 bp, mouse
ggcctcagtaccaacgggct

SEQ ID NO: 447560 - DNA, 20 bp, mouse
gaatggtcgacgggttcccc

SEQ ID NO: 447561 - DNA, 20 bp, mouse
gcctacaccttgctctgctc

SEQ ID NO: 447562 - DNA, 20 bp, mouse
gacgcgagcctcagtaccaa

SEQ ID NO: 447563 - DNA, 20 bp, mouse
ggcctagcccgttggtactg

SEQ ID NO: 447564 - DNA, 20 bp, mouse
gtgccgaactcctcgaagag

SEQ ID NO: 447565 - DNA, 20 bp, mouse
gcatatgcccggcgctgccc

SEQ ID NO: 447566 - DNA, 20 bp, mouse
gggccgctgacggagtgaag

SEQ ID NO: 447567 - DNA, 20 bp, mouse
gcgctgacggagtgaagcgg

SEQ ID NO: 447568 - DNA, 20 bp, mouse
gcccgggcctggccggtggg

SEQ ID NO: 447569 - DNA, 20 bp, mouse
gagcgggccggagcgccccg

SEQ ID NO: 447570 - DNA, 20 bp, mouse
gcaccggcgtgcacaaaggt

SEQ ID NO: 447571 - DNA, 20 bp, mouse
gtgcagaaggcggggttcaa

SEQ ID NO: 447572 - DNA, 20 bp, mouse
gccggcccgctgccgcccac

SEQ ID NO: 447573 - DNA, 20 bp, mouse
gtgctcaaggacccgcacac

SEQ ID NO: 447574 - DNA, 20 bp, mouse
gcccgacggcatgaaggacc

SEQ ID NO: 447575 - DNA, 20 bp, mouse
ggccccggggcgcggcccga

SEQ ID NO: 447576 - DNA, 20 bp, mouse
gacaggcgggacgctcggga

SEQ ID NO: 447577 - DNA, 20 bp, mouse
gggccctcgccagcagtcca

SEQ ID NO: 447578 - DNA, 20 bp, mouse
gcagtccagggaagggacgg

SEQ ID NO: 447579 - DNA, 20 bp, mouse
gacgctcgggagggcggacg

SEQ ID NO: 447580 - DNA, 20 bp, mouse
gcgggacaggcgggacgctc

SEQ ID NO: 447581 - DNA, 20 bp, mouse
gaagggacggcgggacaggc

SEQ ID NO: 447582 - DNA, 20 bp, mouse
gagggaagggacggcgggac

SEQ ID NO: 447583 - DNA, 20 bp, mouse
gactgctggcgagggcctgg

SEQ ID NO: 447584 - DNA, 20 bp, mouse
gagggaacagaactgaggtg

SEQ ID NO: 447585 - DNA, 20 bp, mouse
ggtcgggaaaggttctagta

SEQ ID NO: 447586 - DNA, 20 bp, mouse
gcagacagctgagtgccggg

SEQ ID NO: 447587 - DNA, 20 bp, mouse
gtgtgagggattgatgttgg

SEQ ID NO: 447588 - DNA, 20 bp, mouse
gtcaccttctcaggccagat

SEQ ID NO: 447589 - DNA, 20 bp, mouse
gggggcagacagctgagtgc

SEQ ID NO: 447590 - DNA, 20 bp, mouse
gggatgtgagggattgatgt

SEQ ID NO: 447591 - DNA, 20 bp, mouse
gtgccaagagctgggtgcgt

SEQ ID NO: 447592 - DNA, 20 bp, mouse
gggatcacatgaggtaatgg

SEQ ID NO: 447593 - DNA, 20 bp, mouse
gtctagacttataacctgag

SEQ ID NO: 447594 - DNA, 20 bp, mouse
gggtgaagccggatggagga

SEQ ID NO: 447595 - DNA, 20 bp, mouse
gatcatgaattcacttaggg

SEQ ID NO: 447596 - DNA, 20 bp, mouse
gtgatgcgcggcgccctccc

SEQ ID NO: 447597 - DNA, 20 bp, mouse
gcagcagcgccggctccagg

SEQ ID NO: 447598 - DNA, 20 bp, mouse
gctcctccgtgcgtcccggg

SEQ ID NO: 447599 - DNA, 20 bp, mouse
gtgccaagttggtttcaaga

SEQ ID NO: 447600 - DNA, 20 bp, mouse
ggctgctgcaggttgatgcg

SEQ ID NO: 447601 - DNA, 20 bp, mouse
gtggctcctccgtgcgtccc

SEQ ID NO: 447602 - DNA, 20 bp, mouse
ggcggctgctcccaactcca

SEQ ID NO: 447603 - DNA, 20 bp, mouse
ggccctggcgaggacaccgg

SEQ ID NO: 447604 - DNA, 20 bp, mouse
gcacgcccgcccagcagagt

SEQ ID NO: 447605 - DNA, 20 bp, mouse
gggcacccgcagctcccaag

SEQ ID NO: 447606 - DNA, 20 bp, mouse
gccgggaggcgagggaacgc

SEQ ID NO: 447607 - DNA, 20 bp, mouse
gcaggagacgacagctccag

SEQ ID NO: 447608 - DNA, 20 bp, mouse
gcgcgggccgcgaggatctc

SEQ ID NO: 447609 - DNA, 20 bp, mouse
gtccccgccgcggcagctac

SEQ ID NO: 447610 - DNA, 20 bp, mouse
gtgcagagcagcggcggtgg

SEQ ID NO: 447611 - DNA, 20 bp, mouse
gaggctccgcagacgcaggt

SEQ ID NO: 447612 - DNA, 20 bp, mouse
gctccaggggcagccttcag

SEQ ID NO: 447613 - DNA, 20 bp, mouse
gctcccagtagtggcgacgg

SEQ ID NO: 447614 - DNA, 20 bp, mouse
ggcgcagcgtgaacccgcag

SEQ ID NO: 447615 - DNA, 20 bp, mouse
ggctggggaaggctcaccag

SEQ ID NO: 447616 - DNA, 20 bp, mouse
ggccatgttggagcgtcggg

SEQ ID NO: 447617 - DNA, 20 bp, mouse
ggcctcccgacgctccaaca

SEQ ID NO: 447618 - DNA, 20 bp, mouse
ggagcggccgggagccatgt

SEQ ID NO: 447619 - DNA, 20 bp, mouse
ggcgtcggggatgctgtggt

SEQ ID NO: 447620 - DNA, 20 bp, mouse
ggaccaggactgggacccag

SEQ ID NO: 447621 - DNA, 20 bp, mouse
gcggaggtggagcaaaccat

SEQ ID NO: 447622 - DNA, 20 bp, mouse
gccgggagaccccaccatag

SEQ ID NO: 447623 - DNA, 20 bp, mouse
gtccgcggccagagcccctt

SEQ ID NO: 447624 - DNA, 20 bp, mouse
ggtggagcaaaccatcggag

SEQ ID NO: 447625 - DNA, 20 bp, mouse
gggagccatgttggagcgtc

SEQ ID NO: 447626 - DNA, 20 bp, mouse
gtcgcttcacgggatgacag

SEQ ID NO: 447627 - DNA, 20 bp, mouse
gtgcgcagcgagaagctgga

SEQ ID NO: 447628 - DNA, 20 bp, mouse
gttcacgggatgacagcggg

SEQ ID NO: 447629 - DNA, 20 bp, mouse
ggaaactcctgagcactcct

SEQ ID NO: 447630 - DNA, 20 bp, mouse
ggcggtggctgcggataccg

SEQ ID NO: 447631 - DNA, 20 bp, mouse
gcggataccgaggagtgctc

SEQ ID NO: 447632 - DNA, 20 bp, mouse
gacgggatgacagcgggcgg

SEQ ID NO: 447633 - DNA, 20 bp, mouse
gcgctgcgcattcgcttcac

SEQ ID NO: 447634 - DNA, 20 bp, mouse
gaggctacaggcccttccga

SEQ ID NO: 447635 - DNA, 20 bp, mouse
gtcctggcacgccctcggaa

SEQ ID NO: 447636 - DNA, 20 bp, mouse
gttcggcagcaggaccaaga

SEQ ID NO: 447637 - DNA, 20 bp, mouse
gccgaacgcgagcaagccca

SEQ ID NO: 447638 - DNA, 20 bp, mouse
ggaccaagaaggcttaggga

SEQ ID NO: 447639 - DNA, 20 bp, mouse
gcgcgacagagctccagtgt

SEQ ID NO: 447640 - DNA, 20 bp, mouse
gcgtcaggaccgccagaact

SEQ ID NO: 447641 - DNA, 20 bp, mouse
gccccacaggatgaccgcac

SEQ ID NO: 447642 - DNA, 20 bp, mouse
gcggtcctgacgcgcacctt

SEQ ID NO: 447643 - DNA, 20 bp, mouse
ggcttgctcgcgttcggttt

SEQ ID NO: 447644 - DNA, 20 bp, mouse
gtctacaggcccggccccac

SEQ ID NO: 447645 - DNA, 20 bp, mouse
ggccggtgcggtcatcctgt

SEQ ID NO: 447646 - DNA, 20 bp, mouse
gcgccccgcccgagacaaag

SEQ ID NO: 447647 - DNA, 20 bp, mouse
gagaacccggacctacgcaa

SEQ ID NO: 447648 - DNA, 20 bp, mouse
gcacgcgcgggaaaggtcat

SEQ ID NO: 447649 - DNA, 20 bp, mouse
ggacaaagcggctcgcgggg

SEQ ID NO: 447650 - DNA, 20 bp, mouse
gaagtcgcggatcatccagg

SEQ ID NO: 447651 - DNA, 20 bp, mouse
gcgggatgggccccaagcgg

SEQ ID NO: 447652 - DNA, 20 bp, mouse
gcccgtacgacaagctggag

SEQ ID NO: 447653 - DNA, 20 bp, mouse
gtcggagcgcaagtacggag

SEQ ID NO: 447654 - DNA, 20 bp, mouse
gtggcgtcggagcgcaagta

SEQ ID NO: 447655 - DNA, 20 bp, mouse
gccgcgagccgctttgtctc

SEQ ID NO: 447656 - DNA, 20 bp, mouse
gatgcacccggtccagcaca

SEQ ID NO: 447657 - DNA, 20 bp, mouse
gctaggcttgtgcgcaggcg

SEQ ID NO: 447658 - DNA, 20 bp, mouse
gacctagtgggccggaacca

SEQ ID NO: 447659 - DNA, 20 bp, mouse
gggtggctgctgtttattta

SEQ ID NO: 447660 - DNA, 20 bp, mouse
gcacccagacaggcgggact

SEQ ID NO: 447661 - DNA, 20 bp, mouse
gtacggctgagtgttaagtg

SEQ ID NO: 447662 - DNA, 20 bp, mouse
ggtaagtgcgggtctggatc

SEQ ID NO: 447663 - DNA, 20 bp, mouse
gtttaaaaaacgccaattaa

SEQ ID NO: 447664 - DNA, 20 bp, mouse
ggggaaacccaagccggcca

SEQ ID NO: 447665 - DNA, 20 bp, mouse
gcatctggtaagtgcgggtc

SEQ ID NO: 447666 - DNA, 20 bp, mouse
gtagtctgcagcggacagga

SEQ ID NO: 447667 - DNA, 20 bp, mouse
ggcggacaggatggccgagg

SEQ ID NO: 447668 - DNA, 20 bp, mouse
gtgcagactaagggaaacga

SEQ ID NO: 447669 - DNA, 20 bp, mouse
gggcggcccgggagctcggt

SEQ ID NO: 447670 - DNA, 20 bp, mouse
gcccttagtctgcagcggac

SEQ ID NO: 447671 - DNA, 20 bp, mouse
gccgcctacctgctgttgag

SEQ ID NO: 447672 - DNA, 20 bp, mouse
gtccgtccatcaggcgagga

SEQ ID NO: 447673 - DNA, 20 bp, mouse
ggcagcggacaggatggccg

SEQ ID NO: 447674 - DNA, 20 bp, mouse
gcgggtgtcggtgtgactcg

SEQ ID NO: 447675 - DNA, 20 bp, mouse
ggccgtcctcgcctgatgga

SEQ ID NO: 447676 - DNA, 20 bp, mouse
gcgctgtgtgaggagctcgg

SEQ ID NO: 447677 - DNA, 20 bp, mouse
gcgtgctggtcggggaggaa

SEQ ID NO: 447678 - DNA, 20 bp, mouse
gaggaacggtgcgctgtgtg

SEQ ID NO: 447679 - DNA, 20 bp, mouse
ggaatcgctcgtgctggtcg

SEQ ID NO: 447680 - DNA, 20 bp, mouse
gagctcggcggtgaggaact

SEQ ID NO: 447681 - DNA, 20 bp, mouse
ggtgcgctgtgtgaggagct

SEQ ID NO: 447682 - DNA, 20 bp, mouse
gtgtgaggagctcggcggtg

SEQ ID NO: 447683 - DNA, 20 bp, mouse
gctagctagcactggcagag

SEQ ID NO: 447684 - DNA, 20 bp, mouse
gcccggagccaggttctgtg

SEQ ID NO: 447685 - DNA, 20 bp, mouse
gaggcaggggatcctgacgg

SEQ ID NO: 447686 - DNA, 20 bp, mouse
gcggcctcagacctctcccg

SEQ ID NO: 447687 - DNA, 20 bp, mouse
gcagccagcccggaccacag

SEQ ID NO: 447688 - DNA, 20 bp, mouse
gcgtggcgggaagaactgct

SEQ ID NO: 447689 - DNA, 20 bp, mouse
ggggcgggacccttccggaa

SEQ ID NO: 447690 - DNA, 20 bp, mouse
gactgctgggttattttctg

SEQ ID NO: 447691 - DNA, 20 bp, mouse
gtgcaatggaggagcagccg

SEQ ID NO: 447692 - DNA, 20 bp, mouse
gcgcaagcctggctcaagac

SEQ ID NO: 447693 - DNA, 20 bp, mouse
gcggagccctaaatcagcca

SEQ ID NO: 447694 - DNA, 20 bp, mouse
ggaaccctgagcctcccgag

SEQ ID NO: 447695 - DNA, 20 bp, mouse
gtctgtggcgttcaaacctg

SEQ ID NO: 447696 - DNA, 20 bp, mouse
gaagccgcctggagattcaa

SEQ ID NO: 447697 - DNA, 20 bp, mouse
gtcggcgagcacacagcctc

SEQ ID NO: 447698 - DNA, 20 bp, mouse
gctctaggtgagttgcctag

SEQ ID NO: 447699 - DNA, 20 bp, mouse
gggcggcttttgggctccag

SEQ ID NO: 447700 - DNA, 20 bp, mouse
ggaatcggcctagtcgagag

SEQ ID NO: 447701 - DNA, 20 bp, mouse
ggcgcctttgaatctccagg

SEQ ID NO: 447702 - DNA, 20 bp, mouse
ggccgccgcgggctcctccg

SEQ ID NO: 447703 - DNA, 20 bp, mouse
gttcactgttgggtggggag

SEQ ID NO: 447704 - DNA, 20 bp, mouse
gtgctccctggcctctctat

SEQ ID NO: 447705 - DNA, 20 bp, mouse
gcggcaaaccactctcgact

SEQ ID NO: 447706 - DNA, 20 bp, mouse
ggctgcagcgatggttgtgg

SEQ ID NO: 447707 - DNA, 20 bp, mouse
gctggctgcagcgatggttg

SEQ ID NO: 447708 - DNA, 20 bp, mouse
gaaatgccgggccagctaag

SEQ ID NO: 447709 - DNA, 20 bp, mouse
gtgactatcgctggtcggag

SEQ ID NO: 447710 - DNA, 20 bp, mouse
ggctaagtggtgactatcgc

SEQ ID NO: 447711 - DNA, 20 bp, mouse
gggggctctggctgcagcga

SEQ ID NO: 447712 - DNA, 20 bp, mouse
gccttgaggaccgatccccc

SEQ ID NO: 447713 - DNA, 20 bp, mouse
gtgttcttccgagcacccgg

SEQ ID NO: 447714 - DNA, 20 bp, mouse
gtcgaagaacggtaactgat

SEQ ID NO: 447715 - DNA, 20 bp, mouse
gcggctcattcgtaaatgcc

SEQ ID NO: 447716 - DNA, 20 bp, mouse
gtgtgttgacgagagcgctg

SEQ ID NO: 447717 - DNA, 20 bp, mouse
ggttgacgagagcgctgagg

SEQ ID NO: 447718 - DNA, 20 bp, mouse
ggactgaagtgagttgaaac

SEQ ID NO: 447719 - DNA, 20 bp, mouse
gagttgaaaccggctctgac

SEQ ID NO: 447720 - DNA, 20 bp, mouse
gcctccttgacagaaaactg

SEQ ID NO: 447721 - DNA, 20 bp, mouse
gggcctttgccagtcagagc

SEQ ID NO: 447722 - DNA, 20 bp, mouse
ggcagcgcgcgtaaacagcg

SEQ ID NO: 447723 - DNA, 20 bp, mouse
gaaccggctctgactggcaa

SEQ ID NO: 447724 - DNA, 20 bp, mouse
gcgtaagcgtccgatctagg

SEQ ID NO: 447725 - DNA, 20 bp, mouse
gagcaggcaggtggagacgc

SEQ ID NO: 447726 - DNA, 20 bp, mouse
gggagctctccggggatcaa

SEQ ID NO: 447727 - DNA, 20 bp, mouse
gccttctccggagctctccg

SEQ ID NO: 447728 - DNA, 20 bp, mouse
gcgccggcccacgaaaaaca

SEQ ID NO: 447729 - DNA, 20 bp, mouse
gggaaaagcgcctagacgag

SEQ ID NO: 447730 - DNA, 20 bp, mouse
gagagaaccgaagcaatccc

SEQ ID NO: 447731 - DNA, 20 bp, mouse
gctccggagaagggtctttg

SEQ ID NO: 447732 - DNA, 20 bp, mouse
gtgcagtacacggccagtcg

SEQ ID NO: 447733 - DNA, 20 bp, mouse
ggaagagacatcaggagtcc

SEQ ID NO: 447734 - DNA, 20 bp, mouse
gtcccccgggagagacagct

SEQ ID NO: 447735 - DNA, 20 bp, mouse
ggccgagctgtctctcccgg

SEQ ID NO: 447736 - DNA, 20 bp, mouse
ggcgcgctgaggctgaggaa

SEQ ID NO: 447737 - DNA, 20 bp, mouse
ggctgctgccgctgagatgt

SEQ ID NO: 447738 - DNA, 20 bp, mouse
gcagcggcagcagcgccact

SEQ ID NO: 447739 - DNA, 20 bp, mouse
gcggtagccctgttcaggtc

SEQ ID NO: 447740 - DNA, 20 bp, mouse
gtactctggaccaatcggag

SEQ ID NO: 447741 - DNA, 20 bp, mouse
ggccccgcccactagagagg

SEQ ID NO: 447742 - DNA, 20 bp, mouse
gaagctgcccgacctgaaca

SEQ ID NO: 447743 - DNA, 20 bp, mouse
gctgcccgcacctaccaaga

SEQ ID NO: 447744 - DNA, 20 bp, mouse
gcgcgccccgcccactagag

SEQ ID NO: 447745 - DNA, 20 bp, mouse
gcaaggcccgcctctctagt

SEQ ID NO: 447746 - DNA, 20 bp, mouse
ggcgggaaccgctgcagaga

SEQ ID NO: 447747 - DNA, 20 bp, mouse
gggaaccgctgcagagacgg

SEQ ID NO: 447748 - DNA, 20 bp, mouse
gcgggcgatgtggactggta

SEQ ID NO: 447749 - DNA, 20 bp, mouse
ggcagagacggcgggcgatg

SEQ ID NO: 447750 - DNA, 20 bp, mouse
ggacggcgggcgatgtggac

SEQ ID NO: 447751 - DNA, 20 bp, mouse
gtcgcccgccgtctctgcag

SEQ ID NO: 447752 - DNA, 20 bp, mouse
gggcttcaaaagcacctcgg

SEQ ID NO: 447753 - DNA, 20 bp, mouse
ggccgcctccgagtccaatt

SEQ ID NO: 447754 - DNA, 20 bp, mouse
ggacaccgaattggactcgg

SEQ ID NO: 447755 - DNA, 20 bp, mouse
ggggcccgagcggccattgg

SEQ ID NO: 447756 - DNA, 20 bp, mouse
gatcctgagtgagggagctt

SEQ ID NO: 447757 - DNA, 20 bp, mouse
gcgccaaagctccctcactc

SEQ ID NO: 447758 - DNA, 20 bp, mouse
gcgggactgtcaggcaatag

SEQ ID NO: 447759 - DNA, 20 bp, mouse
gggtgaggtaggcgtggaca

SEQ ID NO: 447760 - DNA, 20 bp, mouse
gcaaagcactctgggatcag

SEQ ID NO: 447761 - DNA, 20 bp, mouse
ggacagggctgaccagtcca

SEQ ID NO: 447762 - DNA, 20 bp, mouse
gtacttcagttgctctcggc

SEQ ID NO: 447763 - DNA, 20 bp, mouse
gtgctaatctgtctaccact

SEQ ID NO: 447764 - DNA, 20 bp, mouse
ggtggccacggcggtgaggt

SEQ ID NO: 447765 - DNA, 20 bp, mouse
gaagcccggctggaccatag

SEQ ID NO: 447766 - DNA, 20 bp, mouse
gtaccgacgtggaaccctga

SEQ ID NO: 447767 - DNA, 20 bp, mouse
ggcccagactgccattctcc

SEQ ID NO: 447768 - DNA, 20 bp, mouse
gcaccttcagggttccacgt

SEQ ID NO: 447769 - DNA, 20 bp, mouse
gggtgaagtagcccggagaa

SEQ ID NO: 447770 - DNA, 20 bp, mouse
ggaatccatggctaccgacg

SEQ ID NO: 447771 - DNA, 20 bp, mouse
gaggtccgcggggtgctaca

SEQ ID NO: 447772 - DNA, 20 bp, mouse
gtcgcgggtctcggaatcca

SEQ ID NO: 447773 - DNA, 20 bp, mouse
gccctgaaggtgaagtagcc

SEQ ID NO: 447774 - DNA, 20 bp, mouse
gtccagggcgcgcagttcgc

SEQ ID NO: 447775 - DNA, 20 bp, mouse
ggggcagccaggagacttca

SEQ ID NO: 447776 - DNA, 20 bp, mouse
gcccaaacaaccggaaaaga

SEQ ID NO: 447777 - DNA, 20 bp, mouse
gggaaccggaagcgtcagtg

SEQ ID NO: 447778 - DNA, 20 bp, mouse
gagtcgaggaagcgataaag

SEQ ID NO: 447779 - DNA, 20 bp, mouse
gcggagaacttccaggatct

SEQ ID NO: 447780 - DNA, 20 bp, mouse
gaaagcggctgacagatcca

SEQ ID NO: 447781 - DNA, 20 bp, mouse
gaagcaactgtgaagagtcg

SEQ ID NO: 447782 - DNA, 20 bp, mouse
ggaaaagacggagaacttcc

SEQ ID NO: 447783 - DNA, 20 bp, mouse
gtgtccgtcgctccaggacg

SEQ ID NO: 447784 - DNA, 20 bp, mouse
gagattcaggaaccaagacc

SEQ ID NO: 447785 - DNA, 20 bp, mouse
gtcaggaaccaagaccggga

SEQ ID NO: 447786 - DNA, 20 bp, mouse
gaggggtggggtcctgaaca

SEQ ID NO: 447787 - DNA, 20 bp, mouse
gctgcttgagcagttaggag

SEQ ID NO: 447788 - DNA, 20 bp, mouse
gttgagcagttaggaggggt

SEQ ID NO: 447789 - DNA, 20 bp, mouse
gcggcgcgtgctggagacgg

SEQ ID NO: 447790 - DNA, 20 bp, mouse
gatcgccgtcagaaaagctg

SEQ ID NO: 447791 - DNA, 20 bp, mouse
ggcaaaagcgtgcgtacagt

SEQ ID NO: 447792 - DNA, 20 bp, mouse
gcatgggagcctcagagagt

SEQ ID NO: 447793 - DNA, 20 bp, mouse
gttgcggcgcgtgctggaga

SEQ ID NO: 447794 - DNA, 20 bp, mouse
ggatgctgagatcagactcg

SEQ ID NO: 447795 - DNA, 20 bp, mouse
ggctgaggtccgccatgttc

SEQ ID NO: 447796 - DNA, 20 bp, mouse
gggctgagggagacatgcgg

SEQ ID NO: 447797 - DNA, 20 bp, mouse
ggccggcggtggctcctcgg

SEQ ID NO: 447798 - DNA, 20 bp, mouse
gtcgagcgccgacaccgagg

SEQ ID NO: 447799 - DNA, 20 bp, mouse
gaggcctgcgagcccggctg

SEQ ID NO: 447800 - DNA, 20 bp, mouse
gtcccgcgggccggtggcca

SEQ ID NO: 447801 - DNA, 20 bp, mouse
gcaccggcccgcgggagcag

SEQ ID NO: 447802 - DNA, 20 bp, mouse
gcgctcccggagcaggacta

SEQ ID NO: 447803 - DNA, 20 bp, mouse
gccgcctcctgggcccgcgg

SEQ ID NO: 447804 - DNA, 20 bp, mouse
gaggtcgagcgccgacaccg

SEQ ID NO: 447805 - DNA, 20 bp, mouse
gggcgctcgggggccaccgg

SEQ ID NO: 447806 - DNA, 20 bp, mouse
gcgcggcccgtcgcacgtca

SEQ ID NO: 447807 - DNA, 20 bp, mouse
gctccttccgcggtcccccg

SEQ ID NO: 447808 - DNA, 20 bp, mouse
gcgtgtcagtctgtggtgag

SEQ ID NO: 447809 - DNA, 20 bp, mouse
gaccactcggcggtgtgggg

SEQ ID NO: 447810 - DNA, 20 bp, mouse
gagcggccctgacgtgcgac

SEQ ID NO: 447811 - DNA, 20 bp, mouse
gagcagaagaagcctcacct

SEQ ID NO: 447812 - DNA, 20 bp, mouse
gagccaggcagtctccttaa

SEQ ID NO: 447813 - DNA, 20 bp, mouse
gcaggcccgccggccacgac

SEQ ID NO: 447814 - DNA, 20 bp, mouse
gtcccgcgggagttttgaac

SEQ ID NO: 447815 - DNA, 20 bp, mouse
gtcgaccactcggcggtgtg

SEQ ID NO: 447816 - DNA, 20 bp, mouse
gcagctgcggcccgggccct

SEQ ID NO: 447817 - DNA, 20 bp, mouse
gcctccaaggccaggtgtca

SEQ ID NO: 447818 - DNA, 20 bp, mouse
gtgctatgggagcgcagctg

SEQ ID NO: 447819 - DNA, 20 bp, mouse
gggaggcctggaacaggcac

SEQ ID NO: 447820 - DNA, 20 bp, mouse
gctgcagggaggcctggaac

SEQ ID NO: 447821 - DNA, 20 bp, mouse
gtggccgcgcagtccctcca

SEQ ID NO: 447822 - DNA, 20 bp, mouse
gtgtagctctggctccgggt

SEQ ID NO: 447823 - DNA, 20 bp, mouse
gggtcttcggcaggcacccg

SEQ ID NO: 447824 - DNA, 20 bp, mouse
gcttcggcaggcacccgggg

SEQ ID NO: 447825 - DNA, 20 bp, mouse
gacccctccgaagatagcgg

SEQ ID NO: 447826 - DNA, 20 bp, mouse
ggtgctgtcggtctcctgag

SEQ ID NO: 447827 - DNA, 20 bp, mouse
gcgccgggatacttcccctc

SEQ ID NO: 447828 - DNA, 20 bp, mouse
ggagagggccagcttggtgt

SEQ ID NO: 447829 - DNA, 20 bp, mouse
gaggaacggcctagcgggag

SEQ ID NO: 447830 - DNA, 20 bp, mouse
gacgggaaggaacggcctag

SEQ ID NO: 447831 - DNA, 20 bp, mouse
gtcaccgcctcagcacggga

SEQ ID NO: 447832 - DNA, 20 bp, mouse
gagctggccctctcggcaac

SEQ ID NO: 447833 - DNA, 20 bp, mouse
ggcgtgcacagcctaggtcg

SEQ ID NO: 447834 - DNA, 20 bp, mouse
ggagccggcacacctcacgc

SEQ ID NO: 447835 - DNA, 20 bp, mouse
ggttgtgccggttgccgaga

SEQ ID NO: 447836 - DNA, 20 bp, mouse
gggaggcgcttgccaagatg

SEQ ID NO: 447837 - DNA, 20 bp, mouse
gaggcgctgggaagttactt

SEQ ID NO: 447838 - DNA, 20 bp, mouse
gagccgtggggaacaaaaac

SEQ ID NO: 447839 - DNA, 20 bp, mouse
gggaagttacttgggcacgg

SEQ ID NO: 447840 - DNA, 20 bp, mouse
gctgggaagttacttgggca

SEQ ID NO: 447841 - DNA, 20 bp, mouse
gctgttatgacagagccgtg

SEQ ID NO: 447842 - DNA, 20 bp, mouse
gtgcagaagaaccgcaggaa

SEQ ID NO: 447843 - DNA, 20 bp, mouse
gaaagaaagggcttggacgg

SEQ ID NO: 447844 - DNA, 20 bp, mouse
gtcccagcgcctcaaactat

SEQ ID NO: 447845 - DNA, 20 bp, mouse
gaccgctgcagaagaaccgc

SEQ ID NO: 447846 - DNA, 20 bp, mouse
ggcgtcggcggccgagtgga

SEQ ID NO: 447847 - DNA, 20 bp, mouse
gcccagccgccacagccaaa

SEQ ID NO: 447848 - DNA, 20 bp, mouse
ggggccgtccagcaaaccgg

SEQ ID NO: 447849 - DNA, 20 bp, mouse
gctgggcgtcggcggccgag

SEQ ID NO: 447850 - DNA, 20 bp, mouse
gtgaaaccgtttggctgtgg

SEQ ID NO: 447851 - DNA, 20 bp, mouse
ggtggacggcttgcttgttg

SEQ ID NO: 447852 - DNA, 20 bp, mouse
ggcaaggatttgaaaccgtt

SEQ ID NO: 447853 - DNA, 20 bp, mouse
gcccgagtgggcaccgggag

SEQ ID NO: 447854 - DNA, 20 bp, mouse
gccactcagaacctgggagt

SEQ ID NO: 447855 - DNA, 20 bp, mouse
gagcagccgagcgacggcca

SEQ ID NO: 447856 - DNA, 20 bp, mouse
gaacgcccgggcagccgcag

SEQ ID NO: 447857 - DNA, 20 bp, mouse
gcaggccgagagcccggggg

SEQ ID NO: 447858 - DNA, 20 bp, mouse
gtgcccgggcgtttgaatag

SEQ ID NO: 447859 - DNA, 20 bp, mouse
gtgcgggcctggttgctagg

SEQ ID NO: 447860 - DNA, 20 bp, mouse
gcaagagccccggggagacg

SEQ ID NO: 447861 - DNA, 20 bp, mouse
gcccgcaggccgagagcccg

SEQ ID NO: 447862 - DNA, 20 bp, mouse
gcggcctgcgcacctcaact

SEQ ID NO: 447863 - DNA, 20 bp, mouse
gcaaagggtgatagagacca

SEQ ID NO: 447864 - DNA, 20 bp, mouse
gagccgctattcaaacgccc

SEQ ID NO: 447865 - DNA, 20 bp, mouse
gaggcggaagcggggcgcgg

SEQ ID NO: 447866 - DNA, 20 bp, mouse
gcggctaccagcgaccccga

SEQ ID NO: 447867 - DNA, 20 bp, mouse
gtgccatagctgcaagtccc

SEQ ID NO: 447868 - DNA, 20 bp, mouse
ggctgcaagtcccgggtgag

SEQ ID NO: 447869 - DNA, 20 bp, mouse
gcacccgggacttgcagcta

SEQ ID NO: 447870 - DNA, 20 bp, mouse
gagtcccgggtgagcggagt

SEQ ID NO: 447871 - DNA, 20 bp, mouse
gtgctctagcggtgcctggg

SEQ ID NO: 447872 - DNA, 20 bp, mouse
gccctaggacaaggggaagt

SEQ ID NO: 447873 - DNA, 20 bp, mouse
gcaaccgactccgctcaccc

SEQ ID NO: 447874 - DNA, 20 bp, mouse
ggcgcctaggagggagccct

SEQ ID NO: 447875 - DNA, 20 bp, mouse
ggtgagcggagtcggttgcg

SEQ ID NO: 447876 - DNA, 20 bp, mouse
gccggagcggcccacagtgg

SEQ ID NO: 447877 - DNA, 20 bp, mouse
ggccgaaagccgccatctcc

SEQ ID NO: 447878 - DNA, 20 bp, mouse
gcgcgccggccgcccggaga

SEQ ID NO: 447879 - DNA, 20 bp, mouse
ggcgcgcgcgccgccactgt

SEQ ID NO: 447880 - DNA, 20 bp, mouse
ggaaagccgccatctccggg

SEQ ID NO: 447881 - DNA, 20 bp, mouse
gtcggtgcccggaaacgtaa

SEQ ID NO: 447882 - DNA, 20 bp, mouse
gcggtcgcggcccacaagga

SEQ ID NO: 447883 - DNA, 20 bp, mouse
ggatgtacctcgggacggag

SEQ ID NO: 447884 - DNA, 20 bp, mouse
ggtacctcgggacggagcgg

SEQ ID NO: 447885 - DNA, 20 bp, mouse
gtccgttaccggggcaacgg

SEQ ID NO: 447886 - DNA, 20 bp, mouse
gtgctcgcggctggaagtca

SEQ ID NO: 447887 - DNA, 20 bp, mouse
gtgagtacacccagtcgagg

SEQ ID NO: 447888 - DNA, 20 bp, mouse
gcgcgggctagggtgtaacc

SEQ ID NO: 447889 - DNA, 20 bp, mouse
gggctagggtgtaaccggga

SEQ ID NO: 447890 - DNA, 20 bp, mouse
ggtaaccgggaaggtgctcg

SEQ ID NO: 447891 - DNA, 20 bp, mouse
gacaggaagccccctcgact

SEQ ID NO: 447892 - DNA, 20 bp, mouse
ggcaagcacagccccggtgt

SEQ ID NO: 447893 - DNA, 20 bp, mouse
gcccggggtccaagaaccac

SEQ ID NO: 447894 - DNA, 20 bp, mouse
gaagtcagggcagcgggttg

SEQ ID NO: 447895 - DNA, 20 bp, mouse
ggcgggttgcgggttgcggg

SEQ ID NO: 447896 - DNA, 20 bp, mouse
gtcgctgcagggcaacaccc

SEQ ID NO: 447897 - DNA, 20 bp, mouse
gcccggccccccaccttcca

SEQ ID NO: 447898 - DNA, 20 bp, mouse
gagcggggagccggacaccc

SEQ ID NO: 447899 - DNA, 20 bp, mouse
gccagggacgccggggtgtc

SEQ ID NO: 447900 - DNA, 20 bp, mouse
gggcaacaccccggcgtccc

SEQ ID NO: 447901 - DNA, 20 bp, mouse
gcggcgtccctggaaggtgg

SEQ ID NO: 447902 - DNA, 20 bp, mouse
ggccagctgggcaagagagg

SEQ ID NO: 447903 - DNA, 20 bp, mouse
ggtccggctccccgcttcca

SEQ ID NO: 447904 - DNA, 20 bp, mouse
gcccggcgtccctggaagcg

SEQ ID NO: 447905 - DNA, 20 bp, mouse
ggtcaccgaggccaagaaga

SEQ ID NO: 447906 - DNA, 20 bp, mouse
gtagcgggaacggcagcgaa

SEQ ID NO: 447907 - DNA, 20 bp, mouse
ggccccacacatagcgggaa

SEQ ID NO: 447908 - DNA, 20 bp, mouse
gacacacgccccacacatag

SEQ ID NO: 447909 - DNA, 20 bp, mouse
gattgcccagcggaaccgag

SEQ ID NO: 447910 - DNA, 20 bp, mouse
gccggtccggtccctctctg

SEQ ID NO: 447911 - DNA, 20 bp, mouse
gcgaggggcccccagctcca

SEQ ID NO: 447912 - DNA, 20 bp, mouse
ggccgccgccgtggagctgg

SEQ ID NO: 447913 - DNA, 20 bp, mouse
gtgccgttcccgctatgtgt

SEQ ID NO: 447914 - DNA, 20 bp, mouse
ggaataacgttattgcccag

SEQ ID NO: 447915 - DNA, 20 bp, mouse
gtaagtgatgcgctcggggt

SEQ ID NO: 447916 - DNA, 20 bp, mouse
gggcgcggcccgcacgctgg

SEQ ID NO: 447917 - DNA, 20 bp, mouse
gctgcccgtgggctcggccg

SEQ ID NO: 447918 - DNA, 20 bp, mouse
ggtgtcgcggcagacgtcag

SEQ ID NO: 447919 - DNA, 20 bp, mouse
gcgcacgctggcggcagccc

SEQ ID NO: 447920 - DNA, 20 bp, mouse
ggcgccgggcatgtcctagg

SEQ ID NO: 447921 - DNA, 20 bp, mouse
ggccagccctgcgcccacgg

SEQ ID NO: 447922 - DNA, 20 bp, mouse
gcgggcagagcgccggaccg

SEQ ID NO: 447923 - DNA, 20 bp, mouse
gcccgggcgcgcgcagacat

SEQ ID NO: 447924 - DNA, 20 bp, mouse
ggccgcgccgggcatgtcct

SEQ ID NO: 447925 - DNA, 20 bp, mouse
gccgccgcctaggacatgcc

SEQ ID NO: 447926 - DNA, 20 bp, mouse
gccggtccaagggcccacct

SEQ ID NO: 447927 - DNA, 20 bp, mouse
gcgcggggagtgcggtccta

SEQ ID NO: 447928 - DNA, 20 bp, mouse
ggccttgggaacgatcctcg

SEQ ID NO: 447929 - DNA, 20 bp, mouse
ggcactgcacagaggagctt

SEQ ID NO: 447930 - DNA, 20 bp, mouse
gggcagctcgcccggtccaa

SEQ ID NO: 447931 - DNA, 20 bp, mouse
gcggttgtgggcaggaagcg

SEQ ID NO: 447932 - DNA, 20 bp, mouse
gatcctcggggcgcctaggt

SEQ ID NO: 447933 - DNA, 20 bp, mouse
gaacgatcctcggggcgcct

SEQ ID NO: 447934 - DNA, 20 bp, mouse
ggccccgaggatcgttccca

SEQ ID NO: 447935 - DNA, 20 bp, mouse
gagcctacaggaataaccat

SEQ ID NO: 447936 - DNA, 20 bp, mouse
gcgtggctggcggatcttgg

SEQ ID NO: 447937 - DNA, 20 bp, mouse
ggtcgatgcggtggactcgg

SEQ ID NO: 447938 - DNA, 20 bp, mouse
gaccggagggaacaaggatg

SEQ ID NO: 447939 - DNA, 20 bp, mouse
gcgctaaaggggcggatccg

SEQ ID NO: 447940 - DNA, 20 bp, mouse
gtgaggaggggtcgtcgatg

SEQ ID NO: 447941 - DNA, 20 bp, mouse
gagccggaccggagggaaca

SEQ ID NO: 447942 - DNA, 20 bp, mouse
ggagcaatccctagccggac

SEQ ID NO: 447943 - DNA, 20 bp, mouse
ggggtcgtggccgggtgagg

SEQ ID NO: 447944 - DNA, 20 bp, mouse
gtgggctgctctgtgagatc

SEQ ID NO: 447945 - DNA, 20 bp, mouse
gaggaaaacgtccgctaaag

SEQ ID NO: 447946 - DNA, 20 bp, mouse
gaagcgctccgcagctaccg

SEQ ID NO: 447947 - DNA, 20 bp, mouse
gggcctggcctccagactga

SEQ ID NO: 447948 - DNA, 20 bp, mouse
gactctggtgaggtgggcag

SEQ ID NO: 447949 - DNA, 20 bp, mouse
gggagcgcttcgggatcccc

SEQ ID NO: 447950 - DNA, 20 bp, mouse
gcggctgcagcaggaaactg

SEQ ID NO: 447951 - DNA, 20 bp, mouse
ggcagcggcctcggtagctg

SEQ ID NO: 447952 - DNA, 20 bp, mouse
gtcaccagagtcggttcccg

SEQ ID NO: 447953 - DNA, 20 bp, mouse
gaggcaccccgggcccagag

SEQ ID NO: 447954 - DNA, 20 bp, mouse
ggaaagggcgggagtttgac

SEQ ID NO: 447955 - DNA, 20 bp, mouse
gccagactgagggcggcccc

SEQ ID NO: 447956 - DNA, 20 bp, mouse
gcttccaacaacaggatgag

SEQ ID NO: 447957 - DNA, 20 bp, mouse
gtgagggcaagggaaagtct

SEQ ID NO: 447958 - DNA, 20 bp, mouse
ggcacatctcatctgctcca

SEQ ID NO: 447959 - DNA, 20 bp, mouse
gtcctgttgttggaagacct

SEQ ID NO: 447960 - DNA, 20 bp, mouse
ggggcttcagtgctagaagg

SEQ ID NO: 447961 - DNA, 20 bp, mouse
gctgtcagcttatgagccgg

SEQ ID NO: 447962 - DNA, 20 bp, mouse
gcagcccctcatcctgttgt

SEQ ID NO: 447963 - DNA, 20 bp, mouse
gggaccattaacttagaacc

SEQ ID NO: 447964 - DNA, 20 bp, mouse
gcttcctggttctaagttaa

SEQ ID NO: 447965 - DNA, 20 bp, mouse
gaaggagagagtatccctcc

SEQ ID NO: 447966 - DNA, 20 bp, mouse
ggatgccacctaatataaag

SEQ ID NO: 447967 - DNA, 20 bp, mouse
gctttccactttatattagg

SEQ ID NO: 447968 - DNA, 20 bp, mouse
gcttgccgtggcaggtcatc

SEQ ID NO: 447969 - DNA, 20 bp, mouse
gctgctaactcttcttgccg

SEQ ID NO: 447970 - DNA, 20 bp, mouse
gtttgtaggaaagagtgtgt

SEQ ID NO: 447971 - DNA, 20 bp, mouse
gttattgatatctttatcca

SEQ ID NO: 447972 - DNA, 20 bp, mouse
gtttcatgtatagcttatag

SEQ ID NO: 447973 - DNA, 20 bp, mouse
gaatcattgaatgctataac

SEQ ID NO: 447974 - DNA, 20 bp, mouse
gctatacatgaaatgataag

SEQ ID NO: 447975 - DNA, 20 bp, mouse
gagagtcataaagaatcata

SEQ ID NO: 447976 - DNA, 20 bp, mouse
gcccgccccgggagtcactt

SEQ ID NO: 447977 - DNA, 20 bp, mouse
ggctgccgaagtgactcccg

SEQ ID NO: 447978 - DNA, 20 bp, mouse
gagctcaacaactgacacgg

SEQ ID NO: 447979 - DNA, 20 bp, mouse
gaactgacacggaggaggag

SEQ ID NO: 447980 - DNA, 20 bp, mouse
gggctctccgcagtcctctc

SEQ ID NO: 447981 - DNA, 20 bp, mouse
ggccgaagtgactcccgggg

SEQ ID NO: 447982 - DNA, 20 bp, mouse
gtacagctcaacaactgaca

SEQ ID NO: 447983 - DNA, 20 bp, mouse
gggagtcacttcggcagcgg

SEQ ID NO: 447984 - DNA, 20 bp, mouse
gccgcggacagagacatccg

SEQ ID NO: 447985 - DNA, 20 bp, mouse
gtcaacaactgacacggagg

SEQ ID NO: 447986 - DNA, 20 bp, mouse
gggattcccaatgtgcctcc

SEQ ID NO: 447987 - DNA, 20 bp, mouse
gctagaaccccgagcgtggt

SEQ ID NO: 447988 - DNA, 20 bp, mouse
gaggcacattgggaatcctg

SEQ ID NO: 447989 - DNA, 20 bp, mouse
ggtctgcccggaggcacatt

SEQ ID NO: 447990 - DNA, 20 bp, mouse
gagcaaatatgtctgcccgg

SEQ ID NO: 447991 - DNA, 20 bp, mouse
gagattagtagccagacgtg

SEQ ID NO: 447992 - DNA, 20 bp, mouse
gaaccccgagcgtggtcggt

SEQ ID NO: 447993 - DNA, 20 bp, mouse
gggccgaggctccacgtcag

SEQ ID NO: 447994 - DNA, 20 bp, mouse
ggaggctagaaccccgagcg

SEQ ID NO: 447995 - DNA, 20 bp, mouse
gcggacctggccctcacctc

SEQ ID NO: 447996 - DNA, 20 bp, mouse
ggagccgagagttcgaacag

SEQ ID NO: 447997 - DNA, 20 bp, mouse
gcggcacgaggggcgacccg

SEQ ID NO: 447998 - DNA, 20 bp, mouse
gagttctaaaaacaaaccgt

SEQ ID NO: 447999 - DNA, 20 bp, mouse
gaacaaaccgtcggcacgag

SEQ ID NO: 448000 - DNA, 20 bp, mouse
gcaacccaggaacctcggtg

SEQ ID NO: 448001 - DNA, 20 bp, mouse
ggaggggcgacccgaggcgc

SEQ ID NO: 448002 - DNA, 20 bp, mouse
gtagccgctgttcgaactct

SEQ ID NO: 448003 - DNA, 20 bp, mouse
gctcggtgaggacagcagaa

SEQ ID NO: 448004 - DNA, 20 bp, mouse
gagccttacgcccgcgcctc

SEQ ID NO: 448005 - DNA, 20 bp, mouse
gacagcaggtccacgagctc

SEQ ID NO: 448006 - DNA, 20 bp, mouse
gcggtgtcctggttgataag

SEQ ID NO: 448007 - DNA, 20 bp, mouse
gctggttgataagtggtctg

SEQ ID NO: 448008 - DNA, 20 bp, mouse
ggaggtctagtcctgcccag

SEQ ID NO: 448009 - DNA, 20 bp, mouse
gtagtgagtggtcccggcct

SEQ ID NO: 448010 - DNA, 20 bp, mouse
gctcaggtagtgagtggtcc

SEQ ID NO: 448011 - DNA, 20 bp, mouse
gctacgaggggtcaggaaag

SEQ ID NO: 448012 - DNA, 20 bp, mouse
gtccctccccggccgaggcc

SEQ ID NO: 448013 - DNA, 20 bp, mouse
ggccgcgggattcaaactcc

SEQ ID NO: 448014 - DNA, 20 bp, mouse
gaagcaaaggctgaccgcac

SEQ ID NO: 448015 - DNA, 20 bp, mouse
gcaggactagacctcccggg

SEQ ID NO: 448016 - DNA, 20 bp, mouse
gcgagaccgaggctcctata

SEQ ID NO: 448017 - DNA, 20 bp, mouse
gggcgagctgcgaaccctat

SEQ ID NO: 448018 - DNA, 20 bp, mouse
gcactcagcgcgcacgggaa

SEQ ID NO: 448019 - DNA, 20 bp, mouse
gcggaggaggagctcaagga

SEQ ID NO: 448020 - DNA, 20 bp, mouse
ggcgaaccctataggagcct

SEQ ID NO: 448021 - DNA, 20 bp, mouse
ggggcggctgtcgaatccgg

SEQ ID NO: 448022 - DNA, 20 bp, mouse
gcggctgtcgaatccggagg

SEQ ID NO: 448023 - DNA, 20 bp, mouse
gtaaggggcggcaatcgcgt

SEQ ID NO: 448024 - DNA, 20 bp, mouse
gggccgcgtgccactcccgg

SEQ ID NO: 448025 - DNA, 20 bp, mouse
gagctcaaggacggcgtctg

SEQ ID NO: 448026 - DNA, 20 bp, mouse
gctggaggccgtggttaact

SEQ ID NO: 448027 - DNA, 20 bp, mouse
gggacgctcccagttaacca

SEQ ID NO: 448028 - DNA, 20 bp, mouse
gcgcgaaccaacggttctgg

SEQ ID NO: 448029 - DNA, 20 bp, mouse
ggcctaccacgcttaccaga

SEQ ID NO: 448030 - DNA, 20 bp, mouse
ggtctttgcccgcgaaccaa

SEQ ID NO: 448031 - DNA, 20 bp, mouse
gtccatctggtaagcgtggt

SEQ ID NO: 448032 - DNA, 20 bp, mouse
ggcaaagacaagtgtcgcgg

SEQ ID NO: 448033 - DNA, 20 bp, mouse
gctctcccggcaagccacga

SEQ ID NO: 448034 - DNA, 20 bp, mouse
gcgggcaaagacaagtgtcg

SEQ ID NO: 448035 - DNA, 20 bp, mouse
ggcccgcgaaccaacggttc

SEQ ID NO: 448036 - DNA, 20 bp, mouse
gtccccggccggaggaacgg

SEQ ID NO: 448037 - DNA, 20 bp, mouse
ggcatccccggccggaggaa

SEQ ID NO: 448038 - DNA, 20 bp, mouse
gcggcagagcgcgcctccgg

SEQ ID NO: 448039 - DNA, 20 bp, mouse
ggccagcccagagtcccata

SEQ ID NO: 448040 - DNA, 20 bp, mouse
gagcccagagtcccataggg

SEQ ID NO: 448041 - DNA, 20 bp, mouse
gcggttacagagcgcgcccc

SEQ ID NO: 448042 - DNA, 20 bp, mouse
gacccaggggcgcgacgacc

SEQ ID NO: 448043 - DNA, 20 bp, mouse
ggagtcccatagggaggagg

SEQ ID NO: 448044 - DNA, 20 bp, mouse
gggcgagctgcggctaactg

SEQ ID NO: 448045 - DNA, 20 bp, mouse
gggtgggccgcaacgagctg

SEQ ID NO: 448046 - DNA, 20 bp, mouse
gcgcggcctggagggcacaa

SEQ ID NO: 448047 - DNA, 20 bp, mouse
ggtagctgggccagggtccc

SEQ ID NO: 448048 - DNA, 20 bp, mouse
ggtcccaggcggcgacgacg

SEQ ID NO: 448049 - DNA, 20 bp, mouse
ggacccgcgtagctgggcca

SEQ ID NO: 448050 - DNA, 20 bp, mouse
gcgacgacggggcctcccgc

SEQ ID NO: 448051 - DNA, 20 bp, mouse
gccagctacgcgggtcgctc

SEQ ID NO: 448052 - DNA, 20 bp, mouse
ggaccctggcccagctacgc

SEQ ID NO: 448053 - DNA, 20 bp, mouse
gggcacggtccgcaagatgg

SEQ ID NO: 448054 - DNA, 20 bp, mouse
gggtcgctcgggacgtgcgg

SEQ ID NO: 448055 - DNA, 20 bp, mouse
gccgcactcctggggaggga

SEQ ID NO: 448056 - DNA, 20 bp, mouse
gcgagcgcggtggaagccac

SEQ ID NO: 448057 - DNA, 20 bp, mouse
gaagccacgggctgtgaccg

SEQ ID NO: 448058 - DNA, 20 bp, mouse
ggggctgtgaccgaggtgag

SEQ ID NO: 448059 - DNA, 20 bp, mouse
ggaaatgcgcgtgcaggtgt

SEQ ID NO: 448060 - DNA, 20 bp, mouse
ggctgcgctaacggtcgcgt

SEQ ID NO: 448061 - DNA, 20 bp, mouse
gggggcccacgtaaagtcct

SEQ ID NO: 448062 - DNA, 20 bp, mouse
ggtcgccgaggactttacgt

SEQ ID NO: 448063 - DNA, 20 bp, mouse
gagctagcgcgtaggagccg

SEQ ID NO: 448064 - DNA, 20 bp, mouse
gagatcgcggagtaaagggt

SEQ ID NO: 448065 - DNA, 20 bp, mouse
gttgggcgtgcacctgaagg

SEQ ID NO: 448066 - DNA, 20 bp, mouse
gaaacatggcgccaggccag

SEQ ID NO: 448067 - DNA, 20 bp, mouse
gatggcgccaggccagcggt

SEQ ID NO: 448068 - DNA, 20 bp, mouse
gagactgtacgagagcgcag

SEQ ID NO: 448069 - DNA, 20 bp, mouse
gccggctgggcgggtttgtg

SEQ ID NO: 448070 - DNA, 20 bp, mouse
gcccccacgcacccaggtcg

SEQ ID NO: 448071 - DNA, 20 bp, mouse
gtcaagtgccattcgcacgg

SEQ ID NO: 448072 - DNA, 20 bp, mouse
gcaaggaggcggggccggct

SEQ ID NO: 448073 - DNA, 20 bp, mouse
gggcccgtggggcaaggagg

SEQ ID NO: 448074 - DNA, 20 bp, mouse
ggaggcagagctatcaggcc

SEQ ID NO: 448075 - DNA, 20 bp, mouse
gacgcacccaggtcgcggtg

SEQ ID NO: 448076 - DNA, 20 bp, mouse
ggccgcggccgcgtcagacc

SEQ ID NO: 448077 - DNA, 20 bp, mouse
gacctggcagggcgggaatc

SEQ ID NO: 448078 - DNA, 20 bp, mouse
ggcgtcagacctggcagggc

SEQ ID NO: 448079 - DNA, 20 bp, mouse
gggccgcgtcagacctggca

SEQ ID NO: 448080 - DNA, 20 bp, mouse
gtgagcaaggtgaggacctc

SEQ ID NO: 448081 - DNA, 20 bp, mouse
gtaagttagttggggcgccg

SEQ ID NO: 448082 - DNA, 20 bp, mouse
gtcagctccgaggctttctc

SEQ ID NO: 448083 - DNA, 20 bp, mouse
gccgctgcaccgtgtgaggt

SEQ ID NO: 448084 - DNA, 20 bp, mouse
gccggcagtcgaggacagaa

SEQ ID NO: 448085 - DNA, 20 bp, mouse
ggctagtcgcccacctcaca

SEQ ID NO: 448086 - DNA, 20 bp, mouse
gtcgccggtgactagaacgg

SEQ ID NO: 448087 - DNA, 20 bp, mouse
gagctcgccggtgactagaa

SEQ ID NO: 448088 - DNA, 20 bp, mouse
gccggtgactagaacggcgg

SEQ ID NO: 448089 - DNA, 20 bp, mouse
gcggcggcggctcccagagc

SEQ ID NO: 448090 - DNA, 20 bp, mouse
gcctcccgccacgcctcggg

SEQ ID NO: 448091 - DNA, 20 bp, mouse
gctaaccgcccgaggcgtgg

SEQ ID NO: 448092 - DNA, 20 bp, mouse
ggtcgcccgcgggagctcgc

SEQ ID NO: 448093 - DNA, 20 bp, mouse
gcggctggtggaggtccccg

SEQ ID NO: 448094 - DNA, 20 bp, mouse
gaggcgcgcacggcgggcag

SEQ ID NO: 448095 - DNA, 20 bp, mouse
gatcatgaccggcaaccccg

SEQ ID NO: 448096 - DNA, 20 bp, mouse
gcgttaggcgacctgaggag

SEQ ID NO: 448097 - DNA, 20 bp, mouse
gacggccgttaggcgacctg

SEQ ID NO: 448098 - DNA, 20 bp, mouse
gcggcgaccccactcactct

SEQ ID NO: 448099 - DNA, 20 bp, mouse
gcggcttgacgggcgtggaa

SEQ ID NO: 448100 - DNA, 20 bp, mouse
gcgggcgtggaacggccgtt

SEQ ID NO: 448101 - DNA, 20 bp, mouse
gctggggcgtgcggcttgac

SEQ ID NO: 448102 - DNA, 20 bp, mouse
gaagaccacgtccgcacgag

SEQ ID NO: 448103 - DNA, 20 bp, mouse
gagcggcgaatccgctcctc

SEQ ID NO: 448104 - DNA, 20 bp, mouse
gcagtgtcccagagtgagtg

SEQ ID NO: 448105 - DNA, 20 bp, mouse
gtcgggacctagcttcttgg

SEQ ID NO: 448106 - DNA, 20 bp, mouse
ggctagtagctccccggtga

SEQ ID NO: 448107 - DNA, 20 bp, mouse
gagtagctccccggtgacgg

SEQ ID NO: 448108 - DNA, 20 bp, mouse
gaggttctgccgggcggagg

SEQ ID NO: 448109 - DNA, 20 bp, mouse
gggggaagctagtagctccc

SEQ ID NO: 448110 - DNA, 20 bp, mouse
ggcgatcgcgccgccgtcac

SEQ ID NO: 448111 - DNA, 20 bp, mouse
gttctgggcggaaacttgag

SEQ ID NO: 448112 - DNA, 20 bp, mouse
ggcggcgcgatcgcaggctc

SEQ ID NO: 448113 - DNA, 20 bp, mouse
gggtcgcctcggcttctggg

SEQ ID NO: 448114 - DNA, 20 bp, mouse
ggaagctgcgggccccgctg

SEQ ID NO: 448115 - DNA, 20 bp, mouse
gcagcgggccgggccaggac

SEQ ID NO: 448116 - DNA, 20 bp, mouse
gaggcgctggactagctgga

SEQ ID NO: 448117 - DNA, 20 bp, mouse
gccgcgggagctaggctgtg

SEQ ID NO: 448118 - DNA, 20 bp, mouse
ggggttgagccgccaggcgc

SEQ ID NO: 448119 - DNA, 20 bp, mouse
gcgccaggcgctggactagc

SEQ ID NO: 448120 - DNA, 20 bp, mouse
gatgcctgcatagcaagaga

SEQ ID NO: 448121 - DNA, 20 bp, mouse
gaggccaagattcctgtctg

SEQ ID NO: 448122 - DNA, 20 bp, mouse
gggctgcgggttgagccgcc

SEQ ID NO: 448123 - DNA, 20 bp, mouse
gggcaggctctggacatgaa

SEQ ID NO: 448124 - DNA, 20 bp, mouse
gctggctccggcggttcctg

SEQ ID NO: 448125 - DNA, 20 bp, mouse
gcgaggcgggatcgctatca

SEQ ID NO: 448126 - DNA, 20 bp, mouse
gatactgccaggagaggtcg

SEQ ID NO: 448127 - DNA, 20 bp, mouse
ggactccaagacgagagcgc

SEQ ID NO: 448128 - DNA, 20 bp, mouse
ggggcgacggtgtcccagaa

SEQ ID NO: 448129 - DNA, 20 bp, mouse
gctggccatactgccaggag

SEQ ID NO: 448130 - DNA, 20 bp, mouse
ggtcccagaagggtcgaact

SEQ ID NO: 448131 - DNA, 20 bp, mouse
ggtcgcccgcgctctcgtct

SEQ ID NO: 448132 - DNA, 20 bp, mouse
gtcgagccgacgggaggagg

SEQ ID NO: 448133 - DNA, 20 bp, mouse
gactcggtcgagccgacggg

SEQ ID NO: 448134 - DNA, 20 bp, mouse
ggtccggccgcgacctctcc

SEQ ID NO: 448135 - DNA, 20 bp, mouse
ggaccgagttcgacccttct

SEQ ID NO: 448136 - DNA, 20 bp, mouse
gtagcaagcggcaagtatgg

SEQ ID NO: 448137 - DNA, 20 bp, mouse
ggcggtggcgcgagtcgacg

SEQ ID NO: 448138 - DNA, 20 bp, mouse
gcattagcaagcggcaagta

SEQ ID NO: 448139 - DNA, 20 bp, mouse
gtctacagaacggcagaaga

SEQ ID NO: 448140 - DNA, 20 bp, mouse
ggcctggtgtcattagcaag

SEQ ID NO: 448141 - DNA, 20 bp, mouse
gtgaggggctgtaagcaaca

SEQ ID NO: 448142 - DNA, 20 bp, mouse
ggttctcggacgagaaggag

SEQ ID NO: 448143 - DNA, 20 bp, mouse
gggggctgtaagcaacacgg

SEQ ID NO: 448144 - DNA, 20 bp, mouse
ggccgcttgctaatgacacc

SEQ ID NO: 448145 - DNA, 20 bp, mouse
gggatcatcgtaccttctcc

SEQ ID NO: 448146 - DNA, 20 bp, mouse
gcgactgagtgactgatagg

SEQ ID NO: 448147 - DNA, 20 bp, mouse
gtcactcagtcgcctggagt

SEQ ID NO: 448148 - DNA, 20 bp, mouse
gcacccagcgccagcaagga

SEQ ID NO: 448149 - DNA, 20 bp, mouse
gaaatagcaactccgactcc

SEQ ID NO: 448150 - DNA, 20 bp, mouse
gttctaggcttgtgcttgtt

SEQ ID NO: 448151 - DNA, 20 bp, mouse
gcccgggaggagcggagcga

SEQ ID NO: 448152 - DNA, 20 bp, mouse
gagcaccccaggctaacccc

SEQ ID NO: 448153 - DNA, 20 bp, mouse
gccagccctcggctcaccgg

SEQ ID NO: 448154 - DNA, 20 bp, mouse
gtatcagtcactcagtcgcc

SEQ ID NO: 448155 - DNA, 20 bp, mouse
gtggacccgccagacaaggt

SEQ ID NO: 448156 - DNA, 20 bp, mouse
gcacgtggccaaccacgagg

SEQ ID NO: 448157 - DNA, 20 bp, mouse
gctctgcacggctacagtcg

SEQ ID NO: 448158 - DNA, 20 bp, mouse
gaagagaggctccctctgca

SEQ ID NO: 448159 - DNA, 20 bp, mouse
gatggacgggcctaaaagag

SEQ ID NO: 448160 - DNA, 20 bp, mouse
ggttagattcacagatggac

SEQ ID NO: 448161 - DNA, 20 bp, mouse
gctgaggttagattcacaga

SEQ ID NO: 448162 - DNA, 20 bp, mouse
gtggccgtgccacacctcat

SEQ ID NO: 448163 - DNA, 20 bp, mouse
ggcacggccacaaacagatc

SEQ ID NO: 448164 - DNA, 20 bp, mouse
gctccacgtggccaaccacg

SEQ ID NO: 448165 - DNA, 20 bp, mouse
ggactcagccagcagatggg

SEQ ID NO: 448166 - DNA, 20 bp, mouse
gcctctggtgagagatccag

SEQ ID NO: 448167 - DNA, 20 bp, mouse
gcgtgcatggcgggactcgg

SEQ ID NO: 448168 - DNA, 20 bp, mouse
gagccgcgcaacgtgcatgg

SEQ ID NO: 448169 - DNA, 20 bp, mouse
gtactgtggtgggaaacccg

SEQ ID NO: 448170 - DNA, 20 bp, mouse
gccagcgcacccaggtagtg

SEQ ID NO: 448171 - DNA, 20 bp, mouse
gaggagccgcgcaacgtgca

SEQ ID NO: 448172 - DNA, 20 bp, mouse
gtggtgagagatccaggggt

SEQ ID NO: 448173 - DNA, 20 bp, mouse
gcaacgtgcatggcgggact

SEQ ID NO: 448174 - DNA, 20 bp, mouse
gtccaggggtgggtgcatat

SEQ ID NO: 448175 - DNA, 20 bp, mouse
ggggacgcccgagacatgta

SEQ ID NO: 448176 - DNA, 20 bp, mouse
ggggcgcgcggacaccgggg

SEQ ID NO: 448177 - DNA, 20 bp, mouse
gagactgcaggggccgctaa

SEQ ID NO: 448178 - DNA, 20 bp, mouse
gacccgggaggaggcgacca

SEQ ID NO: 448179 - DNA, 20 bp, mouse
gcccacagcacggagtgcag

SEQ ID NO: 448180 - DNA, 20 bp, mouse
gaacggtcccgcgccccccc

SEQ ID NO: 448181 - DNA, 20 bp, mouse
gagaggcgcccgggataccg

SEQ ID NO: 448182 - DNA, 20 bp, mouse
gccgggatggccacacttac

SEQ ID NO: 448183 - DNA, 20 bp, mouse
gggaggaggcgaccagggtg

SEQ ID NO: 448184 - DNA, 20 bp, mouse
gctccgggcaggctgggatg

SEQ ID NO: 448185 - DNA, 20 bp, mouse
ggacaggagaagctagactt

SEQ ID NO: 448186 - DNA, 20 bp, mouse
ggcgcctccggagaacccaa

SEQ ID NO: 448187 - DNA, 20 bp, mouse
gtgggacaaggcccaggcag

SEQ ID NO: 448188 - DNA, 20 bp, mouse
gagccaccagaaatcttcgt

SEQ ID NO: 448189 - DNA, 20 bp, mouse
gcggagggaaagctgcgatg

SEQ ID NO: 448190 - DNA, 20 bp, mouse
ggaaggaaggcggggcggaa

SEQ ID NO: 448191 - DNA, 20 bp, mouse
gggcatcttcgagatccgga

SEQ ID NO: 448192 - DNA, 20 bp, mouse
gggagacgcaggagccgggt

SEQ ID NO: 448193 - DNA, 20 bp, mouse
gggcaaccaaaagctcctga

SEQ ID NO: 448194 - DNA, 20 bp, mouse
gtggcggcagaagggcgtgg

SEQ ID NO: 448195 - DNA, 20 bp, mouse
gactcaccagccgggagctc

SEQ ID NO: 448196 - DNA, 20 bp, mouse
gggaccggtgcaggcaacag

SEQ ID NO: 448197 - DNA, 20 bp, mouse
gggcgcgcggcgactcggac

SEQ ID NO: 448198 - DNA, 20 bp, mouse
gagcggagacagcggagaat

SEQ ID NO: 448199 - DNA, 20 bp, mouse
gtcgagcctgggggtcgccg

SEQ ID NO: 448200 - DNA, 20 bp, mouse
ggcgagggcgcgcggcgact

SEQ ID NO: 448201 - DNA, 20 bp, mouse
ggctgcggcgcgtgacgcga

SEQ ID NO: 448202 - DNA, 20 bp, mouse
gtctggcgcctcgagcctgg

SEQ ID NO: 448203 - DNA, 20 bp, mouse
gcctgaggccccaacatcct

SEQ ID NO: 448204 - DNA, 20 bp, mouse
gcagcggccaccatggacat

SEQ ID NO: 448205 - DNA, 20 bp, mouse
ggtgagacctaggagggtgg

SEQ ID NO: 448206 - DNA, 20 bp, mouse
gccggccgggcgctagaagt

SEQ ID NO: 448207 - DNA, 20 bp, mouse
gcagtcagtgcgcaccggcc

SEQ ID NO: 448208 - DNA, 20 bp, mouse
ggaagtgggaaacggagtag

SEQ ID NO: 448209 - DNA, 20 bp, mouse
gggccggagcagctctgcac

SEQ ID NO: 448210 - DNA, 20 bp, mouse
gcggcccagtcagtgcgcac

SEQ ID NO: 448211 - DNA, 20 bp, mouse
ggacgcacgcgggcccgcag

SEQ ID NO: 448212 - DNA, 20 bp, mouse
ggtccggtgcagagctgctc

SEQ ID NO: 448213 - DNA, 20 bp, mouse
gacccgcgcacagacttact

SEQ ID NO: 448214 - DNA, 20 bp, mouse
gggagccgcgggcagcggaa

SEQ ID NO: 448215 - DNA, 20 bp, mouse
gaaacggagtagcggcgccc

SEQ ID NO: 448216 - DNA, 20 bp, mouse
ggaacaaagctgcctggaac

SEQ ID NO: 448217 - DNA, 20 bp, mouse
gcagggcttacgtatagatg

SEQ ID NO: 448218 - DNA, 20 bp, mouse
gtggagaggcttcccgttcc

SEQ ID NO: 448219 - DNA, 20 bp, mouse
gaggatactcctcgcctgtg

SEQ ID NO: 448220 - DNA, 20 bp, mouse
ggggatgccgagagtgagtt

SEQ ID NO: 448221 - DNA, 20 bp, mouse
gctcgcctgtggggagcaac

SEQ ID NO: 448222 - DNA, 20 bp, mouse
gccaaagcgccagtctgcac

SEQ ID NO: 448223 - DNA, 20 bp, mouse
gtgaatcttcccccacctca

SEQ ID NO: 448224 - DNA, 20 bp, mouse
gtctgtggcaggggtggatg

SEQ ID NO: 448225 - DNA, 20 bp, mouse
gtcttgagaacaaagctgcc

SEQ ID NO: 448226 - DNA, 20 bp, mouse
gctcggcccagagcggtctg

SEQ ID NO: 448227 - DNA, 20 bp, mouse
gacaagccgcagaccgctct

SEQ ID NO: 448228 - DNA, 20 bp, mouse
ggcggtctgcggcttgtcta

SEQ ID NO: 448229 - DNA, 20 bp, mouse
gaccttgtcggagaaatgat

SEQ ID NO: 448230 - DNA, 20 bp, mouse
gacagagcctccacccgcga

SEQ ID NO: 448231 - DNA, 20 bp, mouse
gtccagggctaagagcagtc

SEQ ID NO: 448232 - DNA, 20 bp, mouse
ggcgagggaggaaataggac

SEQ ID NO: 448233 - DNA, 20 bp, mouse
ggggtggaggctctgtagcg

SEQ ID NO: 448234 - DNA, 20 bp, mouse
gggcttgtctaaggcatctt

SEQ ID NO: 448235 - DNA, 20 bp, mouse
gaacgcgcgggagagaatgg

SEQ ID NO: 448236 - DNA, 20 bp, mouse
gactgcctccgaggctgtgg

SEQ ID NO: 448237 - DNA, 20 bp, mouse
gccgccgggcgcgcgtaaga

SEQ ID NO: 448238 - DNA, 20 bp, mouse
gacagcctcggaggcagtca

SEQ ID NO: 448239 - DNA, 20 bp, mouse
gtccgaggctgtggcggcag

SEQ ID NO: 448240 - DNA, 20 bp, mouse
gcaaccccacaggaggccca

SEQ ID NO: 448241 - DNA, 20 bp, mouse
gctgcagcagcggaaaccct

SEQ ID NO: 448242 - DNA, 20 bp, mouse
gaggccgggacccacatgag

SEQ ID NO: 448243 - DNA, 20 bp, mouse
ggctgctgcgacggagaagt

SEQ ID NO: 448244 - DNA, 20 bp, mouse
gcctcggggccgcctcccag

SEQ ID NO: 448245 - DNA, 20 bp, mouse
gcgagggccggaagccgagg

SEQ ID NO: 448246 - DNA, 20 bp, mouse
gctgtggccgctgcactctc

SEQ ID NO: 448247 - DNA, 20 bp, mouse
ggcggagcctgagagtgcag

SEQ ID NO: 448248 - DNA, 20 bp, mouse
ggcagacctgaagaacacgg

SEQ ID NO: 448249 - DNA, 20 bp, mouse
gcctgccgccgcctcctctg

SEQ ID NO: 448250 - DNA, 20 bp, mouse
gtgagctgcagagagctcgg

SEQ ID NO: 448251 - DNA, 20 bp, mouse
gtgggcagacctgaagaaca

SEQ ID NO: 448252 - DNA, 20 bp, mouse
gctgcccaggtgacattgtg

SEQ ID NO: 448253 - DNA, 20 bp, mouse
gagcgcgggagcagcgacac

SEQ ID NO: 448254 - DNA, 20 bp, mouse
ggggagcagcgacaccggag

SEQ ID NO: 448255 - DNA, 20 bp, mouse
gagcctggttctggaacgag

SEQ ID NO: 448256 - DNA, 20 bp, mouse
ggcctaatcatgagatgaca

SEQ ID NO: 448257 - DNA, 20 bp, mouse
gtgggttgccatcagactcc

SEQ ID NO: 448258 - DNA, 20 bp, mouse
gcttgaactaaggctatgta

SEQ ID NO: 448259 - DNA, 20 bp, mouse
gaccttgtcatctcatgatt

SEQ ID NO: 448260 - DNA, 20 bp, mouse
gctaaggctatgtatggctt

SEQ ID NO: 448261 - DNA, 20 bp, mouse
gatcttggtgctcttctgaa

SEQ ID NO: 448262 - DNA, 20 bp, mouse
ggaccacacatggatggatg

SEQ ID NO: 448263 - DNA, 20 bp, mouse
gctcctaagccagggcaaat

SEQ ID NO: 448264 - DNA, 20 bp, mouse
gcatctcatgattaggccac

SEQ ID NO: 448265 - DNA, 20 bp, mouse
gcaactggccttccagcatg

SEQ ID NO: 448266 - DNA, 20 bp, mouse
gacaggaactctaggagaca

SEQ ID NO: 448267 - DNA, 20 bp, mouse
ggaagaacttaccccatatt

SEQ ID NO: 448268 - DNA, 20 bp, mouse
gcccttgtacgggcttagat

SEQ ID NO: 448269 - DNA, 20 bp, mouse
gttgctctttgcccaatatg

SEQ ID NO: 448270 - DNA, 20 bp, mouse
gagggtgagtgtcctgatat

SEQ ID NO: 448271 - DNA, 20 bp, mouse
gtgtccactaccggtgatga

SEQ ID NO: 448272 - DNA, 20 bp, mouse
ggcccatctaagcccgtaca

SEQ ID NO: 448273 - DNA, 20 bp, mouse
gcagttcactgacccttgta

SEQ ID NO: 448274 - DNA, 20 bp, mouse
gatagtcacttgaacttcta

SEQ ID NO: 448275 - DNA, 20 bp, mouse
gtggccctctctttaatgtt

SEQ ID NO: 448276 - DNA, 20 bp, mouse
gagagcatggagccacatgt

SEQ ID NO: 448277 - DNA, 20 bp, mouse
ggagaggagctcttagagac

SEQ ID NO: 448278 - DNA, 20 bp, mouse
gccttccaacattaaataca

SEQ ID NO: 448279 - DNA, 20 bp, mouse
ggtgtggtgtccaccacagg

SEQ ID NO: 448280 - DNA, 20 bp, mouse
gcactcactcttaccacctg

SEQ ID NO: 448281 - DNA, 20 bp, mouse
gtcactcttaccacctgtgg

SEQ ID NO: 448282 - DNA, 20 bp, mouse
gcccaggactttgccttgtg

SEQ ID NO: 448283 - DNA, 20 bp, mouse
gtcacattttctcgaccatc

SEQ ID NO: 448284 - DNA, 20 bp, mouse
ggaagtacttacccagaatt

SEQ ID NO: 448285 - DNA, 20 bp, mouse
gacatgttggaaggaaggag

SEQ ID NO: 448286 - DNA, 20 bp, mouse
gagagggtagaggcccattg

SEQ ID NO: 448287 - DNA, 20 bp, mouse
ggggcctctaccctctgata

SEQ ID NO: 448288 - DNA, 20 bp, mouse
gggaaggacaagggctctgt

SEQ ID NO: 448289 - DNA, 20 bp, mouse
ggcccattgtggaaggacaa

SEQ ID NO: 448290 - DNA, 20 bp, mouse
gaagccatatcagagggtag

SEQ ID NO: 448291 - DNA, 20 bp, mouse
gtgggatacccagctatagg

SEQ ID NO: 448292 - DNA, 20 bp, mouse
gagcccttgtccttccacaa

SEQ ID NO: 448293 - DNA, 20 bp, mouse
gacccagctataggaggcac

SEQ ID NO: 448294 - DNA, 20 bp, mouse
gtgattaggagccagatata

SEQ ID NO: 448295 - DNA, 20 bp, mouse
gagaaagcaaaactcaccaa

SEQ ID NO: 448296 - DNA, 20 bp, mouse
gctccagcctgtgacaaagg

SEQ ID NO: 448297 - DNA, 20 bp, mouse
ggctcataccaggtagaggt

SEQ ID NO: 448298 - DNA, 20 bp, mouse
gctggtaccctccaggagtg

SEQ ID NO: 448299 - DNA, 20 bp, mouse
gcaccaggatcagagcagag

SEQ ID NO: 448300 - DNA, 20 bp, mouse
gcagagaggcacatggtagg

SEQ ID NO: 448301 - DNA, 20 bp, mouse
gaaaagctcataccaggtag

SEQ ID NO: 448302 - DNA, 20 bp, mouse
gtcacatggcaggtcgagaa

SEQ ID NO: 448303 - DNA, 20 bp, mouse
ggctacaggtttgcaggaca

SEQ ID NO: 448304 - DNA, 20 bp, mouse
gaaatttgctggtaccctcc

SEQ ID NO: 448305 - DNA, 20 bp, mouse
gttgattgagagaaatttgc

SEQ ID NO: 448306 - DNA, 20 bp, mouse
gggacaggctcccaagtcaa

SEQ ID NO: 448307 - DNA, 20 bp, mouse
gcatggtgtaggccacttag

SEQ ID NO: 448308 - DNA, 20 bp, mouse
gtactcaccgcaaatcacac

SEQ ID NO: 448309 - DNA, 20 bp, mouse
ggagtccctgcagcacactt

SEQ ID NO: 448310 - DNA, 20 bp, mouse
gtacatgtaaaggcatgaag

SEQ ID NO: 448311 - DNA, 20 bp, mouse
gaggaacatcttgcatggac

SEQ ID NO: 448312 - DNA, 20 bp, mouse
ggaggacccactacatgtaa

SEQ ID NO: 448313 - DNA, 20 bp, mouse
ggttagaaggtccattgact

SEQ ID NO: 448314 - DNA, 20 bp, mouse
ggtgtcctgcaccatggtgt

SEQ ID NO: 448315 - DNA, 20 bp, mouse
gtgctaaggaacatcttgca

SEQ ID NO: 448316 - DNA, 20 bp, mouse
gggtctagtgaggtgtctgg

SEQ ID NO: 448317 - DNA, 20 bp, mouse
gtggggtctagtgaggtgtc

SEQ ID NO: 448318 - DNA, 20 bp, mouse
gcatggaagaatagcagctc

SEQ ID NO: 448319 - DNA, 20 bp, mouse
gctgctattcttccatgatg

SEQ ID NO: 448320 - DNA, 20 bp, mouse
gtcactgcttgcttgagtct

SEQ ID NO: 448321 - DNA, 20 bp, mouse
gggtgttcatccgccagaca

SEQ ID NO: 448322 - DNA, 20 bp, mouse
gactggactgcaacccaatg

SEQ ID NO: 448323 - DNA, 20 bp, mouse
ggccctcagcttagagtaac

SEQ ID NO: 448324 - DNA, 20 bp, mouse
ggatgaacacctctaagaaa

SEQ ID NO: 448325 - DNA, 20 bp, mouse
ggtattctgtccatgtctgg

SEQ ID NO: 448326 - DNA, 20 bp, mouse
gcagcagaatcagagcgtag

SEQ ID NO: 448327 - DNA, 20 bp, mouse
gagagcgtagaggcacatca

SEQ ID NO: 448328 - DNA, 20 bp, mouse
gtccctctcagccatggcat

SEQ ID NO: 448329 - DNA, 20 bp, mouse
gggacaccctggatcaggag

SEQ ID NO: 448330 - DNA, 20 bp, mouse
gtgggaaaacagacttgcag

SEQ ID NO: 448331 - DNA, 20 bp, mouse
gtccctgggactggacaccc

SEQ ID NO: 448332 - DNA, 20 bp, mouse
gagtcccagggaaatcatcc

SEQ ID NO: 448333 - DNA, 20 bp, mouse
gaaagtgcacagggataggg

SEQ ID NO: 448334 - DNA, 20 bp, mouse
ggttatcctctcctgatcca

SEQ ID NO: 448335 - DNA, 20 bp, mouse
gttacccggatgatttccct

SEQ ID NO: 448336 - DNA, 20 bp, mouse
gcccagttcggcaaagtcag

SEQ ID NO: 448337 - DNA, 20 bp, mouse
gccaggaagggaaaaggagc

SEQ ID NO: 448338 - DNA, 20 bp, mouse
gggtcagaactgccccagtt

SEQ ID NO: 448339 - DNA, 20 bp, mouse
gtgagattcaaccatgccat

SEQ ID NO: 448340 - DNA, 20 bp, mouse
gctgaggttagcacatactg

SEQ ID NO: 448341 - DNA, 20 bp, mouse
gtgccattggctagacttcc

SEQ ID NO: 448342 - DNA, 20 bp, mouse
gccgccccatgtgccctggt

SEQ ID NO: 448343 - DNA, 20 bp, mouse
ggagccacttggcattagga

SEQ ID NO: 448344 - DNA, 20 bp, mouse
gttgtgggatggaaggcacc

SEQ ID NO: 448345 - DNA, 20 bp, mouse
gaaatgagcacaggggactt

SEQ ID NO: 448346 - DNA, 20 bp, mouse
gacggagccaaatgcataac

SEQ ID NO: 448347 - DNA, 20 bp, mouse
gagccaaatgcataactggc

SEQ ID NO: 448348 - DNA, 20 bp, mouse
gaaagcatggggggcatgga

SEQ ID NO: 448349 - DNA, 20 bp, mouse
ggactgtgtgagtcctgccc

SEQ ID NO: 448350 - DNA, 20 bp, mouse
gcttttgcctgggtattggt

SEQ ID NO: 448351 - DNA, 20 bp, mouse
gaactatagattatgaccat

SEQ ID NO: 448352 - DNA, 20 bp, mouse
gtgcaatagataaaaatatg

SEQ ID NO: 448353 - DNA, 20 bp, mouse
gcttataccagtcaatatat

SEQ ID NO: 448354 - DNA, 20 bp, mouse
gagagcaacattaagttaga

SEQ ID NO: 448355 - DNA, 20 bp, mouse
ggaccctctgagtgttagtg

SEQ ID NO: 448356 - DNA, 20 bp, mouse
gatcttagcagcacagactt

SEQ ID NO: 448357 - DNA, 20 bp, mouse
gctgagagctgatcatgaca

SEQ ID NO: 448358 - DNA, 20 bp, mouse
gctgatgctgtcggatatat

SEQ ID NO: 448359 - DNA, 20 bp, mouse
gacggaaccaactacataac

SEQ ID NO: 448360 - DNA, 20 bp, mouse
gcaagagcaacattacagta

SEQ ID NO: 448361 - DNA, 20 bp, mouse
ggttgaaaatggctgatcta

SEQ ID NO: 448362 - DNA, 20 bp, mouse
gattcagccagttatgtagt

SEQ ID NO: 448363 - DNA, 20 bp, mouse
gaggctaactaacctgtcaa

SEQ ID NO: 448364 - DNA, 20 bp, mouse
ggctgaatgctgggttcttc

SEQ ID NO: 448365 - DNA, 20 bp, mouse
gtccaatggtcatggcccaa

SEQ ID NO: 448366 - DNA, 20 bp, mouse
gggtgaaccaggggtagtgg

SEQ ID NO: 448367 - DNA, 20 bp, mouse
gctggttcacctgtgagtgt

SEQ ID NO: 448368 - DNA, 20 bp, mouse
gtagggagaccattcatata

SEQ ID NO: 448369 - DNA, 20 bp, mouse
ggagtggtttctagctggag

SEQ ID NO: 448370 - DNA, 20 bp, mouse
gaactgtaggtcacgatcat

SEQ ID NO: 448371 - DNA, 20 bp, mouse
gaggaagctcccacactcac

SEQ ID NO: 448372 - DNA, 20 bp, mouse
gcacacactggccagatccg

SEQ ID NO: 448373 - DNA, 20 bp, mouse
ggctgaatgctgtgcttttt

SEQ ID NO: 448374 - DNA, 20 bp, mouse
ggtttctagctggaggggta

SEQ ID NO: 448375 - DNA, 20 bp, mouse
gagaccattcatatatggag

SEQ ID NO: 448376 - DNA, 20 bp, mouse
gtgtgggagggaagtcacca

SEQ ID NO: 448377 - DNA, 20 bp, mouse
gatccaagaagtttgtatag

SEQ ID NO: 448378 - DNA, 20 bp, mouse
gccatagcacacagatatcc

SEQ ID NO: 448379 - DNA, 20 bp, mouse
gggagggaagtcaccaggga

SEQ ID NO: 448380 - DNA, 20 bp, mouse
ggcagggcatgtctctaagg

SEQ ID NO: 448381 - DNA, 20 bp, mouse
ggcagcagggttcactctgt

SEQ ID NO: 448382 - DNA, 20 bp, mouse
gactctgtgggctttggtga

SEQ ID NO: 448383 - DNA, 20 bp, mouse
gaaagatgtgggtcttgcct

SEQ ID NO: 448384 - DNA, 20 bp, mouse
gtaagaagtgctgcacctga

SEQ ID NO: 448385 - DNA, 20 bp, mouse
gtcaccagggagggaaaagc

SEQ ID NO: 448386 - DNA, 20 bp, mouse
gagcagcccaggtcagtcag

SEQ ID NO: 448387 - DNA, 20 bp, mouse
gagtgcacagacttcctgga

SEQ ID NO: 448388 - DNA, 20 bp, mouse
gccgcagcatccagccatcc

SEQ ID NO: 448389 - DNA, 20 bp, mouse
ggtcaggagaagagcaaaag

SEQ ID NO: 448390 - DNA, 20 bp, mouse
gtgccagtgcacagacttcc

SEQ ID NO: 448391 - DNA, 20 bp, mouse
ggttcttgaggaacagattc

SEQ ID NO: 448392 - DNA, 20 bp, mouse
gctcacccttcacatggagg

SEQ ID NO: 448393 - DNA, 20 bp, mouse
ggggtgagactccctaagtg

SEQ ID NO: 448394 - DNA, 20 bp, mouse
gggagctggacctgaaggtc

SEQ ID NO: 448395 - DNA, 20 bp, mouse
gactggcatgatcggctccc

SEQ ID NO: 448396 - DNA, 20 bp, mouse
ggaatatgtgagccttgccc

SEQ ID NO: 448397 - DNA, 20 bp, mouse
gtcagtgaatcgggaggcac

SEQ ID NO: 448398 - DNA, 20 bp, mouse
gagctatgcatttggttccg

SEQ ID NO: 448399 - DNA, 20 bp, mouse
gttttggtcagtgaatcggg

SEQ ID NO: 448400 - DNA, 20 bp, mouse
gctaagatcactccatactg

SEQ ID NO: 448401 - DNA, 20 bp, mouse
ggtgaactgtctcctcagta

SEQ ID NO: 448402 - DNA, 20 bp, mouse
ggtgggctcataaaatctga

SEQ ID NO: 448403 - DNA, 20 bp, mouse
gtctgactctgtatgctagt

SEQ ID NO: 448404 - DNA, 20 bp, mouse
gtgagccaaaaagataaagg

SEQ ID NO: 448405 - DNA, 20 bp, mouse
gaaccaaatgcatagctggc

SEQ ID NO: 448406 - DNA, 20 bp, mouse
ggctaaccaccgcgacctgt

SEQ ID NO: 448407 - DNA, 20 bp, mouse
gagcctcaccctggacccgg

SEQ ID NO: 448408 - DNA, 20 bp, mouse
gaggagcccacaggtcgcgg

SEQ ID NO: 448409 - DNA, 20 bp, mouse
gagcaggagcccacaggtcg

SEQ ID NO: 448410 - DNA, 20 bp, mouse
gtcccctgagagcctcaccc

SEQ ID NO: 448411 - DNA, 20 bp, mouse
gctcctccgggtccagggtg

SEQ ID NO: 448412 - DNA, 20 bp, mouse
gactctgcaagtgtcaaggt

SEQ ID NO: 448413 - DNA, 20 bp, mouse
gtgcttctcctccgggtcca

SEQ ID NO: 448414 - DNA, 20 bp, mouse
gggaggaaatggccaaggat

SEQ ID NO: 448415 - DNA, 20 bp, mouse
gtgtgtaccaaccatgagac

SEQ ID NO: 448416 - DNA, 20 bp, mouse
ggccatccagactcggacac

SEQ ID NO: 448417 - DNA, 20 bp, mouse
gtccagtgtccgagtctgga

SEQ ID NO: 448418 - DNA, 20 bp, mouse
gcagtccattatgacaaata

SEQ ID NO: 448419 - DNA, 20 bp, mouse
ggacagtggtaggaaatatc

SEQ ID NO: 448420 - DNA, 20 bp, mouse
gtggagacaacggcacaagc

SEQ ID NO: 448421 - DNA, 20 bp, mouse
gacctgaggaaggaggagac

SEQ ID NO: 448422 - DNA, 20 bp, mouse
gaccccatgaggacatagag

SEQ ID NO: 448423 - DNA, 20 bp, mouse
gccatgaggacatagagggg

SEQ ID NO: 448424 - DNA, 20 bp, mouse
gtatgtcttaccaatgacag

SEQ ID NO: 448425 - DNA, 20 bp, mouse
gtcttaccaatgacagtggt

SEQ ID NO: 448426 - DNA, 20 bp, mouse
ggggtccagtgtcctagtct

SEQ ID NO: 448427 - DNA, 20 bp, mouse
ggtcacccagactaggacac

SEQ ID NO: 448428 - DNA, 20 bp, mouse
ggaagctgtggaaagctggg

SEQ ID NO: 448429 - DNA, 20 bp, mouse
ggaggacaatgataccagct

SEQ ID NO: 448430 - DNA, 20 bp, mouse
gcagctccgtgggaaacctg

SEQ ID NO: 448431 - DNA, 20 bp, mouse
ggccccatgaggccatacag

SEQ ID NO: 448432 - DNA, 20 bp, mouse
ggctggaagccccacttcac

SEQ ID NO: 448433 - DNA, 20 bp, mouse
gcggactgtggacgaagctg

SEQ ID NO: 448434 - DNA, 20 bp, mouse
ggacgaagctgtggaaagct

SEQ ID NO: 448435 - DNA, 20 bp, mouse
ggactgtggtaacaaatgcc

SEQ ID NO: 448436 - DNA, 20 bp, mouse
gtaggcatcactgcagccca

SEQ ID NO: 448437 - DNA, 20 bp, mouse
gtacacttctggggtcagaa

SEQ ID NO: 448438 - DNA, 20 bp, mouse
gtgcagcccatggcagaagc

SEQ ID NO: 448439 - DNA, 20 bp, mouse
gagctggctggaacatgaag

SEQ ID NO: 448440 - DNA, 20 bp, mouse
gagtgatgcctacacttctg

SEQ ID NO: 448441 - DNA, 20 bp, mouse
gggactgggatccccagtag

SEQ ID NO: 448442 - DNA, 20 bp, mouse
gcaagatctaggcagatgga

SEQ ID NO: 448443 - DNA, 20 bp, mouse
gtaaggctgtctggactacc

SEQ ID NO: 448444 - DNA, 20 bp, mouse
gcgtctgcttaggagaaaaa

SEQ ID NO: 448445 - DNA, 20 bp, mouse
gaagtcccactgtgtagaag

SEQ ID NO: 448446 - DNA, 20 bp, mouse
ggagtagacaggggctgaac

SEQ ID NO: 448447 - DNA, 20 bp, mouse
gcctcagagaacttcaatca

SEQ ID NO: 448448 - DNA, 20 bp, mouse
gaggctgtgggagatgggca

SEQ ID NO: 448449 - DNA, 20 bp, mouse
ggccatcatcgagggtgcaa

SEQ ID NO: 448450 - DNA, 20 bp, mouse
gcgagggtgcaatggcaggt

SEQ ID NO: 448451 - DNA, 20 bp, mouse
gacggtaccggtaccatcct

SEQ ID NO: 448452 - DNA, 20 bp, mouse
gattgaagttctctgaggtc

SEQ ID NO: 448453 - DNA, 20 bp, mouse
gacagggtgtgaagaaccca

SEQ ID NO: 448454 - DNA, 20 bp, mouse
gagcacaggctccagtccac

SEQ ID NO: 448455 - DNA, 20 bp, mouse
gactcacagacaatactttc

SEQ ID NO: 448456 - DNA, 20 bp, mouse
gtcacacacgtgcgatgtca

SEQ ID NO: 448457 - DNA, 20 bp, mouse
gacaacagttgggatcttaa

SEQ ID NO: 448458 - DNA, 20 bp, mouse
ggccatcctccacaacagtt

SEQ ID NO: 448459 - DNA, 20 bp, mouse
gtggcgcaggcgcactagca

SEQ ID NO: 448460 - DNA, 20 bp, mouse
gacgtttgacttcctgaagg

SEQ ID NO: 448461 - DNA, 20 bp, mouse
gtcccaactgttgtggagga

SEQ ID NO: 448462 - DNA, 20 bp, mouse
gtttctcttgtagctggtag

SEQ ID NO: 448463 - DNA, 20 bp, mouse
ggaggatggcgtccaccttc

SEQ ID NO: 448464 - DNA, 20 bp, mouse
gccagctacaagagaaaggt

SEQ ID NO: 448465 - DNA, 20 bp, mouse
gagcgggaccatcgatgtga

SEQ ID NO: 448466 - DNA, 20 bp, mouse
gccgttgccttaacaaccgg

SEQ ID NO: 448467 - DNA, 20 bp, mouse
gaaccggtggcagagtccgt

SEQ ID NO: 448468 - DNA, 20 bp, mouse
gggcgtactcgcagcctcag

SEQ ID NO: 448469 - DNA, 20 bp, mouse
gagcacttaccatcacccaa

SEQ ID NO: 448470 - DNA, 20 bp, mouse
gctgcaccgaggcctaggaa

SEQ ID NO: 448471 - DNA, 20 bp, mouse
gggcagagtccgttgggtga

SEQ ID NO: 448472 - DNA, 20 bp, mouse
ggtaagtgctagggattcgg

SEQ ID NO: 448473 - DNA, 20 bp, mouse
gagcagtgggaacgccgctg

SEQ ID NO: 448474 - DNA, 20 bp, mouse
gactctgccaccggttgtta

SEQ ID NO: 448475 - DNA, 20 bp, mouse
gtgtgcgcgcgtggagcagt

SEQ ID NO: 448476 - DNA, 20 bp, mouse
gggtggtccccgaggcgtgg

SEQ ID NO: 448477 - DNA, 20 bp, mouse
ggaggttggtggctgttgag

SEQ ID NO: 448478 - DNA, 20 bp, mouse
gccgtggtaaagtccccgag

SEQ ID NO: 448479 - DNA, 20 bp, mouse
gcccgaggcgtggaggttgg

SEQ ID NO: 448480 - DNA, 20 bp, mouse
ggtccccgaggcgtggaggt

SEQ ID NO: 448481 - DNA, 20 bp, mouse
ggacagagatgttccactcg

SEQ ID NO: 448482 - DNA, 20 bp, mouse
gcccgccctggccctctggg

SEQ ID NO: 448483 - DNA, 20 bp, mouse
ggtctggtgggtggtccccg

SEQ ID NO: 448484 - DNA, 20 bp, mouse
gacctcgcgagacttcactc

SEQ ID NO: 448485 - DNA, 20 bp, mouse
gtgtggacgggagaccgggt

SEQ ID NO: 448486 - DNA, 20 bp, mouse
ggagcaaacgcgggccgcgg

SEQ ID NO: 448487 - DNA, 20 bp, mouse
gcgcctgtcgggagcaaacg

SEQ ID NO: 448488 - DNA, 20 bp, mouse
ggctatagcaaccgcctgtc

SEQ ID NO: 448489 - DNA, 20 bp, mouse
ggcccgcgtttgctcccgac

SEQ ID NO: 448490 - DNA, 20 bp, mouse
gcgggagcaaacgcgggccg

SEQ ID NO: 448491 - DNA, 20 bp, mouse
gcctcatagactgcaggcgt

SEQ ID NO: 448492 - DNA, 20 bp, mouse
ggcctgcagtctatgagggt

SEQ ID NO: 448493 - DNA, 20 bp, mouse
ggctaaccactgatgatcag

SEQ ID NO: 448494 - DNA, 20 bp, mouse
gcagtcagcagatgagttgg

SEQ ID NO: 448495 - DNA, 20 bp, mouse
gcgttggtggataaatggaa

SEQ ID NO: 448496 - DNA, 20 bp, mouse
ggcctaagaccaagaggacg

SEQ ID NO: 448497 - DNA, 20 bp, mouse
gtggagggagtagagatcaa

SEQ ID NO: 448498 - DNA, 20 bp, mouse
gtttggacaggaggtcaaat

SEQ ID NO: 448499 - DNA, 20 bp, mouse
gcacccagagtgacctggag

SEQ ID NO: 448500 - DNA, 20 bp, mouse
ggtggcccaaagccctctcc

SEQ ID NO: 448501 - DNA, 20 bp, mouse
gtccagaaggcggaatgcag

SEQ ID NO: 448502 - DNA, 20 bp, mouse
gggagttgcgctcacacctg

SEQ ID NO: 448503 - DNA, 20 bp, mouse
ggagggacataggtactcca

SEQ ID NO: 448504 - DNA, 20 bp, mouse
gtttgggccactggactctc

SEQ ID NO: 448505 - DNA, 20 bp, mouse
gccgccttggagaagttgaa

SEQ ID NO: 448506 - DNA, 20 bp, mouse
gcaggtgttgaagccctctc

SEQ ID NO: 448507 - DNA, 20 bp, mouse
gtcaggagctctgaaccacc

SEQ ID NO: 448508 - DNA, 20 bp, mouse
gctgcatccaggactgtata

SEQ ID NO: 448509 - DNA, 20 bp, mouse
gcagagctcctgacctgaga

SEQ ID NO: 448510 - DNA, 20 bp, mouse
ggttgaagccctctcaggtc

SEQ ID NO: 448511 - DNA, 20 bp, mouse
ggagctctgaaccaccaggc

SEQ ID NO: 448512 - DNA, 20 bp, mouse
ggtcagcacttccagcctgg

SEQ ID NO: 448513 - DNA, 20 bp, mouse
gagggtcagcacttccagcc

SEQ ID NO: 448514 - DNA, 20 bp, mouse
gccagagacagcagggttaa

SEQ ID NO: 448515 - DNA, 20 bp, mouse
gaatgcatcaagccaggtaa

SEQ ID NO: 448516 - DNA, 20 bp, mouse
gtcgtggctctggtgatcct

SEQ ID NO: 448517 - DNA, 20 bp, mouse
gtcctgggagcggctgtatg

SEQ ID NO: 448518 - DNA, 20 bp, mouse
gaccagagccacgaagtaca

SEQ ID NO: 448519 - DNA, 20 bp, mouse
gcacagctccgtgtacttcg

SEQ ID NO: 448520 - DNA, 20 bp, mouse
ggtatgtggtgagtggacca

SEQ ID NO: 448521 - DNA, 20 bp, mouse
gctgacccagcaggctctca

SEQ ID NO: 448522 - DNA, 20 bp, mouse
gtgtcaaactggtccctccc

SEQ ID NO: 448523 - DNA, 20 bp, mouse
gaccacatacagccgctccc

SEQ ID NO: 448524 - DNA, 20 bp, mouse
gcgaggggctgcaaattcag

SEQ ID NO: 448525 - DNA, 20 bp, mouse
gtgctgtgctggcccaccaa

SEQ ID NO: 448526 - DNA, 20 bp, mouse
gatatagggcgagaccatag

SEQ ID NO: 448527 - DNA, 20 bp, mouse
gtgctggtcctgtaccccta

SEQ ID NO: 448528 - DNA, 20 bp, mouse
gggtacaggaccagcagcta

SEQ ID NO: 448529 - DNA, 20 bp, mouse
ggcagtggccgcagtcgtgt

SEQ ID NO: 448530 - DNA, 20 bp, mouse
ggcatgtgcgctcgcctcta

SEQ ID NO: 448531 - DNA, 20 bp, mouse
ggcagctagggccgccctag

SEQ ID NO: 448532 - DNA, 20 bp, mouse
gggcgagaccataggggtac

SEQ ID NO: 448533 - DNA, 20 bp, mouse
gtgtgcgctcgcctctaggg

SEQ ID NO: 448534 - DNA, 20 bp, mouse
gtccgggagagtctcgagtg

SEQ ID NO: 448535 - DNA, 20 bp, mouse
gctctcccggacggtcccca

SEQ ID NO: 448536 - DNA, 20 bp, mouse
gaccacagttcatagcagag

SEQ ID NO: 448537 - DNA, 20 bp, mouse
gtcctctctgctatgaactg

SEQ ID NO: 448538 - DNA, 20 bp, mouse
ggttcatagcagagaggaac

SEQ ID NO: 448539 - DNA, 20 bp, mouse
ggtacagcacagatttctct

SEQ ID NO: 448540 - DNA, 20 bp, mouse
gtcataatttggatctttct

SEQ ID NO: 448541 - DNA, 20 bp, mouse
gccatttgcaatctataatt

SEQ ID NO: 448542 - DNA, 20 bp, mouse
gtgctgacagtctcataatt

SEQ ID NO: 448543 - DNA, 20 bp, mouse
gactgtcagcaagaattatt

SEQ ID NO: 448544 - DNA, 20 bp, mouse
ggggaaagacttgcttcaaa

SEQ ID NO: 448545 - DNA, 20 bp, mouse
ggttacttagtggatttggg

SEQ ID NO: 448546 - DNA, 20 bp, mouse
gccagaagcaccaccaggat

SEQ ID NO: 448547 - DNA, 20 bp, mouse
ggcctagagcactccaatcc

SEQ ID NO: 448548 - DNA, 20 bp, mouse
gaccaggattggagtgctct

SEQ ID NO: 448549 - DNA, 20 bp, mouse
gagtagagaaccatgaggtt

SEQ ID NO: 448550 - DNA, 20 bp, mouse
gctctaggctttagaagatg

SEQ ID NO: 448551 - DNA, 20 bp, mouse
gaacaatagctaagagcaac

SEQ ID NO: 448552 - DNA, 20 bp, mouse
gttctgcttaccttcacctt

SEQ ID NO: 448553 - DNA, 20 bp, mouse
gtattgttctcctaacctca

SEQ ID NO: 448554 - DNA, 20 bp, mouse
ggtaaaaaccagtcaacata

SEQ ID NO: 448555 - DNA, 20 bp, mouse
gcatggttctctactgccaa

SEQ ID NO: 448556 - DNA, 20 bp, mouse
gacaatgctgtgtatcacat

SEQ ID NO: 448557 - DNA, 20 bp, mouse
gaaggggaaggtaagtggaa

SEQ ID NO: 448558 - DNA, 20 bp, mouse
gtgctaaaggggaaggtaag

SEQ ID NO: 448559 - DNA, 20 bp, mouse
gactttgacatttaccaaac

SEQ ID NO: 448560 - DNA, 20 bp, mouse
ggtaaaaataaatttatttt

SEQ ID NO: 448561 - DNA, 20 bp, mouse
gcttaaagctccagatgtgg

SEQ ID NO: 448562 - DNA, 20 bp, mouse
gcagatgtggtggtccttct

SEQ ID NO: 448563 - DNA, 20 bp, mouse
gtaatgacggggttcccaga

SEQ ID NO: 448564 - DNA, 20 bp, mouse
gaaacttaaagctccagatg

SEQ ID NO: 448565 - DNA, 20 bp, mouse
gacacagcattgttaatgac

SEQ ID NO: 448566 - DNA, 20 bp, mouse
gagttatactgataatgtat

SEQ ID NO: 448567 - DNA, 20 bp, mouse
gagaatatcagacatataca

SEQ ID NO: 448568 - DNA, 20 bp, mouse
gtaaggatattacatattca

SEQ ID NO: 448569 - DNA, 20 bp, mouse
gtttgagttaaggtccataa

SEQ ID NO: 448570 - DNA, 20 bp, mouse
gctgataatgtataggagtt

SEQ ID NO: 448571 - DNA, 20 bp, mouse
gactgtatttcctaaaacaa

SEQ ID NO: 448572 - DNA, 20 bp, mouse
gagagggcaatgttccttta

SEQ ID NO: 448573 - DNA, 20 bp, mouse
gaatttgacactttgagtta

SEQ ID NO: 448574 - DNA, 20 bp, mouse
gcaccaaaatttctggtact

SEQ ID NO: 448575 - DNA, 20 bp, mouse
gtacttgccttcaaaatgga

SEQ ID NO: 448576 - DNA, 20 bp, mouse
gacttggccccgcactcctc

SEQ ID NO: 448577 - DNA, 20 bp, mouse
gcaccctggaagaactcaag

SEQ ID NO: 448578 - DNA, 20 bp, mouse
ggcgtagctggaatggacaa

SEQ ID NO: 448579 - DNA, 20 bp, mouse
gagatgagcgagcttcatgc

SEQ ID NO: 448580 - DNA, 20 bp, mouse
gttcatgccggaggagtgcg

SEQ ID NO: 448581 - DNA, 20 bp, mouse
gaatggacaagggtcttccg

SEQ ID NO: 448582 - DNA, 20 bp, mouse
gtgagcgagcttcatgccgg

SEQ ID NO: 448583 - DNA, 20 bp, mouse
gtccttaaaagggatacggg

SEQ ID NO: 448584 - DNA, 20 bp, mouse
gaaaatctcatcactcaccc

SEQ ID NO: 448585 - DNA, 20 bp, mouse
gtagacgtacatattacctc

SEQ ID NO: 448586 - DNA, 20 bp, mouse
ggattaagggtctcattgaa

SEQ ID NO: 448587 - DNA, 20 bp, mouse
ggccgcgttcagtcggatcc

SEQ ID NO: 448588 - DNA, 20 bp, mouse
ggtaggagccgcacaatgag

SEQ ID NO: 448589 - DNA, 20 bp, mouse
gcggcgcgcgccccacccaa

SEQ ID NO: 448590 - DNA, 20 bp, mouse
ggcaccccgagcgagattaa

SEQ ID NO: 448591 - DNA, 20 bp, mouse
ggccgggatccgactgaacg

SEQ ID NO: 448592 - DNA, 20 bp, mouse
gcactgcgcccgagggaagt

SEQ ID NO: 448593 - DNA, 20 bp, mouse
gggctcctactaaacggaag

SEQ ID NO: 448594 - DNA, 20 bp, mouse
gttgtgcggctcctactaaa

SEQ ID NO: 448595 - DNA, 20 bp, mouse
gacactggacccctccccca

SEQ ID NO: 448596 - DNA, 20 bp, mouse
ggcgggcagcagagagtgca

SEQ ID NO: 448597 - DNA, 20 bp, mouse
gagccgcgggcactatggta

SEQ ID NO: 448598 - DNA, 20 bp, mouse
gatagtgcccgcggctgaag

SEQ ID NO: 448599 - DNA, 20 bp, mouse
gcccgtgaaaaggctcccta

SEQ ID NO: 448600 - DNA, 20 bp, mouse
ggagaagaaggaggggtcgg

SEQ ID NO: 448601 - DNA, 20 bp, mouse
gcccgcctcgggactcggag

SEQ ID NO: 448602 - DNA, 20 bp, mouse
ggcgggcactatggtaaggt

SEQ ID NO: 448603 - DNA, 20 bp, mouse
gctctgggtgagggtctagg

SEQ ID NO: 448604 - DNA, 20 bp, mouse
gcaccgcacaggcccaggca

SEQ ID NO: 448605 - DNA, 20 bp, mouse
ggcgcaggcccggcgcgaga

SEQ ID NO: 448606 - DNA, 20 bp, mouse
gggattgtggaattcagcaa

SEQ ID NO: 448607 - DNA, 20 bp, mouse
gcacaatcctaacaagaggg

SEQ ID NO: 448608 - DNA, 20 bp, mouse
gggctccgagaagatgagaa

SEQ ID NO: 448609 - DNA, 20 bp, mouse
gttccacaatcctaacaaga

SEQ ID NO: 448610 - DNA, 20 bp, mouse
ggagggcggaggaaagttac

SEQ ID NO: 448611 - DNA, 20 bp, mouse
gtttcctccgccctcttgtt

SEQ ID NO: 448612 - DNA, 20 bp, mouse
gaatcctaacaagagggcgg

SEQ ID NO: 448613 - DNA, 20 bp, mouse
gcccccgcaagagtactctg

SEQ ID NO: 448614 - DNA, 20 bp, mouse
ggcgagtgtgagcaaagaga

SEQ ID NO: 448615 - DNA, 20 bp, mouse
gcggaagttggcttcctctc

SEQ ID NO: 448616 - DNA, 20 bp, mouse
gtgctttagggtccgcaaaa

SEQ ID NO: 448617 - DNA, 20 bp, mouse
gcagccagcaaagccagtaa

SEQ ID NO: 448618 - DNA, 20 bp, mouse
gctggcgcacaggggatggc

SEQ ID NO: 448619 - DNA, 20 bp, mouse
gggcgctggcgcacagggga

SEQ ID NO: 448620 - DNA, 20 bp, mouse
gcgcaggtcacgtacctgtc

SEQ ID NO: 448621 - DNA, 20 bp, mouse
gaaggaggtcgctacgagtc

SEQ ID NO: 448622 - DNA, 20 bp, mouse
ggcgttctagcccggcaagg

SEQ ID NO: 448623 - DNA, 20 bp, mouse
gtagaacgcgcacggcacag

SEQ ID NO: 448624 - DNA, 20 bp, mouse
gcacagcggcccgggactta

SEQ ID NO: 448625 - DNA, 20 bp, mouse
gagcctgggaccctaagtcc

SEQ ID NO: 448626 - DNA, 20 bp, mouse
ggtcagtccagacaaaacca

SEQ ID NO: 448627 - DNA, 20 bp, mouse
gtgaaatgcaagcccctcag

SEQ ID NO: 448628 - DNA, 20 bp, mouse
gctacttgggagagacatca

SEQ ID NO: 448629 - DNA, 20 bp, mouse
gctccagaaagaggaaccca

SEQ ID NO: 448630 - DNA, 20 bp, mouse
gctgggtgaagcagagcaca

SEQ ID NO: 448631 - DNA, 20 bp, mouse
ggccagaggactcctcatac

SEQ ID NO: 448632 - DNA, 20 bp, mouse
ggtctgagcctgtaagatca

SEQ ID NO: 448633 - DNA, 20 bp, mouse
gtcatgctcctggaaggcat

SEQ ID NO: 448634 - DNA, 20 bp, mouse
ggaggggcttgcatttcagc

SEQ ID NO: 448635 - DNA, 20 bp, mouse
ggcctgtaagatcaggggag

SEQ ID NO: 448636 - DNA, 20 bp, mouse
ggcgctggctttaacctggg

SEQ ID NO: 448637 - DNA, 20 bp, mouse
gaggtgtgtgggacccgagt

SEQ ID NO: 448638 - DNA, 20 bp, mouse
ggtggagagcagcgactgtg

SEQ ID NO: 448639 - DNA, 20 bp, mouse
ggcagcgctggctttaacct

SEQ ID NO: 448640 - DNA, 20 bp, mouse
ggagcagcgactgtgaggct

SEQ ID NO: 448641 - DNA, 20 bp, mouse
gcctgggcggcggaggcgtg

SEQ ID NO: 448642 - DNA, 20 bp, mouse
gatgtctccgtgaggcaatg

SEQ ID NO: 448643 - DNA, 20 bp, mouse
gtgttcggctaaattcaggt

SEQ ID NO: 448644 - DNA, 20 bp, mouse
gacctcaggtctgagtaaaa

SEQ ID NO: 448645 - DNA, 20 bp, mouse
gctggctttaacctgggcgg

SEQ ID NO: 448646 - DNA, 20 bp, mouse
gaggtgattgtcgatctgag

SEQ ID NO: 448647 - DNA, 20 bp, mouse
gcatccctcaaaaagtccag

SEQ ID NO: 448648 - DNA, 20 bp, mouse
gctacctctggactttttga

SEQ ID NO: 448649 - DNA, 20 bp, mouse
gtcatcatattacctacctc

SEQ ID NO: 448650 - DNA, 20 bp, mouse
ggggagactttattaactgc

SEQ ID NO: 448651 - DNA, 20 bp, mouse
ggcaggagatacttgtatcc

SEQ ID NO: 448652 - DNA, 20 bp, mouse
gcgtaagctaagatgttatc

SEQ ID NO: 448653 - DNA, 20 bp, mouse
gtatgatgaaatcatttggg

SEQ ID NO: 448654 - DNA, 20 bp, mouse
gccattgcacgtcattggaa

SEQ ID NO: 448655 - DNA, 20 bp, mouse
ggtaatatgatgaaatcatt

SEQ ID NO: 448656 - DNA, 20 bp, mouse
ggccgcggcggagctcgctc

SEQ ID NO: 448657 - DNA, 20 bp, mouse
gagctgggaaggcggaaggt

SEQ ID NO: 448658 - DNA, 20 bp, mouse
gggccgggcgagggaaccgg

SEQ ID NO: 448659 - DNA, 20 bp, mouse
gggcgcggcaggggacacgg

SEQ ID NO: 448660 - DNA, 20 bp, mouse
ggcggcggagctcgctcggg

SEQ ID NO: 448661 - DNA, 20 bp, mouse
gcggtcccgaagagctggga

SEQ ID NO: 448662 - DNA, 20 bp, mouse
ggatgaaggagatcccgttg

SEQ ID NO: 448663 - DNA, 20 bp, mouse
ggggacagccacggagtcgg

SEQ ID NO: 448664 - DNA, 20 bp, mouse
gtagggcgcgccggaggacg

SEQ ID NO: 448665 - DNA, 20 bp, mouse
gcttctccggggccctccga

SEQ ID NO: 448666 - DNA, 20 bp, mouse
ggggagctcagagctcggag

SEQ ID NO: 448667 - DNA, 20 bp, mouse
gggattcacacaccccgcag

SEQ ID NO: 448668 - DNA, 20 bp, mouse
gcggagcgcgatcccctgcg

SEQ ID NO: 448669 - DNA, 20 bp, mouse
gaagggcggtcagagtgcgg

SEQ ID NO: 448670 - DNA, 20 bp, mouse
gcgcgtgtagctcggctggt

SEQ ID NO: 448671 - DNA, 20 bp, mouse
gtgctcgagggccggagtag

SEQ ID NO: 448672 - DNA, 20 bp, mouse
gggagcactgatctggaccg

SEQ ID NO: 448673 - DNA, 20 bp, mouse
gctcagagctcggaggggct

SEQ ID NO: 448674 - DNA, 20 bp, mouse
ggtgctgagtttagcaggaa

SEQ ID NO: 448675 - DNA, 20 bp, mouse
ggcacctgtgcccaggagga

SEQ ID NO: 448676 - DNA, 20 bp, mouse
gtgccggagcgggaccctgg

SEQ ID NO: 448677 - DNA, 20 bp, mouse
gagctgccggagcgggaccc

SEQ ID NO: 448678 - DNA, 20 bp, mouse
ggcggtaagtgagctccgag

SEQ ID NO: 448679 - DNA, 20 bp, mouse
gctctccggcccggctctgc

SEQ ID NO: 448680 - DNA, 20 bp, mouse
gggtcccgcgcacaccctcc

SEQ ID NO: 448681 - DNA, 20 bp, mouse
gcggcctcctggcgacgcgg

SEQ ID NO: 448682 - DNA, 20 bp, mouse
gcgccgcggctgcagtcccg

SEQ ID NO: 448683 - DNA, 20 bp, mouse
ggatcccacgaccgacgctg

SEQ ID NO: 448684 - DNA, 20 bp, mouse
gctccgagcgggagcccgga

SEQ ID NO: 448685 - DNA, 20 bp, mouse
ggagttcccgggcaccgtct

SEQ ID NO: 448686 - DNA, 20 bp, mouse
ggcggcgctgtgcgcgactg

SEQ ID NO: 448687 - DNA, 20 bp, mouse
gcagcgccgccgcagcaggt

SEQ ID NO: 448688 - DNA, 20 bp, mouse
gccggcttcgtgaactctat

SEQ ID NO: 448689 - DNA, 20 bp, mouse
gcagccgggcgagagcggcg

SEQ ID NO: 448690 - DNA, 20 bp, mouse
gctgtgcgcgactggggctc

SEQ ID NO: 448691 - DNA, 20 bp, mouse
gtctgacccacctgctgcgg

SEQ ID NO: 448692 - DNA, 20 bp, mouse
gatctcagggatgaccctag

SEQ ID NO: 448693 - DNA, 20 bp, mouse
gagcccagtccaagcctcag

SEQ ID NO: 448694 - DNA, 20 bp, mouse
gcctagtggtcggtcctagg

SEQ ID NO: 448695 - DNA, 20 bp, mouse
ggcatgggccagggcttagt

SEQ ID NO: 448696 - DNA, 20 bp, mouse
gtgagcccaggagaccccga

SEQ ID NO: 448697 - DNA, 20 bp, mouse
gccaccgctatgtagaagag

SEQ ID NO: 448698 - DNA, 20 bp, mouse
gctgcggtcccatcccacgg

SEQ ID NO: 448699 - DNA, 20 bp, mouse
gaggaacactgcggccatcg

SEQ ID NO: 448700 - DNA, 20 bp, mouse
ggcggccatcggggtctcct

SEQ ID NO: 448701 - DNA, 20 bp, mouse
gctgggccgagtgtgttcgg

SEQ ID NO: 448702 - DNA, 20 bp, mouse
ggcgcgcagacctgacccaa

SEQ ID NO: 448703 - DNA, 20 bp, mouse
gcccctgcggtcccatccca

SEQ ID NO: 448704 - DNA, 20 bp, mouse
gaagatctgggaccaagcaa

SEQ ID NO: 448705 - DNA, 20 bp, mouse
gccggtatggcgccccggag

SEQ ID NO: 448706 - DNA, 20 bp, mouse
gtgggacatagtctcagcat

SEQ ID NO: 448707 - DNA, 20 bp, mouse
ggctggaacagcccaggtct

SEQ ID NO: 448708 - DNA, 20 bp, mouse
gtcagcatgggctgctacaa

SEQ ID NO: 448709 - DNA, 20 bp, mouse
gggttcggagctccaagacc

SEQ ID NO: 448710 - DNA, 20 bp, mouse
gtacggaaggcgagaagtcc

SEQ ID NO: 448711 - DNA, 20 bp, mouse
gggaaggcgagaagtccggg

SEQ ID NO: 448712 - DNA, 20 bp, mouse
gtccttatggtgtcccagag

SEQ ID NO: 448713 - DNA, 20 bp, mouse
gatgggctgctacaacggtt

SEQ ID NO: 448714 - DNA, 20 bp, mouse
gctggggagaccacaattgt

SEQ ID NO: 448715 - DNA, 20 bp, mouse
ggtccagcaccacgaacggt

SEQ ID NO: 448716 - DNA, 20 bp, mouse
gacgggcacggaaggaccga

SEQ ID NO: 448717 - DNA, 20 bp, mouse
gccgtgccggagaccagtct

SEQ ID NO: 448718 - DNA, 20 bp, mouse
ggccaggtgtacgcgtccgt

SEQ ID NO: 448719 - DNA, 20 bp, mouse
ggcgcagggacggacccggg

SEQ ID NO: 448720 - DNA, 20 bp, mouse
gtgccggagaccagtctcgg

SEQ ID NO: 448721 - DNA, 20 bp, mouse
gagggagacaccttccatag

SEQ ID NO: 448722 - DNA, 20 bp, mouse
gcccacacggctgtcactat

SEQ ID NO: 448723 - DNA, 20 bp, mouse
gcccgggtggcctccgagac

SEQ ID NO: 448724 - DNA, 20 bp, mouse
gtctccggcacgggcacgga

SEQ ID NO: 448725 - DNA, 20 bp, mouse
gaagtccggcttccacacta

SEQ ID NO: 448726 - DNA, 20 bp, mouse
ggaacgagactgctaccgag

SEQ ID NO: 448727 - DNA, 20 bp, mouse
gtgctaccgaggggagtaac

SEQ ID NO: 448728 - DNA, 20 bp, mouse
gagcagccggttactcccct

SEQ ID NO: 448729 - DNA, 20 bp, mouse
gcggggtcccaggcaaggta

SEQ ID NO: 448730 - DNA, 20 bp, mouse
ggaagtccgagtgccggtca

SEQ ID NO: 448731 - DNA, 20 bp, mouse
gagtgctctgctgggtaggt

SEQ ID NO: 448732 - DNA, 20 bp, mouse
gcggctgctggggcagtgcc

SEQ ID NO: 448733 - DNA, 20 bp, mouse
gcacttcttgagagaggcaa

SEQ ID NO: 448734 - DNA, 20 bp, mouse
gcatctttctggaccctgac

SEQ ID NO: 448735 - DNA, 20 bp, mouse
gtctggcttcgcctgatgtg

SEQ ID NO: 448736 - DNA, 20 bp, mouse
gagagcgcgcgggccatggt

SEQ ID NO: 448737 - DNA, 20 bp, mouse
gggcatggtccgaaacgagt

SEQ ID NO: 448738 - DNA, 20 bp, mouse
ggttggaacgccttgagcct

SEQ ID NO: 448739 - DNA, 20 bp, mouse
ggctcaaggcgttccaacca

SEQ ID NO: 448740 - DNA, 20 bp, mouse
gggtgcagggagaccaggtt

SEQ ID NO: 448741 - DNA, 20 bp, mouse
gctgccttagcccccagccc

SEQ ID NO: 448742 - DNA, 20 bp, mouse
ggtctcccggcccatttata

SEQ ID NO: 448743 - DNA, 20 bp, mouse
gaataagagcgcgcgggcca

SEQ ID NO: 448744 - DNA, 20 bp, mouse
ggaggagagagcaacccccg

SEQ ID NO: 448745 - DNA, 20 bp, mouse
gtgtcatctgcgacaaggtg

SEQ ID NO: 448746 - DNA, 20 bp, mouse
gagttccagtcggcatggag

SEQ ID NO: 448747 - DNA, 20 bp, mouse
gcaaggctggcagttccagt

SEQ ID NO: 448748 - DNA, 20 bp, mouse
ggtctggaggccccacacaa

SEQ ID NO: 448749 - DNA, 20 bp, mouse
gtggggcctccagacaaggc

SEQ ID NO: 448750 - DNA, 20 bp, mouse
gccttatgaagtgggatctg

SEQ ID NO: 448751 - DNA, 20 bp, mouse
gccagggagttagaactaga

SEQ ID NO: 448752 - DNA, 20 bp, mouse
gctggcagttccagtcggca

SEQ ID NO: 448753 - DNA, 20 bp, mouse
gtggaactgccagccttgtc

SEQ ID NO: 448754 - DNA, 20 bp, mouse
gaggtccgtgggatcaggga

SEQ ID NO: 448755 - DNA, 20 bp, mouse
gctcacctctccatgccgac

SEQ ID NO: 448756 - DNA, 20 bp, mouse
gtccaggagctgggtgtcgt

SEQ ID NO: 448757 - DNA, 20 bp, mouse
gcccggcacagcacttgcga

SEQ ID NO: 448758 - DNA, 20 bp, mouse
gcgcgtgcgtcgccgagacc

SEQ ID NO: 448759 - DNA, 20 bp, mouse
gtgtcgttggggaagccgcg

SEQ ID NO: 448760 - DNA, 20 bp, mouse
ggacgcacgcgcaggctgga

SEQ ID NO: 448761 - DNA, 20 bp, mouse
gaggcccgagagctggttgt

SEQ ID NO: 448762 - DNA, 20 bp, mouse
ggtggttgcgcctcaggtcc

SEQ ID NO: 448763 - DNA, 20 bp, mouse
gacagcacttgcgacggccg

SEQ ID NO: 448764 - DNA, 20 bp, mouse
gcgcctcaggtccaggagct

SEQ ID NO: 448765 - DNA, 20 bp, mouse
gtcgaaggggcccccaacct

SEQ ID NO: 448766 - DNA, 20 bp, mouse
gcagcagaagtgacaccggt

SEQ ID NO: 448767 - DNA, 20 bp, mouse
gcagaagtgacaccggtggg

SEQ ID NO: 448768 - DNA, 20 bp, mouse
gggcggctcaggcttcagtc

SEQ ID NO: 448769 - DNA, 20 bp, mouse
gaagtgacaccggtgggagg

SEQ ID NO: 448770 - DNA, 20 bp, mouse
gtgcacactccgcctcccac

SEQ ID NO: 448771 - DNA, 20 bp, mouse
gggctcaggcttcagtcggg

SEQ ID NO: 448772 - DNA, 20 bp, mouse
gagcctaagtggcctcgggg

SEQ ID NO: 448773 - DNA, 20 bp, mouse
gcggggcggagaccaggaga

SEQ ID NO: 448774 - DNA, 20 bp, mouse
gaggagaagggagggctctt

SEQ ID NO: 448775 - DNA, 20 bp, mouse
gggaggcggagtgtgcagcc

SEQ ID NO: 448776 - DNA, 20 bp, mouse
gggaccgagttactgcaggt

SEQ ID NO: 448777 - DNA, 20 bp, mouse
gcagtaactcggtccacccg

SEQ ID NO: 448778 - DNA, 20 bp, mouse
gcccgaggaggcgtgaccgg

SEQ ID NO: 448779 - DNA, 20 bp, mouse
gccaacccaggtcagaagcg

SEQ ID NO: 448780 - DNA, 20 bp, mouse
gggtcagaagcgcggaagcc

SEQ ID NO: 448781 - DNA, 20 bp, mouse
gagtactggctatcatcccg

SEQ ID NO: 448782 - DNA, 20 bp, mouse
ggcaagggagggagttcacg

SEQ ID NO: 448783 - DNA, 20 bp, mouse
gaggtaggtttgctgatacc

SEQ ID NO: 448784 - DNA, 20 bp, mouse
gagaactcacggccccggtg

SEQ ID NO: 448785 - DNA, 20 bp, mouse
gaaccaaacaccccagacgg

SEQ ID NO: 448786 - DNA, 20 bp, mouse
gggctgtgcggcctcgggaa

SEQ ID NO: 448787 - DNA, 20 bp, mouse
gtgtgcggcctcgggaatgg

SEQ ID NO: 448788 - DNA, 20 bp, mouse
gaagaggaggaaacgcccac

SEQ ID NO: 448789 - DNA, 20 bp, mouse
gaacacaaggctggccccgg

SEQ ID NO: 448790 - DNA, 20 bp, mouse
gacaaggctggccccggagg

SEQ ID NO: 448791 - DNA, 20 bp, mouse
ggcgagcgcgcggtacttcc

SEQ ID NO: 448792 - DNA, 20 bp, mouse
gcgtccagccgccattcccg

SEQ ID NO: 448793 - DNA, 20 bp, mouse
ggcgacccggaggcacgcga

SEQ ID NO: 448794 - DNA, 20 bp, mouse
gtggcggcgcacaggatggg

SEQ ID NO: 448795 - DNA, 20 bp, mouse
ggcgtggcggcgcacaggat

SEQ ID NO: 448796 - DNA, 20 bp, mouse
gctctgctacagaacctagg

SEQ ID NO: 448797 - DNA, 20 bp, mouse
ggatctggcaacttcgtcgg

SEQ ID NO: 448798 - DNA, 20 bp, mouse
gtgggatctggcaacttcgt

SEQ ID NO: 448799 - DNA, 20 bp, mouse
ggcttgcagtcagtcagtcg

SEQ ID NO: 448800 - DNA, 20 bp, mouse
gggcagcagtaccagaggtt

SEQ ID NO: 448801 - DNA, 20 bp, mouse
ggaggttgggcccgccacct

SEQ ID NO: 448802 - DNA, 20 bp, mouse
gtgctacagaacctaggtgg

SEQ ID NO: 448803 - DNA, 20 bp, mouse
gtagtcgtcggggtacatct

SEQ ID NO: 448804 - DNA, 20 bp, mouse
ggcggctgcgtgagccagaa

SEQ ID NO: 448805 - DNA, 20 bp, mouse
ggcgtgagccagaagggcca

SEQ ID NO: 448806 - DNA, 20 bp, mouse
gcttgagtggggctcacaag

SEQ ID NO: 448807 - DNA, 20 bp, mouse
gaagtggcgtggaagcttct

SEQ ID NO: 448808 - DNA, 20 bp, mouse
gcgcctccaagtcttgagtg

SEQ ID NO: 448809 - DNA, 20 bp, mouse
gagccccactcaagacttgg

SEQ ID NO: 448810 - DNA, 20 bp, mouse
ggtggggctcacaagtggcg

SEQ ID NO: 448811 - DNA, 20 bp, mouse
ggcagagggagggtaaggtc

SEQ ID NO: 448812 - DNA, 20 bp, mouse
gttgctgtcagtagaggctt

SEQ ID NO: 448813 - DNA, 20 bp, mouse
gtctggagagaagagggcca

SEQ ID NO: 448814 - DNA, 20 bp, mouse
gaaaaggagaggccaggtag

SEQ ID NO: 448815 - DNA, 20 bp, mouse
gcgcgcccggaaagccgaaa

SEQ ID NO: 448816 - DNA, 20 bp, mouse
gccaggcggccgcgtagact

SEQ ID NO: 448817 - DNA, 20 bp, mouse
gtggcgacgcccagtctacg

SEQ ID NO: 448818 - DNA, 20 bp, mouse
gggcggctaggtaatctcgg

SEQ ID NO: 448819 - DNA, 20 bp, mouse
gctgggaacgctgtgcaaaa

SEQ ID NO: 448820 - DNA, 20 bp, mouse
gatacaggttgcctctggag

SEQ ID NO: 448821 - DNA, 20 bp, mouse
gcggcgccgcggagcctact

SEQ ID NO: 448822 - DNA, 20 bp, mouse
gcccagttcttcccctccag

SEQ ID NO: 448823 - DNA, 20 bp, mouse
gtctacgcggccgcctggcg

SEQ ID NO: 448824 - DNA, 20 bp, mouse
gtggcgcggtttgcgaaccc

SEQ ID NO: 448825 - DNA, 20 bp, mouse
ggttcgcaaaccgcgccagg

SEQ ID NO: 448826 - DNA, 20 bp, mouse
ggactgcggtgggatcaagt

SEQ ID NO: 448827 - DNA, 20 bp, mouse
gcagtgccgggcaactaaca

SEQ ID NO: 448828 - DNA, 20 bp, mouse
gcttccccgaggcatgactg

SEQ ID NO: 448829 - DNA, 20 bp, mouse
gactgagcgagcggctgcta

SEQ ID NO: 448830 - DNA, 20 bp, mouse
gccgcactgcggcttccccg

SEQ ID NO: 448831 - DNA, 20 bp, mouse
gccccgaggcatgactgcgg

SEQ ID NO: 448832 - DNA, 20 bp, mouse
gttgcccggcactgagcgag

SEQ ID NO: 448833 - DNA, 20 bp, mouse
gtggagctgagtaagaagcg

SEQ ID NO: 448834 - DNA, 20 bp, mouse
gaacgtgggtgctctcccaa

SEQ ID NO: 448835 - DNA, 20 bp, mouse
gggtgagagagagagcgaca

SEQ ID NO: 448836 - DNA, 20 bp, mouse
gcaaaggagatatcagtaat

SEQ ID NO: 448837 - DNA, 20 bp, mouse
gggcctaggacgctgagtcc

SEQ ID NO: 448838 - DNA, 20 bp, mouse
ggagggcgtagtatacaagg

SEQ ID NO: 448839 - DNA, 20 bp, mouse
gctgagaacagggacatggt

SEQ ID NO: 448840 - DNA, 20 bp, mouse
gcggccaggtgagaccctcg

SEQ ID NO: 448841 - DNA, 20 bp, mouse
gggcccggaagttacgaagt

SEQ ID NO: 448842 - DNA, 20 bp, mouse
gagcctggactcagcgtcct

SEQ ID NO: 448843 - DNA, 20 bp, mouse
ggctaaaggttattggacaa

SEQ ID NO: 448844 - DNA, 20 bp, mouse
gaaccgagcgcgggccgcca

SEQ ID NO: 448845 - DNA, 20 bp, mouse
gctcgggcgctaaaggttat

SEQ ID NO: 448846 - DNA, 20 bp, mouse
gcctgcaagagaagcgtcca

SEQ ID NO: 448847 - DNA, 20 bp, mouse
gcacttgcgcgtgaaagccc

SEQ ID NO: 448848 - DNA, 20 bp, mouse
gcgttgggatccgaggtcaa

SEQ ID NO: 448849 - DNA, 20 bp, mouse
gcgccgggtcaccttcgagg

SEQ ID NO: 448850 - DNA, 20 bp, mouse
gtctggcacgtgaccggagg

SEQ ID NO: 448851 - DNA, 20 bp, mouse
gccggtcacgtgccagaagt

SEQ ID NO: 448852 - DNA, 20 bp, mouse
ggagaacgagaacatcaccg

SEQ ID NO: 448853 - DNA, 20 bp, mouse
gagaagcaaggagaaggcgc

SEQ ID NO: 448854 - DNA, 20 bp, mouse
ggctagaagtctgggtctct

SEQ ID NO: 448855 - DNA, 20 bp, mouse
gtgggtcctgacgtgctcgt

SEQ ID NO: 448856 - DNA, 20 bp, mouse
ggaagcggcgagggaggtca

SEQ ID NO: 448857 - DNA, 20 bp, mouse
gagtcctctgcagctcgcag

SEQ ID NO: 448858 - DNA, 20 bp, mouse
gttccagacgagagaggcag

SEQ ID NO: 448859 - DNA, 20 bp, mouse
gggcggtttccagacgagag

SEQ ID NO: 448860 - DNA, 20 bp, mouse
gccgtcccggccggtctcca

SEQ ID NO: 448861 - DNA, 20 bp, mouse
ggagggaggtcacggcgaga

SEQ ID NO: 448862 - DNA, 20 bp, mouse
gcaggcctgagaagcggcga

SEQ ID NO: 448863 - DNA, 20 bp, mouse
ggcctcggagggcctcacgt

SEQ ID NO: 448864 - DNA, 20 bp, mouse
gtcaagtggtctccaccgag

SEQ ID NO: 448865 - DNA, 20 bp, mouse
gccgcgtgaggcccactaaa

SEQ ID NO: 448866 - DNA, 20 bp, mouse
gttcaagcgccgatcagtca

SEQ ID NO: 448867 - DNA, 20 bp, mouse
ggatagggacaaccaacgag

SEQ ID NO: 448868 - DNA, 20 bp, mouse
gagcatgatctagagttata

SEQ ID NO: 448869 - DNA, 20 bp, mouse
gtctcttctccctgactgat

SEQ ID NO: 448870 - DNA, 20 bp, mouse
gggcagccaagccagagtcg

SEQ ID NO: 448871 - DNA, 20 bp, mouse
gaacaacctgataccggaaa

SEQ ID NO: 448872 - DNA, 20 bp, mouse
gaacctgataccggaaaagg

SEQ ID NO: 448873 - DNA, 20 bp, mouse
ggtgtaaagatcctgtgata

SEQ ID NO: 448874 - DNA, 20 bp, mouse
gttccacaacgcgcagggat

SEQ ID NO: 448875 - DNA, 20 bp, mouse
gcagactgcacggtccccaa

SEQ ID NO: 448876 - DNA, 20 bp, mouse
gccaggacgacgctgctcag

SEQ ID NO: 448877 - DNA, 20 bp, mouse
gcctgcccgcctcctgtcat

SEQ ID NO: 448878 - DNA, 20 bp, mouse
gcggcgctgcccatgacagg

SEQ ID NO: 448879 - DNA, 20 bp, mouse
gtctcggcgctgcccatgac

SEQ ID NO: 448880 - DNA, 20 bp, mouse
gagccggctccacagcaacc

SEQ ID NO: 448881 - DNA, 20 bp, mouse
gagcgtcgtcctggttgctg

SEQ ID NO: 448882 - DNA, 20 bp, mouse
gggcgtgaggccacgcgagc

SEQ ID NO: 448883 - DNA, 20 bp, mouse
gatgtatctggtccccggga

SEQ ID NO: 448884 - DNA, 20 bp, mouse
gtgtcccgagtgacgagcgt

SEQ ID NO: 448885 - DNA, 20 bp, mouse
gaggaggcgggcagggcgtg

SEQ ID NO: 448886 - DNA, 20 bp, mouse
ggccggagaccactcaccac

SEQ ID NO: 448887 - DNA, 20 bp, mouse
gggcccgggtgctggctgag

SEQ ID NO: 448888 - DNA, 20 bp, mouse
ggtcccgggcctgctgtcca

SEQ ID NO: 448889 - DNA, 20 bp, mouse
ggcctgctgtccagggaggg

SEQ ID NO: 448890 - DNA, 20 bp, mouse
gaggggagtgacacaatccg

SEQ ID NO: 448891 - DNA, 20 bp, mouse
ggcctgtggtgagtggtctc

SEQ ID NO: 448892 - DNA, 20 bp, mouse
gaatcgcgtggcgtgagtag

SEQ ID NO: 448893 - DNA, 20 bp, mouse
gggtgaccccatgcaggtct

SEQ ID NO: 448894 - DNA, 20 bp, mouse
gttggaactgcagccggccc

SEQ ID NO: 448895 - DNA, 20 bp, mouse
gctgcagccggcccgggtgc

SEQ ID NO: 448896 - DNA, 20 bp, mouse
ggaggcgacagcgacctcgg

SEQ ID NO: 448897 - DNA, 20 bp, mouse
gagacggttgcgctcgatcg

SEQ ID NO: 448898 - DNA, 20 bp, mouse
gcggcgccgcgcggcggaga

SEQ ID NO: 448899 - DNA, 20 bp, mouse
gcgcggtcttggcgtcatgg

SEQ ID NO: 448900 - DNA, 20 bp, mouse
ggccgagcgggaagtaccga

SEQ ID NO: 448901 - DNA, 20 bp, mouse
ggctgccggcggccgataag

SEQ ID NO: 448902 - DNA, 20 bp, mouse
ggatcgcggtcttggcgtca

SEQ ID NO: 448903 - DNA, 20 bp, mouse
gcggcggccgataagcggcg

SEQ ID NO: 448904 - DNA, 20 bp, mouse
gctcccgccccgccgcttat

SEQ ID NO: 448905 - DNA, 20 bp, mouse
ggcgtcatggcggctgccgg

SEQ ID NO: 448906 - DNA, 20 bp, mouse
gggcgctgccggccgaacac

SEQ ID NO: 448907 - DNA, 20 bp, mouse
gggcctctcgggatggcgag

SEQ ID NO: 448908 - DNA, 20 bp, mouse
gtccgcacgcgcgggagcga

SEQ ID NO: 448909 - DNA, 20 bp, mouse
gagccgctcgccatcccgag

SEQ ID NO: 448910 - DNA, 20 bp, mouse
ggctccggcccgtgttcggc

SEQ ID NO: 448911 - DNA, 20 bp, mouse
gggcttgccgcgcttcctgc

SEQ ID NO: 448912 - DNA, 20 bp, mouse
gctgccggccgaacacgggc

SEQ ID NO: 448913 - DNA, 20 bp, mouse
ggtgagtgcgcatgcccagt

SEQ ID NO: 448914 - DNA, 20 bp, mouse
gcggcagggaaacgcagact

SEQ ID NO: 448915 - DNA, 20 bp, mouse
gcctgcacccgcgtccgaag

SEQ ID NO: 448916 - DNA, 20 bp, mouse
ggcaaagcgcgctctctcta

SEQ ID NO: 448917 - DNA, 20 bp, mouse
gacgacctgggctctcaata

SEQ ID NO: 448918 - DNA, 20 bp, mouse
gtgtagagagtgtcaatcaa

SEQ ID NO: 448919 - DNA, 20 bp, mouse
gtgaggctgcccgaaagtta

SEQ ID NO: 448920 - DNA, 20 bp, mouse
gcgtaaagtgaaccgaagca

SEQ ID NO: 448921 - DNA, 20 bp, mouse
gacggcagcttcttccaaca

SEQ ID NO: 448922 - DNA, 20 bp, mouse
gcccagtaagtcactagaag

SEQ ID NO: 448923 - DNA, 20 bp, mouse
gctggaaaaaacaacgacct

SEQ ID NO: 448924 - DNA, 20 bp, mouse
gggagagcgcacaaaaatgg

SEQ ID NO: 448925 - DNA, 20 bp, mouse
gagtcactagaagaggcagg

SEQ ID NO: 448926 - DNA, 20 bp, mouse
gtcccctctgagggacgagg

SEQ ID NO: 448927 - DNA, 20 bp, mouse
gaggatggcttcccctctga

SEQ ID NO: 448928 - DNA, 20 bp, mouse
gtcctcctcgtccctcagag

SEQ ID NO: 448929 - DNA, 20 bp, mouse
gccgagccgaggagagtccc

SEQ ID NO: 448930 - DNA, 20 bp, mouse
ggccgacgaggacgatgagg

SEQ ID NO: 448931 - DNA, 20 bp, mouse
gggacgaagagggagtactc

SEQ ID NO: 448932 - DNA, 20 bp, mouse
gcggacggacgcttacctgg

SEQ ID NO: 448933 - DNA, 20 bp, mouse
ggcgcgggccgggccacgac

SEQ ID NO: 448934 - DNA, 20 bp, mouse
gtagacgggcccggcagtcc

SEQ ID NO: 448935 - DNA, 20 bp, mouse
ggggcccggcacctacggtt

SEQ ID NO: 448936 - DNA, 20 bp, mouse
ggctggagcgggagtgacac

SEQ ID NO: 448937 - DNA, 20 bp, mouse
ggcgacctgaggcggctcta

SEQ ID NO: 448938 - DNA, 20 bp, mouse
gctgaggcggctctagggtg

SEQ ID NO: 448939 - DNA, 20 bp, mouse
gcctcgccgcggccgaaggg

SEQ ID NO: 448940 - DNA, 20 bp, mouse
gccccgggacgcctgaagaa

SEQ ID NO: 448941 - DNA, 20 bp, mouse
gggccgcctccggggaagaa

SEQ ID NO: 448942 - DNA, 20 bp, mouse
ggcgggccgtcccctctcca

SEQ ID NO: 448943 - DNA, 20 bp, mouse
gtgaggagcgcgcgaggcaa

SEQ ID NO: 448944 - DNA, 20 bp, mouse
gggtaacccggccgcctccg

SEQ ID NO: 448945 - DNA, 20 bp, mouse
ggcgccgtctggaggtaacc

SEQ ID NO: 448946 - DNA, 20 bp, mouse
gtcccgcagccggccgaggg

SEQ ID NO: 448947 - DNA, 20 bp, mouse
gcgcagccggccgagggtgg

SEQ ID NO: 448948 - DNA, 20 bp, mouse
ggcggaggagatggagaacg

SEQ ID NO: 448949 - DNA, 20 bp, mouse
gcgagtcccgcagccggccg

SEQ ID NO: 448950 - DNA, 20 bp, mouse
gagaacgaggaggagatgtc

SEQ ID NO: 448951 - DNA, 20 bp, mouse
ggcagcgcgagtcccgcagc

SEQ ID NO: 448952 - DNA, 20 bp, mouse
gcccgcgcaggcccccacca

SEQ ID NO: 448953 - DNA, 20 bp, mouse
gcgcttcccgccgccttcaa

SEQ ID NO: 448954 - DNA, 20 bp, mouse
gttgcggggtcgaaacgggg

SEQ ID NO: 448955 - DNA, 20 bp, mouse
gggtccgtccggcagcgcac

SEQ ID NO: 448956 - DNA, 20 bp, mouse
gagcgcgcggcagccgggag

SEQ ID NO: 448957 - DNA, 20 bp, mouse
gcagccccgctccattcata

SEQ ID NO: 448958 - DNA, 20 bp, mouse
ggagaagaacttacctaaaa

SEQ ID NO: 448959 - DNA, 20 bp, mouse
ggcgggcccaagctgggtta

SEQ ID NO: 448960 - DNA, 20 bp, mouse
ggggttagggtgtccttgca

SEQ ID NO: 448961 - DNA, 20 bp, mouse
gggccagcggggcggagaca

SEQ ID NO: 448962 - DNA, 20 bp, mouse
gtgaatggagcggggctgag

SEQ ID NO: 448963 - DNA, 20 bp, mouse
ggcgctctcccaaggacgga

SEQ ID NO: 448964 - DNA, 20 bp, mouse
ggggaaggcgggcccaagct

SEQ ID NO: 448965 - DNA, 20 bp, mouse
ggatggggctgccctatgaa

SEQ ID NO: 448966 - DNA, 20 bp, mouse
ggagcgcgtccgcaccacca

SEQ ID NO: 448967 - DNA, 20 bp, mouse
ggcggccgggggctgatcca

SEQ ID NO: 448968 - DNA, 20 bp, mouse
gcgcaggcgctggcgtgctg

SEQ ID NO: 448969 - DNA, 20 bp, mouse
gacacaaaggagcgccgcgg

SEQ ID NO: 448970 - DNA, 20 bp, mouse
gatcgagtggaattacacaa

SEQ ID NO: 448971 - DNA, 20 bp, mouse
gccggcgcccccgggagggg

SEQ ID NO: 448972 - DNA, 20 bp, mouse
ggcggccgccgagccaactc

SEQ ID NO: 448973 - DNA, 20 bp, mouse
gaggaggcggcccggggacc

SEQ ID NO: 448974 - DNA, 20 bp, mouse
gcgcagagcggctccggagt

SEQ ID NO: 448975 - DNA, 20 bp, mouse
gcggtgagcgcagacttccc

SEQ ID NO: 448976 - DNA, 20 bp, mouse
gtcctgaacttcatggagca

SEQ ID NO: 448977 - DNA, 20 bp, mouse
gagccttcagcgggagaaga

SEQ ID NO: 448978 - DNA, 20 bp, mouse
gaagatggcagaccccatca

SEQ ID NO: 448979 - DNA, 20 bp, mouse
gatcttggtagagtaataaa

SEQ ID NO: 448980 - DNA, 20 bp, mouse
ggaagatggaactcctgtga

SEQ ID NO: 448981 - DNA, 20 bp, mouse
ggccttgctccatgaagttc

SEQ ID NO: 448982 - DNA, 20 bp, mouse
gttccatcttctcccgctga

SEQ ID NO: 448983 - DNA, 20 bp, mouse
gtcctggctggtgggctgag

SEQ ID NO: 448984 - DNA, 20 bp, mouse
gccaaggagtccagagagct

SEQ ID NO: 448985 - DNA, 20 bp, mouse
ggaagttccggggagggaag

SEQ ID NO: 448986 - DNA, 20 bp, mouse
gcgccggcgagggagacaga

SEQ ID NO: 448987 - DNA, 20 bp, mouse
gcgttccccacgctccccaa

SEQ ID NO: 448988 - DNA, 20 bp, mouse
gacaccgcggagcccggggg

SEQ ID NO: 448989 - DNA, 20 bp, mouse
ggagcgcaggcaccacctag

SEQ ID NO: 448990 - DNA, 20 bp, mouse
gagcgccggcagctaaggta

SEQ ID NO: 448991 - DNA, 20 bp, mouse
gaaatctgcgcccccccccc

SEQ ID NO: 448992 - DNA, 20 bp, mouse
ggctaaggtaaggattcctc

SEQ ID NO: 448993 - DNA, 20 bp, mouse
gcccagcctcagacattcta

SEQ ID NO: 448994 - DNA, 20 bp, mouse
gccagagtcctagggttccg

SEQ ID NO: 448995 - DNA, 20 bp, mouse
gaggacagcgccggcagcta

SEQ ID NO: 448996 - DNA, 20 bp, mouse
gattagtaagaacctgaaca

SEQ ID NO: 448997 - DNA, 20 bp, mouse
gtagaaacaaaatgtttgat

SEQ ID NO: 448998 - DNA, 20 bp, mouse
gaaggaaggtaagttgttta

SEQ ID NO: 448999 - DNA, 20 bp, mouse
ggagctaactgagataaaga

SEQ ID NO: 449000 - DNA, 20 bp, mouse
gagagagttgttttaaagga

SEQ ID NO: 449001 - DNA, 20 bp, mouse
gtcgcattctctccctgttc

SEQ ID NO: 449002 - DNA, 20 bp, mouse
gttgttggggcagcagcatt

SEQ ID NO: 449003 - DNA, 20 bp, mouse
gtaaacaatactgtatttat

SEQ ID NO: 449004 - DNA, 20 bp, mouse
gttttcccacatgatttgat

SEQ ID NO: 449005 - DNA, 20 bp, mouse
gaggggacaagagaagataa

SEQ ID NO: 449006 - DNA, 20 bp, mouse
gagcagcgggcgaggatcag

SEQ ID NO: 449007 - DNA, 20 bp, mouse
gggagccaggagagccgaga

SEQ ID NO: 449008 - DNA, 20 bp, mouse
gagcagctcgcggcactccc

SEQ ID NO: 449009 - DNA, 20 bp, mouse
ggacgccagttaaagagcag

SEQ ID NO: 449010 - DNA, 20 bp, mouse
gagccagacggagcagctcg

SEQ ID NO: 449011 - DNA, 20 bp, mouse
gagtcgggcagatctcactc

SEQ ID NO: 449012 - DNA, 20 bp, mouse
ggggccaggacgcgaaggac

SEQ ID NO: 449013 - DNA, 20 bp, mouse
gacccgcgcctggagccaga

SEQ ID NO: 449014 - DNA, 20 bp, mouse
gcacctgggccaggacgcga

SEQ ID NO: 449015 - DNA, 20 bp, mouse
ggtgaggacctgaagcggag

SEQ ID NO: 449016 - DNA, 20 bp, mouse
gctgtgcatttggattcctg

SEQ ID NO: 449017 - DNA, 20 bp, mouse
gctccagcaaaggacccaga

SEQ ID NO: 449018 - DNA, 20 bp, mouse
gccagcaccgggagggaaca

SEQ ID NO: 449019 - DNA, 20 bp, mouse
gagggaccagagcgattgta

SEQ ID NO: 449020 - DNA, 20 bp, mouse
gtccagactagcagagaggt

SEQ ID NO: 449021 - DNA, 20 bp, mouse
gtgggaaagaactccagcaa

SEQ ID NO: 449022 - DNA, 20 bp, mouse
ggagttctttcccactgttc

SEQ ID NO: 449023 - DNA, 20 bp, mouse
ggaattggaagtgagcgggt

SEQ ID NO: 449024 - DNA, 20 bp, mouse
gcggagagaagcgggaggca

SEQ ID NO: 449025 - DNA, 20 bp, mouse
ggagcagctgggtgtaacta

SEQ ID NO: 449026 - DNA, 20 bp, mouse
gcacgcggtgagtcataagt

SEQ ID NO: 449027 - DNA, 20 bp, mouse
gggctcctggtggtctcacg

SEQ ID NO: 449028 - DNA, 20 bp, mouse
gaggtttagcgccactccac

SEQ ID NO: 449029 - DNA, 20 bp, mouse
gctcaccgcgtgagaccacc

SEQ ID NO: 449030 - DNA, 20 bp, mouse
gacagcctccgccagtggag

SEQ ID NO: 449031 - DNA, 20 bp, mouse
gactgcacagcctccgccag

SEQ ID NO: 449032 - DNA, 20 bp, mouse
ggccccaagggcagataaaa

SEQ ID NO: 449033 - DNA, 20 bp, mouse
gggctctgcaggaactgaag

SEQ ID NO: 449034 - DNA, 20 bp, mouse
ggggtggagtttgtatccgt

SEQ ID NO: 449035 - DNA, 20 bp, mouse
ggcatacgtgaggggtagga

SEQ ID NO: 449036 - DNA, 20 bp, mouse
gctggtaagcgatcgtgagg

SEQ ID NO: 449037 - DNA, 20 bp, mouse
ggtgctggtaagcgatcgtg

SEQ ID NO: 449038 - DNA, 20 bp, mouse
gcggcggaggacgttgccag

SEQ ID NO: 449039 - DNA, 20 bp, mouse
gggcggcatcggcatctcca

SEQ ID NO: 449040 - DNA, 20 bp, mouse
ggtaagcgatcgtgaggcgg

SEQ ID NO: 449041 - DNA, 20 bp, mouse
gaatgcggggaaccacggag

SEQ ID NO: 449042 - DNA, 20 bp, mouse
gaccaggccggggtcctctg

SEQ ID NO: 449043 - DNA, 20 bp, mouse
gcctcaccatctggcggcat

SEQ ID NO: 449044 - DNA, 20 bp, mouse
gccaggaatgcggggaacca

SEQ ID NO: 449045 - DNA, 20 bp, mouse
gggtgtacgggtcctgacta

SEQ ID NO: 449046 - DNA, 20 bp, mouse
gagatgtctgttgacagcgg

SEQ ID NO: 449047 - DNA, 20 bp, mouse
ggcctcccgtggatcagctg

SEQ ID NO: 449048 - DNA, 20 bp, mouse
gaccccagctgatccacggg

SEQ ID NO: 449049 - DNA, 20 bp, mouse
gagcggtggcggcgactgta

SEQ ID NO: 449050 - DNA, 20 bp, mouse
ggggtaccccagctgatcca

SEQ ID NO: 449051 - DNA, 20 bp, mouse
ggtggcggcgactgtaaggc

SEQ ID NO: 449052 - DNA, 20 bp, mouse
ggacgaagaagcctccccca

SEQ ID NO: 449053 - DNA, 20 bp, mouse
gtgatccacgggaggcgagg

SEQ ID NO: 449054 - DNA, 20 bp, mouse
gccacgccctgcgcggatcc

SEQ ID NO: 449055 - DNA, 20 bp, mouse
gcgccgccgcaggaaccctg

SEQ ID NO: 449056 - DNA, 20 bp, mouse
gagcgggaacactgcagtag

SEQ ID NO: 449057 - DNA, 20 bp, mouse
ggggaacactgcagtagcgg

SEQ ID NO: 449058 - DNA, 20 bp, mouse
gcgggagtgggtctgtagtc

SEQ ID NO: 449059 - DNA, 20 bp, mouse
ggtaacagcggtgatggtgg

SEQ ID NO: 449060 - DNA, 20 bp, mouse
ggtggtggtaacagcggtga

SEQ ID NO: 449061 - DNA, 20 bp, mouse
gtcccgctggtgcagagctt

SEQ ID NO: 449062 - DNA, 20 bp, mouse
gaacactgcagtagcggtgg

SEQ ID NO: 449063 - DNA, 20 bp, mouse
gcggctcctctagggacctg

SEQ ID NO: 449064 - DNA, 20 bp, mouse
gagggacctggggcaagaga

SEQ ID NO: 449065 - DNA, 20 bp, mouse
ggaatcctccggctcctcta

SEQ ID NO: 449066 - DNA, 20 bp, mouse
gcctctcgccagctgagtgt

SEQ ID NO: 449067 - DNA, 20 bp, mouse
ggagtgtaggaggagctcgg

SEQ ID NO: 449068 - DNA, 20 bp, mouse
gctcgccagctgagtgtagg

SEQ ID NO: 449069 - DNA, 20 bp, mouse
gggaggccgaggagcatagc

SEQ ID NO: 449070 - DNA, 20 bp, mouse
gaggcaaggcaagggataca

SEQ ID NO: 449071 - DNA, 20 bp, mouse
gagctcctcctacactcagc

SEQ ID NO: 449072 - DNA, 20 bp, mouse
gagagcagctgtggcgcggt

SEQ ID NO: 449073 - DNA, 20 bp, mouse
gcagagccgctgcgcccagg

SEQ ID NO: 449074 - DNA, 20 bp, mouse
gcagccccggcggggaaagg

SEQ ID NO: 449075 - DNA, 20 bp, mouse
ggcctggcctggctttgagt

SEQ ID NO: 449076 - DNA, 20 bp, mouse
gcccatcctggcttcagtag

SEQ ID NO: 449077 - DNA, 20 bp, mouse
gtcagtagaggtgtgcatga

SEQ ID NO: 449078 - DNA, 20 bp, mouse
ggccaggatgggcatgaggg

SEQ ID NO: 449079 - DNA, 20 bp, mouse
gaggccctgactaggaagct

SEQ ID NO: 449080 - DNA, 20 bp, mouse
ggactaggaagctgggtact

SEQ ID NO: 449081 - DNA, 20 bp, mouse
ggcatgagggcggcactgac

SEQ ID NO: 449082 - DNA, 20 bp, mouse
ggccgccctcatgcccatcc

SEQ ID NO: 449083 - DNA, 20 bp, mouse
gtagtcagggcctcttcctt

SEQ ID NO: 449084 - DNA, 20 bp, mouse
gaagcctgtggggaaatcca

SEQ ID NO: 449085 - DNA, 20 bp, mouse
ggaaggagatgtggagccta

SEQ ID NO: 449086 - DNA, 20 bp, mouse
ggaaccgagtagggtggtgt

SEQ ID NO: 449087 - DNA, 20 bp, mouse
ggtggtgtgggaggcttgtc

SEQ ID NO: 449088 - DNA, 20 bp, mouse
gcagcctggagcctcaggag

SEQ ID NO: 449089 - DNA, 20 bp, mouse
gctgaaagaaccgagtaggg

SEQ ID NO: 449090 - DNA, 20 bp, mouse
gtatctgaaagaaccgagta

SEQ ID NO: 449091 - DNA, 20 bp, mouse
ggctgaaggatgacttctac

SEQ ID NO: 449092 - DNA, 20 bp, mouse
ggcgaagggaaccttctcgt

SEQ ID NO: 449093 - DNA, 20 bp, mouse
gccccggaacaaagaaggag

SEQ ID NO: 449094 - DNA, 20 bp, mouse
gtgtgggaggcttgtcaggc

SEQ ID NO: 449095 - DNA, 20 bp, mouse
gagatatgcgacttcctcaa

SEQ ID NO: 449096 - DNA, 20 bp, mouse
gtccctcacaggatctaaca

SEQ ID NO: 449097 - DNA, 20 bp, mouse
gcattacaaaatcatggtct

SEQ ID NO: 449098 - DNA, 20 bp, mouse
gtctgagagagagctatccc

SEQ ID NO: 449099 - DNA, 20 bp, mouse
gtccttgttagatcctgtga

SEQ ID NO: 449100 - DNA, 20 bp, mouse
ggagaatgacaaataaacct

SEQ ID NO: 449101 - DNA, 20 bp, mouse
gtgcatggtttttccctcac

SEQ ID NO: 449102 - DNA, 20 bp, mouse
gtcaaaacattacaaaatca

SEQ ID NO: 449103 - DNA, 20 bp, mouse
ggttttgaaaatgggaagtt

SEQ ID NO: 449104 - DNA, 20 bp, mouse
gtttgtaatgttttgaaaat

SEQ ID NO: 449105 - DNA, 20 bp, mouse
gacaagaatgagcttggcca

SEQ ID NO: 449106 - DNA, 20 bp, mouse
ggggccagtactaattgtag

SEQ ID NO: 449107 - DNA, 20 bp, mouse
gacagatgaatcaggactcc

SEQ ID NO: 449108 - DNA, 20 bp, mouse
ggtgcccctacaattagtac

SEQ ID NO: 449109 - DNA, 20 bp, mouse
ggaaagtacacagatgaatc

SEQ ID NO: 449110 - DNA, 20 bp, mouse
gcaattagtactggcccacc

SEQ ID NO: 449111 - DNA, 20 bp, mouse
ggcttagggagagtacatac

SEQ ID NO: 449112 - DNA, 20 bp, mouse
gtcatgtcattaataatgag

SEQ ID NO: 449113 - DNA, 20 bp, mouse
gcaattctcaaacatagaat

SEQ ID NO: 449114 - DNA, 20 bp, mouse
gtcatacttgtgaataagtt

SEQ ID NO: 449115 - DNA, 20 bp, mouse
ggtcatattgtatgtgctta

SEQ ID NO: 449116 - DNA, 20 bp, mouse
gcttacagaatctgacaagg

SEQ ID NO: 449117 - DNA, 20 bp, mouse
gcaatggaaagtggcaatga

SEQ ID NO: 449118 - DNA, 20 bp, mouse
gtctgagatagtgctaccgc

SEQ ID NO: 449119 - DNA, 20 bp, mouse
gaaaaaccatgcaagactga

SEQ ID NO: 449120 - DNA, 20 bp, mouse
gtcccttacagaatctgaca

SEQ ID NO: 449121 - DNA, 20 bp, mouse
gagagagacaaataaacctg

SEQ ID NO: 449122 - DNA, 20 bp, mouse
gttaggtaatcaatggaaag

SEQ ID NO: 449123 - DNA, 20 bp, mouse
gaactttttcagagacaggc

SEQ ID NO: 449124 - DNA, 20 bp, mouse
gtcaggcaggtggcatagca

SEQ ID NO: 449125 - DNA, 20 bp, mouse
gagcagggtaaggaatgagt

SEQ ID NO: 449126 - DNA, 20 bp, mouse
ggtagagtgagaatacctca

SEQ ID NO: 449127 - DNA, 20 bp, mouse
gagatggaaagcgtttgcta

SEQ ID NO: 449128 - DNA, 20 bp, mouse
gtcaggatctgacaaccgtg

SEQ ID NO: 449129 - DNA, 20 bp, mouse
ggtggcagtgaaataactaa

SEQ ID NO: 449130 - DNA, 20 bp, mouse
ggactataaggtttgtcaga

SEQ ID NO: 449131 - DNA, 20 bp, mouse
gcctgagaacaaaaaaagac

SEQ ID NO: 449132 - DNA, 20 bp, mouse
ggcttcagaagagtctcagt

SEQ ID NO: 449133 - DNA, 20 bp, mouse
gtaaaacatttaagactata

SEQ ID NO: 449134 - DNA, 20 bp, mouse
gagaacaagacattgaatga

SEQ ID NO: 449135 - DNA, 20 bp, mouse
gtacagtttctctcacatat

SEQ ID NO: 449136 - DNA, 20 bp, mouse
gggttctcctggagcagtac

SEQ ID NO: 449137 - DNA, 20 bp, mouse
gagcagtacgggaggaacga

SEQ ID NO: 449138 - DNA, 20 bp, mouse
gccaagctacttctcgtcac

SEQ ID NO: 449139 - DNA, 20 bp, mouse
gcttaagaggaaaggatgca

SEQ ID NO: 449140 - DNA, 20 bp, mouse
gctctctaagctcacatcac

SEQ ID NO: 449141 - DNA, 20 bp, mouse
gagacaggtaccgaaagaca

SEQ ID NO: 449142 - DNA, 20 bp, mouse
gctggttatgagatcttaag

SEQ ID NO: 449143 - DNA, 20 bp, mouse
ggttcctcccgtactgctcc

SEQ ID NO: 449144 - DNA, 20 bp, mouse
gaagccatttgaggttctcc

SEQ ID NO: 449145 - DNA, 20 bp, mouse
gtcacatcactggcatgtta

SEQ ID NO: 449146 - DNA, 20 bp, mouse
gagcatcctgctgcccaaca

SEQ ID NO: 449147 - DNA, 20 bp, mouse
gtgtcgaactccgccatgtt

SEQ ID NO: 449148 - DNA, 20 bp, mouse
ggagagtggcggctatcgtg

SEQ ID NO: 449149 - DNA, 20 bp, mouse
ggcggagttcgacaccatct

SEQ ID NO: 449150 - DNA, 20 bp, mouse
gacgacgacggagacgacga

SEQ ID NO: 449151 - DNA, 20 bp, mouse
gggcgccgcgcaccaacaca

SEQ ID NO: 449152 - DNA, 20 bp, mouse
ggacaccatctcggaattgg

SEQ ID NO: 449153 - DNA, 20 bp, mouse
gtcactacccgaggcggggg

SEQ ID NO: 449154 - DNA, 20 bp, mouse
gcgctcactacccgaggcgg

SEQ ID NO: 449155 - DNA, 20 bp, mouse
gcgcaccaacacagggtctg

SEQ ID NO: 449156 - DNA, 20 bp, mouse
gagctggcgctcggcagtgt

SEQ ID NO: 449157 - DNA, 20 bp, mouse
ggccgtcgccgccgcaactc

SEQ ID NO: 449158 - DNA, 20 bp, mouse
gccaccgccgccattaccgt

SEQ ID NO: 449159 - DNA, 20 bp, mouse
ggtggttgccggagttgcgg

SEQ ID NO: 449160 - DNA, 20 bp, mouse
gtactgaggagacctggtcc

SEQ ID NO: 449161 - DNA, 20 bp, mouse
gggagccgcggaccaccacc

SEQ ID NO: 449162 - DNA, 20 bp, mouse
gaccgtgtaaggccctgcga

SEQ ID NO: 449163 - DNA, 20 bp, mouse
gtccggctactgaggagacc

SEQ ID NO: 449164 - DNA, 20 bp, mouse
ggctgtggttgccggagttg

SEQ ID NO: 449165 - DNA, 20 bp, mouse
gcccgggaagtctcgcgatg

SEQ ID NO: 449166 - DNA, 20 bp, mouse
gagtgtgagcgggaaggaga

SEQ ID NO: 449167 - DNA, 20 bp, mouse
gatgaaggtgagcccggctg

SEQ ID NO: 449168 - DNA, 20 bp, mouse
gggccggtctcctgacatga

SEQ ID NO: 449169 - DNA, 20 bp, mouse
gggctctccccggacagaac

SEQ ID NO: 449170 - DNA, 20 bp, mouse
gcggccagacccatcaagca

SEQ ID NO: 449171 - DNA, 20 bp, mouse
gatgggagctatgaatgtga

SEQ ID NO: 449172 - DNA, 20 bp, mouse
gtcttccggccgtgcttgat

SEQ ID NO: 449173 - DNA, 20 bp, mouse
gtgtgtcagcctgagagtaa

SEQ ID NO: 449174 - DNA, 20 bp, mouse
gttagggtgagagcaggtat

SEQ ID NO: 449175 - DNA, 20 bp, mouse
gcgggcagcgaggctctccc

SEQ ID NO: 449176 - DNA, 20 bp, mouse
gggcactgtctaggccgact

SEQ ID NO: 449177 - DNA, 20 bp, mouse
gagatccccctagaggccgg

SEQ ID NO: 449178 - DNA, 20 bp, mouse
gacatcctccggcctctagg

SEQ ID NO: 449179 - DNA, 20 bp, mouse
gtggtgcagaccttgctcaa

SEQ ID NO: 449180 - DNA, 20 bp, mouse
gcttcatgggagcgaaccag

SEQ ID NO: 449181 - DNA, 20 bp, mouse
gttaagatccccctagaggc

SEQ ID NO: 449182 - DNA, 20 bp, mouse
ggaagttatgctgaagaacg

SEQ ID NO: 449183 - DNA, 20 bp, mouse
ggtttggagggtgatatgaa

SEQ ID NO: 449184 - DNA, 20 bp, mouse
gctgcttgaagctaaggcga

SEQ ID NO: 449185 - DNA, 20 bp, mouse
ggaacaagttgtagagctct

SEQ ID NO: 449186 - DNA, 20 bp, mouse
gagaggcagcaatggacgtc

SEQ ID NO: 449187 - DNA, 20 bp, mouse
gaacgagagacgagcgcggg

SEQ ID NO: 449188 - DNA, 20 bp, mouse
ggacgagcgcgggaggctga

SEQ ID NO: 449189 - DNA, 20 bp, mouse
gagcgcgggaggctgacggc

SEQ ID NO: 449190 - DNA, 20 bp, mouse
gcgtcggcgacggcggggag

SEQ ID NO: 449191 - DNA, 20 bp, mouse
ggggcggccacagcacgaga

SEQ ID NO: 449192 - DNA, 20 bp, mouse
gagtaacgagagacgagcgc

SEQ ID NO: 449193 - DNA, 20 bp, mouse
gtccccgcgccggcccccag

SEQ ID NO: 449194 - DNA, 20 bp, mouse
gtccagccggaccctgagtg

SEQ ID NO: 449195 - DNA, 20 bp, mouse
ggcgcgcggggaggcgacgt

SEQ ID NO: 449196 - DNA, 20 bp, mouse
ggcagcgccgagcctatcag

SEQ ID NO: 449197 - DNA, 20 bp, mouse
gcggcgctcaaaggcaaaga

SEQ ID NO: 449198 - DNA, 20 bp, mouse
gtactcccggcaccactgat

SEQ ID NO: 449199 - DNA, 20 bp, mouse
gagagactgataggcggatc

SEQ ID NO: 449200 - DNA, 20 bp, mouse
gcccgagcgcgccccactca

SEQ ID NO: 449201 - DNA, 20 bp, mouse
gaggttggctccttccgggt

SEQ ID NO: 449202 - DNA, 20 bp, mouse
gaaggagccaacctcacctg

SEQ ID NO: 449203 - DNA, 20 bp, mouse
gtcagggctgcggcgctcaa

SEQ ID NO: 449204 - DNA, 20 bp, mouse
gacaggggtagtcggaggag

SEQ ID NO: 449205 - DNA, 20 bp, mouse
gggctgacccctgacctcac

SEQ ID NO: 449206 - DNA, 20 bp, mouse
ggcaccgccgcaggtggcta

SEQ ID NO: 449207 - DNA, 20 bp, mouse
gcctgcggcggtgctacgaa

SEQ ID NO: 449208 - DNA, 20 bp, mouse
gcagccttagccacctgcgg

SEQ ID NO: 449209 - DNA, 20 bp, mouse
ggcggcggtgctacgaaagg

SEQ ID NO: 449210 - DNA, 20 bp, mouse
gccttccctaacctgagaag

SEQ ID NO: 449211 - DNA, 20 bp, mouse
gggaccccaacacctatagg

SEQ ID NO: 449212 - DNA, 20 bp, mouse
gcaagctgccaaccttcggt

SEQ ID NO: 449213 - DNA, 20 bp, mouse
gccctgaaggctatggtcta

SEQ ID NO: 449214 - DNA, 20 bp, mouse
gtttactccatccactgacc

SEQ ID NO: 449215 - DNA, 20 bp, mouse
gccccactccctgaaggcta

SEQ ID NO: 449216 - DNA, 20 bp, mouse
gatgtgatcgtaatagggac

SEQ ID NO: 449217 - DNA, 20 bp, mouse
ggatcacatcaaagtccgaa

SEQ ID NO: 449218 - DNA, 20 bp, mouse
gtaatagggacgggtatgtg

SEQ ID NO: 449219 - DNA, 20 bp, mouse
ggtggagtcagcgcaggact

SEQ ID NO: 449220 - DNA, 20 bp, mouse
ggcgggtccaagcccctccc

SEQ ID NO: 449221 - DNA, 20 bp, mouse
gctttgatgtgatcgtaata

SEQ ID NO: 449222 - DNA, 20 bp, mouse
ggattatccgccatcttgac

SEQ ID NO: 449223 - DNA, 20 bp, mouse
gggtagtgtggagtcagcgc

SEQ ID NO: 449224 - DNA, 20 bp, mouse
ggcagtgtcatgagaatgga

SEQ ID NO: 449225 - DNA, 20 bp, mouse
gatggcggataatctccctt

SEQ ID NO: 449226 - DNA, 20 bp, mouse
gcagctgccaggatggactc

SEQ ID NO: 449227 - DNA, 20 bp, mouse
gggcttgccggagtccatcc

SEQ ID NO: 449228 - DNA, 20 bp, mouse
gatgtggtaataatagggac

SEQ ID NO: 449229 - DNA, 20 bp, mouse
ggtttgatgtggtaataata

SEQ ID NO: 449230 - DNA, 20 bp, mouse
gtcatcagctcctaggatgg

SEQ ID NO: 449231 - DNA, 20 bp, mouse
ggcttcatcagctcctagga

SEQ ID NO: 449232 - DNA, 20 bp, mouse
gcagctgcatgttcaagaag

SEQ ID NO: 449233 - DNA, 20 bp, mouse
gatcaggtcttgccatgtgg

SEQ ID NO: 449234 - DNA, 20 bp, mouse
gttaccacatcaaactctgt

SEQ ID NO: 449235 - DNA, 20 bp, mouse
gggaaggcgtgaccgccaca

SEQ ID NO: 449236 - DNA, 20 bp, mouse
ggaagccctcgcggagacag

SEQ ID NO: 449237 - DNA, 20 bp, mouse
ggtctccgcgagggcttccg

SEQ ID NO: 449238 - DNA, 20 bp, mouse
ggcgaccccggaagccctcg

SEQ ID NO: 449239 - DNA, 20 bp, mouse
gccggaagcggtggcgaccc

SEQ ID NO: 449240 - DNA, 20 bp, mouse
gtagcccgaccggccatgga

SEQ ID NO: 449241 - DNA, 20 bp, mouse
ggggtcccggtccgaataca

SEQ ID NO: 449242 - DNA, 20 bp, mouse
gccccagggcaggtcctagt

SEQ ID NO: 449243 - DNA, 20 bp, mouse
gttaccgtccatggccggtc

SEQ ID NO: 449244 - DNA, 20 bp, mouse
gcgggtcctggtggctacac

SEQ ID NO: 449245 - DNA, 20 bp, mouse
gtagccaccaggacccgacc

SEQ ID NO: 449246 - DNA, 20 bp, mouse
ggagtctcaaggcttcggag

SEQ ID NO: 449247 - DNA, 20 bp, mouse
gcaggggctaccgaaccgag

SEQ ID NO: 449248 - DNA, 20 bp, mouse
gcaacgacaacccctcggtt

SEQ ID NO: 449249 - DNA, 20 bp, mouse
ggcgtaccgagggcaggaag

SEQ ID NO: 449250 - DNA, 20 bp, mouse
ggaggtgaagacctcgatgt

SEQ ID NO: 449251 - DNA, 20 bp, mouse
gtggtaggcagcgtaggagg

SEQ ID NO: 449252 - DNA, 20 bp, mouse
gggttcggtagcccctgctg

SEQ ID NO: 449253 - DNA, 20 bp, mouse
ggaggggtagaggcgtgacc

SEQ ID NO: 449254 - DNA, 20 bp, mouse
gtagaggcgtgacccggaag

SEQ ID NO: 449255 - DNA, 20 bp, mouse
gcctcgatgtgggtagggac

SEQ ID NO: 449256 - DNA, 20 bp, mouse
gcccggtcacctgagcaccc

SEQ ID NO: 449257 - DNA, 20 bp, mouse
ggcacccaggacgcgttctc

SEQ ID NO: 449258 - DNA, 20 bp, mouse
ggctcccgagaacgcgtcct

SEQ ID NO: 449259 - DNA, 20 bp, mouse
gccggttctgggaacaggac

SEQ ID NO: 449260 - DNA, 20 bp, mouse
gagccggccaggtaagccag

SEQ ID NO: 449261 - DNA, 20 bp, mouse
ggctccccagagaccccggg

SEQ ID NO: 449262 - DNA, 20 bp, mouse
gcgcgttctcgggagcctcg

SEQ ID NO: 449263 - DNA, 20 bp, mouse
gaaccgggccggaccgaacc

SEQ ID NO: 449264 - DNA, 20 bp, mouse
gttcttgaagagggaggcca

SEQ ID NO: 449265 - DNA, 20 bp, mouse
gcccgtgtcggaggccccac

SEQ ID NO: 449266 - DNA, 20 bp, mouse
gtgccgccgcgcccttctct

SEQ ID NO: 449267 - DNA, 20 bp, mouse
ggaccggggaagctccgcag

SEQ ID NO: 449268 - DNA, 20 bp, mouse
gggaatcagacgcccagaga

SEQ ID NO: 449269 - DNA, 20 bp, mouse
gacgggcagccgcctgggcg

SEQ ID NO: 449270 - DNA, 20 bp, mouse
gtggtaagggccagcgaccg

SEQ ID NO: 449271 - DNA, 20 bp, mouse
ggggaacggaaagtcggaag

SEQ ID NO: 449272 - DNA, 20 bp, mouse
ggaagctccgcagcggaggt

SEQ ID NO: 449273 - DNA, 20 bp, mouse
gcactctgccgaggggccga

SEQ ID NO: 449274 - DNA, 20 bp, mouse
gcggcctgcagaccacccgg

SEQ ID NO: 449275 - DNA, 20 bp, mouse
gaggccctacacacccgggt

SEQ ID NO: 449276 - DNA, 20 bp, mouse
gagccgagccgagccggagt

SEQ ID NO: 449277 - DNA, 20 bp, mouse
gcggcgagcagcaaccatgt

SEQ ID NO: 449278 - DNA, 20 bp, mouse
gcggcctccggcgcccactc

SEQ ID NO: 449279 - DNA, 20 bp, mouse
ggccccatcagactctccac

SEQ ID NO: 449280 - DNA, 20 bp, mouse
ggaagaggcctgccagggta

SEQ ID NO: 449281 - DNA, 20 bp, mouse
gggagcggcaggccgggagt

SEQ ID NO: 449282 - DNA, 20 bp, mouse
gcggctcccgcgcccactcc

SEQ ID NO: 449283 - DNA, 20 bp, mouse
ggccagtggagagtctgatg

SEQ ID NO: 449284 - DNA, 20 bp, mouse
gccgctggatggcctcctgg

SEQ ID NO: 449285 - DNA, 20 bp, mouse
gctctccactggctctccta

SEQ ID NO: 449286 - DNA, 20 bp, mouse
ggctctgtcggctccgactg

SEQ ID NO: 449287 - DNA, 20 bp, mouse
ggagacaggtaagccacagt

SEQ ID NO: 449288 - DNA, 20 bp, mouse
gcggagccgacagagctcct

SEQ ID NO: 449289 - DNA, 20 bp, mouse
ggacgagcgtcccagcgctc

SEQ ID NO: 449290 - DNA, 20 bp, mouse
gccagggaagggctgagagt

SEQ ID NO: 449291 - DNA, 20 bp, mouse
gcaggccctggagatcaggt

SEQ ID NO: 449292 - DNA, 20 bp, mouse
gcctggagaaccgaatccag

SEQ ID NO: 449293 - DNA, 20 bp, mouse
ggtgagagacgcatgtcctg

SEQ ID NO: 449294 - DNA, 20 bp, mouse
gccaggaaatgcccaagagt

SEQ ID NO: 449295 - DNA, 20 bp, mouse
ggcaggtgacacccactctt

SEQ ID NO: 449296 - DNA, 20 bp, mouse
gtgcgaggaaacccaaacac

SEQ ID NO: 449297 - DNA, 20 bp, mouse
ggaggaaacccaaacactgg

SEQ ID NO: 449298 - DNA, 20 bp, mouse
gagtccgtcaagctaggtgg

SEQ ID NO: 449299 - DNA, 20 bp, mouse
gccgaagaatcggttcatct

SEQ ID NO: 449300 - DNA, 20 bp, mouse
gtgggcccgaaccaggaatg

SEQ ID NO: 449301 - DNA, 20 bp, mouse
ggtagtgacatagggtacgt

SEQ ID NO: 449302 - DNA, 20 bp, mouse
gttcggaaaagcgaaaccca

SEQ ID NO: 449303 - DNA, 20 bp, mouse
gaacggaagcgtagtcgctc

SEQ ID NO: 449304 - DNA, 20 bp, mouse
gaaccaaagcgaggaagaag

SEQ ID NO: 449305 - DNA, 20 bp, mouse
ggtggggatgaagaagactc

SEQ ID NO: 449306 - DNA, 20 bp, mouse
gtacggtggccgcagagcgg

SEQ ID NO: 449307 - DNA, 20 bp, mouse
ggagtacggtggccgcagag

SEQ ID NO: 449308 - DNA, 20 bp, mouse
gccgaacaggttgcccatgg

SEQ ID NO: 449309 - DNA, 20 bp, mouse
gtaggtcgggcggagtacgg

SEQ ID NO: 449310 - DNA, 20 bp, mouse
ggcggcggctgcgacgggtt

SEQ ID NO: 449311 - DNA, 20 bp, mouse
gcggccgaacaggttgccca

SEQ ID NO: 449312 - DNA, 20 bp, mouse
gccgtaggtcgggcggagta

SEQ ID NO: 449313 - DNA, 20 bp, mouse
gcggctgcgacgggttcggc

SEQ ID NO: 449314 - DNA, 20 bp, mouse
gctgcttcttgcggccgaac

SEQ ID NO: 449315 - DNA, 20 bp, mouse
gggctcggcccggaaagacc

SEQ ID NO: 449316 - DNA, 20 bp, mouse
gctcaggaagcagcactggg

SEQ ID NO: 449317 - DNA, 20 bp, mouse
gccctactcagatacccaga

SEQ ID NO: 449318 - DNA, 20 bp, mouse
gagcagcactgggtggtgag

SEQ ID NO: 449319 - DNA, 20 bp, mouse
gtggtctggctcaacgccaa

SEQ ID NO: 449320 - DNA, 20 bp, mouse
ggccttctgggtatctgagt

SEQ ID NO: 449321 - DNA, 20 bp, mouse
gtcactggtgccgagtgcca

SEQ ID NO: 449322 - DNA, 20 bp, mouse
gggtctgggcagtggaagac

SEQ ID NO: 449323 - DNA, 20 bp, mouse
gcttcctgagctctgtgggc

SEQ ID NO: 449324 - DNA, 20 bp, mouse
ggggcagtggaagactggtc

SEQ ID NO: 449325 - DNA, 20 bp, mouse
gcatcaggtgatgtccatag

SEQ ID NO: 449326 - DNA, 20 bp, mouse
gggaagccgagagggacctg

SEQ ID NO: 449327 - DNA, 20 bp, mouse
gcccgctccggggaccacat

SEQ ID NO: 449328 - DNA, 20 bp, mouse
gagagggacctggggcggaa

SEQ ID NO: 449329 - DNA, 20 bp, mouse
gcccgggccaggcttgtgtt

SEQ ID NO: 449330 - DNA, 20 bp, mouse
ggcggaaggggacccgggcc

SEQ ID NO: 449331 - DNA, 20 bp, mouse
gtcgcaggcgcaccacccct

SEQ ID NO: 449332 - DNA, 20 bp, mouse
gcggggctggggttccgatg

SEQ ID NO: 449333 - DNA, 20 bp, mouse
ggcctgggcctcccgctccg

SEQ ID NO: 449334 - DNA, 20 bp, mouse
gtgtgttcggttccttggcg

SEQ ID NO: 449335 - DNA, 20 bp, mouse
gcacagccgccgccaagggg

SEQ ID NO: 449336 - DNA, 20 bp, mouse
ggaccggccgggcggagcga

SEQ ID NO: 449337 - DNA, 20 bp, mouse
gcggccgggcggagcgacgg

SEQ ID NO: 449338 - DNA, 20 bp, mouse
gcgctctggcaagatggcgt

SEQ ID NO: 449339 - DNA, 20 bp, mouse
gcgctccaggagccccgaca

SEQ ID NO: 449340 - DNA, 20 bp, mouse
ggcgcgggcgggcggacctg

SEQ ID NO: 449341 - DNA, 20 bp, mouse
gtgaggcgcgaccggccggg

SEQ ID NO: 449342 - DNA, 20 bp, mouse
gggcagacggcacctcggcg

SEQ ID NO: 449343 - DNA, 20 bp, mouse
gcccatggcggcgacaggtg

SEQ ID NO: 449344 - DNA, 20 bp, mouse
ggcggcgcgctctggcaaga

SEQ ID NO: 449345 - DNA, 20 bp, mouse
gtggcgtcggcgaggtcgcg

SEQ ID NO: 449346 - DNA, 20 bp, mouse
gctggcggagcaggaagtac

SEQ ID NO: 449347 - DNA, 20 bp, mouse
gccgcgcggcccccagccca

SEQ ID NO: 449348 - DNA, 20 bp, mouse
gaagtacaggcagagtccgg

SEQ ID NO: 449349 - DNA, 20 bp, mouse
gagcccatggcaaagtcctg

SEQ ID NO: 449350 - DNA, 20 bp, mouse
gagcagccggccgagggcag

SEQ ID NO: 449351 - DNA, 20 bp, mouse
ggtcagtgccgggagccgaa

SEQ ID NO: 449352 - DNA, 20 bp, mouse
ggcggcagcgcgtcatctgg

SEQ ID NO: 449353 - DNA, 20 bp, mouse
ggaaggcgcagggaagctga

SEQ ID NO: 449354 - DNA, 20 bp, mouse
gtctcctagagcgggaggga

SEQ ID NO: 449355 - DNA, 20 bp, mouse
gggggacgcgcgggaagcac

SEQ ID NO: 449356 - DNA, 20 bp, mouse
gggactgagctggtgtgtcc

SEQ ID NO: 449357 - DNA, 20 bp, mouse
gctggagtgcaggacaccgt

SEQ ID NO: 449358 - DNA, 20 bp, mouse
ggagtgccgccagcgcagag

SEQ ID NO: 449359 - DNA, 20 bp, mouse
gtcaggtctctgtgttctaa

SEQ ID NO: 449360 - DNA, 20 bp, mouse
gtgctgttgaagccactacc

SEQ ID NO: 449361 - DNA, 20 bp, mouse
gggcagaaggtcctccctaa

SEQ ID NO: 449362 - DNA, 20 bp, mouse
ggctgctgcgctgggaagga

SEQ ID NO: 449363 - DNA, 20 bp, mouse
gtgcagcaggtgtccagtga

SEQ ID NO: 449364 - DNA, 20 bp, mouse
gaacagccgctctgcgctgg

SEQ ID NO: 449365 - DNA, 20 bp, mouse
gtgctggtgagagccaccgg

SEQ ID NO: 449366 - DNA, 20 bp, mouse
gggcttccggaagctagctg

SEQ ID NO: 449367 - DNA, 20 bp, mouse
gattcctgaagcagtaccgg

SEQ ID NO: 449368 - DNA, 20 bp, mouse
gggaggccaagggtccggag

SEQ ID NO: 449369 - DNA, 20 bp, mouse
gggccctgcgctcccagaga

SEQ ID NO: 449370 - DNA, 20 bp, mouse
ggcggcctgaacagtagtgc

SEQ ID NO: 449371 - DNA, 20 bp, mouse
ggtgaaggaggccaagggtc

SEQ ID NO: 449372 - DNA, 20 bp, mouse
gggcgaaatccacaccaccc

SEQ ID NO: 449373 - DNA, 20 bp, mouse
ggagagctgggaggctccgg

SEQ ID NO: 449374 - DNA, 20 bp, mouse
gttaggcccaggaatcacgg

SEQ ID NO: 449375 - DNA, 20 bp, mouse
gaagaggtgaagccaggtga

SEQ ID NO: 449376 - DNA, 20 bp, mouse
ggcagcagcggcagaaggga

SEQ ID NO: 449377 - DNA, 20 bp, mouse
gagaagcagcagcggcagaa

SEQ ID NO: 449378 - DNA, 20 bp, mouse
gcccggaggagctcccgtca

SEQ ID NO: 449379 - DNA, 20 bp, mouse
gaccgtgacgggagctcctc

SEQ ID NO: 449380 - DNA, 20 bp, mouse
gtcgctgagggcttgatctg

SEQ ID NO: 449381 - DNA, 20 bp, mouse
gcgagaccccatcaccgtga

SEQ ID NO: 449382 - DNA, 20 bp, mouse
gtcgtcccgcaataacgtgg

SEQ ID NO: 449383 - DNA, 20 bp, mouse
gcaccggaggaaccacatcc

SEQ ID NO: 449384 - DNA, 20 bp, mouse
gagctcccgtcacggtgatg

SEQ ID NO: 449385 - DNA, 20 bp, mouse
ggcccggggagagaaacaag

SEQ ID NO: 449386 - DNA, 20 bp, mouse
gtgagagcttcgtgagccca

SEQ ID NO: 449387 - DNA, 20 bp, mouse
gcctcctgtggctctgccat

SEQ ID NO: 449388 - DNA, 20 bp, mouse
gggctgctcgtctcctcctg

SEQ ID NO: 449389 - DNA, 20 bp, mouse
gagaggactcctggttcccc

SEQ ID NO: 449390 - DNA, 20 bp, mouse
gagaggaagcagaggactcc

SEQ ID NO: 449391 - DNA, 20 bp, mouse
gacgagcagccaggggaacc

SEQ ID NO: 449392 - DNA, 20 bp, mouse
ggcgcagcccagtagttcgt

SEQ ID NO: 449393 - DNA, 20 bp, mouse
gtgcccgcccacgaactact

SEQ ID NO: 449394 - DNA, 20 bp, mouse
gatcgcgctcattccagacg

SEQ ID NO: 449395 - DNA, 20 bp, mouse
gtcctcccgtccaaaaggcg

SEQ ID NO: 449396 - DNA, 20 bp, mouse
gcgcagtgctgctctaaggg

SEQ ID NO: 449397 - DNA, 20 bp, mouse
ggcgcgcagtgctgctctaa

SEQ ID NO: 449398 - DNA, 20 bp, mouse
gctccccgccgagcagaggt

SEQ ID NO: 449399 - DNA, 20 bp, mouse
ggctcaagcccggaatcccc

SEQ ID NO: 449400 - DNA, 20 bp, mouse
gtcggtgacacgtcggacag

SEQ ID NO: 449401 - DNA, 20 bp, mouse
gctggctgcgcgggatggta

SEQ ID NO: 449402 - DNA, 20 bp, mouse
gggccctgtcggtgacacgt

SEQ ID NO: 449403 - DNA, 20 bp, mouse
gcggctagaccccacctcgg

SEQ ID NO: 449404 - DNA, 20 bp, mouse
ggccgcctcgggctacgcgg

SEQ ID NO: 449405 - DNA, 20 bp, mouse
gccggaatccccgggcgggt

SEQ ID NO: 449406 - DNA, 20 bp, mouse
gcctcggcccgccacagggt

SEQ ID NO: 449407 - DNA, 20 bp, mouse
gcaggaacacccaagcccca

SEQ ID NO: 449408 - DNA, 20 bp, mouse
gctggcttgtgaggtggcag

SEQ ID NO: 449409 - DNA, 20 bp, mouse
gagctcctcggcccgccaca

SEQ ID NO: 449410 - DNA, 20 bp, mouse
gcgagggctggcttgtgagg

SEQ ID NO: 449411 - DNA, 20 bp, mouse
gggtggcagcggcagcaaag

SEQ ID NO: 449412 - DNA, 20 bp, mouse
gcagcggaagaggaagccga

SEQ ID NO: 449413 - DNA, 20 bp, mouse
ggtgccagcccccagaagaa

SEQ ID NO: 449414 - DNA, 20 bp, mouse
ggcagcaaagcggagctcct

SEQ ID NO: 449415 - DNA, 20 bp, mouse
gggtgggctcacccgcgagg

SEQ ID NO: 449416 - DNA, 20 bp, mouse
gggcggagagagccgagcga

SEQ ID NO: 449417 - DNA, 20 bp, mouse
ggctaagtgagtcccaccgg

SEQ ID NO: 449418 - DNA, 20 bp, mouse
ggctgctaagtgagtcccac

SEQ ID NO: 449419 - DNA, 20 bp, mouse
gtacagtcacggaggaggta

SEQ ID NO: 449420 - DNA, 20 bp, mouse
gaggtccagtaaagctgcag

SEQ ID NO: 449421 - DNA, 20 bp, mouse
ggaggagcaccgctacaccg

SEQ ID NO: 449422 - DNA, 20 bp, mouse
gtgcggggcccgccgcgacc

SEQ ID NO: 449423 - DNA, 20 bp, mouse
ggagcgagggcacagcgccc

SEQ ID NO: 449424 - DNA, 20 bp, mouse
ggcagctgcgcggcactgag

SEQ ID NO: 449425 - DNA, 20 bp, mouse
gtccagtaaagctgcagcgg

SEQ ID NO: 449426 - DNA, 20 bp, mouse
ggggccgcccgggacggacg

SEQ ID NO: 449427 - DNA, 20 bp, mouse
gggaaaagtgcggggaccag

SEQ ID NO: 449428 - DNA, 20 bp, mouse
gcggccgcgcgaagcatcac

SEQ ID NO: 449429 - DNA, 20 bp, mouse
gcatcacgggccgcccggga

SEQ ID NO: 449430 - DNA, 20 bp, mouse
gccgggacggacgcggaaga

SEQ ID NO: 449431 - DNA, 20 bp, mouse
gtgactcggatgcgggacag

SEQ ID NO: 449432 - DNA, 20 bp, mouse
gcgtgtgtgcggagcccgag

SEQ ID NO: 449433 - DNA, 20 bp, mouse
ggaagcatcacgggccgccc

SEQ ID NO: 449434 - DNA, 20 bp, mouse
gccgcacttttccttcccca

SEQ ID NO: 449435 - DNA, 20 bp, mouse
ggcgcagacgcaagagaaag

SEQ ID NO: 449436 - DNA, 20 bp, mouse
gcgggaggctcggcatgacg

SEQ ID NO: 449437 - DNA, 20 bp, mouse
gagcccgaggagcagccgcg

SEQ ID NO: 449438 - DNA, 20 bp, mouse
gcttcgcgcagcgggagggt

SEQ ID NO: 449439 - DNA, 20 bp, mouse
ggagcccggagcaggcatta

SEQ ID NO: 449440 - DNA, 20 bp, mouse
gctggcaagtctacatccac

SEQ ID NO: 449441 - DNA, 20 bp, mouse
gtccacagggagagggcccc

SEQ ID NO: 449442 - DNA, 20 bp, mouse
gtacctgccgctccccggac

SEQ ID NO: 449443 - DNA, 20 bp, mouse
gcaggtaggtgggctccagg

SEQ ID NO: 449444 - DNA, 20 bp, mouse
ggcccggggccctctccctg

SEQ ID NO: 449445 - DNA, 20 bp, mouse
gggcacgagcaaccggacag

SEQ ID NO: 449446 - DNA, 20 bp, mouse
gtgcgagccccagacctcgg

SEQ ID NO: 449447 - DNA, 20 bp, mouse
gacctgcgagccccagacct

SEQ ID NO: 449448 - DNA, 20 bp, mouse
gaccctgtgggaacgtccag

SEQ ID NO: 449449 - DNA, 20 bp, mouse
gggcgctcctccgaggtctg

SEQ ID NO: 449450 - DNA, 20 bp, mouse
gaggcactggttactgacct

SEQ ID NO: 449451 - DNA, 20 bp, mouse
ggtgcaagcgtggcagcagg

SEQ ID NO: 449452 - DNA, 20 bp, mouse
ggacctcggaggagcgcccc

SEQ ID NO: 449453 - DNA, 20 bp, mouse
gactatagaactggttggga

SEQ ID NO: 449454 - DNA, 20 bp, mouse
ggtctggggctcgcaggttg

SEQ ID NO: 449455 - DNA, 20 bp, mouse
gctcagagcttgtgcaagcg

SEQ ID NO: 449456 - DNA, 20 bp, mouse
ggcgcccgaggcgtgcacag

SEQ ID NO: 449457 - DNA, 20 bp, mouse
ggcgacaagaccctcggtgg

SEQ ID NO: 449458 - DNA, 20 bp, mouse
gggtggggcgacaagaccct

SEQ ID NO: 449459 - DNA, 20 bp, mouse
ggcgggtctggggcgcggtg

SEQ ID NO: 449460 - DNA, 20 bp, mouse
gggggcgacaagaccctcgg

SEQ ID NO: 449461 - DNA, 20 bp, mouse
gaccctcggtggcggcgcgg

SEQ ID NO: 449462 - DNA, 20 bp, mouse
gtcccccgcgccgccaccga

SEQ ID NO: 449463 - DNA, 20 bp, mouse
gagtcctcagaggaccaagt

SEQ ID NO: 449464 - DNA, 20 bp, mouse
gatgaagaggagccaaggac

SEQ ID NO: 449465 - DNA, 20 bp, mouse
gtgaggatgagaggacggtg

SEQ ID NO: 449466 - DNA, 20 bp, mouse
gccctctcgaggctcaaagt

SEQ ID NO: 449467 - DNA, 20 bp, mouse
ggtgccccccttgtccacaa

SEQ ID NO: 449468 - DNA, 20 bp, mouse
ggagaggcacagccagtgat

SEQ ID NO: 449469 - DNA, 20 bp, mouse
ggtgcccttgtggacaaggg

SEQ ID NO: 449470 - DNA, 20 bp, mouse
gacccactttgagcctcgag

SEQ ID NO: 449471 - DNA, 20 bp, mouse
gtggcacgccagccttgggg

SEQ ID NO: 449472 - DNA, 20 bp, mouse
gggtgggacatgccaatcac

SEQ ID NO: 449473 - DNA, 20 bp, mouse
ggagagagaaggcggataca

SEQ ID NO: 449474 - DNA, 20 bp, mouse
gttggacttttagctttcct

SEQ ID NO: 449475 - DNA, 20 bp, mouse
gctctccggctgccagcaca

SEQ ID NO: 449476 - DNA, 20 bp, mouse
ggctctgctgctacacacag

SEQ ID NO: 449477 - DNA, 20 bp, mouse
gaacacaaacgcacaaatag

SEQ ID NO: 449478 - DNA, 20 bp, mouse
gcccacttggaaatcgccag

SEQ ID NO: 449479 - DNA, 20 bp, mouse
gcccgggagcaggcacgcgg

SEQ ID NO: 449480 - DNA, 20 bp, mouse
gtgctacacacagcgggtga

SEQ ID NO: 449481 - DNA, 20 bp, mouse
gttcgattagctgcaatggg

SEQ ID NO: 449482 - DNA, 20 bp, mouse
ggggggtgtgatgctcaagg

SEQ ID NO: 449483 - DNA, 20 bp, mouse
gcgaaacagaaaggagacct

SEQ ID NO: 449484 - DNA, 20 bp, mouse
gggcgaggagaccagttccc

SEQ ID NO: 449485 - DNA, 20 bp, mouse
ggaagtagtaattagtgtct

SEQ ID NO: 449486 - DNA, 20 bp, mouse
gtgggtgcacagtccctcag

SEQ ID NO: 449487 - DNA, 20 bp, mouse
gagggcagccccgcctctga

SEQ ID NO: 449488 - DNA, 20 bp, mouse
gacccaggaagagctgatgt

SEQ ID NO: 449489 - DNA, 20 bp, mouse
gattgagagactgtccccaa

SEQ ID NO: 449490 - DNA, 20 bp, mouse
ggtgcacagtccctcagagg

SEQ ID NO: 449491 - DNA, 20 bp, mouse
gccccctagagggtcactgg

SEQ ID NO: 449492 - DNA, 20 bp, mouse
ggatggtgtggccccctaga

SEQ ID NO: 449493 - DNA, 20 bp, mouse
gtgcgcaggccaggcttaag

SEQ ID NO: 449494 - DNA, 20 bp, mouse
gacctccagtgaccctctag

SEQ ID NO: 449495 - DNA, 20 bp, mouse
ggactctctgacatagtctg

SEQ ID NO: 449496 - DNA, 20 bp, mouse
gggagctgcaggcgaagcag

SEQ ID NO: 449497 - DNA, 20 bp, mouse
ggaggccctgcgagtcggtg

SEQ ID NO: 449498 - DNA, 20 bp, mouse
ggcggggacagggtgccaag

SEQ ID NO: 449499 - DNA, 20 bp, mouse
ggggacagggtgccaagggg

SEQ ID NO: 449500 - DNA, 20 bp, mouse
gagccagaggccctgcgagt

SEQ ID NO: 449501 - DNA, 20 bp, mouse
gacctctggagaccttcagg

SEQ ID NO: 449502 - DNA, 20 bp, mouse
gggcggagagctcagagatg

SEQ ID NO: 449503 - DNA, 20 bp, mouse
ggctggcgccggacagacgg

SEQ ID NO: 449504 - DNA, 20 bp, mouse
gcagcgggtgagtaactccg

SEQ ID NO: 449505 - DNA, 20 bp, mouse
gtaactccgcggaatcgcgg

SEQ ID NO: 449506 - DNA, 20 bp, mouse
gttcttgagccaggatggaa

SEQ ID NO: 449507 - DNA, 20 bp, mouse
gtaagactccccttccatcc

SEQ ID NO: 449508 - DNA, 20 bp, mouse
gactggggtgccgttgacag

SEQ ID NO: 449509 - DNA, 20 bp, mouse
gacaatgaaaccactgtcaa

SEQ ID NO: 449510 - DNA, 20 bp, mouse
gagagagtagcgccaaacct

SEQ ID NO: 449511 - DNA, 20 bp, mouse
ggtcatcagactgaccacag

SEQ ID NO: 449512 - DNA, 20 bp, mouse
gtcagatttggtccaaggtt

SEQ ID NO: 449513 - DNA, 20 bp, mouse
gcagcgtcccatgaggatgt

SEQ ID NO: 449514 - DNA, 20 bp, mouse
ggtaatttcttgagccagga

SEQ ID NO: 449515 - DNA, 20 bp, mouse
gaagaaattacactcagatt

SEQ ID NO: 449516 - DNA, 20 bp, mouse
gaagccgctggcggccacag

SEQ ID NO: 449517 - DNA, 20 bp, mouse
ggaacagtcgagagctccat

SEQ ID NO: 449518 - DNA, 20 bp, mouse
gagccagggtggagtaggac

SEQ ID NO: 449519 - DNA, 20 bp, mouse
gcagcggcacccacagccca

SEQ ID NO: 449520 - DNA, 20 bp, mouse
gctgggacttaccggagcag

SEQ ID NO: 449521 - DNA, 20 bp, mouse
gcgagagctccatgggctgt

SEQ ID NO: 449522 - DNA, 20 bp, mouse
gccctaagccagggtggagt

SEQ ID NO: 449523 - DNA, 20 bp, mouse
ggtgccgctgtggccgccag

SEQ ID NO: 449524 - DNA, 20 bp, mouse
gacacagccacaccagccaa

SEQ ID NO: 449525 - DNA, 20 bp, mouse
gcaagctccctaagccaggg

SEQ ID NO: 449526 - DNA, 20 bp, mouse
ggctaccacagccagagggt

SEQ ID NO: 449527 - DNA, 20 bp, mouse
gttgctcagagcccaggtac

SEQ ID NO: 449528 - DNA, 20 bp, mouse
gctctcagcagaatagggcc

SEQ ID NO: 449529 - DNA, 20 bp, mouse
gcagggaatggattgaaggg

SEQ ID NO: 449530 - DNA, 20 bp, mouse
gcaatccattccctgtacct

SEQ ID NO: 449531 - DNA, 20 bp, mouse
ggggccaggaactcgtatca

SEQ ID NO: 449532 - DNA, 20 bp, mouse
ggtacagggaatggattgaa

SEQ ID NO: 449533 - DNA, 20 bp, mouse
gctagtcatatggaaaggga

SEQ ID NO: 449534 - DNA, 20 bp, mouse
ggggtttgaggtgctgtaag

SEQ ID NO: 449535 - DNA, 20 bp, mouse
gggccctgctggcacggatg

SEQ ID NO: 449536 - DNA, 20 bp, mouse
gacgcttgcagactctggat

SEQ ID NO: 449537 - DNA, 20 bp, mouse
gctcagagctgttaatgata

SEQ ID NO: 449538 - DNA, 20 bp, mouse
ggcagactctggatggggta

SEQ ID NO: 449539 - DNA, 20 bp, mouse
gggacagtgacagtttggag

SEQ ID NO: 449540 - DNA, 20 bp, mouse
ggggtcacttgggacagtgt

SEQ ID NO: 449541 - DNA, 20 bp, mouse
gacagtgtaggatagactaa

SEQ ID NO: 449542 - DNA, 20 bp, mouse
gagctgttaatgatatggcc

SEQ ID NO: 449543 - DNA, 20 bp, mouse
gcaagcgtgactttgagtcc

SEQ ID NO: 449544 - DNA, 20 bp, mouse
gtggactagagatagaacac

SEQ ID NO: 449545 - DNA, 20 bp, mouse
gggagacagcagcagctggt

SEQ ID NO: 449546 - DNA, 20 bp, mouse
gcaagtgcgcgggagctcgg

SEQ ID NO: 449547 - DNA, 20 bp, mouse
ggcccgagtgcacgaacccc

SEQ ID NO: 449548 - DNA, 20 bp, mouse
ggagtgcacgaaccccaggc

SEQ ID NO: 449549 - DNA, 20 bp, mouse
ggcatcagcatggacagcgg

SEQ ID NO: 449550 - DNA, 20 bp, mouse
ggagagcgcggggttcctcc

SEQ ID NO: 449551 - DNA, 20 bp, mouse
ggtgggtgcctagacttcta

SEQ ID NO: 449552 - DNA, 20 bp, mouse
gactcgggcgcgcaagtgcg

SEQ ID NO: 449553 - DNA, 20 bp, mouse
gtagcagcgcttgcctgcct

SEQ ID NO: 449554 - DNA, 20 bp, mouse
gaccagagccttagaagtct

SEQ ID NO: 449555 - DNA, 20 bp, mouse
ggtacaagcggggagcggtc

SEQ ID NO: 449556 - DNA, 20 bp, mouse
gggcgggagctcgaggttgt

SEQ ID NO: 449557 - DNA, 20 bp, mouse
gctcgtcccgcggggtgcgg

SEQ ID NO: 449558 - DNA, 20 bp, mouse
ggcggcggggcgggagctcg

SEQ ID NO: 449559 - DNA, 20 bp, mouse
gtggaggctgcaggtccggg

SEQ ID NO: 449560 - DNA, 20 bp, mouse
gggctccgcagctcgtcccg

SEQ ID NO: 449561 - DNA, 20 bp, mouse
gcagctcgtcccgcggggtg

SEQ ID NO: 449562 - DNA, 20 bp, mouse
ggacgagcggccgcgacacg

SEQ ID NO: 449563 - DNA, 20 bp, mouse
ggtgcgcgcgggtctcggag

SEQ ID NO: 449564 - DNA, 20 bp, mouse
gagcccggtttggggacgag

SEQ ID NO: 449565 - DNA, 20 bp, mouse
gcgagctgcggagcccggtt

SEQ ID NO: 449566 - DNA, 20 bp, mouse
ggcagaagctgaagagcgag

SEQ ID NO: 449567 - DNA, 20 bp, mouse
gttccaccgagtggtaaggt

SEQ ID NO: 449568 - DNA, 20 bp, mouse
ggaaggcccgcggagctcga

SEQ ID NO: 449569 - DNA, 20 bp, mouse
gggccttccaccgagtggta

SEQ ID NO: 449570 - DNA, 20 bp, mouse
gagaaacgagcggatttcgg

SEQ ID NO: 449571 - DNA, 20 bp, mouse
gctgaagagcgagcggcgag

SEQ ID NO: 449572 - DNA, 20 bp, mouse
gtactccgggccctgaggga

SEQ ID NO: 449573 - DNA, 20 bp, mouse
ggcggcttccgagaaacgag

SEQ ID NO: 449574 - DNA, 20 bp, mouse
gccgcgggccttccaccgag

SEQ ID NO: 449575 - DNA, 20 bp, mouse
gggcccgcggagctcgaggg

SEQ ID NO: 449576 - DNA, 20 bp, mouse
ggaaagccccgggaagctcc

SEQ ID NO: 449577 - DNA, 20 bp, mouse
gttccctgcacagaggtcta

SEQ ID NO: 449578 - DNA, 20 bp, mouse
gcttctgtgaagtgaaaaca

SEQ ID NO: 449579 - DNA, 20 bp, mouse
gcaggctgaaacagatgtga

SEQ ID NO: 449580 - DNA, 20 bp, mouse
gccagccgagtgaagcagca

SEQ ID NO: 449581 - DNA, 20 bp, mouse
gtagaggactttaattagtt

SEQ ID NO: 449582 - DNA, 20 bp, mouse
gatcagatattgaaagcccc

SEQ ID NO: 449583 - DNA, 20 bp, mouse
gcacagaggtctagggtgac

SEQ ID NO: 449584 - DNA, 20 bp, mouse
gcagccctccgtgtagaaat

SEQ ID NO: 449585 - DNA, 20 bp, mouse
ggaaacagatgtgaagggca

SEQ ID NO: 449586 - DNA, 20 bp, mouse
gcccggcggacggcgggaca

SEQ ID NO: 449587 - DNA, 20 bp, mouse
gacatgtgcggccggcgggg

SEQ ID NO: 449588 - DNA, 20 bp, mouse
gaggctcagggagaagtaca

SEQ ID NO: 449589 - DNA, 20 bp, mouse
ggctgctccggcgacatgtg

SEQ ID NO: 449590 - DNA, 20 bp, mouse
gagcggcagctcggccccgg

SEQ ID NO: 449591 - DNA, 20 bp, mouse
ggcagctcggccccggcgga

SEQ ID NO: 449592 - DNA, 20 bp, mouse
gcgggacacggcggctgctc

SEQ ID NO: 449593 - DNA, 20 bp, mouse
gcgccggccgcacatgtcgc

SEQ ID NO: 449594 - DNA, 20 bp, mouse
ggctcggccccggcggacgg

SEQ ID NO: 449595 - DNA, 20 bp, mouse
gcggccggcggggaggcatc

SEQ ID NO: 449596 - DNA, 20 bp, mouse
gcagagggtgccgaatccaa

SEQ ID NO: 449597 - DNA, 20 bp, mouse
gaatgctgctagaaaggcag

SEQ ID NO: 449598 - DNA, 20 bp, mouse
gaaaggcaggggtggtccct

SEQ ID NO: 449599 - DNA, 20 bp, mouse
gccaagggaagccgaatgac

SEQ ID NO: 449600 - DNA, 20 bp, mouse
gggagacgcagctgacaccc

SEQ ID NO: 449601 - DNA, 20 bp, mouse
ggcagcatttggaggcggag

SEQ ID NO: 449602 - DNA, 20 bp, mouse
gtgatttggcttgaaggcag

SEQ ID NO: 449603 - DNA, 20 bp, mouse
gtctcagcttaccagagggg

SEQ ID NO: 449604 - DNA, 20 bp, mouse
gttgctgcttctggaatcaa

SEQ ID NO: 449605 - DNA, 20 bp, mouse
gcacagtctcagcttaccag

SEQ ID NO: 449606 - DNA, 20 bp, mouse
gggcagggccatggccttag

SEQ ID NO: 449607 - DNA, 20 bp, mouse
gagcagcgcccctaaggcca

SEQ ID NO: 449608 - DNA, 20 bp, mouse
gagcagaagcagcgccccta

SEQ ID NO: 449609 - DNA, 20 bp, mouse
gtcactgagcgaaagaggca

SEQ ID NO: 449610 - DNA, 20 bp, mouse
gggcgctgcttctgcttcta

SEQ ID NO: 449611 - DNA, 20 bp, mouse
gacccaaactgacttacctg

SEQ ID NO: 449612 - DNA, 20 bp, mouse
gaaacttcactgagcgaaag

SEQ ID NO: 449613 - DNA, 20 bp, mouse
gtctgcttctaggggtactc

SEQ ID NO: 449614 - DNA, 20 bp, mouse
ggctgggcaggaccgactgg

SEQ ID NO: 449615 - DNA, 20 bp, mouse
gctcaccgagctatcatagt

SEQ ID NO: 449616 - DNA, 20 bp, mouse
gacacaagtggaactactag

SEQ ID NO: 449617 - DNA, 20 bp, mouse
gtggaacgagggggaggtcc

SEQ ID NO: 449618 - DNA, 20 bp, mouse
ggcggcagttcctggaacga

SEQ ID NO: 449619 - DNA, 20 bp, mouse
gccgggaccggcaagaagcc

SEQ ID NO: 449620 - DNA, 20 bp, mouse
gcggtcccggctgctcttct

SEQ ID NO: 449621 - DNA, 20 bp, mouse
gctcttctagggaacacaag

SEQ ID NO: 449622 - DNA, 20 bp, mouse
gcaagtggaactactagggg

SEQ ID NO: 449623 - DNA, 20 bp, mouse
ggcccggtgctccaactcta

SEQ ID NO: 449624 - DNA, 20 bp, mouse
gcggagcctcgctgacacaa

SEQ ID NO: 449625 - DNA, 20 bp, mouse
gggctgaagtgcccactgcg

SEQ ID NO: 449626 - DNA, 20 bp, mouse
ggagcctcgatgcaacccaa

SEQ ID NO: 449627 - DNA, 20 bp, mouse
gagctggtcacgatcccctt

SEQ ID NO: 449628 - DNA, 20 bp, mouse
ggagagccaagaagacccgt

SEQ ID NO: 449629 - DNA, 20 bp, mouse
gatccccttgggttgcatcg

SEQ ID NO: 449630 - DNA, 20 bp, mouse
ggtcacaagtcacctcccgt

SEQ ID NO: 449631 - DNA, 20 bp, mouse
ggtgatcttacctgagagag

SEQ ID NO: 449632 - DNA, 20 bp, mouse
gaaaaacccacaccgacggg

SEQ ID NO: 449633 - DNA, 20 bp, mouse
ggtcatgacaggcttcctac

SEQ ID NO: 449634 - DNA, 20 bp, mouse
gggcttcctacgggtcttct

SEQ ID NO: 449635 - DNA, 20 bp, mouse
gttaaaaaacccacaccgac

SEQ ID NO: 449636 - DNA, 20 bp, mouse
gtagtgcgtggcactcggga

SEQ ID NO: 449637 - DNA, 20 bp, mouse
gacagagagacgaggagcag

SEQ ID NO: 449638 - DNA, 20 bp, mouse
ggctgccggtcaccccacaa

SEQ ID NO: 449639 - DNA, 20 bp, mouse
gtcaggagccgggtagtgcg

SEQ ID NO: 449640 - DNA, 20 bp, mouse
gtgcgtggcactcgggaggg

SEQ ID NO: 449641 - DNA, 20 bp, mouse
gctgagtgtgagaaagtctc

SEQ ID NO: 449642 - DNA, 20 bp, mouse
gccgagtgccacgcactacc

SEQ ID NO: 449643 - DNA, 20 bp, mouse
gtgggacagacgctcactcg

SEQ ID NO: 449644 - DNA, 20 bp, mouse
gcccagagcagggtgtgtct

SEQ ID NO: 449645 - DNA, 20 bp, mouse
gcactcgcggttccattgtg

SEQ ID NO: 449646 - DNA, 20 bp, mouse
gagggcctgtgctcacactg

SEQ ID NO: 449647 - DNA, 20 bp, mouse
gccccacctctgactgacta

SEQ ID NO: 449648 - DNA, 20 bp, mouse
gtccttaccacacacaacaa

SEQ ID NO: 449649 - DNA, 20 bp, mouse
gaccctagtcagtcagaggt

SEQ ID NO: 449650 - DNA, 20 bp, mouse
gacaaaccctagtcagtcag

SEQ ID NO: 449651 - DNA, 20 bp, mouse
gggatgcctagggttagaaa

SEQ ID NO: 449652 - DNA, 20 bp, mouse
gcctaggcatcccaccctca

SEQ ID NO: 449653 - DNA, 20 bp, mouse
gtccacagccaacaggctga

SEQ ID NO: 449654 - DNA, 20 bp, mouse
gcatagaaggcccccaggaa

SEQ ID NO: 449655 - DNA, 20 bp, mouse
ggccagctgctccctgaggg

SEQ ID NO: 449656 - DNA, 20 bp, mouse
gaagcccgcttcccacccct

SEQ ID NO: 449657 - DNA, 20 bp, mouse
ggactcatgctacatcccct

SEQ ID NO: 449658 - DNA, 20 bp, mouse
gggctcgagcccaggagacg

SEQ ID NO: 449659 - DNA, 20 bp, mouse
gcttacctggcgcagccgag

SEQ ID NO: 449660 - DNA, 20 bp, mouse
ggcgccaggtaagcgctggt

SEQ ID NO: 449661 - DNA, 20 bp, mouse
ggggatgtagcatgagtcgt

SEQ ID NO: 449662 - DNA, 20 bp, mouse
gggcattctgctcagagcgg

SEQ ID NO: 449663 - DNA, 20 bp, mouse
gttggagaaagtactgccca

SEQ ID NO: 449664 - DNA, 20 bp, mouse
gtctccaaccagcgcttacc

SEQ ID NO: 449665 - DNA, 20 bp, mouse
gagggtcagaggcatcggca

SEQ ID NO: 449666 - DNA, 20 bp, mouse
gactgaggcaccatgcaagg

SEQ ID NO: 449667 - DNA, 20 bp, mouse
ggaggaggcacagagggata

SEQ ID NO: 449668 - DNA, 20 bp, mouse
ggcccctgcaacagaaggag

SEQ ID NO: 449669 - DNA, 20 bp, mouse
gcaagaggagctgaggtctc

SEQ ID NO: 449670 - DNA, 20 bp, mouse
gtactgtcctgctcttcact

SEQ ID NO: 449671 - DNA, 20 bp, mouse
gggtctctggcccccttgca

SEQ ID NO: 449672 - DNA, 20 bp, mouse
ggggataaggtggagactgg

SEQ ID NO: 449673 - DNA, 20 bp, mouse
gactagggatttgagacctg

SEQ ID NO: 449674 - DNA, 20 bp, mouse
gtctgcctgggtgaaatact

SEQ ID NO: 449675 - DNA, 20 bp, mouse
gctccctggtgagcaacagg

SEQ ID NO: 449676 - DNA, 20 bp, mouse
ggcaaggagggtactccgtg

SEQ ID NO: 449677 - DNA, 20 bp, mouse
gtgactccgagacgcaagga

SEQ ID NO: 449678 - DNA, 20 bp, mouse
gaggacagcagcagcctcgg

SEQ ID NO: 449679 - DNA, 20 bp, mouse
ggtctcggagtcaaaagcag

SEQ ID NO: 449680 - DNA, 20 bp, mouse
gtcagcgccgagctagcggg

SEQ ID NO: 449681 - DNA, 20 bp, mouse
ggagtaccctccttgcgtct

SEQ ID NO: 449682 - DNA, 20 bp, mouse
gagacccggccgatacctgg

SEQ ID NO: 449683 - DNA, 20 bp, mouse
gctagagtcaggctctccgg

SEQ ID NO: 449684 - DNA, 20 bp, mouse
ggcagcagaacaggagcccc

SEQ ID NO: 449685 - DNA, 20 bp, mouse
gtgctgtcctccggagactg

SEQ ID NO: 449686 - DNA, 20 bp, mouse
gccaggcccacactcccggg

SEQ ID NO: 449687 - DNA, 20 bp, mouse
gactcccgggcggcagtggg

SEQ ID NO: 449688 - DNA, 20 bp, mouse
gcactgccgcccgggagtgt

SEQ ID NO: 449689 - DNA, 20 bp, mouse
gggcgacgacgcgcaggacc

SEQ ID NO: 449690 - DNA, 20 bp, mouse
ggtgcagccacgccggaagg

SEQ ID NO: 449691 - DNA, 20 bp, mouse
gggcccgagcagagcgccag

SEQ ID NO: 449692 - DNA, 20 bp, mouse
gcgggcgcgtgcgagcttcg

SEQ ID NO: 449693 - DNA, 20 bp, mouse
gcgcgcgtgcacagcggtgg

SEQ ID NO: 449694 - DNA, 20 bp, mouse
gtgccgggtagacagaaggg

SEQ ID NO: 449695 - DNA, 20 bp, mouse
gtgcaggggtgcagccacgc

SEQ ID NO: 449696 - DNA, 20 bp, mouse
gcagtgatctatatattcca

SEQ ID NO: 449697 - DNA, 20 bp, mouse
gagtagcttttggcgaggga

SEQ ID NO: 449698 - DNA, 20 bp, mouse
gggagcatcgagcagaggcg

SEQ ID NO: 449699 - DNA, 20 bp, mouse
ggcatcgagcagaggcgagg

SEQ ID NO: 449700 - DNA, 20 bp, mouse
gggcgccctcccctcgccgg

SEQ ID NO: 449701 - DNA, 20 bp, mouse
gcggccgcaggcgccagcag

SEQ ID NO: 449702 - DNA, 20 bp, mouse
gccggcccgtgaggaggcag

SEQ ID NO: 449703 - DNA, 20 bp, mouse
ggctcccgctagcttcaccg

SEQ ID NO: 449704 - DNA, 20 bp, mouse
ggccgccgctgcctcctcac

SEQ ID NO: 449705 - DNA, 20 bp, mouse
gagaggccagtgcacggcgg

SEQ ID NO: 449706 - DNA, 20 bp, mouse
gctgtggcgggcgctaggtg

SEQ ID NO: 449707 - DNA, 20 bp, mouse
gagcagagcgaggggtgcgt

SEQ ID NO: 449708 - DNA, 20 bp, mouse
gtagcgggaggaggcgattt

SEQ ID NO: 449709 - DNA, 20 bp, mouse
gcaggctcgagcagagcgag

SEQ ID NO: 449710 - DNA, 20 bp, mouse
ggcagggctgcacaagaaga

SEQ ID NO: 449711 - DNA, 20 bp, mouse
gttcgaacccgggaccacgt

SEQ ID NO: 449712 - DNA, 20 bp, mouse
gcagccagctggacagaact

SEQ ID NO: 449713 - DNA, 20 bp, mouse
ggtaggagtcccgagtccta

SEQ ID NO: 449714 - DNA, 20 bp, mouse
ggaaggtgcacgcttggcta

SEQ ID NO: 449715 - DNA, 20 bp, mouse
ggagtcccgagtcctagggt

SEQ ID NO: 449716 - DNA, 20 bp, mouse
gcgcgtgccaggcacagcat

SEQ ID NO: 449717 - DNA, 20 bp, mouse
ggacttgccaccaccggcaa

SEQ ID NO: 449718 - DNA, 20 bp, mouse
gcacccagacttgccaccac

SEQ ID NO: 449719 - DNA, 20 bp, mouse
gggcaagggccgcctgcaac

SEQ ID NO: 449720 - DNA, 20 bp, mouse
gtgcaggcggcccttgccgg

SEQ ID NO: 449721 - DNA, 20 bp, mouse
gaggcggcccttgccggtgg

SEQ ID NO: 449722 - DNA, 20 bp, mouse
gaccgggacgcagggcgcac

SEQ ID NO: 449723 - DNA, 20 bp, mouse
gggcatcgccagtggaagac

SEQ ID NO: 449724 - DNA, 20 bp, mouse
gtcccaccagcagctctaca

SEQ ID NO: 449725 - DNA, 20 bp, mouse
ggtggcaggcgacagtcatc

SEQ ID NO: 449726 - DNA, 20 bp, mouse
gtcgggaggggagggatagt

SEQ ID NO: 449727 - DNA, 20 bp, mouse
gtagtgggtggccagctccc

SEQ ID NO: 449728 - DNA, 20 bp, mouse
gaggggctggaggtctcggg

SEQ ID NO: 449729 - DNA, 20 bp, mouse
ggacctcgaggctgcagggg

SEQ ID NO: 449730 - DNA, 20 bp, mouse
gagctcccggggtgcaggca

SEQ ID NO: 449731 - DNA, 20 bp, mouse
gggggtgcaggcagggacca

SEQ ID NO: 449732 - DNA, 20 bp, mouse
ggcatggacggcagcagcag

SEQ ID NO: 449733 - DNA, 20 bp, mouse
gcagcgaacatcagcatgga

SEQ ID NO: 449734 - DNA, 20 bp, mouse
gcggggagagaagagcggcc

SEQ ID NO: 449735 - DNA, 20 bp, mouse
gagcggccgggcgggacatc

SEQ ID NO: 449736 - DNA, 20 bp, mouse
ggcctagcaccccgcaccca

SEQ ID NO: 449737 - DNA, 20 bp, mouse
gaccctgcgggaaggactac

SEQ ID NO: 449738 - DNA, 20 bp, mouse
gctgggagtccggaccgcca

SEQ ID NO: 449739 - DNA, 20 bp, mouse
gagtcaggttgacgcgccct

SEQ ID NO: 449740 - DNA, 20 bp, mouse
gaagctgcacacagccctgg

SEQ ID NO: 449741 - DNA, 20 bp, mouse
gagttgggctctgggtgact

SEQ ID NO: 449742 - DNA, 20 bp, mouse
ggcgaggaggcctgaccgag

SEQ ID NO: 449743 - DNA, 20 bp, mouse
gaacctgggcgaacccgcag

SEQ ID NO: 449744 - DNA, 20 bp, mouse
gctgcgggaaggactaccgg

SEQ ID NO: 449745 - DNA, 20 bp, mouse
gcgcggagtcggagctgcag

SEQ ID NO: 449746 - DNA, 20 bp, mouse
gtctgccctacgaggtcccg

SEQ ID NO: 449747 - DNA, 20 bp, mouse
gtctgcctcgggacctcgta

SEQ ID NO: 449748 - DNA, 20 bp, mouse
gcccgggcgccgctttagtg

SEQ ID NO: 449749 - DNA, 20 bp, mouse
gtcgggtagcagcatcctcc

SEQ ID NO: 449750 - DNA, 20 bp, mouse
gtgcaggcgcccggcgtagg

SEQ ID NO: 449751 - DNA, 20 bp, mouse
gcagcggcttctgccctacg

SEQ ID NO: 449752 - DNA, 20 bp, mouse
gcgcccgccaggacatcctc

SEQ ID NO: 449753 - DNA, 20 bp, mouse
gggcaggaggcgacagtggg

SEQ ID NO: 449754 - DNA, 20 bp, mouse
gcatcacccggaggatgtcc

SEQ ID NO: 449755 - DNA, 20 bp, mouse
gcccacccccgcgtcaccag

SEQ ID NO: 449756 - DNA, 20 bp, mouse
ggcgcgtgtggagtgaggtg

SEQ ID NO: 449757 - DNA, 20 bp, mouse
gcgggtgcgcgtgtggagtg

SEQ ID NO: 449758 - DNA, 20 bp, mouse
gacgcgcacccggcaacttg

SEQ ID NO: 449759 - DNA, 20 bp, mouse
gcctcttcgagaggccgggt

SEQ ID NO: 449760 - DNA, 20 bp, mouse
gcgatcccgctagcgaccgg

SEQ ID NO: 449761 - DNA, 20 bp, mouse
gagtctggaggagaggcgcg

SEQ ID NO: 449762 - DNA, 20 bp, mouse
gagccggcagctgcaacttt

SEQ ID NO: 449763 - DNA, 20 bp, mouse
gctagccgaggacgcagagt

SEQ ID NO: 449764 - DNA, 20 bp, mouse
gtggggacgctcggtgaagt

SEQ ID NO: 449765 - DNA, 20 bp, mouse
gggcctctcgaagaggatgg

SEQ ID NO: 449766 - DNA, 20 bp, mouse
gtgggccctgaggaagccta

SEQ ID NO: 449767 - DNA, 20 bp, mouse
gtcgtgatagctgctcccca

SEQ ID NO: 449768 - DNA, 20 bp, mouse
gggaattctcttcttacctt

SEQ ID NO: 449769 - DNA, 20 bp, mouse
gagggcccacaatgactgag

SEQ ID NO: 449770 - DNA, 20 bp, mouse
gcttaccttaggcttcctca

SEQ ID NO: 449771 - DNA, 20 bp, mouse
gtggatggtcagatatacta

SEQ ID NO: 449772 - DNA, 20 bp, mouse
gggaacactctggtcaccaa

SEQ ID NO: 449773 - DNA, 20 bp, mouse
gccaccagctccacccataa

SEQ ID NO: 449774 - DNA, 20 bp, mouse
ggaacgggagagaatctgga

SEQ ID NO: 449775 - DNA, 20 bp, mouse
gagggcattatcccagctac

SEQ ID NO: 449776 - DNA, 20 bp, mouse
ggcgcagcgcagaagcgcag

SEQ ID NO: 449777 - DNA, 20 bp, mouse
ggcgggcagcgcaggtagag

SEQ ID NO: 449778 - DNA, 20 bp, mouse
gcaaagagccgctcagtcgg

SEQ ID NO: 449779 - DNA, 20 bp, mouse
gcttctgcgctgcgcaccca

SEQ ID NO: 449780 - DNA, 20 bp, mouse
gatcggcccgggaatctaga

SEQ ID NO: 449781 - DNA, 20 bp, mouse
gaatctagagggcaccgatg

SEQ ID NO: 449782 - DNA, 20 bp, mouse
gagagccaccaccgactgag

SEQ ID NO: 449783 - DNA, 20 bp, mouse
gcccgtcccctcccccgtcc

SEQ ID NO: 449784 - DNA, 20 bp, mouse
ggtagagcggggccgggacg

SEQ ID NO: 449785 - DNA, 20 bp, mouse
gggacggggtgcctgctcca

SEQ ID NO: 449786 - DNA, 20 bp, mouse
ggccacagcgagcaggacaa

SEQ ID NO: 449787 - DNA, 20 bp, mouse
gcattgagggagacccgaag

SEQ ID NO: 449788 - DNA, 20 bp, mouse
gaatgttgggtggagcggag

SEQ ID NO: 449789 - DNA, 20 bp, mouse
gtcgggtctccctcaatgtt

SEQ ID NO: 449790 - DNA, 20 bp, mouse
gccgctccacccaacattga

SEQ ID NO: 449791 - DNA, 20 bp, mouse
gggtctccctcaatgttggg

SEQ ID NO: 449792 - DNA, 20 bp, mouse
gctgtagtggatacaccgcc

SEQ ID NO: 449793 - DNA, 20 bp, mouse
gggccggagccgaggacttt

SEQ ID NO: 449794 - DNA, 20 bp, mouse
ggagggagacccgaagaggc

SEQ ID NO: 449795 - DNA, 20 bp, mouse
gaaacccagcccaaagtcct

SEQ ID NO: 449796 - DNA, 20 bp, mouse
ggcgcgtgagccggatccgg

SEQ ID NO: 449797 - DNA, 20 bp, mouse
ggggaagagacaggaccggg

SEQ ID NO: 449798 - DNA, 20 bp, mouse
gcgcggggaagagacaggac

SEQ ID NO: 449799 - DNA, 20 bp, mouse
gggcaccgcggggaagagac

SEQ ID NO: 449800 - DNA, 20 bp, mouse
gggcggtggcggcagagaca

SEQ ID NO: 449801 - DNA, 20 bp, mouse
gtcttccctccggagctctt

SEQ ID NO: 449802 - DNA, 20 bp, mouse
gagtccggcggggttctcgg

SEQ ID NO: 449803 - DNA, 20 bp, mouse
gaagagacaggaccgggcgg

SEQ ID NO: 449804 - DNA, 20 bp, mouse
ggcttcccaagagctccgga

SEQ ID NO: 449805 - DNA, 20 bp, mouse
gacttcgctgggagccttcc

SEQ ID NO: 449806 - DNA, 20 bp, mouse
ggtaaacgctctactcctgt

SEQ ID NO: 449807 - DNA, 20 bp, mouse
gtggatgggcagatcagaga

SEQ ID NO: 449808 - DNA, 20 bp, mouse
gtgtcttggtgcacatggat

SEQ ID NO: 449809 - DNA, 20 bp, mouse
gcctgctgtttgggacagca

SEQ ID NO: 449810 - DNA, 20 bp, mouse
gatgctgctgtgacgttgat

SEQ ID NO: 449811 - DNA, 20 bp, mouse
gagcaatcgtggttaataga

SEQ ID NO: 449812 - DNA, 20 bp, mouse
gagcagcatatgtaatacca

SEQ ID NO: 449813 - DNA, 20 bp, mouse
gtaataccaaggagcaatcg

SEQ ID NO: 449814 - DNA, 20 bp, mouse
gactagagctttgcagtctt

SEQ ID NO: 449815 - DNA, 20 bp, mouse
ggatctgggtatttgagtta

SEQ ID NO: 449816 - DNA, 20 bp, mouse
ggcgcggtgcgtgacgtgag

SEQ ID NO: 449817 - DNA, 20 bp, mouse
gtctgcagctgcacatcctc

SEQ ID NO: 449818 - DNA, 20 bp, mouse
gcgcagggcaccgagagggc

SEQ ID NO: 449819 - DNA, 20 bp, mouse
gcagctgcagaggcggcgca

SEQ ID NO: 449820 - DNA, 20 bp, mouse
ggtgaggggctcctttgcaa

SEQ ID NO: 449821 - DNA, 20 bp, mouse
gctccggcgcgaggcgacag

SEQ ID NO: 449822 - DNA, 20 bp, mouse
gttaaaggcgcaggccgcgg

SEQ ID NO: 449823 - DNA, 20 bp, mouse
gttaagaagcggcccgccgg

SEQ ID NO: 449824 - DNA, 20 bp, mouse
gcggcctgcgcctttaagag

SEQ ID NO: 449825 - DNA, 20 bp, mouse
ggggcccgccgcgcccatcg

SEQ ID NO: 449826 - DNA, 20 bp, mouse
gagggtcgggagtgaaactt

SEQ ID NO: 449827 - DNA, 20 bp, mouse
ggggagtgaaacttcggcag

SEQ ID NO: 449828 - DNA, 20 bp, mouse
gcagggtggcagccgagaag

SEQ ID NO: 449829 - DNA, 20 bp, mouse
gcctcctgcagctcctctcg

SEQ ID NO: 449830 - DNA, 20 bp, mouse
ggagcgcacggccatcgtag

SEQ ID NO: 449831 - DNA, 20 bp, mouse
ggggcgcggagacccagccg

SEQ ID NO: 449832 - DNA, 20 bp, mouse
ggctgcagctccgggcgagg

SEQ ID NO: 449833 - DNA, 20 bp, mouse
gaccaggcgcgcctgtgaca

SEQ ID NO: 449834 - DNA, 20 bp, mouse
ggcgctgtcgcgggtcccct

SEQ ID NO: 449835 - DNA, 20 bp, mouse
gtgccacgctcacccatggg

SEQ ID NO: 449836 - DNA, 20 bp, mouse
ggcggcgcgggaagttctga

SEQ ID NO: 449837 - DNA, 20 bp, mouse
gggctccatggaagactacg

SEQ ID NO: 449838 - DNA, 20 bp, mouse
gagctgtgggagttgtggtc

SEQ ID NO: 449839 - DNA, 20 bp, mouse
gtcttcctcgtagtcttcca

SEQ ID NO: 449840 - DNA, 20 bp, mouse
gactacgaggaagatctgta

SEQ ID NO: 449841 - DNA, 20 bp, mouse
gctctgagctgtgggagttg

SEQ ID NO: 449842 - DNA, 20 bp, mouse
ggaggaagatctgtatggtg

SEQ ID NO: 449843 - DNA, 20 bp, mouse
gtgcagcatggagagctgtg

SEQ ID NO: 449844 - DNA, 20 bp, mouse
gagagctgtgtggatgggat

SEQ ID NO: 449845 - DNA, 20 bp, mouse
gtctgtctcagcaggaacac

SEQ ID NO: 449846 - DNA, 20 bp, mouse
ggcgcaggcaatgctcgcgg

SEQ ID NO: 449847 - DNA, 20 bp, mouse
gagtgcgcaggcaatgctcg

SEQ ID NO: 449848 - DNA, 20 bp, mouse
gccgtcccggaagtactccg

SEQ ID NO: 449849 - DNA, 20 bp, mouse
ggcgacggcggcgggaggtt

SEQ ID NO: 449850 - DNA, 20 bp, mouse
ggctgggcccgggagagtga

SEQ ID NO: 449851 - DNA, 20 bp, mouse
gagaagaatggcgagcggag

SEQ ID NO: 449852 - DNA, 20 bp, mouse
gcccgcggcctgacctgcaa

SEQ ID NO: 449853 - DNA, 20 bp, mouse
gcaggcaatgctcgcggcgg

SEQ ID NO: 449854 - DNA, 20 bp, mouse
ggagtgggagaagggcggaa

SEQ ID NO: 449855 - DNA, 20 bp, mouse
gagggagcgagggagtcggg

SEQ ID NO: 449856 - DNA, 20 bp, mouse
ggctgcactggtgggcccgg

SEQ ID NO: 449857 - DNA, 20 bp, mouse
gccggtcacgctgcactggt

SEQ ID NO: 449858 - DNA, 20 bp, mouse
gcccgccgtcagctcaggtt

SEQ ID NO: 449859 - DNA, 20 bp, mouse
gaccgggctgaggtgcgcag

SEQ ID NO: 449860 - DNA, 20 bp, mouse
gtgggtggcaggtgtggacc

SEQ ID NO: 449861 - DNA, 20 bp, mouse
gttagccggtcacgctgcac

SEQ ID NO: 449862 - DNA, 20 bp, mouse
gcccggcggccattttgttt

SEQ ID NO: 449863 - DNA, 20 bp, mouse
gcgctggcgtccatctcctt

SEQ ID NO: 449864 - DNA, 20 bp, mouse
gagcggcccgccgtcagctc

SEQ ID NO: 449865 - DNA, 20 bp, mouse
gctggtggtgctggtcgtag

SEQ ID NO: 449866 - DNA, 20 bp, mouse
gcccggaaccggccttagac

SEQ ID NO: 449867 - DNA, 20 bp, mouse
gggaaccggccttagaccgg

SEQ ID NO: 449868 - DNA, 20 bp, mouse
gcgggagcgccagccgcctc

SEQ ID NO: 449869 - DNA, 20 bp, mouse
gacgcagtctcgcgagacgg

SEQ ID NO: 449870 - DNA, 20 bp, mouse
gccggcggcgttgcctgagg

SEQ ID NO: 449871 - DNA, 20 bp, mouse
gaggcaacgccgccggtcta

SEQ ID NO: 449872 - DNA, 20 bp, mouse
gagcctcggcggcccggaac

SEQ ID NO: 449873 - DNA, 20 bp, mouse
gccccgggggccgctccatg

SEQ ID NO: 449874 - DNA, 20 bp, mouse
gaggactccgcaagcctcgg

SEQ ID NO: 449875 - DNA, 20 bp, mouse
gcgggggccgctccatgggg

SEQ ID NO: 449876 - DNA, 20 bp, mouse
gcccaatcgggtgagcaagt

SEQ ID NO: 449877 - DNA, 20 bp, mouse
ggaccccagcgacacccgga

SEQ ID NO: 449878 - DNA, 20 bp, mouse
ggagaaggagtaccccaatc

SEQ ID NO: 449879 - DNA, 20 bp, mouse
ggaacgaccccagcgacacc

SEQ ID NO: 449880 - DNA, 20 bp, mouse
gaactgcgtgacgatgtgtg

SEQ ID NO: 449881 - DNA, 20 bp, mouse
gagccaccagagggaacctg

SEQ ID NO: 449882 - DNA, 20 bp, mouse
gcgccttccgggtgtcgctg

SEQ ID NO: 449883 - DNA, 20 bp, mouse
ggatcgcgtcagggcctcag

SEQ ID NO: 449884 - DNA, 20 bp, mouse
gggccgcaggttccctctgg

SEQ ID NO: 449885 - DNA, 20 bp, mouse
gccccagcaacagaaccgga

SEQ ID NO: 449886 - DNA, 20 bp, mouse
ggcgggcacgtcaattccta

SEQ ID NO: 449887 - DNA, 20 bp, mouse
ggcagaagctgtacatctga

SEQ ID NO: 449888 - DNA, 20 bp, mouse
gtgtacatctgacggtctca

SEQ ID NO: 449889 - DNA, 20 bp, mouse
gggtcacgcggcgtcaacag

SEQ ID NO: 449890 - DNA, 20 bp, mouse
gagtgtgccagcgtcaacag

SEQ ID NO: 449891 - DNA, 20 bp, mouse
ggcaacgcgccaaacgcgct

SEQ ID NO: 449892 - DNA, 20 bp, mouse
gagccaacagggtccccgag

SEQ ID NO: 449893 - DNA, 20 bp, mouse
gcctccgcaggaagccaaca

SEQ ID NO: 449894 - DNA, 20 bp, mouse
gcctggcctggaacccctcg

SEQ ID NO: 449895 - DNA, 20 bp, mouse
gccaagccaggccttaccct

SEQ ID NO: 449896 - DNA, 20 bp, mouse
gtcaggctacgaggaaggtg

SEQ ID NO: 449897 - DNA, 20 bp, mouse
gaggaaggtgaggacgctcg

SEQ ID NO: 449898 - DNA, 20 bp, mouse
gaccagagtggcccctagga

SEQ ID NO: 449899 - DNA, 20 bp, mouse
ggaagccgaagcgagagcac

SEQ ID NO: 449900 - DNA, 20 bp, mouse
gggtcgctcgagcatctgag

SEQ ID NO: 449901 - DNA, 20 bp, mouse
gccccaaggggtgacaatga

SEQ ID NO: 449902 - DNA, 20 bp, mouse
gggagaccagagtggcccct

SEQ ID NO: 449903 - DNA, 20 bp, mouse
gagagaccaggacgagaagc

SEQ ID NO: 449904 - DNA, 20 bp, mouse
ggaagccggcgtccgcggag

SEQ ID NO: 449905 - DNA, 20 bp, mouse
gatcgctagggaccacaccc

SEQ ID NO: 449906 - DNA, 20 bp, mouse
gccgcggcgatgggaggttc

SEQ ID NO: 449907 - DNA, 20 bp, mouse
gcgcgcaccgcggcgatggg

SEQ ID NO: 449908 - DNA, 20 bp, mouse
gccggcgtcccggggagagt

SEQ ID NO: 449909 - DNA, 20 bp, mouse
gtcgggcagtcgcctgtcta

SEQ ID NO: 449910 - DNA, 20 bp, mouse
ggggtcagggcagcactcac

SEQ ID NO: 449911 - DNA, 20 bp, mouse
gcagctaggccaactctccc

SEQ ID NO: 449912 - DNA, 20 bp, mouse
gagttggaggaccggggtca

SEQ ID NO: 449913 - DNA, 20 bp, mouse
gcctagctgtgcgcgcaccg

SEQ ID NO: 449914 - DNA, 20 bp, mouse
ggaaaggcaaatccagacaa

SEQ ID NO: 449915 - DNA, 20 bp, mouse
ggccccgcgcacctggtact

SEQ ID NO: 449916 - DNA, 20 bp, mouse
gactgaactgcgggacccag

SEQ ID NO: 449917 - DNA, 20 bp, mouse
gcgctgcgcgctgaaggtag

SEQ ID NO: 449918 - DNA, 20 bp, mouse
ggagtgctgcttcccatcgg

SEQ ID NO: 449919 - DNA, 20 bp, mouse
ggagcagctggacaactacc

SEQ ID NO: 449920 - DNA, 20 bp, mouse
gtgggaagcagcactcgaaa

SEQ ID NO: 449921 - DNA, 20 bp, mouse
gactgcgggacccagcggag

SEQ ID NO: 449922 - DNA, 20 bp, mouse
gacaaaaaggaggactacag

SEQ ID NO: 449923 - DNA, 20 bp, mouse
gtcccgggcctgggaaactg

SEQ ID NO: 449924 - DNA, 20 bp, mouse
gttcagtgggaggggtgcag

SEQ ID NO: 449925 - DNA, 20 bp, mouse
gcccttgccagcccgggagc

SEQ ID NO: 449926 - DNA, 20 bp, mouse
gaagaaagtacagtcctgtg

SEQ ID NO: 449927 - DNA, 20 bp, mouse
ggatgacccagaggcaggtc

SEQ ID NO: 449928 - DNA, 20 bp, mouse
gcagaggtaatgttgaggtt

SEQ ID NO: 449929 - DNA, 20 bp, mouse
gtcagtgggggaatgaaggg

SEQ ID NO: 449930 - DNA, 20 bp, mouse
gaggtcagtgggggaatgaa

SEQ ID NO: 449931 - DNA, 20 bp, mouse
gcacgaggaaggagatcatg

SEQ ID NO: 449932 - DNA, 20 bp, mouse
gggactgtactttcttcacg

SEQ ID NO: 449933 - DNA, 20 bp, mouse
gaggagatcatgaggtcagt

SEQ ID NO: 449934 - DNA, 20 bp, mouse
ggtaatgttgaggttaggct

SEQ ID NO: 449935 - DNA, 20 bp, mouse
gtgtactttcttcacgagga

SEQ ID NO: 449936 - DNA, 20 bp, mouse
gaggaggctggtttagcatg

SEQ ID NO: 449937 - DNA, 20 bp, mouse
gcaggagggatagagagtag

SEQ ID NO: 449938 - DNA, 20 bp, mouse
gaagttctactgctggcagg

SEQ ID NO: 449939 - DNA, 20 bp, mouse
gcagaagttctactgctggc

SEQ ID NO: 449940 - DNA, 20 bp, mouse
gggggcagaagttctactgc

SEQ ID NO: 449941 - DNA, 20 bp, mouse
ggaggacctggaagagtacc

SEQ ID NO: 449942 - DNA, 20 bp, mouse
gttaaggtaccagatgcagt

SEQ ID NO: 449943 - DNA, 20 bp, mouse
gaggagctcttgcctgatca

SEQ ID NO: 449944 - DNA, 20 bp, mouse
gacctggaagagtaccaggt

SEQ ID NO: 449945 - DNA, 20 bp, mouse
gacccacctggtactcttcc

SEQ ID NO: 449946 - DNA, 20 bp, mouse
gcggctgtagcggcacgagg

SEQ ID NO: 449947 - DNA, 20 bp, mouse
gcgcctcagcgaggagccac

SEQ ID NO: 449948 - DNA, 20 bp, mouse
gctcgctgaggcggctgtag

SEQ ID NO: 449949 - DNA, 20 bp, mouse
ggacgccagagccagcaatc

SEQ ID NO: 449950 - DNA, 20 bp, mouse
gctggctctggcgtcgccag

SEQ ID NO: 449951 - DNA, 20 bp, mouse
gcagcaatccgggtgagtcg

SEQ ID NO: 449952 - DNA, 20 bp, mouse
gcccagggccccgactcacc

SEQ ID NO: 449953 - DNA, 20 bp, mouse
gtcacccggattgctggctc

SEQ ID NO: 449954 - DNA, 20 bp, mouse
gctgtagcggcacgaggggg

SEQ ID NO: 449955 - DNA, 20 bp, mouse
gtgggaacatcttagaccca

SEQ ID NO: 449956 - DNA, 20 bp, mouse
gctccggccaccccacgcgg

SEQ ID NO: 449957 - DNA, 20 bp, mouse
gcgccagacgcgggtatcag

SEQ ID NO: 449958 - DNA, 20 bp, mouse
gagcagcgggaacccgacag

SEQ ID NO: 449959 - DNA, 20 bp, mouse
gcggcggagacccccgcgtg

SEQ ID NO: 449960 - DNA, 20 bp, mouse
gaacatgccgaggccacgag

SEQ ID NO: 449961 - DNA, 20 bp, mouse
gcccctccggccaccccacg

SEQ ID NO: 449962 - DNA, 20 bp, mouse
gtttgcgcaggcgcgcccgg

SEQ ID NO: 449963 - DNA, 20 bp, mouse
ggagaggccgcgccagacgc

SEQ ID NO: 449964 - DNA, 20 bp, mouse
gggaggtgcgatcccctgtc

SEQ ID NO: 449965 - DNA, 20 bp, mouse
gggcaggcggcgctttgcgc

SEQ ID NO: 449966 - DNA, 20 bp, mouse
gagaccgccagggactacgc

SEQ ID NO: 449967 - DNA, 20 bp, mouse
gcccagggagcagagacccg

SEQ ID NO: 449968 - DNA, 20 bp, mouse
gctacgcgggagccctcatc

SEQ ID NO: 449969 - DNA, 20 bp, mouse
ggtcggcactcgcctgatga

SEQ ID NO: 449970 - DNA, 20 bp, mouse
ggctcccgcgtagtccctgg

SEQ ID NO: 449971 - DNA, 20 bp, mouse
gacaggaggacccgcaccaa

SEQ ID NO: 449972 - DNA, 20 bp, mouse
ggcaccaatggagaccgcca

SEQ ID NO: 449973 - DNA, 20 bp, mouse
gaagggtgacccgggcgcag

SEQ ID NO: 449974 - DNA, 20 bp, mouse
ggggcgcaggggtacgtggt

SEQ ID NO: 449975 - DNA, 20 bp, mouse
gagggctcccgcgtagtccc

SEQ ID NO: 449976 - DNA, 20 bp, mouse
gccctagggttgacatatag

SEQ ID NO: 449977 - DNA, 20 bp, mouse
gttagccctggtaaagtgag

SEQ ID NO: 449978 - DNA, 20 bp, mouse
gggtactccatgcagaggga

SEQ ID NO: 449979 - DNA, 20 bp, mouse
gctcacctctcactttacca

SEQ ID NO: 449980 - DNA, 20 bp, mouse
gatgtcaaccctagggatat

SEQ ID NO: 449981 - DNA, 20 bp, mouse
ggaaatctgtagaggagata

SEQ ID NO: 449982 - DNA, 20 bp, mouse
gttgtctgcccatatcccta

SEQ ID NO: 449983 - DNA, 20 bp, mouse
gtagggaagtgagtcttcct

SEQ ID NO: 449984 - DNA, 20 bp, mouse
gatccaaaggagagacttag

SEQ ID NO: 449985 - DNA, 20 bp, mouse
gtgaaaggtactccatgcag

SEQ ID NO: 449986 - DNA, 20 bp, mouse
ggcttgggtcggagaaacaa

SEQ ID NO: 449987 - DNA, 20 bp, mouse
gagaaacaatggagtgagtg

SEQ ID NO: 449988 - DNA, 20 bp, mouse
ggtttctccgacccaagctg

SEQ ID NO: 449989 - DNA, 20 bp, mouse
ggtggtcagatgagagactg

SEQ ID NO: 449990 - DNA, 20 bp, mouse
gcagcgacctggggtacagg

SEQ ID NO: 449991 - DNA, 20 bp, mouse
gtcacctggacagcgacctg

SEQ ID NO: 449992 - DNA, 20 bp, mouse
gaggaggctgagagacttca

SEQ ID NO: 449993 - DNA, 20 bp, mouse
gtctggttagcgagaaggga

SEQ ID NO: 449994 - DNA, 20 bp, mouse
gcttatctggttagcgagaa

SEQ ID NO: 449995 - DNA, 20 bp, mouse
gtggactccggggaaatggg

SEQ ID NO: 449996 - DNA, 20 bp, mouse
ggctcctaactgatagacag

SEQ ID NO: 449997 - DNA, 20 bp, mouse
ggtgccggaagtctccaaaa

SEQ ID NO: 449998 - DNA, 20 bp, mouse
gtgatagacagaggcatgtg

SEQ ID NO: 449999 - DNA, 20 bp, mouse
gacttccggcacgccaggag

SEQ ID NO: 450000 - DNA, 20 bp, mouse
gtccttaaggaggaaccctg

SEQ ID NO: 450001 - DNA, 20 bp, mouse
gtgcacactgaggtcttggg

SEQ ID NO: 450002 - DNA, 20 bp, mouse
gatgcctctgtctatcagtt

SEQ ID NO: 450003 - DNA, 20 bp, mouse
ggtagtccagctgcccctcc

SEQ ID NO: 450004 - DNA, 20 bp, mouse
gggctgagagctgccagcag

SEQ ID NO: 450005 - DNA, 20 bp, mouse
gtgccggagttgcaaggtaa

SEQ ID NO: 450006 - DNA, 20 bp, mouse
gcggcagggagactgcatgc

SEQ ID NO: 450007 - DNA, 20 bp, mouse
gatcttggagacacctaccg

SEQ ID NO: 450008 - DNA, 20 bp, mouse
ggcacagccacagccgcggt

SEQ ID NO: 450009 - DNA, 20 bp, mouse
ggcggctgcaaaggggatct

SEQ ID NO: 450010 - DNA, 20 bp, mouse
gctcctaggagccacggagc

SEQ ID NO: 450011 - DNA, 20 bp, mouse
ggagacacctaccgcggctg

SEQ ID NO: 450012 - DNA, 20 bp, mouse
gtggtagtgaaggcaagtgg

SEQ ID NO: 450013 - DNA, 20 bp, mouse
gctgagactcagaccgtggg

SEQ ID NO: 450014 - DNA, 20 bp, mouse
ggctctgagactcagaccgt

SEQ ID NO: 450015 - DNA, 20 bp, mouse
gcttggggcgggcagtctcc

SEQ ID NO: 450016 - DNA, 20 bp, mouse
ggtagttagacacagggatg

SEQ ID NO: 450017 - DNA, 20 bp, mouse
gagggatggggtgagagatt

SEQ ID NO: 450018 - DNA, 20 bp, mouse
gggagccaaagagaagaacg

SEQ ID NO: 450019 - DNA, 20 bp, mouse
gagaagaacgaggcagaaag

SEQ ID NO: 450020 - DNA, 20 bp, mouse
ggagccaggtagttagacac

SEQ ID NO: 450021 - DNA, 20 bp, mouse
ggacggctggactgctggag

SEQ ID NO: 450022 - DNA, 20 bp, mouse
ggagcaagactcttagctgg

SEQ ID NO: 450023 - DNA, 20 bp, mouse
gcaagatggagccacttggg

SEQ ID NO: 450024 - DNA, 20 bp, mouse
gcctcttcggaggaaatggt

SEQ ID NO: 450025 - DNA, 20 bp, mouse
gaagaggtatctagggatgg

SEQ ID NO: 450026 - DNA, 20 bp, mouse
gagcagttcggacctggcga

SEQ ID NO: 450027 - DNA, 20 bp, mouse
gtcgcagagcagttcggacc

SEQ ID NO: 450028 - DNA, 20 bp, mouse
gcgctaggtgtaaggcggca

SEQ ID NO: 450029 - DNA, 20 bp, mouse
gagagcttcgcagagcagtt

SEQ ID NO: 450030 - DNA, 20 bp, mouse
gaagctctgagatctgactg

SEQ ID NO: 450031 - DNA, 20 bp, mouse
gcagaggtgatgccatcgcc

SEQ ID NO: 450032 - DNA, 20 bp, mouse
gccgcaggcacagaagcggg

SEQ ID NO: 450033 - DNA, 20 bp, mouse
ggaccttcctgggacgacga

SEQ ID NO: 450034 - DNA, 20 bp, mouse
gcgcgctcccgctaggtgta

SEQ ID NO: 450035 - DNA, 20 bp, mouse
gcaggcacagaagcgggcgg

SEQ ID NO: 450036 - DNA, 20 bp, mouse
gctgtcacgcaccttccatg

SEQ ID NO: 450037 - DNA, 20 bp, mouse
gcttccatgcggcggcccac

SEQ ID NO: 450038 - DNA, 20 bp, mouse
ggtgtgggcgggcccaagga

SEQ ID NO: 450039 - DNA, 20 bp, mouse
gcttctcaggaatctacctg

SEQ ID NO: 450040 - DNA, 20 bp, mouse
ggggcgcgcctggacctcgt

SEQ ID NO: 450041 - DNA, 20 bp, mouse
gtagggaagggttctccgag

SEQ ID NO: 450042 - DNA, 20 bp, mouse
gctacctgtgggccgccgca

SEQ ID NO: 450043 - DNA, 20 bp, mouse
gcgggtttttgggtcttctc

SEQ ID NO: 450044 - DNA, 20 bp, mouse
gtcacgcaccttccatgcgg

SEQ ID NO: 450045 - DNA, 20 bp, mouse
gacctgcagcccccacaact

SEQ ID NO: 450046 - DNA, 20 bp, mouse
ggagcttcaccggaactgct

SEQ ID NO: 450047 - DNA, 20 bp, mouse
gggaactgctaggcaagttt

SEQ ID NO: 450048 - DNA, 20 bp, mouse
gcggaagagagcaagagggg

SEQ ID NO: 450049 - DNA, 20 bp, mouse
ggagtaaaggcatccggaga

SEQ ID NO: 450050 - DNA, 20 bp, mouse
ggtttgggcgagaacttccg

SEQ ID NO: 450051 - DNA, 20 bp, mouse
ggagggtcgtatcctcctca

SEQ ID NO: 450052 - DNA, 20 bp, mouse
ggacccagagcagagttcac

SEQ ID NO: 450053 - DNA, 20 bp, mouse
gatggagagtgagcagaggg

SEQ ID NO: 450054 - DNA, 20 bp, mouse
ggacgactccagccgtgagg

SEQ ID NO: 450055 - DNA, 20 bp, mouse
gactgacaggcgggacttgg

SEQ ID NO: 450056 - DNA, 20 bp, mouse
gagggacctgcccgactcag

SEQ ID NO: 450057 - DNA, 20 bp, mouse
ggagccctcaccgctgagtc

SEQ ID NO: 450058 - DNA, 20 bp, mouse
gctaaggcgcgagtgcgagg

SEQ ID NO: 450059 - DNA, 20 bp, mouse
gctcgcgccttaggaagctt

SEQ ID NO: 450060 - DNA, 20 bp, mouse
gggcaggtccctgacgcgag

SEQ ID NO: 450061 - DNA, 20 bp, mouse
gggcgggcagcgggacactg

SEQ ID NO: 450062 - DNA, 20 bp, mouse
gctgcccgactcagcggtga

SEQ ID NO: 450063 - DNA, 20 bp, mouse
gcgaggccgaccttaacggt

SEQ ID NO: 450064 - DNA, 20 bp, mouse
gtgtcttcccgctcgcgtca

SEQ ID NO: 450065 - DNA, 20 bp, mouse
ggccgagtgcccggatggaa

SEQ ID NO: 450066 - DNA, 20 bp, mouse
gggagcatcgaatccctgag

SEQ ID NO: 450067 - DNA, 20 bp, mouse
gtcaccagctgctgtctagg

SEQ ID NO: 450068 - DNA, 20 bp, mouse
gagctgctgtctagggggag

SEQ ID NO: 450069 - DNA, 20 bp, mouse
gaagaatgccaggacccctc

SEQ ID NO: 450070 - DNA, 20 bp, mouse
gtcgaatccctgaggggtcc

SEQ ID NO: 450071 - DNA, 20 bp, mouse
ggacagcagctggtgactca

SEQ ID NO: 450072 - DNA, 20 bp, mouse
gaggtgacccagctgtcacc

SEQ ID NO: 450073 - DNA, 20 bp, mouse
gggtcctggcattcttctcc

SEQ ID NO: 450074 - DNA, 20 bp, mouse
gccttggagagagtacagtc

SEQ ID NO: 450075 - DNA, 20 bp, mouse
gctgaaggtcagtgagtctg

SEQ ID NO: 450076 - DNA, 20 bp, mouse
gagttcggggagaactccgg

SEQ ID NO: 450077 - DNA, 20 bp, mouse
ggagaagcgaggtccggggt

SEQ ID NO: 450078 - DNA, 20 bp, mouse
gcggagagaagcgaggtccg

SEQ ID NO: 450079 - DNA, 20 bp, mouse
ggccggggcggagagaagcg

SEQ ID NO: 450080 - DNA, 20 bp, mouse
ggccgggaactcgccaaccc

SEQ ID NO: 450081 - DNA, 20 bp, mouse
gggaatcccagagcacgagt

SEQ ID NO: 450082 - DNA, 20 bp, mouse
gcccggcggtaggtgagttc

SEQ ID NO: 450083 - DNA, 20 bp, mouse
gaagcgcgcacgtggggccg

SEQ ID NO: 450084 - DNA, 20 bp, mouse
gctatcctcaagggagccac

SEQ ID NO: 450085 - DNA, 20 bp, mouse
gtccggggttggcgagttcc

SEQ ID NO: 450086 - DNA, 20 bp, mouse
gctggggaccgcggagactt

SEQ ID NO: 450087 - DNA, 20 bp, mouse
gtggcagtgagtgggccccg

SEQ ID NO: 450088 - DNA, 20 bp, mouse
ggagcgagcgctggggaccg

SEQ ID NO: 450089 - DNA, 20 bp, mouse
gtgggcaagacgcgacctcg

SEQ ID NO: 450090 - DNA, 20 bp, mouse
gcgtcttgcccaagtctccg

SEQ ID NO: 450091 - DNA, 20 bp, mouse
gaggcctgcggagcgctcgg

SEQ ID NO: 450092 - DNA, 20 bp, mouse
gtggcccgggaagtggtcca

SEQ ID NO: 450093 - DNA, 20 bp, mouse
gcgctcgcgcggtcctgcca

SEQ ID NO: 450094 - DNA, 20 bp, mouse
gggcggctcacctcgcacag

SEQ ID NO: 450095 - DNA, 20 bp, mouse
gaaggtgacagtccggataa

SEQ ID NO: 450096 - DNA, 20 bp, mouse
gtcgcgcgccgcccccgtgg

SEQ ID NO: 450097 - DNA, 20 bp, mouse
gaggaccatcctgccgccgg

SEQ ID NO: 450098 - DNA, 20 bp, mouse
ggcttgcgtgagagcggaag

SEQ ID NO: 450099 - DNA, 20 bp, mouse
gtcacgcaagcgcagcagcc

SEQ ID NO: 450100 - DNA, 20 bp, mouse
gagcgtggcccgcatcgtga

SEQ ID NO: 450101 - DNA, 20 bp, mouse
gtccaccgctgcccccacgg

SEQ ID NO: 450102 - DNA, 20 bp, mouse
gtgctgcgcttgcgtgagag

SEQ ID NO: 450103 - DNA, 20 bp, mouse
ggacgccgccggcggcagga

SEQ ID NO: 450104 - DNA, 20 bp, mouse
gtccaggaccatcctgccgc

SEQ ID NO: 450105 - DNA, 20 bp, mouse
ggccgggcagcggacgccgc

SEQ ID NO: 450106 - DNA, 20 bp, mouse
gtcggccgcgcgtccccaca

SEQ ID NO: 450107 - DNA, 20 bp, mouse
gcacagggcagtctttccgg

SEQ ID NO: 450108 - DNA, 20 bp, mouse
gagacgccggaagcccatca

SEQ ID NO: 450109 - DNA, 20 bp, mouse
ggaggggtggagtctgacct

SEQ ID NO: 450110 - DNA, 20 bp, mouse
ggggacgcgcggccgagggg

SEQ ID NO: 450111 - DNA, 20 bp, mouse
ggtctgacctgggccggtgg

SEQ ID NO: 450112 - DNA, 20 bp, mouse
gccggaagcccatcagggaa

SEQ ID NO: 450113 - DNA, 20 bp, mouse
gccccacagggcagtctttc

SEQ ID NO: 450114 - DNA, 20 bp, mouse
ggccaggggtcaccaaagat

SEQ ID NO: 450115 - DNA, 20 bp, mouse
gactgccctgtggggacgcg

SEQ ID NO: 450116 - DNA, 20 bp, mouse
ggcggcgagcagggactgaa

SEQ ID NO: 450117 - DNA, 20 bp, mouse
ggggtcccggggcacacggg

SEQ ID NO: 450118 - DNA, 20 bp, mouse
gtgcgaaggtcagggtcccg

SEQ ID NO: 450119 - DNA, 20 bp, mouse
ggccaggggtgcgaaggtca

SEQ ID NO: 450120 - DNA, 20 bp, mouse
gcccgcatggagcctaggta

SEQ ID NO: 450121 - DNA, 20 bp, mouse
gaggagccaatgggtgccag

SEQ ID NO: 450122 - DNA, 20 bp, mouse
gcatgtcccagagacaacgg

SEQ ID NO: 450123 - DNA, 20 bp, mouse
gaccgactggaggtgatgga

SEQ ID NO: 450124 - DNA, 20 bp, mouse
gaggctccatgcgggagata

SEQ ID NO: 450125 - DNA, 20 bp, mouse
ggaccatgtcccagagacaa

SEQ ID NO: 450126 - DNA, 20 bp, mouse
gcgggagactcagggcggag

SEQ ID NO: 450127 - DNA, 20 bp, mouse
gcggggcgaatgtaagccgg

SEQ ID NO: 450128 - DNA, 20 bp, mouse
gaatgtaagccgggggtctg

SEQ ID NO: 450129 - DNA, 20 bp, mouse
ggagcggggcgaatgtaagc

SEQ ID NO: 450130 - DNA, 20 bp, mouse
ggtgctgccggaggacctca

SEQ ID NO: 450131 - DNA, 20 bp, mouse
gaaggcctcaggatagcggg

SEQ ID NO: 450132 - DNA, 20 bp, mouse
gcgtttgaaggaaacgacgt

SEQ ID NO: 450133 - DNA, 20 bp, mouse
gggctgcacccacagacccc

SEQ ID NO: 450134 - DNA, 20 bp, mouse
ggacagagactggtctacag

SEQ ID NO: 450135 - DNA, 20 bp, mouse
ggggtcgaccagggagacct

SEQ ID NO: 450136 - DNA, 20 bp, mouse
ggaagtgcgctgccgagctg

SEQ ID NO: 450137 - DNA, 20 bp, mouse
gccccgcgccgataggttgt

SEQ ID NO: 450138 - DNA, 20 bp, mouse
ggcgctgccgagctgcggtg

SEQ ID NO: 450139 - DNA, 20 bp, mouse
gtgctcctcccacaacctat

SEQ ID NO: 450140 - DNA, 20 bp, mouse
gtgtgggaggagcagccggg

SEQ ID NO: 450141 - DNA, 20 bp, mouse
gtgaggaagctagctccgcc

SEQ ID NO: 450142 - DNA, 20 bp, mouse
ggctctacgggaggcagtgg

SEQ ID NO: 450143 - DNA, 20 bp, mouse
gacttacggagggcccgagt

SEQ ID NO: 450144 - DNA, 20 bp, mouse
gggagcagccccgcgccgat

SEQ ID NO: 450145 - DNA, 20 bp, mouse
gagaggaccagacgcgagga

SEQ ID NO: 450146 - DNA, 20 bp, mouse
gcggtcttgcggagcggcta

SEQ ID NO: 450147 - DNA, 20 bp, mouse
ggcctggcggtcttgcggag

SEQ ID NO: 450148 - DNA, 20 bp, mouse
gcggcgggcgaagctagcca

SEQ ID NO: 450149 - DNA, 20 bp, mouse
gcggcagaggacccgatcca

SEQ ID NO: 450150 - DNA, 20 bp, mouse
ggccgctccgcaagaccgcc

SEQ ID NO: 450151 - DNA, 20 bp, mouse
ggagccagccctgccctcgg

SEQ ID NO: 450152 - DNA, 20 bp, mouse
gtagctccgtgtccctgagg

SEQ ID NO: 450153 - DNA, 20 bp, mouse
gagtgcacggaagcatctac

SEQ ID NO: 450154 - DNA, 20 bp, mouse
gcagctgcctggcggtcttg

SEQ ID NO: 450155 - DNA, 20 bp, mouse
ggatgtgcaaccacagggtg

SEQ ID NO: 450156 - DNA, 20 bp, mouse
gggcctgcaactactgctgt

SEQ ID NO: 450157 - DNA, 20 bp, mouse
gcgaaagcctgggaaccctt

SEQ ID NO: 450158 - DNA, 20 bp, mouse
gcgcagaagagaggagatcc

SEQ ID NO: 450159 - DNA, 20 bp, mouse
ggccctcggcgagcatcagg

SEQ ID NO: 450160 - DNA, 20 bp, mouse
gagacagcccaagggttccc

SEQ ID NO: 450161 - DNA, 20 bp, mouse
gagaggagatccgggagacc

SEQ ID NO: 450162 - DNA, 20 bp, mouse
gagccgctggccgagacccg

SEQ ID NO: 450163 - DNA, 20 bp, mouse
gcagtccctgcaactcaacc

SEQ ID NO: 450164 - DNA, 20 bp, mouse
gaaagaaacagacagcccaa

SEQ ID NO: 450165 - DNA, 20 bp, mouse
gtgtagcaggcagtagccct

SEQ ID NO: 450166 - DNA, 20 bp, mouse
gcccgccccggaagcgacag

SEQ ID NO: 450167 - DNA, 20 bp, mouse
gggacactccgaaggcccag

SEQ ID NO: 450168 - DNA, 20 bp, mouse
ggcgacagtggaggagggtt

SEQ ID NO: 450169 - DNA, 20 bp, mouse
gtccggggcgggcaccacac

SEQ ID NO: 450170 - DNA, 20 bp, mouse
ggggtggaccgcagggatag

SEQ ID NO: 450171 - DNA, 20 bp, mouse
ggccccggaagcgacagtgg

SEQ ID NO: 450172 - DNA, 20 bp, mouse
ggcctgtccacaaagcccgt

SEQ ID NO: 450173 - DNA, 20 bp, mouse
gccgggaagggtggaccgca

SEQ ID NO: 450174 - DNA, 20 bp, mouse
gccggaagcgacagtggagg

SEQ ID NO: 450175 - DNA, 20 bp, mouse
gcgtgggtgggactgtgtag

SEQ ID NO: 450176 - DNA, 20 bp, mouse
gaggcgcgctcattaagcga

SEQ ID NO: 450177 - DNA, 20 bp, mouse
ggctgcaggtcccgggtcac

SEQ ID NO: 450178 - DNA, 20 bp, mouse
gggtcccgggtcaccggcaa

SEQ ID NO: 450179 - DNA, 20 bp, mouse
gttaagcgatggcagagtcc

SEQ ID NO: 450180 - DNA, 20 bp, mouse
gagtccaggaaacgcttcct

SEQ ID NO: 450181 - DNA, 20 bp, mouse
ggctggtctcgcctggtcgg

SEQ ID NO: 450182 - DNA, 20 bp, mouse
gctgccaaggaagcgtttcc

SEQ ID NO: 450183 - DNA, 20 bp, mouse
gctctgtgcttggaacgtgg

SEQ ID NO: 450184 - DNA, 20 bp, mouse
ggggggcagctgcaggtccc

SEQ ID NO: 450185 - DNA, 20 bp, mouse
gcctgcagctgcccccgacc

SEQ ID NO: 450186 - DNA, 20 bp, mouse
ggggccccaccatggctcta

SEQ ID NO: 450187 - DNA, 20 bp, mouse
gtcgccgtagagccatggtg

SEQ ID NO: 450188 - DNA, 20 bp, mouse
gcggttctcgtactagaaca

SEQ ID NO: 450189 - DNA, 20 bp, mouse
ggcgcagccgcgggtaagtg

SEQ ID NO: 450190 - DNA, 20 bp, mouse
gtgccgaccacacttacccg

SEQ ID NO: 450191 - DNA, 20 bp, mouse
gaactgtcgccgtagagcca

SEQ ID NO: 450192 - DNA, 20 bp, mouse
gaacaaggcgcgccctttga

SEQ ID NO: 450193 - DNA, 20 bp, mouse
ggaggcctggcagcttctgg

SEQ ID NO: 450194 - DNA, 20 bp, mouse
gcgcggctgcgctggcagtg

SEQ ID NO: 450195 - DNA, 20 bp, mouse
gagccgcgggtaagtgtggt

SEQ ID NO: 450196 - DNA, 20 bp, mouse
gccgcccgcgcagtccccgt

SEQ ID NO: 450197 - DNA, 20 bp, mouse
gtcggagcggccgggaacgt

SEQ ID NO: 450198 - DNA, 20 bp, mouse
gacgctggctccggctccca

SEQ ID NO: 450199 - DNA, 20 bp, mouse
ggctcccacggggactgcgc

SEQ ID NO: 450200 - DNA, 20 bp, mouse
gcggcccgggacgctggctc

SEQ ID NO: 450201 - DNA, 20 bp, mouse
ggggcgcagcggcgtcggag

SEQ ID NO: 450202 - DNA, 20 bp, mouse
gccgcgagcccctcggacaa

SEQ ID NO: 450203 - DNA, 20 bp, mouse
ggactgcgcgggcggcacgc

SEQ ID NO: 450204 - DNA, 20 bp, mouse
gtccgcgccgcccgacgggt

SEQ ID NO: 450205 - DNA, 20 bp, mouse
ggagccggagccagcgtccc

SEQ ID NO: 450206 - DNA, 20 bp, mouse
gctgccgggtcagaaccgag

SEQ ID NO: 450207 - DNA, 20 bp, mouse
gtgacccggcagaggtgagt

SEQ ID NO: 450208 - DNA, 20 bp, mouse
gaggcccctcggttctgacc

SEQ ID NO: 450209 - DNA, 20 bp, mouse
gcgcgaacccggcaggtctg

SEQ ID NO: 450210 - DNA, 20 bp, mouse
ggcgcgcgctagaggaccca

SEQ ID NO: 450211 - DNA, 20 bp, mouse
gctgcccactcacctctgcc

SEQ ID NO: 450212 - DNA, 20 bp, mouse
ggtagtggacgcagggatgg

SEQ ID NO: 450213 - DNA, 20 bp, mouse
gcggcccaagcggttttaaa

SEQ ID NO: 450214 - DNA, 20 bp, mouse
ggaggacactgcggggtgtg

SEQ ID NO: 450215 - DNA, 20 bp, mouse
gtgggagcccgcggctggca

SEQ ID NO: 450216 - DNA, 20 bp, mouse
ggggatgccggacgaagcag

SEQ ID NO: 450217 - DNA, 20 bp, mouse
gtcccggtgagcgggtccaa

SEQ ID NO: 450218 - DNA, 20 bp, mouse
gccatcgcccctgcttcgtc

SEQ ID NO: 450219 - DNA, 20 bp, mouse
gcgtccagggaaagtctcgg

SEQ ID NO: 450220 - DNA, 20 bp, mouse
ggagccgccgaccttcctca

SEQ ID NO: 450221 - DNA, 20 bp, mouse
gcgcgtcgccggcctcccat

SEQ ID NO: 450222 - DNA, 20 bp, mouse
gccccgcaggactatacccc

SEQ ID NO: 450223 - DNA, 20 bp, mouse
ggcccttggacccgctcacc

SEQ ID NO: 450224 - DNA, 20 bp, mouse
gagcaggtctaggatatcta

SEQ ID NO: 450225 - DNA, 20 bp, mouse
gtgcgttgtagagagggtca

SEQ ID NO: 450226 - DNA, 20 bp, mouse
gggtagtcaggagtgctccg

SEQ ID NO: 450227 - DNA, 20 bp, mouse
gtcgagaaggcttgaaagag

SEQ ID NO: 450228 - DNA, 20 bp, mouse
ggagctggtggcgcgagtcc

SEQ ID NO: 450229 - DNA, 20 bp, mouse
gctccggggtagagaagact

SEQ ID NO: 450230 - DNA, 20 bp, mouse
gcgaccggagaagaactata

SEQ ID NO: 450231 - DNA, 20 bp, mouse
ggccccggcagttgagctgg

SEQ ID NO: 450232 - DNA, 20 bp, mouse
gccagccccggcagttgagc

SEQ ID NO: 450233 - DNA, 20 bp, mouse
gccagggcgggaatgcaggg

SEQ ID NO: 450234 - DNA, 20 bp, mouse
gccgcgctcaggccaagtcc

SEQ ID NO: 450235 - DNA, 20 bp, mouse
ggccaccagctcaactgccg

SEQ ID NO: 450236 - DNA, 20 bp, mouse
gggagccagccagccaggta

SEQ ID NO: 450237 - DNA, 20 bp, mouse
gggactgagagaaatcactg

SEQ ID NO: 450238 - DNA, 20 bp, mouse
gggaggtggtggtgacccgg

SEQ ID NO: 450239 - DNA, 20 bp, mouse
ggtggggcgtgggagtccaa

SEQ ID NO: 450240 - DNA, 20 bp, mouse
gtgagagaaatcactggggt

SEQ ID NO: 450241 - DNA, 20 bp, mouse
gccacaaccataacatgact

SEQ ID NO: 450242 - DNA, 20 bp, mouse
ggggcacaggggctgccccc

SEQ ID NO: 450243 - DNA, 20 bp, mouse
gtgtggaggtggtggtgacc

SEQ ID NO: 450244 - DNA, 20 bp, mouse
gacccatctcgaaagagaga

SEQ ID NO: 450245 - DNA, 20 bp, mouse
gaagttaaagggccactgac

SEQ ID NO: 450246 - DNA, 20 bp, mouse
ggcttctcctgcagcctggt

SEQ ID NO: 450247 - DNA, 20 bp, mouse
gtccgggcggagcagaatcc

SEQ ID NO: 450248 - DNA, 20 bp, mouse
ggatgcaaccgggtagagag

SEQ ID NO: 450249 - DNA, 20 bp, mouse
ggccccacccctggagactg

SEQ ID NO: 450250 - DNA, 20 bp, mouse
ggagactggagccaaaatag

SEQ ID NO: 450251 - DNA, 20 bp, mouse
gggagaagcgcagcgaagca

SEQ ID NO: 450252 - DNA, 20 bp, mouse
gtaggagggaagatgcaacc

SEQ ID NO: 450253 - DNA, 20 bp, mouse
ggggcggagcagaatcccgg

SEQ ID NO: 450254 - DNA, 20 bp, mouse
gcagacagcagacgggagaa

SEQ ID NO: 450255 - DNA, 20 bp, mouse
gcaaccgggtagagagagga

SEQ ID NO: 450256 - DNA, 20 bp, mouse
gtgactgaccttgaagctgg

SEQ ID NO: 450257 - DNA, 20 bp, mouse
gagtgtaacaggagcctgtg

SEQ ID NO: 450258 - DNA, 20 bp, mouse
gatgggacccacaaccatgt

SEQ ID NO: 450259 - DNA, 20 bp, mouse
gaggctcctgttacacttct

SEQ ID NO: 450260 - DNA, 20 bp, mouse
gacagaggcactgtgagcta

SEQ ID NO: 450261 - DNA, 20 bp, mouse
gcggtgggccagatagaaat

SEQ ID NO: 450262 - DNA, 20 bp, mouse
gcatgtgctaaggctcacca

SEQ ID NO: 450263 - DNA, 20 bp, mouse
gtagaaatgggaacgtgatg

SEQ ID NO: 450264 - DNA, 20 bp, mouse
gcacagccaagaagtgtaac

SEQ ID NO: 450265 - DNA, 20 bp, mouse
gcagggaaaaacgtgattcc

SEQ ID NO: 450266 - DNA, 20 bp, mouse
gaagcgaggccaaagagggt

SEQ ID NO: 450267 - DNA, 20 bp, mouse
gacatgattgctctgtccga

SEQ ID NO: 450268 - DNA, 20 bp, mouse
gttgaaagcgaggccaaaga

SEQ ID NO: 450269 - DNA, 20 bp, mouse
gcgtgcgcaaggaattaccg

SEQ ID NO: 450270 - DNA, 20 bp, mouse
gttacctaggccggagtggg

SEQ ID NO: 450271 - DNA, 20 bp, mouse
gtgtctggaggcctgcggcg

SEQ ID NO: 450272 - DNA, 20 bp, mouse
gtagttacctaggccggagt

SEQ ID NO: 450273 - DNA, 20 bp, mouse
gggtgggagcgcgtgctgct

SEQ ID NO: 450274 - DNA, 20 bp, mouse
ggcgggggacagtgtagaac

SEQ ID NO: 450275 - DNA, 20 bp, mouse
gtccccgcgccggcactaac

SEQ ID NO: 450276 - DNA, 20 bp, mouse
ggcaaggctgcccggacgga

SEQ ID NO: 450277 - DNA, 20 bp, mouse
gtagaggcctccgtccgtcc

SEQ ID NO: 450278 - DNA, 20 bp, mouse
gcgcgctgggaggtcagacc

SEQ ID NO: 450279 - DNA, 20 bp, mouse
gggtcgtgaactcccagact

SEQ ID NO: 450280 - DNA, 20 bp, mouse
gaggctgcccggacggacgg

SEQ ID NO: 450281 - DNA, 20 bp, mouse
gcgacgcaacgactcgaatg

SEQ ID NO: 450282 - DNA, 20 bp, mouse
gctccgcaggcgctcctcac

SEQ ID NO: 450283 - DNA, 20 bp, mouse
ggcgttgggcctgcggtcgt

SEQ ID NO: 450284 - DNA, 20 bp, mouse
ggaggtcagacctggtggtc

SEQ ID NO: 450285 - DNA, 20 bp, mouse
ggaccgcaggcccaacgctc

SEQ ID NO: 450286 - DNA, 20 bp, mouse
gctcattggggtggaggaga

SEQ ID NO: 450287 - DNA, 20 bp, mouse
ggcgcttaacctcattgggg

SEQ ID NO: 450288 - DNA, 20 bp, mouse
gtactgttgcggctgcggac

SEQ ID NO: 450289 - DNA, 20 bp, mouse
gggagaaggcggtggctgtc

SEQ ID NO: 450290 - DNA, 20 bp, mouse
gccaaaagtgcaccccagag

SEQ ID NO: 450291 - DNA, 20 bp, mouse
gcggccctgggatgggatct

SEQ ID NO: 450292 - DNA, 20 bp, mouse
gccaagcgcttaacctcatt

SEQ ID NO: 450293 - DNA, 20 bp, mouse
gccagagcggctgacagcac

SEQ ID NO: 450294 - DNA, 20 bp, mouse
gctattattcactactgttg

SEQ ID NO: 450295 - DNA, 20 bp, mouse
gcaatcagaactgaagccgg

SEQ ID NO: 450296 - DNA, 20 bp, mouse
ggcctgcagcctacaggcac

SEQ ID NO: 450297 - DNA, 20 bp, mouse
ggcttagtgcctgcgccact

SEQ ID NO: 450298 - DNA, 20 bp, mouse
gcgggagcactgtgtgaccc

SEQ ID NO: 450299 - DNA, 20 bp, mouse
ggcggtgcagagctgcagcg

SEQ ID NO: 450300 - DNA, 20 bp, mouse
gggtctggcaaacataaggt

SEQ ID NO: 450301 - DNA, 20 bp, mouse
gcagagctgcagcgcggcct

SEQ ID NO: 450302 - DNA, 20 bp, mouse
ggctccctggaccatctgaa

SEQ ID NO: 450303 - DNA, 20 bp, mouse
gaagggtagtggaagggtca

SEQ ID NO: 450304 - DNA, 20 bp, mouse
gagggtcagggaatgtgtac

SEQ ID NO: 450305 - DNA, 20 bp, mouse
gttgggtcaccaaagggtag

SEQ ID NO: 450306 - DNA, 20 bp, mouse
ggcgcgctcacgacccacac

SEQ ID NO: 450307 - DNA, 20 bp, mouse
gcggattcgggcctgaggag

SEQ ID NO: 450308 - DNA, 20 bp, mouse
ggcgactggccggtgagtgc

SEQ ID NO: 450309 - DNA, 20 bp, mouse
gcgcgcgcgagcgcagcagt

SEQ ID NO: 450310 - DNA, 20 bp, mouse
ggctcggaagccgggaggtc

SEQ ID NO: 450311 - DNA, 20 bp, mouse
gtcacgacccacaccggaag

SEQ ID NO: 450312 - DNA, 20 bp, mouse
ggtgggaggcggcgactggc

SEQ ID NO: 450313 - DNA, 20 bp, mouse
gagcgcctcggacaaggatg

SEQ ID NO: 450314 - DNA, 20 bp, mouse
gccaccgctcggaagccggg

SEQ ID NO: 450315 - DNA, 20 bp, mouse
ggaagtgagaggttgagcga

SEQ ID NO: 450316 - DNA, 20 bp, mouse
gacggttttaccctcctaaa

SEQ ID NO: 450317 - DNA, 20 bp, mouse
ggttaaagtgccctttagga

SEQ ID NO: 450318 - DNA, 20 bp, mouse
gctgcccccccagcctgtcc

SEQ ID NO: 450319 - DNA, 20 bp, mouse
gcttgtccaggacaggctgg

SEQ ID NO: 450320 - DNA, 20 bp, mouse
gataataaaaatataaagct

SEQ ID NO: 450321 - DNA, 20 bp, mouse
ggatggttaaagtgcccttt

SEQ ID NO: 450322 - DNA, 20 bp, mouse
gcactggagcagtgcgaaca

SEQ ID NO: 450323 - DNA, 20 bp, mouse
gtgtgtgagtttggatgcgc

SEQ ID NO: 450324 - DNA, 20 bp, mouse
gtgttaataatttattaact

SEQ ID NO: 450325 - DNA, 20 bp, mouse
gtatttcaaattcccgagcg

SEQ ID NO: 450326 - DNA, 20 bp, mouse
gtgactgaagataatactgc

SEQ ID NO: 450327 - DNA, 20 bp, mouse
gataatttattaacttgata

SEQ ID NO: 450328 - DNA, 20 bp, mouse
gtataataaaatataatgct

SEQ ID NO: 450329 - DNA, 20 bp, mouse
gattaaccccagtgtgccag

SEQ ID NO: 450330 - DNA, 20 bp, mouse
ggtattatcttcagtcatga

SEQ ID NO: 450331 - DNA, 20 bp, mouse
gacctgcagccctggcacca

SEQ ID NO: 450332 - DNA, 20 bp, mouse
ggtcaaagcgccccttggga

SEQ ID NO: 450333 - DNA, 20 bp, mouse
ggacggtcaaagcgcccctt

SEQ ID NO: 450334 - DNA, 20 bp, mouse
gacggttttaccctcccaag

SEQ ID NO: 450335 - DNA, 20 bp, mouse
gaagttaataaattattaac

SEQ ID NO: 450336 - DNA, 20 bp, mouse
gcagaaggtggaggatcaag

SEQ ID NO: 450337 - DNA, 20 bp, mouse
gaactccttccagaaggtgg

SEQ ID NO: 450338 - DNA, 20 bp, mouse
gacacccagccctttccaga

SEQ ID NO: 450339 - DNA, 20 bp, mouse
gactcagaactccttccaga

SEQ ID NO: 450340 - DNA, 20 bp, mouse
gtgatcctccaccttctgga

SEQ ID NO: 450341 - DNA, 20 bp, mouse
ggcagctttccctctggaaa

SEQ ID NO: 450342 - DNA, 20 bp, mouse
gtgaacaacaacggctatga

SEQ ID NO: 450343 - DNA, 20 bp, mouse
ggtggcaattacctatgctt

SEQ ID NO: 450344 - DNA, 20 bp, mouse
ggaattagtattagcaaatt

SEQ ID NO: 450345 - DNA, 20 bp, mouse
gacataaaggtacatgccag

SEQ ID NO: 450346 - DNA, 20 bp, mouse
gccattactaagatagagtg

SEQ ID NO: 450347 - DNA, 20 bp, mouse
gataatttattaagtaggtg

SEQ ID NO: 450348 - DNA, 20 bp, mouse
gtaatagacttgagagcaag

SEQ ID NO: 450349 - DNA, 20 bp, mouse
gtattatatattaaattcta

SEQ ID NO: 450350 - DNA, 20 bp, mouse
gtcaacagcaatggatatga

SEQ ID NO: 450351 - DNA, 20 bp, mouse
gtattatcttcagtcaagat

SEQ ID NO: 450352 - DNA, 20 bp, mouse
gacctgcagccctggcacca

SEQ ID NO: 450353 - DNA, 20 bp, mouse
ggtcaaagcgccccttggga

SEQ ID NO: 450354 - DNA, 20 bp, mouse
ggacggtcaaagcgcccctt

SEQ ID NO: 450355 - DNA, 20 bp, mouse
gtgttaataatttattaagt

SEQ ID NO: 450356 - DNA, 20 bp, mouse
gtattcacggggagcctgct

SEQ ID NO: 450357 - DNA, 20 bp, mouse
gacattgatcagctgactca

SEQ ID NO: 450358 - DNA, 20 bp, mouse
gaaacctctggtttattcac

SEQ ID NO: 450359 - DNA, 20 bp, mouse
gctgactcaaggtacccagc

SEQ ID NO: 450360 - DNA, 20 bp, mouse
gcatcttgcagtgaaacctc

SEQ ID NO: 450361 - DNA, 20 bp, mouse
gtcgggtacccggggattga

SEQ ID NO: 450362 - DNA, 20 bp, mouse
gcagcacaggacctgtcatc

SEQ ID NO: 450363 - DNA, 20 bp, mouse
gtgacccacagggacagcac

SEQ ID NO: 450364 - DNA, 20 bp, mouse
gtgatcaatgtggaagcagc

SEQ ID NO: 450365 - DNA, 20 bp, mouse
gcactgcaagatgacccaca

SEQ ID NO: 450366 - DNA, 20 bp, mouse
gaagagacacagagaaacaa

SEQ ID NO: 450367 - DNA, 20 bp, mouse
gcagagaaacaaaggcctct

SEQ ID NO: 450368 - DNA, 20 bp, mouse
gcccccaaagcaggtacagg

SEQ ID NO: 450369 - DNA, 20 bp, mouse
gttctcattcagccttatca

SEQ ID NO: 450370 - DNA, 20 bp, mouse
gccaaagcaggtacaggagg

SEQ ID NO: 450371 - DNA, 20 bp, mouse
gggtgaccaggctggaatga

SEQ ID NO: 450372 - DNA, 20 bp, mouse
gtgacccccaaagcaggtac

SEQ ID NO: 450373 - DNA, 20 bp, mouse
gttccagcctggtcacccag

SEQ ID NO: 450374 - DNA, 20 bp, mouse
ggaatgatggctttctccag

SEQ ID NO: 450375 - DNA, 20 bp, mouse
gggcctctgggtgaccaggc

SEQ ID NO: 450376 - DNA, 20 bp, mouse
gagtgcaccgtgtttgaggt

SEQ ID NO: 450377 - DNA, 20 bp, mouse
gtaccgagcggcccaccctg

SEQ ID NO: 450378 - DNA, 20 bp, mouse
gctcggactggagtcccgag

SEQ ID NO: 450379 - DNA, 20 bp, mouse
gaaacacggtgcactcggac

SEQ ID NO: 450380 - DNA, 20 bp, mouse
gccgagacaaggggaatgac

SEQ ID NO: 450381 - DNA, 20 bp, mouse
gacccgcgtaagacggaaca

SEQ ID NO: 450382 - DNA, 20 bp, mouse
gcgagtcgatgagtccgctc

SEQ ID NO: 450383 - DNA, 20 bp, mouse
gggcggctcggcgtcttccg

SEQ ID NO: 450384 - DNA, 20 bp, mouse
ggtgtttgaggtaggcggct

SEQ ID NO: 450385 - DNA, 20 bp, mouse
ggagcgcccactcacgtcga

SEQ ID NO: 450386 - DNA, 20 bp, mouse
gacctgctcggaggtccatg

SEQ ID NO: 450387 - DNA, 20 bp, mouse
gtcccagaggctggcggagt

SEQ ID NO: 450388 - DNA, 20 bp, mouse
gcccacccggcccctctcga

SEQ ID NO: 450389 - DNA, 20 bp, mouse
gggtaggagccaggcgtccg

SEQ ID NO: 450390 - DNA, 20 bp, mouse
ggccccatggacctccgagc

SEQ ID NO: 450391 - DNA, 20 bp, mouse
ggagccccgcgccagaatcg

SEQ ID NO: 450392 - DNA, 20 bp, mouse
gctggctcctacctgctcgg

SEQ ID NO: 450393 - DNA, 20 bp, mouse
gggccgggcgccctcgagag

SEQ ID NO: 450394 - DNA, 20 bp, mouse
gcgcctggctcctacctgct

SEQ ID NO: 450395 - DNA, 20 bp, mouse
gggagtgggagggcgagccg

SEQ ID NO: 450396 - DNA, 20 bp, mouse
ggagctacttgggggagact

SEQ ID NO: 450397 - DNA, 20 bp, mouse
ggaggcttaaggagctactt

SEQ ID NO: 450398 - DNA, 20 bp, mouse
ggactgccctcagagaatgg

SEQ ID NO: 450399 - DNA, 20 bp, mouse
gactgtccccaaggcgtctg

SEQ ID NO: 450400 - DNA, 20 bp, mouse
gggagcggtcccagtcccag

SEQ ID NO: 450401 - DNA, 20 bp, mouse
ggaaggcccccattctctga

SEQ ID NO: 450402 - DNA, 20 bp, mouse
gaccggccccgaaaggacat

SEQ ID NO: 450403 - DNA, 20 bp, mouse
ggaggggaacagagctggtg

SEQ ID NO: 450404 - DNA, 20 bp, mouse
ggcaggccaaggcctggctg

SEQ ID NO: 450405 - DNA, 20 bp, mouse
ggacattacctgtgttgggt

SEQ ID NO: 450406 - DNA, 20 bp, mouse
gctgggctgaggggacggga

SEQ ID NO: 450407 - DNA, 20 bp, mouse
gccgcctgggctgaggggac

SEQ ID NO: 450408 - DNA, 20 bp, mouse
gtgaggggacgggacgggtg

SEQ ID NO: 450409 - DNA, 20 bp, mouse
ggtcaaggccgagaagcaga

SEQ ID NO: 450410 - DNA, 20 bp, mouse
gactctgcactcggccgcct

SEQ ID NO: 450411 - DNA, 20 bp, mouse
gctgcagcattggtcccgta

SEQ ID NO: 450412 - DNA, 20 bp, mouse
gcagagtgcgacgggtcccc

SEQ ID NO: 450413 - DNA, 20 bp, mouse
gctgcagtacgagcagaccc

SEQ ID NO: 450414 - DNA, 20 bp, mouse
gctcggccgcctgggctgag

SEQ ID NO: 450415 - DNA, 20 bp, mouse
gcctggtaagtgaaacccaa

SEQ ID NO: 450416 - DNA, 20 bp, mouse
gcaaggcccgagcacctcgg

SEQ ID NO: 450417 - DNA, 20 bp, mouse
gccgggaagggccacctccg

SEQ ID NO: 450418 - DNA, 20 bp, mouse
gccacaaggcccgagcacct

SEQ ID NO: 450419 - DNA, 20 bp, mouse
gtgaagaagccccgagaagg

SEQ ID NO: 450420 - DNA, 20 bp, mouse
gggcccgagcacctcggagg

SEQ ID NO: 450421 - DNA, 20 bp, mouse
gaactcggtgactccgtcca

SEQ ID NO: 450422 - DNA, 20 bp, mouse
gtcttcacttccgccgggaa

SEQ ID NO: 450423 - DNA, 20 bp, mouse
ggcacgcggacttcagggaa

SEQ ID NO: 450424 - DNA, 20 bp, mouse
gcagcgcggtaccccgtcgg

SEQ ID NO: 450425 - DNA, 20 bp, mouse
gaatctgtccccgccttgga

SEQ ID NO: 450426 - DNA, 20 bp, mouse
gcagttcagcgggtcagggc

SEQ ID NO: 450427 - DNA, 20 bp, mouse
ggagcgcaccggcaacgagc

SEQ ID NO: 450428 - DNA, 20 bp, mouse
gcgcgtgcgacgcacctgtc

SEQ ID NO: 450429 - DNA, 20 bp, mouse
gcgcagtgagcctccagtcg

SEQ ID NO: 450430 - DNA, 20 bp, mouse
gcggcccgccccgagcgcac

SEQ ID NO: 450431 - DNA, 20 bp, mouse
ggcaggagtcggagcccgac

SEQ ID NO: 450432 - DNA, 20 bp, mouse
gcatcctccggacagacgga

SEQ ID NO: 450433 - DNA, 20 bp, mouse
gccgcctctgccccgactgg

SEQ ID NO: 450434 - DNA, 20 bp, mouse
gagcgggtcagggctggtcg

SEQ ID NO: 450435 - DNA, 20 bp, mouse
gttcaggagaggttacgtaa

SEQ ID NO: 450436 - DNA, 20 bp, mouse
ggttctaacctcatcaaata

SEQ ID NO: 450437 - DNA, 20 bp, mouse
ggaagatgccatatttgatg

SEQ ID NO: 450438 - DNA, 20 bp, mouse
gtccttgcttgctatagcag

SEQ ID NO: 450439 - DNA, 20 bp, mouse
gtcccctgctatagcaagca

SEQ ID NO: 450440 - DNA, 20 bp, mouse
gtagaactgcatagttcgac

SEQ ID NO: 450441 - DNA, 20 bp, mouse
gtcgactggctgaagcaact

SEQ ID NO: 450442 - DNA, 20 bp, mouse
gcttgctagattaaaaagac

SEQ ID NO: 450443 - DNA, 20 bp, mouse
ggccacagagcaaacaatca

SEQ ID NO: 450444 - DNA, 20 bp, mouse
ggcagctcactgcagcacgg

SEQ ID NO: 450445 - DNA, 20 bp, mouse
ggcagtgcctcagatcacat

SEQ ID NO: 450446 - DNA, 20 bp, mouse
gagacagccgcgctgaagag

SEQ ID NO: 450447 - DNA, 20 bp, mouse
ggcggacacagcgggaggag

SEQ ID NO: 450448 - DNA, 20 bp, mouse
gggctcccggaagagcatcc

SEQ ID NO: 450449 - DNA, 20 bp, mouse
gatctaggacgctgtccggg

SEQ ID NO: 450450 - DNA, 20 bp, mouse
gccgtggcgagcatcagacg

SEQ ID NO: 450451 - DNA, 20 bp, mouse
gacggccacgccgcaagacg

SEQ ID NO: 450452 - DNA, 20 bp, mouse
gatgatctaggacgctgtcc

SEQ ID NO: 450453 - DNA, 20 bp, mouse
gctcgccacggcggacacag

SEQ ID NO: 450454 - DNA, 20 bp, mouse
ggaagtggccgagggcaggg

SEQ ID NO: 450455 - DNA, 20 bp, mouse
ggccccgcttccggtttcag

SEQ ID NO: 450456 - DNA, 20 bp, mouse
ggctctggggagctttagaa

SEQ ID NO: 450457 - DNA, 20 bp, mouse
gtctgaccaaccgggagcac

SEQ ID NO: 450458 - DNA, 20 bp, mouse
ggcactggtggctctttagg

SEQ ID NO: 450459 - DNA, 20 bp, mouse
ggaccaaccgggagcactgg

SEQ ID NO: 450460 - DNA, 20 bp, mouse
gagccaccagtgctcccggt

SEQ ID NO: 450461 - DNA, 20 bp, mouse
gaagcatgctccgggagcag

SEQ ID NO: 450462 - DNA, 20 bp, mouse
gagcaggagacagacgacaa

SEQ ID NO: 450463 - DNA, 20 bp, mouse
gtctggtcatgtgatctcat

SEQ ID NO: 450464 - DNA, 20 bp, mouse
gcccaggctgaagcatgctc

SEQ ID NO: 450465 - DNA, 20 bp, mouse
gttacaggacgcccgctctg

SEQ ID NO: 450466 - DNA, 20 bp, mouse
gtggcctaggtggtccggag

SEQ ID NO: 450467 - DNA, 20 bp, mouse
gaccgcagcagcaacaccac

SEQ ID NO: 450468 - DNA, 20 bp, mouse
gtccggagcggcagcaaagg

SEQ ID NO: 450469 - DNA, 20 bp, mouse
gtggtccggagcggcagcaa

SEQ ID NO: 450470 - DNA, 20 bp, mouse
gtgaggcgcggatcctgggt

SEQ ID NO: 450471 - DNA, 20 bp, mouse
ggcaaaggaggaagatggcg

SEQ ID NO: 450472 - DNA, 20 bp, mouse
gccgctcaccagctcctcgg

SEQ ID NO: 450473 - DNA, 20 bp, mouse
gctgccgctccggaccacct

SEQ ID NO: 450474 - DNA, 20 bp, mouse
ggcttcccgagcccaggcag

SEQ ID NO: 450475 - DNA, 20 bp, mouse
ggccagagaaactacaccaa

SEQ ID NO: 450476 - DNA, 20 bp, mouse
gacaagaacagccggcagac

SEQ ID NO: 450477 - DNA, 20 bp, mouse
gcgttggccatggcccactg

SEQ ID NO: 450478 - DNA, 20 bp, mouse
gaccggcgcagcgatcccgg

SEQ ID NO: 450479 - DNA, 20 bp, mouse
ggatagatcacgtgagacct

SEQ ID NO: 450480 - DNA, 20 bp, mouse
gtgttgagtttggtcctcag

SEQ ID NO: 450481 - DNA, 20 bp, mouse
ggggaatgctgccggtctgc

SEQ ID NO: 450482 - DNA, 20 bp, mouse
gttcttagagacgttggcca

SEQ ID NO: 450483 - DNA, 20 bp, mouse
ggtctcacgtgatctatcat

SEQ ID NO: 450484 - DNA, 20 bp, mouse
gcagcgacaacggttcctgg

SEQ ID NO: 450485 - DNA, 20 bp, mouse
gagatcgcgatgatgaggag

SEQ ID NO: 450486 - DNA, 20 bp, mouse
ggccaggcaggacctctaca

SEQ ID NO: 450487 - DNA, 20 bp, mouse
gctctacagggtggaccggg

SEQ ID NO: 450488 - DNA, 20 bp, mouse
ggacctctacagggtggacc

SEQ ID NO: 450489 - DNA, 20 bp, mouse
ggttcctgccgtgaacaaag

SEQ ID NO: 450490 - DNA, 20 bp, mouse
gtgttagagaagcaccagcc

SEQ ID NO: 450491 - DNA, 20 bp, mouse
ggtactgagggataggtatg

SEQ ID NO: 450492 - DNA, 20 bp, mouse
gttgttcacggcaggaacag

SEQ ID NO: 450493 - DNA, 20 bp, mouse
gtgaggaacgcagggtactg

SEQ ID NO: 450494 - DNA, 20 bp, mouse
ggcagcctagagtcccagga

SEQ ID NO: 450495 - DNA, 20 bp, mouse
gaagcaggtgggatgagggt

SEQ ID NO: 450496 - DNA, 20 bp, mouse
gcagggcacactgacaggtg

SEQ ID NO: 450497 - DNA, 20 bp, mouse
ggcctgttggggcttcagca

SEQ ID NO: 450498 - DNA, 20 bp, mouse
gtgttggaggagggcctgtt

SEQ ID NO: 450499 - DNA, 20 bp, mouse
gacactgacaggtgaggagc

SEQ ID NO: 450500 - DNA, 20 bp, mouse
gggagcaggtgggtgctcgg

SEQ ID NO: 450501 - DNA, 20 bp, mouse
gggccagacacggagaggga

SEQ ID NO: 450502 - DNA, 20 bp, mouse
gggccaggccagacacggag

SEQ ID NO: 450503 - DNA, 20 bp, mouse
ggccctgctgaagccccaac

SEQ ID NO: 450504 - DNA, 20 bp, mouse
ggttctgaaggatggccata

SEQ ID NO: 450505 - DNA, 20 bp, mouse
gacaaacaaagaagctgtgt

SEQ ID NO: 450506 - DNA, 20 bp, mouse
gcctggcttctggtccgggt

SEQ ID NO: 450507 - DNA, 20 bp, mouse
gggcttctggtccgggtagg

SEQ ID NO: 450508 - DNA, 20 bp, mouse
gggtaggcggtggtggagtc

SEQ ID NO: 450509 - DNA, 20 bp, mouse
gtgctctctgtgcagctgcg

SEQ ID NO: 450510 - DNA, 20 bp, mouse
gtgagctcccgaaggtgatg

SEQ ID NO: 450511 - DNA, 20 bp, mouse
gggcagggcagtgctgacga

SEQ ID NO: 450512 - DNA, 20 bp, mouse
gccgctcaggccatctacga

SEQ ID NO: 450513 - DNA, 20 bp, mouse
gaagagccatggccaacgcg

SEQ ID NO: 450514 - DNA, 20 bp, mouse
gtctgagacgctgaaccgcc

SEQ ID NO: 450515 - DNA, 20 bp, mouse
gactgagcccgcgggagcct

SEQ ID NO: 450516 - DNA, 20 bp, mouse
gcccgagatggagactacga

SEQ ID NO: 450517 - DNA, 20 bp, mouse
ggcgccgctgcagcccagca

SEQ ID NO: 450518 - DNA, 20 bp, mouse
gactagcacccagcccgaga

SEQ ID NO: 450519 - DNA, 20 bp, mouse
gacgaaggcgacgatttcca

SEQ ID NO: 450520 - DNA, 20 bp, mouse
gcagtagtcggtgggcagtg

SEQ ID NO: 450521 - DNA, 20 bp, mouse
gggcatcgcagaccctcccg

SEQ ID NO: 450522 - DNA, 20 bp, mouse
gagaccttccagtagtcggt

SEQ ID NO: 450523 - DNA, 20 bp, mouse
gagcatggctagcacggcct

SEQ ID NO: 450524 - DNA, 20 bp, mouse
ggccttcgtagtctccatct

SEQ ID NO: 450525 - DNA, 20 bp, mouse
gtacggatgggtgtccggtg

SEQ ID NO: 450526 - DNA, 20 bp, mouse
gctccgggctactcgagatg

SEQ ID NO: 450527 - DNA, 20 bp, mouse
ggggacaggtgcgcctggag

SEQ ID NO: 450528 - DNA, 20 bp, mouse
gtcgagtagcccggagccag

SEQ ID NO: 450529 - DNA, 20 bp, mouse
ggacagcgtgcagcggggac

SEQ ID NO: 450530 - DNA, 20 bp, mouse
gcggctcgcgagggccaaga

SEQ ID NO: 450531 - DNA, 20 bp, mouse
gctgctgcgacagcgtgcag

SEQ ID NO: 450532 - DNA, 20 bp, mouse
ggacgtcgctgcggccacca

SEQ ID NO: 450533 - DNA, 20 bp, mouse
gaggcaagtggctaccatgg

SEQ ID NO: 450534 - DNA, 20 bp, mouse
gcaggtcaccacccagtcat

SEQ ID NO: 450535 - DNA, 20 bp, mouse
ggacgaaacccaccacctga

SEQ ID NO: 450536 - DNA, 20 bp, mouse
ggagggagaccaaggagccg

SEQ ID NO: 450537 - DNA, 20 bp, mouse
gtcgccagaacgcacttccg

SEQ ID NO: 450538 - DNA, 20 bp, mouse
gcgagccgtgaggagccggt

SEQ ID NO: 450539 - DNA, 20 bp, mouse
gagaccaaggagccgcggct

SEQ ID NO: 450540 - DNA, 20 bp, mouse
ggctcacccactccgagccg

SEQ ID NO: 450541 - DNA, 20 bp, mouse
gtggttccctgaagcctccg

SEQ ID NO: 450542 - DNA, 20 bp, mouse
gttccctgaagcctccgggg

SEQ ID NO: 450543 - DNA, 20 bp, mouse
ggcacttccgcggcagcgga

SEQ ID NO: 450544 - DNA, 20 bp, mouse
gactccgagccgcggctcct

SEQ ID NO: 450545 - DNA, 20 bp, mouse
gggctccacactcctcggag

SEQ ID NO: 450546 - DNA, 20 bp, mouse
gctgtcaccaatgatgatct

SEQ ID NO: 450547 - DNA, 20 bp, mouse
gggcagcacgcagctcacaa

SEQ ID NO: 450548 - DNA, 20 bp, mouse
gtgactacctagatcatcat

SEQ ID NO: 450549 - DNA, 20 bp, mouse
ggggggccagcacgtatgag

SEQ ID NO: 450550 - DNA, 20 bp, mouse
gcaggaccaggacgagtcag

SEQ ID NO: 450551 - DNA, 20 bp, mouse
gtgacttcactgggttgggt

SEQ ID NO: 450552 - DNA, 20 bp, mouse
ggttgacacaggaccctatc

SEQ ID NO: 450553 - DNA, 20 bp, mouse
gcacagaccctcccaaatgg

SEQ ID NO: 450554 - DNA, 20 bp, mouse
gcagtctgtttcaccagata

SEQ ID NO: 450555 - DNA, 20 bp, mouse
gggattccaagagccgagga

SEQ ID NO: 450556 - DNA, 20 bp, mouse
gtcgccgaatggaagctcta

SEQ ID NO: 450557 - DNA, 20 bp, mouse
gtggccttagagcttccatt

SEQ ID NO: 450558 - DNA, 20 bp, mouse
gagcttccattcggcgaatg

SEQ ID NO: 450559 - DNA, 20 bp, mouse
ggatgctctcaggtagacca

SEQ ID NO: 450560 - DNA, 20 bp, mouse
ggagcggccagagacaatga

SEQ ID NO: 450561 - DNA, 20 bp, mouse
gacccaggaccgaggaccct

SEQ ID NO: 450562 - DNA, 20 bp, mouse
gagagttgtctggtcaatta

SEQ ID NO: 450563 - DNA, 20 bp, mouse
gtgtgggtggttgagttgaa

SEQ ID NO: 450564 - DNA, 20 bp, mouse
gccaagctgctgaggaccta

SEQ ID NO: 450565 - DNA, 20 bp, mouse
ggacaggcagggcccagctt

SEQ ID NO: 450566 - DNA, 20 bp, mouse
gcctctgcctggtctctggg

SEQ ID NO: 450567 - DNA, 20 bp, mouse
gctgcttcctggcaggtcag

SEQ ID NO: 450568 - DNA, 20 bp, mouse
gcttgtctgccgtcttctgg

SEQ ID NO: 450569 - DNA, 20 bp, mouse
gacaatcaacagctgcggag

SEQ ID NO: 450570 - DNA, 20 bp, mouse
gtctgggaggctctgcttcc

SEQ ID NO: 450571 - DNA, 20 bp, mouse
gaggtctgagtgcctctgcc

SEQ ID NO: 450572 - DNA, 20 bp, mouse
ggggatgtcacggaagactg

SEQ ID NO: 450573 - DNA, 20 bp, mouse
ggagactcccagggagtcgg

SEQ ID NO: 450574 - DNA, 20 bp, mouse
ggacctgcatcccagcatgt

SEQ ID NO: 450575 - DNA, 20 bp, mouse
gctgcggagcggagcaggct

SEQ ID NO: 450576 - DNA, 20 bp, mouse
gaggacggaggaaggatcct

SEQ ID NO: 450577 - DNA, 20 bp, mouse
ggccacgatcaaaaacccag

SEQ ID NO: 450578 - DNA, 20 bp, mouse
gtccagagcgagggtcgtgg

SEQ ID NO: 450579 - DNA, 20 bp, mouse
gtgcctgcaagagggatgtg

SEQ ID NO: 450580 - DNA, 20 bp, mouse
ggtggcaagatggaggacgg

SEQ ID NO: 450581 - DNA, 20 bp, mouse
gaaaaacccagtggagaata

SEQ ID NO: 450582 - DNA, 20 bp, mouse
gtcttggccatattctccac

SEQ ID NO: 450583 - DNA, 20 bp, mouse
gggctcccaatcagaagcca

SEQ ID NO: 450584 - DNA, 20 bp, mouse
ggaactcctagagcattctg

SEQ ID NO: 450585 - DNA, 20 bp, mouse
gacctggacagactgttgga

SEQ ID NO: 450586 - DNA, 20 bp, mouse
gatcaggagcggagaagacc

SEQ ID NO: 450587 - DNA, 20 bp, mouse
gacatcatgggtatcaggag

SEQ ID NO: 450588 - DNA, 20 bp, mouse
gatttggacgaacacatcat

SEQ ID NO: 450589 - DNA, 20 bp, mouse
ggtcaagatgcagaatgtgt

SEQ ID NO: 450590 - DNA, 20 bp, mouse
gtaggagtcttctagtctag

SEQ ID NO: 450591 - DNA, 20 bp, mouse
gctactgcttcagcctggaa

SEQ ID NO: 450592 - DNA, 20 bp, mouse
gaagctgacactctccattg

SEQ ID NO: 450593 - DNA, 20 bp, mouse
ggtaggccaaggaaagacaa

SEQ ID NO: 450594 - DNA, 20 bp, mouse
gcgaacacatcatgggtatc

SEQ ID NO: 450595 - DNA, 20 bp, mouse
gtacttgcttggaacctcag

SEQ ID NO: 450596 - DNA, 20 bp, mouse
gcaggcggtcaccgacatga

SEQ ID NO: 450597 - DNA, 20 bp, mouse
gactctgtgctccatcatgt

SEQ ID NO: 450598 - DNA, 20 bp, mouse
gtgtcggtgaccgcctgcca

SEQ ID NO: 450599 - DNA, 20 bp, mouse
gtctgagggcaccgagtata

SEQ ID NO: 450600 - DNA, 20 bp, mouse
gagggcaccgagtataggga

SEQ ID NO: 450601 - DNA, 20 bp, mouse
gaaccccaagccctggcagg

SEQ ID NO: 450602 - DNA, 20 bp, mouse
gcatgcgtccgagagagctc

SEQ ID NO: 450603 - DNA, 20 bp, mouse
gcaacagggtgaagtagcct

SEQ ID NO: 450604 - DNA, 20 bp, mouse
gttacctggcaaccccaaca

SEQ ID NO: 450605 - DNA, 20 bp, mouse
ggctacccccagccacccta

SEQ ID NO: 450606 - DNA, 20 bp, mouse
gcagccggccagacccagga

SEQ ID NO: 450607 - DNA, 20 bp, mouse
gcaccacgtgccaggtggta

SEQ ID NO: 450608 - DNA, 20 bp, mouse
gtatgcagccggccagaccc

SEQ ID NO: 450609 - DNA, 20 bp, mouse
ggccaccaccacgtgccagg

SEQ ID NO: 450610 - DNA, 20 bp, mouse
gcgcccagcagctgaagcca

SEQ ID NO: 450611 - DNA, 20 bp, mouse
gcatcctgggccttccaggt

SEQ ID NO: 450612 - DNA, 20 bp, mouse
gagccctaccacctggcacg

SEQ ID NO: 450613 - DNA, 20 bp, mouse
gcaggtaggcgaggtgattg

SEQ ID NO: 450614 - DNA, 20 bp, mouse
ggctgccacagtcacacctg

SEQ ID NO: 450615 - DNA, 20 bp, mouse
gccagtatgaagggctctgg

SEQ ID NO: 450616 - DNA, 20 bp, mouse
ggggagctaagtggcacagg

SEQ ID NO: 450617 - DNA, 20 bp, mouse
gagaggaacagccggaaaag

SEQ ID NO: 450618 - DNA, 20 bp, mouse
gaaggggagctaagtggcac

SEQ ID NO: 450619 - DNA, 20 bp, mouse
gaagttagggactcccacag

SEQ ID NO: 450620 - DNA, 20 bp, mouse
gaggcccacggcagtgatga

SEQ ID NO: 450621 - DNA, 20 bp, mouse
gacctgcccggtgctctgag

SEQ ID NO: 450622 - DNA, 20 bp, mouse
gtggaggagcgttgtggtca

SEQ ID NO: 450623 - DNA, 20 bp, mouse
gtcatggtaagaggaacagc

SEQ ID NO: 450624 - DNA, 20 bp, mouse
gagcccttcgtagaggccca

SEQ ID NO: 450625 - DNA, 20 bp, mouse
gagttccaggactcagagat

SEQ ID NO: 450626 - DNA, 20 bp, mouse
gcagatgggaatgaaaccct

SEQ ID NO: 450627 - DNA, 20 bp, mouse
gatgggaatgaaacccttgg

SEQ ID NO: 450628 - DNA, 20 bp, mouse
gccgcctaagtgagcctgaa

SEQ ID NO: 450629 - DNA, 20 bp, mouse
gtaagaaggctcagagttac

SEQ ID NO: 450630 - DNA, 20 bp, mouse
gtggaggctggaaaagattg

SEQ ID NO: 450631 - DNA, 20 bp, mouse
gctacccttcaggctcactt

SEQ ID NO: 450632 - DNA, 20 bp, mouse
gtctgagccttcttacagat

SEQ ID NO: 450633 - DNA, 20 bp, mouse
ggcttctggggacaaggact

SEQ ID NO: 450634 - DNA, 20 bp, mouse
gttcattcccatctgtaaga

SEQ ID NO: 450635 - DNA, 20 bp, mouse
gactcacgaccagatactca

SEQ ID NO: 450636 - DNA, 20 bp, mouse
gttccagtttggcagcagag

SEQ ID NO: 450637 - DNA, 20 bp, mouse
gttcatcctggccgtgtctg

SEQ ID NO: 450638 - DNA, 20 bp, mouse
gagacaccccagacacggcc

SEQ ID NO: 450639 - DNA, 20 bp, mouse
gtcgcagtctgcacatggac

SEQ ID NO: 450640 - DNA, 20 bp, mouse
gaggagctggagacctgccg

SEQ ID NO: 450641 - DNA, 20 bp, mouse
gtggacggggagcgacagaa

SEQ ID NO: 450642 - DNA, 20 bp, mouse
gatgcattaaccttccagtt

SEQ ID NO: 450643 - DNA, 20 bp, mouse
gcagctccttgctttcatcc

SEQ ID NO: 450644 - DNA, 20 bp, mouse
gtgccactctgctgccaaac

SEQ ID NO: 450645 - DNA, 20 bp, mouse
ggtccaggtgcaggggttgt

SEQ ID NO: 450646 - DNA, 20 bp, mouse
gcccattagaacgttctggg

SEQ ID NO: 450647 - DNA, 20 bp, mouse
gtaagcgtggggcaggagtc

SEQ ID NO: 450648 - DNA, 20 bp, mouse
gcgtggggcaggagtcgggc

SEQ ID NO: 450649 - DNA, 20 bp, mouse
ggcctcccagaacgttctaa

SEQ ID NO: 450650 - DNA, 20 bp, mouse
gaagcccattagaacgttct

SEQ ID NO: 450651 - DNA, 20 bp, mouse
gatgggcttagtcttccgaa

SEQ ID NO: 450652 - DNA, 20 bp, mouse
ggtgcggcaagtagtttgta

SEQ ID NO: 450653 - DNA, 20 bp, mouse
gttccgaacggcaacgcagg

SEQ ID NO: 450654 - DNA, 20 bp, mouse
gagccgcctgcgttgccgtt

SEQ ID NO: 450655 - DNA, 20 bp, mouse
ggtcttccgaacggcaacgc

SEQ ID NO: 450656 - DNA, 20 bp, mouse
gtcgaggacagggtgcgcag

SEQ ID NO: 450657 - DNA, 20 bp, mouse
ggcatcgctgctacccagcc

SEQ ID NO: 450658 - DNA, 20 bp, mouse
ggccagcagcagccctaggg

SEQ ID NO: 450659 - DNA, 20 bp, mouse
gtctgcgaggttgccgggct

SEQ ID NO: 450660 - DNA, 20 bp, mouse
gtcgaatctgcgaggttgcc

SEQ ID NO: 450661 - DNA, 20 bp, mouse
ggatgctcgctgcgctctct

SEQ ID NO: 450662 - DNA, 20 bp, mouse
gcctcgcagattcgaggaca

SEQ ID NO: 450663 - DNA, 20 bp, mouse
gggtacagcaccacgtccac

SEQ ID NO: 450664 - DNA, 20 bp, mouse
gcgggctggcggctggtgaa

SEQ ID NO: 450665 - DNA, 20 bp, mouse
gcagtacactggccccgggc

SEQ ID NO: 450666 - DNA, 20 bp, mouse
gaacggccatgcaatcagta

SEQ ID NO: 450667 - DNA, 20 bp, mouse
gttccagtgtggtagatatg

SEQ ID NO: 450668 - DNA, 20 bp, mouse
gtaccacatatctaccacac

SEQ ID NO: 450669 - DNA, 20 bp, mouse
ggttgtagtctctatcccga

SEQ ID NO: 450670 - DNA, 20 bp, mouse
ggaaagccctactgattgca

SEQ ID NO: 450671 - DNA, 20 bp, mouse
gatggctttcatcttcagaa

SEQ ID NO: 450672 - DNA, 20 bp, mouse
gggtagatatgtggtaataa

SEQ ID NO: 450673 - DNA, 20 bp, mouse
gtctctgtcattgctgggat

SEQ ID NO: 450674 - DNA, 20 bp, mouse
gcccacctgggcacaatctc

SEQ ID NO: 450675 - DNA, 20 bp, mouse
gggctttctctgtcattgct

SEQ ID NO: 450676 - DNA, 20 bp, mouse
ggccggtggagtgagaggat

SEQ ID NO: 450677 - DNA, 20 bp, mouse
ggcgaagccggtggagtgag

SEQ ID NO: 450678 - DNA, 20 bp, mouse
gagctggagggcgaagccgg

SEQ ID NO: 450679 - DNA, 20 bp, mouse
gaggaggcgcggggagagta

SEQ ID NO: 450680 - DNA, 20 bp, mouse
ggagagtagggtgctgtggt

SEQ ID NO: 450681 - DNA, 20 bp, mouse
gcggagctggagggcgaagc

SEQ ID NO: 450682 - DNA, 20 bp, mouse
ggtgctgtggtcggagctgg

SEQ ID NO: 450683 - DNA, 20 bp, mouse
gcagggaagtacgtcagagg

SEQ ID NO: 450684 - DNA, 20 bp, mouse
gctgcagggaagtacgtcag

SEQ ID NO: 450685 - DNA, 20 bp, mouse
gagggtgctgtggtcggagc

SEQ ID NO: 450686 - DNA, 20 bp, mouse
gcaggacgctcgccccgatc

SEQ ID NO: 450687 - DNA, 20 bp, mouse
ggagtggaggcagtagtcgg

SEQ ID NO: 450688 - DNA, 20 bp, mouse
gtagacgccggctgaactgg

SEQ ID NO: 450689 - DNA, 20 bp, mouse
gcgccccgatccggagcggt

SEQ ID NO: 450690 - DNA, 20 bp, mouse
gggagggtcgggaggcacta

SEQ ID NO: 450691 - DNA, 20 bp, mouse
ggggaagcgaagatagacgc

SEQ ID NO: 450692 - DNA, 20 bp, mouse
gttcccaccgctccggatcg

SEQ ID NO: 450693 - DNA, 20 bp, mouse
gctgaaacctcaagaagact

SEQ ID NO: 450694 - DNA, 20 bp, mouse
gggcgccgaggtagaggtgt

SEQ ID NO: 450695 - DNA, 20 bp, mouse
gtcttcgcttcccaccgctc

SEQ ID NO: 450696 - DNA, 20 bp, mouse
ggtcgccgggaacgacgggt

SEQ ID NO: 450697 - DNA, 20 bp, mouse
ggcttaacggctcctctcct

SEQ ID NO: 450698 - DNA, 20 bp, mouse
gaacgacgggtgggtggcaa

SEQ ID NO: 450699 - DNA, 20 bp, mouse
ggtctgtcgccgggaacgac

SEQ ID NO: 450700 - DNA, 20 bp, mouse
gggaagggcgcagcacacga

SEQ ID NO: 450701 - DNA, 20 bp, mouse
ggtccagcagccatgtccat

SEQ ID NO: 450702 - DNA, 20 bp, mouse
gcagtctctgtgcgagcccc

SEQ ID NO: 450703 - DNA, 20 bp, mouse
gatcacggcgcagatcacct

SEQ ID NO: 450704 - DNA, 20 bp, mouse
gagcgccacgaggagcccga

SEQ ID NO: 450705 - DNA, 20 bp, mouse
ggccgggaacgacgggtggg

SEQ ID NO: 450706 - DNA, 20 bp, mouse
gcgcttggtagctggtgcat

SEQ ID NO: 450707 - DNA, 20 bp, mouse
ggagctgcagtgttcgcgct

SEQ ID NO: 450708 - DNA, 20 bp, mouse
gcctctgcaggggtcaaagt

SEQ ID NO: 450709 - DNA, 20 bp, mouse
ggactgccaaggagattccc

SEQ ID NO: 450710 - DNA, 20 bp, mouse
gctctctctctggagtcaga

SEQ ID NO: 450711 - DNA, 20 bp, mouse
ggatgatccccagccagccc

SEQ ID NO: 450712 - DNA, 20 bp, mouse
gatggcgtctatgggactac

SEQ ID NO: 450713 - DNA, 20 bp, mouse
gatcggcagcaacatcgtca

SEQ ID NO: 450714 - DNA, 20 bp, mouse
ggaatctccttggcagtcct

SEQ ID NO: 450715 - DNA, 20 bp, mouse
gctggtgcatcggactcagc

SEQ ID NO: 450716 - DNA, 20 bp, mouse
gcagcgcagagagcacccgg

SEQ ID NO: 450717 - DNA, 20 bp, mouse
ggagcacccggaggccccaa

SEQ ID NO: 450718 - DNA, 20 bp, mouse
ggattctggtgcctctgctc

SEQ ID NO: 450719 - DNA, 20 bp, mouse
gtctctgcgctgcttaggct

SEQ ID NO: 450720 - DNA, 20 bp, mouse
gacgatgttgtggtccagga

SEQ ID NO: 450721 - DNA, 20 bp, mouse
gcagctcgggcactcaccgt

SEQ ID NO: 450722 - DNA, 20 bp, mouse
gggttacttcagaacccagt

SEQ ID NO: 450723 - DNA, 20 bp, mouse
gcggcgcagacgacttggaa

SEQ ID NO: 450724 - DNA, 20 bp, mouse
ggtgctgtgtctggtaggat

SEQ ID NO: 450725 - DNA, 20 bp, mouse
gaggcacgggtagcactcac

SEQ ID NO: 450726 - DNA, 20 bp, mouse
gtcctaggctcggatatcag

SEQ ID NO: 450727 - DNA, 20 bp, mouse
gaggagtgcgagaccaggag

SEQ ID NO: 450728 - DNA, 20 bp, mouse
gtggccacctaggcaggaga

SEQ ID NO: 450729 - DNA, 20 bp, mouse
gtagttggtggccactccaa

SEQ ID NO: 450730 - DNA, 20 bp, mouse
gaccaggaggggcttaatgg

SEQ ID NO: 450731 - DNA, 20 bp, mouse
gtgcgggtgtgaaaatacgc

SEQ ID NO: 450732 - DNA, 20 bp, mouse
ggatgtggcagagtgcgtgc

SEQ ID NO: 450733 - DNA, 20 bp, mouse
gagaagcgctcgggtcccct

SEQ ID NO: 450734 - DNA, 20 bp, mouse
gtaggctcggatatcagggg

SEQ ID NO: 450735 - DNA, 20 bp, mouse
gaaagtaggaatgagggcgg

SEQ ID NO: 450736 - DNA, 20 bp, mouse
ggcacagggagctggcggtg

SEQ ID NO: 450737 - DNA, 20 bp, mouse
gagaagtggaggggccgtta

SEQ ID NO: 450738 - DNA, 20 bp, mouse
ggagtgtcgcttcaccggag

SEQ ID NO: 450739 - DNA, 20 bp, mouse
gcagggagctggcggtgcgg

SEQ ID NO: 450740 - DNA, 20 bp, mouse
ggggcccgcatactttctgg

SEQ ID NO: 450741 - DNA, 20 bp, mouse
gtgccgcgcaccgcagcctg

SEQ ID NO: 450742 - DNA, 20 bp, mouse
gtggcccccagaaagtatgc

SEQ ID NO: 450743 - DNA, 20 bp, mouse
gccgagactacccaaagaag

SEQ ID NO: 450744 - DNA, 20 bp, mouse
gagaaagtatgcgggccctt

SEQ ID NO: 450745 - DNA, 20 bp, mouse
gggctgcggtgcgcggcaca

SEQ ID NO: 450746 - DNA, 20 bp, mouse
ggccactcgagccttaatgg

SEQ ID NO: 450747 - DNA, 20 bp, mouse
ggctaagaagcccaacacca

SEQ ID NO: 450748 - DNA, 20 bp, mouse
gtaaggctggcgccatccta

SEQ ID NO: 450749 - DNA, 20 bp, mouse
gaccagggacaccaccatta

SEQ ID NO: 450750 - DNA, 20 bp, mouse
gcccgaatagctatgactgg

SEQ ID NO: 450751 - DNA, 20 bp, mouse
gcaggccactcgagccttaa

SEQ ID NO: 450752 - DNA, 20 bp, mouse
gcccatcgtggcgacaaaca

SEQ ID NO: 450753 - DNA, 20 bp, mouse
gcggcggtcattgctggaaa

SEQ ID NO: 450754 - DNA, 20 bp, mouse
ggggtccagggtgggaccaa

SEQ ID NO: 450755 - DNA, 20 bp, mouse
gaccaccattaaggctcgag

SEQ ID NO: 450756 - DNA, 20 bp, mouse
gaaatctgtacgccttggga

SEQ ID NO: 450757 - DNA, 20 bp, mouse
gaggcagacactctccactg

SEQ ID NO: 450758 - DNA, 20 bp, mouse
ggatttgatctggccagaga

SEQ ID NO: 450759 - DNA, 20 bp, mouse
gaacgctgacccgggaagta

SEQ ID NO: 450760 - DNA, 20 bp, mouse
gaactgttccctccctccca

SEQ ID NO: 450761 - DNA, 20 bp, mouse
ggttgtgagcacatttctac

SEQ ID NO: 450762 - DNA, 20 bp, mouse
gtctgtacgccttgggaggg

SEQ ID NO: 450763 - DNA, 20 bp, mouse
gcagtcctcgggatgcctgg

SEQ ID NO: 450764 - DNA, 20 bp, mouse
ggccagcactagatttgatc

SEQ ID NO: 450765 - DNA, 20 bp, mouse
gcatccacaagccttcccag

SEQ ID NO: 450766 - DNA, 20 bp, mouse
gctcaaaacagggaaccgtg

SEQ ID NO: 450767 - DNA, 20 bp, mouse
ggaaccgtgaggtgccactt

SEQ ID NO: 450768 - DNA, 20 bp, mouse
gcagccagcagagaggaacg

SEQ ID NO: 450769 - DNA, 20 bp, mouse
gtgagaggcccgcagctgtg

SEQ ID NO: 450770 - DNA, 20 bp, mouse
gaggcggtcaccttccacag

SEQ ID NO: 450771 - DNA, 20 bp, mouse
gtgccacttgggacgtctga

SEQ ID NO: 450772 - DNA, 20 bp, mouse
gtacagatgagcgggaccta

SEQ ID NO: 450773 - DNA, 20 bp, mouse
ggcgtctcactgctcaggag

SEQ ID NO: 450774 - DNA, 20 bp, mouse
gggctgctcacgtactttct

SEQ ID NO: 450775 - DNA, 20 bp, mouse
gggtcatgccgaggagttca

SEQ ID NO: 450776 - DNA, 20 bp, mouse
ggaactgagtctcttagagg

SEQ ID NO: 450777 - DNA, 20 bp, mouse
gctgcgacaaagagcccgcg

SEQ ID NO: 450778 - DNA, 20 bp, mouse
gctctttgtcgcaggggacc

SEQ ID NO: 450779 - DNA, 20 bp, mouse
gaaagagcccgcggggttgg

SEQ ID NO: 450780 - DNA, 20 bp, mouse
ggtgtgtatgtgtacgggta

SEQ ID NO: 450781 - DNA, 20 bp, mouse
gaggaagaggccagtagcat

SEQ ID NO: 450782 - DNA, 20 bp, mouse
gaggggggtcataagttctt

SEQ ID NO: 450783 - DNA, 20 bp, mouse
gttcttaggcaaggtagctg

SEQ ID NO: 450784 - DNA, 20 bp, mouse
gagggccaccttcctcactg

SEQ ID NO: 450785 - DNA, 20 bp, mouse
gggagaactgagtctcttag

SEQ ID NO: 450786 - DNA, 20 bp, mouse
gatatcccggagggttggtg

SEQ ID NO: 450787 - DNA, 20 bp, mouse
gcacagagagggaggacgtt

SEQ ID NO: 450788 - DNA, 20 bp, mouse
gaactgggccagggttgcca

SEQ ID NO: 450789 - DNA, 20 bp, mouse
gactctgtcttgtgtgcttg

SEQ ID NO: 450790 - DNA, 20 bp, mouse
gtcccaaaatacagaccact

SEQ ID NO: 450791 - DNA, 20 bp, mouse
gcacaagacagagtcttgct

SEQ ID NO: 450792 - DNA, 20 bp, mouse
ggcaagacgcttcacagaga

SEQ ID NO: 450793 - DNA, 20 bp, mouse
gtgggcttggatgacctaag

SEQ ID NO: 450794 - DNA, 20 bp, mouse
gtgaatctggaagcagaata

SEQ ID NO: 450795 - DNA, 20 bp, mouse
gctgcagtggatccccaact

SEQ ID NO: 450796 - DNA, 20 bp, mouse
ggcaagtgtcccagtctggt

SEQ ID NO: 450797 - DNA, 20 bp, mouse
gtgagacagagcagatcagg

SEQ ID NO: 450798 - DNA, 20 bp, mouse
ggtgagctgcccaccagact

SEQ ID NO: 450799 - DNA, 20 bp, mouse
gagaaagcctggcagaaaga

SEQ ID NO: 450800 - DNA, 20 bp, mouse
ggactcaccaagagaagctg

SEQ ID NO: 450801 - DNA, 20 bp, mouse
gcctagcaagtgtcccagtc

SEQ ID NO: 450802 - DNA, 20 bp, mouse
ggggcagctcacaagcccct

SEQ ID NO: 450803 - DNA, 20 bp, mouse
gagttgagacagagcagatc

SEQ ID NO: 450804 - DNA, 20 bp, mouse
gtcatggagcccgaggtcct

SEQ ID NO: 450805 - DNA, 20 bp, mouse
gagggcctcctggagattct

SEQ ID NO: 450806 - DNA, 20 bp, mouse
gggttagccacagtttacag

SEQ ID NO: 450807 - DNA, 20 bp, mouse
gtacagagggttgaaagtct

SEQ ID NO: 450808 - DNA, 20 bp, mouse
ggagggttgaaagtctaggt

SEQ ID NO: 450809 - DNA, 20 bp, mouse
gtccttcgaaaaaggtgaga

SEQ ID NO: 450810 - DNA, 20 bp, mouse
gagaagtctgacaaatgtgg

SEQ ID NO: 450811 - DNA, 20 bp, mouse
gaaggaaatttgagcttgtg

SEQ ID NO: 450812 - DNA, 20 bp, mouse
ggccctctcacctttttcga

SEQ ID NO: 450813 - DNA, 20 bp, mouse
gatttgagagtctggcatag

SEQ ID NO: 450814 - DNA, 20 bp, mouse
gggctgaacaaaaattcata

SEQ ID NO: 450815 - DNA, 20 bp, mouse
gagaaaatgtccttcgaaaa

SEQ ID NO: 450816 - DNA, 20 bp, mouse
gggactctgcaagagtgagg

SEQ ID NO: 450817 - DNA, 20 bp, mouse
gtcaggactctgcaagagtg

SEQ ID NO: 450818 - DNA, 20 bp, mouse
gtgaagcatcagtgtcgcat

SEQ ID NO: 450819 - DNA, 20 bp, mouse
ggagtgagggggaatcggga

SEQ ID NO: 450820 - DNA, 20 bp, mouse
gtgcaagagtgagggggaat

SEQ ID NO: 450821 - DNA, 20 bp, mouse
gaatgaggcgtaagaatcta

SEQ ID NO: 450822 - DNA, 20 bp, mouse
ggttaagtgcttggagatgt

SEQ ID NO: 450823 - DNA, 20 bp, mouse
gctccttaagagaattgatg

SEQ ID NO: 450824 - DNA, 20 bp, mouse
gtgtgaattgaatggaatca

SEQ ID NO: 450825 - DNA, 20 bp, mouse
gaattgaatggaatcatggt

SEQ ID NO: 450826 - DNA, 20 bp, mouse
ggtgccctccagcaaaccag

SEQ ID NO: 450827 - DNA, 20 bp, mouse
gatgttgagtctccaggatg

SEQ ID NO: 450828 - DNA, 20 bp, mouse
gggaggcacagggcaagcgc

SEQ ID NO: 450829 - DNA, 20 bp, mouse
gtccagcaaaccagaggact

SEQ ID NO: 450830 - DNA, 20 bp, mouse
ggaggggagggcacacatag

SEQ ID NO: 450831 - DNA, 20 bp, mouse
ggaggaggcctgcagcctaa

SEQ ID NO: 450832 - DNA, 20 bp, mouse
ggctaccttcaagagaaggg

SEQ ID NO: 450833 - DNA, 20 bp, mouse
ggaggacagcccactaccgt

SEQ ID NO: 450834 - DNA, 20 bp, mouse
gctgcgctccaggccaccag

SEQ ID NO: 450835 - DNA, 20 bp, mouse
gaccttcaagagaagggcgg

SEQ ID NO: 450836 - DNA, 20 bp, mouse
gtctcaagcccagccagcgg

SEQ ID NO: 450837 - DNA, 20 bp, mouse
gacatctcaagcccagccag

SEQ ID NO: 450838 - DNA, 20 bp, mouse
gggaggtgcgaggaagacag

SEQ ID NO: 450839 - DNA, 20 bp, mouse
gggctggggagcaaggtgct

SEQ ID NO: 450840 - DNA, 20 bp, mouse
gcttcaggtggtccaaggag

SEQ ID NO: 450841 - DNA, 20 bp, mouse
gccggctgaatgtcagtgcg

SEQ ID NO: 450842 - DNA, 20 bp, mouse
gcaagcccagccagcggcgg

SEQ ID NO: 450843 - DNA, 20 bp, mouse
ggacgctcacggagctgggt

SEQ ID NO: 450844 - DNA, 20 bp, mouse
ggctcggacatgaaaccgtg

SEQ ID NO: 450845 - DNA, 20 bp, mouse
gcagtgcggggctttgggct

SEQ ID NO: 450846 - DNA, 20 bp, mouse
gtagcttcatgaacacgggg

SEQ ID NO: 450847 - DNA, 20 bp, mouse
gggcttcccagccacaggga

SEQ ID NO: 450848 - DNA, 20 bp, mouse
gagggctccggctgaatcat

SEQ ID NO: 450849 - DNA, 20 bp, mouse
ggaatagcttcatgaacacg

SEQ ID NO: 450850 - DNA, 20 bp, mouse
gtgaacacggggaggctagc

SEQ ID NO: 450851 - DNA, 20 bp, mouse
ggatcccactctgcaaggta

SEQ ID NO: 450852 - DNA, 20 bp, mouse
ggcctgagagagggtagcga

SEQ ID NO: 450853 - DNA, 20 bp, mouse
gaggaacacctgggcaaaga

SEQ ID NO: 450854 - DNA, 20 bp, mouse
gggcaggccaatgattcagc

SEQ ID NO: 450855 - DNA, 20 bp, mouse
ggggaggatggaaggatact

SEQ ID NO: 450856 - DNA, 20 bp, mouse
gcaggaaaccaggcactgag

SEQ ID NO: 450857 - DNA, 20 bp, mouse
ggtatctgagggtagacagg

SEQ ID NO: 450858 - DNA, 20 bp, mouse
gggtttcctgaggtatctga

SEQ ID NO: 450859 - DNA, 20 bp, mouse
ggcacgtctggtgacagtgg

SEQ ID NO: 450860 - DNA, 20 bp, mouse
ggtctaccctcagatacctc

SEQ ID NO: 450861 - DNA, 20 bp, mouse
gtctgcacgtctggtgacag

SEQ ID NO: 450862 - DNA, 20 bp, mouse
gagcaagtacctgagtgcct

SEQ ID NO: 450863 - DNA, 20 bp, mouse
gatgagcaaggctgagtgaa

SEQ ID NO: 450864 - DNA, 20 bp, mouse
gggaaccagcatacacacgg

SEQ ID NO: 450865 - DNA, 20 bp, mouse
gtgtgctcagattgctcgag

SEQ ID NO: 450866 - DNA, 20 bp, mouse
gtctcagtgcctgccagtgt

SEQ ID NO: 450867 - DNA, 20 bp, mouse
gcccacaccaccgggagaga

SEQ ID NO: 450868 - DNA, 20 bp, mouse
ggactctaagggtggacatt

SEQ ID NO: 450869 - DNA, 20 bp, mouse
gggcactgagactctaaggg

SEQ ID NO: 450870 - DNA, 20 bp, mouse
gtgggctccttctctcccgg

SEQ ID NO: 450871 - DNA, 20 bp, mouse
ggcatatggccccacaccac

SEQ ID NO: 450872 - DNA, 20 bp, mouse
gcatatgcaccaggacactt

SEQ ID NO: 450873 - DNA, 20 bp, mouse
ggtgtgggctccttctctcc

SEQ ID NO: 450874 - DNA, 20 bp, mouse
gtggatgttcagagatacgt

SEQ ID NO: 450875 - DNA, 20 bp, mouse
ggtttaagcaccctgtcact

SEQ ID NO: 450876 - DNA, 20 bp, mouse
gtgcctgtgggactaagcat

SEQ ID NO: 450877 - DNA, 20 bp, mouse
gtgtgggactaagcataggt

SEQ ID NO: 450878 - DNA, 20 bp, mouse
gctgagaggcacaaatacgt

SEQ ID NO: 450879 - DNA, 20 bp, mouse
gtctgagatgtgtgtcacaa

SEQ ID NO: 450880 - DNA, 20 bp, mouse
ggtacaaagcgagaacgctg

SEQ ID NO: 450881 - DNA, 20 bp, mouse
gcagagaggagtttcaaaca

SEQ ID NO: 450882 - DNA, 20 bp, mouse
gagtcccacaggcagcccgc

SEQ ID NO: 450883 - DNA, 20 bp, mouse
gtcctctctgcccctcccat

SEQ ID NO: 450884 - DNA, 20 bp, mouse
gacctcctgcgggctgcctg

SEQ ID NO: 450885 - DNA, 20 bp, mouse
ggaggagtttcaaacagggc

SEQ ID NO: 450886 - DNA, 20 bp, mouse
gagtgctgcaaaggttgaag

SEQ ID NO: 450887 - DNA, 20 bp, mouse
gcacactaaagggatagagg

SEQ ID NO: 450888 - DNA, 20 bp, mouse
gcttaccatgacaggctaac

SEQ ID NO: 450889 - DNA, 20 bp, mouse
gttcaaatcttctgagtctc

SEQ ID NO: 450890 - DNA, 20 bp, mouse
gaagatttgaaagaaaactg

SEQ ID NO: 450891 - DNA, 20 bp, mouse
gtgaaagaaaactgtggaca

SEQ ID NO: 450892 - DNA, 20 bp, mouse
gtagaagtagaaatgcttgg

SEQ ID NO: 450893 - DNA, 20 bp, mouse
gagcacatacagtgtataaa

SEQ ID NO: 450894 - DNA, 20 bp, mouse
gcactttgaatcacactaaa

SEQ ID NO: 450895 - DNA, 20 bp, mouse
ggttatattagttactctac

SEQ ID NO: 450896 - DNA, 20 bp, mouse
gagtggtgttgagcataggt

SEQ ID NO: 450897 - DNA, 20 bp, mouse
gtctgagatgaacattacaa

SEQ ID NO: 450898 - DNA, 20 bp, mouse
gtgcaagtggtgttgagcat

SEQ ID NO: 450899 - DNA, 20 bp, mouse
ggaagctgagttaccactat

SEQ ID NO: 450900 - DNA, 20 bp, mouse
gtccctcctgcagctgcaag

SEQ ID NO: 450901 - DNA, 20 bp, mouse
gtacagctctggctcttaga

SEQ ID NO: 450902 - DNA, 20 bp, mouse
gcaccacttgcagctgcagg

SEQ ID NO: 450903 - DNA, 20 bp, mouse
gcaacaccacttgcagctgc

SEQ ID NO: 450904 - DNA, 20 bp, mouse
gtccactcttctcagagatc

SEQ ID NO: 450905 - DNA, 20 bp, mouse
gtttacatgtccctgagtga

SEQ ID NO: 450906 - DNA, 20 bp, mouse
gaggttgaaacgagttccat

SEQ ID NO: 450907 - DNA, 20 bp, mouse
ggccctctgcagcatgccca

SEQ ID NO: 450908 - DNA, 20 bp, mouse
gtgactcaactgaattcagg

SEQ ID NO: 450909 - DNA, 20 bp, mouse
gctatgactcaactgaattc

SEQ ID NO: 450910 - DNA, 20 bp, mouse
gctgtagaagtggtgatgtt

SEQ ID NO: 450911 - DNA, 20 bp, mouse
gtggtgaatctctgtagaag

SEQ ID NO: 450912 - DNA, 20 bp, mouse
gttccatgggcatgctgcag

SEQ ID NO: 450913 - DNA, 20 bp, mouse
gccacaagagcctaagccat

SEQ ID NO: 450914 - DNA, 20 bp, mouse
gtacagagattcaccatggc

SEQ ID NO: 450915 - DNA, 20 bp, mouse
gcaaacaaatcctatggctt

SEQ ID NO: 450916 - DNA, 20 bp, mouse
gacagaggggaaaaaggggc

SEQ ID NO: 450917 - DNA, 20 bp, mouse
ggatcagctgaggctggggt

SEQ ID NO: 450918 - DNA, 20 bp, mouse
gggtctctatagatcagctg

SEQ ID NO: 450919 - DNA, 20 bp, mouse
gctggggtggggtggacggt

SEQ ID NO: 450920 - DNA, 20 bp, mouse
gggaggggcacttaaggtgt

SEQ ID NO: 450921 - DNA, 20 bp, mouse
ggtgggccagagcaccccca

SEQ ID NO: 450922 - DNA, 20 bp, mouse
gtatagatcagctgaggctg

SEQ ID NO: 450923 - DNA, 20 bp, mouse
gattgactggaggaccttgg

SEQ ID NO: 450924 - DNA, 20 bp, mouse
gatgttacttaaatacgatt

SEQ ID NO: 450925 - DNA, 20 bp, mouse
gtgtggaggaggggcactta

SEQ ID NO: 450926 - DNA, 20 bp, mouse
gcccttgggggaactattga

SEQ ID NO: 450927 - DNA, 20 bp, mouse
gggttctgagactttttcct

SEQ ID NO: 450928 - DNA, 20 bp, mouse
ggcctggtatctaaactcat

SEQ ID NO: 450929 - DNA, 20 bp, mouse
gctttgatgggcacatcccc

SEQ ID NO: 450930 - DNA, 20 bp, mouse
gtcttatattcatatcttac

SEQ ID NO: 450931 - DNA, 20 bp, mouse
ggaaggcagagaatagcaag

SEQ ID NO: 450932 - DNA, 20 bp, mouse
gagtgcttagaaagtataac

SEQ ID NO: 450933 - DNA, 20 bp, mouse
ggctggatgtcatcttcccg

SEQ ID NO: 450934 - DNA, 20 bp, mouse
ggccttcaatagttccccca

SEQ ID NO: 450935 - DNA, 20 bp, mouse
gagtaggaacttcaaaagtg

SEQ ID NO: 450936 - DNA, 20 bp, mouse
gagaggcccgtggcccagag

SEQ ID NO: 450937 - DNA, 20 bp, mouse
gccccgcgggccgcccaggc

SEQ ID NO: 450938 - DNA, 20 bp, mouse
gccgcgacgtccgcaagccg

SEQ ID NO: 450939 - DNA, 20 bp, mouse
gcggagtaccgagccggcct

SEQ ID NO: 450940 - DNA, 20 bp, mouse
ggatccgggtcaggctacga

SEQ ID NO: 450941 - DNA, 20 bp, mouse
gcggtcccggagtaccgagc

SEQ ID NO: 450942 - DNA, 20 bp, mouse
gaggccgcgctctccagcgg

SEQ ID NO: 450943 - DNA, 20 bp, mouse
gagtaccgagccggcctggg

SEQ ID NO: 450944 - DNA, 20 bp, mouse
ggacctgagcgtctccggcg

SEQ ID NO: 450945 - DNA, 20 bp, mouse
gcttgcggacgtcgcggtcc

SEQ ID NO: 450946 - DNA, 20 bp, mouse
gtgcaactctggggcagcta

SEQ ID NO: 450947 - DNA, 20 bp, mouse
gcacttggtctgcaactctg

SEQ ID NO: 450948 - DNA, 20 bp, mouse
gcccaccctgaggaaaccta

SEQ ID NO: 450949 - DNA, 20 bp, mouse
ggctctgggacaggccaggc

SEQ ID NO: 450950 - DNA, 20 bp, mouse
gtactcctggaccagaccga

SEQ ID NO: 450951 - DNA, 20 bp, mouse
gtcttgctctgggctgctgg

SEQ ID NO: 450952 - DNA, 20 bp, mouse
gaatgggcaacagacatacg

SEQ ID NO: 450953 - DNA, 20 bp, mouse
gacgccgcgtgaaaggtaat

SEQ ID NO: 450954 - DNA, 20 bp, mouse
gaactctcctgaggctccaa

SEQ ID NO: 450955 - DNA, 20 bp, mouse
gggaaacctagggtttttct

SEQ ID NO: 450956 - DNA, 20 bp, mouse
gcaggcagcagcagcagtat

SEQ ID NO: 450957 - DNA, 20 bp, mouse
ggccttaagacgtgtagccc

SEQ ID NO: 450958 - DNA, 20 bp, mouse
ggcctgggctacacgtctta

SEQ ID NO: 450959 - DNA, 20 bp, mouse
ggactcaccaacatcagata

SEQ ID NO: 450960 - DNA, 20 bp, mouse
ggatcatgaggtaaccagga

SEQ ID NO: 450961 - DNA, 20 bp, mouse
gctgctcctagggcattggg

SEQ ID NO: 450962 - DNA, 20 bp, mouse
gacgtgttgggtgccagagg

SEQ ID NO: 450963 - DNA, 20 bp, mouse
ggcagcagtatgggattttg

SEQ ID NO: 450964 - DNA, 20 bp, mouse
gactgctccccagaagataa

SEQ ID NO: 450965 - DNA, 20 bp, mouse
gatatggagggaggatcatg

SEQ ID NO: 450966 - DNA, 20 bp, mouse
gaggtgcagagacacttaat

SEQ ID NO: 450967 - DNA, 20 bp, mouse
gtaatccagcatccaggata

SEQ ID NO: 450968 - DNA, 20 bp, mouse
gtataaacgagaaataaaca

SEQ ID NO: 450969 - DNA, 20 bp, mouse
ggtgtctctgcaccttatcc

SEQ ID NO: 450970 - DNA, 20 bp, mouse
gacgagaaataaacatggta

SEQ ID NO: 450971 - DNA, 20 bp, mouse
gtgaagacgagtctgagatg

SEQ ID NO: 450972 - DNA, 20 bp, mouse
gcctgaagacgagtctgaga

SEQ ID NO: 450973 - DNA, 20 bp, mouse
gaaggattaatccagcatcc

SEQ ID NO: 450974 - DNA, 20 bp, mouse
gccacagggtggaactctct

SEQ ID NO: 450975 - DNA, 20 bp, mouse
gtgtggggatcagccctctg

SEQ ID NO: 450976 - DNA, 20 bp, mouse
gaatcaccagggcgagataa

SEQ ID NO: 450977 - DNA, 20 bp, mouse
ggagccttgttccttctcta

SEQ ID NO: 450978 - DNA, 20 bp, mouse
ggaacaaggctctcttctga

SEQ ID NO: 450979 - DNA, 20 bp, mouse
ggagctgtagagttgtatag

SEQ ID NO: 450980 - DNA, 20 bp, mouse
gcatttcccttatctcgccc

SEQ ID NO: 450981 - DNA, 20 bp, mouse
ggtctgtacttaatgtagat

SEQ ID NO: 450982 - DNA, 20 bp, mouse
gtgtacttaatgtagatggg

SEQ ID NO: 450983 - DNA, 20 bp, mouse
ggacaacttatcacagtgat

SEQ ID NO: 450984 - DNA, 20 bp, mouse
gaatgtagatgggaggataa

SEQ ID NO: 450985 - DNA, 20 bp, mouse
ggtagagttgtatagtggga

SEQ ID NO: 450986 - DNA, 20 bp, mouse
gggggagtgctgcaagctga

SEQ ID NO: 450987 - DNA, 20 bp, mouse
ggcctgcaaagggagtatcg

SEQ ID NO: 450988 - DNA, 20 bp, mouse
gaggtcataggattgtacag

SEQ ID NO: 450989 - DNA, 20 bp, mouse
gtactccctttgcaggccag

SEQ ID NO: 450990 - DNA, 20 bp, mouse
ggatgacacacatcttctga

SEQ ID NO: 450991 - DNA, 20 bp, mouse
gctcatttctagctggtgtc

SEQ ID NO: 450992 - DNA, 20 bp, mouse
gacacttggctgaggctcca

SEQ ID NO: 450993 - DNA, 20 bp, mouse
gcactcccctggcctgcaaa

SEQ ID NO: 450994 - DNA, 20 bp, mouse
gagacagatggtcttagatg

SEQ ID NO: 450995 - DNA, 20 bp, mouse
ggacagacatggaaggtcat

SEQ ID NO: 450996 - DNA, 20 bp, mouse
gtatgtagactggaggataa

SEQ ID NO: 450997 - DNA, 20 bp, mouse
gggccactagcaaagttagg

SEQ ID NO: 450998 - DNA, 20 bp, mouse
gaatggccactagcaaagtt

SEQ ID NO: 450999 - DNA, 20 bp, mouse
gctgtacttatgtagactgg

SEQ ID NO: 451000 - DNA, 20 bp, mouse
gggcaggtcttttcttgaaa

SEQ ID NO: 451001 - DNA, 20 bp, mouse
gagtctacataagtacagaa

SEQ ID NO: 451002 - DNA, 20 bp, mouse
gctacataagtacagaaagg

SEQ ID NO: 451003 - DNA, 20 bp, mouse
gagctggacagttttatagt

SEQ ID NO: 451004 - DNA, 20 bp, mouse
ggacaacctgttgctgcaat

SEQ ID NO: 451005 - DNA, 20 bp, mouse
gcattttgagtaggtgtcca

SEQ ID NO: 451006 - DNA, 20 bp, mouse
gtttagctcagagcatgagg

SEQ ID NO: 451007 - DNA, 20 bp, mouse
ggaggaggttgactgagttc

SEQ ID NO: 451008 - DNA, 20 bp, mouse
gtggccaagtcggccctgaa

SEQ ID NO: 451009 - DNA, 20 bp, mouse
gattattgaggtctatgtgc

SEQ ID NO: 451010 - DNA, 20 bp, mouse
gactcttgaagatatgactc

SEQ ID NO: 451011 - DNA, 20 bp, mouse
gttcaggaaagacagctaca

SEQ ID NO: 451012 - DNA, 20 bp, mouse
gaccaagacagcaagaccat

SEQ ID NO: 451013 - DNA, 20 bp, mouse
gggaaagacagctacaaggt

SEQ ID NO: 451014 - DNA, 20 bp, mouse
gaccatgcagacaagtgggc

SEQ ID NO: 451015 - DNA, 20 bp, mouse
gatgcaatgaggaggtcctt

SEQ ID NO: 451016 - DNA, 20 bp, mouse
gctagtgaatttagcttagg

SEQ ID NO: 451017 - DNA, 20 bp, mouse
ggaccagcccaaggtaaggt

SEQ ID NO: 451018 - DNA, 20 bp, mouse
gggtaatggtacatccaagt

SEQ ID NO: 451019 - DNA, 20 bp, mouse
gattctagtgaatttagctt

SEQ ID NO: 451020 - DNA, 20 bp, mouse
gttcctggcccctttcaaaa

SEQ ID NO: 451021 - DNA, 20 bp, mouse
gtttagcttagggggtgtga

SEQ ID NO: 451022 - DNA, 20 bp, mouse
gtgcaggaaagaccagccca

SEQ ID NO: 451023 - DNA, 20 bp, mouse
gttggatgtaccattacccc

SEQ ID NO: 451024 - DNA, 20 bp, mouse
ggagcgctgacctttttgaa

SEQ ID NO: 451025 - DNA, 20 bp, mouse
gagtgtgtgatgtgatgatg

SEQ ID NO: 451026 - DNA, 20 bp, mouse
gagaggggcgaaagacaagg

SEQ ID NO: 451027 - DNA, 20 bp, mouse
gtcaagtctgaggcaatccc

SEQ ID NO: 451028 - DNA, 20 bp, mouse
gtgatggaaatatacactct

SEQ ID NO: 451029 - DNA, 20 bp, mouse
gtctcttgacacacataatg

SEQ ID NO: 451030 - DNA, 20 bp, mouse
gagatttattctttttcact

SEQ ID NO: 451031 - DNA, 20 bp, mouse
gtctgaagagatacttgtga

SEQ ID NO: 451032 - DNA, 20 bp, mouse
gagagactcacatttcattt

SEQ ID NO: 451033 - DNA, 20 bp, mouse
gcaaaactttatcttgaaga

SEQ ID NO: 451034 - DNA, 20 bp, mouse
gttgacacacataatgtggc

SEQ ID NO: 451035 - DNA, 20 bp, mouse
gggaggaagaggaggaccat

SEQ ID NO: 451036 - DNA, 20 bp, mouse
gctggaaagtgagtcttgaa

SEQ ID NO: 451037 - DNA, 20 bp, mouse
ggatagaaaagcacttactg

SEQ ID NO: 451038 - DNA, 20 bp, mouse
gcaccacacaggtacaatct

SEQ ID NO: 451039 - DNA, 20 bp, mouse
gtctcttagaagtttgccaa

SEQ ID NO: 451040 - DNA, 20 bp, mouse
gcgcctgcatcccaccacac

SEQ ID NO: 451041 - DNA, 20 bp, mouse
ggttgacatactgtgctatc

SEQ ID NO: 451042 - DNA, 20 bp, mouse
gagaagtttgccaagggcta

SEQ ID NO: 451043 - DNA, 20 bp, mouse
gagaaaagcacttactgagg

SEQ ID NO: 451044 - DNA, 20 bp, mouse
ggtcttgaacttttaaaaag

SEQ ID NO: 451045 - DNA, 20 bp, mouse
gtggtgggatgcaggcgatt

SEQ ID NO: 451046 - DNA, 20 bp, mouse
ggacaggctttaggaaccag

SEQ ID NO: 451047 - DNA, 20 bp, mouse
gtaggaaccagtggcaagaa

SEQ ID NO: 451048 - DNA, 20 bp, mouse
gccagtggcaagaacggtgc

SEQ ID NO: 451049 - DNA, 20 bp, mouse
ggaacggtgcaggaggatga

SEQ ID NO: 451050 - DNA, 20 bp, mouse
gcctcaggagaacatagatc

SEQ ID NO: 451051 - DNA, 20 bp, mouse
gttactatggaaccaaggca

SEQ ID NO: 451052 - DNA, 20 bp, mouse
gtctctgggctggcaaagat

SEQ ID NO: 451053 - DNA, 20 bp, mouse
gggcttgcaggacaggcttt

SEQ ID NO: 451054 - DNA, 20 bp, mouse
gccagtggaggggctcttgg

SEQ ID NO: 451055 - DNA, 20 bp, mouse
gagggatgatacaaatctct

SEQ ID NO: 451056 - DNA, 20 bp, mouse
gcaattgaagaggtctccag

SEQ ID NO: 451057 - DNA, 20 bp, mouse
gtgaagaggtctccagaggt

SEQ ID NO: 451058 - DNA, 20 bp, mouse
gctggtgaatacaacaagct

SEQ ID NO: 451059 - DNA, 20 bp, mouse
gccaccaccaccatgaacac

SEQ ID NO: 451060 - DNA, 20 bp, mouse
gctgggcagtgcaattgaag

SEQ ID NO: 451061 - DNA, 20 bp, mouse
gtattcaccagtgttcatgg

SEQ ID NO: 451062 - DNA, 20 bp, mouse
ggaacccatggaggacgatg

SEQ ID NO: 451063 - DNA, 20 bp, mouse
gtacaggagacaccactgta

SEQ ID NO: 451064 - DNA, 20 bp, mouse
gggacttcccagggtcctaa

SEQ ID NO: 451065 - DNA, 20 bp, mouse
gtcaccagtgttcatggtgg

SEQ ID NO: 451066 - DNA, 20 bp, mouse
gagtagcaggaaccttggaa

SEQ ID NO: 451067 - DNA, 20 bp, mouse
ggaagggtagccatgatggt

SEQ ID NO: 451068 - DNA, 20 bp, mouse
gtgagcagtgcccaccatca

SEQ ID NO: 451069 - DNA, 20 bp, mouse
gcttggaagggtagccatga

SEQ ID NO: 451070 - DNA, 20 bp, mouse
gtgactcaggaagccctgga

SEQ ID NO: 451071 - DNA, 20 bp, mouse
gactgctcacaggagcctgt

SEQ ID NO: 451072 - DNA, 20 bp, mouse
ggtctcagagaaatagtagc

SEQ ID NO: 451073 - DNA, 20 bp, mouse
gtggtgtggcccagaacatt

SEQ ID NO: 451074 - DNA, 20 bp, mouse
gaagattcaaggctaccggt

SEQ ID NO: 451075 - DNA, 20 bp, mouse
gctttgtgctgtatcccatg

SEQ ID NO: 451076 - DNA, 20 bp, mouse
ggcagcattggcccgctctg

SEQ ID NO: 451077 - DNA, 20 bp, mouse
ggaaagacaatcccaaggtg

SEQ ID NO: 451078 - DNA, 20 bp, mouse
gtgcaggaaagacaatccca

SEQ ID NO: 451079 - DNA, 20 bp, mouse
gcatttaactcaagtgtgtg

SEQ ID NO: 451080 - DNA, 20 bp, mouse
gctcagtcaaaggagacaat

SEQ ID NO: 451081 - DNA, 20 bp, mouse
gtctacctgggacaagtggc

SEQ ID NO: 451082 - DNA, 20 bp, mouse
gggaattctcacctcacctt

SEQ ID NO: 451083 - DNA, 20 bp, mouse
gtcagcctgccacttgtccc

SEQ ID NO: 451084 - DNA, 20 bp, mouse
ggtctccaaaatacgactca

SEQ ID NO: 451085 - DNA, 20 bp, mouse
gaggaatacgtactgtgatg

SEQ ID NO: 451086 - DNA, 20 bp, mouse
gagatgctgctaaaacagag

SEQ ID NO: 451087 - DNA, 20 bp, mouse
ggagcaggcggggcaaaaag

SEQ ID NO: 451088 - DNA, 20 bp, mouse
gtctgggttggcatacagat

SEQ ID NO: 451089 - DNA, 20 bp, mouse
gtctttctggaagtctgggt

SEQ ID NO: 451090 - DNA, 20 bp, mouse
gaacaaggacattaccgagc

SEQ ID NO: 451091 - DNA, 20 bp, mouse
gatattcggtgcagcgagca

SEQ ID NO: 451092 - DNA, 20 bp, mouse
gaagtatgtcagatgagcag

SEQ ID NO: 451093 - DNA, 20 bp, mouse
gtgtagggaaattactcagt

SEQ ID NO: 451094 - DNA, 20 bp, mouse
ggtctttttgataagatatt

SEQ ID NO: 451095 - DNA, 20 bp, mouse
gctgaatgtatgctcctgct

SEQ ID NO: 451096 - DNA, 20 bp, mouse
ggtggtgaagcagtctacat

SEQ ID NO: 451097 - DNA, 20 bp, mouse
gatgctgaaggtgcttggag

SEQ ID NO: 451098 - DNA, 20 bp, mouse
gagcctggcacaaagaactt

SEQ ID NO: 451099 - DNA, 20 bp, mouse
gagcagtctacataggagcc

SEQ ID NO: 451100 - DNA, 20 bp, mouse
gttcggttgtagttaggagt

SEQ ID NO: 451101 - DNA, 20 bp, mouse
ggcatggaggagtaagtgaa

SEQ ID NO: 451102 - DNA, 20 bp, mouse
ggttgtagttaggagtaggt

SEQ ID NO: 451103 - DNA, 20 bp, mouse
gagtaggttggtacaagaaa

SEQ ID NO: 451104 - DNA, 20 bp, mouse
gaagaacttcggttgtagtt

SEQ ID NO: 451105 - DNA, 20 bp, mouse
gtcttccgcatgcatgctga

SEQ ID NO: 451106 - DNA, 20 bp, mouse
ggacgccgggcaccaagtag

SEQ ID NO: 451107 - DNA, 20 bp, mouse
gtgccggcgggatcgctctg

SEQ ID NO: 451108 - DNA, 20 bp, mouse
ggttagcagtcgctgctggg

SEQ ID NO: 451109 - DNA, 20 bp, mouse
gatcgctctggggagacgcc

SEQ ID NO: 451110 - DNA, 20 bp, mouse
gctccccagagcgatcccgc

SEQ ID NO: 451111 - DNA, 20 bp, mouse
gggcagctcaggtgtccgac

SEQ ID NO: 451112 - DNA, 20 bp, mouse
gctcagaagaggatgctgcg

SEQ ID NO: 451113 - DNA, 20 bp, mouse
gagcttggtgcggccaggtg

SEQ ID NO: 451114 - DNA, 20 bp, mouse
ggtggaaccgggccacacag

SEQ ID NO: 451115 - DNA, 20 bp, mouse
gtgtccgactggccgctact

SEQ ID NO: 451116 - DNA, 20 bp, mouse
gtcatttcgaggccattctg

SEQ ID NO: 451117 - DNA, 20 bp, mouse
ggagtcaggtgaggactcag

SEQ ID NO: 451118 - DNA, 20 bp, mouse
gccgagcgaacgagcaaatc

SEQ ID NO: 451119 - DNA, 20 bp, mouse
gttctcggtttacctcagaa

SEQ ID NO: 451120 - DNA, 20 bp, mouse
gccccggagggaaggcttaa

SEQ ID NO: 451121 - DNA, 20 bp, mouse
ggcgcgctgcagcggaatcg

SEQ ID NO: 451122 - DNA, 20 bp, mouse
gaagctgtggagtgagggtt

SEQ ID NO: 451123 - DNA, 20 bp, mouse
gaagtgtggaaatgcatcct

SEQ ID NO: 451124 - DNA, 20 bp, mouse
gacagtgtaatcaggtatcc

SEQ ID NO: 451125 - DNA, 20 bp, mouse
ggggctagaaaggcatttgg

SEQ ID NO: 451126 - DNA, 20 bp, mouse
gatggctgaagaacaacctc

SEQ ID NO: 451127 - DNA, 20 bp, mouse
gctggtccccgacgcaacca

SEQ ID NO: 451128 - DNA, 20 bp, mouse
gcaggtcgaactgttcgtga

SEQ ID NO: 451129 - DNA, 20 bp, mouse
gctcccagttcccccagcga

SEQ ID NO: 451130 - DNA, 20 bp, mouse
ggatggggcagagagaacgt

SEQ ID NO: 451131 - DNA, 20 bp, mouse
ggctgggagtggggtcaact

SEQ ID NO: 451132 - DNA, 20 bp, mouse
gttcagccatggttgcgtcg

SEQ ID NO: 451133 - DNA, 20 bp, mouse
ggcctgtggggaagccgtgt

SEQ ID NO: 451134 - DNA, 20 bp, mouse
ggaggggccggggcaaggga

SEQ ID NO: 451135 - DNA, 20 bp, mouse
gtaaacaggagggaccgagg

SEQ ID NO: 451136 - DNA, 20 bp, mouse
gtgggagccgaggcatccgg

SEQ ID NO: 451137 - DNA, 20 bp, mouse
ggaagagccgctgacaggaa

SEQ ID NO: 451138 - DNA, 20 bp, mouse
gtgggtgaggagctaccata

SEQ ID NO: 451139 - DNA, 20 bp, mouse
gtcagccatggtgggagccg

SEQ ID NO: 451140 - DNA, 20 bp, mouse
ggaggtggctggcccgaggt

SEQ ID NO: 451141 - DNA, 20 bp, mouse
gtggtggtttcagccatggt

SEQ ID NO: 451142 - DNA, 20 bp, mouse
ggtgaggagctaccataagg

SEQ ID NO: 451143 - DNA, 20 bp, mouse
gagagactggctgcagggtg

SEQ ID NO: 451144 - DNA, 20 bp, mouse
gtggtgggagccgaggcatc

SEQ ID NO: 451145 - DNA, 20 bp, mouse
gtggctctggaggcaggcta

SEQ ID NO: 451146 - DNA, 20 bp, mouse
gccacgggcagccagacgcc

SEQ ID NO: 451147 - DNA, 20 bp, mouse
gcagcccgcgtcgctcggga

SEQ ID NO: 451148 - DNA, 20 bp, mouse
gggaatgagcgcgggaggta

SEQ ID NO: 451149 - DNA, 20 bp, mouse
gtgacgaagagctcgatgag

SEQ ID NO: 451150 - DNA, 20 bp, mouse
gccgctgggcggagccctat

SEQ ID NO: 451151 - DNA, 20 bp, mouse
ggctggacagtcccggcgtc

SEQ ID NO: 451152 - DNA, 20 bp, mouse
gtccgcccagcggtttgaag

SEQ ID NO: 451153 - DNA, 20 bp, mouse
gagcccagcccaaccggcca

SEQ ID NO: 451154 - DNA, 20 bp, mouse
gaggcgcggagcccagacaa

SEQ ID NO: 451155 - DNA, 20 bp, mouse
ggagggtgacagtacccacg

SEQ ID NO: 451156 - DNA, 20 bp, mouse
gcaagtgcctgactgctggg

SEQ ID NO: 451157 - DNA, 20 bp, mouse
ggactgctgggaggtgtcac

SEQ ID NO: 451158 - DNA, 20 bp, mouse
ggagctaagggattgacaac

SEQ ID NO: 451159 - DNA, 20 bp, mouse
ggcgggatcgctgacagtct

SEQ ID NO: 451160 - DNA, 20 bp, mouse
gaaaaggaaaagcgagctaa

SEQ ID NO: 451161 - DNA, 20 bp, mouse
gaggctcctgctcacagcgg

SEQ ID NO: 451162 - DNA, 20 bp, mouse
ggccaccggcaggaccagga

SEQ ID NO: 451163 - DNA, 20 bp, mouse
gcgctggactgtgctcccta

SEQ ID NO: 451164 - DNA, 20 bp, mouse
ggcctgaagtgctgcagagg

SEQ ID NO: 451165 - DNA, 20 bp, mouse
gcattcgcgggcctcctccc

SEQ ID NO: 451166 - DNA, 20 bp, mouse
gtctgtgcaggccagggtgt

SEQ ID NO: 451167 - DNA, 20 bp, mouse
gtggttccctgcggtctcaa

SEQ ID NO: 451168 - DNA, 20 bp, mouse
gtgaagtctttggaagagat

SEQ ID NO: 451169 - DNA, 20 bp, mouse
ggcttgcctcttgaagtctt

SEQ ID NO: 451170 - DNA, 20 bp, mouse
gcgacgctgctcagggtgag

SEQ ID NO: 451171 - DNA, 20 bp, mouse
gcgggaggacaccccactcg

SEQ ID NO: 451172 - DNA, 20 bp, mouse
gaggagctgcggacctggag

SEQ ID NO: 451173 - DNA, 20 bp, mouse
gtggggtgtcctcccggagg

SEQ ID NO: 451174 - DNA, 20 bp, mouse
ggaagctgcagaggcaccta

SEQ ID NO: 451175 - DNA, 20 bp, mouse
ggtcaacccttgagaccgca

SEQ ID NO: 451176 - DNA, 20 bp, mouse
gtggccgggagaaggagctc

SEQ ID NO: 451177 - DNA, 20 bp, mouse
ggggagaaggagctccggct

SEQ ID NO: 451178 - DNA, 20 bp, mouse
gtccggctagggagagttcg

SEQ ID NO: 451179 - DNA, 20 bp, mouse
gggctagggagagttcgcgg

SEQ ID NO: 451180 - DNA, 20 bp, mouse
gcttctcccggccacagcca

SEQ ID NO: 451181 - DNA, 20 bp, mouse
gcgtctcgacgtgtcactgg

SEQ ID NO: 451182 - DNA, 20 bp, mouse
gacaaagcgtgagtatcggg

SEQ ID NO: 451183 - DNA, 20 bp, mouse
gagttcgcggcggtgggtgg

SEQ ID NO: 451184 - DNA, 20 bp, mouse
gagggagagttcgcggcggt

SEQ ID NO: 451185 - DNA, 20 bp, mouse
gccgcgtctcgacgtgtcac

SEQ ID NO: 451186 - DNA, 20 bp, mouse
gccgagccgaagagccgggg

SEQ ID NO: 451187 - DNA, 20 bp, mouse
ggctgctgggaggcaggtga

SEQ ID NO: 451188 - DNA, 20 bp, mouse
gggcaggtgacggcgaccag

SEQ ID NO: 451189 - DNA, 20 bp, mouse
ggagcggagggagaacgggt

SEQ ID NO: 451190 - DNA, 20 bp, mouse
ggaaggagcggagggagaac

SEQ ID NO: 451191 - DNA, 20 bp, mouse
ggccgcggacgcacccggga

SEQ ID NO: 451192 - DNA, 20 bp, mouse
gccgagaacggctcccgagg

SEQ ID NO: 451193 - DNA, 20 bp, mouse
ggccgaagagccggggaggc

SEQ ID NO: 451194 - DNA, 20 bp, mouse
gagggaaacgccgggaggga

SEQ ID NO: 451195 - DNA, 20 bp, mouse
gtcccgcctccccggctctt

SEQ ID NO: 451196 - DNA, 20 bp, mouse
gggacgcgcggaccaagagg

SEQ ID NO: 451197 - DNA, 20 bp, mouse
gtgtatcggcgtgaggagac

SEQ ID NO: 451198 - DNA, 20 bp, mouse
gggagacccggttagtgtat

SEQ ID NO: 451199 - DNA, 20 bp, mouse
ggactccgagcgcggagacc

SEQ ID NO: 451200 - DNA, 20 bp, mouse
ggaggcccggactccgagcg

SEQ ID NO: 451201 - DNA, 20 bp, mouse
gacgtccagaaggggataga

SEQ ID NO: 451202 - DNA, 20 bp, mouse
gaaggacgcagagtcgcggg

SEQ ID NO: 451203 - DNA, 20 bp, mouse
gcaggatctacgtccagaag

SEQ ID NO: 451204 - DNA, 20 bp, mouse
ggctgctggagctccaaggt

SEQ ID NO: 451205 - DNA, 20 bp, mouse
ggtcgcgtgggcaaggacag

SEQ ID NO: 451206 - DNA, 20 bp, mouse
ggacgagatgggggacgaga

SEQ ID NO: 451207 - DNA, 20 bp, mouse
gatcggggtgtcagtgtcgg

SEQ ID NO: 451208 - DNA, 20 bp, mouse
gcagtgtcgggggacgagat

SEQ ID NO: 451209 - DNA, 20 bp, mouse
gtggcacccgaagagaagaa

SEQ ID NO: 451210 - DNA, 20 bp, mouse
gagagagttcaggagtatcg

SEQ ID NO: 451211 - DNA, 20 bp, mouse
gtccagagctggggactagg

SEQ ID NO: 451212 - DNA, 20 bp, mouse
ggatataggtcagcatgaga

SEQ ID NO: 451213 - DNA, 20 bp, mouse
gggggacgaggcccagacgc

SEQ ID NO: 451214 - DNA, 20 bp, mouse
gtgggcctgagagaagtggc

SEQ ID NO: 451215 - DNA, 20 bp, mouse
ggaggcccagacgctggcgg

SEQ ID NO: 451216 - DNA, 20 bp, mouse
gaggggactccaccaaaggg

SEQ ID NO: 451217 - DNA, 20 bp, mouse
gcaaaggggactccaccaaa

SEQ ID NO: 451218 - DNA, 20 bp, mouse
gaagccacggtggtaatggc

SEQ ID NO: 451219 - DNA, 20 bp, mouse
gtggcttggggcactcaaag

SEQ ID NO: 451220 - DNA, 20 bp, mouse
ggaatctacatagggcccga

SEQ ID NO: 451221 - DNA, 20 bp, mouse
gctggaacttgaatctacat

SEQ ID NO: 451222 - DNA, 20 bp, mouse
gttgtcttgcctccctttgg

SEQ ID NO: 451223 - DNA, 20 bp, mouse
gaagccagccaggtcaccac

SEQ ID NO: 451224 - DNA, 20 bp, mouse
gaaggcagaggtggataaca

SEQ ID NO: 451225 - DNA, 20 bp, mouse
ggtgaaactcacttctgtaa

SEQ ID NO: 451226 - DNA, 20 bp, mouse
gtagtagaagctcaagaggt

SEQ ID NO: 451227 - DNA, 20 bp, mouse
gagaggtggcaggctcgtct

SEQ ID NO: 451228 - DNA, 20 bp, mouse
ggagttagtagaagctcaag

SEQ ID NO: 451229 - DNA, 20 bp, mouse
gtcagaatggaacggcgacc

SEQ ID NO: 451230 - DNA, 20 bp, mouse
ggctcgtctcggtacttacc

SEQ ID NO: 451231 - DNA, 20 bp, mouse
gcaagccaggatgcactccg

SEQ ID NO: 451232 - DNA, 20 bp, mouse
gccttgggagctaaaatcta

SEQ ID NO: 451233 - DNA, 20 bp, mouse
gctaaatgagattctcagaa

SEQ ID NO: 451234 - DNA, 20 bp, mouse
ggactcctcggagtgcatcc

SEQ ID NO: 451235 - DNA, 20 bp, mouse
gagccggttgaaggactcct

SEQ ID NO: 451236 - DNA, 20 bp, mouse
ggacaaagcttacaaggcga

SEQ ID NO: 451237 - DNA, 20 bp, mouse
gggcgaagacaaagcttaca

SEQ ID NO: 451238 - DNA, 20 bp, mouse
gccgcctacgcagaagccag

SEQ ID NO: 451239 - DNA, 20 bp, mouse
gccgctgcggctcttcacgg

SEQ ID NO: 451240 - DNA, 20 bp, mouse
ggcggcgggacctaagatgg

SEQ ID NO: 451241 - DNA, 20 bp, mouse
gaccccgctgcggctcttca

SEQ ID NO: 451242 - DNA, 20 bp, mouse
gctcccaacacaaaatggtg

SEQ ID NO: 451243 - DNA, 20 bp, mouse
gggccagagctccgcagccg

SEQ ID NO: 451244 - DNA, 20 bp, mouse
ggccgcagcggggtccttgg

SEQ ID NO: 451245 - DNA, 20 bp, mouse
gtggccgctggcttctgcgt

SEQ ID NO: 451246 - DNA, 20 bp, mouse
gtcccacaggaagtccgtga

SEQ ID NO: 451247 - DNA, 20 bp, mouse
gccagagccggagaccgagc

SEQ ID NO: 451248 - DNA, 20 bp, mouse
gcggagtcccggcacccccg

SEQ ID NO: 451249 - DNA, 20 bp, mouse
gcgtgcgtgctcgctcacgg

SEQ ID NO: 451250 - DNA, 20 bp, mouse
gggcgccgagcggatcctgg

SEQ ID NO: 451251 - DNA, 20 bp, mouse
gaggtcccagggccccgggt

SEQ ID NO: 451252 - DNA, 20 bp, mouse
gggcactgcggccggagtcc

SEQ ID NO: 451253 - DNA, 20 bp, mouse
gccggagaccgagctgggat

SEQ ID NO: 451254 - DNA, 20 bp, mouse
gatggctaccgccagacgga

SEQ ID NO: 451255 - DNA, 20 bp, mouse
gaggaagtccgtgatggcgg

SEQ ID NO: 451256 - DNA, 20 bp, mouse
gacgggctgagtgactcgag

SEQ ID NO: 451257 - DNA, 20 bp, mouse
ggatgccgcagcgaaaggac

SEQ ID NO: 451258 - DNA, 20 bp, mouse
gggtgggaggggtctagact

SEQ ID NO: 451259 - DNA, 20 bp, mouse
gagtgactcgagtggcagag

SEQ ID NO: 451260 - DNA, 20 bp, mouse
gcgttggacagtaggtggga

SEQ ID NO: 451261 - DNA, 20 bp, mouse
gtcagcccgtcctttcgctg

SEQ ID NO: 451262 - DNA, 20 bp, mouse
gcgcccgatgccgcagcgaa

SEQ ID NO: 451263 - DNA, 20 bp, mouse
ggctcgagcgagcagtctcc

SEQ ID NO: 451264 - DNA, 20 bp, mouse
gaaagcgttggacagtaggt

SEQ ID NO: 451265 - DNA, 20 bp, mouse
gtgctcgctcgagccagctg

SEQ ID NO: 451266 - DNA, 20 bp, mouse
ggccacctgaggaggttgta

SEQ ID NO: 451267 - DNA, 20 bp, mouse
gagcggctggagaggaacga

SEQ ID NO: 451268 - DNA, 20 bp, mouse
gggctggagaggaacgacgg

SEQ ID NO: 451269 - DNA, 20 bp, mouse
ggcgctggagccacctgagg

SEQ ID NO: 451270 - DNA, 20 bp, mouse
gttgtcggtgtctgtcgcag

SEQ ID NO: 451271 - DNA, 20 bp, mouse
gaggttgtagggtgacggcg

SEQ ID NO: 451272 - DNA, 20 bp, mouse
gtgaggaggttgtagggtga

SEQ ID NO: 451273 - DNA, 20 bp, mouse
ggcgacagacaccgacaaaa

SEQ ID NO: 451274 - DNA, 20 bp, mouse
gggcgcggacgccattttgt

SEQ ID NO: 451275 - DNA, 20 bp, mouse
ggagaggaacgacggcggtt

SEQ ID NO: 451276 - DNA, 20 bp, mouse
gccagcgcgaggagctcatc

SEQ ID NO: 451277 - DNA, 20 bp, mouse
gcgaagggccggccccgccg

SEQ ID NO: 451278 - DNA, 20 bp, mouse
ggggccggccccgccgcggg

SEQ ID NO: 451279 - DNA, 20 bp, mouse
gggctgctcaggagtgggac

SEQ ID NO: 451280 - DNA, 20 bp, mouse
gcggcgcaggccagccacac

SEQ ID NO: 451281 - DNA, 20 bp, mouse
ggcacagcgtcagtcccgag

SEQ ID NO: 451282 - DNA, 20 bp, mouse
gtaccggaggcggtaggagg

SEQ ID NO: 451283 - DNA, 20 bp, mouse
ggggctggtgggcgggcgaa

SEQ ID NO: 451284 - DNA, 20 bp, mouse
gggatacgggccctccgggg

SEQ ID NO: 451285 - DNA, 20 bp, mouse
gcggctccggggcgcacggg

SEQ ID NO: 451286 - DNA, 20 bp, mouse
gtagggaggagaaggcgagg

SEQ ID NO: 451287 - DNA, 20 bp, mouse
gggaaaagtgttccacgaag

SEQ ID NO: 451288 - DNA, 20 bp, mouse
gggttagggaggagaaggcg

SEQ ID NO: 451289 - DNA, 20 bp, mouse
gctgctcacagaaggtccgt

SEQ ID NO: 451290 - DNA, 20 bp, mouse
gaggagaaggcgaggcggca

SEQ ID NO: 451291 - DNA, 20 bp, mouse
ggcaaggagctaccgcttcg

SEQ ID NO: 451292 - DNA, 20 bp, mouse
gggggccgggcccagggtta

SEQ ID NO: 451293 - DNA, 20 bp, mouse
gctgggcccggcccccgtcc

SEQ ID NO: 451294 - DNA, 20 bp, mouse
ggccccccgcgcgcaccccg

SEQ ID NO: 451295 - DNA, 20 bp, mouse
gtaggtgagtgccttgggga

SEQ ID NO: 451296 - DNA, 20 bp, mouse
gcttaaaggtacaggcctgg

SEQ ID NO: 451297 - DNA, 20 bp, mouse
gtgtcgtgtatagcagacag

SEQ ID NO: 451298 - DNA, 20 bp, mouse
gcacgtgatggaaggctcac

SEQ ID NO: 451299 - DNA, 20 bp, mouse
gagcagctgaactctccgca

SEQ ID NO: 451300 - DNA, 20 bp, mouse
gagagttcagctgctcttaa

SEQ ID NO: 451301 - DNA, 20 bp, mouse
gcgggggctttgctttagag

SEQ ID NO: 451302 - DNA, 20 bp, mouse
gcaaggtagacgagcaggtt

SEQ ID NO: 451303 - DNA, 20 bp, mouse
gcggaacctgggactgaccg

SEQ ID NO: 451304 - DNA, 20 bp, mouse
gctccgcaaggtagacgagc

SEQ ID NO: 451305 - DNA, 20 bp, mouse
gatagcagacagcggaacct

SEQ ID NO: 451306 - DNA, 20 bp, mouse
gcggctccctgagatcccgg

SEQ ID NO: 451307 - DNA, 20 bp, mouse
gcggagcctccgggatctca

SEQ ID NO: 451308 - DNA, 20 bp, mouse
ggccccccgcgcagcatccg

SEQ ID NO: 451309 - DNA, 20 bp, mouse
gccgcggctccctgagatcc

SEQ ID NO: 451310 - DNA, 20 bp, mouse
gtagcgcgcccggggacgca

SEQ ID NO: 451311 - DNA, 20 bp, mouse
ggcgcacgcaaggccgacgc

SEQ ID NO: 451312 - DNA, 20 bp, mouse
gcttggctggctcctcgcgg

SEQ ID NO: 451313 - DNA, 20 bp, mouse
ggcaatggcagctaacgata

SEQ ID NO: 451314 - DNA, 20 bp, mouse
ggtgcttggctggctcctcg

SEQ ID NO: 451315 - DNA, 20 bp, mouse
gcccgggcgcgctaaggtat

SEQ ID NO: 451316 - DNA, 20 bp, mouse
gcgccttccgggaggagaga

SEQ ID NO: 451317 - DNA, 20 bp, mouse
gagccgtctctcctcccgga

SEQ ID NO: 451318 - DNA, 20 bp, mouse
gctcggcctcgccttccggg

SEQ ID NO: 451319 - DNA, 20 bp, mouse
ggcgcagccgtctctcctcc

SEQ ID NO: 451320 - DNA, 20 bp, mouse
ggcccaacgcggggaaggct

SEQ ID NO: 451321 - DNA, 20 bp, mouse
gagtttgagagacctcgcca

SEQ ID NO: 451322 - DNA, 20 bp, mouse
ggcagggataggctactcgg

SEQ ID NO: 451323 - DNA, 20 bp, mouse
gacgctcggcctcgccttcc

SEQ ID NO: 451324 - DNA, 20 bp, mouse
gaggcggcagctcctcggag

SEQ ID NO: 451325 - DNA, 20 bp, mouse
ggcccagccttccccgcgtt

SEQ ID NO: 451326 - DNA, 20 bp, mouse
ggccatcccgcccctagcac

SEQ ID NO: 451327 - DNA, 20 bp, mouse
gcagcgcgcgacactgtcgt

SEQ ID NO: 451328 - DNA, 20 bp, mouse
gcggtcacgaggtgtgtcta

SEQ ID NO: 451329 - DNA, 20 bp, mouse
gtccggtgctaggggcggga

SEQ ID NO: 451330 - DNA, 20 bp, mouse
gctgaggcggggacacagat

SEQ ID NO: 451331 - DNA, 20 bp, mouse
gcgggtggacgattcagact

SEQ ID NO: 451332 - DNA, 20 bp, mouse
gccggagccagatagaatac

SEQ ID NO: 451333 - DNA, 20 bp, mouse
gatttctccggtgctagggg

SEQ ID NO: 451334 - DNA, 20 bp, mouse
gataggtcctgggccaccgt

SEQ ID NO: 451335 - DNA, 20 bp, mouse
gagactgggtccgactggat

SEQ ID NO: 451336 - DNA, 20 bp, mouse
ggctgaaggactctgctgag

SEQ ID NO: 451337 - DNA, 20 bp, mouse
gctcctggaaagggggtcca

SEQ ID NO: 451338 - DNA, 20 bp, mouse
ggtgctccaggatgcgaccg

SEQ ID NO: 451339 - DNA, 20 bp, mouse
ggacggctagctcctggaaa

SEQ ID NO: 451340 - DNA, 20 bp, mouse
gggggtccacggtcgcatcc

SEQ ID NO: 451341 - DNA, 20 bp, mouse
gctcttggttcacactgtca

SEQ ID NO: 451342 - DNA, 20 bp, mouse
gtcagtcttcctttagtcaa

SEQ ID NO: 451343 - DNA, 20 bp, mouse
gctatcttacagagtgctcc

SEQ ID NO: 451344 - DNA, 20 bp, mouse
ggaccgtggaccccctttcc

SEQ ID NO: 451345 - DNA, 20 bp, mouse
gctagcggctcctccaatgg

SEQ ID NO: 451346 - DNA, 20 bp, mouse
ggctccacgcgaaccgagag

SEQ ID NO: 451347 - DNA, 20 bp, mouse
ggcccgtcggccgacccagg

SEQ ID NO: 451348 - DNA, 20 bp, mouse
ggctacgactactgcttccg

SEQ ID NO: 451349 - DNA, 20 bp, mouse
ggaggcgagtaccgcaatcg

SEQ ID NO: 451350 - DNA, 20 bp, mouse
gcgtcggccgacccaggcgg

SEQ ID NO: 451351 - DNA, 20 bp, mouse
gaaccagccgagctcgggag

SEQ ID NO: 451352 - DNA, 20 bp, mouse
gtgctgcagccggagcccgt

SEQ ID NO: 451353 - DNA, 20 bp, mouse
ggacagaaccagccgagctc

SEQ ID NO: 451354 - DNA, 20 bp, mouse
gctgcagcagccagacaccg

SEQ ID NO: 451355 - DNA, 20 bp, mouse
gtccgtgcgagccgcgattg

SEQ ID NO: 451356 - DNA, 20 bp, mouse
gggagagaggaaaccccgga

SEQ ID NO: 451357 - DNA, 20 bp, mouse
gcgggagccggcagcaccag

SEQ ID NO: 451358 - DNA, 20 bp, mouse
gccgggaggcagcgcaatca

SEQ ID NO: 451359 - DNA, 20 bp, mouse
gggcagcgcaatcacggact

SEQ ID NO: 451360 - DNA, 20 bp, mouse
gcgacagccgggacacgcca

SEQ ID NO: 451361 - DNA, 20 bp, mouse
gccacgacgcatgcgccggg

SEQ ID NO: 451362 - DNA, 20 bp, mouse
gggactcggctggcggctac

SEQ ID NO: 451363 - DNA, 20 bp, mouse
gtcggctggcggctaccggc

SEQ ID NO: 451364 - DNA, 20 bp, mouse
gcccgggttccgtggaggag

SEQ ID NO: 451365 - DNA, 20 bp, mouse
ggcgcaatcacggactcggc

SEQ ID NO: 451366 - DNA, 20 bp, mouse
gtgaggtccgaggtttgctg

SEQ ID NO: 451367 - DNA, 20 bp, mouse
gcgaggtttgctgaggtcgg

SEQ ID NO: 451368 - DNA, 20 bp, mouse
gactagccggaaagcaaagg

SEQ ID NO: 451369 - DNA, 20 bp, mouse
gcacagaaacctgggacctc

SEQ ID NO: 451370 - DNA, 20 bp, mouse
ggtccgtgcccgtataggta

SEQ ID NO: 451371 - DNA, 20 bp, mouse
gtttaggtgaacgttattcg

SEQ ID NO: 451372 - DNA, 20 bp, mouse
gaccagcttcacagaaacct

SEQ ID NO: 451373 - DNA, 20 bp, mouse
gtgctgggccgggaataaca

SEQ ID NO: 451374 - DNA, 20 bp, mouse
gaatactagccggaaagcaa

SEQ ID NO: 451375 - DNA, 20 bp, mouse
gcgttattcgtggtttgctg

SEQ ID NO: 451376 - DNA, 20 bp, mouse
ggctccagggcgcacccaag

SEQ ID NO: 451377 - DNA, 20 bp, mouse
ggcggcagccatgttgatcg

SEQ ID NO: 451378 - DNA, 20 bp, mouse
ggtgctagccacgatcaaca

SEQ ID NO: 451379 - DNA, 20 bp, mouse
ggtggttctcctcaacaccg

SEQ ID NO: 451380 - DNA, 20 bp, mouse
gaccttcgtccccggacggg

SEQ ID NO: 451381 - DNA, 20 bp, mouse
gccagctagagaaagatctg

SEQ ID NO: 451382 - DNA, 20 bp, mouse
gagaccgcggggagccgcag

SEQ ID NO: 451383 - DNA, 20 bp, mouse
gttaaccctaggaagagccg

SEQ ID NO: 451384 - DNA, 20 bp, mouse
gagcgcctcggctcttccta

SEQ ID NO: 451385 - DNA, 20 bp, mouse
gtctccacggcgcccccagg

SEQ ID NO: 451386 - DNA, 20 bp, mouse
gtggcccagagtgctgctgg

SEQ ID NO: 451387 - DNA, 20 bp, mouse
gagtggtggagcagacggta

SEQ ID NO: 451388 - DNA, 20 bp, mouse
gaggcccgggtggctgtgga

SEQ ID NO: 451389 - DNA, 20 bp, mouse
gcccagagtgctgctggggg

SEQ ID NO: 451390 - DNA, 20 bp, mouse
gcggagtgcgcgtcgtcatg

SEQ ID NO: 451391 - DNA, 20 bp, mouse
ggtcggtcggcgtgcaaggg

SEQ ID NO: 451392 - DNA, 20 bp, mouse
gagtgctgctgggggaggcc

SEQ ID NO: 451393 - DNA, 20 bp, mouse
gagcagctcacagcagtcca

SEQ ID NO: 451394 - DNA, 20 bp, mouse
ggacgacgcgcactccggct

SEQ ID NO: 451395 - DNA, 20 bp, mouse
ggtagttccggaagccaagc

SEQ ID NO: 451396 - DNA, 20 bp, mouse
gagaacaaggaccttctcca

SEQ ID NO: 451397 - DNA, 20 bp, mouse
ggtgtctggtaaagctgggg

SEQ ID NO: 451398 - DNA, 20 bp, mouse
gctccggcagcacacagcta

SEQ ID NO: 451399 - DNA, 20 bp, mouse
ggacagccgagaactcaggg

SEQ ID NO: 451400 - DNA, 20 bp, mouse
gccagctttaccagacacca

SEQ ID NO: 451401 - DNA, 20 bp, mouse
gtaagacagccgagaactca

SEQ ID NO: 451402 - DNA, 20 bp, mouse
gtgcataggccactgcaagg

SEQ ID NO: 451403 - DNA, 20 bp, mouse
gagctgcataggccactgca

SEQ ID NO: 451404 - DNA, 20 bp, mouse
ggactcggccggctgtacag

SEQ ID NO: 451405 - DNA, 20 bp, mouse
gcggggtccgggagctgcat

SEQ ID NO: 451406 - DNA, 20 bp, mouse
gaaagccaggacggtgacca

SEQ ID NO: 451407 - DNA, 20 bp, mouse
gcaggccttggtcaccgtcc

SEQ ID NO: 451408 - DNA, 20 bp, mouse
gccgtcccagggcaagtcaa

SEQ ID NO: 451409 - DNA, 20 bp, mouse
gaatgccatgatggcctggg

SEQ ID NO: 451410 - DNA, 20 bp, mouse
gggtcccagcaagcaaagcc

SEQ ID NO: 451411 - DNA, 20 bp, mouse
ggcctgagtgaatgccatga

SEQ ID NO: 451412 - DNA, 20 bp, mouse
gaggtgtacttcacagtcct

SEQ ID NO: 451413 - DNA, 20 bp, mouse
gagagggcttgggatagtgg

SEQ ID NO: 451414 - DNA, 20 bp, mouse
gatggtctccagtccaggaa

SEQ ID NO: 451415 - DNA, 20 bp, mouse
ggccgcaagctccctgaacc

SEQ ID NO: 451416 - DNA, 20 bp, mouse
gaggcagctctggtcaggta

SEQ ID NO: 451417 - DNA, 20 bp, mouse
ggcggcgcaggaggcggacg

SEQ ID NO: 451418 - DNA, 20 bp, mouse
ggccggcagcgccgtggtgg

SEQ ID NO: 451419 - DNA, 20 bp, mouse
gcagctctggtcaggtacgg

SEQ ID NO: 451420 - DNA, 20 bp, mouse
ggacggggccggcagcgccg

SEQ ID NO: 451421 - DNA, 20 bp, mouse
gccgcagtgcccgagatcgg

SEQ ID NO: 451422 - DNA, 20 bp, mouse
gaatattcaaggtccctctg

SEQ ID NO: 451423 - DNA, 20 bp, mouse
gggagacccggcgcgcaaca

SEQ ID NO: 451424 - DNA, 20 bp, mouse
gcggccgggggaggcagctc

SEQ ID NO: 451425 - DNA, 20 bp, mouse
gcaccgtccggcctcctggg

SEQ ID NO: 451426 - DNA, 20 bp, mouse
gccgggaaccgagcagctgg

SEQ ID NO: 451427 - DNA, 20 bp, mouse
ggagtcacccgagcacggac

SEQ ID NO: 451428 - DNA, 20 bp, mouse
gtgggccgcagggccagata

SEQ ID NO: 451429 - DNA, 20 bp, mouse
ggctgctcggttcccggaag

SEQ ID NO: 451430 - DNA, 20 bp, mouse
ggcgtccgggagccctaaga

SEQ ID NO: 451431 - DNA, 20 bp, mouse
ggctcccgataacccacacc

SEQ ID NO: 451432 - DNA, 20 bp, mouse
gttatcgggagcatgcgggg

SEQ ID NO: 451433 - DNA, 20 bp, mouse
ggttgcggcgccatgtggag

SEQ ID NO: 451434 - DNA, 20 bp, mouse
ggcgccgggtgtgggttatc

SEQ ID NO: 451435 - DNA, 20 bp, mouse
ggcagcggctctcccgtgag

SEQ ID NO: 451436 - DNA, 20 bp, mouse
gtactccggtgagtagaagg

SEQ ID NO: 451437 - DNA, 20 bp, mouse
gtagaaccgacggaagggag

SEQ ID NO: 451438 - DNA, 20 bp, mouse
gcgcgccctgaggatcgagg

SEQ ID NO: 451439 - DNA, 20 bp, mouse
gggaggggaggagcctactc

SEQ ID NO: 451440 - DNA, 20 bp, mouse
gtgggacgctgggatcgtcc

SEQ ID NO: 451441 - DNA, 20 bp, mouse
gtgcgccagcatagaaccga

SEQ ID NO: 451442 - DNA, 20 bp, mouse
gccggtgagtagaaggcggt

SEQ ID NO: 451443 - DNA, 20 bp, mouse
gcagcatagaaccgacggaa

SEQ ID NO: 451444 - DNA, 20 bp, mouse
gtggctccgctcccttccgt

SEQ ID NO: 451445 - DNA, 20 bp, mouse
gcaggcctggctgcctggtg

SEQ ID NO: 451446 - DNA, 20 bp, mouse
ggtggaaccactgtaaggaa

SEQ ID NO: 451447 - DNA, 20 bp, mouse
gggggaccatgcaggcaatt

SEQ ID NO: 451448 - DNA, 20 bp, mouse
gttagtaagtgacatgagag

SEQ ID NO: 451449 - DNA, 20 bp, mouse
gacatgagaggggaccatgc

SEQ ID NO: 451450 - DNA, 20 bp, mouse
ggcctggtggaaccactgta

SEQ ID NO: 451451 - DNA, 20 bp, mouse
gttccttaaacagaaatctt

SEQ ID NO: 451452 - DNA, 20 bp, mouse
gcaagtagcgactgccccgt

SEQ ID NO: 451453 - DNA, 20 bp, mouse
gcttctctcaagttacacgg

SEQ ID NO: 451454 - DNA, 20 bp, mouse
gacttactaagaaaggtata

SEQ ID NO: 451455 - DNA, 20 bp, mouse
ggtgataaatgcagccgacg

SEQ ID NO: 451456 - DNA, 20 bp, mouse
gagcactctgggcaaccgtt

SEQ ID NO: 451457 - DNA, 20 bp, mouse
gtgtatggagcaggctatta

SEQ ID NO: 451458 - DNA, 20 bp, mouse
gagaggctggggatgtgcgt

SEQ ID NO: 451459 - DNA, 20 bp, mouse
gagtcatcccccagcactct

SEQ ID NO: 451460 - DNA, 20 bp, mouse
gcttccgaggatgcaaggtg

SEQ ID NO: 451461 - DNA, 20 bp, mouse
ggcgacgatgatcagaagga

SEQ ID NO: 451462 - DNA, 20 bp, mouse
ggaactagcgtgtatggagc

SEQ ID NO: 451463 - DNA, 20 bp, mouse
gatcttgtgtcagactggag

SEQ ID NO: 451464 - DNA, 20 bp, mouse
gagggttgtctgcagaggct

SEQ ID NO: 451465 - DNA, 20 bp, mouse
gtgggcaaccgttgggcaag

SEQ ID NO: 451466 - DNA, 20 bp, mouse
gtgggatccagtatttagaa

SEQ ID NO: 451467 - DNA, 20 bp, mouse
gagaaaggacgtctagcact

SEQ ID NO: 451468 - DNA, 20 bp, mouse
gaaacttcccaggaagacgc

SEQ ID NO: 451469 - DNA, 20 bp, mouse
ggtaaaacctgcgtcttcct

SEQ ID NO: 451470 - DNA, 20 bp, mouse
gagtaagcataaaacttccc

SEQ ID NO: 451471 - DNA, 20 bp, mouse
gagcccataggtaataacaa

SEQ ID NO: 451472 - DNA, 20 bp, mouse
gaaggcccccaaatattcta

SEQ ID NO: 451473 - DNA, 20 bp, mouse
gagacgtcctttctaaatac

SEQ ID NO: 451474 - DNA, 20 bp, mouse
gcctcacttgggactttgaa

SEQ ID NO: 451475 - DNA, 20 bp, mouse
ggcaaccttagaatatttgg

SEQ ID NO: 451476 - DNA, 20 bp, mouse
gttcgctgccgagctggaga

SEQ ID NO: 451477 - DNA, 20 bp, mouse
ggctgccgagctggagacgg

SEQ ID NO: 451478 - DNA, 20 bp, mouse
ggctcccgccgtctccagct

SEQ ID NO: 451479 - DNA, 20 bp, mouse
gctcctggagctgtgcggaa

SEQ ID NO: 451480 - DNA, 20 bp, mouse
gtgcagtaacctcaacttga

SEQ ID NO: 451481 - DNA, 20 bp, mouse
gcagtccagtggtctcggag

SEQ ID NO: 451482 - DNA, 20 bp, mouse
gagctgtcgccgtcaagttg

SEQ ID NO: 451483 - DNA, 20 bp, mouse
ggagctttcgcgcccagacg

SEQ ID NO: 451484 - DNA, 20 bp, mouse
gccagatggagaccctccag

SEQ ID NO: 451485 - DNA, 20 bp, mouse
ggggaggccggaatcatgac

SEQ ID NO: 451486 - DNA, 20 bp, mouse
ggcgcgcgccctcccctcgt

SEQ ID NO: 451487 - DNA, 20 bp, mouse
ggcgcagcgctgccgacgag

SEQ ID NO: 451488 - DNA, 20 bp, mouse
gggcagcgctgcgctggagg

SEQ ID NO: 451489 - DNA, 20 bp, mouse
ggcggcggcggctaagatgg

SEQ ID NO: 451490 - DNA, 20 bp, mouse
gagcgctgccgacgagggga

SEQ ID NO: 451491 - DNA, 20 bp, mouse
ggcgcggcgagcaccgggat

SEQ ID NO: 451492 - DNA, 20 bp, mouse
gcgcgcgcggcccagcagca

SEQ ID NO: 451493 - DNA, 20 bp, mouse
ggtcggcagcgctgcgctgg

SEQ ID NO: 451494 - DNA, 20 bp, mouse
gtcgcgcgggacgccgagag

SEQ ID NO: 451495 - DNA, 20 bp, mouse
gcgccacggccggcccgacg

SEQ ID NO: 451496 - DNA, 20 bp, mouse
gtgcgggagagcgagcgacg

SEQ ID NO: 451497 - DNA, 20 bp, mouse
ggcgacgcggcgaagggcag

SEQ ID NO: 451498 - DNA, 20 bp, mouse
gcactggcgcggacccggag

SEQ ID NO: 451499 - DNA, 20 bp, mouse
gaggcaccggcggacaccag

SEQ ID NO: 451500 - DNA, 20 bp, mouse
gcggtgagtgagggcggcgg

SEQ ID NO: 451501 - DNA, 20 bp, mouse
gagagcgagcgacgcggcga

SEQ ID NO: 451502 - DNA, 20 bp, mouse
gcggcgcgagcggtaggagg

SEQ ID NO: 451503 - DNA, 20 bp, mouse
gagcgcacccggcagctcca

SEQ ID NO: 451504 - DNA, 20 bp, mouse
ggaggcggcgcggcaggcac

SEQ ID NO: 451505 - DNA, 20 bp, mouse
ggcggctccagaagcgcacc

SEQ ID NO: 451506 - DNA, 20 bp, mouse
gccgctgggtggctgagatg

SEQ ID NO: 451507 - DNA, 20 bp, mouse
gtgtgttcagacccgctggg

SEQ ID NO: 451508 - DNA, 20 bp, mouse
gcagcaggagggtcatggtg

SEQ ID NO: 451509 - DNA, 20 bp, mouse
gaagcgagagtgaggacgct

SEQ ID NO: 451510 - DNA, 20 bp, mouse
ggagagtgaggacgctgggc

SEQ ID NO: 451511 - DNA, 20 bp, mouse
ggcaggcttgaggctcccag

SEQ ID NO: 451512 - DNA, 20 bp, mouse
ggatgggagcctctgaactg

SEQ ID NO: 451513 - DNA, 20 bp, mouse
gagatgtgttcagacccgct

SEQ ID NO: 451514 - DNA, 20 bp, mouse
gccaggcgttcctatcccct

SEQ ID NO: 451515 - DNA, 20 bp, mouse
gtgcagagactacgagggaa

SEQ ID NO: 451516 - DNA, 20 bp, mouse
ggcagccgccagcacagtgt

SEQ ID NO: 451517 - DNA, 20 bp, mouse
gtgctggcggctgctaccgg

SEQ ID NO: 451518 - DNA, 20 bp, mouse
gcggaggacgagcgagaaga

SEQ ID NO: 451519 - DNA, 20 bp, mouse
gccagcagccgacactgtgc

SEQ ID NO: 451520 - DNA, 20 bp, mouse
gcggctgctgggcggggtgt

SEQ ID NO: 451521 - DNA, 20 bp, mouse
gctgctgggcggggtgtcgg

SEQ ID NO: 451522 - DNA, 20 bp, mouse
gggcgccggcgaagaagacc

SEQ ID NO: 451523 - DNA, 20 bp, mouse
gttcgggcgggaggacttgt

SEQ ID NO: 451524 - DNA, 20 bp, mouse
gtgctgcgccaagaaggccg

SEQ ID NO: 451525 - DNA, 20 bp, mouse
gcagtgtcggctgctgggcg

SEQ ID NO: 451526 - DNA, 20 bp, mouse
gagtgacaggcaagccgggc

SEQ ID NO: 451527 - DNA, 20 bp, mouse
gccgcagtgacaggcaagcc

SEQ ID NO: 451528 - DNA, 20 bp, mouse
gggcaagccgggcgggtgac

SEQ ID NO: 451529 - DNA, 20 bp, mouse
ggcggcggcgggaggagtcg

SEQ ID NO: 451530 - DNA, 20 bp, mouse
gggcgggtgacgggaagtgc

SEQ ID NO: 451531 - DNA, 20 bp, mouse
gccgctgcagccgcagtgac

SEQ ID NO: 451532 - DNA, 20 bp, mouse
gagcagccacgcggggaaga

SEQ ID NO: 451533 - DNA, 20 bp, mouse
gctctgagtccggctatcca

SEQ ID NO: 451534 - DNA, 20 bp, mouse
gtgacgggaagtgcgggccg

SEQ ID NO: 451535 - DNA, 20 bp, mouse
gggaggtgacagcagccacg

SEQ ID NO: 451536 - DNA, 20 bp, mouse
ggccgggagagccgcaatgg

SEQ ID NO: 451537 - DNA, 20 bp, mouse
gacgagagagcttgggtcgg

SEQ ID NO: 451538 - DNA, 20 bp, mouse
gcaggcagacgagagagctt

SEQ ID NO: 451539 - DNA, 20 bp, mouse
gccgggagcagcgcagactc

SEQ ID NO: 451540 - DNA, 20 bp, mouse
ggccctgcggaaggatcccg

SEQ ID NO: 451541 - DNA, 20 bp, mouse
gctcagagggatactctccg

SEQ ID NO: 451542 - DNA, 20 bp, mouse
gggggccgggagagccgcaa

SEQ ID NO: 451543 - DNA, 20 bp, mouse
gcagacgagagagcttgggt

SEQ ID NO: 451544 - DNA, 20 bp, mouse
ggcctgcccgggctctccaa

SEQ ID NO: 451545 - DNA, 20 bp, mouse
gcggacggcgtgaggagact

SEQ ID NO: 451546 - DNA, 20 bp, mouse
gctggagccaagccgcagac

SEQ ID NO: 451547 - DNA, 20 bp, mouse
ggtcaccaggaggagcgcac

SEQ ID NO: 451548 - DNA, 20 bp, mouse
gaaaggtgcagctgtctcac

SEQ ID NO: 451549 - DNA, 20 bp, mouse
gcaccacccgcgtcaccagg

SEQ ID NO: 451550 - DNA, 20 bp, mouse
gagcgccgctgaagccacac

SEQ ID NO: 451551 - DNA, 20 bp, mouse
ggcttcagcggcgctggggt

SEQ ID NO: 451552 - DNA, 20 bp, mouse
ggtgcacgctggctcagaca

SEQ ID NO: 451553 - DNA, 20 bp, mouse
gcacaccggcagggatggga

SEQ ID NO: 451554 - DNA, 20 bp, mouse
gaagccacaccggcagggat

SEQ ID NO: 451555 - DNA, 20 bp, mouse
gggctccagtgcgctcctcc

SEQ ID NO: 451556 - DNA, 20 bp, mouse
gccacagcgccgggaaactt

SEQ ID NO: 451557 - DNA, 20 bp, mouse
gagactagcagattctgacc

SEQ ID NO: 451558 - DNA, 20 bp, mouse
gtgctggtaatatggactcc

SEQ ID NO: 451559 - DNA, 20 bp, mouse
gctaagaacagactccctct

SEQ ID NO: 451560 - DNA, 20 bp, mouse
gtctaggtctgctggtaata

SEQ ID NO: 451561 - DNA, 20 bp, mouse
ggtaagtcagtgtagaggga

SEQ ID NO: 451562 - DNA, 20 bp, mouse
gaactgagcagcgttgtcct

SEQ ID NO: 451563 - DNA, 20 bp, mouse
gacaacaacaccacagcgcc

SEQ ID NO: 451564 - DNA, 20 bp, mouse
ggggagcctggcaggtgtct

SEQ ID NO: 451565 - DNA, 20 bp, mouse
gagtatcaagatgagctaca

SEQ ID NO: 451566 - DNA, 20 bp, mouse
ggacaggaagcgaagagggg

SEQ ID NO: 451567 - DNA, 20 bp, mouse
gcaggacaggaagcgaagag

SEQ ID NO: 451568 - DNA, 20 bp, mouse
gtcgcaggcccagcgctctc

SEQ ID NO: 451569 - DNA, 20 bp, mouse
gagaggccttggacagcgtg

SEQ ID NO: 451570 - DNA, 20 bp, mouse
gctgcgaactctacagagac

SEQ ID NO: 451571 - DNA, 20 bp, mouse
gtctctatagcaacgctcag

SEQ ID NO: 451572 - DNA, 20 bp, mouse
gaggggagtctcgagatcct

SEQ ID NO: 451573 - DNA, 20 bp, mouse
gcggaggtcgcggaaagaca

SEQ ID NO: 451574 - DNA, 20 bp, mouse
gtctggcaggggtccggcag

SEQ ID NO: 451575 - DNA, 20 bp, mouse
gcgtgcggaccaggccaaac

SEQ ID NO: 451576 - DNA, 20 bp, mouse
gcgtggcgcgcagggcactt

SEQ ID NO: 451577 - DNA, 20 bp, mouse
ggctaaagcgcgcaccacgt

SEQ ID NO: 451578 - DNA, 20 bp, mouse
gcgcagggcacttgggttag

SEQ ID NO: 451579 - DNA, 20 bp, mouse
ggaccgtggaagggcatcca

SEQ ID NO: 451580 - DNA, 20 bp, mouse
ggcgggaaggacggagtcac

SEQ ID NO: 451581 - DNA, 20 bp, mouse
gcatggcgggagcaggcgtc

SEQ ID NO: 451582 - DNA, 20 bp, mouse
gggagggctcgggactcggt

SEQ ID NO: 451583 - DNA, 20 bp, mouse
ggcacgtggggaccgtggaa

SEQ ID NO: 451584 - DNA, 20 bp, mouse
gctgcgcgccacggccgctg

SEQ ID NO: 451585 - DNA, 20 bp, mouse
gggcacttgggttagtggcg

SEQ ID NO: 451586 - DNA, 20 bp, mouse
gtgggtgagatcccctaccc

SEQ ID NO: 451587 - DNA, 20 bp, mouse
gtcctcgcggctgaactggg

SEQ ID NO: 451588 - DNA, 20 bp, mouse
gtgagagcccgggctgcatg

SEQ ID NO: 451589 - DNA, 20 bp, mouse
ggtgtcctcgcggctgaact

SEQ ID NO: 451590 - DNA, 20 bp, mouse
ggctccaactgccagggtag

SEQ ID NO: 451591 - DNA, 20 bp, mouse
ggcagaggcggtgaagagtg

SEQ ID NO: 451592 - DNA, 20 bp, mouse
ggatcccctaccctggcagt

SEQ ID NO: 451593 - DNA, 20 bp, mouse
gatggggctgtgatttgggt

SEQ ID NO: 451594 - DNA, 20 bp, mouse
ggtgcagtgggattgcagat

SEQ ID NO: 451595 - DNA, 20 bp, mouse
gccgctagagcggggacggg

SEQ ID NO: 451596 - DNA, 20 bp, mouse
ggcagagtcactaagcaatg

SEQ ID NO: 451597 - DNA, 20 bp, mouse
gttcctaccagcaaaccgcg

SEQ ID NO: 451598 - DNA, 20 bp, mouse
ggcttagtgactctgcctcg

SEQ ID NO: 451599 - DNA, 20 bp, mouse
gtattgggtacctttgacag

SEQ ID NO: 451600 - DNA, 20 bp, mouse
gcagcatccatcagccctgg

SEQ ID NO: 451601 - DNA, 20 bp, mouse
ggttattacgatccaattag

SEQ ID NO: 451602 - DNA, 20 bp, mouse
gggcaagtcccctgaaataa

SEQ ID NO: 451603 - DNA, 20 bp, mouse
ggagcccacgcctctgtcaa

SEQ ID NO: 451604 - DNA, 20 bp, mouse
ggagagactaggcagaagtt

SEQ ID NO: 451605 - DNA, 20 bp, mouse
ggtacctttgacagaggcgt

SEQ ID NO: 451606 - DNA, 20 bp, mouse
ggaacctgaactcacagcct

SEQ ID NO: 451607 - DNA, 20 bp, mouse
gaacacggttcgtggagcgg

SEQ ID NO: 451608 - DNA, 20 bp, mouse
gcggaacacggttcgtggag

SEQ ID NO: 451609 - DNA, 20 bp, mouse
gcaggctccagagaccactc

SEQ ID NO: 451610 - DNA, 20 bp, mouse
ggcagcagccgcagcgacct

SEQ ID NO: 451611 - DNA, 20 bp, mouse
gggcagaggtcaaggaccgg

SEQ ID NO: 451612 - DNA, 20 bp, mouse
ggggcgtaggcgggccagtc

SEQ ID NO: 451613 - DNA, 20 bp, mouse
gctgcccaggctgtgagttc

SEQ ID NO: 451614 - DNA, 20 bp, mouse
gacctctgccaaggtcgctg

SEQ ID NO: 451615 - DNA, 20 bp, mouse
gtcaaggaccggaggcacag

SEQ ID NO: 451616 - DNA, 20 bp, mouse
gctctcagagggcctcctca

SEQ ID NO: 451617 - DNA, 20 bp, mouse
ggtggcagagctgttatcac

SEQ ID NO: 451618 - DNA, 20 bp, mouse
gtattactcccagcgggcag

SEQ ID NO: 451619 - DNA, 20 bp, mouse
gttaggcttattactcccag

SEQ ID NO: 451620 - DNA, 20 bp, mouse
gaggagctgaccctgcagat

SEQ ID NO: 451621 - DNA, 20 bp, mouse
ggaagcctgcagcagccctg

SEQ ID NO: 451622 - DNA, 20 bp, mouse
gctgaccctgcagattggag

SEQ ID NO: 451623 - DNA, 20 bp, mouse
ggctccctctccaatctgca

SEQ ID NO: 451624 - DNA, 20 bp, mouse
gggtgctggaacccaggaga

SEQ ID NO: 451625 - DNA, 20 bp, mouse
gtgctgcaggcttcatattt

SEQ ID NO: 451626 - DNA, 20 bp, mouse
gttgctcttcaagctgttgg

SEQ ID NO: 451627 - DNA, 20 bp, mouse
gcgagtcgggaggagagtta

SEQ ID NO: 451628 - DNA, 20 bp, mouse
gcttaagcagggcaaaataa

SEQ ID NO: 451629 - DNA, 20 bp, mouse
gaggtcagagcgaccaggca

SEQ ID NO: 451630 - DNA, 20 bp, mouse
ggaaatgggtcctttcccag

SEQ ID NO: 451631 - DNA, 20 bp, mouse
gaggaggaggcatccttcca

SEQ ID NO: 451632 - DNA, 20 bp, mouse
gatgtcattaaggacccact

SEQ ID NO: 451633 - DNA, 20 bp, mouse
gggttctgaggaaaaggatt

SEQ ID NO: 451634 - DNA, 20 bp, mouse
gttcaaagacccgagtcggg

SEQ ID NO: 451635 - DNA, 20 bp, mouse
ggaattcaaagacccgagtc

SEQ ID NO: 451636 - DNA, 20 bp, mouse
gcacaccaggaaggcgagga

SEQ ID NO: 451637 - DNA, 20 bp, mouse
gcaggaaggcgaggatggcg

SEQ ID NO: 451638 - DNA, 20 bp, mouse
ggaatcacaccaggaaggcg

SEQ ID NO: 451639 - DNA, 20 bp, mouse
ggaggagcatgcacccggtt

SEQ ID NO: 451640 - DNA, 20 bp, mouse
gtacttctgcgaatcacacc

SEQ ID NO: 451641 - DNA, 20 bp, mouse
gaaggagaaggaccatctaa

SEQ ID NO: 451642 - DNA, 20 bp, mouse
gcagctgctttgaaataccc

SEQ ID NO: 451643 - DNA, 20 bp, mouse
ggcaggagacagggtcagca

SEQ ID NO: 451644 - DNA, 20 bp, mouse
gagttgccaacctcaaggaa

SEQ ID NO: 451645 - DNA, 20 bp, mouse
ggcctctgagcccgggttgt

SEQ ID NO: 451646 - DNA, 20 bp, mouse
gatggacgcgctggagaagg

SEQ ID NO: 451647 - DNA, 20 bp, mouse
gggatgtggagacgttggag

SEQ ID NO: 451648 - DNA, 20 bp, mouse
gcgcggggcgggccccgacg

SEQ ID NO: 451649 - DNA, 20 bp, mouse
gctcccggatgtggagacgt

SEQ ID NO: 451650 - DNA, 20 bp, mouse
gtgtggagacgttggagcgg

SEQ ID NO: 451651 - DNA, 20 bp, mouse
ggaagggggccgccacgtcg

SEQ ID NO: 451652 - DNA, 20 bp, mouse
gcggtaccgagtggagtcgg

SEQ ID NO: 451653 - DNA, 20 bp, mouse
ggggcggtaccgagtggagt

SEQ ID NO: 451654 - DNA, 20 bp, mouse
ggcaccagcgctgccaggtg

SEQ ID NO: 451655 - DNA, 20 bp, mouse
gtggaagacccccgcatcca

SEQ ID NO: 451656 - DNA, 20 bp, mouse
gccctaccgggtcagctcca

SEQ ID NO: 451657 - DNA, 20 bp, mouse
gcagcaggaggcagacgccc

SEQ ID NO: 451658 - DNA, 20 bp, mouse
ggccctggagctgacccggt

SEQ ID NO: 451659 - DNA, 20 bp, mouse
gcagcacctaccttgtctaa

SEQ ID NO: 451660 - DNA, 20 bp, mouse
gagtcaagggtgggcaccta

SEQ ID NO: 451661 - DNA, 20 bp, mouse
gatcctcagaagtcaagggt

SEQ ID NO: 451662 - DNA, 20 bp, mouse
gaggtaggtgctggtcgctg

SEQ ID NO: 451663 - DNA, 20 bp, mouse
gtgctcttcaccattagaca

SEQ ID NO: 451664 - DNA, 20 bp, mouse
gctgcatgtccctccctacc

SEQ ID NO: 451665 - DNA, 20 bp, mouse
ggggacatgcagaagaaggg

SEQ ID NO: 451666 - DNA, 20 bp, mouse
gggtccagcgccatctcgga

SEQ ID NO: 451667 - DNA, 20 bp, mouse
gctggaccccgcaggtactg

SEQ ID NO: 451668 - DNA, 20 bp, mouse
ggcttctccgccctccgaga

SEQ ID NO: 451669 - DNA, 20 bp, mouse
ggcaccagagccccagcgag

SEQ ID NO: 451670 - DNA, 20 bp, mouse
gggctctggtgctcagtgag

SEQ ID NO: 451671 - DNA, 20 bp, mouse
gagatggcgctggaccccgc

SEQ ID NO: 451672 - DNA, 20 bp, mouse
gacgccgaccccagtacctg

SEQ ID NO: 451673 - DNA, 20 bp, mouse
gccagcgccatctcggaggg

SEQ ID NO: 451674 - DNA, 20 bp, mouse
gcggccccttagcgcgtgag

SEQ ID NO: 451675 - DNA, 20 bp, mouse
gccagcgagcggcagatgaa

SEQ ID NO: 451676 - DNA, 20 bp, mouse
gggagctgcgggctccgtgt

SEQ ID NO: 451677 - DNA, 20 bp, mouse
ggaaagagaagtcaccgaca

SEQ ID NO: 451678 - DNA, 20 bp, mouse
gcggtgcttgcaagtcctaa

SEQ ID NO: 451679 - DNA, 20 bp, mouse
gcggagcccgcagctccctt

SEQ ID NO: 451680 - DNA, 20 bp, mouse
gaggtcgcaatgccagcgag

SEQ ID NO: 451681 - DNA, 20 bp, mouse
ggctgagtgacggtgagtgt

SEQ ID NO: 451682 - DNA, 20 bp, mouse
gggtccaagggcagggacat

SEQ ID NO: 451683 - DNA, 20 bp, mouse
gctggctgataactaatcta

SEQ ID NO: 451684 - DNA, 20 bp, mouse
gtctttctgtgcttcttgta

SEQ ID NO: 451685 - DNA, 20 bp, mouse
gtgcctgtggcggaaggacg

SEQ ID NO: 451686 - DNA, 20 bp, mouse
gcgcagcacacactcgcgga

SEQ ID NO: 451687 - DNA, 20 bp, mouse
gacacactcgcggacggacg

SEQ ID NO: 451688 - DNA, 20 bp, mouse
gcgcccgcagcacacactcg

SEQ ID NO: 451689 - DNA, 20 bp, mouse
gagctagaaggaagcagccc

SEQ ID NO: 451690 - DNA, 20 bp, mouse
gcatgccggcgcgaacgggt

SEQ ID NO: 451691 - DNA, 20 bp, mouse
gatgcgccccagcagctaga

SEQ ID NO: 451692 - DNA, 20 bp, mouse
gctcgcgcgggcgcgctgtg

SEQ ID NO: 451693 - DNA, 20 bp, mouse
ggcgccccgcggggacgaac

SEQ ID NO: 451694 - DNA, 20 bp, mouse
gtggatgtgacgagcagctc

SEQ ID NO: 451695 - DNA, 20 bp, mouse
gagaggatcgggtcctcggg

SEQ ID NO: 451696 - DNA, 20 bp, mouse
gaggacagagggaggctctt

SEQ ID NO: 451697 - DNA, 20 bp, mouse
gtcccgagaggacagttcag

SEQ ID NO: 451698 - DNA, 20 bp, mouse
gtctgtggcacggcacaagt

SEQ ID NO: 451699 - DNA, 20 bp, mouse
gtaggatgttgtgctccgcg

SEQ ID NO: 451700 - DNA, 20 bp, mouse
ggagccggagagcctgacgg

SEQ ID NO: 451701 - DNA, 20 bp, mouse
ggtcctgcagagggcgggaa

SEQ ID NO: 451702 - DNA, 20 bp, mouse
ggggacgcgcaggcagggac

SEQ ID NO: 451703 - DNA, 20 bp, mouse
ggaagtcgcaggagccggag

SEQ ID NO: 451704 - DNA, 20 bp, mouse
gaggagccggagggggatat

SEQ ID NO: 451705 - DNA, 20 bp, mouse
gaaacagctggagcggggag

SEQ ID NO: 451706 - DNA, 20 bp, mouse
gaagctgctggcggaggaca

SEQ ID NO: 451707 - DNA, 20 bp, mouse
gttctaggcccgaccagtgg

SEQ ID NO: 451708 - DNA, 20 bp, mouse
gtaccgctagaagctgctgg

SEQ ID NO: 451709 - DNA, 20 bp, mouse
gagcttctaggcccgaccag

SEQ ID NO: 451710 - DNA, 20 bp, mouse
ggaggtggaaaagcccccac

SEQ ID NO: 451711 - DNA, 20 bp, mouse
gtagtaccgctagaagctgc

SEQ ID NO: 451712 - DNA, 20 bp, mouse
gcgctagaagctgctggcgg

SEQ ID NO: 451713 - DNA, 20 bp, mouse
gtaatttgtcccggcttcgg

SEQ ID NO: 451714 - DNA, 20 bp, mouse
gtcaacacaggctaagaaca

SEQ ID NO: 451715 - DNA, 20 bp, mouse
ggaggcgcccagtttccggt

SEQ ID NO: 451716 - DNA, 20 bp, mouse
gaggttcaccaggctctggt

SEQ ID NO: 451717 - DNA, 20 bp, mouse
gctagaggttcaccaggctc

SEQ ID NO: 451718 - DNA, 20 bp, mouse
ggaccagatctgcaccctag

SEQ ID NO: 451719 - DNA, 20 bp, mouse
gttttactggatgtcatcgg

SEQ ID NO: 451720 - DNA, 20 bp, mouse
gtggatgtcatcggaggcaa

SEQ ID NO: 451721 - DNA, 20 bp, mouse
gtgcaccctagaggttcacc

SEQ ID NO: 451722 - DNA, 20 bp, mouse
gaacctctagggtgcagatc

SEQ ID NO: 451723 - DNA, 20 bp, mouse
gtcaactctgggccctgaag

SEQ ID NO: 451724 - DNA, 20 bp, mouse
gtcggaggcaaaggccatcc

SEQ ID NO: 451725 - DNA, 20 bp, mouse
gaggttttactggatgtcat

SEQ ID NO: 451726 - DNA, 20 bp, mouse
ggctccttggaacccgacaa

SEQ ID NO: 451727 - DNA, 20 bp, mouse
gacgccattgtcgggttcca

SEQ ID NO: 451728 - DNA, 20 bp, mouse
gatctcaatgactgccacga

SEQ ID NO: 451729 - DNA, 20 bp, mouse
gctgacgcaagaactcttca

SEQ ID NO: 451730 - DNA, 20 bp, mouse
ggctctacagtccctaagaa

SEQ ID NO: 451731 - DNA, 20 bp, mouse
gtgactgccacgatggaagt

SEQ ID NO: 451732 - DNA, 20 bp, mouse
gctgtgtccaacttccatcg

SEQ ID NO: 451733 - DNA, 20 bp, mouse
gagttctggagacccacagg

SEQ ID NO: 451734 - DNA, 20 bp, mouse
ggaactccactgagggtgaa

SEQ ID NO: 451735 - DNA, 20 bp, mouse
gcagggacgacgccattgtc

SEQ ID NO: 451736 - DNA, 20 bp, mouse
ggaaggtcctgttacaggag

SEQ ID NO: 451737 - DNA, 20 bp, mouse
gcctagttgctcagagctca

SEQ ID NO: 451738 - DNA, 20 bp, mouse
ggggcaaggttggggttggg

SEQ ID NO: 451739 - DNA, 20 bp, mouse
ggtgcttgtgactgattgtg

SEQ ID NO: 451740 - DNA, 20 bp, mouse
gcaactaggtgagtatgttt

SEQ ID NO: 451741 - DNA, 20 bp, mouse
gcacagcactaaggctgatt

SEQ ID NO: 451742 - DNA, 20 bp, mouse
gtatgtttgggggcaaggtt

SEQ ID NO: 451743 - DNA, 20 bp, mouse
gaacaagaaggtcctgttac

SEQ ID NO: 451744 - DNA, 20 bp, mouse
gtgagaaaacatgaacaaga

SEQ ID NO: 451745 - DNA, 20 bp, mouse
ggttcagagctgatgggaaa

SEQ ID NO: 451746 - DNA, 20 bp, mouse
ggtgagagaatagagagtcg

SEQ ID NO: 451747 - DNA, 20 bp, mouse
gtagagagtcgaggctggga

SEQ ID NO: 451748 - DNA, 20 bp, mouse
gttctttggatggcatttgg

SEQ ID NO: 451749 - DNA, 20 bp, mouse
gctttcagctctgtgatacc

SEQ ID NO: 451750 - DNA, 20 bp, mouse
gtgctcctgagccctcagtc

SEQ ID NO: 451751 - DNA, 20 bp, mouse
gggttctagcagattttctt

SEQ ID NO: 451752 - DNA, 20 bp, mouse
gagaatagagagtcgaggct

SEQ ID NO: 451753 - DNA, 20 bp, mouse
gagaacctgactgagggctc

SEQ ID NO: 451754 - DNA, 20 bp, mouse
ggttgttccacaccttaata

SEQ ID NO: 451755 - DNA, 20 bp, mouse
gatgtggtgtccccagctac

SEQ ID NO: 451756 - DNA, 20 bp, mouse
gagggcgacggagagctccc

SEQ ID NO: 451757 - DNA, 20 bp, mouse
ggctcgggaccaggacgtgc

SEQ ID NO: 451758 - DNA, 20 bp, mouse
gcggccgccgtgacaggaag

SEQ ID NO: 451759 - DNA, 20 bp, mouse
ggaggtgaggccgtgcggga

SEQ ID NO: 451760 - DNA, 20 bp, mouse
ggccgctgacccgcacactg

SEQ ID NO: 451761 - DNA, 20 bp, mouse
gatcccaggagtggaagcaa

SEQ ID NO: 451762 - DNA, 20 bp, mouse
gaggggcgcggccgccaacg

SEQ ID NO: 451763 - DNA, 20 bp, mouse
gcttctgacagcggccggcg

SEQ ID NO: 451764 - DNA, 20 bp, mouse
ggaccaacggcttcatgagg

SEQ ID NO: 451765 - DNA, 20 bp, mouse
gcggcttcatgaggtggaga

SEQ ID NO: 451766 - DNA, 20 bp, mouse
gagtagctcggccacactgg

SEQ ID NO: 451767 - DNA, 20 bp, mouse
gccccgggaaacgaaagtga

SEQ ID NO: 451768 - DNA, 20 bp, mouse
ggtgtggccgagctactccc

SEQ ID NO: 451769 - DNA, 20 bp, mouse
ggtggctgagacctccagtg

SEQ ID NO: 451770 - DNA, 20 bp, mouse
gcccaggacgaagtgagtca

SEQ ID NO: 451771 - DNA, 20 bp, mouse
gagagctgctcggcccccca

SEQ ID NO: 451772 - DNA, 20 bp, mouse
gccgccctcgagccccactg

SEQ ID NO: 451773 - DNA, 20 bp, mouse
gccgcggtgaccacagaccc

SEQ ID NO: 451774 - DNA, 20 bp, mouse
gagtgagtcagggagcaatc

SEQ ID NO: 451775 - DNA, 20 bp, mouse
gagacgcccgagccacagtg

SEQ ID NO: 451776 - DNA, 20 bp, mouse
ggcagctgaggcgaggacca

SEQ ID NO: 451777 - DNA, 20 bp, mouse
gaccagggcaggaggaacga

SEQ ID NO: 451778 - DNA, 20 bp, mouse
ggctacacgcggaaaaacca

SEQ ID NO: 451779 - DNA, 20 bp, mouse
ggcgttagcaacgctacacg

SEQ ID NO: 451780 - DNA, 20 bp, mouse
gggcggccgctcgcgctcct

SEQ ID NO: 451781 - DNA, 20 bp, mouse
gcaaccagatgaaagcaagg

SEQ ID NO: 451782 - DNA, 20 bp, mouse
gcgcgggcgacggagttcct

SEQ ID NO: 451783 - DNA, 20 bp, mouse
gcacgcgggtaaggcagctg

SEQ ID NO: 451784 - DNA, 20 bp, mouse
gggaagtagccctctcagac

SEQ ID NO: 451785 - DNA, 20 bp, mouse
gcgactgccacacgcgggta

SEQ ID NO: 451786 - DNA, 20 bp, mouse
gcggccacccagccgaccag

SEQ ID NO: 451787 - DNA, 20 bp, mouse
gctggccctgtgcctctggt

SEQ ID NO: 451788 - DNA, 20 bp, mouse
ggcagggcgatggcccactg

SEQ ID NO: 451789 - DNA, 20 bp, mouse
ggttgaagccagttccccag

SEQ ID NO: 451790 - DNA, 20 bp, mouse
ggggccagcctggcataatc

SEQ ID NO: 451791 - DNA, 20 bp, mouse
ggtgcctctggtcggctggg

SEQ ID NO: 451792 - DNA, 20 bp, mouse
gcaggctggccctgtgcctc

SEQ ID NO: 451793 - DNA, 20 bp, mouse
gccctgtgcctctggtcggc

SEQ ID NO: 451794 - DNA, 20 bp, mouse
gttccaagcctgattatgcc

SEQ ID NO: 451795 - DNA, 20 bp, mouse
gccgccaggcgtgagtccgg

SEQ ID NO: 451796 - DNA, 20 bp, mouse
gcggccacccagccgaccag

SEQ ID NO: 451797 - DNA, 20 bp, mouse
gctggccctgtgcctctggt

SEQ ID NO: 451798 - DNA, 20 bp, mouse
ggcagggcgatggcccactg

SEQ ID NO: 451799 - DNA, 20 bp, mouse
ggggccagcctggcataatc

SEQ ID NO: 451800 - DNA, 20 bp, mouse
ggttgaagccagttccccag

SEQ ID NO: 451801 - DNA, 20 bp, mouse
ggtgcctctggtcggctggg

SEQ ID NO: 451802 - DNA, 20 bp, mouse
gcaggctggccctgtgcctc

SEQ ID NO: 451803 - DNA, 20 bp, mouse
gccctgtgcctctggtcggc

SEQ ID NO: 451804 - DNA, 20 bp, mouse
gttccaagcctgattatgcc

SEQ ID NO: 451805 - DNA, 20 bp, mouse
gccgccaggcgtgagtccgg

SEQ ID NO: 451806 - DNA, 20 bp, mouse
ggagaggtcctcagaagtag

SEQ ID NO: 451807 - DNA, 20 bp, mouse
gggacacgaccccaaaaagg

SEQ ID NO: 451808 - DNA, 20 bp, mouse
gagaggaggtcagcccagag

SEQ ID NO: 451809 - DNA, 20 bp, mouse
ggggcttcgacgctatctat

SEQ ID NO: 451810 - DNA, 20 bp, mouse
gagaggacacgaccccaaaa

SEQ ID NO: 451811 - DNA, 20 bp, mouse
gttggggtcgtgtcctctct

SEQ ID NO: 451812 - DNA, 20 bp, mouse
gttccatttcggcccagagg

SEQ ID NO: 451813 - DNA, 20 bp, mouse
ggacctcctctgggccgaaa

SEQ ID NO: 451814 - DNA, 20 bp, mouse
ggcaggatcaggaccggatg

SEQ ID NO: 451815 - DNA, 20 bp, mouse
ggtggagtcgatatgttgtt

SEQ ID NO: 451816 - DNA, 20 bp, mouse
gccgcgccgcgagcccggac

SEQ ID NO: 451817 - DNA, 20 bp, mouse
gcgccgcgagcccggacagg

SEQ ID NO: 451818 - DNA, 20 bp, mouse
gtacaccggaggggttgcaa

SEQ ID NO: 451819 - DNA, 20 bp, mouse
ggggttcaaaggctacaagt

SEQ ID NO: 451820 - DNA, 20 bp, mouse
gttcttcttgccacctgtcc

SEQ ID NO: 451821 - DNA, 20 bp, mouse
ggcaatgaggaggatctgaa

SEQ ID NO: 451822 - DNA, 20 bp, mouse
gtgccacctgtccgggctcg

SEQ ID NO: 451823 - DNA, 20 bp, mouse
gagagcccttgcaacccctc

SEQ ID NO: 451824 - DNA, 20 bp, mouse
gcgcggcgcgggcgctgcca

SEQ ID NO: 451825 - DNA, 20 bp, mouse
ggtggggttcctcaaaagca

SEQ ID NO: 451826 - DNA, 20 bp, mouse
ggcgtccgggggccacatag

SEQ ID NO: 451827 - DNA, 20 bp, mouse
gcgcttccctccagggcggt

SEQ ID NO: 451828 - DNA, 20 bp, mouse
ggccacatagcggcgctatc

SEQ ID NO: 451829 - DNA, 20 bp, mouse
ggcgctatctggtcgagcct

SEQ ID NO: 451830 - DNA, 20 bp, mouse
gggtgcaaggccccaggctg

SEQ ID NO: 451831 - DNA, 20 bp, mouse
gccatgcgcggactctggat

SEQ ID NO: 451832 - DNA, 20 bp, mouse
ggggctctggctctgcgtcc

SEQ ID NO: 451833 - DNA, 20 bp, mouse
gccgcgcatggcccccgaag

SEQ ID NO: 451834 - DNA, 20 bp, mouse
gcgcctcctgctggccgagt

SEQ ID NO: 451835 - DNA, 20 bp, mouse
ggcggcctttgagagagcag

SEQ ID NO: 451836 - DNA, 20 bp, mouse
gcctcggcagcggaaaggga

SEQ ID NO: 451837 - DNA, 20 bp, mouse
gggcgggagccgagccccag

SEQ ID NO: 451838 - DNA, 20 bp, mouse
ggccgcctcggcagcggaaa

SEQ ID NO: 451839 - DNA, 20 bp, mouse
gctggcgcccgagatcatgg

SEQ ID NO: 451840 - DNA, 20 bp, mouse
ggctcccgccgcctcggcag

SEQ ID NO: 451841 - DNA, 20 bp, mouse
gggctcccgcctccttccct

SEQ ID NO: 451842 - DNA, 20 bp, mouse
gaggagctggacggcttcga

SEQ ID NO: 451843 - DNA, 20 bp, mouse
gcgagcacctccatgatctc

SEQ ID NO: 451844 - DNA, 20 bp, mouse
gtcaaggtcgcccaagtggt

SEQ ID NO: 451845 - DNA, 20 bp, mouse
gcacttgggcgaccttgagg

SEQ ID NO: 451846 - DNA, 20 bp, mouse
gagctgggtgaagcccatcc

SEQ ID NO: 451847 - DNA, 20 bp, mouse
gtctggttagagaagcagac

SEQ ID NO: 451848 - DNA, 20 bp, mouse
ggggctccagggcttcggag

SEQ ID NO: 451849 - DNA, 20 bp, mouse
gcgccgggaacggcccccag

SEQ ID NO: 451850 - DNA, 20 bp, mouse
gaggcagtagtaaccaggga

SEQ ID NO: 451851 - DNA, 20 bp, mouse
gaggcccctgcttcactttc

SEQ ID NO: 451852 - DNA, 20 bp, mouse
gttccccagagtcctacagc

SEQ ID NO: 451853 - DNA, 20 bp, mouse
gagggaaggcttgcccggat

SEQ ID NO: 451854 - DNA, 20 bp, mouse
ggatgcctttgagggaagac

SEQ ID NO: 451855 - DNA, 20 bp, mouse
ggctgctgggaatctggtga

SEQ ID NO: 451856 - DNA, 20 bp, mouse
ggtctacagtcccaccaccg

SEQ ID NO: 451857 - DNA, 20 bp, mouse
gggcggcggccgggacctgt

SEQ ID NO: 451858 - DNA, 20 bp, mouse
gctcggccgagagtttagct

SEQ ID NO: 451859 - DNA, 20 bp, mouse
gtacagtcccaccaccgagg

SEQ ID NO: 451860 - DNA, 20 bp, mouse
gccagtgcccggggccgcct

SEQ ID NO: 451861 - DNA, 20 bp, mouse
gagcctgcccaggacgaagt

SEQ ID NO: 451862 - DNA, 20 bp, mouse
gaacgaggaggccgagcgag

SEQ ID NO: 451863 - DNA, 20 bp, mouse
gtgggtgagcgagtgtttgc

SEQ ID NO: 451864 - DNA, 20 bp, mouse
gctctcggccgagcggtagg

SEQ ID NO: 451865 - DNA, 20 bp, mouse
gctgaggccgggccacgggt

SEQ ID NO: 451866 - DNA, 20 bp, mouse
gacatcgcgcgacccagccc

SEQ ID NO: 451867 - DNA, 20 bp, mouse
gtgggtcgcgcgatgtctca

SEQ ID NO: 451868 - DNA, 20 bp, mouse
gtccggaccacgtgcagcag

SEQ ID NO: 451869 - DNA, 20 bp, mouse
gtccgaggcccggggacctc

SEQ ID NO: 451870 - DNA, 20 bp, mouse
gcgcgcgacccagcccgggc

SEQ ID NO: 451871 - DNA, 20 bp, mouse
gaagtgagctgggcccggta

SEQ ID NO: 451872 - DNA, 20 bp, mouse
gggaggcggccagcccgggc

SEQ ID NO: 451873 - DNA, 20 bp, mouse
gccggacccggagaggactc

SEQ ID NO: 451874 - DNA, 20 bp, mouse
gaggcccggggacctctggc

SEQ ID NO: 451875 - DNA, 20 bp, mouse
gggaccacgtgcagcagcgg

SEQ ID NO: 451876 - DNA, 20 bp, mouse
gacctcggcgagcgcactct

SEQ ID NO: 451877 - DNA, 20 bp, mouse
gcaaacccgggtgatctcca

SEQ ID NO: 451878 - DNA, 20 bp, mouse
gctgctcggagacccgggaa

SEQ ID NO: 451879 - DNA, 20 bp, mouse
gcgcaagtgtcccaacacct

SEQ ID NO: 451880 - DNA, 20 bp, mouse
gcgggatcgctggcgaccgg

SEQ ID NO: 451881 - DNA, 20 bp, mouse
gacccagagtgcgctcgccg

SEQ ID NO: 451882 - DNA, 20 bp, mouse
ggtgcgctcgccgaggtgtt

SEQ ID NO: 451883 - DNA, 20 bp, mouse
gctgggtctgctcggagacc

SEQ ID NO: 451884 - DNA, 20 bp, mouse
gcgccagcgatcccgttccc

SEQ ID NO: 451885 - DNA, 20 bp, mouse
ggggaatcgcggatgatggg

SEQ ID NO: 451886 - DNA, 20 bp, mouse
gagccggcgagcggagacga

SEQ ID NO: 451887 - DNA, 20 bp, mouse
gaggaaaacgaaagtgaggg

SEQ ID NO: 451888 - DNA, 20 bp, mouse
gggctcgtgacgttatcaag

SEQ ID NO: 451889 - DNA, 20 bp, mouse
ggcagctagccggccctgcg

SEQ ID NO: 451890 - DNA, 20 bp, mouse
gggcaaagcggccgccgcag

SEQ ID NO: 451891 - DNA, 20 bp, mouse
gccagcctgggcggcgacag

SEQ ID NO: 451892 - DNA, 20 bp, mouse
gcactcacgctgaggggatg

SEQ ID NO: 451893 - DNA, 20 bp, mouse
gccctggccgaggaaatgag

SEQ ID NO: 451894 - DNA, 20 bp, mouse
gcaaaggagaagctccgtcg

SEQ ID NO: 451895 - DNA, 20 bp, mouse
ggcacagcatccttcccctg

SEQ ID NO: 451896 - DNA, 20 bp, mouse
gagagtgaggaccgcgtgtg

SEQ ID NO: 451897 - DNA, 20 bp, mouse
gcaggtggctcgttagagtg

SEQ ID NO: 451898 - DNA, 20 bp, mouse
gctgctcgaggggctctggt

SEQ ID NO: 451899 - DNA, 20 bp, mouse
gtcccgggagcggaagtggc

SEQ ID NO: 451900 - DNA, 20 bp, mouse
ggcagaggagacgccacccc

SEQ ID NO: 451901 - DNA, 20 bp, mouse
gcgggagcggaagtggcagg

SEQ ID NO: 451902 - DNA, 20 bp, mouse
gcggaagctgttcccgggag

SEQ ID NO: 451903 - DNA, 20 bp, mouse
gtactctgctcctgctcgag

SEQ ID NO: 451904 - DNA, 20 bp, mouse
gacccccggaagctgttccc

SEQ ID NO: 451905 - DNA, 20 bp, mouse
gcagagtagcaccgcacacg

SEQ ID NO: 451906 - DNA, 20 bp, mouse
gagaacaccgggcgaggcgt

SEQ ID NO: 451907 - DNA, 20 bp, mouse
ggcagtcagacggagaacac

SEQ ID NO: 451908 - DNA, 20 bp, mouse
ggcgtgggcagctccgactc

SEQ ID NO: 451909 - DNA, 20 bp, mouse
gcgatggagagcggcgacag

SEQ ID NO: 451910 - DNA, 20 bp, mouse
gctccgactccggccaggac

SEQ ID NO: 451911 - DNA, 20 bp, mouse
gccggccaggacaggcgcga

SEQ ID NO: 451912 - DNA, 20 bp, mouse
gagacggagaacaccgggcg

SEQ ID NO: 451913 - DNA, 20 bp, mouse
gggcagctccgactccggcc

SEQ ID NO: 451914 - DNA, 20 bp, mouse
gcggcgggacacctgtggag

SEQ ID NO: 451915 - DNA, 20 bp, mouse
gcccagggcttcctaggatg

SEQ ID NO: 451916 - DNA, 20 bp, mouse
gtgtgggccaaaatactgtt

SEQ ID NO: 451917 - DNA, 20 bp, mouse
ggtggcaaactgtgaagtgg

SEQ ID NO: 451918 - DNA, 20 bp, mouse
gggaggaggcacattgctaa

SEQ ID NO: 451919 - DNA, 20 bp, mouse
gttgctaatggctaacatgt

SEQ ID NO: 451920 - DNA, 20 bp, mouse
gtacgtggcaaactgtgaag

SEQ ID NO: 451921 - DNA, 20 bp, mouse
ggcaaactgtgaagtggagg

SEQ ID NO: 451922 - DNA, 20 bp, mouse
gcaggcatttgagagtcagt

SEQ ID NO: 451923 - DNA, 20 bp, mouse
gagaggaacatacttatctt

SEQ ID NO: 451924 - DNA, 20 bp, mouse
ggagactacttgagtgttag

SEQ ID NO: 451925 - DNA, 20 bp, mouse
gtgtcatcttataaggcagg

SEQ ID NO: 451926 - DNA, 20 bp, mouse
gctactgacactaaggatgg

SEQ ID NO: 451927 - DNA, 20 bp, mouse
gttgtccgccggctccaatg

SEQ ID NO: 451928 - DNA, 20 bp, mouse
gggcactgcaaggtccccat

SEQ ID NO: 451929 - DNA, 20 bp, mouse
gcgggacgcggactcaggac

SEQ ID NO: 451930 - DNA, 20 bp, mouse
ggctctactgacactaagga

SEQ ID NO: 451931 - DNA, 20 bp, mouse
ggaccagcatctaccctagg

SEQ ID NO: 451932 - DNA, 20 bp, mouse
gttggagccggcggacaagt

SEQ ID NO: 451933 - DNA, 20 bp, mouse
gaggtccccattggagccgg

SEQ ID NO: 451934 - DNA, 20 bp, mouse
ggatcctgcctggtcaagta

SEQ ID NO: 451935 - DNA, 20 bp, mouse
gtaaggatggcggcactgca

SEQ ID NO: 451936 - DNA, 20 bp, mouse
gaaggcgactcgcaaagcag

SEQ ID NO: 451937 - DNA, 20 bp, mouse
gctcggacgaagaaccaaga

SEQ ID NO: 451938 - DNA, 20 bp, mouse
ggcccacagcggaggagact

SEQ ID NO: 451939 - DNA, 20 bp, mouse
gccgtgtgcagacccgcgtg

SEQ ID NO: 451940 - DNA, 20 bp, mouse
gcaggacgcccgccacagta

SEQ ID NO: 451941 - DNA, 20 bp, mouse
gtctgagctgcccacagcgg

SEQ ID NO: 451942 - DNA, 20 bp, mouse
gggaggagagccgtgcgcag

SEQ ID NO: 451943 - DNA, 20 bp, mouse
gctcagacgccgaaggtgag

SEQ ID NO: 451944 - DNA, 20 bp, mouse
gtgcggccgagacggacgga

SEQ ID NO: 451945 - DNA, 20 bp, mouse
ggaactgcgaggcgcgatgg

SEQ ID NO: 451946 - DNA, 20 bp, mouse
gacttggtaagtaaaatcgt

SEQ ID NO: 451947 - DNA, 20 bp, mouse
gattaggacggcgtgagact

SEQ ID NO: 451948 - DNA, 20 bp, mouse
gggaaactgaagggtctcag

SEQ ID NO: 451949 - DNA, 20 bp, mouse
gcagcagtagtggggagtct

SEQ ID NO: 451950 - DNA, 20 bp, mouse
gttcaccacacaagaacatt

SEQ ID NO: 451951 - DNA, 20 bp, mouse
gccgtcctaatgttcttgtg

SEQ ID NO: 451952 - DNA, 20 bp, mouse
ggatgatggcgaaggctctg

SEQ ID NO: 451953 - DNA, 20 bp, mouse
gaaatcgttggtgcttaaat

SEQ ID NO: 451954 - DNA, 20 bp, mouse
gtccaaggatccctgaagag

SEQ ID NO: 451955 - DNA, 20 bp, mouse
gatcccagaccagcagaaca

SEQ ID NO: 451956 - DNA, 20 bp, mouse
gtcaggctgacttcagaccg

SEQ ID NO: 451957 - DNA, 20 bp, mouse
ggtcagacctgcttgcagct

SEQ ID NO: 451958 - DNA, 20 bp, mouse
gttcagtcccagctgcaagc

SEQ ID NO: 451959 - DNA, 20 bp, mouse
gaaccaggaccgctacgtca

SEQ ID NO: 451960 - DNA, 20 bp, mouse
ggaccgctacgtcaaggtga

SEQ ID NO: 451961 - DNA, 20 bp, mouse
gtactggaagacagctttga

SEQ ID NO: 451962 - DNA, 20 bp, mouse
gcacatgagagctttccaag

SEQ ID NO: 451963 - DNA, 20 bp, mouse
ggaccctcaccttgacgtag

SEQ ID NO: 451964 - DNA, 20 bp, mouse
ggaaccgagcatgtccttaa

SEQ ID NO: 451965 - DNA, 20 bp, mouse
gttgagggctgacatctttc

SEQ ID NO: 451966 - DNA, 20 bp, mouse
gtcccgggaaggaaggccca

SEQ ID NO: 451967 - DNA, 20 bp, mouse
gcgtgcagggacacgtggtg

SEQ ID NO: 451968 - DNA, 20 bp, mouse
ggcggaaccggcgcggtaag

SEQ ID NO: 451969 - DNA, 20 bp, mouse
gacgtggtgcggaaccggcg

SEQ ID NO: 451970 - DNA, 20 bp, mouse
ggggacacgtggtgcggaac

SEQ ID NO: 451971 - DNA, 20 bp, mouse
gggttcccccgcaccctccc

SEQ ID NO: 451972 - DNA, 20 bp, mouse
gtccctgggccttccttccc

SEQ ID NO: 451973 - DNA, 20 bp, mouse
ggccccaggcctccggacat

SEQ ID NO: 451974 - DNA, 20 bp, mouse
ggagcgtccgcttaccgcgc

SEQ ID NO: 451975 - DNA, 20 bp, mouse
gctccggacattggctggtg

SEQ ID NO: 451976 - DNA, 20 bp, mouse
gccagcgagttcatgtcggg

SEQ ID NO: 451977 - DNA, 20 bp, mouse
ggcagctccggtcaccgcca

SEQ ID NO: 451978 - DNA, 20 bp, mouse
gggcgggctgcgatgaggac

SEQ ID NO: 451979 - DNA, 20 bp, mouse
ggttccagcgagttcatgtc

SEQ ID NO: 451980 - DNA, 20 bp, mouse
gaccgggccgtggcggtgac

SEQ ID NO: 451981 - DNA, 20 bp, mouse
gtcatgtcgggcggcagctc

SEQ ID NO: 451982 - DNA, 20 bp, mouse
ggcctcgggacgggacccgg

SEQ ID NO: 451983 - DNA, 20 bp, mouse
gtccggtcaccgccacggcc

SEQ ID NO: 451984 - DNA, 20 bp, mouse
gggaaggcggcacccctcgg

SEQ ID NO: 451985 - DNA, 20 bp, mouse
gggctgaagggagcggttag

SEQ ID NO: 451986 - DNA, 20 bp, mouse
gcgtgaggggatggagatag

SEQ ID NO: 451987 - DNA, 20 bp, mouse
ggccagagagcagggactta

SEQ ID NO: 451988 - DNA, 20 bp, mouse
gtacctgcagatccacgtga

SEQ ID NO: 451989 - DNA, 20 bp, mouse
gagataggcagagaaccgag

SEQ ID NO: 451990 - DNA, 20 bp, mouse
gtcccctcacgtggatctgc

SEQ ID NO: 451991 - DNA, 20 bp, mouse
gaggtgcctgccagagagca

SEQ ID NO: 451992 - DNA, 20 bp, mouse
ggtaagatgatcccagtcag

SEQ ID NO: 451993 - DNA, 20 bp, mouse
gtaggcagagaaccgagcgg

SEQ ID NO: 451994 - DNA, 20 bp, mouse
gggatggagatagaggttct

SEQ ID NO: 451995 - DNA, 20 bp, mouse
gccttgtctagggagagcaa

SEQ ID NO: 451996 - DNA, 20 bp, mouse
gctcagaaaagacaggtcca

SEQ ID NO: 451997 - DNA, 20 bp, mouse
gtggcaggggaggatgttcg

SEQ ID NO: 451998 - DNA, 20 bp, mouse
gttcttgcagggccaatcag

SEQ ID NO: 451999 - DNA, 20 bp, mouse
gaaagacaggtccatggcat

SEQ ID NO: 452000 - DNA, 20 bp, mouse
gagcgcaggtaagaatccag

SEQ ID NO: 452001 - DNA, 20 bp, mouse
ggatgttcgtggctcagtac

SEQ ID NO: 452002 - DNA, 20 bp, mouse
gatttgtgctgcttaaggag

SEQ ID NO: 452003 - DNA, 20 bp, mouse
gcttggcaaatctgaatctc

SEQ ID NO: 452004 - DNA, 20 bp, mouse
ggcagatatatggttaatgt

SEQ ID NO: 452005 - DNA, 20 bp, mouse
gcgtggctcagtactggatt

SEQ ID NO: 452006 - DNA, 20 bp, mouse
gtacattgactaagggacag

SEQ ID NO: 452007 - DNA, 20 bp, mouse
gcacggactacattgactaa

SEQ ID NO: 452008 - DNA, 20 bp, mouse
ggacaggggcacgatgtact

SEQ ID NO: 452009 - DNA, 20 bp, mouse
gcgtggctatcaacagctgt

SEQ ID NO: 452010 - DNA, 20 bp, mouse
gatgtagtccgtgcacaccg

SEQ ID NO: 452011 - DNA, 20 bp, mouse
gcagcccaggaagccaacag

SEQ ID NO: 452012 - DNA, 20 bp, mouse
gcagctgtgggctagatgct

SEQ ID NO: 452013 - DNA, 20 bp, mouse
ggcaagcagcttccccagac

SEQ ID NO: 452014 - DNA, 20 bp, mouse
gggtctcagagaaccttccc

SEQ ID NO: 452015 - DNA, 20 bp, mouse
gatagaagcccccaatccat

SEQ ID NO: 452016 - DNA, 20 bp, mouse
ggaagaccatgccggagaca

SEQ ID NO: 452017 - DNA, 20 bp, mouse
ggtcttctgggtccagcagg

SEQ ID NO: 452018 - DNA, 20 bp, mouse
gcagctccctgtctccggca

SEQ ID NO: 452019 - DNA, 20 bp, mouse
gcagggtaaggactcaaggg

SEQ ID NO: 452020 - DNA, 20 bp, mouse
ggcgctgggagacactaatc

SEQ ID NO: 452021 - DNA, 20 bp, mouse
gaccaggaccagcttggacc

SEQ ID NO: 452022 - DNA, 20 bp, mouse
gtctgttctgggcaacagcc

SEQ ID NO: 452023 - DNA, 20 bp, mouse
gcccagagtagccagtagat

SEQ ID NO: 452024 - DNA, 20 bp, mouse
gagctggtcctggtgagtgg

SEQ ID NO: 452025 - DNA, 20 bp, mouse
gtactcagggtagagctaca

SEQ ID NO: 452026 - DNA, 20 bp, mouse
gggacttcgccaattagagg

SEQ ID NO: 452027 - DNA, 20 bp, mouse
gccaggacttcgccaattag

SEQ ID NO: 452028 - DNA, 20 bp, mouse
ggtgattagaccccacacag

SEQ ID NO: 452029 - DNA, 20 bp, mouse
ggaagtcctggatatcctac

SEQ ID NO: 452030 - DNA, 20 bp, mouse
gttctcaagccacctctaat

SEQ ID NO: 452031 - DNA, 20 bp, mouse
gcctagcctgtaggatatcc

SEQ ID NO: 452032 - DNA, 20 bp, mouse
gtgcctggtggataaatgag

SEQ ID NO: 452033 - DNA, 20 bp, mouse
gccccagatgggtctaggac

SEQ ID NO: 452034 - DNA, 20 bp, mouse
gctaatcacctcactccctg

SEQ ID NO: 452035 - DNA, 20 bp, mouse
ggagaaagtgcctggcttcc

SEQ ID NO: 452036 - DNA, 20 bp, mouse
gtagccgctgacatctgaac

SEQ ID NO: 452037 - DNA, 20 bp, mouse
gttacctgttcagatgtcag

SEQ ID NO: 452038 - DNA, 20 bp, mouse
gtgagcgtggtgatccccca

SEQ ID NO: 452039 - DNA, 20 bp, mouse
ggtccccacactctatcctg

SEQ ID NO: 452040 - DNA, 20 bp, mouse
ggtaactcaacatgaaatgg

SEQ ID NO: 452041 - DNA, 20 bp, mouse
gcctcccccaaaccctctgg

SEQ ID NO: 452042 - DNA, 20 bp, mouse
gaagccacaggatagagtgt

SEQ ID NO: 452043 - DNA, 20 bp, mouse
gggtctgagaggccagctgc

SEQ ID NO: 452044 - DNA, 20 bp, mouse
gatacccccagagggtttgg

SEQ ID NO: 452045 - DNA, 20 bp, mouse
gagtgggagggcagcaagac

SEQ ID NO: 452046 - DNA, 20 bp, mouse
ggtagagccgggagaagccc

SEQ ID NO: 452047 - DNA, 20 bp, mouse
ggagaagccctgggtcagcc

SEQ ID NO: 452048 - DNA, 20 bp, mouse
gggagcatatgagtagagcc

SEQ ID NO: 452049 - DNA, 20 bp, mouse
ggtaggagaagggctgaggt

SEQ ID NO: 452050 - DNA, 20 bp, mouse
ggcttctaagatgctgtgat

SEQ ID NO: 452051 - DNA, 20 bp, mouse
gggtgtggctaaacccagga

SEQ ID NO: 452052 - DNA, 20 bp, mouse
gcggagctggtgtccttcct

SEQ ID NO: 452053 - DNA, 20 bp, mouse
gctctgagtaggtaggagaa

SEQ ID NO: 452054 - DNA, 20 bp, mouse
gagcgaagccaagcctggga

SEQ ID NO: 452055 - DNA, 20 bp, mouse
gctgggtttagccacaccaa

SEQ ID NO: 452056 - DNA, 20 bp, mouse
gtacagggtcatataatcgg

SEQ ID NO: 452057 - DNA, 20 bp, mouse
gagatacagggtcatataat

SEQ ID NO: 452058 - DNA, 20 bp, mouse
ggattttaacatcttctctg

SEQ ID NO: 452059 - DNA, 20 bp, mouse
gcaaagtgaatcccatggaa

SEQ ID NO: 452060 - DNA, 20 bp, mouse
gctctcctcttcgagataca

SEQ ID NO: 452061 - DNA, 20 bp, mouse
gatgaccctgtatctcgaag

SEQ ID NO: 452062 - DNA, 20 bp, mouse
ggagaaagactgctcaggtt

SEQ ID NO: 452063 - DNA, 20 bp, mouse
gaacatacctgtgctatggt

SEQ ID NO: 452064 - DNA, 20 bp, mouse
ggctaataaatgctgtcata

SEQ ID NO: 452065 - DNA, 20 bp, mouse
gtctcagccaaccatagcac

SEQ ID NO: 452066 - DNA, 20 bp, mouse
gggcagctcctccccggcca

SEQ ID NO: 452067 - DNA, 20 bp, mouse
ggtgaacgccatggccgggg

SEQ ID NO: 452068 - DNA, 20 bp, mouse
gcggggccagcggagaaagg

SEQ ID NO: 452069 - DNA, 20 bp, mouse
gtagcagccaggccacgtcc

SEQ ID NO: 452070 - DNA, 20 bp, mouse
gaaagtgaacgccatggccg

SEQ ID NO: 452071 - DNA, 20 bp, mouse
gagcgccagcatatagcaga

SEQ ID NO: 452072 - DNA, 20 bp, mouse
ggcgaagaagatgagcgcgg

SEQ ID NO: 452073 - DNA, 20 bp, mouse
ggccggcgcgcgccaggacg

SEQ ID NO: 452074 - DNA, 20 bp, mouse
gcgccggggccagcggagaa

SEQ ID NO: 452075 - DNA, 20 bp, mouse
ggccatggcgttcactttcg

SEQ ID NO: 452076 - DNA, 20 bp, mouse
gagggaggcgcacagcacca

SEQ ID NO: 452077 - DNA, 20 bp, mouse
ggccgcgggcgagggatcgc

SEQ ID NO: 452078 - DNA, 20 bp, mouse
gctgcccgatggacagacgg

SEQ ID NO: 452079 - DNA, 20 bp, mouse
gttcgcgggctggagagcga

SEQ ID NO: 452080 - DNA, 20 bp, mouse
gcccgtccggccctaagtgt

SEQ ID NO: 452081 - DNA, 20 bp, mouse
ggatcgcaggatgagcgatc

SEQ ID NO: 452082 - DNA, 20 bp, mouse
gcatggcccaccggactcta

SEQ ID NO: 452083 - DNA, 20 bp, mouse
gtcatctggcacgtaagact

SEQ ID NO: 452084 - DNA, 20 bp, mouse
gacgcgccccccgagcccca

SEQ ID NO: 452085 - DNA, 20 bp, mouse
gcatacccacagacaggcgg

SEQ ID NO: 452086 - DNA, 20 bp, mouse
gagcggctcgcagctgaatg

SEQ ID NO: 452087 - DNA, 20 bp, mouse
ggcgggtttccggccaagag

SEQ ID NO: 452088 - DNA, 20 bp, mouse
gttcagctgcgagccgctct

SEQ ID NO: 452089 - DNA, 20 bp, mouse
ggcgggcgccgcgaggaatg

SEQ ID NO: 452090 - DNA, 20 bp, mouse
gcccagcgccgcattcctcg

SEQ ID NO: 452091 - DNA, 20 bp, mouse
gggtgcccaagcaaagaggt

SEQ ID NO: 452092 - DNA, 20 bp, mouse
gcgctgggacccctccctcg

SEQ ID NO: 452093 - DNA, 20 bp, mouse
gcccggggcgcagggctaac

SEQ ID NO: 452094 - DNA, 20 bp, mouse
gcggcccgacccagtttccc

SEQ ID NO: 452095 - DNA, 20 bp, mouse
gccccagagcacaagtcttg

SEQ ID NO: 452096 - DNA, 20 bp, mouse
gacagtcgaggagcgagaag

SEQ ID NO: 452097 - DNA, 20 bp, mouse
ggatgagcgcgcaacagtcg

SEQ ID NO: 452098 - DNA, 20 bp, mouse
gggcatgccgcctatcccag

SEQ ID NO: 452099 - DNA, 20 bp, mouse
ggctggtttgacgggcggag

SEQ ID NO: 452100 - DNA, 20 bp, mouse
gggcccgaagctggtttgac

SEQ ID NO: 452101 - DNA, 20 bp, mouse
ggcccaggcaggcgaagagg

SEQ ID NO: 452102 - DNA, 20 bp, mouse
ggccgcgccgctgggatagg

SEQ ID NO: 452103 - DNA, 20 bp, mouse
gggatacgaagtagacggag

SEQ ID NO: 452104 - DNA, 20 bp, mouse
ggtgtggggagtctccagaa

SEQ ID NO: 452105 - DNA, 20 bp, mouse
gccgaagctggtttgacggg

SEQ ID NO: 452106 - DNA, 20 bp, mouse
gtgcaggggctggacgctac

SEQ ID NO: 452107 - DNA, 20 bp, mouse
gctcaggatggagcccgtgg

SEQ ID NO: 452108 - DNA, 20 bp, mouse
gcaagctgccaccttcccgg

SEQ ID NO: 452109 - DNA, 20 bp, mouse
ggaggcctggacccccggga

SEQ ID NO: 452110 - DNA, 20 bp, mouse
gcgggggtccaggcctccac

SEQ ID NO: 452111 - DNA, 20 bp, mouse
gcccaatacaggaacagtga

SEQ ID NO: 452112 - DNA, 20 bp, mouse
gacgctggtcggctggtaca

SEQ ID NO: 452113 - DNA, 20 bp, mouse
ggaacagtgagggcagagat

SEQ ID NO: 452114 - DNA, 20 bp, mouse
gctcgggctcggactgggag

SEQ ID NO: 452115 - DNA, 20 bp, mouse
ggcctggacccccgggaagg

SEQ ID NO: 452116 - DNA, 20 bp, mouse
gtcgcggcggggaaaggaag

SEQ ID NO: 452117 - DNA, 20 bp, mouse
ggctcgagccgccgaggtcg

SEQ ID NO: 452118 - DNA, 20 bp, mouse
gtgcatggctcgagccgccg

SEQ ID NO: 452119 - DNA, 20 bp, mouse
gccgaggtcgcggcggggaa

SEQ ID NO: 452120 - DNA, 20 bp, mouse
gcgagccgccgaggtcgcgg

SEQ ID NO: 452121 - DNA, 20 bp, mouse
gcccaaggctggagcgtcgg

SEQ ID NO: 452122 - DNA, 20 bp, mouse
gcggggaaaggaagaggcgc

SEQ ID NO: 452123 - DNA, 20 bp, mouse
gcgcgcgccaggcgagcgag

SEQ ID NO: 452124 - DNA, 20 bp, mouse
gaaggctggagcgtcggagg

SEQ ID NO: 452125 - DNA, 20 bp, mouse
gccggggtgagcgtcccgag

SEQ ID NO: 452126 - DNA, 20 bp, mouse
gcccgggcggaggaaaaaag

SEQ ID NO: 452127 - DNA, 20 bp, mouse
gcgacggtggcgcaggaggt

SEQ ID NO: 452128 - DNA, 20 bp, mouse
ggctgccggaataagagagg

SEQ ID NO: 452129 - DNA, 20 bp, mouse
gccagaagagtcccacgcca

SEQ ID NO: 452130 - DNA, 20 bp, mouse
gtcccgtgcgcagagaccca

SEQ ID NO: 452131 - DNA, 20 bp, mouse
gttattccggcagcgccgag

SEQ ID NO: 452132 - DNA, 20 bp, mouse
gacacgcaggggacaaccac

SEQ ID NO: 452133 - DNA, 20 bp, mouse
gcccgcgacggtggcgcagg

SEQ ID NO: 452134 - DNA, 20 bp, mouse
gaacctcaaaccccaggccg

SEQ ID NO: 452135 - DNA, 20 bp, mouse
gtggccgggaacttctaggt

SEQ ID NO: 452136 - DNA, 20 bp, mouse
ggagggtgcagacggaggct

SEQ ID NO: 452137 - DNA, 20 bp, mouse
gtaggacacgtgacacaggt

SEQ ID NO: 452138 - DNA, 20 bp, mouse
gcagaagacatgctggccag

SEQ ID NO: 452139 - DNA, 20 bp, mouse
gacttcagcagacaagccgt

SEQ ID NO: 452140 - DNA, 20 bp, mouse
gagggctctggggtgttgaa

SEQ ID NO: 452141 - DNA, 20 bp, mouse
ggacctgagaagttaacggt

SEQ ID NO: 452142 - DNA, 20 bp, mouse
gtgacacagacaagcgcaac

SEQ ID NO: 452143 - DNA, 20 bp, mouse
gctaagacctgagaagttaa

SEQ ID NO: 452144 - DNA, 20 bp, mouse
gtgttcctgggagggatgta

SEQ ID NO: 452145 - DNA, 20 bp, mouse
ggtcttaggacacgtgacac

SEQ ID NO: 452146 - DNA, 20 bp, mouse
gatggcgcgggaccccggag

SEQ ID NO: 452147 - DNA, 20 bp, mouse
gacaggaggaccagcgggac

SEQ ID NO: 452148 - DNA, 20 bp, mouse
ggctccacgcagttcaacaa

SEQ ID NO: 452149 - DNA, 20 bp, mouse
gcgggaccccggagcgggac

SEQ ID NO: 452150 - DNA, 20 bp, mouse
ggaccccggagcgggacagg

SEQ ID NO: 452151 - DNA, 20 bp, mouse
gagctcatggcgcgggaccc

SEQ ID NO: 452152 - DNA, 20 bp, mouse
ggcgggaccggcagagggtc

SEQ ID NO: 452153 - DNA, 20 bp, mouse
gggaccagcgggaccggcag

SEQ ID NO: 452154 - DNA, 20 bp, mouse
gccagaccctccggatatca

SEQ ID NO: 452155 - DNA, 20 bp, mouse
ggcgggacaggaggaccagc

SEQ ID NO: 452156 - DNA, 20 bp, mouse
gccgccgcggagagacgtcg

SEQ ID NO: 452157 - DNA, 20 bp, mouse
gcgaacgccgcagacggacg

SEQ ID NO: 452158 - DNA, 20 bp, mouse
gaggctgggggcagagcgtg

SEQ ID NO: 452159 - DNA, 20 bp, mouse
ggagcctggctcgcacgcgt

SEQ ID NO: 452160 - DNA, 20 bp, mouse
gtgcggcgttcgggcttctc

SEQ ID NO: 452161 - DNA, 20 bp, mouse
gtgatgcttcgaggttcgct

SEQ ID NO: 452162 - DNA, 20 bp, mouse
gcgccgcagggcccgctcca

SEQ ID NO: 452163 - DNA, 20 bp, mouse
gcggagagacgtcgaggctg

SEQ ID NO: 452164 - DNA, 20 bp, mouse
gcgtaccttgttcttaactt

SEQ ID NO: 452165 - DNA, 20 bp, mouse
ggcaccctacagccttggag

SEQ ID NO: 452166 - DNA, 20 bp, mouse
gaaccgcgccgggtgcagga

SEQ ID NO: 452167 - DNA, 20 bp, mouse
ggagaagaagagcaggagta

SEQ ID NO: 452168 - DNA, 20 bp, mouse
gctggaagtagacccgcagg

SEQ ID NO: 452169 - DNA, 20 bp, mouse
ggcgctgggtgtcaggctcc

SEQ ID NO: 452170 - DNA, 20 bp, mouse
gaggctggaagtagacccgc

SEQ ID NO: 452171 - DNA, 20 bp, mouse
ggtatcacgtgcaaccgcgc

SEQ ID NO: 452172 - DNA, 20 bp, mouse
ggaggccgcgtgtctctgga

SEQ ID NO: 452173 - DNA, 20 bp, mouse
gaagccgagcgcgagctgga

SEQ ID NO: 452174 - DNA, 20 bp, mouse
ggagcaggagtacggcgccc

SEQ ID NO: 452175 - DNA, 20 bp, mouse
gggcagcgctgaggtcccgg

SEQ ID NO: 452176 - DNA, 20 bp, mouse
gagccagctgaggaaccccc

SEQ ID NO: 452177 - DNA, 20 bp, mouse
ggaggaacccccgggctcga

SEQ ID NO: 452178 - DNA, 20 bp, mouse
gtcagagagaaggacagcta

SEQ ID NO: 452179 - DNA, 20 bp, mouse
ggaacccccgggctcgaggg

SEQ ID NO: 452180 - DNA, 20 bp, mouse
gtcagtgtcattcagagaga

SEQ ID NO: 452181 - DNA, 20 bp, mouse
ggcgccgccatcttccaagt

SEQ ID NO: 452182 - DNA, 20 bp, mouse
gcctcctccctcgagcccgg

SEQ ID NO: 452183 - DNA, 20 bp, mouse
ggagaaggacagctaagggc

SEQ ID NO: 452184 - DNA, 20 bp, mouse
ggccacagccaatcataggg

SEQ ID NO: 452185 - DNA, 20 bp, mouse
gtctctgaatgacactgatt

SEQ ID NO: 452186 - DNA, 20 bp, mouse
gcggctgtggtgggttggtt

SEQ ID NO: 452187 - DNA, 20 bp, mouse
gctgcgcccgaggcccagaa

SEQ ID NO: 452188 - DNA, 20 bp, mouse
gtgtctgggcagcaccgcag

SEQ ID NO: 452189 - DNA, 20 bp, mouse
gtgcttgccgcgttctgtct

SEQ ID NO: 452190 - DNA, 20 bp, mouse
gcgcggaagggcagcgccag

SEQ ID NO: 452191 - DNA, 20 bp, mouse
ggcgggctccctgcgcggaa

SEQ ID NO: 452192 - DNA, 20 bp, mouse
gaacagaggcgcgggtgagt

SEQ ID NO: 452193 - DNA, 20 bp, mouse
gatggcctgctaccccttct

SEQ ID NO: 452194 - DNA, 20 bp, mouse
gctgggcagcaccgcagggg

SEQ ID NO: 452195 - DNA, 20 bp, mouse
gggcagcaccgcaggggagg

SEQ ID NO: 452196 - DNA, 20 bp, mouse
gggtatcgttgaagacaaag

SEQ ID NO: 452197 - DNA, 20 bp, mouse
gtcctggaggagttcaagcg

SEQ ID NO: 452198 - DNA, 20 bp, mouse
gacctcgcttgaactcctcc

SEQ ID NO: 452199 - DNA, 20 bp, mouse
gaaactggacgctgtcctgg

SEQ ID NO: 452200 - DNA, 20 bp, mouse
gagcgggtgatggtgctgag

SEQ ID NO: 452201 - DNA, 20 bp, mouse
ggtcttcaacgataccaaac

SEQ ID NO: 452202 - DNA, 20 bp, mouse
gggagttcaagcgaggtaag

SEQ ID NO: 452203 - DNA, 20 bp, mouse
ggagtggatggttgtagaag

SEQ ID NO: 452204 - DNA, 20 bp, mouse
gtggtactgggtaatggtca

SEQ ID NO: 452205 - DNA, 20 bp, mouse
ggtgctatgggagtctgatg

SEQ ID NO: 452206 - DNA, 20 bp, mouse
gcggcagcggagcggcagga

SEQ ID NO: 452207 - DNA, 20 bp, mouse
gcccagcagagcgtgatcct

SEQ ID NO: 452208 - DNA, 20 bp, mouse
gagcggagcggcaggagggc

SEQ ID NO: 452209 - DNA, 20 bp, mouse
ggacgtcaggtcctcggctg

SEQ ID NO: 452210 - DNA, 20 bp, mouse
gcgtgcgggatgaacccgga

SEQ ID NO: 452211 - DNA, 20 bp, mouse
ggctggggcagttggcgcgg

SEQ ID NO: 452212 - DNA, 20 bp, mouse
gcggtctgacgtcaggtcct

SEQ ID NO: 452213 - DNA, 20 bp, mouse
gcacctcggtgaaggagatc

SEQ ID NO: 452214 - DNA, 20 bp, mouse
gcagcagcagcgcagccagg

SEQ ID NO: 452215 - DNA, 20 bp, mouse
gggagcaacatggcgccggg

SEQ ID NO: 452216 - DNA, 20 bp, mouse
gcggagttaaccgaagaggg

SEQ ID NO: 452217 - DNA, 20 bp, mouse
gtcgaggagagccggagtcg

SEQ ID NO: 452218 - DNA, 20 bp, mouse
gtctcctcgacccccctctt

SEQ ID NO: 452219 - DNA, 20 bp, mouse
gtaaccgaagaggggggtcg

SEQ ID NO: 452220 - DNA, 20 bp, mouse
gctcccgcagcgctggacac

SEQ ID NO: 452221 - DNA, 20 bp, mouse
ggcgctgcgggagccgactg

SEQ ID NO: 452222 - DNA, 20 bp, mouse
gcaagcggagttaaccgaag

SEQ ID NO: 452223 - DNA, 20 bp, mouse
ggacgtgagcgcgcgacctc

SEQ ID NO: 452224 - DNA, 20 bp, mouse
gcttggagaagggagaccgg

SEQ ID NO: 452225 - DNA, 20 bp, mouse
gccccgggaaaaggcttcca

SEQ ID NO: 452226 - DNA, 20 bp, mouse
gccgcccaggaccttagccg

SEQ ID NO: 452227 - DNA, 20 bp, mouse
gtagccgaggcgactggagc

SEQ ID NO: 452228 - DNA, 20 bp, mouse
gtggtggtgagtcctaccgg

SEQ ID NO: 452229 - DNA, 20 bp, mouse
gggctggtggtgagtcctac

SEQ ID NO: 452230 - DNA, 20 bp, mouse
gtggtgagtcctaccggcgg

SEQ ID NO: 452231 - DNA, 20 bp, mouse
gggactcaccaccagcccgg

SEQ ID NO: 452232 - DNA, 20 bp, mouse
ggtcgcctcggctaaggtcc

SEQ ID NO: 452233 - DNA, 20 bp, mouse
gaagcccgctccagtcgcct

SEQ ID NO: 452234 - DNA, 20 bp, mouse
gagagttgtcccccgccggt

SEQ ID NO: 452235 - DNA, 20 bp, mouse
gggccacgccacctacaggg

SEQ ID NO: 452236 - DNA, 20 bp, mouse
gctcggccgggaagcggggt

SEQ ID NO: 452237 - DNA, 20 bp, mouse
ggcgggaggacgcagcgagt

SEQ ID NO: 452238 - DNA, 20 bp, mouse
ggcccctctgggatccgctg

SEQ ID NO: 452239 - DNA, 20 bp, mouse
gaggctcgagagctccttcg

SEQ ID NO: 452240 - DNA, 20 bp, mouse
ggcctctcggccgggaagcg

SEQ ID NO: 452241 - DNA, 20 bp, mouse
gaggatgagcctgaccccga

SEQ ID NO: 452242 - DNA, 20 bp, mouse
ggggcgaggttgatgcccgg

SEQ ID NO: 452243 - DNA, 20 bp, mouse
gttcccggccgagaggccca

SEQ ID NO: 452244 - DNA, 20 bp, mouse
gcgagcggaacggagacaca

SEQ ID NO: 452245 - DNA, 20 bp, mouse
gccgcgctaggcagcaggtc

SEQ ID NO: 452246 - DNA, 20 bp, mouse
gagcccaggaagcagcacgg

SEQ ID NO: 452247 - DNA, 20 bp, mouse
gttgtcccgcggatccaaga

SEQ ID NO: 452248 - DNA, 20 bp, mouse
gcgggacaagaaaattcatg

SEQ ID NO: 452249 - DNA, 20 bp, mouse
ggatggcgacgtatccaccg

SEQ ID NO: 452250 - DNA, 20 bp, mouse
gctcggctccaatcgagaga

SEQ ID NO: 452251 - DNA, 20 bp, mouse
gaggcggcggaagcccggga

SEQ ID NO: 452252 - DNA, 20 bp, mouse
ggcggtgaccgaggagagtg

SEQ ID NO: 452253 - DNA, 20 bp, mouse
gtggcttcgggagcccggag

SEQ ID NO: 452254 - DNA, 20 bp, mouse
gccgggcctaagctccggag

SEQ ID NO: 452255 - DNA, 20 bp, mouse
gcgtcgccatcttggatccg

SEQ ID NO: 452256 - DNA, 20 bp, mouse
gcgaccgagtaggggattca

SEQ ID NO: 452257 - DNA, 20 bp, mouse
gcagggatcaaggaaaggcc

SEQ ID NO: 452258 - DNA, 20 bp, mouse
gtcaaggaaaggcccggcag

SEQ ID NO: 452259 - DNA, 20 bp, mouse
gtcgcgacaggcgaggaggg

SEQ ID NO: 452260 - DNA, 20 bp, mouse
gtcagcttccgtggagccgt

SEQ ID NO: 452261 - DNA, 20 bp, mouse
ggcggctgccgacggctcca

SEQ ID NO: 452262 - DNA, 20 bp, mouse
gggattcagggatcaaggaa

SEQ ID NO: 452263 - DNA, 20 bp, mouse
ggttctagacgaccgagtag

SEQ ID NO: 452264 - DNA, 20 bp, mouse
gggctccacggaagctgaac

SEQ ID NO: 452265 - DNA, 20 bp, mouse
ggggtcgcggagcaagaagt

SEQ ID NO: 452266 - DNA, 20 bp, mouse
gcagctttcggtgggttcca

SEQ ID NO: 452267 - DNA, 20 bp, mouse
ggggccaccatcttacatta

SEQ ID NO: 452268 - DNA, 20 bp, mouse
ggagactctcagctttcggt

SEQ ID NO: 452269 - DNA, 20 bp, mouse
gatggtggcccgtctagccg

SEQ ID NO: 452270 - DNA, 20 bp, mouse
gaccggctacgagagagcgg

SEQ ID NO: 452271 - DNA, 20 bp, mouse
ggtctctctctcagccgtaa

SEQ ID NO: 452272 - DNA, 20 bp, mouse
ggtcttaccctaatgtaaga

SEQ ID NO: 452273 - DNA, 20 bp, mouse
gccgccccgcccagccggat

SEQ ID NO: 452274 - DNA, 20 bp, mouse
gggtgggttccacggctaga

SEQ ID NO: 452275 - DNA, 20 bp, mouse
gaggcgggtgagtgtctgcg

SEQ ID NO: 452276 - DNA, 20 bp, mouse
gggcgcggaagaggaggcgt

SEQ ID NO: 452277 - DNA, 20 bp, mouse
ggaagaggaggcgtcggcgt

SEQ ID NO: 452278 - DNA, 20 bp, mouse
gagagggcggcagagcgtag

SEQ ID NO: 452279 - DNA, 20 bp, mouse
ggacggcgcggaggcgaagg

SEQ ID NO: 452280 - DNA, 20 bp, mouse
gctttcaatgaaaacgaggg

SEQ ID NO: 452281 - DNA, 20 bp, mouse
gtcggtggcggcggcgtcga

SEQ ID NO: 452282 - DNA, 20 bp, mouse
ggaggcgggcggctgaggag

SEQ ID NO: 452283 - DNA, 20 bp, mouse
ggcagcgggcgggactggta

SEQ ID NO: 452284 - DNA, 20 bp, mouse
gaggagcggcggccgaggag

SEQ ID NO: 452285 - DNA, 20 bp, mouse
gaacgaggggggcgcggaag

SEQ ID NO: 452286 - DNA, 20 bp, mouse
ggggccggggagagaagtcc

SEQ ID NO: 452287 - DNA, 20 bp, mouse
gctcacaaccccgagggccg

SEQ ID NO: 452288 - DNA, 20 bp, mouse
gtgcagagagtgcgaggagg

SEQ ID NO: 452289 - DNA, 20 bp, mouse
gcacacgctcacaaccccga

SEQ ID NO: 452290 - DNA, 20 bp, mouse
ggctttagagattaataaca

SEQ ID NO: 452291 - DNA, 20 bp, mouse
ggccaggaggccaaggccaa

SEQ ID NO: 452292 - DNA, 20 bp, mouse
gcttctctccccggccctcg

SEQ ID NO: 452293 - DNA, 20 bp, mouse
ggcctgaggaaccaccgagg

SEQ ID NO: 452294 - DNA, 20 bp, mouse
gtcggcatcgacccccgcgg

SEQ ID NO: 452295 - DNA, 20 bp, mouse
ggccgcctgaggaaccaccg

SEQ ID NO: 452296 - DNA, 20 bp, mouse
gacaggcgtgaggactgtag

SEQ ID NO: 452297 - DNA, 20 bp, mouse
ggacctagaaagctacctac

SEQ ID NO: 452298 - DNA, 20 bp, mouse
gacttagtcaggtgctatac

SEQ ID NO: 452299 - DNA, 20 bp, mouse
ggcctcctggggtaacttgt

SEQ ID NO: 452300 - DNA, 20 bp, mouse
gtgactgtctttcccgtgct

SEQ ID NO: 452301 - DNA, 20 bp, mouse
gtgcctgtaggtagctttct

SEQ ID NO: 452302 - DNA, 20 bp, mouse
gagtcaggtgctatacaggc

SEQ ID NO: 452303 - DNA, 20 bp, mouse
ggccaacaagttaccccagg

SEQ ID NO: 452304 - DNA, 20 bp, mouse
gaggttggactaaaccagtt

SEQ ID NO: 452305 - DNA, 20 bp, mouse
gaaagccaacaagttacccc

SEQ ID NO: 452306 - DNA, 20 bp, mouse
gagggcgagaggcgtctatg

SEQ ID NO: 452307 - DNA, 20 bp, mouse
gcctctcgccctgcgaaagg

SEQ ID NO: 452308 - DNA, 20 bp, mouse
gccatagagctagcacccgg

SEQ ID NO: 452309 - DNA, 20 bp, mouse
ggaccggtgtgaggacggag

SEQ ID NO: 452310 - DNA, 20 bp, mouse
gggagtggggagcccgagat

SEQ ID NO: 452311 - DNA, 20 bp, mouse
gagccaccggggccccaagt

SEQ ID NO: 452312 - DNA, 20 bp, mouse
gctctatggcgaggaggagg

SEQ ID NO: 452313 - DNA, 20 bp, mouse
gcatcgcgcgcgccaatctc

SEQ ID NO: 452314 - DNA, 20 bp, mouse
gagcggcgctcggcccagcg

SEQ ID NO: 452315 - DNA, 20 bp, mouse
gagtcccaggtacaaagcgg

SEQ ID NO: 452316 - DNA, 20 bp, mouse
gcagccagggtaagcaggtt

SEQ ID NO: 452317 - DNA, 20 bp, mouse
gcggatccggggcaagaggg

SEQ ID NO: 452318 - DNA, 20 bp, mouse
gtcggcggggccgccagcca

SEQ ID NO: 452319 - DNA, 20 bp, mouse
gcggccccgccgagtgcggg

SEQ ID NO: 452320 - DNA, 20 bp, mouse
ggagcggatccggggcaaga

SEQ ID NO: 452321 - DNA, 20 bp, mouse
gtggcggccccgccgagtgc

SEQ ID NO: 452322 - DNA, 20 bp, mouse
gcaacctaacctgcttaccc

SEQ ID NO: 452323 - DNA, 20 bp, mouse
gctgccgcccgcactcggcg

SEQ ID NO: 452324 - DNA, 20 bp, mouse
gaggttaggttgcttacggt

SEQ ID NO: 452325 - DNA, 20 bp, mouse
ggtaggatgggtcgccacgg

SEQ ID NO: 452326 - DNA, 20 bp, mouse
ggctgccttggaggacccag

SEQ ID NO: 452327 - DNA, 20 bp, mouse
gccgcctgcgtgagggacac

SEQ ID NO: 452328 - DNA, 20 bp, mouse
gggagacatagtacccgcaa

SEQ ID NO: 452329 - DNA, 20 bp, mouse
ggcggtgcgcccactcatca

SEQ ID NO: 452330 - DNA, 20 bp, mouse
ggggccgcccgcctgcgtga

SEQ ID NO: 452331 - DNA, 20 bp, mouse
ggtcctccaaggcagcccta

SEQ ID NO: 452332 - DNA, 20 bp, mouse
ggtacccgcaaaggcggtga

SEQ ID NO: 452333 - DNA, 20 bp, mouse
ggacatagtacccgcaaagg

SEQ ID NO: 452334 - DNA, 20 bp, mouse
ggttgcctctgggtcctcca

SEQ ID NO: 452335 - DNA, 20 bp, mouse
gctgcgctcaccatgatgag

SEQ ID NO: 452336 - DNA, 20 bp, mouse
gcctggaagcacaccttcgt

SEQ ID NO: 452337 - DNA, 20 bp, mouse
ggtgctggaggggtgatccg

SEQ ID NO: 452338 - DNA, 20 bp, mouse
ggtgccctaacagcccggat

SEQ ID NO: 452339 - DNA, 20 bp, mouse
ggatcacccctccagcaccc

SEQ ID NO: 452340 - DNA, 20 bp, mouse
gcgcgtgaggcactgcccag

SEQ ID NO: 452341 - DNA, 20 bp, mouse
gaggggactggaggcgaaga

SEQ ID NO: 452342 - DNA, 20 bp, mouse
gcgtgatcctgcacccacga

SEQ ID NO: 452343 - DNA, 20 bp, mouse
gaggtgtgcttccagggtgc

SEQ ID NO: 452344 - DNA, 20 bp, mouse
ggagggccgacgctccaaga

SEQ ID NO: 452345 - DNA, 20 bp, mouse
gaacaccgggagaagacctc

SEQ ID NO: 452346 - DNA, 20 bp, mouse
ggcggtggccctttcgggag

SEQ ID NO: 452347 - DNA, 20 bp, mouse
ggaggctgcgcgcagtcggg

SEQ ID NO: 452348 - DNA, 20 bp, mouse
gttcgggagaggtgggccaa

SEQ ID NO: 452349 - DNA, 20 bp, mouse
gacgggtgagcacggctctg

SEQ ID NO: 452350 - DNA, 20 bp, mouse
gtggccctttcgggagaggt

SEQ ID NO: 452351 - DNA, 20 bp, mouse
ggccaccctgcgaaggtgga

SEQ ID NO: 452352 - DNA, 20 bp, mouse
ggtcagccgccaccctgcga

SEQ ID NO: 452353 - DNA, 20 bp, mouse
gggtctggaggagaacgcct

SEQ ID NO: 452354 - DNA, 20 bp, mouse
gagccgccaccctgcgaagg

SEQ ID NO: 452355 - DNA, 20 bp, mouse
gtctgggagtcagaactccc

SEQ ID NO: 452356 - DNA, 20 bp, mouse
gtccacaccgaggttgtcag

SEQ ID NO: 452357 - DNA, 20 bp, mouse
ggaagtccggaaggcgaggg

SEQ ID NO: 452358 - DNA, 20 bp, mouse
ggcaagccgaggccgatgag

SEQ ID NO: 452359 - DNA, 20 bp, mouse
ggttttgtctcggtttccaa

SEQ ID NO: 452360 - DNA, 20 bp, mouse
gaccttgtgcggcgtctaga

SEQ ID NO: 452361 - DNA, 20 bp, mouse
gaccgagacaaaaccttgtg

SEQ ID NO: 452362 - DNA, 20 bp, mouse
gggaaggagccgcagggacc

SEQ ID NO: 452363 - DNA, 20 bp, mouse
ggcggcgtctagacgggtca

SEQ ID NO: 452364 - DNA, 20 bp, mouse
gcgccccggcaggtcctgga

SEQ ID NO: 452365 - DNA, 20 bp, mouse
gcctcctcgggaagtccgga

SEQ ID NO: 452366 - DNA, 20 bp, mouse
gcagctggctgggaaaaacg

SEQ ID NO: 452367 - DNA, 20 bp, mouse
ggcggcggccgtgggagcag

SEQ ID NO: 452368 - DNA, 20 bp, mouse
gtatgtggacctagcaccaa

SEQ ID NO: 452369 - DNA, 20 bp, mouse
gagagcctgggccacggcgg

SEQ ID NO: 452370 - DNA, 20 bp, mouse
gccaggctctggaaagcagc

SEQ ID NO: 452371 - DNA, 20 bp, mouse
gggacagatgcgagcgtcag

SEQ ID NO: 452372 - DNA, 20 bp, mouse
gcagcttcccgcacttaact

SEQ ID NO: 452373 - DNA, 20 bp, mouse
gtgcgagcgtcagaggctgt

SEQ ID NO: 452374 - DNA, 20 bp, mouse
ggcacctaagcggagatctg

SEQ ID NO: 452375 - DNA, 20 bp, mouse
gctgtgggcgcactgaggtt

SEQ ID NO: 452376 - DNA, 20 bp, mouse
gcagagcagagcggacccgg

SEQ ID NO: 452377 - DNA, 20 bp, mouse
gacccagagcagagcggacc

SEQ ID NO: 452378 - DNA, 20 bp, mouse
gcggggcgcgagctcagaca

SEQ ID NO: 452379 - DNA, 20 bp, mouse
ggacccggcggcgcttcctc

SEQ ID NO: 452380 - DNA, 20 bp, mouse
gcagtcccggaagcggccgg

SEQ ID NO: 452381 - DNA, 20 bp, mouse
gacgtgcgcagtcccggaag

SEQ ID NO: 452382 - DNA, 20 bp, mouse
gcgttgccgtggttacccag

SEQ ID NO: 452383 - DNA, 20 bp, mouse
gctaggcccgagtcccgccg

SEQ ID NO: 452384 - DNA, 20 bp, mouse
ggctccgcgcgcgctgccgg

SEQ ID NO: 452385 - DNA, 20 bp, mouse
gctgccggaggaagcgccgc

SEQ ID NO: 452386 - DNA, 20 bp, mouse
gcaaagggtggttgtatgtg

SEQ ID NO: 452387 - DNA, 20 bp, mouse
gcttccagaagttggtctga

SEQ ID NO: 452388 - DNA, 20 bp, mouse
gcccgctgccttccagaagt

SEQ ID NO: 452389 - DNA, 20 bp, mouse
gattcagcctagagttagag

SEQ ID NO: 452390 - DNA, 20 bp, mouse
gaccaacttctggaaggcag

SEQ ID NO: 452391 - DNA, 20 bp, mouse
gctcctgcctctctaactct

SEQ ID NO: 452392 - DNA, 20 bp, mouse
ggcagtatctccagccgcac

SEQ ID NO: 452393 - DNA, 20 bp, mouse
ggctgaggcgacaaaagagg

SEQ ID NO: 452394 - DNA, 20 bp, mouse
gttgccttcagaccaacttc

SEQ ID NO: 452395 - DNA, 20 bp, mouse
gagggaaagcagggttaagg

SEQ ID NO: 452396 - DNA, 20 bp, mouse
gagaggcagggacctcaagc

SEQ ID NO: 452397 - DNA, 20 bp, mouse
gcgccaggggagccagaagg

SEQ ID NO: 452398 - DNA, 20 bp, mouse
ggagacagcgcgcgagctga

SEQ ID NO: 452399 - DNA, 20 bp, mouse
gcggcgacgggcgctcgggg

SEQ ID NO: 452400 - DNA, 20 bp, mouse
gtcaagcagggcgcggcgac

SEQ ID NO: 452401 - DNA, 20 bp, mouse
gggcctggggccgcccgctt

SEQ ID NO: 452402 - DNA, 20 bp, mouse
gggcggaggcggaaaagaag

SEQ ID NO: 452403 - DNA, 20 bp, mouse
ggatcggtcagtaagtcagt

SEQ ID NO: 452404 - DNA, 20 bp, mouse
gcgctcggggtggcccaagc

SEQ ID NO: 452405 - DNA, 20 bp, mouse
ggcacgggtgctagaggccg

SEQ ID NO: 452406 - DNA, 20 bp, mouse
gccagcagggacccccacgt

SEQ ID NO: 452407 - DNA, 20 bp, mouse
gtgtgagagcaagaaacccc

SEQ ID NO: 452408 - DNA, 20 bp, mouse
gtcgcagatgagtgaatgag

SEQ ID NO: 452409 - DNA, 20 bp, mouse
gcagctcttgggacctacgt

SEQ ID NO: 452410 - DNA, 20 bp, mouse
gcagatctggagacccagca

SEQ ID NO: 452411 - DNA, 20 bp, mouse
gggggaagtggtaaccggta

SEQ ID NO: 452412 - DNA, 20 bp, mouse
gagagttgaggttagaacat

SEQ ID NO: 452413 - DNA, 20 bp, mouse
ggtctgaagtaaaacaacaa

SEQ ID NO: 452414 - DNA, 20 bp, mouse
gttgtctgtagggacatggg

SEQ ID NO: 452415 - DNA, 20 bp, mouse
ggtcttgtggagccttgtcc

SEQ ID NO: 452416 - DNA, 20 bp, mouse
gtctctgctgactcagactg

SEQ ID NO: 452417 - DNA, 20 bp, mouse
ggatgtttgctgggtggcca

SEQ ID NO: 452418 - DNA, 20 bp, mouse
gagcagagatgtttgctggg

SEQ ID NO: 452419 - DNA, 20 bp, mouse
gcctacctaactaactgtta

SEQ ID NO: 452420 - DNA, 20 bp, mouse
gggacagtaacagtcgtctg

SEQ ID NO: 452421 - DNA, 20 bp, mouse
gtttgctgggtggccacggc

SEQ ID NO: 452422 - DNA, 20 bp, mouse
gagtcagcagagatgtttgc

SEQ ID NO: 452423 - DNA, 20 bp, mouse
gctgctgtaagtttaatgtt

SEQ ID NO: 452424 - DNA, 20 bp, mouse
gtggtagggattgccaggca

SEQ ID NO: 452425 - DNA, 20 bp, mouse
ggccagagaccttgttacaa

SEQ ID NO: 452426 - DNA, 20 bp, mouse
ggggctcgcagtgactggac

SEQ ID NO: 452427 - DNA, 20 bp, mouse
gtgcaggccacagctaggag

SEQ ID NO: 452428 - DNA, 20 bp, mouse
gtgcgtgcagggccctgcgt

SEQ ID NO: 452429 - DNA, 20 bp, mouse
ggggccctgcacgcacgcga

SEQ ID NO: 452430 - DNA, 20 bp, mouse
gcgcgagggctcgcagtgac

SEQ ID NO: 452431 - DNA, 20 bp, mouse
gttggcaaccgagactggag

SEQ ID NO: 452432 - DNA, 20 bp, mouse
gggccctgcgtggggagcgg

SEQ ID NO: 452433 - DNA, 20 bp, mouse
gaaggcgcacgagtccgggt

SEQ ID NO: 452434 - DNA, 20 bp, mouse
gctggagtggtggacagtga

SEQ ID NO: 452435 - DNA, 20 bp, mouse
gccagcagtgctgatttgcg

SEQ ID NO: 452436 - DNA, 20 bp, mouse
gtgccgcgggagacccgagc

SEQ ID NO: 452437 - DNA, 20 bp, mouse
ggggtctcccgcggcactgg

SEQ ID NO: 452438 - DNA, 20 bp, mouse
gcggcggtgtgacagctcgt

SEQ ID NO: 452439 - DNA, 20 bp, mouse
gcgccggctcgggtctcccg

SEQ ID NO: 452440 - DNA, 20 bp, mouse
gagggttgcgcagagggagg

SEQ ID NO: 452441 - DNA, 20 bp, mouse
ggctgtcacaccgccggctc

SEQ ID NO: 452442 - DNA, 20 bp, mouse
gagccgggagggttgcgcag

SEQ ID NO: 452443 - DNA, 20 bp, mouse
gacccgctgcaactccgggg

SEQ ID NO: 452444 - DNA, 20 bp, mouse
ggggaggacagcgcccgggg

SEQ ID NO: 452445 - DNA, 20 bp, mouse
gccggggaggacagcgcccg

SEQ ID NO: 452446 - DNA, 20 bp, mouse
gtgtccaccacggcttcgaa

SEQ ID NO: 452447 - DNA, 20 bp, mouse
gtcaccagcctgggcctcaa

SEQ ID NO: 452448 - DNA, 20 bp, mouse
gtgaccgttcgaagccgtgg

SEQ ID NO: 452449 - DNA, 20 bp, mouse
gcgagggcaaacatatagaa

SEQ ID NO: 452450 - DNA, 20 bp, mouse
ggcaaacatatagaaaggga

SEQ ID NO: 452451 - DNA, 20 bp, mouse
gtcagggagacccggatcgt

SEQ ID NO: 452452 - DNA, 20 bp, mouse
gtgttgaccgttcgaagccg

SEQ ID NO: 452453 - DNA, 20 bp, mouse
ggagctctctgtgtcagttg

SEQ ID NO: 452454 - DNA, 20 bp, mouse
gtttctcagattcgaagcga

SEQ ID NO: 452455 - DNA, 20 bp, mouse
gagattctggaaataagcta

SEQ ID NO: 452456 - DNA, 20 bp, mouse
ggcggctacagaggtcccgg

SEQ ID NO: 452457 - DNA, 20 bp, mouse
gtcctgggacagttgattta

SEQ ID NO: 452458 - DNA, 20 bp, mouse
gcccctaaatcaactgtccc

SEQ ID NO: 452459 - DNA, 20 bp, mouse
gagagcggctacagaggtcc

SEQ ID NO: 452460 - DNA, 20 bp, mouse
gcagaggtcccggcggtgaa

SEQ ID NO: 452461 - DNA, 20 bp, mouse
gaggctggatgaagacagta

SEQ ID NO: 452462 - DNA, 20 bp, mouse
gaacatgatggttaagagtt

SEQ ID NO: 452463 - DNA, 20 bp, mouse
gccagatagagcggctacag

SEQ ID NO: 452464 - DNA, 20 bp, mouse
ggcccagtagatttagtctg

SEQ ID NO: 452465 - DNA, 20 bp, mouse
ggggagtcacatttcttatt

SEQ ID NO: 452466 - DNA, 20 bp, mouse
ggagcgcggagcgagcactg

SEQ ID NO: 452467 - DNA, 20 bp, mouse
ggtgcgggtagagtgagtga

SEQ ID NO: 452468 - DNA, 20 bp, mouse
gcccgcctgcagcggccgaa

SEQ ID NO: 452469 - DNA, 20 bp, mouse
ggcggcgcggggttcggcag

SEQ ID NO: 452470 - DNA, 20 bp, mouse
gtggcgcgtccggacgtagg

SEQ ID NO: 452471 - DNA, 20 bp, mouse
gtggaggcggcggctccagc

SEQ ID NO: 452472 - DNA, 20 bp, mouse
gtgagtgaggggacacgcgt

SEQ ID NO: 452473 - DNA, 20 bp, mouse
ggcgcatgctgctcaagggt

SEQ ID NO: 452474 - DNA, 20 bp, mouse
ggcggagcgagcactgcggc

SEQ ID NO: 452475 - DNA, 20 bp, mouse
gctcaagggtgggaagaaca

SEQ ID NO: 452476 - DNA, 20 bp, mouse
gccagtcgaaaaatccaagg

SEQ ID NO: 452477 - DNA, 20 bp, mouse
gttccccggctgagggctag

SEQ ID NO: 452478 - DNA, 20 bp, mouse
gcccggctgagggctagggg

SEQ ID NO: 452479 - DNA, 20 bp, mouse
gaggccagtcgaaaaatcca

SEQ ID NO: 452480 - DNA, 20 bp, mouse
gtatcctggggagctgaggt

SEQ ID NO: 452481 - DNA, 20 bp, mouse
ggatacagaccctaactagt

SEQ ID NO: 452482 - DNA, 20 bp, mouse
gtcccgcagccgactagtta

SEQ ID NO: 452483 - DNA, 20 bp, mouse
gagttagggtctgtatcctg

SEQ ID NO: 452484 - DNA, 20 bp, mouse
gcggctgcgggaaggaatgc

SEQ ID NO: 452485 - DNA, 20 bp, mouse
gtctgtatcctggggagctg

SEQ ID NO: 452486 - DNA, 20 bp, mouse
gggctggaccgccgcaccgg

SEQ ID NO: 452487 - DNA, 20 bp, mouse
gccatggccgcggcgcctaa

SEQ ID NO: 452488 - DNA, 20 bp, mouse
gcccgacgcgcagggaccgc

SEQ ID NO: 452489 - DNA, 20 bp, mouse
gctggcgacaggagcgacag

SEQ ID NO: 452490 - DNA, 20 bp, mouse
gagcgggaacttgacccgtt

SEQ ID NO: 452491 - DNA, 20 bp, mouse
gaggccaggctccccaggat

SEQ ID NO: 452492 - DNA, 20 bp, mouse
ggaggggcgaagaagggtca

SEQ ID NO: 452493 - DNA, 20 bp, mouse
gtggaccgccgcaccggggg

SEQ ID NO: 452494 - DNA, 20 bp, mouse
ggccgcgagggaggtcgtcg

SEQ ID NO: 452495 - DNA, 20 bp, mouse
gcgaagaagggtcaggggga

SEQ ID NO: 452496 - DNA, 20 bp, mouse
ggctccgcctaagcgaggag

SEQ ID NO: 452497 - DNA, 20 bp, mouse
gccagcgccactcctcgctt

SEQ ID NO: 452498 - DNA, 20 bp, mouse
gggagtggcgctgggctggt

SEQ ID NO: 452499 - DNA, 20 bp, mouse
gccgggagccggggtaacca

SEQ ID NO: 452500 - DNA, 20 bp, mouse
gtactgctgtcaagtagcta

SEQ ID NO: 452501 - DNA, 20 bp, mouse
ggtagggccaggcagcgagg

SEQ ID NO: 452502 - DNA, 20 bp, mouse
gggtgggctccgcctaagcg

SEQ ID NO: 452503 - DNA, 20 bp, mouse
gacaggagtggggaacaggt

SEQ ID NO: 452504 - DNA, 20 bp, mouse
ggcgccactcctcgcttagg

SEQ ID NO: 452505 - DNA, 20 bp, mouse
gcgaggaggcgacaggagtg

SEQ ID NO: 452506 - DNA, 20 bp, mouse
gactggctgtcctggcgtgg

SEQ ID NO: 452507 - DNA, 20 bp, mouse
gccccgccggccttagccac

SEQ ID NO: 452508 - DNA, 20 bp, mouse
gtgtcctggcgtggcggcag

SEQ ID NO: 452509 - DNA, 20 bp, mouse
gccaggacagccagtggcta

SEQ ID NO: 452510 - DNA, 20 bp, mouse
gtcaaggaagacatttataa

SEQ ID NO: 452511 - DNA, 20 bp, mouse
ggagatgctgcagtggctcg

SEQ ID NO: 452512 - DNA, 20 bp, mouse
gtagagtgcgggaagggtgt

SEQ ID NO: 452513 - DNA, 20 bp, mouse
ggcgtggcggcagcgggcga

SEQ ID NO: 452514 - DNA, 20 bp, mouse
gctgggtgctgtttcaagag

SEQ ID NO: 452515 - DNA, 20 bp, mouse
gctgcggggtcgctactatg

SEQ ID NO: 452516 - DNA, 20 bp, mouse
gagcaagagtgactcttgtc

SEQ ID NO: 452517 - DNA, 20 bp, mouse
gacccaagtatgggagagga

SEQ ID NO: 452518 - DNA, 20 bp, mouse
ggtgagattgcagtccatct

SEQ ID NO: 452519 - DNA, 20 bp, mouse
gtgacaacatcatctttaat

SEQ ID NO: 452520 - DNA, 20 bp, mouse
gcatgtctgtaacccaagta

SEQ ID NO: 452521 - DNA, 20 bp, mouse
ggccttcctctcccatactt

SEQ ID NO: 452522 - DNA, 20 bp, mouse
ggtaaggtaaaattacaaca

SEQ ID NO: 452523 - DNA, 20 bp, mouse
gcatatattttgcagattaa

SEQ ID NO: 452524 - DNA, 20 bp, mouse
ggcagccaatgaatgaaagc

SEQ ID NO: 452525 - DNA, 20 bp, mouse
gaaaggatttgcgaataacc

SEQ ID NO: 452526 - DNA, 20 bp, mouse
gagctgccaccagcacaggg

SEQ ID NO: 452527 - DNA, 20 bp, mouse
ggacagtgcgctccagagtc

SEQ ID NO: 452528 - DNA, 20 bp, mouse
gcacagcgcctaggagaact

SEQ ID NO: 452529 - DNA, 20 bp, mouse
gagggagggagaggaacgcg

SEQ ID NO: 452530 - DNA, 20 bp, mouse
ggagcaagcccagttctcct

SEQ ID NO: 452531 - DNA, 20 bp, mouse
gcaacgtccgaaggtcccgg

SEQ ID NO: 452532 - DNA, 20 bp, mouse
gtgtccgggaggctgcgagg

SEQ ID NO: 452533 - DNA, 20 bp, mouse
gaccgctgcagcctgaactc

SEQ ID NO: 452534 - DNA, 20 bp, mouse
gctgcaggagcgacaaccct

SEQ ID NO: 452535 - DNA, 20 bp, mouse
gcactagcggaagactcata

SEQ ID NO: 452536 - DNA, 20 bp, mouse
ggatgcaggcaggtgcaagt

SEQ ID NO: 452537 - DNA, 20 bp, mouse
gagcagaagggacccaggtg

SEQ ID NO: 452538 - DNA, 20 bp, mouse
gagcccggagcagcagcggg

SEQ ID NO: 452539 - DNA, 20 bp, mouse
gcgcgagcccggagcagcag

SEQ ID NO: 452540 - DNA, 20 bp, mouse
gggctgccatcagttgcgtg

SEQ ID NO: 452541 - DNA, 20 bp, mouse
gctccgccccacgcaactga

SEQ ID NO: 452542 - DNA, 20 bp, mouse
gtccacctgaggtgtgtcca

SEQ ID NO: 452543 - DNA, 20 bp, mouse
gcgtgccctggacacacctc

SEQ ID NO: 452544 - DNA, 20 bp, mouse
gtcaggaggatgcctcacct

SEQ ID NO: 452545 - DNA, 20 bp, mouse
gtgccatcagttgcgtgggg

SEQ ID NO: 452546 - DNA, 20 bp, mouse
gctgtctggagtcctcagtc

SEQ ID NO: 452547 - DNA, 20 bp, mouse
gcaggcagaaccaagccgta

SEQ ID NO: 452548 - DNA, 20 bp, mouse
ggctgcatagacattccata

SEQ ID NO: 452549 - DNA, 20 bp, mouse
gcttaccagggaaatgtctc

SEQ ID NO: 452550 - DNA, 20 bp, mouse
ggtcaggaatgcagcaggag

SEQ ID NO: 452551 - DNA, 20 bp, mouse
ggtacttacggatcttacca

SEQ ID NO: 452552 - DNA, 20 bp, mouse
gggagccacgcaatactcag

SEQ ID NO: 452553 - DNA, 20 bp, mouse
gagatcccgagacatttccc

SEQ ID NO: 452554 - DNA, 20 bp, mouse
gtgacttgagtctctatcgg

SEQ ID NO: 452555 - DNA, 20 bp, mouse
gctacacacccttccagtaa

SEQ ID NO: 452556 - DNA, 20 bp, mouse
ggccagaacgggagccctag

SEQ ID NO: 452557 - DNA, 20 bp, mouse
ggagccggagactcatcatg

SEQ ID NO: 452558 - DNA, 20 bp, mouse
gcaaggctgacacccagcgt

SEQ ID NO: 452559 - DNA, 20 bp, mouse
gcaagctccagagaccaccg

SEQ ID NO: 452560 - DNA, 20 bp, mouse
ggagccctagcggcgcaaca

SEQ ID NO: 452561 - DNA, 20 bp, mouse
gtgcggagctgaccaacgct

SEQ ID NO: 452562 - DNA, 20 bp, mouse
ggctccgcatgatgagtctc

SEQ ID NO: 452563 - DNA, 20 bp, mouse
ggagctggcgcgtacaggga

SEQ ID NO: 452564 - DNA, 20 bp, mouse
ggatcagcaccagacagcag

SEQ ID NO: 452565 - DNA, 20 bp, mouse
gagagaccaccgtggcgagc

SEQ ID NO: 452566 - DNA, 20 bp, mouse
gaaccgagaaggaataggag

SEQ ID NO: 452567 - DNA, 20 bp, mouse
gtccagtacggagcctggag

SEQ ID NO: 452568 - DNA, 20 bp, mouse
gtctctgtgaggttcttgaa

SEQ ID NO: 452569 - DNA, 20 bp, mouse
gccagaactggaacctgaag

SEQ ID NO: 452570 - DNA, 20 bp, mouse
gattcaaaccgagaaggaat

SEQ ID NO: 452571 - DNA, 20 bp, mouse
gggaacctgaagagggtgag

SEQ ID NO: 452572 - DNA, 20 bp, mouse
gcgagccagtgaaatgccag

SEQ ID NO: 452573 - DNA, 20 bp, mouse
ggagaggagagagctactta

SEQ ID NO: 452574 - DNA, 20 bp, mouse
gcattgaagtggctccagta

SEQ ID NO: 452575 - DNA, 20 bp, mouse
ggagcgcccttacaccaatg

SEQ ID NO: 452576 - DNA, 20 bp, mouse
ggcagcctgtgagttgcaag

SEQ ID NO: 452577 - DNA, 20 bp, mouse
gctttcctcttgcaactcac

SEQ ID NO: 452578 - DNA, 20 bp, mouse
ggatctcctgctgctactag

SEQ ID NO: 452579 - DNA, 20 bp, mouse
gagaggaaagccggcaagca

SEQ ID NO: 452580 - DNA, 20 bp, mouse
gttgtgtgcagctggagcag

SEQ ID NO: 452581 - DNA, 20 bp, mouse
ggacaaccctccctgcttgc

SEQ ID NO: 452582 - DNA, 20 bp, mouse
ggtggcttcagtgtcctgcc

SEQ ID NO: 452583 - DNA, 20 bp, mouse
gcttctacgttgccagagca

SEQ ID NO: 452584 - DNA, 20 bp, mouse
gcctgctgctactaggggca

SEQ ID NO: 452585 - DNA, 20 bp, mouse
gtgatcatggcacgggtcaa

SEQ ID NO: 452586 - DNA, 20 bp, mouse
gctctcagagcgctggagac

SEQ ID NO: 452587 - DNA, 20 bp, mouse
gcgagtggctctcagagcgc

SEQ ID NO: 452588 - DNA, 20 bp, mouse
gccttcacccagcactgact

SEQ ID NO: 452589 - DNA, 20 bp, mouse
gtgaagacccagtcagtgct

SEQ ID NO: 452590 - DNA, 20 bp, mouse
gctccccaaaatatctcgag

SEQ ID NO: 452591 - DNA, 20 bp, mouse
ggagccactcgagatatttt

SEQ ID NO: 452592 - DNA, 20 bp, mouse
gggctaggaaaagcactaca

SEQ ID NO: 452593 - DNA, 20 bp, mouse
gtgatttaaaacttgcaggg

SEQ ID NO: 452594 - DNA, 20 bp, mouse
ggacctcaagacaggcgcaa

SEQ ID NO: 452595 - DNA, 20 bp, mouse
gactcaaaattggaacagag

SEQ ID NO: 452596 - DNA, 20 bp, mouse
gttgtaaggttcaagctcca

SEQ ID NO: 452597 - DNA, 20 bp, mouse
gaggtctcaaagagctgccc

SEQ ID NO: 452598 - DNA, 20 bp, mouse
gctcacagctcgcatctcag

SEQ ID NO: 452599 - DNA, 20 bp, mouse
ggagcttctgaggatcagga

SEQ ID NO: 452600 - DNA, 20 bp, mouse
gtagccgaaagcacctcgtt

SEQ ID NO: 452601 - DNA, 20 bp, mouse
gctcgttcggaaatgagagc

SEQ ID NO: 452602 - DNA, 20 bp, mouse
ggaagcggacagctccttat

SEQ ID NO: 452603 - DNA, 20 bp, mouse
gaaggagctgtccgcttccc

SEQ ID NO: 452604 - DNA, 20 bp, mouse
ggaagagatcgctcactcgg

SEQ ID NO: 452605 - DNA, 20 bp, mouse
ggagctgtgagctgcgatcg

SEQ ID NO: 452606 - DNA, 20 bp, mouse
gaagtactttagactattgg

SEQ ID NO: 452607 - DNA, 20 bp, mouse
ggcgaggctgtgcgaaggag

SEQ ID NO: 452608 - DNA, 20 bp, mouse
gctccgaggaagctctgcta

SEQ ID NO: 452609 - DNA, 20 bp, mouse
gactgcagctcggagctccg

SEQ ID NO: 452610 - DNA, 20 bp, mouse
gacaaagtactttagactat

SEQ ID NO: 452611 - DNA, 20 bp, mouse
gagagtgtctgtttaagggg

SEQ ID NO: 452612 - DNA, 20 bp, mouse
gagattcagcaccagggtga

SEQ ID NO: 452613 - DNA, 20 bp, mouse
gtaaagattgcctttcttaa

SEQ ID NO: 452614 - DNA, 20 bp, mouse
gaaggagctgtccttcaccc

SEQ ID NO: 452615 - DNA, 20 bp, mouse
gaaaggcaatctttaagaga

SEQ ID NO: 452616 - DNA, 20 bp, mouse
gtaaagtcgagcgcagttct

SEQ ID NO: 452617 - DNA, 20 bp, mouse
ggggaatccggaggaagacg

SEQ ID NO: 452618 - DNA, 20 bp, mouse
gattggagctcgcatctccg

SEQ ID NO: 452619 - DNA, 20 bp, mouse
gaatgagctgtccgcctctc

SEQ ID NO: 452620 - DNA, 20 bp, mouse
gctgaagcagaacggagtga

SEQ ID NO: 452621 - DNA, 20 bp, mouse
gtttgtctgttggtggaact

SEQ ID NO: 452622 - DNA, 20 bp, mouse
gttaaaggaagggaatccgg

SEQ ID NO: 452623 - DNA, 20 bp, mouse
ggaggcggacagctcatttc

SEQ ID NO: 452624 - DNA, 20 bp, mouse
gagtgagcgatcgcttccaa

SEQ ID NO: 452625 - DNA, 20 bp, mouse
gggaagcgatcgctcactga

SEQ ID NO: 452626 - DNA, 20 bp, mouse
gctccacagagaaagaccaa

SEQ ID NO: 452627 - DNA, 20 bp, mouse
gagtgtcgcgctagggaggt

SEQ ID NO: 452628 - DNA, 20 bp, mouse
gagctagtgtcgcgctaggg

SEQ ID NO: 452629 - DNA, 20 bp, mouse
ggcaagctagtgtcgcgcta

SEQ ID NO: 452630 - DNA, 20 bp, mouse
ggtgggcgggaggctgccaa

SEQ ID NO: 452631 - DNA, 20 bp, mouse
gaggcgggattgcaagcggt

SEQ ID NO: 452632 - DNA, 20 bp, mouse
ggccctggtttcccaagatg

SEQ ID NO: 452633 - DNA, 20 bp, mouse
gcactagcttgcaaaaccgt

SEQ ID NO: 452634 - DNA, 20 bp, mouse
ggaggaagtcgactctgggt

SEQ ID NO: 452635 - DNA, 20 bp, mouse
gtgcggtagagaataccagg

SEQ ID NO: 452636 - DNA, 20 bp, mouse
gttagggcggagcagcaaca

SEQ ID NO: 452637 - DNA, 20 bp, mouse
gcgggcttgacggcttaggg

SEQ ID NO: 452638 - DNA, 20 bp, mouse
gacatggcggcccctggagc

SEQ ID NO: 452639 - DNA, 20 bp, mouse
gtggcgagttccgggcttga

SEQ ID NO: 452640 - DNA, 20 bp, mouse
gggacccggaacatcatgac

SEQ ID NO: 452641 - DNA, 20 bp, mouse
ggtctctccgccctagagga

SEQ ID NO: 452642 - DNA, 20 bp, mouse
gctttcctgtccctcctcta

SEQ ID NO: 452643 - DNA, 20 bp, mouse
gttccgggcttgacggctta

SEQ ID NO: 452644 - DNA, 20 bp, mouse
gtcctgtccctcctctaggg

SEQ ID NO: 452645 - DNA, 20 bp, mouse
ggcaagggtggctagacgaa

SEQ ID NO: 452646 - DNA, 20 bp, mouse
gcttcctgcggagagaacag

SEQ ID NO: 452647 - DNA, 20 bp, mouse
gcccagacgcggggattcgt

SEQ ID NO: 452648 - DNA, 20 bp, mouse
gccgctgggtcggcttcctg

SEQ ID NO: 452649 - DNA, 20 bp, mouse
gcccagcgggagcacacacg

SEQ ID NO: 452650 - DNA, 20 bp, mouse
gcggggattcgtaggcaata

SEQ ID NO: 452651 - DNA, 20 bp, mouse
gttggcaaggccttctagta

SEQ ID NO: 452652 - DNA, 20 bp, mouse
gactgggagaggtgcttcag

SEQ ID NO: 452653 - DNA, 20 bp, mouse
gcttctagtaaggcatgaca

SEQ ID NO: 452654 - DNA, 20 bp, mouse
gcgggagtgctcctgaaact

SEQ ID NO: 452655 - DNA, 20 bp, mouse
ggcgttccgccccagacgcg

SEQ ID NO: 452656 - DNA, 20 bp, mouse
gcgagggccgtgatccagtg

SEQ ID NO: 452657 - DNA, 20 bp, mouse
gcaccccgcacggcccggaa

SEQ ID NO: 452658 - DNA, 20 bp, mouse
gggccgtgcggggtgaccga

SEQ ID NO: 452659 - DNA, 20 bp, mouse
gtgatccagtgtggtgaggg

SEQ ID NO: 452660 - DNA, 20 bp, mouse
ggcttgtcctcataataccg

SEQ ID NO: 452661 - DNA, 20 bp, mouse
gccgtgatccagtgtggtga

SEQ ID NO: 452662 - DNA, 20 bp, mouse
gccagtgtggtgagggcggt

SEQ ID NO: 452663 - DNA, 20 bp, mouse
ggccatgccccggtattatg

SEQ ID NO: 452664 - DNA, 20 bp, mouse
gggcagagctcagtcaagac

SEQ ID NO: 452665 - DNA, 20 bp, mouse
ggaggtcacgtcgagggtag

SEQ ID NO: 452666 - DNA, 20 bp, mouse
ggccggggcaggtcaatcgg

SEQ ID NO: 452667 - DNA, 20 bp, mouse
gcctacgtgggagagcggtg

SEQ ID NO: 452668 - DNA, 20 bp, mouse
gcaggtccaccgactgcaca

SEQ ID NO: 452669 - DNA, 20 bp, mouse
gtgcagtcggtggacctgcg

SEQ ID NO: 452670 - DNA, 20 bp, mouse
gagtttccctgtgcagtcgg

SEQ ID NO: 452671 - DNA, 20 bp, mouse
ggtccaggcagcgccagtac

SEQ ID NO: 452672 - DNA, 20 bp, mouse
gtgcctggacgacaacgcgg

SEQ ID NO: 452673 - DNA, 20 bp, mouse
ggaggccggggcaggtcaat

SEQ ID NO: 452674 - DNA, 20 bp, mouse
gcgctgcctggacgacaacg

SEQ ID NO: 452675 - DNA, 20 bp, mouse
ggtggactgtggttcccgca

SEQ ID NO: 452676 - DNA, 20 bp, mouse
ggcctaggacgcctccacgg

SEQ ID NO: 452677 - DNA, 20 bp, mouse
gaccgccgtggaggcgtcct

SEQ ID NO: 452678 - DNA, 20 bp, mouse
ggcagcctaggacgcctcca

SEQ ID NO: 452679 - DNA, 20 bp, mouse
gtccacgctttgaggctggt

SEQ ID NO: 452680 - DNA, 20 bp, mouse
gggcgtcctaggctgcagcc

SEQ ID NO: 452681 - DNA, 20 bp, mouse
ggcttctacttacaccgccg

SEQ ID NO: 452682 - DNA, 20 bp, mouse
gtgcttccgggctgcagcct

SEQ ID NO: 452683 - DNA, 20 bp, mouse
gcggttcagcctaacaagag

SEQ ID NO: 452684 - DNA, 20 bp, mouse
gcggaggcgagggactagag

SEQ ID NO: 452685 - DNA, 20 bp, mouse
gctgaggccgaggcctgtag

SEQ ID NO: 452686 - DNA, 20 bp, mouse
ggtgcggagagagacggacg

SEQ ID NO: 452687 - DNA, 20 bp, mouse
ggggggcgtgcggagagaga

SEQ ID NO: 452688 - DNA, 20 bp, mouse
gagaggacggaagcgacctg

SEQ ID NO: 452689 - DNA, 20 bp, mouse
gagcggccgtgccgagagga

SEQ ID NO: 452690 - DNA, 20 bp, mouse
gagggtaagcgggcccacga

SEQ ID NO: 452691 - DNA, 20 bp, mouse
ggcggggctagcgaggacag

SEQ ID NO: 452692 - DNA, 20 bp, mouse
gccccgcgtgggaggacgat

SEQ ID NO: 452693 - DNA, 20 bp, mouse
ggtcctcgctagccccgcgt

SEQ ID NO: 452694 - DNA, 20 bp, mouse
ggagccacgcccgccctcgt

SEQ ID NO: 452695 - DNA, 20 bp, mouse
gcaccttgctcccgcgcccg

SEQ ID NO: 452696 - DNA, 20 bp, mouse
ggctgcggggtaggggatcc

SEQ ID NO: 452697 - DNA, 20 bp, mouse
gggcgcgtcactgctagggt

SEQ ID NO: 452698 - DNA, 20 bp, mouse
gtaggggatccgggacgctg

SEQ ID NO: 452699 - DNA, 20 bp, mouse
ggcgatggaccgcagcgtcc

SEQ ID NO: 452700 - DNA, 20 bp, mouse
gcccgggccgacccacacgc

SEQ ID NO: 452701 - DNA, 20 bp, mouse
ggccgcggccagcagcgcga

SEQ ID NO: 452702 - DNA, 20 bp, mouse
gtccatcgcgctgctggccg

SEQ ID NO: 452703 - DNA, 20 bp, mouse
gccctcgggcagggaccgac

SEQ ID NO: 452704 - DNA, 20 bp, mouse
gaggcggcgcgtcactgcta

SEQ ID NO: 452705 - DNA, 20 bp, mouse
gggaggagcggagcctggac

SEQ ID NO: 452706 - DNA, 20 bp, mouse
gcgccaggacacacaggcag

SEQ ID NO: 452707 - DNA, 20 bp, mouse
gggggtacgccaggacacac

SEQ ID NO: 452708 - DNA, 20 bp, mouse
ggcccggctacacccgagtg

SEQ ID NO: 452709 - DNA, 20 bp, mouse
gcacgcaggtgcgggacccg

SEQ ID NO: 452710 - DNA, 20 bp, mouse
gagccgggcggatcccacgc

SEQ ID NO: 452711 - DNA, 20 bp, mouse
ggagcagggatcctggacga

SEQ ID NO: 452712 - DNA, 20 bp, mouse
ggggacccggggaggtgcat

SEQ ID NO: 452713 - DNA, 20 bp, mouse
ggtggacctgcgggagagtg

SEQ ID NO: 452714 - DNA, 20 bp, mouse
gggcatggcgaggatctccg

SEQ ID NO: 452715 - DNA, 20 bp, mouse
ggatgggagtgtacccaccg

SEQ ID NO: 452716 - DNA, 20 bp, mouse
gtccagccgcttgagcgcgg

SEQ ID NO: 452717 - DNA, 20 bp, mouse
ggaagcggccggcggatccc

SEQ ID NO: 452718 - DNA, 20 bp, mouse
gtaccgcgacctgatcgagg

SEQ ID NO: 452719 - DNA, 20 bp, mouse
ggagtctcgaagagcgcgtt

SEQ ID NO: 452720 - DNA, 20 bp, mouse
gagcgcggaggaggcggtcg

SEQ ID NO: 452721 - DNA, 20 bp, mouse
gagatccagccgcttgagcg

SEQ ID NO: 452722 - DNA, 20 bp, mouse
gaggcgggcgcagtattgat

SEQ ID NO: 452723 - DNA, 20 bp, mouse
gcggtaccgcgacctgatcg

SEQ ID NO: 452724 - DNA, 20 bp, mouse
gcgcctcctccgcgctcaag

SEQ ID NO: 452725 - DNA, 20 bp, mouse
gcgctgcgccgagggcctgg

SEQ ID NO: 452726 - DNA, 20 bp, mouse
gctcaaggccaagaccgcag

SEQ ID NO: 452727 - DNA, 20 bp, mouse
ggccaagaccgcaggggacg

SEQ ID NO: 452728 - DNA, 20 bp, mouse
gtgggctgccgcgtcccctg

SEQ ID NO: 452729 - DNA, 20 bp, mouse
gcggtcttggccttgagggg

SEQ ID NO: 452730 - DNA, 20 bp, mouse
ggagctgggacgctgggggt

SEQ ID NO: 452731 - DNA, 20 bp, mouse
gacagcgtgtccggccccgt

SEQ ID NO: 452732 - DNA, 20 bp, mouse
gctcgctgctgccatactgg

SEQ ID NO: 452733 - DNA, 20 bp, mouse
gagtggagctgggacgctgg

SEQ ID NO: 452734 - DNA, 20 bp, mouse
gcagcgtccggccaactcag

SEQ ID NO: 452735 - DNA, 20 bp, mouse
gagcaggcacagcctccgaa

SEQ ID NO: 452736 - DNA, 20 bp, mouse
ggagcccgacaggcagagcc

SEQ ID NO: 452737 - DNA, 20 bp, mouse
gggcagagccgggaacttcc

SEQ ID NO: 452738 - DNA, 20 bp, mouse
gagagccgggaacttccggg

SEQ ID NO: 452739 - DNA, 20 bp, mouse
gcggtcctcccggaagttcc

SEQ ID NO: 452740 - DNA, 20 bp, mouse
gtgcgccgcggaggggccca

SEQ ID NO: 452741 - DNA, 20 bp, mouse
gtcggtgctggagctcaagg

SEQ ID NO: 452742 - DNA, 20 bp, mouse
ggctgcggcgctggaagtcc

SEQ ID NO: 452743 - DNA, 20 bp, mouse
gcccctccgcggcgcagaac

SEQ ID NO: 452744 - DNA, 20 bp, mouse
ggccggtgcccgccgaggtg

SEQ ID NO: 452745 - DNA, 20 bp, mouse
ggatggcgccgctgacagac

SEQ ID NO: 452746 - DNA, 20 bp, mouse
ggagctcctgacaatttcag

SEQ ID NO: 452747 - DNA, 20 bp, mouse
gcgcccaccgggagccaaga

SEQ ID NO: 452748 - DNA, 20 bp, mouse
gactctgtggcgaggaggtg

SEQ ID NO: 452749 - DNA, 20 bp, mouse
gcggtggcagagggcatcac

SEQ ID NO: 452750 - DNA, 20 bp, mouse
gagctcctccgccaccggag

SEQ ID NO: 452751 - DNA, 20 bp, mouse
gaagcccggaagcgcccacc

SEQ ID NO: 452752 - DNA, 20 bp, mouse
gcgccatcttggctcccggt

SEQ ID NO: 452753 - DNA, 20 bp, mouse
gtcaatacggaggcagacca

SEQ ID NO: 452754 - DNA, 20 bp, mouse
gtttttcctggaggatccgg

SEQ ID NO: 452755 - DNA, 20 bp, mouse
gctcgtcagggaaatcaata

SEQ ID NO: 452756 - DNA, 20 bp, mouse
gtgcggaacccgaagcccca

SEQ ID NO: 452757 - DNA, 20 bp, mouse
ggaagccccacggcctgcta

SEQ ID NO: 452758 - DNA, 20 bp, mouse
gacggtcgccgccactactg

SEQ ID NO: 452759 - DNA, 20 bp, mouse
gatttccgtagcaggccgtg

SEQ ID NO: 452760 - DNA, 20 bp, mouse
gaacccggcacttgccaaca

SEQ ID NO: 452761 - DNA, 20 bp, mouse
gttgcaagacgtcatcaacc

SEQ ID NO: 452762 - DNA, 20 bp, mouse
gtcgggttccgcagtagtgg

SEQ ID NO: 452763 - DNA, 20 bp, mouse
ggcttcgggttccgcagtag

SEQ ID NO: 452764 - DNA, 20 bp, mouse
gacgttccccgtgaaactgg

SEQ ID NO: 452765 - DNA, 20 bp, mouse
gaagacacccacgggaagag

SEQ ID NO: 452766 - DNA, 20 bp, mouse
gacgccgggtctgtcagcga

SEQ ID NO: 452767 - DNA, 20 bp, mouse
gatggctgacgccagcgggg

SEQ ID NO: 452768 - DNA, 20 bp, mouse
ggctgacagacccggcgtaa

SEQ ID NO: 452769 - DNA, 20 bp, mouse
gcagcgatggctgacgccag

SEQ ID NO: 452770 - DNA, 20 bp, mouse
gaagccattggcggccccgg

SEQ ID NO: 452771 - DNA, 20 bp, mouse
gggacacagcaagagcgcaa

SEQ ID NO: 452772 - DNA, 20 bp, mouse
gccattactgaagccattgg

SEQ ID NO: 452773 - DNA, 20 bp, mouse
gagcttctgcccgagaccag

SEQ ID NO: 452774 - DNA, 20 bp, mouse
gccgcctccggggccgccaa

SEQ ID NO: 452775 - DNA, 20 bp, mouse
ggccccattactgaagccat

SEQ ID NO: 452776 - DNA, 20 bp, mouse
gcgcgagtgcgctgacgggg

SEQ ID NO: 452777 - DNA, 20 bp, mouse
ggcggcaagtaaagcttggt

SEQ ID NO: 452778 - DNA, 20 bp, mouse
gtggcgcgcggtctccgggt

SEQ ID NO: 452779 - DNA, 20 bp, mouse
gtcgacgggtgtcccgaagg

SEQ ID NO: 452780 - DNA, 20 bp, mouse
gaagcttggtgggtttcgac

SEQ ID NO: 452781 - DNA, 20 bp, mouse
gagagccggccccaaagacg

SEQ ID NO: 452782 - DNA, 20 bp, mouse
gcggcgcgagtgcgctgacg

SEQ ID NO: 452783 - DNA, 20 bp, mouse
gctgcgtggctcaccctcca

SEQ ID NO: 452784 - DNA, 20 bp, mouse
ggtttcgacgggtgtcccga

SEQ ID NO: 452785 - DNA, 20 bp, mouse
gcggggcggcaagtaaagct

SEQ ID NO: 452786 - DNA, 20 bp, mouse
gggctctgaagaggaagtga

SEQ ID NO: 452787 - DNA, 20 bp, mouse
gtggccgaagcggtcgtgga

SEQ ID NO: 452788 - DNA, 20 bp, mouse
ggtcgtggccgaagcggtcg

SEQ ID NO: 452789 - DNA, 20 bp, mouse
gcggtaccgtgcttgagaga

SEQ ID NO: 452790 - DNA, 20 bp, mouse
ggctgtcgtcgtggccgaag

SEQ ID NO: 452791 - DNA, 20 bp, mouse
gcgaagcggtcgtggagggc

SEQ ID NO: 452792 - DNA, 20 bp, mouse
gggccgccatctctcaagca

SEQ ID NO: 452793 - DNA, 20 bp, mouse
gggcgtgagaagcccgacgt

SEQ ID NO: 452794 - DNA, 20 bp, mouse
gtcggccacgacgacagcca

SEQ ID NO: 452795 - DNA, 20 bp, mouse
gggcggaagagcgggcccag

SEQ ID NO: 452796 - DNA, 20 bp, mouse
gaagatggcagcctccgaga

SEQ ID NO: 452797 - DNA, 20 bp, mouse
gctccgagacggttaggcta

SEQ ID NO: 452798 - DNA, 20 bp, mouse
gggcagcctccgagacggtt

SEQ ID NO: 452799 - DNA, 20 bp, mouse
gagccgtagcctaaccgtct

SEQ ID NO: 452800 - DNA, 20 bp, mouse
gtgcagtgtggagtggccgg

SEQ ID NO: 452801 - DNA, 20 bp, mouse
ggccagaagaccgtgcagtg

SEQ ID NO: 452802 - DNA, 20 bp, mouse
gccgtcgagcatgagcaaga

SEQ ID NO: 452803 - DNA, 20 bp, mouse
gaagaccgtgcagtgtggag

SEQ ID NO: 452804 - DNA, 20 bp, mouse
gggaagccgagaggttccaa

SEQ ID NO: 452805 - DNA, 20 bp, mouse
ggagctagccagctgcggaa

SEQ ID NO: 452806 - DNA, 20 bp, mouse
gtggtgctgggagatgcgtg

SEQ ID NO: 452807 - DNA, 20 bp, mouse
gccctcagacgaggcttacc

SEQ ID NO: 452808 - DNA, 20 bp, mouse
gggcattatccactgctcct

SEQ ID NO: 452809 - DNA, 20 bp, mouse
ggcctcgtctgagggtcaat

SEQ ID NO: 452810 - DNA, 20 bp, mouse
gaccaggtaagcctcgtctg

SEQ ID NO: 452811 - DNA, 20 bp, mouse
gctcctgggcagaggaagcc

SEQ ID NO: 452812 - DNA, 20 bp, mouse
gatgcgtggggcagctttcc

SEQ ID NO: 452813 - DNA, 20 bp, mouse
gatactccagggcagccgtg

SEQ ID NO: 452814 - DNA, 20 bp, mouse
ggacgaggcttacctggtgc

SEQ ID NO: 452815 - DNA, 20 bp, mouse
gtccagggcagccgtgggga

SEQ ID NO: 452816 - DNA, 20 bp, mouse
gcagactgagggcagatgaa

SEQ ID NO: 452817 - DNA, 20 bp, mouse
gaggcgtaggacgggtcccg

SEQ ID NO: 452818 - DNA, 20 bp, mouse
ggcagggtcaggcgtaggac

SEQ ID NO: 452819 - DNA, 20 bp, mouse
gcgtaggcgacaccttggaa

SEQ ID NO: 452820 - DNA, 20 bp, mouse
gatggctgtgtagcgaacgt

SEQ ID NO: 452821 - DNA, 20 bp, mouse
gcgcaggagactgcgacccc

SEQ ID NO: 452822 - DNA, 20 bp, mouse
ggctacacagccatccggaa

SEQ ID NO: 452823 - DNA, 20 bp, mouse
gctcctgcgggccaccccaa

SEQ ID NO: 452824 - DNA, 20 bp, mouse
ggcgaacgtaggcgacacct

SEQ ID NO: 452825 - DNA, 20 bp, mouse
gagaagtggggagacgacaa

SEQ ID NO: 452826 - DNA, 20 bp, mouse
gagaagaggtgcccccacaa

SEQ ID NO: 452827 - DNA, 20 bp, mouse
gcagcaaggtgccgttgtgg

SEQ ID NO: 452828 - DNA, 20 bp, mouse
gggccaggggcacacagtag

SEQ ID NO: 452829 - DNA, 20 bp, mouse
gagtgctgcttgctcttcgg

SEQ ID NO: 452830 - DNA, 20 bp, mouse
gggcccagctccatgcagca

SEQ ID NO: 452831 - DNA, 20 bp, mouse
gctcttacctgcccatcccg

SEQ ID NO: 452832 - DNA, 20 bp, mouse
ggtcagtgctgcttgctctt

SEQ ID NO: 452833 - DNA, 20 bp, mouse
gatgcagcaaggtgccgttg

SEQ ID NO: 452834 - DNA, 20 bp, mouse
ggcctcggaaccaggacccc

SEQ ID NO: 452835 - DNA, 20 bp, mouse
gggcattctgagccatggag

SEQ ID NO: 452836 - DNA, 20 bp, mouse
gtagtgcgcagagtgagcgg

SEQ ID NO: 452837 - DNA, 20 bp, mouse
ggcctagtgcgcagagtgag

SEQ ID NO: 452838 - DNA, 20 bp, mouse
gcgcagagtgagcggaggca

SEQ ID NO: 452839 - DNA, 20 bp, mouse
gcctgagccggaggtgacag

SEQ ID NO: 452840 - DNA, 20 bp, mouse
ggtctcttcccagtcggcaa

SEQ ID NO: 452841 - DNA, 20 bp, mouse
gtgtgcccgagatagatctg

SEQ ID NO: 452842 - DNA, 20 bp, mouse
gtcttcccagtcggcaaagg

SEQ ID NO: 452843 - DNA, 20 bp, mouse
gccgcgggctacttaataga

SEQ ID NO: 452844 - DNA, 20 bp, mouse
gtgtgccacagatctatctc

SEQ ID NO: 452845 - DNA, 20 bp, mouse
gcgcggagtctcttcccagt

SEQ ID NO: 452846 - DNA, 20 bp, mouse
gcggctgtgtcaagttacag

SEQ ID NO: 452847 - DNA, 20 bp, mouse
gcatgggcagaggtgggtcg

SEQ ID NO: 452848 - DNA, 20 bp, mouse
ggctgcagtgagccgcgctg

SEQ ID NO: 452849 - DNA, 20 bp, mouse
ggttacagaggcgccagaat

SEQ ID NO: 452850 - DNA, 20 bp, mouse
ggccagaatcggccccagcg

SEQ ID NO: 452851 - DNA, 20 bp, mouse
gaggcgcgatccaaactgag

SEQ ID NO: 452852 - DNA, 20 bp, mouse
ggccgcgctggggccgattc

SEQ ID NO: 452853 - DNA, 20 bp, mouse
gtgtcagtccccgggcgaag

SEQ ID NO: 452854 - DNA, 20 bp, mouse
gtaacttgacacagccggcg

SEQ ID NO: 452855 - DNA, 20 bp, mouse
ggcggagcgcacccgcaaag

SEQ ID NO: 452856 - DNA, 20 bp, mouse
gctgtagggcaggaggcgac

SEQ ID NO: 452857 - DNA, 20 bp, mouse
ggccgagcgggaaaacagta

SEQ ID NO: 452858 - DNA, 20 bp, mouse
ggccaagaggtccccaacct

SEQ ID NO: 452859 - DNA, 20 bp, mouse
gtgatcctgggtgagaggcg

SEQ ID NO: 452860 - DNA, 20 bp, mouse
gctgcaggtggctctcactg

SEQ ID NO: 452861 - DNA, 20 bp, mouse
gtctgagggaaggcgagcca

SEQ ID NO: 452862 - DNA, 20 bp, mouse
gagaggacagagtgaacgac

SEQ ID NO: 452863 - DNA, 20 bp, mouse
gtcacccaggatcagataag

SEQ ID NO: 452864 - DNA, 20 bp, mouse
ggggtggccggagaccttag

SEQ ID NO: 452865 - DNA, 20 bp, mouse
gttcgctaagaaccagtcgg

SEQ ID NO: 452866 - DNA, 20 bp, mouse
gtacttcgcccgcggaacaa

SEQ ID NO: 452867 - DNA, 20 bp, mouse
ggaacaaaggctgcgctcgg

SEQ ID NO: 452868 - DNA, 20 bp, mouse
ggcgcgggtgactcaggcgc

SEQ ID NO: 452869 - DNA, 20 bp, mouse
gaagtacagctggggtccgg

SEQ ID NO: 452870 - DNA, 20 bp, mouse
gttcagagcgcgggtgactc

SEQ ID NO: 452871 - DNA, 20 bp, mouse
gactcaggcgcgggcagcag

SEQ ID NO: 452872 - DNA, 20 bp, mouse
ggcgcgggtctgcaggacag

SEQ ID NO: 452873 - DNA, 20 bp, mouse
ggcagggccggcgcccgagg

SEQ ID NO: 452874 - DNA, 20 bp, mouse
ggcggtcctcctgcaagaag

SEQ ID NO: 452875 - DNA, 20 bp, mouse
gccgcgggcgaagtacagct

SEQ ID NO: 452876 - DNA, 20 bp, mouse
gcactcagtctagagaactc

SEQ ID NO: 452877 - DNA, 20 bp, mouse
ggcactgaggccctcagaga

SEQ ID NO: 452878 - DNA, 20 bp, mouse
gtcaggacgtggaaaagctg

SEQ ID NO: 452879 - DNA, 20 bp, mouse
gagctggggtcagcgcagac

SEQ ID NO: 452880 - DNA, 20 bp, mouse
ggactggcagggagagatcg

SEQ ID NO: 452881 - DNA, 20 bp, mouse
ggtgctggcccacttaccaa

SEQ ID NO: 452882 - DNA, 20 bp, mouse
gagatcgaggatcctcctgt

SEQ ID NO: 452883 - DNA, 20 bp, mouse
ggccggcagttcctgcaagc

SEQ ID NO: 452884 - DNA, 20 bp, mouse
gtgactcgctatgtgacctg

SEQ ID NO: 452885 - DNA, 20 bp, mouse
gtgccggccgctcctggaga

SEQ ID NO: 452886 - DNA, 20 bp, mouse
gagcgctgaaggaaacagaa

SEQ ID NO: 452887 - DNA, 20 bp, mouse
gccagacgcgaagccaggtg

SEQ ID NO: 452888 - DNA, 20 bp, mouse
ggctttaacacaccttgact

SEQ ID NO: 452889 - DNA, 20 bp, mouse
gagagggtgtctgcctgaag

SEQ ID NO: 452890 - DNA, 20 bp, mouse
gaggagctgggaaccacttc

SEQ ID NO: 452891 - DNA, 20 bp, mouse
gctgccagtggactgtggaa

SEQ ID NO: 452892 - DNA, 20 bp, mouse
gaccacggcgcacctttgtc

SEQ ID NO: 452893 - DNA, 20 bp, mouse
gaggtgaggtacaggagccc

SEQ ID NO: 452894 - DNA, 20 bp, mouse
gagtccactggcagagggag

SEQ ID NO: 452895 - DNA, 20 bp, mouse
ggaagaaaagcatccgaggg

SEQ ID NO: 452896 - DNA, 20 bp, mouse
gcccttctgccagagggaag

SEQ ID NO: 452897 - DNA, 20 bp, mouse
gttctgccagagggaagcgg

SEQ ID NO: 452898 - DNA, 20 bp, mouse
gtccctccaccgcttccctc

SEQ ID NO: 452899 - DNA, 20 bp, mouse
gtgccagagggaagcggtgg

SEQ ID NO: 452900 - DNA, 20 bp, mouse
gagcgctggcaggcacaagg

SEQ ID NO: 452901 - DNA, 20 bp, mouse
ggactgggaaccaggaatga

SEQ ID NO: 452902 - DNA, 20 bp, mouse
gctggggtcgggagccatca

SEQ ID NO: 452903 - DNA, 20 bp, mouse
gaggagccggcccagcgcag

SEQ ID NO: 452904 - DNA, 20 bp, mouse
gatcaaggtgatccaccaaa

SEQ ID NO: 452905 - DNA, 20 bp, mouse
ggagctgcccccggaggaag

SEQ ID NO: 452906 - DNA, 20 bp, mouse
gtggtgtcagagcccctggg

SEQ ID NO: 452907 - DNA, 20 bp, mouse
ggcgcggtggagtccggaca

SEQ ID NO: 452908 - DNA, 20 bp, mouse
gactccaccgcgcctcccag

SEQ ID NO: 452909 - DNA, 20 bp, mouse
ggagctgcgcagcttacctt

SEQ ID NO: 452910 - DNA, 20 bp, mouse
ggctggagcgggccactccg

SEQ ID NO: 452911 - DNA, 20 bp, mouse
ggggccactccgcggcggtg

SEQ ID NO: 452912 - DNA, 20 bp, mouse
gggagcgggccactccgcgg

SEQ ID NO: 452913 - DNA, 20 bp, mouse
ggcagagaccgggcttgtga

SEQ ID NO: 452914 - DNA, 20 bp, mouse
gcagggctgccgcaccgccg

SEQ ID NO: 452915 - DNA, 20 bp, mouse
gattcccacgcggagacgag

SEQ ID NO: 452916 - DNA, 20 bp, mouse
gctcctcgggacggagcagg

SEQ ID NO: 452917 - DNA, 20 bp, mouse
ggccagtcgtcggagcagac

SEQ ID NO: 452918 - DNA, 20 bp, mouse
gggacggagcaggaggcacg

SEQ ID NO: 452919 - DNA, 20 bp, mouse
gcgggagtttctcctcggga

SEQ ID NO: 452920 - DNA, 20 bp, mouse
gcagacgggagtttctcctc

SEQ ID NO: 452921 - DNA, 20 bp, mouse
gctgctccagaggcagggat

SEQ ID NO: 452922 - DNA, 20 bp, mouse
ggcaggaggcacgcggagtg

SEQ ID NO: 452923 - DNA, 20 bp, mouse
gtgcctcctgctccgtcccg

SEQ ID NO: 452924 - DNA, 20 bp, mouse
ggttagcttcggctcatgcg

SEQ ID NO: 452925 - DNA, 20 bp, mouse
ggagggcagtggcccctaag

SEQ ID NO: 452926 - DNA, 20 bp, mouse
gtaaacaaagctctagactg

SEQ ID NO: 452927 - DNA, 20 bp, mouse
gtccgtgcgcctcttagaca

SEQ ID NO: 452928 - DNA, 20 bp, mouse
gctataacgtcccagttctc

SEQ ID NO: 452929 - DNA, 20 bp, mouse
gacagggcaaagagtgagta

SEQ ID NO: 452930 - DNA, 20 bp, mouse
gtgagtaaggctgggatccc

SEQ ID NO: 452931 - DNA, 20 bp, mouse
gcgggtcagagaccttaccc

SEQ ID NO: 452932 - DNA, 20 bp, mouse
gacgttcagtgacagcacca

SEQ ID NO: 452933 - DNA, 20 bp, mouse
gatttggttcccgcgcgcgt

SEQ ID NO: 452934 - DNA, 20 bp, mouse
ggatttgagggaagaatata

SEQ ID NO: 452935 - DNA, 20 bp, mouse
gaccttaccccggagcacca

SEQ ID NO: 452936 - DNA, 20 bp, mouse
gcaccagcggaggtatcacc

SEQ ID NO: 452937 - DNA, 20 bp, mouse
gcagcggaggtatcacctgg

SEQ ID NO: 452938 - DNA, 20 bp, mouse
gagagcccctgggtcaccag

SEQ ID NO: 452939 - DNA, 20 bp, mouse
gaggtttcgactaagttgga

SEQ ID NO: 452940 - DNA, 20 bp, mouse
gacctccgctggtgacccag

SEQ ID NO: 452941 - DNA, 20 bp, mouse
gcaggaggtttcgactaagt

SEQ ID NO: 452942 - DNA, 20 bp, mouse
ggggcgcaggcatgcaatcg

SEQ ID NO: 452943 - DNA, 20 bp, mouse
ggcccctgggtcaccagcgg

SEQ ID NO: 452944 - DNA, 20 bp, mouse
gggtatcacctggcgggcgc

SEQ ID NO: 452945 - DNA, 20 bp, mouse
gtctgtcggagaaaacacta

SEQ ID NO: 452946 - DNA, 20 bp, mouse
ggcaggaggtagaaagtaca

SEQ ID NO: 452947 - DNA, 20 bp, mouse
ggggctgccagggcatttct

SEQ ID NO: 452948 - DNA, 20 bp, mouse
gggcatttctaggtagcagg

SEQ ID NO: 452949 - DNA, 20 bp, mouse
gtctgtgcactgtctgtctc

SEQ ID NO: 452950 - DNA, 20 bp, mouse
ggactgtgggaggatctata

SEQ ID NO: 452951 - DNA, 20 bp, mouse
ggacgctgcactggacccat

SEQ ID NO: 452952 - DNA, 20 bp, mouse
gcagccactcgggttcccat

SEQ ID NO: 452953 - DNA, 20 bp, mouse
gcaccttgccgagagttaca

SEQ ID NO: 452954 - DNA, 20 bp, mouse
gagttacagggtgagaccgt

SEQ ID NO: 452955 - DNA, 20 bp, mouse
ggctcatgacccagccactc

SEQ ID NO: 452956 - DNA, 20 bp, mouse
ggagcccctggggaggccta

SEQ ID NO: 452957 - DNA, 20 bp, mouse
gggccagtgagcccctgggg

SEQ ID NO: 452958 - DNA, 20 bp, mouse
ggctgccctaggcctcccca

SEQ ID NO: 452959 - DNA, 20 bp, mouse
gccaggaacaaagctgccct

SEQ ID NO: 452960 - DNA, 20 bp, mouse
gcagggaagatcccagtctc

SEQ ID NO: 452961 - DNA, 20 bp, mouse
gagggccaagcgggtcctca

SEQ ID NO: 452962 - DNA, 20 bp, mouse
ggagtcttcccctagaccat

SEQ ID NO: 452963 - DNA, 20 bp, mouse
gggctcactggccggtctct

SEQ ID NO: 452964 - DNA, 20 bp, mouse
ggaaagaagtcctaaaatgt

SEQ ID NO: 452965 - DNA, 20 bp, mouse
gagggtcagaggttccagtg

SEQ ID NO: 452966 - DNA, 20 bp, mouse
gtctgagcgggcggctaggg

SEQ ID NO: 452967 - DNA, 20 bp, mouse
gtagaaggaactgcccgcag

SEQ ID NO: 452968 - DNA, 20 bp, mouse
ggccgcccgctcagactcag

SEQ ID NO: 452969 - DNA, 20 bp, mouse
gagtggccgctgagtctgag

SEQ ID NO: 452970 - DNA, 20 bp, mouse
gcagactcagcggccactgc

SEQ ID NO: 452971 - DNA, 20 bp, mouse
ggccgctgagtctgagcggg

SEQ ID NO: 452972 - DNA, 20 bp, mouse
ggagtctgagcgggcggcta

SEQ ID NO: 452973 - DNA, 20 bp, mouse
gggcgcgcaggaccccggag

SEQ ID NO: 452974 - DNA, 20 bp, mouse
ggcggggctccgcgtccggg

SEQ ID NO: 452975 - DNA, 20 bp, mouse
ggaggaggcgcgcaggaccc

SEQ ID NO: 452976 - DNA, 20 bp, mouse
ggaaccgcaagtgaactcca

SEQ ID NO: 452977 - DNA, 20 bp, mouse
ggagttcacttgcggttcaa

SEQ ID NO: 452978 - DNA, 20 bp, mouse
gcagccctggagttcacttg

SEQ ID NO: 452979 - DNA, 20 bp, mouse
gacccgcagaacggagtgta

SEQ ID NO: 452980 - DNA, 20 bp, mouse
gtgctctggaaacctagctc

SEQ ID NO: 452981 - DNA, 20 bp, mouse
gcagaacggagtgtagggtg

SEQ ID NO: 452982 - DNA, 20 bp, mouse
ggctgctcccaactgcctca

SEQ ID NO: 452983 - DNA, 20 bp, mouse
gtcacctctggtccccccag

SEQ ID NO: 452984 - DNA, 20 bp, mouse
gccccaggggagagcgaccc

SEQ ID NO: 452985 - DNA, 20 bp, mouse
gctgcttcgcctggaagaag

SEQ ID NO: 452986 - DNA, 20 bp, mouse
gagagcgcagcccccgtggg

SEQ ID NO: 452987 - DNA, 20 bp, mouse
gcagcccccgtgggtggtag

SEQ ID NO: 452988 - DNA, 20 bp, mouse
ggcgagagcgcagcccccgt

SEQ ID NO: 452989 - DNA, 20 bp, mouse
gattcctctaccacccacgg

SEQ ID NO: 452990 - DNA, 20 bp, mouse
gtccgcgcgggggaccccta

SEQ ID NO: 452991 - DNA, 20 bp, mouse
gaacaggtcggagcagagag

SEQ ID NO: 452992 - DNA, 20 bp, mouse
gcaggtgggagacaggtcgg

SEQ ID NO: 452993 - DNA, 20 bp, mouse
ggatcgctgcttgggtcact

SEQ ID NO: 452994 - DNA, 20 bp, mouse
ggcgcgggggacccctaagg

SEQ ID NO: 452995 - DNA, 20 bp, mouse
gctcacacaagagcatcccg

SEQ ID NO: 452996 - DNA, 20 bp, mouse
gctccctgcgctccagcctg

SEQ ID NO: 452997 - DNA, 20 bp, mouse
ggcagggagctagccggtga

SEQ ID NO: 452998 - DNA, 20 bp, mouse
gcggtgatggcgtgaagtca

SEQ ID NO: 452999 - DNA, 20 bp, mouse
ggctccagcctggggcaaca

SEQ ID NO: 453000 - DNA, 20 bp, mouse
ggtgaagtcagggtcggagg

SEQ ID NO: 453001 - DNA, 20 bp, mouse
gcaggagtgccccagaccgc

SEQ ID NO: 453002 - DNA, 20 bp, mouse
gggtctggggcactcctgat

SEQ ID NO: 453003 - DNA, 20 bp, mouse
gcgggagccgggagccgatc

SEQ ID NO: 453004 - DNA, 20 bp, mouse
gggcgtgaagtcagggtcgg

SEQ ID NO: 453005 - DNA, 20 bp, mouse
gggactgaccctgttgcccc

SEQ ID NO: 453006 - DNA, 20 bp, mouse
gggccgctagcggtctctgg

SEQ ID NO: 453007 - DNA, 20 bp, mouse
gctctcctcccccaggccgg

SEQ ID NO: 453008 - DNA, 20 bp, mouse
gccggcagtcctgggaccat

SEQ ID NO: 453009 - DNA, 20 bp, mouse
ggtggaagctgcctccccgc

SEQ ID NO: 453010 - DNA, 20 bp, mouse
gagcggcgtcaggacccggg

SEQ ID NO: 453011 - DNA, 20 bp, mouse
gggctccgcagcatgaagta

SEQ ID NO: 453012 - DNA, 20 bp, mouse
gtcatgctgcggagcccggg

SEQ ID NO: 453013 - DNA, 20 bp, mouse
gctgcctccccgccggcctg

SEQ ID NO: 453014 - DNA, 20 bp, mouse
ggagcccggggggcaagtgt

SEQ ID NO: 453015 - DNA, 20 bp, mouse
gccaggggcgccggagcaga

SEQ ID NO: 453016 - DNA, 20 bp, mouse
gggagccggagcacgcggag

SEQ ID NO: 453017 - DNA, 20 bp, mouse
gccgcacccggagctcgagc

SEQ ID NO: 453018 - DNA, 20 bp, mouse
ggagctggagccggagcacg

SEQ ID NO: 453019 - DNA, 20 bp, mouse
gcagagctccgtgagtccca

SEQ ID NO: 453020 - DNA, 20 bp, mouse
gacggcgccgggaggagcat

SEQ ID NO: 453021 - DNA, 20 bp, mouse
ggagtcccagggcacttact

SEQ ID NO: 453022 - DNA, 20 bp, mouse
gttcttaggcgggtgcctaa

SEQ ID NO: 453023 - DNA, 20 bp, mouse
gtggccggtcggttcttagg

SEQ ID NO: 453024 - DNA, 20 bp, mouse
gcgctggccggtcggttctt

SEQ ID NO: 453025 - DNA, 20 bp, mouse
ggctgcagcgcagggggacc

SEQ ID NO: 453026 - DNA, 20 bp, mouse
gcatagaacttgagccttga

SEQ ID NO: 453027 - DNA, 20 bp, mouse
ggtaatgagtacatgatcct

SEQ ID NO: 453028 - DNA, 20 bp, mouse
gtaacacagacagcctcaac

SEQ ID NO: 453029 - DNA, 20 bp, mouse
gccaatactatacagatgaa

SEQ ID NO: 453030 - DNA, 20 bp, mouse
gttgtgatcacaagagtccc

SEQ ID NO: 453031 - DNA, 20 bp, mouse
ggaacttgagccttgagggc

SEQ ID NO: 453032 - DNA, 20 bp, mouse
ggttgatgatggaagactcc

SEQ ID NO: 453033 - DNA, 20 bp, mouse
gtgcagagagagagagactt

SEQ ID NO: 453034 - DNA, 20 bp, mouse
gggagcactcagttccaaat

SEQ ID NO: 453035 - DNA, 20 bp, mouse
gttgatgaagacatcctatt

SEQ ID NO: 453036 - DNA, 20 bp, mouse
gaggaggccctaggagcagg

SEQ ID NO: 453037 - DNA, 20 bp, mouse
gggcctcctgcatgagggag

SEQ ID NO: 453038 - DNA, 20 bp, mouse
ggaagacgcagagcgccgct

SEQ ID NO: 453039 - DNA, 20 bp, mouse
gctgcctcctcctgctccta

SEQ ID NO: 453040 - DNA, 20 bp, mouse
gtgagggagcggtagagacc

SEQ ID NO: 453041 - DNA, 20 bp, mouse
gggcgctctgcgtcttcccc

SEQ ID NO: 453042 - DNA, 20 bp, mouse
ggcagcgaggcggcagagca

SEQ ID NO: 453043 - DNA, 20 bp, mouse
gtaactggagcctctgccgg

SEQ ID NO: 453044 - DNA, 20 bp, mouse
gctctaccgctccctcatgc

SEQ ID NO: 453045 - DNA, 20 bp, mouse
gcagagcacggagcgggtcc

SEQ ID NO: 453046 - DNA, 20 bp, mouse
gtgacgggcccggtgctgaa

SEQ ID NO: 453047 - DNA, 20 bp, mouse
gggcccggtgctgaagggca

SEQ ID NO: 453048 - DNA, 20 bp, mouse
gcagtccaacgtaggtaagt

SEQ ID NO: 453049 - DNA, 20 bp, mouse
gtggcacagcagtccaacgt

SEQ ID NO: 453050 - DNA, 20 bp, mouse
gggctagacaggaaattctt

SEQ ID NO: 453051 - DNA, 20 bp, mouse
ggctgtgccaaaataagagt

SEQ ID NO: 453052 - DNA, 20 bp, mouse
ggagactctttgtgcaaaag

SEQ ID NO: 453053 - DNA, 20 bp, mouse
gagcggctgagttttatgac

SEQ ID NO: 453054 - DNA, 20 bp, mouse
gttacaaagggtaagatagt

SEQ ID NO: 453055 - DNA, 20 bp, mouse
gagtaggtaccgatttgaac

SEQ ID NO: 453056 - DNA, 20 bp, mouse
gacggcgaggtgctcagtct

SEQ ID NO: 453057 - DNA, 20 bp, mouse
gcgaggtgctcagtctcgga

SEQ ID NO: 453058 - DNA, 20 bp, mouse
ggcacccgggacggtgagca

SEQ ID NO: 453059 - DNA, 20 bp, mouse
ggagccctgctcaccgtccc

SEQ ID NO: 453060 - DNA, 20 bp, mouse
gctaggagagggagacccgg

SEQ ID NO: 453061 - DNA, 20 bp, mouse
ggcgcagagtcaccgcaccc

SEQ ID NO: 453062 - DNA, 20 bp, mouse
ggttcccgtgggccacggcg

SEQ ID NO: 453063 - DNA, 20 bp, mouse
ggcacctcgccgtggcccac

SEQ ID NO: 453064 - DNA, 20 bp, mouse
gaggggaccagcagagacgg

SEQ ID NO: 453065 - DNA, 20 bp, mouse
gcgctcctcgtggagcagaa

SEQ ID NO: 453066 - DNA, 20 bp, mouse
ggcagggagtccgaacgccg

SEQ ID NO: 453067 - DNA, 20 bp, mouse
gcaaggggctcgtggaatcg

SEQ ID NO: 453068 - DNA, 20 bp, mouse
gggtgagagcgacccccggg

SEQ ID NO: 453069 - DNA, 20 bp, mouse
gccgggattggcgagccaag

SEQ ID NO: 453070 - DNA, 20 bp, mouse
gggctctctgtgcctcccgg

SEQ ID NO: 453071 - DNA, 20 bp, mouse
ggctggtgcttgcccgggat

SEQ ID NO: 453072 - DNA, 20 bp, mouse
gtcggggcgcgggaggagct

SEQ ID NO: 453073 - DNA, 20 bp, mouse
gtgcgacaccaagtcccgag

SEQ ID NO: 453074 - DNA, 20 bp, mouse
gtgaggtgagagcgaccccc

SEQ ID NO: 453075 - DNA, 20 bp, mouse
gggacctgtagcgccggagt

SEQ ID NO: 453076 - DNA, 20 bp, mouse
gggcgggacacagattggag

SEQ ID NO: 453077 - DNA, 20 bp, mouse
gtccccggcgggacacagat

SEQ ID NO: 453078 - DNA, 20 bp, mouse
gaccttgctagccacaggag

SEQ ID NO: 453079 - DNA, 20 bp, mouse
ggtaagggctcgacccactg

SEQ ID NO: 453080 - DNA, 20 bp, mouse
gagcaaggcgagcgtcactg

SEQ ID NO: 453081 - DNA, 20 bp, mouse
gactggggcgagttttgtaa

SEQ ID NO: 453082 - DNA, 20 bp, mouse
ggaggacaaacagacctcag

SEQ ID NO: 453083 - DNA, 20 bp, mouse
gcaggtgggcgcagctccag

SEQ ID NO: 453084 - DNA, 20 bp, mouse
gtcgccccagtgggccagca

SEQ ID NO: 453085 - DNA, 20 bp, mouse
gcaggcgtccatgtccccgg

SEQ ID NO: 453086 - DNA, 20 bp, mouse
gacgggaagagccaagccaa

SEQ ID NO: 453087 - DNA, 20 bp, mouse
gaccggggaaggaggacgag

SEQ ID NO: 453088 - DNA, 20 bp, mouse
gggtgtgagtgagtggatct

SEQ ID NO: 453089 - DNA, 20 bp, mouse
gtagatgccaacctcagtca

SEQ ID NO: 453090 - DNA, 20 bp, mouse
gggagggtaaatagtggacc

SEQ ID NO: 453091 - DNA, 20 bp, mouse
gcggcggctgacggctggaa

SEQ ID NO: 453092 - DNA, 20 bp, mouse
gagcccgctccggggagtga

SEQ ID NO: 453093 - DNA, 20 bp, mouse
gtgacgacgggtagggaagg

SEQ ID NO: 453094 - DNA, 20 bp, mouse
gcctgacaccgagcggaccg

SEQ ID NO: 453095 - DNA, 20 bp, mouse
gcgacgggtagggaaggagg

SEQ ID NO: 453096 - DNA, 20 bp, mouse
gagctctagggactgcccat

SEQ ID NO: 453097 - DNA, 20 bp, mouse
gaagtttgctggcagctcta

SEQ ID NO: 453098 - DNA, 20 bp, mouse
gctggctgcgagttgaaggc

SEQ ID NO: 453099 - DNA, 20 bp, mouse
gcgcagacctgaggctggac

SEQ ID NO: 453100 - DNA, 20 bp, mouse
gaggcaccgccccagcgtca

SEQ ID NO: 453101 - DNA, 20 bp, mouse
gttgaaggccggcagccgat

SEQ ID NO: 453102 - DNA, 20 bp, mouse
gaggtaagccgccctcagac

SEQ ID NO: 453103 - DNA, 20 bp, mouse
gggtagcaggcagaccagac

SEQ ID NO: 453104 - DNA, 20 bp, mouse
gagagcaagaggcagatgag

SEQ ID NO: 453105 - DNA, 20 bp, mouse
ggacctgaggctggacaggc

SEQ ID NO: 453106 - DNA, 20 bp, mouse
ggagcactttgccttctgtt

SEQ ID NO: 453107 - DNA, 20 bp, mouse
ggttatgctggtgcacttgg

SEQ ID NO: 453108 - DNA, 20 bp, mouse
gtggccaaggtcaaagagta

SEQ ID NO: 453109 - DNA, 20 bp, mouse
gggctgcccccacagacaca

SEQ ID NO: 453110 - DNA, 20 bp, mouse
gagcacccgcagggaatccc

SEQ ID NO: 453111 - DNA, 20 bp, mouse
ggtttgcaagtcccaacaga

SEQ ID NO: 453112 - DNA, 20 bp, mouse
gatttgtaggacgttgagtg

SEQ ID NO: 453113 - DNA, 20 bp, mouse
ggttggagcgagcagtgatg

SEQ ID NO: 453114 - DNA, 20 bp, mouse
ggagcagtgatggggcggga

SEQ ID NO: 453115 - DNA, 20 bp, mouse
ggagagatcggctttgggga

SEQ ID NO: 453116 - DNA, 20 bp, mouse
gcaaaggaaaacacacgcag

SEQ ID NO: 453117 - DNA, 20 bp, mouse
ggagtgctagaagttgtagc

SEQ ID NO: 453118 - DNA, 20 bp, mouse
ggtctcctgggacccagctc

SEQ ID NO: 453119 - DNA, 20 bp, mouse
gccgcggcgcgggctcatct

SEQ ID NO: 453120 - DNA, 20 bp, mouse
ggagatagttccatgagccc

SEQ ID NO: 453121 - DNA, 20 bp, mouse
gctgtcactgcggaaaaagt

SEQ ID NO: 453122 - DNA, 20 bp, mouse
ggagggagggtgagaaacat

SEQ ID NO: 453123 - DNA, 20 bp, mouse
ggcatcaaaagggagcccgg

SEQ ID NO: 453124 - DNA, 20 bp, mouse
gctgcggaaaaagtgggagt

SEQ ID NO: 453125 - DNA, 20 bp, mouse
gtgctccggagctgggtccc

SEQ ID NO: 453126 - DNA, 20 bp, mouse
ggcgcaggacctcactccag

SEQ ID NO: 453127 - DNA, 20 bp, mouse
gactccagcggagcgcccac

SEQ ID NO: 453128 - DNA, 20 bp, mouse
gaggccacgagactagaagg

SEQ ID NO: 453129 - DNA, 20 bp, mouse
gaggaggccacgagactaga

SEQ ID NO: 453130 - DNA, 20 bp, mouse
gtccgcactcctggtccccg

SEQ ID NO: 453131 - DNA, 20 bp, mouse
gccacggggagcgggtcgcg

SEQ ID NO: 453132 - DNA, 20 bp, mouse
ggcggagcgcccacggggag

SEQ ID NO: 453133 - DNA, 20 bp, mouse
gaccagagacacgtcccggg

SEQ ID NO: 453134 - DNA, 20 bp, mouse
gccacgagactagaaggagg

SEQ ID NO: 453135 - DNA, 20 bp, mouse
ggcggtggctgttctggaag

SEQ ID NO: 453136 - DNA, 20 bp, mouse
gctggtgctgaaacagactg

SEQ ID NO: 453137 - DNA, 20 bp, mouse
ggctgaaaaagagcccccag

SEQ ID NO: 453138 - DNA, 20 bp, mouse
gaacagactgaggcagcgcg

SEQ ID NO: 453139 - DNA, 20 bp, mouse
gtcgcagactgtgccggacc

SEQ ID NO: 453140 - DNA, 20 bp, mouse
ggatcgaagagtagatactg

SEQ ID NO: 453141 - DNA, 20 bp, mouse
ggcaccatgaattccgctgg

SEQ ID NO: 453142 - DNA, 20 bp, mouse
ggagcccccagcggaattca

SEQ ID NO: 453143 - DNA, 20 bp, mouse
ggtagcaccatgaattccgc

SEQ ID NO: 453144 - DNA, 20 bp, mouse
ggagacatgtgggtcctcct

SEQ ID NO: 453145 - DNA, 20 bp, mouse
gagggcacgcacagaagctc

SEQ ID NO: 453146 - DNA, 20 bp, mouse
ggctggtgagcagggacgaa

SEQ ID NO: 453147 - DNA, 20 bp, mouse
gctggtgcaccaaggccaag

SEQ ID NO: 453148 - DNA, 20 bp, mouse
gatgttgccaggaaaagtgt

SEQ ID NO: 453149 - DNA, 20 bp, mouse
gcagctagagctagacccta

SEQ ID NO: 453150 - DNA, 20 bp, mouse
ggatgtggactggtcttcct

SEQ ID NO: 453151 - DNA, 20 bp, mouse
gctgaagctgatccagtctc

SEQ ID NO: 453152 - DNA, 20 bp, mouse
gagcagtcactctggacagc

SEQ ID NO: 453153 - DNA, 20 bp, mouse
gctgcagggaggccaggagc

SEQ ID NO: 453154 - DNA, 20 bp, mouse
gcaggacacgagctgcaggg

SEQ ID NO: 453155 - DNA, 20 bp, mouse
gcggcagcttctcatcccag

SEQ ID NO: 453156 - DNA, 20 bp, mouse
gcaaatgtgggccagggtca

SEQ ID NO: 453157 - DNA, 20 bp, mouse
gagcaggcttgtagcagcag

SEQ ID NO: 453158 - DNA, 20 bp, mouse
gcaccgtcaaatgtgggcca

SEQ ID NO: 453159 - DNA, 20 bp, mouse
gtgcgagtcaccgtcaaatg

SEQ ID NO: 453160 - DNA, 20 bp, mouse
ggaaggcctgaaagttgatg

SEQ ID NO: 453161 - DNA, 20 bp, mouse
ggtggagagccactaagaag

SEQ ID NO: 453162 - DNA, 20 bp, mouse
gcaccggacagtaccttgtg

SEQ ID NO: 453163 - DNA, 20 bp, mouse
ggagccctggatgtcctgtg

SEQ ID NO: 453164 - DNA, 20 bp, mouse
gtaccccacaaggtactgtc

SEQ ID NO: 453165 - DNA, 20 bp, mouse
gccttccaaggtgagtaaac

SEQ ID NO: 453166 - DNA, 20 bp, mouse
gctgtcctcgggaagtaccc

SEQ ID NO: 453167 - DNA, 20 bp, mouse
ggtcctgacggcccgaggtg

SEQ ID NO: 453168 - DNA, 20 bp, mouse
ggatgcctgggtacttcccg

SEQ ID NO: 453169 - DNA, 20 bp, mouse
gaggacagcccgggtcctga

SEQ ID NO: 453170 - DNA, 20 bp, mouse
gcgaggtgcgggcgccgagt

SEQ ID NO: 453171 - DNA, 20 bp, mouse
ggtgcgggcgccgagtgggt

SEQ ID NO: 453172 - DNA, 20 bp, mouse
gccatgcgaagaagcttacc

SEQ ID NO: 453173 - DNA, 20 bp, mouse
gcctacggagaggctaacaa

SEQ ID NO: 453174 - DNA, 20 bp, mouse
gctgtcgaacagaggcctag

SEQ ID NO: 453175 - DNA, 20 bp, mouse
gtagtctccaggtggcccct

SEQ ID NO: 453176 - DNA, 20 bp, mouse
ggagttcagcctttccccaa

SEQ ID NO: 453177 - DNA, 20 bp, mouse
gaaaggctgctcagttctct

SEQ ID NO: 453178 - DNA, 20 bp, mouse
gttccagcgaggattgcaag

SEQ ID NO: 453179 - DNA, 20 bp, mouse
gtaggctccagcttccagcg

SEQ ID NO: 453180 - DNA, 20 bp, mouse
gctcctcttgcaatcctcgc

SEQ ID NO: 453181 - DNA, 20 bp, mouse
gtgcaatcctcgctggaagc

SEQ ID NO: 453182 - DNA, 20 bp, mouse
ggaaaggctgaactccaaac

SEQ ID NO: 453183 - DNA, 20 bp, mouse
gcaaactggacagggtccag

SEQ ID NO: 453184 - DNA, 20 bp, mouse
gcatgcaggcagggacacac

SEQ ID NO: 453185 - DNA, 20 bp, mouse
ggcgtcttcaggtccgctca

SEQ ID NO: 453186 - DNA, 20 bp, mouse
ggggattcccaggctcacac

SEQ ID NO: 453187 - DNA, 20 bp, mouse
gaggctcacacgggctctga

SEQ ID NO: 453188 - DNA, 20 bp, mouse
gtgtgtgctaggggattccc

SEQ ID NO: 453189 - DNA, 20 bp, mouse
gggtgtgtcactgctcctcc

SEQ ID NO: 453190 - DNA, 20 bp, mouse
gaccagctcttcctaggggt

SEQ ID NO: 453191 - DNA, 20 bp, mouse
gtctccagagaggggcggag

SEQ ID NO: 453192 - DNA, 20 bp, mouse
gaagaaccagctcttcctag

SEQ ID NO: 453193 - DNA, 20 bp, mouse
gaaaactctaaatcagtcgt

SEQ ID NO: 453194 - DNA, 20 bp, mouse
gatggggccgttccattcag

SEQ ID NO: 453195 - DNA, 20 bp, mouse
gctggagagcattaaatgct

SEQ ID NO: 453196 - DNA, 20 bp, mouse
gcatgctccaaggggacaca

SEQ ID NO: 453197 - DNA, 20 bp, mouse
gcagcgaggtgcatgctcca

SEQ ID NO: 453198 - DNA, 20 bp, mouse
gctgggttcctgctgctccg

SEQ ID NO: 453199 - DNA, 20 bp, mouse
gggggtccccgaggatcctg

SEQ ID NO: 453200 - DNA, 20 bp, mouse
ggtcattggacaccacccgg

SEQ ID NO: 453201 - DNA, 20 bp, mouse
gggctgccccaggatcctcg

SEQ ID NO: 453202 - DNA, 20 bp, mouse
ggagcatgcacctcgctgct

SEQ ID NO: 453203 - DNA, 20 bp, mouse
gcggggaccccaggaagtct

SEQ ID NO: 453204 - DNA, 20 bp, mouse
ggctcccagcctgagattca

SEQ ID NO: 453205 - DNA, 20 bp, mouse
gtgcttgggttccagaatcg

SEQ ID NO: 453206 - DNA, 20 bp, mouse
gcacgccctggtggccccca

SEQ ID NO: 453207 - DNA, 20 bp, mouse
gtgctgctcaagccttggga

SEQ ID NO: 453208 - DNA, 20 bp, mouse
ggcagcccgcgggaccccag

SEQ ID NO: 453209 - DNA, 20 bp, mouse
gccaaggcttgagcagcacg

SEQ ID NO: 453210 - DNA, 20 bp, mouse
gtgagcagcacgcggagccc

SEQ ID NO: 453211 - DNA, 20 bp, mouse
ggcgggaccccagaggccag

SEQ ID NO: 453212 - DNA, 20 bp, mouse
gtggatcagccagttgagag

SEQ ID NO: 453213 - DNA, 20 bp, mouse
gctgggtagaagtttccctg

SEQ ID NO: 453214 - DNA, 20 bp, mouse
gtggatgaaaacctccaaag

SEQ ID NO: 453215 - DNA, 20 bp, mouse
ggccgcgcagagtcacatcc

SEQ ID NO: 453216 - DNA, 20 bp, mouse
gtcctcgcacaggcaagatc

SEQ ID NO: 453217 - DNA, 20 bp, mouse
ggcaggctgactcctcgcac

SEQ ID NO: 453218 - DNA, 20 bp, mouse
ggtgccggcaggacttgctg

SEQ ID NO: 453219 - DNA, 20 bp, mouse
gcaggcaagatcgggacttg

SEQ ID NO: 453220 - DNA, 20 bp, mouse
ggggcccagcccagagatag

SEQ ID NO: 453221 - DNA, 20 bp, mouse
ggcaagatcgggacttgggg

SEQ ID NO: 453222 - DNA, 20 bp, mouse
ggcgctgcagagatcctgat

SEQ ID NO: 453223 - DNA, 20 bp, mouse
gatgggagcgccggaagtgt

SEQ ID NO: 453224 - DNA, 20 bp, mouse
ggcgccgcagcaagtcctgc

SEQ ID NO: 453225 - DNA, 20 bp, mouse
ggatgcccacctctatctct

SEQ ID NO: 453226 - DNA, 20 bp, mouse
ggactcgggctcccacggag

SEQ ID NO: 453227 - DNA, 20 bp, mouse
gacagggactcgggctccca

SEQ ID NO: 453228 - DNA, 20 bp, mouse
ggctcccacggagaggaccg

SEQ ID NO: 453229 - DNA, 20 bp, mouse
gcttccacggtcctctccgt

SEQ ID NO: 453230 - DNA, 20 bp, mouse
gagttacccgcagagcacag

SEQ ID NO: 453231 - DNA, 20 bp, mouse
gccttgagcacgtcagatct

SEQ ID NO: 453232 - DNA, 20 bp, mouse
ggatctgggagacagggact

SEQ ID NO: 453233 - DNA, 20 bp, mouse
gaccagcagggactcactcc

SEQ ID NO: 453234 - DNA, 20 bp, mouse
gggtaagataacccttgtca

SEQ ID NO: 453235 - DNA, 20 bp, mouse
gaagtcagcagccctgacaa

SEQ ID NO: 453236 - DNA, 20 bp, mouse
gcgctcgagggcgacccgga

SEQ ID NO: 453237 - DNA, 20 bp, mouse
ggagcgacgcggagttctgg

SEQ ID NO: 453238 - DNA, 20 bp, mouse
gctgcagggcggcctccggg

SEQ ID NO: 453239 - DNA, 20 bp, mouse
ggtgcgaggacaggacctgg

SEQ ID NO: 453240 - DNA, 20 bp, mouse
gccggcgctcgagggcgacc

SEQ ID NO: 453241 - DNA, 20 bp, mouse
gggcagcgggcagagcgacg

SEQ ID NO: 453242 - DNA, 20 bp, mouse
gcaggtgtccagccccgacg

SEQ ID NO: 453243 - DNA, 20 bp, mouse
gcggggccagggcgtcgtcg

SEQ ID NO: 453244 - DNA, 20 bp, mouse
ggcagagcgacgcggagttc

SEQ ID NO: 453245 - DNA, 20 bp, mouse
gcccggatggcgcaggctcg

SEQ ID NO: 453246 - DNA, 20 bp, mouse
gggacttccaaattcaccca

SEQ ID NO: 453247 - DNA, 20 bp, mouse
gtggggtatagaagtctaga

SEQ ID NO: 453248 - DNA, 20 bp, mouse
gcagagccagcccagaggat

SEQ ID NO: 453249 - DNA, 20 bp, mouse
gaagcgcataaagtagcacc

SEQ ID NO: 453250 - DNA, 20 bp, mouse
gctactttatgcgcttggtg

SEQ ID NO: 453251 - DNA, 20 bp, mouse
gacctttgcaaccagtaccc

SEQ ID NO: 453252 - DNA, 20 bp, mouse
ggtctgcggacagaaaaaga

SEQ ID NO: 453253 - DNA, 20 bp, mouse
gtcccagcttacctcatcag

SEQ ID NO: 453254 - DNA, 20 bp, mouse
ggaagaaacccaggtcccct

SEQ ID NO: 453255 - DNA, 20 bp, mouse
gctggggacgaggagtgctt

SEQ ID NO: 453256 - DNA, 20 bp, mouse
ggtccaagcaccgatggcgg

SEQ ID NO: 453257 - DNA, 20 bp, mouse
gtttcgggagatccagtccg

SEQ ID NO: 453258 - DNA, 20 bp, mouse
gtgctttcggagcctcggac

SEQ ID NO: 453259 - DNA, 20 bp, mouse
gccaggctctgcaccaggga

SEQ ID NO: 453260 - DNA, 20 bp, mouse
gcggcggtcatggcgaacag

SEQ ID NO: 453261 - DNA, 20 bp, mouse
gagtctgtccctagcctgag

SEQ ID NO: 453262 - DNA, 20 bp, mouse
ggtcacctgagagcactgtg

SEQ ID NO: 453263 - DNA, 20 bp, mouse
gcgaacagcgggttctggag

SEQ ID NO: 453264 - DNA, 20 bp, mouse
ggcagctagacgggccgggg

SEQ ID NO: 453265 - DNA, 20 bp, mouse
gggggtccaagcaccgatgg

SEQ ID NO: 453266 - DNA, 20 bp, mouse
gcctggcagcaaggagtccg

SEQ ID NO: 453267 - DNA, 20 bp, mouse
gaaggagtccgtggagagac

SEQ ID NO: 453268 - DNA, 20 bp, mouse
gttgctgccaggggacggtg

SEQ ID NO: 453269 - DNA, 20 bp, mouse
gggggtagccggtctctcca

SEQ ID NO: 453270 - DNA, 20 bp, mouse
gggcaccggcatctccgctg

SEQ ID NO: 453271 - DNA, 20 bp, mouse
gctcagtccacaccgtcccc

SEQ ID NO: 453272 - DNA, 20 bp, mouse
gccggtgccccaggagtgca

SEQ ID NO: 453273 - DNA, 20 bp, mouse
gccagggacagggattctat

SEQ ID NO: 453274 - DNA, 20 bp, mouse
ggcctcagatcgagaatctg

SEQ ID NO: 453275 - DNA, 20 bp, mouse
gtaaagcggggagttcccag

SEQ ID NO: 453276 - DNA, 20 bp, mouse
gcccagcagcagcagggcta

SEQ ID NO: 453277 - DNA, 20 bp, mouse
gggaccctcgaggacatctg

SEQ ID NO: 453278 - DNA, 20 bp, mouse
gagcgcctgccagccatgac

SEQ ID NO: 453279 - DNA, 20 bp, mouse
gagggcaggcgctccggtca

SEQ ID NO: 453280 - DNA, 20 bp, mouse
gcaggcgctccggtcatggc

SEQ ID NO: 453281 - DNA, 20 bp, mouse
gcagaactcgccagccggag

SEQ ID NO: 453282 - DNA, 20 bp, mouse
gagggctagggcaggcgctc

SEQ ID NO: 453283 - DNA, 20 bp, mouse
ggagcgacgggcagcagggt

SEQ ID NO: 453284 - DNA, 20 bp, mouse
gagggagtctccaggaacaa

SEQ ID NO: 453285 - DNA, 20 bp, mouse
gccgccgccaaggaccctcg

SEQ ID NO: 453286 - DNA, 20 bp, mouse
gagaagccacacagcagcta

SEQ ID NO: 453287 - DNA, 20 bp, mouse
ggctgcaaaggcaagcaagg

SEQ ID NO: 453288 - DNA, 20 bp, mouse
gggataggttgcttcgaagc

SEQ ID NO: 453289 - DNA, 20 bp, mouse
gtcttgcactttcagagtct

SEQ ID NO: 453290 - DNA, 20 bp, mouse
ggactgtgattcttcaacag

SEQ ID NO: 453291 - DNA, 20 bp, mouse
gcgcactggaagagggtctc

SEQ ID NO: 453292 - DNA, 20 bp, mouse
gccatttcaccaggacctaa

SEQ ID NO: 453293 - DNA, 20 bp, mouse
gtggaaaagggtggaatcct

SEQ ID NO: 453294 - DNA, 20 bp, mouse
ggctacaaactaaaacaagg

SEQ ID NO: 453295 - DNA, 20 bp, mouse
gacaatccagggaagcctat

SEQ ID NO: 453296 - DNA, 20 bp, mouse
gctggatgcacactaggcga

SEQ ID NO: 453297 - DNA, 20 bp, mouse
ggtcctggcctagtgtcctg

SEQ ID NO: 453298 - DNA, 20 bp, mouse
gctgccagccggtgactgtc

SEQ ID NO: 453299 - DNA, 20 bp, mouse
gtggcagagacactgctcca

SEQ ID NO: 453300 - DNA, 20 bp, mouse
gactgctccaaggagcctca

SEQ ID NO: 453301 - DNA, 20 bp, mouse
ggatgctgccccaggacact

SEQ ID NO: 453302 - DNA, 20 bp, mouse
gtaacagccatgaggctcct

SEQ ID NO: 453303 - DNA, 20 bp, mouse
gtggggcagcatctcttacc

SEQ ID NO: 453304 - DNA, 20 bp, mouse
gcactaggccaggactggac

SEQ ID NO: 453305 - DNA, 20 bp, mouse
ggtgtcgagcacaggcagga

SEQ ID NO: 453306 - DNA, 20 bp, mouse
gggcgtgcagtgagagacac

SEQ ID NO: 453307 - DNA, 20 bp, mouse
ggaacgctgaaggctgccat

SEQ ID NO: 453308 - DNA, 20 bp, mouse
gcagaacgggacgctaggac

SEQ ID NO: 453309 - DNA, 20 bp, mouse
ggtctctcactgcacgccca

SEQ ID NO: 453310 - DNA, 20 bp, mouse
ggcggcagcagagtgcagaa

SEQ ID NO: 453311 - DNA, 20 bp, mouse
ggctaggactggaacgctga

SEQ ID NO: 453312 - DNA, 20 bp, mouse
gacactggtacgacttctcc

SEQ ID NO: 453313 - DNA, 20 bp, mouse
ggagtgcagaacgggacgct

SEQ ID NO: 453314 - DNA, 20 bp, mouse
gcgcacagcgggagccctcg

SEQ ID NO: 453315 - DNA, 20 bp, mouse
gggaacgctgcgccgcacag

SEQ ID NO: 453316 - DNA, 20 bp, mouse
ggcgacgcgtggcgcgatgg

SEQ ID NO: 453317 - DNA, 20 bp, mouse
ggagcagctgcgccacccac

SEQ ID NO: 453318 - DNA, 20 bp, mouse
ggcagcccgcgtgacccgcg

SEQ ID NO: 453319 - DNA, 20 bp, mouse
ggttgccacgcgggtcacgc

SEQ ID NO: 453320 - DNA, 20 bp, mouse
gaaggcgacgcgtggcgcga

SEQ ID NO: 453321 - DNA, 20 bp, mouse
ggtgcatagcaacctccctc

SEQ ID NO: 453322 - DNA, 20 bp, mouse
gcggcagaaaagctgcttaa

SEQ ID NO: 453323 - DNA, 20 bp, mouse
gcagcgccgtgcgctcccgt

SEQ ID NO: 453324 - DNA, 20 bp, mouse
gaggcgcggccctcgtcccc

SEQ ID NO: 453325 - DNA, 20 bp, mouse
gtgctccagggcgcccagcg

SEQ ID NO: 453326 - DNA, 20 bp, mouse
gacaagcgcagcctggacta

SEQ ID NO: 453327 - DNA, 20 bp, mouse
gcagacaggtcgactccggg

SEQ ID NO: 453328 - DNA, 20 bp, mouse
gctgcagacaggtcgactcc

SEQ ID NO: 453329 - DNA, 20 bp, mouse
gggctgcgcttgtacagctg

SEQ ID NO: 453330 - DNA, 20 bp, mouse
gaacagcgcgcaggcgacag

SEQ ID NO: 453331 - DNA, 20 bp, mouse
ggggaaagttcccctagtcc

SEQ ID NO: 453332 - DNA, 20 bp, mouse
gggacggcgggagcgtgcac

SEQ ID NO: 453333 - DNA, 20 bp, mouse
gctgatcttcccgagttcca

SEQ ID NO: 453334 - DNA, 20 bp, mouse
gggatgcggctgccccggga

SEQ ID NO: 453335 - DNA, 20 bp, mouse
gccaggcagccgaggaagta

SEQ ID NO: 453336 - DNA, 20 bp, mouse
gtggttaatatcaagtcaga

SEQ ID NO: 453337 - DNA, 20 bp, mouse
gaatatcaagtcagagggca

SEQ ID NO: 453338 - DNA, 20 bp, mouse
gcgtctgcaggggcagaagg

SEQ ID NO: 453339 - DNA, 20 bp, mouse
gtaaccagacctggccagca

SEQ ID NO: 453340 - DNA, 20 bp, mouse
gacggaagcgaggaaagtct

SEQ ID NO: 453341 - DNA, 20 bp, mouse
gtcctcgcttccgtctgcag

SEQ ID NO: 453342 - DNA, 20 bp, mouse
ggcagctgagtagtgacggt

SEQ ID NO: 453343 - DNA, 20 bp, mouse
ggtgacaggaagcaccttgg

SEQ ID NO: 453344 - DNA, 20 bp, mouse
gggcctttggagacaagctc

SEQ ID NO: 453345 - DNA, 20 bp, mouse
gacttgatattaaccagacc

SEQ ID NO: 453346 - DNA, 20 bp, mouse
gccatggcgggcgatctgga

SEQ ID NO: 453347 - DNA, 20 bp, mouse
gagggtggcaagtccctgag

SEQ ID NO: 453348 - DNA, 20 bp, mouse
gccttcctggcgaagatgag

SEQ ID NO: 453349 - DNA, 20 bp, mouse
gggcaggccctccttagcca

SEQ ID NO: 453350 - DNA, 20 bp, mouse
ggggcctgaggctgcgagga

SEQ ID NO: 453351 - DNA, 20 bp, mouse
gcagcagcacccgaggctgg

SEQ ID NO: 453352 - DNA, 20 bp, mouse
gagatcgcccgccatggcta

SEQ ID NO: 453353 - DNA, 20 bp, mouse
ggagaggacttctcaaggta

SEQ ID NO: 453354 - DNA, 20 bp, mouse
gaagatgagaggacttctca

SEQ ID NO: 453355 - DNA, 20 bp, mouse
gaggacttctcaaggtacgg

SEQ ID NO: 453356 - DNA, 20 bp, mouse
gaccgctacctggggctctc

SEQ ID NO: 453357 - DNA, 20 bp, mouse
ggcccgagagccccaggtag

SEQ ID NO: 453358 - DNA, 20 bp, mouse
gtcgggcaggatcagcgctg

SEQ ID NO: 453359 - DNA, 20 bp, mouse
gcgcgggcgagggagcttca

SEQ ID NO: 453360 - DNA, 20 bp, mouse
ggctgcggaggaacttccca

SEQ ID NO: 453361 - DNA, 20 bp, mouse
gtgagcgcccggccatgcgg

SEQ ID NO: 453362 - DNA, 20 bp, mouse
gcgtggcgtggcgaaggagt

SEQ ID NO: 453363 - DNA, 20 bp, mouse
ggcacagctgacagtcgcgc

SEQ ID NO: 453364 - DNA, 20 bp, mouse
gagggcgcagagtagggcgt

SEQ ID NO: 453365 - DNA, 20 bp, mouse
gagtcggagtgaggctgcgg

SEQ ID NO: 453366 - DNA, 20 bp, mouse
gcagaggtcggaagtggtga

SEQ ID NO: 453367 - DNA, 20 bp, mouse
gccccgtcggaggaactcca

SEQ ID NO: 453368 - DNA, 20 bp, mouse
gcctgcacagaggtcggaag

SEQ ID NO: 453369 - DNA, 20 bp, mouse
gaactcggcgaccactgcaa

SEQ ID NO: 453370 - DNA, 20 bp, mouse
gaggtcggaagtggtgaggg

SEQ ID NO: 453371 - DNA, 20 bp, mouse
ggcgccgccagtaagaaagg

SEQ ID NO: 453372 - DNA, 20 bp, mouse
ggagttcgggaggatcgccg

SEQ ID NO: 453373 - DNA, 20 bp, mouse
gagtggtcgccgagttcggg

SEQ ID NO: 453374 - DNA, 20 bp, mouse
gtgcggcggggacaacccgg

SEQ ID NO: 453375 - DNA, 20 bp, mouse
gcccgcagagcagtcagtca

SEQ ID NO: 453376 - DNA, 20 bp, mouse
gtctcggagtctgtgcaaag

SEQ ID NO: 453377 - DNA, 20 bp, mouse
ggcgaaggcgttggagtcaa

SEQ ID NO: 453378 - DNA, 20 bp, mouse
gggtcacggcgcgctcacaa

SEQ ID NO: 453379 - DNA, 20 bp, mouse
ggcccggaggagaagcgcga

SEQ ID NO: 453380 - DNA, 20 bp, mouse
ggtgtgcgtgtcgaaggtca

SEQ ID NO: 453381 - DNA, 20 bp, mouse
gcaaagaggcatccagacgc

SEQ ID NO: 453382 - DNA, 20 bp, mouse
gaccgggatccgccagcgtc

SEQ ID NO: 453383 - DNA, 20 bp, mouse
gagaggcatccagacgctgg

SEQ ID NO: 453384 - DNA, 20 bp, mouse
ggcgctcacaatggagctct

SEQ ID NO: 453385 - DNA, 20 bp, mouse
gcgtagagctggccccgtgt

SEQ ID NO: 453386 - DNA, 20 bp, mouse
ggccggaagaagctctggat

SEQ ID NO: 453387 - DNA, 20 bp, mouse
ggtcaagccggaagaagctc

SEQ ID NO: 453388 - DNA, 20 bp, mouse
ggagagtctgagaatccggg

SEQ ID NO: 453389 - DNA, 20 bp, mouse
gtctcctgacatcatggtga

SEQ ID NO: 453390 - DNA, 20 bp, mouse
gattggatctcctgacatca

SEQ ID NO: 453391 - DNA, 20 bp, mouse
gaatccctcaccatgatgtc

SEQ ID NO: 453392 - DNA, 20 bp, mouse
ggactctccacggcccccaa

SEQ ID NO: 453393 - DNA, 20 bp, mouse
ggtgagggattgggaaagat

SEQ ID NO: 453394 - DNA, 20 bp, mouse
ggtggagagtctgagaatcc

SEQ ID NO: 453395 - DNA, 20 bp, mouse
gggaagtgggtgacccaggg

SEQ ID NO: 453396 - DNA, 20 bp, mouse
gcctggaggaagctatccgc

SEQ ID NO: 453397 - DNA, 20 bp, mouse
gcaggtgcagagggcgttca

SEQ ID NO: 453398 - DNA, 20 bp, mouse
gggaagctatccgcaggagc

SEQ ID NO: 453399 - DNA, 20 bp, mouse
gcgcaggagctggctgtggc

SEQ ID NO: 453400 - DNA, 20 bp, mouse
gtagcttcctccaggtgcag

SEQ ID NO: 453401 - DNA, 20 bp, mouse
gcggcccggaagtgtctaag

SEQ ID NO: 453402 - DNA, 20 bp, mouse
gtagcagaagggaggcgtcc

SEQ ID NO: 453403 - DNA, 20 bp, mouse
ggtcccggagatttaacagt

SEQ ID NO: 453404 - DNA, 20 bp, mouse
gccgcctgagtctagcagaa

SEQ ID NO: 453405 - DNA, 20 bp, mouse
gagtggcacttcctgagact

SEQ ID NO: 453406 - DNA, 20 bp, mouse
gccaagtcggaggtgagtac

SEQ ID NO: 453407 - DNA, 20 bp, mouse
ggtgctggatgccaagtcgg

SEQ ID NO: 453408 - DNA, 20 bp, mouse
ggatcacactgtggtcatgg

SEQ ID NO: 453409 - DNA, 20 bp, mouse
gcccgtgctggatgccaagt

SEQ ID NO: 453410 - DNA, 20 bp, mouse
gtggccggtggatcacactg

SEQ ID NO: 453411 - DNA, 20 bp, mouse
gagtgggcggggcctaggtc

SEQ ID NO: 453412 - DNA, 20 bp, mouse
ggtggatcacactgtggtca

SEQ ID NO: 453413 - DNA, 20 bp, mouse
gccatcgtagggcaagaagt

SEQ ID NO: 453414 - DNA, 20 bp, mouse
gccacagcggccatcccctc

SEQ ID NO: 453415 - DNA, 20 bp, mouse
gctgtggtcatggaggagtc

SEQ ID NO: 453416 - DNA, 20 bp, mouse
gaagcgcagcgagacccggg

SEQ ID NO: 453417 - DNA, 20 bp, mouse
gcggaagcgcagcgagaccc

SEQ ID NO: 453418 - DNA, 20 bp, mouse
gtgccaggaaccccgcaacc

SEQ ID NO: 453419 - DNA, 20 bp, mouse
gcgcagcgagacccgggtgg

SEQ ID NO: 453420 - DNA, 20 bp, mouse
ggcggggttcctggcaccat

SEQ ID NO: 453421 - DNA, 20 bp, mouse
gggcgggcgggctcaggaat

SEQ ID NO: 453422 - DNA, 20 bp, mouse
gccagctgggcgctcaggtg

SEQ ID NO: 453423 - DNA, 20 bp, mouse
gctgcactgcacgcaggacc

SEQ ID NO: 453424 - DNA, 20 bp, mouse
ggagcgtcgctgcccggttg

SEQ ID NO: 453425 - DNA, 20 bp, mouse
gatgggcggacgcactccgg

SEQ ID NO: 453426 - DNA, 20 bp, mouse
ggcttctgtagccgccaaag

SEQ ID NO: 453427 - DNA, 20 bp, mouse
gggggatggagccggaagag

SEQ ID NO: 453428 - DNA, 20 bp, mouse
gtcaccccggcgccctgctc

SEQ ID NO: 453429 - DNA, 20 bp, mouse
gggaagaggggacgccgctt

SEQ ID NO: 453430 - DNA, 20 bp, mouse
gtacttctcggggatggagc

SEQ ID NO: 453431 - DNA, 20 bp, mouse
gcaggtatctctacttctcg

SEQ ID NO: 453432 - DNA, 20 bp, mouse
gcctccggagcagggcgccg

SEQ ID NO: 453433 - DNA, 20 bp, mouse
gagaggggacgccgctttgg

SEQ ID NO: 453434 - DNA, 20 bp, mouse
gcccaggcctgggtgcgtgt

SEQ ID NO: 453435 - DNA, 20 bp, mouse
ggaccagagacagccaacca

SEQ ID NO: 453436 - DNA, 20 bp, mouse
gccttcaagataccttcagt

SEQ ID NO: 453437 - DNA, 20 bp, mouse
ggtcccagaccctaagacgg

SEQ ID NO: 453438 - DNA, 20 bp, mouse
ggacgtccctagaagtacta

SEQ ID NO: 453439 - DNA, 20 bp, mouse
gaggcacgctccgcttgctc

SEQ ID NO: 453440 - DNA, 20 bp, mouse
ggacgcgcggcgggtagggt

SEQ ID NO: 453441 - DNA, 20 bp, mouse
gtcacgcccagatattaagg

SEQ ID NO: 453442 - DNA, 20 bp, mouse
gcactgacgcgcggcgggta

SEQ ID NO: 453443 - DNA, 20 bp, mouse
gtgaaggtatcttgaagggg

SEQ ID NO: 453444 - DNA, 20 bp, mouse
gtgagagaggcgtaaagact

SEQ ID NO: 453445 - DNA, 20 bp, mouse
gaagtactagggtgacaaga

SEQ ID NO: 453446 - DNA, 20 bp, mouse
ggtcgcccgcaggatagcca

SEQ ID NO: 453447 - DNA, 20 bp, mouse
gagcactagaacgcaggcag

SEQ ID NO: 453448 - DNA, 20 bp, mouse
gagggcgagcactagaacgc

SEQ ID NO: 453449 - DNA, 20 bp, mouse
gctcgccctggctatcctgc

SEQ ID NO: 453450 - DNA, 20 bp, mouse
gtcctgcgggcgacaggcca

SEQ ID NO: 453451 - DNA, 20 bp, mouse
ggtccacaggggccagtgat

SEQ ID NO: 453452 - DNA, 20 bp, mouse
gactaagcggctttacccag

SEQ ID NO: 453453 - DNA, 20 bp, mouse
gtgctctccaggaacgtccg

SEQ ID NO: 453454 - DNA, 20 bp, mouse
gaaataggccgcgggctcga

SEQ ID NO: 453455 - DNA, 20 bp, mouse
ggagcagaccccaagttctg

SEQ ID NO: 453456 - DNA, 20 bp, mouse
gcccgcccggagctcggact

SEQ ID NO: 453457 - DNA, 20 bp, mouse
gggcaccactcacctcgtca

SEQ ID NO: 453458 - DNA, 20 bp, mouse
ggcggccttgacgaggtgag

SEQ ID NO: 453459 - DNA, 20 bp, mouse
gatgcaccgaactgggacta

SEQ ID NO: 453460 - DNA, 20 bp, mouse
ggcgagtgcagcgggaggta

SEQ ID NO: 453461 - DNA, 20 bp, mouse
gcccgagtccgagctccggg

SEQ ID NO: 453462 - DNA, 20 bp, mouse
ggacgctcaggcagtgcgaa

SEQ ID NO: 453463 - DNA, 20 bp, mouse
ggcgcacaggtctgaccccg

SEQ ID NO: 453464 - DNA, 20 bp, mouse
ggaggtgagtggtgcccgcc

SEQ ID NO: 453465 - DNA, 20 bp, mouse
gtttgcaaggagtgacccgg

SEQ ID NO: 453466 - DNA, 20 bp, mouse
gccgctgctaacctgcacca

SEQ ID NO: 453467 - DNA, 20 bp, mouse
ggccgagcccagggccagtg

SEQ ID NO: 453468 - DNA, 20 bp, mouse
ggggagagggtgccgagtca

SEQ ID NO: 453469 - DNA, 20 bp, mouse
gtgcaggttagcagcggcgg

SEQ ID NO: 453470 - DNA, 20 bp, mouse
gcccagcgcggccgagccca

SEQ ID NO: 453471 - DNA, 20 bp, mouse
ggcccagggccagtgcggct

SEQ ID NO: 453472 - DNA, 20 bp, mouse
gctccccggcagggaaacgg

SEQ ID NO: 453473 - DNA, 20 bp, mouse
gagaaatgcaggccctgact

SEQ ID NO: 453474 - DNA, 20 bp, mouse
gcctctccccggcagggaaa

SEQ ID NO: 453475 - DNA, 20 bp, mouse
ggccgcctggacccccatgg

SEQ ID NO: 453476 - DNA, 20 bp, mouse
ggctcccggtggcactccca

SEQ ID NO: 453477 - DNA, 20 bp, mouse
ggacccgggagtagctgacg

SEQ ID NO: 453478 - DNA, 20 bp, mouse
gggagtgccaccgggagcgg

SEQ ID NO: 453479 - DNA, 20 bp, mouse
gggacccgctaacctgacct

SEQ ID NO: 453480 - DNA, 20 bp, mouse
ggaagccttgggagtgccac

SEQ ID NO: 453481 - DNA, 20 bp, mouse
gggctcctaggtcaggttag

SEQ ID NO: 453482 - DNA, 20 bp, mouse
gttccacgtcagctactccc

SEQ ID NO: 453483 - DNA, 20 bp, mouse
gggcctcgggctcctaggtc

SEQ ID NO: 453484 - DNA, 20 bp, mouse
gaacccggaggaataaccga

SEQ ID NO: 453485 - DNA, 20 bp, mouse
gtcttccaggaggcccgacg

SEQ ID NO: 453486 - DNA, 20 bp, mouse
ggaggccgggagggaaccgt

SEQ ID NO: 453487 - DNA, 20 bp, mouse
gcggcagcggctgtccggac

SEQ ID NO: 453488 - DNA, 20 bp, mouse
ggtcgctacctggctccgag

SEQ ID NO: 453489 - DNA, 20 bp, mouse
gggaccgccgactaccggtc

SEQ ID NO: 453490 - DNA, 20 bp, mouse
gtgtccggaccggtagtcgg

SEQ ID NO: 453491 - DNA, 20 bp, mouse
gtccacgtcagccaaggact

SEQ ID NO: 453492 - DNA, 20 bp, mouse
gggctgtccggaccggtagt

SEQ ID NO: 453493 - DNA, 20 bp, mouse
gccgtgggaccgccgactac

SEQ ID NO: 453494 - DNA, 20 bp, mouse
ggctacctggctccgagggg

SEQ ID NO: 453495 - DNA, 20 bp, mouse
gtgggccgcggtcccctggg

SEQ ID NO: 453496 - DNA, 20 bp, mouse
gggttggccggtccacgggt

SEQ ID NO: 453497 - DNA, 20 bp, mouse
ggtcgccttgagcctgtgac

SEQ ID NO: 453498 - DNA, 20 bp, mouse
gtcaggaacccaccgacccg

SEQ ID NO: 453499 - DNA, 20 bp, mouse
gagtgggttggccggtccac

SEQ ID NO: 453500 - DNA, 20 bp, mouse
gggccggtccacgggtcggt

SEQ ID NO: 453501 - DNA, 20 bp, mouse
gcctgcccgtcacaggctca

SEQ ID NO: 453502 - DNA, 20 bp, mouse
ggacccggtgcagactgcaa

SEQ ID NO: 453503 - DNA, 20 bp, mouse
ggcgagcccctgcccgtcac

SEQ ID NO: 453504 - DNA, 20 bp, mouse
gggaggaagaaggccagacc

SEQ ID NO: 453505 - DNA, 20 bp, mouse
gcccggaagttccacgtcag

SEQ ID NO: 453506 - DNA, 20 bp, mouse
gagaccgcgccaggaaccgg

SEQ ID NO: 453507 - DNA, 20 bp, mouse
gcagagaccgcgccaggaac

SEQ ID NO: 453508 - DNA, 20 bp, mouse
ggtctctggcggctccggag

SEQ ID NO: 453509 - DNA, 20 bp, mouse
gacgtgtcccagaagaaggt

SEQ ID NO: 453510 - DNA, 20 bp, mouse
gagaaggttggttagaggtg

SEQ ID NO: 453511 - DNA, 20 bp, mouse
gggttagaggtgcggtgaca

SEQ ID NO: 453512 - DNA, 20 bp, mouse
gtgcggtgacatggctcctc

SEQ ID NO: 453513 - DNA, 20 bp, mouse
gctggaggcgcaggacctca

SEQ ID NO: 453514 - DNA, 20 bp, mouse
ggctcctccggttcctggcg

SEQ ID NO: 453515 - DNA, 20 bp, mouse
gtgaagtcagggtaatggtg

SEQ ID NO: 453516 - DNA, 20 bp, mouse
gaggaagatgctcagagtag

SEQ ID NO: 453517 - DNA, 20 bp, mouse
gagtgctcagggcgacgtgg

SEQ ID NO: 453518 - DNA, 20 bp, mouse
gtgcagtgctcagggcgacg

SEQ ID NO: 453519 - DNA, 20 bp, mouse
ggacgtggcgggcgggagta

SEQ ID NO: 453520 - DNA, 20 bp, mouse
gggaggtcagatcctcgtag

SEQ ID NO: 453521 - DNA, 20 bp, mouse
ggggccccttgaaagacctg

SEQ ID NO: 453522 - DNA, 20 bp, mouse
gcgccctgagcactgcacta

SEQ ID NO: 453523 - DNA, 20 bp, mouse
gcgaggcccaagaggggcag

SEQ ID NO: 453524 - DNA, 20 bp, mouse
gcgggagtacggaagccgca

SEQ ID NO: 453525 - DNA, 20 bp, mouse
gttcttcaacatggtgtcag

SEQ ID NO: 453526 - DNA, 20 bp, mouse
gcgcctgggacggttgcggt

SEQ ID NO: 453527 - DNA, 20 bp, mouse
gagcggaagacgctgcagga

SEQ ID NO: 453528 - DNA, 20 bp, mouse
ggcggcgcctgggacggttg

SEQ ID NO: 453529 - DNA, 20 bp, mouse
ggacccaccgcaaccgtccc

SEQ ID NO: 453530 - DNA, 20 bp, mouse
gcaaccggtgcgagaaccca

SEQ ID NO: 453531 - DNA, 20 bp, mouse
gaggcgccgcagccggcgag

SEQ ID NO: 453532 - DNA, 20 bp, mouse
ggtcttccgctcgccggctg

SEQ ID NO: 453533 - DNA, 20 bp, mouse
gtccgtggggccctgtcggg

SEQ ID NO: 453534 - DNA, 20 bp, mouse
gggcgccggggcctcccctc

SEQ ID NO: 453535 - DNA, 20 bp, mouse
gattttttaatcatcttgga

SEQ ID NO: 453536 - DNA, 20 bp, mouse
gcggccgggcatggaccctc

SEQ ID NO: 453537 - DNA, 20 bp, mouse
gcagagagcctggccggtaa

SEQ ID NO: 453538 - DNA, 20 bp, mouse
gtcacgtgccggagcgtccc

SEQ ID NO: 453539 - DNA, 20 bp, mouse
gccgaccggtggctgcctga

SEQ ID NO: 453540 - DNA, 20 bp, mouse
gcccgtcggccgtcacgtgc

SEQ ID NO: 453541 - DNA, 20 bp, mouse
gcaggaggcccccagcgcgg

SEQ ID NO: 453542 - DNA, 20 bp, mouse
gcgcccacagccaggcgcct

SEQ ID NO: 453543 - DNA, 20 bp, mouse
gcagcgccagccacagccta

SEQ ID NO: 453544 - DNA, 20 bp, mouse
gtgcggctggagcgggctca

SEQ ID NO: 453545 - DNA, 20 bp, mouse
ggctcacccgggaaacgccg

SEQ ID NO: 453546 - DNA, 20 bp, mouse
gccggccaagatgtctgaca

SEQ ID NO: 453547 - DNA, 20 bp, mouse
gggaggactacgacctggtg

SEQ ID NO: 453548 - DNA, 20 bp, mouse
ggccaagatgtctgacatgg

SEQ ID NO: 453549 - DNA, 20 bp, mouse
ggatgaggaggactacgacc

SEQ ID NO: 453550 - DNA, 20 bp, mouse
gagacatcttggccggaggg

SEQ ID NO: 453551 - DNA, 20 bp, mouse
gtccagagtggagaagagat

SEQ ID NO: 453552 - DNA, 20 bp, mouse
gctgggccgcggagcactgt

SEQ ID NO: 453553 - DNA, 20 bp, mouse
gtccctgggcccagcgtcca

SEQ ID NO: 453554 - DNA, 20 bp, mouse
gctggtgaggcgcagggagc

SEQ ID NO: 453555 - DNA, 20 bp, mouse
gctggcgtcgcgggcctgtg

SEQ ID NO: 453556 - DNA, 20 bp, mouse
gctggtggcccgagcaacag

SEQ ID NO: 453557 - DNA, 20 bp, mouse
gccaccagcggggggaaaca

SEQ ID NO: 453558 - DNA, 20 bp, mouse
gtgctcgggccaccagcggg

SEQ ID NO: 453559 - DNA, 20 bp, mouse
gaaggcttgagcaggtccag

SEQ ID NO: 453560 - DNA, 20 bp, mouse
gaaaaagcgactgctctagg

SEQ ID NO: 453561 - DNA, 20 bp, mouse
gggagaggctagagagcgaa

SEQ ID NO: 453562 - DNA, 20 bp, mouse
ggctcctaccctaagcacca

SEQ ID NO: 453563 - DNA, 20 bp, mouse
gaagcgactgctctaggagg

SEQ ID NO: 453564 - DNA, 20 bp, mouse
gccgaggcaggggaaggcga

SEQ ID NO: 453565 - DNA, 20 bp, mouse
ggtaggagcgcacggccgag

SEQ ID NO: 453566 - DNA, 20 bp, mouse
gtgggccaaatcctgtcgca

SEQ ID NO: 453567 - DNA, 20 bp, mouse
ggcgagaggtcccgcagccg

SEQ ID NO: 453568 - DNA, 20 bp, mouse
gaacacggcgaaggcagggg

SEQ ID NO: 453569 - DNA, 20 bp, mouse
gcggctgtggcggtaaatgt

SEQ ID NO: 453570 - DNA, 20 bp, mouse
gggagcaacagaaagctgta

SEQ ID NO: 453571 - DNA, 20 bp, mouse
gtcgagctaggcctgactca

SEQ ID NO: 453572 - DNA, 20 bp, mouse
ggctcgccgaagagactcta

SEQ ID NO: 453573 - DNA, 20 bp, mouse
ggctgccgtgcgacaggatt

SEQ ID NO: 453574 - DNA, 20 bp, mouse
gtccaacacggcgaaggcag

SEQ ID NO: 453575 - DNA, 20 bp, mouse
gctgtagggacggtatgctg

SEQ ID NO: 453576 - DNA, 20 bp, mouse
ggtgagtgtgcaccctggtg

SEQ ID NO: 453577 - DNA, 20 bp, mouse
ggtctagtgagtgtgcaccc

SEQ ID NO: 453578 - DNA, 20 bp, mouse
gcacactcactagactctca

SEQ ID NO: 453579 - DNA, 20 bp, mouse
gccatgacacttgagaccgg

SEQ ID NO: 453580 - DNA, 20 bp, mouse
gtctggaccaacgtcacctc

SEQ ID NO: 453581 - DNA, 20 bp, mouse
gaggccctagaggacaggta

SEQ ID NO: 453582 - DNA, 20 bp, mouse
gtaaggagtgaggaggtccc

SEQ ID NO: 453583 - DNA, 20 bp, mouse
gtctactgggcctcagcgtg

SEQ ID NO: 453584 - DNA, 20 bp, mouse
gggtatggcccagaaaacct

SEQ ID NO: 453585 - DNA, 20 bp, mouse
gttgagaccggaggtgacgt

SEQ ID NO: 453586 - DNA, 20 bp, mouse
ggcgggcgcggggaaaatgg

SEQ ID NO: 453587 - DNA, 20 bp, mouse
gcggcgggggcgaatgggag

SEQ ID NO: 453588 - DNA, 20 bp, mouse
ggtggatgcagcaggtaacg

SEQ ID NO: 453589 - DNA, 20 bp, mouse
gagctgcggcgggggcgaat

SEQ ID NO: 453590 - DNA, 20 bp, mouse
gcccctagacatggaagcag

SEQ ID NO: 453591 - DNA, 20 bp, mouse
gccgcatgcgctcccaggag

SEQ ID NO: 453592 - DNA, 20 bp, mouse
gcggaagccgagaaggaaag

SEQ ID NO: 453593 - DNA, 20 bp, mouse
gtgtctaggggaaaatgtgt

SEQ ID NO: 453594 - DNA, 20 bp, mouse
gacatagcggctgagagctc

SEQ ID NO: 453595 - DNA, 20 bp, mouse
gtgcataggccgcccctcct

SEQ ID NO: 453596 - DNA, 20 bp, mouse
gccccgtgcgctgggagacg

SEQ ID NO: 453597 - DNA, 20 bp, mouse
gccggaccgactgcaaccga

SEQ ID NO: 453598 - DNA, 20 bp, mouse
ggagccgctgccggaggtga

SEQ ID NO: 453599 - DNA, 20 bp, mouse
gactgcaaccgacggctacc

SEQ ID NO: 453600 - DNA, 20 bp, mouse
ggaggcttccaggtagccgt

SEQ ID NO: 453601 - DNA, 20 bp, mouse
ggctgccggaggtgacggag

SEQ ID NO: 453602 - DNA, 20 bp, mouse
gagactgatgaaccagggaa

SEQ ID NO: 453603 - DNA, 20 bp, mouse
gcaaggccaggtcgtacccc

SEQ ID NO: 453604 - DNA, 20 bp, mouse
ggactcgcgtcccgaagtgg

SEQ ID NO: 453605 - DNA, 20 bp, mouse
ggcggccgctccgtcacctc

SEQ ID NO: 453606 - DNA, 20 bp, mouse
gctctgggaggccgagacat

SEQ ID NO: 453607 - DNA, 20 bp, mouse
gctggacgccgggccgatca

SEQ ID NO: 453608 - DNA, 20 bp, mouse
gggcgaagagaacagagagt

SEQ ID NO: 453609 - DNA, 20 bp, mouse
gtggaagcttgacaacctgc

SEQ ID NO: 453610 - DNA, 20 bp, mouse
gagtcggcggggacaggtag

SEQ ID NO: 453611 - DNA, 20 bp, mouse
gagacagcctctaccggaag

SEQ ID NO: 453612 - DNA, 20 bp, mouse
gcacagagtaaggagcctcc

SEQ ID NO: 453613 - DNA, 20 bp, mouse
gaccggaaggggcagaccga

SEQ ID NO: 453614 - DNA, 20 bp, mouse
gcccgttgcaggacgcctgg

SEQ ID NO: 453615 - DNA, 20 bp, mouse
gctagagtggacgtcaggac

SEQ ID NO: 453616 - DNA, 20 bp, mouse
gcagaaaccaaccccatagg

SEQ ID NO: 453617 - DNA, 20 bp, mouse
gtatttgaaatcctcctatg

SEQ ID NO: 453618 - DNA, 20 bp, mouse
gtgcacactgctcggcacac

SEQ ID NO: 453619 - DNA, 20 bp, mouse
gtgaaatcctcctatggggt

SEQ ID NO: 453620 - DNA, 20 bp, mouse
gaggaaatagagacccggtg

SEQ ID NO: 453621 - DNA, 20 bp, mouse
gctcaggagtctgcaaacca

SEQ ID NO: 453622 - DNA, 20 bp, mouse
gtctctcgtggcttaatatg

SEQ ID NO: 453623 - DNA, 20 bp, mouse
ggtgggttgtcacgtctccg

SEQ ID NO: 453624 - DNA, 20 bp, mouse
gacagaagttaactgtcggt

SEQ ID NO: 453625 - DNA, 20 bp, mouse
gaaaagaagaccttcctgct

SEQ ID NO: 453626 - DNA, 20 bp, mouse
ggcggccgggaagatgccag

SEQ ID NO: 453627 - DNA, 20 bp, mouse
ggccgggaagatgccagtgg

SEQ ID NO: 453628 - DNA, 20 bp, mouse
gaagcacaagctggccctcg

SEQ ID NO: 453629 - DNA, 20 bp, mouse
gacgccgtagcggaatacaa

SEQ ID NO: 453630 - DNA, 20 bp, mouse
gaagatgccagtggcggtga

SEQ ID NO: 453631 - DNA, 20 bp, mouse
gctcgcccatgcgtactgag

SEQ ID NO: 453632 - DNA, 20 bp, mouse
ggaggtggtggcggcgagag

SEQ ID NO: 453633 - DNA, 20 bp, mouse
gcgcgcccgcgatgaggtaa

SEQ ID NO: 453634 - DNA, 20 bp, mouse
gagtggcacaggactccggt

SEQ ID NO: 453635 - DNA, 20 bp, mouse
gtgtccgccatcaccgccac

SEQ ID NO: 453636 - DNA, 20 bp, mouse
ggcagctacgggcaagatgg

SEQ ID NO: 453637 - DNA, 20 bp, mouse
gcgcttgtgcgactccacgt

SEQ ID NO: 453638 - DNA, 20 bp, mouse
gccacgtcggcagcagctac

SEQ ID NO: 453639 - DNA, 20 bp, mouse
ggcagcagctacgggcaaga

SEQ ID NO: 453640 - DNA, 20 bp, mouse
gtagagccgcggtatagagt

SEQ ID NO: 453641 - DNA, 20 bp, mouse
gtggaggcgctgattttggt

SEQ ID NO: 453642 - DNA, 20 bp, mouse
ggacaccacaacggagccac

SEQ ID NO: 453643 - DNA, 20 bp, mouse
gccccacctcccggaccccc

SEQ ID NO: 453644 - DNA, 20 bp, mouse
gacaatgggagctagagccg

SEQ ID NO: 453645 - DNA, 20 bp, mouse
ggattttggtaggagctgga

SEQ ID NO: 453646 - DNA, 20 bp, mouse
gggcagcgagcggaatgcag

SEQ ID NO: 453647 - DNA, 20 bp, mouse
gtggccacgtccgcacccgg

SEQ ID NO: 453648 - DNA, 20 bp, mouse
gggctgaggccccctccccc

SEQ ID NO: 453649 - DNA, 20 bp, mouse
gtgtcagtgcaggcagcgag

SEQ ID NO: 453650 - DNA, 20 bp, mouse
ggggagcccgggcccaggaa

SEQ ID NO: 453651 - DNA, 20 bp, mouse
gcctcagccgcccaagccgg

SEQ ID NO: 453652 - DNA, 20 bp, mouse
gggcccgggctccctctccg

SEQ ID NO: 453653 - DNA, 20 bp, mouse
ggcggacgtggccaggcctc

SEQ ID NO: 453654 - DNA, 20 bp, mouse
gcctcccccgggtgcggacg

SEQ ID NO: 453655 - DNA, 20 bp, mouse
ggctgttccgtggctcgggt

SEQ ID NO: 453656 - DNA, 20 bp, mouse
gatggaggacgagacatcac

SEQ ID NO: 453657 - DNA, 20 bp, mouse
gaaaaatgtgtactcaatgg

SEQ ID NO: 453658 - DNA, 20 bp, mouse
gctgggaagtggcagcaaga

SEQ ID NO: 453659 - DNA, 20 bp, mouse
gggaaaaaacaagcgctctt

SEQ ID NO: 453660 - DNA, 20 bp, mouse
ggggaaaaatgtgtactcaa

SEQ ID NO: 453661 - DNA, 20 bp, mouse
gaaggtgaatactacgtccc

SEQ ID NO: 453662 - DNA, 20 bp, mouse
gttgggaaaagtatgaccaa

SEQ ID NO: 453663 - DNA, 20 bp, mouse
gacatgcatgctctccagga

SEQ ID NO: 453664 - DNA, 20 bp, mouse
gtgttttttccttgaatcct

SEQ ID NO: 453665 - DNA, 20 bp, mouse
gagctggctactctaaaact

SEQ ID NO: 453666 - DNA, 20 bp, mouse
gggcagctcggaccagtcag

SEQ ID NO: 453667 - DNA, 20 bp, mouse
gtcgttccgggtgcccgcgt

SEQ ID NO: 453668 - DNA, 20 bp, mouse
gagtcggctccggagacccg

SEQ ID NO: 453669 - DNA, 20 bp, mouse
gtgaagccggtagccaacgc

SEQ ID NO: 453670 - DNA, 20 bp, mouse
gcacctcttggagaccggaa

SEQ ID NO: 453671 - DNA, 20 bp, mouse
gccggggcgctgaccctagt

SEQ ID NO: 453672 - DNA, 20 bp, mouse
ggggtgcccgcgttggctac

SEQ ID NO: 453673 - DNA, 20 bp, mouse
gctccaggccggcctgaggg

SEQ ID NO: 453674 - DNA, 20 bp, mouse
ggactcaccccgataatatg

SEQ ID NO: 453675 - DNA, 20 bp, mouse
ggccaggacacgcactccca

SEQ ID NO: 453676 - DNA, 20 bp, mouse
ggcgccatgctgcgctgggg

SEQ ID NO: 453677 - DNA, 20 bp, mouse
gcggtcggtggcgtcatcca

SEQ ID NO: 453678 - DNA, 20 bp, mouse
ggcccgccccactcacctat

SEQ ID NO: 453679 - DNA, 20 bp, mouse
ggcgcctccccagcgcagca

SEQ ID NO: 453680 - DNA, 20 bp, mouse
ggtcctgaccgagtcccgag

SEQ ID NO: 453681 - DNA, 20 bp, mouse
gatggctgcgaggtccgcgc

SEQ ID NO: 453682 - DNA, 20 bp, mouse
ggccctggtgcgcagcgcag

SEQ ID NO: 453683 - DNA, 20 bp, mouse
gtctgagccgggagtcccgg

SEQ ID NO: 453684 - DNA, 20 bp, mouse
gcaggctggacgccggtcgg

SEQ ID NO: 453685 - DNA, 20 bp, mouse
gcccaatgggtgcatcgcag

SEQ ID NO: 453686 - DNA, 20 bp, mouse
gtggaaggctgggctctcgt

SEQ ID NO: 453687 - DNA, 20 bp, mouse
gtagtcgcgatgtggagagg

SEQ ID NO: 453688 - DNA, 20 bp, mouse
gcgcgatgtggagaggtgga

SEQ ID NO: 453689 - DNA, 20 bp, mouse
gtcgtctcctggaaacgcta

SEQ ID NO: 453690 - DNA, 20 bp, mouse
gcaggtcccggaggtcacca

SEQ ID NO: 453691 - DNA, 20 bp, mouse
gttctagtcgcgatgtggag

SEQ ID NO: 453692 - DNA, 20 bp, mouse
ggagggaccggaaaaggagt

SEQ ID NO: 453693 - DNA, 20 bp, mouse
ggcgcaagcgcggcagagag

SEQ ID NO: 453694 - DNA, 20 bp, mouse
ggtcaccagggatgaggacg

SEQ ID NO: 453695 - DNA, 20 bp, mouse
gtcctggaaacgctagggtt

SEQ ID NO: 453696 - DNA, 20 bp, mouse
gcgtacggggccgaagactg

SEQ ID NO: 453697 - DNA, 20 bp, mouse
gagcagcagcagggtcgcca

SEQ ID NO: 453698 - DNA, 20 bp, mouse
gacggggccgaagactgcgg

SEQ ID NO: 453699 - DNA, 20 bp, mouse
gcccgtacgcggccagctgt

SEQ ID NO: 453700 - DNA, 20 bp, mouse
ggggccgaagactgcggtgg

SEQ ID NO: 453701 - DNA, 20 bp, mouse
gagcagggtcgccatggcag

SEQ ID NO: 453702 - DNA, 20 bp, mouse
gagactgcggtggaggcgca

SEQ ID NO: 453703 - DNA, 20 bp, mouse
gggagccccgcctaaccacg

SEQ ID NO: 453704 - DNA, 20 bp, mouse
gacctacagctggccgcgta

SEQ ID NO: 453705 - DNA, 20 bp, mouse
gcagggagcgaagcagcagc

SEQ ID NO: 453706 - DNA, 20 bp, mouse
ggccatagaacgcagcacct

SEQ ID NO: 453707 - DNA, 20 bp, mouse
gggtcgccggggtgtcacga

SEQ ID NO: 453708 - DNA, 20 bp, mouse
gcgccggggtgtcacgatgg

SEQ ID NO: 453709 - DNA, 20 bp, mouse
ggcccaggtgctgcgttcta

SEQ ID NO: 453710 - DNA, 20 bp, mouse
gcgccgccatcgtgacaccc

SEQ ID NO: 453711 - DNA, 20 bp, mouse
gaaggtgacagagggcgcga

SEQ ID NO: 453712 - DNA, 20 bp, mouse
gccaggatctatgacacccg

SEQ ID NO: 453713 - DNA, 20 bp, mouse
ggcgttctatggcgcgtctg

SEQ ID NO: 453714 - DNA, 20 bp, mouse
gacccgaacaggagcccgac

SEQ ID NO: 453715 - DNA, 20 bp, mouse
gcacagctccggggccgaca

SEQ ID NO: 453716 - DNA, 20 bp, mouse
ggcgcaggcaggagtcatta

SEQ ID NO: 453717 - DNA, 20 bp, mouse
gcaggcaggagtcattatgg

SEQ ID NO: 453718 - DNA, 20 bp, mouse
gcctatcagggagaagtccc

SEQ ID NO: 453719 - DNA, 20 bp, mouse
gcgcagctcgcagccagagg

SEQ ID NO: 453720 - DNA, 20 bp, mouse
gtgtcaggaggaggcctagt

SEQ ID NO: 453721 - DNA, 20 bp, mouse
gcctgccatggagccaatgc

SEQ ID NO: 453722 - DNA, 20 bp, mouse
gggagggacggtactcacag

SEQ ID NO: 453723 - DNA, 20 bp, mouse
ggtcgagatgcacctaccta

SEQ ID NO: 453724 - DNA, 20 bp, mouse
ggttctgcgggatcacaagt

SEQ ID NO: 453725 - DNA, 20 bp, mouse
ggcggcccgcattggctcca

SEQ ID NO: 453726 - DNA, 20 bp, mouse
gcctgagtcgagagcacgat

SEQ ID NO: 453727 - DNA, 20 bp, mouse
gagcgccgccggagccatag

SEQ ID NO: 453728 - DNA, 20 bp, mouse
gcccacggaagcagccgcta

SEQ ID NO: 453729 - DNA, 20 bp, mouse
ggtcgagagcacgattggcg

SEQ ID NO: 453730 - DNA, 20 bp, mouse
ggaagcagccgctatggctc

SEQ ID NO: 453731 - DNA, 20 bp, mouse
ggctgcggacaatgcagcta

SEQ ID NO: 453732 - DNA, 20 bp, mouse
gccagtgcgcaggcgtccca

SEQ ID NO: 453733 - DNA, 20 bp, mouse
gggtcacggatgtcacgggg

SEQ ID NO: 453734 - DNA, 20 bp, mouse
ggcagccgctatggctccgg

SEQ ID NO: 453735 - DNA, 20 bp, mouse
gtcacaagcgcgcgacatgg

SEQ ID NO: 453736 - DNA, 20 bp, mouse
gcggccgaggacaccagaca

SEQ ID NO: 453737 - DNA, 20 bp, mouse
gcaggagcctccagcccaag

SEQ ID NO: 453738 - DNA, 20 bp, mouse
ggtgcccacttccaagatgg

SEQ ID NO: 453739 - DNA, 20 bp, mouse
gctggtgtcctcggccgctt

SEQ ID NO: 453740 - DNA, 20 bp, mouse
gcctccagcccaagcggccg

SEQ ID NO: 453741 - DNA, 20 bp, mouse
gcggcgacagcagccgtgtc

SEQ ID NO: 453742 - DNA, 20 bp, mouse
gcacgcacgcacgctgaggg

SEQ ID NO: 453743 - DNA, 20 bp, mouse
gcggctggctgtcacctcac

SEQ ID NO: 453744 - DNA, 20 bp, mouse
ggcttggcgtgggatgatag

SEQ ID NO: 453745 - DNA, 20 bp, mouse
gtcggggctagcaaggtaaa

SEQ ID NO: 453746 - DNA, 20 bp, mouse
gcggagacgctggcagtcat

SEQ ID NO: 453747 - DNA, 20 bp, mouse
gcgccaagccacaggagtga

SEQ ID NO: 453748 - DNA, 20 bp, mouse
gagacggtccctcactcctg

SEQ ID NO: 453749 - DNA, 20 bp, mouse
ggtctccgacgccaagccac

SEQ ID NO: 453750 - DNA, 20 bp, mouse
gtgctcactgacctacggac

SEQ ID NO: 453751 - DNA, 20 bp, mouse
gaaggcatagggccatccgg

SEQ ID NO: 453752 - DNA, 20 bp, mouse
gcctacggacgggaaggagg

SEQ ID NO: 453753 - DNA, 20 bp, mouse
ggtggctcgttctagtcccc

SEQ ID NO: 453754 - DNA, 20 bp, mouse
gatctcgaggagaggcacta

SEQ ID NO: 453755 - DNA, 20 bp, mouse
gcccaaggggccgggtccga

SEQ ID NO: 453756 - DNA, 20 bp, mouse
ggacccctcccaagtagagg

SEQ ID NO: 453757 - DNA, 20 bp, mouse
gcttgacagagcatcctcgg

SEQ ID NO: 453758 - DNA, 20 bp, mouse
gagctgcaggctggccaccg

SEQ ID NO: 453759 - DNA, 20 bp, mouse
gtaggtcccagagtgctcca

SEQ ID NO: 453760 - DNA, 20 bp, mouse
gaggacgagggagttcgaag

SEQ ID NO: 453761 - DNA, 20 bp, mouse
ggccagctagtgaagcccag

SEQ ID NO: 453762 - DNA, 20 bp, mouse
gaagtctccaagacaggaag

SEQ ID NO: 453763 - DNA, 20 bp, mouse
gagggagcttctgaaggtgg

SEQ ID NO: 453764 - DNA, 20 bp, mouse
gagccccgccaggaggatcg

SEQ ID NO: 453765 - DNA, 20 bp, mouse
gccggggagggagcttctga

SEQ ID NO: 453766 - DNA, 20 bp, mouse
gggactgcggcggcgacctc

SEQ ID NO: 453767 - DNA, 20 bp, mouse
ggcccctggggagcggagag

SEQ ID NO: 453768 - DNA, 20 bp, mouse
ggcagtccccggcgcccctg

SEQ ID NO: 453769 - DNA, 20 bp, mouse
gcaccgctctccgctcccca

SEQ ID NO: 453770 - DNA, 20 bp, mouse
gcttcccagaggccgggatc

SEQ ID NO: 453771 - DNA, 20 bp, mouse
ggagcggtgagcggtgagag

SEQ ID NO: 453772 - DNA, 20 bp, mouse
ggggagtcgggaatgaaggt

SEQ ID NO: 453773 - DNA, 20 bp, mouse
ggctgggtgatggggagaag

SEQ ID NO: 453774 - DNA, 20 bp, mouse
gctcgggcggctccggatcc

SEQ ID NO: 453775 - DNA, 20 bp, mouse
gtagggaccctggctgaaca

SEQ ID NO: 453776 - DNA, 20 bp, mouse
gagcggttggaggcttcgcg

SEQ ID NO: 453777 - DNA, 20 bp, mouse
ggcagcgcgcgctcaggacg

SEQ ID NO: 453778 - DNA, 20 bp, mouse
ggcgctgcttaccagagccc

SEQ ID NO: 453779 - DNA, 20 bp, mouse
ggcgctcagacaccgcctca

SEQ ID NO: 453780 - DNA, 20 bp, mouse
ggagcgctgcgaagagcctg

SEQ ID NO: 453781 - DNA, 20 bp, mouse
gaccccgcgtgtgaagctct

SEQ ID NO: 453782 - DNA, 20 bp, mouse
gctcggctgacaggagccgg

SEQ ID NO: 453783 - DNA, 20 bp, mouse
gcgtgggcccggcagccgtg

SEQ ID NO: 453784 - DNA, 20 bp, mouse
gtgcggccgagcgctcacgt

SEQ ID NO: 453785 - DNA, 20 bp, mouse
ggcgtgcgccccgcaccact

SEQ ID NO: 453786 - DNA, 20 bp, mouse
gcgcggcagccaacaaggta

SEQ ID NO: 453787 - DNA, 20 bp, mouse
gactgggcgcggggactcgg

SEQ ID NO: 453788 - DNA, 20 bp, mouse
gacctgcgcggcagccaaca

SEQ ID NO: 453789 - DNA, 20 bp, mouse
gggcggcgcgaagcgcggag

SEQ ID NO: 453790 - DNA, 20 bp, mouse
gcggtcccaccctaccttgt

SEQ ID NO: 453791 - DNA, 20 bp, mouse
gctctggagcgcgaacctgg

SEQ ID NO: 453792 - DNA, 20 bp, mouse
ggcagccaacaaggtagggt

SEQ ID NO: 453793 - DNA, 20 bp, mouse
ggaaactgaggactggagcg

SEQ ID NO: 453794 - DNA, 20 bp, mouse
ggtgcggccgctccctcagt

SEQ ID NO: 453795 - DNA, 20 bp, mouse
ggctccctcagtgggtgact

SEQ ID NO: 453796 - DNA, 20 bp, mouse
gtattatagatgctcggccg

SEQ ID NO: 453797 - DNA, 20 bp, mouse
gcgctggctgatgtcagccg

SEQ ID NO: 453798 - DNA, 20 bp, mouse
gaggccgccgcgccgcagga

SEQ ID NO: 453799 - DNA, 20 bp, mouse
ggacttgaggggcttaggaa

SEQ ID NO: 453800 - DNA, 20 bp, mouse
gcgagcatctataatagatg

SEQ ID NO: 453801 - DNA, 20 bp, mouse
gggctggggaccgcgcgctc

SEQ ID NO: 453802 - DNA, 20 bp, mouse
gccctcaagtccctgcccgg

SEQ ID NO: 453803 - DNA, 20 bp, mouse
ggcatcccgtagtcccctgg

SEQ ID NO: 453804 - DNA, 20 bp, mouse
gcgcgcgctcgggaggccgc

SEQ ID NO: 453805 - DNA, 20 bp, mouse
ggcccgaagcagctttccag

SEQ ID NO: 453806 - DNA, 20 bp, mouse
gggtatgcgaagggccgagg

SEQ ID NO: 453807 - DNA, 20 bp, mouse
gggcagcggccggaacaccc

SEQ ID NO: 453808 - DNA, 20 bp, mouse
ggcgggccggggtatgcgaa

SEQ ID NO: 453809 - DNA, 20 bp, mouse
gacaccctggcccggacgca

SEQ ID NO: 453810 - DNA, 20 bp, mouse
gaggcggcgtccgtgcgtcc

SEQ ID NO: 453811 - DNA, 20 bp, mouse
gcgtccgggccagggtgttc

SEQ ID NO: 453812 - DNA, 20 bp, mouse
gtcacgctgcgactcctctg

SEQ ID NO: 453813 - DNA, 20 bp, mouse
gtcctctgcggagcgggccg

SEQ ID NO: 453814 - DNA, 20 bp, mouse
gctgcgactcctctgcggag

SEQ ID NO: 453815 - DNA, 20 bp, mouse
ggagagccgcaggcagcggc

SEQ ID NO: 453816 - DNA, 20 bp, mouse
gggcaggctgcaagagtcca

SEQ ID NO: 453817 - DNA, 20 bp, mouse
gagctcaggctggagaacga

SEQ ID NO: 453818 - DNA, 20 bp, mouse
gacgagggtcgtcaggtact

SEQ ID NO: 453819 - DNA, 20 bp, mouse
ggctgggacagagcaagctc

SEQ ID NO: 453820 - DNA, 20 bp, mouse
gctggagaacgagggtcgtc

SEQ ID NO: 453821 - DNA, 20 bp, mouse
gcctccgggaccagaagcca

SEQ ID NO: 453822 - DNA, 20 bp, mouse
ggagtgtgcactgcacaggc

SEQ ID NO: 453823 - DNA, 20 bp, mouse
ggccagtggaccccactccc

SEQ ID NO: 453824 - DNA, 20 bp, mouse
gagttccgggtggacagatg

SEQ ID NO: 453825 - DNA, 20 bp, mouse
gaggggcggcctgaactcta

SEQ ID NO: 453826 - DNA, 20 bp, mouse
gcacgtccgaggatgatggg

SEQ ID NO: 453827 - DNA, 20 bp, mouse
gcagagcagcagcagcccga

SEQ ID NO: 453828 - DNA, 20 bp, mouse
gctcggccacccatcatcct

SEQ ID NO: 453829 - DNA, 20 bp, mouse
gtgatgggtggccgaggcac

SEQ ID NO: 453830 - DNA, 20 bp, mouse
gtcagcacgtccgaggatga

SEQ ID NO: 453831 - DNA, 20 bp, mouse
ggagggcaaacagggaccag

SEQ ID NO: 453832 - DNA, 20 bp, mouse
gacagacctcagcacgtccg

SEQ ID NO: 453833 - DNA, 20 bp, mouse
gagcagcagcccgaaggctg

SEQ ID NO: 453834 - DNA, 20 bp, mouse
gctcacggcagagaagacgg

SEQ ID NO: 453835 - DNA, 20 bp, mouse
gcaagtggccctcagccttc

SEQ ID NO: 453836 - DNA, 20 bp, mouse
gtcgagcgggctccgagagt

SEQ ID NO: 453837 - DNA, 20 bp, mouse
gcgctcgcaacagcaagcta

SEQ ID NO: 453838 - DNA, 20 bp, mouse
gaaccgcgggcctctctccg

SEQ ID NO: 453839 - DNA, 20 bp, mouse
ggcccgctcgactctcgtag

SEQ ID NO: 453840 - DNA, 20 bp, mouse
gcgggctccgagagtgggca

SEQ ID NO: 453841 - DNA, 20 bp, mouse
gtccgctacgagagtcgagc

SEQ ID NO: 453842 - DNA, 20 bp, mouse
gagctaaggtcctcggagag

SEQ ID NO: 453843 - DNA, 20 bp, mouse
gctggctctgcagtaaccgc

SEQ ID NO: 453844 - DNA, 20 bp, mouse
ggtcctcggagagaggcccg

SEQ ID NO: 453845 - DNA, 20 bp, mouse
gtgatcgccggggacaatgg

SEQ ID NO: 453846 - DNA, 20 bp, mouse
gcaggagccggtgaggtgag

SEQ ID NO: 453847 - DNA, 20 bp, mouse
gtgaggtgagaggcgtcctg

SEQ ID NO: 453848 - DNA, 20 bp, mouse
ggatggcggcgcccaggagc

SEQ ID NO: 453849 - DNA, 20 bp, mouse
ggaagtcccgcctcactcag

SEQ ID NO: 453850 - DNA, 20 bp, mouse
gggacgcggccataacgtac

SEQ ID NO: 453851 - DNA, 20 bp, mouse
gtactggtgcagcagtcccc

SEQ ID NO: 453852 - DNA, 20 bp, mouse
gagagggcgggctagcaaga

SEQ ID NO: 453853 - DNA, 20 bp, mouse
gctgccaagtgacaagccaa

SEQ ID NO: 453854 - DNA, 20 bp, mouse
gacctttagggtcacctgaa

SEQ ID NO: 453855 - DNA, 20 bp, mouse
gaggcggtggccaggaaccg

SEQ ID NO: 453856 - DNA, 20 bp, mouse
gtggtgtccgggatggaggt

SEQ ID NO: 453857 - DNA, 20 bp, mouse
gaggcgggcattctttccgg

SEQ ID NO: 453858 - DNA, 20 bp, mouse
gcggctctactgccaggtaa

SEQ ID NO: 453859 - DNA, 20 bp, mouse
gctttccggggggttatggg

SEQ ID NO: 453860 - DNA, 20 bp, mouse
gtggcggcggcggaacaaga

SEQ ID NO: 453861 - DNA, 20 bp, mouse
gcgcgacgcagccgccacgg

SEQ ID NO: 453862 - DNA, 20 bp, mouse
gggcagtagagccgatagag

SEQ ID NO: 453863 - DNA, 20 bp, mouse
ggggcccccggaccccgcac

SEQ ID NO: 453864 - DNA, 20 bp, mouse
gcgccagcggccccgccagg

SEQ ID NO: 453865 - DNA, 20 bp, mouse
gtctcgcgagatctcgccag

SEQ ID NO: 453866 - DNA, 20 bp, mouse
gcggcccgcggcctacctgg

SEQ ID NO: 453867 - DNA, 20 bp, mouse
gggtagaagccggaagttca

SEQ ID NO: 453868 - DNA, 20 bp, mouse
gaggagccgcgcgctctcaa

SEQ ID NO: 453869 - DNA, 20 bp, mouse
gcgagttgcagcctccaggt

SEQ ID NO: 453870 - DNA, 20 bp, mouse
gggctggctctcgctttagt

SEQ ID NO: 453871 - DNA, 20 bp, mouse
gcgcgcggtgcgggacacag

SEQ ID NO: 453872 - DNA, 20 bp, mouse
ggactcggaacggggagcag

SEQ ID NO: 453873 - DNA, 20 bp, mouse
gagcaggcatcgctctgacg

SEQ ID NO: 453874 - DNA, 20 bp, mouse
ggcggcgacacggggagcag

SEQ ID NO: 453875 - DNA, 20 bp, mouse
gtggctgaggagctgcgcgt

SEQ ID NO: 453876 - DNA, 20 bp, mouse
gccgtcaaggccctcaggga

SEQ ID NO: 453877 - DNA, 20 bp, mouse
gctgtactgtcagcatgcaa

SEQ ID NO: 453878 - DNA, 20 bp, mouse
gcaaggccctcagggacgga

SEQ ID NO: 453879 - DNA, 20 bp, mouse
gagcggaccgcagctcgctg

SEQ ID NO: 453880 - DNA, 20 bp, mouse
gctccccgtcaaggccctca

SEQ ID NO: 453881 - DNA, 20 bp, mouse
ggcagctcgctggggcgctc

SEQ ID NO: 453882 - DNA, 20 bp, mouse
gcgctggggcgctccggcag

SEQ ID NO: 453883 - DNA, 20 bp, mouse
ggacagtacagcgccactgc

SEQ ID NO: 453884 - DNA, 20 bp, mouse
gtgttctggacgccacccta

SEQ ID NO: 453885 - DNA, 20 bp, mouse
ggtcgggctcctggtcccta

SEQ ID NO: 453886 - DNA, 20 bp, mouse
gcgcctgataagcctccccg

SEQ ID NO: 453887 - DNA, 20 bp, mouse
gtgcctcggggaggcttatc

SEQ ID NO: 453888 - DNA, 20 bp, mouse
gggcttatcaggcgtggacc

SEQ ID NO: 453889 - DNA, 20 bp, mouse
ggcggctgtgacgggagcag

SEQ ID NO: 453890 - DNA, 20 bp, mouse
ggcggcccgcaacacgtctc

SEQ ID NO: 453891 - DNA, 20 bp, mouse
ggaagttgtagactcagcgc

SEQ ID NO: 453892 - DNA, 20 bp, mouse
ggtttccgtttgcctcgggg

SEQ ID NO: 453893 - DNA, 20 bp, mouse
ggtagactcagcgcaggctt

SEQ ID NO: 453894 - DNA, 20 bp, mouse
gaggggctgcgagtccggaa

SEQ ID NO: 453895 - DNA, 20 bp, mouse
gcacagccgctcaccaacat

SEQ ID NO: 453896 - DNA, 20 bp, mouse
ggtcagtgcgtagcccggga

SEQ ID NO: 453897 - DNA, 20 bp, mouse
gacagacggctcagggtagt

SEQ ID NO: 453898 - DNA, 20 bp, mouse
gtagcccgggagggaagccc

SEQ ID NO: 453899 - DNA, 20 bp, mouse
gggctagcggccgccagtcc

SEQ ID NO: 453900 - DNA, 20 bp, mouse
gccagtcccggcatctttcc

SEQ ID NO: 453901 - DNA, 20 bp, mouse
gctcagggtagtcggagttt

SEQ ID NO: 453902 - DNA, 20 bp, mouse
ggagaggacagcggaactat

SEQ ID NO: 453903 - DNA, 20 bp, mouse
gagccgagctgctaaagccc

SEQ ID NO: 453904 - DNA, 20 bp, mouse
ggcctgcccggaaaccaaga

SEQ ID NO: 453905 - DNA, 20 bp, mouse
ggtcccccttcgattgactg

SEQ ID NO: 453906 - DNA, 20 bp, mouse
ggagccacccggcacacgac

SEQ ID NO: 453907 - DNA, 20 bp, mouse
ggcacacgaccggcacagca

SEQ ID NO: 453908 - DNA, 20 bp, mouse
ggaggccgcagacaccgaag

SEQ ID NO: 453909 - DNA, 20 bp, mouse
gctagagcactagcaccagg

SEQ ID NO: 453910 - DNA, 20 bp, mouse
gccggcacagcatggttaca

SEQ ID NO: 453911 - DNA, 20 bp, mouse
gacagcatggttacacggag

SEQ ID NO: 453912 - DNA, 20 bp, mouse
ggcggctgcccataccggaa

SEQ ID NO: 453913 - DNA, 20 bp, mouse
gtccaggcgggcggtgatcc

SEQ ID NO: 453914 - DNA, 20 bp, mouse
gcatggttacacggagcggg

SEQ ID NO: 453915 - DNA, 20 bp, mouse
gagtgctgataggcggccag

SEQ ID NO: 453916 - DNA, 20 bp, mouse
gagccgcggcccccagacaa

SEQ ID NO: 453917 - DNA, 20 bp, mouse
gatcacggcgaaatccagag

SEQ ID NO: 453918 - DNA, 20 bp, mouse
gttctcggtgacaggatcag

SEQ ID NO: 453919 - DNA, 20 bp, mouse
gttcattgcggtcgacatca

SEQ ID NO: 453920 - DNA, 20 bp, mouse
ggtgctgagtctgagtggta

SEQ ID NO: 453921 - DNA, 20 bp, mouse
gttggtcccgaagttcattg

SEQ ID NO: 453922 - DNA, 20 bp, mouse
gggagagcgacggcgacgca

SEQ ID NO: 453923 - DNA, 20 bp, mouse
gaatccagagcggagagcga

SEQ ID NO: 453924 - DNA, 20 bp, mouse
gtgtcgaccgcaatgaactt

SEQ ID NO: 453925 - DNA, 20 bp, mouse
ggcttcccgctggaccactt

SEQ ID NO: 453926 - DNA, 20 bp, mouse
gccccacgagacggagaaaa

SEQ ID NO: 453927 - DNA, 20 bp, mouse
ggcggggcgatggagaggac

SEQ ID NO: 453928 - DNA, 20 bp, mouse
ggagcgcacactcacaggta

SEQ ID NO: 453929 - DNA, 20 bp, mouse
gtgttcgccatggggcaagg

SEQ ID NO: 453930 - DNA, 20 bp, mouse
gtacctcgcggctatgggat

SEQ ID NO: 453931 - DNA, 20 bp, mouse
gcacaggagcgcacactcac

SEQ ID NO: 453932 - DNA, 20 bp, mouse
ggccccgcccaggcccgcga

SEQ ID NO: 453933 - DNA, 20 bp, mouse
ggggatgggtctaggaaacc

SEQ ID NO: 453934 - DNA, 20 bp, mouse
gtagtgaagagcaggcctgc

SEQ ID NO: 453935 - DNA, 20 bp, mouse
ggtagaaagggctaataaag

SEQ ID NO: 453936 - DNA, 20 bp, mouse
gtccggtcgcgagcacccca

SEQ ID NO: 453937 - DNA, 20 bp, mouse
gcaccccagggtgtagaggg

SEQ ID NO: 453938 - DNA, 20 bp, mouse
ggaccgccctctacaccctg

SEQ ID NO: 453939 - DNA, 20 bp, mouse
ggagcaccccagggtgtaga

SEQ ID NO: 453940 - DNA, 20 bp, mouse
gggcaggtgacggccttgga

SEQ ID NO: 453941 - DNA, 20 bp, mouse
ggcggtcgcggcggtcgcct

SEQ ID NO: 453942 - DNA, 20 bp, mouse
ggtgtagagggcggtcgcgg

SEQ ID NO: 453943 - DNA, 20 bp, mouse
ggtgctcgcgaccggaagaa

SEQ ID NO: 453944 - DNA, 20 bp, mouse
gaccctggggtgctcgcgac

SEQ ID NO: 453945 - DNA, 20 bp, mouse
gcgcaaccggaagaccaaga

SEQ ID NO: 453946 - DNA, 20 bp, mouse
gctgggtcagcgggtaggag

SEQ ID NO: 453947 - DNA, 20 bp, mouse
ggagcaggcagagcgcacgt

SEQ ID NO: 453948 - DNA, 20 bp, mouse
ggagtcccacctgaggggaa

SEQ ID NO: 453949 - DNA, 20 bp, mouse
gaattgcaagctggaggcgg

SEQ ID NO: 453950 - DNA, 20 bp, mouse
gattgtgagtcccacctgag

SEQ ID NO: 453951 - DNA, 20 bp, mouse
gcgagtccggagtgatggta

SEQ ID NO: 453952 - DNA, 20 bp, mouse
gagctgccctgctgagtgac

SEQ ID NO: 453953 - DNA, 20 bp, mouse
gccaaactgggtcagcgggt

SEQ ID NO: 453954 - DNA, 20 bp, mouse
gaaccgcagacccggagagg

SEQ ID NO: 453955 - DNA, 20 bp, mouse
ggggaaccgcagacccggag

SEQ ID NO: 453956 - DNA, 20 bp, mouse
ggtacagcgacggagggcag

SEQ ID NO: 453957 - DNA, 20 bp, mouse
ggacggcgaccacagcgcac

SEQ ID NO: 453958 - DNA, 20 bp, mouse
ggctgcggtacagcgacgga

SEQ ID NO: 453959 - DNA, 20 bp, mouse
gaccgcccgcgagctcacac

SEQ ID NO: 453960 - DNA, 20 bp, mouse
ggaccacagcgcactggctg

SEQ ID NO: 453961 - DNA, 20 bp, mouse
gggctcccgccgccactcga

SEQ ID NO: 453962 - DNA, 20 bp, mouse
ggccggtgtgagctcgcggg

SEQ ID NO: 453963 - DNA, 20 bp, mouse
gtcgagggcaggctccctgg

SEQ ID NO: 453964 - DNA, 20 bp, mouse
gcgcggctgcggtacagcga

SEQ ID NO: 453965 - DNA, 20 bp, mouse
ggctgaggctgacgagaagc

SEQ ID NO: 453966 - DNA, 20 bp, mouse
ggagcctaaggtggtcagca

SEQ ID NO: 453967 - DNA, 20 bp, mouse
gcagatgcacttccgggaac

SEQ ID NO: 453968 - DNA, 20 bp, mouse
ggagccctgctgaccacctt

SEQ ID NO: 453969 - DNA, 20 bp, mouse
gcggctcccggagcctaagg

SEQ ID NO: 453970 - DNA, 20 bp, mouse
ggggctcgagagaacgctaa

SEQ ID NO: 453971 - DNA, 20 bp, mouse
gaaagcgggttcgatcgggt

SEQ ID NO: 453972 - DNA, 20 bp, mouse
gcgccggaggccatggacac

SEQ ID NO: 453973 - DNA, 20 bp, mouse
gcgcggtgggaagggaaaaa

SEQ ID NO: 453974 - DNA, 20 bp, mouse
ggcaagaccggacagagcgc

SEQ ID NO: 453975 - DNA, 20 bp, mouse
gaggtacgtgaccagctggg

SEQ ID NO: 453976 - DNA, 20 bp, mouse
gctgatgcgcaggtgagggt

SEQ ID NO: 453977 - DNA, 20 bp, mouse
gtgcgcatcaggaccaaggt

SEQ ID NO: 453978 - DNA, 20 bp, mouse
ggacatgggccgcctcaacc

SEQ ID NO: 453979 - DNA, 20 bp, mouse
gggagggttcaggtacccgg

SEQ ID NO: 453980 - DNA, 20 bp, mouse
ggagggtaggcaacgaacgg

SEQ ID NO: 453981 - DNA, 20 bp, mouse
gccgtgggcgccactcgaca

SEQ ID NO: 453982 - DNA, 20 bp, mouse
gcggatgcctggaggacgga

SEQ ID NO: 453983 - DNA, 20 bp, mouse
gagttccatgatggcgtcgg

SEQ ID NO: 453984 - DNA, 20 bp, mouse
gggtcctgatgcgcaggtga

SEQ ID NO: 453985 - DNA, 20 bp, mouse
gtgaggcggcccatgtcgag

SEQ ID NO: 453986 - DNA, 20 bp, mouse
gtccggctcaggacctttag

SEQ ID NO: 453987 - DNA, 20 bp, mouse
ggtcaaagggaggctaggaa

SEQ ID NO: 453988 - DNA, 20 bp, mouse
gcagagccattgtcaaaggg

SEQ ID NO: 453989 - DNA, 20 bp, mouse
ggaggcagagccattgtcaa

SEQ ID NO: 453990 - DNA, 20 bp, mouse
ggtcaggaggcgccaggtgt

SEQ ID NO: 453991 - DNA, 20 bp, mouse
ggcatggccagcgcagccaa

SEQ ID NO: 453992 - DNA, 20 bp, mouse
gccattgtcaaagggaggct

SEQ ID NO: 453993 - DNA, 20 bp, mouse
gtggctggaggagcaaaggt

SEQ ID NO: 453994 - DNA, 20 bp, mouse
ggcccctccatggtctcctt

SEQ ID NO: 453995 - DNA, 20 bp, mouse
gggggtgtgagtagattcat

SEQ ID NO: 453996 - DNA, 20 bp, mouse
gtgaagggtcgggatcctgg

SEQ ID NO: 453997 - DNA, 20 bp, mouse
gtaggtgagtgtgaagggtc

SEQ ID NO: 453998 - DNA, 20 bp, mouse
gctatcaaaggggacttgta

SEQ ID NO: 453999 - DNA, 20 bp, mouse
gactcacctaaagattgtcc

SEQ ID NO: 454000 - DNA, 20 bp, mouse
ggctgaaggatggagtaata

SEQ ID NO: 454001 - DNA, 20 bp, mouse
gtggcgtcagggaagccccg

SEQ ID NO: 454002 - DNA, 20 bp, mouse
ggacttgtagggctgaagga

SEQ ID NO: 454003 - DNA, 20 bp, mouse
gatctttaggtgagtgtgaa

SEQ ID NO: 454004 - DNA, 20 bp, mouse
gcaacggacaaggttccccc

SEQ ID NO: 454005 - DNA, 20 bp, mouse
gattgaagtaacgctactcc

SEQ ID NO: 454006 - DNA, 20 bp, mouse
gcaaagtagctggaacacca

SEQ ID NO: 454007 - DNA, 20 bp, mouse
ggggctggtcccaagagcac

SEQ ID NO: 454008 - DNA, 20 bp, mouse
gcagtctggtaaggacaggg

SEQ ID NO: 454009 - DNA, 20 bp, mouse
gggaagcgcggatcaaaggg

SEQ ID NO: 454010 - DNA, 20 bp, mouse
gctggtaaggacagggtggg

SEQ ID NO: 454011 - DNA, 20 bp, mouse
gctcaaactaaaggcacggg

SEQ ID NO: 454012 - DNA, 20 bp, mouse
gcttcagtctggtaaggaca

SEQ ID NO: 454013 - DNA, 20 bp, mouse
ggccctcattctcaaactaa

SEQ ID NO: 454014 - DNA, 20 bp, mouse
gtagggaagcgcggatcaaa

SEQ ID NO: 454015 - DNA, 20 bp, mouse
gggctcacttcagtctggta

SEQ ID NO: 454016 - DNA, 20 bp, mouse
ggcgcatgcgtgctgctgga

SEQ ID NO: 454017 - DNA, 20 bp, mouse
ggcctgaccggcctgaactc

SEQ ID NO: 454018 - DNA, 20 bp, mouse
gagcgcacgcggggagatgg

SEQ ID NO: 454019 - DNA, 20 bp, mouse
gggcaacgcgcccacgagga

SEQ ID NO: 454020 - DNA, 20 bp, mouse
gaggaggctgcgggcctgac

SEQ ID NO: 454021 - DNA, 20 bp, mouse
ggcaggcccgaggctccact

SEQ ID NO: 454022 - DNA, 20 bp, mouse
gcccccgccgcgtcctcagg

SEQ ID NO: 454023 - DNA, 20 bp, mouse
gggccaccagcgagaccctg

SEQ ID NO: 454024 - DNA, 20 bp, mouse
gaaggggtgcgaccttggag

SEQ ID NO: 454025 - DNA, 20 bp, mouse
gcatgcgcaagagtcgatgg

SEQ ID NO: 454026 - DNA, 20 bp, mouse
gcgcaaaatgagggccctac

SEQ ID NO: 454027 - DNA, 20 bp, mouse
ggtccttgggcgaagagggg

SEQ ID NO: 454028 - DNA, 20 bp, mouse
gaggtgactcggagctgctg

SEQ ID NO: 454029 - DNA, 20 bp, mouse
ggtgctggggcctcacccgt

SEQ ID NO: 454030 - DNA, 20 bp, mouse
gcacgtccttgggcgaagag

SEQ ID NO: 454031 - DNA, 20 bp, mouse
gctgctgaggacgcaaaatg

SEQ ID NO: 454032 - DNA, 20 bp, mouse
gcccagcacgggctgtgtcg

SEQ ID NO: 454033 - DNA, 20 bp, mouse
gaatgagggccctacgggtg

SEQ ID NO: 454034 - DNA, 20 bp, mouse
ggccccctgggatgttaagg

SEQ ID NO: 454035 - DNA, 20 bp, mouse
gtaacatggtccagaaccct

SEQ ID NO: 454036 - DNA, 20 bp, mouse
ggcgagtggacggaaggtca

SEQ ID NO: 454037 - DNA, 20 bp, mouse
gccaggggcgagtggacgga

SEQ ID NO: 454038 - DNA, 20 bp, mouse
gctcgttccgggaagaggag

SEQ ID NO: 454039 - DNA, 20 bp, mouse
gtgttgcggaatctgctggt

SEQ ID NO: 454040 - DNA, 20 bp, mouse
gaaagccaccagaccggaaa

SEQ ID NO: 454041 - DNA, 20 bp, mouse
gacagccaggggcgagtgga

SEQ ID NO: 454042 - DNA, 20 bp, mouse
gagttccgtttccggtctgg

SEQ ID NO: 454043 - DNA, 20 bp, mouse
gacagcagccggagtcacct

SEQ ID NO: 454044 - DNA, 20 bp, mouse
gcgcgcgcgcagcgctagga

SEQ ID NO: 454045 - DNA, 20 bp, mouse
gaaatcgaaagccaccagac

SEQ ID NO: 454046 - DNA, 20 bp, mouse
ggccggagaacagcagcccg

SEQ ID NO: 454047 - DNA, 20 bp, mouse
gaccgccctagaaaaggacc

SEQ ID NO: 454048 - DNA, 20 bp, mouse
gtaaccacgcaggcttggag

SEQ ID NO: 454049 - DNA, 20 bp, mouse
gtgcgtggttaaggacacca

SEQ ID NO: 454050 - DNA, 20 bp, mouse
gggacaccagcaagccggac

SEQ ID NO: 454051 - DNA, 20 bp, mouse
gaccagcaagccggaccggt

SEQ ID NO: 454052 - DNA, 20 bp, mouse
ggcgaggttcgagccgtgaa

SEQ ID NO: 454053 - DNA, 20 bp, mouse
gaagtgtacctgcggggtgt

SEQ ID NO: 454054 - DNA, 20 bp, mouse
ggccatgcaaacctcgccta

SEQ ID NO: 454055 - DNA, 20 bp, mouse
gtctccggcccaaggcgacg

SEQ ID NO: 454056 - DNA, 20 bp, mouse
ggtgactggagaccacgcag

SEQ ID NO: 454057 - DNA, 20 bp, mouse
gagcgtcctgaaaaacaaaa

SEQ ID NO: 454058 - DNA, 20 bp, mouse
gcaaggtgagcagataatgt

SEQ ID NO: 454059 - DNA, 20 bp, mouse
ggggaagctagccataacag

SEQ ID NO: 454060 - DNA, 20 bp, mouse
gaagagggcagaagagcacg

SEQ ID NO: 454061 - DNA, 20 bp, mouse
gacgaggacagccggatccc

SEQ ID NO: 454062 - DNA, 20 bp, mouse
gaaacccgcaggatttgggg

SEQ ID NO: 454063 - DNA, 20 bp, mouse
gtcctccgccccaaatcctg

SEQ ID NO: 454064 - DNA, 20 bp, mouse
gggtctccagtcactgggaa

SEQ ID NO: 454065 - DNA, 20 bp, mouse
gacagaggtagctgtgacag

SEQ ID NO: 454066 - DNA, 20 bp, mouse
gtacttaccagcaacgacac

SEQ ID NO: 454067 - DNA, 20 bp, mouse
gtggtaagtacagagtttca

SEQ ID NO: 454068 - DNA, 20 bp, mouse
gtcactgcggggttattgac

SEQ ID NO: 454069 - DNA, 20 bp, mouse
gctaaaaagagatggcgccg

SEQ ID NO: 454070 - DNA, 20 bp, mouse
gcggggttattgacaggtac

SEQ ID NO: 454071 - DNA, 20 bp, mouse
gacaggtactggattcgcct

SEQ ID NO: 454072 - DNA, 20 bp, mouse
gttaggatgtagagtgaatg

SEQ ID NO: 454073 - DNA, 20 bp, mouse
gaataaccccgcagtgaaag

SEQ ID NO: 454074 - DNA, 20 bp, mouse
gctaagatatcaggctgtga

SEQ ID NO: 454075 - DNA, 20 bp, mouse
gaggggaaatccaaccgaaa

SEQ ID NO: 454076 - DNA, 20 bp, mouse
gcagagcgcgaagaccgaaa

SEQ ID NO: 454077 - DNA, 20 bp, mouse
ggtgaggctcggctgcctag

SEQ ID NO: 454078 - DNA, 20 bp, mouse
gcggctgacaggcggcgtgg

SEQ ID NO: 454079 - DNA, 20 bp, mouse
gacaggcggcgtggaggcag

SEQ ID NO: 454080 - DNA, 20 bp, mouse
gcgagcgtcaccttgcccct

SEQ ID NO: 454081 - DNA, 20 bp, mouse
gcgaagaccgaaagggaaga

SEQ ID NO: 454082 - DNA, 20 bp, mouse
ggaggcctggaaggttcggt

SEQ ID NO: 454083 - DNA, 20 bp, mouse
gtcgctctgcggctgacagg

SEQ ID NO: 454084 - DNA, 20 bp, mouse
gccacaccccggggagaact

SEQ ID NO: 454085 - DNA, 20 bp, mouse
gcttcgcgctctgccgagca

SEQ ID NO: 454086 - DNA, 20 bp, mouse
gcgcggaacgaccacggacg

SEQ ID NO: 454087 - DNA, 20 bp, mouse
ggaggaccagtccaaggtca

SEQ ID NO: 454088 - DNA, 20 bp, mouse
gacggacgaggaccagtcca

SEQ ID NO: 454089 - DNA, 20 bp, mouse
gcaggacagacatgacggcg

SEQ ID NO: 454090 - DNA, 20 bp, mouse
gtgactccctgaccttggac

SEQ ID NO: 454091 - DNA, 20 bp, mouse
gtggcttaggcctgtcctca

SEQ ID NO: 454092 - DNA, 20 bp, mouse
gcctcagcagcagtggcgtc

SEQ ID NO: 454093 - DNA, 20 bp, mouse
gctggtgagcgggacggacc

SEQ ID NO: 454094 - DNA, 20 bp, mouse
gtagcctgcgacattggctt

SEQ ID NO: 454095 - DNA, 20 bp, mouse
gctgtggtagcctgcgacat

SEQ ID NO: 454096 - DNA, 20 bp, mouse
ggacgtgcagcggacattca

SEQ ID NO: 454097 - DNA, 20 bp, mouse
gtccttccttggccccaaag

SEQ ID NO: 454098 - DNA, 20 bp, mouse
ggagcagccgcaggataggg

SEQ ID NO: 454099 - DNA, 20 bp, mouse
gttggagcagccgcaggata

SEQ ID NO: 454100 - DNA, 20 bp, mouse
gagccttggcatgattctcg

SEQ ID NO: 454101 - DNA, 20 bp, mouse
gcgacagtgacagaactagg

SEQ ID NO: 454102 - DNA, 20 bp, mouse
gcctgggcttcagggcaaca

SEQ ID NO: 454103 - DNA, 20 bp, mouse
ggcgcctgcgaagttcacag

SEQ ID NO: 454104 - DNA, 20 bp, mouse
gtggctacctaagtggtcag

SEQ ID NO: 454105 - DNA, 20 bp, mouse
gccccagctggctacctaag

SEQ ID NO: 454106 - DNA, 20 bp, mouse
ggcagcaggcgagacatcgc

SEQ ID NO: 454107 - DNA, 20 bp, mouse
gccaccagtgtcggagtcaa

SEQ ID NO: 454108 - DNA, 20 bp, mouse
ggtgtgcgcgaggaaagggc

SEQ ID NO: 454109 - DNA, 20 bp, mouse
gctccgacactggtggtctc

SEQ ID NO: 454110 - DNA, 20 bp, mouse
gcggcctttgactccgacac

SEQ ID NO: 454111 - DNA, 20 bp, mouse
gctcgcgcacactttaccaa

SEQ ID NO: 454112 - DNA, 20 bp, mouse
gagacatcgcaggtcagaaa

SEQ ID NO: 454113 - DNA, 20 bp, mouse
gccggtttgctctgtctcag

SEQ ID NO: 454114 - DNA, 20 bp, mouse
ggaacaggactgcacggtgg

SEQ ID NO: 454115 - DNA, 20 bp, mouse
gtaaagtgtgcgcgaggaaa

SEQ ID NO: 454116 - DNA, 20 bp, mouse
gtgcatcgtgggctccgaga

SEQ ID NO: 454117 - DNA, 20 bp, mouse
gttatctcttgccaaggcta

SEQ ID NO: 454118 - DNA, 20 bp, mouse
ggttctggtaaaccacgaag

SEQ ID NO: 454119 - DNA, 20 bp, mouse
gtggtctgagggagctatac

SEQ ID NO: 454120 - DNA, 20 bp, mouse
gtttcactttattgcatcgt

SEQ ID NO: 454121 - DNA, 20 bp, mouse
gtaatgcttatctcttgcca

SEQ ID NO: 454122 - DNA, 20 bp, mouse
ggaacacatttgggagataa

SEQ ID NO: 454123 - DNA, 20 bp, mouse
gggtttcttactctctccta

SEQ ID NO: 454124 - DNA, 20 bp, mouse
gttgtatagttccttagcct

SEQ ID NO: 454125 - DNA, 20 bp, mouse
gggaattactgaagcagtct

SEQ ID NO: 454126 - DNA, 20 bp, mouse
gtgaccgtctcgccatgaag

SEQ ID NO: 454127 - DNA, 20 bp, mouse
gagaaccagcagcctcttca

SEQ ID NO: 454128 - DNA, 20 bp, mouse
gcaggctgagaccaagactg

SEQ ID NO: 454129 - DNA, 20 bp, mouse
gtgctgctggcagcagtctt

SEQ ID NO: 454130 - DNA, 20 bp, mouse
ggacagaccgataccaccct

SEQ ID NO: 454131 - DNA, 20 bp, mouse
gccctgggacagcaacctgg

SEQ ID NO: 454132 - DNA, 20 bp, mouse
gggcagggcagggtttggaa

SEQ ID NO: 454133 - DNA, 20 bp, mouse
gggaggagcgggtatctgga

SEQ ID NO: 454134 - DNA, 20 bp, mouse
gaggtctactgaacccgtaa

SEQ ID NO: 454135 - DNA, 20 bp, mouse
ggccctgcccgccttccccc

SEQ ID NO: 454136 - DNA, 20 bp, mouse
gcagtagatatacccaaata

SEQ ID NO: 454137 - DNA, 20 bp, mouse
gaatagggcaaccaataacg

SEQ ID NO: 454138 - DNA, 20 bp, mouse
gaataacggggtcaacctca

SEQ ID NO: 454139 - DNA, 20 bp, mouse
ggctctgaactctggactct

SEQ ID NO: 454140 - DNA, 20 bp, mouse
gagagactgcaggctcccac

SEQ ID NO: 454141 - DNA, 20 bp, mouse
ggggcacttacagactgtgg

SEQ ID NO: 454142 - DNA, 20 bp, mouse
gatctccccccaacctaaga

SEQ ID NO: 454143 - DNA, 20 bp, mouse
ggggagatagcgggaaaggt

SEQ ID NO: 454144 - DNA, 20 bp, mouse
gttcagagccctcttaggtt

SEQ ID NO: 454145 - DNA, 20 bp, mouse
gtggagatgaatgactgtag

SEQ ID NO: 454146 - DNA, 20 bp, mouse
gcaagccaagaaaaaacatg

SEQ ID NO: 454147 - DNA, 20 bp, mouse
gagtctctgggtgaaaaagg

SEQ ID NO: 454148 - DNA, 20 bp, mouse
ggtcaagttcttcaagacac

SEQ ID NO: 454149 - DNA, 20 bp, mouse
gtgacaaacgagggaggaag

SEQ ID NO: 454150 - DNA, 20 bp, mouse
gtgaggtaaaccattcagag

SEQ ID NO: 454151 - DNA, 20 bp, mouse
ggcttgatctgacccctata

SEQ ID NO: 454152 - DNA, 20 bp, mouse
gaaaggttgacaaacgaggg

SEQ ID NO: 454153 - DNA, 20 bp, mouse
gtgctcctgtccactttgac

SEQ ID NO: 454154 - DNA, 20 bp, mouse
gatgaggttcttcttgctta

SEQ ID NO: 454155 - DNA, 20 bp, mouse
gttcattctggagtttcaca

SEQ ID NO: 454156 - DNA, 20 bp, mouse
ggcgcccttgagacatgaag

SEQ ID NO: 454157 - DNA, 20 bp, mouse
gcagatgcctgccccaatca

SEQ ID NO: 454158 - DNA, 20 bp, mouse
gttctttggggccctgattg

SEQ ID NO: 454159 - DNA, 20 bp, mouse
gtagccacttcatgtctcaa

SEQ ID NO: 454160 - DNA, 20 bp, mouse
ggctggaggttaaggagctg

SEQ ID NO: 454161 - DNA, 20 bp, mouse
ggactcagtcagtatgtgac

SEQ ID NO: 454162 - DNA, 20 bp, mouse
ggcggccgagataaattctt

SEQ ID NO: 454163 - DNA, 20 bp, mouse
gaagtggctactgttctttg

SEQ ID NO: 454164 - DNA, 20 bp, mouse
gtcacccaaagaatttatct

SEQ ID NO: 454165 - DNA, 20 bp, mouse
ggaatgcaccagctatacac

SEQ ID NO: 454166 - DNA, 20 bp, mouse
gagagcgaggcgaaagaaag

SEQ ID NO: 454167 - DNA, 20 bp, mouse
gcctgcacttggtttagaaa

SEQ ID NO: 454168 - DNA, 20 bp, mouse
gtgaccgtgtgcggagaggg

SEQ ID NO: 454169 - DNA, 20 bp, mouse
gtaaaggagtagggcaggcg

SEQ ID NO: 454170 - DNA, 20 bp, mouse
gtagctgaccgtgtgcggag

SEQ ID NO: 454171 - DNA, 20 bp, mouse
gcccatgaaataaaggagta

SEQ ID NO: 454172 - DNA, 20 bp, mouse
gttcagaaggaaaaaaggtg

SEQ ID NO: 454173 - DNA, 20 bp, mouse
gagagtttggtgtgcctgaa

SEQ ID NO: 454174 - DNA, 20 bp, mouse
gcggctgacccatgaaataa

SEQ ID NO: 454175 - DNA, 20 bp, mouse
ggaggagcggttagaaattc

SEQ ID NO: 454176 - DNA, 20 bp, mouse
ggtgacactttaggcagcta

SEQ ID NO: 454177 - DNA, 20 bp, mouse
ggcctcgcaggacaagaagt

SEQ ID NO: 454178 - DNA, 20 bp, mouse
ggagcaaaatgtgacacttt

SEQ ID NO: 454179 - DNA, 20 bp, mouse
ggggagttgctattaagact

SEQ ID NO: 454180 - DNA, 20 bp, mouse
gtcaaaaggagccagcaaac

SEQ ID NO: 454181 - DNA, 20 bp, mouse
gagcaagttgtctgggaaag

SEQ ID NO: 454182 - DNA, 20 bp, mouse
gatagcggttgtcgtaagag

SEQ ID NO: 454183 - DNA, 20 bp, mouse
ggtggctcctgggattcccg

SEQ ID NO: 454184 - DNA, 20 bp, mouse
ggaacttcctcgggaatccc

SEQ ID NO: 454185 - DNA, 20 bp, mouse
gcgtaagagtggcagtgccc

SEQ ID NO: 454186 - DNA, 20 bp, mouse
gctactggccctggtgagtg

SEQ ID NO: 454187 - DNA, 20 bp, mouse
ggttgcccagtaattcagac

SEQ ID NO: 454188 - DNA, 20 bp, mouse
gttctgaggagaactttgat

SEQ ID NO: 454189 - DNA, 20 bp, mouse
gggtgcctgtctgaattact

SEQ ID NO: 454190 - DNA, 20 bp, mouse
gaagctagcaaaacttactt

SEQ ID NO: 454191 - DNA, 20 bp, mouse
ggcagcaaaagaaagcgcgg

SEQ ID NO: 454192 - DNA, 20 bp, mouse
ggaggagaactttgatgggt

SEQ ID NO: 454193 - DNA, 20 bp, mouse
ggaactagccaacaccaaac

SEQ ID NO: 454194 - DNA, 20 bp, mouse
gctgaattactgggcaacct

SEQ ID NO: 454195 - DNA, 20 bp, mouse
gctgtgacggctaaatgagt

SEQ ID NO: 454196 - DNA, 20 bp, mouse
gtacaccaagtacaacaact

SEQ ID NO: 454197 - DNA, 20 bp, mouse
gaacaactgggaaacggtat

SEQ ID NO: 454198 - DNA, 20 bp, mouse
gtgggaaacggtatggggtg

SEQ ID NO: 454199 - DNA, 20 bp, mouse
gtagctgtgtccacttgcac

SEQ ID NO: 454200 - DNA, 20 bp, mouse
ggtgtccacttgcacgggtg

SEQ ID NO: 454201 - DNA, 20 bp, mouse
gacagccacacccgtgcaag

SEQ ID NO: 454202 - DNA, 20 bp, mouse
ggactctctttggcagatag

SEQ ID NO: 454203 - DNA, 20 bp, mouse
gacaaggtctggattatcat

SEQ ID NO: 454204 - DNA, 20 bp, mouse
gccaaggaatctgagctata

SEQ ID NO: 454205 - DNA, 20 bp, mouse
gctgtaagcaatctaagtga

SEQ ID NO: 454206 - DNA, 20 bp, mouse
ggaagccatgctgctcatag

SEQ ID NO: 454207 - DNA, 20 bp, mouse
gtgctgctcatagaggatga

SEQ ID NO: 454208 - DNA, 20 bp, mouse
gttgctcacaagtcactgtt

SEQ ID NO: 454209 - DNA, 20 bp, mouse
ggatggctaccaggattcca

SEQ ID NO: 454210 - DNA, 20 bp, mouse
gctgggatagagagccaact

SEQ ID NO: 454211 - DNA, 20 bp, mouse
gcttcatggccttggaatcc

SEQ ID NO: 454212 - DNA, 20 bp, mouse
ggcatggcttcgcctttcag

SEQ ID NO: 454213 - DNA, 20 bp, mouse
gtagagagccaactgggtag

SEQ ID NO: 454214 - DNA, 20 bp, mouse
ggacttgtgagcaagccctt

SEQ ID NO: 454215 - DNA, 20 bp, mouse
gaagtcgtttgggtataaca

SEQ ID NO: 454216 - DNA, 20 bp, mouse
gtggagccgctggagcggag

SEQ ID NO: 454217 - DNA, 20 bp, mouse
gtagcggcgttgctggaaga

SEQ ID NO: 454218 - DNA, 20 bp, mouse
gtggagcggagcggtattag

SEQ ID NO: 454219 - DNA, 20 bp, mouse
gggcgtcccagccgccaggg

SEQ ID NO: 454220 - DNA, 20 bp, mouse
gctccagcggctccacactc

SEQ ID NO: 454221 - DNA, 20 bp, mouse
gagcggctccacactccggg

SEQ ID NO: 454222 - DNA, 20 bp, mouse
gaggcgaccacgacaaccgt

SEQ ID NO: 454223 - DNA, 20 bp, mouse
ggttgctggaagatggcgag

SEQ ID NO: 454224 - DNA, 20 bp, mouse
gcaggcggcgcacatcaaga

SEQ ID NO: 454225 - DNA, 20 bp, mouse
gtggcggcggcagcagacgc

SEQ ID NO: 454226 - DNA, 20 bp, mouse
gcattgagcggtggaaggtg

SEQ ID NO: 454227 - DNA, 20 bp, mouse
ggcccgggcccgggtggagt

SEQ ID NO: 454228 - DNA, 20 bp, mouse
gggcggctccagcaagagga

SEQ ID NO: 454229 - DNA, 20 bp, mouse
ggagcgcaccgttcattgag

SEQ ID NO: 454230 - DNA, 20 bp, mouse
ggagctcgccaactccaccc

SEQ ID NO: 454231 - DNA, 20 bp, mouse
ggggcccgggcagacaaaag

SEQ ID NO: 454232 - DNA, 20 bp, mouse
gccgggcagacaaaagaggc

SEQ ID NO: 454233 - DNA, 20 bp, mouse
gcaggagcccggggcgccag

SEQ ID NO: 454234 - DNA, 20 bp, mouse
gaggccggcagtgcagctcg

SEQ ID NO: 454235 - DNA, 20 bp, mouse
ggcgcagctctggatagcgg

SEQ ID NO: 454236 - DNA, 20 bp, mouse
gaaattcggggcaagagatc

SEQ ID NO: 454237 - DNA, 20 bp, mouse
gttgttccgagaggcgtcat

SEQ ID NO: 454238 - DNA, 20 bp, mouse
gacgctccctccagaatgac

SEQ ID NO: 454239 - DNA, 20 bp, mouse
ggctttactgacaaaattcg

SEQ ID NO: 454240 - DNA, 20 bp, mouse
ggcgaagctgttgttccgag

SEQ ID NO: 454241 - DNA, 20 bp, mouse
gagctagggctggaccagac

SEQ ID NO: 454242 - DNA, 20 bp, mouse
gggcagtcggtctgaagtga

SEQ ID NO: 454243 - DNA, 20 bp, mouse
ggctggcccatgacgcctct

SEQ ID NO: 454244 - DNA, 20 bp, mouse
gcccggagcgcaggcgtcag

SEQ ID NO: 454245 - DNA, 20 bp, mouse
ggaagcccaagcgagcgcag

SEQ ID NO: 454246 - DNA, 20 bp, mouse
gcccgcaggacttcagtaag

SEQ ID NO: 454247 - DNA, 20 bp, mouse
ggcttcgcgtccggagggtg

SEQ ID NO: 454248 - DNA, 20 bp, mouse
ggcgtgtgcgggaggctgaa

SEQ ID NO: 454249 - DNA, 20 bp, mouse
gcgcgtccggagggtgggga

SEQ ID NO: 454250 - DNA, 20 bp, mouse
ggccgctgggcgaagtcctg

SEQ ID NO: 454251 - DNA, 20 bp, mouse
gcggcggcttcgcgtccgga

SEQ ID NO: 454252 - DNA, 20 bp, mouse
ggagctggggcaggtcgacc

SEQ ID NO: 454253 - DNA, 20 bp, mouse
ggccgcaggacttcgcccag

SEQ ID NO: 454254 - DNA, 20 bp, mouse
gtcaccggcggcgtcgaggg

SEQ ID NO: 454255 - DNA, 20 bp, mouse
gcgggaggtgctgcgtgtgc

SEQ ID NO: 454256 - DNA, 20 bp, mouse
gctggaggaaggaaacggga

SEQ ID NO: 454257 - DNA, 20 bp, mouse
gctcggaccgtccccgctag

SEQ ID NO: 454258 - DNA, 20 bp, mouse
gggctgtgcagcctctagcg

SEQ ID NO: 454259 - DNA, 20 bp, mouse
gagaggctgcacagcccgcc

SEQ ID NO: 454260 - DNA, 20 bp, mouse
ggagctgaggggacaagacg

SEQ ID NO: 454261 - DNA, 20 bp, mouse
gccccctggaggaaggaaac

SEQ ID NO: 454262 - DNA, 20 bp, mouse
ggggacaagacgcggagaag

SEQ ID NO: 454263 - DNA, 20 bp, mouse
gaaacgggagggcgccggcc

SEQ ID NO: 454264 - DNA, 20 bp, mouse
gtcagctctcgcgctcaggt

SEQ ID NO: 454265 - DNA, 20 bp, mouse
gggcacggcggcgggggtcc

SEQ ID NO: 454266 - DNA, 20 bp, mouse
gtgacaactgtaagaagagt

SEQ ID NO: 454267 - DNA, 20 bp, mouse
ggttgattatgtgaccgctc

SEQ ID NO: 454268 - DNA, 20 bp, mouse
gcccaccgcacacaatagac

SEQ ID NO: 454269 - DNA, 20 bp, mouse
gtcaaagtgcttttccagag

SEQ ID NO: 454270 - DNA, 20 bp, mouse
gctgcctgtataatttgatt

SEQ ID NO: 454271 - DNA, 20 bp, mouse
gcctccaaatcaaattatac

SEQ ID NO: 454272 - DNA, 20 bp, mouse
gaaagccggtctattgtgtg

SEQ ID NO: 454273 - DNA, 20 bp, mouse
gaaagatcatattaaaaggt

SEQ ID NO: 454274 - DNA, 20 bp, mouse
gctattgtgtgcggtggggg

SEQ ID NO: 454275 - DNA, 20 bp, mouse
ggccggtctattgtgtgcgg

SEQ ID NO: 454276 - DNA, 20 bp, mouse
ggaggagaaggactcagccg

SEQ ID NO: 454277 - DNA, 20 bp, mouse
gtgcccaggtcccgcagccg

SEQ ID NO: 454278 - DNA, 20 bp, mouse
gttcactcggctcggtcctg

SEQ ID NO: 454279 - DNA, 20 bp, mouse
gctgcgggaccggggaaaag

SEQ ID NO: 454280 - DNA, 20 bp, mouse
gcggcggcccagcaaccgtg

SEQ ID NO: 454281 - DNA, 20 bp, mouse
gaagagagcgcgagccgagg

SEQ ID NO: 454282 - DNA, 20 bp, mouse
gaaggactcagccgcggctg

SEQ ID NO: 454283 - DNA, 20 bp, mouse
gtcgaaccggaagtgtctct

SEQ ID NO: 454284 - DNA, 20 bp, mouse
gagctggttgtcatttcact

SEQ ID NO: 454285 - DNA, 20 bp, mouse
gttccggttcgatgagggag

SEQ ID NO: 454286 - DNA, 20 bp, mouse
gacagacacgcgcagactcg

SEQ ID NO: 454287 - DNA, 20 bp, mouse
ggcgcgtgccagctgcacac

SEQ ID NO: 454288 - DNA, 20 bp, mouse
gagcgatggcccaggtcctc

SEQ ID NO: 454289 - DNA, 20 bp, mouse
gtgcacacagggccgagagc

SEQ ID NO: 454290 - DNA, 20 bp, mouse
gccgccccgctcggcctggg

SEQ ID NO: 454291 - DNA, 20 bp, mouse
gggccgagagccggaggacc

SEQ ID NO: 454292 - DNA, 20 bp, mouse
ggaaggaaacacccaggcgt

SEQ ID NO: 454293 - DNA, 20 bp, mouse
ggcggggcggagctaaacta

SEQ ID NO: 454294 - DNA, 20 bp, mouse
gtcggcctgggtggcagcga

SEQ ID NO: 454295 - DNA, 20 bp, mouse
gttcatctcactctcacgca

SEQ ID NO: 454296 - DNA, 20 bp, mouse
ggagcaaggtctgagattgg

SEQ ID NO: 454297 - DNA, 20 bp, mouse
gaccgagcaaggtctgagat

SEQ ID NO: 454298 - DNA, 20 bp, mouse
gcttagggtgtggctgggga

SEQ ID NO: 454299 - DNA, 20 bp, mouse
gcagggatgtctagcctcta

SEQ ID NO: 454300 - DNA, 20 bp, mouse
gtgtagggagaatgtgtcct

SEQ ID NO: 454301 - DNA, 20 bp, mouse
gagtgcgcgtccaagctgta

SEQ ID NO: 454302 - DNA, 20 bp, mouse
gggtgcttagggtgtggctg

SEQ ID NO: 454303 - DNA, 20 bp, mouse
gctctcttctgcaccgagca

SEQ ID NO: 454304 - DNA, 20 bp, mouse
gttggacgcgcactgcatct

SEQ ID NO: 454305 - DNA, 20 bp, mouse
gaaagtaagttgcttggtaa

SEQ ID NO: 454306 - DNA, 20 bp, mouse
ggagcaaggtctgagattgg

SEQ ID NO: 454307 - DNA, 20 bp, mouse
gaccgagcaaggtctgagat

SEQ ID NO: 454308 - DNA, 20 bp, mouse
gcttagggtgtggctgggga

SEQ ID NO: 454309 - DNA, 20 bp, mouse
gcagggatgtctagcctcta

SEQ ID NO: 454310 - DNA, 20 bp, mouse
gtgtagggagaatgtgtcct

SEQ ID NO: 454311 - DNA, 20 bp, mouse
gagtgcgcgtccaagctgta

SEQ ID NO: 454312 - DNA, 20 bp, mouse
gggtgcttagggtgtggctg

SEQ ID NO: 454313 - DNA, 20 bp, mouse
gctctcttctgcaccgagca

SEQ ID NO: 454314 - DNA, 20 bp, mouse
gttggacgcgcactgcatct

SEQ ID NO: 454315 - DNA, 20 bp, mouse
gaaagtaagttgcttggtaa

SEQ ID NO: 454316 - DNA, 20 bp, mouse
gcagagatgaggccgggcag

SEQ ID NO: 454317 - DNA, 20 bp, mouse
gaaaaagaaaaacagagatg

SEQ ID NO: 454318 - DNA, 20 bp, mouse
gagaaaaacagagatgaggc

SEQ ID NO: 454319 - DNA, 20 bp, mouse
ggagcaaggtctgagattgg

SEQ ID NO: 454320 - DNA, 20 bp, mouse
gaccgagcaaggtctgagat

SEQ ID NO: 454321 - DNA, 20 bp, mouse
gaaagtaagttgcttggtaa

SEQ ID NO: 454322 - DNA, 20 bp, mouse
gagctacagaagccatagtt

SEQ ID NO: 454323 - DNA, 20 bp, mouse
gatagaggctagacatccct

SEQ ID NO: 454324 - DNA, 20 bp, mouse
gttggtaagggaccaaacta

SEQ ID NO: 454325 - DNA, 20 bp, mouse
gagtgcgcgtccaagctgta

SEQ ID NO: 454326 - DNA, 20 bp, mouse
ggagcaaggtctgagattgg

SEQ ID NO: 454327 - DNA, 20 bp, mouse
gaccgagcaaggtctgagat

SEQ ID NO: 454328 - DNA, 20 bp, mouse
gcttagggtgtggctgggga

SEQ ID NO: 454329 - DNA, 20 bp, mouse
gcagggatgtctagcctcta

SEQ ID NO: 454330 - DNA, 20 bp, mouse
gtgtagggagaatgtgtcct

SEQ ID NO: 454331 - DNA, 20 bp, mouse
gagtgcgcgtccaagctgta

SEQ ID NO: 454332 - DNA, 20 bp, mouse
gggtgcttagggtgtggctg

SEQ ID NO: 454333 - DNA, 20 bp, mouse
gctctcttctgcaccgagca

SEQ ID NO: 454334 - DNA, 20 bp, mouse
gttggacgcgcactgcatct

SEQ ID NO: 454335 - DNA, 20 bp, mouse
gaaagtaagttgcttggtaa

SEQ ID NO: 454336 - DNA, 20 bp, mouse
gcaggccggcggggtccatg

SEQ ID NO: 454337 - DNA, 20 bp, mouse
gaggagggcgcgtcactcag

SEQ ID NO: 454338 - DNA, 20 bp, mouse
gcagcagcgcgctctcaggc

SEQ ID NO: 454339 - DNA, 20 bp, mouse
ggggcgccggttaccttcca

SEQ ID NO: 454340 - DNA, 20 bp, mouse
gcgccggttaccttccaagg

SEQ ID NO: 454341 - DNA, 20 bp, mouse
gagcgccacatggaccccgc

SEQ ID NO: 454342 - DNA, 20 bp, mouse
ggggaacctaggatatgggt

SEQ ID NO: 454343 - DNA, 20 bp, mouse
ggagtgacgcgccctcctcg

SEQ ID NO: 454344 - DNA, 20 bp, mouse
gagcagcacagagcgccaca

SEQ ID NO: 454345 - DNA, 20 bp, mouse
gaccttgggtctgaaagaca

SEQ ID NO: 454346 - DNA, 20 bp, mouse
gtgcctggcggagttacacc

SEQ ID NO: 454347 - DNA, 20 bp, mouse
gaccaggcagcggcgcgagc

SEQ ID NO: 454348 - DNA, 20 bp, mouse
gagccctgcagtggcttaga

SEQ ID NO: 454349 - DNA, 20 bp, mouse
gaaccgtctaagccactgca

SEQ ID NO: 454350 - DNA, 20 bp, mouse
gaactccgccaggcaagctg

SEQ ID NO: 454351 - DNA, 20 bp, mouse
gcgctggagctgcagactcg

SEQ ID NO: 454352 - DNA, 20 bp, mouse
gcaccacagcgagcgggtag

SEQ ID NO: 454353 - DNA, 20 bp, mouse
gcgggcagtgtagctttgag

SEQ ID NO: 454354 - DNA, 20 bp, mouse
gtgtagcagagggtccggga

SEQ ID NO: 454355 - DNA, 20 bp, mouse
gcccacggccagcaccgacc

SEQ ID NO: 454356 - DNA, 20 bp, mouse
gtaagtcccggggacagctc

SEQ ID NO: 454357 - DNA, 20 bp, mouse
gcgggacttagtgctgaagt

SEQ ID NO: 454358 - DNA, 20 bp, mouse
gcgcaaccggagctgtcccc

SEQ ID NO: 454359 - DNA, 20 bp, mouse
gggaccagtgctcaaagcgt

SEQ ID NO: 454360 - DNA, 20 bp, mouse
gaagtaggcgctgacgaacc

SEQ ID NO: 454361 - DNA, 20 bp, mouse
gtggggcgcgagctcgcaac

SEQ ID NO: 454362 - DNA, 20 bp, mouse
gcggtggtcagaaaagacca

SEQ ID NO: 454363 - DNA, 20 bp, mouse
gagtctgcagccgaagcaca

SEQ ID NO: 454364 - DNA, 20 bp, mouse
gggtgggtgtagcagcgtga

SEQ ID NO: 454365 - DNA, 20 bp, mouse
gggagggttttgggaaggta

SEQ ID NO: 454366 - DNA, 20 bp, mouse
gtccaagggcacagcggcag

SEQ ID NO: 454367 - DNA, 20 bp, mouse
gcgcagcctcctctgtccaa

SEQ ID NO: 454368 - DNA, 20 bp, mouse
gtccttcgctcccaaatgtg

SEQ ID NO: 454369 - DNA, 20 bp, mouse
gggcacctcagaccccgcgg

SEQ ID NO: 454370 - DNA, 20 bp, mouse
gggctgtggttgaaaatatt

SEQ ID NO: 454371 - DNA, 20 bp, mouse
gccatcagcccgggcactga

SEQ ID NO: 454372 - DNA, 20 bp, mouse
ggctaaagggatgactagag

SEQ ID NO: 454373 - DNA, 20 bp, mouse
gttagccgccgcggggtctg

SEQ ID NO: 454374 - DNA, 20 bp, mouse
gctgtatcagtagcatccgg

SEQ ID NO: 454375 - DNA, 20 bp, mouse
gagaggtagagtcaaaggaa

SEQ ID NO: 454376 - DNA, 20 bp, mouse
gggagacgcgcgcctggtac

SEQ ID NO: 454377 - DNA, 20 bp, mouse
gcctccgaggagccaggtga

SEQ ID NO: 454378 - DNA, 20 bp, mouse
gactggtgaggtttgcggaa

SEQ ID NO: 454379 - DNA, 20 bp, mouse
gcgcgcgcctggtactggtg

SEQ ID NO: 454380 - DNA, 20 bp, mouse
gctgctgcggggactcgggc

SEQ ID NO: 454381 - DNA, 20 bp, mouse
gcgggctgcggggctccggt

SEQ ID NO: 454382 - DNA, 20 bp, mouse
gcgcaaacctcaccagtacc

SEQ ID NO: 454383 - DNA, 20 bp, mouse
ggcggtccatgtcctagaga

SEQ ID NO: 454384 - DNA, 20 bp, mouse
gctctacgctccctcctccg

SEQ ID NO: 454385 - DNA, 20 bp, mouse
gcagcagaagccccagccac

SEQ ID NO: 454386 - DNA, 20 bp, mouse
gatctcgcggagcttctaag

SEQ ID NO: 454387 - DNA, 20 bp, mouse
ggatagccacaataccctcc

SEQ ID NO: 454388 - DNA, 20 bp, mouse
gggcttccagatttaggagg

SEQ ID NO: 454389 - DNA, 20 bp, mouse
gaagggcttccagatttagg

SEQ ID NO: 454390 - DNA, 20 bp, mouse
ggattgcttagagagcggga

SEQ ID NO: 454391 - DNA, 20 bp, mouse
gatgagcccggagggtattg

SEQ ID NO: 454392 - DNA, 20 bp, mouse
gggaagagaaatgagcccgg

SEQ ID NO: 454393 - DNA, 20 bp, mouse
ggggtattgtggctatcctg

SEQ ID NO: 454394 - DNA, 20 bp, mouse
gctgtgctctggatccagac

SEQ ID NO: 454395 - DNA, 20 bp, mouse
gcatcgggcgcagtgtgaag

SEQ ID NO: 454396 - DNA, 20 bp, mouse
gggctagctgatccactcaa

SEQ ID NO: 454397 - DNA, 20 bp, mouse
gcaggtggggccagaagccc

SEQ ID NO: 454398 - DNA, 20 bp, mouse
ggcaggtggcctaccgtgag

SEQ ID NO: 454399 - DNA, 20 bp, mouse
gtgtttccgaggaaaaacca

SEQ ID NO: 454400 - DNA, 20 bp, mouse
ggggagccaggtgtgaacgg

SEQ ID NO: 454401 - DNA, 20 bp, mouse
gctgcccagcccctcacggt

SEQ ID NO: 454402 - DNA, 20 bp, mouse
gtggcctaccgtgaggggct

SEQ ID NO: 454403 - DNA, 20 bp, mouse
gcaggggagccaggtgtgaa

SEQ ID NO: 454404 - DNA, 20 bp, mouse
gagaagccctggtttttcct

SEQ ID NO: 454405 - DNA, 20 bp, mouse
ggcttccccttgcaggtaag

SEQ ID NO: 454406 - DNA, 20 bp, mouse
ggaagcggctgtggaggtgt

SEQ ID NO: 454407 - DNA, 20 bp, mouse
gccgacagccccagcccgaa

SEQ ID NO: 454408 - DNA, 20 bp, mouse
gccgccccgaggcaccaagg

SEQ ID NO: 454409 - DNA, 20 bp, mouse
gggctccgggaaagccgttc

SEQ ID NO: 454410 - DNA, 20 bp, mouse
ggccccgccccgaggcacca

SEQ ID NO: 454411 - DNA, 20 bp, mouse
gtgcccggtggtcctgagag

SEQ ID NO: 454412 - DNA, 20 bp, mouse
gggaacgcggagcgccggag

SEQ ID NO: 454413 - DNA, 20 bp, mouse
gccagcccgaacggctttcc

SEQ ID NO: 454414 - DNA, 20 bp, mouse
ggactcccgcagccccggaa

SEQ ID NO: 454415 - DNA, 20 bp, mouse
gttttgtgaagcggctgtgg

SEQ ID NO: 454416 - DNA, 20 bp, mouse
gcccgggcgagcgcacgagt

SEQ ID NO: 454417 - DNA, 20 bp, mouse
ggcgagcgcacgagtgggta

SEQ ID NO: 454418 - DNA, 20 bp, mouse
gcgagtgggtacggccgcgc

SEQ ID NO: 454419 - DNA, 20 bp, mouse
gtcggcctggggcttggagg

SEQ ID NO: 454420 - DNA, 20 bp, mouse
gccctctagacatctaacgg

SEQ ID NO: 454421 - DNA, 20 bp, mouse
ggctcagggcgctacccgcg

SEQ ID NO: 454422 - DNA, 20 bp, mouse
ggggcggcggccagggacat

SEQ ID NO: 454423 - DNA, 20 bp, mouse
gtccagtcgagggaggatgt

SEQ ID NO: 454424 - DNA, 20 bp, mouse
gcgctgtgctgtcggccggg

SEQ ID NO: 454425 - DNA, 20 bp, mouse
ggggccgccggggcatcccc

SEQ ID NO: 454426 - DNA, 20 bp, mouse
ggccagcgaggagcaccgca

SEQ ID NO: 454427 - DNA, 20 bp, mouse
gcaaggcggcaggaccgcag

SEQ ID NO: 454428 - DNA, 20 bp, mouse
gagcgaggagcaccgcaagg

SEQ ID NO: 454429 - DNA, 20 bp, mouse
gcgccgcagaagtcgagtga

SEQ ID NO: 454430 - DNA, 20 bp, mouse
gcgcagaagtcgagtgaggg

SEQ ID NO: 454431 - DNA, 20 bp, mouse
gactcgggagtccccagagt

SEQ ID NO: 454432 - DNA, 20 bp, mouse
gggttccagtaaagcccctg

SEQ ID NO: 454433 - DNA, 20 bp, mouse
gagtgggcaccggaaaccca

SEQ ID NO: 454434 - DNA, 20 bp, mouse
gcctccgcggtccagccctc

SEQ ID NO: 454435 - DNA, 20 bp, mouse
gaggaccgcaggggctttac

SEQ ID NO: 454436 - DNA, 20 bp, mouse
gcggcgtggaaggagctgct

SEQ ID NO: 454437 - DNA, 20 bp, mouse
gagagggtgaacggcgtgga

SEQ ID NO: 454438 - DNA, 20 bp, mouse
gaggaactcgctgagtaaag

SEQ ID NO: 454439 - DNA, 20 bp, mouse
gactcgctgagtaaagagga

SEQ ID NO: 454440 - DNA, 20 bp, mouse
gcccccagtggaccaaagag

SEQ ID NO: 454441 - DNA, 20 bp, mouse
gagccccaagaatggagtcg

SEQ ID NO: 454442 - DNA, 20 bp, mouse
gctctgaggctggcacaccc

SEQ ID NO: 454443 - DNA, 20 bp, mouse
ggtagttgtaaagaggtctt

SEQ ID NO: 454444 - DNA, 20 bp, mouse
ggctagaagctgccatctcc

SEQ ID NO: 454445 - DNA, 20 bp, mouse
ggctgggctgctgggcgcaa

SEQ ID NO: 454446 - DNA, 20 bp, mouse
gaggcgctggcggcgactca

SEQ ID NO: 454447 - DNA, 20 bp, mouse
gggagccggagccctagcag

SEQ ID NO: 454448 - DNA, 20 bp, mouse
ggggggcccgaggagaaacg

SEQ ID NO: 454449 - DNA, 20 bp, mouse
gggagaggagcgcgaagagg

SEQ ID NO: 454450 - DNA, 20 bp, mouse
ggctgcagccgctccggagg

SEQ ID NO: 454451 - DNA, 20 bp, mouse
ggggcgcggcgagggaaccc

SEQ ID NO: 454452 - DNA, 20 bp, mouse
gggagccctagcagaggacg

SEQ ID NO: 454453 - DNA, 20 bp, mouse
gctgcgccccaagcccgagg

SEQ ID NO: 454454 - DNA, 20 bp, mouse
gcgagggaacccaggcgcag

SEQ ID NO: 454455 - DNA, 20 bp, mouse
gccggagcggctgcagccct

SEQ ID NO: 454456 - DNA, 20 bp, mouse
gtggagcagcgaggaagtca

SEQ ID NO: 454457 - DNA, 20 bp, mouse
gagcgaggaagtcaggggca

SEQ ID NO: 454458 - DNA, 20 bp, mouse
gtcacctgggctcttagtgg

SEQ ID NO: 454459 - DNA, 20 bp, mouse
gaagactgcagactggagag

SEQ ID NO: 454460 - DNA, 20 bp, mouse
ggagccggagctggcgccag

SEQ ID NO: 454461 - DNA, 20 bp, mouse
gaacgtggagcccgtgaggt

SEQ ID NO: 454462 - DNA, 20 bp, mouse
gatgcccctgcctacctcac

SEQ ID NO: 454463 - DNA, 20 bp, mouse
gcggagctggcgccagcggc

SEQ ID NO: 454464 - DNA, 20 bp, mouse
gggctcacctgggctcttag

SEQ ID NO: 454465 - DNA, 20 bp, mouse
gctggttctgacagagacac

SEQ ID NO: 454466 - DNA, 20 bp, mouse
ggcggagcctgaagcatgag

SEQ ID NO: 454467 - DNA, 20 bp, mouse
gagggccagtggctacaggt

SEQ ID NO: 454468 - DNA, 20 bp, mouse
ggctccgcactcgaaccggt

SEQ ID NO: 454469 - DNA, 20 bp, mouse
ggtgggcgccggagaaatgg

SEQ ID NO: 454470 - DNA, 20 bp, mouse
ggcgcccaccggttcgagtg

SEQ ID NO: 454471 - DNA, 20 bp, mouse
gtcaggctccgcactcgaac

SEQ ID NO: 454472 - DNA, 20 bp, mouse
gtgaagcatgagcggcgact

SEQ ID NO: 454473 - DNA, 20 bp, mouse
gccggtgggcgccggagaaa

SEQ ID NO: 454474 - DNA, 20 bp, mouse
gaagcgcccaggctagacta

SEQ ID NO: 454475 - DNA, 20 bp, mouse
gccagtggctacaggtaggg

SEQ ID NO: 454476 - DNA, 20 bp, mouse
gtccatctcgagctgaggaa

SEQ ID NO: 454477 - DNA, 20 bp, mouse
gcccgccgcagcttggatgt

SEQ ID NO: 454478 - DNA, 20 bp, mouse
gcgtagggcgcagagacagt

SEQ ID NO: 454479 - DNA, 20 bp, mouse
gagctccgcaccgacgggaa

SEQ ID NO: 454480 - DNA, 20 bp, mouse
gtagcgctccaggtaccacg

SEQ ID NO: 454481 - DNA, 20 bp, mouse
gcaccctcaccccttcccgt

SEQ ID NO: 454482 - DNA, 20 bp, mouse
ggtggggagcatatcagctg

SEQ ID NO: 454483 - DNA, 20 bp, mouse
ggcccacatccaagctgcgg

SEQ ID NO: 454484 - DNA, 20 bp, mouse
gggctactggactgatgtgg

SEQ ID NO: 454485 - DNA, 20 bp, mouse
gggctgtccatctcgagctg

SEQ ID NO: 454486 - DNA, 20 bp, mouse
ggaggccggcccatgtgcgg

SEQ ID NO: 454487 - DNA, 20 bp, mouse
ggagcagcggagcgcacaca

SEQ ID NO: 454488 - DNA, 20 bp, mouse
gggcccatgtgcggaggcag

SEQ ID NO: 454489 - DNA, 20 bp, mouse
gccccgggtgccgaagctag

SEQ ID NO: 454490 - DNA, 20 bp, mouse
gactgtcagggcgcgagcag

SEQ ID NO: 454491 - DNA, 20 bp, mouse
gagcggagcgcacacaaggc

SEQ ID NO: 454492 - DNA, 20 bp, mouse
ggcagctgcgggttcagtgt

SEQ ID NO: 454493 - DNA, 20 bp, mouse
ggtgccgaagctaggggcgg

SEQ ID NO: 454494 - DNA, 20 bp, mouse
gagccgctgcctccgcacat

SEQ ID NO: 454495 - DNA, 20 bp, mouse
gcccagcgcggcccgctcac

SEQ ID NO: 454496 - DNA, 20 bp, mouse
ggaagagctgctgcgagtgt

SEQ ID NO: 454497 - DNA, 20 bp, mouse
ggtgcaggaggcgataggac

SEQ ID NO: 454498 - DNA, 20 bp, mouse
gactccccagcactgctacg

SEQ ID NO: 454499 - DNA, 20 bp, mouse
gactccacgtagcagtgctg

SEQ ID NO: 454500 - DNA, 20 bp, mouse
gtccgatcctgcagacccac

SEQ ID NO: 454501 - DNA, 20 bp, mouse
gatggtgcccaagagctcgg

SEQ ID NO: 454502 - DNA, 20 bp, mouse
gtaggtcgcaggctgctggc

SEQ ID NO: 454503 - DNA, 20 bp, mouse
ggtctgggtctcaggaccct

SEQ ID NO: 454504 - DNA, 20 bp, mouse
gcgctgcacgtgcccaaagg

SEQ ID NO: 454505 - DNA, 20 bp, mouse
gggcagctggcagacgcggg

SEQ ID NO: 454506 - DNA, 20 bp, mouse
ggccatgtccgctatggagg

SEQ ID NO: 454507 - DNA, 20 bp, mouse
ggccgcctccatagcggaca

SEQ ID NO: 454508 - DNA, 20 bp, mouse
gtcgctcgccatgtccgcta

SEQ ID NO: 454509 - DNA, 20 bp, mouse
ggcgtccagggtcctgcccc

SEQ ID NO: 454510 - DNA, 20 bp, mouse
gacatccgccgcctccatag

SEQ ID NO: 454511 - DNA, 20 bp, mouse
gtctatccggatcccttcgt

SEQ ID NO: 454512 - DNA, 20 bp, mouse
gcacagaacgtgcccaggca

SEQ ID NO: 454513 - DNA, 20 bp, mouse
ggctgtgtgcaacccacgaa

SEQ ID NO: 454514 - DNA, 20 bp, mouse
gcccgcccggccctcctgga

SEQ ID NO: 454515 - DNA, 20 bp, mouse
ggaagcacccaacactgcga

SEQ ID NO: 454516 - DNA, 20 bp, mouse
gcagcagcggccacaacacc

SEQ ID NO: 454517 - DNA, 20 bp, mouse
ggcggccacaacacccggtg

SEQ ID NO: 454518 - DNA, 20 bp, mouse
gacctgatcacgaggctctg

SEQ ID NO: 454519 - DNA, 20 bp, mouse
ggggcactcacctgatcacg

SEQ ID NO: 454520 - DNA, 20 bp, mouse
ggaagctcctaggcagtcca

SEQ ID NO: 454521 - DNA, 20 bp, mouse
gagaccacaggcacgttcgg

SEQ ID NO: 454522 - DNA, 20 bp, mouse
gtgagtgccccccaggctgt

SEQ ID NO: 454523 - DNA, 20 bp, mouse
ggcagtctcgtcctatgcaa

SEQ ID NO: 454524 - DNA, 20 bp, mouse
gtgtggtctgcaggcctcac

SEQ ID NO: 454525 - DNA, 20 bp, mouse
gccaggcctgcagactactg

SEQ ID NO: 454526 - DNA, 20 bp, mouse
gtgtggcgacagtacagttg

SEQ ID NO: 454527 - DNA, 20 bp, mouse
gacagtacagttgaggctgt

SEQ ID NO: 454528 - DNA, 20 bp, mouse
gacactggttacaaacaaat

SEQ ID NO: 454529 - DNA, 20 bp, mouse
gcatcagacacaagaaacag

SEQ ID NO: 454530 - DNA, 20 bp, mouse
gacacagctttctttcacac

SEQ ID NO: 454531 - DNA, 20 bp, mouse
ggtgactacgaagcgacagt

SEQ ID NO: 454532 - DNA, 20 bp, mouse
ggggtgttaccttcacagaa

SEQ ID NO: 454533 - DNA, 20 bp, mouse
gtgccctgtcagcaccacat

SEQ ID NO: 454534 - DNA, 20 bp, mouse
ggtgtctgatgataatgcac

SEQ ID NO: 454535 - DNA, 20 bp, mouse
gtgtcgcttcgtagtcacat

SEQ ID NO: 454536 - DNA, 20 bp, mouse
gggctccggcgtgacagtgg

SEQ ID NO: 454537 - DNA, 20 bp, mouse
gggcggctccggcgtgacag

SEQ ID NO: 454538 - DNA, 20 bp, mouse
gtccctgtcccccgagtcgg

SEQ ID NO: 454539 - DNA, 20 bp, mouse
gtggtaaactccagcccggt

SEQ ID NO: 454540 - DNA, 20 bp, mouse
gagtggcggcgacatgtacg

SEQ ID NO: 454541 - DNA, 20 bp, mouse
gccgtccctgtcccccgagt

SEQ ID NO: 454542 - DNA, 20 bp, mouse
gcgccggagccgccgactcg

SEQ ID NO: 454543 - DNA, 20 bp, mouse
gatgtacgcggtgtacaagc

SEQ ID NO: 454544 - DNA, 20 bp, mouse
ggtcgccgccactgtcacgc

SEQ ID NO: 454545 - DNA, 20 bp, mouse
gaggatgaggccaaacaacg

SEQ ID NO: 454546 - DNA, 20 bp, mouse
ggatggcggccaccacacag

SEQ ID NO: 454547 - DNA, 20 bp, mouse
gagagctagcgcgcgctcag

SEQ ID NO: 454548 - DNA, 20 bp, mouse
gctgctcaggcccaagatgg

SEQ ID NO: 454549 - DNA, 20 bp, mouse
gggcaggagcccctgtgtgg

SEQ ID NO: 454550 - DNA, 20 bp, mouse
gatcttgggcctgagcagag

SEQ ID NO: 454551 - DNA, 20 bp, mouse
ggttgggaggaggccctcaa

SEQ ID NO: 454552 - DNA, 20 bp, mouse
gcccctagtggaacgcaggt

SEQ ID NO: 454553 - DNA, 20 bp, mouse
ggtgtggtggccgccatctt

SEQ ID NO: 454554 - DNA, 20 bp, mouse
ggtgaggacgggagacggaa

SEQ ID NO: 454555 - DNA, 20 bp, mouse
gggcctgagcagagcggctg

SEQ ID NO: 454556 - DNA, 20 bp, mouse
gcctggagggacccccgcgg

SEQ ID NO: 454557 - DNA, 20 bp, mouse
gagcgccggaagttgtgtgt

SEQ ID NO: 454558 - DNA, 20 bp, mouse
ggagcctggagggacccccg

SEQ ID NO: 454559 - DNA, 20 bp, mouse
ggccggaagttgtgtgttgg

SEQ ID NO: 454560 - DNA, 20 bp, mouse
gtctagcgcatcccttacag

SEQ ID NO: 454561 - DNA, 20 bp, mouse
ggagggccgaatctagctcc

SEQ ID NO: 454562 - DNA, 20 bp, mouse
ggctttgaatttagagactg

SEQ ID NO: 454563 - DNA, 20 bp, mouse
gtccgggaacgctagagcgc

SEQ ID NO: 454564 - DNA, 20 bp, mouse
ggcgttcccggagctagatt

SEQ ID NO: 454565 - DNA, 20 bp, mouse
ggctgatccgacccctgtaa

SEQ ID NO: 454566 - DNA, 20 bp, mouse
gccgcccgcaggagagccgc

SEQ ID NO: 454567 - DNA, 20 bp, mouse
gtggcacccagcatacacct

SEQ ID NO: 454568 - DNA, 20 bp, mouse
gcaccatcggaacccatctc

SEQ ID NO: 454569 - DNA, 20 bp, mouse
gggcgtccggagagtcggat

SEQ ID NO: 454570 - DNA, 20 bp, mouse
gctgcctgcggctctcctgc

SEQ ID NO: 454571 - DNA, 20 bp, mouse
ggcctcgaaccacggctcca

SEQ ID NO: 454572 - DNA, 20 bp, mouse
ggcgtagcagcaagccaggg

SEQ ID NO: 454573 - DNA, 20 bp, mouse
ggggaggtcgcctcgaacca

SEQ ID NO: 454574 - DNA, 20 bp, mouse
gaggactcggactcacccaa

SEQ ID NO: 454575 - DNA, 20 bp, mouse
gcgcgcgcggggtctgcctg

SEQ ID NO: 454576 - DNA, 20 bp, mouse
gcggcaagcgagaaggggac

SEQ ID NO: 454577 - DNA, 20 bp, mouse
gggtggcggcaagcgagaag

SEQ ID NO: 454578 - DNA, 20 bp, mouse
gtagcgtgagttgcggagag

SEQ ID NO: 454579 - DNA, 20 bp, mouse
gagcggctgagagacctgag

SEQ ID NO: 454580 - DNA, 20 bp, mouse
gggagaggtagcgtgagttg

SEQ ID NO: 454581 - DNA, 20 bp, mouse
gtcgggcccagctccccctc

SEQ ID NO: 454582 - DNA, 20 bp, mouse
gcactatccatgccggggaa

SEQ ID NO: 454583 - DNA, 20 bp, mouse
gggcatccctcgcggggcgg

SEQ ID NO: 454584 - DNA, 20 bp, mouse
gggacggaagcggaggaact

SEQ ID NO: 454585 - DNA, 20 bp, mouse
gcccggggatcaaggatcca

SEQ ID NO: 454586 - DNA, 20 bp, mouse
gaggaagaggtgacctgaga

SEQ ID NO: 454587 - DNA, 20 bp, mouse
gcagtcacctggccccttga

SEQ ID NO: 454588 - DNA, 20 bp, mouse
ggaggggccagcatcagata

SEQ ID NO: 454589 - DNA, 20 bp, mouse
gcctggccccttgaaggaag

SEQ ID NO: 454590 - DNA, 20 bp, mouse
gcctgagagggtgagaaaga

SEQ ID NO: 454591 - DNA, 20 bp, mouse
gggcgggagacggaagatgg

SEQ ID NO: 454592 - DNA, 20 bp, mouse
gtggctgagtgtacccccag

SEQ ID NO: 454593 - DNA, 20 bp, mouse
gtggatgtggaatcgcagaa

SEQ ID NO: 454594 - DNA, 20 bp, mouse
gggcagccgaggagcctctg

SEQ ID NO: 454595 - DNA, 20 bp, mouse
ggattccacatccagctcaa

SEQ ID NO: 454596 - DNA, 20 bp, mouse
gggccgaggccgagggaaga

SEQ ID NO: 454597 - DNA, 20 bp, mouse
gcgcggcccggaggcgccaa

SEQ ID NO: 454598 - DNA, 20 bp, mouse
gaccgtccgccatcttccct

SEQ ID NO: 454599 - DNA, 20 bp, mouse
gtccgctgctgctgcctcgg

SEQ ID NO: 454600 - DNA, 20 bp, mouse
gcgccatcttccctcggcct

SEQ ID NO: 454601 - DNA, 20 bp, mouse
ggaggcagcagcagcggatc

SEQ ID NO: 454602 - DNA, 20 bp, mouse
gcgggccgcggcacagtctg

SEQ ID NO: 454603 - DNA, 20 bp, mouse
gaaacgacgcgcgagaacaa

SEQ ID NO: 454604 - DNA, 20 bp, mouse
gaccgtccggaggaaccggg

SEQ ID NO: 454605 - DNA, 20 bp, mouse
gcccgccaccgagccaacaa

SEQ ID NO: 454606 - DNA, 20 bp, mouse
gcccgttaccgggaatatgg

SEQ ID NO: 454607 - DNA, 20 bp, mouse
ggcctagtcgggactctccg

SEQ ID NO: 454608 - DNA, 20 bp, mouse
ggccgcggagagtcccgact

SEQ ID NO: 454609 - DNA, 20 bp, mouse
ggttaccgggaatatggcgg

SEQ ID NO: 454610 - DNA, 20 bp, mouse
ggcccccgttaccgggaata

SEQ ID NO: 454611 - DNA, 20 bp, mouse
gaggtcctggagctgtggga

SEQ ID NO: 454612 - DNA, 20 bp, mouse
ggccgcgcgcccccgttacc

SEQ ID NO: 454613 - DNA, 20 bp, mouse
gtggcggcggcggaagacag

SEQ ID NO: 454614 - DNA, 20 bp, mouse
gagcagggcaggcctagcct

SEQ ID NO: 454615 - DNA, 20 bp, mouse
gcgcgcgcttcgggcctagt

SEQ ID NO: 454616 - DNA, 20 bp, mouse
gactcggtaagacaccgcga

SEQ ID NO: 454617 - DNA, 20 bp, mouse
gttaccgagtctgcagacgg

SEQ ID NO: 454618 - DNA, 20 bp, mouse
gcacccgcgcgcccagccca

SEQ ID NO: 454619 - DNA, 20 bp, mouse
gccgagtctgcagacggcgg

SEQ ID NO: 454620 - DNA, 20 bp, mouse
gtgccgcagcgctgccctcg

SEQ ID NO: 454621 - DNA, 20 bp, mouse
gagtctgcagacggcggcgg

SEQ ID NO: 454622 - DNA, 20 bp, mouse
ggtcttaccgagtctgcaga

SEQ ID NO: 454623 - DNA, 20 bp, mouse
gcggctcacgcgtaccctac

SEQ ID NO: 454624 - DNA, 20 bp, mouse
gaggtcccacgcgtcccgag

SEQ ID NO: 454625 - DNA, 20 bp, mouse
ggaatgagcgagcggagtcc

SEQ ID NO: 454626 - DNA, 20 bp, mouse
gggtccccaactcacagctc

SEQ ID NO: 454627 - DNA, 20 bp, mouse
gctggctccaggcgccccaa

SEQ ID NO: 454628 - DNA, 20 bp, mouse
ggtggggacatgggccagag

SEQ ID NO: 454629 - DNA, 20 bp, mouse
gcgggcaagccgatcagcaa

SEQ ID NO: 454630 - DNA, 20 bp, mouse
ggcaaacctgagctgtgagt

SEQ ID NO: 454631 - DNA, 20 bp, mouse
gagctcaggtttgcttctgt

SEQ ID NO: 454632 - DNA, 20 bp, mouse
ggaagtgctgtgggatggaa

SEQ ID NO: 454633 - DNA, 20 bp, mouse
ggcgccccaagggcagcgaa

SEQ ID NO: 454634 - DNA, 20 bp, mouse
gccccaagggcagcgaaggg

SEQ ID NO: 454635 - DNA, 20 bp, mouse
gatagcttggctgagagtaa

SEQ ID NO: 454636 - DNA, 20 bp, mouse
ggcgcccgcgaggtgtctct

SEQ ID NO: 454637 - DNA, 20 bp, mouse
gtcaggataacagccaaaga

SEQ ID NO: 454638 - DNA, 20 bp, mouse
gaaacccagagacacctcgc

SEQ ID NO: 454639 - DNA, 20 bp, mouse
ggaggcggggataaaaccta

SEQ ID NO: 454640 - DNA, 20 bp, mouse
gaacgcggagggatcggagg

SEQ ID NO: 454641 - DNA, 20 bp, mouse
gctagtaccaggtacaggag

SEQ ID NO: 454642 - DNA, 20 bp, mouse
ggggccagaacacccagttc

SEQ ID NO: 454643 - DNA, 20 bp, mouse
gctggtactagtacttacac

SEQ ID NO: 454644 - DNA, 20 bp, mouse
ggtgttggggcaggcgagta

SEQ ID NO: 454645 - DNA, 20 bp, mouse
gtagtacttacaccggtcag

SEQ ID NO: 454646 - DNA, 20 bp, mouse
gtggcggcttgaggacgcgg

SEQ ID NO: 454647 - DNA, 20 bp, mouse
gtgcccggaagtgcccctgt

SEQ ID NO: 454648 - DNA, 20 bp, mouse
gtcgtcccgggcggcaatgg

SEQ ID NO: 454649 - DNA, 20 bp, mouse
gggctcccaggacaagcgag

SEQ ID NO: 454650 - DNA, 20 bp, mouse
gggacaagcgaggggcaccg

SEQ ID NO: 454651 - DNA, 20 bp, mouse
gtcatcgtcccgggcggcaa

SEQ ID NO: 454652 - DNA, 20 bp, mouse
gcaatggcggcttgaggacg

SEQ ID NO: 454653 - DNA, 20 bp, mouse
gagttcaactccgcccacag

SEQ ID NO: 454654 - DNA, 20 bp, mouse
gtgtcctgggagcccctagt

SEQ ID NO: 454655 - DNA, 20 bp, mouse
gaagtctctacgggtgtccc

SEQ ID NO: 454656 - DNA, 20 bp, mouse
gcaggtagctatgaggaata

SEQ ID NO: 454657 - DNA, 20 bp, mouse
gaacgccagaggtcataacc

SEQ ID NO: 454658 - DNA, 20 bp, mouse
ggctacctggttatgacctc

SEQ ID NO: 454659 - DNA, 20 bp, mouse
ggatagccacaacaaaaagc

SEQ ID NO: 454660 - DNA, 20 bp, mouse
gggctccaatggtaacttag

SEQ ID NO: 454661 - DNA, 20 bp, mouse
gtccaatggtaacttagtgg

SEQ ID NO: 454662 - DNA, 20 bp, mouse
ggtggtggtttatttagtgg

SEQ ID NO: 454663 - DNA, 20 bp, mouse
gagccccctgctttttgttg

SEQ ID NO: 454664 - DNA, 20 bp, mouse
ggagtggtaacttattaatc

SEQ ID NO: 454665 - DNA, 20 bp, mouse
gatgacctctggcgtttcct

SEQ ID NO: 454666 - DNA, 20 bp, mouse
gaatatcaggagagcagacc

SEQ ID NO: 454667 - DNA, 20 bp, mouse
ggtgtaaagggatgaatatc

SEQ ID NO: 454668 - DNA, 20 bp, mouse
gggtactacagtataaggaa

SEQ ID NO: 454669 - DNA, 20 bp, mouse
gtgtagtaccataaatacgt

SEQ ID NO: 454670 - DNA, 20 bp, mouse
gttcactgctctgaatcagg

SEQ ID NO: 454671 - DNA, 20 bp, mouse
gtttctacaagatggacttc

SEQ ID NO: 454672 - DNA, 20 bp, mouse
ggaataagtgtcagtgtaaa

SEQ ID NO: 454673 - DNA, 20 bp, mouse
ggaatcttagacacttctgt

SEQ ID NO: 454674 - DNA, 20 bp, mouse
ggacacttctgtgggaaaaa

SEQ ID NO: 454675 - DNA, 20 bp, mouse
gatatatctcttagatcctt

SEQ ID NO: 454676 - DNA, 20 bp, mouse
ggagaacccaccaagaacct

SEQ ID NO: 454677 - DNA, 20 bp, mouse
gagaccccacatagcgggaa

SEQ ID NO: 454678 - DNA, 20 bp, mouse
gagaccgacggaaggcgcaa

SEQ ID NO: 454679 - DNA, 20 bp, mouse
gctgtgccgaggttcttggt

SEQ ID NO: 454680 - DNA, 20 bp, mouse
ggcaagagaccccacatagc

SEQ ID NO: 454681 - DNA, 20 bp, mouse
ggagctctgggtcccatggt

SEQ ID NO: 454682 - DNA, 20 bp, mouse
gccgacggaaggcgcaaagg

SEQ ID NO: 454683 - DNA, 20 bp, mouse
gccagccccagaccgacgga

SEQ ID NO: 454684 - DNA, 20 bp, mouse
gagctggaggacccagctgg

SEQ ID NO: 454685 - DNA, 20 bp, mouse
gcgcgctgtgccgaggttct

SEQ ID NO: 454686 - DNA, 20 bp, mouse
gccgcacccagggtaggatc

SEQ ID NO: 454687 - DNA, 20 bp, mouse
ggggctacaaatgacgacta

SEQ ID NO: 454688 - DNA, 20 bp, mouse
gtctgccccgcacccagggt

SEQ ID NO: 454689 - DNA, 20 bp, mouse
gagggtaggatcgggtcccc

SEQ ID NO: 454690 - DNA, 20 bp, mouse
gcgactacggcgcgggacag

SEQ ID NO: 454691 - DNA, 20 bp, mouse
ggcggcgcgggcgctattat

SEQ ID NO: 454692 - DNA, 20 bp, mouse
gtggctggagtcagagccca

SEQ ID NO: 454693 - DNA, 20 bp, mouse
gtaatagtcaggctcctcga

SEQ ID NO: 454694 - DNA, 20 bp, mouse
ggggcaggcggtccccagac

SEQ ID NO: 454695 - DNA, 20 bp, mouse
ggcccaagaaggctcccaag

SEQ ID NO: 454696 - DNA, 20 bp, mouse
ggatgcacggatgcgcggga

SEQ ID NO: 454697 - DNA, 20 bp, mouse
ggcggcattgtcggcatggt

SEQ ID NO: 454698 - DNA, 20 bp, mouse
gccagcagcagcggcattgt

SEQ ID NO: 454699 - DNA, 20 bp, mouse
ggcgggagggcgcagtgatg

SEQ ID NO: 454700 - DNA, 20 bp, mouse
gcatggtgggcacagatgca

SEQ ID NO: 454701 - DNA, 20 bp, mouse
gcgcagtgatgtggcactcg

SEQ ID NO: 454702 - DNA, 20 bp, mouse
gagcagcggcattgtcggca

SEQ ID NO: 454703 - DNA, 20 bp, mouse
gactggctaaggtctcaatg

SEQ ID NO: 454704 - DNA, 20 bp, mouse
gcacagatgcacggatgcgc

SEQ ID NO: 454705 - DNA, 20 bp, mouse
gcaggcatccagcaccgcca

SEQ ID NO: 454706 - DNA, 20 bp, mouse
gtacctagtaggtcagctcc

SEQ ID NO: 454707 - DNA, 20 bp, mouse
gttcctggagctgacctact

SEQ ID NO: 454708 - DNA, 20 bp, mouse
gctgcaagtggaaaacttcc

SEQ ID NO: 454709 - DNA, 20 bp, mouse
gaactggttcaatacctagt

SEQ ID NO: 454710 - DNA, 20 bp, mouse
gagtcgaaggttcctgcaag

SEQ ID NO: 454711 - DNA, 20 bp, mouse
ggcagctcacccaaagtaaa

SEQ ID NO: 454712 - DNA, 20 bp, mouse
ggattcagcaatgcagaaac

SEQ ID NO: 454713 - DNA, 20 bp, mouse
gaagcagtcccacccagaaa

SEQ ID NO: 454714 - DNA, 20 bp, mouse
gccgcgcctagcccagctag

SEQ ID NO: 454715 - DNA, 20 bp, mouse
gaattccacagaaatcccag

SEQ ID NO: 454716 - DNA, 20 bp, mouse
ggtgagcctgtagcaaggag

SEQ ID NO: 454717 - DNA, 20 bp, mouse
gtgtcctctagcctttgtgt

SEQ ID NO: 454718 - DNA, 20 bp, mouse
gtgcggctggctgtaagcag

SEQ ID NO: 454719 - DNA, 20 bp, mouse
gaaatacgggaattccacca

SEQ ID NO: 454720 - DNA, 20 bp, mouse
gtgtgcagcagtccaatggc

SEQ ID NO: 454721 - DNA, 20 bp, mouse
gctcttcctctccttgctac

SEQ ID NO: 454722 - DNA, 20 bp, mouse
gttcttggtgagctgggcac

SEQ ID NO: 454723 - DNA, 20 bp, mouse
gactttctgtgcctacacaa

SEQ ID NO: 454724 - DNA, 20 bp, mouse
gggcacgggagctcaaatac

SEQ ID NO: 454725 - DNA, 20 bp, mouse
ggagacagagggatctccaa

SEQ ID NO: 454726 - DNA, 20 bp, mouse
gagcggcggcgcgaaggcag

SEQ ID NO: 454727 - DNA, 20 bp, mouse
gaccgctccgcagcagaggt

SEQ ID NO: 454728 - DNA, 20 bp, mouse
gacccacctctgctgcggag

SEQ ID NO: 454729 - DNA, 20 bp, mouse
ggcggcgcgaaggcaggggc

SEQ ID NO: 454730 - DNA, 20 bp, mouse
gtgcgaccgctccgcagcag

SEQ ID NO: 454731 - DNA, 20 bp, mouse
gtcaggcaggagggagtcaa

SEQ ID NO: 454732 - DNA, 20 bp, mouse
gggcgcccgggtcccagaga

SEQ ID NO: 454733 - DNA, 20 bp, mouse
ggcccgggtcccagagaggg

SEQ ID NO: 454734 - DNA, 20 bp, mouse
gtccaggtaccggcgaagtt

SEQ ID NO: 454735 - DNA, 20 bp, mouse
gcgctgcgttgcagagagac

SEQ ID NO: 454736 - DNA, 20 bp, mouse
gacgcggcttggtccccagg

SEQ ID NO: 454737 - DNA, 20 bp, mouse
gctagagctctggcgcccag

SEQ ID NO: 454738 - DNA, 20 bp, mouse
gtggggaccaagccgcgtgg

SEQ ID NO: 454739 - DNA, 20 bp, mouse
gggaaggatctgttctgcaa

SEQ ID NO: 454740 - DNA, 20 bp, mouse
ggaacagatccttccacctg

SEQ ID NO: 454741 - DNA, 20 bp, mouse
ggaggacaagaagggcgctg

SEQ ID NO: 454742 - DNA, 20 bp, mouse
gactggacgctgagtccttt

SEQ ID NO: 454743 - DNA, 20 bp, mouse
gtgtgcaattgtcctccacg

SEQ ID NO: 454744 - DNA, 20 bp, mouse
gaggcatagtggcagcaagg

SEQ ID NO: 454745 - DNA, 20 bp, mouse
gctaaaagctctgggtaagg

SEQ ID NO: 454746 - DNA, 20 bp, mouse
gccctgcgcggctctcccgg

SEQ ID NO: 454747 - DNA, 20 bp, mouse
ggccgtgagcacgcatgcat

SEQ ID NO: 454748 - DNA, 20 bp, mouse
gctcggaggaaaccgacccc

SEQ ID NO: 454749 - DNA, 20 bp, mouse
gccgcagactgtcctctcgg

SEQ ID NO: 454750 - DNA, 20 bp, mouse
ggaataactaaaactacaac

SEQ ID NO: 454751 - DNA, 20 bp, mouse
gtacaggttccctagcagtc

SEQ ID NO: 454752 - DNA, 20 bp, mouse
gtggcaggtgaggagggcgt

SEQ ID NO: 454753 - DNA, 20 bp, mouse
ggctttcagctgccgagaca

SEQ ID NO: 454754 - DNA, 20 bp, mouse
gaaccggaatccagactgct

SEQ ID NO: 454755 - DNA, 20 bp, mouse
gtggcttgcggtggcaatga

SEQ ID NO: 454756 - DNA, 20 bp, mouse
gcggcgtcccgggtgtggga

SEQ ID NO: 454757 - DNA, 20 bp, mouse
ggactggcgcgcggctaaca

SEQ ID NO: 454758 - DNA, 20 bp, mouse
ggcgcggctaacagggctga

SEQ ID NO: 454759 - DNA, 20 bp, mouse
gcactcgccctcccacaccc

SEQ ID NO: 454760 - DNA, 20 bp, mouse
gagcgcggcgtcccgggtgt

SEQ ID NO: 454761 - DNA, 20 bp, mouse
gttagccgcgcgccagtcca

SEQ ID NO: 454762 - DNA, 20 bp, mouse
gcgcgcgccagtccacggag

SEQ ID NO: 454763 - DNA, 20 bp, mouse
ggggcgagtggcggctgcac

SEQ ID NO: 454764 - DNA, 20 bp, mouse
gccttcgcaagacctctccg

SEQ ID NO: 454765 - DNA, 20 bp, mouse
ggccgccggggacctgaagt

SEQ ID NO: 454766 - DNA, 20 bp, mouse
gtgccgctagccagtagagg

SEQ ID NO: 454767 - DNA, 20 bp, mouse
gctgctgggcgaactcacca

SEQ ID NO: 454768 - DNA, 20 bp, mouse
gctggctagcggcagtgact

SEQ ID NO: 454769 - DNA, 20 bp, mouse
gggccgcctctactggctag

SEQ ID NO: 454770 - DNA, 20 bp, mouse
ggccatggacgggacaagac

SEQ ID NO: 454771 - DNA, 20 bp, mouse
ggccagtagaggcggccccg

SEQ ID NO: 454772 - DNA, 20 bp, mouse
gtggggcaggactcacgggg

SEQ ID NO: 454773 - DNA, 20 bp, mouse
gcgggcagaagcatagccta

SEQ ID NO: 454774 - DNA, 20 bp, mouse
gtggagaagtggctctagtc

SEQ ID NO: 454775 - DNA, 20 bp, mouse
gcgcggccaccgggcccggc

SEQ ID NO: 454776 - DNA, 20 bp, mouse
gtgggacagagatggcatcc

SEQ ID NO: 454777 - DNA, 20 bp, mouse
gtctactaagccaggaagag

SEQ ID NO: 454778 - DNA, 20 bp, mouse
gggcagggcattgctaactg

SEQ ID NO: 454779 - DNA, 20 bp, mouse
gcagtgaggagctgaggtac

SEQ ID NO: 454780 - DNA, 20 bp, mouse
gaggagtcaagagccaaaca

SEQ ID NO: 454781 - DNA, 20 bp, mouse
ggctgaggtacaggaagaga

SEQ ID NO: 454782 - DNA, 20 bp, mouse
ggggcattgctaactgggga

SEQ ID NO: 454783 - DNA, 20 bp, mouse
gctttctgattctctgtctg

SEQ ID NO: 454784 - DNA, 20 bp, mouse
gcacagcaccttacaggcac

SEQ ID NO: 454785 - DNA, 20 bp, mouse
gtgctgaagctatccctgtt

SEQ ID NO: 454786 - DNA, 20 bp, mouse
ggctggttggagggacgcag

SEQ ID NO: 454787 - DNA, 20 bp, mouse
gcgcggagcccgccgagcag

SEQ ID NO: 454788 - DNA, 20 bp, mouse
gccgagcagagggttcccgc

SEQ ID NO: 454789 - DNA, 20 bp, mouse
gctaggccccaccagcgcca

SEQ ID NO: 454790 - DNA, 20 bp, mouse
gactcaccagccgggaccca

SEQ ID NO: 454791 - DNA, 20 bp, mouse
gccacctcgtcagtgctggt

SEQ ID NO: 454792 - DNA, 20 bp, mouse
gcctccaaccagcactgacg

SEQ ID NO: 454793 - DNA, 20 bp, mouse
ggcactgacgaggtggacag

SEQ ID NO: 454794 - DNA, 20 bp, mouse
gagagctcggagtgttctgg

SEQ ID NO: 454795 - DNA, 20 bp, mouse
ggagagaatggtgatgctag

SEQ ID NO: 454796 - DNA, 20 bp, mouse
gggagcgaccgggtgaagga

SEQ ID NO: 454797 - DNA, 20 bp, mouse
gggtgaaggacggagactcg

SEQ ID NO: 454798 - DNA, 20 bp, mouse
gacgctggagtcaggtaggg

SEQ ID NO: 454799 - DNA, 20 bp, mouse
gcagctgggaacccgggatt

SEQ ID NO: 454800 - DNA, 20 bp, mouse
gcgctcaggttcccaatccc

SEQ ID NO: 454801 - DNA, 20 bp, mouse
ggggcgcagcatagggtgag

SEQ ID NO: 454802 - DNA, 20 bp, mouse
gtctgagagggacttcgctc

SEQ ID NO: 454803 - DNA, 20 bp, mouse
gatctggagcgaccgggtga

SEQ ID NO: 454804 - DNA, 20 bp, mouse
gggacctggggaccagaccg

SEQ ID NO: 454805 - DNA, 20 bp, mouse
gctgactccagcgtctgaga

SEQ ID NO: 454806 - DNA, 20 bp, mouse
ggccggcgagggagatcagc

SEQ ID NO: 454807 - DNA, 20 bp, mouse
ggcgggtaaacagacatggc

SEQ ID NO: 454808 - DNA, 20 bp, mouse
ggcccgtcccggaggttacc

SEQ ID NO: 454809 - DNA, 20 bp, mouse
gcaggacgctgcgcacaaca

SEQ ID NO: 454810 - DNA, 20 bp, mouse
gaccaggcagaagcggcagg

SEQ ID NO: 454811 - DNA, 20 bp, mouse
gaaacagacatggccggcga

SEQ ID NO: 454812 - DNA, 20 bp, mouse
gctttgcgggtaaacagaca

SEQ ID NO: 454813 - DNA, 20 bp, mouse
gagggcgaggctcacacggg

SEQ ID NO: 454814 - DNA, 20 bp, mouse
ggcccaggagacaggccggg

SEQ ID NO: 454815 - DNA, 20 bp, mouse
ggttaccaggcagaagcggc

SEQ ID NO: 454816 - DNA, 20 bp, mouse
gcaacgtgagactcttctca

SEQ ID NO: 454817 - DNA, 20 bp, mouse
gtgcggcacacacacggaac

SEQ ID NO: 454818 - DNA, 20 bp, mouse
gacggcggttgcgtacgctg

SEQ ID NO: 454819 - DNA, 20 bp, mouse
gacccgcgagcaggacgggt

SEQ ID NO: 454820 - DNA, 20 bp, mouse
ggtgtaagcgacacgaccag

SEQ ID NO: 454821 - DNA, 20 bp, mouse
gcgggacccgcgagcaggac

SEQ ID NO: 454822 - DNA, 20 bp, mouse
gcgtgagactcttctcacgg

SEQ ID NO: 454823 - DNA, 20 bp, mouse
ggtgccttgcggcacacaca

SEQ ID NO: 454824 - DNA, 20 bp, mouse
gcctggaagtggggcggcag

SEQ ID NO: 454825 - DNA, 20 bp, mouse
ggaagagtctcacgttgcgc

SEQ ID NO: 454826 - DNA, 20 bp, mouse
ggcaggtgtcaagttccagt

SEQ ID NO: 454827 - DNA, 20 bp, mouse
gtactagaccttggctccac

SEQ ID NO: 454828 - DNA, 20 bp, mouse
gaactgagtgagtcttcctg

SEQ ID NO: 454829 - DNA, 20 bp, mouse
gatctaagcggggtgtctgg

SEQ ID NO: 454830 - DNA, 20 bp, mouse
gcagaagactgaacagtgta

SEQ ID NO: 454831 - DNA, 20 bp, mouse
gactcactcagttctccaac

SEQ ID NO: 454832 - DNA, 20 bp, mouse
gccagggaacctaaagaccc

SEQ ID NO: 454833 - DNA, 20 bp, mouse
gcatggcgctgacctttgaa

SEQ ID NO: 454834 - DNA, 20 bp, mouse
gaataggaataacttaacca

SEQ ID NO: 454835 - DNA, 20 bp, mouse
gtaaggaaaaggcagagaat

SEQ ID NO: 454836 - DNA, 20 bp, mouse
ggctgggagaagcggagtgt

SEQ ID NO: 454837 - DNA, 20 bp, mouse
ggctgcggctcctcagtcgg

SEQ ID NO: 454838 - DNA, 20 bp, mouse
gtcccagccgcccgggccac

SEQ ID NO: 454839 - DNA, 20 bp, mouse
gctggctgcggctcctcagt

SEQ ID NO: 454840 - DNA, 20 bp, mouse
gcagcagccgccgccgactg

SEQ ID NO: 454841 - DNA, 20 bp, mouse
ggcggctcctcagtcggcgg

SEQ ID NO: 454842 - DNA, 20 bp, mouse
gctgcgcactcggcactggg

SEQ ID NO: 454843 - DNA, 20 bp, mouse
gctgtccccccggctctctc

SEQ ID NO: 454844 - DNA, 20 bp, mouse
ggtgttggtgagtgacgcgg

SEQ ID NO: 454845 - DNA, 20 bp, mouse
ggacgcggtgtgttacgtgg

SEQ ID NO: 454846 - DNA, 20 bp, mouse
gctccgtcactccgggacaa

SEQ ID NO: 454847 - DNA, 20 bp, mouse
ggccgactggacagactgag

SEQ ID NO: 454848 - DNA, 20 bp, mouse
gggcccttgtcccggagtga

SEQ ID NO: 454849 - DNA, 20 bp, mouse
ggacagctaggcccttgtcc

SEQ ID NO: 454850 - DNA, 20 bp, mouse
gtccgttgtgttggaagctg

SEQ ID NO: 454851 - DNA, 20 bp, mouse
gcccagcaggtcctgatcac

SEQ ID NO: 454852 - DNA, 20 bp, mouse
gcaagaactgagcgactggg

SEQ ID NO: 454853 - DNA, 20 bp, mouse
gacttaacctccgtcactcc

SEQ ID NO: 454854 - DNA, 20 bp, mouse
ggggatgtccgcgagaccca

SEQ ID NO: 454855 - DNA, 20 bp, mouse
ggtccgcgagacccaaggta

SEQ ID NO: 454856 - DNA, 20 bp, mouse
ggagtcgcagagatctctct

SEQ ID NO: 454857 - DNA, 20 bp, mouse
gatgctcccccgaggatggg

SEQ ID NO: 454858 - DNA, 20 bp, mouse
gtcaatgctcccccgaggat

SEQ ID NO: 454859 - DNA, 20 bp, mouse
gagtgacagaagccgcgcag

SEQ ID NO: 454860 - DNA, 20 bp, mouse
ggcgccccgggaggagcagg

SEQ ID NO: 454861 - DNA, 20 bp, mouse
gcggcagccacccatcctcg

SEQ ID NO: 454862 - DNA, 20 bp, mouse
ggcggcgccgaaagcaccgt

SEQ ID NO: 454863 - DNA, 20 bp, mouse
ggaccaggagcctagagagt

SEQ ID NO: 454864 - DNA, 20 bp, mouse
ggtctgaaactgggaacccg

SEQ ID NO: 454865 - DNA, 20 bp, mouse
gcccgcaagagccaaggagg

SEQ ID NO: 454866 - DNA, 20 bp, mouse
gacaagcccactccccacta

SEQ ID NO: 454867 - DNA, 20 bp, mouse
gtggagccctagtggggagt

SEQ ID NO: 454868 - DNA, 20 bp, mouse
ggcagagctcaagagcccaa

SEQ ID NO: 454869 - DNA, 20 bp, mouse
gtttgtctggagccctagtg

SEQ ID NO: 454870 - DNA, 20 bp, mouse
gtgcactggagcaggaactc

SEQ ID NO: 454871 - DNA, 20 bp, mouse
gatcgggctgtgcatccaaa

SEQ ID NO: 454872 - DNA, 20 bp, mouse
ggttgcgcgaggactttctt

SEQ ID NO: 454873 - DNA, 20 bp, mouse
gtccgggcaaagggagtcgg

SEQ ID NO: 454874 - DNA, 20 bp, mouse
gcgcagggccgaggatgctg

SEQ ID NO: 454875 - DNA, 20 bp, mouse
ggatcgggcggaaggtgcag

SEQ ID NO: 454876 - DNA, 20 bp, mouse
gggaggtggagacgtggcaa

SEQ ID NO: 454877 - DNA, 20 bp, mouse
ggtgacagggacccgaaaag

SEQ ID NO: 454878 - DNA, 20 bp, mouse
gtggcaaaggctgtagcagg

SEQ ID NO: 454879 - DNA, 20 bp, mouse
gtccatgagtcccgtgcctg

SEQ ID NO: 454880 - DNA, 20 bp, mouse
gctcatggatggggacatag

SEQ ID NO: 454881 - DNA, 20 bp, mouse
ggccacaggcacgggactca

SEQ ID NO: 454882 - DNA, 20 bp, mouse
gctgtcctgaagtccctgga

SEQ ID NO: 454883 - DNA, 20 bp, mouse
gggcacgggactcatggatg

SEQ ID NO: 454884 - DNA, 20 bp, mouse
gtagcggctggaaaggtgag

SEQ ID NO: 454885 - DNA, 20 bp, mouse
ggagttcacatagccttcca

SEQ ID NO: 454886 - DNA, 20 bp, mouse
gctgtcaggtaagactgtca

SEQ ID NO: 454887 - DNA, 20 bp, mouse
gcttctgaaggccctatagg

SEQ ID NO: 454888 - DNA, 20 bp, mouse
gaaggccctataggaggaga

SEQ ID NO: 454889 - DNA, 20 bp, mouse
gaggatctaagactactgtc

SEQ ID NO: 454890 - DNA, 20 bp, mouse
gactcttctgaaggccctat

SEQ ID NO: 454891 - DNA, 20 bp, mouse
ggaggagcccgtagcttcag

SEQ ID NO: 454892 - DNA, 20 bp, mouse
gtcatagacaacctcataga

SEQ ID NO: 454893 - DNA, 20 bp, mouse
gcgtaccctctcctcctata

SEQ ID NO: 454894 - DNA, 20 bp, mouse
gccctggtggtgagattaag

SEQ ID NO: 454895 - DNA, 20 bp, mouse
gtctcctggtagggacagtg

SEQ ID NO: 454896 - DNA, 20 bp, mouse
gcacctcatggacatcactg

SEQ ID NO: 454897 - DNA, 20 bp, mouse
ggtgcagaataggagagctg

SEQ ID NO: 454898 - DNA, 20 bp, mouse
ggaggctgagttccctcctg

SEQ ID NO: 454899 - DNA, 20 bp, mouse
ggcctcttcgaggtaagaag

SEQ ID NO: 454900 - DNA, 20 bp, mouse
gagcctcagtgatgtccatg

SEQ ID NO: 454901 - DNA, 20 bp, mouse
ggcccaaagaatccctaaaa

SEQ ID NO: 454902 - DNA, 20 bp, mouse
gccagatcggactgcagtag

SEQ ID NO: 454903 - DNA, 20 bp, mouse
gtcctcttcttacctcgaag

SEQ ID NO: 454904 - DNA, 20 bp, mouse
gcggtgtcgctcctaatcgg

SEQ ID NO: 454905 - DNA, 20 bp, mouse
gctcctaatcggaggagaca

SEQ ID NO: 454906 - DNA, 20 bp, mouse
gcccgcggccggacgaccgg

SEQ ID NO: 454907 - DNA, 20 bp, mouse
gtggccggccgggatgacag

SEQ ID NO: 454908 - DNA, 20 bp, mouse
gcgcgacgcggcccggacgg

SEQ ID NO: 454909 - DNA, 20 bp, mouse
ggcattgtttttcctcacgg

SEQ ID NO: 454910 - DNA, 20 bp, mouse
gggcggagcccaaagccccc

SEQ ID NO: 454911 - DNA, 20 bp, mouse
gcgcggcccgggcacccaag

SEQ ID NO: 454912 - DNA, 20 bp, mouse
ggagggcgcaggccgggtgg

SEQ ID NO: 454913 - DNA, 20 bp, mouse
gtcgcccgcggccggacgac

SEQ ID NO: 454914 - DNA, 20 bp, mouse
gtcccgagcgcgacactccg

SEQ ID NO: 454915 - DNA, 20 bp, mouse
gggatcggaccccccactct

SEQ ID NO: 454916 - DNA, 20 bp, mouse
gacccggaccagttcaggaa

SEQ ID NO: 454917 - DNA, 20 bp, mouse
gtgaggcacactggtatcta

SEQ ID NO: 454918 - DNA, 20 bp, mouse
gccgagcggggaggtgcctg

SEQ ID NO: 454919 - DNA, 20 bp, mouse
gtgggcggcgagactacgtg

SEQ ID NO: 454920 - DNA, 20 bp, mouse
gccccgtgaccgtggcttca

SEQ ID NO: 454921 - DNA, 20 bp, mouse
gaactgttaggcgaaggagg

SEQ ID NO: 454922 - DNA, 20 bp, mouse
gtccctgaagccacggtcac

SEQ ID NO: 454923 - DNA, 20 bp, mouse
gcggggacccggaccagttc

SEQ ID NO: 454924 - DNA, 20 bp, mouse
gcagttcaggaatggcagag

SEQ ID NO: 454925 - DNA, 20 bp, mouse
gggaatggcagagcggaccc

SEQ ID NO: 454926 - DNA, 20 bp, mouse
ggcagcatggagacggcccg

SEQ ID NO: 454927 - DNA, 20 bp, mouse
gaccgctcggcattcacctg

SEQ ID NO: 454928 - DNA, 20 bp, mouse
gggatccggccgcgcttacg

SEQ ID NO: 454929 - DNA, 20 bp, mouse
ggcggttcaggcactggatc

SEQ ID NO: 454930 - DNA, 20 bp, mouse
gaaccgaggcagcatggaga

SEQ ID NO: 454931 - DNA, 20 bp, mouse
gctgaggctgaaggcggttc

SEQ ID NO: 454932 - DNA, 20 bp, mouse
gattcacctgaggctgaagg

SEQ ID NO: 454933 - DNA, 20 bp, mouse
gcgatttccgggaacccgtc

SEQ ID NO: 454934 - DNA, 20 bp, mouse
ggccgcggcccacgtgaggg

SEQ ID NO: 454935 - DNA, 20 bp, mouse
gatataaccgtcggccgcgg

SEQ ID NO: 454936 - DNA, 20 bp, mouse
gaggcagtggaagcgcgaag

SEQ ID NO: 454937 - DNA, 20 bp, mouse
gggccgcgccacccagacag

SEQ ID NO: 454938 - DNA, 20 bp, mouse
gaggtccgagtggcctccgg

SEQ ID NO: 454939 - DNA, 20 bp, mouse
gcgcggccgagtcctccccc

SEQ ID NO: 454940 - DNA, 20 bp, mouse
gcccccagcgcgcagagcca

SEQ ID NO: 454941 - DNA, 20 bp, mouse
gcccaaccccccgcacgagg

SEQ ID NO: 454942 - DNA, 20 bp, mouse
ggcgcggggcaaggtccgag

SEQ ID NO: 454943 - DNA, 20 bp, mouse
gaaccccccgcacgaggcgg

SEQ ID NO: 454944 - DNA, 20 bp, mouse
gcccgcacgaggcgggggga

SEQ ID NO: 454945 - DNA, 20 bp, mouse
gccctcgcccctgaagatgg

SEQ ID NO: 454946 - DNA, 20 bp, mouse
gaccagcgcgggcgccagaa

SEQ ID NO: 454947 - DNA, 20 bp, mouse
gcgcgcgagctcaggagcac

SEQ ID NO: 454948 - DNA, 20 bp, mouse
ggactccgcagtcagcgtca

SEQ ID NO: 454949 - DNA, 20 bp, mouse
ggtcctccgggagaaggcac

SEQ ID NO: 454950 - DNA, 20 bp, mouse
ggcagggaacgcgcgagctc

SEQ ID NO: 454951 - DNA, 20 bp, mouse
ggcagccatgacgctgactg

SEQ ID NO: 454952 - DNA, 20 bp, mouse
gccagtagtgccaccagcgc

SEQ ID NO: 454953 - DNA, 20 bp, mouse
ggtggactcaggtacatgta

SEQ ID NO: 454954 - DNA, 20 bp, mouse
gtagttaccccggcagagtt

SEQ ID NO: 454955 - DNA, 20 bp, mouse
gtgactcacgtctcagactg

SEQ ID NO: 454956 - DNA, 20 bp, mouse
ggacagcgacatcttcttgg

SEQ ID NO: 454957 - DNA, 20 bp, mouse
gaagatgtcgctgtccggca

SEQ ID NO: 454958 - DNA, 20 bp, mouse
gccggcggctggggacaaca

SEQ ID NO: 454959 - DNA, 20 bp, mouse
gaccaggacaggcgactccc

SEQ ID NO: 454960 - DNA, 20 bp, mouse
gggagcgtcctgcttggcca

SEQ ID NO: 454961 - DNA, 20 bp, mouse
gccggacagcgacatcttct

SEQ ID NO: 454962 - DNA, 20 bp, mouse
gggcgactccctggccaagc

SEQ ID NO: 454963 - DNA, 20 bp, mouse
ggcgggcagcgcctcctcag

SEQ ID NO: 454964 - DNA, 20 bp, mouse
gccaagcagcggccagccag

SEQ ID NO: 454965 - DNA, 20 bp, mouse
ggtcagtggtccccgccaca

SEQ ID NO: 454966 - DNA, 20 bp, mouse
gagggtctcagtgagttatt

SEQ ID NO: 454967 - DNA, 20 bp, mouse
gactggggtagtggaagcag

SEQ ID NO: 454968 - DNA, 20 bp, mouse
gccaaaattagagagagggt

SEQ ID NO: 454969 - DNA, 20 bp, mouse
gaggggccaaaattagagag

SEQ ID NO: 454970 - DNA, 20 bp, mouse
gcagctcggggagaaggatg

SEQ ID NO: 454971 - DNA, 20 bp, mouse
gctggggacgtgcagataga

SEQ ID NO: 454972 - DNA, 20 bp, mouse
gttccgagagaaaggcggat

SEQ ID NO: 454973 - DNA, 20 bp, mouse
ggagcctctttgggagatgg

SEQ ID NO: 454974 - DNA, 20 bp, mouse
gcgagagaaaggcggatggg

SEQ ID NO: 454975 - DNA, 20 bp, mouse
gggatgggcggtcctggagg

SEQ ID NO: 454976 - DNA, 20 bp, mouse
gggcgacccaccgagaactg

SEQ ID NO: 454977 - DNA, 20 bp, mouse
ggacccaccgagaactgcgg

SEQ ID NO: 454978 - DNA, 20 bp, mouse
gcagcaggtgcatggcggga

SEQ ID NO: 454979 - DNA, 20 bp, mouse
gagcagcagcagcccgaacg

SEQ ID NO: 454980 - DNA, 20 bp, mouse
gctccgccgcagttctcggt

SEQ ID NO: 454981 - DNA, 20 bp, mouse
ggaggtggcaccagctcgat

SEQ ID NO: 454982 - DNA, 20 bp, mouse
gggcatctctggcacatcgt

SEQ ID NO: 454983 - DNA, 20 bp, mouse
ggacgcagtcaagtagcccg

SEQ ID NO: 454984 - DNA, 20 bp, mouse
gccatcccctgtagtggagg

SEQ ID NO: 454985 - DNA, 20 bp, mouse
gcggccaggaagaatttcgg

SEQ ID NO: 454986 - DNA, 20 bp, mouse
gggaggaggacgccttgttg

SEQ ID NO: 454987 - DNA, 20 bp, mouse
gctaggaagagctaaggggt

SEQ ID NO: 454988 - DNA, 20 bp, mouse
gcttgttgaggcagatgact

SEQ ID NO: 454989 - DNA, 20 bp, mouse
gggacggggcgtattggagg

SEQ ID NO: 454990 - DNA, 20 bp, mouse
gttacggacgggaggaggtg

SEQ ID NO: 454991 - DNA, 20 bp, mouse
gtggggacggggcgtattgg

SEQ ID NO: 454992 - DNA, 20 bp, mouse
gaatagaacgggggtcgggg

SEQ ID NO: 454993 - DNA, 20 bp, mouse
gcaagcagcggaccgaactg

SEQ ID NO: 454994 - DNA, 20 bp, mouse
gccttggggacggggcgtat

SEQ ID NO: 454995 - DNA, 20 bp, mouse
ggcagtcagcgggattgcag

SEQ ID NO: 454996 - DNA, 20 bp, mouse
ggtatatgaggacaaatgta

SEQ ID NO: 454997 - DNA, 20 bp, mouse
ggtggtacctgtgggcacac

SEQ ID NO: 454998 - DNA, 20 bp, mouse
ggcagattggtggtacctgt

SEQ ID NO: 454999 - DNA, 20 bp, mouse
gtggcaggaaaaagtatatg

SEQ ID NO: 455000 - DNA, 20 bp, mouse
ggcaagaccttccaaagaat

SEQ ID NO: 455001 - DNA, 20 bp, mouse
gatgaggacaaatgtaaggt

SEQ ID NO: 455002 - DNA, 20 bp, mouse
ggctctgcatagtagagtat

SEQ ID NO: 455003 - DNA, 20 bp, mouse
gcaggataaataaggaaaac

SEQ ID NO: 455004 - DNA, 20 bp, mouse
ggatatgctttcctattctt

SEQ ID NO: 455005 - DNA, 20 bp, mouse
gcctgaagaccttagctgga

SEQ ID NO: 455006 - DNA, 20 bp, mouse
gcacaggcattccagcacat

SEQ ID NO: 455007 - DNA, 20 bp, mouse
ggagagaagtccctctgcag

SEQ ID NO: 455008 - DNA, 20 bp, mouse
ggtgcgggctcacctaccaa

SEQ ID NO: 455009 - DNA, 20 bp, mouse
gaggtaggcagcgcctagac

SEQ ID NO: 455010 - DNA, 20 bp, mouse
gagctcaggcagcacaaagt

SEQ ID NO: 455011 - DNA, 20 bp, mouse
gtcagtctctcaacgtactt

SEQ ID NO: 455012 - DNA, 20 bp, mouse
ggagctgctgtggtgagccc

SEQ ID NO: 455013 - DNA, 20 bp, mouse
gacagactatgagcagtgag

SEQ ID NO: 455014 - DNA, 20 bp, mouse
ggggccctgccaaggagcga

SEQ ID NO: 455015 - DNA, 20 bp, mouse
gacatgggcagctggctccg

SEQ ID NO: 455016 - DNA, 20 bp, mouse
gtcagtgtgggcgaaggtgt

SEQ ID NO: 455017 - DNA, 20 bp, mouse
ggctctgctgcggagatctt

SEQ ID NO: 455018 - DNA, 20 bp, mouse
gaagctgtctaggtgaacca

SEQ ID NO: 455019 - DNA, 20 bp, mouse
gtccctggctaaatactcaa

SEQ ID NO: 455020 - DNA, 20 bp, mouse
ggagctctcagtgtgggcga

SEQ ID NO: 455021 - DNA, 20 bp, mouse
gtcctcctgacagctctaag

SEQ ID NO: 455022 - DNA, 20 bp, mouse
gatggctcacctctaggtag

SEQ ID NO: 455023 - DNA, 20 bp, mouse
ggaaaggatggctcacctct

SEQ ID NO: 455024 - DNA, 20 bp, mouse
gtgttaagctcgagaaagga

SEQ ID NO: 455025 - DNA, 20 bp, mouse
ggccaggtcccgcttcagat

SEQ ID NO: 455026 - DNA, 20 bp, mouse
ggcaggagagaggtagctgt

SEQ ID NO: 455027 - DNA, 20 bp, mouse
ggctgtgggcccagctgagt

SEQ ID NO: 455028 - DNA, 20 bp, mouse
gcgccctgcgcgagcaagtc

SEQ ID NO: 455029 - DNA, 20 bp, mouse
gggctaggcgggatccaggc

SEQ ID NO: 455030 - DNA, 20 bp, mouse
gaccgggctaggcgggatcc

SEQ ID NO: 455031 - DNA, 20 bp, mouse
ggccttctccccactcagct

SEQ ID NO: 455032 - DNA, 20 bp, mouse
gtcccagagcgaagagcggg

SEQ ID NO: 455033 - DNA, 20 bp, mouse
ggagccagagcctgccggtg

SEQ ID NO: 455034 - DNA, 20 bp, mouse
gcgggcgctgtcccatcctc

SEQ ID NO: 455035 - DNA, 20 bp, mouse
ggaccagacttgctcgcgca

SEQ ID NO: 455036 - DNA, 20 bp, mouse
gtctgtccggcctctctctt

SEQ ID NO: 455037 - DNA, 20 bp, mouse
gttaccttggtgggtaggtc

SEQ ID NO: 455038 - DNA, 20 bp, mouse
gctgcccgacctacccacca

SEQ ID NO: 455039 - DNA, 20 bp, mouse
gcccagggctttaccttggt

SEQ ID NO: 455040 - DNA, 20 bp, mouse
gaggcgggtgaagaatgccc

SEQ ID NO: 455041 - DNA, 20 bp, mouse
gcttccaaaggaggtctgtc

SEQ ID NO: 455042 - DNA, 20 bp, mouse
gggtgcccagggctttacct

SEQ ID NO: 455043 - DNA, 20 bp, mouse
ggggctttaccttggtgggt

SEQ ID NO: 455044 - DNA, 20 bp, mouse
gcactggaagcagggaaaac

SEQ ID NO: 455045 - DNA, 20 bp, mouse
gtctgaggtgacaccatcct

SEQ ID NO: 455046 - DNA, 20 bp, mouse
gccgagccgggcacaaggaa

SEQ ID NO: 455047 - DNA, 20 bp, mouse
gcgcgggagagagccgagcc

SEQ ID NO: 455048 - DNA, 20 bp, mouse
ggcctcccgagccgccgagt

SEQ ID NO: 455049 - DNA, 20 bp, mouse
gaaacaagcgcccggaggag

SEQ ID NO: 455050 - DNA, 20 bp, mouse
ggagagccgagccgggcaca

SEQ ID NO: 455051 - DNA, 20 bp, mouse
ggcacaaggaacggacgcca

SEQ ID NO: 455052 - DNA, 20 bp, mouse
ggattgccggggaaagacga

SEQ ID NO: 455053 - DNA, 20 bp, mouse
gagcgcccggaggagcggcg

SEQ ID NO: 455054 - DNA, 20 bp, mouse
gtgcgcaccgctccgaagaa

SEQ ID NO: 455055 - DNA, 20 bp, mouse
gtctcccgcgccgctcctcc

SEQ ID NO: 455056 - DNA, 20 bp, mouse
gcagccacttgtgcaggacc

SEQ ID NO: 455057 - DNA, 20 bp, mouse
ggtacctggtcctgcacaag

SEQ ID NO: 455058 - DNA, 20 bp, mouse
gacaagtggctgcagctaga

SEQ ID NO: 455059 - DNA, 20 bp, mouse
gcctggctgtctagagtcca

SEQ ID NO: 455060 - DNA, 20 bp, mouse
gcacttggggcacttcggca

SEQ ID NO: 455061 - DNA, 20 bp, mouse
gacgcggaagcgtggtccag

SEQ ID NO: 455062 - DNA, 20 bp, mouse
gtgtcgcacttggggcactt

SEQ ID NO: 455063 - DNA, 20 bp, mouse
gttggggcacttcggcatgg

SEQ ID NO: 455064 - DNA, 20 bp, mouse
gggaagtaggttgcaggctc

SEQ ID NO: 455065 - DNA, 20 bp, mouse
gaagccgcgggcaagatcta

SEQ ID NO: 455066 - DNA, 20 bp, mouse
ggacacttggaggccatggt

SEQ ID NO: 455067 - DNA, 20 bp, mouse
gcgaccgagcgcaccgacca

SEQ ID NO: 455068 - DNA, 20 bp, mouse
gagagacgagcgcgggtgga

SEQ ID NO: 455069 - DNA, 20 bp, mouse
ggcggcacagagacgagcgc

SEQ ID NO: 455070 - DNA, 20 bp, mouse
ggcctgctcgtggtagaagg

SEQ ID NO: 455071 - DNA, 20 bp, mouse
gggtgcggcccgaggctcga

SEQ ID NO: 455072 - DNA, 20 bp, mouse
gggatactcaccgaagtata

SEQ ID NO: 455073 - DNA, 20 bp, mouse
gaggagcctggaggcgaagg

SEQ ID NO: 455074 - DNA, 20 bp, mouse
ggaagagcgtccctgaagaa

SEQ ID NO: 455075 - DNA, 20 bp, mouse
gatcgcgcatcccaagacgg

SEQ ID NO: 455076 - DNA, 20 bp, mouse
gtgggacctaggaggagtaa

SEQ ID NO: 455077 - DNA, 20 bp, mouse
gggtaaggctgggacctagg

SEQ ID NO: 455078 - DNA, 20 bp, mouse
ggcccaagcaagagacacca

SEQ ID NO: 455079 - DNA, 20 bp, mouse
gcgcggacaagtccagctca

SEQ ID NO: 455080 - DNA, 20 bp, mouse
gaagcaagagacaccagggt

SEQ ID NO: 455081 - DNA, 20 bp, mouse
gcaacccgtttactttggta

SEQ ID NO: 455082 - DNA, 20 bp, mouse
gaaacgggttgctgacaacg

SEQ ID NO: 455083 - DNA, 20 bp, mouse
gccagccttaccaaagtaaa

SEQ ID NO: 455084 - DNA, 20 bp, mouse
gctgagaaggtgagctcctt

SEQ ID NO: 455085 - DNA, 20 bp, mouse
ggtcagcaacccgtttactt

SEQ ID NO: 455086 - DNA, 20 bp, mouse
gacacaccatccttacatgg

SEQ ID NO: 455087 - DNA, 20 bp, mouse
gacagggacacccccatgta

SEQ ID NO: 455088 - DNA, 20 bp, mouse
gacaggcaagaagggccgag

SEQ ID NO: 455089 - DNA, 20 bp, mouse
gggacacccccatgtaagga

SEQ ID NO: 455090 - DNA, 20 bp, mouse
gctcctgctttgccggctga

SEQ ID NO: 455091 - DNA, 20 bp, mouse
ggaggaagtcgtctccgctg

SEQ ID NO: 455092 - DNA, 20 bp, mouse
gtgccctcagccggcaaagc

SEQ ID NO: 455093 - DNA, 20 bp, mouse
ggggcagggtaggaagacac

SEQ ID NO: 455094 - DNA, 20 bp, mouse
ggtgaaaagtgtaagttcag

SEQ ID NO: 455095 - DNA, 20 bp, mouse
gaaacacaacaacgccccag

SEQ ID NO: 455096 - DNA, 20 bp, mouse
gaatattgtaaagaaataat

SEQ ID NO: 455097 - DNA, 20 bp, mouse
ggaatgaggcgttgttctgc

SEQ ID NO: 455098 - DNA, 20 bp, mouse
ggactacaacttaggagtgt

SEQ ID NO: 455099 - DNA, 20 bp, mouse
gttttcaagtgttctgtgag

SEQ ID NO: 455100 - DNA, 20 bp, mouse
gtctaataagactacaactt

SEQ ID NO: 455101 - DNA, 20 bp, mouse
gtatagcttatttgttatct

SEQ ID NO: 455102 - DNA, 20 bp, mouse
gacatttaattaattatgtg

SEQ ID NO: 455103 - DNA, 20 bp, mouse
gttttagaatatgtatgtga

SEQ ID NO: 455104 - DNA, 20 bp, mouse
ggttgtaaatgtattcaatt

SEQ ID NO: 455105 - DNA, 20 bp, mouse
gctggcttcagagtagaatg

SEQ ID NO: 455106 - DNA, 20 bp, mouse
gagagtggatgtgaccaggg

SEQ ID NO: 455107 - DNA, 20 bp, mouse
gcgttgctcaccgaggggag

SEQ ID NO: 455108 - DNA, 20 bp, mouse
gtacgctggttcaacagcac

SEQ ID NO: 455109 - DNA, 20 bp, mouse
gaccagcgtaaatattaggg

SEQ ID NO: 455110 - DNA, 20 bp, mouse
gtgaaccagcgtaaatatta

SEQ ID NO: 455111 - DNA, 20 bp, mouse
gtgggagagtggatgtgacc

SEQ ID NO: 455112 - DNA, 20 bp, mouse
ggggcaacaagagccctttc

SEQ ID NO: 455113 - DNA, 20 bp, mouse
ggttatcgttgctcaccgag

SEQ ID NO: 455114 - DNA, 20 bp, mouse
gcccgccctaatatttacgc

SEQ ID NO: 455115 - DNA, 20 bp, mouse
ggatttctaccgagtcacgg

SEQ ID NO: 455116 - DNA, 20 bp, mouse
gcttgatctcataataaagg

SEQ ID NO: 455117 - DNA, 20 bp, mouse
ggaatgaggtgttgtcctgc

SEQ ID NO: 455118 - DNA, 20 bp, mouse
gacaatgattcaggagtgta

SEQ ID NO: 455119 - DNA, 20 bp, mouse
gaattttgtacagagataat

SEQ ID NO: 455120 - DNA, 20 bp, mouse
gttccaagcagaactgttag

SEQ ID NO: 455121 - DNA, 20 bp, mouse
gtttactaagacaatgattc

SEQ ID NO: 455122 - DNA, 20 bp, mouse
gtcacctttcttcttcctgc

SEQ ID NO: 455123 - DNA, 20 bp, mouse
gtaccactaacagttctgct

SEQ ID NO: 455124 - DNA, 20 bp, mouse
gttttagaagatggatatga

SEQ ID NO: 455125 - DNA, 20 bp, mouse
gcagttaattactgcatgtg

SEQ ID NO: 455126 - DNA, 20 bp, mouse
gttgtgtgctgatacaaatc

SEQ ID NO: 455127 - DNA, 20 bp, mouse
gtttaagagatacatggatg

SEQ ID NO: 455128 - DNA, 20 bp, mouse
gcacaattttaagagataca

SEQ ID NO: 455129 - DNA, 20 bp, mouse
gactaaaattgtggaaatgg

SEQ ID NO: 455130 - DNA, 20 bp, mouse
gtgaaaagagattaattgaa

SEQ ID NO: 455131 - DNA, 20 bp, mouse
gaaaatcatgtatagatata

SEQ ID NO: 455132 - DNA, 20 bp, mouse
gcctactaaaattgtggaaa

SEQ ID NO: 455133 - DNA, 20 bp, mouse
gtaagtaaagatgtccaaat

SEQ ID NO: 455134 - DNA, 20 bp, mouse
ggaagggaaaaggagagata

SEQ ID NO: 455135 - DNA, 20 bp, mouse
gtcgaaaagtgacataatct

SEQ ID NO: 455136 - DNA, 20 bp, mouse
gccggtgttccagagatcta

SEQ ID NO: 455137 - DNA, 20 bp, mouse
gctgaagcaggaggtccccg

SEQ ID NO: 455138 - DNA, 20 bp, mouse
ggttccagagatctagggtg

SEQ ID NO: 455139 - DNA, 20 bp, mouse
gctagggtgaggtgggacaa

SEQ ID NO: 455140 - DNA, 20 bp, mouse
ggccgagtgctgaggagcgg

SEQ ID NO: 455141 - DNA, 20 bp, mouse
gtctgtgaagggcagagtca

SEQ ID NO: 455142 - DNA, 20 bp, mouse
gacaaaggaaaaactccccg

SEQ ID NO: 455143 - DNA, 20 bp, mouse
ggcggaagcgcctggcgcca

SEQ ID NO: 455144 - DNA, 20 bp, mouse
gccagagatctagggtgagg

SEQ ID NO: 455145 - DNA, 20 bp, mouse
gcccagaacttgaggtaagt

SEQ ID NO: 455146 - DNA, 20 bp, mouse
ggaactctggcctcaacctg

SEQ ID NO: 455147 - DNA, 20 bp, mouse
gtaagggctctgcagaacgg

SEQ ID NO: 455148 - DNA, 20 bp, mouse
gcctcaacctggggagcgct

SEQ ID NO: 455149 - DNA, 20 bp, mouse
ggactctcttgccctgacta

SEQ ID NO: 455150 - DNA, 20 bp, mouse
gggatgctgggcgctctgag

SEQ ID NO: 455151 - DNA, 20 bp, mouse
gtgaggccagagttccgcac

SEQ ID NO: 455152 - DNA, 20 bp, mouse
gggcaagcaagttgcagatc

SEQ ID NO: 455153 - DNA, 20 bp, mouse
gagagcgcccagcatccgca

SEQ ID NO: 455154 - DNA, 20 bp, mouse
ggagttccgcacaggtgaga

SEQ ID NO: 455155 - DNA, 20 bp, mouse
gaggggccgcgctcaagtcc

SEQ ID NO: 455156 - DNA, 20 bp, mouse
gcggctgtgttggaagtcag

SEQ ID NO: 455157 - DNA, 20 bp, mouse
gatgagacgacacaacccgg

SEQ ID NO: 455158 - DNA, 20 bp, mouse
gaacccggaggcctgctctc

SEQ ID NO: 455159 - DNA, 20 bp, mouse
gtcgatgagacgacacaacc

SEQ ID NO: 455160 - DNA, 20 bp, mouse
ggtccagagagcaggcctcc

SEQ ID NO: 455161 - DNA, 20 bp, mouse
gggaaagccctcggctgtgt

SEQ ID NO: 455162 - DNA, 20 bp, mouse
ggtcatagagaaggcctgag

SEQ ID NO: 455163 - DNA, 20 bp, mouse
ggtgtcgtctcatcgatgtg

SEQ ID NO: 455164 - DNA, 20 bp, mouse
gggatggcccagcaatgtac

SEQ ID NO: 455165 - DNA, 20 bp, mouse
gatttgaggagaagcgagct

SEQ ID NO: 455166 - DNA, 20 bp, mouse
gccagcagcgcccgaaatgg

SEQ ID NO: 455167 - DNA, 20 bp, mouse
gcgcccgccgcccagcggac

SEQ ID NO: 455168 - DNA, 20 bp, mouse
gccggagccggtccgctggg

SEQ ID NO: 455169 - DNA, 20 bp, mouse
ggcagcgcccgaaatggcgg

SEQ ID NO: 455170 - DNA, 20 bp, mouse
gctcccagcagcgcccgaaa

SEQ ID NO: 455171 - DNA, 20 bp, mouse
gtctgctgcaggagggacgt

SEQ ID NO: 455172 - DNA, 20 bp, mouse
gcttcccggcagcctccctc

SEQ ID NO: 455173 - DNA, 20 bp, mouse
ggggcgacggaggcactgga

SEQ ID NO: 455174 - DNA, 20 bp, mouse
gacaccggagccggtccgct

SEQ ID NO: 455175 - DNA, 20 bp, mouse
gggcgggcgccagggctgga

SEQ ID NO: 455176 - DNA, 20 bp, mouse
gttgctgtggctattgggag

SEQ ID NO: 455177 - DNA, 20 bp, mouse
ggggctgggtaagactgctc

SEQ ID NO: 455178 - DNA, 20 bp, mouse
gtcagctggccggagtacag

SEQ ID NO: 455179 - DNA, 20 bp, mouse
gtgaatgcgctggaccaagg

SEQ ID NO: 455180 - DNA, 20 bp, mouse
gaaagccccggggtcgaggt

SEQ ID NO: 455181 - DNA, 20 bp, mouse
gctgggtaagactgctcggg

SEQ ID NO: 455182 - DNA, 20 bp, mouse
gccagctgagaagcccgagg

SEQ ID NO: 455183 - DNA, 20 bp, mouse
ggagccggtccgggaacact

SEQ ID NO: 455184 - DNA, 20 bp, mouse
ggagcctgcaccgatccccg

SEQ ID NO: 455185 - DNA, 20 bp, mouse
gcggccagctgagaagcccg

SEQ ID NO: 455186 - DNA, 20 bp, mouse
gcagggcgcacggtactcac

SEQ ID NO: 455187 - DNA, 20 bp, mouse
ggtctgcggggtgcagattg

SEQ ID NO: 455188 - DNA, 20 bp, mouse
gcactgggcgcggacagcga

SEQ ID NO: 455189 - DNA, 20 bp, mouse
gctgcaacgccggtatgggg

SEQ ID NO: 455190 - DNA, 20 bp, mouse
gtgactgcaacgccggtatg

SEQ ID NO: 455191 - DNA, 20 bp, mouse
gggtcctcacgcgcgtcact

SEQ ID NO: 455192 - DNA, 20 bp, mouse
gcaacgccggtatggggcgg

SEQ ID NO: 455193 - DNA, 20 bp, mouse
gtccgccccgaggcaccccg

SEQ ID NO: 455194 - DNA, 20 bp, mouse
gactcgcccccgccccatac

SEQ ID NO: 455195 - DNA, 20 bp, mouse
gtcacgcgcgtcactgggcg

SEQ ID NO: 455196 - DNA, 20 bp, mouse
ggggcgccctcgactcggac

SEQ ID NO: 455197 - DNA, 20 bp, mouse
gtccgagccggtccgagtcg

SEQ ID NO: 455198 - DNA, 20 bp, mouse
gggcctgggcgccctcgact

SEQ ID NO: 455199 - DNA, 20 bp, mouse
gaggaggagcgagattgtgg

SEQ ID NO: 455200 - DNA, 20 bp, mouse
ggccgaaaacgggaagccgg

SEQ ID NO: 455201 - DNA, 20 bp, mouse
ggccgcttagagccgaaaac

SEQ ID NO: 455202 - DNA, 20 bp, mouse
gcagctggttcggtccgagc

SEQ ID NO: 455203 - DNA, 20 bp, mouse
gctgccgccgcaaggagccg

SEQ ID NO: 455204 - DNA, 20 bp, mouse
gcagtgattgacagctggtt

SEQ ID NO: 455205 - DNA, 20 bp, mouse
gaggcctctggccctcctaa

SEQ ID NO: 455206 - DNA, 20 bp, mouse
gggcgcagtcgggaatccgg

SEQ ID NO: 455207 - DNA, 20 bp, mouse
gctaggcgcagtcgggaatc

SEQ ID NO: 455208 - DNA, 20 bp, mouse
ggaagcccgcgagaacgtgg

SEQ ID NO: 455209 - DNA, 20 bp, mouse
ggcgggagctaggcgcagtc

SEQ ID NO: 455210 - DNA, 20 bp, mouse
gcgctgcgcgaggccgctcg

SEQ ID NO: 455211 - DNA, 20 bp, mouse
gctccatcgcgcccttcatc

SEQ ID NO: 455212 - DNA, 20 bp, mouse
gaagtgggtcgcagacctgt

SEQ ID NO: 455213 - DNA, 20 bp, mouse
gtcccgcgagcgaccccgag

SEQ ID NO: 455214 - DNA, 20 bp, mouse
ggctgggccagcggctgcag

SEQ ID NO: 455215 - DNA, 20 bp, mouse
ggaccagatgaagggcgcga

SEQ ID NO: 455216 - DNA, 20 bp, mouse
ggagcggtgccgaggccgta

SEQ ID NO: 455217 - DNA, 20 bp, mouse
gcttctctagagaagtcgag

SEQ ID NO: 455218 - DNA, 20 bp, mouse
gcagagtgtagaaattagta

SEQ ID NO: 455219 - DNA, 20 bp, mouse
gtagtatggagctgtccata

SEQ ID NO: 455220 - DNA, 20 bp, mouse
ggagaagtcgagcggtgccg

SEQ ID NO: 455221 - DNA, 20 bp, mouse
gggagctgtccatacggcct

SEQ ID NO: 455222 - DNA, 20 bp, mouse
gttcaggccacctgtataag

SEQ ID NO: 455223 - DNA, 20 bp, mouse
gcgaggcagcaggccgcggg

SEQ ID NO: 455224 - DNA, 20 bp, mouse
gaggtggcctgaaccgccaa

SEQ ID NO: 455225 - DNA, 20 bp, mouse
gactcagacgcccctggcac

SEQ ID NO: 455226 - DNA, 20 bp, mouse
ggcggcggcgggccgagcag

SEQ ID NO: 455227 - DNA, 20 bp, mouse
gaggggccatgtctcatcag

SEQ ID NO: 455228 - DNA, 20 bp, mouse
gccctccttgccaagccggg

SEQ ID NO: 455229 - DNA, 20 bp, mouse
gagagcggcgacaaaggcca

SEQ ID NO: 455230 - DNA, 20 bp, mouse
ggcggggagtgggcagcggt

SEQ ID NO: 455231 - DNA, 20 bp, mouse
ggcgccgccgggagagaccc

SEQ ID NO: 455232 - DNA, 20 bp, mouse
gaagcactgcggcagggtgg

SEQ ID NO: 455233 - DNA, 20 bp, mouse
ggcggcgacaaaggccaggg

SEQ ID NO: 455234 - DNA, 20 bp, mouse
gcgggccgagcagcggggag

SEQ ID NO: 455235 - DNA, 20 bp, mouse
gctcgtgagagcggcgacaa

SEQ ID NO: 455236 - DNA, 20 bp, mouse
gccgccgcgggcccgcaccg

SEQ ID NO: 455237 - DNA, 20 bp, mouse
gcccaagcgcgactgcggtc

SEQ ID NO: 455238 - DNA, 20 bp, mouse
gccccgcgccagaagtacgg

SEQ ID NO: 455239 - DNA, 20 bp, mouse
gggcggcccaagcgcgactg

SEQ ID NO: 455240 - DNA, 20 bp, mouse
ggactgcggtcgggcaaaga

SEQ ID NO: 455241 - DNA, 20 bp, mouse
gtcgtaggcgccctccacgg

SEQ ID NO: 455242 - DNA, 20 bp, mouse
gttctcgtaggcgccctcca

SEQ ID NO: 455243 - DNA, 20 bp, mouse
ggagctgaccgccggagacg

SEQ ID NO: 455244 - DNA, 20 bp, mouse
gtgcggtcgggcaaagaggg

SEQ ID NO: 455245 - DNA, 20 bp, mouse
gggtcagctctcgccaccgc

SEQ ID NO: 455246 - DNA, 20 bp, mouse
ggccacaacaaactagatac

SEQ ID NO: 455247 - DNA, 20 bp, mouse
gaggccgtggcacctttgag

SEQ ID NO: 455248 - DNA, 20 bp, mouse
ggctgcgccgcagggatata

SEQ ID NO: 455249 - DNA, 20 bp, mouse
ggtcatggcagcctccacgg

SEQ ID NO: 455250 - DNA, 20 bp, mouse
gagcgatcctggccgacaac

SEQ ID NO: 455251 - DNA, 20 bp, mouse
gagaagacaggtggtcggtg

SEQ ID NO: 455252 - DNA, 20 bp, mouse
gttcaggtgtagaaactccg

SEQ ID NO: 455253 - DNA, 20 bp, mouse
gtagataccggaaccggaac

SEQ ID NO: 455254 - DNA, 20 bp, mouse
gcaggatcgctcgagttcca

SEQ ID NO: 455255 - DNA, 20 bp, mouse
gaaaagcacttcgaaccggc

SEQ ID NO: 455256 - DNA, 20 bp, mouse
gacaggctagacccattgag

SEQ ID NO: 455257 - DNA, 20 bp, mouse
ggggaacttacctaatgctc

SEQ ID NO: 455258 - DNA, 20 bp, mouse
gtagaatgagcaagaagttc

SEQ ID NO: 455259 - DNA, 20 bp, mouse
gcccatcctgcctgagcatt

SEQ ID NO: 455260 - DNA, 20 bp, mouse
gctagaaccttaggaaggag

SEQ ID NO: 455261 - DNA, 20 bp, mouse
gacttacctaatgctcaggc

SEQ ID NO: 455262 - DNA, 20 bp, mouse
gagctcaagttgccttatgg

SEQ ID NO: 455263 - DNA, 20 bp, mouse
gtcttctcactagatgacat

SEQ ID NO: 455264 - DNA, 20 bp, mouse
gtgtgtagagtacttgtcag

SEQ ID NO: 455265 - DNA, 20 bp, mouse
gatccaggatggtacatggg

SEQ ID NO: 455266 - DNA, 20 bp, mouse
gtccgccgccaagaccggga

SEQ ID NO: 455267 - DNA, 20 bp, mouse
gccgcgaaggtaggaggccg

SEQ ID NO: 455268 - DNA, 20 bp, mouse
gaccgggaaggcacaggcgt

SEQ ID NO: 455269 - DNA, 20 bp, mouse
gcaggccccgggctccagac

SEQ ID NO: 455270 - DNA, 20 bp, mouse
gggcggcggaccgcgaaggt

SEQ ID NO: 455271 - DNA, 20 bp, mouse
ggccaagaccgggaaggcac

SEQ ID NO: 455272 - DNA, 20 bp, mouse
gtcttggcggcggaccgcga

SEQ ID NO: 455273 - DNA, 20 bp, mouse
gagacgggaagactccaata

SEQ ID NO: 455274 - DNA, 20 bp, mouse
ggcggtccgccgccaagacc

SEQ ID NO: 455275 - DNA, 20 bp, mouse
ggggaaggggactcaaccag

SEQ ID NO: 455276 - DNA, 20 bp, mouse
gccccctcctcaaagtacag

SEQ ID NO: 455277 - DNA, 20 bp, mouse
gggccccagcaggacctgaa

SEQ ID NO: 455278 - DNA, 20 bp, mouse
gccgtgtccaccctgtccag

SEQ ID NO: 455279 - DNA, 20 bp, mouse
gcctgaagggcagagaaggt

SEQ ID NO: 455280 - DNA, 20 bp, mouse
gacctctgtactttgaggag

SEQ ID NO: 455281 - DNA, 20 bp, mouse
gacctctcaccactactaca

SEQ ID NO: 455282 - DNA, 20 bp, mouse
gcattggtgtgttagtgcgt

SEQ ID NO: 455283 - DNA, 20 bp, mouse
gagtgtggggaagtgtgcga

SEQ ID NO: 455284 - DNA, 20 bp, mouse
gaccttgtagtagtggtgag

SEQ ID NO: 455285 - DNA, 20 bp, mouse
gacaccaatgccaggctgct

SEQ ID NO: 455286 - DNA, 20 bp, mouse
gccgacgcagagggacaaga

SEQ ID NO: 455287 - DNA, 20 bp, mouse
gaggacaccccaaaccagaa

SEQ ID NO: 455288 - DNA, 20 bp, mouse
gaggccggtgcaactgagag

SEQ ID NO: 455289 - DNA, 20 bp, mouse
gagagggacaagaggggcgc

SEQ ID NO: 455290 - DNA, 20 bp, mouse
gccccctcgccatgtgggag

SEQ ID NO: 455291 - DNA, 20 bp, mouse
gcaggctctgggctgtcctg

SEQ ID NO: 455292 - DNA, 20 bp, mouse
ggcgcgggaggtgaggattc

SEQ ID NO: 455293 - DNA, 20 bp, mouse
gcctatcagatggacccaag

SEQ ID NO: 455294 - DNA, 20 bp, mouse
gtcctgaggccggaccagaa

SEQ ID NO: 455295 - DNA, 20 bp, mouse
gtcaccgaggataaggacaa

SEQ ID NO: 455296 - DNA, 20 bp, mouse
gtgctgggatctggactaag

SEQ ID NO: 455297 - DNA, 20 bp, mouse
ggaatcaaggatcaggatca

SEQ ID NO: 455298 - DNA, 20 bp, mouse
gcaccagagtagcttctcca

SEQ ID NO: 455299 - DNA, 20 bp, mouse
ggatcaaggacaaggagtcc

SEQ ID NO: 455300 - DNA, 20 bp, mouse
gccagcagcatccatagcca

SEQ ID NO: 455301 - DNA, 20 bp, mouse
gagtagcttctccatggcta

SEQ ID NO: 455302 - DNA, 20 bp, mouse
gggcccgaggcaagcgttcc

SEQ ID NO: 455303 - DNA, 20 bp, mouse
gggtcatctggtcctctccc

SEQ ID NO: 455304 - DNA, 20 bp, mouse
gttccctatgggagaatggt

SEQ ID NO: 455305 - DNA, 20 bp, mouse
ggtcctggaacgcttgcctc

SEQ ID NO: 455306 - DNA, 20 bp, mouse
gcgaggccagcccgggacca

SEQ ID NO: 455307 - DNA, 20 bp, mouse
gagggctgggcgctgcaagg

SEQ ID NO: 455308 - DNA, 20 bp, mouse
gtgcaaggcggcggcgccag

SEQ ID NO: 455309 - DNA, 20 bp, mouse
gaagcgagcgcgcggcgtcg

SEQ ID NO: 455310 - DNA, 20 bp, mouse
gcccagccctggtcccgggc

SEQ ID NO: 455311 - DNA, 20 bp, mouse
gtctccgccggaaggggtgg

SEQ ID NO: 455312 - DNA, 20 bp, mouse
gaagcccgggcgcgctcgag

SEQ ID NO: 455313 - DNA, 20 bp, mouse
gcctccccgcacgcccccag

SEQ ID NO: 455314 - DNA, 20 bp, mouse
gccgacgcccccaagcggtg

SEQ ID NO: 455315 - DNA, 20 bp, mouse
ggggcaatggggctagtagg

SEQ ID NO: 455316 - DNA, 20 bp, mouse
ggcacagccagcatgtggtg

SEQ ID NO: 455317 - DNA, 20 bp, mouse
gtgggtgccggtgcaaggta

SEQ ID NO: 455318 - DNA, 20 bp, mouse
gtgctggctgtgctgaacgg

SEQ ID NO: 455319 - DNA, 20 bp, mouse
gacccagaacagcaaactga

SEQ ID NO: 455320 - DNA, 20 bp, mouse
gagggctccccaccacatgc

SEQ ID NO: 455321 - DNA, 20 bp, mouse
ggttcagcacagccagcatg

SEQ ID NO: 455322 - DNA, 20 bp, mouse
gctaagtccttaccttgcac

SEQ ID NO: 455323 - DNA, 20 bp, mouse
ggtctctgacagcttcctgt

SEQ ID NO: 455324 - DNA, 20 bp, mouse
ggctcaacccacacgtccaa

SEQ ID NO: 455325 - DNA, 20 bp, mouse
gtaactgcccttggacgtgt

SEQ ID NO: 455326 - DNA, 20 bp, mouse
gtagcacaaccctcagaaga

SEQ ID NO: 455327 - DNA, 20 bp, mouse
gtgtgacactgagcacgatg

SEQ ID NO: 455328 - DNA, 20 bp, mouse
gaccctcagaagagggtagc

SEQ ID NO: 455329 - DNA, 20 bp, mouse
gatgtggctaaagctcatct

SEQ ID NO: 455330 - DNA, 20 bp, mouse
gtccagcagcccacaagtac

SEQ ID NO: 455331 - DNA, 20 bp, mouse
gtgagggttgtgctaaaacc

SEQ ID NO: 455332 - DNA, 20 bp, mouse
gtgatctgcaactaaaaagg

SEQ ID NO: 455333 - DNA, 20 bp, mouse
ggaaacctcaaaacctgatg

SEQ ID NO: 455334 - DNA, 20 bp, mouse
gtggaaccaaaggttgatat

SEQ ID NO: 455335 - DNA, 20 bp, mouse
ggtgggctgctggagggctt

SEQ ID NO: 455336 - DNA, 20 bp, mouse
ggacgcggcaggcctaggaa

SEQ ID NO: 455337 - DNA, 20 bp, mouse
ggagctgaggacgcgcgacg

SEQ ID NO: 455338 - DNA, 20 bp, mouse
ggcggcaggcctaggaaggg

SEQ ID NO: 455339 - DNA, 20 bp, mouse
gacgcgctcgaccagtacag

SEQ ID NO: 455340 - DNA, 20 bp, mouse
gcaccagcaacgcggccgta

SEQ ID NO: 455341 - DNA, 20 bp, mouse
gagcactgggccgagagcgt

SEQ ID NO: 455342 - DNA, 20 bp, mouse
ggctcggggctctggttcgt

SEQ ID NO: 455343 - DNA, 20 bp, mouse
ggtactggtcgagcgcgtgg

SEQ ID NO: 455344 - DNA, 20 bp, mouse
gatggggccccgcagcccta

SEQ ID NO: 455345 - DNA, 20 bp, mouse
gggcggtaggccgactcgag

SEQ ID NO: 455346 - DNA, 20 bp, mouse
gggtggctcccgagagtggg

SEQ ID NO: 455347 - DNA, 20 bp, mouse
gggcgacttcgaacaatccg

SEQ ID NO: 455348 - DNA, 20 bp, mouse
gcacaaccagaagcaggcgg

SEQ ID NO: 455349 - DNA, 20 bp, mouse
gcatcaggtagcaatcaggg

SEQ ID NO: 455350 - DNA, 20 bp, mouse
gctgcacaaccagaagcagg

SEQ ID NO: 455351 - DNA, 20 bp, mouse
gtcttctcgctaaatttccg

SEQ ID NO: 455352 - DNA, 20 bp, mouse
gacgccgccacagcgctgag

SEQ ID NO: 455353 - DNA, 20 bp, mouse
gggcgtggggacacctgcgg

SEQ ID NO: 455354 - DNA, 20 bp, mouse
gtggagtcgtaggtcctacg

SEQ ID NO: 455355 - DNA, 20 bp, mouse
ggtagcaatgatggagtcgt

SEQ ID NO: 455356 - DNA, 20 bp, mouse
gtgcgtccggagtctggagt

SEQ ID NO: 455357 - DNA, 20 bp, mouse
gcggagtctggagtaggctg

SEQ ID NO: 455358 - DNA, 20 bp, mouse
gcgtcaggccgaggagacgg

SEQ ID NO: 455359 - DNA, 20 bp, mouse
gcggctgctgctaaggctga

SEQ ID NO: 455360 - DNA, 20 bp, mouse
gaccttcccagttccagcca

SEQ ID NO: 455361 - DNA, 20 bp, mouse
gcagcgtcaggccgaggaga

SEQ ID NO: 455362 - DNA, 20 bp, mouse
gaaggctgaaggagccgggc

SEQ ID NO: 455363 - DNA, 20 bp, mouse
gaggctggggccgagccgcc

SEQ ID NO: 455364 - DNA, 20 bp, mouse
gccagccacggcctctgccg

SEQ ID NO: 455365 - DNA, 20 bp, mouse
gcgggaagaggtgaacacac

SEQ ID NO: 455366 - DNA, 20 bp, mouse
gctccggcgcgacccggcag

SEQ ID NO: 455367 - DNA, 20 bp, mouse
ggcctgcggacagaccgggt

SEQ ID NO: 455368 - DNA, 20 bp, mouse
gccggaggacaggtttcggg

SEQ ID NO: 455369 - DNA, 20 bp, mouse
gggcggcctgcggacagacc

SEQ ID NO: 455370 - DNA, 20 bp, mouse
gcctgtcctccggcgcgacc

SEQ ID NO: 455371 - DNA, 20 bp, mouse
gccggccccggagctcaccc

SEQ ID NO: 455372 - DNA, 20 bp, mouse
gctcctctgccgggtcgcgc

SEQ ID NO: 455373 - DNA, 20 bp, mouse
gcggcaggccgaggagacgc

SEQ ID NO: 455374 - DNA, 20 bp, mouse
gcgcgccggaggacaggttt

SEQ ID NO: 455375 - DNA, 20 bp, mouse
ggcccacccggtctgtccgc

SEQ ID NO: 455376 - DNA, 20 bp, mouse
gtggatgttcaggtactgga

SEQ ID NO: 455377 - DNA, 20 bp, mouse
gtcctggaaagactcacctt

SEQ ID NO: 455378 - DNA, 20 bp, mouse
gggtcacttaggaccatgat

SEQ ID NO: 455379 - DNA, 20 bp, mouse
gagttgttgggatccaggag

SEQ ID NO: 455380 - DNA, 20 bp, mouse
ggggactctcctggatgttc

SEQ ID NO: 455381 - DNA, 20 bp, mouse
gagcagaggctagaggaaat

SEQ ID NO: 455382 - DNA, 20 bp, mouse
ggaaataggtcccctcacac

SEQ ID NO: 455383 - DNA, 20 bp, mouse
ggaaagactcacctttggaa

SEQ ID NO: 455384 - DNA, 20 bp, mouse
gatactctgaggacattcag

SEQ ID NO: 455385 - DNA, 20 bp, mouse
gacttaggaccatgatagga

SEQ ID NO: 455386 - DNA, 20 bp, mouse
ggtcctggggctatctgtgg

SEQ ID NO: 455387 - DNA, 20 bp, mouse
ggaggtcctggggctatctg

SEQ ID NO: 455388 - DNA, 20 bp, mouse
ggacctccacagatagcccc

SEQ ID NO: 455389 - DNA, 20 bp, mouse
gagaaatctctgaggtcctg

SEQ ID NO: 455390 - DNA, 20 bp, mouse
ggtctttccagaaatctctg

SEQ ID NO: 455391 - DNA, 20 bp, mouse
gtggctttgttgcttaggta

SEQ ID NO: 455392 - DNA, 20 bp, mouse
gctgggaggagtagagtgtg

SEQ ID NO: 455393 - DNA, 20 bp, mouse
gtggaggtctgtccttgggt

SEQ ID NO: 455394 - DNA, 20 bp, mouse
gaaagtggggtgtaactggg

SEQ ID NO: 455395 - DNA, 20 bp, mouse
gatcccagttctgacgagac

SEQ ID NO: 455396 - DNA, 20 bp, mouse
gggcctgtgcgtcccggagt

SEQ ID NO: 455397 - DNA, 20 bp, mouse
gcagcctcgggaccggtgac

SEQ ID NO: 455398 - DNA, 20 bp, mouse
gccggcaggcgagcgtcccg

SEQ ID NO: 455399 - DNA, 20 bp, mouse
gccggagtgggcagcgagct

SEQ ID NO: 455400 - DNA, 20 bp, mouse
ggagcgcgggctagagctcc

SEQ ID NO: 455401 - DNA, 20 bp, mouse
ggcagcgagctcggagagcg

SEQ ID NO: 455402 - DNA, 20 bp, mouse
gtgacgcggcggagtcaccc

SEQ ID NO: 455403 - DNA, 20 bp, mouse
gacccgggcagcctcgggac

SEQ ID NO: 455404 - DNA, 20 bp, mouse
gctcgggaccggtgaccggc

SEQ ID NO: 455405 - DNA, 20 bp, mouse
ggcagctggcagatgaatgg

SEQ ID NO: 455406 - DNA, 20 bp, mouse
ggcagaccgagacccagtcc

SEQ ID NO: 455407 - DNA, 20 bp, mouse
gccagtccaggcggcgatgg

SEQ ID NO: 455408 - DNA, 20 bp, mouse
gcggtccccgcgcaatcgat

SEQ ID NO: 455409 - DNA, 20 bp, mouse
ggaccgagacccagtccagg

SEQ ID NO: 455410 - DNA, 20 bp, mouse
ggacccagtccaggcggcga

SEQ ID NO: 455411 - DNA, 20 bp, mouse
ggcgtccccgggaaagacag

SEQ ID NO: 455412 - DNA, 20 bp, mouse
gtgtgggcatcaaccgatgg

SEQ ID NO: 455413 - DNA, 20 bp, mouse
gttgcggaaccagtgcaccg

SEQ ID NO: 455414 - DNA, 20 bp, mouse
gcggttgatgcccacagacg

SEQ ID NO: 455415 - DNA, 20 bp, mouse
gacgaggaggccgcgaacca

SEQ ID NO: 455416 - DNA, 20 bp, mouse
ggagtcagacaggagcctct

SEQ ID NO: 455417 - DNA, 20 bp, mouse
gtcaccaccgcactgcccag

SEQ ID NO: 455418 - DNA, 20 bp, mouse
ggagcctctgggcagtgcgg

SEQ ID NO: 455419 - DNA, 20 bp, mouse
gttggtgatgcagggaccga

SEQ ID NO: 455420 - DNA, 20 bp, mouse
gggctggcagtgagtcagac

SEQ ID NO: 455421 - DNA, 20 bp, mouse
gccagggcacgcttgaacca

SEQ ID NO: 455422 - DNA, 20 bp, mouse
ggagggactggcggtagtag

SEQ ID NO: 455423 - DNA, 20 bp, mouse
gacagctagggatcctcgag

SEQ ID NO: 455424 - DNA, 20 bp, mouse
gacccctctgagcagctagg

SEQ ID NO: 455425 - DNA, 20 bp, mouse
gttgaaccaaggatgctgaa

SEQ ID NO: 455426 - DNA, 20 bp, mouse
ggaaggggcgccggatccag

SEQ ID NO: 455427 - DNA, 20 bp, mouse
gtggatggcgatgtccattg

SEQ ID NO: 455428 - DNA, 20 bp, mouse
gtgggtgcccgcaggaagga

SEQ ID NO: 455429 - DNA, 20 bp, mouse
gagatgaatgcagagtcggt

SEQ ID NO: 455430 - DNA, 20 bp, mouse
ggggtggccgaaggtagaag

SEQ ID NO: 455431 - DNA, 20 bp, mouse
gggggcgccggatccagggg

SEQ ID NO: 455432 - DNA, 20 bp, mouse
ggcgccggatccaggggtgg

SEQ ID NO: 455433 - DNA, 20 bp, mouse
gggtgagtctgcctatgcca

SEQ ID NO: 455434 - DNA, 20 bp, mouse
gggctagatgaatgcagagt

SEQ ID NO: 455435 - DNA, 20 bp, mouse
gattgacaccggactctcag

SEQ ID NO: 455436 - DNA, 20 bp, mouse
gagactgtgcagcgggagtt

SEQ ID NO: 455437 - DNA, 20 bp, mouse
ggcatctgtctatcgaggaa

SEQ ID NO: 455438 - DNA, 20 bp, mouse
gcacagtctgggtctccatc

SEQ ID NO: 455439 - DNA, 20 bp, mouse
ggagacgaagctgcaccaga

SEQ ID NO: 455440 - DNA, 20 bp, mouse
gtaggagtcagcaggtcgca

SEQ ID NO: 455441 - DNA, 20 bp, mouse
gcctctgcatctgtctatcg

SEQ ID NO: 455442 - DNA, 20 bp, mouse
gcagcaggtcgcagggcaca

SEQ ID NO: 455443 - DNA, 20 bp, mouse
gtgccacaggcaactactta

SEQ ID NO: 455444 - DNA, 20 bp, mouse
ggagacccagactgtgcagc

SEQ ID NO: 455445 - DNA, 20 bp, mouse
gtatatgatgaggagaagga

SEQ ID NO: 455446 - DNA, 20 bp, mouse
gctcactcggtgagtactgg

SEQ ID NO: 455447 - DNA, 20 bp, mouse
ggcaccgacggaaaatggag

SEQ ID NO: 455448 - DNA, 20 bp, mouse
gtgagtgagcaccgcaccga

SEQ ID NO: 455449 - DNA, 20 bp, mouse
ggcccacccgctccgcacag

SEQ ID NO: 455450 - DNA, 20 bp, mouse
gaggctgccgctgtgcggag

SEQ ID NO: 455451 - DNA, 20 bp, mouse
ggcaccgcaccgacggaaaa

SEQ ID NO: 455452 - DNA, 20 bp, mouse
gagggtctggatccggacac

SEQ ID NO: 455453 - DNA, 20 bp, mouse
ggctccccgctcacagacgt

SEQ ID NO: 455454 - DNA, 20 bp, mouse
gcgcagggtgcgctcagtca

SEQ ID NO: 455455 - DNA, 20 bp, mouse
gtagccggcagcgacgaccc

SEQ ID NO: 455456 - DNA, 20 bp, mouse
gcttcttggtaagtatgaga

SEQ ID NO: 455457 - DNA, 20 bp, mouse
gacaaggtcagggctcttat

SEQ ID NO: 455458 - DNA, 20 bp, mouse
gtagtgcgtggctctcatag

SEQ ID NO: 455459 - DNA, 20 bp, mouse
ggctctcatagtggacacac

SEQ ID NO: 455460 - DNA, 20 bp, mouse
gtccccaagattgatattgt

SEQ ID NO: 455461 - DNA, 20 bp, mouse
gatgatgccaccagagagct

SEQ ID NO: 455462 - DNA, 20 bp, mouse
ggcagtgctagcctagtgcg

SEQ ID NO: 455463 - DNA, 20 bp, mouse
gaccagaaccagacaaggtc

SEQ ID NO: 455464 - DNA, 20 bp, mouse
gctggttctgacgtgtgctc

SEQ ID NO: 455465 - DNA, 20 bp, mouse
gtgggatgtgatggcattca

SEQ ID NO: 455466 - DNA, 20 bp, mouse
gcctgcacagatggtggtgt

SEQ ID NO: 455467 - DNA, 20 bp, mouse
gagaaggcttccagggccga

SEQ ID NO: 455468 - DNA, 20 bp, mouse
ggcacttgggaggggcacat

SEQ ID NO: 455469 - DNA, 20 bp, mouse
gggtaagagggactgtaagg

SEQ ID NO: 455470 - DNA, 20 bp, mouse
gaccatctgtgcaggaaaga

SEQ ID NO: 455471 - DNA, 20 bp, mouse
gtgtacctaggatcatacac

SEQ ID NO: 455472 - DNA, 20 bp, mouse
ggagggtaagagggactgta

SEQ ID NO: 455473 - DNA, 20 bp, mouse
gactcttcagcacttgggag

SEQ ID NO: 455474 - DNA, 20 bp, mouse
gagcctggaaagatgtacct

SEQ ID NO: 455475 - DNA, 20 bp, mouse
gtctggagggcatcgagtca

SEQ ID NO: 455476 - DNA, 20 bp, mouse
gccaccaatacaggtaagag

SEQ ID NO: 455477 - DNA, 20 bp, mouse
ggtcctcaccaagagaggga

SEQ ID NO: 455478 - DNA, 20 bp, mouse
gtatagcctggcagacatca

SEQ ID NO: 455479 - DNA, 20 bp, mouse
gctgccaggctataaaatgg

SEQ ID NO: 455480 - DNA, 20 bp, mouse
gacctgtattggtggacagg

SEQ ID NO: 455481 - DNA, 20 bp, mouse
gcagctagagagaggatgtt

SEQ ID NO: 455482 - DNA, 20 bp, mouse
gacatctggaccacatctgg

SEQ ID NO: 455483 - DNA, 20 bp, mouse
gagtcccctcttacctgtat

SEQ ID NO: 455484 - DNA, 20 bp, mouse
gaatagagacaggttgaggg

SEQ ID NO: 455485 - DNA, 20 bp, mouse
gaagttccctgggtccaggt

SEQ ID NO: 455486 - DNA, 20 bp, mouse
gggcttcacggcactcgcgg

SEQ ID NO: 455487 - DNA, 20 bp, mouse
gatagccagtgcctggacaa

SEQ ID NO: 455488 - DNA, 20 bp, mouse
gggctggcgatctggtaaga

SEQ ID NO: 455489 - DNA, 20 bp, mouse
ggccgtgaagccaggctggt

SEQ ID NO: 455490 - DNA, 20 bp, mouse
gcacactctgcacccaggaa

SEQ ID NO: 455491 - DNA, 20 bp, mouse
gtccacccttttcaacaagg

SEQ ID NO: 455492 - DNA, 20 bp, mouse
gcatccgacagggccctgga

SEQ ID NO: 455493 - DNA, 20 bp, mouse
gtagattgcttcctaaccca

SEQ ID NO: 455494 - DNA, 20 bp, mouse
gagtacccttgtccaggcac

SEQ ID NO: 455495 - DNA, 20 bp, mouse
gtactccacccttttcaaca

SEQ ID NO: 455496 - DNA, 20 bp, mouse
ggggctgaggaccaaggagt

SEQ ID NO: 455497 - DNA, 20 bp, mouse
ggtctggagacaactggtcc

SEQ ID NO: 455498 - DNA, 20 bp, mouse
gcctcgagtgagccagacaa

SEQ ID NO: 455499 - DNA, 20 bp, mouse
gacgccagtctggagacaac

SEQ ID NO: 455500 - DNA, 20 bp, mouse
gagcaggtttgtactggact

SEQ ID NO: 455501 - DNA, 20 bp, mouse
ggctcactcgagggtaggga

SEQ ID NO: 455502 - DNA, 20 bp, mouse
gccttggaggcacgccagtc

SEQ ID NO: 455503 - DNA, 20 bp, mouse
ggggagtgtactgttgagga

SEQ ID NO: 455504 - DNA, 20 bp, mouse
ggcccagccacagacagagc

SEQ ID NO: 455505 - DNA, 20 bp, mouse
gttgaggaaggtgcaacctc

SEQ ID NO: 455506 - DNA, 20 bp, mouse
gagagccatggaggccttgg

SEQ ID NO: 455507 - DNA, 20 bp, mouse
gcagctggcaagagccatgg

SEQ ID NO: 455508 - DNA, 20 bp, mouse
gctgcagctggcaagagcca

SEQ ID NO: 455509 - DNA, 20 bp, mouse
gcagcacggagcacctgagc

SEQ ID NO: 455510 - DNA, 20 bp, mouse
ggctgcccccaaggcctcca

SEQ ID NO: 455511 - DNA, 20 bp, mouse
gtgccagctgcagcctgctc

SEQ ID NO: 455512 - DNA, 20 bp, mouse
ggctgctccgccatctctct

SEQ ID NO: 455513 - DNA, 20 bp, mouse
gaactcaagcgaggtcacac

SEQ ID NO: 455514 - DNA, 20 bp, mouse
gggccttgggggcagctaca

SEQ ID NO: 455515 - DNA, 20 bp, mouse
gcccgggcaccaggcttcgg

SEQ ID NO: 455516 - DNA, 20 bp, mouse
gtcagtggtgatgggagttc

SEQ ID NO: 455517 - DNA, 20 bp, mouse
gtgtatggatcagtggtgat

SEQ ID NO: 455518 - DNA, 20 bp, mouse
gttgctcagtcggaacataa

SEQ ID NO: 455519 - DNA, 20 bp, mouse
gactgtcagggaagcggtca

SEQ ID NO: 455520 - DNA, 20 bp, mouse
gatcggttcacaagaaagca

SEQ ID NO: 455521 - DNA, 20 bp, mouse
ggacagtgaaagtattagtc

SEQ ID NO: 455522 - DNA, 20 bp, mouse
gtgagataaataagctaaat

SEQ ID NO: 455523 - DNA, 20 bp, mouse
gcagctatgaggtggctcct

SEQ ID NO: 455524 - DNA, 20 bp, mouse
gtagcatatgctttagtgat

SEQ ID NO: 455525 - DNA, 20 bp, mouse
gcagcccactatgaaaacca

SEQ ID NO: 455526 - DNA, 20 bp, mouse
gcactcaacagactcgggga

SEQ ID NO: 455527 - DNA, 20 bp, mouse
gctcggggagggttctcctt

SEQ ID NO: 455528 - DNA, 20 bp, mouse
ggtcagtgttgagtatgatg

SEQ ID NO: 455529 - DNA, 20 bp, mouse
gcacacggatggagttgcag

SEQ ID NO: 455530 - DNA, 20 bp, mouse
gatttgctgtcaacaacgat

SEQ ID NO: 455531 - DNA, 20 bp, mouse
ggagtgccccctctgggtgg

SEQ ID NO: 455532 - DNA, 20 bp, mouse
gggcgcatcccccacccaga

SEQ ID NO: 455533 - DNA, 20 bp, mouse
gtctgttgagtgccccctct

SEQ ID NO: 455534 - DNA, 20 bp, mouse
gcagccactgtccacacgga

SEQ ID NO: 455535 - DNA, 20 bp, mouse
gcatcacatggtcaactcga

SEQ ID NO: 455536 - DNA, 20 bp, mouse
gtgcttgcgggcaaaggtca

SEQ ID NO: 455537 - DNA, 20 bp, mouse
gactctcagcgagatgggaa

SEQ ID NO: 455538 - DNA, 20 bp, mouse
ggggagctgtgagactctag

SEQ ID NO: 455539 - DNA, 20 bp, mouse
gctcttactctcagcgagat

SEQ ID NO: 455540 - DNA, 20 bp, mouse
gggatgctgcttgcgggcaa

SEQ ID NO: 455541 - DNA, 20 bp, mouse
ggactctaggggagctcccc

SEQ ID NO: 455542 - DNA, 20 bp, mouse
gccgcaagcagcatccttgc

SEQ ID NO: 455543 - DNA, 20 bp, mouse
gatgaggcagcaggaacgaa

SEQ ID NO: 455544 - DNA, 20 bp, mouse
gcctactggatacacatact

SEQ ID NO: 455545 - DNA, 20 bp, mouse
gtgatctgtaagcgcagaaa

SEQ ID NO: 455546 - DNA, 20 bp, mouse
gggtcagccagccatgggga

SEQ ID NO: 455547 - DNA, 20 bp, mouse
ggttctgctcaccttcccca

SEQ ID NO: 455548 - DNA, 20 bp, mouse
gctggacactgaactcacca

SEQ ID NO: 455549 - DNA, 20 bp, mouse
gccacgggtcagccagccat

SEQ ID NO: 455550 - DNA, 20 bp, mouse
gatatagaccagccactctc

SEQ ID NO: 455551 - DNA, 20 bp, mouse
ggtaaacagtgaggacccct

SEQ ID NO: 455552 - DNA, 20 bp, mouse
ggctggtctatatagcagga

SEQ ID NO: 455553 - DNA, 20 bp, mouse
gtcaaacaggactcacatgg

SEQ ID NO: 455554 - DNA, 20 bp, mouse
gactgaaccgccttaacacg

SEQ ID NO: 455555 - DNA, 20 bp, mouse
gatgtggaatccagagagta

SEQ ID NO: 455556 - DNA, 20 bp, mouse
gactggcagcccgtgaagtt

SEQ ID NO: 455557 - DNA, 20 bp, mouse
ggggaagggacctgccctgg

SEQ ID NO: 455558 - DNA, 20 bp, mouse
ggtccagattctcaagactg

SEQ ID NO: 455559 - DNA, 20 bp, mouse
ggagaatctggactcacgtg

SEQ ID NO: 455560 - DNA, 20 bp, mouse
ggactgcagttgccagtata

SEQ ID NO: 455561 - DNA, 20 bp, mouse
gtatgagcagcccaacttca

SEQ ID NO: 455562 - DNA, 20 bp, mouse
gtcaacatttaaccttatac

SEQ ID NO: 455563 - DNA, 20 bp, mouse
gtgcctcagtcttgagaatc

SEQ ID NO: 455564 - DNA, 20 bp, mouse
gtgggtttttctttacaagc

SEQ ID NO: 455565 - DNA, 20 bp, mouse
gcccaaaatgaggatgccct

SEQ ID NO: 455566 - DNA, 20 bp, mouse
gggatcacataattgactgt

SEQ ID NO: 455567 - DNA, 20 bp, mouse
gtgtgaaaagactcacgtgg

SEQ ID NO: 455568 - DNA, 20 bp, mouse
gagtggcagccaccttcctc

SEQ ID NO: 455569 - DNA, 20 bp, mouse
gagctagtaatatctgtgac

SEQ ID NO: 455570 - DNA, 20 bp, mouse
gcagatattactagctggtc

SEQ ID NO: 455571 - DNA, 20 bp, mouse
gcacataattgactgtaggc

SEQ ID NO: 455572 - DNA, 20 bp, mouse
ggactggctcaagtcaggag

SEQ ID NO: 455573 - DNA, 20 bp, mouse
gaggacacagaaccagagga

SEQ ID NO: 455574 - DNA, 20 bp, mouse
gtctgtgactggctcaagtc

SEQ ID NO: 455575 - DNA, 20 bp, mouse
gtgatgtggcctggacccca

SEQ ID NO: 455576 - DNA, 20 bp, mouse
gcccagggcatccagaatgt

SEQ ID NO: 455577 - DNA, 20 bp, mouse
gcgaagttgggctagatcag

SEQ ID NO: 455578 - DNA, 20 bp, mouse
ggggcatccagaatgtgggg

SEQ ID NO: 455579 - DNA, 20 bp, mouse
gcaagtccctccccacattc

SEQ ID NO: 455580 - DNA, 20 bp, mouse
gtaggaagaaactcacgtgg

SEQ ID NO: 455581 - DNA, 20 bp, mouse
gaggggcagggtgagattga

SEQ ID NO: 455582 - DNA, 20 bp, mouse
gcttgggtccaggccatatc

SEQ ID NO: 455583 - DNA, 20 bp, mouse
gtagagaacccccacaagga

SEQ ID NO: 455584 - DNA, 20 bp, mouse
gttgggctagatcaggggca

SEQ ID NO: 455585 - DNA, 20 bp, mouse
gtaaccctcagctcgaagtt

SEQ ID NO: 455586 - DNA, 20 bp, mouse
gatggcgcaacgctcgggaa

SEQ ID NO: 455587 - DNA, 20 bp, mouse
gccactagcggggctccccg

SEQ ID NO: 455588 - DNA, 20 bp, mouse
gggagccccgctagtgggga

SEQ ID NO: 455589 - DNA, 20 bp, mouse
gagtggccagcgatacacca

SEQ ID NO: 455590 - DNA, 20 bp, mouse
gcaaccccgaagaacacctg

SEQ ID NO: 455591 - DNA, 20 bp, mouse
gacaccatggcgcaacgctc

SEQ ID NO: 455592 - DNA, 20 bp, mouse
gtatataccgggtctcgcag

SEQ ID NO: 455593 - DNA, 20 bp, mouse
gcccgaagaacacctggggt

SEQ ID NO: 455594 - DNA, 20 bp, mouse
ggagggcacagaccgacccc

SEQ ID NO: 455595 - DNA, 20 bp, mouse
ggggcgtgtatggagtacgt

SEQ ID NO: 455596 - DNA, 20 bp, mouse
gggtgtaaatgtgggaccca

SEQ ID NO: 455597 - DNA, 20 bp, mouse
gccacacgacgactctccct

SEQ ID NO: 455598 - DNA, 20 bp, mouse
gagtatagaggtgtaaatgt

SEQ ID NO: 455599 - DNA, 20 bp, mouse
gaggttcttaataagtatag

SEQ ID NO: 455600 - DNA, 20 bp, mouse
ggtgtggacgctctcacttg

SEQ ID NO: 455601 - DNA, 20 bp, mouse
gtaagggagctaggaagtcg

SEQ ID NO: 455602 - DNA, 20 bp, mouse
gtagagcacaggcaccgcca

SEQ ID NO: 455603 - DNA, 20 bp, mouse
gcccaaatcccccaacacaa

SEQ ID NO: 455604 - DNA, 20 bp, mouse
gttaactgggaagatcggat

SEQ ID NO: 455605 - DNA, 20 bp, mouse
gactgggaagatcggatggg

SEQ ID NO: 455606 - DNA, 20 bp, mouse
ggctccaggactacaggcag

SEQ ID NO: 455607 - DNA, 20 bp, mouse
gggatctctctcagtagtgc

SEQ ID NO: 455608 - DNA, 20 bp, mouse
gtgtagtcctggagctgccc

SEQ ID NO: 455609 - DNA, 20 bp, mouse
gcggaaggcagcccttgcaa

SEQ ID NO: 455610 - DNA, 20 bp, mouse
gttagacattgtatgtgcaa

SEQ ID NO: 455611 - DNA, 20 bp, mouse
gtacatctccagctgccgga

SEQ ID NO: 455612 - DNA, 20 bp, mouse
ggtccctctgcctgtagtcc

SEQ ID NO: 455613 - DNA, 20 bp, mouse
gggcagagggacatttatag

SEQ ID NO: 455614 - DNA, 20 bp, mouse
gtaacagtaactctttaacg

SEQ ID NO: 455615 - DNA, 20 bp, mouse
gcactagtttactcatctca

SEQ ID NO: 455616 - DNA, 20 bp, mouse
gcccgctgctggggacgcca

SEQ ID NO: 455617 - DNA, 20 bp, mouse
ggtacagctgcgttagcgga

SEQ ID NO: 455618 - DNA, 20 bp, mouse
ggccaggcccggatctgcca

SEQ ID NO: 455619 - DNA, 20 bp, mouse
gcgggcggggtggtgatcgt

SEQ ID NO: 455620 - DNA, 20 bp, mouse
gcgggtcgcgcgccagaata

SEQ ID NO: 455621 - DNA, 20 bp, mouse
gggccgtgggtgcctcgggt

SEQ ID NO: 455622 - DNA, 20 bp, mouse
ggccatggcgtccccagcag

SEQ ID NO: 455623 - DNA, 20 bp, mouse
gctggcagtagactaggtgg

SEQ ID NO: 455624 - DNA, 20 bp, mouse
gggctgtacagctgcgttag

SEQ ID NO: 455625 - DNA, 20 bp, mouse
ggccatggcagatccgggcc

SEQ ID NO: 455626 - DNA, 20 bp, mouse
gggcaggcggcgagatgaag

SEQ ID NO: 455627 - DNA, 20 bp, mouse
ggccgcctgccttcgaaccc

SEQ ID NO: 455628 - DNA, 20 bp, mouse
ggcccgggttcgaaggcagg

SEQ ID NO: 455629 - DNA, 20 bp, mouse
gtgtttcagcccgggttcga

SEQ ID NO: 455630 - DNA, 20 bp, mouse
ggcctgtagccaagcaccga

SEQ ID NO: 455631 - DNA, 20 bp, mouse
ggcaccgagggtgagtgtaa

SEQ ID NO: 455632 - DNA, 20 bp, mouse
gcctctgcgctcaggaacgc

SEQ ID NO: 455633 - DNA, 20 bp, mouse
gtcagcccgggttcgaaggc

SEQ ID NO: 455634 - DNA, 20 bp, mouse
gcaggcagtccgctcattta

SEQ ID NO: 455635 - DNA, 20 bp, mouse
ggtggagtgtgtttcagccc

SEQ ID NO: 455636 - DNA, 20 bp, mouse
gaagctccagaaggtctgtg

SEQ ID NO: 455637 - DNA, 20 bp, mouse
gacttaccctcctctagagt

SEQ ID NO: 455638 - DNA, 20 bp, mouse
gagaccttctggagcttagg

SEQ ID NO: 455639 - DNA, 20 bp, mouse
gtgtttcctactctagagga

SEQ ID NO: 455640 - DNA, 20 bp, mouse
gagtaggcagctaccccagt

SEQ ID NO: 455641 - DNA, 20 bp, mouse
gggcgcgagtgcctgggtgg

SEQ ID NO: 455642 - DNA, 20 bp, mouse
gcggccggtggttccgactg

SEQ ID NO: 455643 - DNA, 20 bp, mouse
gacaggcgtaaaccgagagg

SEQ ID NO: 455644 - DNA, 20 bp, mouse
ggtgcgccgccagaccgtac

SEQ ID NO: 455645 - DNA, 20 bp, mouse
gcgtacaggcgtaaaccgag

SEQ ID NO: 455646 - DNA, 20 bp, mouse
gggctctctgcagaaggact

SEQ ID NO: 455647 - DNA, 20 bp, mouse
gaggactgggaaggtggcgg

SEQ ID NO: 455648 - DNA, 20 bp, mouse
gtgacgggcagtctgaccaa

SEQ ID NO: 455649 - DNA, 20 bp, mouse
ggcgaaggcgctggcggttg

SEQ ID NO: 455650 - DNA, 20 bp, mouse
gcaagggacgagacaaggat

SEQ ID NO: 455651 - DNA, 20 bp, mouse
gcgttcttccctggctcacc

SEQ ID NO: 455652 - DNA, 20 bp, mouse
gagtattacccgcccctcgg

SEQ ID NO: 455653 - DNA, 20 bp, mouse
ggacacacatcgttcttccc

SEQ ID NO: 455654 - DNA, 20 bp, mouse
ggtactgtttggacccaaga

SEQ ID NO: 455655 - DNA, 20 bp, mouse
gcccttgaaggcgtaactag

SEQ ID NO: 455656 - DNA, 20 bp, mouse
gtggagaccgcgccaaccgg

SEQ ID NO: 455657 - DNA, 20 bp, mouse
gggcggacaaggttgaaagg

SEQ ID NO: 455658 - DNA, 20 bp, mouse
gctggcgggaagggaccgaa

SEQ ID NO: 455659 - DNA, 20 bp, mouse
gaccggcggacaaggttgaa

SEQ ID NO: 455660 - DNA, 20 bp, mouse
gccgcgccaaccggcggaca

SEQ ID NO: 455661 - DNA, 20 bp, mouse
gggagcggtcgccgctgtga

SEQ ID NO: 455662 - DNA, 20 bp, mouse
gaaggaggcggctgagggga

SEQ ID NO: 455663 - DNA, 20 bp, mouse
ggccaaggtgagcttaaagg

SEQ ID NO: 455664 - DNA, 20 bp, mouse
ggcgttcaccttagccggaa

SEQ ID NO: 455665 - DNA, 20 bp, mouse
ggagggctgcgctccggtgt

SEQ ID NO: 455666 - DNA, 20 bp, mouse
gaagaacactcagtacctaa

SEQ ID NO: 455667 - DNA, 20 bp, mouse
gcggccgccatcttcactga

SEQ ID NO: 455668 - DNA, 20 bp, mouse
gggctcgcctggaaccttta

SEQ ID NO: 455669 - DNA, 20 bp, mouse
ggtaccgcaggactgcgcaa

SEQ ID NO: 455670 - DNA, 20 bp, mouse
ggtacctaaaggttccctaa

SEQ ID NO: 455671 - DNA, 20 bp, mouse
ggagctgccctcagtgaaga

SEQ ID NO: 455672 - DNA, 20 bp, mouse
gtccggtgcctgctgctgtg

SEQ ID NO: 455673 - DNA, 20 bp, mouse
ggagccgttgcgcagtcctg

SEQ ID NO: 455674 - DNA, 20 bp, mouse
gaaggttccctaaaggttcc

SEQ ID NO: 455675 - DNA, 20 bp, mouse
gtactgagtgttctttgaga

SEQ ID NO: 455676 - DNA, 20 bp, mouse
gagccagagtcacatggcag

SEQ ID NO: 455677 - DNA, 20 bp, mouse
gcagtatccgaggagatggt

SEQ ID NO: 455678 - DNA, 20 bp, mouse
gagggcagtggcagtatccg

SEQ ID NO: 455679 - DNA, 20 bp, mouse
ggagatggtgggaacaaaga

SEQ ID NO: 455680 - DNA, 20 bp, mouse
gtgccactgccatgtgactc

SEQ ID NO: 455681 - DNA, 20 bp, mouse
gcagcaggctgaatgaggaa

SEQ ID NO: 455682 - DNA, 20 bp, mouse
gcctggctgagttcacatta

SEQ ID NO: 455683 - DNA, 20 bp, mouse
ggtggcagtatccgaggaga

SEQ ID NO: 455684 - DNA, 20 bp, mouse
ggccacggggtccccatcca

SEQ ID NO: 455685 - DNA, 20 bp, mouse
gaccctggatggggaccccg

SEQ ID NO: 455686 - DNA, 20 bp, mouse
gtgagtgagtgaggggcccg

SEQ ID NO: 455687 - DNA, 20 bp, mouse
gggtgtgcaggaggcacctc

SEQ ID NO: 455688 - DNA, 20 bp, mouse
gctgtggagctggctcgcag

SEQ ID NO: 455689 - DNA, 20 bp, mouse
gcagctgccacggcgaggta

SEQ ID NO: 455690 - DNA, 20 bp, mouse
gggcgaggtaagggacctga

SEQ ID NO: 455691 - DNA, 20 bp, mouse
gctggataatgcactctccg

SEQ ID NO: 455692 - DNA, 20 bp, mouse
gtggcagaggcaggggccga

SEQ ID NO: 455693 - DNA, 20 bp, mouse
gcatcctgacgtcagcagga

SEQ ID NO: 455694 - DNA, 20 bp, mouse
gcgccgtggcagctgggtcc

SEQ ID NO: 455695 - DNA, 20 bp, mouse
gacctgaaggaagccggtga

SEQ ID NO: 455696 - DNA, 20 bp, mouse
gtatggcggcgctggagagg

SEQ ID NO: 455697 - DNA, 20 bp, mouse
gcgggccgtgctgcttatgg

SEQ ID NO: 455698 - DNA, 20 bp, mouse
ggcagcacggcccggtacgt

SEQ ID NO: 455699 - DNA, 20 bp, mouse
ggacctcagtgttaaagtgg

SEQ ID NO: 455700 - DNA, 20 bp, mouse
ggcttatggcggcgctggag

SEQ ID NO: 455701 - DNA, 20 bp, mouse
ggccggccctgaggccgaga

SEQ ID NO: 455702 - DNA, 20 bp, mouse
ggccgagacggttgaagcca

SEQ ID NO: 455703 - DNA, 20 bp, mouse
gccgcgaagccttagtgagg

SEQ ID NO: 455704 - DNA, 20 bp, mouse
gaaaaagggacgcctggagt

SEQ ID NO: 455705 - DNA, 20 bp, mouse
gccccgccaagccgcagagg

SEQ ID NO: 455706 - DNA, 20 bp, mouse
gtgaatgtgaggcggagcag

SEQ ID NO: 455707 - DNA, 20 bp, mouse
ggggacgccgagaccgagga

SEQ ID NO: 455708 - DNA, 20 bp, mouse
gccagggtttgaatgtgagg

SEQ ID NO: 455709 - DNA, 20 bp, mouse
ggtcaggcccgacccagagg

SEQ ID NO: 455710 - DNA, 20 bp, mouse
ggcggagcagcggctggagt

SEQ ID NO: 455711 - DNA, 20 bp, mouse
ggcggtcaggcccgacccag

SEQ ID NO: 455712 - DNA, 20 bp, mouse
gaatggcgcggcggctaagg

SEQ ID NO: 455713 - DNA, 20 bp, mouse
gtgtgaggcggagcagcggc

SEQ ID NO: 455714 - DNA, 20 bp, mouse
gccgccgcgccattttgcca

SEQ ID NO: 455715 - DNA, 20 bp, mouse
gcgtggggacgccgagaccg

SEQ ID NO: 455716 - DNA, 20 bp, mouse
gagcgacaccgagagcaccg

SEQ ID NO: 455717 - DNA, 20 bp, mouse
gcaagggagcgagcgaacca

SEQ ID NO: 455718 - DNA, 20 bp, mouse
ggcacagccacagagcgacg

SEQ ID NO: 455719 - DNA, 20 bp, mouse
ggttgcagcttaccgaagaa

SEQ ID NO: 455720 - DNA, 20 bp, mouse
gagggccacgccgctgtcct

SEQ ID NO: 455721 - DNA, 20 bp, mouse
ggcgccccgcgcggtcatac

SEQ ID NO: 455722 - DNA, 20 bp, mouse
gctgggcagctggcgagaag

SEQ ID NO: 455723 - DNA, 20 bp, mouse
ggcggcgtggccctcgaccg

SEQ ID NO: 455724 - DNA, 20 bp, mouse
ggagcccgcgccccggtcga

SEQ ID NO: 455725 - DNA, 20 bp, mouse
gagagctagcggggacgacc

SEQ ID NO: 455726 - DNA, 20 bp, mouse
gagcgtgagccgatgcaggt

SEQ ID NO: 455727 - DNA, 20 bp, mouse
gccgatgcaggttggagagt

SEQ ID NO: 455728 - DNA, 20 bp, mouse
gggctcacgctatcccctgg

SEQ ID NO: 455729 - DNA, 20 bp, mouse
gctgctagttctgtgaggac

SEQ ID NO: 455730 - DNA, 20 bp, mouse
ggagaagagtaggtgagagt

SEQ ID NO: 455731 - DNA, 20 bp, mouse
gggatagcgtgagccgatgc

SEQ ID NO: 455732 - DNA, 20 bp, mouse
gcccagctgctagttctgtg

SEQ ID NO: 455733 - DNA, 20 bp, mouse
gatcggctcacgctatcccc

SEQ ID NO: 455734 - DNA, 20 bp, mouse
gcgtctgcaggtgggaggga

SEQ ID NO: 455735 - DNA, 20 bp, mouse
gtggagagtcggctgggcac

SEQ ID NO: 455736 - DNA, 20 bp, mouse
gtaaggtcctgaggaggatg

SEQ ID NO: 455737 - DNA, 20 bp, mouse
gcagtgatgggtgagcgggt

SEQ ID NO: 455738 - DNA, 20 bp, mouse
ggagaaaggctaaggtcctg

SEQ ID NO: 455739 - DNA, 20 bp, mouse
gaaaggctaaggtcctgagg

SEQ ID NO: 455740 - DNA, 20 bp, mouse
ggctgtagaccacaatgccc

SEQ ID NO: 455741 - DNA, 20 bp, mouse
gcaaggccgggtgacagtga

SEQ ID NO: 455742 - DNA, 20 bp, mouse
gcaagacaagggccaatggg

SEQ ID NO: 455743 - DNA, 20 bp, mouse
gctgcagccacatcctcctc

SEQ ID NO: 455744 - DNA, 20 bp, mouse
ggccgtgttaccaagctgaa

SEQ ID NO: 455745 - DNA, 20 bp, mouse
gctgtcacgttggtgagtga

SEQ ID NO: 455746 - DNA, 20 bp, mouse
gggctctgacctgagacagg

SEQ ID NO: 455747 - DNA, 20 bp, mouse
gcttcctgcgatggatggtg

SEQ ID NO: 455748 - DNA, 20 bp, mouse
ggcgatggatggtgaggcct

SEQ ID NO: 455749 - DNA, 20 bp, mouse
gggacacagacgctgcgccc

SEQ ID NO: 455750 - DNA, 20 bp, mouse
gaccttgtacccgagaccca

SEQ ID NO: 455751 - DNA, 20 bp, mouse
gcagggctcagacccacggg

SEQ ID NO: 455752 - DNA, 20 bp, mouse
ggggggcttcctgcgatgga

SEQ ID NO: 455753 - DNA, 20 bp, mouse
ggcacacagtagggccaggt

SEQ ID NO: 455754 - DNA, 20 bp, mouse
ggtttcccaacctgcagatg

SEQ ID NO: 455755 - DNA, 20 bp, mouse
gccccagggctcagacccac

SEQ ID NO: 455756 - DNA, 20 bp, mouse
ggaggggcaccccggagcat

SEQ ID NO: 455757 - DNA, 20 bp, mouse
ggcttcctgatgcagagctg

SEQ ID NO: 455758 - DNA, 20 bp, mouse
gacggttaggatacgctctg

SEQ ID NO: 455759 - DNA, 20 bp, mouse
gtcccagctccaatgctccg

SEQ ID NO: 455760 - DNA, 20 bp, mouse
gctccagggtggaaaaggac

SEQ ID NO: 455761 - DNA, 20 bp, mouse
ggcccgatatagagctttag

SEQ ID NO: 455762 - DNA, 20 bp, mouse
gaccccggagcattggagct

SEQ ID NO: 455763 - DNA, 20 bp, mouse
ggaattaagtaacatatgga

SEQ ID NO: 455764 - DNA, 20 bp, mouse
gcagggaattaagtaacata

SEQ ID NO: 455765 - DNA, 20 bp, mouse
gtcccctaaagctctatatc

SEQ ID NO: 455766 - DNA, 20 bp, mouse
gctgatacggagctaaggat

SEQ ID NO: 455767 - DNA, 20 bp, mouse
gggtaagtggcttcctgata

SEQ ID NO: 455768 - DNA, 20 bp, mouse
ggcatgccggaacattggag

SEQ ID NO: 455769 - DNA, 20 bp, mouse
gtgaccagaaactcaggata

SEQ ID NO: 455770 - DNA, 20 bp, mouse
ggactgaagtaacatatggg

SEQ ID NO: 455771 - DNA, 20 bp, mouse
ggaggggcatgccggaacat

SEQ ID NO: 455772 - DNA, 20 bp, mouse
gtagggactgaagtaacata

SEQ ID NO: 455773 - DNA, 20 bp, mouse
gtggagcggggaacaaagtc

SEQ ID NO: 455774 - DNA, 20 bp, mouse
ggcttcctgatacggagcta

SEQ ID NO: 455775 - DNA, 20 bp, mouse
gtccctgaaagctctatgtg

SEQ ID NO: 455776 - DNA, 20 bp, mouse
gcacccagggcaggtaacca

SEQ ID NO: 455777 - DNA, 20 bp, mouse
gccagatcacccagaatcca

SEQ ID NO: 455778 - DNA, 20 bp, mouse
gagaggcgcatgaagctaat

SEQ ID NO: 455779 - DNA, 20 bp, mouse
gggctcaactttctgcccag

SEQ ID NO: 455780 - DNA, 20 bp, mouse
gacttaagcaggaagcttcg

SEQ ID NO: 455781 - DNA, 20 bp, mouse
gtctctccattccacaccca

SEQ ID NO: 455782 - DNA, 20 bp, mouse
gaagttgagccatggattct

SEQ ID NO: 455783 - DNA, 20 bp, mouse
ggggctaggagcaaacagac

SEQ ID NO: 455784 - DNA, 20 bp, mouse
gtgccagggcccagctccag

SEQ ID NO: 455785 - DNA, 20 bp, mouse
gtaagtccctggagcaagtg

SEQ ID NO: 455786 - DNA, 20 bp, mouse
ggaacttgccccaagaggag

SEQ ID NO: 455787 - DNA, 20 bp, mouse
gagagagagcacaagcgtgg

SEQ ID NO: 455788 - DNA, 20 bp, mouse
gcctccccctacttacactg

SEQ ID NO: 455789 - DNA, 20 bp, mouse
gttcgggaacttgccccaag

SEQ ID NO: 455790 - DNA, 20 bp, mouse
gctagccccagtgtaagtag

SEQ ID NO: 455791 - DNA, 20 bp, mouse
ggagcacaagcgtgggggct

SEQ ID NO: 455792 - DNA, 20 bp, mouse
gtgtgtgtatagcatcaggg

SEQ ID NO: 455793 - DNA, 20 bp, mouse
gtctgaaggatagggactct

SEQ ID NO: 455794 - DNA, 20 bp, mouse
gcctgctagggccacatcag

SEQ ID NO: 455795 - DNA, 20 bp, mouse
gaggctaagggaaccgggag

SEQ ID NO: 455796 - DNA, 20 bp, mouse
gacagcggagccggatccct

SEQ ID NO: 455797 - DNA, 20 bp, mouse
ggcctcgcaagggctacaga

SEQ ID NO: 455798 - DNA, 20 bp, mouse
gcagcggctgttggaactgg

SEQ ID NO: 455799 - DNA, 20 bp, mouse
gaggggagcagcgtagccga

SEQ ID NO: 455800 - DNA, 20 bp, mouse
gccagggccgcctcgcagga

SEQ ID NO: 455801 - DNA, 20 bp, mouse
gcggctgttggaactggagg

SEQ ID NO: 455802 - DNA, 20 bp, mouse
gagagaccactgctgtccta

SEQ ID NO: 455803 - DNA, 20 bp, mouse
gagtggtctctggaagccag

SEQ ID NO: 455804 - DNA, 20 bp, mouse
gcccgacctcgacctcaggg

SEQ ID NO: 455805 - DNA, 20 bp, mouse
gagcggtgcaggcgtcctcc

SEQ ID NO: 455806 - DNA, 20 bp, mouse
ggaggcgcggcaggacacgg

SEQ ID NO: 455807 - DNA, 20 bp, mouse
gaagtggcggtgctccgcgg

SEQ ID NO: 455808 - DNA, 20 bp, mouse
gccagaggcgcggcaggaca

SEQ ID NO: 455809 - DNA, 20 bp, mouse
gcggaagtggcggtgctccg

SEQ ID NO: 455810 - DNA, 20 bp, mouse
gcagaggcggcgacgctgag

SEQ ID NO: 455811 - DNA, 20 bp, mouse
gtcctcgcgcgcgccggaag

SEQ ID NO: 455812 - DNA, 20 bp, mouse
gaacgggaccagcctcggga

SEQ ID NO: 455813 - DNA, 20 bp, mouse
gcagcggtccctggcagcag

SEQ ID NO: 455814 - DNA, 20 bp, mouse
ggcctcgggagggcgcgtca

SEQ ID NO: 455815 - DNA, 20 bp, mouse
ggccgggccggccccgcgca

SEQ ID NO: 455816 - DNA, 20 bp, mouse
gtcgcccgggctccgatggg

SEQ ID NO: 455817 - DNA, 20 bp, mouse
gtggcgcggaagcgcaagga

SEQ ID NO: 455818 - DNA, 20 bp, mouse
gggccaacctcagctcgccc

SEQ ID NO: 455819 - DNA, 20 bp, mouse
gcagctcgcccgggctccga

SEQ ID NO: 455820 - DNA, 20 bp, mouse
ggcaggcgcgccgcagcggg

SEQ ID NO: 455821 - DNA, 20 bp, mouse
gaccccggtgggattccccg

SEQ ID NO: 455822 - DNA, 20 bp, mouse
gccgatgggaggaagctcgc

SEQ ID NO: 455823 - DNA, 20 bp, mouse
gggcctggtgagaggaagcg

SEQ ID NO: 455824 - DNA, 20 bp, mouse
gcttcctcccatcggagccc

SEQ ID NO: 455825 - DNA, 20 bp, mouse
ggaccgcagtgcccccagag

SEQ ID NO: 455826 - DNA, 20 bp, mouse
ggaccgatctgagcctcgga

SEQ ID NO: 455827 - DNA, 20 bp, mouse
gctgatgtctgagccctccg

SEQ ID NO: 455828 - DNA, 20 bp, mouse
gagccctccgaggctcagat

SEQ ID NO: 455829 - DNA, 20 bp, mouse
gaggacatcagcatcccaag

SEQ ID NO: 455830 - DNA, 20 bp, mouse
gcctggcaggatgggatcaa

SEQ ID NO: 455831 - DNA, 20 bp, mouse
gcagagaccgatctgagcct

SEQ ID NO: 455832 - DNA, 20 bp, mouse
ggctacagcaattttttcaa

SEQ ID NO: 455833 - DNA, 20 bp, mouse
gtcaaaggaacgaagccact

SEQ ID NO: 455834 - DNA, 20 bp, mouse
gtagcagtctgcttaaagga

SEQ ID NO: 455835 - DNA, 20 bp, mouse
gggaatggccgccactgtga

SEQ ID NO: 455836 - DNA, 20 bp, mouse
ggccgggcaggaaggcacca

SEQ ID NO: 455837 - DNA, 20 bp, mouse
gtctcctccgaggaacaacc

SEQ ID NO: 455838 - DNA, 20 bp, mouse
gtcgggtccgagccactgcg

SEQ ID NO: 455839 - DNA, 20 bp, mouse
gacagaaccgccagcaccag

SEQ ID NO: 455840 - DNA, 20 bp, mouse
gcctgcgggagcactagcag

SEQ ID NO: 455841 - DNA, 20 bp, mouse
ggagtccggtaatcaccaaa

SEQ ID NO: 455842 - DNA, 20 bp, mouse
gggagaccggcgcatccgag

SEQ ID NO: 455843 - DNA, 20 bp, mouse
gacccaccgagaggggaagg

SEQ ID NO: 455844 - DNA, 20 bp, mouse
gtggagagagagccagcgag

SEQ ID NO: 455845 - DNA, 20 bp, mouse
gagcatcttcagccccgcag

SEQ ID NO: 455846 - DNA, 20 bp, mouse
ggtagccgtaagggaaccct

SEQ ID NO: 455847 - DNA, 20 bp, mouse
gagagcccagggttccctta

SEQ ID NO: 455848 - DNA, 20 bp, mouse
gtccaccttcagggtcccaa

SEQ ID NO: 455849 - DNA, 20 bp, mouse
ggtagttcgggtagccgtaa

SEQ ID NO: 455850 - DNA, 20 bp, mouse
gtgtgccattgggaccctga

SEQ ID NO: 455851 - DNA, 20 bp, mouse
gatggcacagtggagagccc

SEQ ID NO: 455852 - DNA, 20 bp, mouse
gcgtgcagttggcgtagttc

SEQ ID NO: 455853 - DNA, 20 bp, mouse
gggcagagaaccttcgaaca

SEQ ID NO: 455854 - DNA, 20 bp, mouse
gcaccgcggaggaccagcac

SEQ ID NO: 455855 - DNA, 20 bp, mouse
gactaactggaagataaagg

SEQ ID NO: 455856 - DNA, 20 bp, mouse
ggctcgcgaataatatgaaa

SEQ ID NO: 455857 - DNA, 20 bp, mouse
ggcaacaactctactgcgct

SEQ ID NO: 455858 - DNA, 20 bp, mouse
gggtcacagctcggagtgaa

SEQ ID NO: 455859 - DNA, 20 bp, mouse
gaccacagaagagggtaccc

SEQ ID NO: 455860 - DNA, 20 bp, mouse
gttggtgcgcggtcacagct

SEQ ID NO: 455861 - DNA, 20 bp, mouse
gcctcttctgtggtggacat

SEQ ID NO: 455862 - DNA, 20 bp, mouse
gcctatctgaggggaggaaa

SEQ ID NO: 455863 - DNA, 20 bp, mouse
gatatgaaagggagccgcaa

SEQ ID NO: 455864 - DNA, 20 bp, mouse
gcagcgtcaataaaaagacg

SEQ ID NO: 455865 - DNA, 20 bp, mouse
gcttcaggatgaagtctagg

SEQ ID NO: 455866 - DNA, 20 bp, mouse
gtaccttgaacccaagagta

SEQ ID NO: 455867 - DNA, 20 bp, mouse
ggagtagggagagggaatct

SEQ ID NO: 455868 - DNA, 20 bp, mouse
gctccctactcttgggttca

SEQ ID NO: 455869 - DNA, 20 bp, mouse
gagtttcaaatagatttcca

SEQ ID NO: 455870 - DNA, 20 bp, mouse
gatgcatgaaaatttctgtt

SEQ ID NO: 455871 - DNA, 20 bp, mouse
gttttaagctcttagcgtac

SEQ ID NO: 455872 - DNA, 20 bp, mouse
gtttgcccactttgcaaatg

SEQ ID NO: 455873 - DNA, 20 bp, mouse
gattccctctccctactctt

SEQ ID NO: 455874 - DNA, 20 bp, mouse
gtgggagatgatcaagaaga

SEQ ID NO: 455875 - DNA, 20 bp, mouse
gatcaagaagatggctgagg

SEQ ID NO: 455876 - DNA, 20 bp, mouse
gtccccaaatggaagacgag

SEQ ID NO: 455877 - DNA, 20 bp, mouse
gaatggaagacgagaggaat

SEQ ID NO: 455878 - DNA, 20 bp, mouse
gcattaccttgctccccaaa

SEQ ID NO: 455879 - DNA, 20 bp, mouse
gggtagatgatgatctgcag

SEQ ID NO: 455880 - DNA, 20 bp, mouse
gtcctctcgtcttccatttg

SEQ ID NO: 455881 - DNA, 20 bp, mouse
gagcacaatgactctcacat

SEQ ID NO: 455882 - DNA, 20 bp, mouse
ggtcttccatttggggagca

SEQ ID NO: 455883 - DNA, 20 bp, mouse
gtgaatgttagtttttaact

SEQ ID NO: 455884 - DNA, 20 bp, mouse
gaataattttcagtgatggc

SEQ ID NO: 455885 - DNA, 20 bp, mouse
gaaattattctaaagattcc

SEQ ID NO: 455886 - DNA, 20 bp, mouse
ggatgagtgaaaatatgtag

SEQ ID NO: 455887 - DNA, 20 bp, mouse
ggacagcttgtcttcaactt

SEQ ID NO: 455888 - DNA, 20 bp, mouse
ggtccaggcaatgagagacc

SEQ ID NO: 455889 - DNA, 20 bp, mouse
gggtagaatgaacgactgta

SEQ ID NO: 455890 - DNA, 20 bp, mouse
ggtcttcaacttaggaagca

SEQ ID NO: 455891 - DNA, 20 bp, mouse
gtcccaggtctctcattgcc

SEQ ID NO: 455892 - DNA, 20 bp, mouse
ggacttagacacttgttgtt

SEQ ID NO: 455893 - DNA, 20 bp, mouse
gagtaaggtcaccaaaatga

SEQ ID NO: 455894 - DNA, 20 bp, mouse
gaagtcttagttcaaaagta

SEQ ID NO: 455895 - DNA, 20 bp, mouse
gttatacttatctctatgct

SEQ ID NO: 455896 - DNA, 20 bp, mouse
gtagtggaggacaagagagg

SEQ ID NO: 455897 - DNA, 20 bp, mouse
gaagttcttacctttagtgg

SEQ ID NO: 455898 - DNA, 20 bp, mouse
gtacggtcacagagtctgat

SEQ ID NO: 455899 - DNA, 20 bp, mouse
gctgaagttcttacctttag

SEQ ID NO: 455900 - DNA, 20 bp, mouse
gcaaataagatagattactt

SEQ ID NO: 455901 - DNA, 20 bp, mouse
gagccagtgactactatgaa

SEQ ID NO: 455902 - DNA, 20 bp, mouse
gtccccttcatagtagtcac

SEQ ID NO: 455903 - DNA, 20 bp, mouse
gtacaaattataatgacaac

SEQ ID NO: 455904 - DNA, 20 bp, mouse
gggcatttctgacttttgaa

SEQ ID NO: 455905 - DNA, 20 bp, mouse
gatacactcaaattatatca

SEQ ID NO: 455906 - DNA, 20 bp, mouse
gggtcttctctgcagctaag

SEQ ID NO: 455907 - DNA, 20 bp, mouse
gtctacatcatcactgccct

SEQ ID NO: 455908 - DNA, 20 bp, mouse
gcaattcttgcttggcagta

SEQ ID NO: 455909 - DNA, 20 bp, mouse
gaagaattgactccaaataa

SEQ ID NO: 455910 - DNA, 20 bp, mouse
gcttggcagtagggtttgcc

SEQ ID NO: 455911 - DNA, 20 bp, mouse
gttctctgcagctaagaggc

SEQ ID NO: 455912 - DNA, 20 bp, mouse
gagtctccgttatttatctt

SEQ ID NO: 455913 - DNA, 20 bp, mouse
gaattacagggtattagtac

SEQ ID NO: 455914 - DNA, 20 bp, mouse
gataacggagactaattaca

SEQ ID NO: 455915 - DNA, 20 bp, mouse
gtttggagtcaattcttgct

SEQ ID NO: 455916 - DNA, 20 bp, mouse
gggaagccgtcactccgccg

SEQ ID NO: 455917 - DNA, 20 bp, mouse
gagctagagtaacaagatgg

SEQ ID NO: 455918 - DNA, 20 bp, mouse
gagcggctcccggggactgg

SEQ ID NO: 455919 - DNA, 20 bp, mouse
gggcggcctcggcggagtga

SEQ ID NO: 455920 - DNA, 20 bp, mouse
gagtaacaagatggcggcct

SEQ ID NO: 455921 - DNA, 20 bp, mouse
ggccgcccgagaacaacaag

SEQ ID NO: 455922 - DNA, 20 bp, mouse
gccgccggctccggcccgga

SEQ ID NO: 455923 - DNA, 20 bp, mouse
gaaaggggcgcggtgaacga

SEQ ID NO: 455924 - DNA, 20 bp, mouse
gggttcgtgaagggtggtcg

SEQ ID NO: 455925 - DNA, 20 bp, mouse
gtcctgagacgcgaagatgg

SEQ ID NO: 455926 - DNA, 20 bp, mouse
gcagctccatggcagcggtg

SEQ ID NO: 455927 - DNA, 20 bp, mouse
gacccaggaagcggccgggc

SEQ ID NO: 455928 - DNA, 20 bp, mouse
gaccctcagctccatggcag

SEQ ID NO: 455929 - DNA, 20 bp, mouse
gcctcccggagcgcagaccc

SEQ ID NO: 455930 - DNA, 20 bp, mouse
ggcagacccaggaagcggcc

SEQ ID NO: 455931 - DNA, 20 bp, mouse
gtcgggaacaggtaccgact

SEQ ID NO: 455932 - DNA, 20 bp, mouse
gaccgactgggccgcaagat

SEQ ID NO: 455933 - DNA, 20 bp, mouse
gggagctgagggtcgggaac

SEQ ID NO: 455934 - DNA, 20 bp, mouse
gtgaggcgctgagagcgacg

SEQ ID NO: 455935 - DNA, 20 bp, mouse
gcggaccggacccgcagtag

SEQ ID NO: 455936 - DNA, 20 bp, mouse
ggcgccgcccgtgaggacaa

SEQ ID NO: 455937 - DNA, 20 bp, mouse
ggcggagcctgagcccggcc

SEQ ID NO: 455938 - DNA, 20 bp, mouse
gccggcgcggtgagcatcgg

SEQ ID NO: 455939 - DNA, 20 bp, mouse
gcgcggcccggcgaatcctc

SEQ ID NO: 455940 - DNA, 20 bp, mouse
ggccgccgggtgcaccgagg

SEQ ID NO: 455941 - DNA, 20 bp, mouse
gccgccggggcggatgccag

SEQ ID NO: 455942 - DNA, 20 bp, mouse
gtcctttgtggcgagaagaa

SEQ ID NO: 455943 - DNA, 20 bp, mouse
gcaggccgccgggtgcaccg

SEQ ID NO: 455944 - DNA, 20 bp, mouse
ggctcggcccggccgggctc

SEQ ID NO: 455945 - DNA, 20 bp, mouse
ggccgcctcggtgcacccgg

SEQ ID NO: 455946 - DNA, 20 bp, mouse
gaaagctgcggcttaagggg

SEQ ID NO: 455947 - DNA, 20 bp, mouse
gtcccaggagcgggagggag

SEQ ID NO: 455948 - DNA, 20 bp, mouse
gggtggttgagagaagcagt

SEQ ID NO: 455949 - DNA, 20 bp, mouse
gagcagtaggcgcctcgggg

SEQ ID NO: 455950 - DNA, 20 bp, mouse
gagcaaagctgcggcttaag

SEQ ID NO: 455951 - DNA, 20 bp, mouse
gtgctttcccaggagcggga

SEQ ID NO: 455952 - DNA, 20 bp, mouse
gagagaagcagtaggcgcct

SEQ ID NO: 455953 - DNA, 20 bp, mouse
ggagtacctacctaaatcag

SEQ ID NO: 455954 - DNA, 20 bp, mouse
gtgtccgtggagggttgcgg

SEQ ID NO: 455955 - DNA, 20 bp, mouse
gcatccagggccgaaatcaa

SEQ ID NO: 455956 - DNA, 20 bp, mouse
ggccagcgtccgccagcggg

SEQ ID NO: 455957 - DNA, 20 bp, mouse
ggggacagtgagggatactg

SEQ ID NO: 455958 - DNA, 20 bp, mouse
gccggcctcggcatgttcgg

SEQ ID NO: 455959 - DNA, 20 bp, mouse
gagcgggcgcggcggagcgg

SEQ ID NO: 455960 - DNA, 20 bp, mouse
gggcggcgtaaggcgcgcgg

SEQ ID NO: 455961 - DNA, 20 bp, mouse
gatgttcggcggagagggcc

SEQ ID NO: 455962 - DNA, 20 bp, mouse
ggagtcacggggtcccgacg

SEQ ID NO: 455963 - DNA, 20 bp, mouse
gggcggacgctggcggcgta

SEQ ID NO: 455964 - DNA, 20 bp, mouse
ggccccccgctggcggacgc

SEQ ID NO: 455965 - DNA, 20 bp, mouse
gccggggtcagtgggagtca

SEQ ID NO: 455966 - DNA, 20 bp, mouse
ggccagggccccagcaagat

SEQ ID NO: 455967 - DNA, 20 bp, mouse
gggggaccccaaaaagaaca

SEQ ID NO: 455968 - DNA, 20 bp, mouse
gacagggcaggtgcgtgctg

SEQ ID NO: 455969 - DNA, 20 bp, mouse
ggtgctggggccttgcaagg

SEQ ID NO: 455970 - DNA, 20 bp, mouse
ggaagtgagcccaggctcag

SEQ ID NO: 455971 - DNA, 20 bp, mouse
gggcattgtgggtcaggcca

SEQ ID NO: 455972 - DNA, 20 bp, mouse
gctcacttggggaaagaatc

SEQ ID NO: 455973 - DNA, 20 bp, mouse
gttgtgggtcaggccaggga

SEQ ID NO: 455974 - DNA, 20 bp, mouse
gagccctgccctccttccaa

SEQ ID NO: 455975 - DNA, 20 bp, mouse
gcaggctcaggggaaatgct

SEQ ID NO: 455976 - DNA, 20 bp, mouse
gaagcgtctagtctctccgg

SEQ ID NO: 455977 - DNA, 20 bp, mouse
gggaaagcgtctagtctctc

SEQ ID NO: 455978 - DNA, 20 bp, mouse
gaccgggaatgaatgcacgg

SEQ ID NO: 455979 - DNA, 20 bp, mouse
gcgtctagtctctccggcgg

SEQ ID NO: 455980 - DNA, 20 bp, mouse
gccggaagtgaacacatgag

SEQ ID NO: 455981 - DNA, 20 bp, mouse
gcggccgcggaagatgaacg

SEQ ID NO: 455982 - DNA, 20 bp, mouse
ggcgcgagcgagggaaggac

SEQ ID NO: 455983 - DNA, 20 bp, mouse
gtgtggccaccgaggcaacc

SEQ ID NO: 455984 - DNA, 20 bp, mouse
gctagtctctccggcggcgg

SEQ ID NO: 455985 - DNA, 20 bp, mouse
ggcggagccgaagatgacac

SEQ ID NO: 455986 - DNA, 20 bp, mouse
gccatcaggcatacaaacga

SEQ ID NO: 455987 - DNA, 20 bp, mouse
gctcccaaccagaggcgggg

SEQ ID NO: 455988 - DNA, 20 bp, mouse
ggcaggaaacacgccatctt

SEQ ID NO: 455989 - DNA, 20 bp, mouse
gggtttgacacagccgaaga

SEQ ID NO: 455990 - DNA, 20 bp, mouse
gggaggcgccccgccctcgg

SEQ ID NO: 455991 - DNA, 20 bp, mouse
gggcggggcggagccggaaa

SEQ ID NO: 455992 - DNA, 20 bp, mouse
gcccctcccaaccagaggcg

SEQ ID NO: 455993 - DNA, 20 bp, mouse
gacggtacctgcggtggaag

SEQ ID NO: 455994 - DNA, 20 bp, mouse
gctccgccccgcctctggtt

SEQ ID NO: 455995 - DNA, 20 bp, mouse
gttaagtcagaacctgtgat

SEQ ID NO: 455996 - DNA, 20 bp, mouse
ggcagcggcagccaccggtc

SEQ ID NO: 455997 - DNA, 20 bp, mouse
gtcggctcgcggccccccag

SEQ ID NO: 455998 - DNA, 20 bp, mouse
gcgcggccccccagaggcgg

SEQ ID NO: 455999 - DNA, 20 bp, mouse
gctgcccctctcccgaccgg

SEQ ID NO: 456000 - DNA, 20 bp, mouse
gccgctgcccctctcccgac

SEQ ID NO: 456001 - DNA, 20 bp, mouse
gcgccaccaccgcctctggg

SEQ ID NO: 456002 - DNA, 20 bp, mouse
gggcagccaccggtcgggag

SEQ ID NO: 456003 - DNA, 20 bp, mouse
ggggctgcccaagcaagagg

SEQ ID NO: 456004 - DNA, 20 bp, mouse
gagccgagcggaggcctccg

SEQ ID NO: 456005 - DNA, 20 bp, mouse
gcgcgggctgcccaagcaag

SEQ ID NO: 456006 - DNA, 20 bp, mouse
gcagcagacgaagtagggag

SEQ ID NO: 456007 - DNA, 20 bp, mouse
gggccgcagcagacgaagta

SEQ ID NO: 456008 - DNA, 20 bp, mouse
gtcgtctgctgcggccgggt

SEQ ID NO: 456009 - DNA, 20 bp, mouse
gacgaaggaagtgaccgggt

SEQ ID NO: 456010 - DNA, 20 bp, mouse
gacagcgcaaaaagccgacc

SEQ ID NO: 456011 - DNA, 20 bp, mouse
ggagtgccgcgcccagggac

SEQ ID NO: 456012 - DNA, 20 bp, mouse
gatcagcccgaggacctacc

SEQ ID NO: 456013 - DNA, 20 bp, mouse
gggtagccgaaggaggtcgg

SEQ ID NO: 456014 - DNA, 20 bp, mouse
gctgtgccaggccaacccac

SEQ ID NO: 456015 - DNA, 20 bp, mouse
gctgggcgcggcactctggt

SEQ ID NO: 456016 - DNA, 20 bp, mouse
gtcagaggcttgctacagtc

SEQ ID NO: 456017 - DNA, 20 bp, mouse
gagtattctggaccttgggg

SEQ ID NO: 456018 - DNA, 20 bp, mouse
ggcttgctacagtcgggtag

SEQ ID NO: 456019 - DNA, 20 bp, mouse
gtgttattagagtttgatac

SEQ ID NO: 456020 - DNA, 20 bp, mouse
gcagcctaaacctaaaatag

SEQ ID NO: 456021 - DNA, 20 bp, mouse
gtctcttgaattcagtcgag

SEQ ID NO: 456022 - DNA, 20 bp, mouse
gaagcagtattctggacctt

SEQ ID NO: 456023 - DNA, 20 bp, mouse
gtatttggcagtctggaaca

SEQ ID NO: 456024 - DNA, 20 bp, mouse
gcagggatgactataatcta

SEQ ID NO: 456025 - DNA, 20 bp, mouse
gtcgattttgctggggacaa

SEQ ID NO: 456026 - DNA, 20 bp, mouse
gagccctgctccctcgactt

SEQ ID NO: 456027 - DNA, 20 bp, mouse
gaattcaagtccaaagtcga

SEQ ID NO: 456028 - DNA, 20 bp, mouse
gggagcagggctcctcgcac

SEQ ID NO: 456029 - DNA, 20 bp, mouse
gcgcccccggagttaagtac

SEQ ID NO: 456030 - DNA, 20 bp, mouse
ggtccaaagtcgagggagca

SEQ ID NO: 456031 - DNA, 20 bp, mouse
gctgggtgcctggacttgta

SEQ ID NO: 456032 - DNA, 20 bp, mouse
gcgcacgggctagggcgcaa

SEQ ID NO: 456033 - DNA, 20 bp, mouse
gtgtcccagacaacctgggt

SEQ ID NO: 456034 - DNA, 20 bp, mouse
ggaacagagcgtgctgaatc

SEQ ID NO: 456035 - DNA, 20 bp, mouse
gcgacttgcgacttgcgact

SEQ ID NO: 456036 - DNA, 20 bp, mouse
ggggccagaggaggcactag

SEQ ID NO: 456037 - DNA, 20 bp, mouse
gatgtcccggtgagaggctg

SEQ ID NO: 456038 - DNA, 20 bp, mouse
gggtggcatgtcccggtgag

SEQ ID NO: 456039 - DNA, 20 bp, mouse
gtgtttcccgtgctgtggga

SEQ ID NO: 456040 - DNA, 20 bp, mouse
gatctacctcagcctctcac

SEQ ID NO: 456041 - DNA, 20 bp, mouse
gagacctcgtggacagagcg

SEQ ID NO: 456042 - DNA, 20 bp, mouse
gaggcatcggctgcagtgac

SEQ ID NO: 456043 - DNA, 20 bp, mouse
ggaggaggcactagaggcat

SEQ ID NO: 456044 - DNA, 20 bp, mouse
gacagagcggggcagtgaga

SEQ ID NO: 456045 - DNA, 20 bp, mouse
gagtctgcgagacgaggtca

SEQ ID NO: 456046 - DNA, 20 bp, mouse
gccggcgcggacctaaaaac

SEQ ID NO: 456047 - DNA, 20 bp, mouse
gcagcgggctccacagtccg

SEQ ID NO: 456048 - DNA, 20 bp, mouse
gtccgtggttccggcgactc

SEQ ID NO: 456049 - DNA, 20 bp, mouse
gtcgccggaaccacggactg

SEQ ID NO: 456050 - DNA, 20 bp, mouse
gtctccagagacgcagcggg

SEQ ID NO: 456051 - DNA, 20 bp, mouse
gtcgctgggagtaagtcggt

SEQ ID NO: 456052 - DNA, 20 bp, mouse
gggttccggcgactccggcg

SEQ ID NO: 456053 - DNA, 20 bp, mouse
gaggtccgcgccggagtcgc

SEQ ID NO: 456054 - DNA, 20 bp, mouse
gggagtcctgagcgggcgac

SEQ ID NO: 456055 - DNA, 20 bp, mouse
ggaagctccggggtgttgtg

SEQ ID NO: 456056 - DNA, 20 bp, mouse
gccctcaggtgagcagagtg

SEQ ID NO: 456057 - DNA, 20 bp, mouse
gacgttgttgggattccctc

SEQ ID NO: 456058 - DNA, 20 bp, mouse
gccaggcggtgcagtcagaa

SEQ ID NO: 456059 - DNA, 20 bp, mouse
ggggaatcccaacaacgtct

SEQ ID NO: 456060 - DNA, 20 bp, mouse
gttccacgaaggcttccagg

SEQ ID NO: 456061 - DNA, 20 bp, mouse
gtcccgccaagaccttcctt

SEQ ID NO: 456062 - DNA, 20 bp, mouse
gatcccaacaacgtctagga

SEQ ID NO: 456063 - DNA, 20 bp, mouse
gaaggtcttggcgggagcag

SEQ ID NO: 456064 - DNA, 20 bp, mouse
gccctcactctgctcacctg

SEQ ID NO: 456065 - DNA, 20 bp, mouse
ggagggtcgagcttccacga

SEQ ID NO: 456066 - DNA, 20 bp, mouse
gctgctgccaggcaaggacg

SEQ ID NO: 456067 - DNA, 20 bp, mouse
ggctagctcgagggatggat

SEQ ID NO: 456068 - DNA, 20 bp, mouse
gctgccaggcaaggacgagg

SEQ ID NO: 456069 - DNA, 20 bp, mouse
ggcgaagaccagaaccgtcc

SEQ ID NO: 456070 - DNA, 20 bp, mouse
ggtcgggcggctctgcactc

SEQ ID NO: 456071 - DNA, 20 bp, mouse
gcccggctccggctaacaat

SEQ ID NO: 456072 - DNA, 20 bp, mouse
gttgcctggcagcagttctc

SEQ ID NO: 456073 - DNA, 20 bp, mouse
gctctcacgcctcttcccag

SEQ ID NO: 456074 - DNA, 20 bp, mouse
ggaagaggcgtgagagctag

SEQ ID NO: 456075 - DNA, 20 bp, mouse
ggcgccggagcgctgctcca

SEQ ID NO: 456076 - DNA, 20 bp, mouse
gacaacgccgcagctatgag

SEQ ID NO: 456077 - DNA, 20 bp, mouse
gctggagtgggaatgagcaa

SEQ ID NO: 456078 - DNA, 20 bp, mouse
gtgtcacatgtacctggagt

SEQ ID NO: 456079 - DNA, 20 bp, mouse
ggtcgagtcggctcactggg

SEQ ID NO: 456080 - DNA, 20 bp, mouse
gcagaacctgagagtcgagt

SEQ ID NO: 456081 - DNA, 20 bp, mouse
gaagaggaagttcgaagatg

SEQ ID NO: 456082 - DNA, 20 bp, mouse
gcggcgttgtcacatgtacc

SEQ ID NO: 456083 - DNA, 20 bp, mouse
gtaaataacgggacccactg

SEQ ID NO: 456084 - DNA, 20 bp, mouse
gtcatccgattcccgagcag

SEQ ID NO: 456085 - DNA, 20 bp, mouse
gggggggttccagtactcac

SEQ ID NO: 456086 - DNA, 20 bp, mouse
gcacccgctatgtccattaa

SEQ ID NO: 456087 - DNA, 20 bp, mouse
gcggacccgcagtggggagt

SEQ ID NO: 456088 - DNA, 20 bp, mouse
gtatccgttaatggacatag

SEQ ID NO: 456089 - DNA, 20 bp, mouse
gagcacccggacccgcagtg

SEQ ID NO: 456090 - DNA, 20 bp, mouse
ggccgtaaacaagtaacgca

SEQ ID NO: 456091 - DNA, 20 bp, mouse
gggggcagaagggagttcag

SEQ ID NO: 456092 - DNA, 20 bp, mouse
gtggagctgcagttcgccca

SEQ ID NO: 456093 - DNA, 20 bp, mouse
gatgcaaatgagagcagcac

SEQ ID NO: 456094 - DNA, 20 bp, mouse
ggcccagggtacctgcatcc

SEQ ID NO: 456095 - DNA, 20 bp, mouse
gagtgctccagcagccaaag

SEQ ID NO: 456096 - DNA, 20 bp, mouse
ggctccatgtgatcacatat

SEQ ID NO: 456097 - DNA, 20 bp, mouse
gtatgtgtcagcatcacgga

SEQ ID NO: 456098 - DNA, 20 bp, mouse
gcatataggcagcctggctg

SEQ ID NO: 456099 - DNA, 20 bp, mouse
gatcgttcttcctggttcag

SEQ ID NO: 456100 - DNA, 20 bp, mouse
gtgatcacatataggcagcc

SEQ ID NO: 456101 - DNA, 20 bp, mouse
ggtgaagtcagaagcaaggc

SEQ ID NO: 456102 - DNA, 20 bp, mouse
gaacagctgtagtcgagtcc

SEQ ID NO: 456103 - DNA, 20 bp, mouse
gcacagtgaagtcagaagca

SEQ ID NO: 456104 - DNA, 20 bp, mouse
gctgcctatatgtgatcaca

SEQ ID NO: 456105 - DNA, 20 bp, mouse
ggtaccagcaataaaacacg

SEQ ID NO: 456106 - DNA, 20 bp, mouse
gcagctgctgggaggcgcac

SEQ ID NO: 456107 - DNA, 20 bp, mouse
ggcacgggcgacagctctca

SEQ ID NO: 456108 - DNA, 20 bp, mouse
gacccgaggcggaccacccg

SEQ ID NO: 456109 - DNA, 20 bp, mouse
gcagttgcggggacccgagg

SEQ ID NO: 456110 - DNA, 20 bp, mouse
gacccggggtaacactcacc

SEQ ID NO: 456111 - DNA, 20 bp, mouse
gtcacctggcagctgctggg

SEQ ID NO: 456112 - DNA, 20 bp, mouse
ggccaggtgagtgttacccc

SEQ ID NO: 456113 - DNA, 20 bp, mouse
gctctcagggaagcggtgac

SEQ ID NO: 456114 - DNA, 20 bp, mouse
gaagagtgatcccaagaggg

SEQ ID NO: 456115 - DNA, 20 bp, mouse
ggaagtggctagagttagct

SEQ ID NO: 456116 - DNA, 20 bp, mouse
gtcctaggactcacccgagt

SEQ ID NO: 456117 - DNA, 20 bp, mouse
gtaggactcacccgagtggg

SEQ ID NO: 456118 - DNA, 20 bp, mouse
gactcacccgagtgggagga

SEQ ID NO: 456119 - DNA, 20 bp, mouse
gagctaacgaggtctgaccg

SEQ ID NO: 456120 - DNA, 20 bp, mouse
ggcggcgggcggagctaacg

SEQ ID NO: 456121 - DNA, 20 bp, mouse
gcagtctccggatccgcccg

SEQ ID NO: 456122 - DNA, 20 bp, mouse
ggtctgaccgaggaaagccg

SEQ ID NO: 456123 - DNA, 20 bp, mouse
gatccgcccgcggctttcct

SEQ ID NO: 456124 - DNA, 20 bp, mouse
ggaccatcgcacaccccgag

SEQ ID NO: 456125 - DNA, 20 bp, mouse
gtctctcccagagaacagga

SEQ ID NO: 456126 - DNA, 20 bp, mouse
ggccacgaggcgggagactg

SEQ ID NO: 456127 - DNA, 20 bp, mouse
ggccgggagcgggaatgtcg

SEQ ID NO: 456128 - DNA, 20 bp, mouse
gggtcgagcctggcccgttg

SEQ ID NO: 456129 - DNA, 20 bp, mouse
gacgcgcgcagggacagctg

SEQ ID NO: 456130 - DNA, 20 bp, mouse
gggaatgtcgaggagttcga

SEQ ID NO: 456131 - DNA, 20 bp, mouse
gtctgaagcagcggcaggac

SEQ ID NO: 456132 - DNA, 20 bp, mouse
gctcggcgccccggaagacg

SEQ ID NO: 456133 - DNA, 20 bp, mouse
gcaacggctctgcgctcgag

SEQ ID NO: 456134 - DNA, 20 bp, mouse
ggccgcagccgcaacgggcc

SEQ ID NO: 456135 - DNA, 20 bp, mouse
ggcgacgatagcacttgcaa

SEQ ID NO: 456136 - DNA, 20 bp, mouse
ggagccggcagagaccacac

SEQ ID NO: 456137 - DNA, 20 bp, mouse
gcggcagagaccacacaggc

SEQ ID NO: 456138 - DNA, 20 bp, mouse
gcaggtaagtagaccacaac

SEQ ID NO: 456139 - DNA, 20 bp, mouse
gtgccggctcaactgagtaa

SEQ ID NO: 456140 - DNA, 20 bp, mouse
gaccacaacaggcatttggg

SEQ ID NO: 456141 - DNA, 20 bp, mouse
gaccctggctacagatgagg

SEQ ID NO: 456142 - DNA, 20 bp, mouse
gacggagtcctatacagtgg

SEQ ID NO: 456143 - DNA, 20 bp, mouse
gcagggtgggtgctgagact

SEQ ID NO: 456144 - DNA, 20 bp, mouse
gaagtatgattgatattggg

SEQ ID NO: 456145 - DNA, 20 bp, mouse
gaacaggcatttgggcgggc

SEQ ID NO: 456146 - DNA, 20 bp, mouse
gagctgaacaagttactgag

SEQ ID NO: 456147 - DNA, 20 bp, mouse
gaggtctctgctccaactct

SEQ ID NO: 456148 - DNA, 20 bp, mouse
gtgatgcttacgccaagagt

SEQ ID NO: 456149 - DNA, 20 bp, mouse
gcaggacgacaagactgtcc

SEQ ID NO: 456150 - DNA, 20 bp, mouse
gtctaacagaagcttccaca

SEQ ID NO: 456151 - DNA, 20 bp, mouse
gtggaagcttctgttagact

SEQ ID NO: 456152 - DNA, 20 bp, mouse
ggaacaagttactgagcggc

SEQ ID NO: 456153 - DNA, 20 bp, mouse
gatagatagataaatggatc

SEQ ID NO: 456154 - DNA, 20 bp, mouse
gtggtattctaggacaaagt

SEQ ID NO: 456155 - DNA, 20 bp, mouse
gaacttgttcagctcactgc

SEQ ID NO: 456156 - DNA, 20 bp, mouse
gagccaacacaggcatcgag

SEQ ID NO: 456157 - DNA, 20 bp, mouse
gagcccctcgatgcctgtgt

SEQ ID NO: 456158 - DNA, 20 bp, mouse
gtctaaagcttcatcaacca

SEQ ID NO: 456159 - DNA, 20 bp, mouse
gcagcagaccaggctcaatc

SEQ ID NO: 456160 - DNA, 20 bp, mouse
gacagccagggtcagtgtca

SEQ ID NO: 456161 - DNA, 20 bp, mouse
ggcttcagggatcacagcca

SEQ ID NO: 456162 - DNA, 20 bp, mouse
gtggcgctcatcagtcgtat

SEQ ID NO: 456163 - DNA, 20 bp, mouse
gccagctgaccctaaggata

SEQ ID NO: 456164 - DNA, 20 bp, mouse
ggaagacattctccccctgg

SEQ ID NO: 456165 - DNA, 20 bp, mouse
ggtctggccgaagggataga

SEQ ID NO: 456166 - DNA, 20 bp, mouse
gcggatcttggaaggcaaca

SEQ ID NO: 456167 - DNA, 20 bp, mouse
ggccaccagggccaccagaa

SEQ ID NO: 456168 - DNA, 20 bp, mouse
gatggcggccggatcttgga

SEQ ID NO: 456169 - DNA, 20 bp, mouse
gtggtagctgaaagccacca

SEQ ID NO: 456170 - DNA, 20 bp, mouse
gagagcacagggtccctctg

SEQ ID NO: 456171 - DNA, 20 bp, mouse
gaaggcaacacggctcctgt

SEQ ID NO: 456172 - DNA, 20 bp, mouse
ggcctgacccagagacactg

SEQ ID NO: 456173 - DNA, 20 bp, mouse
gaaagatggcggccggatct

SEQ ID NO: 456174 - DNA, 20 bp, mouse
gccagctgaaagatggcggc

SEQ ID NO: 456175 - DNA, 20 bp, mouse
gtcactgtgcagactaggtt

SEQ ID NO: 456176 - DNA, 20 bp, mouse
gcacaatgagtgccacggac

SEQ ID NO: 456177 - DNA, 20 bp, mouse
gaggaccgacttccacaaca

SEQ ID NO: 456178 - DNA, 20 bp, mouse
gctgagagctgagagtacat

SEQ ID NO: 456179 - DNA, 20 bp, mouse
gtctgaagacagccatgttg

SEQ ID NO: 456180 - DNA, 20 bp, mouse
gacagccatgttgtggaagt

SEQ ID NO: 456181 - DNA, 20 bp, mouse
gcacctgacgaagacttctc

SEQ ID NO: 456182 - DNA, 20 bp, mouse
gagtgagtgtagcctctgaa

SEQ ID NO: 456183 - DNA, 20 bp, mouse
gcggactctcaggaacttgt

SEQ ID NO: 456184 - DNA, 20 bp, mouse
ggtccggagaagtcttcgtc

SEQ ID NO: 456185 - DNA, 20 bp, mouse
gccgtggcactcattgtgct

SEQ ID NO: 456186 - DNA, 20 bp, mouse
gatccccacagatgcctatc

SEQ ID NO: 456187 - DNA, 20 bp, mouse
gcttccagataggcatctgt

SEQ ID NO: 456188 - DNA, 20 bp, mouse
gaacagggcaagtgaggtgg

SEQ ID NO: 456189 - DNA, 20 bp, mouse
gagggtggtcttcaaggaca

SEQ ID NO: 456190 - DNA, 20 bp, mouse
ggagcatgaacttggtatgc

SEQ ID NO: 456191 - DNA, 20 bp, mouse
gtagtcttcactacagataa

SEQ ID NO: 456192 - DNA, 20 bp, mouse
gtaggttaatgggatcacag

SEQ ID NO: 456193 - DNA, 20 bp, mouse
gaagagtaaagtgttcaggg

SEQ ID NO: 456194 - DNA, 20 bp, mouse
gataagcaaggtgattagtg

SEQ ID NO: 456195 - DNA, 20 bp, mouse
gggatagagtagccacttta

SEQ ID NO: 456196 - DNA, 20 bp, mouse
gctgtgagcgagtacaacaa

SEQ ID NO: 456197 - DNA, 20 bp, mouse
gggaacagcaaggagcgcag

SEQ ID NO: 456198 - DNA, 20 bp, mouse
ggcagcgggctggccatggt

SEQ ID NO: 456199 - DNA, 20 bp, mouse
gctccaacaagactctgagt

SEQ ID NO: 456200 - DNA, 20 bp, mouse
gcatggttggctaggacaaa

SEQ ID NO: 456201 - DNA, 20 bp, mouse
gatgttgggagccccggagg

SEQ ID NO: 456202 - DNA, 20 bp, mouse
gcacagccgcgccatacagg

SEQ ID NO: 456203 - DNA, 20 bp, mouse
gggagcggcctggagacgtc

SEQ ID NO: 456204 - DNA, 20 bp, mouse
ggagcgcagcgggctggcca

SEQ ID NO: 456205 - DNA, 20 bp, mouse
ggaggaggcagatgccaatg

SEQ ID NO: 456206 - DNA, 20 bp, mouse
gccatcgccagcgggaagtg

SEQ ID NO: 456207 - DNA, 20 bp, mouse
ggcgcgggcgtcaggtgaca

SEQ ID NO: 456208 - DNA, 20 bp, mouse
gctgtggccagctacaatat

SEQ ID NO: 456209 - DNA, 20 bp, mouse
gggtgtctcggaagtagtag

SEQ ID NO: 456210 - DNA, 20 bp, mouse
ggagcgtcctcacttcccgc

SEQ ID NO: 456211 - DNA, 20 bp, mouse
ggccaaggcccatcgccagc

SEQ ID NO: 456212 - DNA, 20 bp, mouse
gtgaggacgctccatagccg

SEQ ID NO: 456213 - DNA, 20 bp, mouse
gcaggaggcagaatgcgagc

SEQ ID NO: 456214 - DNA, 20 bp, mouse
ggacactgaatccgcggcta

SEQ ID NO: 456215 - DNA, 20 bp, mouse
gtcccgctggcgatgggcct

SEQ ID NO: 456216 - DNA, 20 bp, mouse
gaatgcagggagcatgtagt

SEQ ID NO: 456217 - DNA, 20 bp, mouse
gaagtacagctccaggacca

SEQ ID NO: 456218 - DNA, 20 bp, mouse
gcccatgggtgtcagaagtt

SEQ ID NO: 456219 - DNA, 20 bp, mouse
ggctcggcaagtacagctcc

SEQ ID NO: 456220 - DNA, 20 bp, mouse
gtcagaagttaggcagcaga

SEQ ID NO: 456221 - DNA, 20 bp, mouse
gtggtggggtagcttcagtg

SEQ ID NO: 456222 - DNA, 20 bp, mouse
gcatgctagtggccagtgag

SEQ ID NO: 456223 - DNA, 20 bp, mouse
ggatccccagccccttgcca

SEQ ID NO: 456224 - DNA, 20 bp, mouse
gatgcaagactaacaggcca

SEQ ID NO: 456225 - DNA, 20 bp, mouse
gctgagaaagaccctggcaa

SEQ ID NO: 456226 - DNA, 20 bp, mouse
gcccagcaggacgagcaggt

SEQ ID NO: 456227 - DNA, 20 bp, mouse
gggagagtcacagaaaggta

SEQ ID NO: 456228 - DNA, 20 bp, mouse
gggagcccagcaggacgagc

SEQ ID NO: 456229 - DNA, 20 bp, mouse
gggattgtacctagaatggg

SEQ ID NO: 456230 - DNA, 20 bp, mouse
gctcaccagggtcttcctag

SEQ ID NO: 456231 - DNA, 20 bp, mouse
gcccagcttgtggttcttct

SEQ ID NO: 456232 - DNA, 20 bp, mouse
gctctggccaccccagcttg

SEQ ID NO: 456233 - DNA, 20 bp, mouse
gtgtaaattggaactataat

SEQ ID NO: 456234 - DNA, 20 bp, mouse
gaatggattgtacctagaat

SEQ ID NO: 456235 - DNA, 20 bp, mouse
ggcagagcctcttaaactgg

SEQ ID NO: 456236 - DNA, 20 bp, mouse
ggcagagctttctttctcag

SEQ ID NO: 456237 - DNA, 20 bp, mouse
gatgatatgttccatcctgt

SEQ ID NO: 456238 - DNA, 20 bp, mouse
ggctttctttctcagtggac

SEQ ID NO: 456239 - DNA, 20 bp, mouse
gactcccacaggagtctatc

SEQ ID NO: 456240 - DNA, 20 bp, mouse
gtgtgcctgatagactcctg

SEQ ID NO: 456241 - DNA, 20 bp, mouse
ggccgtgaacacattcaacc

SEQ ID NO: 456242 - DNA, 20 bp, mouse
gcattccgacaagacagaaa

SEQ ID NO: 456243 - DNA, 20 bp, mouse
gtcacggcaaattccactgt

SEQ ID NO: 456244 - DNA, 20 bp, mouse
gctgctagtccatgaagaat

SEQ ID NO: 456245 - DNA, 20 bp, mouse
gacattcaaccaggaaagtc

SEQ ID NO: 456246 - DNA, 20 bp, mouse
gtggtgattagacatttcat

SEQ ID NO: 456247 - DNA, 20 bp, mouse
gtcctgggagcagatgtgtg

SEQ ID NO: 456248 - DNA, 20 bp, mouse
ggtgatatttcacactcata

SEQ ID NO: 456249 - DNA, 20 bp, mouse
ggtcgatgtacttcaggata

SEQ ID NO: 456250 - DNA, 20 bp, mouse
gtgattagacatttcatagg

SEQ ID NO: 456251 - DNA, 20 bp, mouse
gatttcacactcatagggca

SEQ ID NO: 456252 - DNA, 20 bp, mouse
gcttttataacagctaaaag

SEQ ID NO: 456253 - DNA, 20 bp, mouse
gctggcaagcagggagactt

SEQ ID NO: 456254 - DNA, 20 bp, mouse
gtcacagaaaccagaaatac

SEQ ID NO: 456255 - DNA, 20 bp, mouse
gatttcataggaggagttta

SEQ ID NO: 456256 - DNA, 20 bp, mouse
ggtctcccctagctttccgg

SEQ ID NO: 456257 - DNA, 20 bp, mouse
gaaactgctgagatgaggtt

SEQ ID NO: 456258 - DNA, 20 bp, mouse
gggagccaccggaaagctag

SEQ ID NO: 456259 - DNA, 20 bp, mouse
gcggtggctccagaatttaa

SEQ ID NO: 456260 - DNA, 20 bp, mouse
ggcgcctccgccatcagact

SEQ ID NO: 456261 - DNA, 20 bp, mouse
gccagcaactggcgctgggt

SEQ ID NO: 456262 - DNA, 20 bp, mouse
gcagagagatggaggaatgt

SEQ ID NO: 456263 - DNA, 20 bp, mouse
ggtgaggacagggtcagtcg

SEQ ID NO: 456264 - DNA, 20 bp, mouse
gtaggggagacaaccggcgt

SEQ ID NO: 456265 - DNA, 20 bp, mouse
gactgggagtgcctctgatt

SEQ ID NO: 456266 - DNA, 20 bp, mouse
gatcttggcagcagtagtcg

SEQ ID NO: 456267 - DNA, 20 bp, mouse
gggcgcgccacacatcatct

SEQ ID NO: 456268 - DNA, 20 bp, mouse
gctgctgccaagatgatgtg

SEQ ID NO: 456269 - DNA, 20 bp, mouse
gggcacccaggtctcctagt

SEQ ID NO: 456270 - DNA, 20 bp, mouse
gagcagtagtcggggtagca

SEQ ID NO: 456271 - DNA, 20 bp, mouse
gagatccaactaggagacct

SEQ ID NO: 456272 - DNA, 20 bp, mouse
gacgtgctacgggtccgggg

SEQ ID NO: 456273 - DNA, 20 bp, mouse
gtgcaggacctgaccagtct

SEQ ID NO: 456274 - DNA, 20 bp, mouse
ggattcagggccgggaactg

SEQ ID NO: 456275 - DNA, 20 bp, mouse
ggcagctgttagaacctaga

SEQ ID NO: 456276 - DNA, 20 bp, mouse
gaccccgtacccgcagatca

SEQ ID NO: 456277 - DNA, 20 bp, mouse
gtgcgggtacggggtcaagg

SEQ ID NO: 456278 - DNA, 20 bp, mouse
gtacccgcagatcagggtct

SEQ ID NO: 456279 - DNA, 20 bp, mouse
gagaccgagaccctgatctg

SEQ ID NO: 456280 - DNA, 20 bp, mouse
ggcactccgagcgatcgatc

SEQ ID NO: 456281 - DNA, 20 bp, mouse
gctctcttctagaaaaatgg

SEQ ID NO: 456282 - DNA, 20 bp, mouse
gagcacggcgggcgatagaa

SEQ ID NO: 456283 - DNA, 20 bp, mouse
ggtgcgcctgcgcccagcta

SEQ ID NO: 456284 - DNA, 20 bp, mouse
gctgcaccccggctctcaaa

SEQ ID NO: 456285 - DNA, 20 bp, mouse
ggaacggccgcagatcggac

SEQ ID NO: 456286 - DNA, 20 bp, mouse
ggcaccggaagccacctcgg

SEQ ID NO: 456287 - DNA, 20 bp, mouse
gccagtgagagaccctgcgg

SEQ ID NO: 456288 - DNA, 20 bp, mouse
gcagggaacgatccaccgca

SEQ ID NO: 456289 - DNA, 20 bp, mouse
gccgccatggctcacccccg

SEQ ID NO: 456290 - DNA, 20 bp, mouse
gagcgcaccggaagccacct

SEQ ID NO: 456291 - DNA, 20 bp, mouse
gccacctcgggggtgagcca

SEQ ID NO: 456292 - DNA, 20 bp, mouse
gtccagacgggggaccgcag

SEQ ID NO: 456293 - DNA, 20 bp, mouse
gtcaccgaagacggagcgca

SEQ ID NO: 456294 - DNA, 20 bp, mouse
gggcggaggctcaggagaag

SEQ ID NO: 456295 - DNA, 20 bp, mouse
gcgcctggcgggaacgaccg

SEQ ID NO: 456296 - DNA, 20 bp, mouse
gcggaagtgtggttcgccag

SEQ ID NO: 456297 - DNA, 20 bp, mouse
ggaacgcagcgatcgatcca

SEQ ID NO: 456298 - DNA, 20 bp, mouse
gcgacatgattgctgccgag

SEQ ID NO: 456299 - DNA, 20 bp, mouse
ggagagactgggaagcccaa

SEQ ID NO: 456300 - DNA, 20 bp, mouse
gtcaatctccgctgtcctct

SEQ ID NO: 456301 - DNA, 20 bp, mouse
gcgcagaagccataaccctt

SEQ ID NO: 456302 - DNA, 20 bp, mouse
gcagcgatcgatccatggct

SEQ ID NO: 456303 - DNA, 20 bp, mouse
gccgttacagagcggaagtg

SEQ ID NO: 456304 - DNA, 20 bp, mouse
gcggagattgaattcgtcta

SEQ ID NO: 456305 - DNA, 20 bp, mouse
gcaatgggcgagagtttagt

SEQ ID NO: 456306 - DNA, 20 bp, mouse
gaaatctgagtgggcggcgg

SEQ ID NO: 456307 - DNA, 20 bp, mouse
gctttggctctgagggacag

SEQ ID NO: 456308 - DNA, 20 bp, mouse
ggcggcagcggatttggcgg

SEQ ID NO: 456309 - DNA, 20 bp, mouse
gttcaaatctgagtgggcgg

SEQ ID NO: 456310 - DNA, 20 bp, mouse
gagcaggtgaggaacgggag

SEQ ID NO: 456311 - DNA, 20 bp, mouse
gtaattcaaatctgagtggg

SEQ ID NO: 456312 - DNA, 20 bp, mouse
gaagtatgggacttagacaa

SEQ ID NO: 456313 - DNA, 20 bp, mouse
gcggggtgctcgcacccaca

SEQ ID NO: 456314 - DNA, 20 bp, mouse
gggcaaaccccaccaaaacc

SEQ ID NO: 456315 - DNA, 20 bp, mouse
gtctcctgacatggcctcgg

SEQ ID NO: 456316 - DNA, 20 bp, mouse
ggtaggaggcaggtgagtaa

SEQ ID NO: 456317 - DNA, 20 bp, mouse
ggagtaaggggacctgactg

SEQ ID NO: 456318 - DNA, 20 bp, mouse
ggaaatctgtggcaggtagg

SEQ ID NO: 456319 - DNA, 20 bp, mouse
gagagaaatctgtggcaggt

SEQ ID NO: 456320 - DNA, 20 bp, mouse
gtgctggtgacttgataagg

SEQ ID NO: 456321 - DNA, 20 bp, mouse
gacatgtacaggcaaggcta

SEQ ID NO: 456322 - DNA, 20 bp, mouse
gtccatggaaaacttcccaa

SEQ ID NO: 456323 - DNA, 20 bp, mouse
ggtgctaaggacactatcca

SEQ ID NO: 456324 - DNA, 20 bp, mouse
gggtgacttgataaggtggg

SEQ ID NO: 456325 - DNA, 20 bp, mouse
gccggcaagactgctgtgga

SEQ ID NO: 456326 - DNA, 20 bp, mouse
ggcaggtggtgaagaagacg

SEQ ID NO: 456327 - DNA, 20 bp, mouse
gaccatgcaggatcctagtg

SEQ ID NO: 456328 - DNA, 20 bp, mouse
gggtggtgaagaagacgggg

SEQ ID NO: 456329 - DNA, 20 bp, mouse
gaactcaagggtccctgtag

SEQ ID NO: 456330 - DNA, 20 bp, mouse
gattataggggaactctggg

SEQ ID NO: 456331 - DNA, 20 bp, mouse
ggtccctgtagaggcaagag

SEQ ID NO: 456332 - DNA, 20 bp, mouse
gtccccactaggatcctgca

SEQ ID NO: 456333 - DNA, 20 bp, mouse
ggcaagagtggtggtcgaag

SEQ ID NO: 456334 - DNA, 20 bp, mouse
ggagttgagactaccttggg

SEQ ID NO: 456335 - DNA, 20 bp, mouse
gtgctcaccctgaggagcta

SEQ ID NO: 456336 - DNA, 20 bp, mouse
gccatctccgcgcccacggg

SEQ ID NO: 456337 - DNA, 20 bp, mouse
gctgcgaggcctccgcccgt

SEQ ID NO: 456338 - DNA, 20 bp, mouse
gcggccatctccgcgcccac

SEQ ID NO: 456339 - DNA, 20 bp, mouse
gagcaggcccgacgcgatcg

SEQ ID NO: 456340 - DNA, 20 bp, mouse
ggcgagcagcggccgagtac

SEQ ID NO: 456341 - DNA, 20 bp, mouse
ggcgctgccccgatcgcgtc

SEQ ID NO: 456342 - DNA, 20 bp, mouse
ggcagcggccgagtacaggc

SEQ ID NO: 456343 - DNA, 20 bp, mouse
gcgctcgcccggcctgtact

SEQ ID NO: 456344 - DNA, 20 bp, mouse
gcgtcgggcctgctgctggc

SEQ ID NO: 456345 - DNA, 20 bp, mouse
gttccccccgcggcgagcag

SEQ ID NO: 456346 - DNA, 20 bp, mouse
gcgcgcgcggccttacccag

SEQ ID NO: 456347 - DNA, 20 bp, mouse
gtggcggctcggcacggcgg

SEQ ID NO: 456348 - DNA, 20 bp, mouse
gcggtggcggctcggcacgg

SEQ ID NO: 456349 - DNA, 20 bp, mouse
ggctcccacttgctcaacaa

SEQ ID NO: 456350 - DNA, 20 bp, mouse
ggcggctggcggcgcggtgg

SEQ ID NO: 456351 - DNA, 20 bp, mouse
gccaggcgcagggctcgcgg

SEQ ID NO: 456352 - DNA, 20 bp, mouse
gtccccgcccgctcgtcggt

SEQ ID NO: 456353 - DNA, 20 bp, mouse
gccgcgctccgaccgacgag

SEQ ID NO: 456354 - DNA, 20 bp, mouse
gtcggtcggagcgcggctgg

SEQ ID NO: 456355 - DNA, 20 bp, mouse
gcgtgtccccgcccgctcgt

SEQ ID NO: 456356 - DNA, 20 bp, mouse
ggccatgccgcgctgagagg

SEQ ID NO: 456357 - DNA, 20 bp, mouse
gacgccggcgacccaggacg

SEQ ID NO: 456358 - DNA, 20 bp, mouse
gcgccggcgtccaaggagaa

SEQ ID NO: 456359 - DNA, 20 bp, mouse
gaggagaagggcgcccaccc

SEQ ID NO: 456360 - DNA, 20 bp, mouse
ggcggaggacgagaaccccc

SEQ ID NO: 456361 - DNA, 20 bp, mouse
ggaggagcaagagaccgagc

SEQ ID NO: 456362 - DNA, 20 bp, mouse
gagaagggcgcccacccggg

SEQ ID NO: 456363 - DNA, 20 bp, mouse
ggaagtaggaagaggctcgg

SEQ ID NO: 456364 - DNA, 20 bp, mouse
gggcgacccaggacgaggta

SEQ ID NO: 456365 - DNA, 20 bp, mouse
gggccagcaagcgcaatcgg

SEQ ID NO: 456366 - DNA, 20 bp, mouse
gccgagagccgtgccaacag

SEQ ID NO: 456367 - DNA, 20 bp, mouse
gcagcagagtgaattccggg

SEQ ID NO: 456368 - DNA, 20 bp, mouse
ggagagcagcctcggagcac

SEQ ID NO: 456369 - DNA, 20 bp, mouse
ggccacacagcgccatgcct

SEQ ID NO: 456370 - DNA, 20 bp, mouse
gtggcctcgggaatctgatg

SEQ ID NO: 456371 - DNA, 20 bp, mouse
gtcggagcacgggcagtccc

SEQ ID NO: 456372 - DNA, 20 bp, mouse
gagccacctgcggggagggt

SEQ ID NO: 456373 - DNA, 20 bp, mouse
gcccgtcggtctgatactca

SEQ ID NO: 456374 - DNA, 20 bp, mouse
ggggaatgacgcctcttgaa

SEQ ID NO: 456375 - DNA, 20 bp, mouse
gtcagggcccgcccttcaag

SEQ ID NO: 456376 - DNA, 20 bp, mouse
gacacaaacagcactcacgg

SEQ ID NO: 456377 - DNA, 20 bp, mouse
gcagcactcacggaggtagg

SEQ ID NO: 456378 - DNA, 20 bp, mouse
gggagttcgcgcgttcttca

SEQ ID NO: 456379 - DNA, 20 bp, mouse
ggtaggggtttggctcatca

SEQ ID NO: 456380 - DNA, 20 bp, mouse
gtcgcgcgttcttcagggta

SEQ ID NO: 456381 - DNA, 20 bp, mouse
gaaacagcactcacggaggt

SEQ ID NO: 456382 - DNA, 20 bp, mouse
gtccgggcgcaagtgctcac

SEQ ID NO: 456383 - DNA, 20 bp, mouse
gggcgcaagtgctcacggga

SEQ ID NO: 456384 - DNA, 20 bp, mouse
ggtaaaccttcgacagtggg

SEQ ID NO: 456385 - DNA, 20 bp, mouse
gatcacacaaacagcactca

SEQ ID NO: 456386 - DNA, 20 bp, mouse
ggcctcgagggtagagacaa

SEQ ID NO: 456387 - DNA, 20 bp, mouse
gcgcggagctgcttctttgg

SEQ ID NO: 456388 - DNA, 20 bp, mouse
ggccagaggcctaccatgtt

SEQ ID NO: 456389 - DNA, 20 bp, mouse
ggcctctaggtgtcacgatg

SEQ ID NO: 456390 - DNA, 20 bp, mouse
ggccccatcgtgacacctag

SEQ ID NO: 456391 - DNA, 20 bp, mouse
ggccgcagcagggacggtag

SEQ ID NO: 456392 - DNA, 20 bp, mouse
gcgaccagcagcagccggtg

SEQ ID NO: 456393 - DNA, 20 bp, mouse
gcagccagcgccgaccggag

SEQ ID NO: 456394 - DNA, 20 bp, mouse
gcacaggctcggacacaaaa

SEQ ID NO: 456395 - DNA, 20 bp, mouse
gtgtggcgcgaaggtaaagg

SEQ ID NO: 456396 - DNA, 20 bp, mouse
ggcagggctctggtagaggg

SEQ ID NO: 456397 - DNA, 20 bp, mouse
gctgcgcagggctctggtag

SEQ ID NO: 456398 - DNA, 20 bp, mouse
gcagcacctgcgcagggctc

SEQ ID NO: 456399 - DNA, 20 bp, mouse
ggcacgaggtggcaaggtgg

SEQ ID NO: 456400 - DNA, 20 bp, mouse
gttagcacgaggtggcaagg

SEQ ID NO: 456401 - DNA, 20 bp, mouse
ggcgccacgaggccaaagag

SEQ ID NO: 456402 - DNA, 20 bp, mouse
gagagcaatttagcacgagg

SEQ ID NO: 456403 - DNA, 20 bp, mouse
gaggaggcaggggcacccca

SEQ ID NO: 456404 - DNA, 20 bp, mouse
ggcggggcgccgagcttggg

SEQ ID NO: 456405 - DNA, 20 bp, mouse
gtcccgccagcacctgcgca

SEQ ID NO: 456406 - DNA, 20 bp, mouse
ggtgggaagcctagctgcag

SEQ ID NO: 456407 - DNA, 20 bp, mouse
gctgcagccccgctcctcag

SEQ ID NO: 456408 - DNA, 20 bp, mouse
gaaatggcgcctgtcagagt

SEQ ID NO: 456409 - DNA, 20 bp, mouse
gagagaggagggagcccttt

SEQ ID NO: 456410 - DNA, 20 bp, mouse
gagctccgccagccccccgg

SEQ ID NO: 456411 - DNA, 20 bp, mouse
gggacagaggaccccaccac

SEQ ID NO: 456412 - DNA, 20 bp, mouse
gagccctttgggcggtaaaa

SEQ ID NO: 456413 - DNA, 20 bp, mouse
gggcaccgacgacttcgcgt

SEQ ID NO: 456414 - DNA, 20 bp, mouse
gaccggaagtaatgtcagag

SEQ ID NO: 456415 - DNA, 20 bp, mouse
gggcccacatgagcgggaag

SEQ ID NO: 456416 - DNA, 20 bp, mouse
gcggcgggtgaagccggtgt

SEQ ID NO: 456417 - DNA, 20 bp, mouse
ggaagtgagtgcgcagcgag

SEQ ID NO: 456418 - DNA, 20 bp, mouse
gggtgaagccggtgtcggag

SEQ ID NO: 456419 - DNA, 20 bp, mouse
gggtgttcccgctccgacac

SEQ ID NO: 456420 - DNA, 20 bp, mouse
ggtgagtgcgcagcgagcgg

SEQ ID NO: 456421 - DNA, 20 bp, mouse
ggcacggacggtcacaacag

SEQ ID NO: 456422 - DNA, 20 bp, mouse
gtccatcgtgacccagagag

SEQ ID NO: 456423 - DNA, 20 bp, mouse
gtccactccagcagacgcag

SEQ ID NO: 456424 - DNA, 20 bp, mouse
ggcgcgcacgcagcccccag

SEQ ID NO: 456425 - DNA, 20 bp, mouse
ggacgcagcacgcccccccc

SEQ ID NO: 456426 - DNA, 20 bp, mouse
gaggggagccaggttctcgg

SEQ ID NO: 456427 - DNA, 20 bp, mouse
ggagtttcctccccgcgagg

SEQ ID NO: 456428 - DNA, 20 bp, mouse
gatccccgcgagcttcggag

SEQ ID NO: 456429 - DNA, 20 bp, mouse
gcgcgagcttcggaggggag

SEQ ID NO: 456430 - DNA, 20 bp, mouse
gttgcatccgcctcgcgggg

SEQ ID NO: 456431 - DNA, 20 bp, mouse
gcgcgaggcggatgcaaaca

SEQ ID NO: 456432 - DNA, 20 bp, mouse
gggatgcaaacatggaaccc

SEQ ID NO: 456433 - DNA, 20 bp, mouse
gcccgctgcggggcaaaggt

SEQ ID NO: 456434 - DNA, 20 bp, mouse
gatggagtttcctccccgcg

SEQ ID NO: 456435 - DNA, 20 bp, mouse
gttaaggggaagccttgaaa

SEQ ID NO: 456436 - DNA, 20 bp, mouse
gccatgttggacccaaactg

SEQ ID NO: 456437 - DNA, 20 bp, mouse
gcgctccggattctccatgt

SEQ ID NO: 456438 - DNA, 20 bp, mouse
gccggagcgaaaacaagagg

SEQ ID NO: 456439 - DNA, 20 bp, mouse
gagaggccggcccaagatct

SEQ ID NO: 456440 - DNA, 20 bp, mouse
ggggtccaacatggagaatc

SEQ ID NO: 456441 - DNA, 20 bp, mouse
gtcgccggaggagggtcccg

SEQ ID NO: 456442 - DNA, 20 bp, mouse
gggctctcggaccccggtgg

SEQ ID NO: 456443 - DNA, 20 bp, mouse
gccgccccctccccgttcgg

SEQ ID NO: 456444 - DNA, 20 bp, mouse
gaatccggagcgaaaacaag

SEQ ID NO: 456445 - DNA, 20 bp, mouse
gggccggcccaagatctggg

SEQ ID NO: 456446 - DNA, 20 bp, mouse
gcgagcaggcgacggagaga

SEQ ID NO: 456447 - DNA, 20 bp, mouse
gaggagcgagcgcggagcta

SEQ ID NO: 456448 - DNA, 20 bp, mouse
gccccgcgctccgagagagg

SEQ ID NO: 456449 - DNA, 20 bp, mouse
ggcctcgtcagcatgaaccc

SEQ ID NO: 456450 - DNA, 20 bp, mouse
ggcgcggagctagggcggga

SEQ ID NO: 456451 - DNA, 20 bp, mouse
gacccaggtgaccaacccca

SEQ ID NO: 456452 - DNA, 20 bp, mouse
gcgcggcgcgcacccatgga

SEQ ID NO: 456453 - DNA, 20 bp, mouse
gcccgggagagccgcgctcg

SEQ ID NO: 456454 - DNA, 20 bp, mouse
gcgcctgctcgcgcttcccg

SEQ ID NO: 456455 - DNA, 20 bp, mouse
ggtcgcgggcgaaaaaggtg

SEQ ID NO: 456456 - DNA, 20 bp, mouse
gtgcggtgcagcaggtcggt

SEQ ID NO: 456457 - DNA, 20 bp, mouse
gtccgtgcggtgcagcaggt

SEQ ID NO: 456458 - DNA, 20 bp, mouse
ggagggctcggctagagaag

SEQ ID NO: 456459 - DNA, 20 bp, mouse
gcaggtcggtaggcgggaaa

SEQ ID NO: 456460 - DNA, 20 bp, mouse
gcggcagacggccctgagag

SEQ ID NO: 456461 - DNA, 20 bp, mouse
gggctcggctagagaagggg

SEQ ID NO: 456462 - DNA, 20 bp, mouse
gctgctgcaccgcacggaca

SEQ ID NO: 456463 - DNA, 20 bp, mouse
gacgctccgagccccatcgg

SEQ ID NO: 456464 - DNA, 20 bp, mouse
gggactgagcttcggagcaa

SEQ ID NO: 456465 - DNA, 20 bp, mouse
gcgctctggtgagttcccta

SEQ ID NO: 456466 - DNA, 20 bp, mouse
ggggagggaagtctgggtaa

SEQ ID NO: 456467 - DNA, 20 bp, mouse
gccctcctcctcccccggag

SEQ ID NO: 456468 - DNA, 20 bp, mouse
gccccggaggggtgtgttga

SEQ ID NO: 456469 - DNA, 20 bp, mouse
ggggaacctggataagcctg

SEQ ID NO: 456470 - DNA, 20 bp, mouse
ggctggccccaggcttatcc

SEQ ID NO: 456471 - DNA, 20 bp, mouse
gccccgactcctattcacca

SEQ ID NO: 456472 - DNA, 20 bp, mouse
gcccgctggttacctgacac

SEQ ID NO: 456473 - DNA, 20 bp, mouse
gggtaaccagcgggtgagtt

SEQ ID NO: 456474 - DNA, 20 bp, mouse
ggagcaggcgcaaggaattg

SEQ ID NO: 456475 - DNA, 20 bp, mouse
gggagggagaggccgagtta

SEQ ID NO: 456476 - DNA, 20 bp, mouse
gctgggtgagtgagggtaca

SEQ ID NO: 456477 - DNA, 20 bp, mouse
ggcagtacatcctccctcct

SEQ ID NO: 456478 - DNA, 20 bp, mouse
ggtgagggtacagggtatca

SEQ ID NO: 456479 - DNA, 20 bp, mouse
gcagtctctgggtctttcca

SEQ ID NO: 456480 - DNA, 20 bp, mouse
gtagaggccccactatgtat

SEQ ID NO: 456481 - DNA, 20 bp, mouse
gactgcctgctgggtgagtg

SEQ ID NO: 456482 - DNA, 20 bp, mouse
gactcaaggagtggttatag

SEQ ID NO: 456483 - DNA, 20 bp, mouse
gcaactgtaccaatacatag

SEQ ID NO: 456484 - DNA, 20 bp, mouse
gtattggtacagttgtctct

SEQ ID NO: 456485 - DNA, 20 bp, mouse
ggggaggatgtactgcctgc

SEQ ID NO: 456486 - DNA, 20 bp, mouse
ggagaccgacctcctccaga

SEQ ID NO: 456487 - DNA, 20 bp, mouse
gcagagagcgaggagcacca

SEQ ID NO: 456488 - DNA, 20 bp, mouse
gggaggaggtcggtctcctg

SEQ ID NO: 456489 - DNA, 20 bp, mouse
gtggggctgctgccgtctgg

SEQ ID NO: 456490 - DNA, 20 bp, mouse
gagcaggctgcggagaggaa

SEQ ID NO: 456491 - DNA, 20 bp, mouse
ggacggaggcgagcatgatc

SEQ ID NO: 456492 - DNA, 20 bp, mouse
gctgatgggacctgcgacgg

SEQ ID NO: 456493 - DNA, 20 bp, mouse
gccactccagctccgacccc

SEQ ID NO: 456494 - DNA, 20 bp, mouse
gaggctgatgggacctgcga

SEQ ID NO: 456495 - DNA, 20 bp, mouse
gcccatagcaggctgcggag

SEQ ID NO: 456496 - DNA, 20 bp, mouse
gggcaggaagccgctcaaag

SEQ ID NO: 456497 - DNA, 20 bp, mouse
gtggcgaaatgctggaaact

SEQ ID NO: 456498 - DNA, 20 bp, mouse
gagaaggacgcctctttgag

SEQ ID NO: 456499 - DNA, 20 bp, mouse
ggaaatgctggaaactaggc

SEQ ID NO: 456500 - DNA, 20 bp, mouse
gccactcaggccatccacgt

SEQ ID NO: 456501 - DNA, 20 bp, mouse
gcagtcctcggtaagcagcc

SEQ ID NO: 456502 - DNA, 20 bp, mouse
gcctgcccggctgcttaccg

SEQ ID NO: 456503 - DNA, 20 bp, mouse
ggaggcgtccttctgcatgc

SEQ ID NO: 456504 - DNA, 20 bp, mouse
gatgtggtggccaacgaaat

SEQ ID NO: 456505 - DNA, 20 bp, mouse
ggctgactgtgggagcgctc

SEQ ID NO: 456506 - DNA, 20 bp, mouse
gcgcggagcaggaggtaaag

SEQ ID NO: 456507 - DNA, 20 bp, mouse
ggaccgtaggggtgagtgta

SEQ ID NO: 456508 - DNA, 20 bp, mouse
ggtggtggtgctgaccgtag

SEQ ID NO: 456509 - DNA, 20 bp, mouse
ggcgctgatccggcagaggg

SEQ ID NO: 456510 - DNA, 20 bp, mouse
gagtgaaaggcgcattgatg

SEQ ID NO: 456511 - DNA, 20 bp, mouse
ggagggcggcgctcagtgaa

SEQ ID NO: 456512 - DNA, 20 bp, mouse
gacctggtaagtctgagagt

SEQ ID NO: 456513 - DNA, 20 bp, mouse
gagccaggatcgcaccggga

SEQ ID NO: 456514 - DNA, 20 bp, mouse
gcagagggaggtggtagacc

SEQ ID NO: 456515 - DNA, 20 bp, mouse
gtggctgcgaagcgcggagc

SEQ ID NO: 456516 - DNA, 20 bp, mouse
gggaccgacccagtcgagag

SEQ ID NO: 456517 - DNA, 20 bp, mouse
gggcagccagaggaaccccg

SEQ ID NO: 456518 - DNA, 20 bp, mouse
gcccactagacccagaggag

SEQ ID NO: 456519 - DNA, 20 bp, mouse
ggggaccaggctgcaaagag

SEQ ID NO: 456520 - DNA, 20 bp, mouse
gcgacccagtcgagagggga

SEQ ID NO: 456521 - DNA, 20 bp, mouse
gcggtacccactagacccag

SEQ ID NO: 456522 - DNA, 20 bp, mouse
gcgcgtctggagcctcactc

SEQ ID NO: 456523 - DNA, 20 bp, mouse
gaggtgccggatccccctca

SEQ ID NO: 456524 - DNA, 20 bp, mouse
gggctccgcgcggcagccag

SEQ ID NO: 456525 - DNA, 20 bp, mouse
gctttccctgtgtcagtact

SEQ ID NO: 456526 - DNA, 20 bp, mouse
gagttgctcttcagagaccg

SEQ ID NO: 456527 - DNA, 20 bp, mouse
gaccgtggacaacaaaatga

SEQ ID NO: 456528 - DNA, 20 bp, mouse
gaggaggctggtggtacttg

SEQ ID NO: 456529 - DNA, 20 bp, mouse
gccaaacttggatcaggggg

SEQ ID NO: 456530 - DNA, 20 bp, mouse
gagttttttatgatactaat

SEQ ID NO: 456531 - DNA, 20 bp, mouse
gaccatcattttgttgtcca

SEQ ID NO: 456532 - DNA, 20 bp, mouse
gtatccaaacttggatcagg

SEQ ID NO: 456533 - DNA, 20 bp, mouse
gcaaaagcctacaatctggt

SEQ ID NO: 456534 - DNA, 20 bp, mouse
gattttaccaaccagattgt

SEQ ID NO: 456535 - DNA, 20 bp, mouse
gtttgcaaaagcctacaatc

SEQ ID NO: 456536 - DNA, 20 bp, mouse
gtctgtcagttgctcttcag

SEQ ID NO: 456537 - DNA, 20 bp, mouse
gaggaggctagtggtgcatg

SEQ ID NO: 456538 - DNA, 20 bp, mouse
gaccagaactttgttgtcca

SEQ ID NO: 456539 - DNA, 20 bp, mouse
ggagacatctcctatttcgt

SEQ ID NO: 456540 - DNA, 20 bp, mouse
gtgaataaaacctacgaaat

SEQ ID NO: 456541 - DNA, 20 bp, mouse
gagttgctcttcagaggccc

SEQ ID NO: 456542 - DNA, 20 bp, mouse
gagagaaaagcaaggtacac

SEQ ID NO: 456543 - DNA, 20 bp, mouse
gaattttttatgatgataat

SEQ ID NO: 456544 - DNA, 20 bp, mouse
gttgttgaaaatgagttagc

SEQ ID NO: 456545 - DNA, 20 bp, mouse
gcataaaaaattaagaagcc

SEQ ID NO: 456546 - DNA, 20 bp, mouse
gaaatgtgctgaggtcctca

SEQ ID NO: 456547 - DNA, 20 bp, mouse
gaagacaagccatggctggg

SEQ ID NO: 456548 - DNA, 20 bp, mouse
gtgggttcaaacacatctca

SEQ ID NO: 456549 - DNA, 20 bp, mouse
ggagcagagtaaaacccaac

SEQ ID NO: 456550 - DNA, 20 bp, mouse
gaaagtccccgagtctgtgt

SEQ ID NO: 456551 - DNA, 20 bp, mouse
gcacatttgccccccagcca

SEQ ID NO: 456552 - DNA, 20 bp, mouse
ggacttctggaacatggagg

SEQ ID NO: 456553 - DNA, 20 bp, mouse
gggcttgtcttggactccgg

SEQ ID NO: 456554 - DNA, 20 bp, mouse
gggagacttctggaacatgg

SEQ ID NO: 456555 - DNA, 20 bp, mouse
ggtccaagacaagccatggc

SEQ ID NO: 456556 - DNA, 20 bp, mouse
ggagcacgggacgactcctg

SEQ ID NO: 456557 - DNA, 20 bp, mouse
gcagcgaactgggcgagcac

SEQ ID NO: 456558 - DNA, 20 bp, mouse
gggacgggcgggagacaaag

SEQ ID NO: 456559 - DNA, 20 bp, mouse
gcgggcgggagacaaagcgg

SEQ ID NO: 456560 - DNA, 20 bp, mouse
ggagttacctgcagcgaact

SEQ ID NO: 456561 - DNA, 20 bp, mouse
gtcctgaggcgccaagccga

SEQ ID NO: 456562 - DNA, 20 bp, mouse
gctcctgggagccggacggg

SEQ ID NO: 456563 - DNA, 20 bp, mouse
gttcctcctgggagccggac

SEQ ID NO: 456564 - DNA, 20 bp, mouse
ggccctagcccgacgctcta

SEQ ID NO: 456565 - DNA, 20 bp, mouse
gagccccgcgccccactagg

SEQ ID NO: 456566 - DNA, 20 bp, mouse
ggaggcggcggtggggacta

SEQ ID NO: 456567 - DNA, 20 bp, mouse
gagtgaggcggagacccggg

SEQ ID NO: 456568 - DNA, 20 bp, mouse
gctgctgcagacagaggacg

SEQ ID NO: 456569 - DNA, 20 bp, mouse
gacccacagaggtgagtccc

SEQ ID NO: 456570 - DNA, 20 bp, mouse
gcgccagctgctgcagacag

SEQ ID NO: 456571 - DNA, 20 bp, mouse
ggagaggagagagggatgtt

SEQ ID NO: 456572 - DNA, 20 bp, mouse
gagcgggcggcaccgcacct

SEQ ID NO: 456573 - DNA, 20 bp, mouse
gtccctgagggtgggatggt

SEQ ID NO: 456574 - DNA, 20 bp, mouse
gggcggagacccgggcggag

SEQ ID NO: 456575 - DNA, 20 bp, mouse
gcctgagtgaggcggagacc

SEQ ID NO: 456576 - DNA, 20 bp, mouse
ggaaagagacagagctggtg

SEQ ID NO: 456577 - DNA, 20 bp, mouse
gcaaagagagctcgaagggt

SEQ ID NO: 456578 - DNA, 20 bp, mouse
gtttccaaagagagctcgaa

SEQ ID NO: 456579 - DNA, 20 bp, mouse
gaacccatgacgtatgaagg

SEQ ID NO: 456580 - DNA, 20 bp, mouse
ggaggttacaagccaggggt

SEQ ID NO: 456581 - DNA, 20 bp, mouse
gctctcttatcctgagtgaa

SEQ ID NO: 456582 - DNA, 20 bp, mouse
gaggggaggttacaagccag

SEQ ID NO: 456583 - DNA, 20 bp, mouse
gcagggcaagctagtagcca

SEQ ID NO: 456584 - DNA, 20 bp, mouse
gtaactttcagactccgcca

SEQ ID NO: 456585 - DNA, 20 bp, mouse
gtcatgggtttataacgtgg

SEQ ID NO: 456586 - DNA, 20 bp, mouse
ggcggtacctgagaaaccag

SEQ ID NO: 456587 - DNA, 20 bp, mouse
ggaggcggcgggcaacccgg

SEQ ID NO: 456588 - DNA, 20 bp, mouse
gtagcgcgctgtgctatcgg

SEQ ID NO: 456589 - DNA, 20 bp, mouse
gggcgaggcggcgggcaacc

SEQ ID NO: 456590 - DNA, 20 bp, mouse
gtgctatcggtggagggcca

SEQ ID NO: 456591 - DNA, 20 bp, mouse
ggagccgggcggctactcct

SEQ ID NO: 456592 - DNA, 20 bp, mouse
gaacccggaggctggttggc

SEQ ID NO: 456593 - DNA, 20 bp, mouse
gcgcgctgtgctatcggtgg

SEQ ID NO: 456594 - DNA, 20 bp, mouse
gccgcttctccagtcccggg

SEQ ID NO: 456595 - DNA, 20 bp, mouse
gcattgcgcgagcaagacgg

SEQ ID NO: 456596 - DNA, 20 bp, mouse
gaggcggagacggagcacgg

SEQ ID NO: 456597 - DNA, 20 bp, mouse
gaccgagcgagggcttaaga

SEQ ID NO: 456598 - DNA, 20 bp, mouse
gtgctccacgagggacagag

SEQ ID NO: 456599 - DNA, 20 bp, mouse
gcacaggacacgagctgacg

SEQ ID NO: 456600 - DNA, 20 bp, mouse
gttaagccctcgctcggtgg

SEQ ID NO: 456601 - DNA, 20 bp, mouse
gtcgtgtcctgtgaagcccg

SEQ ID NO: 456602 - DNA, 20 bp, mouse
gcctcggcctcctgcactga

SEQ ID NO: 456603 - DNA, 20 bp, mouse
ggggaggcggagacggagca

SEQ ID NO: 456604 - DNA, 20 bp, mouse
ggccatcttaagccctcgct

SEQ ID NO: 456605 - DNA, 20 bp, mouse
gagcgcgcgggcctgaggtg

SEQ ID NO: 456606 - DNA, 20 bp, mouse
ggccgcggtgactcacggag

SEQ ID NO: 456607 - DNA, 20 bp, mouse
gtcagccggagaagcagccg

SEQ ID NO: 456608 - DNA, 20 bp, mouse
gagcgcggcggcctgttccg

SEQ ID NO: 456609 - DNA, 20 bp, mouse
ggtgactcacggagaggcgg

SEQ ID NO: 456610 - DNA, 20 bp, mouse
ggcggtgactcacggagagg

SEQ ID NO: 456611 - DNA, 20 bp, mouse
gctgcgggtccggagcgcgg

SEQ ID NO: 456612 - DNA, 20 bp, mouse
gaggagacccccaagagaaa

SEQ ID NO: 456613 - DNA, 20 bp, mouse
gcccagaggggtgagcaact

SEQ ID NO: 456614 - DNA, 20 bp, mouse
gcccctccccgggagacaaa

SEQ ID NO: 456615 - DNA, 20 bp, mouse
ggaccccgcagagacccacc

SEQ ID NO: 456616 - DNA, 20 bp, mouse
gccgtggttcgggagttgag

SEQ ID NO: 456617 - DNA, 20 bp, mouse
gcaatcagcacagggtaccc

SEQ ID NO: 456618 - DNA, 20 bp, mouse
gtccggacccaatcagcaca

SEQ ID NO: 456619 - DNA, 20 bp, mouse
gggtccggaaccatggacgt

SEQ ID NO: 456620 - DNA, 20 bp, mouse
ggtgagggccagggaccgag

SEQ ID NO: 456621 - DNA, 20 bp, mouse
gcgaaccacgggccgctcag

SEQ ID NO: 456622 - DNA, 20 bp, mouse
ggtcaggaaaagcctctgag

SEQ ID NO: 456623 - DNA, 20 bp, mouse
gaagggtccagagggcttag

SEQ ID NO: 456624 - DNA, 20 bp, mouse
gctgattgggtccggaacca

SEQ ID NO: 456625 - DNA, 20 bp, mouse
ggagctgagggctaccgggt

SEQ ID NO: 456626 - DNA, 20 bp, mouse
gacttaggaaagctagggta

SEQ ID NO: 456627 - DNA, 20 bp, mouse
gtttaggtgttggatctgag

SEQ ID NO: 456628 - DNA, 20 bp, mouse
gccagcgagcgagacagaca

SEQ ID NO: 456629 - DNA, 20 bp, mouse
gttgcacccagccaaaggca

SEQ ID NO: 456630 - DNA, 20 bp, mouse
gacatcacttaggaaagcta

SEQ ID NO: 456631 - DNA, 20 bp, mouse
gcaggaaagatcctggaacg

SEQ ID NO: 456632 - DNA, 20 bp, mouse
ggggtggtgacaaactgatc

SEQ ID NO: 456633 - DNA, 20 bp, mouse
gaggctgccttgcctttggc

SEQ ID NO: 456634 - DNA, 20 bp, mouse
gtgggtgcaacttccatttt

SEQ ID NO: 456635 - DNA, 20 bp, mouse
gaagaggacgatcaagaggg

SEQ ID NO: 456636 - DNA, 20 bp, mouse
gggcaaccggccgagcggag

SEQ ID NO: 456637 - DNA, 20 bp, mouse
ggcggcggcggcgacacagg

SEQ ID NO: 456638 - DNA, 20 bp, mouse
gacgctcgccgcgctcggag

SEQ ID NO: 456639 - DNA, 20 bp, mouse
gaggcgccgcgctctctcgg

SEQ ID NO: 456640 - DNA, 20 bp, mouse
gccgccgcgggcgcgagcct

SEQ ID NO: 456641 - DNA, 20 bp, mouse
gggcgcagctcgagagcgct

SEQ ID NO: 456642 - DNA, 20 bp, mouse
gaaccggccgagcggagcgg

SEQ ID NO: 456643 - DNA, 20 bp, mouse
gggaggagcctcgctctcgg

SEQ ID NO: 456644 - DNA, 20 bp, mouse
ggctaaggcaactcaccgaa

SEQ ID NO: 456645 - DNA, 20 bp, mouse
gctcgccgcgctcggagggg

SEQ ID NO: 456646 - DNA, 20 bp, mouse
gctcgcaccagaaaccgctt

SEQ ID NO: 456647 - DNA, 20 bp, mouse
ggaaaccgcttaggagtgta

SEQ ID NO: 456648 - DNA, 20 bp, mouse
gctctttcacacaaagtcgg

SEQ ID NO: 456649 - DNA, 20 bp, mouse
ggcaacctacgctaccagag

SEQ ID NO: 456650 - DNA, 20 bp, mouse
gagcgtaggttgcccctctg

SEQ ID NO: 456651 - DNA, 20 bp, mouse
gaggtctgtccaccaagcct

SEQ ID NO: 456652 - DNA, 20 bp, mouse
gaagtcaggtggttcaggtc

SEQ ID NO: 456653 - DNA, 20 bp, mouse
gttagccccgcacctcagag

SEQ ID NO: 456654 - DNA, 20 bp, mouse
gccaagcctgggaagctgtc

SEQ ID NO: 456655 - DNA, 20 bp, mouse
gtaccagaggggcagcgcct

SEQ ID NO: 456656 - DNA, 20 bp, mouse
gatgcggcccggccgagcac

SEQ ID NO: 456657 - DNA, 20 bp, mouse
gcgcgcgcgtggtgagcctc

SEQ ID NO: 456658 - DNA, 20 bp, mouse
gtccgaagccggcctcaggt

SEQ ID NO: 456659 - DNA, 20 bp, mouse
ggcctcgggcagccagtgct

SEQ ID NO: 456660 - DNA, 20 bp, mouse
gctgagaggcgggctctagg

SEQ ID NO: 456661 - DNA, 20 bp, mouse
gcgccagccgtctttctgag

SEQ ID NO: 456662 - DNA, 20 bp, mouse
gcgcctctcagaaagacggc

SEQ ID NO: 456663 - DNA, 20 bp, mouse
ggggcagccagtgctcggcc

SEQ ID NO: 456664 - DNA, 20 bp, mouse
ggctctgggagacccctccg

SEQ ID NO: 456665 - DNA, 20 bp, mouse
ggttagagatgcagcccatt

SEQ ID NO: 456666 - DNA, 20 bp, mouse
gcggactgcgaggggaaggt

SEQ ID NO: 456667 - DNA, 20 bp, mouse
gctaggcaccgaggccggag

SEQ ID NO: 456668 - DNA, 20 bp, mouse
gggtgcagggaccgcatcta

SEQ ID NO: 456669 - DNA, 20 bp, mouse
ggtctagagcagagggtgat

SEQ ID NO: 456670 - DNA, 20 bp, mouse
gatgcggtccctgcacccgt

SEQ ID NO: 456671 - DNA, 20 bp, mouse
ggaccagagagccctagatg

SEQ ID NO: 456672 - DNA, 20 bp, mouse
gcggcccagctgactcacgc

SEQ ID NO: 456673 - DNA, 20 bp, mouse
gccctggagggtggctcacg

SEQ ID NO: 456674 - DNA, 20 bp, mouse
gaggggtgttacctgtgcag

SEQ ID NO: 456675 - DNA, 20 bp, mouse
gccggctgccggactgcgag

SEQ ID NO: 456676 - DNA, 20 bp, mouse
gtttcagcggcggacagcag

SEQ ID NO: 456677 - DNA, 20 bp, mouse
gctccgctgggtgtgaggtg

SEQ ID NO: 456678 - DNA, 20 bp, mouse
gccggcttccagccttacag

SEQ ID NO: 456679 - DNA, 20 bp, mouse
gaggtgtggtaacctctgta

SEQ ID NO: 456680 - DNA, 20 bp, mouse
gggtctccggcagctccgct

SEQ ID NO: 456681 - DNA, 20 bp, mouse
ggtgggtgccgagtgtgcag

SEQ ID NO: 456682 - DNA, 20 bp, mouse
gtcacacccagcggagctgc

SEQ ID NO: 456683 - DNA, 20 bp, mouse
gtccgggatactgacgaggt

SEQ ID NO: 456684 - DNA, 20 bp, mouse
gcccctccgggatactgacg

SEQ ID NO: 456685 - DNA, 20 bp, mouse
ggctcggcagatcgcagtcc

SEQ ID NO: 456686 - DNA, 20 bp, mouse
gccaaaggtggcgcccacaa

SEQ ID NO: 456687 - DNA, 20 bp, mouse
gcataaaagagcctcagagt

SEQ ID NO: 456688 - DNA, 20 bp, mouse
ggcggggcttgaggacccta

SEQ ID NO: 456689 - DNA, 20 bp, mouse
gacaagccaaaggaatgcca

SEQ ID NO: 456690 - DNA, 20 bp, mouse
gattcccttcaccagcacca

SEQ ID NO: 456691 - DNA, 20 bp, mouse
gtccagatgtggctaaggta

SEQ ID NO: 456692 - DNA, 20 bp, mouse
ggtaagtgctgggactcacc

SEQ ID NO: 456693 - DNA, 20 bp, mouse
gggtttatgccctacttcag

SEQ ID NO: 456694 - DNA, 20 bp, mouse
gccaaggtctctggataaca

SEQ ID NO: 456695 - DNA, 20 bp, mouse
gatgaagcttgcctactctg

SEQ ID NO: 456696 - DNA, 20 bp, mouse
gagcttaccgcaggccagga

SEQ ID NO: 456697 - DNA, 20 bp, mouse
gcctgcggtaagcttgggag

SEQ ID NO: 456698 - DNA, 20 bp, mouse
gtcgctgccatcctggcctg

SEQ ID NO: 456699 - DNA, 20 bp, mouse
gtggttcaggtgttgaggac

SEQ ID NO: 456700 - DNA, 20 bp, mouse
gaggactgtaattcccaaca

SEQ ID NO: 456701 - DNA, 20 bp, mouse
gtcaacacctgaaccatgtt

SEQ ID NO: 456702 - DNA, 20 bp, mouse
ggaccaggcagggcatttat

SEQ ID NO: 456703 - DNA, 20 bp, mouse
gtctccaggacctaccaatc

SEQ ID NO: 456704 - DNA, 20 bp, mouse
gggacctaccaatctggaag

SEQ ID NO: 456705 - DNA, 20 bp, mouse
gtggctggtgtgaccaggca

SEQ ID NO: 456706 - DNA, 20 bp, mouse
ggaggaccaggctaagggtt

SEQ ID NO: 456707 - DNA, 20 bp, mouse
gccttcagggctgagagtaa

SEQ ID NO: 456708 - DNA, 20 bp, mouse
gcccttagcctggtcctcct

SEQ ID NO: 456709 - DNA, 20 bp, mouse
gggctcctcctggggtaagt

SEQ ID NO: 456710 - DNA, 20 bp, mouse
gcattgtgacaaataaggaa

SEQ ID NO: 456711 - DNA, 20 bp, mouse
gaccgaccttggctgttcag

SEQ ID NO: 456712 - DNA, 20 bp, mouse
gagtagcattgtgacaaata

SEQ ID NO: 456713 - DNA, 20 bp, mouse
gccagcccacttaccccagg

SEQ ID NO: 456714 - DNA, 20 bp, mouse
gggagccagcctgatgagaa

SEQ ID NO: 456715 - DNA, 20 bp, mouse
ggccagacctaaggaggctc

SEQ ID NO: 456716 - DNA, 20 bp, mouse
ggggaagcaacagtcaccac

SEQ ID NO: 456717 - DNA, 20 bp, mouse
ggaaagattgcagtggacca

SEQ ID NO: 456718 - DNA, 20 bp, mouse
gacctttggaaagattgcag

SEQ ID NO: 456719 - DNA, 20 bp, mouse
gtccactgcaatctttccaa

SEQ ID NO: 456720 - DNA, 20 bp, mouse
ggtgaaggtagacaaggatg

SEQ ID NO: 456721 - DNA, 20 bp, mouse
ggagttgttggcccaggtct

SEQ ID NO: 456722 - DNA, 20 bp, mouse
gcctataggaacatgaaccc

SEQ ID NO: 456723 - DNA, 20 bp, mouse
ggccactgattgagtatcta

SEQ ID NO: 456724 - DNA, 20 bp, mouse
gaaggatggggaagcttgag

SEQ ID NO: 456725 - DNA, 20 bp, mouse
gatctggagaggctgacatc

SEQ ID NO: 456726 - DNA, 20 bp, mouse
ggggttgccgaaacagatcc

SEQ ID NO: 456727 - DNA, 20 bp, mouse
gacagcaatcaccacaggta

SEQ ID NO: 456728 - DNA, 20 bp, mouse
gaggaatctagactctacct

SEQ ID NO: 456729 - DNA, 20 bp, mouse
gaactcttcagaaattgctg

SEQ ID NO: 456730 - DNA, 20 bp, mouse
gagcctgcatagcacctggg

SEQ ID NO: 456731 - DNA, 20 bp, mouse
ggccttaagagacttcatgg

SEQ ID NO: 456732 - DNA, 20 bp, mouse
gtgttgaacacaggaattat

SEQ ID NO: 456733 - DNA, 20 bp, mouse
ggcccaggaggtgacaatga

SEQ ID NO: 456734 - DNA, 20 bp, mouse
ggaggttccaggatctgttt

SEQ ID NO: 456735 - DNA, 20 bp, mouse
gtttcggcaacccctcactc

SEQ ID NO: 456736 - DNA, 20 bp, mouse
gtagcagcaatcatcagagg

SEQ ID NO: 456737 - DNA, 20 bp, mouse
gagtctcttcagaggttgtt

SEQ ID NO: 456738 - DNA, 20 bp, mouse
gacaaacctggatccaggtg

SEQ ID NO: 456739 - DNA, 20 bp, mouse
gatgcagaggaaataatagg

SEQ ID NO: 456740 - DNA, 20 bp, mouse
gttgttgggctgtcaggatc

SEQ ID NO: 456741 - DNA, 20 bp, mouse
ggtcagcagcccccattgtg

SEQ ID NO: 456742 - DNA, 20 bp, mouse
gccccattgtgtggaagtgg

SEQ ID NO: 456743 - DNA, 20 bp, mouse
gttccaggaaaagtagagtc

SEQ ID NO: 456744 - DNA, 20 bp, mouse
ggaggaatccaagccacacc

SEQ ID NO: 456745 - DNA, 20 bp, mouse
gtctggccaaaaagtataag

SEQ ID NO: 456746 - DNA, 20 bp, mouse
ggctcaagtaaaatacagca

SEQ ID NO: 456747 - DNA, 20 bp, mouse
gacccagtggcaatgtgtaa

SEQ ID NO: 456748 - DNA, 20 bp, mouse
ggggatagaaaagatacctg

SEQ ID NO: 456749 - DNA, 20 bp, mouse
gacctgaggcacaacagacc

SEQ ID NO: 456750 - DNA, 20 bp, mouse
gctatagtcttacagtttgg

SEQ ID NO: 456751 - DNA, 20 bp, mouse
gtatctatagtcttacagtt

SEQ ID NO: 456752 - DNA, 20 bp, mouse
gaatgtcaagttaaccatgt

SEQ ID NO: 456753 - DNA, 20 bp, mouse
gaaagctctttgggagaatc

SEQ ID NO: 456754 - DNA, 20 bp, mouse
gccccttacacattgccact

SEQ ID NO: 456755 - DNA, 20 bp, mouse
gacaaaagagaaccattcac

SEQ ID NO: 456756 - DNA, 20 bp, mouse
gacgcaaggaagcagaggta

SEQ ID NO: 456757 - DNA, 20 bp, mouse
gcggagatgcccaaactggt

SEQ ID NO: 456758 - DNA, 20 bp, mouse
gctgcaggaggaagcatcgg

SEQ ID NO: 456759 - DNA, 20 bp, mouse
gcctggagagcaaggacgca

SEQ ID NO: 456760 - DNA, 20 bp, mouse
gcttcgctgcccaccagttt

SEQ ID NO: 456761 - DNA, 20 bp, mouse
gccgaagcgcaagggatctg

SEQ ID NO: 456762 - DNA, 20 bp, mouse
gccaggaggcgcctttggac

SEQ ID NO: 456763 - DNA, 20 bp, mouse
gcacatgacttccagtccaa

SEQ ID NO: 456764 - DNA, 20 bp, mouse
gagactggcgggatccagag

SEQ ID NO: 456765 - DNA, 20 bp, mouse
ggaaggtcaaccagaagcgg

SEQ ID NO: 456766 - DNA, 20 bp, mouse
ggagcgcagcgcgacagcct

SEQ ID NO: 456767 - DNA, 20 bp, mouse
gaggctcccgcaggctagac

SEQ ID NO: 456768 - DNA, 20 bp, mouse
gccagggcgagcagcatcta

SEQ ID NO: 456769 - DNA, 20 bp, mouse
gcgggtacttaggagtgcac

SEQ ID NO: 456770 - DNA, 20 bp, mouse
gcgctcggtgagtttgcccg

SEQ ID NO: 456771 - DNA, 20 bp, mouse
gctgcagccaccaagccaaa

SEQ ID NO: 456772 - DNA, 20 bp, mouse
gctaagaccgcgatccgcca

SEQ ID NO: 456773 - DNA, 20 bp, mouse
gggagtgcacgggagaggcc

SEQ ID NO: 456774 - DNA, 20 bp, mouse
gtggccttggcgcacttcaa

SEQ ID NO: 456775 - DNA, 20 bp, mouse
gccggggcacagtggctcca

SEQ ID NO: 456776 - DNA, 20 bp, mouse
gacggcgcccgcggagcaga

SEQ ID NO: 456777 - DNA, 20 bp, mouse
gtcgcctgactgccatcgag

SEQ ID NO: 456778 - DNA, 20 bp, mouse
gcaactggaacaccactcga

SEQ ID NO: 456779 - DNA, 20 bp, mouse
gcaggacggcgcgcaaggag

SEQ ID NO: 456780 - DNA, 20 bp, mouse
gcgcgcaaggagtgggtcca

SEQ ID NO: 456781 - DNA, 20 bp, mouse
ggtccagggacccatgctga

SEQ ID NO: 456782 - DNA, 20 bp, mouse
gtttaaggcgggagccacta

SEQ ID NO: 456783 - DNA, 20 bp, mouse
gggcagtcaggcgaccctag

SEQ ID NO: 456784 - DNA, 20 bp, mouse
ggtgcccagcagatcagggt

SEQ ID NO: 456785 - DNA, 20 bp, mouse
gttctctgccatctgctccg

SEQ ID NO: 456786 - DNA, 20 bp, mouse
gcagggtcccacagactatg

SEQ ID NO: 456787 - DNA, 20 bp, mouse
ggaatgagcagcaagacgcc

SEQ ID NO: 456788 - DNA, 20 bp, mouse
gaagacgccgggagtcttca

SEQ ID NO: 456789 - DNA, 20 bp, mouse
ggtctgtgggaccctgagga

SEQ ID NO: 456790 - DNA, 20 bp, mouse
gccgggagtcttcatggtcg

SEQ ID NO: 456791 - DNA, 20 bp, mouse
gcccagcgcagccttcctca

SEQ ID NO: 456792 - DNA, 20 bp, mouse
gggagtcttcatggtcgcgg

SEQ ID NO: 456793 - DNA, 20 bp, mouse
gggcctgaggaagttcaggg

SEQ ID NO: 456794 - DNA, 20 bp, mouse
gcgaacaggagggtacagta

SEQ ID NO: 456795 - DNA, 20 bp, mouse
ggttcgaccataggagtcat

SEQ ID NO: 456796 - DNA, 20 bp, mouse
gggcttcattgtggtccaag

SEQ ID NO: 456797 - DNA, 20 bp, mouse
gtgagagagaagctacccct

SEQ ID NO: 456798 - DNA, 20 bp, mouse
gcctcttgatcacagggcag

SEQ ID NO: 456799 - DNA, 20 bp, mouse
gacaaggaggggcttcattg

SEQ ID NO: 456800 - DNA, 20 bp, mouse
gcaacccagggctgccccgg

SEQ ID NO: 456801 - DNA, 20 bp, mouse
ggcacctacactggaaggag

SEQ ID NO: 456802 - DNA, 20 bp, mouse
gttctctcctcttgatcaca

SEQ ID NO: 456803 - DNA, 20 bp, mouse
gctgaggcaggcacctacac

SEQ ID NO: 456804 - DNA, 20 bp, mouse
ggaagaaaccgggatctctc

SEQ ID NO: 456805 - DNA, 20 bp, mouse
gttgggcctgagccagatcc

SEQ ID NO: 456806 - DNA, 20 bp, mouse
gtgtagtaagtggatgggtt

SEQ ID NO: 456807 - DNA, 20 bp, mouse
gtttcttgtagtaagtggat

SEQ ID NO: 456808 - DNA, 20 bp, mouse
gcctacgcaaagctccccgt

SEQ ID NO: 456809 - DNA, 20 bp, mouse
gaagtgagcacctcctaaga

SEQ ID NO: 456810 - DNA, 20 bp, mouse
ggttagcaaacaacaaaacg

SEQ ID NO: 456811 - DNA, 20 bp, mouse
gttatatccggtaacttcaa

SEQ ID NO: 456812 - DNA, 20 bp, mouse
gtgtgtactgatgaaatcgg

SEQ ID NO: 456813 - DNA, 20 bp, mouse
gaaatggcagccttcttagg

SEQ ID NO: 456814 - DNA, 20 bp, mouse
gcatctaaataaagagtgga

SEQ ID NO: 456815 - DNA, 20 bp, mouse
gcagtacacaaatagtagta

SEQ ID NO: 456816 - DNA, 20 bp, mouse
gcggatcaagagacccgagg

SEQ ID NO: 456817 - DNA, 20 bp, mouse
gacacggatcaagagacccg

SEQ ID NO: 456818 - DNA, 20 bp, mouse
gaggcggagcctgctgtcag

SEQ ID NO: 456819 - DNA, 20 bp, mouse
gacaagggccgtgctaggag

SEQ ID NO: 456820 - DNA, 20 bp, mouse
gcagtaggggcgccatagcg

SEQ ID NO: 456821 - DNA, 20 bp, mouse
gccggtagggaggcacagat

SEQ ID NO: 456822 - DNA, 20 bp, mouse
gtttgtgggtcagtgaatcc

SEQ ID NO: 456823 - DNA, 20 bp, mouse
ggttgtagggaaactctctg

SEQ ID NO: 456824 - DNA, 20 bp, mouse
gagccacagaagctgcagta

SEQ ID NO: 456825 - DNA, 20 bp, mouse
gcccgtccccgccaagccct

SEQ ID NO: 456826 - DNA, 20 bp, mouse
ggcagcaactgactaagcaa

SEQ ID NO: 456827 - DNA, 20 bp, mouse
ggtctggcagagaaaagccc

SEQ ID NO: 456828 - DNA, 20 bp, mouse
gtctccttggagtagaataa

SEQ ID NO: 456829 - DNA, 20 bp, mouse
gggacaggacctgatctctg

SEQ ID NO: 456830 - DNA, 20 bp, mouse
ggagtagaataaaggtcaac

SEQ ID NO: 456831 - DNA, 20 bp, mouse
gtctgaggaaggaagtacca

SEQ ID NO: 456832 - DNA, 20 bp, mouse
gaaatcatggcactagatat

SEQ ID NO: 456833 - DNA, 20 bp, mouse
gactgactaagcaacggttc

SEQ ID NO: 456834 - DNA, 20 bp, mouse
gtaattgtcatagcaacctt

SEQ ID NO: 456835 - DNA, 20 bp, mouse
ggcttagtcagttgctgccg

SEQ ID NO: 456836 - DNA, 20 bp, mouse
gaggccccagcgcacagcag

SEQ ID NO: 456837 - DNA, 20 bp, mouse
ggcgttcacggtcagctcgg

SEQ ID NO: 456838 - DNA, 20 bp, mouse
gggcagtgagcgccgagatg

SEQ ID NO: 456839 - DNA, 20 bp, mouse
gggctcagagggcactcggt

SEQ ID NO: 456840 - DNA, 20 bp, mouse
ggaccgtgaacgccataggt

SEQ ID NO: 456841 - DNA, 20 bp, mouse
ggggcaccggagggagaaca

SEQ ID NO: 456842 - DNA, 20 bp, mouse
gccggagggagaacagggac

SEQ ID NO: 456843 - DNA, 20 bp, mouse
gtccacaggctgggctcaga

SEQ ID NO: 456844 - DNA, 20 bp, mouse
gccttctgccggacagctaa

SEQ ID NO: 456845 - DNA, 20 bp, mouse
gcgtgatccgaggaacaggc

SEQ ID NO: 456846 - DNA, 20 bp, mouse
gtctgtggagtggactaagg

SEQ ID NO: 456847 - DNA, 20 bp, mouse
ggagtctgtggagtggacta

SEQ ID NO: 456848 - DNA, 20 bp, mouse
gcacagactcaactcttcag

SEQ ID NO: 456849 - DNA, 20 bp, mouse
ggtgttgctggccagaactc

SEQ ID NO: 456850 - DNA, 20 bp, mouse
ggcatcagtcaccacaggtg

SEQ ID NO: 456851 - DNA, 20 bp, mouse
gctcttctgtgtgtaggtgg

SEQ ID NO: 456852 - DNA, 20 bp, mouse
gatgggaagctatctcggtg

SEQ ID NO: 456853 - DNA, 20 bp, mouse
ggcctgtgccaaggcaaaat

SEQ ID NO: 456854 - DNA, 20 bp, mouse
gcccaggtttacatttgtat

SEQ ID NO: 456855 - DNA, 20 bp, mouse
gcagctcttctgtgtgtagg

SEQ ID NO: 456856 - DNA, 20 bp, mouse
ggaagcgtggctactgtgag

SEQ ID NO: 456857 - DNA, 20 bp, mouse
gactgtgagcggaagactaa

SEQ ID NO: 456858 - DNA, 20 bp, mouse
gtggctgttggtataatcag

SEQ ID NO: 456859 - DNA, 20 bp, mouse
gcgctaggctcttttcggat

SEQ ID NO: 456860 - DNA, 20 bp, mouse
gagcagagcaccagtaaccg

SEQ ID NO: 456861 - DNA, 20 bp, mouse
gaagagcccacgcttgagac

SEQ ID NO: 456862 - DNA, 20 bp, mouse
gggtgtgacaggcttgcggg

SEQ ID NO: 456863 - DNA, 20 bp, mouse
gtgttgagaatctgttcgct

SEQ ID NO: 456864 - DNA, 20 bp, mouse
gtaagggtgctagatttatt

SEQ ID NO: 456865 - DNA, 20 bp, mouse
ggtaagcctgtctcaagcgt

SEQ ID NO: 456866 - DNA, 20 bp, mouse
gccgaggtccgagaatctgg

SEQ ID NO: 456867 - DNA, 20 bp, mouse
gtgcaaactcggatccccgg

SEQ ID NO: 456868 - DNA, 20 bp, mouse
gcgcgggggtcactcacctg

SEQ ID NO: 456869 - DNA, 20 bp, mouse
gggatccccggaggtcgccg

SEQ ID NO: 456870 - DNA, 20 bp, mouse
gtcgccgaggtccgagaatc

SEQ ID NO: 456871 - DNA, 20 bp, mouse
ggtctgcaaactcggatccc

SEQ ID NO: 456872 - DNA, 20 bp, mouse
gcccgagcaagggcaggtag

SEQ ID NO: 456873 - DNA, 20 bp, mouse
gggactggagacccccggat

SEQ ID NO: 456874 - DNA, 20 bp, mouse
ggagatcctggcccatccgg

SEQ ID NO: 456875 - DNA, 20 bp, mouse
gagaccccgctcgacaacaa

SEQ ID NO: 456876 - DNA, 20 bp, mouse
gtctcccttgataaagctaa

SEQ ID NO: 456877 - DNA, 20 bp, mouse
gtaaagctaagggactcacc

SEQ ID NO: 456878 - DNA, 20 bp, mouse
gagcatcttgcagctcccta

SEQ ID NO: 456879 - DNA, 20 bp, mouse
gcaatgcagagtataatgaa

SEQ ID NO: 456880 - DNA, 20 bp, mouse
gagtcccttagctttatcaa

SEQ ID NO: 456881 - DNA, 20 bp, mouse
gaatgaatggagagcccagg

SEQ ID NO: 456882 - DNA, 20 bp, mouse
gggaggtcaccagaaccttc

SEQ ID NO: 456883 - DNA, 20 bp, mouse
gctgtccacagctgggcagg

SEQ ID NO: 456884 - DNA, 20 bp, mouse
ggtggcacctacagtttagg

SEQ ID NO: 456885 - DNA, 20 bp, mouse
gctcaaccttagcacacctg

SEQ ID NO: 456886 - DNA, 20 bp, mouse
gaaagctgtgcagtggaccg

SEQ ID NO: 456887 - DNA, 20 bp, mouse
gacctagaggacctgaacca

SEQ ID NO: 456888 - DNA, 20 bp, mouse
gagttgttggccacgatccc

SEQ ID NO: 456889 - DNA, 20 bp, mouse
ggtaaaggtagacaaggatc

SEQ ID NO: 456890 - DNA, 20 bp, mouse
gcagtagccatgctttgtaa

SEQ ID NO: 456891 - DNA, 20 bp, mouse
gtctggtaccatatatagta

SEQ ID NO: 456892 - DNA, 20 bp, mouse
gtggttggcatgagcagttg

SEQ ID NO: 456893 - DNA, 20 bp, mouse
ggatactcaatcagcgtccc

SEQ ID NO: 456894 - DNA, 20 bp, mouse
gtacttaattcctgggatcg

SEQ ID NO: 456895 - DNA, 20 bp, mouse
gccaaaggttacttaattcc

SEQ ID NO: 456896 - DNA, 20 bp, mouse
gggtcccggcgaccccgtgg

SEQ ID NO: 456897 - DNA, 20 bp, mouse
gtggctccaagaccaggtcc

SEQ ID NO: 456898 - DNA, 20 bp, mouse
ggcagcaacacagtagcaag

SEQ ID NO: 456899 - DNA, 20 bp, mouse
ggcaagaggttcaccaactg

SEQ ID NO: 456900 - DNA, 20 bp, mouse
gaccgggatgaagccgcagt

SEQ ID NO: 456901 - DNA, 20 bp, mouse
gaccaactgcggcttcatcc

SEQ ID NO: 456902 - DNA, 20 bp, mouse
gccccggggcagtagaggga

SEQ ID NO: 456903 - DNA, 20 bp, mouse
gcacagtggacctcgggcac

SEQ ID NO: 456904 - DNA, 20 bp, mouse
gtccctccctaggagccccg

SEQ ID NO: 456905 - DNA, 20 bp, mouse
ggtcagagagaacttgatgg

SEQ ID NO: 456906 - DNA, 20 bp, mouse
ggaatctctggagtgatctg

SEQ ID NO: 456907 - DNA, 20 bp, mouse
gtggtcatcccagaaaggta

SEQ ID NO: 456908 - DNA, 20 bp, mouse
ggagtgatctgaggcagtag

SEQ ID NO: 456909 - DNA, 20 bp, mouse
ggtaaggctctgccagtgaa

SEQ ID NO: 456910 - DNA, 20 bp, mouse
gctccaacgagttgaatctc

SEQ ID NO: 456911 - DNA, 20 bp, mouse
gctccagagattcaactcgt

SEQ ID NO: 456912 - DNA, 20 bp, mouse
gctctctgtagttagagcag

SEQ ID NO: 456913 - DNA, 20 bp, mouse
ggatgatcaggttcagggtc

SEQ ID NO: 456914 - DNA, 20 bp, mouse
gctctaactacagagaggac

SEQ ID NO: 456915 - DNA, 20 bp, mouse
gtctgtagttagagcagggg

SEQ ID NO: 456916 - DNA, 20 bp, mouse
gaggcagaggcagtcacctc

SEQ ID NO: 456917 - DNA, 20 bp, mouse
gaggggcatgatctcacctg

SEQ ID NO: 456918 - DNA, 20 bp, mouse
ggagtctgtggagtggattg

SEQ ID NO: 456919 - DNA, 20 bp, mouse
ggccagagagaggtgttgct

SEQ ID NO: 456920 - DNA, 20 bp, mouse
gtcagattctgccttggtag

SEQ ID NO: 456921 - DNA, 20 bp, mouse
gatctgaagtggccatgaag

SEQ ID NO: 456922 - DNA, 20 bp, mouse
ggggatttaaagccagagag

SEQ ID NO: 456923 - DNA, 20 bp, mouse
ggccacttcagattctgcct

SEQ ID NO: 456924 - DNA, 20 bp, mouse
gcaaaagttgctgaagtctc

SEQ ID NO: 456925 - DNA, 20 bp, mouse
gaccaaggcagaatctgaag

SEQ ID NO: 456926 - DNA, 20 bp, mouse
gctgctgccagggacatctt

SEQ ID NO: 456927 - DNA, 20 bp, mouse
gcacttcaggatgaccatga

SEQ ID NO: 456928 - DNA, 20 bp, mouse
ggcgtggccaggagccctca

SEQ ID NO: 456929 - DNA, 20 bp, mouse
gctcactccaaagatgtccc

SEQ ID NO: 456930 - DNA, 20 bp, mouse
ggaagcagacagtacataca

SEQ ID NO: 456931 - DNA, 20 bp, mouse
gaaaacaagaggcgaatggg

SEQ ID NO: 456932 - DNA, 20 bp, mouse
gggagtgagcaccacacttc

SEQ ID NO: 456933 - DNA, 20 bp, mouse
gagaaaaacaagaggcgaat

SEQ ID NO: 456934 - DNA, 20 bp, mouse
gggatgaccatgagggctcc

SEQ ID NO: 456935 - DNA, 20 bp, mouse
gcatacatggcagcgtggcc

SEQ ID NO: 456936 - DNA, 20 bp, mouse
gaggtgggcagtcagtgtca

SEQ ID NO: 456937 - DNA, 20 bp, mouse
ggccttggcccgctaacaac

SEQ ID NO: 456938 - DNA, 20 bp, mouse
gtagtgaggacagggctatg

SEQ ID NO: 456939 - DNA, 20 bp, mouse
gagtgactccctcctcacca

SEQ ID NO: 456940 - DNA, 20 bp, mouse
ggacagggtcccgaagggct

SEQ ID NO: 456941 - DNA, 20 bp, mouse
ggcccacctctcctactttc

SEQ ID NO: 456942 - DNA, 20 bp, mouse
gaaagaaaagaccccagagg

SEQ ID NO: 456943 - DNA, 20 bp, mouse
gtccctctgagaagtcggga

SEQ ID NO: 456944 - DNA, 20 bp, mouse
gaggagagaccttaagacaa

SEQ ID NO: 456945 - DNA, 20 bp, mouse
gtcttaagacagggtcccga

SEQ ID NO: 456946 - DNA, 20 bp, mouse
gagcatggcgtcgtcggggt

SEQ ID NO: 456947 - DNA, 20 bp, mouse
gcaggagcatggcgtcgtcg

SEQ ID NO: 456948 - DNA, 20 bp, mouse
gctcctgctccgggccaatt

SEQ ID NO: 456949 - DNA, 20 bp, mouse
ggcaaggtcccaagtgtcag

SEQ ID NO: 456950 - DNA, 20 bp, mouse
gcccgagcggaagtagagtc

SEQ ID NO: 456951 - DNA, 20 bp, mouse
gcgtgatccaggatccgaat

SEQ ID NO: 456952 - DNA, 20 bp, mouse
gggtcgggtcaagaggtcga

SEQ ID NO: 456953 - DNA, 20 bp, mouse
gtcactaacaaaggcagtag

SEQ ID NO: 456954 - DNA, 20 bp, mouse
gcagcagaacccaggactat

SEQ ID NO: 456955 - DNA, 20 bp, mouse
ggctctgctggggcgcaggt

SEQ ID NO: 456956 - DNA, 20 bp, mouse
gcgcaccagcagggtccacc

SEQ ID NO: 456957 - DNA, 20 bp, mouse
gctgctggtgcggtgagcgg

SEQ ID NO: 456958 - DNA, 20 bp, mouse
gaccctgctggtgcggtgag

SEQ ID NO: 456959 - DNA, 20 bp, mouse
ggtcgaggcctcggagtgta

SEQ ID NO: 456960 - DNA, 20 bp, mouse
gagcgggcacagggagcggc

SEQ ID NO: 456961 - DNA, 20 bp, mouse
ggtcccagccctacactccg

SEQ ID NO: 456962 - DNA, 20 bp, mouse
gaccggaagtgagcgggcac

SEQ ID NO: 456963 - DNA, 20 bp, mouse
ggctgcagggctaggatcgg

SEQ ID NO: 456964 - DNA, 20 bp, mouse
ggtcggggcccaggggtgca

SEQ ID NO: 456965 - DNA, 20 bp, mouse
gggtgcggtgagcgggggat

SEQ ID NO: 456966 - DNA, 20 bp, mouse
gggacacagaccagagcgga

SEQ ID NO: 456967 - DNA, 20 bp, mouse
ggcccgaggacaggctctcc

SEQ ID NO: 456968 - DNA, 20 bp, mouse
ggtgaaagctgcccgaggac

SEQ ID NO: 456969 - DNA, 20 bp, mouse
gctgcctgcactgggcactg

SEQ ID NO: 456970 - DNA, 20 bp, mouse
gttagacagctggctctgcc

SEQ ID NO: 456971 - DNA, 20 bp, mouse
gcttacgtgaggctgaggat

SEQ ID NO: 456972 - DNA, 20 bp, mouse
gcgctctggtctgtgtcccc

SEQ ID NO: 456973 - DNA, 20 bp, mouse
gccgttggctcactacatgg

SEQ ID NO: 456974 - DNA, 20 bp, mouse
gaagactggtgagccatggt

SEQ ID NO: 456975 - DNA, 20 bp, mouse
gcggatggacaaggtaagac

SEQ ID NO: 456976 - DNA, 20 bp, mouse
gtccgaatgcgagctcggag

SEQ ID NO: 456977 - DNA, 20 bp, mouse
ggaatgcgagctcggagcgg

SEQ ID NO: 456978 - DNA, 20 bp, mouse
gaaggaccgggcacccctag

SEQ ID NO: 456979 - DNA, 20 bp, mouse
gcccactggacactccccta

SEQ ID NO: 456980 - DNA, 20 bp, mouse
gggaaggaatgggtaatcaa

SEQ ID NO: 456981 - DNA, 20 bp, mouse
gggttcagctctctcggcgc

SEQ ID NO: 456982 - DNA, 20 bp, mouse
gcggggaagggacacacgaa

SEQ ID NO: 456983 - DNA, 20 bp, mouse
gtcccgggctgagagcgcgg

SEQ ID NO: 456984 - DNA, 20 bp, mouse
gcggcggggttcagctctct

SEQ ID NO: 456985 - DNA, 20 bp, mouse
ggagtgtccagtggggaccc

SEQ ID NO: 456986 - DNA, 20 bp, mouse
gggagcgccgaggccaggta

SEQ ID NO: 456987 - DNA, 20 bp, mouse
ggaggccaggtacggagcgt

SEQ ID NO: 456988 - DNA, 20 bp, mouse
gggaggagacccctgctgag

SEQ ID NO: 456989 - DNA, 20 bp, mouse
gcggcggcggggaaggatcc

SEQ ID NO: 456990 - DNA, 20 bp, mouse
gctcggagacccggctcccc

SEQ ID NO: 456991 - DNA, 20 bp, mouse
gggaggctctctcggagacc

SEQ ID NO: 456992 - DNA, 20 bp, mouse
ggcctcagagtggtactggt

SEQ ID NO: 456993 - DNA, 20 bp, mouse
gggcgtcgcggcatcctccg

SEQ ID NO: 456994 - DNA, 20 bp, mouse
gggtacggagcgtgggctcg

SEQ ID NO: 456995 - DNA, 20 bp, mouse
ggaatcccgggatctggagg

SEQ ID NO: 456996 - DNA, 20 bp, mouse
gccaagcccgtaggaaccgg

SEQ ID NO: 456997 - DNA, 20 bp, mouse
gagaggaacactaacctgag

SEQ ID NO: 456998 - DNA, 20 bp, mouse
ggccccaagcccgtaggaac

SEQ ID NO: 456999 - DNA, 20 bp, mouse
gaccatggccccaagcccgt

SEQ ID NO: 457000 - DNA, 20 bp, mouse
gtactcagctcgttccactc

SEQ ID NO: 457001 - DNA, 20 bp, mouse
gaggagagttggccacccgg

SEQ ID NO: 457002 - DNA, 20 bp, mouse
ggccacgcggaagcctggag

SEQ ID NO: 457003 - DNA, 20 bp, mouse
ggagtactctgcctgccacg

SEQ ID NO: 457004 - DNA, 20 bp, mouse
gggtggccaactctcctaaa

SEQ ID NO: 457005 - DNA, 20 bp, mouse
gatttaacaggggcaagaga

SEQ ID NO: 457006 - DNA, 20 bp, mouse
ggtgggtcccgactgcggag

SEQ ID NO: 457007 - DNA, 20 bp, mouse
ggaggggtgggtcccgactg

SEQ ID NO: 457008 - DNA, 20 bp, mouse
gggccccgcgtaatcctcac

SEQ ID NO: 457009 - DNA, 20 bp, mouse
gtcctcaccggcctgacaca

SEQ ID NO: 457010 - DNA, 20 bp, mouse
gggcctgacacatggagggg

SEQ ID NO: 457011 - DNA, 20 bp, mouse
gcaccggcctgacacatgga

SEQ ID NO: 457012 - DNA, 20 bp, mouse
gcgggactgctgtgagtcgg

SEQ ID NO: 457013 - DNA, 20 bp, mouse
gcaggccggtgaggattacg

SEQ ID NO: 457014 - DNA, 20 bp, mouse
gctcacgccactccgcagtc

SEQ ID NO: 457015 - DNA, 20 bp, mouse
gggcggctagaactaaacct

SEQ ID NO: 457016 - DNA, 20 bp, mouse
gtcccgggtggcagtggtag

SEQ ID NO: 457017 - DNA, 20 bp, mouse
gctggagcggtggagaccga

SEQ ID NO: 457018 - DNA, 20 bp, mouse
gaccccacccgcccctggag

SEQ ID NO: 457019 - DNA, 20 bp, mouse
gttgctctggtcttcccggg

SEQ ID NO: 457020 - DNA, 20 bp, mouse
ggtctccaccgctccagggg

SEQ ID NO: 457021 - DNA, 20 bp, mouse
gcccgggagtcggctacggt

SEQ ID NO: 457022 - DNA, 20 bp, mouse
gcaccgctccaggggcgggt

SEQ ID NO: 457023 - DNA, 20 bp, mouse
ggtagcccgggagtcggcta

SEQ ID NO: 457024 - DNA, 20 bp, mouse
gccgtctaggaccaagggtg

SEQ ID NO: 457025 - DNA, 20 bp, mouse
ggccatgggaacagccgcgg

SEQ ID NO: 457026 - DNA, 20 bp, mouse
gttccagccagtagacttgt

SEQ ID NO: 457027 - DNA, 20 bp, mouse
gaacctgccaacaagtctac

SEQ ID NO: 457028 - DNA, 20 bp, mouse
ggctctccctgccccccact

SEQ ID NO: 457029 - DNA, 20 bp, mouse
gaaacaggagagccgagtgg

SEQ ID NO: 457030 - DNA, 20 bp, mouse
gcgtttacacgaaccgagat

SEQ ID NO: 457031 - DNA, 20 bp, mouse
gactggcgctggaaccctgt

SEQ ID NO: 457032 - DNA, 20 bp, mouse
gggttccagcgccagtcccc

SEQ ID NO: 457033 - DNA, 20 bp, mouse
gcagggagagcttgtaggtt

SEQ ID NO: 457034 - DNA, 20 bp, mouse
gtgccaacaagtctactggc

SEQ ID NO: 457035 - DNA, 20 bp, mouse
gaccctgttggtgaatgctg

SEQ ID NO: 457036 - DNA, 20 bp, mouse
gtgcctcagcaactcttcgg

SEQ ID NO: 457037 - DNA, 20 bp, mouse
gcggttgcagactcactgag

SEQ ID NO: 457038 - DNA, 20 bp, mouse
gttgcagactcactgagagg

SEQ ID NO: 457039 - DNA, 20 bp, mouse
gggtagcagcgagcagctga

SEQ ID NO: 457040 - DNA, 20 bp, mouse
gctcaaagaagcagctgtat

SEQ ID NO: 457041 - DNA, 20 bp, mouse
gtcagcctggccgggaagaa

SEQ ID NO: 457042 - DNA, 20 bp, mouse
gtacgatggagtacctgatc

SEQ ID NO: 457043 - DNA, 20 bp, mouse
ggcgtttgcccagccagatc

SEQ ID NO: 457044 - DNA, 20 bp, mouse
gaggtagttaaaagcctgtc

SEQ ID NO: 457045 - DNA, 20 bp, mouse
gtggagtacctgatctggct

SEQ ID NO: 457046 - DNA, 20 bp, mouse
gttgccggcgaggtgagcgg

SEQ ID NO: 457047 - DNA, 20 bp, mouse
ggctcccccgctcacctcgc

SEQ ID NO: 457048 - DNA, 20 bp, mouse
ggctcacctcgccggcaaga

SEQ ID NO: 457049 - DNA, 20 bp, mouse
gagagtggtctccctcttgc

SEQ ID NO: 457050 - DNA, 20 bp, mouse
ggcccctggggagaagattt

SEQ ID NO: 457051 - DNA, 20 bp, mouse
gggtctccctcttgccggcg

SEQ ID NO: 457052 - DNA, 20 bp, mouse
gtgatggtacccggattaga

SEQ ID NO: 457053 - DNA, 20 bp, mouse
ggcccaaatcttctccccag

SEQ ID NO: 457054 - DNA, 20 bp, mouse
gtggcctcacattttctctg

SEQ ID NO: 457055 - DNA, 20 bp, mouse
gcgatgttaaaaagcccctg

SEQ ID NO: 457056 - DNA, 20 bp, mouse
ggaggggcgcggtcccgcgg

SEQ ID NO: 457057 - DNA, 20 bp, mouse
ggggcggcgagagcgaatcg

SEQ ID NO: 457058 - DNA, 20 bp, mouse
ggagcgtgcggaggatcccg

SEQ ID NO: 457059 - DNA, 20 bp, mouse
gccgcggggccgctggggtc

SEQ ID NO: 457060 - DNA, 20 bp, mouse
gcagccggcgccgcgaggaa

SEQ ID NO: 457061 - DNA, 20 bp, mouse
gccaggaacgaggcgggcag

SEQ ID NO: 457062 - DNA, 20 bp, mouse
ggcctcgcgtcccttcctcg

SEQ ID NO: 457063 - DNA, 20 bp, mouse
ggtgcccaggaccaggaacg

SEQ ID NO: 457064 - DNA, 20 bp, mouse
gcgcgagctcgcgctagggg

SEQ ID NO: 457065 - DNA, 20 bp, mouse
gcgctcccgcggggccgctg

SEQ ID NO: 457066 - DNA, 20 bp, mouse
ggactctcctaaggccggag

SEQ ID NO: 457067 - DNA, 20 bp, mouse
ggcgcgggacaagttgctgg

SEQ ID NO: 457068 - DNA, 20 bp, mouse
ggctctctgcgactctccta

SEQ ID NO: 457069 - DNA, 20 bp, mouse
gaccgcgcgggacaagttgc

SEQ ID NO: 457070 - DNA, 20 bp, mouse
gggaaatcacctgctccgtc

SEQ ID NO: 457071 - DNA, 20 bp, mouse
gtctgcgactctcctaaggc

SEQ ID NO: 457072 - DNA, 20 bp, mouse
ggccccaccaacgagatcaa

SEQ ID NO: 457073 - DNA, 20 bp, mouse
gcgtaagggaacgccaggag

SEQ ID NO: 457074 - DNA, 20 bp, mouse
gtgtgactcaccctctcccg

SEQ ID NO: 457075 - DNA, 20 bp, mouse
ggactcaccctctcccgagg

SEQ ID NO: 457076 - DNA, 20 bp, mouse
ggagggacgcggccagacct

SEQ ID NO: 457077 - DNA, 20 bp, mouse
ggccgggccggagaagtcgt

SEQ ID NO: 457078 - DNA, 20 bp, mouse
gggacgcggccagacctcgg

SEQ ID NO: 457079 - DNA, 20 bp, mouse
gtcgcacgcagctccaggcg

SEQ ID NO: 457080 - DNA, 20 bp, mouse
gcgcggggcccgccgaggtc

SEQ ID NO: 457081 - DNA, 20 bp, mouse
ggtgctcgcggggcccgccg

SEQ ID NO: 457082 - DNA, 20 bp, mouse
gcggagatgcgggtgagtag

SEQ ID NO: 457083 - DNA, 20 bp, mouse
gagaggccgccccgacgcga

SEQ ID NO: 457084 - DNA, 20 bp, mouse
gcgggcgccccccgacgctc

SEQ ID NO: 457085 - DNA, 20 bp, mouse
ggccgcgtccctcagcgccc

SEQ ID NO: 457086 - DNA, 20 bp, mouse
gcggcctcggcgcacagtaa

SEQ ID NO: 457087 - DNA, 20 bp, mouse
gagccccgggctcggagggt

SEQ ID NO: 457088 - DNA, 20 bp, mouse
gccaggcgcgaggaggtcaa

SEQ ID NO: 457089 - DNA, 20 bp, mouse
gatggcagcgctgtgagccg

SEQ ID NO: 457090 - DNA, 20 bp, mouse
gacgaagccccgggctcgga

SEQ ID NO: 457091 - DNA, 20 bp, mouse
ggctgtcagctcgcgttccc

SEQ ID NO: 457092 - DNA, 20 bp, mouse
gctcgggagcaggtaagtgg

SEQ ID NO: 457093 - DNA, 20 bp, mouse
ggcgtgaaggacgaagcccc

SEQ ID NO: 457094 - DNA, 20 bp, mouse
gagggaggggcagacgacag

SEQ ID NO: 457095 - DNA, 20 bp, mouse
gaggcaacccgcaggcgtga

SEQ ID NO: 457096 - DNA, 20 bp, mouse
gcgagatccggcccagaggg

SEQ ID NO: 457097 - DNA, 20 bp, mouse
gggatctcgtctcgctgagg

SEQ ID NO: 457098 - DNA, 20 bp, mouse
gagacgagatccggcccaga

SEQ ID NO: 457099 - DNA, 20 bp, mouse
ggccggatctcgtctcgctg

SEQ ID NO: 457100 - DNA, 20 bp, mouse
ggaaggaggaggaggacgtt

SEQ ID NO: 457101 - DNA, 20 bp, mouse
gatccggcccagagggtgga

SEQ ID NO: 457102 - DNA, 20 bp, mouse
gcgcggaggagcgcgataaa

SEQ ID NO: 457103 - DNA, 20 bp, mouse
gccggcggcggcgctgacgg

SEQ ID NO: 457104 - DNA, 20 bp, mouse
gtgtcacattgaaggcggga

SEQ ID NO: 457105 - DNA, 20 bp, mouse
gagatctcgcgagatcgggg

SEQ ID NO: 457106 - DNA, 20 bp, mouse
gcggacgagggccctcggaa

SEQ ID NO: 457107 - DNA, 20 bp, mouse
ggcagcgtctcggctctcat

SEQ ID NO: 457108 - DNA, 20 bp, mouse
ggcgtccggcccagccatgg

SEQ ID NO: 457109 - DNA, 20 bp, mouse
gcctcggaagggcagcgtct

SEQ ID NO: 457110 - DNA, 20 bp, mouse
gctctcatgggccgcaccaa

SEQ ID NO: 457111 - DNA, 20 bp, mouse
ggcccagccatggcggacga

SEQ ID NO: 457112 - DNA, 20 bp, mouse
ggcggcgtccggcccagcca

SEQ ID NO: 457113 - DNA, 20 bp, mouse
gcaacgccgcgggcttggtg

SEQ ID NO: 457114 - DNA, 20 bp, mouse
gcgagggccctcgtccgcca

SEQ ID NO: 457115 - DNA, 20 bp, mouse
ggccctcgtccgccatggct

SEQ ID NO: 457116 - DNA, 20 bp, mouse
ggctcttaccggaagtgcct

SEQ ID NO: 457117 - DNA, 20 bp, mouse
gtcaagtccggcggacccgg

SEQ ID NO: 457118 - DNA, 20 bp, mouse
gcgcccggaacgctcactcc

SEQ ID NO: 457119 - DNA, 20 bp, mouse
ggtggagaggaggacccgag

SEQ ID NO: 457120 - DNA, 20 bp, mouse
gtccctgagagagggagaaa

SEQ ID NO: 457121 - DNA, 20 bp, mouse
gacttccggtaagagcgatg

SEQ ID NO: 457122 - DNA, 20 bp, mouse
gaacccccccacctcaagtc

SEQ ID NO: 457123 - DNA, 20 bp, mouse
gcccgggggcttcaggatct

SEQ ID NO: 457124 - DNA, 20 bp, mouse
gccccccacctcaagtccgg

SEQ ID NO: 457125 - DNA, 20 bp, mouse
gacggtgagggagcccggtg

SEQ ID NO: 457126 - DNA, 20 bp, mouse
gcaagcgggtgcaagcccag

SEQ ID NO: 457127 - DNA, 20 bp, mouse
ggccggcaacgactttatct

SEQ ID NO: 457128 - DNA, 20 bp, mouse
ggcttagggcccgcacctca

SEQ ID NO: 457129 - DNA, 20 bp, mouse
gagcccagcggcagaagcga

SEQ ID NO: 457130 - DNA, 20 bp, mouse
gctctcgcgtgggcaggccg

SEQ ID NO: 457131 - DNA, 20 bp, mouse
ggacgccgccacggaccctg

SEQ ID NO: 457132 - DNA, 20 bp, mouse
gagccgaccagaccgggaag

SEQ ID NO: 457133 - DNA, 20 bp, mouse
gtcgttgccggcggcccaag

SEQ ID NO: 457134 - DNA, 20 bp, mouse
ggacgcgagcggcgaatggt

SEQ ID NO: 457135 - DNA, 20 bp, mouse
gcgggagccgagcgcatcga

SEQ ID NO: 457136 - DNA, 20 bp, mouse
gagggacgcgcggaacacga

SEQ ID NO: 457137 - DNA, 20 bp, mouse
ggacgcgcggaacacgatgg

SEQ ID NO: 457138 - DNA, 20 bp, mouse
gcctcgcgccaggatcccgg

SEQ ID NO: 457139 - DNA, 20 bp, mouse
gaggcctcgcgccaggatcc

SEQ ID NO: 457140 - DNA, 20 bp, mouse
gttgcagagctagggacgcg

SEQ ID NO: 457141 - DNA, 20 bp, mouse
gccctagctctgcaaaggac

SEQ ID NO: 457142 - DNA, 20 bp, mouse
gggatcccggcggacttctg

SEQ ID NO: 457143 - DNA, 20 bp, mouse
ggatcggaagcccagaatag

SEQ ID NO: 457144 - DNA, 20 bp, mouse
gtcccggcggacttctgagg

SEQ ID NO: 457145 - DNA, 20 bp, mouse
gcggaacacgatggcggctg

SEQ ID NO: 457146 - DNA, 20 bp, mouse
gagcgagggtccagccggga

SEQ ID NO: 457147 - DNA, 20 bp, mouse
gcagccgggagggcggtgag

SEQ ID NO: 457148 - DNA, 20 bp, mouse
gcgctgctgggtgacagcga

SEQ ID NO: 457149 - DNA, 20 bp, mouse
ggagggtccagccgggaggg

SEQ ID NO: 457150 - DNA, 20 bp, mouse
ggaggaggcgggcccagttg

SEQ ID NO: 457151 - DNA, 20 bp, mouse
ggtgacagcgagggtccagc

SEQ ID NO: 457152 - DNA, 20 bp, mouse
gtccaagctagactccagag

SEQ ID NO: 457153 - DNA, 20 bp, mouse
gagttgcgggacccgctgct

SEQ ID NO: 457154 - DNA, 20 bp, mouse
gggactagagggagaagtcg

SEQ ID NO: 457155 - DNA, 20 bp, mouse
ggtccgggaggaagggatga

SEQ ID NO: 457156 - DNA, 20 bp, mouse
ggcgtaagagggttagagag

SEQ ID NO: 457157 - DNA, 20 bp, mouse
gtatctggggacaacggaat

SEQ ID NO: 457158 - DNA, 20 bp, mouse
gttcgcttatctggggacaa

SEQ ID NO: 457159 - DNA, 20 bp, mouse
gcaaactgttcgcttatctg

SEQ ID NO: 457160 - DNA, 20 bp, mouse
gttcagacaagcagcgtaag

SEQ ID NO: 457161 - DNA, 20 bp, mouse
ggataagcgaacagtttgct

SEQ ID NO: 457162 - DNA, 20 bp, mouse
gcggcacctagagcccatca

SEQ ID NO: 457163 - DNA, 20 bp, mouse
gggccagagaaggggacgga

SEQ ID NO: 457164 - DNA, 20 bp, mouse
gtcggggacaggaggcttag

SEQ ID NO: 457165 - DNA, 20 bp, mouse
gagtgagttgcattctggag

SEQ ID NO: 457166 - DNA, 20 bp, mouse
gggctactgcaggtaagagg

SEQ ID NO: 457167 - DNA, 20 bp, mouse
gaggtctggagactccggga

SEQ ID NO: 457168 - DNA, 20 bp, mouse
gcgtggctactgcaggtaag

SEQ ID NO: 457169 - DNA, 20 bp, mouse
gtggagactccgggaaggca

SEQ ID NO: 457170 - DNA, 20 bp, mouse
gcgcgtcacgtggctactgc

SEQ ID NO: 457171 - DNA, 20 bp, mouse
gcagggctgctcctgtcacg

SEQ ID NO: 457172 - DNA, 20 bp, mouse
gagaggcggccgctccgccg

SEQ ID NO: 457173 - DNA, 20 bp, mouse
gagcttctgcagcggaacag

SEQ ID NO: 457174 - DNA, 20 bp, mouse
ggcacctgggctgccttctg

SEQ ID NO: 457175 - DNA, 20 bp, mouse
gtcaatggccgctcattgca

SEQ ID NO: 457176 - DNA, 20 bp, mouse
gtacctgaggctgtagttca

SEQ ID NO: 457177 - DNA, 20 bp, mouse
gcctgagggagcccggtgga

SEQ ID NO: 457178 - DNA, 20 bp, mouse
gaaccgtgaactacagcctc

SEQ ID NO: 457179 - DNA, 20 bp, mouse
gagttcacggttactgccta

SEQ ID NO: 457180 - DNA, 20 bp, mouse
gcatggacagaccggaatca

SEQ ID NO: 457181 - DNA, 20 bp, mouse
gggattggggatttagccct

SEQ ID NO: 457182 - DNA, 20 bp, mouse
gactcaccaggaggcatgta

SEQ ID NO: 457183 - DNA, 20 bp, mouse
gtcagggcgggcaaggagga

SEQ ID NO: 457184 - DNA, 20 bp, mouse
gagcctcagggcgggcaagg

SEQ ID NO: 457185 - DNA, 20 bp, mouse
gacagcctcaggtagggtgc

SEQ ID NO: 457186 - DNA, 20 bp, mouse
gcgcggccgcggggactcag

SEQ ID NO: 457187 - DNA, 20 bp, mouse
gggaaaccgaaggcgagcga

SEQ ID NO: 457188 - DNA, 20 bp, mouse
ggcggccgcgcgagcgacgg

SEQ ID NO: 457189 - DNA, 20 bp, mouse
ggccgcgcgagcgacggagg

SEQ ID NO: 457190 - DNA, 20 bp, mouse
gaaccgaaggcgagcgaggg

SEQ ID NO: 457191 - DNA, 20 bp, mouse
ggggactcagtggaaaccga

SEQ ID NO: 457192 - DNA, 20 bp, mouse
ggcgagcgagggaggaacgc

SEQ ID NO: 457193 - DNA, 20 bp, mouse
ggcgggaagcatgaagaaag

SEQ ID NO: 457194 - DNA, 20 bp, mouse
gggtttccactgagtccccg

SEQ ID NO: 457195 - DNA, 20 bp, mouse
gtcccactcgccaccctcgg

SEQ ID NO: 457196 - DNA, 20 bp, mouse
gtcaagatggcggccaatgt

SEQ ID NO: 457197 - DNA, 20 bp, mouse
gcatattgagacggagtgag

SEQ ID NO: 457198 - DNA, 20 bp, mouse
ggagttcaggagccgccagg

SEQ ID NO: 457199 - DNA, 20 bp, mouse
gagtgagaggctgatagaga

SEQ ID NO: 457200 - DNA, 20 bp, mouse
gatcttgagacatattgaga

SEQ ID NO: 457201 - DNA, 20 bp, mouse
gtgagagccggggagcccga

SEQ ID NO: 457202 - DNA, 20 bp, mouse
gtgaaacatcgatcccacat

SEQ ID NO: 457203 - DNA, 20 bp, mouse
gagtcggcggcgagtccctc

SEQ ID NO: 457204 - DNA, 20 bp, mouse
gctcggccccgctcttctcc

SEQ ID NO: 457205 - DNA, 20 bp, mouse
ggggatcgatgtttcaatat

SEQ ID NO: 457206 - DNA, 20 bp, mouse
ggaagatggaggtcactgga

SEQ ID NO: 457207 - DNA, 20 bp, mouse
ggcacagctgaattctacag

SEQ ID NO: 457208 - DNA, 20 bp, mouse
ggaattcagctgtgccccac

SEQ ID NO: 457209 - DNA, 20 bp, mouse
gcctgagggtgagggccctg

SEQ ID NO: 457210 - DNA, 20 bp, mouse
gatcttcgcagggtgcctca

SEQ ID NO: 457211 - DNA, 20 bp, mouse
gataagaagcctgagggtga

SEQ ID NO: 457212 - DNA, 20 bp, mouse
gtgaattctacagaggctga

SEQ ID NO: 457213 - DNA, 20 bp, mouse
gtgtcacacaccggtaggat

SEQ ID NO: 457214 - DNA, 20 bp, mouse
gcactggaaggctgttcatc

SEQ ID NO: 457215 - DNA, 20 bp, mouse
gagtgacctccatcttcgca

SEQ ID NO: 457216 - DNA, 20 bp, mouse
gtgggagctaagggtcgcat

SEQ ID NO: 457217 - DNA, 20 bp, mouse
gccccggcgccgagatttct

SEQ ID NO: 457218 - DNA, 20 bp, mouse
gcatgcccggctgctcactc

SEQ ID NO: 457219 - DNA, 20 bp, mouse
gttcatgagtgagtttcgga

SEQ ID NO: 457220 - DNA, 20 bp, mouse
gcggcctgtacgatcgtcac

SEQ ID NO: 457221 - DNA, 20 bp, mouse
gcggctgctcactctggcgg

SEQ ID NO: 457222 - DNA, 20 bp, mouse
gttggttcatgagtgagttt

SEQ ID NO: 457223 - DNA, 20 bp, mouse
gcagcccgtgacgatcgtac

SEQ ID NO: 457224 - DNA, 20 bp, mouse
ggagcccctggtgtaaaaac

SEQ ID NO: 457225 - DNA, 20 bp, mouse
gctgcaccggtgaccgcccc

SEQ ID NO: 457226 - DNA, 20 bp, mouse
gtacggaactctgaagactc

SEQ ID NO: 457227 - DNA, 20 bp, mouse
gcgctcttccggtatgatgg

SEQ ID NO: 457228 - DNA, 20 bp, mouse
gtaggcccagccggctcaca

SEQ ID NO: 457229 - DNA, 20 bp, mouse
ggtggctgcgccgtctccac

SEQ ID NO: 457230 - DNA, 20 bp, mouse
gtgcgaaacatggatcacta

SEQ ID NO: 457231 - DNA, 20 bp, mouse
gcggctgggcctagcgccgg

SEQ ID NO: 457232 - DNA, 20 bp, mouse
gctagggctaaacatgacag

SEQ ID NO: 457233 - DNA, 20 bp, mouse
gcctctcctgggagcaccct

SEQ ID NO: 457234 - DNA, 20 bp, mouse
gcgcgacccagggtgctccc

SEQ ID NO: 457235 - DNA, 20 bp, mouse
gcgcgggccgccggtggaga

SEQ ID NO: 457236 - DNA, 20 bp, mouse
ggacctgaaagattcagcga

SEQ ID NO: 457237 - DNA, 20 bp, mouse
gagggcagctggttcctgta

SEQ ID NO: 457238 - DNA, 20 bp, mouse
ggtctctgaactgtttccct

SEQ ID NO: 457239 - DNA, 20 bp, mouse
ggtagggattaggtcccgag

SEQ ID NO: 457240 - DNA, 20 bp, mouse
gagattcagcgaaggcagag

SEQ ID NO: 457241 - DNA, 20 bp, mouse
gcggaagtgcgagctagagc

SEQ ID NO: 457242 - DNA, 20 bp, mouse
gcagttcagagacggcctct

SEQ ID NO: 457243 - DNA, 20 bp, mouse
gaggtctccgcctcccatga

SEQ ID NO: 457244 - DNA, 20 bp, mouse
ggactgagcccgagacccac

SEQ ID NO: 457245 - DNA, 20 bp, mouse
ggaaccgtctccaccatcat

SEQ ID NO: 457246 - DNA, 20 bp, mouse
ggagtaactagtgattagta

SEQ ID NO: 457247 - DNA, 20 bp, mouse
gacatggcggcgtccatgat

SEQ ID NO: 457248 - DNA, 20 bp, mouse
gctccggtccgggagcaaca

SEQ ID NO: 457249 - DNA, 20 bp, mouse
gtcaccgtgtccaggaggta

SEQ ID NO: 457250 - DNA, 20 bp, mouse
ggagccgcccactaatggga

SEQ ID NO: 457251 - DNA, 20 bp, mouse
gccaggagccgcccactaat

SEQ ID NO: 457252 - DNA, 20 bp, mouse
gaacttcactcggtcagagt

SEQ ID NO: 457253 - DNA, 20 bp, mouse
gttgcggccacactaaggag

SEQ ID NO: 457254 - DNA, 20 bp, mouse
gtccccaaactagcccatca

SEQ ID NO: 457255 - DNA, 20 bp, mouse
gtcctggacacggtgactgg

SEQ ID NO: 457256 - DNA, 20 bp, mouse
gccatcgggaatgacaacca

SEQ ID NO: 457257 - DNA, 20 bp, mouse
gaggtcactcacagacgcag

SEQ ID NO: 457258 - DNA, 20 bp, mouse
gctgctgggagccggagtgg

SEQ ID NO: 457259 - DNA, 20 bp, mouse
gcagtggcttctgagccatc

SEQ ID NO: 457260 - DNA, 20 bp, mouse
gacgaacgcgcgctcaaggt

SEQ ID NO: 457261 - DNA, 20 bp, mouse
gcgggaatgacaaccagggc

SEQ ID NO: 457262 - DNA, 20 bp, mouse
ggctcaaggttggaacgccg

SEQ ID NO: 457263 - DNA, 20 bp, mouse
gttggtggccgtcccagccc

SEQ ID NO: 457264 - DNA, 20 bp, mouse
gcaccagggcgaaatgaact

SEQ ID NO: 457265 - DNA, 20 bp, mouse
gtgaactgggaggcgagaac

SEQ ID NO: 457266 - DNA, 20 bp, mouse
gtcgacggcaacaactatgg

SEQ ID NO: 457267 - DNA, 20 bp, mouse
gttttcgacggcaacaacta

SEQ ID NO: 457268 - DNA, 20 bp, mouse
gcggcgtccttgcttttcga

SEQ ID NO: 457269 - DNA, 20 bp, mouse
ggaacagacccgtaatgcca

SEQ ID NO: 457270 - DNA, 20 bp, mouse
ggtaaaccgaggtttcccga

SEQ ID NO: 457271 - DNA, 20 bp, mouse
gggacgccgtcgggaaacct

SEQ ID NO: 457272 - DNA, 20 bp, mouse
ggatacctggcgtaacacct

SEQ ID NO: 457273 - DNA, 20 bp, mouse
gtggcgtaacacctcggccc

SEQ ID NO: 457274 - DNA, 20 bp, mouse
gcacctcggccctggcatta

SEQ ID NO: 457275 - DNA, 20 bp, mouse
gagtgagtggactatctccc

SEQ ID NO: 457276 - DNA, 20 bp, mouse
gaccgagcaggcagaccggg

SEQ ID NO: 457277 - DNA, 20 bp, mouse
ggtagctcgcgggtctgagg

SEQ ID NO: 457278 - DNA, 20 bp, mouse
gcagacccgcgagctactcg

SEQ ID NO: 457279 - DNA, 20 bp, mouse
ggaggcggcagcaggagtcc

SEQ ID NO: 457280 - DNA, 20 bp, mouse
gctactcggggacaccgagc

SEQ ID NO: 457281 - DNA, 20 bp, mouse
gcgcacgcggggcgagggaa

SEQ ID NO: 457282 - DNA, 20 bp, mouse
ggtgtccccgagtagctcgc

SEQ ID NO: 457283 - DNA, 20 bp, mouse
gcggaccccgcaggaagcgc

SEQ ID NO: 457284 - DNA, 20 bp, mouse
ggaccttgctgggtaagtcg

SEQ ID NO: 457285 - DNA, 20 bp, mouse
gggcagcaggagtcctggca

SEQ ID NO: 457286 - DNA, 20 bp, mouse
gactactaggagctgcgaca

SEQ ID NO: 457287 - DNA, 20 bp, mouse
gggcgcagcagccacgcgag

SEQ ID NO: 457288 - DNA, 20 bp, mouse
gctggagtgcaggaattcgg

SEQ ID NO: 457289 - DNA, 20 bp, mouse
gccagccgcgagtgactact

SEQ ID NO: 457290 - DNA, 20 bp, mouse
gtggctggagtgcaggaatt

SEQ ID NO: 457291 - DNA, 20 bp, mouse
ggcggcgagggagccatggc

SEQ ID NO: 457292 - DNA, 20 bp, mouse
gctgggggcctggagcgaca

SEQ ID NO: 457293 - DNA, 20 bp, mouse
gagtcggggagacacctcgg

SEQ ID NO: 457294 - DNA, 20 bp, mouse
gaggaattcggcgggccagg

SEQ ID NO: 457295 - DNA, 20 bp, mouse
gcgagtcccagccatcccag

SEQ ID NO: 457296 - DNA, 20 bp, mouse
ggtggagtctgcgtgagact

SEQ ID NO: 457297 - DNA, 20 bp, mouse
gttacctgagcagatgggaa

SEQ ID NO: 457298 - DNA, 20 bp, mouse
gggtacttacctgagcagat

SEQ ID NO: 457299 - DNA, 20 bp, mouse
gatgggaagggaacttctgc

SEQ ID NO: 457300 - DNA, 20 bp, mouse
gagagggaagcacttgcctc

SEQ ID NO: 457301 - DNA, 20 bp, mouse
ggggaggagtctggagtccg

SEQ ID NO: 457302 - DNA, 20 bp, mouse
gtgaccccacgcccaggtat

SEQ ID NO: 457303 - DNA, 20 bp, mouse
gccccacgcccaggtatggg

SEQ ID NO: 457304 - DNA, 20 bp, mouse
gatcctcaggaaaatagaca

SEQ ID NO: 457305 - DNA, 20 bp, mouse
gagtgcttccctctctatga

SEQ ID NO: 457306 - DNA, 20 bp, mouse
gagccagtcgggagtgtacc

SEQ ID NO: 457307 - DNA, 20 bp, mouse
gagcctggtacactcccgac

SEQ ID NO: 457308 - DNA, 20 bp, mouse
gccaccgccgggagccagtc

SEQ ID NO: 457309 - DNA, 20 bp, mouse
gactcccgactggctcccgg

SEQ ID NO: 457310 - DNA, 20 bp, mouse
gagacgcgggaaacagacaa

SEQ ID NO: 457311 - DNA, 20 bp, mouse
gcggcctcccgggaacaatg

SEQ ID NO: 457312 - DNA, 20 bp, mouse
gcccagggcgccaacactgt

SEQ ID NO: 457313 - DNA, 20 bp, mouse
gtacactcccgactggctcc

SEQ ID NO: 457314 - DNA, 20 bp, mouse
gggagcgcaagcgactggga

SEQ ID NO: 457315 - DNA, 20 bp, mouse
gtgcccatccgccactacca

SEQ ID NO: 457316 - DNA, 20 bp, mouse
ggagtctggagtgctggaac

SEQ ID NO: 457317 - DNA, 20 bp, mouse
ggagcgggtggctgggatca

SEQ ID NO: 457318 - DNA, 20 bp, mouse
gatggtgctgtgttggagtg

SEQ ID NO: 457319 - DNA, 20 bp, mouse
gtggcgataggcgcccctat

SEQ ID NO: 457320 - DNA, 20 bp, mouse
gtgggatcatggtgctgtgt

SEQ ID NO: 457321 - DNA, 20 bp, mouse
gtggtcagcgggactgtggg

SEQ ID NO: 457322 - DNA, 20 bp, mouse
gcgctgcacagagaagcgag

SEQ ID NO: 457323 - DNA, 20 bp, mouse
gcccactaggagaagtgtgg

SEQ ID NO: 457324 - DNA, 20 bp, mouse
ggagaagcgagcgggtggct

SEQ ID NO: 457325 - DNA, 20 bp, mouse
ggaggctctgagtcctgttg

SEQ ID NO: 457326 - DNA, 20 bp, mouse
gtgatggggaggcttccgga

SEQ ID NO: 457327 - DNA, 20 bp, mouse
gacatcccgagccaaccttc

SEQ ID NO: 457328 - DNA, 20 bp, mouse
gtcgggatgtctctcagcgg

SEQ ID NO: 457329 - DNA, 20 bp, mouse
gggggaggcttccggaaggt

SEQ ID NO: 457330 - DNA, 20 bp, mouse
gttgggttcatggtgctgat

SEQ ID NO: 457331 - DNA, 20 bp, mouse
gggcttccggaaggttggct

SEQ ID NO: 457332 - DNA, 20 bp, mouse
gacggcagcacttgggttca

SEQ ID NO: 457333 - DNA, 20 bp, mouse
gtgtgtacctataaagaaga

SEQ ID NO: 457334 - DNA, 20 bp, mouse
gtgagtgggactcaaggtaa

SEQ ID NO: 457335 - DNA, 20 bp, mouse
gcatcctgctgggtctgagt

SEQ ID NO: 457336 - DNA, 20 bp, mouse
gggacagcaagaggacaccg

SEQ ID NO: 457337 - DNA, 20 bp, mouse
gtggaccgagagtgaaagtg

SEQ ID NO: 457338 - DNA, 20 bp, mouse
gcagagcgcggccagcacca

SEQ ID NO: 457339 - DNA, 20 bp, mouse
gtgcagagctggacagcaag

SEQ ID NO: 457340 - DNA, 20 bp, mouse
gcggccataggacctagaga

SEQ ID NO: 457341 - DNA, 20 bp, mouse
ggacaccctggacatgaggt

SEQ ID NO: 457342 - DNA, 20 bp, mouse
ggccagcacggcgacgacct

SEQ ID NO: 457343 - DNA, 20 bp, mouse
ggaggacccgcaggattgtt

SEQ ID NO: 457344 - DNA, 20 bp, mouse
gcgcggacccgaaggagctc

SEQ ID NO: 457345 - DNA, 20 bp, mouse
gtttcactctcggtccacct

SEQ ID NO: 457346 - DNA, 20 bp, mouse
gtccacctccaggcagaatg

SEQ ID NO: 457347 - DNA, 20 bp, mouse
gtgagcctcattctgcctgg

SEQ ID NO: 457348 - DNA, 20 bp, mouse
gctcaccgtggcctggagag

SEQ ID NO: 457349 - DNA, 20 bp, mouse
ggcctcattctgcctggagg

SEQ ID NO: 457350 - DNA, 20 bp, mouse
gcgcacagactccgagctaa

SEQ ID NO: 457351 - DNA, 20 bp, mouse
ggagaaggagtgtcgtggag

SEQ ID NO: 457352 - DNA, 20 bp, mouse
gttcaaaaatctagaaacaa

SEQ ID NO: 457353 - DNA, 20 bp, mouse
gcttagagaagaggtacagg

SEQ ID NO: 457354 - DNA, 20 bp, mouse
ggagcgcagcactctgagta

SEQ ID NO: 457355 - DNA, 20 bp, mouse
gagtatggctgcacatggta

SEQ ID NO: 457356 - DNA, 20 bp, mouse
gagcgcggcaccgcgacaga

SEQ ID NO: 457357 - DNA, 20 bp, mouse
gggcaggagcacccatcgac

SEQ ID NO: 457358 - DNA, 20 bp, mouse
gcggcaccgcgacagacggc

SEQ ID NO: 457359 - DNA, 20 bp, mouse
ggtgctcctgccgtctgtcg

SEQ ID NO: 457360 - DNA, 20 bp, mouse
gctccagctacgcccgtcga

SEQ ID NO: 457361 - DNA, 20 bp, mouse
ggcggtcgcggagacctgta

SEQ ID NO: 457362 - DNA, 20 bp, mouse
gcccagcgccaagcgcagcg

SEQ ID NO: 457363 - DNA, 20 bp, mouse
gccgcgacagagggccctcg

SEQ ID NO: 457364 - DNA, 20 bp, mouse
ggtcgcggagacctgtacgg

SEQ ID NO: 457365 - DNA, 20 bp, mouse
gagcctcatgctggccggag

SEQ ID NO: 457366 - DNA, 20 bp, mouse
ggtcaggccacagacggaca

SEQ ID NO: 457367 - DNA, 20 bp, mouse
gaccagagtcaggccacaga

SEQ ID NO: 457368 - DNA, 20 bp, mouse
ggagcagccatgtccgtctg

SEQ ID NO: 457369 - DNA, 20 bp, mouse
gtgctggctgtccttaacct

SEQ ID NO: 457370 - DNA, 20 bp, mouse
gaccgaagatgcctaggtta

SEQ ID NO: 457371 - DNA, 20 bp, mouse
gtagcttaccgaagatgcct

SEQ ID NO: 457372 - DNA, 20 bp, mouse
gtaccatccagaccagagtc

SEQ ID NO: 457373 - DNA, 20 bp, mouse
gggacatggctgctcaaggc

SEQ ID NO: 457374 - DNA, 20 bp, mouse
gtaaaaccagcaaggccaca

SEQ ID NO: 457375 - DNA, 20 bp, mouse
gcatcttcggtaagctaacg

SEQ ID NO: 457376 - DNA, 20 bp, mouse
gccggtaccgaccagacggt

SEQ ID NO: 457377 - DNA, 20 bp, mouse
gccggaaccgaccgtctggt

SEQ ID NO: 457378 - DNA, 20 bp, mouse
ggcgcccagctcccagtcgg

SEQ ID NO: 457379 - DNA, 20 bp, mouse
gtccgtgccaagctcaggag

SEQ ID NO: 457380 - DNA, 20 bp, mouse
gctccccggtaccgaccaga

SEQ ID NO: 457381 - DNA, 20 bp, mouse
gtccgcagaagccggagatg

SEQ ID NO: 457382 - DNA, 20 bp, mouse
gctgtccggaaccgaccgtc

SEQ ID NO: 457383 - DNA, 20 bp, mouse
ggtgtgtgtgtcccccgact

SEQ ID NO: 457384 - DNA, 20 bp, mouse
gtgggagctgggcgcaaagc

SEQ ID NO: 457385 - DNA, 20 bp, mouse
gaccctgccaggttagtcgg

SEQ ID NO: 457386 - DNA, 20 bp, mouse
ggaaatcagaagcctctaac

SEQ ID NO: 457387 - DNA, 20 bp, mouse
ggtggattgtcaccagttag

SEQ ID NO: 457388 - DNA, 20 bp, mouse
ggaggctagaagcttcattg

SEQ ID NO: 457389 - DNA, 20 bp, mouse
ggctgtctgttggttcttaa

SEQ ID NO: 457390 - DNA, 20 bp, mouse
gggacccaggatactgtggt

SEQ ID NO: 457391 - DNA, 20 bp, mouse
gactggaagcaacagaagga

SEQ ID NO: 457392 - DNA, 20 bp, mouse
gcccaagggtgttcttgtgt

SEQ ID NO: 457393 - DNA, 20 bp, mouse
ggtggcacacctataatact

SEQ ID NO: 457394 - DNA, 20 bp, mouse
gtgatttcttgtaactgctc

SEQ ID NO: 457395 - DNA, 20 bp, mouse
gccatggacatgagcatcac

SEQ ID NO: 457396 - DNA, 20 bp, mouse
ggcctccaacaagcttcctc

SEQ ID NO: 457397 - DNA, 20 bp, mouse
gaagcttgttggaggcactg

SEQ ID NO: 457398 - DNA, 20 bp, mouse
ggcccgaggaagcttgttgg

SEQ ID NO: 457399 - DNA, 20 bp, mouse
gagtgcccgaggaagcttgt

SEQ ID NO: 457400 - DNA, 20 bp, mouse
gctggagtctggagtgcccg

SEQ ID NO: 457401 - DNA, 20 bp, mouse
gggcactgaggcgcagtctg

SEQ ID NO: 457402 - DNA, 20 bp, mouse
gtgcctgaagaccctgccaa

SEQ ID NO: 457403 - DNA, 20 bp, mouse
gggctctgcagagagatgtg

SEQ ID NO: 457404 - DNA, 20 bp, mouse
gtctgcagagccactctcaa

SEQ ID NO: 457405 - DNA, 20 bp, mouse
ggtctgggcaactctggcca

SEQ ID NO: 457406 - DNA, 20 bp, mouse
ggcgcgggagctggtgcgaa

SEQ ID NO: 457407 - DNA, 20 bp, mouse
ggagctggtgcgaagggctg

SEQ ID NO: 457408 - DNA, 20 bp, mouse
gtgcctgaacaccctaccaa

SEQ ID NO: 457409 - DNA, 20 bp, mouse
gaggggccatggcgctaggc

SEQ ID NO: 457410 - DNA, 20 bp, mouse
ggtggctggagtctggagcg

SEQ ID NO: 457411 - DNA, 20 bp, mouse
ggagtctggagcgcgggagc

SEQ ID NO: 457412 - DNA, 20 bp, mouse
ggctattctggccatggtag

SEQ ID NO: 457413 - DNA, 20 bp, mouse
gaaggctcgaggttctgctg

SEQ ID NO: 457414 - DNA, 20 bp, mouse
gtggtctcaaaatcaaccct

SEQ ID NO: 457415 - DNA, 20 bp, mouse
gacaccgggtcagaggggct

SEQ ID NO: 457416 - DNA, 20 bp, mouse
ggctcgggatatgctggagg

SEQ ID NO: 457417 - DNA, 20 bp, mouse
gtggacaagatcccggacca

SEQ ID NO: 457418 - DNA, 20 bp, mouse
gctcattgtggacaagatcc

SEQ ID NO: 457419 - DNA, 20 bp, mouse
ggcaccagctcgggatatgc

SEQ ID NO: 457420 - DNA, 20 bp, mouse
gccagctcgggatatgctgg

SEQ ID NO: 457421 - DNA, 20 bp, mouse
gggaggaggtgtggagattg

SEQ ID NO: 457422 - DNA, 20 bp, mouse
gggggctctacagagcacta

SEQ ID NO: 457423 - DNA, 20 bp, mouse
gagcatctagctgaaggtga

SEQ ID NO: 457424 - DNA, 20 bp, mouse
gagctggtgctccctggtcc

SEQ ID NO: 457425 - DNA, 20 bp, mouse
gtgagggcgcagcacctgcg

SEQ ID NO: 457426 - DNA, 20 bp, mouse
gcccaagaggaaaagaacag

SEQ ID NO: 457427 - DNA, 20 bp, mouse
gaaaagaacagcggacttca

SEQ ID NO: 457428 - DNA, 20 bp, mouse
ggctgtgagcagttatccaa

SEQ ID NO: 457429 - DNA, 20 bp, mouse
gtggagcagtgtggagttcg

SEQ ID NO: 457430 - DNA, 20 bp, mouse
gtgctctctaaagacattct

SEQ ID NO: 457431 - DNA, 20 bp, mouse
gcagtgtggagttcgaggtg

SEQ ID NO: 457432 - DNA, 20 bp, mouse
gcaagaaggcatatttaact

SEQ ID NO: 457433 - DNA, 20 bp, mouse
gctttagagagcatgttctt

SEQ ID NO: 457434 - DNA, 20 bp, mouse
gtcaccgtaaaagccttctc

SEQ ID NO: 457435 - DNA, 20 bp, mouse
gcggttgaggaaagtgatgc

SEQ ID NO: 457436 - DNA, 20 bp, mouse
ggacacaggcgtcctacctg

SEQ ID NO: 457437 - DNA, 20 bp, mouse
gcccagctggtgcctcaggt

SEQ ID NO: 457438 - DNA, 20 bp, mouse
gtcctcccgcacacaaggaa

SEQ ID NO: 457439 - DNA, 20 bp, mouse
ggctgtgaccgtaagcacct

SEQ ID NO: 457440 - DNA, 20 bp, mouse
gcacaaggaacggacccagc

SEQ ID NO: 457441 - DNA, 20 bp, mouse
gtgggtccgttccttgtgtg

SEQ ID NO: 457442 - DNA, 20 bp, mouse
ggccttcctaccccaacatg

SEQ ID NO: 457443 - DNA, 20 bp, mouse
gtcctacctgaggcaccagc

SEQ ID NO: 457444 - DNA, 20 bp, mouse
gcaggctcctcccgcacaca

SEQ ID NO: 457445 - DNA, 20 bp, mouse
gcgtacctagacacagtgag

SEQ ID NO: 457446 - DNA, 20 bp, mouse
gctgtcagggctggttgaac

SEQ ID NO: 457447 - DNA, 20 bp, mouse
ggttgaactggaagaaagtg

SEQ ID NO: 457448 - DNA, 20 bp, mouse
ggcttgggagctgtcagggc

SEQ ID NO: 457449 - DNA, 20 bp, mouse
ggtcagtagtttcctcatca

SEQ ID NO: 457450 - DNA, 20 bp, mouse
gtcaaggcttgggagctgtc

SEQ ID NO: 457451 - DNA, 20 bp, mouse
gaagtgaggcagccgtgatg

SEQ ID NO: 457452 - DNA, 20 bp, mouse
ggcctccaggacttccccat

SEQ ID NO: 457453 - DNA, 20 bp, mouse
gatgaggaaactactgacct

SEQ ID NO: 457454 - DNA, 20 bp, mouse
gtgccgtgggatactagtga

SEQ ID NO: 457455 - DNA, 20 bp, mouse
gtcgtagaactactgcaggt

SEQ ID NO: 457456 - DNA, 20 bp, mouse
gtgaggcatccaagccacag

SEQ ID NO: 457457 - DNA, 20 bp, mouse
gcacagccaagaggcaccag

SEQ ID NO: 457458 - DNA, 20 bp, mouse
ggaacttacctcaaggtaca

SEQ ID NO: 457459 - DNA, 20 bp, mouse
gcagcctggccactaaccac

SEQ ID NO: 457460 - DNA, 20 bp, mouse
gggataccagggacaagcgt

SEQ ID NO: 457461 - DNA, 20 bp, mouse
gtggccgagctcggatacca

SEQ ID NO: 457462 - DNA, 20 bp, mouse
gtgagcagcatcgaatgcag

SEQ ID NO: 457463 - DNA, 20 bp, mouse
gagccaagccatgtaccttg

SEQ ID NO: 457464 - DNA, 20 bp, mouse
gttggctggtgctccggctg

SEQ ID NO: 457465 - DNA, 20 bp, mouse
ggggaacttgcagtgaacag

SEQ ID NO: 457466 - DNA, 20 bp, mouse
gggtagcagtgaaacctctg

SEQ ID NO: 457467 - DNA, 20 bp, mouse
gggtgctccggtaaccacca

SEQ ID NO: 457468 - DNA, 20 bp, mouse
gggagcaccaaacgcctcag

SEQ ID NO: 457469 - DNA, 20 bp, mouse
gctacagccgtggtggttac

SEQ ID NO: 457470 - DNA, 20 bp, mouse
gactcgctctacagccgtgg

SEQ ID NO: 457471 - DNA, 20 bp, mouse
ggggtgtcagggtcacaagg

SEQ ID NO: 457472 - DNA, 20 bp, mouse
gcgcgcgccgcgggactcaa

SEQ ID NO: 457473 - DNA, 20 bp, mouse
gctcacactgatcggttcca

SEQ ID NO: 457474 - DNA, 20 bp, mouse
gaacactcgctctacagccg

SEQ ID NO: 457475 - DNA, 20 bp, mouse
gtgtagagcgagtgttgcca

SEQ ID NO: 457476 - DNA, 20 bp, mouse
ggcccatgtccagggttagt

SEQ ID NO: 457477 - DNA, 20 bp, mouse
gacccactaaccctggacat

SEQ ID NO: 457478 - DNA, 20 bp, mouse
ggtgatggagcccatgtcca

SEQ ID NO: 457479 - DNA, 20 bp, mouse
gacgcctgccacctctccat

SEQ ID NO: 457480 - DNA, 20 bp, mouse
ggctggtgcctatggagagg

SEQ ID NO: 457481 - DNA, 20 bp, mouse
ggctgcagctctgcgtcacc

SEQ ID NO: 457482 - DNA, 20 bp, mouse
gcgcaaggattatagaacat

SEQ ID NO: 457483 - DNA, 20 bp, mouse
gggctccatcacatacaata

SEQ ID NO: 457484 - DNA, 20 bp, mouse
gtgtgtctcccacctccctt

SEQ ID NO: 457485 - DNA, 20 bp, mouse
gcatcagacagtgaccagcc

SEQ ID NO: 457486 - DNA, 20 bp, mouse
gcactctggaacaaagctac

SEQ ID NO: 457487 - DNA, 20 bp, mouse
gcacaggtcctgctgcagac

SEQ ID NO: 457488 - DNA, 20 bp, mouse
gaggatgggaaaggtagtaa

SEQ ID NO: 457489 - DNA, 20 bp, mouse
gcaagtggttataaaaggat

SEQ ID NO: 457490 - DNA, 20 bp, mouse
gtagactgctctggattcct

SEQ ID NO: 457491 - DNA, 20 bp, mouse
gtccagagcagtctagtcac

SEQ ID NO: 457492 - DNA, 20 bp, mouse
gccatggttgctgcaagggt

SEQ ID NO: 457493 - DNA, 20 bp, mouse
gctgctctggattcctaggt

SEQ ID NO: 457494 - DNA, 20 bp, mouse
gtagctcgcaccgtatacac

SEQ ID NO: 457495 - DNA, 20 bp, mouse
ggcagcaggacctgtgtata

SEQ ID NO: 457496 - DNA, 20 bp, mouse
ggaggcgtgcccaaggtctc

SEQ ID NO: 457497 - DNA, 20 bp, mouse
gaggagaagaggcgtgccca

SEQ ID NO: 457498 - DNA, 20 bp, mouse
gtcaattacaaaggcgtcgc

SEQ ID NO: 457499 - DNA, 20 bp, mouse
gcagagattgtcaattacaa

SEQ ID NO: 457500 - DNA, 20 bp, mouse
gggctctccggactcttgat

SEQ ID NO: 457501 - DNA, 20 bp, mouse
ggggctggctggaggctctc

SEQ ID NO: 457502 - DNA, 20 bp, mouse
ggctgaccccatcaagagtc

SEQ ID NO: 457503 - DNA, 20 bp, mouse
gcggaagtgcgtaggagaag

SEQ ID NO: 457504 - DNA, 20 bp, mouse
gagtcgcttggtggccgggc

SEQ ID NO: 457505 - DNA, 20 bp, mouse
gcagaccggctcctacatgt

SEQ ID NO: 457506 - DNA, 20 bp, mouse
gcttgtgctaggatgattgt

SEQ ID NO: 457507 - DNA, 20 bp, mouse
ggtcaattacaaggcgtcgc

SEQ ID NO: 457508 - DNA, 20 bp, mouse
gaagaggagggacttgtgct

SEQ ID NO: 457509 - DNA, 20 bp, mouse
gggctctccggactcttgat

SEQ ID NO: 457510 - DNA, 20 bp, mouse
ggggctggctggaggctctc

SEQ ID NO: 457511 - DNA, 20 bp, mouse
ggctgaccccatcaagagtc

SEQ ID NO: 457512 - DNA, 20 bp, mouse
gcggaagtgcgtgggagaag

SEQ ID NO: 457513 - DNA, 20 bp, mouse
gggcgtcgccggaagtgcgt

SEQ ID NO: 457514 - DNA, 20 bp, mouse
gacagagattgtcaattaca

SEQ ID NO: 457515 - DNA, 20 bp, mouse
ggcagcgtcatggaaggcca

SEQ ID NO: 457516 - DNA, 20 bp, mouse
ggaggcgtgcccaaggtctc

SEQ ID NO: 457517 - DNA, 20 bp, mouse
gaggagaagaggcgtgccca

SEQ ID NO: 457518 - DNA, 20 bp, mouse
gtcaattacaaaggcgtcgc

SEQ ID NO: 457519 - DNA, 20 bp, mouse
gcagagattgtcaattacaa

SEQ ID NO: 457520 - DNA, 20 bp, mouse
gggctctccggactcttgat

SEQ ID NO: 457521 - DNA, 20 bp, mouse
ggggctggctggaggctctc

SEQ ID NO: 457522 - DNA, 20 bp, mouse
ggctgaccccatcaagagtc

SEQ ID NO: 457523 - DNA, 20 bp, mouse
gcggaagtgcgtaggagaag

SEQ ID NO: 457524 - DNA, 20 bp, mouse
gagtcgcttggtggccgggc

SEQ ID NO: 457525 - DNA, 20 bp, mouse
gcagaccggctcctacatgt

SEQ ID NO: 457526 - DNA, 20 bp, mouse
gcttgtgctaggatgattgt

SEQ ID NO: 457527 - DNA, 20 bp, mouse
ggtcaattacaaggcgtcgc

SEQ ID NO: 457528 - DNA, 20 bp, mouse
gaagaggagggacttgtgct

SEQ ID NO: 457529 - DNA, 20 bp, mouse
gggctctccggactcttgat

SEQ ID NO: 457530 - DNA, 20 bp, mouse
ggggctggctggaggctctc

SEQ ID NO: 457531 - DNA, 20 bp, mouse
ggctgaccccatcaagagtc

SEQ ID NO: 457532 - DNA, 20 bp, mouse
gcggaagtgcgtgggagaag

SEQ ID NO: 457533 - DNA, 20 bp, mouse
gggcgtcgccggaagtgcgt

SEQ ID NO: 457534 - DNA, 20 bp, mouse
gacagagattgtcaattaca

SEQ ID NO: 457535 - DNA, 20 bp, mouse
ggcagcgtcatggaaggcca

SEQ ID NO: 457536 - DNA, 20 bp, mouse
ggaagagcgcccccccgacc

SEQ ID NO: 457537 - DNA, 20 bp, mouse
ggatctctgcctggtcgggg

SEQ ID NO: 457538 - DNA, 20 bp, mouse
gcgggggggcgctcttctaa

SEQ ID NO: 457539 - DNA, 20 bp, mouse
gcctggcccgagctgcgtaa

SEQ ID NO: 457540 - DNA, 20 bp, mouse
gttaatccggcggtccatgg

SEQ ID NO: 457541 - DNA, 20 bp, mouse
gcgagctgcgtaaaggccgt

SEQ ID NO: 457542 - DNA, 20 bp, mouse
gtgcttggcttgtcaataag

SEQ ID NO: 457543 - DNA, 20 bp, mouse
gatgaaggaggagttcgggt

SEQ ID NO: 457544 - DNA, 20 bp, mouse
gagctcgggccaggccatga

SEQ ID NO: 457545 - DNA, 20 bp, mouse
gtagctgaaagtgcagagga

SEQ ID NO: 457546 - DNA, 20 bp, mouse
ggactcgatggtcaagatgg

SEQ ID NO: 457547 - DNA, 20 bp, mouse
gggcgacagagagaccttcg

SEQ ID NO: 457548 - DNA, 20 bp, mouse
ggaccttcgcggctctaggt

SEQ ID NO: 457549 - DNA, 20 bp, mouse
gcccggcgcgacggctttag

SEQ ID NO: 457550 - DNA, 20 bp, mouse
gctcccacctagagccgcga

SEQ ID NO: 457551 - DNA, 20 bp, mouse
gctcggaggacctgaactgt

SEQ ID NO: 457552 - DNA, 20 bp, mouse
gcatcgagtccgtaagacag

SEQ ID NO: 457553 - DNA, 20 bp, mouse
ggctttagcggcaaacaaat

SEQ ID NO: 457554 - DNA, 20 bp, mouse
gcgctctgtgagcggagata

SEQ ID NO: 457555 - DNA, 20 bp, mouse
ggggtcggatcggggttcag

SEQ ID NO: 457556 - DNA, 20 bp, mouse
ggccgagtgtgagcgtgtgt

SEQ ID NO: 457557 - DNA, 20 bp, mouse
gcagcgactggagacggacc

SEQ ID NO: 457558 - DNA, 20 bp, mouse
gagcgcggggctgttgtcgg

SEQ ID NO: 457559 - DNA, 20 bp, mouse
gggaccgggagcaacgcgcc

SEQ ID NO: 457560 - DNA, 20 bp, mouse
gagcgtgtgtgggagagcgc

SEQ ID NO: 457561 - DNA, 20 bp, mouse
gcgcacacagcgactggaga

SEQ ID NO: 457562 - DNA, 20 bp, mouse
gcaaactgttgggaatgggg

SEQ ID NO: 457563 - DNA, 20 bp, mouse
gagtcgctgtgtgcgaggga

SEQ ID NO: 457564 - DNA, 20 bp, mouse
ggtgatgtgcaactaattaa

SEQ ID NO: 457565 - DNA, 20 bp, mouse
gcttcccggcgcgttgctcc

SEQ ID NO: 457566 - DNA, 20 bp, mouse
gagctgggatgtagaggcgg

SEQ ID NO: 457567 - DNA, 20 bp, mouse
gacgcggggctgggctgtcg

SEQ ID NO: 457568 - DNA, 20 bp, mouse
gaccgcggcggtgcccagag

SEQ ID NO: 457569 - DNA, 20 bp, mouse
gaggcgcaggctgggacgcg

SEQ ID NO: 457570 - DNA, 20 bp, mouse
gaggagggcccgacacctac

SEQ ID NO: 457571 - DNA, 20 bp, mouse
gggctgggctgtcggggatg

SEQ ID NO: 457572 - DNA, 20 bp, mouse
gggatgaggctctcctcttc

SEQ ID NO: 457573 - DNA, 20 bp, mouse
ggcgcggcgggcgaaggact

SEQ ID NO: 457574 - DNA, 20 bp, mouse
gggcctcgcggcgaccgtgg

SEQ ID NO: 457575 - DNA, 20 bp, mouse
ggcgcggcgggcgactggag

SEQ ID NO: 457576 - DNA, 20 bp, mouse
gggcatgcccatgggaggta

SEQ ID NO: 457577 - DNA, 20 bp, mouse
gctcggaacagtgagtctac

SEQ ID NO: 457578 - DNA, 20 bp, mouse
gatggccgggcagtcagaca

SEQ ID NO: 457579 - DNA, 20 bp, mouse
gcggtcccaggtcacaccgg

SEQ ID NO: 457580 - DNA, 20 bp, mouse
gtcactgttccgagatggcc

SEQ ID NO: 457581 - DNA, 20 bp, mouse
gctccaatgggacacaggaa

SEQ ID NO: 457582 - DNA, 20 bp, mouse
gtgcttctgaatctcttcca

SEQ ID NO: 457583 - DNA, 20 bp, mouse
gtcccggctgtggatacccc

SEQ ID NO: 457584 - DNA, 20 bp, mouse
gcctgcaacacagccgtgca

SEQ ID NO: 457585 - DNA, 20 bp, mouse
ggatgtgaagtactacaccc

SEQ ID NO: 457586 - DNA, 20 bp, mouse
gggcggcggcgggacaaggt

SEQ ID NO: 457587 - DNA, 20 bp, mouse
ggacagtgggagctcagtcg

SEQ ID NO: 457588 - DNA, 20 bp, mouse
ggacaaggtaggcgacgggg

SEQ ID NO: 457589 - DNA, 20 bp, mouse
gggaacctgccgagcgtccg

SEQ ID NO: 457590 - DNA, 20 bp, mouse
gcgggacaaggtaggcgacg

SEQ ID NO: 457591 - DNA, 20 bp, mouse
gcaggcgccggcactcggta

SEQ ID NO: 457592 - DNA, 20 bp, mouse
ggtctgcccgagttagaatg

SEQ ID NO: 457593 - DNA, 20 bp, mouse
gtatcctgcccgaggacggt

SEQ ID NO: 457594 - DNA, 20 bp, mouse
gtccacgagcctcggcgcga

SEQ ID NO: 457595 - DNA, 20 bp, mouse
ggcagtccccattctaactc

SEQ ID NO: 457596 - DNA, 20 bp, mouse
gtcaagaggagcctagggag

SEQ ID NO: 457597 - DNA, 20 bp, mouse
ggcgagagctgccactccct

SEQ ID NO: 457598 - DNA, 20 bp, mouse
ggaggttcaagaggagccta

SEQ ID NO: 457599 - DNA, 20 bp, mouse
gctggaaagtcagttctccg

SEQ ID NO: 457600 - DNA, 20 bp, mouse
gacacagtgggacaccttgg

SEQ ID NO: 457601 - DNA, 20 bp, mouse
gcagttctccgaggttcaag

SEQ ID NO: 457602 - DNA, 20 bp, mouse
ggaagcggcggaaccaccac

SEQ ID NO: 457603 - DNA, 20 bp, mouse
gaccacggcatccgctacag

SEQ ID NO: 457604 - DNA, 20 bp, mouse
ggagcgaagcaaggaagcgg

SEQ ID NO: 457605 - DNA, 20 bp, mouse
gaccacctgcggtatggaag

SEQ ID NO: 457606 - DNA, 20 bp, mouse
gcaaacccggaagaagcctc

SEQ ID NO: 457607 - DNA, 20 bp, mouse
gggcacaatccagctaccag

SEQ ID NO: 457608 - DNA, 20 bp, mouse
ggcctccgcgatagcaaacc

SEQ ID NO: 457609 - DNA, 20 bp, mouse
gtggggcggggccaaagaag

SEQ ID NO: 457610 - DNA, 20 bp, mouse
gggaaccagacctacctcca

SEQ ID NO: 457611 - DNA, 20 bp, mouse
gccggaagtccagggagggt

SEQ ID NO: 457612 - DNA, 20 bp, mouse
gatagcagtgccaggccggc

SEQ ID NO: 457613 - DNA, 20 bp, mouse
ggcggcggcggctacaggag

SEQ ID NO: 457614 - DNA, 20 bp, mouse
gggttcccggaagtccaggg

SEQ ID NO: 457615 - DNA, 20 bp, mouse
gtgagtgtgcgaggcgaggt

SEQ ID NO: 457616 - DNA, 20 bp, mouse
gaagctactccgtaacggag

SEQ ID NO: 457617 - DNA, 20 bp, mouse
gaagtgaagctactccgtaa

SEQ ID NO: 457618 - DNA, 20 bp, mouse
gccgcgccaccgctccgtta

SEQ ID NO: 457619 - DNA, 20 bp, mouse
gctactccgtaacggagcgg

SEQ ID NO: 457620 - DNA, 20 bp, mouse
ggtcccaggaagtctcgggt

SEQ ID NO: 457621 - DNA, 20 bp, mouse
gggaaggcgtggagcactac

SEQ ID NO: 457622 - DNA, 20 bp, mouse
gacgtcatcgttagccggaa

SEQ ID NO: 457623 - DNA, 20 bp, mouse
gtgaggagggcaaaattcta

SEQ ID NO: 457624 - DNA, 20 bp, mouse
gacaggtagactgctaagtt

SEQ ID NO: 457625 - DNA, 20 bp, mouse
gacgatcgcaccttccaagt

SEQ ID NO: 457626 - DNA, 20 bp, mouse
ggcggtggaagcccagatag

SEQ ID NO: 457627 - DNA, 20 bp, mouse
ggtggaagcccagatagcgg

SEQ ID NO: 457628 - DNA, 20 bp, mouse
gaagtcaaggaagttagcgg

SEQ ID NO: 457629 - DNA, 20 bp, mouse
gagcgcgggccggcaagtca

SEQ ID NO: 457630 - DNA, 20 bp, mouse
ggccctctccgccgctatct

SEQ ID NO: 457631 - DNA, 20 bp, mouse
gccactgccgctggcctccg

SEQ ID NO: 457632 - DNA, 20 bp, mouse
ggatcccatggcgaccccgg

SEQ ID NO: 457633 - DNA, 20 bp, mouse
ggcagtggcgagaaggtcga

SEQ ID NO: 457634 - DNA, 20 bp, mouse
gggaaccgtgaccctcggag

SEQ ID NO: 457635 - DNA, 20 bp, mouse
gaggaggacccagcgcgggc

SEQ ID NO: 457636 - DNA, 20 bp, mouse
gctgtggccggtggccggaa

SEQ ID NO: 457637 - DNA, 20 bp, mouse
gtcaatggccggccacccaa

SEQ ID NO: 457638 - DNA, 20 bp, mouse
gagggacacacggtagggaa

SEQ ID NO: 457639 - DNA, 20 bp, mouse
gaggtaagggacacacggta

SEQ ID NO: 457640 - DNA, 20 bp, mouse
gagttagttatacgtaagta

SEQ ID NO: 457641 - DNA, 20 bp, mouse
ggttatacgtaagtagggcg

SEQ ID NO: 457642 - DNA, 20 bp, mouse
ggtagcccagtaggcatgta

SEQ ID NO: 457643 - DNA, 20 bp, mouse
gtaggctcgaagccggaatc

SEQ ID NO: 457644 - DNA, 20 bp, mouse
gaggtccctacatgcctact

SEQ ID NO: 457645 - DNA, 20 bp, mouse
ggctggttctggcccttggg

SEQ ID NO: 457646 - DNA, 20 bp, mouse
gttagtggtggcttaagagg

SEQ ID NO: 457647 - DNA, 20 bp, mouse
gcacaccagacacgcttcgg

SEQ ID NO: 457648 - DNA, 20 bp, mouse
ggtcttagtggtggcttaag

SEQ ID NO: 457649 - DNA, 20 bp, mouse
ggtctctgctgtcttagtgg

SEQ ID NO: 457650 - DNA, 20 bp, mouse
gcaacacaccagacacgctt

SEQ ID NO: 457651 - DNA, 20 bp, mouse
gggcgtctctgctgtcttag

SEQ ID NO: 457652 - DNA, 20 bp, mouse
ggctacctccgaagcgtgtc

SEQ ID NO: 457653 - DNA, 20 bp, mouse
gagcctggggcgcactatag

SEQ ID NO: 457654 - DNA, 20 bp, mouse
ggagacgccggccgtgacgt

SEQ ID NO: 457655 - DNA, 20 bp, mouse
ggccgagcagtgccaagtac

SEQ ID NO: 457656 - DNA, 20 bp, mouse
gcacagaacgagggtcttac

SEQ ID NO: 457657 - DNA, 20 bp, mouse
gcggagcgggacgcacctct

SEQ ID NO: 457658 - DNA, 20 bp, mouse
ggacgcacctctaggtcatg

SEQ ID NO: 457659 - DNA, 20 bp, mouse
gctggatccccatgacctag

SEQ ID NO: 457660 - DNA, 20 bp, mouse
gggcggtgaccccgggctca

SEQ ID NO: 457661 - DNA, 20 bp, mouse
gaggtgcgtcccgctccggt

SEQ ID NO: 457662 - DNA, 20 bp, mouse
gtgcccagaaccagctgagg

SEQ ID NO: 457663 - DNA, 20 bp, mouse
gcgggctctgtggatagagg

SEQ ID NO: 457664 - DNA, 20 bp, mouse
gtctttccgccccaccggag

SEQ ID NO: 457665 - DNA, 20 bp, mouse
ggaacgagggtcttaccggc

SEQ ID NO: 457666 - DNA, 20 bp, mouse
gttcatctcgaggataagtc

SEQ ID NO: 457667 - DNA, 20 bp, mouse
gtcatcatccccaccatcaa

SEQ ID NO: 457668 - DNA, 20 bp, mouse
gaagtcaggcatctcgctcc

SEQ ID NO: 457669 - DNA, 20 bp, mouse
ggttctgccgggaaagcgcg

SEQ ID NO: 457670 - DNA, 20 bp, mouse
ggaacaaactggcctagtga

SEQ ID NO: 457671 - DNA, 20 bp, mouse
ggtgtggcaagtctctagag

SEQ ID NO: 457672 - DNA, 20 bp, mouse
gtggccgaggcaggattcac

SEQ ID NO: 457673 - DNA, 20 bp, mouse
gtttcccggcagaactcacc

SEQ ID NO: 457674 - DNA, 20 bp, mouse
ggctccaggtgagttctgcc

SEQ ID NO: 457675 - DNA, 20 bp, mouse
gaaaggcactgttcatctcg

SEQ ID NO: 457676 - DNA, 20 bp, mouse
gcatggtggcgaagaagaga

SEQ ID NO: 457677 - DNA, 20 bp, mouse
gggtggcgaagaagagacgg

SEQ ID NO: 457678 - DNA, 20 bp, mouse
gggagcggccggctgagtag

SEQ ID NO: 457679 - DNA, 20 bp, mouse
ggagacggtggcctcacgca

SEQ ID NO: 457680 - DNA, 20 bp, mouse
gctagccagggcgtgagtca

SEQ ID NO: 457681 - DNA, 20 bp, mouse
ggaccgaggcgggttgttgg

SEQ ID NO: 457682 - DNA, 20 bp, mouse
gcgaggtgttgagaccgagg

SEQ ID NO: 457683 - DNA, 20 bp, mouse
ggggtgtagaaccgtgcgtg

SEQ ID NO: 457684 - DNA, 20 bp, mouse
ggtggcgcggccactagcca

SEQ ID NO: 457685 - DNA, 20 bp, mouse
ggtgtgcgcgaatgagaata

SEQ ID NO: 457686 - DNA, 20 bp, mouse
ggccaaggagcccgcacgga

SEQ ID NO: 457687 - DNA, 20 bp, mouse
gccctggcgaccccggaagt

SEQ ID NO: 457688 - DNA, 20 bp, mouse
gaaggagcccgcacggacgg

SEQ ID NO: 457689 - DNA, 20 bp, mouse
gccggacaggctgccctggt

SEQ ID NO: 457690 - DNA, 20 bp, mouse
ggagcccgcacggacggtgg

SEQ ID NO: 457691 - DNA, 20 bp, mouse
gccgggccaaggagcccgca

SEQ ID NO: 457692 - DNA, 20 bp, mouse
ggcctgacccctggcgaccc

SEQ ID NO: 457693 - DNA, 20 bp, mouse
gaggggcgcagcaaggtaag

SEQ ID NO: 457694 - DNA, 20 bp, mouse
gcgcccaccaccgtccgtgc

SEQ ID NO: 457695 - DNA, 20 bp, mouse
ggaggtggcactaaatctga

SEQ ID NO: 457696 - DNA, 20 bp, mouse
ggccggcgcggaggagcgta

SEQ ID NO: 457697 - DNA, 20 bp, mouse
gaagaaacttgctggtaggt

SEQ ID NO: 457698 - DNA, 20 bp, mouse
ggtgtgggcaacgctgagaa

SEQ ID NO: 457699 - DNA, 20 bp, mouse
gaggtaggtgagcgcggtgg

SEQ ID NO: 457700 - DNA, 20 bp, mouse
gagcgcggtggtggagctcg

SEQ ID NO: 457701 - DNA, 20 bp, mouse
gcagcaagtttcttcacgtg

SEQ ID NO: 457702 - DNA, 20 bp, mouse
ggctggtaggtaggtgagcg

SEQ ID NO: 457703 - DNA, 20 bp, mouse
gtgaggcgtcggacccgcta

SEQ ID NO: 457704 - DNA, 20 bp, mouse
gaacgctgagaagggcggaa

SEQ ID NO: 457705 - DNA, 20 bp, mouse
gtgctaagtaagcatcgggt

SEQ ID NO: 457706 - DNA, 20 bp, mouse
gtgggctgcagagttggacc

SEQ ID NO: 457707 - DNA, 20 bp, mouse
gtgcgcagggtcctcgtcat

SEQ ID NO: 457708 - DNA, 20 bp, mouse
gcagatcgagtgggccatgt

SEQ ID NO: 457709 - DNA, 20 bp, mouse
ggtcatggggcagatcgagt

SEQ ID NO: 457710 - DNA, 20 bp, mouse
ggccatgtgggccaacgaac

SEQ ID NO: 457711 - DNA, 20 bp, mouse
gtgtgcccggaggccccggt

SEQ ID NO: 457712 - DNA, 20 bp, mouse
gcagtgaggacttgcgaagt

SEQ ID NO: 457713 - DNA, 20 bp, mouse
gtcctcggagagacctaccg

SEQ ID NO: 457714 - DNA, 20 bp, mouse
gcctccgggcacaggacggg

SEQ ID NO: 457715 - DNA, 20 bp, mouse
gcgcgctgggacctcagagg

SEQ ID NO: 457716 - DNA, 20 bp, mouse
gcagttccccatgttagcaa

SEQ ID NO: 457717 - DNA, 20 bp, mouse
ggttagcaaaggttaagtgt

SEQ ID NO: 457718 - DNA, 20 bp, mouse
ggtacttacaatgacaaaga

SEQ ID NO: 457719 - DNA, 20 bp, mouse
gtgctgggattaagaagcct

SEQ ID NO: 457720 - DNA, 20 bp, mouse
gggaatgtgaactagagcaa

SEQ ID NO: 457721 - DNA, 20 bp, mouse
gggattaagaagcctgggat

SEQ ID NO: 457722 - DNA, 20 bp, mouse
gtaagaaatatacttactct

SEQ ID NO: 457723 - DNA, 20 bp, mouse
gacttaacctttgctaacat

SEQ ID NO: 457724 - DNA, 20 bp, mouse
gatctgcttgcaggtagatt

SEQ ID NO: 457725 - DNA, 20 bp, mouse
gtggctaacttcatagtctt

SEQ ID NO: 457726 - DNA, 20 bp, mouse
gaagccccggtagccctcca

SEQ ID NO: 457727 - DNA, 20 bp, mouse
ggcaggctgtcgtggagcat

SEQ ID NO: 457728 - DNA, 20 bp, mouse
gccgccgggccagtaccccg

SEQ ID NO: 457729 - DNA, 20 bp, mouse
ggggctaccggggcttcctg

SEQ ID NO: 457730 - DNA, 20 bp, mouse
ggttctccagcaggctgtcg

SEQ ID NO: 457731 - DNA, 20 bp, mouse
ggagaggggcttggctggaa

SEQ ID NO: 457732 - DNA, 20 bp, mouse
gggtactgggatcctcgagg

SEQ ID NO: 457733 - DNA, 20 bp, mouse
gcatggggtgctgatggcca

SEQ ID NO: 457734 - DNA, 20 bp, mouse
gccggcttcgtcttcatcca

SEQ ID NO: 457735 - DNA, 20 bp, mouse
gcagcgggctcgagtttaac

SEQ ID NO: 457736 - DNA, 20 bp, mouse
gccgcgggcccagtaccgtc

SEQ ID NO: 457737 - DNA, 20 bp, mouse
gacggcggccgcactaaagg

SEQ ID NO: 457738 - DNA, 20 bp, mouse
gcaggggccgacgggaacgg

SEQ ID NO: 457739 - DNA, 20 bp, mouse
gccgcaggggccgacgggaa

SEQ ID NO: 457740 - DNA, 20 bp, mouse
gctaaagggggccgacatgg

SEQ ID NO: 457741 - DNA, 20 bp, mouse
ggcactaaagggggccgaca

SEQ ID NO: 457742 - DNA, 20 bp, mouse
gagctctcgtcggcccgcag

SEQ ID NO: 457743 - DNA, 20 bp, mouse
gccctcagccctgaaggtca

SEQ ID NO: 457744 - DNA, 20 bp, mouse
gggaacggcggccgcactaa

SEQ ID NO: 457745 - DNA, 20 bp, mouse
ggcgcgccgcccagcagacc

SEQ ID NO: 457746 - DNA, 20 bp, mouse
gcgcacgtcgggccgcggac

SEQ ID NO: 457747 - DNA, 20 bp, mouse
gcggacgggcggaacaagtg

SEQ ID NO: 457748 - DNA, 20 bp, mouse
gacgtcgggccgcggacggg

SEQ ID NO: 457749 - DNA, 20 bp, mouse
gatgaggtgcggttacgtca

SEQ ID NO: 457750 - DNA, 20 bp, mouse
gactgtggcacggctggagg

SEQ ID NO: 457751 - DNA, 20 bp, mouse
gtacgtcacggcgcagcaga

SEQ ID NO: 457752 - DNA, 20 bp, mouse
gtctcacgttgagatcccag

SEQ ID NO: 457753 - DNA, 20 bp, mouse
gagacggcgctaccgcacgt

SEQ ID NO: 457754 - DNA, 20 bp, mouse
ggcacggctggaggcggcgt

SEQ ID NO: 457755 - DNA, 20 bp, mouse
ggctaccgcacgtcgggccg

SEQ ID NO: 457756 - DNA, 20 bp, mouse
ggcagggaggccaagatgta

SEQ ID NO: 457757 - DNA, 20 bp, mouse
ggcctttaagaggagtcctt

SEQ ID NO: 457758 - DNA, 20 bp, mouse
gccctgcatcagtggaccaa

SEQ ID NO: 457759 - DNA, 20 bp, mouse
gtgcatcagtggaccaaggg

SEQ ID NO: 457760 - DNA, 20 bp, mouse
gccgtgccctgggccaccct

SEQ ID NO: 457761 - DNA, 20 bp, mouse
ggcccaaggactcctcttaa

SEQ ID NO: 457762 - DNA, 20 bp, mouse
ggcctgggagccctgattgt

SEQ ID NO: 457763 - DNA, 20 bp, mouse
gcttggcctccctgcatcag

SEQ ID NO: 457764 - DNA, 20 bp, mouse
gggcctgggtggaccgagag

SEQ ID NO: 457765 - DNA, 20 bp, mouse
gccgagagaggagcgttcaa

SEQ ID NO: 457766 - DNA, 20 bp, mouse
gcgccctggacaaccgaagg

SEQ ID NO: 457767 - DNA, 20 bp, mouse
ggcccgccctggacaaccga

SEQ ID NO: 457768 - DNA, 20 bp, mouse
gggcgcagaccaggtaaggg

SEQ ID NO: 457769 - DNA, 20 bp, mouse
ggagctgccgtgcagagacc

SEQ ID NO: 457770 - DNA, 20 bp, mouse
gtggggtaggaaagctcccg

SEQ ID NO: 457771 - DNA, 20 bp, mouse
gcgccgccttcggttgtcca

SEQ ID NO: 457772 - DNA, 20 bp, mouse
gcagtggagcaaggaccccg

SEQ ID NO: 457773 - DNA, 20 bp, mouse
gggcaggcggggctacggta

SEQ ID NO: 457774 - DNA, 20 bp, mouse
gtcgccccaccggactacag

SEQ ID NO: 457775 - DNA, 20 bp, mouse
gccaggcgaccgcccttacc

SEQ ID NO: 457776 - DNA, 20 bp, mouse
gtcggtggcaggtccagggg

SEQ ID NO: 457777 - DNA, 20 bp, mouse
gcttggcgcccgaggctaca

SEQ ID NO: 457778 - DNA, 20 bp, mouse
ggggacccgaggctaccgca

SEQ ID NO: 457779 - DNA, 20 bp, mouse
gctccgcgcagcagcctcag

SEQ ID NO: 457780 - DNA, 20 bp, mouse
gtggctcggtggcaggtcca

SEQ ID NO: 457781 - DNA, 20 bp, mouse
gtagcctcgggtccctcccc

SEQ ID NO: 457782 - DNA, 20 bp, mouse
gcggtccgccggcgcagcgg

SEQ ID NO: 457783 - DNA, 20 bp, mouse
gctgcccagggcgcccgggg

SEQ ID NO: 457784 - DNA, 20 bp, mouse
ggccccggcgcggggccctg

SEQ ID NO: 457785 - DNA, 20 bp, mouse
gagaggcagggatagtctcg

SEQ ID NO: 457786 - DNA, 20 bp, mouse
ggagtagagcgccggaggga

SEQ ID NO: 457787 - DNA, 20 bp, mouse
gcgaggagtagagcgccgga

SEQ ID NO: 457788 - DNA, 20 bp, mouse
ggacacacgctccctccctc

SEQ ID NO: 457789 - DNA, 20 bp, mouse
gcgggcgaggagtagagcgc

SEQ ID NO: 457790 - DNA, 20 bp, mouse
gtccgaggcggagaggaagg

SEQ ID NO: 457791 - DNA, 20 bp, mouse
ggccaactgcgaggacgtgg

SEQ ID NO: 457792 - DNA, 20 bp, mouse
ggcgtgcgaggcgggcagga

SEQ ID NO: 457793 - DNA, 20 bp, mouse
gagcgaggagctgtccgagg

SEQ ID NO: 457794 - DNA, 20 bp, mouse
gaggccggtgcgtgcgaggc

SEQ ID NO: 457795 - DNA, 20 bp, mouse
gaggagcgaggagctgtccg

SEQ ID NO: 457796 - DNA, 20 bp, mouse
gccgccccggccaccaaccc

SEQ ID NO: 457797 - DNA, 20 bp, mouse
gactgaggcagctgcacggt

SEQ ID NO: 457798 - DNA, 20 bp, mouse
gtccgcagcgaaaacaaaga

SEQ ID NO: 457799 - DNA, 20 bp, mouse
gcgtcggcccgcagccgccc

SEQ ID NO: 457800 - DNA, 20 bp, mouse
ggcccactgaggcagctgca

SEQ ID NO: 457801 - DNA, 20 bp, mouse
gcggctgcgggccgacgggc

SEQ ID NO: 457802 - DNA, 20 bp, mouse
gtcctcggcgccggacatca

SEQ ID NO: 457803 - DNA, 20 bp, mouse
gatggcggccgcgccggggt

SEQ ID NO: 457804 - DNA, 20 bp, mouse
gccacccccgccggcctcct

SEQ ID NO: 457805 - DNA, 20 bp, mouse
ggctcggcagctgcaagagg

SEQ ID NO: 457806 - DNA, 20 bp, mouse
gtgaagtcctggcagaagac

SEQ ID NO: 457807 - DNA, 20 bp, mouse
gatggaaagagtgtctgtgt

SEQ ID NO: 457808 - DNA, 20 bp, mouse
gtttaaaaggaaagtactta

SEQ ID NO: 457809 - DNA, 20 bp, mouse
ggaaagtacttaaggcctga

SEQ ID NO: 457810 - DNA, 20 bp, mouse
gcttttaaatatagccaatt

SEQ ID NO: 457811 - DNA, 20 bp, mouse
gattccctgggcatttttat

SEQ ID NO: 457812 - DNA, 20 bp, mouse
gttttcaaaagaagccgaat

SEQ ID NO: 457813 - DNA, 20 bp, mouse
gacaatgtttgtgtttaaac

SEQ ID NO: 457814 - DNA, 20 bp, mouse
ggtaaagtactgttattccc

SEQ ID NO: 457815 - DNA, 20 bp, mouse
gtttcctactcatacatttt

SEQ ID NO: 457816 - DNA, 20 bp, mouse
ggccctggcacgtcacaggt

SEQ ID NO: 457817 - DNA, 20 bp, mouse
gttaggccctggcacgtcac

SEQ ID NO: 457818 - DNA, 20 bp, mouse
gtcccacctgtgacgtgcca

SEQ ID NO: 457819 - DNA, 20 bp, mouse
gacaaaaagacttacaatct

SEQ ID NO: 457820 - DNA, 20 bp, mouse
gggaagagagcttcattctt

SEQ ID NO: 457821 - DNA, 20 bp, mouse
ggtaacttctcaattaactg

SEQ ID NO: 457822 - DNA, 20 bp, mouse
gtttgtacgtggcccagcga

SEQ ID NO: 457823 - DNA, 20 bp, mouse
gtagcaaaatatggagattt

SEQ ID NO: 457824 - DNA, 20 bp, mouse
gtttaggccaaccataagca

SEQ ID NO: 457825 - DNA, 20 bp, mouse
ggccatgagtcaagttttta

SEQ ID NO: 457826 - DNA, 20 bp, mouse
ggcgcctgaggtaaatactg

SEQ ID NO: 457827 - DNA, 20 bp, mouse
gaggtaaatactggggtggt

SEQ ID NO: 457828 - DNA, 20 bp, mouse
gaggctggaggtgacaaccg

SEQ ID NO: 457829 - DNA, 20 bp, mouse
gacgctggttctgaagcccg

SEQ ID NO: 457830 - DNA, 20 bp, mouse
gagcaggttcggctgcgcgg

SEQ ID NO: 457831 - DNA, 20 bp, mouse
ggcttcagaaccagcgtccc

SEQ ID NO: 457832 - DNA, 20 bp, mouse
gccgcgagtcgggagccctc

SEQ ID NO: 457833 - DNA, 20 bp, mouse
gatactggggtggtgggtgt

SEQ ID NO: 457834 - DNA, 20 bp, mouse
gtcggcccggggcagctaac

SEQ ID NO: 457835 - DNA, 20 bp, mouse
ggcccggggcagctaacggg

SEQ ID NO: 457836 - DNA, 20 bp, mouse
gaccacatggctctgggaga

SEQ ID NO: 457837 - DNA, 20 bp, mouse
gggagatggcgagagcagcg

SEQ ID NO: 457838 - DNA, 20 bp, mouse
gtgaatgttggaccctgggt

SEQ ID NO: 457839 - DNA, 20 bp, mouse
gctataaaggccgagaggat

SEQ ID NO: 457840 - DNA, 20 bp, mouse
gtgagtgtgaccccgaggag

SEQ ID NO: 457841 - DNA, 20 bp, mouse
gggatgggtactagctagag

SEQ ID NO: 457842 - DNA, 20 bp, mouse
gccagggtccaacattcacc

SEQ ID NO: 457843 - DNA, 20 bp, mouse
ggtggtcaccaggtgaatgt

SEQ ID NO: 457844 - DNA, 20 bp, mouse
ggcgcctcattctggatcac

SEQ ID NO: 457845 - DNA, 20 bp, mouse
gcattctggatcacaggaaa

SEQ ID NO: 457846 - DNA, 20 bp, mouse
gcgtagggctcaggaaaggt

SEQ ID NO: 457847 - DNA, 20 bp, mouse
gacactcgtgcagcaggaag

SEQ ID NO: 457848 - DNA, 20 bp, mouse
gagcaggaagtggcagtcgt

SEQ ID NO: 457849 - DNA, 20 bp, mouse
gagtcgtggggacagtatgc

SEQ ID NO: 457850 - DNA, 20 bp, mouse
gcactggaccctgccacgta

SEQ ID NO: 457851 - DNA, 20 bp, mouse
gtgcgctcagtgctggtcaa

SEQ ID NO: 457852 - DNA, 20 bp, mouse
gaccacttctggagggagag

SEQ ID NO: 457853 - DNA, 20 bp, mouse
ggggacagtatgctggctaa

SEQ ID NO: 457854 - DNA, 20 bp, mouse
ggccactctccctccagaag

SEQ ID NO: 457855 - DNA, 20 bp, mouse
ggacctaggactgctagtag

SEQ ID NO: 457856 - DNA, 20 bp, mouse
gaaggccacggactaaacac

SEQ ID NO: 457857 - DNA, 20 bp, mouse
gtcttcctgtgtttagtccg

SEQ ID NO: 457858 - DNA, 20 bp, mouse
ggaagagaggaagatgacaa

SEQ ID NO: 457859 - DNA, 20 bp, mouse
gaaaacaagataaaaggcca

SEQ ID NO: 457860 - DNA, 20 bp, mouse
gctgagaggatagtgtgtgt

SEQ ID NO: 457861 - DNA, 20 bp, mouse
gtgtgtggctggcaagaccc

SEQ ID NO: 457862 - DNA, 20 bp, mouse
gcagggtgacaacagatgtg

SEQ ID NO: 457863 - DNA, 20 bp, mouse
gaagatgacaatggctctca

SEQ ID NO: 457864 - DNA, 20 bp, mouse
gaccctggcagtgcctgcac

SEQ ID NO: 457865 - DNA, 20 bp, mouse
gacaagggcactgggcacca

SEQ ID NO: 457866 - DNA, 20 bp, mouse
gaaggctgtgaactgaagac

SEQ ID NO: 457867 - DNA, 20 bp, mouse
ggactcatgggttctccaca

SEQ ID NO: 457868 - DNA, 20 bp, mouse
ggaagacaggaggatggcaa

SEQ ID NO: 457869 - DNA, 20 bp, mouse
ggctgtgaactgaagacagg

SEQ ID NO: 457870 - DNA, 20 bp, mouse
ggttgaagtggaggggagtc

SEQ ID NO: 457871 - DNA, 20 bp, mouse
ggaggatggcaatggctctc

SEQ ID NO: 457872 - DNA, 20 bp, mouse
ggctgagaggatagagtgtg

SEQ ID NO: 457873 - DNA, 20 bp, mouse
ggtgcctttctctgaccatg

SEQ ID NO: 457874 - DNA, 20 bp, mouse
gtgtgtggctggcaagaccc

SEQ ID NO: 457875 - DNA, 20 bp, mouse
gcagggtgacagcagatgtg

SEQ ID NO: 457876 - DNA, 20 bp, mouse
gccacatggcagccaggtgt

SEQ ID NO: 457877 - DNA, 20 bp, mouse
gcagatggccagctgtggag

SEQ ID NO: 457878 - DNA, 20 bp, mouse
gctgccatgtgggaacttgt

SEQ ID NO: 457879 - DNA, 20 bp, mouse
gagacccacaagttcccaca

SEQ ID NO: 457880 - DNA, 20 bp, mouse
gccaggcgaagagaatagat

SEQ ID NO: 457881 - DNA, 20 bp, mouse
gacggtagactacccaccag

SEQ ID NO: 457882 - DNA, 20 bp, mouse
gtcctgcagcttgaagaagt

SEQ ID NO: 457883 - DNA, 20 bp, mouse
gccagggaccgaggaagagg

SEQ ID NO: 457884 - DNA, 20 bp, mouse
gaagttcccacatggcagcc

SEQ ID NO: 457885 - DNA, 20 bp, mouse
gaccccagggaccgaggaag

SEQ ID NO: 457886 - DNA, 20 bp, mouse
ggagttagaacgtaacccag

SEQ ID NO: 457887 - DNA, 20 bp, mouse
gttctatgggaagaaagcag

SEQ ID NO: 457888 - DNA, 20 bp, mouse
gggcccatgatcagcaggag

SEQ ID NO: 457889 - DNA, 20 bp, mouse
gtggctcctgtcacttggaa

SEQ ID NO: 457890 - DNA, 20 bp, mouse
gagaacgtaacccagcggtt

SEQ ID NO: 457891 - DNA, 20 bp, mouse
ggagccacagccaaaccgct

SEQ ID NO: 457892 - DNA, 20 bp, mouse
gaaaaaaagtaaagttctat

SEQ ID NO: 457893 - DNA, 20 bp, mouse
gggtgctggattggagagat

SEQ ID NO: 457894 - DNA, 20 bp, mouse
gcagcacccttccaagtgac

SEQ ID NO: 457895 - DNA, 20 bp, mouse
gtgatgtggtcatctgtcgt

SEQ ID NO: 457896 - DNA, 20 bp, mouse
ggcttccccgatcctcccta

SEQ ID NO: 457897 - DNA, 20 bp, mouse
gaggaccctagggaggatcg

SEQ ID NO: 457898 - DNA, 20 bp, mouse
ggttctctaggaccctaggg

SEQ ID NO: 457899 - DNA, 20 bp, mouse
gccaaggtgagtgcttgggg

SEQ ID NO: 457900 - DNA, 20 bp, mouse
gtcctcaggactgccagtgg

SEQ ID NO: 457901 - DNA, 20 bp, mouse
gctcaccttgggctgtaagg

SEQ ID NO: 457902 - DNA, 20 bp, mouse
gttcaccctaaccctgaagg

SEQ ID NO: 457903 - DNA, 20 bp, mouse
ggccttcaccctaaccctga

SEQ ID NO: 457904 - DNA, 20 bp, mouse
ggcactcaccttgggctgta

SEQ ID NO: 457905 - DNA, 20 bp, mouse
gccctgaaggtggtagttct

SEQ ID NO: 457906 - DNA, 20 bp, mouse
gtggagactggcagagttgt

SEQ ID NO: 457907 - DNA, 20 bp, mouse
gcagacgtacctgaagggca

SEQ ID NO: 457908 - DNA, 20 bp, mouse
ggacacacagacgtacctga

SEQ ID NO: 457909 - DNA, 20 bp, mouse
gagcagcaggtctcatgatc

SEQ ID NO: 457910 - DNA, 20 bp, mouse
gcgtcggaacccagaagtcc

SEQ ID NO: 457911 - DNA, 20 bp, mouse
gtctccagcccctgcccttc

SEQ ID NO: 457912 - DNA, 20 bp, mouse
ggaagtgaaggaaatctgag

SEQ ID NO: 457913 - DNA, 20 bp, mouse
gcacacacacggaggtgcaa

SEQ ID NO: 457914 - DNA, 20 bp, mouse
gacagttgcctggagtaaag

SEQ ID NO: 457915 - DNA, 20 bp, mouse
gtgcctggagtaaagaggta

SEQ ID NO: 457916 - DNA, 20 bp, mouse
gtgtctgcaacgcaccccag

SEQ ID NO: 457917 - DNA, 20 bp, mouse
gtttcaagctggcgtcgcag

SEQ ID NO: 457918 - DNA, 20 bp, mouse
gaaaccccggagtagaggga

SEQ ID NO: 457919 - DNA, 20 bp, mouse
gggatggcgcatcgcctctg

SEQ ID NO: 457920 - DNA, 20 bp, mouse
gtgcagttgagaagggtcgg

SEQ ID NO: 457921 - DNA, 20 bp, mouse
gctgggaccccgcaaagtca

SEQ ID NO: 457922 - DNA, 20 bp, mouse
gcttaaaaccccggagtaga

SEQ ID NO: 457923 - DNA, 20 bp, mouse
ggagttaaatcccagcccgc

SEQ ID NO: 457924 - DNA, 20 bp, mouse
gcggtgggtggcagacactg

SEQ ID NO: 457925 - DNA, 20 bp, mouse
ggcgccatccctctactccg

SEQ ID NO: 457926 - DNA, 20 bp, mouse
gagcgccagcaggaacgtca

SEQ ID NO: 457927 - DNA, 20 bp, mouse
gtcggccgtgagctccgtgg

SEQ ID NO: 457928 - DNA, 20 bp, mouse
gtcacggccgaggaccgcgc

SEQ ID NO: 457929 - DNA, 20 bp, mouse
gggcgccaccacggagctca

SEQ ID NO: 457930 - DNA, 20 bp, mouse
gcgggcgagaggaagcatgc

SEQ ID NO: 457931 - DNA, 20 bp, mouse
gaggaacgtcacggcgaaga

SEQ ID NO: 457932 - DNA, 20 bp, mouse
gtggcgcccgcagctgggga

SEQ ID NO: 457933 - DNA, 20 bp, mouse
ggcacggggaacgcacgccg

SEQ ID NO: 457934 - DNA, 20 bp, mouse
gtgcgccgcgaggacctggg

SEQ ID NO: 457935 - DNA, 20 bp, mouse
gcgcccgcccgcgcggtcct

SEQ ID NO: 457936 - DNA, 20 bp, mouse
gtagcaccaccacatctgag

SEQ ID NO: 457937 - DNA, 20 bp, mouse
gtggatcaaggcctcctcaa

SEQ ID NO: 457938 - DNA, 20 bp, mouse
ggaggccttgatccaaaagt

SEQ ID NO: 457939 - DNA, 20 bp, mouse
gcctttcccctcagatgtgg

SEQ ID NO: 457940 - DNA, 20 bp, mouse
gtctaacagaaccattgagg

SEQ ID NO: 457941 - DNA, 20 bp, mouse
ggccttgatccaaaagtggg

SEQ ID NO: 457942 - DNA, 20 bp, mouse
ggccgaccccatatgctaaa

SEQ ID NO: 457943 - DNA, 20 bp, mouse
gcccatatgctaaatggtaa

SEQ ID NO: 457944 - DNA, 20 bp, mouse
gatgctaaatggtaagggtt

SEQ ID NO: 457945 - DNA, 20 bp, mouse
gaccatttagcatatggggt

SEQ ID NO: 457946 - DNA, 20 bp, mouse
gagctcggggaggcacaagg

SEQ ID NO: 457947 - DNA, 20 bp, mouse
gtaagcccgggagctcgggg

SEQ ID NO: 457948 - DNA, 20 bp, mouse
ggtttggcccgagtactctg

SEQ ID NO: 457949 - DNA, 20 bp, mouse
gtaaggtctaaagccacgag

SEQ ID NO: 457950 - DNA, 20 bp, mouse
gtgccctgagctggccacag

SEQ ID NO: 457951 - DNA, 20 bp, mouse
gggggtcaaggagggtcgaa

SEQ ID NO: 457952 - DNA, 20 bp, mouse
gctaaagccacgaggggtca

SEQ ID NO: 457953 - DNA, 20 bp, mouse
gcaaggaggtacatcagacc

SEQ ID NO: 457954 - DNA, 20 bp, mouse
gtgacactcgaggagcagta

SEQ ID NO: 457955 - DNA, 20 bp, mouse
ggaccctccttgacccctcg

SEQ ID NO: 457956 - DNA, 20 bp, mouse
gagcagcgccgggagcccca

SEQ ID NO: 457957 - DNA, 20 bp, mouse
gggaagcccatggtaccggg

SEQ ID NO: 457958 - DNA, 20 bp, mouse
gagcagcagcggcagcacga

SEQ ID NO: 457959 - DNA, 20 bp, mouse
ggaggctgaagcgtgccatg

SEQ ID NO: 457960 - DNA, 20 bp, mouse
gtgtctgaccaaggtaacgt

SEQ ID NO: 457961 - DNA, 20 bp, mouse
gctcgcgagggaggcgacca

SEQ ID NO: 457962 - DNA, 20 bp, mouse
gtccgctgagagggaggtgg

SEQ ID NO: 457963 - DNA, 20 bp, mouse
gacgaaggtgcagagcgcac

SEQ ID NO: 457964 - DNA, 20 bp, mouse
ggcggcggggttcggagcta

SEQ ID NO: 457965 - DNA, 20 bp, mouse
gacgtgggcagtaacctggg

SEQ ID NO: 457966 - DNA, 20 bp, mouse
gggagaagactccccagatg

SEQ ID NO: 457967 - DNA, 20 bp, mouse
gcagccggcgacagagcccc

SEQ ID NO: 457968 - DNA, 20 bp, mouse
gccgagcgcgagtgcggagt

SEQ ID NO: 457969 - DNA, 20 bp, mouse
ggagccgagagactgcgtcc

SEQ ID NO: 457970 - DNA, 20 bp, mouse
gcggcgacagagccccgggc

SEQ ID NO: 457971 - DNA, 20 bp, mouse
ggcggcgggagggaggggta

SEQ ID NO: 457972 - DNA, 20 bp, mouse
gtctacactcgcctcatctg

SEQ ID NO: 457973 - DNA, 20 bp, mouse
ggagtcggcgagccgcagcg

SEQ ID NO: 457974 - DNA, 20 bp, mouse
ggtagaagctggagcggccg

SEQ ID NO: 457975 - DNA, 20 bp, mouse
gttcctgcttaaagctaggg

SEQ ID NO: 457976 - DNA, 20 bp, mouse
ggcggagaagggttaacgga

SEQ ID NO: 457977 - DNA, 20 bp, mouse
ggcgctcctagatagaggct

SEQ ID NO: 457978 - DNA, 20 bp, mouse
ggccagccactgttgctgca

SEQ ID NO: 457979 - DNA, 20 bp, mouse
gctgggagaaacaattcacc

SEQ ID NO: 457980 - DNA, 20 bp, mouse
ggtgggcggagaagggttaa

SEQ ID NO: 457981 - DNA, 20 bp, mouse
ggtgagctaggccactggga

SEQ ID NO: 457982 - DNA, 20 bp, mouse
gagaagggttaacggaggga

SEQ ID NO: 457983 - DNA, 20 bp, mouse
gaacagtggctggcagtgcc

SEQ ID NO: 457984 - DNA, 20 bp, mouse
ggaaggtgggagcattccag

SEQ ID NO: 457985 - DNA, 20 bp, mouse
ggagaatgcagggttgagag

SEQ ID NO: 457986 - DNA, 20 bp, mouse
ggcttctcgggcacgatcca

SEQ ID NO: 457987 - DNA, 20 bp, mouse
gctgcctccttgcctggata

SEQ ID NO: 457988 - DNA, 20 bp, mouse
ggagactatgagccctatcc

SEQ ID NO: 457989 - DNA, 20 bp, mouse
gcaggcacaggagagtacgg

SEQ ID NO: 457990 - DNA, 20 bp, mouse
gtggctcgagcctcagacag

SEQ ID NO: 457991 - DNA, 20 bp, mouse
gtctaaactcttggcttctc

SEQ ID NO: 457992 - DNA, 20 bp, mouse
ggagccgcacgaggctgaga

SEQ ID NO: 457993 - DNA, 20 bp, mouse
ggtacggagggtccaggaac

SEQ ID NO: 457994 - DNA, 20 bp, mouse
gcccagtgcccagacccagg

SEQ ID NO: 457995 - DNA, 20 bp, mouse
gccgcgcctgcggagtccgg

SEQ ID NO: 457996 - DNA, 20 bp, mouse
gccctgctcagtcctaccaa

SEQ ID NO: 457997 - DNA, 20 bp, mouse
gattcggtgaaaaactctgg

SEQ ID NO: 457998 - DNA, 20 bp, mouse
gtggattcggtgaaaaactc

SEQ ID NO: 457999 - DNA, 20 bp, mouse
ggcaagtgcagaagatgctc

SEQ ID NO: 458000 - DNA, 20 bp, mouse
ggaggcgagcttgactgcct

SEQ ID NO: 458001 - DNA, 20 bp, mouse
ggcatgaactgcaggtaagg

SEQ ID NO: 458002 - DNA, 20 bp, mouse
gtgaactcttctgcaaaggg

SEQ ID NO: 458003 - DNA, 20 bp, mouse
gggacaagcgtgctgaagga

SEQ ID NO: 458004 - DNA, 20 bp, mouse
gggctccagaggcagtgagt

SEQ ID NO: 458005 - DNA, 20 bp, mouse
gggaccacggtgaagaacac

SEQ ID NO: 458006 - DNA, 20 bp, mouse
gtcagtctgtcaatcctcat

SEQ ID NO: 458007 - DNA, 20 bp, mouse
gctgctcctcctagccattc

SEQ ID NO: 458008 - DNA, 20 bp, mouse
ggaaggccagaatggctagg

SEQ ID NO: 458009 - DNA, 20 bp, mouse
gcaggaaggccagaatggct

SEQ ID NO: 458010 - DNA, 20 bp, mouse
gtaatctgacttctgtgtac

SEQ ID NO: 458011 - DNA, 20 bp, mouse
gacactcaggaaggccagaa

SEQ ID NO: 458012 - DNA, 20 bp, mouse
gagccctgagcccagcatgg

SEQ ID NO: 458013 - DNA, 20 bp, mouse
gcctcattggccaccatgct

SEQ ID NO: 458014 - DNA, 20 bp, mouse
gattgacagactgatagcca

SEQ ID NO: 458015 - DNA, 20 bp, mouse
gtccatcacacaggtatcat

SEQ ID NO: 458016 - DNA, 20 bp, mouse
ggaaggccagtatggctacg

SEQ ID NO: 458017 - DNA, 20 bp, mouse
gtcctcactggccatcatgc

SEQ ID NO: 458018 - DNA, 20 bp, mouse
gcttaactggaccagtacag

SEQ ID NO: 458019 - DNA, 20 bp, mouse
gcataatctgacctctgtac

SEQ ID NO: 458020 - DNA, 20 bp, mouse
gctgctcctcgtagccatac

SEQ ID NO: 458021 - DNA, 20 bp, mouse
gtcagcctgtcagtcctcac

SEQ ID NO: 458022 - DNA, 20 bp, mouse
gttttcaagcatttctttgt

SEQ ID NO: 458023 - DNA, 20 bp, mouse
gacactcaggaaggccagta

SEQ ID NO: 458024 - DNA, 20 bp, mouse
gatggccagtgaggactgac

SEQ ID NO: 458025 - DNA, 20 bp, mouse
gactgacaggctgatagcca

SEQ ID NO: 458026 - DNA, 20 bp, mouse
gacctgtgggatcacatctt

SEQ ID NO: 458027 - DNA, 20 bp, mouse
ggatgtgatcccacaggtct

SEQ ID NO: 458028 - DNA, 20 bp, mouse
gtcccaagatgtgatcccac

SEQ ID NO: 458029 - DNA, 20 bp, mouse
gcgccacttcctagacctgt

SEQ ID NO: 458030 - DNA, 20 bp, mouse
gccagacagacatcaaaacc

SEQ ID NO: 458031 - DNA, 20 bp, mouse
ggaaggaagttcccaacgaa

SEQ ID NO: 458032 - DNA, 20 bp, mouse
gatcccacaggtctaggaag

SEQ ID NO: 458033 - DNA, 20 bp, mouse
ggagaaatgaatcccagact

SEQ ID NO: 458034 - DNA, 20 bp, mouse
gcaccccactgcccttcgtt

SEQ ID NO: 458035 - DNA, 20 bp, mouse
gatactttgatacctagtct

SEQ ID NO: 458036 - DNA, 20 bp, mouse
ggacctgtggatcacatctt

SEQ ID NO: 458037 - DNA, 20 bp, mouse
ggtcccaagatgtgatccac

SEQ ID NO: 458038 - DNA, 20 bp, mouse
gccagacagacatcaagacc

SEQ ID NO: 458039 - DNA, 20 bp, mouse
gggtcagcatggtggcggtg

SEQ ID NO: 458040 - DNA, 20 bp, mouse
ggaaggaagttcccaatgaa

SEQ ID NO: 458041 - DNA, 20 bp, mouse
gcaccccactgcccttcatt

SEQ ID NO: 458042 - DNA, 20 bp, mouse
gatactttgatacctggtct

SEQ ID NO: 458043 - DNA, 20 bp, mouse
gctaaaatcacacgcccacc

SEQ ID NO: 458044 - DNA, 20 bp, mouse
gcctgtattcaccatctacc

SEQ ID NO: 458045 - DNA, 20 bp, mouse
ggccaccaggaggagtcctg

SEQ ID NO: 458046 - DNA, 20 bp, mouse
gggatagtactagagaacaa

SEQ ID NO: 458047 - DNA, 20 bp, mouse
gaggtacgaaatgctttgtc

SEQ ID NO: 458048 - DNA, 20 bp, mouse
gtttttggagagtttttgtc

SEQ ID NO: 458049 - DNA, 20 bp, mouse
gtaaggttaaaaagtaagaa

SEQ ID NO: 458050 - DNA, 20 bp, mouse
gacataatataagatctcta

SEQ ID NO: 458051 - DNA, 20 bp, mouse
gtttaaattttaagccatag

SEQ ID NO: 458052 - DNA, 20 bp, mouse
ggcctattttgtcctgttct

SEQ ID NO: 458053 - DNA, 20 bp, mouse
gttacagttttgaaaatttg

SEQ ID NO: 458054 - DNA, 20 bp, mouse
gcaaaacaaaacaaagtcag

SEQ ID NO: 458055 - DNA, 20 bp, mouse
gacctagaacaggacaaaat

SEQ ID NO: 458056 - DNA, 20 bp, mouse
gcgtggagtgaagtcaacat

SEQ ID NO: 458057 - DNA, 20 bp, mouse
gttcaggtgagaacaatatg

SEQ ID NO: 458058 - DNA, 20 bp, mouse
ggagcaagagactccttcca

SEQ ID NO: 458059 - DNA, 20 bp, mouse
gagtcaacattggttagacc

SEQ ID NO: 458060 - DNA, 20 bp, mouse
gtcttgttactcttagccag

SEQ ID NO: 458061 - DNA, 20 bp, mouse
gtgggcttcgagaggcgtag

SEQ ID NO: 458062 - DNA, 20 bp, mouse
gcctggtgggaagttgccac

SEQ ID NO: 458063 - DNA, 20 bp, mouse
gcttgtgcttgggcttcgag

SEQ ID NO: 458064 - DNA, 20 bp, mouse
ggaagttgccacgggacttt

SEQ ID NO: 458065 - DNA, 20 bp, mouse
gctcctccttgctctccttg

SEQ ID NO: 458066 - DNA, 20 bp, mouse
gcatgtagaattttattcct

SEQ ID NO: 458067 - DNA, 20 bp, mouse
gcattcatgtaagaactata

SEQ ID NO: 458068 - DNA, 20 bp, mouse
gccaagaggggtagaggacg

SEQ ID NO: 458069 - DNA, 20 bp, mouse
ggtgaaatactgactagtaa

SEQ ID NO: 458070 - DNA, 20 bp, mouse
gagcaggacactaggatcca

SEQ ID NO: 458071 - DNA, 20 bp, mouse
ggctcagaaggacagcaagg

SEQ ID NO: 458072 - DNA, 20 bp, mouse
ggacactaggatccatggtc

SEQ ID NO: 458073 - DNA, 20 bp, mouse
gtaagctcagaaggacagca

SEQ ID NO: 458074 - DNA, 20 bp, mouse
gctcttgttagaccggacca

SEQ ID NO: 458075 - DNA, 20 bp, mouse
gtcctggtggaagatgacca

SEQ ID NO: 458076 - DNA, 20 bp, mouse
ggcctgtggtgagagcgaga

SEQ ID NO: 458077 - DNA, 20 bp, mouse
gtccttctcgctctcaccac

SEQ ID NO: 458078 - DNA, 20 bp, mouse
ggacctccaagagcaaacct

SEQ ID NO: 458079 - DNA, 20 bp, mouse
gcacagggcctgagacctgt

SEQ ID NO: 458080 - DNA, 20 bp, mouse
gagtcagaagtgattagacc

SEQ ID NO: 458081 - DNA, 20 bp, mouse
gatacaggtgagccatccac

SEQ ID NO: 458082 - DNA, 20 bp, mouse
gatgggtctttggctgactt

SEQ ID NO: 458083 - DNA, 20 bp, mouse
gcctggtgggaagtggccat

SEQ ID NO: 458084 - DNA, 20 bp, mouse
gagagcaaggggctccttcc

SEQ ID NO: 458085 - DNA, 20 bp, mouse
gccaggctgtatattcaggt

SEQ ID NO: 458086 - DNA, 20 bp, mouse
ggagtagcaagaagcctgtg

SEQ ID NO: 458087 - DNA, 20 bp, mouse
ggaagcctgtgaggagagca

SEQ ID NO: 458088 - DNA, 20 bp, mouse
gtcctccttgctctcctcac

SEQ ID NO: 458089 - DNA, 20 bp, mouse
gtaggttcaggtgggaaggt

SEQ ID NO: 458090 - DNA, 20 bp, mouse
gtggagtgtgagaggtatag

SEQ ID NO: 458091 - DNA, 20 bp, mouse
gttgattagaggccagccaa

SEQ ID NO: 458092 - DNA, 20 bp, mouse
gttaaggtgagaactatatg

SEQ ID NO: 458093 - DNA, 20 bp, mouse
gcctgtgttggaattgtgtg

SEQ ID NO: 458094 - DNA, 20 bp, mouse
gtcttgctactcttgattag

SEQ ID NO: 458095 - DNA, 20 bp, mouse
ggagcaagaaacaccttcca

SEQ ID NO: 458096 - DNA, 20 bp, mouse
gccaagaggggtagaggatg

SEQ ID NO: 458097 - DNA, 20 bp, mouse
gtcctggtggaagatggcca

SEQ ID NO: 458098 - DNA, 20 bp, mouse
ggtgaaatactgacttgtaa

SEQ ID NO: 458099 - DNA, 20 bp, mouse
gtcctctatccatctgcaac

SEQ ID NO: 458100 - DNA, 20 bp, mouse
ggcagcccaggtaggaacta

SEQ ID NO: 458101 - DNA, 20 bp, mouse
gggtcaccagcagcccaggt

SEQ ID NO: 458102 - DNA, 20 bp, mouse
gagcaggtcaccagcagccc

SEQ ID NO: 458103 - DNA, 20 bp, mouse
gtccttgccaaagtctaggg

SEQ ID NO: 458104 - DNA, 20 bp, mouse
gagcaccatagttcctacct

SEQ ID NO: 458105 - DNA, 20 bp, mouse
gagcaggacactaggatcca

SEQ ID NO: 458106 - DNA, 20 bp, mouse
gtcagtaaggaggttcgcta

SEQ ID NO: 458107 - DNA, 20 bp, mouse
gcacaactgtgtcagtaagg

SEQ ID NO: 458108 - DNA, 20 bp, mouse
gacaggatagagtgagcgct

SEQ ID NO: 458109 - DNA, 20 bp, mouse
gccccactaataacttgata

SEQ ID NO: 458110 - DNA, 20 bp, mouse
gaggaggttcgctatggatc

SEQ ID NO: 458111 - DNA, 20 bp, mouse
ggatcacaactgtgtcagta

SEQ ID NO: 458112 - DNA, 20 bp, mouse
ggcctaaagaatacttacgt

SEQ ID NO: 458113 - DNA, 20 bp, mouse
ggccttatcaagttattagt

SEQ ID NO: 458114 - DNA, 20 bp, mouse
gacataaggtacacaatact

SEQ ID NO: 458115 - DNA, 20 bp, mouse
ggagtaatgagcaaggtctt

SEQ ID NO: 458116 - DNA, 20 bp, mouse
gagatcaattgattgcactt

SEQ ID NO: 458117 - DNA, 20 bp, mouse
gggtaaattactaaagagca

SEQ ID NO: 458118 - DNA, 20 bp, mouse
gtctattttgtcactagtcc

SEQ ID NO: 458119 - DNA, 20 bp, mouse
gtccccgtgcaaaatactgg

SEQ ID NO: 458120 - DNA, 20 bp, mouse
gctggagacagagctctgaa

SEQ ID NO: 458121 - DNA, 20 bp, mouse
gcacagttgtgattgggggc

SEQ ID NO: 458122 - DNA, 20 bp, mouse
gatccttcagatagatgtga

SEQ ID NO: 458123 - DNA, 20 bp, mouse
gaggaaatgtttagaaaata

SEQ ID NO: 458124 - DNA, 20 bp, mouse
gctcctccagtattttgcac

SEQ ID NO: 458125 - DNA, 20 bp, mouse
gctttagtaatttaccaacc

SEQ ID NO: 458126 - DNA, 20 bp, mouse
gtgaataaggagggtttcta

SEQ ID NO: 458127 - DNA, 20 bp, mouse
gtcaactgtatgaataagga

SEQ ID NO: 458128 - DNA, 20 bp, mouse
ggatctcaactgtatgaata

SEQ ID NO: 458129 - DNA, 20 bp, mouse
gaacaactgggaggagagtg

SEQ ID NO: 458130 - DNA, 20 bp, mouse
ggggaagggtaacaactggg

SEQ ID NO: 458131 - DNA, 20 bp, mouse
gatagtagactaagtgggaa

SEQ ID NO: 458132 - DNA, 20 bp, mouse
gctgtgaatagtagactaag

SEQ ID NO: 458133 - DNA, 20 bp, mouse
ggccagctgtaaaaggcatg

SEQ ID NO: 458134 - DNA, 20 bp, mouse
gttataacattattggctct

SEQ ID NO: 458135 - DNA, 20 bp, mouse
ggttcttcacatcaatctga

SEQ ID NO: 458136 - DNA, 20 bp, mouse
ggagcactaggaatgtgaca

SEQ ID NO: 458137 - DNA, 20 bp, mouse
gaggaatgtgacaaggtcca

SEQ ID NO: 458138 - DNA, 20 bp, mouse
gagtgggtagggtaacaaca

SEQ ID NO: 458139 - DNA, 20 bp, mouse
ggggtagggtaacaacaggg

SEQ ID NO: 458140 - DNA, 20 bp, mouse
gcgtggatggtagattaagt

SEQ ID NO: 458141 - DNA, 20 bp, mouse
gaattgtgatcaggcatcac

SEQ ID NO: 458142 - DNA, 20 bp, mouse
ggatggtagattaagtgggt

SEQ ID NO: 458143 - DNA, 20 bp, mouse
gttaatctaccatccacggg

SEQ ID NO: 458144 - DNA, 20 bp, mouse
gtgaataaaaagggtttcca

SEQ ID NO: 458145 - DNA, 20 bp, mouse
gacaattgtgtgaataaaaa

SEQ ID NO: 458146 - DNA, 20 bp, mouse
ggaacattagctccactaat

SEQ ID NO: 458147 - DNA, 20 bp, mouse
gtataattacctaaatttca

SEQ ID NO: 458148 - DNA, 20 bp, mouse
gattgaagaccctgaaattt

SEQ ID NO: 458149 - DNA, 20 bp, mouse
gaatgtacctgaagaacgta

SEQ ID NO: 458150 - DNA, 20 bp, mouse
gtttgcctctagttctgatt

SEQ ID NO: 458151 - DNA, 20 bp, mouse
ggatagatatgaaggacatt

SEQ ID NO: 458152 - DNA, 20 bp, mouse
gataccagtgtcagtaagaa

SEQ ID NO: 458153 - DNA, 20 bp, mouse
gagacccttcttactgacac

SEQ ID NO: 458154 - DNA, 20 bp, mouse
gaatgacaggacaagcagaa

SEQ ID NO: 458155 - DNA, 20 bp, mouse
ggaatgctgtataaagtgtc

SEQ ID NO: 458156 - DNA, 20 bp, mouse
gaaaccaggagagcaagcgt

SEQ ID NO: 458157 - DNA, 20 bp, mouse
gtaacatcccggggctgaca

SEQ ID NO: 458158 - DNA, 20 bp, mouse
ggagggacatcaccaaaacc

SEQ ID NO: 458159 - DNA, 20 bp, mouse
gagcttcagttaacatcccg

SEQ ID NO: 458160 - DNA, 20 bp, mouse
gggttgcttccaggttaggt

SEQ ID NO: 458161 - DNA, 20 bp, mouse
gcacactgaaaggaggctga

SEQ ID NO: 458162 - DNA, 20 bp, mouse
gggacgagagccccttacct

SEQ ID NO: 458163 - DNA, 20 bp, mouse
gggatagccagtaccccatg

SEQ ID NO: 458164 - DNA, 20 bp, mouse
ggatgagtgcctacctaacc

SEQ ID NO: 458165 - DNA, 20 bp, mouse
gctccctacgcttgctctcc

SEQ ID NO: 458166 - DNA, 20 bp, mouse
gcgaaagaaatggaaatgtt

SEQ ID NO: 458167 - DNA, 20 bp, mouse
gaactaggaatcgaaagaaa

SEQ ID NO: 458168 - DNA, 20 bp, mouse
gcttctccagtattttgcat

SEQ ID NO: 458169 - DNA, 20 bp, mouse
gtagtaatgagcaacgcttc

SEQ ID NO: 458170 - DNA, 20 bp, mouse
gcattactaatttcccaacc

SEQ ID NO: 458171 - DNA, 20 bp, mouse
ggtccttcacattgatctga

SEQ ID NO: 458172 - DNA, 20 bp, mouse
gacaggagagggtgaacacc

SEQ ID NO: 458173 - DNA, 20 bp, mouse
gtgtgttataatagaaaata

SEQ ID NO: 458174 - DNA, 20 bp, mouse
gaaagtgcaatggattgatc

SEQ ID NO: 458175 - DNA, 20 bp, mouse
gtttaaaatgttcattaagt

SEQ ID NO: 458176 - DNA, 20 bp, mouse
ggagacagagctatgaaaga

SEQ ID NO: 458177 - DNA, 20 bp, mouse
gaaagagggaagcttccccc

SEQ ID NO: 458178 - DNA, 20 bp, mouse
gcacattacagtttcctact

SEQ ID NO: 458179 - DNA, 20 bp, mouse
gtttataatgttcaccaagt

SEQ ID NO: 458180 - DNA, 20 bp, mouse
gagaacaatcaattgcactt

SEQ ID NO: 458181 - DNA, 20 bp, mouse
gggtaaattactaatgagca

SEQ ID NO: 458182 - DNA, 20 bp, mouse
gtccccgtgcaaaatactgg

SEQ ID NO: 458183 - DNA, 20 bp, mouse
gtggaagaggagtggggcca

SEQ ID NO: 458184 - DNA, 20 bp, mouse
gatccttcagatagatgtga

SEQ ID NO: 458185 - DNA, 20 bp, mouse
gcattagtaatttaccaacc

SEQ ID NO: 458186 - DNA, 20 bp, mouse
gctcagaagcactgttaagt

SEQ ID NO: 458187 - DNA, 20 bp, mouse
gcataactgattggtcactt

SEQ ID NO: 458188 - DNA, 20 bp, mouse
gcctctggagacaaaactct

SEQ ID NO: 458189 - DNA, 20 bp, mouse
gtatccttcttgctatatag

SEQ ID NO: 458190 - DNA, 20 bp, mouse
gaggatacttacatagttga

SEQ ID NO: 458191 - DNA, 20 bp, mouse
gaaaactgcacataactgat

SEQ ID NO: 458192 - DNA, 20 bp, mouse
gcaaccactatatagcaaga

SEQ ID NO: 458193 - DNA, 20 bp, mouse
ggttaaactatatcatcata

SEQ ID NO: 458194 - DNA, 20 bp, mouse
gcaataattgggaaaggggt

SEQ ID NO: 458195 - DNA, 20 bp, mouse
ggttaaataagtacatttct

SEQ ID NO: 458196 - DNA, 20 bp, mouse
gtaagaagagaagcaaacaa

SEQ ID NO: 458197 - DNA, 20 bp, mouse
gtaactgaaggtattaagaa

SEQ ID NO: 458198 - DNA, 20 bp, mouse
gggtttccccctttctccaa

SEQ ID NO: 458199 - DNA, 20 bp, mouse
ggcacttccctttggagaaa

SEQ ID NO: 458200 - DNA, 20 bp, mouse
gaaacattggcacttccctt

SEQ ID NO: 458201 - DNA, 20 bp, mouse
ggctctatacaatagaggat

SEQ ID NO: 458202 - DNA, 20 bp, mouse
gcagattgaaaatcacggtg

SEQ ID NO: 458203 - DNA, 20 bp, mouse
gattacaatatgaggtaatg

SEQ ID NO: 458204 - DNA, 20 bp, mouse
gtttcagaaattacaatatg

SEQ ID NO: 458205 - DNA, 20 bp, mouse
gggggaaacccttctgcttc

SEQ ID NO: 458206 - DNA, 20 bp, mouse
gtatcttgagaagcaagcaa

SEQ ID NO: 458207 - DNA, 20 bp, mouse
gttttcccagaagcactcaa

SEQ ID NO: 458208 - DNA, 20 bp, mouse
gcactcaaagggaagtaaat

SEQ ID NO: 458209 - DNA, 20 bp, mouse
gtctcagaaattataataca

SEQ ID NO: 458210 - DNA, 20 bp, mouse
gcttccctttgagtgcttct

SEQ ID NO: 458211 - DNA, 20 bp, mouse
gatgactagttaaatattaa

SEQ ID NO: 458212 - DNA, 20 bp, mouse
gattataatacaaggcaatg

SEQ ID NO: 458213 - DNA, 20 bp, mouse
gatggctgaaggaaaaacaa

SEQ ID NO: 458214 - DNA, 20 bp, mouse
gtatttccaatgatgggaag

SEQ ID NO: 458215 - DNA, 20 bp, mouse
gatatttttcacttaaacat

SEQ ID NO: 458216 - DNA, 20 bp, mouse
gaatagaattttatgaaagt

SEQ ID NO: 458217 - DNA, 20 bp, mouse
gtgttgttggtcctccgagt

SEQ ID NO: 458218 - DNA, 20 bp, mouse
gattagtggacgtaatattg

SEQ ID NO: 458219 - DNA, 20 bp, mouse
ggtacatttcaaattgagac

SEQ ID NO: 458220 - DNA, 20 bp, mouse
gattgcctctagttctgatc

SEQ ID NO: 458221 - DNA, 20 bp, mouse
gcctccgagttggcggcaac

SEQ ID NO: 458222 - DNA, 20 bp, mouse
gatacctgtgtcagtaagag

SEQ ID NO: 458223 - DNA, 20 bp, mouse
gtgttggtcctccgagttgg

SEQ ID NO: 458224 - DNA, 20 bp, mouse
gacttacattggtaaggcac

SEQ ID NO: 458225 - DNA, 20 bp, mouse
gattgaagactctgaaatgc

SEQ ID NO: 458226 - DNA, 20 bp, mouse
ggaatgcactacaaagtgtc

SEQ ID NO: 458227 - DNA, 20 bp, mouse
gaatattgtggaaatgaata

SEQ ID NO: 458228 - DNA, 20 bp, mouse
gtctgcttctcctgtcactg

SEQ ID NO: 458229 - DNA, 20 bp, mouse
gattagtggaggaaatattg

SEQ ID NO: 458230 - DNA, 20 bp, mouse
gacatttttttaaacaaatt

SEQ ID NO: 458231 - DNA, 20 bp, mouse
gaggcatacttacattagta

SEQ ID NO: 458232 - DNA, 20 bp, mouse
gttgggagaggagtgggtcc

SEQ ID NO: 458233 - DNA, 20 bp, mouse
gggagaggagtgggtccagg

SEQ ID NO: 458234 - DNA, 20 bp, mouse
gcaaaatcaatatttgtgtt

SEQ ID NO: 458235 - DNA, 20 bp, mouse
gattgaagtacctgaaatgc

SEQ ID NO: 458236 - DNA, 20 bp, mouse
gaatgacaggagaagcataa

SEQ ID NO: 458237 - DNA, 20 bp, mouse
ggctttttagaaaaaaaatg

SEQ ID NO: 458238 - DNA, 20 bp, mouse
gatttcctaatcaaaactag

SEQ ID NO: 458239 - DNA, 20 bp, mouse
gattagtggagctaatgttg

SEQ ID NO: 458240 - DNA, 20 bp, mouse
gactgaagaccctgaaatgc

SEQ ID NO: 458241 - DNA, 20 bp, mouse
gtttgcctctagttttgatt

SEQ ID NO: 458242 - DNA, 20 bp, mouse
ggatagatatgaaggacatt

SEQ ID NO: 458243 - DNA, 20 bp, mouse
gtataattacctgcatttca

SEQ ID NO: 458244 - DNA, 20 bp, mouse
gtgttgttggtcctctgagc

SEQ ID NO: 458245 - DNA, 20 bp, mouse
gataacagtgtcagtaagaa

SEQ ID NO: 458246 - DNA, 20 bp, mouse
gtcactgggaacaaatgcac

SEQ ID NO: 458247 - DNA, 20 bp, mouse
gttctatggaatcagcaccg

SEQ ID NO: 458248 - DNA, 20 bp, mouse
gtaaaggagtggggccaggt

SEQ ID NO: 458249 - DNA, 20 bp, mouse
gtttgttcccagtgagtcaa

SEQ ID NO: 458250 - DNA, 20 bp, mouse
gtggaaagcttatgttccaa

SEQ ID NO: 458251 - DNA, 20 bp, mouse
gaagagagccattgactcac

SEQ ID NO: 458252 - DNA, 20 bp, mouse
ggaatcagcaccgtggcaga

SEQ ID NO: 458253 - DNA, 20 bp, mouse
ggcagagggaagctcccacc

SEQ ID NO: 458254 - DNA, 20 bp, mouse
gcaacaattggtaaaggagt

SEQ ID NO: 458255 - DNA, 20 bp, mouse
gtatttccaacaattggtaa

SEQ ID NO: 458256 - DNA, 20 bp, mouse
ggtaacacctagaatcagac

SEQ ID NO: 458257 - DNA, 20 bp, mouse
gcagccactgggaatttgta

SEQ ID NO: 458258 - DNA, 20 bp, mouse
gggtttgagccacagtttag

SEQ ID NO: 458259 - DNA, 20 bp, mouse
gaaggtgagtgactcagcaa

SEQ ID NO: 458260 - DNA, 20 bp, mouse
gtgagtgactcagcaatgga

SEQ ID NO: 458261 - DNA, 20 bp, mouse
gtagatccccaagagggaat

SEQ ID NO: 458262 - DNA, 20 bp, mouse
ggttcctgtcctgtccaact

SEQ ID NO: 458263 - DNA, 20 bp, mouse
ggacaggacaggaactgtag

SEQ ID NO: 458264 - DNA, 20 bp, mouse
gcagcctagttggacaggac

SEQ ID NO: 458265 - DNA, 20 bp, mouse
gcagcaatggatggtatgtg

SEQ ID NO: 458266 - DNA, 20 bp, mouse
ggatttagtcgattcggaca

SEQ ID NO: 458267 - DNA, 20 bp, mouse
gcagcaggatttagtcgatt

SEQ ID NO: 458268 - DNA, 20 bp, mouse
gagcttcctttataaggata

SEQ ID NO: 458269 - DNA, 20 bp, mouse
gaccatggagctgctgactg

SEQ ID NO: 458270 - DNA, 20 bp, mouse
gtctacagcggcacatacta

SEQ ID NO: 458271 - DNA, 20 bp, mouse
gtagacctccaagagaggac

SEQ ID NO: 458272 - DNA, 20 bp, mouse
gtaggtgttgtattgagtgt

SEQ ID NO: 458273 - DNA, 20 bp, mouse
ggaagtaatggtatctacag

SEQ ID NO: 458274 - DNA, 20 bp, mouse
gtccttataaaggaagcttg

SEQ ID NO: 458275 - DNA, 20 bp, mouse
gttgctctaggaattcccag

SEQ ID NO: 458276 - DNA, 20 bp, mouse
ggcagaaggatcctgatcct

SEQ ID NO: 458277 - DNA, 20 bp, mouse
gttgctctaggtactcccag

SEQ ID NO: 458278 - DNA, 20 bp, mouse
gagaccccccaagagggaac

SEQ ID NO: 458279 - DNA, 20 bp, mouse
gggatatagaccccccaaga

SEQ ID NO: 458280 - DNA, 20 bp, mouse
gttgatgtagcgtttttcat

SEQ ID NO: 458281 - DNA, 20 bp, mouse
ggtagcaagaagtccagctc

SEQ ID NO: 458282 - DNA, 20 bp, mouse
gacatcaaacacctaggatc

SEQ ID NO: 458283 - DNA, 20 bp, mouse
ggaagttatggtgtccttag

SEQ ID NO: 458284 - DNA, 20 bp, mouse
ggatttagtgtgtttataca

SEQ ID NO: 458285 - DNA, 20 bp, mouse
gaagcctgttccctcttggg

SEQ ID NO: 458286 - DNA, 20 bp, mouse
gaggaggattcactctgagg

SEQ ID NO: 458287 - DNA, 20 bp, mouse
gctgaaactcagccgaggag

SEQ ID NO: 458288 - DNA, 20 bp, mouse
gattcactctgaggtggagg

SEQ ID NO: 458289 - DNA, 20 bp, mouse
gggagcctcgcaggaacagg

SEQ ID NO: 458290 - DNA, 20 bp, mouse
gaggagggcacgttctgacg

SEQ ID NO: 458291 - DNA, 20 bp, mouse
gccctgggcggggctggagt

SEQ ID NO: 458292 - DNA, 20 bp, mouse
gcaaggtagccccagcgcag

SEQ ID NO: 458293 - DNA, 20 bp, mouse
gtctggagcctcgcaggaac

SEQ ID NO: 458294 - DNA, 20 bp, mouse
gcaggaggagtaggagctcg

SEQ ID NO: 458295 - DNA, 20 bp, mouse
gggcagaggggaacctccaa

SEQ ID NO: 458296 - DNA, 20 bp, mouse
ggttcccagtccatcataag

SEQ ID NO: 458297 - DNA, 20 bp, mouse
gtcaaaagcctggaagcagt

SEQ ID NO: 458298 - DNA, 20 bp, mouse
gcagcaggtttcccagccca

SEQ ID NO: 458299 - DNA, 20 bp, mouse
gctggttggagatgacttat

SEQ ID NO: 458300 - DNA, 20 bp, mouse
gtgacccaggcagcacgtgg

SEQ ID NO: 458301 - DNA, 20 bp, mouse
ggttccagaaacttagaatc

SEQ ID NO: 458302 - DNA, 20 bp, mouse
gaggcctcgctgcctatctt

SEQ ID NO: 458303 - DNA, 20 bp, mouse
gaggcctgagaccacacaac

SEQ ID NO: 458304 - DNA, 20 bp, mouse
gtggtcccttataaagaggg

SEQ ID NO: 458305 - DNA, 20 bp, mouse
ggaagaagtcagagtgaccc

SEQ ID NO: 458306 - DNA, 20 bp, mouse
gaagggccttgggacctcta

SEQ ID NO: 458307 - DNA, 20 bp, mouse
gtcgagcaactggtcagaca

SEQ ID NO: 458308 - DNA, 20 bp, mouse
gtgagtgacttagtggtggg

SEQ ID NO: 458309 - DNA, 20 bp, mouse
gtggatgccaccaaaaaatt

SEQ ID NO: 458310 - DNA, 20 bp, mouse
gggacgagcagtagccatag

SEQ ID NO: 458311 - DNA, 20 bp, mouse
gtggcaacgttcagtctggt

SEQ ID NO: 458312 - DNA, 20 bp, mouse
ggtgatggcaacgttcagtc

SEQ ID NO: 458313 - DNA, 20 bp, mouse
gttgggggataaattccagg

SEQ ID NO: 458314 - DNA, 20 bp, mouse
gaactggtcagacagggaac

SEQ ID NO: 458315 - DNA, 20 bp, mouse
gtctagggcaatagttttgg

SEQ ID NO: 458316 - DNA, 20 bp, mouse
gcattgggtaggtattactg

SEQ ID NO: 458317 - DNA, 20 bp, mouse
gagccaaccctgggatgcgt

SEQ ID NO: 458318 - DNA, 20 bp, mouse
gaattctcctacgcatccca

SEQ ID NO: 458319 - DNA, 20 bp, mouse
gtgtaaccacctgaagtcat

SEQ ID NO: 458320 - DNA, 20 bp, mouse
gcaaaagacatttctcataa

SEQ ID NO: 458321 - DNA, 20 bp, mouse
gggcggctggtccgagttcc

SEQ ID NO: 458322 - DNA, 20 bp, mouse
gaagacatttctcataatgg

SEQ ID NO: 458323 - DNA, 20 bp, mouse
gcctacccaatgacttcagg

SEQ ID NO: 458324 - DNA, 20 bp, mouse
gggtgagagagtgtgagatc

SEQ ID NO: 458325 - DNA, 20 bp, mouse
gacttcaggtggttacaatt

SEQ ID NO: 458326 - DNA, 20 bp, mouse
gccatcaaacaccttggatc

SEQ ID NO: 458327 - DNA, 20 bp, mouse
gcatccaatgaatctctcta

SEQ ID NO: 458328 - DNA, 20 bp, mouse
gtctagggcaacggatatgg

SEQ ID NO: 458329 - DNA, 20 bp, mouse
gcagatcgctgttggacctg

SEQ ID NO: 458330 - DNA, 20 bp, mouse
gttgccctagagagattcat

SEQ ID NO: 458331 - DNA, 20 bp, mouse
gctctctagggcaacggata

SEQ ID NO: 458332 - DNA, 20 bp, mouse
ggcgatctggaacctctaaa

SEQ ID NO: 458333 - DNA, 20 bp, mouse
gacagtgaaggccaagccac

SEQ ID NO: 458334 - DNA, 20 bp, mouse
ggaatcaggatgtgagagca

SEQ ID NO: 458335 - DNA, 20 bp, mouse
gtctgtagtgtacacagtga

SEQ ID NO: 458336 - DNA, 20 bp, mouse
ggcgctggcgctggtgggtc

SEQ ID NO: 458337 - DNA, 20 bp, mouse
gagtccagcgctggcgctgg

SEQ ID NO: 458338 - DNA, 20 bp, mouse
ggtatttagtcagtttggac

SEQ ID NO: 458339 - DNA, 20 bp, mouse
gcaacagtatttagtcagtt

SEQ ID NO: 458340 - DNA, 20 bp, mouse
gggaagcctgggcagtagtg

SEQ ID NO: 458341 - DNA, 20 bp, mouse
gtctacagcggcacatacta

SEQ ID NO: 458342 - DNA, 20 bp, mouse
gtagacctccaagagaggac

SEQ ID NO: 458343 - DNA, 20 bp, mouse
ggaagtaatggtatctacag

SEQ ID NO: 458344 - DNA, 20 bp, mouse
gttgctctaggaattcccag

SEQ ID NO: 458345 - DNA, 20 bp, mouse
gggatctagacctccaagag

SEQ ID NO: 458346 - DNA, 20 bp, mouse
gatccagacaagcaaggcaa

SEQ ID NO: 458347 - DNA, 20 bp, mouse
gagccccatcggcaccatgg

SEQ ID NO: 458348 - DNA, 20 bp, mouse
ggtgatgccaagaaccgcca

SEQ ID NO: 458349 - DNA, 20 bp, mouse
gatggatacgaggaggaggg

SEQ ID NO: 458350 - DNA, 20 bp, mouse
gatttagagtggagccccat

SEQ ID NO: 458351 - DNA, 20 bp, mouse
gaaccgccatggtgccgatg

SEQ ID NO: 458352 - DNA, 20 bp, mouse
ggtggcgatccagacaagca

SEQ ID NO: 458353 - DNA, 20 bp, mouse
gtcggcaccatggcggttct

SEQ ID NO: 458354 - DNA, 20 bp, mouse
gccagatggatacgaggagg

SEQ ID NO: 458355 - DNA, 20 bp, mouse
gggctccactctaaatttgt

SEQ ID NO: 458356 - DNA, 20 bp, mouse
gtactgatacaggtgagggg

SEQ ID NO: 458357 - DNA, 20 bp, mouse
gagagacagagacctctctt

SEQ ID NO: 458358 - DNA, 20 bp, mouse
gtgctgcagaatactgatac

SEQ ID NO: 458359 - DNA, 20 bp, mouse
ggaatactgatacaggtgag

SEQ ID NO: 458360 - DNA, 20 bp, mouse
gtgacaagcagcaatatcat

SEQ ID NO: 458361 - DNA, 20 bp, mouse
ggatagacactgcaaaataa

SEQ ID NO: 458362 - DNA, 20 bp, mouse
gtttaaaagggcctggagac

SEQ ID NO: 458363 - DNA, 20 bp, mouse
gtgcagtgtctatcactgga

SEQ ID NO: 458364 - DNA, 20 bp, mouse
ggtctctgcaaatcaattct

SEQ ID NO: 458365 - DNA, 20 bp, mouse
gggaggacaaacggcatgca

SEQ ID NO: 458366 - DNA, 20 bp, mouse
gaaggctcctcccagcatca

SEQ ID NO: 458367 - DNA, 20 bp, mouse
gcatcatggtgctaagttga

SEQ ID NO: 458368 - DNA, 20 bp, mouse
gaacttagcaccatgatgct

SEQ ID NO: 458369 - DNA, 20 bp, mouse
gcttggaagaggaccagtaa

SEQ ID NO: 458370 - DNA, 20 bp, mouse
gtagtgatgaaggtcacaga

SEQ ID NO: 458371 - DNA, 20 bp, mouse
ggatctcctagaagctattt

SEQ ID NO: 458372 - DNA, 20 bp, mouse
ggtcacagatggcacagctg

SEQ ID NO: 458373 - DNA, 20 bp, mouse
gagcacactaaccttctgga

SEQ ID NO: 458374 - DNA, 20 bp, mouse
gggtcctcttccaagcaatc

SEQ ID NO: 458375 - DNA, 20 bp, mouse
gaagctatttaggcaagctc

SEQ ID NO: 458376 - DNA, 20 bp, mouse
gacaagctggaacttagcag

SEQ ID NO: 458377 - DNA, 20 bp, mouse
gcccttctggaaagatagaa

SEQ ID NO: 458378 - DNA, 20 bp, mouse
gtggttagccacgaacaagc

SEQ ID NO: 458379 - DNA, 20 bp, mouse
gctaagttccagcttgttcg

SEQ ID NO: 458380 - DNA, 20 bp, mouse
gggcagaaggatatggtgac

SEQ ID NO: 458381 - DNA, 20 bp, mouse
gcaagttgcaatagcaagca

SEQ ID NO: 458382 - DNA, 20 bp, mouse
gacaggtcagtatcaggtca

SEQ ID NO: 458383 - DNA, 20 bp, mouse
ggctattgcaacttgcctgg

SEQ ID NO: 458384 - DNA, 20 bp, mouse
gaagaaagggagaggggttc

SEQ ID NO: 458385 - DNA, 20 bp, mouse
gaaaacagaacaaacccttc

SEQ ID NO: 458386 - DNA, 20 bp, mouse
ggagagaggcacagtcctca

SEQ ID NO: 458387 - DNA, 20 bp, mouse
ggttctggtaggacagagag

SEQ ID NO: 458388 - DNA, 20 bp, mouse
gccacctggtgctgataata

SEQ ID NO: 458389 - DNA, 20 bp, mouse
ggtggacaaggagttctggt

SEQ ID NO: 458390 - DNA, 20 bp, mouse
gagagggttgaacttagcag

SEQ ID NO: 458391 - DNA, 20 bp, mouse
gatgatgagagtccaagctg

SEQ ID NO: 458392 - DNA, 20 bp, mouse
gcagcaccaggtggttaccc

SEQ ID NO: 458393 - DNA, 20 bp, mouse
gggtttcctgggtaaccacc

SEQ ID NO: 458394 - DNA, 20 bp, mouse
gaacagcaggatatgactgg

SEQ ID NO: 458395 - DNA, 20 bp, mouse
gaacagtggacaaggagttc

SEQ ID NO: 458396 - DNA, 20 bp, mouse
gacttgagcagactttccag

SEQ ID NO: 458397 - DNA, 20 bp, mouse
ggcagctgccagggagtccg

SEQ ID NO: 458398 - DNA, 20 bp, mouse
ggagtccgcggcttcgagca

SEQ ID NO: 458399 - DNA, 20 bp, mouse
gctcgaagccgcggactccc

SEQ ID NO: 458400 - DNA, 20 bp, mouse
gccgcggcttcgagcatggc

SEQ ID NO: 458401 - DNA, 20 bp, mouse
gggaattagcgtttgagctg

SEQ ID NO: 458402 - DNA, 20 bp, mouse
ggctcaaacgctaattcccc

SEQ ID NO: 458403 - DNA, 20 bp, mouse
gtccctggcagctgccttct

SEQ ID NO: 458404 - DNA, 20 bp, mouse
gtagcagcagagtccggaga

SEQ ID NO: 458405 - DNA, 20 bp, mouse
gccacaaagggcaagcgcgg

SEQ ID NO: 458406 - DNA, 20 bp, mouse
gatcatcaaggggcaggaag

SEQ ID NO: 458407 - DNA, 20 bp, mouse
gtacttggaagatcatcaag

SEQ ID NO: 458408 - DNA, 20 bp, mouse
gctctatgacagggttacag

SEQ ID NO: 458409 - DNA, 20 bp, mouse
gccacagcagggcttgtact

SEQ ID NO: 458410 - DNA, 20 bp, mouse
gtgcttcagcaggtaagatg

SEQ ID NO: 458411 - DNA, 20 bp, mouse
gaggctgcttcacccaacag

SEQ ID NO: 458412 - DNA, 20 bp, mouse
gtccctggtgaccaccttct

SEQ ID NO: 458413 - DNA, 20 bp, mouse
gtggagtgcttcccagaagg

SEQ ID NO: 458414 - DNA, 20 bp, mouse
gtggaagatcatcaaggggc

SEQ ID NO: 458415 - DNA, 20 bp, mouse
ggcttctgaggatgttaatc

SEQ ID NO: 458416 - DNA, 20 bp, mouse
gtcccaggtgctaacaacaa

SEQ ID NO: 458417 - DNA, 20 bp, mouse
gggtagcagcgagcatggct

SEQ ID NO: 458418 - DNA, 20 bp, mouse
gactgcagctggttcgtctg

SEQ ID NO: 458419 - DNA, 20 bp, mouse
ggagccggtagcagcgagca

SEQ ID NO: 458420 - DNA, 20 bp, mouse
gccggctggattgagaggtg

SEQ ID NO: 458421 - DNA, 20 bp, mouse
gtggagcgctgcccagatcg

SEQ ID NO: 458422 - DNA, 20 bp, mouse
gtcctaccggctggattgag

SEQ ID NO: 458423 - DNA, 20 bp, mouse
gatcgtggctaacaaggagc

SEQ ID NO: 458424 - DNA, 20 bp, mouse
gcaatccagccggtaggaag

SEQ ID NO: 458425 - DNA, 20 bp, mouse
gcttggggtctgcctttcgt

SEQ ID NO: 458426 - DNA, 20 bp, mouse
gtcgactgtgggctccctag

SEQ ID NO: 458427 - DNA, 20 bp, mouse
gctccctagtggctagaata

SEQ ID NO: 458428 - DNA, 20 bp, mouse
ggaccatattctagccacta

SEQ ID NO: 458429 - DNA, 20 bp, mouse
ggagcccacagtcgaaagca

SEQ ID NO: 458430 - DNA, 20 bp, mouse
ggaggtagtcagcaaggagc

SEQ ID NO: 458431 - DNA, 20 bp, mouse
gccaggtctagaatgggtca

SEQ ID NO: 458432 - DNA, 20 bp, mouse
gcatggtgagagtctgaatt

SEQ ID NO: 458433 - DNA, 20 bp, mouse
gtgttgctccaggtctagaa

SEQ ID NO: 458434 - DNA, 20 bp, mouse
gtcaccatgctttcgactgt

SEQ ID NO: 458435 - DNA, 20 bp, mouse
gagaaactggctaaattggc

SEQ ID NO: 458436 - DNA, 20 bp, mouse
ggcttgggtaacaaggaaca

SEQ ID NO: 458437 - DNA, 20 bp, mouse
ggggctaaaagtactgtcag

SEQ ID NO: 458438 - DNA, 20 bp, mouse
gcaggcgccatggtccagga

SEQ ID NO: 458439 - DNA, 20 bp, mouse
gacaaggtagaacttagcac

SEQ ID NO: 458440 - DNA, 20 bp, mouse
ggaactaccctcctggacca

SEQ ID NO: 458441 - DNA, 20 bp, mouse
gtacttccagaaagataggc

SEQ ID NO: 458442 - DNA, 20 bp, mouse
gggttgactacatcaaaaac

SEQ ID NO: 458443 - DNA, 20 bp, mouse
gccagaaagataggcaggct

SEQ ID NO: 458444 - DNA, 20 bp, mouse
gatggcaggcgccatggtcc

SEQ ID NO: 458445 - DNA, 20 bp, mouse
gaccccaagaactaccctcc

SEQ ID NO: 458446 - DNA, 20 bp, mouse
ggcggcagccggctccctag

SEQ ID NO: 458447 - DNA, 20 bp, mouse
ggcatggctgatatcagagc

SEQ ID NO: 458448 - DNA, 20 bp, mouse
gactacaggcagtgtccttg

SEQ ID NO: 458449 - DNA, 20 bp, mouse
gcctgctgaagggataggtg

SEQ ID NO: 458450 - DNA, 20 bp, mouse
ggcccaaatggcagccacta

SEQ ID NO: 458451 - DNA, 20 bp, mouse
ggagccggctgccgcaagca

SEQ ID NO: 458452 - DNA, 20 bp, mouse
gtcctacctgctgaagggat

SEQ ID NO: 458453 - DNA, 20 bp, mouse
gggaacaagcaacccacgaa

SEQ ID NO: 458454 - DNA, 20 bp, mouse
ggaaggcgcattggccctgg

SEQ ID NO: 458455 - DNA, 20 bp, mouse
gagatggagcgcagcccaaa

SEQ ID NO: 458456 - DNA, 20 bp, mouse
gctcccggtagctccaacat

SEQ ID NO: 458457 - DNA, 20 bp, mouse
gcccagcccggggccgatgt

SEQ ID NO: 458458 - DNA, 20 bp, mouse
gttggagctaccgggagccc

SEQ ID NO: 458459 - DNA, 20 bp, mouse
gagcgccccagcgcacgccc

SEQ ID NO: 458460 - DNA, 20 bp, mouse
ggaaccagtccggagcgagg

SEQ ID NO: 458461 - DNA, 20 bp, mouse
gggagcccgggcgtgcgctg

SEQ ID NO: 458462 - DNA, 20 bp, mouse
gggccgatgttggagctacc

SEQ ID NO: 458463 - DNA, 20 bp, mouse
gtagctccaacatcggcccc

SEQ ID NO: 458464 - DNA, 20 bp, mouse
gggaagcagagccgggtgta

SEQ ID NO: 458465 - DNA, 20 bp, mouse
gggcgaggtaggcctcaacg

SEQ ID NO: 458466 - DNA, 20 bp, mouse
gagcagcagcgcccaggtgc

SEQ ID NO: 458467 - DNA, 20 bp, mouse
ggcggcaaggagcttctagg

SEQ ID NO: 458468 - DNA, 20 bp, mouse
gccggcggcaaggagcttct

SEQ ID NO: 458469 - DNA, 20 bp, mouse
gccatctctgcaggtcggct

SEQ ID NO: 458470 - DNA, 20 bp, mouse
gcctcccctaactagtccgg

SEQ ID NO: 458471 - DNA, 20 bp, mouse
ggcaaggacatcctaaccag

SEQ ID NO: 458472 - DNA, 20 bp, mouse
ggtcttggaagtgggatcca

SEQ ID NO: 458473 - DNA, 20 bp, mouse
gtgagcaagggtatccaggt

SEQ ID NO: 458474 - DNA, 20 bp, mouse
ggcagcggcgtgggccccgg

SEQ ID NO: 458475 - DNA, 20 bp, mouse
gtggctgcctccatctctgc

SEQ ID NO: 458476 - DNA, 20 bp, mouse
gagcagcagcaacgccaagc

SEQ ID NO: 458477 - DNA, 20 bp, mouse
gtaagatcctcaatgtgcgg

SEQ ID NO: 458478 - DNA, 20 bp, mouse
gttggaccgtgtgctcatgg

SEQ ID NO: 458479 - DNA, 20 bp, mouse
ggacaggatggtcacctgct

SEQ ID NO: 458480 - DNA, 20 bp, mouse
ggttgtgcccagccagaaga

SEQ ID NO: 458481 - DNA, 20 bp, mouse
gtaatgctgttgctttggtg

SEQ ID NO: 458482 - DNA, 20 bp, mouse
gctgcatctgagcttggcgg

SEQ ID NO: 458483 - DNA, 20 bp, mouse
gccagggtctgaaaagtgag

SEQ ID NO: 458484 - DNA, 20 bp, mouse
gggagaggtgcgggccctgg

SEQ ID NO: 458485 - DNA, 20 bp, mouse
gcaactgccaccgcacattg

SEQ ID NO: 458486 - DNA, 20 bp, mouse
gctgcagcggagctagatgc

SEQ ID NO: 458487 - DNA, 20 bp, mouse
gccgagcgaggacatgtccc

SEQ ID NO: 458488 - DNA, 20 bp, mouse
gcagcggagctagatgcagg

SEQ ID NO: 458489 - DNA, 20 bp, mouse
gctagatgcaggcggtacct

SEQ ID NO: 458490 - DNA, 20 bp, mouse
gagctccgctgcagacgcgc

SEQ ID NO: 458491 - DNA, 20 bp, mouse
gatgtagccggctactgtcg

SEQ ID NO: 458492 - DNA, 20 bp, mouse
gtagccggctacatgactca

SEQ ID NO: 458493 - DNA, 20 bp, mouse
ggcccgaagttacccacgag

SEQ ID NO: 458494 - DNA, 20 bp, mouse
gccggcaccgcgacagtagc

SEQ ID NO: 458495 - DNA, 20 bp, mouse
gccaagcctcggccactcgt

SEQ ID NO: 458496 - DNA, 20 bp, mouse
ggcactgatggaggtagggt

SEQ ID NO: 458497 - DNA, 20 bp, mouse
gcaagatcccccagacaccc

SEQ ID NO: 458498 - DNA, 20 bp, mouse
gggtgtgacccaacaagacc

SEQ ID NO: 458499 - DNA, 20 bp, mouse
gccgggcactgatggaggta

SEQ ID NO: 458500 - DNA, 20 bp, mouse
ggctgctcctgggtgtctgg

SEQ ID NO: 458501 - DNA, 20 bp, mouse
ggcagagccatgtgaacagc

SEQ ID NO: 458502 - DNA, 20 bp, mouse
gtgagctgtgagatgaaata

SEQ ID NO: 458503 - DNA, 20 bp, mouse
gcaaatcctcagctctccag

SEQ ID NO: 458504 - DNA, 20 bp, mouse
gaatgcaggttccccaggaa

SEQ ID NO: 458505 - DNA, 20 bp, mouse
gtataaggcagagggctcac

SEQ ID NO: 458506 - DNA, 20 bp, mouse
gtgaaaacgtccttctccag

SEQ ID NO: 458507 - DNA, 20 bp, mouse
gggggactaggagattcccc

SEQ ID NO: 458508 - DNA, 20 bp, mouse
gcctcagtcggcgggggact

SEQ ID NO: 458509 - DNA, 20 bp, mouse
gcattttcctcagtcggcgg

SEQ ID NO: 458510 - DNA, 20 bp, mouse
gtccagccttggatgcacgg

SEQ ID NO: 458511 - DNA, 20 bp, mouse
ggctcagagtttgcaaaact

SEQ ID NO: 458512 - DNA, 20 bp, mouse
gcagtgacagggagtttgga

SEQ ID NO: 458513 - DNA, 20 bp, mouse
ggcgcattttcctcagtcgg

SEQ ID NO: 458514 - DNA, 20 bp, mouse
gtctgttgattctggaagat

SEQ ID NO: 458515 - DNA, 20 bp, mouse
gccagaacggcgattgctat

SEQ ID NO: 458516 - DNA, 20 bp, mouse
ggcagagggaagcattgagg

SEQ ID NO: 458517 - DNA, 20 bp, mouse
ggatcacacacacagttgta

SEQ ID NO: 458518 - DNA, 20 bp, mouse
gggaatctgacaccttccac

SEQ ID NO: 458519 - DNA, 20 bp, mouse
gtgtcctcagtgcagcagag

SEQ ID NO: 458520 - DNA, 20 bp, mouse
gctattctgttattattggg

SEQ ID NO: 458521 - DNA, 20 bp, mouse
gccagcagctggagagccga

SEQ ID NO: 458522 - DNA, 20 bp, mouse
gcatctattctgttattatt

SEQ ID NO: 458523 - DNA, 20 bp, mouse
gctgattgctaggagcaccc

SEQ ID NO: 458524 - DNA, 20 bp, mouse
gtgatcctcaagacatggta

SEQ ID NO: 458525 - DNA, 20 bp, mouse
gcaccctgatcctcaagaca

SEQ ID NO: 458526 - DNA, 20 bp, mouse
gttgtgtgctgcacctttca

SEQ ID NO: 458527 - DNA, 20 bp, mouse
gtcctgagtcacaaacagct

SEQ ID NO: 458528 - DNA, 20 bp, mouse
gcaaaattgagagtacaact

SEQ ID NO: 458529 - DNA, 20 bp, mouse
gtcacaagtagagaaggacc

SEQ ID NO: 458530 - DNA, 20 bp, mouse
gaataacccaggtctaactg

SEQ ID NO: 458531 - DNA, 20 bp, mouse
gttcttagtgagcaggactt

SEQ ID NO: 458532 - DNA, 20 bp, mouse
ggagtcacaaacagctgggc

SEQ ID NO: 458533 - DNA, 20 bp, mouse
gggattttccaagccagtaa

SEQ ID NO: 458534 - DNA, 20 bp, mouse
gccataggagggatttgcat

SEQ ID NO: 458535 - DNA, 20 bp, mouse
gaagtagagaaggaccaggc

SEQ ID NO: 458536 - DNA, 20 bp, mouse
gattatcaggaagatcaaaa

SEQ ID NO: 458537 - DNA, 20 bp, mouse
gctgtccattcagaggacat

SEQ ID NO: 458538 - DNA, 20 bp, mouse
ggaccatgtcctcaggatag

SEQ ID NO: 458539 - DNA, 20 bp, mouse
ggagtatcacccctatcctg

SEQ ID NO: 458540 - DNA, 20 bp, mouse
ggcttgctaatgaacttagt

SEQ ID NO: 458541 - DNA, 20 bp, mouse
gcaaaatggttatcagaagc

SEQ ID NO: 458542 - DNA, 20 bp, mouse
ggtcacacacacacatctgg

SEQ ID NO: 458543 - DNA, 20 bp, mouse
ggagcaccaggatgattgcc

SEQ ID NO: 458544 - DNA, 20 bp, mouse
gacatggtctgggaaggaac

SEQ ID NO: 458545 - DNA, 20 bp, mouse
gtctgtaactatatctccag

SEQ ID NO: 458546 - DNA, 20 bp, mouse
gtgagtggaagcccatagga

SEQ ID NO: 458547 - DNA, 20 bp, mouse
ggcacaatgctcgaacttgt

SEQ ID NO: 458548 - DNA, 20 bp, mouse
gatgctcgaacttgtaggtc

SEQ ID NO: 458549 - DNA, 20 bp, mouse
gcgaacttgtaggtctggtg

SEQ ID NO: 458550 - DNA, 20 bp, mouse
gagttcgagcattgtgcaag

SEQ ID NO: 458551 - DNA, 20 bp, mouse
gaatatcattggccatccta

SEQ ID NO: 458552 - DNA, 20 bp, mouse
gtggtagttagaaattagcc

SEQ ID NO: 458553 - DNA, 20 bp, mouse
gaaacaattgactagtgtcc

SEQ ID NO: 458554 - DNA, 20 bp, mouse
ggttctgagtggaagcccat

SEQ ID NO: 458555 - DNA, 20 bp, mouse
gactctttctatgtaatttt

SEQ ID NO: 458556 - DNA, 20 bp, mouse
ggagctccatttggatgttg

SEQ ID NO: 458557 - DNA, 20 bp, mouse
ggggtggtagctttgtaacc

SEQ ID NO: 458558 - DNA, 20 bp, mouse
ggtcacacacacacatctgg

SEQ ID NO: 458559 - DNA, 20 bp, mouse
ggcactgactgtcccttcag

SEQ ID NO: 458560 - DNA, 20 bp, mouse
gacatggtctgggaaggaac

SEQ ID NO: 458561 - DNA, 20 bp, mouse
ggagcaccaggatgattgcc

SEQ ID NO: 458562 - DNA, 20 bp, mouse
gctggatacatgggtcctcc

SEQ ID NO: 458563 - DNA, 20 bp, mouse
gatctgcaactatatctcca

SEQ ID NO: 458564 - DNA, 20 bp, mouse
gtcaaacctgtgtcctctga

SEQ ID NO: 458565 - DNA, 20 bp, mouse
ggatgattctgagctccatt

SEQ ID NO: 458566 - DNA, 20 bp, mouse
ggagctccatttgaatgttg

SEQ ID NO: 458567 - DNA, 20 bp, mouse
ggggtggtagctatgtaacc

SEQ ID NO: 458568 - DNA, 20 bp, mouse
gttgaaccccaacattcaaa

SEQ ID NO: 458569 - DNA, 20 bp, mouse
ggcactgactgtcccttcag

SEQ ID NO: 458570 - DNA, 20 bp, mouse
gacatggtctgggaaggaac

SEQ ID NO: 458571 - DNA, 20 bp, mouse
ggagcaccaggatgattgcc

SEQ ID NO: 458572 - DNA, 20 bp, mouse
gctggatacatgggtcctcc

SEQ ID NO: 458573 - DNA, 20 bp, mouse
gatctgcaactatatctcca

SEQ ID NO: 458574 - DNA, 20 bp, mouse
gtcaaacctgtgtcctctga

SEQ ID NO: 458575 - DNA, 20 bp, mouse
gcaaaatgattattagaagc

SEQ ID NO: 458576 - DNA, 20 bp, mouse
ggagtcacacatacatctgg

SEQ ID NO: 458577 - DNA, 20 bp, mouse
gagagagtcacacatacatc

SEQ ID NO: 458578 - DNA, 20 bp, mouse
gtcacacatacatctggagg

SEQ ID NO: 458579 - DNA, 20 bp, mouse
gaagctttaagcgctatgac

SEQ ID NO: 458580 - DNA, 20 bp, mouse
gctggatacattggtcctgc

SEQ ID NO: 458581 - DNA, 20 bp, mouse
gggtggtagcttttgtaact

SEQ ID NO: 458582 - DNA, 20 bp, mouse
ggcttgctaacgaacttagt

SEQ ID NO: 458583 - DNA, 20 bp, mouse
gacttcaggcacagcaaagt

SEQ ID NO: 458584 - DNA, 20 bp, mouse
ggcactgactgtccatccag

SEQ ID NO: 458585 - DNA, 20 bp, mouse
ggatgattctgagctccatt

SEQ ID NO: 458586 - DNA, 20 bp, mouse
ggttctgggtgtgagctcat

SEQ ID NO: 458587 - DNA, 20 bp, mouse
gcttgcagcgcttctctgct

SEQ ID NO: 458588 - DNA, 20 bp, mouse
gtgggtgtgagctcatagga

SEQ ID NO: 458589 - DNA, 20 bp, mouse
gtaggtagtgtctgtcaaga

SEQ ID NO: 458590 - DNA, 20 bp, mouse
gtataaagccacacaattat

SEQ ID NO: 458591 - DNA, 20 bp, mouse
gaaacagtcaactaatatgc

SEQ ID NO: 458592 - DNA, 20 bp, mouse
gacccataaggttagagttc

SEQ ID NO: 458593 - DNA, 20 bp, mouse
gcaatcaaatctctctttat

SEQ ID NO: 458594 - DNA, 20 bp, mouse
gtctctttataggtaatttt

SEQ ID NO: 458595 - DNA, 20 bp, mouse
gacccagaactctaacctta

SEQ ID NO: 458596 - DNA, 20 bp, mouse
gctagaatggccagtgatat

SEQ ID NO: 458597 - DNA, 20 bp, mouse
gtggtagttagaaattagtg

SEQ ID NO: 458598 - DNA, 20 bp, mouse
gactcagaactcttacctta

SEQ ID NO: 458599 - DNA, 20 bp, mouse
gaatggccagtgatattggt

SEQ ID NO: 458600 - DNA, 20 bp, mouse
ggccacctgtattattatac

SEQ ID NO: 458601 - DNA, 20 bp, mouse
gtagttcctaccaatatcac

SEQ ID NO: 458602 - DNA, 20 bp, mouse
gttcccctccattttctctt

SEQ ID NO: 458603 - DNA, 20 bp, mouse
gctcaaacaaaactctttct

SEQ ID NO: 458604 - DNA, 20 bp, mouse
gtgccagctaggcctagcag

SEQ ID NO: 458605 - DNA, 20 bp, mouse
gtgagtggaagctcctagaa

SEQ ID NO: 458606 - DNA, 20 bp, mouse
gcgcagcgctgacagctagt

SEQ ID NO: 458607 - DNA, 20 bp, mouse
gggtcggcgccggtgcagag

SEQ ID NO: 458608 - DNA, 20 bp, mouse
gaggccgaaggcgagcagga

SEQ ID NO: 458609 - DNA, 20 bp, mouse
gggggctcatggctcgtggt

SEQ ID NO: 458610 - DNA, 20 bp, mouse
ggagccagcgcccaggacgg

SEQ ID NO: 458611 - DNA, 20 bp, mouse
ggctagtcggtcgcagcctc

SEQ ID NO: 458612 - DNA, 20 bp, mouse
gtggccgtgcgtacaagacg

SEQ ID NO: 458613 - DNA, 20 bp, mouse
gccggtgcagagggggccgg

SEQ ID NO: 458614 - DNA, 20 bp, mouse
gcccggggatgtgctcatag

SEQ ID NO: 458615 - DNA, 20 bp, mouse
ggagacgcaggcccggagag

SEQ ID NO: 458616 - DNA, 20 bp, mouse
gcttgagtagccattgcctg

SEQ ID NO: 458617 - DNA, 20 bp, mouse
gagccataagtaacttgtca

SEQ ID NO: 458618 - DNA, 20 bp, mouse
gttccttgacaagttactta

SEQ ID NO: 458619 - DNA, 20 bp, mouse
ggctgtctgcaaatcgggtt

SEQ ID NO: 458620 - DNA, 20 bp, mouse
gttgcctgtggaggtagaac

SEQ ID NO: 458621 - DNA, 20 bp, mouse
gaggagcagaccgagcacag

SEQ ID NO: 458622 - DNA, 20 bp, mouse
ggtggaagagaagggaagat

SEQ ID NO: 458623 - DNA, 20 bp, mouse
gagatgcccagctcaggctg

SEQ ID NO: 458624 - DNA, 20 bp, mouse
gtccaagtggcctctgtgct

SEQ ID NO: 458625 - DNA, 20 bp, mouse
gccagtgaaaaggaggtgat

SEQ ID NO: 458626 - DNA, 20 bp, mouse
ggacctgaacagcctctttg

SEQ ID NO: 458627 - DNA, 20 bp, mouse
gctccccaaagaggctgttc

SEQ ID NO: 458628 - DNA, 20 bp, mouse
gatttcaagaccagggttga

SEQ ID NO: 458629 - DNA, 20 bp, mouse
gctgatggagctcagagcag

SEQ ID NO: 458630 - DNA, 20 bp, mouse
gtgttcaggtccatcaaccc

SEQ ID NO: 458631 - DNA, 20 bp, mouse
ggagcttgatttcaagacca

SEQ ID NO: 458632 - DNA, 20 bp, mouse
gccctctccctcccccaagt

SEQ ID NO: 458633 - DNA, 20 bp, mouse
gctgtctgcaaaccccagga

SEQ ID NO: 458634 - DNA, 20 bp, mouse
ggagcacagaggctacttga

SEQ ID NO: 458635 - DNA, 20 bp, mouse
gtgggagagcagggaagatg

SEQ ID NO: 458636 - DNA, 20 bp, mouse
gctgatggagctcagagcag

SEQ ID NO: 458637 - DNA, 20 bp, mouse
gctggggtttgcagacagga

SEQ ID NO: 458638 - DNA, 20 bp, mouse
gctgtctgcaaaccccagga

SEQ ID NO: 458639 - DNA, 20 bp, mouse
gatgcttcctgggaatctga

SEQ ID NO: 458640 - DNA, 20 bp, mouse
ggtactcagagatgcttcct

SEQ ID NO: 458641 - DNA, 20 bp, mouse
gtgggagagcagggaagatg

SEQ ID NO: 458642 - DNA, 20 bp, mouse
ggagcacagaggctacttga

SEQ ID NO: 458643 - DNA, 20 bp, mouse
gccagtgagaaggtggggat

SEQ ID NO: 458644 - DNA, 20 bp, mouse
gaagagccagtgagaaggtg

SEQ ID NO: 458645 - DNA, 20 bp, mouse
gaggaaggaaagagatgggt

SEQ ID NO: 458646 - DNA, 20 bp, mouse
gtccagaaactactaaccat

SEQ ID NO: 458647 - DNA, 20 bp, mouse
gaccatccaagtaccttgta

SEQ ID NO: 458648 - DNA, 20 bp, mouse
gactgagcaagaaggcccat

SEQ ID NO: 458649 - DNA, 20 bp, mouse
ggccctacaaggtacttgga

SEQ ID NO: 458650 - DNA, 20 bp, mouse
gcatctgaaggtaggaagaa

SEQ ID NO: 458651 - DNA, 20 bp, mouse
ggtacttggatggtatctct

SEQ ID NO: 458652 - DNA, 20 bp, mouse
gtacagggcagtctgctgag

SEQ ID NO: 458653 - DNA, 20 bp, mouse
gcaaatctcaggctgtagaa

SEQ ID NO: 458654 - DNA, 20 bp, mouse
gatggtgcccccaaagccag

SEQ ID NO: 458655 - DNA, 20 bp, mouse
gttttttatttagccctaca

SEQ ID NO: 458656 - DNA, 20 bp, mouse
gagagtgaggacctcaacaa

SEQ ID NO: 458657 - DNA, 20 bp, mouse
gtaagcctgacccgatttgc

SEQ ID NO: 458658 - DNA, 20 bp, mouse
gcccatcaccgccctttcac

SEQ ID NO: 458659 - DNA, 20 bp, mouse
gtcatagttcacctttgttg

SEQ ID NO: 458660 - DNA, 20 bp, mouse
gaccagtgaaagggcggtga

SEQ ID NO: 458661 - DNA, 20 bp, mouse
gttagtatagaattgagcaa

SEQ ID NO: 458662 - DNA, 20 bp, mouse
gggcatgtcatcctaacaaa

SEQ ID NO: 458663 - DNA, 20 bp, mouse
gagatagtaacccttttgtt

SEQ ID NO: 458664 - DNA, 20 bp, mouse
gacctagtctcctcctcttc

SEQ ID NO: 458665 - DNA, 20 bp, mouse
gaggagcagacagaacacag

SEQ ID NO: 458666 - DNA, 20 bp, mouse
gtaacaatagcgttactgtc

SEQ ID NO: 458667 - DNA, 20 bp, mouse
ggtgggagagcagggaagtt

SEQ ID NO: 458668 - DNA, 20 bp, mouse
gtttcctgtgcaggtagaac

SEQ ID NO: 458669 - DNA, 20 bp, mouse
ggggcatcttatgaggcact

SEQ ID NO: 458670 - DNA, 20 bp, mouse
gaggagcagaccgagcacag

SEQ ID NO: 458671 - DNA, 20 bp, mouse
gactcaaccagaagaggagg

SEQ ID NO: 458672 - DNA, 20 bp, mouse
gtccaagtggcctctgtgct

SEQ ID NO: 458673 - DNA, 20 bp, mouse
gccagtgaaaaggaggtgat

SEQ ID NO: 458674 - DNA, 20 bp, mouse
gacatgtctcagcctgagct

SEQ ID NO: 458675 - DNA, 20 bp, mouse
gctttgccctgtgaatttga

SEQ ID NO: 458676 - DNA, 20 bp, mouse
gccacaggccgaggcgggaa

SEQ ID NO: 458677 - DNA, 20 bp, mouse
gtacagaagcccacaggccg

SEQ ID NO: 458678 - DNA, 20 bp, mouse
gtccagaggggggcatctgg

SEQ ID NO: 458679 - DNA, 20 bp, mouse
gggtcctgcgagtttagcca

SEQ ID NO: 458680 - DNA, 20 bp, mouse
gagaagcccacaggccgagg

SEQ ID NO: 458681 - DNA, 20 bp, mouse
gtataagacaatccagaggg

SEQ ID NO: 458682 - DNA, 20 bp, mouse
ggcgccatggctaaactcgc

SEQ ID NO: 458683 - DNA, 20 bp, mouse
ggcctccagatgcccccctc

SEQ ID NO: 458684 - DNA, 20 bp, mouse
ggcttctgtagtgatcctga

SEQ ID NO: 458685 - DNA, 20 bp, mouse
gaagccagcttgaaagtcag

SEQ ID NO: 458686 - DNA, 20 bp, mouse
gctcgtgagagaaggtgccg

SEQ ID NO: 458687 - DNA, 20 bp, mouse
ggtgagagaaggtgccgggg

SEQ ID NO: 458688 - DNA, 20 bp, mouse
gagcagtagatgccacggag

SEQ ID NO: 458689 - DNA, 20 bp, mouse
gctacagccattccagctgt

SEQ ID NO: 458690 - DNA, 20 bp, mouse
gaaggcaacaaggcgagttc

SEQ ID NO: 458691 - DNA, 20 bp, mouse
ggagaaggtgccggggtgga

SEQ ID NO: 458692 - DNA, 20 bp, mouse
gtgccacggagaggcagtca

SEQ ID NO: 458693 - DNA, 20 bp, mouse
gattcgctgctcgtgagaga

SEQ ID NO: 458694 - DNA, 20 bp, mouse
ggaggctccggagaagggtg

SEQ ID NO: 458695 - DNA, 20 bp, mouse
gagaagaggaagaacacaac

SEQ ID NO: 458696 - DNA, 20 bp, mouse
gagggacctagcctggaaca

SEQ ID NO: 458697 - DNA, 20 bp, mouse
ggtagatgcctgttcctgag

SEQ ID NO: 458698 - DNA, 20 bp, mouse
ggggtgaagaggtacaggag

SEQ ID NO: 458699 - DNA, 20 bp, mouse
ggacctagcctggaacaggg

SEQ ID NO: 458700 - DNA, 20 bp, mouse
gagggataaaagagtcccag

SEQ ID NO: 458701 - DNA, 20 bp, mouse
gggcacctcctctcaggaac

SEQ ID NO: 458702 - DNA, 20 bp, mouse
gatctcaagacactggacag

SEQ ID NO: 458703 - DNA, 20 bp, mouse
gatgttgggtgaagaggtac

SEQ ID NO: 458704 - DNA, 20 bp, mouse
gagtggagaagaagatgaat

SEQ ID NO: 458705 - DNA, 20 bp, mouse
gacagggagggtaaaactca

SEQ ID NO: 458706 - DNA, 20 bp, mouse
gaaggtgcctggctaagagt

SEQ ID NO: 458707 - DNA, 20 bp, mouse
gctaaaggaaggagaaccgt

SEQ ID NO: 458708 - DNA, 20 bp, mouse
gagaactctaagcctgaacc

SEQ ID NO: 458709 - DNA, 20 bp, mouse
ggaaataagcagccaggttc

SEQ ID NO: 458710 - DNA, 20 bp, mouse
gactcactgttcctgagaga

SEQ ID NO: 458711 - DNA, 20 bp, mouse
gaggaacagtgagtttccca

SEQ ID NO: 458712 - DNA, 20 bp, mouse
gatggacagacagtgagact

SEQ ID NO: 458713 - DNA, 20 bp, mouse
ggaaataggcagtaatatgg

SEQ ID NO: 458714 - DNA, 20 bp, mouse
gttgtaggaggagagatcca

SEQ ID NO: 458715 - DNA, 20 bp, mouse
gccaactgtggcatcctgtg

SEQ ID NO: 458716 - DNA, 20 bp, mouse
gttgggctctgaggcaagac

SEQ ID NO: 458717 - DNA, 20 bp, mouse
ggaaactggagagtagagca

SEQ ID NO: 458718 - DNA, 20 bp, mouse
gacaagagctgttgaagtct

SEQ ID NO: 458719 - DNA, 20 bp, mouse
gtaaatgcttttcacaggac

SEQ ID NO: 458720 - DNA, 20 bp, mouse
gcagtgttggggtggctcca

SEQ ID NO: 458721 - DNA, 20 bp, mouse
gggatgagtttatcagtgtt

SEQ ID NO: 458722 - DNA, 20 bp, mouse
gacaagtgagcctgggttcc

SEQ ID NO: 458723 - DNA, 20 bp, mouse
ggagtttatcagtgttgggg

SEQ ID NO: 458724 - DNA, 20 bp, mouse
ggctgcttggagtggcttcc

SEQ ID NO: 458725 - DNA, 20 bp, mouse
ggagctgttgaagtctggga

SEQ ID NO: 458726 - DNA, 20 bp, mouse
ggaaggcccctactgaacag

SEQ ID NO: 458727 - DNA, 20 bp, mouse
gtacggagagacagagaatc

SEQ ID NO: 458728 - DNA, 20 bp, mouse
ggagggctctgggccaccga

SEQ ID NO: 458729 - DNA, 20 bp, mouse
gagaaacgtccgctcttccc

SEQ ID NO: 458730 - DNA, 20 bp, mouse
gctctgggccaccgagggat

SEQ ID NO: 458731 - DNA, 20 bp, mouse
gagacagaggtggccctcca

SEQ ID NO: 458732 - DNA, 20 bp, mouse
gtgcagaagttgccatggga

SEQ ID NO: 458733 - DNA, 20 bp, mouse
gttggcctagactgaagcac

SEQ ID NO: 458734 - DNA, 20 bp, mouse
gaaagggacacccagggcta

SEQ ID NO: 458735 - DNA, 20 bp, mouse
gacttagaggactagaacac

SEQ ID NO: 458736 - DNA, 20 bp, mouse
ggaaggggagagacagacct

SEQ ID NO: 458737 - DNA, 20 bp, mouse
ggagagaaggtaccagacta

SEQ ID NO: 458738 - DNA, 20 bp, mouse
gtaggacctctcagccccaa

SEQ ID NO: 458739 - DNA, 20 bp, mouse
gtctatgggaggaggcaagg

SEQ ID NO: 458740 - DNA, 20 bp, mouse
ggagacccagggcaatctat

SEQ ID NO: 458741 - DNA, 20 bp, mouse
gtaccagactagggccattg

SEQ ID NO: 458742 - DNA, 20 bp, mouse
gagccccaatggccctagtc

SEQ ID NO: 458743 - DNA, 20 bp, mouse
gtagggccattggggctgag

SEQ ID NO: 458744 - DNA, 20 bp, mouse
gacccagggcaatctatggg

SEQ ID NO: 458745 - DNA, 20 bp, mouse
gggggcacctagagaagtct

SEQ ID NO: 458746 - DNA, 20 bp, mouse
gagagcggcaggctgagacc

SEQ ID NO: 458747 - DNA, 20 bp, mouse
ggggcggggcgaacatcagt

SEQ ID NO: 458748 - DNA, 20 bp, mouse
gccgctaaggccacagtcgc

SEQ ID NO: 458749 - DNA, 20 bp, mouse
ggactgcactgtcaaagaag

SEQ ID NO: 458750 - DNA, 20 bp, mouse
ggatctggatcgagagcggc

SEQ ID NO: 458751 - DNA, 20 bp, mouse
gcgggttgtagaaagagagg

SEQ ID NO: 458752 - DNA, 20 bp, mouse
gtgtgtgggtccagcgactg

SEQ ID NO: 458753 - DNA, 20 bp, mouse
gactgtcaaagaagcggatc

SEQ ID NO: 458754 - DNA, 20 bp, mouse
ggaccccacgaccagtgatg

SEQ ID NO: 458755 - DNA, 20 bp, mouse
gtcagcccggcaggtttaaa

SEQ ID NO: 458756 - DNA, 20 bp, mouse
gctgggcatgaggccaagaa

SEQ ID NO: 458757 - DNA, 20 bp, mouse
ggagagaaggtgccaagcta

SEQ ID NO: 458758 - DNA, 20 bp, mouse
gtagggaaagtggagctcca

SEQ ID NO: 458759 - DNA, 20 bp, mouse
gtggcaccttctctcaggag

SEQ ID NO: 458760 - DNA, 20 bp, mouse
gaccacaccagacatgatca

SEQ ID NO: 458761 - DNA, 20 bp, mouse
ggagctccagggtactatcc

SEQ ID NO: 458762 - DNA, 20 bp, mouse
gggtagtggaaacccaatgt

SEQ ID NO: 458763 - DNA, 20 bp, mouse
gtgtcagatctgggaaggtt

SEQ ID NO: 458764 - DNA, 20 bp, mouse
gatcagggctctctcaaacc

SEQ ID NO: 458765 - DNA, 20 bp, mouse
gtcaaaccaggatagtaccc

SEQ ID NO: 458766 - DNA, 20 bp, mouse
gtcaggaaaaagaacccccg

SEQ ID NO: 458767 - DNA, 20 bp, mouse
ggaggacctggtgtgccccg

SEQ ID NO: 458768 - DNA, 20 bp, mouse
gagaacccccggggcacacc

SEQ ID NO: 458769 - DNA, 20 bp, mouse
gtcgctgccgggtgcagagg

SEQ ID NO: 458770 - DNA, 20 bp, mouse
gttcgggaactccaagctcc

SEQ ID NO: 458771 - DNA, 20 bp, mouse
gaggagggagggacaaattc

SEQ ID NO: 458772 - DNA, 20 bp, mouse
gaactccaagctcccggctc

SEQ ID NO: 458773 - DNA, 20 bp, mouse
gctctcagatcttccagctc

SEQ ID NO: 458774 - DNA, 20 bp, mouse
ggcgtgtcccaccaaggggt

SEQ ID NO: 458775 - DNA, 20 bp, mouse
ggcgtctgcaccacgccctg

SEQ ID NO: 458776 - DNA, 20 bp, mouse
gtgggtggaggatatggtag

SEQ ID NO: 458777 - DNA, 20 bp, mouse
ggtggaggatatggtagtgg

SEQ ID NO: 458778 - DNA, 20 bp, mouse
ggttcacgccagctccgggc

SEQ ID NO: 458779 - DNA, 20 bp, mouse
gcttttcggcgggcagtggg

SEQ ID NO: 458780 - DNA, 20 bp, mouse
gggccatgaagctctacctg

SEQ ID NO: 458781 - DNA, 20 bp, mouse
gagcgagctcagagtgatgg

SEQ ID NO: 458782 - DNA, 20 bp, mouse
gtcctggctggagactcgtt

SEQ ID NO: 458783 - DNA, 20 bp, mouse
gacaccagaaggtagatgga

SEQ ID NO: 458784 - DNA, 20 bp, mouse
gctctgagctcgcttttcgg

SEQ ID NO: 458785 - DNA, 20 bp, mouse
gcagagtgatggaggcctcc

SEQ ID NO: 458786 - DNA, 20 bp, mouse
ggaagccggcagatagaagt

SEQ ID NO: 458787 - DNA, 20 bp, mouse
gccggcagatagaagtcggg

SEQ ID NO: 458788 - DNA, 20 bp, mouse
ggagacggaacaggtagacg

SEQ ID NO: 458789 - DNA, 20 bp, mouse
ggcccacggcgagacggaac

SEQ ID NO: 458790 - DNA, 20 bp, mouse
gagactaagccatcaggccg

SEQ ID NO: 458791 - DNA, 20 bp, mouse
gtggcgcgcgagctgtctgt

SEQ ID NO: 458792 - DNA, 20 bp, mouse
ggatccgcccggtaggctgg

SEQ ID NO: 458793 - DNA, 20 bp, mouse
gtcgcttcgatccgcccggt

SEQ ID NO: 458794 - DNA, 20 bp, mouse
ggactcggtgaagaaagtga

SEQ ID NO: 458795 - DNA, 20 bp, mouse
gcggcccccagcctaccggg

SEQ ID NO: 458796 - DNA, 20 bp, mouse
gaagcaggaaaacgtcccaa

SEQ ID NO: 458797 - DNA, 20 bp, mouse
gcaagacggtccagaaactg

SEQ ID NO: 458798 - DNA, 20 bp, mouse
gtaagcacagattctcccct

SEQ ID NO: 458799 - DNA, 20 bp, mouse
ggatgactgcacacttgctt

SEQ ID NO: 458800 - DNA, 20 bp, mouse
gttgatctgggggattgctg

SEQ ID NO: 458801 - DNA, 20 bp, mouse
gtgaatgtgaatatgctaag

SEQ ID NO: 458802 - DNA, 20 bp, mouse
gtgagcatttctttgatctg

SEQ ID NO: 458803 - DNA, 20 bp, mouse
gacaagatctgcattaccag

SEQ ID NO: 458804 - DNA, 20 bp, mouse
gggtagtgagctgttgcata

SEQ ID NO: 458805 - DNA, 20 bp, mouse
gatattactcttctcagctt

SEQ ID NO: 458806 - DNA, 20 bp, mouse
ggccctctcttctagaccag

SEQ ID NO: 458807 - DNA, 20 bp, mouse
gaacagggccgagagcagta

SEQ ID NO: 458808 - DNA, 20 bp, mouse
gtcttctagaccagaggctg

SEQ ID NO: 458809 - DNA, 20 bp, mouse
ggcgggcaggccacagcctc

SEQ ID NO: 458810 - DNA, 20 bp, mouse
gacgagctggcggctctgta

SEQ ID NO: 458811 - DNA, 20 bp, mouse
ggcggctctgtagggagcga

SEQ ID NO: 458812 - DNA, 20 bp, mouse
gcctggcgaggcggcatcta

SEQ ID NO: 458813 - DNA, 20 bp, mouse
ggacattctgctctgtgcag

SEQ ID NO: 458814 - DNA, 20 bp, mouse
gtggctggccacgcatgcgt

SEQ ID NO: 458815 - DNA, 20 bp, mouse
gcctggtgcgccgggtaagg

SEQ ID NO: 458816 - DNA, 20 bp, mouse
ggcgctgtagagctgacaag

SEQ ID NO: 458817 - DNA, 20 bp, mouse
gacaccacagcgtcatggct

SEQ ID NO: 458818 - DNA, 20 bp, mouse
ggtgctaggagccctgctca

SEQ ID NO: 458819 - DNA, 20 bp, mouse
ggtcatggctaggctccagc

SEQ ID NO: 458820 - DNA, 20 bp, mouse
gactgtacaccacagcgtca

SEQ ID NO: 458821 - DNA, 20 bp, mouse
gcatcccacaaccgtgagca

SEQ ID NO: 458822 - DNA, 20 bp, mouse
gccatggagtgacccagcca

SEQ ID NO: 458823 - DNA, 20 bp, mouse
gtcttcacggtgcagctggg

SEQ ID NO: 458824 - DNA, 20 bp, mouse
ggagccctgctcacggttgt

SEQ ID NO: 458825 - DNA, 20 bp, mouse
gtgtccagaggtggctccca

SEQ ID NO: 458826 - DNA, 20 bp, mouse
ggagctcttgggccagtctc

SEQ ID NO: 458827 - DNA, 20 bp, mouse
gctgaaagaactagtcataa

SEQ ID NO: 458828 - DNA, 20 bp, mouse
gaagagtgtgaagatctctt

SEQ ID NO: 458829 - DNA, 20 bp, mouse
ggatggggattcatgtgaag

SEQ ID NO: 458830 - DNA, 20 bp, mouse
gttaaaggtgagagatccca

SEQ ID NO: 458831 - DNA, 20 bp, mouse
gttcgaaattttggcagcag

SEQ ID NO: 458832 - DNA, 20 bp, mouse
gactggtctagcgcagcagc

SEQ ID NO: 458833 - DNA, 20 bp, mouse
gttctcaagcttcgaaattt

SEQ ID NO: 458834 - DNA, 20 bp, mouse
gggagggaatgaacttacct

SEQ ID NO: 458835 - DNA, 20 bp, mouse
ggactagttctttcagatta

SEQ ID NO: 458836 - DNA, 20 bp, mouse
gtggaggaagagccccagta

SEQ ID NO: 458837 - DNA, 20 bp, mouse
gcagcagcagtagtcggctc

SEQ ID NO: 458838 - DNA, 20 bp, mouse
gtggccacacgtgccatact

SEQ ID NO: 458839 - DNA, 20 bp, mouse
gagcagcaagatccaagcag

SEQ ID NO: 458840 - DNA, 20 bp, mouse
ggtcggctcaggcgctctct

SEQ ID NO: 458841 - DNA, 20 bp, mouse
ggcgtcaacaggcatcgaaa

SEQ ID NO: 458842 - DNA, 20 bp, mouse
gggaatcgtagagcttccta

SEQ ID NO: 458843 - DNA, 20 bp, mouse
gtcagagctctggggccagt

SEQ ID NO: 458844 - DNA, 20 bp, mouse
ggggaagagagggcgtcaac

SEQ ID NO: 458845 - DNA, 20 bp, mouse
gtggagcctaggagctgacc

SEQ ID NO: 458846 - DNA, 20 bp, mouse
gtccaagccaaagaaatgta

SEQ ID NO: 458847 - DNA, 20 bp, mouse
gtgctgcaaaagttgtggtg

SEQ ID NO: 458848 - DNA, 20 bp, mouse
gggatggggatttgtgaaaa

SEQ ID NO: 458849 - DNA, 20 bp, mouse
gaggaagccttacatttctt

SEQ ID NO: 458850 - DNA, 20 bp, mouse
gtacatgggaaatttatagc

SEQ ID NO: 458851 - DNA, 20 bp, mouse
ggccttacatttctttggct

SEQ ID NO: 458852 - DNA, 20 bp, mouse
gttggatgttgctcgtgcat

SEQ ID NO: 458853 - DNA, 20 bp, mouse
gggaaagagagtttttcaac

SEQ ID NO: 458854 - DNA, 20 bp, mouse
gtgaaggaagagcaccagta

SEQ ID NO: 458855 - DNA, 20 bp, mouse
ggtgcataggcagtaggctt

SEQ ID NO: 458856 - DNA, 20 bp, mouse
gtggaagaaagatataatat

SEQ ID NO: 458857 - DNA, 20 bp, mouse
gggtggggattcatgaaaag

SEQ ID NO: 458858 - DNA, 20 bp, mouse
gtaagcctactgcctatgca

SEQ ID NO: 458859 - DNA, 20 bp, mouse
gagaaagatataatatgggt

SEQ ID NO: 458860 - DNA, 20 bp, mouse
gactttacatttcttcagct

SEQ ID NO: 458861 - DNA, 20 bp, mouse
gtgctacaaatgttgtgatg

SEQ ID NO: 458862 - DNA, 20 bp, mouse
gtgggatgttgcccgtgcat

SEQ ID NO: 458863 - DNA, 20 bp, mouse
gagcaccagtatggcacatg

SEQ ID NO: 458864 - DNA, 20 bp, mouse
ggaaatttatagcagacctg

SEQ ID NO: 458865 - DNA, 20 bp, mouse
gaatgttgtgatgaggtgag

SEQ ID NO: 458866 - DNA, 20 bp, mouse
ggatggcgattcgtgtaaag

SEQ ID NO: 458867 - DNA, 20 bp, mouse
ggtaggcccgagaacgtctt

SEQ ID NO: 458868 - DNA, 20 bp, mouse
gttattcgttctcgttcctg

SEQ ID NO: 458869 - DNA, 20 bp, mouse
gatgtactttttctataaga

SEQ ID NO: 458870 - DNA, 20 bp, mouse
gagcttcgatcttttggcag

SEQ ID NO: 458871 - DNA, 20 bp, mouse
gctttcccctaagacgttct

SEQ ID NO: 458872 - DNA, 20 bp, mouse
ggctcattcactcccttctt

SEQ ID NO: 458873 - DNA, 20 bp, mouse
gcgaataaaagaatgaatta

SEQ ID NO: 458874 - DNA, 20 bp, mouse
gtatagaaaaagtacattta

SEQ ID NO: 458875 - DNA, 20 bp, mouse
gagctccgctatggctcggg

SEQ ID NO: 458876 - DNA, 20 bp, mouse
gtgccgcagctctagacccg

SEQ ID NO: 458877 - DNA, 20 bp, mouse
gtaaaggggtagaggtagat

SEQ ID NO: 458878 - DNA, 20 bp, mouse
ggatgaggattcatgtaaag

SEQ ID NO: 458879 - DNA, 20 bp, mouse
ggattcatgtaaaggggtag

SEQ ID NO: 458880 - DNA, 20 bp, mouse
gcgtagcagaattacattta

SEQ ID NO: 458881 - DNA, 20 bp, mouse
gagcttgaatcttttggcgg

SEQ ID NO: 458882 - DNA, 20 bp, mouse
gatcttttggcggcggtctt

SEQ ID NO: 458883 - DNA, 20 bp, mouse
ggggggaacaatcacttaga

SEQ ID NO: 458884 - DNA, 20 bp, mouse
ggtccacgggtctagagctg

SEQ ID NO: 458885 - DNA, 20 bp, mouse
gatcacttagaaggagaatt

SEQ ID NO: 458886 - DNA, 20 bp, mouse
ggaacgaagacagcaacaac

SEQ ID NO: 458887 - DNA, 20 bp, mouse
gcggagccaggtctctgtcg

SEQ ID NO: 458888 - DNA, 20 bp, mouse
gggtctctgtcgaggtatgg

SEQ ID NO: 458889 - DNA, 20 bp, mouse
gcggttcgatcagctcccgt

SEQ ID NO: 458890 - DNA, 20 bp, mouse
gccaggtctctgtcgaggta

SEQ ID NO: 458891 - DNA, 20 bp, mouse
gacagagacctggctccgaa

SEQ ID NO: 458892 - DNA, 20 bp, mouse
gcaactcctagactccgaat

SEQ ID NO: 458893 - DNA, 20 bp, mouse
gttggctccaaaggttcagt

SEQ ID NO: 458894 - DNA, 20 bp, mouse
ggccaatgtgtctgagccag

SEQ ID NO: 458895 - DNA, 20 bp, mouse
gcattaaagattacgaagaa

SEQ ID NO: 458896 - DNA, 20 bp, mouse
gctcgaggtgctggcggagg

SEQ ID NO: 458897 - DNA, 20 bp, mouse
ggattgcaggcgcttctctg

SEQ ID NO: 458898 - DNA, 20 bp, mouse
ggaggaggcgcagagattgc

SEQ ID NO: 458899 - DNA, 20 bp, mouse
gccttctctcgaggtgctgg

SEQ ID NO: 458900 - DNA, 20 bp, mouse
gatgcgcccggagtgcggtg

SEQ ID NO: 458901 - DNA, 20 bp, mouse
gtcccaggaagaggccccct

SEQ ID NO: 458902 - DNA, 20 bp, mouse
gggcgggtgtccttctctcg

SEQ ID NO: 458903 - DNA, 20 bp, mouse
gtggcgcgcaggaggaaccg

SEQ ID NO: 458904 - DNA, 20 bp, mouse
gagtctggtcaagtggagaa

SEQ ID NO: 458905 - DNA, 20 bp, mouse
gtctggggcgctctcgctca

SEQ ID NO: 458906 - DNA, 20 bp, mouse
ggcagagacaaggtgagagg

SEQ ID NO: 458907 - DNA, 20 bp, mouse
gaggcccatggagcacgggt

SEQ ID NO: 458908 - DNA, 20 bp, mouse
gagagagaatgtccaaggga

SEQ ID NO: 458909 - DNA, 20 bp, mouse
gactggtggaagggaagtca

SEQ ID NO: 458910 - DNA, 20 bp, mouse
ggccggagtgagaggttgag

SEQ ID NO: 458911 - DNA, 20 bp, mouse
gggagtcatgctgggagcaa

SEQ ID NO: 458912 - DNA, 20 bp, mouse
gtcgttggggcttcaggtac

SEQ ID NO: 458913 - DNA, 20 bp, mouse
gtgcagagtggatagactgg

SEQ ID NO: 458914 - DNA, 20 bp, mouse
gactccctgggagactctca

SEQ ID NO: 458915 - DNA, 20 bp, mouse
gcacgggtgggagtcatgct

SEQ ID NO: 458916 - DNA, 20 bp, mouse
gtgctctgaggtgggaagta

SEQ ID NO: 458917 - DNA, 20 bp, mouse
ggcagctgcatgacttcctg

SEQ ID NO: 458918 - DNA, 20 bp, mouse
gctactgcaatagaatcctc

SEQ ID NO: 458919 - DNA, 20 bp, mouse
gaagaagagtcgaggtctat

SEQ ID NO: 458920 - DNA, 20 bp, mouse
gaactctggcggggttgaag

SEQ ID NO: 458921 - DNA, 20 bp, mouse
gaaccagggaagccaaactc

SEQ ID NO: 458922 - DNA, 20 bp, mouse
gtggcctgacctctctcctc

SEQ ID NO: 458923 - DNA, 20 bp, mouse
gaggagccctgtgaatggag

SEQ ID NO: 458924 - DNA, 20 bp, mouse
gttgagaagtactaagaaac

SEQ ID NO: 458925 - DNA, 20 bp, mouse
gatggtccactccattcaca

SEQ ID NO: 458926 - DNA, 20 bp, mouse
gcagacgccagggcgaccga

SEQ ID NO: 458927 - DNA, 20 bp, mouse
gccagggcgaccgaaggcag

SEQ ID NO: 458928 - DNA, 20 bp, mouse
gggagtcagagcagacgcca

SEQ ID NO: 458929 - DNA, 20 bp, mouse
gcgaccgaaggcagaggcac

SEQ ID NO: 458930 - DNA, 20 bp, mouse
gaaacaagctgcattctatg

SEQ ID NO: 458931 - DNA, 20 bp, mouse
gtgacaatcaagccttgtgg

SEQ ID NO: 458932 - DNA, 20 bp, mouse
gttctatggggcgagaagcc

SEQ ID NO: 458933 - DNA, 20 bp, mouse
gttgaggatgagtacaggaa

SEQ ID NO: 458934 - DNA, 20 bp, mouse
gtccagtttaccacataaga

SEQ ID NO: 458935 - DNA, 20 bp, mouse
ggtgctttgaggatgagtac

SEQ ID NO: 458936 - DNA, 20 bp, mouse
gcagtggctcgcgacaggtg

SEQ ID NO: 458937 - DNA, 20 bp, mouse
ggcgagccactgagccgcag

SEQ ID NO: 458938 - DNA, 20 bp, mouse
gcgactgaagaagactggac

SEQ ID NO: 458939 - DNA, 20 bp, mouse
gaggaggctcgggtgacgtc

SEQ ID NO: 458940 - DNA, 20 bp, mouse
gcggctcagtggctcgcgac

SEQ ID NO: 458941 - DNA, 20 bp, mouse
gcgtcccgactgaagaagac

SEQ ID NO: 458942 - DNA, 20 bp, mouse
gtcgggacggggtcagcgag

SEQ ID NO: 458943 - DNA, 20 bp, mouse
ggacgtcaggcgcgccgctg

SEQ ID NO: 458944 - DNA, 20 bp, mouse
ggctggctgggaccgcggag

SEQ ID NO: 458945 - DNA, 20 bp, mouse
ggctgcttcgtggagcagag

SEQ ID NO: 458946 - DNA, 20 bp, mouse
gcctgtggcgagctggtgtc

SEQ ID NO: 458947 - DNA, 20 bp, mouse
gctggtgtctggcaggacgc

SEQ ID NO: 458948 - DNA, 20 bp, mouse
gcggcagtgcgagggcccgg

SEQ ID NO: 458949 - DNA, 20 bp, mouse
ggagccggtcgccagcacca

SEQ ID NO: 458950 - DNA, 20 bp, mouse
gtggcgagctggtgtctggc

SEQ ID NO: 458951 - DNA, 20 bp, mouse
gcaggcggaagctcacgaag

SEQ ID NO: 458952 - DNA, 20 bp, mouse
ggcctggagggtcacggcag

SEQ ID NO: 458953 - DNA, 20 bp, mouse
gctcaggccctcgagcgtct

SEQ ID NO: 458954 - DNA, 20 bp, mouse
ggagggcctgagggtcgccg

SEQ ID NO: 458955 - DNA, 20 bp, mouse
gtagctgtcatcgtcctcca

SEQ ID NO: 458956 - DNA, 20 bp, mouse
gctgaggacgggcgctgagg

SEQ ID NO: 458957 - DNA, 20 bp, mouse
gcgggcggttgggccgtgaa

SEQ ID NO: 458958 - DNA, 20 bp, mouse
ggcgctgaggacgggcgctg

SEQ ID NO: 458959 - DNA, 20 bp, mouse
gagccccgccgcggacagca

SEQ ID NO: 458960 - DNA, 20 bp, mouse
gtcttttcggcgctgaggac

SEQ ID NO: 458961 - DNA, 20 bp, mouse
ggagcccgctcaaacgcccc

SEQ ID NO: 458962 - DNA, 20 bp, mouse
gggctcctggggcgtttgag

SEQ ID NO: 458963 - DNA, 20 bp, mouse
ggctacggcagcaggaccct

SEQ ID NO: 458964 - DNA, 20 bp, mouse
ggccactgccctgctgtccg

SEQ ID NO: 458965 - DNA, 20 bp, mouse
gggaggacggtgtctacggt

SEQ ID NO: 458966 - DNA, 20 bp, mouse
gacgccgggactaagagaag

SEQ ID NO: 458967 - DNA, 20 bp, mouse
gaagtggtcgcggggagaac

SEQ ID NO: 458968 - DNA, 20 bp, mouse
gcgctcgctgaggagctctc

SEQ ID NO: 458969 - DNA, 20 bp, mouse
gggagccggcgggagcgact

SEQ ID NO: 458970 - DNA, 20 bp, mouse
gtccgcccggccctccgtgg

SEQ ID NO: 458971 - DNA, 20 bp, mouse
gggaggcccggccgcgaccc

SEQ ID NO: 458972 - DNA, 20 bp, mouse
gtcctcagcgagcgcggccc

SEQ ID NO: 458973 - DNA, 20 bp, mouse
gggactaagagaagtggtcg

SEQ ID NO: 458974 - DNA, 20 bp, mouse
gcgcggccgggcctccacgg

SEQ ID NO: 458975 - DNA, 20 bp, mouse
ggagcgactgggctgaacgc

SEQ ID NO: 458976 - DNA, 20 bp, mouse
ggctgggccacctttcccct

SEQ ID NO: 458977 - DNA, 20 bp, mouse
gccaggcctcggggtcccac

SEQ ID NO: 458978 - DNA, 20 bp, mouse
gtttcccctgggcttcagaa

SEQ ID NO: 458979 - DNA, 20 bp, mouse
ggctggcaaggcaagcagct

SEQ ID NO: 458980 - DNA, 20 bp, mouse
gtagccaagaggaccagtca

SEQ ID NO: 458981 - DNA, 20 bp, mouse
gtgtcacacaggtaagcgat

SEQ ID NO: 458982 - DNA, 20 bp, mouse
ggagggaaggccccccataa

SEQ ID NO: 458983 - DNA, 20 bp, mouse
gaaactccatgtgcagaggt

SEQ ID NO: 458984 - DNA, 20 bp, mouse
gtcatagtgcagagcccagg

SEQ ID NO: 458985 - DNA, 20 bp, mouse
gacatccattctgaagccca

SEQ ID NO: 458986 - DNA, 20 bp, mouse
gaggccagggaaccatgtgt

SEQ ID NO: 458987 - DNA, 20 bp, mouse
gcctccctcctgcaaggcca

SEQ ID NO: 458988 - DNA, 20 bp, mouse
ggttccctggccttgcagga

SEQ ID NO: 458989 - DNA, 20 bp, mouse
ggattaatcccgccaacaca

SEQ ID NO: 458990 - DNA, 20 bp, mouse
gccggggacgaaagcaggta

SEQ ID NO: 458991 - DNA, 20 bp, mouse
gccagggaaccatgtgttgg

SEQ ID NO: 458992 - DNA, 20 bp, mouse
gtggcccgtgaggacggagt

SEQ ID NO: 458993 - DNA, 20 bp, mouse
gctcacgggccagctcacga

SEQ ID NO: 458994 - DNA, 20 bp, mouse
gtgcagcggcagggcagcaa

SEQ ID NO: 458995 - DNA, 20 bp, mouse
gaggacggagtaggagccgt

SEQ ID NO: 458996 - DNA, 20 bp, mouse
ggggcagctgacccagcagt

SEQ ID NO: 458997 - DNA, 20 bp, mouse
ggcgcggactgtactgccag

SEQ ID NO: 458998 - DNA, 20 bp, mouse
gcatccgagagtagcaggtg

SEQ ID NO: 458999 - DNA, 20 bp, mouse
ggcaacagaggtagtgtctt

SEQ ID NO: 459000 - DNA, 20 bp, mouse
gtgacccagcagtaggcacc

SEQ ID NO: 459001 - DNA, 20 bp, mouse
gatctccctgggtgtgacag

SEQ ID NO: 459002 - DNA, 20 bp, mouse
gaccctgagccgtgagatca

SEQ ID NO: 459003 - DNA, 20 bp, mouse
ggtgcctggtgcctactgct

SEQ ID NO: 459004 - DNA, 20 bp, mouse
ggtcagcatccgagagtagc

SEQ ID NO: 459005 - DNA, 20 bp, mouse
ggaagtctgccatgatctca

SEQ ID NO: 459006 - DNA, 20 bp, mouse
ggccagggcacagcaccttt

SEQ ID NO: 459007 - DNA, 20 bp, mouse
gcccgggtgagctgccgcag

SEQ ID NO: 459008 - DNA, 20 bp, mouse
ggcagaacataaagcccctg

SEQ ID NO: 459009 - DNA, 20 bp, mouse
gcgatgcggaggatacaggg

SEQ ID NO: 459010 - DNA, 20 bp, mouse
gcagcgatgcggaggataca

SEQ ID NO: 459011 - DNA, 20 bp, mouse
ggacagagaccggtagacct

SEQ ID NO: 459012 - DNA, 20 bp, mouse
ggcccaaaggtgctgtgccc

SEQ ID NO: 459013 - DNA, 20 bp, mouse
gagctgccgtttgcttgcca

SEQ ID NO: 459014 - DNA, 20 bp, mouse
gggacagagggtccagccag

SEQ ID NO: 459015 - DNA, 20 bp, mouse
ggtgaaccccagcagcgatg

SEQ ID NO: 459016 - DNA, 20 bp, mouse
ggtgggcagccaccccgcag

SEQ ID NO: 459017 - DNA, 20 bp, mouse
gcggaacagactgtacacct

SEQ ID NO: 459018 - DNA, 20 bp, mouse
gatcggttgtggcaccccgt

SEQ ID NO: 459019 - DNA, 20 bp, mouse
gctcagagggcgacaagccg

SEQ ID NO: 459020 - DNA, 20 bp, mouse
ggaccggcgcgtcaggctct

SEQ ID NO: 459021 - DNA, 20 bp, mouse
gccggctggttccactcaga

SEQ ID NO: 459022 - DNA, 20 bp, mouse
gcagggatgcgaatcggttg

SEQ ID NO: 459023 - DNA, 20 bp, mouse
gagcctgacgcgccggtccc

SEQ ID NO: 459024 - DNA, 20 bp, mouse
gaccttggctgcagccgctg

SEQ ID NO: 459025 - DNA, 20 bp, mouse
gatgcatccggagcagcgag

SEQ ID NO: 459026 - DNA, 20 bp, mouse
gagctcggctgtcccgaggg

SEQ ID NO: 459027 - DNA, 20 bp, mouse
gcagagctcggctgtcccga

SEQ ID NO: 459028 - DNA, 20 bp, mouse
gcgaagggcagcgcagagct

SEQ ID NO: 459029 - DNA, 20 bp, mouse
gggcggacgagacgttgtgg

SEQ ID NO: 459030 - DNA, 20 bp, mouse
gaaactccggcgctgcgcgg

SEQ ID NO: 459031 - DNA, 20 bp, mouse
gcaacgtctcgtccgccctc

SEQ ID NO: 459032 - DNA, 20 bp, mouse
ggcttgcggggcgcagacgc

SEQ ID NO: 459033 - DNA, 20 bp, mouse
ggctccgggctagtgagtag

SEQ ID NO: 459034 - DNA, 20 bp, mouse
gcggcgcaggttcgaaactc

SEQ ID NO: 459035 - DNA, 20 bp, mouse
gcgcaggtgcgcgcgcatca

SEQ ID NO: 459036 - DNA, 20 bp, mouse
ggtcgaggaagggcgcatcc

SEQ ID NO: 459037 - DNA, 20 bp, mouse
gtctgcaaggagcggagctc

SEQ ID NO: 459038 - DNA, 20 bp, mouse
gctttcccaaagcactgtcg

SEQ ID NO: 459039 - DNA, 20 bp, mouse
gagagtagatctgcaaggag

SEQ ID NO: 459040 - DNA, 20 bp, mouse
ggtcgtgccaagccaggtac

SEQ ID NO: 459041 - DNA, 20 bp, mouse
gacagcagagggtagagacg

SEQ ID NO: 459042 - DNA, 20 bp, mouse
gtactgtctggggccctgtt

SEQ ID NO: 459043 - DNA, 20 bp, mouse
gactgcgggcagctgtccta

SEQ ID NO: 459044 - DNA, 20 bp, mouse
gccccgagagtagatctgca

SEQ ID NO: 459045 - DNA, 20 bp, mouse
gcccgggaggctccccgaaa

SEQ ID NO: 459046 - DNA, 20 bp, mouse
gggacgcgcctaggaggcct

SEQ ID NO: 459047 - DNA, 20 bp, mouse
gcgaccccgagatcgcgcag

SEQ ID NO: 459048 - DNA, 20 bp, mouse
ggcggccgccgagagccatg

SEQ ID NO: 459049 - DNA, 20 bp, mouse
ggcctcggcactcgtcccca

SEQ ID NO: 459050 - DNA, 20 bp, mouse
gtcgtccccatggctctcgg

SEQ ID NO: 459051 - DNA, 20 bp, mouse
gagcgggtgtgattcatcag

SEQ ID NO: 459052 - DNA, 20 bp, mouse
gcgcaggggacgcgcctagg

SEQ ID NO: 459053 - DNA, 20 bp, mouse
ggccatggggacgagtgccg

SEQ ID NO: 459054 - DNA, 20 bp, mouse
gtcgcgcaggggacgcgcct

SEQ ID NO: 459055 - DNA, 20 bp, mouse
ggcgatgcgcgggagccgag

SEQ ID NO: 459056 - DNA, 20 bp, mouse
gggcgccaccaaaaccctga

SEQ ID NO: 459057 - DNA, 20 bp, mouse
gcgttctcctgacaccactg

SEQ ID NO: 459058 - DNA, 20 bp, mouse
gctgacggcagccatcacga

SEQ ID NO: 459059 - DNA, 20 bp, mouse
gggctggctgcccttcgtga

SEQ ID NO: 459060 - DNA, 20 bp, mouse
gggctgcggggacctagcaa

SEQ ID NO: 459061 - DNA, 20 bp, mouse
ggtggtatctggagagcggt

SEQ ID NO: 459062 - DNA, 20 bp, mouse
gctcctgacaccactgtggc

SEQ ID NO: 459063 - DNA, 20 bp, mouse
ggagggagcccggtggtatc

SEQ ID NO: 459064 - DNA, 20 bp, mouse
gcaggcgcgaccccgcccca

SEQ ID NO: 459065 - DNA, 20 bp, mouse
ggcaattaccgagggagggg

SEQ ID NO: 459066 - DNA, 20 bp, mouse
gttggaagcatggagttcca

SEQ ID NO: 459067 - DNA, 20 bp, mouse
ggacgaagaaacaccaggac

SEQ ID NO: 459068 - DNA, 20 bp, mouse
gtccagggcgagcgcgggac

SEQ ID NO: 459069 - DNA, 20 bp, mouse
ggcgagcgcgggaccggtcc

SEQ ID NO: 459070 - DNA, 20 bp, mouse
gaagaagcccggatatagga

SEQ ID NO: 459071 - DNA, 20 bp, mouse
gatatccgggcttctttcag

SEQ ID NO: 459072 - DNA, 20 bp, mouse
gaccggtcccgcgctcgccc

SEQ ID NO: 459073 - DNA, 20 bp, mouse
gcccgtgccttcctatatcc

SEQ ID NO: 459074 - DNA, 20 bp, mouse
gtggcgctgggttggaagca

SEQ ID NO: 459075 - DNA, 20 bp, mouse
ggacaccgtgacctgcgagc

SEQ ID NO: 459076 - DNA, 20 bp, mouse
gccagcccttagctactcca

SEQ ID NO: 459077 - DNA, 20 bp, mouse
gtggttgggaaggtgttggt

SEQ ID NO: 459078 - DNA, 20 bp, mouse
gcgttccatggagtagctaa

SEQ ID NO: 459079 - DNA, 20 bp, mouse
gttcgcgtctccgaacggtg

SEQ ID NO: 459080 - DNA, 20 bp, mouse
ggaacgggctccgcaccgtt

SEQ ID NO: 459081 - DNA, 20 bp, mouse
gggaacttcgcgtctccgaa

SEQ ID NO: 459082 - DNA, 20 bp, mouse
ggccggaccgagaggtgtgg

SEQ ID NO: 459083 - DNA, 20 bp, mouse
gtggaagaggccggaccgag

SEQ ID NO: 459084 - DNA, 20 bp, mouse
ggaggccggaccgagaggtg

SEQ ID NO: 459085 - DNA, 20 bp, mouse
ggttctaagagtgtgcggcg

SEQ ID NO: 459086 - DNA, 20 bp, mouse
ggcgcttaagccgcaggtag

SEQ ID NO: 459087 - DNA, 20 bp, mouse
gcaaagaaccactagcacta

SEQ ID NO: 459088 - DNA, 20 bp, mouse
gagctcccagaccaccactg

SEQ ID NO: 459089 - DNA, 20 bp, mouse
gggttctttgccactacctg

SEQ ID NO: 459090 - DNA, 20 bp, mouse
gtctccctagaccccagtgg

SEQ ID NO: 459091 - DNA, 20 bp, mouse
ggcggcttaagcgcgagcct

SEQ ID NO: 459092 - DNA, 20 bp, mouse
gcagcctgcagaaagtcccc

SEQ ID NO: 459093 - DNA, 20 bp, mouse
ggcggacctccagtcagaag

SEQ ID NO: 459094 - DNA, 20 bp, mouse
gtcaccatatcttctctccc

SEQ ID NO: 459095 - DNA, 20 bp, mouse
ggaagcttccttagtgctag

SEQ ID NO: 459096 - DNA, 20 bp, mouse
gtctgtctgtgcagccgcag

SEQ ID NO: 459097 - DNA, 20 bp, mouse
gggtggagtcagggagactt

SEQ ID NO: 459098 - DNA, 20 bp, mouse
ggtctgtgcagccgcagggg

SEQ ID NO: 459099 - DNA, 20 bp, mouse
ggtcgccctggtaacccggg

SEQ ID NO: 459100 - DNA, 20 bp, mouse
gtccagttgagacacctgcg

SEQ ID NO: 459101 - DNA, 20 bp, mouse
gtgtctcaactggacatcag

SEQ ID NO: 459102 - DNA, 20 bp, mouse
gtgcagccgcaggggtgggc

SEQ ID NO: 459103 - DNA, 20 bp, mouse
ggcatccctaggcagaggta

SEQ ID NO: 459104 - DNA, 20 bp, mouse
ggctccgcggtactccagac

SEQ ID NO: 459105 - DNA, 20 bp, mouse
ggatcgatgggttctcagca

SEQ ID NO: 459106 - DNA, 20 bp, mouse
ggactcctgaaccctcaatg

SEQ ID NO: 459107 - DNA, 20 bp, mouse
ggcaaagaattggtgtcagt

SEQ ID NO: 459108 - DNA, 20 bp, mouse
gtcacagatgggcctcattg

SEQ ID NO: 459109 - DNA, 20 bp, mouse
gagtcagacaagcaaagaat

SEQ ID NO: 459110 - DNA, 20 bp, mouse
gcagatgggtcaggagatgc

SEQ ID NO: 459111 - DNA, 20 bp, mouse
gagagatactctactcaggg

SEQ ID NO: 459112 - DNA, 20 bp, mouse
gtgggcctcattgagggttc

SEQ ID NO: 459113 - DNA, 20 bp, mouse
gtagagagatactctactca

SEQ ID NO: 459114 - DNA, 20 bp, mouse
gccaagacgtagtcaaatag

SEQ ID NO: 459115 - DNA, 20 bp, mouse
gtagggaaagtgattcatct

SEQ ID NO: 459116 - DNA, 20 bp, mouse
gaagccttcttggccaagga

SEQ ID NO: 459117 - DNA, 20 bp, mouse
gtccaagcggatgcggaaga

SEQ ID NO: 459118 - DNA, 20 bp, mouse
ggagccctccttggccaaga

SEQ ID NO: 459119 - DNA, 20 bp, mouse
ggctttctctgcggccgaag

SEQ ID NO: 459120 - DNA, 20 bp, mouse
ggcagcaccaccggccggta

SEQ ID NO: 459121 - DNA, 20 bp, mouse
gtcgctgctcgctttctctg

SEQ ID NO: 459122 - DNA, 20 bp, mouse
gctccacagccactgcccgg

SEQ ID NO: 459123 - DNA, 20 bp, mouse
ggcgtcgctcggtgagtcgg

SEQ ID NO: 459124 - DNA, 20 bp, mouse
gagcgacgcctgcaccgctt

SEQ ID NO: 459125 - DNA, 20 bp, mouse
gcaggcgtcgctcggtgagt

SEQ ID NO: 459126 - DNA, 20 bp, mouse
ggcccggcactgtgctatga

SEQ ID NO: 459127 - DNA, 20 bp, mouse
ggcagcaggctgaacgctct

SEQ ID NO: 459128 - DNA, 20 bp, mouse
gtctaggagcagacattcaa

SEQ ID NO: 459129 - DNA, 20 bp, mouse
gtgacatcaggccctcccag

SEQ ID NO: 459130 - DNA, 20 bp, mouse
ggtgccgggccacaagcagc

SEQ ID NO: 459131 - DNA, 20 bp, mouse
ggaccctcatagcacagtgc

SEQ ID NO: 459132 - DNA, 20 bp, mouse
ggaacacagaggagcacgga

SEQ ID NO: 459133 - DNA, 20 bp, mouse
gtggcgagatctgcagccca

SEQ ID NO: 459134 - DNA, 20 bp, mouse
ggcgttcagcctgctgcttg

SEQ ID NO: 459135 - DNA, 20 bp, mouse
gactgttgagaacctcacaa

SEQ ID NO: 459136 - DNA, 20 bp, mouse
gcttctggcgtctcacacat

SEQ ID NO: 459137 - DNA, 20 bp, mouse
gtgcagtcgctccttggcta

SEQ ID NO: 459138 - DNA, 20 bp, mouse
gctgccctggaagtgtacca

SEQ ID NO: 459139 - DNA, 20 bp, mouse
gccagagatgggcaactgtg

SEQ ID NO: 459140 - DNA, 20 bp, mouse
ggccagaagacgctaactga

SEQ ID NO: 459141 - DNA, 20 bp, mouse
ggagtttaggagcacaccat

SEQ ID NO: 459142 - DNA, 20 bp, mouse
gctgccttggtacacttcca

SEQ ID NO: 459143 - DNA, 20 bp, mouse
ggagagaatgacagctcaaa

SEQ ID NO: 459144 - DNA, 20 bp, mouse
gagatgggcaactgtggggt

SEQ ID NO: 459145 - DNA, 20 bp, mouse
ggtcgtttaagtcagagttt

SEQ ID NO: 459146 - DNA, 20 bp, mouse
ggagctgctccggattcggg

SEQ ID NO: 459147 - DNA, 20 bp, mouse
gcgagcacgttgggtagcca

SEQ ID NO: 459148 - DNA, 20 bp, mouse
gggcccgacgcgagcacgtt

SEQ ID NO: 459149 - DNA, 20 bp, mouse
ggagcagctcccggggcgag

SEQ ID NO: 459150 - DNA, 20 bp, mouse
ggagacggaggccccttcga

SEQ ID NO: 459151 - DNA, 20 bp, mouse
ggaaggggcctccgtctccg

SEQ ID NO: 459152 - DNA, 20 bp, mouse
gcggcggcggcggagacgac

SEQ ID NO: 459153 - DNA, 20 bp, mouse
ggcgggcgtgaggcgctcca

SEQ ID NO: 459154 - DNA, 20 bp, mouse
gccgggagctgctccggatt

SEQ ID NO: 459155 - DNA, 20 bp, mouse
gcccttggtgcgagaggata

SEQ ID NO: 459156 - DNA, 20 bp, mouse
gccgaggcgcgggtcgtagt

SEQ ID NO: 459157 - DNA, 20 bp, mouse
gtttccggcaggccgaaact

SEQ ID NO: 459158 - DNA, 20 bp, mouse
ggccggccacggggcacgga

SEQ ID NO: 459159 - DNA, 20 bp, mouse
gccgaaactaggaagaaact

SEQ ID NO: 459160 - DNA, 20 bp, mouse
gcagtgagcggaagtgacgt

SEQ ID NO: 459161 - DNA, 20 bp, mouse
ggcgccgcgcggacctgtgg

SEQ ID NO: 459162 - DNA, 20 bp, mouse
gccgcgcggcgccggccacg

SEQ ID NO: 459163 - DNA, 20 bp, mouse
gacttggagctgccgaggcg

SEQ ID NO: 459164 - DNA, 20 bp, mouse
gaggcccccacaggtccgcg

SEQ ID NO: 459165 - DNA, 20 bp, mouse
gaagaaacttggagctgccg

SEQ ID NO: 459166 - DNA, 20 bp, mouse
gctggtcctgagcaccagag

SEQ ID NO: 459167 - DNA, 20 bp, mouse
gcaccagagcggctcagaga

SEQ ID NO: 459168 - DNA, 20 bp, mouse
gggtggcccgcggagccgga

SEQ ID NO: 459169 - DNA, 20 bp, mouse
gccgcggagccggacggtag

SEQ ID NO: 459170 - DNA, 20 bp, mouse
ggagaaggacctctaccgtc

SEQ ID NO: 459171 - DNA, 20 bp, mouse
gaatagtgcggatcggatcg

SEQ ID NO: 459172 - DNA, 20 bp, mouse
ggccggcggaaacaatagtg

SEQ ID NO: 459173 - DNA, 20 bp, mouse
gtcggatcgtggcgcgcgga

SEQ ID NO: 459174 - DNA, 20 bp, mouse
gctcaggaccagtgccggga

SEQ ID NO: 459175 - DNA, 20 bp, mouse
gggaccagtgccgggacgga

SEQ ID NO: 459176 - DNA, 20 bp, mouse
gctgtggggcccagcgtccg

SEQ ID NO: 459177 - DNA, 20 bp, mouse
ggggctcgcacggctcccgg

SEQ ID NO: 459178 - DNA, 20 bp, mouse
gcgagggcgcagctgagacg

SEQ ID NO: 459179 - DNA, 20 bp, mouse
gctgttccttgagctccctt

SEQ ID NO: 459180 - DNA, 20 bp, mouse
ggcgccctcgcgggacagta

SEQ ID NO: 459181 - DNA, 20 bp, mouse
gcccaaggtgccccagaaag

SEQ ID NO: 459182 - DNA, 20 bp, mouse
gtcgcgcagcgagtagctgt

SEQ ID NO: 459183 - DNA, 20 bp, mouse
ggggcccagcgtccggggag

SEQ ID NO: 459184 - DNA, 20 bp, mouse
gacacagtacaggcctacct

SEQ ID NO: 459185 - DNA, 20 bp, mouse
gcgcgagcacccagacgcct

SEQ ID NO: 459186 - DNA, 20 bp, mouse
ggggcgagctgcagaatctc

SEQ ID NO: 459187 - DNA, 20 bp, mouse
gcagctcgccctgcaaaagg

SEQ ID NO: 459188 - DNA, 20 bp, mouse
gggtcaagcaggggccagag

SEQ ID NO: 459189 - DNA, 20 bp, mouse
gctgcaaaaggcggaaacct

SEQ ID NO: 459190 - DNA, 20 bp, mouse
gtgccggacgggtcaagcag

SEQ ID NO: 459191 - DNA, 20 bp, mouse
gcccagacccaggctcgtcc

SEQ ID NO: 459192 - DNA, 20 bp, mouse
gctgcagctcgccctgcaaa

SEQ ID NO: 459193 - DNA, 20 bp, mouse
gcggcgcctgacccagaccc

SEQ ID NO: 459194 - DNA, 20 bp, mouse
gagtacttacccttcttata

SEQ ID NO: 459195 - DNA, 20 bp, mouse
gtgacccgtccggcagcggt

SEQ ID NO: 459196 - DNA, 20 bp, mouse
gagatggcagcccccagcgg

SEQ ID NO: 459197 - DNA, 20 bp, mouse
gcattgccccggaagcaaga

SEQ ID NO: 459198 - DNA, 20 bp, mouse
gtcctggagaccgggtggag

SEQ ID NO: 459199 - DNA, 20 bp, mouse
ggtccagaagcctccgctgg

SEQ ID NO: 459200 - DNA, 20 bp, mouse
ggtggtgggctcggacacag

SEQ ID NO: 459201 - DNA, 20 bp, mouse
ggagcgcctgcgcattgccc

SEQ ID NO: 459202 - DNA, 20 bp, mouse
ggtctccaggaccacctgat

SEQ ID NO: 459203 - DNA, 20 bp, mouse
gggaggcttctggactgcgg

SEQ ID NO: 459204 - DNA, 20 bp, mouse
gcacctgatcggaagtccat

SEQ ID NO: 459205 - DNA, 20 bp, mouse
gggtggtcctggagaccggg

SEQ ID NO: 459206 - DNA, 20 bp, mouse
gccagcgagagaggagcgag

SEQ ID NO: 459207 - DNA, 20 bp, mouse
ggcgcgcgcagcccatgagg

SEQ ID NO: 459208 - DNA, 20 bp, mouse
ggccccagagccagcgagag

SEQ ID NO: 459209 - DNA, 20 bp, mouse
gcccgtggagaagcaggtcg

SEQ ID NO: 459210 - DNA, 20 bp, mouse
gaggcctctcaccgcctcat

SEQ ID NO: 459211 - DNA, 20 bp, mouse
gtcctctctcgctggctctg

SEQ ID NO: 459212 - DNA, 20 bp, mouse
gccgggcccgagcccacgaa

SEQ ID NO: 459213 - DNA, 20 bp, mouse
gcagcccatgaggcggtgag

SEQ ID NO: 459214 - DNA, 20 bp, mouse
ggccccgagggcaaaaacac

SEQ ID NO: 459215 - DNA, 20 bp, mouse
gccgctcgtggagtactccc

SEQ ID NO: 459216 - DNA, 20 bp, mouse
gaacactcaccgcacacgtg

SEQ ID NO: 459217 - DNA, 20 bp, mouse
ggtttggtgcgggaagtgtg

SEQ ID NO: 459218 - DNA, 20 bp, mouse
gtccggggcggggcagaacg

SEQ ID NO: 459219 - DNA, 20 bp, mouse
gcgtctgacacgggacgagt

SEQ ID NO: 459220 - DNA, 20 bp, mouse
ggcggggcagaacgcggaag

SEQ ID NO: 459221 - DNA, 20 bp, mouse
gtgttgtggagagtttggtg

SEQ ID NO: 459222 - DNA, 20 bp, mouse
gcaactccgggccagagaag

SEQ ID NO: 459223 - DNA, 20 bp, mouse
gagagctccccgctcccgag

SEQ ID NO: 459224 - DNA, 20 bp, mouse
gggaaccctggcgagggcag

SEQ ID NO: 459225 - DNA, 20 bp, mouse
gtccgccggccgctcgggag

SEQ ID NO: 459226 - DNA, 20 bp, mouse
gcgcgaagccgaacttacca

SEQ ID NO: 459227 - DNA, 20 bp, mouse
ggaagccgaacttaccaggg

SEQ ID NO: 459228 - DNA, 20 bp, mouse
gggcttcgcgaggcgcgact

SEQ ID NO: 459229 - DNA, 20 bp, mouse
gttcgcgaggcgcgacttgg

SEQ ID NO: 459230 - DNA, 20 bp, mouse
gcagggaggaaacagcggct

SEQ ID NO: 459231 - DNA, 20 bp, mouse
gtcgctggcccgggaccgga

SEQ ID NO: 459232 - DNA, 20 bp, mouse
ggacttggcggcaggattcg

SEQ ID NO: 459233 - DNA, 20 bp, mouse
gtgttggcggggttctaaga

SEQ ID NO: 459234 - DNA, 20 bp, mouse
gcggcgcccgcccgaaccca

SEQ ID NO: 459235 - DNA, 20 bp, mouse
gcggacaacctggaactcgg

SEQ ID NO: 459236 - DNA, 20 bp, mouse
gagagcagcgggtacccggc

SEQ ID NO: 459237 - DNA, 20 bp, mouse
gtagctggcgccgagcgcgg

SEQ ID NO: 459238 - DNA, 20 bp, mouse
gagaccccgaagccaagggc

SEQ ID NO: 459239 - DNA, 20 bp, mouse
gtgggagagcagcgggtacc

SEQ ID NO: 459240 - DNA, 20 bp, mouse
gccgcagaccccgaagccaa

SEQ ID NO: 459241 - DNA, 20 bp, mouse
gcacagtggctcgctgactg

SEQ ID NO: 459242 - DNA, 20 bp, mouse
gacccggctggctccgctgg

SEQ ID NO: 459243 - DNA, 20 bp, mouse
ggagccactgtgccagcccc

SEQ ID NO: 459244 - DNA, 20 bp, mouse
gggtacccggctggctccgc

SEQ ID NO: 459245 - DNA, 20 bp, mouse
gcgcgcccggccgggacacg

SEQ ID NO: 459246 - DNA, 20 bp, mouse
gccactccacgggacacctg

SEQ ID NO: 459247 - DNA, 20 bp, mouse
gggctctccgctgctcacta

SEQ ID NO: 459248 - DNA, 20 bp, mouse
gcgtggccacaggtgtcccg

SEQ ID NO: 459249 - DNA, 20 bp, mouse
gttctggaaccggagttagg

SEQ ID NO: 459250 - DNA, 20 bp, mouse
gaagagggcagcgggtcacg

SEQ ID NO: 459251 - DNA, 20 bp, mouse
gcctttctggaaccggagtt

SEQ ID NO: 459252 - DNA, 20 bp, mouse
gaagagtacggagaactctg

SEQ ID NO: 459253 - DNA, 20 bp, mouse
gcagcgggtcacgtggccac

SEQ ID NO: 459254 - DNA, 20 bp, mouse
gcacaaaatggccactccac

SEQ ID NO: 459255 - DNA, 20 bp, mouse
ggcctctttccgcctaactc

SEQ ID NO: 459256 - DNA, 20 bp, mouse
gtgctgcccgggaggttgaa

SEQ ID NO: 459257 - DNA, 20 bp, mouse
gacctcccgggcagcagccc

SEQ ID NO: 459258 - DNA, 20 bp, mouse
ggctacagcctctcctgccg

SEQ ID NO: 459259 - DNA, 20 bp, mouse
gcggcagcgcagacaggacc

SEQ ID NO: 459260 - DNA, 20 bp, mouse
gccggagccgaaagactaaa

SEQ ID NO: 459261 - DNA, 20 bp, mouse
gccagaagcggaagggacta

SEQ ID NO: 459262 - DNA, 20 bp, mouse
ggtcgccgcccggaaccgag

SEQ ID NO: 459263 - DNA, 20 bp, mouse
gctctccactcggttccggg

SEQ ID NO: 459264 - DNA, 20 bp, mouse
gtcacctcccttcaacctcc

SEQ ID NO: 459265 - DNA, 20 bp, mouse
gcgaagaaccgcgggcgcag

SEQ ID NO: 459266 - DNA, 20 bp, mouse
gcgcggtgggcctggaaaca

SEQ ID NO: 459267 - DNA, 20 bp, mouse
gggcctagcccggaacccat

SEQ ID NO: 459268 - DNA, 20 bp, mouse
gccgcacataccggaccaca

SEQ ID NO: 459269 - DNA, 20 bp, mouse
gaccacacggacgcttcctc

SEQ ID NO: 459270 - DNA, 20 bp, mouse
gcccatcggtccgcacatac

SEQ ID NO: 459271 - DNA, 20 bp, mouse
gagctcaggctacgggagag

SEQ ID NO: 459272 - DNA, 20 bp, mouse
gaggctgaccggtcacacat

SEQ ID NO: 459273 - DNA, 20 bp, mouse
gcggaagaggcgaggctaac

SEQ ID NO: 459274 - DNA, 20 bp, mouse
gaccagggtagaagtacaca

SEQ ID NO: 459275 - DNA, 20 bp, mouse
gtaactggcaggcgcgcggt

SEQ ID NO: 459276 - DNA, 20 bp, mouse
gtgcactcggacggaagcta

SEQ ID NO: 459277 - DNA, 20 bp, mouse
gcctacggttctgcaggggt

SEQ ID NO: 459278 - DNA, 20 bp, mouse
gcggaagctagggtgcgtag

SEQ ID NO: 459279 - DNA, 20 bp, mouse
gccgtaggcctgaactagag

SEQ ID NO: 459280 - DNA, 20 bp, mouse
gcaggcctacggttctgcag

SEQ ID NO: 459281 - DNA, 20 bp, mouse
gcagggtgcgggtgcggact

SEQ ID NO: 459282 - DNA, 20 bp, mouse
ggctagctgtagttcctggg

SEQ ID NO: 459283 - DNA, 20 bp, mouse
gttacacccacgggccgtgt

SEQ ID NO: 459284 - DNA, 20 bp, mouse
ggggaagcagggtgcgggtg

SEQ ID NO: 459285 - DNA, 20 bp, mouse
gctcggtctttgcactcgga

SEQ ID NO: 459286 - DNA, 20 bp, mouse
gcacagtaagtagcgccggg

SEQ ID NO: 459287 - DNA, 20 bp, mouse
gtgctcgccgtagtatcggt

SEQ ID NO: 459288 - DNA, 20 bp, mouse
gccgggccggaacgacgggt

SEQ ID NO: 459289 - DNA, 20 bp, mouse
gtggtggcgtcggcccaggc

SEQ ID NO: 459290 - DNA, 20 bp, mouse
gggagccgggccggaacgac

SEQ ID NO: 459291 - DNA, 20 bp, mouse
gcagagtcccaccgatacta

SEQ ID NO: 459292 - DNA, 20 bp, mouse
ggctacttactgtggttcag

SEQ ID NO: 459293 - DNA, 20 bp, mouse
gcccgctggagagcgacccg

SEQ ID NO: 459294 - DNA, 20 bp, mouse
gtggcgtcggcccaggccgg

SEQ ID NO: 459295 - DNA, 20 bp, mouse
gtatctggagctggtggcgt

SEQ ID NO: 459296 - DNA, 20 bp, mouse
gcgtgcgagggtcccggctg

SEQ ID NO: 459297 - DNA, 20 bp, mouse
ggaccagcgtgcgagggtcc

SEQ ID NO: 459298 - DNA, 20 bp, mouse
ggcggttaccccacaatgtc

SEQ ID NO: 459299 - DNA, 20 bp, mouse
gggacagccagtacagtgac

SEQ ID NO: 459300 - DNA, 20 bp, mouse
gcgactcacccgacattgtg

SEQ ID NO: 459301 - DNA, 20 bp, mouse
gagggtgacacactgtctag

SEQ ID NO: 459302 - DNA, 20 bp, mouse
gagtagagaccagcgtgcga

SEQ ID NO: 459303 - DNA, 20 bp, mouse
gagtcgggtcagcctcagcc

SEQ ID NO: 459304 - DNA, 20 bp, mouse
ggacaggcaccacttccgag

SEQ ID NO: 459305 - DNA, 20 bp, mouse
gttggagtgcaaggagttcg

SEQ ID NO: 459306 - DNA, 20 bp, mouse
gtctcagcaacagcttggag

SEQ ID NO: 459307 - DNA, 20 bp, mouse
ggagcccagggagagtggca

SEQ ID NO: 459308 - DNA, 20 bp, mouse
ggcggggaatgtgacatcag

SEQ ID NO: 459309 - DNA, 20 bp, mouse
ggggctccaagtcctccccc

SEQ ID NO: 459310 - DNA, 20 bp, mouse
gtgcagcgcgctggttccag

SEQ ID NO: 459311 - DNA, 20 bp, mouse
gccaggctgaagaagacctg

SEQ ID NO: 459312 - DNA, 20 bp, mouse
gcctccctgccactctccct

SEQ ID NO: 459313 - DNA, 20 bp, mouse
gcggcgaaggagaggccaaa

SEQ ID NO: 459314 - DNA, 20 bp, mouse
gtggagcaggcagctcgcct

SEQ ID NO: 459315 - DNA, 20 bp, mouse
gagcaggcagctcgcctcgg

SEQ ID NO: 459316 - DNA, 20 bp, mouse
gccggcaccctacagacgca

SEQ ID NO: 459317 - DNA, 20 bp, mouse
ggccatccaccgggaggacg

SEQ ID NO: 459318 - DNA, 20 bp, mouse
gtgccgggccatccaccggg

SEQ ID NO: 459319 - DNA, 20 bp, mouse
ggggtgccgggccatccacc

SEQ ID NO: 459320 - DNA, 20 bp, mouse
gcgtttgccctgcgtctgta

SEQ ID NO: 459321 - DNA, 20 bp, mouse
gggagtccgcgtcctcccgg

SEQ ID NO: 459322 - DNA, 20 bp, mouse
ggagccggcgactgcatggg

SEQ ID NO: 459323 - DNA, 20 bp, mouse
gagggcaaacggatgccgca

SEQ ID NO: 459324 - DNA, 20 bp, mouse
gtgcggccagtgctcgatgt

SEQ ID NO: 459325 - DNA, 20 bp, mouse
gtcaagccggccgatcccaa

SEQ ID NO: 459326 - DNA, 20 bp, mouse
gtgcttggcgccttccgcag

SEQ ID NO: 459327 - DNA, 20 bp, mouse
gcgcagcgagtgtctgtctg

SEQ ID NO: 459328 - DNA, 20 bp, mouse
ggcgacagctctaaactggg

SEQ ID NO: 459329 - DNA, 20 bp, mouse
ggacactcgctgcgccactg

SEQ ID NO: 459330 - DNA, 20 bp, mouse
gataggagcaggcactaact

SEQ ID NO: 459331 - DNA, 20 bp, mouse
gctcgggctgaggtgactca

SEQ ID NO: 459332 - DNA, 20 bp, mouse
gctcgctgcgccactgcgga

SEQ ID NO: 459333 - DNA, 20 bp, mouse
ggagcaggcactaactaggt

SEQ ID NO: 459334 - DNA, 20 bp, mouse
ggtccctgaggccgcgttgg

SEQ ID NO: 459335 - DNA, 20 bp, mouse
gctgcaaaaccaagactcgg

SEQ ID NO: 459336 - DNA, 20 bp, mouse
ggagactcgccaccacgcca

SEQ ID NO: 459337 - DNA, 20 bp, mouse
gagccagccagggcgctgag

SEQ ID NO: 459338 - DNA, 20 bp, mouse
ggctccagacgcctccaagt

SEQ ID NO: 459339 - DNA, 20 bp, mouse
gcagcagcaacagcgaggac

SEQ ID NO: 459340 - DNA, 20 bp, mouse
gcgggaggctggactcgcag

SEQ ID NO: 459341 - DNA, 20 bp, mouse
gcacggtcgccggggcccga

SEQ ID NO: 459342 - DNA, 20 bp, mouse
ggggtctcccgcccacttgg

SEQ ID NO: 459343 - DNA, 20 bp, mouse
gggcgtctggagccgaagcc

SEQ ID NO: 459344 - DNA, 20 bp, mouse
gcgagtacgtacaccaggtg

SEQ ID NO: 459345 - DNA, 20 bp, mouse
ggacctcagcagccctggcg

SEQ ID NO: 459346 - DNA, 20 bp, mouse
gggagctgcagtagctttcg

SEQ ID NO: 459347 - DNA, 20 bp, mouse
gtcactggatcgctaggctc

SEQ ID NO: 459348 - DNA, 20 bp, mouse
gcccaggtctctatctctgt

SEQ ID NO: 459349 - DNA, 20 bp, mouse
ggatagagacctgggcgcag

SEQ ID NO: 459350 - DNA, 20 bp, mouse
gcgagatgcccggtgaggag

SEQ ID NO: 459351 - DNA, 20 bp, mouse
gggtgcggcgagggtgggac

SEQ ID NO: 459352 - DNA, 20 bp, mouse
gagagacctgggcgcagggg

SEQ ID NO: 459353 - DNA, 20 bp, mouse
gcccacggtgcggcgagggt

SEQ ID NO: 459354 - DNA, 20 bp, mouse
gccatggcccgggagtcgga

SEQ ID NO: 459355 - DNA, 20 bp, mouse
gaccggcgcggtgtggaacg

SEQ ID NO: 459356 - DNA, 20 bp, mouse
ggaaccgccgcctctaggga

SEQ ID NO: 459357 - DNA, 20 bp, mouse
gaaccgtccatccctagagg

SEQ ID NO: 459358 - DNA, 20 bp, mouse
gactaaccgtccatccctag

SEQ ID NO: 459359 - DNA, 20 bp, mouse
gcgccgcctctagggatgga

SEQ ID NO: 459360 - DNA, 20 bp, mouse
gggacggccgcccaacctcc

SEQ ID NO: 459361 - DNA, 20 bp, mouse
ggccggaaccgccgcctcta

SEQ ID NO: 459362 - DNA, 20 bp, mouse
gtgggccccgccgggaggtt

SEQ ID NO: 459363 - DNA, 20 bp, mouse
gctccctgagacacctccga

SEQ ID NO: 459364 - DNA, 20 bp, mouse
gcggccgcccaacctcccgg

SEQ ID NO: 459365 - DNA, 20 bp, mouse
gagacacctccgagggatga

SEQ ID NO: 459366 - DNA, 20 bp, mouse
gtccagcgaccggagagcac

SEQ ID NO: 459367 - DNA, 20 bp, mouse
gctgcgaccaggaaccgaag

SEQ ID NO: 459368 - DNA, 20 bp, mouse
gggttcccgattccagcgac

SEQ ID NO: 459369 - DNA, 20 bp, mouse
gtcagtcccagtctggactt

SEQ ID NO: 459370 - DNA, 20 bp, mouse
gctctccggtcgctggaatc

SEQ ID NO: 459371 - DNA, 20 bp, mouse
gcactgccaaagtccagact

SEQ ID NO: 459372 - DNA, 20 bp, mouse
gagactgggactgagcttag

SEQ ID NO: 459373 - DNA, 20 bp, mouse
gggagctgcgggacgaagag

SEQ ID NO: 459374 - DNA, 20 bp, mouse
ggcgcgtgcgcgacacccca

SEQ ID NO: 459375 - DNA, 20 bp, mouse
ggatcggtccgcaaacgcaa

SEQ ID NO: 459376 - DNA, 20 bp, mouse
gtcccaggggctcacattac

SEQ ID NO: 459377 - DNA, 20 bp, mouse
ggcctgtaatgtgagcccct

SEQ ID NO: 459378 - DNA, 20 bp, mouse
ggcctgtccttgcttgcagt

SEQ ID NO: 459379 - DNA, 20 bp, mouse
gggacaagtgaggaggaaag

SEQ ID NO: 459380 - DNA, 20 bp, mouse
ggtaggaacactgtcacctc

SEQ ID NO: 459381 - DNA, 20 bp, mouse
gtaatgtcctcagcatggag

SEQ ID NO: 459382 - DNA, 20 bp, mouse
gccatgtagctaagagtggt

SEQ ID NO: 459383 - DNA, 20 bp, mouse
gagtgttcctactgcaagca

SEQ ID NO: 459384 - DNA, 20 bp, mouse
gcagaccatgtagctaagag

SEQ ID NO: 459385 - DNA, 20 bp, mouse
gtctctaatctgcaaatctt

SEQ ID NO: 459386 - DNA, 20 bp, mouse
ggccaggtaacgcagcggag

SEQ ID NO: 459387 - DNA, 20 bp, mouse
ggcggggtcgaagaaggtga

SEQ ID NO: 459388 - DNA, 20 bp, mouse
ggcgcctgggcggaaggata

SEQ ID NO: 459389 - DNA, 20 bp, mouse
ggccgctccgctgcgttacc

SEQ ID NO: 459390 - DNA, 20 bp, mouse
gcggcccggcctgaggacag

SEQ ID NO: 459391 - DNA, 20 bp, mouse
gtccggctcgaggaccccgc

SEQ ID NO: 459392 - DNA, 20 bp, mouse
gggtagccttggcaggtagg

SEQ ID NO: 459393 - DNA, 20 bp, mouse
gagccttggcaggtaggcgg

SEQ ID NO: 459394 - DNA, 20 bp, mouse
ggggcgctgaggctgttgcc

SEQ ID NO: 459395 - DNA, 20 bp, mouse
gggcggaaggatatggaacg

SEQ ID NO: 459396 - DNA, 20 bp, mouse
gccatccgaggtaagcacag

SEQ ID NO: 459397 - DNA, 20 bp, mouse
ggtctgctgtagacttgctc

SEQ ID NO: 459398 - DNA, 20 bp, mouse
gagcagatctgcgtccggga

SEQ ID NO: 459399 - DNA, 20 bp, mouse
gtctgcgtccgggaaggtgc

SEQ ID NO: 459400 - DNA, 20 bp, mouse
gcccacaagccggatctgag

SEQ ID NO: 459401 - DNA, 20 bp, mouse
gtgctcaggtctagtctcgc

SEQ ID NO: 459402 - DNA, 20 bp, mouse
ggagcttcaggtagccagca

SEQ ID NO: 459403 - DNA, 20 bp, mouse
ggccagcttggttggaggac

SEQ ID NO: 459404 - DNA, 20 bp, mouse
gttcaggtagccagcagggt

SEQ ID NO: 459405 - DNA, 20 bp, mouse
gttccagcagatctgcgtcc

SEQ ID NO: 459406 - DNA, 20 bp, mouse
ggctctggagagagtgcgaa

SEQ ID NO: 459407 - DNA, 20 bp, mouse
gaacccggcctcatcccgag

SEQ ID NO: 459408 - DNA, 20 bp, mouse
ggggcagccagacccggaca

SEQ ID NO: 459409 - DNA, 20 bp, mouse
gcccgaggggcagccagacc

SEQ ID NO: 459410 - DNA, 20 bp, mouse
gagagagtgcgaagggcgag

SEQ ID NO: 459411 - DNA, 20 bp, mouse
gccagacccggacagggaag

SEQ ID NO: 459412 - DNA, 20 bp, mouse
ggagaggagtactcctaacc

SEQ ID NO: 459413 - DNA, 20 bp, mouse
gctgcccctcgggatgaggc

SEQ ID NO: 459414 - DNA, 20 bp, mouse
gggcaggacgcgaggcccag

SEQ ID NO: 459415 - DNA, 20 bp, mouse
ggaccagaggagcatcacca

SEQ ID NO: 459416 - DNA, 20 bp, mouse
gctctgctcccaatgcacac

SEQ ID NO: 459417 - DNA, 20 bp, mouse
gactggtaaatagcaagtct

SEQ ID NO: 459418 - DNA, 20 bp, mouse
gtgcgctccatttcagaacc

SEQ ID NO: 459419 - DNA, 20 bp, mouse
ggtaaccagaagactctgcc

SEQ ID NO: 459420 - DNA, 20 bp, mouse
ggacactgcccgtgtgcatt

SEQ ID NO: 459421 - DNA, 20 bp, mouse
gccaatgagagcaaagttca

SEQ ID NO: 459422 - DNA, 20 bp, mouse
gaggctagtagtttggtgag

SEQ ID NO: 459423 - DNA, 20 bp, mouse
gctagtagtttggtgagggg

SEQ ID NO: 459424 - DNA, 20 bp, mouse
gtgcctaaaagagttcacat

SEQ ID NO: 459425 - DNA, 20 bp, mouse
gcatacttgccccaagagac

SEQ ID NO: 459426 - DNA, 20 bp, mouse
gtccagcctggaagccgtag

SEQ ID NO: 459427 - DNA, 20 bp, mouse
gacttggggagtggcgagaa

SEQ ID NO: 459428 - DNA, 20 bp, mouse
gttcgctggaacttggggag

SEQ ID NO: 459429 - DNA, 20 bp, mouse
gcctgtaactggagggacca

SEQ ID NO: 459430 - DNA, 20 bp, mouse
gtttccttcgctggaacttg

SEQ ID NO: 459431 - DNA, 20 bp, mouse
gcctggcattcctgtgtgag

SEQ ID NO: 459432 - DNA, 20 bp, mouse
ggcctcctcctgtaactgga

SEQ ID NO: 459433 - DNA, 20 bp, mouse
ggctgaagacctaccttcca

SEQ ID NO: 459434 - DNA, 20 bp, mouse
gggcagcgaatagaggatcg

SEQ ID NO: 459435 - DNA, 20 bp, mouse
gaagaagagtgcttcctcta

SEQ ID NO: 459436 - DNA, 20 bp, mouse
gtcttcctaaaggctatcgg

SEQ ID NO: 459437 - DNA, 20 bp, mouse
ggcctcctttccatgacgga

SEQ ID NO: 459438 - DNA, 20 bp, mouse
gtttccatgacggaaggctg

SEQ ID NO: 459439 - DNA, 20 bp, mouse
gcagccacagccttccgtca

SEQ ID NO: 459440 - DNA, 20 bp, mouse
gtgtgaagcaggaggtgaaa

SEQ ID NO: 459441 - DNA, 20 bp, mouse
gacatccaccgatagccttt

SEQ ID NO: 459442 - DNA, 20 bp, mouse
gtgctcttcctaaaggctat

SEQ ID NO: 459443 - DNA, 20 bp, mouse
gtggacagaaagctaagggg

SEQ ID NO: 459444 - DNA, 20 bp, mouse
gcggtgtatcctgtccccct

SEQ ID NO: 459445 - DNA, 20 bp, mouse
ggcaggtggacagaaagcta

SEQ ID NO: 459446 - DNA, 20 bp, mouse
gggagcagttccagtgaagc

SEQ ID NO: 459447 - DNA, 20 bp, mouse
ggccagtgcttagaattcgg

SEQ ID NO: 459448 - DNA, 20 bp, mouse
gactgagggggaaggctcca

SEQ ID NO: 459449 - DNA, 20 bp, mouse
gcagcttcctgtctgcacca

SEQ ID NO: 459450 - DNA, 20 bp, mouse
ggtgggaagtgggacccgag

SEQ ID NO: 459451 - DNA, 20 bp, mouse
gccgatgccgtggtgcagac

SEQ ID NO: 459452 - DNA, 20 bp, mouse
gagaggtgacaccgatgccg

SEQ ID NO: 459453 - DNA, 20 bp, mouse
ggaggccagtgcttagaatt

SEQ ID NO: 459454 - DNA, 20 bp, mouse
gggcatagagtcatggctct

SEQ ID NO: 459455 - DNA, 20 bp, mouse
gctctgtccctgcctactga

SEQ ID NO: 459456 - DNA, 20 bp, mouse
gaccagtgcatggggaccca

SEQ ID NO: 459457 - DNA, 20 bp, mouse
gcctgctctaggagcgcctg

SEQ ID NO: 459458 - DNA, 20 bp, mouse
ggtgggaaccgaaagtccct

SEQ ID NO: 459459 - DNA, 20 bp, mouse
gggccctgggacgagatcaa

SEQ ID NO: 459460 - DNA, 20 bp, mouse
gaggtgcggctaggactctc

SEQ ID NO: 459461 - DNA, 20 bp, mouse
gttcccacgcaggccccgcg

SEQ ID NO: 459462 - DNA, 20 bp, mouse
gggccccgcggggcctgcgt

SEQ ID NO: 459463 - DNA, 20 bp, mouse
gccctggctaaccagtgcat

SEQ ID NO: 459464 - DNA, 20 bp, mouse
gtccctgggtccccatgcac

SEQ ID NO: 459465 - DNA, 20 bp, mouse
ggagcggcctttccagaacc

SEQ ID NO: 459466 - DNA, 20 bp, mouse
gctcacggtggccctcggaa

SEQ ID NO: 459467 - DNA, 20 bp, mouse
gggaaactggaatctcacgg

SEQ ID NO: 459468 - DNA, 20 bp, mouse
gagacggcttccttgagtga

SEQ ID NO: 459469 - DNA, 20 bp, mouse
gctcggctctgccaggaaac

SEQ ID NO: 459470 - DNA, 20 bp, mouse
ggaagctggcaagatacggg

SEQ ID NO: 459471 - DNA, 20 bp, mouse
ggcttagaaagccgttccga

SEQ ID NO: 459472 - DNA, 20 bp, mouse
gggaatctcacggtggccct

SEQ ID NO: 459473 - DNA, 20 bp, mouse
gagggggcagcggaaagaca

SEQ ID NO: 459474 - DNA, 20 bp, mouse
gtaagcttgaccatcactca

SEQ ID NO: 459475 - DNA, 20 bp, mouse
gggacaagatcggggaggtg

SEQ ID NO: 459476 - DNA, 20 bp, mouse
ggtcagggcggcgcccgcag

SEQ ID NO: 459477 - DNA, 20 bp, mouse
ggcaccgtgagggctcgtca

SEQ ID NO: 459478 - DNA, 20 bp, mouse
gatgagcgcgggagctgaag

SEQ ID NO: 459479 - DNA, 20 bp, mouse
ggtcctacagggatgagcgc

SEQ ID NO: 459480 - DNA, 20 bp, mouse
gggagctgaagaggatagct

SEQ ID NO: 459481 - DNA, 20 bp, mouse
gcgaggtccagagctagaag

SEQ ID NO: 459482 - DNA, 20 bp, mouse
gaggacactgagtctcaaga

SEQ ID NO: 459483 - DNA, 20 bp, mouse
gccgtgagggctcgtcaggg

SEQ ID NO: 459484 - DNA, 20 bp, mouse
gcgcaggcgcccaccaaagt

SEQ ID NO: 459485 - DNA, 20 bp, mouse
gagacgccgcaggctcggtt

SEQ ID NO: 459486 - DNA, 20 bp, mouse
ggagactgggcgcctagcac

SEQ ID NO: 459487 - DNA, 20 bp, mouse
ggtccgctgcggcggagact

SEQ ID NO: 459488 - DNA, 20 bp, mouse
gacgccggcgtccgctgcgg

SEQ ID NO: 459489 - DNA, 20 bp, mouse
gcagcagcagccagaggccg

SEQ ID NO: 459490 - DNA, 20 bp, mouse
ggctccgcgaggcttacctg

SEQ ID NO: 459491 - DNA, 20 bp, mouse
gcgcccagtctccgccgcag

SEQ ID NO: 459492 - DNA, 20 bp, mouse
gtgcagggcccaggaagaat

SEQ ID NO: 459493 - DNA, 20 bp, mouse
gctcgctgcgcgccggtgct

SEQ ID NO: 459494 - DNA, 20 bp, mouse
ggcgctcaggcccgggacgc

SEQ ID NO: 459495 - DNA, 20 bp, mouse
ggcagagaaggcggccaggg

SEQ ID NO: 459496 - DNA, 20 bp, mouse
gcagggcaggaggttcctag

SEQ ID NO: 459497 - DNA, 20 bp, mouse
gctgtaacaagttcctccgt

SEQ ID NO: 459498 - DNA, 20 bp, mouse
gatggtgccgctgacagaga

SEQ ID NO: 459499 - DNA, 20 bp, mouse
ggcaggaggttcctagaggc

SEQ ID NO: 459500 - DNA, 20 bp, mouse
gcaactggaactgcactact

SEQ ID NO: 459501 - DNA, 20 bp, mouse
gggatagccaaccaaccacg

SEQ ID NO: 459502 - DNA, 20 bp, mouse
gaggatggctcatctcgagg

SEQ ID NO: 459503 - DNA, 20 bp, mouse
gggccaaggcaacagagcct

SEQ ID NO: 459504 - DNA, 20 bp, mouse
gcccaggatggctcatctcg

SEQ ID NO: 459505 - DNA, 20 bp, mouse
gttgccttggccccactcat

SEQ ID NO: 459506 - DNA, 20 bp, mouse
gtgggtcctccacactgaag

SEQ ID NO: 459507 - DNA, 20 bp, mouse
gctttggtgtctgatgagag

SEQ ID NO: 459508 - DNA, 20 bp, mouse
ggaaggggcttcttcgctgt

SEQ ID NO: 459509 - DNA, 20 bp, mouse
gcgaagaagccccttcagtg

SEQ ID NO: 459510 - DNA, 20 bp, mouse
ggaagtcagctgacttattt

SEQ ID NO: 459511 - DNA, 20 bp, mouse
gtagggacaggtgcgacata

SEQ ID NO: 459512 - DNA, 20 bp, mouse
gtcagacaccaaagcacact

SEQ ID NO: 459513 - DNA, 20 bp, mouse
gagaagccccttcagtgtgg

SEQ ID NO: 459514 - DNA, 20 bp, mouse
gtcagtgtttgtggtcaact

SEQ ID NO: 459515 - DNA, 20 bp, mouse
gatgcagagattagagggat

SEQ ID NO: 459516 - DNA, 20 bp, mouse
gtccaacacaggctaacgaa

SEQ ID NO: 459517 - DNA, 20 bp, mouse
gtctgcaaagcgggacatgg

SEQ ID NO: 459518 - DNA, 20 bp, mouse
gctctctgcaaagcgggaca

SEQ ID NO: 459519 - DNA, 20 bp, mouse
gagcgggacatggaggacct

SEQ ID NO: 459520 - DNA, 20 bp, mouse
gccgcgcgggaactcggtgg

SEQ ID NO: 459521 - DNA, 20 bp, mouse
gcgaagcacagtgcccagaa

SEQ ID NO: 459522 - DNA, 20 bp, mouse
gagcacagtgcccagaaagg

SEQ ID NO: 459523 - DNA, 20 bp, mouse
gcttcactcggcgtggaccg

SEQ ID NO: 459524 - DNA, 20 bp, mouse
gaagcctcctctctgcaaag

SEQ ID NO: 459525 - DNA, 20 bp, mouse
gtgttccccggactgcggag

SEQ ID NO: 459526 - DNA, 20 bp, mouse
gtagccggctctattagcac

SEQ ID NO: 459527 - DNA, 20 bp, mouse
gtgtccggtgctaatagagc

SEQ ID NO: 459528 - DNA, 20 bp, mouse
gtgtagagggaatcctgtaa

SEQ ID NO: 459529 - DNA, 20 bp, mouse
gaagggtagagtctgatgag

SEQ ID NO: 459530 - DNA, 20 bp, mouse
gagaaatgaaaaacttcctg

SEQ ID NO: 459531 - DNA, 20 bp, mouse
gtgtctgtaagccaaaacat

SEQ ID NO: 459532 - DNA, 20 bp, mouse
gggtagagtctgatgagagg

SEQ ID NO: 459533 - DNA, 20 bp, mouse
gtagaggctggtcttttctc

SEQ ID NO: 459534 - DNA, 20 bp, mouse
gttcttcctacagcagataa

SEQ ID NO: 459535 - DNA, 20 bp, mouse
gttgctcccttatctgctgt

SEQ ID NO: 459536 - DNA, 20 bp, mouse
gtagccggctctattagcac

SEQ ID NO: 459537 - DNA, 20 bp, mouse
gtgtccggtgctaatagagc

SEQ ID NO: 459538 - DNA, 20 bp, mouse
gtgtagagggaatcctgtaa

SEQ ID NO: 459539 - DNA, 20 bp, mouse
gaagggtagagtctgatgag

SEQ ID NO: 459540 - DNA, 20 bp, mouse
gagaaatgaaaaacttcctg

SEQ ID NO: 459541 - DNA, 20 bp, mouse
gtgtctgtaagccaaaacat

SEQ ID NO: 459542 - DNA, 20 bp, mouse
gggtagagtctgatgagagg

SEQ ID NO: 459543 - DNA, 20 bp, mouse
gtagaggctggtcttttctc

SEQ ID NO: 459544 - DNA, 20 bp, mouse
gttcttcctacagcagataa

SEQ ID NO: 459545 - DNA, 20 bp, mouse
gttgctcccttatctgctgt

SEQ ID NO: 459546 - DNA, 20 bp, mouse
gtagcagcctgtgcagactg

SEQ ID NO: 459547 - DNA, 20 bp, mouse
gacatggccacagtctgcac

SEQ ID NO: 459548 - DNA, 20 bp, mouse
gcctggtacctaggatgtct

SEQ ID NO: 459549 - DNA, 20 bp, mouse
ggatgtgccttgctaaatca

SEQ ID NO: 459550 - DNA, 20 bp, mouse
gcttgctaaatcaaggaaca

SEQ ID NO: 459551 - DNA, 20 bp, mouse
gtcatttcaaagaccatcta

SEQ ID NO: 459552 - DNA, 20 bp, mouse
ggggtgctctctagatccag

SEQ ID NO: 459553 - DNA, 20 bp, mouse
ggcacatctttgtccttaga

SEQ ID NO: 459554 - DNA, 20 bp, mouse
gtgttgaggggagatcacac

SEQ ID NO: 459555 - DNA, 20 bp, mouse
gggggctgcaacctttacaa

SEQ ID NO: 459556 - DNA, 20 bp, mouse
gcttggtggtgaatcttaca

SEQ ID NO: 459557 - DNA, 20 bp, mouse
gcattctctaaccaaggaag

SEQ ID NO: 459558 - DNA, 20 bp, mouse
gagattcaccaccaagaggt

SEQ ID NO: 459559 - DNA, 20 bp, mouse
gttcacaacctacctcttgg

SEQ ID NO: 459560 - DNA, 20 bp, mouse
ggttagagaatgttaggccc

SEQ ID NO: 459561 - DNA, 20 bp, mouse
ggcctaacattctctaacca

SEQ ID NO: 459562 - DNA, 20 bp, mouse
gtgtgaggagtggttgtata

SEQ ID NO: 459563 - DNA, 20 bp, mouse
ggttttcacaacctacctct

SEQ ID NO: 459564 - DNA, 20 bp, mouse
gaagagtcaaatacaattat

SEQ ID NO: 459565 - DNA, 20 bp, mouse
gtgacttgggtgatgaaaag

SEQ ID NO: 459566 - DNA, 20 bp, mouse
gggccgagcagtgccaatac

SEQ ID NO: 459567 - DNA, 20 bp, mouse
gcctccggcattgcaagtat

SEQ ID NO: 459568 - DNA, 20 bp, mouse
ggcaatgccggaggagtaga

SEQ ID NO: 459569 - DNA, 20 bp, mouse
ggtatcggcactgccagtat

SEQ ID NO: 459570 - DNA, 20 bp, mouse
gaaggaaccatctactcctc

SEQ ID NO: 459571 - DNA, 20 bp, mouse
gaggaccatgagtgtcacgt

SEQ ID NO: 459572 - DNA, 20 bp, mouse
gcactcagtagggatgggag

SEQ ID NO: 459573 - DNA, 20 bp, mouse
ggtgccgatacttgcaatgc

SEQ ID NO: 459574 - DNA, 20 bp, mouse
ggagtggagccaaatgagtc

SEQ ID NO: 459575 - DNA, 20 bp, mouse
gtgtagagaggatgaaaatc

SEQ ID NO: 459576 - DNA, 20 bp, mouse
ggctgggagacaccacccaa

SEQ ID NO: 459577 - DNA, 20 bp, mouse
gcagtgacgcatcccttggg

SEQ ID NO: 459578 - DNA, 20 bp, mouse
gtgagcgatgatattctagg

SEQ ID NO: 459579 - DNA, 20 bp, mouse
gtgagaagccacaggcacgg

SEQ ID NO: 459580 - DNA, 20 bp, mouse
gtggcttctcagagcacctg

SEQ ID NO: 459581 - DNA, 20 bp, mouse
gcagccacttcaaactcagt

SEQ ID NO: 459582 - DNA, 20 bp, mouse
gacttcaaactcagtaggag

SEQ ID NO: 459583 - DNA, 20 bp, mouse
gtgttgagcgatgatattct

SEQ ID NO: 459584 - DNA, 20 bp, mouse
gtcacaaggaataaagtctg

SEQ ID NO: 459585 - DNA, 20 bp, mouse
gagcaaacataaacctggag

SEQ ID NO: 459586 - DNA, 20 bp, mouse
ggaatgttcatcagactgta

SEQ ID NO: 459587 - DNA, 20 bp, mouse
gcaggaacagacagagacgg

SEQ ID NO: 459588 - DNA, 20 bp, mouse
ggagtagaagaaggaccccg

SEQ ID NO: 459589 - DNA, 20 bp, mouse
gaggaccccggggcaagaca

SEQ ID NO: 459590 - DNA, 20 bp, mouse
ggagccaggtaacaaaggaa

SEQ ID NO: 459591 - DNA, 20 bp, mouse
gcgggggagccaggtaacaa

SEQ ID NO: 459592 - DNA, 20 bp, mouse
gacagagggtcgaggactgg

SEQ ID NO: 459593 - DNA, 20 bp, mouse
gcagactgtagggctggctt

SEQ ID NO: 459594 - DNA, 20 bp, mouse
gtggacacagatggacgctc

SEQ ID NO: 459595 - DNA, 20 bp, mouse
gatgaacattctagagtatg

SEQ ID NO: 459596 - DNA, 20 bp, mouse
gagccagcggagccagcggt

SEQ ID NO: 459597 - DNA, 20 bp, mouse
gcagatcgtgcgcatggctg

SEQ ID NO: 459598 - DNA, 20 bp, mouse
gatcgtgcgcatggctgcgg

SEQ ID NO: 459599 - DNA, 20 bp, mouse
gcagggtcccgaagtctgtc

SEQ ID NO: 459600 - DNA, 20 bp, mouse
gggcaatgagctggacacgt

SEQ ID NO: 459601 - DNA, 20 bp, mouse
ggagcctggcagccgctctg

SEQ ID NO: 459602 - DNA, 20 bp, mouse
gctggctccagacagacttc

SEQ ID NO: 459603 - DNA, 20 bp, mouse
gctccggttgccccgcagag

SEQ ID NO: 459604 - DNA, 20 bp, mouse
gtggccaaggacaggatccc

SEQ ID NO: 459605 - DNA, 20 bp, mouse
gcaggggaaagagcccgctg

SEQ ID NO: 459606 - DNA, 20 bp, mouse
ggtaccagcagggctatggc

SEQ ID NO: 459607 - DNA, 20 bp, mouse
ggccctacgcagatcacctc

SEQ ID NO: 459608 - DNA, 20 bp, mouse
ggcttctggagcctccccaa

SEQ ID NO: 459609 - DNA, 20 bp, mouse
gtcacctcgggcacgaacgg

SEQ ID NO: 459610 - DNA, 20 bp, mouse
ggcccgaggtgatctgcgta

SEQ ID NO: 459611 - DNA, 20 bp, mouse
gtcaagtctcaggctagaga

SEQ ID NO: 459612 - DNA, 20 bp, mouse
ggcagagctcctcaagtctc

SEQ ID NO: 459613 - DNA, 20 bp, mouse
gtagggctcagagtaccagc

SEQ ID NO: 459614 - DNA, 20 bp, mouse
ggtggctagggccctgagag

SEQ ID NO: 459615 - DNA, 20 bp, mouse
gtgagcagttgcccttgggg

SEQ ID NO: 459616 - DNA, 20 bp, mouse
gcaggccgctgtcatcctgg

SEQ ID NO: 459617 - DNA, 20 bp, mouse
gggctgacggtgcgaccgtg

SEQ ID NO: 459618 - DNA, 20 bp, mouse
gcgaccgtggggcgcagggt

SEQ ID NO: 459619 - DNA, 20 bp, mouse
gctccctcaggtaggccaca

SEQ ID NO: 459620 - DNA, 20 bp, mouse
gtggccgaccctgcgcccca

SEQ ID NO: 459621 - DNA, 20 bp, mouse
ggcgggccgggtgtcatggc

SEQ ID NO: 459622 - DNA, 20 bp, mouse
gagccctgtggcctacctga

SEQ ID NO: 459623 - DNA, 20 bp, mouse
ggccgctgtcatcctggtgg

SEQ ID NO: 459624 - DNA, 20 bp, mouse
ggctcgccggccatgacacc

SEQ ID NO: 459625 - DNA, 20 bp, mouse
gctcccgccatccaagatgg

SEQ ID NO: 459626 - DNA, 20 bp, mouse
gtccgggttgcggtagaaca

SEQ ID NO: 459627 - DNA, 20 bp, mouse
gcagggacaacgcaagttcc

SEQ ID NO: 459628 - DNA, 20 bp, mouse
gggagccgcgggcctcggaa

SEQ ID NO: 459629 - DNA, 20 bp, mouse
gcctaaaagcaaggctgccg

SEQ ID NO: 459630 - DNA, 20 bp, mouse
ggcgcagaaacctaaaagca

SEQ ID NO: 459631 - DNA, 20 bp, mouse
ggccgcgggcctcggaaagg

SEQ ID NO: 459632 - DNA, 20 bp, mouse
ggagcgatgactcgacctgg

SEQ ID NO: 459633 - DNA, 20 bp, mouse
ggggcctcggaaaggcggta

SEQ ID NO: 459634 - DNA, 20 bp, mouse
gttctaccgcaacccggaag

SEQ ID NO: 459635 - DNA, 20 bp, mouse
gaaaagcaaggctgccgcgg

SEQ ID NO: 459636 - DNA, 20 bp, mouse
gcccctgctggcgtccccag

SEQ ID NO: 459637 - DNA, 20 bp, mouse
ggtgcttgcccagccgcggg

SEQ ID NO: 459638 - DNA, 20 bp, mouse
gggcagaagtcagccgcccg

SEQ ID NO: 459639 - DNA, 20 bp, mouse
gtgctccgaggcgtccggcg

SEQ ID NO: 459640 - DNA, 20 bp, mouse
ggatctggagagagagtggt

SEQ ID NO: 459641 - DNA, 20 bp, mouse
gcggactgctgggtcaccga

SEQ ID NO: 459642 - DNA, 20 bp, mouse
gcgctaaagacaatgctccg

SEQ ID NO: 459643 - DNA, 20 bp, mouse
ggacaatgctccgaggcgtc

SEQ ID NO: 459644 - DNA, 20 bp, mouse
gggtctcgcagcctcgccgt

SEQ ID NO: 459645 - DNA, 20 bp, mouse
gcggagtgcttgcccagccg

SEQ ID NO: 459646 - DNA, 20 bp, mouse
gggcccgccaggttgcggta

SEQ ID NO: 459647 - DNA, 20 bp, mouse
gtgtggggcccgccaggttg

SEQ ID NO: 459648 - DNA, 20 bp, mouse
gatgagcgaagggatctcat

SEQ ID NO: 459649 - DNA, 20 bp, mouse
ggccccacaagatgagcgaa

SEQ ID NO: 459650 - DNA, 20 bp, mouse
gccggctcagaatacctccg

SEQ ID NO: 459651 - DNA, 20 bp, mouse
gtcaccttaccgcaacctgg

SEQ ID NO: 459652 - DNA, 20 bp, mouse
gagatccgacagatgctgga

SEQ ID NO: 459653 - DNA, 20 bp, mouse
gcgggcagagtagggccgta

SEQ ID NO: 459654 - DNA, 20 bp, mouse
gtttttgccaagggccgcgg

SEQ ID NO: 459655 - DNA, 20 bp, mouse
gcacgctgcaggactacatc

SEQ ID NO: 459656 - DNA, 20 bp, mouse
gggcgagcaccagcatggcg

SEQ ID NO: 459657 - DNA, 20 bp, mouse
ggcagcggccgtgcggcggt

SEQ ID NO: 459658 - DNA, 20 bp, mouse
gggcggtaggcgccggactg

SEQ ID NO: 459659 - DNA, 20 bp, mouse
gagatcgctgcgagcgagcg

SEQ ID NO: 459660 - DNA, 20 bp, mouse
gtcgcggaggaaggggactc

SEQ ID NO: 459661 - DNA, 20 bp, mouse
gtccctgagcccctcccgga

SEQ ID NO: 459662 - DNA, 20 bp, mouse
gaatctgtgagggttcgcgg

SEQ ID NO: 459663 - DNA, 20 bp, mouse
ggccgtgcggcggtaggcgc

SEQ ID NO: 459664 - DNA, 20 bp, mouse
ggacagccagccccgacgac

SEQ ID NO: 459665 - DNA, 20 bp, mouse
gtgagggttcgcggaggaag

SEQ ID NO: 459666 - DNA, 20 bp, mouse
gggctcggggaacacgactc

SEQ ID NO: 459667 - DNA, 20 bp, mouse
gccgcgtcgtacacctccgg

SEQ ID NO: 459668 - DNA, 20 bp, mouse
gcgaccaggcagagtatcct

SEQ ID NO: 459669 - DNA, 20 bp, mouse
gccaggcagagtatcctggg

SEQ ID NO: 459670 - DNA, 20 bp, mouse
ggcgactccacgacacccag

SEQ ID NO: 459671 - DNA, 20 bp, mouse
ggcgtcccggtgcccggagc

SEQ ID NO: 459672 - DNA, 20 bp, mouse
gtccgggcaccgggacgcgc

SEQ ID NO: 459673 - DNA, 20 bp, mouse
gggagctggttcctgaagca

SEQ ID NO: 459674 - DNA, 20 bp, mouse
gggaccgcgtcgtacacctc

SEQ ID NO: 459675 - DNA, 20 bp, mouse
gaaggtccggctccgggcac

SEQ ID NO: 459676 - DNA, 20 bp, mouse
ggtgcggctccgggaaagaa

SEQ ID NO: 459677 - DNA, 20 bp, mouse
gtggccccccccagaggtag

SEQ ID NO: 459678 - DNA, 20 bp, mouse
ggatggctggccccccccag

SEQ ID NO: 459679 - DNA, 20 bp, mouse
ggaggtggctgggtaaactg

SEQ ID NO: 459680 - DNA, 20 bp, mouse
gtcctgcagtaggggagtat

SEQ ID NO: 459681 - DNA, 20 bp, mouse
gggtaaggggtacatggggt

SEQ ID NO: 459682 - DNA, 20 bp, mouse
gcccccagaggtaggggtaa

SEQ ID NO: 459683 - DNA, 20 bp, mouse
gactgcaggagagtttaggg

SEQ ID NO: 459684 - DNA, 20 bp, mouse
gaagggagcacccccctcag

SEQ ID NO: 459685 - DNA, 20 bp, mouse
gctcacatctgcaggcgagg

SEQ ID NO: 459686 - DNA, 20 bp, mouse
ggaacgagcacgcatcgcgg

SEQ ID NO: 459687 - DNA, 20 bp, mouse
gcgcttacctgagaaagagg

SEQ ID NO: 459688 - DNA, 20 bp, mouse
ggcgctctagagcctcgtcc

SEQ ID NO: 459689 - DNA, 20 bp, mouse
ggtggccgctgcaccatgcg

SEQ ID NO: 459690 - DNA, 20 bp, mouse
gagcgaacgagcacgcatcg

SEQ ID NO: 459691 - DNA, 20 bp, mouse
gctagccgcgcatggtgcag

SEQ ID NO: 459692 - DNA, 20 bp, mouse
gccatgcgcggctagcggtg

SEQ ID NO: 459693 - DNA, 20 bp, mouse
gtggcgcttacctgagaaag

SEQ ID NO: 459694 - DNA, 20 bp, mouse
gagcgacctgagccccgccc

SEQ ID NO: 459695 - DNA, 20 bp, mouse
gtacctgtgcagccttctag

SEQ ID NO: 459696 - DNA, 20 bp, mouse
gtaggaggtgtacttaccta

SEQ ID NO: 459697 - DNA, 20 bp, mouse
ggaggtgtacttacctaggg

SEQ ID NO: 459698 - DNA, 20 bp, mouse
gcctagggtggcaaggtatc

SEQ ID NO: 459699 - DNA, 20 bp, mouse
gtcaaccttgataccagcca

SEQ ID NO: 459700 - DNA, 20 bp, mouse
ggctgggaagaacctcccca

SEQ ID NO: 459701 - DNA, 20 bp, mouse
ggacacagaccgccttgggg

SEQ ID NO: 459702 - DNA, 20 bp, mouse
ggtacttacctagggtggca

SEQ ID NO: 459703 - DNA, 20 bp, mouse
gtgtccgtacccactctgga

SEQ ID NO: 459704 - DNA, 20 bp, mouse
gttgcagaagtgactgctga

SEQ ID NO: 459705 - DNA, 20 bp, mouse
gtttgccctggctggtatca

SEQ ID NO: 459706 - DNA, 20 bp, mouse
gacctacgagcggctgtgaa

SEQ ID NO: 459707 - DNA, 20 bp, mouse
gttgtaccgggagcgcagag

SEQ ID NO: 459708 - DNA, 20 bp, mouse
gctcccggtacaatgggatc

SEQ ID NO: 459709 - DNA, 20 bp, mouse
gcgagttggtaacctacgag

SEQ ID NO: 459710 - DNA, 20 bp, mouse
ggcagcggctgctcaggtga

SEQ ID NO: 459711 - DNA, 20 bp, mouse
ggtcctatcagaggagacga

SEQ ID NO: 459712 - DNA, 20 bp, mouse
gtcccttcacagccgctcgt

SEQ ID NO: 459713 - DNA, 20 bp, mouse
gcccaccccgcgccacggtg

SEQ ID NO: 459714 - DNA, 20 bp, mouse
gaaccggatcccattgtacc

SEQ ID NO: 459715 - DNA, 20 bp, mouse
gagctacgagctgccaatct

SEQ ID NO: 459716 - DNA, 20 bp, mouse
gaggcccgcatggcacggtg

SEQ ID NO: 459717 - DNA, 20 bp, mouse
gtgctgtcccggcttcccgc

SEQ ID NO: 459718 - DNA, 20 bp, mouse
ggccatgcgggcctcagggt

SEQ ID NO: 459719 - DNA, 20 bp, mouse
gacctaccctgaggcccgca

SEQ ID NO: 459720 - DNA, 20 bp, mouse
gagcggagcgcggtgcctgc

SEQ ID NO: 459721 - DNA, 20 bp, mouse
gctgtgtgtgcgtgcagagg

SEQ ID NO: 459722 - DNA, 20 bp, mouse
gcagtgctgcacctaccctg

SEQ ID NO: 459723 - DNA, 20 bp, mouse
ggccgacagctcccacttgt

SEQ ID NO: 459724 - DNA, 20 bp, mouse
ggagactccgatcctggagt

SEQ ID NO: 459725 - DNA, 20 bp, mouse
gaaacaggcagctgctggag

SEQ ID NO: 459726 - DNA, 20 bp, mouse
gcgctcacccgggcttcccc

SEQ ID NO: 459727 - DNA, 20 bp, mouse
gcccagctcggcgctcaccc

SEQ ID NO: 459728 - DNA, 20 bp, mouse
ggccgcagccgcccgggaca

SEQ ID NO: 459729 - DNA, 20 bp, mouse
gtggagagcgcgtttgagtg

SEQ ID NO: 459730 - DNA, 20 bp, mouse
gaaacgcgctctccagcccg

SEQ ID NO: 459731 - DNA, 20 bp, mouse
gggccccagccgagctaccc

SEQ ID NO: 459732 - DNA, 20 bp, mouse
ggcgcgcccgtcgcttcccg

SEQ ID NO: 459733 - DNA, 20 bp, mouse
gagctgggtccatcctcccc

SEQ ID NO: 459734 - DNA, 20 bp, mouse
gatcctccccgggaagcgac

SEQ ID NO: 459735 - DNA, 20 bp, mouse
ggggcccgcgagcccgggta

SEQ ID NO: 459736 - DNA, 20 bp, mouse
gatactcaagcccatcccgg

SEQ ID NO: 459737 - DNA, 20 bp, mouse
gaggaggttgccaccgggat

SEQ ID NO: 459738 - DNA, 20 bp, mouse
gatggatgttgatgacgatg

SEQ ID NO: 459739 - DNA, 20 bp, mouse
gcgatgaggaggttgccacc

SEQ ID NO: 459740 - DNA, 20 bp, mouse
gctgtgcagaagggcatcaa

SEQ ID NO: 459741 - DNA, 20 bp, mouse
gttggcatccaagatacgat

SEQ ID NO: 459742 - DNA, 20 bp, mouse
gtatggtccaggagcccacc

SEQ ID NO: 459743 - DNA, 20 bp, mouse
gtatcatgtccattccaggt

SEQ ID NO: 459744 - DNA, 20 bp, mouse
gtccaggagcccacctggaa

SEQ ID NO: 459745 - DNA, 20 bp, mouse
gtcaaaaagttgctttggta

SEQ ID NO: 459746 - DNA, 20 bp, mouse
gcacagagctggactgactg

SEQ ID NO: 459747 - DNA, 20 bp, mouse
gagagtagccatctagccac

SEQ ID NO: 459748 - DNA, 20 bp, mouse
gggactgactgaggttagca

SEQ ID NO: 459749 - DNA, 20 bp, mouse
gggaacagccagtggctaga

SEQ ID NO: 459750 - DNA, 20 bp, mouse
gatggcagctccacccagat

SEQ ID NO: 459751 - DNA, 20 bp, mouse
gacagaagcccggcctggga

SEQ ID NO: 459752 - DNA, 20 bp, mouse
gtgtcacagaagcccggcct

SEQ ID NO: 459753 - DNA, 20 bp, mouse
gtacccactgggaccaatca

SEQ ID NO: 459754 - DNA, 20 bp, mouse
ggtagtagtgcctatctggg

SEQ ID NO: 459755 - DNA, 20 bp, mouse
gtagccatgattggtcccag

SEQ ID NO: 459756 - DNA, 20 bp, mouse
ggagggacttgggttctccc

SEQ ID NO: 459757 - DNA, 20 bp, mouse
ggaggagggttgagggactt

SEQ ID NO: 459758 - DNA, 20 bp, mouse
gccgccgccgccaccaggag

SEQ ID NO: 459759 - DNA, 20 bp, mouse
gtgaaaaggaggagggttga

SEQ ID NO: 459760 - DNA, 20 bp, mouse
ggaaatgcgagtcctctctc

SEQ ID NO: 459761 - DNA, 20 bp, mouse
gaagcagaagtagagatcgg

SEQ ID NO: 459762 - DNA, 20 bp, mouse
gtctaggaaggaaccttagt

SEQ ID NO: 459763 - DNA, 20 bp, mouse
ggctccggccggaacagagt

SEQ ID NO: 459764 - DNA, 20 bp, mouse
gggaaccttagttggagaga

SEQ ID NO: 459765 - DNA, 20 bp, mouse
gcagagacaacaagcactct

SEQ ID NO: 459766 - DNA, 20 bp, mouse
ggaggctgctcacagtgtgt

SEQ ID NO: 459767 - DNA, 20 bp, mouse
gctgctcacagtgtgtaggg

SEQ ID NO: 459768 - DNA, 20 bp, mouse
gaagttgcagagatcaccgg

SEQ ID NO: 459769 - DNA, 20 bp, mouse
gtgtagggtggtggatgagc

SEQ ID NO: 459770 - DNA, 20 bp, mouse
gctcctggagacgaatacag

SEQ ID NO: 459771 - DNA, 20 bp, mouse
gctcacagtgtgtagggtgg

SEQ ID NO: 459772 - DNA, 20 bp, mouse
ggtctgaagcgcgctggctc

SEQ ID NO: 459773 - DNA, 20 bp, mouse
gtggaagttgcagagatcac

SEQ ID NO: 459774 - DNA, 20 bp, mouse
gtcatggccaataaccataa

SEQ ID NO: 459775 - DNA, 20 bp, mouse
gagcccggaataaacccccc

SEQ ID NO: 459776 - DNA, 20 bp, mouse
gggagcagcagcacacgcta

SEQ ID NO: 459777 - DNA, 20 bp, mouse
gcagcgcgggatgcgagtgc

SEQ ID NO: 459778 - DNA, 20 bp, mouse
gcgcgggatgcgagtgcggg

SEQ ID NO: 459779 - DNA, 20 bp, mouse
ggcagcacacgctagggccc

SEQ ID NO: 459780 - DNA, 20 bp, mouse
gtgcgggcggcatgagctcg

SEQ ID NO: 459781 - DNA, 20 bp, mouse
gcagctgcggggcggcagac

SEQ ID NO: 459782 - DNA, 20 bp, mouse
gcggcagacgggagcagcgc

SEQ ID NO: 459783 - DNA, 20 bp, mouse
gggcgttatcagctgcgggg

SEQ ID NO: 459784 - DNA, 20 bp, mouse
gtgtgctgctgctcccgggc

SEQ ID NO: 459785 - DNA, 20 bp, mouse
ggagcgccaggaggccacgc

SEQ ID NO: 459786 - DNA, 20 bp, mouse
gtagtcgcgcgcccaccctg

SEQ ID NO: 459787 - DNA, 20 bp, mouse
gttgagcgtccgggagatgt

SEQ ID NO: 459788 - DNA, 20 bp, mouse
ggttgggaccgccgcagggt

SEQ ID NO: 459789 - DNA, 20 bp, mouse
gtcgcgcgcccaccctgcgg

SEQ ID NO: 459790 - DNA, 20 bp, mouse
gctgcggcggtcccaacccg

SEQ ID NO: 459791 - DNA, 20 bp, mouse
gtcctgcagcccggccagtg

SEQ ID NO: 459792 - DNA, 20 bp, mouse
gcgagcggccaggggcccgc

SEQ ID NO: 459793 - DNA, 20 bp, mouse
ggtgggcaccgagcggccag

SEQ ID NO: 459794 - DNA, 20 bp, mouse
ggctacgggagcagctggta

SEQ ID NO: 459795 - DNA, 20 bp, mouse
ggagccgcgcgcgggacccg

SEQ ID NO: 459796 - DNA, 20 bp, mouse
gccagcccggccgggcccca

SEQ ID NO: 459797 - DNA, 20 bp, mouse
ggggctcaccgggaacgaga

SEQ ID NO: 459798 - DNA, 20 bp, mouse
gcctcggcgccccccatccc

SEQ ID NO: 459799 - DNA, 20 bp, mouse
gaacgagaaggcccggatca

SEQ ID NO: 459800 - DNA, 20 bp, mouse
gccacggccgcccctctcgc

SEQ ID NO: 459801 - DNA, 20 bp, mouse
gcaccgggaacgagaaggcc

SEQ ID NO: 459802 - DNA, 20 bp, mouse
gggcgcctatgcagatgaga

SEQ ID NO: 459803 - DNA, 20 bp, mouse
ggttgcattggctccgagag

SEQ ID NO: 459804 - DNA, 20 bp, mouse
gccgcgtgcagcaggcgctg

SEQ ID NO: 459805 - DNA, 20 bp, mouse
gggcgccgaggctgaggacg

SEQ ID NO: 459806 - DNA, 20 bp, mouse
ggcgcgagccacatcgtctg

SEQ ID NO: 459807 - DNA, 20 bp, mouse
ggacgccgacatgacgaaca

SEQ ID NO: 459808 - DNA, 20 bp, mouse
gcggacgaccacagacgatg

SEQ ID NO: 459809 - DNA, 20 bp, mouse
gtcggctactgtctcctcgt

SEQ ID NO: 459810 - DNA, 20 bp, mouse
gggagctcaagtactcctcc

SEQ ID NO: 459811 - DNA, 20 bp, mouse
gctggcttcatctcttgtgt

SEQ ID NO: 459812 - DNA, 20 bp, mouse
gacacggggacttcggatac

SEQ ID NO: 459813 - DNA, 20 bp, mouse
ggtccccgtgttcgtcatgt

SEQ ID NO: 459814 - DNA, 20 bp, mouse
gaacttcagccgctgcggag

SEQ ID NO: 459815 - DNA, 20 bp, mouse
ggtcatctcccggttcctgg

SEQ ID NO: 459816 - DNA, 20 bp, mouse
gaacagctccggccaaatcc

SEQ ID NO: 459817 - DNA, 20 bp, mouse
gaagagaccatgccaggatt

SEQ ID NO: 459818 - DNA, 20 bp, mouse
gcggggatcatagccccagg

SEQ ID NO: 459819 - DNA, 20 bp, mouse
ggagcatgcgccctcctggc

SEQ ID NO: 459820 - DNA, 20 bp, mouse
ggaccatgccaggatttggc

SEQ ID NO: 459821 - DNA, 20 bp, mouse
gctccggccaaatcctggca

SEQ ID NO: 459822 - DNA, 20 bp, mouse
gcacgcgggctgcctcacct

SEQ ID NO: 459823 - DNA, 20 bp, mouse
ggcagggctctcttcaacct

SEQ ID NO: 459824 - DNA, 20 bp, mouse
gtgagcagctgaggccgggc

SEQ ID NO: 459825 - DNA, 20 bp, mouse
ggtggtgatgaccaagtccc

SEQ ID NO: 459826 - DNA, 20 bp, mouse
gccagcaggcaggcaccggg

SEQ ID NO: 459827 - DNA, 20 bp, mouse
gtcgcgctcctggggctcgg

SEQ ID NO: 459828 - DNA, 20 bp, mouse
gtcccacggccgactcggag

SEQ ID NO: 459829 - DNA, 20 bp, mouse
gcagcaccacgggcaggccg

SEQ ID NO: 459830 - DNA, 20 bp, mouse
gcacgtaccgagcggtgaga

SEQ ID NO: 459831 - DNA, 20 bp, mouse
ggcgcggagtccccggggag

SEQ ID NO: 459832 - DNA, 20 bp, mouse
ggcttcgcgcggagtccccg

SEQ ID NO: 459833 - DNA, 20 bp, mouse
gcgtgatcgcgcggaggctg

SEQ ID NO: 459834 - DNA, 20 bp, mouse
gggacaccgccgccactccc

SEQ ID NO: 459835 - DNA, 20 bp, mouse
ggcggtgtccctgggcccgg

SEQ ID NO: 459836 - DNA, 20 bp, mouse
gatggaggtggcggtcgcag

SEQ ID NO: 459837 - DNA, 20 bp, mouse
gggcaacgtggatacagcac

SEQ ID NO: 459838 - DNA, 20 bp, mouse
gaagcaacgttagtgaatag

SEQ ID NO: 459839 - DNA, 20 bp, mouse
gcgcggcgggccgagccctg

SEQ ID NO: 459840 - DNA, 20 bp, mouse
ggcccgggcccccttacctc

SEQ ID NO: 459841 - DNA, 20 bp, mouse
gttagtgaataggggccttg

SEQ ID NO: 459842 - DNA, 20 bp, mouse
gggcggccaccgctacacca

SEQ ID NO: 459843 - DNA, 20 bp, mouse
gaggtccgcgggcggaggtg

SEQ ID NO: 459844 - DNA, 20 bp, mouse
gagctctgcgagcggcgtgg

SEQ ID NO: 459845 - DNA, 20 bp, mouse
gctgcggcgggccggaggta

SEQ ID NO: 459846 - DNA, 20 bp, mouse
ggacacgcgcggagtcagaa

SEQ ID NO: 459847 - DNA, 20 bp, mouse
gggccgaacagcaccatccc

SEQ ID NO: 459848 - DNA, 20 bp, mouse
gagggtgcgcgcggcttagg

SEQ ID NO: 459849 - DNA, 20 bp, mouse
ggtgaggccgccgtgagggt

SEQ ID NO: 459850 - DNA, 20 bp, mouse
gtgggaggtgcgccatgccg

SEQ ID NO: 459851 - DNA, 20 bp, mouse
gagaagggtgcgcgcggctt

SEQ ID NO: 459852 - DNA, 20 bp, mouse
gggctcggcgctgcacccta

SEQ ID NO: 459853 - DNA, 20 bp, mouse
gactccgcgcgtgtctggag

SEQ ID NO: 459854 - DNA, 20 bp, mouse
ggcgcctcccaccctcacgg

SEQ ID NO: 459855 - DNA, 20 bp, mouse
gaggtgcgccatgccgggga

SEQ ID NO: 459856 - DNA, 20 bp, mouse
gcttgagttgctgaaggtat

SEQ ID NO: 459857 - DNA, 20 bp, mouse
gtggggactagagagagtcc

SEQ ID NO: 459858 - DNA, 20 bp, mouse
ggtcaggaccgtccacccgg

SEQ ID NO: 459859 - DNA, 20 bp, mouse
ggacggtcctgactgctacc

SEQ ID NO: 459860 - DNA, 20 bp, mouse
ggagtccgggtgtccagagt

SEQ ID NO: 459861 - DNA, 20 bp, mouse
gggcagcatcgtctcagatg

SEQ ID NO: 459862 - DNA, 20 bp, mouse
gcctgtgggagccacaatag

SEQ ID NO: 459863 - DNA, 20 bp, mouse
gaccatggggaaccccactc

SEQ ID NO: 459864 - DNA, 20 bp, mouse
gcccctatggctaggatctc

SEQ ID NO: 459865 - DNA, 20 bp, mouse
ggctgtctctacttcagacc

SEQ ID NO: 459866 - DNA, 20 bp, mouse
ggcgtagcagaccaaagagg

SEQ ID NO: 459867 - DNA, 20 bp, mouse
gagggcgtagcagaccaaag

SEQ ID NO: 459868 - DNA, 20 bp, mouse
ggccagcaggcggccactta

SEQ ID NO: 459869 - DNA, 20 bp, mouse
gaccggtacgcaggcagaac

SEQ ID NO: 459870 - DNA, 20 bp, mouse
gagcgagagtaccggtacgc

SEQ ID NO: 459871 - DNA, 20 bp, mouse
gcgggtactgcgacctctgg

SEQ ID NO: 459872 - DNA, 20 bp, mouse
ggccagttctgcctgcgtac

SEQ ID NO: 459873 - DNA, 20 bp, mouse
gggtactctcgctctcatcc

SEQ ID NO: 459874 - DNA, 20 bp, mouse
gtggtctgctacgccctaag

SEQ ID NO: 459875 - DNA, 20 bp, mouse
ggccttctcctaaccgccag

SEQ ID NO: 459876 - DNA, 20 bp, mouse
gcgaccgggcgccttggggt

SEQ ID NO: 459877 - DNA, 20 bp, mouse
gggccctacagctgcattaa

SEQ ID NO: 459878 - DNA, 20 bp, mouse
gggcccttaatgcagctgta

SEQ ID NO: 459879 - DNA, 20 bp, mouse
gagggcctggtagcccagtg

SEQ ID NO: 459880 - DNA, 20 bp, mouse
gcagcgtctcgccaacccca

SEQ ID NO: 459881 - DNA, 20 bp, mouse
gccaaggcgcccggtcgcca

SEQ ID NO: 459882 - DNA, 20 bp, mouse
gggcgcgcagcgcagtacag

SEQ ID NO: 459883 - DNA, 20 bp, mouse
gacacgaaggtgccgggcat

SEQ ID NO: 459884 - DNA, 20 bp, mouse
gccgcacggaacacgcactc

SEQ ID NO: 459885 - DNA, 20 bp, mouse
gctgcaggcaggagaccgca

SEQ ID NO: 459886 - DNA, 20 bp, mouse
gtgcgcggcggaaacaccgg

SEQ ID NO: 459887 - DNA, 20 bp, mouse
ggcctgcgcggcggaaacac

SEQ ID NO: 459888 - DNA, 20 bp, mouse
ggcggcgctcctccgctccc

SEQ ID NO: 459889 - DNA, 20 bp, mouse
gcgtacggactaaagcagcg

SEQ ID NO: 459890 - DNA, 20 bp, mouse
gcgctcctccgctccccggc

SEQ ID NO: 459891 - DNA, 20 bp, mouse
gaacgttcacctgcgccgta

SEQ ID NO: 459892 - DNA, 20 bp, mouse
gttgttaagagaatattgta

SEQ ID NO: 459893 - DNA, 20 bp, mouse
ggccgggaagaaggctcgga

SEQ ID NO: 459894 - DNA, 20 bp, mouse
gtcttggctgtgggtcctcg

SEQ ID NO: 459895 - DNA, 20 bp, mouse
gagtgttggtgattaagtgg

SEQ ID NO: 459896 - DNA, 20 bp, mouse
gtcgggagaaaaataacctg

SEQ ID NO: 459897 - DNA, 20 bp, mouse
gcaacacagcccagagagtc

SEQ ID NO: 459898 - DNA, 20 bp, mouse
ggagtcaggagcagtcctgc

SEQ ID NO: 459899 - DNA, 20 bp, mouse
gaccactggtgccaggtgtc

SEQ ID NO: 459900 - DNA, 20 bp, mouse
gctgctggaacctgcacccc

SEQ ID NO: 459901 - DNA, 20 bp, mouse
ggtacagtgtcatctctcag

SEQ ID NO: 459902 - DNA, 20 bp, mouse
gctgacatgtacgccagggg

SEQ ID NO: 459903 - DNA, 20 bp, mouse
gatagatcttcacttaccac

SEQ ID NO: 459904 - DNA, 20 bp, mouse
gtgtttcattcctggctggt

SEQ ID NO: 459905 - DNA, 20 bp, mouse
ggagattggtgacccaaaaa

SEQ ID NO: 459906 - DNA, 20 bp, mouse
gccttctggaggcgaagaca

SEQ ID NO: 459907 - DNA, 20 bp, mouse
ggtgcgcgcgcgaggactcg

SEQ ID NO: 459908 - DNA, 20 bp, mouse
gacacaagcaaggggcaccg

SEQ ID NO: 459909 - DNA, 20 bp, mouse
gtcgcccctccgaaaaccag

SEQ ID NO: 459910 - DNA, 20 bp, mouse
gcgcactgacgcccaccccg

SEQ ID NO: 459911 - DNA, 20 bp, mouse
ggcgccgctggttttcggag

SEQ ID NO: 459912 - DNA, 20 bp, mouse
gtctccagctttccttctgg

SEQ ID NO: 459913 - DNA, 20 bp, mouse
gcacgcccccctgcccgggg

SEQ ID NO: 459914 - DNA, 20 bp, mouse
gcccgcccgccggtactgac

SEQ ID NO: 459915 - DNA, 20 bp, mouse
gtcgcctccagaaggaaagc

SEQ ID NO: 459916 - DNA, 20 bp, mouse
ggacccgcacacaccgccag

SEQ ID NO: 459917 - DNA, 20 bp, mouse
gccgccagcggctggatccc

SEQ ID NO: 459918 - DNA, 20 bp, mouse
ggccccgagatagggaatga

SEQ ID NO: 459919 - DNA, 20 bp, mouse
gtgtcggtgatcctccaaga

SEQ ID NO: 459920 - DNA, 20 bp, mouse
ggaagcaagctcgggtcgtg

SEQ ID NO: 459921 - DNA, 20 bp, mouse
gtgcttcacaactgcaggac

SEQ ID NO: 459922 - DNA, 20 bp, mouse
gggagcaggagtcctagtgt

SEQ ID NO: 459923 - DNA, 20 bp, mouse
gaggcgagccgaggaggaga

SEQ ID NO: 459924 - DNA, 20 bp, mouse
ggtgcctgggatccagccgc

SEQ ID NO: 459925 - DNA, 20 bp, mouse
gccgcccccacggctaccaa

SEQ ID NO: 459926 - DNA, 20 bp, mouse
gctgcgcccgacgcaaggag

SEQ ID NO: 459927 - DNA, 20 bp, mouse
gcgagcgcagcggaggagga

SEQ ID NO: 459928 - DNA, 20 bp, mouse
gggtccccggcagctccgag

SEQ ID NO: 459929 - DNA, 20 bp, mouse
gggagccgcgagcgcagcgg

SEQ ID NO: 459930 - DNA, 20 bp, mouse
gcgcccgacgcaaggagcgg

SEQ ID NO: 459931 - DNA, 20 bp, mouse
gctgtccccacgttgtccgg

SEQ ID NO: 459932 - DNA, 20 bp, mouse
gctccgcctccggacaacgt

SEQ ID NO: 459933 - DNA, 20 bp, mouse
gcgcggcgggtccaggtccc

SEQ ID NO: 459934 - DNA, 20 bp, mouse
ggccgcgagcgcagcggagg

SEQ ID NO: 459935 - DNA, 20 bp, mouse
gcggcctccgctccttgcgt

SEQ ID NO: 459936 - DNA, 20 bp, mouse
ggagagctggacgtgcaccg

SEQ ID NO: 459937 - DNA, 20 bp, mouse
gagccgccgaggagcagagg

SEQ ID NO: 459938 - DNA, 20 bp, mouse
gaggaggtgtgagcccacag

SEQ ID NO: 459939 - DNA, 20 bp, mouse
gaagcttaggaggcaccccg

SEQ ID NO: 459940 - DNA, 20 bp, mouse
ggcggcccgggcgctactca

SEQ ID NO: 459941 - DNA, 20 bp, mouse
gcagagccgccgaggagcag

SEQ ID NO: 459942 - DNA, 20 bp, mouse
gggctctgcgggcggacgcc

SEQ ID NO: 459943 - DNA, 20 bp, mouse
ggcgctgggacggcacccgg

SEQ ID NO: 459944 - DNA, 20 bp, mouse
ggcaggctactactacctcg

SEQ ID NO: 459945 - DNA, 20 bp, mouse
gggaccagagtgtcaagctt

SEQ ID NO: 459946 - DNA, 20 bp, mouse
ggcaccgggcggggactcga

SEQ ID NO: 459947 - DNA, 20 bp, mouse
gccagcaccccggaactcag

SEQ ID NO: 459948 - DNA, 20 bp, mouse
gaggcccccgcgagaacctc

SEQ ID NO: 459949 - DNA, 20 bp, mouse
ggtaccggaggttctcgcgg

SEQ ID NO: 459950 - DNA, 20 bp, mouse
ggggactcgatggctgagga

SEQ ID NO: 459951 - DNA, 20 bp, mouse
gaggggagggaacccgcgag

SEQ ID NO: 459952 - DNA, 20 bp, mouse
gacaggtgaggaagctaggt

SEQ ID NO: 459953 - DNA, 20 bp, mouse
gggctgaggacggtacgaat

SEQ ID NO: 459954 - DNA, 20 bp, mouse
gtggctgagacggtaagagt

SEQ ID NO: 459955 - DNA, 20 bp, mouse
gtccggtacaaatcctgaga

SEQ ID NO: 459956 - DNA, 20 bp, mouse
gcggcaaggcactggcacac

SEQ ID NO: 459957 - DNA, 20 bp, mouse
ggtgccttgccgatgctctg

SEQ ID NO: 459958 - DNA, 20 bp, mouse
gaccgccctttcagcgggga

SEQ ID NO: 459959 - DNA, 20 bp, mouse
gtacaaccatggaggagctc

SEQ ID NO: 459960 - DNA, 20 bp, mouse
gggtggtaacccctaggtga

SEQ ID NO: 459961 - DNA, 20 bp, mouse
gccccaaggtggtaacccct

SEQ ID NO: 459962 - DNA, 20 bp, mouse
gtatgaggtcagctaaccat

SEQ ID NO: 459963 - DNA, 20 bp, mouse
gagaaaggtagggctcccca

SEQ ID NO: 459964 - DNA, 20 bp, mouse
ggactcaagaagcagaaacg

SEQ ID NO: 459965 - DNA, 20 bp, mouse
gggctcatctcacctcacta

SEQ ID NO: 459966 - DNA, 20 bp, mouse
ggcgctgctcctcctcgcta

SEQ ID NO: 459967 - DNA, 20 bp, mouse
gctaaggcaggagccggctg

SEQ ID NO: 459968 - DNA, 20 bp, mouse
gggctcctgccttagcgagg

SEQ ID NO: 459969 - DNA, 20 bp, mouse
gcaggtagacgaccatcagg

SEQ ID NO: 459970 - DNA, 20 bp, mouse
ggccggctcctgccttagcg

SEQ ID NO: 459971 - DNA, 20 bp, mouse
gccggctggggctgagtctc

SEQ ID NO: 459972 - DNA, 20 bp, mouse
ggcgctcttaccccaaatcc

SEQ ID NO: 459973 - DNA, 20 bp, mouse
gctggaaacactggtcagag

SEQ ID NO: 459974 - DNA, 20 bp, mouse
gagtcagccatcagaagcaa

SEQ ID NO: 459975 - DNA, 20 bp, mouse
gtgctcctcctcgctaaggc

SEQ ID NO: 459976 - DNA, 20 bp, mouse
ggagagaagtcattagccct

SEQ ID NO: 459977 - DNA, 20 bp, mouse
ggctcagggcagagaagtac

SEQ ID NO: 459978 - DNA, 20 bp, mouse
ggctccaagataagtgccca

SEQ ID NO: 459979 - DNA, 20 bp, mouse
gggcagagaagtacagggcc

SEQ ID NO: 459980 - DNA, 20 bp, mouse
gcgggttctaggcagagcca

SEQ ID NO: 459981 - DNA, 20 bp, mouse
gggatctcccggcaggtcat

SEQ ID NO: 459982 - DNA, 20 bp, mouse
ggtgcagggctagatagaag

SEQ ID NO: 459983 - DNA, 20 bp, mouse
gagctgaggaggagcctgaa

SEQ ID NO: 459984 - DNA, 20 bp, mouse
gctgcctgaaagatggagag

SEQ ID NO: 459985 - DNA, 20 bp, mouse
gaggtggggacagacctact

SEQ ID NO: 459986 - DNA, 20 bp, mouse
gggttccacgcggagactgg

SEQ ID NO: 459987 - DNA, 20 bp, mouse
gcttagaacccgggctggga

SEQ ID NO: 459988 - DNA, 20 bp, mouse
gcgtaggacaggctaagaag

SEQ ID NO: 459989 - DNA, 20 bp, mouse
gagggcgagactgtgcggga

SEQ ID NO: 459990 - DNA, 20 bp, mouse
gctgggagggcgagactgtg

SEQ ID NO: 459991 - DNA, 20 bp, mouse
gccgaagccaaggttccacg

SEQ ID NO: 459992 - DNA, 20 bp, mouse
ggactgggggcttagaaccc

SEQ ID NO: 459993 - DNA, 20 bp, mouse
gctccctcgcaggcttccgt

SEQ ID NO: 459994 - DNA, 20 bp, mouse
ggtgctcccgaggaccccag

SEQ ID NO: 459995 - DNA, 20 bp, mouse
gggcgcgcgagagctcgctg

SEQ ID NO: 459996 - DNA, 20 bp, mouse
gcgccgggcgtcagagggac

SEQ ID NO: 459997 - DNA, 20 bp, mouse
gcgtatctcgaaggtgacca

SEQ ID NO: 459998 - DNA, 20 bp, mouse
gacaaatccaaacagctctg

SEQ ID NO: 459999 - DNA, 20 bp, mouse
ggatacgtgggaataaaggg

SEQ ID NO: 460000 - DNA, 20 bp, mouse
ggtggatgtggtttgtgtct

SEQ ID NO: 460001 - DNA, 20 bp, mouse
ggcgctcgccgggcgtcaga

SEQ ID NO: 460002 - DNA, 20 bp, mouse
gcaaacctggcggcccatcc

SEQ ID NO: 460003 - DNA, 20 bp, mouse
gcataagcagaaatataagg

SEQ ID NO: 460004 - DNA, 20 bp, mouse
gtgctgttgaggcatcttcg

SEQ ID NO: 460005 - DNA, 20 bp, mouse
gccagagcgccccagccgga

SEQ ID NO: 460006 - DNA, 20 bp, mouse
gcccctcagggtaggaaagt

SEQ ID NO: 460007 - DNA, 20 bp, mouse
gctacgaagcccctcagggt

SEQ ID NO: 460008 - DNA, 20 bp, mouse
gatggctacgaagcccctca

SEQ ID NO: 460009 - DNA, 20 bp, mouse
ggaagccagggcccactcgt

SEQ ID NO: 460010 - DNA, 20 bp, mouse
gaggtgggtgacccagactg

SEQ ID NO: 460011 - DNA, 20 bp, mouse
gtgggaaccccgtacctggt

SEQ ID NO: 460012 - DNA, 20 bp, mouse
gtgggtaatagcgaagcaag

SEQ ID NO: 460013 - DNA, 20 bp, mouse
gcggcagcgtatgaaaaggt

SEQ ID NO: 460014 - DNA, 20 bp, mouse
gctcgtgggaaccccgtacc

SEQ ID NO: 460015 - DNA, 20 bp, mouse
gtggtctgggacgaaggagg

SEQ ID NO: 460016 - DNA, 20 bp, mouse
gaggcggagggaactatgcg

SEQ ID NO: 460017 - DNA, 20 bp, mouse
ggccctgaaggcgagtgtgg

SEQ ID NO: 460018 - DNA, 20 bp, mouse
gcctcagaaacggtctctcg

SEQ ID NO: 460019 - DNA, 20 bp, mouse
ggggtaccgtcgctgagagt

SEQ ID NO: 460020 - DNA, 20 bp, mouse
gagggctgaacgccgagaga

SEQ ID NO: 460021 - DNA, 20 bp, mouse
gccgccaaggagccctctct

SEQ ID NO: 460022 - DNA, 20 bp, mouse
gctcggccctgagcctcgtc

SEQ ID NO: 460023 - DNA, 20 bp, mouse
gctagccctgaaggcgagtg

SEQ ID NO: 460024 - DNA, 20 bp, mouse
gaggcttccggtctgttgtg

SEQ ID NO: 460025 - DNA, 20 bp, mouse
ggagttggctgggaaaacca

SEQ ID NO: 460026 - DNA, 20 bp, mouse
ggcggcccggatctgcgcaa

SEQ ID NO: 460027 - DNA, 20 bp, mouse
ggcccggatctgcgcaacgg

SEQ ID NO: 460028 - DNA, 20 bp, mouse
gcagcgaccgttggcgcgga

SEQ ID NO: 460029 - DNA, 20 bp, mouse
gcgaccgttggcgcggaggg

SEQ ID NO: 460030 - DNA, 20 bp, mouse
gcggatctgcgcaacggcgg

SEQ ID NO: 460031 - DNA, 20 bp, mouse
ggccaggcccagagcgaggg

SEQ ID NO: 460032 - DNA, 20 bp, mouse
gggggacgcgcagcgaccgt

SEQ ID NO: 460033 - DNA, 20 bp, mouse
gcctcctccctccgcgccaa

SEQ ID NO: 460034 - DNA, 20 bp, mouse
gacgagcggtgaccttccgg

SEQ ID NO: 460035 - DNA, 20 bp, mouse
gcgggccaggcccagagcga

SEQ ID NO: 460036 - DNA, 20 bp, mouse
gccgcgacgccgagtgggag

SEQ ID NO: 460037 - DNA, 20 bp, mouse
gaccgtccgcgacgccgagt

SEQ ID NO: 460038 - DNA, 20 bp, mouse
gcacggaagtgactccgaac

SEQ ID NO: 460039 - DNA, 20 bp, mouse
gcggggcccagagggccgag

SEQ ID NO: 460040 - DNA, 20 bp, mouse
ggaggaggcgcgcgccgtga

SEQ ID NO: 460041 - DNA, 20 bp, mouse
ggcctccgcccgccctccat

SEQ ID NO: 460042 - DNA, 20 bp, mouse
gacggtgagagcaaggaccg

SEQ ID NO: 460043 - DNA, 20 bp, mouse
gggcgaagccgcgcagggag

SEQ ID NO: 460044 - DNA, 20 bp, mouse
gagcgcggccgcacctgacg

SEQ ID NO: 460045 - DNA, 20 bp, mouse
gccgagcggctgcgttgtgg

SEQ ID NO: 460046 - DNA, 20 bp, mouse
gcccacggccacggagacag

SEQ ID NO: 460047 - DNA, 20 bp, mouse
ggaaagagagcccacggcca

SEQ ID NO: 460048 - DNA, 20 bp, mouse
ggggcaaaaaaaagccgagg

SEQ ID NO: 460049 - DNA, 20 bp, mouse
ggcagtgcaagaccagccgg

SEQ ID NO: 460050 - DNA, 20 bp, mouse
gggcgtggaaaggacccgga

SEQ ID NO: 460051 - DNA, 20 bp, mouse
ggaggcctggaggacaagag

SEQ ID NO: 460052 - DNA, 20 bp, mouse
ggcctggaggacaagagtgg

SEQ ID NO: 460053 - DNA, 20 bp, mouse
gcgccatcatggtgagtcga

SEQ ID NO: 460054 - DNA, 20 bp, mouse
gcagcctaggcgccacctgg

SEQ ID NO: 460055 - DNA, 20 bp, mouse
gcccgaagcgagcgtgctga

SEQ ID NO: 460056 - DNA, 20 bp, mouse
gggaggctcggagcaggaag

SEQ ID NO: 460057 - DNA, 20 bp, mouse
gcgcgcttgagggccggttc

SEQ ID NO: 460058 - DNA, 20 bp, mouse
gccgggccgcgcttgagggc

SEQ ID NO: 460059 - DNA, 20 bp, mouse
gcgagcctccgcgccggaac

SEQ ID NO: 460060 - DNA, 20 bp, mouse
gggggaggggctccataccc

SEQ ID NO: 460061 - DNA, 20 bp, mouse
gttgagggccggttccggcg

SEQ ID NO: 460062 - DNA, 20 bp, mouse
ggactctctagaaccctccg

SEQ ID NO: 460063 - DNA, 20 bp, mouse
gagggccggttccggcgcgg

SEQ ID NO: 460064 - DNA, 20 bp, mouse
gcccagggcctccccggccc

SEQ ID NO: 460065 - DNA, 20 bp, mouse
gggggctccatacccgggag

SEQ ID NO: 460066 - DNA, 20 bp, mouse
gacggacactggggcttggg

SEQ ID NO: 460067 - DNA, 20 bp, mouse
gttgggaggctgctccaaca

SEQ ID NO: 460068 - DNA, 20 bp, mouse
ggctgctccaacaaggctgg

SEQ ID NO: 460069 - DNA, 20 bp, mouse
ggtgaggcggcttccatgta

SEQ ID NO: 460070 - DNA, 20 bp, mouse
gagccccagtgtccgtgagg

SEQ ID NO: 460071 - DNA, 20 bp, mouse
ggccacagcagtgccgtaca

SEQ ID NO: 460072 - DNA, 20 bp, mouse
gaagccgcctcacggacact

SEQ ID NO: 460073 - DNA, 20 bp, mouse
gtggctgagatgagcttgca

SEQ ID NO: 460074 - DNA, 20 bp, mouse
gtgcagccaccaggatgacc

SEQ ID NO: 460075 - DNA, 20 bp, mouse
gttgcacctggagctggaag

SEQ ID NO: 460076 - DNA, 20 bp, mouse
gcgcagtacctgagacatac

SEQ ID NO: 460077 - DNA, 20 bp, mouse
gtacctgagacatactggtg

SEQ ID NO: 460078 - DNA, 20 bp, mouse
gcagcccaccggcaactctc

SEQ ID NO: 460079 - DNA, 20 bp, mouse
ggccggtgggctgaactcct

SEQ ID NO: 460080 - DNA, 20 bp, mouse
ggagcccagctcatagcctg

SEQ ID NO: 460081 - DNA, 20 bp, mouse
gctgaagagcctggaggtcg

SEQ ID NO: 460082 - DNA, 20 bp, mouse
gctgccagagagttgccggt

SEQ ID NO: 460083 - DNA, 20 bp, mouse
ggcatcttcgcagcccggcg

SEQ ID NO: 460084 - DNA, 20 bp, mouse
gatacggatgccgaaagcgc

SEQ ID NO: 460085 - DNA, 20 bp, mouse
gtctctggcagttccggcgt

SEQ ID NO: 460086 - DNA, 20 bp, mouse
gggaagcctaggccgagagg

SEQ ID NO: 460087 - DNA, 20 bp, mouse
gagtacgcgtgcgccttgaa

SEQ ID NO: 460088 - DNA, 20 bp, mouse
gctgggaagcctaggccgag

SEQ ID NO: 460089 - DNA, 20 bp, mouse
gcgctgcgagcttgttggag

SEQ ID NO: 460090 - DNA, 20 bp, mouse
gagagggggcgctgtggcta

SEQ ID NO: 460091 - DNA, 20 bp, mouse
gcgtgcgccttgaacggcag

SEQ ID NO: 460092 - DNA, 20 bp, mouse
gaccctcactcaggaacccc

SEQ ID NO: 460093 - DNA, 20 bp, mouse
gttcgacgctgcgagcttgt

SEQ ID NO: 460094 - DNA, 20 bp, mouse
ggggggcgctgtggctaggg

SEQ ID NO: 460095 - DNA, 20 bp, mouse
gtgctagccgctgccgttca

SEQ ID NO: 460096 - DNA, 20 bp, mouse
gcgaccgacaccggagggag

SEQ ID NO: 460097 - DNA, 20 bp, mouse
gcggaccgaccgacaccgga

SEQ ID NO: 460098 - DNA, 20 bp, mouse
gcaggcggaccgaccgacac

SEQ ID NO: 460099 - DNA, 20 bp, mouse
gtgcagaggctctgaggcgg

SEQ ID NO: 460100 - DNA, 20 bp, mouse
gaacggacagacgcacgcac

SEQ ID NO: 460101 - DNA, 20 bp, mouse
gtacgaggaggtgatccggg

SEQ ID NO: 460102 - DNA, 20 bp, mouse
gggacagacgcacgcacagg

SEQ ID NO: 460103 - DNA, 20 bp, mouse
ggcgtacgaggaggtgatcc

SEQ ID NO: 460104 - DNA, 20 bp, mouse
gggaggagagcgcagccgac

SEQ ID NO: 460105 - DNA, 20 bp, mouse
gccgccctaaggctcactgg

SEQ ID NO: 460106 - DNA, 20 bp, mouse
gcttcgggcacagcgcatcg

SEQ ID NO: 460107 - DNA, 20 bp, mouse
gcatcggggcagcagctaag

SEQ ID NO: 460108 - DNA, 20 bp, mouse
gtccgactcagagctagggg

SEQ ID NO: 460109 - DNA, 20 bp, mouse
ggccgcatggagtctcccga

SEQ ID NO: 460110 - DNA, 20 bp, mouse
gcagagcagttggggcaccc

SEQ ID NO: 460111 - DNA, 20 bp, mouse
gggcagcagctaaggggccg

SEQ ID NO: 460112 - DNA, 20 bp, mouse
gccgggagtagctggctagt

SEQ ID NO: 460113 - DNA, 20 bp, mouse
ggcccggagctcgcatatca

SEQ ID NO: 460114 - DNA, 20 bp, mouse
gccgtccgactcagagctag

SEQ ID NO: 460115 - DNA, 20 bp, mouse
gactactgagtccgggcttc

SEQ ID NO: 460116 - DNA, 20 bp, mouse
ggtgcgctcccgacaagcgg

SEQ ID NO: 460117 - DNA, 20 bp, mouse
gcgagcagcgccggccgggt

SEQ ID NO: 460118 - DNA, 20 bp, mouse
ggcgcgggcgctgcaggtag

SEQ ID NO: 460119 - DNA, 20 bp, mouse
gtgggtgcgctcccgacaag

SEQ ID NO: 460120 - DNA, 20 bp, mouse
gggagcgagcagcgccggcc

SEQ ID NO: 460121 - DNA, 20 bp, mouse
gaagcctgcggggttccctg

SEQ ID NO: 460122 - DNA, 20 bp, mouse
gtgacaccgggaaggaacca

SEQ ID NO: 460123 - DNA, 20 bp, mouse
gcggtctgcggagaggagag

SEQ ID NO: 460124 - DNA, 20 bp, mouse
gtggcgcgtgggcgaagacg

SEQ ID NO: 460125 - DNA, 20 bp, mouse
gccgcgcctgaggaggcaag

SEQ ID NO: 460126 - DNA, 20 bp, mouse
ggagccgaccgaccactagg

SEQ ID NO: 460127 - DNA, 20 bp, mouse
gcggctcaggttcaccgcca

SEQ ID NO: 460128 - DNA, 20 bp, mouse
ggctgcatcgcggggaccgt

SEQ ID NO: 460129 - DNA, 20 bp, mouse
gctgcagcgccggcccgttc

SEQ ID NO: 460130 - DNA, 20 bp, mouse
gaccgtggggcgtgccatgg

SEQ ID NO: 460131 - DNA, 20 bp, mouse
gaccgccatggcacgcccca

SEQ ID NO: 460132 - DNA, 20 bp, mouse
gcggtgaacctgagccggaa

SEQ ID NO: 460133 - DNA, 20 bp, mouse
gaacctgagccggaacgggc

SEQ ID NO: 460134 - DNA, 20 bp, mouse
gaaccaggcagagatcttca

SEQ ID NO: 460135 - DNA, 20 bp, mouse
gtccggccgtcactggaggc

SEQ ID NO: 460136 - DNA, 20 bp, mouse
gcccagaggtgtgcacccag

SEQ ID NO: 460137 - DNA, 20 bp, mouse
gtaccaagtgggcgagtctc

SEQ ID NO: 460138 - DNA, 20 bp, mouse
gtcctatagtctgggcgagt

SEQ ID NO: 460139 - DNA, 20 bp, mouse
gactcaaagactgtcccggg

SEQ ID NO: 460140 - DNA, 20 bp, mouse
gcgctccttctgtaccaagt

SEQ ID NO: 460141 - DNA, 20 bp, mouse
gcagactataggagcctccc

SEQ ID NO: 460142 - DNA, 20 bp, mouse
gtgaagcgtcctgatcctgg

SEQ ID NO: 460143 - DNA, 20 bp, mouse
ggcccctgggtgcacacctc

SEQ ID NO: 460144 - DNA, 20 bp, mouse
gagccagagactcgcccact

SEQ ID NO: 460145 - DNA, 20 bp, mouse
gtcccagagtcgggagagcg

SEQ ID NO: 460146 - DNA, 20 bp, mouse
gacagtgtcatccccagctg

SEQ ID NO: 460147 - DNA, 20 bp, mouse
ggatgacactgtgtggacag

SEQ ID NO: 460148 - DNA, 20 bp, mouse
gggagagaatgatgacagac

SEQ ID NO: 460149 - DNA, 20 bp, mouse
ggaatccgtacagtaagatg

SEQ ID NO: 460150 - DNA, 20 bp, mouse
gtctgacacttggatcaact

SEQ ID NO: 460151 - DNA, 20 bp, mouse
gatgtgctcaaagaatacag

SEQ ID NO: 460152 - DNA, 20 bp, mouse
ggaggctctgacttgtaacg

SEQ ID NO: 460153 - DNA, 20 bp, mouse
gttaattggagagcaagatt

SEQ ID NO: 460154 - DNA, 20 bp, mouse
gttcaccaaggggccaagtg

SEQ ID NO: 460155 - DNA, 20 bp, mouse
gctgtccgcatcttactgta

SEQ ID NO: 460156 - DNA, 20 bp, mouse
gaccaggcagccggcccacc

SEQ ID NO: 460157 - DNA, 20 bp, mouse
gtcgcacagcaaagaacacc

SEQ ID NO: 460158 - DNA, 20 bp, mouse
ggccaacaccaaccgagccg

SEQ ID NO: 460159 - DNA, 20 bp, mouse
ggccgcggctcggttggtgt

SEQ ID NO: 460160 - DNA, 20 bp, mouse
gcccggagcacctgcagccc

SEQ ID NO: 460161 - DNA, 20 bp, mouse
gaggactcgaaactcagccg

SEQ ID NO: 460162 - DNA, 20 bp, mouse
ggaagccggaagttacataa

SEQ ID NO: 460163 - DNA, 20 bp, mouse
gtgctgcggcgacttccagg

SEQ ID NO: 460164 - DNA, 20 bp, mouse
gaactcagccgcggctcggt

SEQ ID NO: 460165 - DNA, 20 bp, mouse
gagcacagaaggagatccac

SEQ ID NO: 460166 - DNA, 20 bp, mouse
gagcgcgtgtactgaggacc

SEQ ID NO: 460167 - DNA, 20 bp, mouse
gggctgcagcgcgtgtactg

SEQ ID NO: 460168 - DNA, 20 bp, mouse
gtcgcgccccgggacgggaa

SEQ ID NO: 460169 - DNA, 20 bp, mouse
gtcagactggtaagcagggt

SEQ ID NO: 460170 - DNA, 20 bp, mouse
gatcagaagggcagcgaagg

SEQ ID NO: 460171 - DNA, 20 bp, mouse
gtaccagtctgacagcgttc

SEQ ID NO: 460172 - DNA, 20 bp, mouse
gggctatttccggagtaaaa

SEQ ID NO: 460173 - DNA, 20 bp, mouse
gggatgcatgcaaatcagaa

SEQ ID NO: 460174 - DNA, 20 bp, mouse
gagccagaacgctgtcagac

SEQ ID NO: 460175 - DNA, 20 bp, mouse
gccaggatgtgggtacggtt

SEQ ID NO: 460176 - DNA, 20 bp, mouse
ggactcgcagacgcccaagt

SEQ ID NO: 460177 - DNA, 20 bp, mouse
gcgcagacgcccaagtagga

SEQ ID NO: 460178 - DNA, 20 bp, mouse
ggagccaaagagggcatcgg

SEQ ID NO: 460179 - DNA, 20 bp, mouse
gcctcccccgatgccctctt

SEQ ID NO: 460180 - DNA, 20 bp, mouse
gggcgtctgcgagtcttctg

SEQ ID NO: 460181 - DNA, 20 bp, mouse
gggtatgctgcgggacaggt

SEQ ID NO: 460182 - DNA, 20 bp, mouse
gactggggcagtgttaaggt

SEQ ID NO: 460183 - DNA, 20 bp, mouse
gcctggtaaccgtcctactt

SEQ ID NO: 460184 - DNA, 20 bp, mouse
gcgtgggtcgcaggaggcta

SEQ ID NO: 460185 - DNA, 20 bp, mouse
gtgctgcgggacaggtaggt

SEQ ID NO: 460186 - DNA, 20 bp, mouse
ggccgcatctgtcactttgt

SEQ ID NO: 460187 - DNA, 20 bp, mouse
gcagatgcggccaacaatga

SEQ ID NO: 460188 - DNA, 20 bp, mouse
gctgggatggaaggtgtgtc

SEQ ID NO: 460189 - DNA, 20 bp, mouse
ggcccacaaagtgacagatg

SEQ ID NO: 460190 - DNA, 20 bp, mouse
gatgaaggcaatgagagtct

SEQ ID NO: 460191 - DNA, 20 bp, mouse
gcggtctgcagatccggaca

SEQ ID NO: 460192 - DNA, 20 bp, mouse
gcagggcgcggacaggatcg

SEQ ID NO: 460193 - DNA, 20 bp, mouse
gggaaggccgaagagtgctg

SEQ ID NO: 460194 - DNA, 20 bp, mouse
ggagtctgggctccagcgag

SEQ ID NO: 460195 - DNA, 20 bp, mouse
ggacgccaccacatcccagt

SEQ ID NO: 460196 - DNA, 20 bp, mouse
ggcgggagcgctgagttgtc

SEQ ID NO: 460197 - DNA, 20 bp, mouse
ggacagcggcccggaatagg

SEQ ID NO: 460198 - DNA, 20 bp, mouse
gggagcgctgagttgtcggg

SEQ ID NO: 460199 - DNA, 20 bp, mouse
gagggcgcgacacccggaag

SEQ ID NO: 460200 - DNA, 20 bp, mouse
ggcgcgacacccggaagtgg

SEQ ID NO: 460201 - DNA, 20 bp, mouse
gctgccgccggccctccgag

SEQ ID NO: 460202 - DNA, 20 bp, mouse
gagcccgggcggggacgaga

SEQ ID NO: 460203 - DNA, 20 bp, mouse
gttgtcgggcggcgggacag

SEQ ID NO: 460204 - DNA, 20 bp, mouse
gccggtcgcggagctggaga

SEQ ID NO: 460205 - DNA, 20 bp, mouse
gcgggacagcggcccggaat

SEQ ID NO: 460206 - DNA, 20 bp, mouse
gctggccgccagaagcgtga

SEQ ID NO: 460207 - DNA, 20 bp, mouse
ggccagaagcgtgacggacg

SEQ ID NO: 460208 - DNA, 20 bp, mouse
gcacccccggcgcaccacgt

SEQ ID NO: 460209 - DNA, 20 bp, mouse
gccgggggtgtgtacaacag

SEQ ID NO: 460210 - DNA, 20 bp, mouse
gagctgtcgcaggacccgca

SEQ ID NO: 460211 - DNA, 20 bp, mouse
gtccaatcagagggccgagg

SEQ ID NO: 460212 - DNA, 20 bp, mouse
gaagcgtgtacacagcaggg

SEQ ID NO: 460213 - DNA, 20 bp, mouse
gcgagtgacgtcagcaggcc

SEQ ID NO: 460214 - DNA, 20 bp, mouse
gggcaaccggaaaggctccg

SEQ ID NO: 460215 - DNA, 20 bp, mouse
gcgtgggcgtgaagctaaac

SEQ ID NO: 460216 - DNA, 20 bp, mouse
gaggcggagaaggcaagggg

SEQ ID NO: 460217 - DNA, 20 bp, mouse
gccgccgtgtctggaaagga

SEQ ID NO: 460218 - DNA, 20 bp, mouse
gcctaccgccgtgtctggaa

SEQ ID NO: 460219 - DNA, 20 bp, mouse
gcggctgcgcaggagtgacg

SEQ ID NO: 460220 - DNA, 20 bp, mouse
gtcgccgtcctttccagaca

SEQ ID NO: 460221 - DNA, 20 bp, mouse
ggagaaggcaaggggcggca

SEQ ID NO: 460222 - DNA, 20 bp, mouse
gcatgaggcggagaaggcaa

SEQ ID NO: 460223 - DNA, 20 bp, mouse
gatggaagaagggaaaatcc

SEQ ID NO: 460224 - DNA, 20 bp, mouse
ggtggccccgcagccacatg

SEQ ID NO: 460225 - DNA, 20 bp, mouse
ggccagggcgggacgagaac

SEQ ID NO: 460226 - DNA, 20 bp, mouse
gaaggctctccggactcggt

SEQ ID NO: 460227 - DNA, 20 bp, mouse
ggcggggagcctaccgagtc

SEQ ID NO: 460228 - DNA, 20 bp, mouse
gcgagtccggagagccttgg

SEQ ID NO: 460229 - DNA, 20 bp, mouse
gaagccgccgaggtcgatca

SEQ ID NO: 460230 - DNA, 20 bp, mouse
gcggtaggctccccgctgat

SEQ ID NO: 460231 - DNA, 20 bp, mouse
gagagcgatcaaccgatcag

SEQ ID NO: 460232 - DNA, 20 bp, mouse
gcctggcgatgaagaagtcc

SEQ ID NO: 460233 - DNA, 20 bp, mouse
ggcctgacgcatgatatcac

SEQ ID NO: 460234 - DNA, 20 bp, mouse
gcggcgaacaacgcgaggtc

SEQ ID NO: 460235 - DNA, 20 bp, mouse
ggcgccctgatcgacctcgg

SEQ ID NO: 460236 - DNA, 20 bp, mouse
ggacttcaccacctcccaga

SEQ ID NO: 460237 - DNA, 20 bp, mouse
gccgccctcggccaagtccc

SEQ ID NO: 460238 - DNA, 20 bp, mouse
gggaagtgctgccgtctggg

SEQ ID NO: 460239 - DNA, 20 bp, mouse
gagcactgcgttgagtgtgg

SEQ ID NO: 460240 - DNA, 20 bp, mouse
ggagtgtggtggcagtgcct

SEQ ID NO: 460241 - DNA, 20 bp, mouse
ggcgggaagtgctgccgtct

SEQ ID NO: 460242 - DNA, 20 bp, mouse
ggtaagcactgcgttgagtg

SEQ ID NO: 460243 - DNA, 20 bp, mouse
ggtgcctgggacttggccga

SEQ ID NO: 460244 - DNA, 20 bp, mouse
ggtgtctccgaatcagcggg

SEQ ID NO: 460245 - DNA, 20 bp, mouse
gtaagagacctgaggttgag

SEQ ID NO: 460246 - DNA, 20 bp, mouse
gaaccgggctcgacttaccg

SEQ ID NO: 460247 - DNA, 20 bp, mouse
gacaggaagcccgcggaagg

SEQ ID NO: 460248 - DNA, 20 bp, mouse
gccacgtgacaggaagcccg

SEQ ID NO: 460249 - DNA, 20 bp, mouse
gtaagtcgagcccggtttaa

SEQ ID NO: 460250 - DNA, 20 bp, mouse
ggtgacaggaagcccgcgga

SEQ ID NO: 460251 - DNA, 20 bp, mouse
gactccacgagcctttaaac

SEQ ID NO: 460252 - DNA, 20 bp, mouse
gcccagagccgccaagatga

SEQ ID NO: 460253 - DNA, 20 bp, mouse
gcagacccaaagaatccggg

SEQ ID NO: 460254 - DNA, 20 bp, mouse
gtgtgtctgcgtgctggccc

SEQ ID NO: 460255 - DNA, 20 bp, mouse
gggccagacccaaagaatcc

SEQ ID NO: 460256 - DNA, 20 bp, mouse
ggcccagctcgaaatcggag

SEQ ID NO: 460257 - DNA, 20 bp, mouse
gcgaaatcggagcggaacag

SEQ ID NO: 460258 - DNA, 20 bp, mouse
gcggttgctccggaagtgga

SEQ ID NO: 460259 - DNA, 20 bp, mouse
ggcccggttgtgaggaggag

SEQ ID NO: 460260 - DNA, 20 bp, mouse
gatggcgcccagctcgaaat

SEQ ID NO: 460261 - DNA, 20 bp, mouse
gacagcggggccgggagcgc

SEQ ID NO: 460262 - DNA, 20 bp, mouse
ggtccccccagggcctccgc

SEQ ID NO: 460263 - DNA, 20 bp, mouse
gcggaggccggggagaatca

SEQ ID NO: 460264 - DNA, 20 bp, mouse
gagcgccggcggaggccctg

SEQ ID NO: 460265 - DNA, 20 bp, mouse
gggaccggttgctccggaag

SEQ ID NO: 460266 - DNA, 20 bp, mouse
gcgcaaaggaacagaatcaa

SEQ ID NO: 460267 - DNA, 20 bp, mouse
gaccccgcgctggggactcg

SEQ ID NO: 460268 - DNA, 20 bp, mouse
gactcggggcagagatcaag

SEQ ID NO: 460269 - DNA, 20 bp, mouse
gatcccgagagcagaaagaa

SEQ ID NO: 460270 - DNA, 20 bp, mouse
gtccggcccatggagactag

SEQ ID NO: 460271 - DNA, 20 bp, mouse
gcacccctcgcggaagtgag

SEQ ID NO: 460272 - DNA, 20 bp, mouse
gagcccggcgactcagcctg

SEQ ID NO: 460273 - DNA, 20 bp, mouse
gggtccgcagggcccaggag

SEQ ID NO: 460274 - DNA, 20 bp, mouse
gtggtgcagaggacgaacct

SEQ ID NO: 460275 - DNA, 20 bp, mouse
gatcaagaggtagcgacaca

SEQ ID NO: 460276 - DNA, 20 bp, mouse
gtctgggctggagcacccag

SEQ ID NO: 460277 - DNA, 20 bp, mouse
gccagatgcacgccacgcat

SEQ ID NO: 460278 - DNA, 20 bp, mouse
gactctgcaaggggatcctg

SEQ ID NO: 460279 - DNA, 20 bp, mouse
gcagaagtgtcgtagctgag

SEQ ID NO: 460280 - DNA, 20 bp, mouse
gccaggggcgtgcaaagatc

SEQ ID NO: 460281 - DNA, 20 bp, mouse
ggtacagcggcaccctccgt

SEQ ID NO: 460282 - DNA, 20 bp, mouse
gcccacgcagaggacagaga

SEQ ID NO: 460283 - DNA, 20 bp, mouse
ggtcctctgcgtgggtacag

SEQ ID NO: 460284 - DNA, 20 bp, mouse
gtgccatacaaggccggagt

SEQ ID NO: 460285 - DNA, 20 bp, mouse
gagctacgacacttctgggc

SEQ ID NO: 460286 - DNA, 20 bp, mouse
gagcgcacagccaggatgtc

SEQ ID NO: 460287 - DNA, 20 bp, mouse
gcagtgaccattgagcatgg

SEQ ID NO: 460288 - DNA, 20 bp, mouse
gcacagaacgccagacatcc

SEQ ID NO: 460289 - DNA, 20 bp, mouse
ggcagctccaccatgctcaa

SEQ ID NO: 460290 - DNA, 20 bp, mouse
gatgtccgttcctaggagag

SEQ ID NO: 460291 - DNA, 20 bp, mouse
ggagcagataaaggcgtggg

SEQ ID NO: 460292 - DNA, 20 bp, mouse
gtaggagcagataaaggcgt

SEQ ID NO: 460293 - DNA, 20 bp, mouse
ggtgcgctctccttcttgcc

SEQ ID NO: 460294 - DNA, 20 bp, mouse
gcctatccatgtccgttcct

SEQ ID NO: 460295 - DNA, 20 bp, mouse
gtagcagtgaccattgagca

SEQ ID NO: 460296 - DNA, 20 bp, mouse
gaggcttctttaaccagcca

SEQ ID NO: 460297 - DNA, 20 bp, mouse
ggcagcatgaggtcagtggt

SEQ ID NO: 460298 - DNA, 20 bp, mouse
gcacctcgctccgtctgcca

SEQ ID NO: 460299 - DNA, 20 bp, mouse
gaggtgtgcagacggtcggt

SEQ ID NO: 460300 - DNA, 20 bp, mouse
gctccccgcgcgcagcgagc

SEQ ID NO: 460301 - DNA, 20 bp, mouse
gtcgctccgtctgccatggc

SEQ ID NO: 460302 - DNA, 20 bp, mouse
ggctcactcaggactttcag

SEQ ID NO: 460303 - DNA, 20 bp, mouse
ggaaagtcctgagtgagcag

SEQ ID NO: 460304 - DNA, 20 bp, mouse
gggcgttcgcggcttcctca

SEQ ID NO: 460305 - DNA, 20 bp, mouse
gagggagggacgcgaccgtg

SEQ ID NO: 460306 - DNA, 20 bp, mouse
ggtagtctgaggagagtatg

SEQ ID NO: 460307 - DNA, 20 bp, mouse
gggcgccgcgactcagaggg

SEQ ID NO: 460308 - DNA, 20 bp, mouse
gcggagaggtacccgggcca

SEQ ID NO: 460309 - DNA, 20 bp, mouse
gccgggagcggagaggtacc

SEQ ID NO: 460310 - DNA, 20 bp, mouse
gactcagagggcggcagcca

SEQ ID NO: 460311 - DNA, 20 bp, mouse
ggccggcgccgcgactcaga

SEQ ID NO: 460312 - DNA, 20 bp, mouse
gcgcgccttctccccgggag

SEQ ID NO: 460313 - DNA, 20 bp, mouse
gcacggccgcgccttctccc

SEQ ID NO: 460314 - DNA, 20 bp, mouse
gccgagccatggctccgcag

SEQ ID NO: 460315 - DNA, 20 bp, mouse
ggcggagccatggctcggag

SEQ ID NO: 460316 - DNA, 20 bp, mouse
gggcgggccggcatcccaaa

SEQ ID NO: 460317 - DNA, 20 bp, mouse
ggtggtagcgctgcccgagc

SEQ ID NO: 460318 - DNA, 20 bp, mouse
gcgagctggtttgaaactgg

SEQ ID NO: 460319 - DNA, 20 bp, mouse
ggccgcagagccggccagag

SEQ ID NO: 460320 - DNA, 20 bp, mouse
ggggccggggcggtcaagaa

SEQ ID NO: 460321 - DNA, 20 bp, mouse
gcggcatcccaaacggaagg

SEQ ID NO: 460322 - DNA, 20 bp, mouse
gggccggcatcccaaacgga

SEQ ID NO: 460323 - DNA, 20 bp, mouse
ggaacggcctagccctccag

SEQ ID NO: 460324 - DNA, 20 bp, mouse
gtagccctccagcgggtcct

SEQ ID NO: 460325 - DNA, 20 bp, mouse
gccgttccgagagggcgggc

SEQ ID NO: 460326 - DNA, 20 bp, mouse
gcaggcgcggagacccgaga

SEQ ID NO: 460327 - DNA, 20 bp, mouse
gcggagacccgagacggtgg

SEQ ID NO: 460328 - DNA, 20 bp, mouse
ggctggccagtgtaagatgg

SEQ ID NO: 460329 - DNA, 20 bp, mouse
ggcgcggagacccgagacgg

SEQ ID NO: 460330 - DNA, 20 bp, mouse
ggccgctggccagtgtaaga

SEQ ID NO: 460331 - DNA, 20 bp, mouse
gagacccgagacggtggtgg

SEQ ID NO: 460332 - DNA, 20 bp, mouse
ggtggcggcagtggacgggg

SEQ ID NO: 460333 - DNA, 20 bp, mouse
gggccagtgtaagatggcgg

SEQ ID NO: 460334 - DNA, 20 bp, mouse
ggaacagtcggagcatccgc

SEQ ID NO: 460335 - DNA, 20 bp, mouse
gaccccgccggaaagcgtga

SEQ ID NO: 460336 - DNA, 20 bp, mouse
gacctaccgggtctccgact

SEQ ID NO: 460337 - DNA, 20 bp, mouse
ggccgagtcggagacccggt

SEQ ID NO: 460338 - DNA, 20 bp, mouse
gagtaagcgcagcggagatt

SEQ ID NO: 460339 - DNA, 20 bp, mouse
gtcggagacccggtaggtag

SEQ ID NO: 460340 - DNA, 20 bp, mouse
gtgaggccgagtcggagacc

SEQ ID NO: 460341 - DNA, 20 bp, mouse
ggagattgggctagcgacgg

SEQ ID NO: 460342 - DNA, 20 bp, mouse
ggggctagcgacggaggctg

SEQ ID NO: 460343 - DNA, 20 bp, mouse
gagccagccagtaagcgcag

SEQ ID NO: 460344 - DNA, 20 bp, mouse
gcacccgcgccgctacctac

SEQ ID NO: 460345 - DNA, 20 bp, mouse
ggcggagattgggctagcga

SEQ ID NO: 460346 - DNA, 20 bp, mouse
ggccgataacggctcatctg

SEQ ID NO: 460347 - DNA, 20 bp, mouse
gaagggcggcctgaaaacct

SEQ ID NO: 460348 - DNA, 20 bp, mouse
gaaagggcttgcaaagtcca

SEQ ID NO: 460349 - DNA, 20 bp, mouse
gccttaacgttagccgataa

SEQ ID NO: 460350 - DNA, 20 bp, mouse
gtgtggcctgttgattacca

SEQ ID NO: 460351 - DNA, 20 bp, mouse
ggccgcccttggtaatcaac

SEQ ID NO: 460352 - DNA, 20 bp, mouse
gccagcctttagggagacct

SEQ ID NO: 460353 - DNA, 20 bp, mouse
ggccacagatgagccgttat

SEQ ID NO: 460354 - DNA, 20 bp, mouse
gaagacccaggtctccctaa

SEQ ID NO: 460355 - DNA, 20 bp, mouse
gaaggaccgttaccattcct

SEQ ID NO: 460356 - DNA, 20 bp, mouse
gcactgccgctgcccgccta

SEQ ID NO: 460357 - DNA, 20 bp, mouse
gcgaaggaggctgccctagg

SEQ ID NO: 460358 - DNA, 20 bp, mouse
gccgggccgggccgcgaagg

SEQ ID NO: 460359 - DNA, 20 bp, mouse
ggcagcggcagtgtagagcc

SEQ ID NO: 460360 - DNA, 20 bp, mouse
gcggcagtgtagagccgggc

SEQ ID NO: 460361 - DNA, 20 bp, mouse
ggactccagacccgcaggat

SEQ ID NO: 460362 - DNA, 20 bp, mouse
gacccgcaggatcggcctcc

SEQ ID NO: 460363 - DNA, 20 bp, mouse
ggctgtgttgtgggcctcgg

SEQ ID NO: 460364 - DNA, 20 bp, mouse
gcaggatcggcctcccggcc

SEQ ID NO: 460365 - DNA, 20 bp, mouse
gacacggcacagatccctct

SEQ ID NO: 460366 - DNA, 20 bp, mouse
gggcccgcccgagagacggt

SEQ ID NO: 460367 - DNA, 20 bp, mouse
gggatcggaggatagcaccg

SEQ ID NO: 460368 - DNA, 20 bp, mouse
gggtcggtctacgagcgcgg

SEQ ID NO: 460369 - DNA, 20 bp, mouse
gccggagcgcggcggatcgg

SEQ ID NO: 460370 - DNA, 20 bp, mouse
gaccccaggccggagcgcgg

SEQ ID NO: 460371 - DNA, 20 bp, mouse
gcgtagaccgaccgtctctc

SEQ ID NO: 460372 - DNA, 20 bp, mouse
gatagcaccggggcccgagc

SEQ ID NO: 460373 - DNA, 20 bp, mouse
gaggccggagcgcggcggat

SEQ ID NO: 460374 - DNA, 20 bp, mouse
ggacggtcggtctacgagcg

SEQ ID NO: 460375 - DNA, 20 bp, mouse
gcgggagcgcgttccagctc

SEQ ID NO: 460376 - DNA, 20 bp, mouse
ggcagaggcggtggagtgcc

SEQ ID NO: 460377 - DNA, 20 bp, mouse
gcggtgtgtgagctgatagt

SEQ ID NO: 460378 - DNA, 20 bp, mouse
gagctggggaaccgggtagg

SEQ ID NO: 460379 - DNA, 20 bp, mouse
ggcgctctcacttgttactg

SEQ ID NO: 460380 - DNA, 20 bp, mouse
gaccgggtagggggcagagg

SEQ ID NO: 460381 - DNA, 20 bp, mouse
gcagagctggggaaccgggt

SEQ ID NO: 460382 - DNA, 20 bp, mouse
gttactggggtgtccgccag

SEQ ID NO: 460383 - DNA, 20 bp, mouse
gtcagctcacacaccgctgg

SEQ ID NO: 460384 - DNA, 20 bp, mouse
gatatccagaagggctaaag

SEQ ID NO: 460385 - DNA, 20 bp, mouse
gcaagtgagagcgctctgcc

SEQ ID NO: 460386 - DNA, 20 bp, mouse
ggagcccgcaagcactccac

SEQ ID NO: 460387 - DNA, 20 bp, mouse
ggctagcggcaggtgaggaa

SEQ ID NO: 460388 - DNA, 20 bp, mouse
gcagggacaaggaaagctag

SEQ ID NO: 460389 - DNA, 20 bp, mouse
ggtcccgcggagaagatgaa

SEQ ID NO: 460390 - DNA, 20 bp, mouse
gggcctgcaacagcagctcg

SEQ ID NO: 460391 - DNA, 20 bp, mouse
gggaaagctagcggcaggtg

SEQ ID NO: 460392 - DNA, 20 bp, mouse
gaggccggtggagtgcttgc

SEQ ID NO: 460393 - DNA, 20 bp, mouse
gagctgctgttgcaggccgg

SEQ ID NO: 460394 - DNA, 20 bp, mouse
gtggaccagatagagagcgg

SEQ ID NO: 460395 - DNA, 20 bp, mouse
gaccacaccccacagagccg

SEQ ID NO: 460396 - DNA, 20 bp, mouse
gtgtgagtgaggatatacaa

SEQ ID NO: 460397 - DNA, 20 bp, mouse
gatggcagccaagaggatat

SEQ ID NO: 460398 - DNA, 20 bp, mouse
gtggctgacctacagaacgg

SEQ ID NO: 460399 - DNA, 20 bp, mouse
gacttggctgacctacagaa

SEQ ID NO: 460400 - DNA, 20 bp, mouse
gaagcaaagcctccatggtg

SEQ ID NO: 460401 - DNA, 20 bp, mouse
gcaccaccagctggtggcct

SEQ ID NO: 460402 - DNA, 20 bp, mouse
gcagaacggaggacagtatg

SEQ ID NO: 460403 - DNA, 20 bp, mouse
gatattggtgtatcgaaatg

SEQ ID NO: 460404 - DNA, 20 bp, mouse
gttcccaggccaccagctgg

SEQ ID NO: 460405 - DNA, 20 bp, mouse
gcgatacaccaatatcctct

SEQ ID NO: 460406 - DNA, 20 bp, mouse
ggcgctggtggacaccacac

SEQ ID NO: 460407 - DNA, 20 bp, mouse
gacaccggccaagaccatct

SEQ ID NO: 460408 - DNA, 20 bp, mouse
gccgttgcggtacaccaaga

SEQ ID NO: 460409 - DNA, 20 bp, mouse
gatagaactggtccccgttg

SEQ ID NO: 460410 - DNA, 20 bp, mouse
ggcgagcgagcagtggccat

SEQ ID NO: 460411 - DNA, 20 bp, mouse
gcagctgaccgagcaggtgg

SEQ ID NO: 460412 - DNA, 20 bp, mouse
gacggggaccagttctatgt

SEQ ID NO: 460413 - DNA, 20 bp, mouse
gcttgcggcccacatagaac

SEQ ID NO: 460414 - DNA, 20 bp, mouse
gcggtacaccaagatggtct

SEQ ID NO: 460415 - DNA, 20 bp, mouse
gacgcgcgggccctatgcgc

SEQ ID NO: 460416 - DNA, 20 bp, mouse
gctgcacagccaccccgcgg

SEQ ID NO: 460417 - DNA, 20 bp, mouse
gagcgagcgcagacagacgg

SEQ ID NO: 460418 - DNA, 20 bp, mouse
gctgtccgccaccgccgcag

SEQ ID NO: 460419 - DNA, 20 bp, mouse
gccggtcactgacctcgatg

SEQ ID NO: 460420 - DNA, 20 bp, mouse
gcgctcgctcgaccgtcggt

SEQ ID NO: 460421 - DNA, 20 bp, mouse
gggcggcgcccctgcggcgg

SEQ ID NO: 460422 - DNA, 20 bp, mouse
ggcaggaggcggcgcccctg

SEQ ID NO: 460423 - DNA, 20 bp, mouse
gggcgcccctgcggcggtgg

SEQ ID NO: 460424 - DNA, 20 bp, mouse
gagcgtgaacgtgagcatgg

SEQ ID NO: 460425 - DNA, 20 bp, mouse
gtctgcgctcgctcgaccgt

SEQ ID NO: 460426 - DNA, 20 bp, mouse
gagggacacggcggcacggg

SEQ ID NO: 460427 - DNA, 20 bp, mouse
ggctccagacggctcgggtg

SEQ ID NO: 460428 - DNA, 20 bp, mouse
gtgcagggacacggcggcac

SEQ ID NO: 460429 - DNA, 20 bp, mouse
gggagctggtcgagggagaa

SEQ ID NO: 460430 - DNA, 20 bp, mouse
ggggcagaacctcttaggtg

SEQ ID NO: 460431 - DNA, 20 bp, mouse
ggcctagctccagacggctc

SEQ ID NO: 460432 - DNA, 20 bp, mouse
ggagaagggcagaacctctt

SEQ ID NO: 460433 - DNA, 20 bp, mouse
gtcccctcggagctggtcga

SEQ ID NO: 460434 - DNA, 20 bp, mouse
ggttccgcacccgagccgtc

SEQ ID NO: 460435 - DNA, 20 bp, mouse
ggctcgggtgcggaacctgc

SEQ ID NO: 460436 - DNA, 20 bp, mouse
gcagcgcatcagtgcactag

SEQ ID NO: 460437 - DNA, 20 bp, mouse
ggctgcggagcacgagcgtc

SEQ ID NO: 460438 - DNA, 20 bp, mouse
ggcaggagccagcaaccctg

SEQ ID NO: 460439 - DNA, 20 bp, mouse
gggagaaccgcatttcaatg

SEQ ID NO: 460440 - DNA, 20 bp, mouse
gggccaggatggaccccact

SEQ ID NO: 460441 - DNA, 20 bp, mouse
ggccccagccgcgcccagcc

SEQ ID NO: 460442 - DNA, 20 bp, mouse
ggagctgtcctcgccgggct

SEQ ID NO: 460443 - DNA, 20 bp, mouse
gcggtggcaccagacaaaag

SEQ ID NO: 460444 - DNA, 20 bp, mouse
gtgcccagtggggtccatcc

SEQ ID NO: 460445 - DNA, 20 bp, mouse
ggcccaggcaaagcacgcac

SEQ ID NO: 460446 - DNA, 20 bp, mouse
ggtcagggcctggaccccgg

SEQ ID NO: 460447 - DNA, 20 bp, mouse
gggcggcgccgcgcgaggag

SEQ ID NO: 460448 - DNA, 20 bp, mouse
gtctcgggcgcgctgagtgg

SEQ ID NO: 460449 - DNA, 20 bp, mouse
ggcggctctacggtccaagg

SEQ ID NO: 460450 - DNA, 20 bp, mouse
gaaccacaccgagagggaga

SEQ ID NO: 460451 - DNA, 20 bp, mouse
gggacagagggtgtcctccg

SEQ ID NO: 460452 - DNA, 20 bp, mouse
gcgagagcgcggatgcccgt

SEQ ID NO: 460453 - DNA, 20 bp, mouse
gcgctctcggccgcctgtca

SEQ ID NO: 460454 - DNA, 20 bp, mouse
gtctagaggatccccggcca

SEQ ID NO: 460455 - DNA, 20 bp, mouse
gcctgtcagggcctggaccc

SEQ ID NO: 460456 - DNA, 20 bp, mouse
ggccgccagcagcaacctaa

SEQ ID NO: 460457 - DNA, 20 bp, mouse
gggttcccgacagtcaccga

SEQ ID NO: 460458 - DNA, 20 bp, mouse
gtcgctgcacagagcgatcc

SEQ ID NO: 460459 - DNA, 20 bp, mouse
gccaggtctcctcttccttt

SEQ ID NO: 460460 - DNA, 20 bp, mouse
gggagactgtccttgcgccg

SEQ ID NO: 460461 - DNA, 20 bp, mouse
gtctgtgcagcgagtagtcc

SEQ ID NO: 460462 - DNA, 20 bp, mouse
gtgggaggcgcagggcgact

SEQ ID NO: 460463 - DNA, 20 bp, mouse
gttgctgctggcggcagcca

SEQ ID NO: 460464 - DNA, 20 bp, mouse
gggcacttacccggaatggg

SEQ ID NO: 460465 - DNA, 20 bp, mouse
ggagggcacttacccggaat

SEQ ID NO: 460466 - DNA, 20 bp, mouse
ggcgagctggcgcagagagg

SEQ ID NO: 460467 - DNA, 20 bp, mouse
gcctcccggtagtccctcgt

SEQ ID NO: 460468 - DNA, 20 bp, mouse
gaggccaggtgtgcccacga

SEQ ID NO: 460469 - DNA, 20 bp, mouse
gcccgcgagctggcgcagag

SEQ ID NO: 460470 - DNA, 20 bp, mouse
gagaggaggcagctgcagcg

SEQ ID NO: 460471 - DNA, 20 bp, mouse
ggtgcccacgagggactacc

SEQ ID NO: 460472 - DNA, 20 bp, mouse
gaacggggcgagctgcacaa

SEQ ID NO: 460473 - DNA, 20 bp, mouse
ggggactaccgggaggaacg

SEQ ID NO: 460474 - DNA, 20 bp, mouse
ggcagacctccagagaggtc

SEQ ID NO: 460475 - DNA, 20 bp, mouse
gagtccctcgtgggcacacc

SEQ ID NO: 460476 - DNA, 20 bp, mouse
gcgcccaacgcggaagaagt

SEQ ID NO: 460477 - DNA, 20 bp, mouse
gaggatgaaagcgcccaacg

SEQ ID NO: 460478 - DNA, 20 bp, mouse
ggcgcgagctttgacaatgt

SEQ ID NO: 460479 - DNA, 20 bp, mouse
gattacgaccccgttcatgg

SEQ ID NO: 460480 - DNA, 20 bp, mouse
ggagttgaggtgtcacccag

SEQ ID NO: 460481 - DNA, 20 bp, mouse
ggagccgcgccgaaccggca

SEQ ID NO: 460482 - DNA, 20 bp, mouse
ggttcccgcgaagaccccac

SEQ ID NO: 460483 - DNA, 20 bp, mouse
gcaaccgcgcgctggagctc

SEQ ID NO: 460484 - DNA, 20 bp, mouse
gaaagaaggtggccgcgctc

SEQ ID NO: 460485 - DNA, 20 bp, mouse
ggatcggaaatcaactacta

SEQ ID NO: 460486 - DNA, 20 bp, mouse
ggaaggagctcatcgcaccc

SEQ ID NO: 460487 - DNA, 20 bp, mouse
gcacctggtgaggggaggac

SEQ ID NO: 460488 - DNA, 20 bp, mouse
ggtgcgatgagctccttcca

SEQ ID NO: 460489 - DNA, 20 bp, mouse
gctatggtctgaagaggcaa

SEQ ID NO: 460490 - DNA, 20 bp, mouse
gctagacccaaagcccacct

SEQ ID NO: 460491 - DNA, 20 bp, mouse
gagctccttccagggacaga

SEQ ID NO: 460492 - DNA, 20 bp, mouse
gagacctggacgctgtggta

SEQ ID NO: 460493 - DNA, 20 bp, mouse
gtgacagtgcgaaaggaagt

SEQ ID NO: 460494 - DNA, 20 bp, mouse
gtccctgtcgaagcggtcaa

SEQ ID NO: 460495 - DNA, 20 bp, mouse
ggctctgccggcctatgggt

SEQ ID NO: 460496 - DNA, 20 bp, mouse
gctgccctgtgactgtcact

SEQ ID NO: 460497 - DNA, 20 bp, mouse
gtgtgctatggagtagaagc

SEQ ID NO: 460498 - DNA, 20 bp, mouse
gtcaacccagtgacagtcac

SEQ ID NO: 460499 - DNA, 20 bp, mouse
gaaagcttctgtcaagtgga

SEQ ID NO: 460500 - DNA, 20 bp, mouse
gctatgcagcccaggcaaaa

SEQ ID NO: 460501 - DNA, 20 bp, mouse
gttagttcttaactgtgcta

SEQ ID NO: 460502 - DNA, 20 bp, mouse
gcccaggcaaaagggtttgc

SEQ ID NO: 460503 - DNA, 20 bp, mouse
ggtgagaaaaaggaacgaga

SEQ ID NO: 460504 - DNA, 20 bp, mouse
gggctcctgtggcaaatacc

SEQ ID NO: 460505 - DNA, 20 bp, mouse
gatacccggattaaaaggta

SEQ ID NO: 460506 - DNA, 20 bp, mouse
gtcggctctgagatccaaga

SEQ ID NO: 460507 - DNA, 20 bp, mouse
gcagagccgagcccctccgg

SEQ ID NO: 460508 - DNA, 20 bp, mouse
ggccggtaggcggaagtgga

SEQ ID NO: 460509 - DNA, 20 bp, mouse
gcaggagcccaggaccgcaa

SEQ ID NO: 460510 - DNA, 20 bp, mouse
gcgactcaacaactccatct

SEQ ID NO: 460511 - DNA, 20 bp, mouse
gcacagtccgcccccgccgg

SEQ ID NO: 460512 - DNA, 20 bp, mouse
gctgccccaaagccaaccag

SEQ ID NO: 460513 - DNA, 20 bp, mouse
ggggaccgcgcagacagctg

SEQ ID NO: 460514 - DNA, 20 bp, mouse
gggagccaaagaggtgaccg

SEQ ID NO: 460515 - DNA, 20 bp, mouse
gggtgagtgaggcccggccg

SEQ ID NO: 460516 - DNA, 20 bp, mouse
gtgatatcgtgtcccttccc

SEQ ID NO: 460517 - DNA, 20 bp, mouse
ggctcggcggtcgattgagg

SEQ ID NO: 460518 - DNA, 20 bp, mouse
gaagggacacgatatcagcc

SEQ ID NO: 460519 - DNA, 20 bp, mouse
ggataagtccagcctcgcgg

SEQ ID NO: 460520 - DNA, 20 bp, mouse
gcacgatgcgactgatgtag

SEQ ID NO: 460521 - DNA, 20 bp, mouse
ggcccgtggcccgcactcag

SEQ ID NO: 460522 - DNA, 20 bp, mouse
gagggggcttcctgaaggct

SEQ ID NO: 460523 - DNA, 20 bp, mouse
gggccatcgggccaacgagt

SEQ ID NO: 460524 - DNA, 20 bp, mouse
gcgggtccaccagcaggtgg

SEQ ID NO: 460525 - DNA, 20 bp, mouse
gtaggggtcgtggcgccgca

SEQ ID NO: 460526 - DNA, 20 bp, mouse
ggcaccgtggagaagcacag

SEQ ID NO: 460527 - DNA, 20 bp, mouse
ggcgcctctgtgcttctcca

SEQ ID NO: 460528 - DNA, 20 bp, mouse
gcacagaggcgcgggccccg

SEQ ID NO: 460529 - DNA, 20 bp, mouse
gaagcggaaccgaggagagg

SEQ ID NO: 460530 - DNA, 20 bp, mouse
gctccgcgcagccggcaccg

SEQ ID NO: 460531 - DNA, 20 bp, mouse
gcagcaggcgcagcgcatcc

SEQ ID NO: 460532 - DNA, 20 bp, mouse
ggaacccgggagtgaatagg

SEQ ID NO: 460533 - DNA, 20 bp, mouse
gtgctgagacccaggactgg

SEQ ID NO: 460534 - DNA, 20 bp, mouse
gggagggaaaagagaggtcg

SEQ ID NO: 460535 - DNA, 20 bp, mouse
gccgcggaagcgaaggtgag

SEQ ID NO: 460536 - DNA, 20 bp, mouse
gttatccacacagattatca

SEQ ID NO: 460537 - DNA, 20 bp, mouse
gacagactaaatattgtcac

SEQ ID NO: 460538 - DNA, 20 bp, mouse
gtcctgggttgtgagagatg

SEQ ID NO: 460539 - DNA, 20 bp, mouse
gaaggcgaaacctctcagcc

SEQ ID NO: 460540 - DNA, 20 bp, mouse
gtgggaagacatcctctgtg

SEQ ID NO: 460541 - DNA, 20 bp, mouse
gcgggactattcttcaaggt

SEQ ID NO: 460542 - DNA, 20 bp, mouse
ggtcacgggactattcttca

SEQ ID NO: 460543 - DNA, 20 bp, mouse
gatcctctgtgtggctgagt

SEQ ID NO: 460544 - DNA, 20 bp, mouse
ggtgtggataaaaaacccaa

SEQ ID NO: 460545 - DNA, 20 bp, mouse
gtgccatgtccatccctggg

SEQ ID NO: 460546 - DNA, 20 bp, mouse
gactgattcttgccttcttg

SEQ ID NO: 460547 - DNA, 20 bp, mouse
gcacaacccaggagacacgg

SEQ ID NO: 460548 - DNA, 20 bp, mouse
gaccgtgggggtccccaaga

SEQ ID NO: 460549 - DNA, 20 bp, mouse
ggccttcttggggaccccca

SEQ ID NO: 460550 - DNA, 20 bp, mouse
gccttgtgtcaaaaccgtgg

SEQ ID NO: 460551 - DNA, 20 bp, mouse
gttaccttgtgtcaaaaccg

SEQ ID NO: 460552 - DNA, 20 bp, mouse
gtcctgggttgtgagagatg

SEQ ID NO: 460553 - DNA, 20 bp, mouse
gagtagcccccgtgtctcct

SEQ ID NO: 460554 - DNA, 20 bp, mouse
gtgccatgtccatccctggg

SEQ ID NO: 460555 - DNA, 20 bp, mouse
ggctgtgtgcctcccaggga

SEQ ID NO: 460556 - DNA, 20 bp, mouse
gtcatgggttgtgagagacg

SEQ ID NO: 460557 - DNA, 20 bp, mouse
gtgggttgtgagagacgagg

SEQ ID NO: 460558 - DNA, 20 bp, mouse
gtggctgagaggactcgcct

SEQ ID NO: 460559 - DNA, 20 bp, mouse
gagtagcccccatgtctcat

SEQ ID NO: 460560 - DNA, 20 bp, mouse
gaacccactcagccacacgg

SEQ ID NO: 460561 - DNA, 20 bp, mouse
gtgggaagacatcctccgtg

SEQ ID NO: 460562 - DNA, 20 bp, mouse
gacagactaaatattgacac

SEQ ID NO: 460563 - DNA, 20 bp, mouse
gaggggagggaaagaggtcc

SEQ ID NO: 460564 - DNA, 20 bp, mouse
gcacaacccatgagacatgg

SEQ ID NO: 460565 - DNA, 20 bp, mouse
ggaaaacccactcagccaca

SEQ ID NO: 460566 - DNA, 20 bp, mouse
gggcgggtacggttcttccc

SEQ ID NO: 460567 - DNA, 20 bp, mouse
gttcttcgtgcaggcgggta

SEQ ID NO: 460568 - DNA, 20 bp, mouse
ggaaggaccgcaaggggcgt

SEQ ID NO: 460569 - DNA, 20 bp, mouse
gaagagaaagcgcgaacagg

SEQ ID NO: 460570 - DNA, 20 bp, mouse
ggcagaaacccccagcacag

SEQ ID NO: 460571 - DNA, 20 bp, mouse
gctgtgaggaaggaccgcaa

SEQ ID NO: 460572 - DNA, 20 bp, mouse
ggagaacggtaagcggacag

SEQ ID NO: 460573 - DNA, 20 bp, mouse
ggaggcttcttcgtgcaggc

SEQ ID NO: 460574 - DNA, 20 bp, mouse
gctcaagagaaagcgcgaac

SEQ ID NO: 460575 - DNA, 20 bp, mouse
ggtgctcagggagtctgcgc

SEQ ID NO: 460576 - DNA, 20 bp, mouse
gtgacccgagggccacagta

SEQ ID NO: 460577 - DNA, 20 bp, mouse
gcgagggccacagtatggac

SEQ ID NO: 460578 - DNA, 20 bp, mouse
gtaggagaggagtgtctcca

SEQ ID NO: 460579 - DNA, 20 bp, mouse
gtcacagccagtccatactg

SEQ ID NO: 460580 - DNA, 20 bp, mouse
gatggactggctgtgaggac

SEQ ID NO: 460581 - DNA, 20 bp, mouse
gttacaggccagtggctggg

SEQ ID NO: 460582 - DNA, 20 bp, mouse
gactcctctcctagttgaga

SEQ ID NO: 460583 - DNA, 20 bp, mouse
gaggctgaaggtaggatctg

SEQ ID NO: 460584 - DNA, 20 bp, mouse
gctttttcaccatctcaact

SEQ ID NO: 460585 - DNA, 20 bp, mouse
gagggaatgaggacagagta

SEQ ID NO: 460586 - DNA, 20 bp, mouse
gcccggagctgaggagttga

SEQ ID NO: 460587 - DNA, 20 bp, mouse
ggtgaagcaaaagacagggg

SEQ ID NO: 460588 - DNA, 20 bp, mouse
ggaaggacacaggccagtcg

SEQ ID NO: 460589 - DNA, 20 bp, mouse
gaggagtaaggccagagtgg

SEQ ID NO: 460590 - DNA, 20 bp, mouse
gccaagcacgggagcaacaa

SEQ ID NO: 460591 - DNA, 20 bp, mouse
ggcatctgagggctgctcac

SEQ ID NO: 460592 - DNA, 20 bp, mouse
gcaggcgctgagattctgag

SEQ ID NO: 460593 - DNA, 20 bp, mouse
ggtggatggccccatagcag

SEQ ID NO: 460594 - DNA, 20 bp, mouse
gagtaaggccagagtggagg

SEQ ID NO: 460595 - DNA, 20 bp, mouse
gctcagaacaactgggtagt

SEQ ID NO: 460596 - DNA, 20 bp, mouse
ggcttgtggaggaacctaag

SEQ ID NO: 460597 - DNA, 20 bp, mouse
gctcagggaagactgctgag

SEQ ID NO: 460598 - DNA, 20 bp, mouse
gacctggcctctcaagctca

SEQ ID NO: 460599 - DNA, 20 bp, mouse
gagcctacgagcttccagaa

SEQ ID NO: 460600 - DNA, 20 bp, mouse
gttacttacaagttccgctt

SEQ ID NO: 460601 - DNA, 20 bp, mouse
gcacccttctggaagctcgt

SEQ ID NO: 460602 - DNA, 20 bp, mouse
gcaggtagacgtgagctact

SEQ ID NO: 460603 - DNA, 20 bp, mouse
gtcctggctgtggttagcat

SEQ ID NO: 460604 - DNA, 20 bp, mouse
ggacccactcttcccaagac

SEQ ID NO: 460605 - DNA, 20 bp, mouse
ggatgactaaggtagaagac

SEQ ID NO: 460606 - DNA, 20 bp, mouse
gtcaaggcaattaaggtcaa

SEQ ID NO: 460607 - DNA, 20 bp, mouse
gcaattaaggtcaagggcta

SEQ ID NO: 460608 - DNA, 20 bp, mouse
gagcagcataataagcagta

SEQ ID NO: 460609 - DNA, 20 bp, mouse
gtttaggtgggaattttgag

SEQ ID NO: 460610 - DNA, 20 bp, mouse
gtaggctctgtgatttaggt

SEQ ID NO: 460611 - DNA, 20 bp, mouse
gtaacatcaggtttaatgag

SEQ ID NO: 460612 - DNA, 20 bp, mouse
gccaaggtcatgcagactcg

SEQ ID NO: 460613 - DNA, 20 bp, mouse
gggcttctgctgggttgtct

SEQ ID NO: 460614 - DNA, 20 bp, mouse
gctgatttaacaaggaagac

SEQ ID NO: 460615 - DNA, 20 bp, mouse
gccaggcctcccaattaaga

SEQ ID NO: 460616 - DNA, 20 bp, mouse
gtgcgcgcgggtaggaagtc

SEQ ID NO: 460617 - DNA, 20 bp, mouse
gcgcgggtaggaagtcggga

SEQ ID NO: 460618 - DNA, 20 bp, mouse
gcctcgaaggagcggacggt

SEQ ID NO: 460619 - DNA, 20 bp, mouse
ggcgcgcacggcggctgtgt

SEQ ID NO: 460620 - DNA, 20 bp, mouse
gtgcacctcgaaggagcgga

SEQ ID NO: 460621 - DNA, 20 bp, mouse
gagagactcggcgctcacgt

SEQ ID NO: 460622 - DNA, 20 bp, mouse
gagcgtggtctgcacctcga

SEQ ID NO: 460623 - DNA, 20 bp, mouse
gcgggagcacagagttgggg

SEQ ID NO: 460624 - DNA, 20 bp, mouse
gagcagggtcctcggccgag

SEQ ID NO: 460625 - DNA, 20 bp, mouse
gttcctacccgcgcgcacgg

SEQ ID NO: 460626 - DNA, 20 bp, mouse
ggcccgcgtacctgctgtca

SEQ ID NO: 460627 - DNA, 20 bp, mouse
gcggggcagcaagtccggag

SEQ ID NO: 460628 - DNA, 20 bp, mouse
ggccctgacagcaggtacgc

SEQ ID NO: 460629 - DNA, 20 bp, mouse
gacggtgtcacagtaagcag

SEQ ID NO: 460630 - DNA, 20 bp, mouse
ggcggcggcggggccgatcg

SEQ ID NO: 460631 - DNA, 20 bp, mouse
gcagctccgcgagagcttcg

SEQ ID NO: 460632 - DNA, 20 bp, mouse
ggtgagcgcaggctttctgt

SEQ ID NO: 460633 - DNA, 20 bp, mouse
gggcagcaagtccggagcgg

SEQ ID NO: 460634 - DNA, 20 bp, mouse
ggggcccctcgcaaatctga

SEQ ID NO: 460635 - DNA, 20 bp, mouse
gagaaagcctgcgctcacta

SEQ ID NO: 460636 - DNA, 20 bp, mouse
gaaggcgacgataaggggag

SEQ ID NO: 460637 - DNA, 20 bp, mouse
gccggggctggtgaccgagt

SEQ ID NO: 460638 - DNA, 20 bp, mouse
ggcgacgataaggggagcgg

SEQ ID NO: 460639 - DNA, 20 bp, mouse
gacgataaggggagcggcgg

SEQ ID NO: 460640 - DNA, 20 bp, mouse
gcagcaaaggcgacgataag

SEQ ID NO: 460641 - DNA, 20 bp, mouse
gagcaggccggcaggaggcg

SEQ ID NO: 460642 - DNA, 20 bp, mouse
ggagcaggaagtctcgcgac

SEQ ID NO: 460643 - DNA, 20 bp, mouse
gtctcgcgacaggagcaggc

SEQ ID NO: 460644 - DNA, 20 bp, mouse
gaggtgctgcggccgtcgaa

SEQ ID NO: 460645 - DNA, 20 bp, mouse
ggggattggtgagagcgaca

SEQ ID NO: 460646 - DNA, 20 bp, mouse
gcaggctgcagaaacgatgg

SEQ ID NO: 460647 - DNA, 20 bp, mouse
gggccaggctgcagaaacga

SEQ ID NO: 460648 - DNA, 20 bp, mouse
gcagcggctacagtctcgag

SEQ ID NO: 460649 - DNA, 20 bp, mouse
gggctctgaccgatgtgcag

SEQ ID NO: 460650 - DNA, 20 bp, mouse
ggactgtagccgctgcacat

SEQ ID NO: 460651 - DNA, 20 bp, mouse
gcccggaacagcctgagggt

SEQ ID NO: 460652 - DNA, 20 bp, mouse
ggtggtagcatccgacccta

SEQ ID NO: 460653 - DNA, 20 bp, mouse
gcagcctggccgcagcaacc

SEQ ID NO: 460654 - DNA, 20 bp, mouse
gcggctacagtctcgagtgg

SEQ ID NO: 460655 - DNA, 20 bp, mouse
ggctggagcgctgggtgtac

SEQ ID NO: 460656 - DNA, 20 bp, mouse
ggtccctgctgcagtcggag

SEQ ID NO: 460657 - DNA, 20 bp, mouse
gtgcagcagggacgccatct

SEQ ID NO: 460658 - DNA, 20 bp, mouse
gatggcgtccctgctgcagt

SEQ ID NO: 460659 - DNA, 20 bp, mouse
gctcgtccaaggagaaaaga

SEQ ID NO: 460660 - DNA, 20 bp, mouse
gtgagggaggagccaacgcc

SEQ ID NO: 460661 - DNA, 20 bp, mouse
ggggttctctatctcgtcca

SEQ ID NO: 460662 - DNA, 20 bp, mouse
ggaagttccgccgggagagg

SEQ ID NO: 460663 - DNA, 20 bp, mouse
gcgggaagttccgccgggag

SEQ ID NO: 460664 - DNA, 20 bp, mouse
ggacgccatcttggtgaggg

SEQ ID NO: 460665 - DNA, 20 bp, mouse
ggccgggctgtgtcacgtga

SEQ ID NO: 460666 - DNA, 20 bp, mouse
ggtctgcctgagctactgac

SEQ ID NO: 460667 - DNA, 20 bp, mouse
gaggatcctgtcagtagctc

SEQ ID NO: 460668 - DNA, 20 bp, mouse
gagtgcagccgggacgggag

SEQ ID NO: 460669 - DNA, 20 bp, mouse
ggagtccagggcggggatag

SEQ ID NO: 460670 - DNA, 20 bp, mouse
ggggaccctcgaggactgga

SEQ ID NO: 460671 - DNA, 20 bp, mouse
ggcggaagtggccgatcaac

SEQ ID NO: 460672 - DNA, 20 bp, mouse
ggaaccagtgcagccgggac

SEQ ID NO: 460673 - DNA, 20 bp, mouse
gagagtcgaatgagagtcca

SEQ ID NO: 460674 - DNA, 20 bp, mouse
gcgaatgagagtccagggcg

SEQ ID NO: 460675 - DNA, 20 bp, mouse
gtgccgccgctggcagtcac

SEQ ID NO: 460676 - DNA, 20 bp, mouse
gtgagacccgggcttgacga

SEQ ID NO: 460677 - DNA, 20 bp, mouse
gggcggagaagacgcaaaag

SEQ ID NO: 460678 - DNA, 20 bp, mouse
ggacccgggcttgacgatgg

SEQ ID NO: 460679 - DNA, 20 bp, mouse
gcgtgttaacacctccgcag

SEQ ID NO: 460680 - DNA, 20 bp, mouse
gacgggttctgcccctgcgg

SEQ ID NO: 460681 - DNA, 20 bp, mouse
gccacgccgcgaccagaaac

SEQ ID NO: 460682 - DNA, 20 bp, mouse
gctccgccatcgtcaagccc

SEQ ID NO: 460683 - DNA, 20 bp, mouse
ggtcccccacgcagccccaa

SEQ ID NO: 460684 - DNA, 20 bp, mouse
gtgcgcaggcgtgctgggat

SEQ ID NO: 460685 - DNA, 20 bp, mouse
gagcccagggccggcaacta

SEQ ID NO: 460686 - DNA, 20 bp, mouse
gctagtgggcggaatgtcca

SEQ ID NO: 460687 - DNA, 20 bp, mouse
gccgcgcgggttggactagt

SEQ ID NO: 460688 - DNA, 20 bp, mouse
gcgcgggttggactagtggg

SEQ ID NO: 460689 - DNA, 20 bp, mouse
gacggtgagcgcggtactgt

SEQ ID NO: 460690 - DNA, 20 bp, mouse
gagtccaacccgcgcgggag

SEQ ID NO: 460691 - DNA, 20 bp, mouse
gcgctcaccgtcaccagccg

SEQ ID NO: 460692 - DNA, 20 bp, mouse
gctccggactgaatctgaac

SEQ ID NO: 460693 - DNA, 20 bp, mouse
ggagatgggtagttggacag

SEQ ID NO: 460694 - DNA, 20 bp, mouse
gtgggcggaatgtccacggc

SEQ ID NO: 460695 - DNA, 20 bp, mouse
gaaccttggagagataacag

SEQ ID NO: 460696 - DNA, 20 bp, mouse
gcggctccgcagcgaatgga

SEQ ID NO: 460697 - DNA, 20 bp, mouse
gctccgcagcgaatggacgg

SEQ ID NO: 460698 - DNA, 20 bp, mouse
gggtccggaggacaccaaca

SEQ ID NO: 460699 - DNA, 20 bp, mouse
gagcccggcgagcccgtgag

SEQ ID NO: 460700 - DNA, 20 bp, mouse
gccgcggttcctcaccatgt

SEQ ID NO: 460701 - DNA, 20 bp, mouse
gcctccggctccgcagcgaa

SEQ ID NO: 460702 - DNA, 20 bp, mouse
gcggcggcggcgcctctcac

SEQ ID NO: 460703 - DNA, 20 bp, mouse
gcgcagcgaatggacggcgg

SEQ ID NO: 460704 - DNA, 20 bp, mouse
gctacgcgagggcccggcag

SEQ ID NO: 460705 - DNA, 20 bp, mouse
gagcgaatggacggcggcgg

SEQ ID NO: 460706 - DNA, 20 bp, mouse
gcgcctgcgcagaggaagag

SEQ ID NO: 460707 - DNA, 20 bp, mouse
gcctccccggagatccaact

SEQ ID NO: 460708 - DNA, 20 bp, mouse
gggaggtcacctctctgtgg

SEQ ID NO: 460709 - DNA, 20 bp, mouse
gcgcggaggtcacctctctg

SEQ ID NO: 460710 - DNA, 20 bp, mouse
gtcctaatgccgccacagag

SEQ ID NO: 460711 - DNA, 20 bp, mouse
gggatctccggggagggcag

SEQ ID NO: 460712 - DNA, 20 bp, mouse
gcagaaaattgaagtcgctt

SEQ ID NO: 460713 - DNA, 20 bp, mouse
gagtcgcttcggcagccttg

SEQ ID NO: 460714 - DNA, 20 bp, mouse
ggagcccagttggatctccg

SEQ ID NO: 460715 - DNA, 20 bp, mouse
gccgtcgtggtgttgaggga

SEQ ID NO: 460716 - DNA, 20 bp, mouse
gcggtgggctgcagatgagg

SEQ ID NO: 460717 - DNA, 20 bp, mouse
ggcggtggcagaaaaggcgg

SEQ ID NO: 460718 - DNA, 20 bp, mouse
ggcggccgcggtggcagaaa

SEQ ID NO: 460719 - DNA, 20 bp, mouse
gcgccggtgggctgcagatg

SEQ ID NO: 460720 - DNA, 20 bp, mouse
gccccaggcccgggattgag

SEQ ID NO: 460721 - DNA, 20 bp, mouse
ggggagcgttgagagatgaa

SEQ ID NO: 460722 - DNA, 20 bp, mouse
gaggggtgctggcgatggac

SEQ ID NO: 460723 - DNA, 20 bp, mouse
gaaacgcaagcggggatggt

SEQ ID NO: 460724 - DNA, 20 bp, mouse
ggtgaggtaggagcccaagg

SEQ ID NO: 460725 - DNA, 20 bp, mouse
ggtttgactggaggaacctc

SEQ ID NO: 460726 - DNA, 20 bp, mouse
gaggtttggggagtcggtag

SEQ ID NO: 460727 - DNA, 20 bp, mouse
gtctgttgcgagctaaggtt

SEQ ID NO: 460728 - DNA, 20 bp, mouse
gggctcccgcgctccactcg

SEQ ID NO: 460729 - DNA, 20 bp, mouse
ggagctaaggtttggggagt

SEQ ID NO: 460730 - DNA, 20 bp, mouse
gggtcctctgttgcgagcta

SEQ ID NO: 460731 - DNA, 20 bp, mouse
gtcggtagggggaccgcgag

SEQ ID NO: 460732 - DNA, 20 bp, mouse
ggggaccgcgagtggagcgc

SEQ ID NO: 460733 - DNA, 20 bp, mouse
gtgcacggaggtggagacgg

SEQ ID NO: 460734 - DNA, 20 bp, mouse
ggagagtcggtggtgcacgg

SEQ ID NO: 460735 - DNA, 20 bp, mouse
ggctcgcaacagaggaccgc

SEQ ID NO: 460736 - DNA, 20 bp, mouse
ggtcaagcaagacctcatgg

SEQ ID NO: 460737 - DNA, 20 bp, mouse
gccaaggctgcccagcgtca

SEQ ID NO: 460738 - DNA, 20 bp, mouse
ggcaagcctgtcgtccacaa

SEQ ID NO: 460739 - DNA, 20 bp, mouse
gtggaggtgagtgagcgagg

SEQ ID NO: 460740 - DNA, 20 bp, mouse
gcagtgtcagagaagacctg

SEQ ID NO: 460741 - DNA, 20 bp, mouse
gtcgctcactcacctccatg

SEQ ID NO: 460742 - DNA, 20 bp, mouse
gcagactgcgcactaaggat

SEQ ID NO: 460743 - DNA, 20 bp, mouse
gttggtcaagcaagacctca

SEQ ID NO: 460744 - DNA, 20 bp, mouse
gggagacggacaaaaggcgt

SEQ ID NO: 460745 - DNA, 20 bp, mouse
gcgaggaggagacggacaaa

SEQ ID NO: 460746 - DNA, 20 bp, mouse
gagtagcagcgaagagcagg

SEQ ID NO: 460747 - DNA, 20 bp, mouse
ggcagcgaacgccgacagcg

SEQ ID NO: 460748 - DNA, 20 bp, mouse
gtgctcttcgctgctactgt

SEQ ID NO: 460749 - DNA, 20 bp, mouse
ggctaaggccggcggtgtcg

SEQ ID NO: 460750 - DNA, 20 bp, mouse
gagcgcagcgctaaggccgg

SEQ ID NO: 460751 - DNA, 20 bp, mouse
gactgtaggtgccgcgctgt

SEQ ID NO: 460752 - DNA, 20 bp, mouse
gggagcgcgatacccctccc

SEQ ID NO: 460753 - DNA, 20 bp, mouse
gcccggcaaggtagacaggg

SEQ ID NO: 460754 - DNA, 20 bp, mouse
ggccgctagccgggaggaga

SEQ ID NO: 460755 - DNA, 20 bp, mouse
gtcgcggctcgggcttttcc

SEQ ID NO: 460756 - DNA, 20 bp, mouse
gactcgaaagccccactcac

SEQ ID NO: 460757 - DNA, 20 bp, mouse
gagcagaaaaccggtgagtg

SEQ ID NO: 460758 - DNA, 20 bp, mouse
gtgtcaaccgggaaagcaca

SEQ ID NO: 460759 - DNA, 20 bp, mouse
gagcatcatagtgaaaacaa

SEQ ID NO: 460760 - DNA, 20 bp, mouse
gccagggagaaaggagataa

SEQ ID NO: 460761 - DNA, 20 bp, mouse
gaacaaaggcatagagagat

SEQ ID NO: 460762 - DNA, 20 bp, mouse
gcggttttctgctggttggg

SEQ ID NO: 460763 - DNA, 20 bp, mouse
gaatgtaacagatgtcaacc

SEQ ID NO: 460764 - DNA, 20 bp, mouse
gttttccaaaggaaaatccc

SEQ ID NO: 460765 - DNA, 20 bp, mouse
gtggtgacactggaaaaaaa

SEQ ID NO: 460766 - DNA, 20 bp, mouse
gatcttgcccaggcaggacc

SEQ ID NO: 460767 - DNA, 20 bp, mouse
gggaccaggctcaagcacca

SEQ ID NO: 460768 - DNA, 20 bp, mouse
gaccggcgcgggcaaaggtg

SEQ ID NO: 460769 - DNA, 20 bp, mouse
ggctcaagcaccatggacct

SEQ ID NO: 460770 - DNA, 20 bp, mouse
ggctggtgcacaggttgtgg

SEQ ID NO: 460771 - DNA, 20 bp, mouse
gtgcctgggcaagatggacc

SEQ ID NO: 460772 - DNA, 20 bp, mouse
gctccaggtccatcttgccc

SEQ ID NO: 460773 - DNA, 20 bp, mouse
gcctggagttccggaatcga

SEQ ID NO: 460774 - DNA, 20 bp, mouse
ggtcggcgggcgctggtcac

SEQ ID NO: 460775 - DNA, 20 bp, mouse
ggttccggaatcgagggtgg

SEQ ID NO: 460776 - DNA, 20 bp, mouse
gatcggagtgagctgcgcgg

SEQ ID NO: 460777 - DNA, 20 bp, mouse
gtgtgcggcggctactggga

SEQ ID NO: 460778 - DNA, 20 bp, mouse
ggcggcggctactgggaagg

SEQ ID NO: 460779 - DNA, 20 bp, mouse
ggccatcggagtgagctgcg

SEQ ID NO: 460780 - DNA, 20 bp, mouse
gtggctgtgcggcggctact

SEQ ID NO: 460781 - DNA, 20 bp, mouse
ggagccttcagagacagtgg

SEQ ID NO: 460782 - DNA, 20 bp, mouse
gggtcacaggtcagcgtgag

SEQ ID NO: 460783 - DNA, 20 bp, mouse
ggcgccatgccgggcagtaa

SEQ ID NO: 460784 - DNA, 20 bp, mouse
gtctatgggcagccctcgga

SEQ ID NO: 460785 - DNA, 20 bp, mouse
gcgcgcggtgctgtcgccat

SEQ ID NO: 460786 - DNA, 20 bp, mouse
gcgagcctgcgagcgcccgg

SEQ ID NO: 460787 - DNA, 20 bp, mouse
gcccgcagcagcacattcat

SEQ ID NO: 460788 - DNA, 20 bp, mouse
gctgggcgcgcgctgctctc

SEQ ID NO: 460789 - DNA, 20 bp, mouse
gagcgcccggcggctcctct

SEQ ID NO: 460790 - DNA, 20 bp, mouse
ggccagcacgagctctacgt

SEQ ID NO: 460791 - DNA, 20 bp, mouse
gacggtggctgggtttgagt

SEQ ID NO: 460792 - DNA, 20 bp, mouse
gtcgcgcggagaggaggcga

SEQ ID NO: 460793 - DNA, 20 bp, mouse
gcagtcgggcaggctctcgt

SEQ ID NO: 460794 - DNA, 20 bp, mouse
gcgcggagaggaggcgacgg

SEQ ID NO: 460795 - DNA, 20 bp, mouse
gcgagcgcctcagcgcgtgg

SEQ ID NO: 460796 - DNA, 20 bp, mouse
ggagctcacgtacgacgatg

SEQ ID NO: 460797 - DNA, 20 bp, mouse
gctggagagacggatagctc

SEQ ID NO: 460798 - DNA, 20 bp, mouse
gacgtgagctcgcctaccct

SEQ ID NO: 460799 - DNA, 20 bp, mouse
gctcacgtacgacgatgggg

SEQ ID NO: 460800 - DNA, 20 bp, mouse
gcgctggtgagtctgaagag

SEQ ID NO: 460801 - DNA, 20 bp, mouse
gacgtacgacgatggggcgg

SEQ ID NO: 460802 - DNA, 20 bp, mouse
ggatagctcgggcttttgag

SEQ ID NO: 460803 - DNA, 20 bp, mouse
gggccaaggctgaaatcaca

SEQ ID NO: 460804 - DNA, 20 bp, mouse
gggcttttgaggggttccca

SEQ ID NO: 460805 - DNA, 20 bp, mouse
ggagggggctgtctccgaaa

SEQ ID NO: 460806 - DNA, 20 bp, mouse
ggaggcagcagccacggagt

SEQ ID NO: 460807 - DNA, 20 bp, mouse
ggagttggctgcgtgagggt

SEQ ID NO: 460808 - DNA, 20 bp, mouse
gcctcacgcagccaactccg

SEQ ID NO: 460809 - DNA, 20 bp, mouse
gggcctgcaacgtgtctcag

SEQ ID NO: 460810 - DNA, 20 bp, mouse
gctgcaacgtgtctcagggg

SEQ ID NO: 460811 - DNA, 20 bp, mouse
gtagagcgacgatagagaga

SEQ ID NO: 460812 - DNA, 20 bp, mouse
gcaacgtgtctcaggggcgg

SEQ ID NO: 460813 - DNA, 20 bp, mouse
gcgccccacgggccaaccca

SEQ ID NO: 460814 - DNA, 20 bp, mouse
ggcggcgggagcaaaaactt

SEQ ID NO: 460815 - DNA, 20 bp, mouse
ggccaggcgcagaggatcac

SEQ ID NO: 460816 - DNA, 20 bp, mouse
gcaggaagggactacgtatg

SEQ ID NO: 460817 - DNA, 20 bp, mouse
gaagcctccgtggagaaaac

SEQ ID NO: 460818 - DNA, 20 bp, mouse
gaggagtggaaaagcctccg

SEQ ID NO: 460819 - DNA, 20 bp, mouse
gctccgtggagaaaacagga

SEQ ID NO: 460820 - DNA, 20 bp, mouse
gttagctgcgctacctgcga

SEQ ID NO: 460821 - DNA, 20 bp, mouse
gctgaacccccggaaagcta

SEQ ID NO: 460822 - DNA, 20 bp, mouse
gcgtgtgcagggtcccggta

SEQ ID NO: 460823 - DNA, 20 bp, mouse
gtatgaggcagcgccgtcgc

SEQ ID NO: 460824 - DNA, 20 bp, mouse
ggcagcagcacaggccgtac

SEQ ID NO: 460825 - DNA, 20 bp, mouse
ggaagagatatcaagctctg

SEQ ID NO: 460826 - DNA, 20 bp, mouse
gctgcgaactgaagaggagg

SEQ ID NO: 460827 - DNA, 20 bp, mouse
ggctctgcgaactgaagagg

SEQ ID NO: 460828 - DNA, 20 bp, mouse
gccagctctgcgaactgaag

SEQ ID NO: 460829 - DNA, 20 bp, mouse
ggacaatcccgacaacagag

SEQ ID NO: 460830 - DNA, 20 bp, mouse
gggcgacacaactgtgaact

SEQ ID NO: 460831 - DNA, 20 bp, mouse
gcattcctattgtgactctt

SEQ ID NO: 460832 - DNA, 20 bp, mouse
gggagcccaagagtcacaat

SEQ ID NO: 460833 - DNA, 20 bp, mouse
gtgccaagacttcagcaaag

SEQ ID NO: 460834 - DNA, 20 bp, mouse
gcacaggtccactctgttgt

SEQ ID NO: 460835 - DNA, 20 bp, mouse
ggtgtgcgtacatacaggca

SEQ ID NO: 460836 - DNA, 20 bp, mouse
gaagagagcgaatagagagg

SEQ ID NO: 460837 - DNA, 20 bp, mouse
ggacaaagagatgtactcac

SEQ ID NO: 460838 - DNA, 20 bp, mouse
gagcaagagagcgaatagag

SEQ ID NO: 460839 - DNA, 20 bp, mouse
gccaacatgcacaggtgaca

SEQ ID NO: 460840 - DNA, 20 bp, mouse
gtgacagttaaaagacacag

SEQ ID NO: 460841 - DNA, 20 bp, mouse
gcaggtgacagggctgctaa

SEQ ID NO: 460842 - DNA, 20 bp, mouse
gctggtagacaacgaccctg

SEQ ID NO: 460843 - DNA, 20 bp, mouse
gggtcgttgtctaccagcag

SEQ ID NO: 460844 - DNA, 20 bp, mouse
ggactggtaccgaatttctc

SEQ ID NO: 460845 - DNA, 20 bp, mouse
ggggaacttcctgagaaatt

SEQ ID NO: 460846 - DNA, 20 bp, mouse
gcggcgcgcagcagcgacag

SEQ ID NO: 460847 - DNA, 20 bp, mouse
gtataaagtccgggccgaga

SEQ ID NO: 460848 - DNA, 20 bp, mouse
ggtccgggccgagagggcgg

SEQ ID NO: 460849 - DNA, 20 bp, mouse
gacgcggcgggcgtgttcgg

SEQ ID NO: 460850 - DNA, 20 bp, mouse
ggcagggctgcgtaacaatg

SEQ ID NO: 460851 - DNA, 20 bp, mouse
gtgggagctgggctcggacg

SEQ ID NO: 460852 - DNA, 20 bp, mouse
gaatggggcgggccccggaa

SEQ ID NO: 460853 - DNA, 20 bp, mouse
gcgtgtggcggaagcgccgg

SEQ ID NO: 460854 - DNA, 20 bp, mouse
gtcggccgagctgaagtcgt

SEQ ID NO: 460855 - DNA, 20 bp, mouse
ggcgtcggatgcgcgtgtgg

SEQ ID NO: 460856 - DNA, 20 bp, mouse
gctcctcagcgctccagcgg

SEQ ID NO: 460857 - DNA, 20 bp, mouse
ggagagcagtgcgcccgcgg

SEQ ID NO: 460858 - DNA, 20 bp, mouse
ggggctcctcagcgctccag

SEQ ID NO: 460859 - DNA, 20 bp, mouse
ggaggagagcagtgcgcccg

SEQ ID NO: 460860 - DNA, 20 bp, mouse
gcgagggctgagagcgcgag

SEQ ID NO: 460861 - DNA, 20 bp, mouse
gctgcgcctccggctctcac

SEQ ID NO: 460862 - DNA, 20 bp, mouse
ggcccgggctccctccgcga

SEQ ID NO: 460863 - DNA, 20 bp, mouse
gaggacgggagatggacgag

SEQ ID NO: 460864 - DNA, 20 bp, mouse
gctgcgctcccggtgagagc

SEQ ID NO: 460865 - DNA, 20 bp, mouse
gaggtctcgggaggataacg

SEQ ID NO: 460866 - DNA, 20 bp, mouse
ggtgcgtagggacctcacag

SEQ ID NO: 460867 - DNA, 20 bp, mouse
gcagaaaggcaagacagagt

SEQ ID NO: 460868 - DNA, 20 bp, mouse
gggctccatggggcatcagc

SEQ ID NO: 460869 - DNA, 20 bp, mouse
gtgctaccttaaggctccat

SEQ ID NO: 460870 - DNA, 20 bp, mouse
gaccagactcaagctcacag

SEQ ID NO: 460871 - DNA, 20 bp, mouse
gatatgaacttgctacctta

SEQ ID NO: 460872 - DNA, 20 bp, mouse
gatggggcatcagctggctc

SEQ ID NO: 460873 - DNA, 20 bp, mouse
gataggagcccagggagcag

SEQ ID NO: 460874 - DNA, 20 bp, mouse
gactcattcagctcgcagaa

SEQ ID NO: 460875 - DNA, 20 bp, mouse
gggaaaaggttacctctgtg

SEQ ID NO: 460876 - DNA, 20 bp, mouse
gctgggcggaaggcagtcgg

SEQ ID NO: 460877 - DNA, 20 bp, mouse
gactcactcgctcccgccct

SEQ ID NO: 460878 - DNA, 20 bp, mouse
gccgcgctggctgccgaggg

SEQ ID NO: 460879 - DNA, 20 bp, mouse
gtccctccgcacacagtaca

SEQ ID NO: 460880 - DNA, 20 bp, mouse
ggtgcggagggacctctccg

SEQ ID NO: 460881 - DNA, 20 bp, mouse
gagacggcgtcgcaggcggg

SEQ ID NO: 460882 - DNA, 20 bp, mouse
gctgcagtgggtgcatccac

SEQ ID NO: 460883 - DNA, 20 bp, mouse
ggcatggcccgggcccgacc

SEQ ID NO: 460884 - DNA, 20 bp, mouse
gaagtcggcgtcgacctgga

SEQ ID NO: 460885 - DNA, 20 bp, mouse
gcggcgtacctggctctcgg

SEQ ID NO: 460886 - DNA, 20 bp, mouse
gcatgttgaagatgagcggg

SEQ ID NO: 460887 - DNA, 20 bp, mouse
gtgaggagagaggcgagtac

SEQ ID NO: 460888 - DNA, 20 bp, mouse
gagccggaacctgaggagag

SEQ ID NO: 460889 - DNA, 20 bp, mouse
ggaataacagccggaacctg

SEQ ID NO: 460890 - DNA, 20 bp, mouse
ggggccgtgagactcctgag

SEQ ID NO: 460891 - DNA, 20 bp, mouse
gggccaggatgggaaggtaa

SEQ ID NO: 460892 - DNA, 20 bp, mouse
ggaggggccggacagcataa

SEQ ID NO: 460893 - DNA, 20 bp, mouse
ggcagttcgcaggaaaggcg

SEQ ID NO: 460894 - DNA, 20 bp, mouse
gatatcatgttgaagatgag

SEQ ID NO: 460895 - DNA, 20 bp, mouse
ggcttacagtggaaggggtg

SEQ ID NO: 460896 - DNA, 20 bp, mouse
ggagcgctctgcctctcgaa

SEQ ID NO: 460897 - DNA, 20 bp, mouse
gaggtgcgagagggttcgaa

SEQ ID NO: 460898 - DNA, 20 bp, mouse
gggttcgaagggacaggtcc

SEQ ID NO: 460899 - DNA, 20 bp, mouse
gaggtccgggcagcgatcgg

SEQ ID NO: 460900 - DNA, 20 bp, mouse
gagttcgctcacccttcgag

SEQ ID NO: 460901 - DNA, 20 bp, mouse
gtagggatcgcagcaggcag

SEQ ID NO: 460902 - DNA, 20 bp, mouse
gcgagagggttcgaagggac

SEQ ID NO: 460903 - DNA, 20 bp, mouse
gatcgcagcaggcagggggg

SEQ ID NO: 460904 - DNA, 20 bp, mouse
ggagcgcggcggccgatcag

SEQ ID NO: 460905 - DNA, 20 bp, mouse
ggcaggggggaggtgcgaga

SEQ ID NO: 460906 - DNA, 20 bp, mouse
gcagtcctgcagcaagccga

SEQ ID NO: 460907 - DNA, 20 bp, mouse
gcaagcttcggactactgag

SEQ ID NO: 460908 - DNA, 20 bp, mouse
ggacgctgaagggtaaaccg

SEQ ID NO: 460909 - DNA, 20 bp, mouse
gccaccgcgcccaccagcac

SEQ ID NO: 460910 - DNA, 20 bp, mouse
ggttgacaaagccctaggag

SEQ ID NO: 460911 - DNA, 20 bp, mouse
gtgcagcaagccgaaggctg

SEQ ID NO: 460912 - DNA, 20 bp, mouse
gcagcctgtgctggtgggcg

SEQ ID NO: 460913 - DNA, 20 bp, mouse
ggacccgaggaggcgggata

SEQ ID NO: 460914 - DNA, 20 bp, mouse
gctccattcgggaggcggag

SEQ ID NO: 460915 - DNA, 20 bp, mouse
ggggaccactgtccaagctt

SEQ ID NO: 460916 - DNA, 20 bp, mouse
ggccggcgcccactgcagag

SEQ ID NO: 460917 - DNA, 20 bp, mouse
gtgagccccctcccaaccca

SEQ ID NO: 460918 - DNA, 20 bp, mouse
gcagtgggcgccggctccct

SEQ ID NO: 460919 - DNA, 20 bp, mouse
gggctccctgggttgggagg

SEQ ID NO: 460920 - DNA, 20 bp, mouse
ggccggctccctgggttggg

SEQ ID NO: 460921 - DNA, 20 bp, mouse
ggggcgccggctccctgggt

SEQ ID NO: 460922 - DNA, 20 bp, mouse
ggggcctgccgctctgcagt

SEQ ID NO: 460923 - DNA, 20 bp, mouse
gccgcacgtgagtgaaggag

SEQ ID NO: 460924 - DNA, 20 bp, mouse
gcgggcccctcggagaataa

SEQ ID NO: 460925 - DNA, 20 bp, mouse
gagctccaggatgaggagtc

SEQ ID NO: 460926 - DNA, 20 bp, mouse
ggtgttggtgccaggacctc

SEQ ID NO: 460927 - DNA, 20 bp, mouse
gtggtatccaccggaggtcc

SEQ ID NO: 460928 - DNA, 20 bp, mouse
ggcagtctggtatccaccgg

SEQ ID NO: 460929 - DNA, 20 bp, mouse
gttggtgccaggacctccgg

SEQ ID NO: 460930 - DNA, 20 bp, mouse
ggaccctagagcaaagagtg

SEQ ID NO: 460931 - DNA, 20 bp, mouse
gcttaggagaccaggctaac

SEQ ID NO: 460932 - DNA, 20 bp, mouse
gtagggtgaaaagcaatctg

SEQ ID NO: 460933 - DNA, 20 bp, mouse
ggttggggccagagattgat

SEQ ID NO: 460934 - DNA, 20 bp, mouse
gctctaataagttaacacta

SEQ ID NO: 460935 - DNA, 20 bp, mouse
gggctctctttccactccac

SEQ ID NO: 460936 - DNA, 20 bp, mouse
gcagaggggccaggcgcgga

SEQ ID NO: 460937 - DNA, 20 bp, mouse
gctgctgcagccctcggagg

SEQ ID NO: 460938 - DNA, 20 bp, mouse
ggccagcagcagcccgcaga

SEQ ID NO: 460939 - DNA, 20 bp, mouse
gagacggcagccccctccga

SEQ ID NO: 460940 - DNA, 20 bp, mouse
gcccggaacccggtcaggag

SEQ ID NO: 460941 - DNA, 20 bp, mouse
gcaggccagcacctgggcac

SEQ ID NO: 460942 - DNA, 20 bp, mouse
gggtgctggcctgggctgct

SEQ ID NO: 460943 - DNA, 20 bp, mouse
gccccgtcggtggaaggtaa

SEQ ID NO: 460944 - DNA, 20 bp, mouse
ggcgcagacgcagccgagca

SEQ ID NO: 460945 - DNA, 20 bp, mouse
ggagcgccgagcagagccga

SEQ ID NO: 460946 - DNA, 20 bp, mouse
gcggcttggggcctcctcgg

SEQ ID NO: 460947 - DNA, 20 bp, mouse
gtcccgcgagcagctgtcgg

SEQ ID NO: 460948 - DNA, 20 bp, mouse
ggcggggctcgggtgtcggg

SEQ ID NO: 460949 - DNA, 20 bp, mouse
gccggcggggctcgggtgtc

SEQ ID NO: 460950 - DNA, 20 bp, mouse
gatggagagtcaaaatcccg

SEQ ID NO: 460951 - DNA, 20 bp, mouse
gcgccccggagagccatgag

SEQ ID NO: 460952 - DNA, 20 bp, mouse
ggggctcgggtgtcgggagg

SEQ ID NO: 460953 - DNA, 20 bp, mouse
gggcccccgacagctgctcg

SEQ ID NO: 460954 - DNA, 20 bp, mouse
gctgtcgggggcctgttccg

SEQ ID NO: 460955 - DNA, 20 bp, mouse
gcggagagccatgagaggta

SEQ ID NO: 460956 - DNA, 20 bp, mouse
gagctgctcttgggcccccg

SEQ ID NO: 460957 - DNA, 20 bp, mouse
gtgaggccgatgaagcctcc

SEQ ID NO: 460958 - DNA, 20 bp, mouse
gcaaagccgggaggcttcat

SEQ ID NO: 460959 - DNA, 20 bp, mouse
gcttgtggtgggaggagagt

SEQ ID NO: 460960 - DNA, 20 bp, mouse
gaccaggtaggccttgtggt

SEQ ID NO: 460961 - DNA, 20 bp, mouse
gcagctgccctggccagctg

SEQ ID NO: 460962 - DNA, 20 bp, mouse
ggcttcatcggcctcagacc

SEQ ID NO: 460963 - DNA, 20 bp, mouse
gctttggggatccaggtctg

SEQ ID NO: 460964 - DNA, 20 bp, mouse
gccccaaaggcgtgtgccta

SEQ ID NO: 460965 - DNA, 20 bp, mouse
gaggagaacctggaggtgag

SEQ ID NO: 460966 - DNA, 20 bp, mouse
ggtggtaggcatacatccac

SEQ ID NO: 460967 - DNA, 20 bp, mouse
gaatgtgaggtctctctcaa

SEQ ID NO: 460968 - DNA, 20 bp, mouse
gtaccacggggctccttcac

SEQ ID NO: 460969 - DNA, 20 bp, mouse
gagtttgaatcagggcggaa

SEQ ID NO: 460970 - DNA, 20 bp, mouse
gtcttcaagactcaggaccg

SEQ ID NO: 460971 - DNA, 20 bp, mouse
ggtgtcagcgagggaagaac

SEQ ID NO: 460972 - DNA, 20 bp, mouse
ggagggcagagtttgaatca

SEQ ID NO: 460973 - DNA, 20 bp, mouse
ggaatcagggcggaagggca

SEQ ID NO: 460974 - DNA, 20 bp, mouse
gggcatcttgcatcagcctg

SEQ ID NO: 460975 - DNA, 20 bp, mouse
gacaggccgatcgcagagtc

SEQ ID NO: 460976 - DNA, 20 bp, mouse
ggggccctgggtgtatctgg

SEQ ID NO: 460977 - DNA, 20 bp, mouse
gccgccaccagatacaccca

SEQ ID NO: 460978 - DNA, 20 bp, mouse
ggcccggctgtctgtcgtca

SEQ ID NO: 460979 - DNA, 20 bp, mouse
ggctgtctgtcgtcatggtg

SEQ ID NO: 460980 - DNA, 20 bp, mouse
gtactctgcaccaataggag

SEQ ID NO: 460981 - DNA, 20 bp, mouse
ggtggggccctgggtgtatc

SEQ ID NO: 460982 - DNA, 20 bp, mouse
gctagtaagcggaacacact

SEQ ID NO: 460983 - DNA, 20 bp, mouse
gaggaggtgccgccgtccca

SEQ ID NO: 460984 - DNA, 20 bp, mouse
ggtgcatgcgcacgagtcga

SEQ ID NO: 460985 - DNA, 20 bp, mouse
gccgcttactaggagtagga

SEQ ID NO: 460986 - DNA, 20 bp, mouse
ggagctgtgggagccagtag

SEQ ID NO: 460987 - DNA, 20 bp, mouse
gcgaagacgtgagtgagggt

SEQ ID NO: 460988 - DNA, 20 bp, mouse
gcatgttagcgggagaagag

SEQ ID NO: 460989 - DNA, 20 bp, mouse
gactgcaccgggtgagctgt

SEQ ID NO: 460990 - DNA, 20 bp, mouse
gggatctaggaagggaggat

SEQ ID NO: 460991 - DNA, 20 bp, mouse
gagggtcggcgagaacttgt

SEQ ID NO: 460992 - DNA, 20 bp, mouse
gacccggtgcagttaccgtt

SEQ ID NO: 460993 - DNA, 20 bp, mouse
ggaagagtgggatcgccaaa

SEQ ID NO: 460994 - DNA, 20 bp, mouse
gcgccaaacggtaactgcac

SEQ ID NO: 460995 - DNA, 20 bp, mouse
gctggctcccacagctcacc

SEQ ID NO: 460996 - DNA, 20 bp, mouse
ggaatcgcccgggcccgcag

SEQ ID NO: 460997 - DNA, 20 bp, mouse
ggcccgcagcggaggagtgc

SEQ ID NO: 460998 - DNA, 20 bp, mouse
gtcgcccgggcccgcagcgg

SEQ ID NO: 460999 - DNA, 20 bp, mouse
gtggaaggagggaatcgccc

SEQ ID NO: 461000 - DNA, 20 bp, mouse
gtcccacaacgaaccggaga

SEQ ID NO: 461001 - DNA, 20 bp, mouse
gcggccccggcgtgtctgga

SEQ ID NO: 461002 - DNA, 20 bp, mouse
ggccttctccggttcgttgt

SEQ ID NO: 461003 - DNA, 20 bp, mouse
ggggaaagccgaaggcagaa

SEQ ID NO: 461004 - DNA, 20 bp, mouse
gcactccacccgctccctgt

SEQ ID NO: 461005 - DNA, 20 bp, mouse
gggaagatggcggccttctc

SEQ ID NO: 461006 - DNA, 20 bp, mouse
ggacccacgacgccgctaca

SEQ ID NO: 461007 - DNA, 20 bp, mouse
gggagcctcctcgctcctca

SEQ ID NO: 461008 - DNA, 20 bp, mouse
gcgaggaggctcccgtgtag

SEQ ID NO: 461009 - DNA, 20 bp, mouse
ggcagctaaagaagccggaa

SEQ ID NO: 461010 - DNA, 20 bp, mouse
gtcccgtgtagcggcgtcgt

SEQ ID NO: 461011 - DNA, 20 bp, mouse
ggcgtgtggagaaggcgcag

SEQ ID NO: 461012 - DNA, 20 bp, mouse
ggcaccaaaagaaggagcgg

SEQ ID NO: 461013 - DNA, 20 bp, mouse
gtgctgtgccttgaggagcg

SEQ ID NO: 461014 - DNA, 20 bp, mouse
gtcctggcagcccccgccat

SEQ ID NO: 461015 - DNA, 20 bp, mouse
gaactacgagaaggtgaggt

SEQ ID NO: 461016 - DNA, 20 bp, mouse
gccgcaggaccgcctcactg

SEQ ID NO: 461017 - DNA, 20 bp, mouse
gcaagcgagcctggccgccg

SEQ ID NO: 461018 - DNA, 20 bp, mouse
gcgaaggcgccactatactt

SEQ ID NO: 461019 - DNA, 20 bp, mouse
gcttgccggcctcagtgagg

SEQ ID NO: 461020 - DNA, 20 bp, mouse
ggccctacggccggacgtgg

SEQ ID NO: 461021 - DNA, 20 bp, mouse
gtgaggccggcaagcgagcc

SEQ ID NO: 461022 - DNA, 20 bp, mouse
gggagaagcgctgcgaccga

SEQ ID NO: 461023 - DNA, 20 bp, mouse
gagtggcagcccaagtatag

SEQ ID NO: 461024 - DNA, 20 bp, mouse
gagtttaaattcagccgcgg

SEQ ID NO: 461025 - DNA, 20 bp, mouse
gtgagaagggcacactcgag

SEQ ID NO: 461026 - DNA, 20 bp, mouse
gtgcagttgctgggaaggaa

SEQ ID NO: 461027 - DNA, 20 bp, mouse
gaagggagacgcctcaaccg

SEQ ID NO: 461028 - DNA, 20 bp, mouse
gtggtcccgctcaaaccggg

SEQ ID NO: 461029 - DNA, 20 bp, mouse
gctcaaaccgggcggtgcca

SEQ ID NO: 461030 - DNA, 20 bp, mouse
ggtctggtcccgctcaaacc

SEQ ID NO: 461031 - DNA, 20 bp, mouse
gcagcaactgcacaaaatgg

SEQ ID NO: 461032 - DNA, 20 bp, mouse
gcggatgaccgagctcggga

SEQ ID NO: 461033 - DNA, 20 bp, mouse
gttaggacagtcgggaggtc

SEQ ID NO: 461034 - DNA, 20 bp, mouse
ggtctagtgatgaccgatgg

SEQ ID NO: 461035 - DNA, 20 bp, mouse
gggttgttaggacagtcggg

SEQ ID NO: 461036 - DNA, 20 bp, mouse
gtgtctcggtgcagacggct

SEQ ID NO: 461037 - DNA, 20 bp, mouse
ggcccccgtggacccttcat

SEQ ID NO: 461038 - DNA, 20 bp, mouse
gggcgggagccggggatgcg

SEQ ID NO: 461039 - DNA, 20 bp, mouse
gggggaacccaggaactcgg

SEQ ID NO: 461040 - DNA, 20 bp, mouse
gtgcgctgggcagcttccgg

SEQ ID NO: 461041 - DNA, 20 bp, mouse
gagaaagccacgccggcaaa

SEQ ID NO: 461042 - DNA, 20 bp, mouse
gcccgcactggcgaacgacg

SEQ ID NO: 461043 - DNA, 20 bp, mouse
ggaaccaatgaagggtccac

SEQ ID NO: 461044 - DNA, 20 bp, mouse
gcgaacgacgtggggaaccc

SEQ ID NO: 461045 - DNA, 20 bp, mouse
gtgaaagtcgggaaccgtaa

SEQ ID NO: 461046 - DNA, 20 bp, mouse
gaccatggccaccgactcat

SEQ ID NO: 461047 - DNA, 20 bp, mouse
gcgttcggcgctggtgttgg

SEQ ID NO: 461048 - DNA, 20 bp, mouse
gaccgccagcgcccatgagt

SEQ ID NO: 461049 - DNA, 20 bp, mouse
ggccagcgcccatgagtcgg

SEQ ID NO: 461050 - DNA, 20 bp, mouse
gtgtgagtggcacttggcgc

SEQ ID NO: 461051 - DNA, 20 bp, mouse
gaagtgccactcacacggag

SEQ ID NO: 461052 - DNA, 20 bp, mouse
gttgcgttcggcgctggtgt

SEQ ID NO: 461053 - DNA, 20 bp, mouse
gccactgaccgacttgacag

SEQ ID NO: 461054 - DNA, 20 bp, mouse
ggggcgcggagcatctctgc

SEQ ID NO: 461055 - DNA, 20 bp, mouse
gtcggctcgcgtcgggacca

SEQ ID NO: 461056 - DNA, 20 bp, mouse
gtgcgaccgcggactcaggt

SEQ ID NO: 461057 - DNA, 20 bp, mouse
ggaccgcggactcaggtggg

SEQ ID NO: 461058 - DNA, 20 bp, mouse
ggcggtgcgaccgcggactc

SEQ ID NO: 461059 - DNA, 20 bp, mouse
gtgccacccacctgagtccg

SEQ ID NO: 461060 - DNA, 20 bp, mouse
gcgcttgggcggtgcgaccg

SEQ ID NO: 461061 - DNA, 20 bp, mouse
gtgaatgatttccctcgggg

SEQ ID NO: 461062 - DNA, 20 bp, mouse
ggcaggcttgcccgcttggg

SEQ ID NO: 461063 - DNA, 20 bp, mouse
gaaggggcagatatcctgac

SEQ ID NO: 461064 - DNA, 20 bp, mouse
gaagtccagcaccgccccga

SEQ ID NO: 461065 - DNA, 20 bp, mouse
gctggcaggcttgcccgctt

SEQ ID NO: 461066 - DNA, 20 bp, mouse
ggcagccatagtggactcgg

SEQ ID NO: 461067 - DNA, 20 bp, mouse
gggaggcgcggctaccatgg

SEQ ID NO: 461068 - DNA, 20 bp, mouse
ggcacgctccgcagccatag

SEQ ID NO: 461069 - DNA, 20 bp, mouse
ggtggactcggaggttgtca

SEQ ID NO: 461070 - DNA, 20 bp, mouse
gacaacctccgagtccacta

SEQ ID NO: 461071 - DNA, 20 bp, mouse
gggcgcggctaccatggcgg

SEQ ID NO: 461072 - DNA, 20 bp, mouse
ggcggcgtttgaagtcccgg

SEQ ID NO: 461073 - DNA, 20 bp, mouse
ggcggcggcgtttgaagtcc

SEQ ID NO: 461074 - DNA, 20 bp, mouse
gtccgcagccatagtggact

SEQ ID NO: 461075 - DNA, 20 bp, mouse
gtctggaggcgcggctacca

SEQ ID NO: 461076 - DNA, 20 bp, mouse
gaaccgcgtgctaggagaga

SEQ ID NO: 461077 - DNA, 20 bp, mouse
gagcagcttctcaggcctac

SEQ ID NO: 461078 - DNA, 20 bp, mouse
ggagagggcgacagagaaag

SEQ ID NO: 461079 - DNA, 20 bp, mouse
gcgcggttgaggaagccggt

SEQ ID NO: 461080 - DNA, 20 bp, mouse
gtattcagcagcagcttctc

SEQ ID NO: 461081 - DNA, 20 bp, mouse
gaataggcccggctgagggg

SEQ ID NO: 461082 - DNA, 20 bp, mouse
gagcacgcggttgaggaagc

SEQ ID NO: 461083 - DNA, 20 bp, mouse
ggccaagttgggctcagacg

SEQ ID NO: 461084 - DNA, 20 bp, mouse
gacgaataggcccggctgag

SEQ ID NO: 461085 - DNA, 20 bp, mouse
ggcccaacttggccccactg

SEQ ID NO: 461086 - DNA, 20 bp, mouse
ggcgcctgaaccgcctaacg

SEQ ID NO: 461087 - DNA, 20 bp, mouse
gacgttgaggccgcgttagg

SEQ ID NO: 461088 - DNA, 20 bp, mouse
gcgggccccgggagcagtgt

SEQ ID NO: 461089 - DNA, 20 bp, mouse
ggcgacgttgaggccgcgtt

SEQ ID NO: 461090 - DNA, 20 bp, mouse
ggcgaaagatggcgactgtt

SEQ ID NO: 461091 - DNA, 20 bp, mouse
ggatctggaaacgcgaaaga

SEQ ID NO: 461092 - DNA, 20 bp, mouse
gcgactgttcggcgacgttg

SEQ ID NO: 461093 - DNA, 20 bp, mouse
gcggcgggcaagagtgaaag

SEQ ID NO: 461094 - DNA, 20 bp, mouse
gaggcggttcaggcgcgggg

SEQ ID NO: 461095 - DNA, 20 bp, mouse
gctccggccgaagcactagt

SEQ ID NO: 461096 - DNA, 20 bp, mouse
gccggcgtgtgaggtgactg

SEQ ID NO: 461097 - DNA, 20 bp, mouse
ggcgtgtgaggtgactgcgg

SEQ ID NO: 461098 - DNA, 20 bp, mouse
gagtcccacgagggcttcaa

SEQ ID NO: 461099 - DNA, 20 bp, mouse
gctgcagttccgggtcgggt

SEQ ID NO: 461100 - DNA, 20 bp, mouse
gagctgctgcagttccgggt

SEQ ID NO: 461101 - DNA, 20 bp, mouse
ggcaaacggcccggcgtgtg

SEQ ID NO: 461102 - DNA, 20 bp, mouse
gggcggtgagtgctctttgt

SEQ ID NO: 461103 - DNA, 20 bp, mouse
gcctcccttgaagccctcgt

SEQ ID NO: 461104 - DNA, 20 bp, mouse
gcgggttggcgcaaacggcc

SEQ ID NO: 461105 - DNA, 20 bp, mouse
gcgtttgcgccaacccgacc

SEQ ID NO: 461106 - DNA, 20 bp, mouse
gagagcggagaccgcagcta

SEQ ID NO: 461107 - DNA, 20 bp, mouse
gtggcgtcgttactttgggg

SEQ ID NO: 461108 - DNA, 20 bp, mouse
gctttggggaggcgacgccg

SEQ ID NO: 461109 - DNA, 20 bp, mouse
gtggggaggcgacgccgggg

SEQ ID NO: 461110 - DNA, 20 bp, mouse
gcggtctccgctctcgcccc

SEQ ID NO: 461111 - DNA, 20 bp, mouse
gagtaacgacgccatagctg

SEQ ID NO: 461112 - DNA, 20 bp, mouse
ggggtggcagcacgtgccag

SEQ ID NO: 461113 - DNA, 20 bp, mouse
gctagaacagggactcccga

SEQ ID NO: 461114 - DNA, 20 bp, mouse
gctatggcgtcgttactttg

SEQ ID NO: 461115 - DNA, 20 bp, mouse
gctcccgagggaagtcccct

SEQ ID NO: 461116 - DNA, 20 bp, mouse
gtaggcagtagtcctggcag

SEQ ID NO: 461117 - DNA, 20 bp, mouse
gtgagcgtggacggatgctt

SEQ ID NO: 461118 - DNA, 20 bp, mouse
ggtagtcctggcagcggcag

SEQ ID NO: 461119 - DNA, 20 bp, mouse
gcggcggcgggcagtagtgg

SEQ ID NO: 461120 - DNA, 20 bp, mouse
ggatgcttaggcagtagtcc

SEQ ID NO: 461121 - DNA, 20 bp, mouse
ggcgctctagtgagcgtgga

SEQ ID NO: 461122 - DNA, 20 bp, mouse
ggcgagcgctctagtgagcg

SEQ ID NO: 461123 - DNA, 20 bp, mouse
gtcagtgcgctggttcatgg

SEQ ID NO: 461124 - DNA, 20 bp, mouse
ggagtggggaccagaaccag

SEQ ID NO: 461125 - DNA, 20 bp, mouse
gctgaactctcgcagagcca

SEQ ID NO: 461126 - DNA, 20 bp, mouse
gcactcgctacgtccggaag

SEQ ID NO: 461127 - DNA, 20 bp, mouse
gaccatcggcgagaatgacg

SEQ ID NO: 461128 - DNA, 20 bp, mouse
gtcggcttcatccggaccat

SEQ ID NO: 461129 - DNA, 20 bp, mouse
gggagcatgtgtccccgact

SEQ ID NO: 461130 - DNA, 20 bp, mouse
gtcggactccggagacgagg

SEQ ID NO: 461131 - DNA, 20 bp, mouse
ggccgtgtcaccaagctgtg

SEQ ID NO: 461132 - DNA, 20 bp, mouse
gcggaaaaggcgggtcgtgt

SEQ ID NO: 461133 - DNA, 20 bp, mouse
gggcggagctcggcttcatc

SEQ ID NO: 461134 - DNA, 20 bp, mouse
gacctcgtcattctcgccga

SEQ ID NO: 461135 - DNA, 20 bp, mouse
ggggacacctgagcacgctg

SEQ ID NO: 461136 - DNA, 20 bp, mouse
ggccgcgccgagaccagcag

SEQ ID NO: 461137 - DNA, 20 bp, mouse
ggagcctcgacggaacctag

SEQ ID NO: 461138 - DNA, 20 bp, mouse
gggctttagccgggccatcg

SEQ ID NO: 461139 - DNA, 20 bp, mouse
ggcaccactaggttccgtcg

SEQ ID NO: 461140 - DNA, 20 bp, mouse
gtccagccacgggaagccag

SEQ ID NO: 461141 - DNA, 20 bp, mouse
gcgggacgagaggttcctca

SEQ ID NO: 461142 - DNA, 20 bp, mouse
ggctgctggcgttagcagta

SEQ ID NO: 461143 - DNA, 20 bp, mouse
gctaacgccagcagccgcga

SEQ ID NO: 461144 - DNA, 20 bp, mouse
gaccgtactccagactacgg

SEQ ID NO: 461145 - DNA, 20 bp, mouse
gtggccgctgcaaactccca

SEQ ID NO: 461146 - DNA, 20 bp, mouse
gcggagccgcggaaccagca

SEQ ID NO: 461147 - DNA, 20 bp, mouse
gagggagcccaggtagcacg

SEQ ID NO: 461148 - DNA, 20 bp, mouse
gaggtagcacgtggagaggg

SEQ ID NO: 461149 - DNA, 20 bp, mouse
ggcccaggtagcacgtggag

SEQ ID NO: 461150 - DNA, 20 bp, mouse
gcgaccggacctgatcactg

SEQ ID NO: 461151 - DNA, 20 bp, mouse
gtggaaagtgcgctccggta

SEQ ID NO: 461152 - DNA, 20 bp, mouse
gacgtcctggaaggccggtc

SEQ ID NO: 461153 - DNA, 20 bp, mouse
ggttccgcggctccgcactt

SEQ ID NO: 461154 - DNA, 20 bp, mouse
ggcagacacgcggagaaggt

SEQ ID NO: 461155 - DNA, 20 bp, mouse
gcgggagagtgagcctccgt

SEQ ID NO: 461156 - DNA, 20 bp, mouse
gtcgcggcgtagaaccggac

SEQ ID NO: 461157 - DNA, 20 bp, mouse
gctcgcggaggcgaaccggg

SEQ ID NO: 461158 - DNA, 20 bp, mouse
gcggcgtagaaccggacggg

SEQ ID NO: 461159 - DNA, 20 bp, mouse
gcagctcgcggaggcgaacc

SEQ ID NO: 461160 - DNA, 20 bp, mouse
gtagcgcgcgtccagggtcg

SEQ ID NO: 461161 - DNA, 20 bp, mouse
gcagggtcgcggcgtagaac

SEQ ID NO: 461162 - DNA, 20 bp, mouse
ggcactgtagcgcgcgtcca

SEQ ID NO: 461163 - DNA, 20 bp, mouse
gccggaagccgacctactaa

SEQ ID NO: 461164 - DNA, 20 bp, mouse
ggcaaagagagccacccgtc

SEQ ID NO: 461165 - DNA, 20 bp, mouse
ggcacagcagcgggacggtt

SEQ ID NO: 461166 - DNA, 20 bp, mouse
ggcactgcgagcgtgtatgg

SEQ ID NO: 461167 - DNA, 20 bp, mouse
gtggcggtggatggtgcaca

SEQ ID NO: 461168 - DNA, 20 bp, mouse
gcgggagaagcagatggcgg

SEQ ID NO: 461169 - DNA, 20 bp, mouse
gtaagcactgcgagcgtgta

SEQ ID NO: 461170 - DNA, 20 bp, mouse
ggcagtgcttaggtaagctt

SEQ ID NO: 461171 - DNA, 20 bp, mouse
gaggaagcgcggagacacaa

SEQ ID NO: 461172 - DNA, 20 bp, mouse
gagcctggaaccggaagtga

SEQ ID NO: 461173 - DNA, 20 bp, mouse
gatggcggcagcaacgggga

SEQ ID NO: 461174 - DNA, 20 bp, mouse
ggtgtatggcggcagcaacg

SEQ ID NO: 461175 - DNA, 20 bp, mouse
gcggggagctgggagacaag

SEQ ID NO: 461176 - DNA, 20 bp, mouse
ggcccggggacggagaggaa

SEQ ID NO: 461177 - DNA, 20 bp, mouse
gaccgcaaaggccctctcac

SEQ ID NO: 461178 - DNA, 20 bp, mouse
gtcccgtgagagggcctttg

SEQ ID NO: 461179 - DNA, 20 bp, mouse
gtgcgccacaaggcaggcta

SEQ ID NO: 461180 - DNA, 20 bp, mouse
ggccgagccggaggaatcac

SEQ ID NO: 461181 - DNA, 20 bp, mouse
ggagagggcctttgcggtag

SEQ ID NO: 461182 - DNA, 20 bp, mouse
gaagcaggcagagctcctaa

SEQ ID NO: 461183 - DNA, 20 bp, mouse
gccggccgcccgggagagga

SEQ ID NO: 461184 - DNA, 20 bp, mouse
gcgccggcccgagccgtcca

SEQ ID NO: 461185 - DNA, 20 bp, mouse
gccgagccgtccagggagac

SEQ ID NO: 461186 - DNA, 20 bp, mouse
gccgtgaggaaacaggtcta

SEQ ID NO: 461187 - DNA, 20 bp, mouse
gcaagtggcagcggaaagta

SEQ ID NO: 461188 - DNA, 20 bp, mouse
gaaaaattgagaacttctca

SEQ ID NO: 461189 - DNA, 20 bp, mouse
ggcgttcaccgtgaggaaac

SEQ ID NO: 461190 - DNA, 20 bp, mouse
gggaattagggccacccgag

SEQ ID NO: 461191 - DNA, 20 bp, mouse
gagctcttgcgttcaccgtg

SEQ ID NO: 461192 - DNA, 20 bp, mouse
gtacaggcttcgcataatgg

SEQ ID NO: 461193 - DNA, 20 bp, mouse
ggaaggagcgtcttatatat

SEQ ID NO: 461194 - DNA, 20 bp, mouse
gttttcagcaatgagtcaag

SEQ ID NO: 461195 - DNA, 20 bp, mouse
gtgtttggcggtgcattaaa

SEQ ID NO: 461196 - DNA, 20 bp, mouse
gctggagcggagaggtgagt

SEQ ID NO: 461197 - DNA, 20 bp, mouse
gtccgcacgaagccacgggg

SEQ ID NO: 461198 - DNA, 20 bp, mouse
gaggctccccgggctcctcg

SEQ ID NO: 461199 - DNA, 20 bp, mouse
gtcctcgcggccggccgacg

SEQ ID NO: 461200 - DNA, 20 bp, mouse
gaggccttggaggcttaggg

SEQ ID NO: 461201 - DNA, 20 bp, mouse
gagcggagaggtgagtgggc

SEQ ID NO: 461202 - DNA, 20 bp, mouse
gccggccgacgcggcttaaa

SEQ ID NO: 461203 - DNA, 20 bp, mouse
gcgctccgcacgaagccacg

SEQ ID NO: 461204 - DNA, 20 bp, mouse
ggcagccgtttaagccgcgt

SEQ ID NO: 461205 - DNA, 20 bp, mouse
gctacggcgaaggaattggg

SEQ ID NO: 461206 - DNA, 20 bp, mouse
gcggaaccggagcggaaggt

SEQ ID NO: 461207 - DNA, 20 bp, mouse
gggaggattcggaaccggag

SEQ ID NO: 461208 - DNA, 20 bp, mouse
gcagcctaagatggaggatt

SEQ ID NO: 461209 - DNA, 20 bp, mouse
ggcatgtgtgcagcctaaga

SEQ ID NO: 461210 - DNA, 20 bp, mouse
ggttccgaatcctccatctt

SEQ ID NO: 461211 - DNA, 20 bp, mouse
ggattcggaaccggagcgga

SEQ ID NO: 461212 - DNA, 20 bp, mouse
gtcagtcccaccttccgctc

SEQ ID NO: 461213 - DNA, 20 bp, mouse
gcggcagcgccggcagctac

SEQ ID NO: 461214 - DNA, 20 bp, mouse
ggctgccgcaacggcacata

SEQ ID NO: 461215 - DNA, 20 bp, mouse
gacgcgcagcggagccaatt

SEQ ID NO: 461216 - DNA, 20 bp, mouse
gtcagcaacgggccgtgagg

SEQ ID NO: 461217 - DNA, 20 bp, mouse
gcagtcagcaacgggccgtg

SEQ ID NO: 461218 - DNA, 20 bp, mouse
ggcaacgggccgtgaggcgg

SEQ ID NO: 461219 - DNA, 20 bp, mouse
gcggcgcgaaagaacccccg

SEQ ID NO: 461220 - DNA, 20 bp, mouse
gccgtgaggcggcggcgaag

SEQ ID NO: 461221 - DNA, 20 bp, mouse
gaagctgtgagagccagtgg

SEQ ID NO: 461222 - DNA, 20 bp, mouse
ggggacacgagaggtaactg

SEQ ID NO: 461223 - DNA, 20 bp, mouse
gctagcccgggggacacgag

SEQ ID NO: 461224 - DNA, 20 bp, mouse
gggcgagggcggaggaacct

SEQ ID NO: 461225 - DNA, 20 bp, mouse
gcgcagtgccgctagcccgg

SEQ ID NO: 461226 - DNA, 20 bp, mouse
gacgcccgaggaggaagcgt

SEQ ID NO: 461227 - DNA, 20 bp, mouse
gccgcctagacatggctctg

SEQ ID NO: 461228 - DNA, 20 bp, mouse
gtctcctcagagccatgtct

SEQ ID NO: 461229 - DNA, 20 bp, mouse
ggcgggttcccgcctagaca

SEQ ID NO: 461230 - DNA, 20 bp, mouse
gcggggagcaacgcccgagg

SEQ ID NO: 461231 - DNA, 20 bp, mouse
ggactcagctgcacaggccg

SEQ ID NO: 461232 - DNA, 20 bp, mouse
gtggaacgacgtgcgacgcg

SEQ ID NO: 461233 - DNA, 20 bp, mouse
gacccggtcgagcttcgccg

SEQ ID NO: 461234 - DNA, 20 bp, mouse
gcgccggggagcaacgcccg

SEQ ID NO: 461235 - DNA, 20 bp, mouse
gcggaggagacgaaccggag

SEQ ID NO: 461236 - DNA, 20 bp, mouse
gcacggtaccgagcgaggac

SEQ ID NO: 461237 - DNA, 20 bp, mouse
ggaggaccggtcctacgaaa

SEQ ID NO: 461238 - DNA, 20 bp, mouse
gcggcttcttgggctcggag

SEQ ID NO: 461239 - DNA, 20 bp, mouse
gggagctctgtccatttcgt

SEQ ID NO: 461240 - DNA, 20 bp, mouse
ggttggccacgctctgatgg

SEQ ID NO: 461241 - DNA, 20 bp, mouse
gcgcgggcgagcggcttctt

SEQ ID NO: 461242 - DNA, 20 bp, mouse
gccgctcagggctcgaccgg

SEQ ID NO: 461243 - DNA, 20 bp, mouse
gaggggagcgagcgggtgga

SEQ ID NO: 461244 - DNA, 20 bp, mouse
gggcgctgcgggtagagtgc

SEQ ID NO: 461245 - DNA, 20 bp, mouse
gggagtctcggtgagtccgc

SEQ ID NO: 461246 - DNA, 20 bp, mouse
ggagcccacgagcaagatgg

SEQ ID NO: 461247 - DNA, 20 bp, mouse
gtgtctgaagggctccagag

SEQ ID NO: 461248 - DNA, 20 bp, mouse
gccggagcccacgagcaaga

SEQ ID NO: 461249 - DNA, 20 bp, mouse
gcagacagctgcggaagagg

SEQ ID NO: 461250 - DNA, 20 bp, mouse
gagcaagatggcggcggacg

SEQ ID NO: 461251 - DNA, 20 bp, mouse
gaggaacccgattccccctc

SEQ ID NO: 461252 - DNA, 20 bp, mouse
gccgccgccatcttgctcgt

SEQ ID NO: 461253 - DNA, 20 bp, mouse
ggacccagcggcatcctaca

SEQ ID NO: 461254 - DNA, 20 bp, mouse
gagggctccagagggggaat

SEQ ID NO: 461255 - DNA, 20 bp, mouse
gctcgtgggctccggaagtg

SEQ ID NO: 461256 - DNA, 20 bp, mouse
gtgagatcgggttgtcgtcg

SEQ ID NO: 461257 - DNA, 20 bp, mouse
gacccgagctgcaccggcgt

SEQ ID NO: 461258 - DNA, 20 bp, mouse
gtggcggggttcgctgagat

SEQ ID NO: 461259 - DNA, 20 bp, mouse
gtaggttctctgcccgggtc

SEQ ID NO: 461260 - DNA, 20 bp, mouse
gccccgccatgctccagacc

SEQ ID NO: 461261 - DNA, 20 bp, mouse
gttatcacacaggtgatggg

SEQ ID NO: 461262 - DNA, 20 bp, mouse
gatttctaggttctctgccc

SEQ ID NO: 461263 - DNA, 20 bp, mouse
gagaacagtgtcgacagctg

SEQ ID NO: 461264 - DNA, 20 bp, mouse
ggccggaagcactcatttct

SEQ ID NO: 461265 - DNA, 20 bp, mouse
gcccgagcatagggagagat

SEQ ID NO: 461266 - DNA, 20 bp, mouse
ggacggcgaagcctctgcgg

SEQ ID NO: 461267 - DNA, 20 bp, mouse
gtaaccgaaggagaccaggg

SEQ ID NO: 461268 - DNA, 20 bp, mouse
ggaggggccggtggtgtcga

SEQ ID NO: 461269 - DNA, 20 bp, mouse
gtcaccagcggaggggccgg

SEQ ID NO: 461270 - DNA, 20 bp, mouse
gctgcgagggcaaggaccga

SEQ ID NO: 461271 - DNA, 20 bp, mouse
gggagagaaggcctcggcga

SEQ ID NO: 461272 - DNA, 20 bp, mouse
gagtcgcggagagaaggcct

SEQ ID NO: 461273 - DNA, 20 bp, mouse
ggcgtcaccagcggaggggc

SEQ ID NO: 461274 - DNA, 20 bp, mouse
gggcgacggcgaagcctctg

SEQ ID NO: 461275 - DNA, 20 bp, mouse
gggaccgatggaaatgaatg

SEQ ID NO: 461276 - DNA, 20 bp, mouse
gcggccaccgagagcgtgaa

SEQ ID NO: 461277 - DNA, 20 bp, mouse
ggcaacctcccgcccggctg

SEQ ID NO: 461278 - DNA, 20 bp, mouse
gcggtggccgtaggtggtcg

SEQ ID NO: 461279 - DNA, 20 bp, mouse
ggccgtcgcaacctcccgcc

SEQ ID NO: 461280 - DNA, 20 bp, mouse
ggtggcccggaagtgacgca

SEQ ID NO: 461281 - DNA, 20 bp, mouse
gccaggccagcgcagcccga

SEQ ID NO: 461282 - DNA, 20 bp, mouse
ggccgggcgggaggttgcga

SEQ ID NO: 461283 - DNA, 20 bp, mouse
ggggcgcagaggccgacgtg

SEQ ID NO: 461284 - DNA, 20 bp, mouse
gcggaagtgacgcacggtcc

SEQ ID NO: 461285 - DNA, 20 bp, mouse
gcggatctctcccgagagat

SEQ ID NO: 461286 - DNA, 20 bp, mouse
gccgcggcgtggggcagcta

SEQ ID NO: 461287 - DNA, 20 bp, mouse
ggcccgcgtaccgcgctatg

SEQ ID NO: 461288 - DNA, 20 bp, mouse
gggagaggaaccgcggcgtg

SEQ ID NO: 461289 - DNA, 20 bp, mouse
ggcgcggtacgcgggcccag

SEQ ID NO: 461290 - DNA, 20 bp, mouse
gcgcgggcccagaggccgcg

SEQ ID NO: 461291 - DNA, 20 bp, mouse
gcccctgccccgcggcctct

SEQ ID NO: 461292 - DNA, 20 bp, mouse
gtcatcaaagagcgccggag

SEQ ID NO: 461293 - DNA, 20 bp, mouse
gtgtcgctcagggagaggtg

SEQ ID NO: 461294 - DNA, 20 bp, mouse
gggcgctgttccacatagcg

SEQ ID NO: 461295 - DNA, 20 bp, mouse
gccgaactcggaggctccta

SEQ ID NO: 461296 - DNA, 20 bp, mouse
gagccggcgaaacaggtcgt

SEQ ID NO: 461297 - DNA, 20 bp, mouse
gggctccaagccggcgaaac

SEQ ID NO: 461298 - DNA, 20 bp, mouse
gggctcaactgagtctaccg

SEQ ID NO: 461299 - DNA, 20 bp, mouse
gcaggcgccgggaggccgtg

SEQ ID NO: 461300 - DNA, 20 bp, mouse
gcggcgcgctggagaccccg

SEQ ID NO: 461301 - DNA, 20 bp, mouse
ggcctgtgcggaagcagtcg

SEQ ID NO: 461302 - DNA, 20 bp, mouse
ggaagtctggggtaaatctt

SEQ ID NO: 461303 - DNA, 20 bp, mouse
gagcagtcgcggatagaaag

SEQ ID NO: 461304 - DNA, 20 bp, mouse
gctttacccagaaggcccca

SEQ ID NO: 461305 - DNA, 20 bp, mouse
gttcacgtcgaacttggcgc

SEQ ID NO: 461306 - DNA, 20 bp, mouse
gtggctgctggcagacgtgt

SEQ ID NO: 461307 - DNA, 20 bp, mouse
gtcttccacggcgccatggt

SEQ ID NO: 461308 - DNA, 20 bp, mouse
ggcgccatggtgggacgcga

SEQ ID NO: 461309 - DNA, 20 bp, mouse
gcaggccgagagcccgaaca

SEQ ID NO: 461310 - DNA, 20 bp, mouse
gccatggtgggacgcgacgg

SEQ ID NO: 461311 - DNA, 20 bp, mouse
gacgcgaagggacccaatga

SEQ ID NO: 461312 - DNA, 20 bp, mouse
gggaaggtaagagcgcgagg

SEQ ID NO: 461313 - DNA, 20 bp, mouse
ggcccggcccgcatggctgc

SEQ ID NO: 461314 - DNA, 20 bp, mouse
gggaagagggcggggcctaa

SEQ ID NO: 461315 - DNA, 20 bp, mouse
gtcttagacccggaagaggg

SEQ ID NO: 461316 - DNA, 20 bp, mouse
gtgaaacccgcagagaaccg

SEQ ID NO: 461317 - DNA, 20 bp, mouse
ggcgcgtccccggttctctg

SEQ ID NO: 461318 - DNA, 20 bp, mouse
gggcacctgcagcgactccc

SEQ ID NO: 461319 - DNA, 20 bp, mouse
gccatggagcacgtgacgga

SEQ ID NO: 461320 - DNA, 20 bp, mouse
ggccgtcaggatctcagact

SEQ ID NO: 461321 - DNA, 20 bp, mouse
ggccaagtctgagatcctga

SEQ ID NO: 461322 - DNA, 20 bp, mouse
gcagtgcaccgagcacccga

SEQ ID NO: 461323 - DNA, 20 bp, mouse
gagtgcagccgcgggcgtca

SEQ ID NO: 461324 - DNA, 20 bp, mouse
ggtgctccatggcgcgtccc

SEQ ID NO: 461325 - DNA, 20 bp, mouse
gcagggagagagccctttcg

SEQ ID NO: 461326 - DNA, 20 bp, mouse
gacagcgtggagtcacgcca

SEQ ID NO: 461327 - DNA, 20 bp, mouse
gcaagcggcgtggagtacag

SEQ ID NO: 461328 - DNA, 20 bp, mouse
gccctccagcgccagaggaa

SEQ ID NO: 461329 - DNA, 20 bp, mouse
gacacatgggcctggatccc

SEQ ID NO: 461330 - DNA, 20 bp, mouse
gtggaggaccaagaagcgct

SEQ ID NO: 461331 - DNA, 20 bp, mouse
gctgcaggagccggggatcc

SEQ ID NO: 461332 - DNA, 20 bp, mouse
ggaggaaccttggcacagtc

SEQ ID NO: 461333 - DNA, 20 bp, mouse
gcgctgggttttgaacacat

SEQ ID NO: 461334 - DNA, 20 bp, mouse
gctgacacaggacctatagg

SEQ ID NO: 461335 - DNA, 20 bp, mouse
gaggctgtggagctgctacc

SEQ ID NO: 461336 - DNA, 20 bp, mouse
ggccagagatgaacgaagtg

SEQ ID NO: 461337 - DNA, 20 bp, mouse
gacgaagtggggactttcca

SEQ ID NO: 461338 - DNA, 20 bp, mouse
gaggcgatcgatgagcgccc

SEQ ID NO: 461339 - DNA, 20 bp, mouse
gtccccacttcgttcatctc

SEQ ID NO: 461340 - DNA, 20 bp, mouse
ggagcctgagagccccagtt

SEQ ID NO: 461341 - DNA, 20 bp, mouse
gttcctatggccagccggct

SEQ ID NO: 461342 - DNA, 20 bp, mouse
gggtgagtggtccccaactg

SEQ ID NO: 461343 - DNA, 20 bp, mouse
gctgctccgctgtcattctg

SEQ ID NO: 461344 - DNA, 20 bp, mouse
gctggctcgaggatggtgag

SEQ ID NO: 461345 - DNA, 20 bp, mouse
gggcggatttgcgggagcca

SEQ ID NO: 461346 - DNA, 20 bp, mouse
ggcgcggggccctcaaaccc

SEQ ID NO: 461347 - DNA, 20 bp, mouse
gccctgcgcctggaccggag

SEQ ID NO: 461348 - DNA, 20 bp, mouse
gagctccgcaatcccagcca

SEQ ID NO: 461349 - DNA, 20 bp, mouse
gtaacctgcgtgctggacgg

SEQ ID NO: 461350 - DNA, 20 bp, mouse
ggcgcacgtcacgaggaccc

SEQ ID NO: 461351 - DNA, 20 bp, mouse
gggctactcggccggaaact

SEQ ID NO: 461352 - DNA, 20 bp, mouse
gtcacgaggaccccggcgag

SEQ ID NO: 461353 - DNA, 20 bp, mouse
gaggcgcagggccgagtttc

SEQ ID NO: 461354 - DNA, 20 bp, mouse
gttacgccggagcacaggag

SEQ ID NO: 461355 - DNA, 20 bp, mouse
gctcggccctgcgcctggac

SEQ ID NO: 461356 - DNA, 20 bp, mouse
gccggcggcggcgacatcgg

SEQ ID NO: 461357 - DNA, 20 bp, mouse
gtggccgctgagaagagcgg

SEQ ID NO: 461358 - DNA, 20 bp, mouse
gcgccggccgaggtagtgcg

SEQ ID NO: 461359 - DNA, 20 bp, mouse
gccgccaccccgcactacct

SEQ ID NO: 461360 - DNA, 20 bp, mouse
gagcccggcggcggcgacat

SEQ ID NO: 461361 - DNA, 20 bp, mouse
gggcccgagtcctaccaccg

SEQ ID NO: 461362 - DNA, 20 bp, mouse
gcgggcggaggtttccgagg

SEQ ID NO: 461363 - DNA, 20 bp, mouse
gcggccgaggtagtgcgggg

SEQ ID NO: 461364 - DNA, 20 bp, mouse
ggggcgggcggaggtttccg

SEQ ID NO: 461365 - DNA, 20 bp, mouse
gacggcggcgggcgagggag

SEQ ID NO: 461366 - DNA, 20 bp, mouse
gggctcgccaggggattgta

SEQ ID NO: 461367 - DNA, 20 bp, mouse
gcaagcacacagtcgaccac

SEQ ID NO: 461368 - DNA, 20 bp, mouse
gattggtcttaggtctcctg

SEQ ID NO: 461369 - DNA, 20 bp, mouse
gctgaggggacagcactagg

SEQ ID NO: 461370 - DNA, 20 bp, mouse
gtacctgctgcgcagaccag

SEQ ID NO: 461371 - DNA, 20 bp, mouse
gaatcgctagctccaaaaag

SEQ ID NO: 461372 - DNA, 20 bp, mouse
gagtactcggtggaccacag

SEQ ID NO: 461373 - DNA, 20 bp, mouse
ggatagggatcaataagtag

SEQ ID NO: 461374 - DNA, 20 bp, mouse
gaagaggtctgagtggtgag

SEQ ID NO: 461375 - DNA, 20 bp, mouse
gggagctagcgattggtctt

SEQ ID NO: 461376 - DNA, 20 bp, mouse
gcgtatggaggactcggact

SEQ ID NO: 461377 - DNA, 20 bp, mouse
gctcggtggagtccgtatgg

SEQ ID NO: 461378 - DNA, 20 bp, mouse
gggagtccgtatggaggact

SEQ ID NO: 461379 - DNA, 20 bp, mouse
gactcggcggcaaaacagct

SEQ ID NO: 461380 - DNA, 20 bp, mouse
gcgccttcgggcggactcgg

SEQ ID NO: 461381 - DNA, 20 bp, mouse
gaaacagctgggcctggccg

SEQ ID NO: 461382 - DNA, 20 bp, mouse
gctggccgaggcggcagctg

SEQ ID NO: 461383 - DNA, 20 bp, mouse
gagcagagacgaggactcgg

SEQ ID NO: 461384 - DNA, 20 bp, mouse
gggcggcggcggcctcatcg

SEQ ID NO: 461385 - DNA, 20 bp, mouse
gggtgatggcggccgaatct

SEQ ID NO: 461386 - DNA, 20 bp, mouse
gcaatcaagagacaatccag

SEQ ID NO: 461387 - DNA, 20 bp, mouse
gtggctacgcggcaaagcca

SEQ ID NO: 461388 - DNA, 20 bp, mouse
gtcgctcctgactggctacg

SEQ ID NO: 461389 - DNA, 20 bp, mouse
gtcctccaggagctgaaaga

SEQ ID NO: 461390 - DNA, 20 bp, mouse
gctttgccgcgtagccagtc

SEQ ID NO: 461391 - DNA, 20 bp, mouse
gtcagcagcgcgcgactcgg

SEQ ID NO: 461392 - DNA, 20 bp, mouse
gtgtcatcttcgctcctgac

SEQ ID NO: 461393 - DNA, 20 bp, mouse
gtgtgggccggggaaggaat

SEQ ID NO: 461394 - DNA, 20 bp, mouse
ggctctcagctggaggtccg

SEQ ID NO: 461395 - DNA, 20 bp, mouse
gcgaccgagagccggagatt

SEQ ID NO: 461396 - DNA, 20 bp, mouse
gctgaggacccggatcgcag

SEQ ID NO: 461397 - DNA, 20 bp, mouse
gaggacccggatcgcagggg

SEQ ID NO: 461398 - DNA, 20 bp, mouse
gacgcagcgcgggagaccag

SEQ ID NO: 461399 - DNA, 20 bp, mouse
gtccgggtcctcagagggta

SEQ ID NO: 461400 - DNA, 20 bp, mouse
gggccgtgcgttctttgctg

SEQ ID NO: 461401 - DNA, 20 bp, mouse
gcaggcgtcccgggaagcag

SEQ ID NO: 461402 - DNA, 20 bp, mouse
ggcagagggtgcaatgagag

SEQ ID NO: 461403 - DNA, 20 bp, mouse
ggagtgctctccccaagtcc

SEQ ID NO: 461404 - DNA, 20 bp, mouse
gcaccccagcaaagaacgca

SEQ ID NO: 461405 - DNA, 20 bp, mouse
gctgcagacatggcgctgct

SEQ ID NO: 461406 - DNA, 20 bp, mouse
gtccgggatggcaaggacag

SEQ ID NO: 461407 - DNA, 20 bp, mouse
gagctcactggagaagatcc

SEQ ID NO: 461408 - DNA, 20 bp, mouse
gtgcgttggaaaggtagatc

SEQ ID NO: 461409 - DNA, 20 bp, mouse
ggattgctgcgtgtccggga

SEQ ID NO: 461410 - DNA, 20 bp, mouse
gtggcaaggacagtggaacc

SEQ ID NO: 461411 - DNA, 20 bp, mouse
gctgcgtgtccgggatggca

SEQ ID NO: 461412 - DNA, 20 bp, mouse
ggctaaagcagggaaccagg

SEQ ID NO: 461413 - DNA, 20 bp, mouse
ggatgggcggcttgatgtgg

SEQ ID NO: 461414 - DNA, 20 bp, mouse
gactggatgtgacatcacag

SEQ ID NO: 461415 - DNA, 20 bp, mouse
ggtctacgattgcccaggaa

SEQ ID NO: 461416 - DNA, 20 bp, mouse
gggcgcggatggatccaaca

SEQ ID NO: 461417 - DNA, 20 bp, mouse
gcgccccgccgcctcactct

SEQ ID NO: 461418 - DNA, 20 bp, mouse
ggcggatggatccaacatgg

SEQ ID NO: 461419 - DNA, 20 bp, mouse
gggcggctggagcccggatg

SEQ ID NO: 461420 - DNA, 20 bp, mouse
gggagaacctccggagaggg

SEQ ID NO: 461421 - DNA, 20 bp, mouse
gctccgtgaggcgcaggccc

SEQ ID NO: 461422 - DNA, 20 bp, mouse
gcaggggagatggcaactgt

SEQ ID NO: 461423 - DNA, 20 bp, mouse
gtgagccgagagtgaggcgg

SEQ ID NO: 461424 - DNA, 20 bp, mouse
ggcccggatgcggctccgtg

SEQ ID NO: 461425 - DNA, 20 bp, mouse
ggcctcacggagccgcatcc

SEQ ID NO: 461426 - DNA, 20 bp, mouse
ggccgtcgcccagaagtcat

SEQ ID NO: 461427 - DNA, 20 bp, mouse
ggtcatcggacgctggaatc

SEQ ID NO: 461428 - DNA, 20 bp, mouse
gccagcgtccgatgacttct

SEQ ID NO: 461429 - DNA, 20 bp, mouse
gcggacgctggaatctggtg

SEQ ID NO: 461430 - DNA, 20 bp, mouse
gaatctggtgaggataagag

SEQ ID NO: 461431 - DNA, 20 bp, mouse
gccctcggccccctgcaagt

SEQ ID NO: 461432 - DNA, 20 bp, mouse
ggatccaaaacaagtggctg

SEQ ID NO: 461433 - DNA, 20 bp, mouse
ggcgagttgggcgaaagagg

SEQ ID NO: 461434 - DNA, 20 bp, mouse
gtccgatgacttctgggcga

SEQ ID NO: 461435 - DNA, 20 bp, mouse
gggtcgtctaggtcagtcgg

SEQ ID NO: 461436 - DNA, 20 bp, mouse
gggagctgctcaagtctatc

SEQ ID NO: 461437 - DNA, 20 bp, mouse
gtccacgtccagtgcagtga

SEQ ID NO: 461438 - DNA, 20 bp, mouse
ggccttcactgcactggacg

SEQ ID NO: 461439 - DNA, 20 bp, mouse
ggacgtggagaagagcggca

SEQ ID NO: 461440 - DNA, 20 bp, mouse
gtggtggcatgagccctctg

SEQ ID NO: 461441 - DNA, 20 bp, mouse
gagcgctgacggggccacaa

SEQ ID NO: 461442 - DNA, 20 bp, mouse
gtggtacgccttcactgcac

SEQ ID NO: 461443 - DNA, 20 bp, mouse
gcagcagccctggccccggg

SEQ ID NO: 461444 - DNA, 20 bp, mouse
gcatccttggggctcagggg

SEQ ID NO: 461445 - DNA, 20 bp, mouse
gccatgaggaagccacaggg

SEQ ID NO: 461446 - DNA, 20 bp, mouse
gccggtccggtacaatgtag

SEQ ID NO: 461447 - DNA, 20 bp, mouse
gagccggtacagtgtatcag

SEQ ID NO: 461448 - DNA, 20 bp, mouse
gacagtgtagccagccggtc

SEQ ID NO: 461449 - DNA, 20 bp, mouse
gcggtacagtgtatcagcgg

SEQ ID NO: 461450 - DNA, 20 bp, mouse
ggccagaaagcggtctctgt

SEQ ID NO: 461451 - DNA, 20 bp, mouse
gggctgccgctacattgtac

SEQ ID NO: 461452 - DNA, 20 bp, mouse
gttggtccccgcagtacgta

SEQ ID NO: 461453 - DNA, 20 bp, mouse
gagcagaaggcgagtccctg

SEQ ID NO: 461454 - DNA, 20 bp, mouse
ggaccgctttctggcttacc

SEQ ID NO: 461455 - DNA, 20 bp, mouse
gcgtactgcggggaccaatg

SEQ ID NO: 461456 - DNA, 20 bp, mouse
gtctgtcagcccaactacct

SEQ ID NO: 461457 - DNA, 20 bp, mouse
ggtgaaactcccaggtagtt

SEQ ID NO: 461458 - DNA, 20 bp, mouse
gctagacttggaaaaccagg

SEQ ID NO: 461459 - DNA, 20 bp, mouse
gtaatgagttttcatagtgg

SEQ ID NO: 461460 - DNA, 20 bp, mouse
gtcacatcctctctgcactc

SEQ ID NO: 461461 - DNA, 20 bp, mouse
gccacccagagacctaactg

SEQ ID NO: 461462 - DNA, 20 bp, mouse
ggtctgtggtcaacagccct

SEQ ID NO: 461463 - DNA, 20 bp, mouse
ggagtgtgctgagtggtctg

SEQ ID NO: 461464 - DNA, 20 bp, mouse
gagtaacagagtgtgctgag

SEQ ID NO: 461465 - DNA, 20 bp, mouse
gtcaaaaagctagtctctgg

SEQ ID NO: 461466 - DNA, 20 bp, mouse
gagatgcagaaaactgaagc

SEQ ID NO: 461467 - DNA, 20 bp, mouse
ggcatctccatgtcctgagc

SEQ ID NO: 461468 - DNA, 20 bp, mouse
gtcagcacctgctcaggaca

SEQ ID NO: 461469 - DNA, 20 bp, mouse
gggcactcagactccagaga

SEQ ID NO: 461470 - DNA, 20 bp, mouse
gaaggtcctcaggcttacct

SEQ ID NO: 461471 - DNA, 20 bp, mouse
gtcctcaggcttacctgggg

SEQ ID NO: 461472 - DNA, 20 bp, mouse
ggagggtcagtaaccacagc

SEQ ID NO: 461473 - DNA, 20 bp, mouse
ggaggaaagtcttgtagcaa

SEQ ID NO: 461474 - DNA, 20 bp, mouse
gagaagtacccattaaacaa

SEQ ID NO: 461475 - DNA, 20 bp, mouse
ggtagtattctattccctga

SEQ ID NO: 461476 - DNA, 20 bp, mouse
ggctgtagtcactgactctc

SEQ ID NO: 461477 - DNA, 20 bp, mouse
gattcacccaagtcactgaa

SEQ ID NO: 461478 - DNA, 20 bp, mouse
gatctcctctttagacagat

SEQ ID NO: 461479 - DNA, 20 bp, mouse
ggggacccatctgtctaaag

SEQ ID NO: 461480 - DNA, 20 bp, mouse
gaaaatctcaggaatccaga

SEQ ID NO: 461481 - DNA, 20 bp, mouse
ggtccctgttgcaggagtag

SEQ ID NO: 461482 - DNA, 20 bp, mouse
gggacacggacacagaaaac

SEQ ID NO: 461483 - DNA, 20 bp, mouse
gcagcacctgctcaggactg

SEQ ID NO: 461484 - DNA, 20 bp, mouse
gctgctcaggactggggaca

SEQ ID NO: 461485 - DNA, 20 bp, mouse
ggaagacctttcagtgactt

SEQ ID NO: 461486 - DNA, 20 bp, mouse
gtcttcatcacagagaatcg

SEQ ID NO: 461487 - DNA, 20 bp, mouse
gggctcttaggaaacatgag

SEQ ID NO: 461488 - DNA, 20 bp, mouse
gcgaaagccatgtaacatgt

SEQ ID NO: 461489 - DNA, 20 bp, mouse
gctctgttcatctggctctt

SEQ ID NO: 461490 - DNA, 20 bp, mouse
gcgagggactactgatgtta

SEQ ID NO: 461491 - DNA, 20 bp, mouse
gatttctcctacatgttaca

SEQ ID NO: 461492 - DNA, 20 bp, mouse
gaattaaagctctgttcatc

SEQ ID NO: 461493 - DNA, 20 bp, mouse
gattgtattgtttagtacac

SEQ ID NO: 461494 - DNA, 20 bp, mouse
gaacatggctctgagcagag

SEQ ID NO: 461495 - DNA, 20 bp, mouse
ggctcagagccatgtttgag

SEQ ID NO: 461496 - DNA, 20 bp, mouse
gtcatgtctccgggcagcag

SEQ ID NO: 461497 - DNA, 20 bp, mouse
gcgtaagtctgggaccaaag

SEQ ID NO: 461498 - DNA, 20 bp, mouse
gggacagatcctgatcaagt

SEQ ID NO: 461499 - DNA, 20 bp, mouse
gctctgtggtccgtaagtct

SEQ ID NO: 461500 - DNA, 20 bp, mouse
gagtgactttccccttacct

SEQ ID NO: 461501 - DNA, 20 bp, mouse
gaaaagattctcatgtctcc

SEQ ID NO: 461502 - DNA, 20 bp, mouse
gttctcattcaactttaccc

SEQ ID NO: 461503 - DNA, 20 bp, mouse
ggcttggagcaacgtttcca

SEQ ID NO: 461504 - DNA, 20 bp, mouse
ggaaacgttgctccaagctg

SEQ ID NO: 461505 - DNA, 20 bp, mouse
gagcgaggactggagcacct

SEQ ID NO: 461506 - DNA, 20 bp, mouse
gaggcaccaagaacaagatg

SEQ ID NO: 461507 - DNA, 20 bp, mouse
gtgggaagcagtcaactatg

SEQ ID NO: 461508 - DNA, 20 bp, mouse
gtgcctgctccaggtaagag

SEQ ID NO: 461509 - DNA, 20 bp, mouse
ggtcccagtctcagcttgtt

SEQ ID NO: 461510 - DNA, 20 bp, mouse
gttcccaacaagctgagact

SEQ ID NO: 461511 - DNA, 20 bp, mouse
gtctgggtgagcatgaaatc

SEQ ID NO: 461512 - DNA, 20 bp, mouse
ggatgaggcgggtggagatt

SEQ ID NO: 461513 - DNA, 20 bp, mouse
gtgttgttgaaagaaaccat

SEQ ID NO: 461514 - DNA, 20 bp, mouse
ggtattcctcatcttgttct

SEQ ID NO: 461515 - DNA, 20 bp, mouse
gagtattccagtgatgaggc

SEQ ID NO: 461516 - DNA, 20 bp, mouse
gagggtcagcacagtgtcca

SEQ ID NO: 461517 - DNA, 20 bp, mouse
gcctagggttgatcacgtgt

SEQ ID NO: 461518 - DNA, 20 bp, mouse
ggtgttgatgctcttgtcca

SEQ ID NO: 461519 - DNA, 20 bp, mouse
gtggtgatggcccagactca

SEQ ID NO: 461520 - DNA, 20 bp, mouse
ggaaaatgaacatctttaca

SEQ ID NO: 461521 - DNA, 20 bp, mouse
gggagggtgatctgtggtga

SEQ ID NO: 461522 - DNA, 20 bp, mouse
gaacttatcgtgaatagaaa

SEQ ID NO: 461523 - DNA, 20 bp, mouse
gaatgaacatctttacatgg

SEQ ID NO: 461524 - DNA, 20 bp, mouse
ggataagttgtcacagcttt

SEQ ID NO: 461525 - DNA, 20 bp, mouse
gatcacgtgtgggcattttc

SEQ ID NO: 461526 - DNA, 20 bp, mouse
gaatcaacaatgaagatgtt

SEQ ID NO: 461527 - DNA, 20 bp, mouse
gcacagagaagataaccatc

SEQ ID NO: 461528 - DNA, 20 bp, mouse
gatgtttggcatcatcctga

SEQ ID NO: 461529 - DNA, 20 bp, mouse
gttgcttagaacataatatg

SEQ ID NO: 461530 - DNA, 20 bp, mouse
gtggtccttctggtaatgtt

SEQ ID NO: 461531 - DNA, 20 bp, mouse
gtttggaatatggaacgaat

SEQ ID NO: 461532 - DNA, 20 bp, mouse
ggaacctgttccttatcagt

SEQ ID NO: 461533 - DNA, 20 bp, mouse
gtctggtaatgtttggaata

SEQ ID NO: 461534 - DNA, 20 bp, mouse
gcaaaatgctgcattagacc

SEQ ID NO: 461535 - DNA, 20 bp, mouse
gaaagtatttcctactgata

SEQ ID NO: 461536 - DNA, 20 bp, mouse
gctcatggtggcaccaccca

SEQ ID NO: 461537 - DNA, 20 bp, mouse
ggtggcaccacccagggtgg

SEQ ID NO: 461538 - DNA, 20 bp, mouse
gagttccgttgccacaagta

SEQ ID NO: 461539 - DNA, 20 bp, mouse
gggtaccccaagatcctgtc

SEQ ID NO: 461540 - DNA, 20 bp, mouse
gctcatccctacctcagtga

SEQ ID NO: 461541 - DNA, 20 bp, mouse
ggcatgcctgacaggatctt

SEQ ID NO: 461542 - DNA, 20 bp, mouse
gcagcagagttccttcactg

SEQ ID NO: 461543 - DNA, 20 bp, mouse
ggacattcgggtgggaactt

SEQ ID NO: 461544 - DNA, 20 bp, mouse
ggcaagagtgacattcgggt

SEQ ID NO: 461545 - DNA, 20 bp, mouse
gaacttaggagagtgctgag

SEQ ID NO: 461546 - DNA, 20 bp, mouse
gccctgagtcagggtacctg

SEQ ID NO: 461547 - DNA, 20 bp, mouse
ggacgcagaaaactggcgga

SEQ ID NO: 461548 - DNA, 20 bp, mouse
gcatggacgcagaaaactgg

SEQ ID NO: 461549 - DNA, 20 bp, mouse
gtaatgagcttcacccacag

SEQ ID NO: 461550 - DNA, 20 bp, mouse
gaaagtctcaggaatcgtga

SEQ ID NO: 461551 - DNA, 20 bp, mouse
gtgagggttgcctgccactg

SEQ ID NO: 461552 - DNA, 20 bp, mouse
gataggtccaaatccctgac

SEQ ID NO: 461553 - DNA, 20 bp, mouse
ggagaagctgtgatcctgtc

SEQ ID NO: 461554 - DNA, 20 bp, mouse
gggcactcagactccagaga

SEQ ID NO: 461555 - DNA, 20 bp, mouse
ggagggtcagtaaccacagc

SEQ ID NO: 461556 - DNA, 20 bp, mouse
ggatcctcccgagacagcag

SEQ ID NO: 461557 - DNA, 20 bp, mouse
ggagacagcaggggatcctg

SEQ ID NO: 461558 - DNA, 20 bp, mouse
ggcagtgagtggcacaccac

SEQ ID NO: 461559 - DNA, 20 bp, mouse
ggatcccctgctgtctcggg

SEQ ID NO: 461560 - DNA, 20 bp, mouse
ggccttggaagagagctatg

SEQ ID NO: 461561 - DNA, 20 bp, mouse
gtgctggctgatactatcag

SEQ ID NO: 461562 - DNA, 20 bp, mouse
gggaatgctggtggtgttct

SEQ ID NO: 461563 - DNA, 20 bp, mouse
gcagtggtgcccgttctctt

SEQ ID NO: 461564 - DNA, 20 bp, mouse
gacctcatagctctcttcca

SEQ ID NO: 461565 - DNA, 20 bp, mouse
gtccaaggcacccaagagaa

SEQ ID NO: 461566 - DNA, 20 bp, mouse
gcccttagtcacttccacta

SEQ ID NO: 461567 - DNA, 20 bp, mouse
gtggatgtgactgttcatga

SEQ ID NO: 461568 - DNA, 20 bp, mouse
gcccccaaggcacaaggcat

SEQ ID NO: 461569 - DNA, 20 bp, mouse
gctgcttaccactctcccat

SEQ ID NO: 461570 - DNA, 20 bp, mouse
gccgaggatgcttctgtcaa

SEQ ID NO: 461571 - DNA, 20 bp, mouse
ggccatagtggaagtgacta

SEQ ID NO: 461572 - DNA, 20 bp, mouse
gaagcatcctcggcagcagt

SEQ ID NO: 461573 - DNA, 20 bp, mouse
gagcagtgggtaactttgta

SEQ ID NO: 461574 - DNA, 20 bp, mouse
ggttggcacaaagcccccca

SEQ ID NO: 461575 - DNA, 20 bp, mouse
gctgttcatgagggcatcct

SEQ ID NO: 461576 - DNA, 20 bp, mouse
ggtagacagtagggacttca

SEQ ID NO: 461577 - DNA, 20 bp, mouse
gcagtaggcagtaggttcta

SEQ ID NO: 461578 - DNA, 20 bp, mouse
gatcacaagagtagacagta

SEQ ID NO: 461579 - DNA, 20 bp, mouse
ggaacctactgcctactgac

SEQ ID NO: 461580 - DNA, 20 bp, mouse
gcttcatggctcctgtcagt

SEQ ID NO: 461581 - DNA, 20 bp, mouse
gtatggagtccaagactctc

SEQ ID NO: 461582 - DNA, 20 bp, mouse
gcttcgctgggagggagcta

SEQ ID NO: 461583 - DNA, 20 bp, mouse
gccaggactattcccaacag

SEQ ID NO: 461584 - DNA, 20 bp, mouse
ggctcctgtcagtaggcagt

SEQ ID NO: 461585 - DNA, 20 bp, mouse
gacatactgcctgagagtct

SEQ ID NO: 461586 - DNA, 20 bp, mouse
ggaacactagtccagacccc

SEQ ID NO: 461587 - DNA, 20 bp, mouse
ggcatgagactggcaaagag

SEQ ID NO: 461588 - DNA, 20 bp, mouse
gtgagtggtagaaaagcccg

SEQ ID NO: 461589 - DNA, 20 bp, mouse
gtgagactgaagcatgagac

SEQ ID NO: 461590 - DNA, 20 bp, mouse
gctccattagacacagtcta

SEQ ID NO: 461591 - DNA, 20 bp, mouse
gaatagagctcagaagacct

SEQ ID NO: 461592 - DNA, 20 bp, mouse
gggtagaaaagcccggggtc

SEQ ID NO: 461593 - DNA, 20 bp, mouse
gtagggggtctcagcaccac

SEQ ID NO: 461594 - DNA, 20 bp, mouse
ggtgaaatcaggtaatgtag

SEQ ID NO: 461595 - DNA, 20 bp, mouse
gaaggagctacagggtaggt

SEQ ID NO: 461596 - DNA, 20 bp, mouse
ggattgcgggaagaagtcag

SEQ ID NO: 461597 - DNA, 20 bp, mouse
gtgcgggaagaagtcagggg

SEQ ID NO: 461598 - DNA, 20 bp, mouse
gcaagctcctgggaagattg

SEQ ID NO: 461599 - DNA, 20 bp, mouse
gagctgggtatgaagcaaga

SEQ ID NO: 461600 - DNA, 20 bp, mouse
gttcttcccgcaatcttccc

SEQ ID NO: 461601 - DNA, 20 bp, mouse
gacctggtggtacatgactc

SEQ ID NO: 461602 - DNA, 20 bp, mouse
gcttggtggccatggcaaag

SEQ ID NO: 461603 - DNA, 20 bp, mouse
gtgagagtgtgcctgatggg

SEQ ID NO: 461604 - DNA, 20 bp, mouse
gaagtggattctgctcattg

SEQ ID NO: 461605 - DNA, 20 bp, mouse
gagagcatggatgatagtgg

SEQ ID NO: 461606 - DNA, 20 bp, mouse
ggccagtgttaggaaaatca

SEQ ID NO: 461607 - DNA, 20 bp, mouse
gagcaacccatggacaatga

SEQ ID NO: 461608 - DNA, 20 bp, mouse
ggacaatgaaggccagtgtt

SEQ ID NO: 461609 - DNA, 20 bp, mouse
ggagaatgatctatgtccgg

SEQ ID NO: 461610 - DNA, 20 bp, mouse
gagagagaatgatctatgtc

SEQ ID NO: 461611 - DNA, 20 bp, mouse
gagcgcagctcagagtgtgg

SEQ ID NO: 461612 - DNA, 20 bp, mouse
gccatgggttgctaactcag

SEQ ID NO: 461613 - DNA, 20 bp, mouse
ggcagctacgggagaagagt

SEQ ID NO: 461614 - DNA, 20 bp, mouse
ggtgcatctaagaccagggg

SEQ ID NO: 461615 - DNA, 20 bp, mouse
gaccctgccatccttggtgg

SEQ ID NO: 461616 - DNA, 20 bp, mouse
gttgtgtcccgagagggtgg

SEQ ID NO: 461617 - DNA, 20 bp, mouse
gctcgggacacaataagctc

SEQ ID NO: 461618 - DNA, 20 bp, mouse
gttattgtgtcccgagaggg

SEQ ID NO: 461619 - DNA, 20 bp, mouse
gtcctggctcagacatcccc

SEQ ID NO: 461620 - DNA, 20 bp, mouse
gtgaggagggggagaacgaa

SEQ ID NO: 461621 - DNA, 20 bp, mouse
gtagcatactgaatgtgctg

SEQ ID NO: 461622 - DNA, 20 bp, mouse
gcaaagacacgagcatagta

SEQ ID NO: 461623 - DNA, 20 bp, mouse
gcatccccaggtaaccaaaa

SEQ ID NO: 461624 - DNA, 20 bp, mouse
gtaccaccaagcaacatccc

SEQ ID NO: 461625 - DNA, 20 bp, mouse
gttagctgtccttgtggtcc

SEQ ID NO: 461626 - DNA, 20 bp, mouse
ggcatgctgaggcgcacaga

SEQ ID NO: 461627 - DNA, 20 bp, mouse
gcctcggggataggtagact

SEQ ID NO: 461628 - DNA, 20 bp, mouse
gggctgcgttgcaggtgact

SEQ ID NO: 461629 - DNA, 20 bp, mouse
ggagagactcgagttacctg

SEQ ID NO: 461630 - DNA, 20 bp, mouse
gctttgtgactggcatgctg

SEQ ID NO: 461631 - DNA, 20 bp, mouse
gtcctggttgacgagaccac

SEQ ID NO: 461632 - DNA, 20 bp, mouse
gctctctcttggcaaaccta

SEQ ID NO: 461633 - DNA, 20 bp, mouse
gagcacgggctaagaaccct

SEQ ID NO: 461634 - DNA, 20 bp, mouse
ggccaagagagagaattaag

SEQ ID NO: 461635 - DNA, 20 bp, mouse
gggtgtcgatgtgggaggtt

SEQ ID NO: 461636 - DNA, 20 bp, mouse
gagggtcatcccacactgat

SEQ ID NO: 461637 - DNA, 20 bp, mouse
gtacacacacacctgatgta

SEQ ID NO: 461638 - DNA, 20 bp, mouse
gcgaagattaagggacataa

SEQ ID NO: 461639 - DNA, 20 bp, mouse
gaccaacacacgaagattaa

SEQ ID NO: 461640 - DNA, 20 bp, mouse
gaagacagatgcatgcgcag

SEQ ID NO: 461641 - DNA, 20 bp, mouse
gaaggagggtatatgtaaaa

SEQ ID NO: 461642 - DNA, 20 bp, mouse
gtcccttaatcttcgtgtgt

SEQ ID NO: 461643 - DNA, 20 bp, mouse
ggacaaacacagagatacat

SEQ ID NO: 461644 - DNA, 20 bp, mouse
gacagaaagatacatagaga

SEQ ID NO: 461645 - DNA, 20 bp, mouse
gagagacaacaccctacatc

SEQ ID NO: 461646 - DNA, 20 bp, mouse
ggagcacgagggtcaactgt

SEQ ID NO: 461647 - DNA, 20 bp, mouse
gagcaagacaaagagcacga

SEQ ID NO: 461648 - DNA, 20 bp, mouse
gactgggttgattgacaatg

SEQ ID NO: 461649 - DNA, 20 bp, mouse
ggaatgaagagaagatgcag

SEQ ID NO: 461650 - DNA, 20 bp, mouse
gagatgactctctgctcact

SEQ ID NO: 461651 - DNA, 20 bp, mouse
ggttttacctggtggaacat

SEQ ID NO: 461652 - DNA, 20 bp, mouse
ggtacacagctaggcgtgag

SEQ ID NO: 461653 - DNA, 20 bp, mouse
gctcttcgagcacagatagg

SEQ ID NO: 461654 - DNA, 20 bp, mouse
gccgagcagagtggaatgat

SEQ ID NO: 461655 - DNA, 20 bp, mouse
gagtaatgctggactgatgt

SEQ ID NO: 461656 - DNA, 20 bp, mouse
gccagaagctggagacctgt

SEQ ID NO: 461657 - DNA, 20 bp, mouse
ggcactgtgaccacagtctg

SEQ ID NO: 461658 - DNA, 20 bp, mouse
gactctatgagcacggcagg

SEQ ID NO: 461659 - DNA, 20 bp, mouse
ggaagaccaatcctgacctg

SEQ ID NO: 461660 - DNA, 20 bp, mouse
gattggtcttccccagactg

SEQ ID NO: 461661 - DNA, 20 bp, mouse
gcagtaacactctatgagca

SEQ ID NO: 461662 - DNA, 20 bp, mouse
gctgagggtccatgatacat

SEQ ID NO: 461663 - DNA, 20 bp, mouse
gcatgggcgacgggaatgga

SEQ ID NO: 461664 - DNA, 20 bp, mouse
ggcgacgggaatggatggta

SEQ ID NO: 461665 - DNA, 20 bp, mouse
gaacactctatgagcacggc

SEQ ID NO: 461666 - DNA, 20 bp, mouse
gtaatagcttacctagaagg

SEQ ID NO: 461667 - DNA, 20 bp, mouse
gacaggcagcacattacctg

SEQ ID NO: 461668 - DNA, 20 bp, mouse
gacatcttgtgatgaagaag

SEQ ID NO: 461669 - DNA, 20 bp, mouse
gaggtgagggactaatggag

SEQ ID NO: 461670 - DNA, 20 bp, mouse
gggcagcacattacctgtgg

SEQ ID NO: 461671 - DNA, 20 bp, mouse
gtgagtgaggaagacttggg

SEQ ID NO: 461672 - DNA, 20 bp, mouse
gcccagtagggggcacagta

SEQ ID NO: 461673 - DNA, 20 bp, mouse
gtctctccaaacccagtagg

SEQ ID NO: 461674 - DNA, 20 bp, mouse
gtcttaatagcttacctaga

SEQ ID NO: 461675 - DNA, 20 bp, mouse
gtgggtacttgatttgacac

SEQ ID NO: 461676 - DNA, 20 bp, mouse
gttggtcccaggtaaagaaa

SEQ ID NO: 461677 - DNA, 20 bp, mouse
ggaaaaggaacatctttata

SEQ ID NO: 461678 - DNA, 20 bp, mouse
gttatatggagggtgacagg

SEQ ID NO: 461679 - DNA, 20 bp, mouse
gaaggaacatctttatatgg

SEQ ID NO: 461680 - DNA, 20 bp, mouse
gtatcacgagaagttgtcac

SEQ ID NO: 461681 - DNA, 20 bp, mouse
gtctttatatggagggtgac

SEQ ID NO: 461682 - DNA, 20 bp, mouse
gcgagaagttgtcacaggtt

SEQ ID NO: 461683 - DNA, 20 bp, mouse
gtgctagtgagcataaagcc

SEQ ID NO: 461684 - DNA, 20 bp, mouse
gcaacttctcgtgatagaaa

SEQ ID NO: 461685 - DNA, 20 bp, mouse
ggttctcttcttttggtccc

SEQ ID NO: 461686 - DNA, 20 bp, mouse
gaaaaaacaaaaaacgtctg

SEQ ID NO: 461687 - DNA, 20 bp, mouse
gtcaggagcaggatcatctt

SEQ ID NO: 461688 - DNA, 20 bp, mouse
gggttccaacgcgactgaca

SEQ ID NO: 461689 - DNA, 20 bp, mouse
ggtcgcgttggaacccaaag

SEQ ID NO: 461690 - DNA, 20 bp, mouse
gaggataagtatacccttgt

SEQ ID NO: 461691 - DNA, 20 bp, mouse
gaccctgtaattttttttaa

SEQ ID NO: 461692 - DNA, 20 bp, mouse
gcggtccttgtcagtcgcgt

SEQ ID NO: 461693 - DNA, 20 bp, mouse
gggtgaagaaaatccacttt

SEQ ID NO: 461694 - DNA, 20 bp, mouse
ggatcttactatggcccaca

SEQ ID NO: 461695 - DNA, 20 bp, mouse
gctgtttgtgtttttctgca

SEQ ID NO: 461696 - DNA, 20 bp, mouse
gctgctcctggagatctgag

SEQ ID NO: 461697 - DNA, 20 bp, mouse
gcgttcgtggcgtactgggg

SEQ ID NO: 461698 - DNA, 20 bp, mouse
gtggggaggccgagacttcc

SEQ ID NO: 461699 - DNA, 20 bp, mouse
ggcagcaggagcttcatcgt

SEQ ID NO: 461700 - DNA, 20 bp, mouse
gcaacgttcgtggcgtactg

SEQ ID NO: 461701 - DNA, 20 bp, mouse
gggtttccgccaggaagtct

SEQ ID NO: 461702 - DNA, 20 bp, mouse
gctcagggaaggggccaggt

SEQ ID NO: 461703 - DNA, 20 bp, mouse
gttgtcagtgaatccccagg

SEQ ID NO: 461704 - DNA, 20 bp, mouse
ggagtccaaagcaacgttcg

SEQ ID NO: 461705 - DNA, 20 bp, mouse
gcggcaagacgtctcgtcca

SEQ ID NO: 461706 - DNA, 20 bp, mouse
gactgagctgattaaagaca

SEQ ID NO: 461707 - DNA, 20 bp, mouse
gtgtagccaactgacaacag

SEQ ID NO: 461708 - DNA, 20 bp, mouse
gtgcatctgtaataatagag

SEQ ID NO: 461709 - DNA, 20 bp, mouse
gctggaagttggatagagag

SEQ ID NO: 461710 - DNA, 20 bp, mouse
gttggcagaacataattcca

SEQ ID NO: 461711 - DNA, 20 bp, mouse
gtgaccagagctgggtgcac

SEQ ID NO: 461712 - DNA, 20 bp, mouse
gctagatgaccatgagaagg

SEQ ID NO: 461713 - DNA, 20 bp, mouse
gaacccagtgcacccagctc

SEQ ID NO: 461714 - DNA, 20 bp, mouse
gaacaggtgaaaaatgagta

SEQ ID NO: 461715 - DNA, 20 bp, mouse
gttctttcttacccccagga

SEQ ID NO: 461716 - DNA, 20 bp, mouse
gcagagctggcctaatagag

SEQ ID NO: 461717 - DNA, 20 bp, mouse
gctggaagaaatatagagag

SEQ ID NO: 461718 - DNA, 20 bp, mouse
gtccacaggatgctgaccct

SEQ ID NO: 461719 - DNA, 20 bp, mouse
gaggatcagtagcagaaagc

SEQ ID NO: 461720 - DNA, 20 bp, mouse
gcagcatgagagtattccta

SEQ ID NO: 461721 - DNA, 20 bp, mouse
gctgtggacaatggccatca

SEQ ID NO: 461722 - DNA, 20 bp, mouse
gtcctagggtcagcatcctg

SEQ ID NO: 461723 - DNA, 20 bp, mouse
gcatcagggacttcagcctg

SEQ ID NO: 461724 - DNA, 20 bp, mouse
gacaaagcagattaaagaca

SEQ ID NO: 461725 - DNA, 20 bp, mouse
ggatgagctatgccttccta

SEQ ID NO: 461726 - DNA, 20 bp, mouse
gtgcatctgttctaatagag

SEQ ID NO: 461727 - DNA, 20 bp, mouse
ggtaagtaacctctgagacg

SEQ ID NO: 461728 - DNA, 20 bp, mouse
gtctgagacgaggcataggg

SEQ ID NO: 461729 - DNA, 20 bp, mouse
gctgggagctgcctagagag

SEQ ID NO: 461730 - DNA, 20 bp, mouse
gttcagccaattggcatcag

SEQ ID NO: 461731 - DNA, 20 bp, mouse
gtctttgaactaagctttct

SEQ ID NO: 461732 - DNA, 20 bp, mouse
gtgaccagagatgggtacac

SEQ ID NO: 461733 - DNA, 20 bp, mouse
gacctctgagacgaggcata

SEQ ID NO: 461734 - DNA, 20 bp, mouse
ggaactaagctttctaggtc

SEQ ID NO: 461735 - DNA, 20 bp, mouse
gaacccagtgtacccatctc

SEQ ID NO: 461736 - DNA, 20 bp, mouse
ggcagagctgattacagtca

SEQ ID NO: 461737 - DNA, 20 bp, mouse
gtatagccaactggcaacag

SEQ ID NO: 461738 - DNA, 20 bp, mouse
gatacaatgggtcagagacc

SEQ ID NO: 461739 - DNA, 20 bp, mouse
gagaaagcaggagatcttca

SEQ ID NO: 461740 - DNA, 20 bp, mouse
gtcagtaggacagcattcca

SEQ ID NO: 461741 - DNA, 20 bp, mouse
ggaccagagatggatacaat

SEQ ID NO: 461742 - DNA, 20 bp, mouse
gtccttaaagctcaacttcg

SEQ ID NO: 461743 - DNA, 20 bp, mouse
gcatgctttcagatcaaccc

SEQ ID NO: 461744 - DNA, 20 bp, mouse
gtcaaaagcctatagccaac

SEQ ID NO: 461745 - DNA, 20 bp, mouse
gacctcgaagttgagcttta

SEQ ID NO: 461746 - DNA, 20 bp, mouse
gcagtttcttggacaagaaa

SEQ ID NO: 461747 - DNA, 20 bp, mouse
gaaaaatagatgaaacttca

SEQ ID NO: 461748 - DNA, 20 bp, mouse
gtaagacaagaataaaatat

SEQ ID NO: 461749 - DNA, 20 bp, mouse
gtatagtaatggagttgggg

SEQ ID NO: 461750 - DNA, 20 bp, mouse
gtattggagtatgaacccac

SEQ ID NO: 461751 - DNA, 20 bp, mouse
gaacagaaacagttactagg

SEQ ID NO: 461752 - DNA, 20 bp, mouse
ggtaactgtttctgttatag

SEQ ID NO: 461753 - DNA, 20 bp, mouse
ggaaggttataatacatagt

SEQ ID NO: 461754 - DNA, 20 bp, mouse
gacaatattaacaggtaata

SEQ ID NO: 461755 - DNA, 20 bp, mouse
gtctagagtacttatagtaa

SEQ ID NO: 461756 - DNA, 20 bp, mouse
ggccctcaagagacccagat

SEQ ID NO: 461757 - DNA, 20 bp, mouse
gggcaattcatggctgggag

SEQ ID NO: 461758 - DNA, 20 bp, mouse
gttggaaaaggaagctctct

SEQ ID NO: 461759 - DNA, 20 bp, mouse
gttgagggccgcaggcaaga

SEQ ID NO: 461760 - DNA, 20 bp, mouse
gacagagcacaggcaattca

SEQ ID NO: 461761 - DNA, 20 bp, mouse
gacttttccacagcagaatc

SEQ ID NO: 461762 - DNA, 20 bp, mouse
gggctcttagcatgtcaaca

SEQ ID NO: 461763 - DNA, 20 bp, mouse
gaaatgagggtagtgctgaa

SEQ ID NO: 461764 - DNA, 20 bp, mouse
gaagtcacattgaaagccca

SEQ ID NO: 461765 - DNA, 20 bp, mouse
gatggcttgagacaccaatc

SEQ ID NO: 461766 - DNA, 20 bp, mouse
gggaccctcatagcagagga

SEQ ID NO: 461767 - DNA, 20 bp, mouse
gaacaggaccctcatagcag

SEQ ID NO: 461768 - DNA, 20 bp, mouse
gctgggccaaggccacagag

SEQ ID NO: 461769 - DNA, 20 bp, mouse
gccctcatagcagaggaggg

SEQ ID NO: 461770 - DNA, 20 bp, mouse
ggccaatgagaaccagaggc

SEQ ID NO: 461771 - DNA, 20 bp, mouse
gagaggaactatggataaca

SEQ ID NO: 461772 - DNA, 20 bp, mouse
gggtcctgttctccatcctg

SEQ ID NO: 461773 - DNA, 20 bp, mouse
gtccaggggcgtgaaaatag

SEQ ID NO: 461774 - DNA, 20 bp, mouse
gtagaagacccagtgagaga

SEQ ID NO: 461775 - DNA, 20 bp, mouse
gtctatgtggggagtatata

SEQ ID NO: 461776 - DNA, 20 bp, mouse
gggttctaacccgagatctg

SEQ ID NO: 461777 - DNA, 20 bp, mouse
gaagactgcggtgttaacta

SEQ ID NO: 461778 - DNA, 20 bp, mouse
ggggtagagcctcagatctc

SEQ ID NO: 461779 - DNA, 20 bp, mouse
gtgggtaggagacactgtct

SEQ ID NO: 461780 - DNA, 20 bp, mouse
gcctgctggaggagagctgg

SEQ ID NO: 461781 - DNA, 20 bp, mouse
gaggttacctggaatgacct

SEQ ID NO: 461782 - DNA, 20 bp, mouse
gacagagctgggtctagtca

SEQ ID NO: 461783 - DNA, 20 bp, mouse
gtgaaggagtctaggttacc

SEQ ID NO: 461784 - DNA, 20 bp, mouse
gagacaaagagcagagctct

SEQ ID NO: 461785 - DNA, 20 bp, mouse
gttcaggaaattcagggtgc

SEQ ID NO: 461786 - DNA, 20 bp, mouse
gccatgtgcaggtaaggcag

SEQ ID NO: 461787 - DNA, 20 bp, mouse
gctctctccatgtgcaggta

SEQ ID NO: 461788 - DNA, 20 bp, mouse
ggcacgcacgcaatcactat

SEQ ID NO: 461789 - DNA, 20 bp, mouse
gtgactgttgaaagaaacca

SEQ ID NO: 461790 - DNA, 20 bp, mouse
gctctctgttactctgtatt

SEQ ID NO: 461791 - DNA, 20 bp, mouse
gacatggagagagcagcacc

SEQ ID NO: 461792 - DNA, 20 bp, mouse
ggagagagaaacatagagag

SEQ ID NO: 461793 - DNA, 20 bp, mouse
ggggcaggagggaaaaagaa

SEQ ID NO: 461794 - DNA, 20 bp, mouse
gataaaagggaaagtaagaa

SEQ ID NO: 461795 - DNA, 20 bp, mouse
gtgctgctctctccatgtgc

SEQ ID NO: 461796 - DNA, 20 bp, mouse
gaggaaggaacgggatcgca

SEQ ID NO: 461797 - DNA, 20 bp, mouse
gacgggatcgcatggtcgag

SEQ ID NO: 461798 - DNA, 20 bp, mouse
gatgatgatgctgagaggta

SEQ ID NO: 461799 - DNA, 20 bp, mouse
gcggtgctggtgaggctcgg

SEQ ID NO: 461800 - DNA, 20 bp, mouse
gaaagaaccccaccacggag

SEQ ID NO: 461801 - DNA, 20 bp, mouse
gtgtggaaggtggtcggtgc

SEQ ID NO: 461802 - DNA, 20 bp, mouse
gtatatcgctgaggggatgg

SEQ ID NO: 461803 - DNA, 20 bp, mouse
gcttcttaggaggtctactg

SEQ ID NO: 461804 - DNA, 20 bp, mouse
gttcaggagcaggacttctt

SEQ ID NO: 461805 - DNA, 20 bp, mouse
gccaacaccttcagaactga

SEQ ID NO: 461806 - DNA, 20 bp, mouse
gagcagatacagtctcatgg

SEQ ID NO: 461807 - DNA, 20 bp, mouse
gatacagtctcatggtggaa

SEQ ID NO: 461808 - DNA, 20 bp, mouse
gttggggtaaaaggtccaag

SEQ ID NO: 461809 - DNA, 20 bp, mouse
gctggactcttggagaatgg

SEQ ID NO: 461810 - DNA, 20 bp, mouse
gagtctggactcttggagaa

SEQ ID NO: 461811 - DNA, 20 bp, mouse
ggaagtgaagatgtggagtc

SEQ ID NO: 461812 - DNA, 20 bp, mouse
ggaactcctaatgcctccca

SEQ ID NO: 461813 - DNA, 20 bp, mouse
ggatgtggagtctggactct

SEQ ID NO: 461814 - DNA, 20 bp, mouse
ggctccactaagattatatc

SEQ ID NO: 461815 - DNA, 20 bp, mouse
gttagccaccaacttacctt

SEQ ID NO: 461816 - DNA, 20 bp, mouse
gggtgtgtcaggggagtacg

SEQ ID NO: 461817 - DNA, 20 bp, mouse
gagagtgagacatatatata

SEQ ID NO: 461818 - DNA, 20 bp, mouse
ggaacacataacagaaagac

SEQ ID NO: 461819 - DNA, 20 bp, mouse
gtgaatctacctgaggctcc

SEQ ID NO: 461820 - DNA, 20 bp, mouse
gagctatctctttttacttt

SEQ ID NO: 461821 - DNA, 20 bp, mouse
gagaaggtaatggatcttca

SEQ ID NO: 461822 - DNA, 20 bp, mouse
gtatggagaggtggagccca

SEQ ID NO: 461823 - DNA, 20 bp, mouse
ggagacatatatatatggag

SEQ ID NO: 461824 - DNA, 20 bp, mouse
gacatatatatatggagagg

SEQ ID NO: 461825 - DNA, 20 bp, mouse
gagtcaaaaagaagtattct

SEQ ID NO: 461826 - DNA, 20 bp, mouse
ggagagaacgagaaactcct

SEQ ID NO: 461827 - DNA, 20 bp, mouse
gtaggcccagagagagaatt

SEQ ID NO: 461828 - DNA, 20 bp, mouse
gaagcagagagtcttcatga

SEQ ID NO: 461829 - DNA, 20 bp, mouse
gagagctcccctggatgtag

SEQ ID NO: 461830 - DNA, 20 bp, mouse
gtaggagacctaaggagaaa

SEQ ID NO: 461831 - DNA, 20 bp, mouse
gcagatgccgggctcatcac

SEQ ID NO: 461832 - DNA, 20 bp, mouse
gatgcagccactacatccag

SEQ ID NO: 461833 - DNA, 20 bp, mouse
gagctgtgtgggcgaaacag

SEQ ID NO: 461834 - DNA, 20 bp, mouse
gatggttgtaagctgggaac

SEQ ID NO: 461835 - DNA, 20 bp, mouse
gacctttgaccatcaggtag

SEQ ID NO: 461836 - DNA, 20 bp, mouse
ggacagcatcaccaggataa

SEQ ID NO: 461837 - DNA, 20 bp, mouse
ggatcttcatgactgatgcc

SEQ ID NO: 461838 - DNA, 20 bp, mouse
gagggggaaataagaaggat

SEQ ID NO: 461839 - DNA, 20 bp, mouse
ggaaaaagggggaaataaga

SEQ ID NO: 461840 - DNA, 20 bp, mouse
gaaaggcaaagagcaggtaa

SEQ ID NO: 461841 - DNA, 20 bp, mouse
ggtgagtcaggggagtatgg

SEQ ID NO: 461842 - DNA, 20 bp, mouse
gcaggataaaggcaaagagc

SEQ ID NO: 461843 - DNA, 20 bp, mouse
gtcaaggtaaaaagcatatt

SEQ ID NO: 461844 - DNA, 20 bp, mouse
gttagaagaaaaagaaaaag

SEQ ID NO: 461845 - DNA, 20 bp, mouse
gtaaaggttcatatagagag

SEQ ID NO: 461846 - DNA, 20 bp, mouse
gaaagtgagacatacatata

SEQ ID NO: 461847 - DNA, 20 bp, mouse
gaaatggagacagcaacacc

SEQ ID NO: 461848 - DNA, 20 bp, mouse
ggtgagtcaggggagtcggg

SEQ ID NO: 461849 - DNA, 20 bp, mouse
gtgttgctgtctccatttgc

SEQ ID NO: 461850 - DNA, 20 bp, mouse
gaagaaagaaaaatagggaa

SEQ ID NO: 461851 - DNA, 20 bp, mouse
gctgacagacatgcacccac

SEQ ID NO: 461852 - DNA, 20 bp, mouse
gtctcacttttttttcctgt

SEQ ID NO: 461853 - DNA, 20 bp, mouse
gaaatgcgaacagaacataa

SEQ ID NO: 461854 - DNA, 20 bp, mouse
ggttctgttcgcatttctcc

SEQ ID NO: 461855 - DNA, 20 bp, mouse
gactatagaagaggaaaagc

SEQ ID NO: 461856 - DNA, 20 bp, mouse
gcagagagaggggggctata

SEQ ID NO: 461857 - DNA, 20 bp, mouse
ggagggtatccacaaaagag

SEQ ID NO: 461858 - DNA, 20 bp, mouse
gaaagacagttcatactcag

SEQ ID NO: 461859 - DNA, 20 bp, mouse
gcagaccaacacaaagatta

SEQ ID NO: 461860 - DNA, 20 bp, mouse
gtctaagcatttttgaaaaa

SEQ ID NO: 461861 - DNA, 20 bp, mouse
ggacatatacaaagagagac

SEQ ID NO: 461862 - DNA, 20 bp, mouse
gaaaaatatgaaagtaagga

SEQ ID NO: 461863 - DNA, 20 bp, mouse
gaggaaaaagagagagtcct

SEQ ID NO: 461864 - DNA, 20 bp, mouse
gtgtcccttaatctttgtgt

SEQ ID NO: 461865 - DNA, 20 bp, mouse
gtgacttcgaacacaaacca

SEQ ID NO: 461866 - DNA, 20 bp, mouse
ggtcctgttgtggtcctctc

SEQ ID NO: 461867 - DNA, 20 bp, mouse
gctccagagaggaccacaac

SEQ ID NO: 461868 - DNA, 20 bp, mouse
ggtggatgctacaggccctc

SEQ ID NO: 461869 - DNA, 20 bp, mouse
ggaagaacccctttgctaca

SEQ ID NO: 461870 - DNA, 20 bp, mouse
gccactcagaactggggaca

SEQ ID NO: 461871 - DNA, 20 bp, mouse
gagaaatgccttgtagcaaa

SEQ ID NO: 461872 - DNA, 20 bp, mouse
gagttctgagtggatgctac

SEQ ID NO: 461873 - DNA, 20 bp, mouse
gaaggcatttcttccatgtc

SEQ ID NO: 461874 - DNA, 20 bp, mouse
gactcacccaagtcactgag

SEQ ID NO: 461875 - DNA, 20 bp, mouse
gggacatggaggcagaaaac

SEQ ID NO: 461876 - DNA, 20 bp, mouse
gcgggacacgcggctaccca

SEQ ID NO: 461877 - DNA, 20 bp, mouse
gccgtccggacacgagccgg

SEQ ID NO: 461878 - DNA, 20 bp, mouse
ggtccacaggccgcagccat

SEQ ID NO: 461879 - DNA, 20 bp, mouse
gacacgagccggaggcagag

SEQ ID NO: 461880 - DNA, 20 bp, mouse
gcccggcgcaaggagatctt

SEQ ID NO: 461881 - DNA, 20 bp, mouse
gggtagccgcgtgtcccgag

SEQ ID NO: 461882 - DNA, 20 bp, mouse
gcggcggccaagcagcggag

SEQ ID NO: 461883 - DNA, 20 bp, mouse
gcgcgccggcggccaagcag

SEQ ID NO: 461884 - DNA, 20 bp, mouse
gccgccgtccggacacgagc

SEQ ID NO: 461885 - DNA, 20 bp, mouse
gatccggtctgggaagccta

SEQ ID NO: 461886 - DNA, 20 bp, mouse
gcgcagcggagagctcgcta

SEQ ID NO: 461887 - DNA, 20 bp, mouse
gacaggtgaacactgcgcag

SEQ ID NO: 461888 - DNA, 20 bp, mouse
gcgggccgcgctattaccca

SEQ ID NO: 461889 - DNA, 20 bp, mouse
ggctccaacgtccccaccat

SEQ ID NO: 461890 - DNA, 20 bp, mouse
ggccgcgctattacccatgg

SEQ ID NO: 461891 - DNA, 20 bp, mouse
ggcccgcagcgacttcgagt

SEQ ID NO: 461892 - DNA, 20 bp, mouse
gcacctgtcacagcatacct

SEQ ID NO: 461893 - DNA, 20 bp, mouse
ggtccccgcccgcgacacct

SEQ ID NO: 461894 - DNA, 20 bp, mouse
gttacccatggtggggacgt

SEQ ID NO: 461895 - DNA, 20 bp, mouse
gcgaccagccgcacacccag

SEQ ID NO: 461896 - DNA, 20 bp, mouse
gcgagtgacagacccagggt

SEQ ID NO: 461897 - DNA, 20 bp, mouse
gccgcgcgacttctacacag

SEQ ID NO: 461898 - DNA, 20 bp, mouse
ggggccgagtgacagaccca

SEQ ID NO: 461899 - DNA, 20 bp, mouse
gaccgcgggtgcgcacgaga

SEQ ID NO: 461900 - DNA, 20 bp, mouse
gcagggtaggcgacttggag

SEQ ID NO: 461901 - DNA, 20 bp, mouse
gttgttgattctgaggagcg

SEQ ID NO: 461902 - DNA, 20 bp, mouse
gtagaagtcgcgcggggccg

SEQ ID NO: 461903 - DNA, 20 bp, mouse
ggcacccgcggtgaggacgg

SEQ ID NO: 461904 - DNA, 20 bp, mouse
gagacccagggtaggcgact

SEQ ID NO: 461905 - DNA, 20 bp, mouse
ggaagcactgaggcccgccg

SEQ ID NO: 461906 - DNA, 20 bp, mouse
ggaggaggccccgggaccat

SEQ ID NO: 461907 - DNA, 20 bp, mouse
gcgagtactttaaccccggg

SEQ ID NO: 461908 - DNA, 20 bp, mouse
gtccagccgggcgagcgcca

SEQ ID NO: 461909 - DNA, 20 bp, mouse
ggcggtgtgagagacggagg

SEQ ID NO: 461910 - DNA, 20 bp, mouse
gcagctgctgtcgcctcccg

SEQ ID NO: 461911 - DNA, 20 bp, mouse
ggagcgagtactttaacccc

SEQ ID NO: 461912 - DNA, 20 bp, mouse
gggcccgcgggtccatgagg

SEQ ID NO: 461913 - DNA, 20 bp, mouse
ggtacgcgcgcgggcgacca

SEQ ID NO: 461914 - DNA, 20 bp, mouse
gtaaagtactcgctccagcc

SEQ ID NO: 461915 - DNA, 20 bp, mouse
gcctggagcccatggtcccg

SEQ ID NO: 461916 - DNA, 20 bp, mouse
gcgggacgcgctgctccgag

SEQ ID NO: 461917 - DNA, 20 bp, mouse
gcggagcagcgcgtcccgga

SEQ ID NO: 461918 - DNA, 20 bp, mouse
gaggccgcggagggcgccgt

SEQ ID NO: 461919 - DNA, 20 bp, mouse
gcgcgggaaccgagaggcgg

SEQ ID NO: 461920 - DNA, 20 bp, mouse
ggacccggcccggggaagac

SEQ ID NO: 461921 - DNA, 20 bp, mouse
gtggcccacggcgccctccg

SEQ ID NO: 461922 - DNA, 20 bp, mouse
gccgggtcgcgggaaccgag

SEQ ID NO: 461923 - DNA, 20 bp, mouse
gaagcagcacacacactcag

SEQ ID NO: 461924 - DNA, 20 bp, mouse
gccgcgcagcgggccgtacc

SEQ ID NO: 461925 - DNA, 20 bp, mouse
gcctcgcggggacagcaccg

SEQ ID NO: 461926 - DNA, 20 bp, mouse
gaggaaactgagcagatcag

SEQ ID NO: 461927 - DNA, 20 bp, mouse
gccagccccagaagcactag

SEQ ID NO: 461928 - DNA, 20 bp, mouse
gccagccctgcagagaccat

SEQ ID NO: 461929 - DNA, 20 bp, mouse
gtccaggaggggatagtcag

SEQ ID NO: 461930 - DNA, 20 bp, mouse
gccagaagcactaggggaaa

SEQ ID NO: 461931 - DNA, 20 bp, mouse
gggatcccatggtctctgca

SEQ ID NO: 461932 - DNA, 20 bp, mouse
gctgaccagaggggcttcta

SEQ ID NO: 461933 - DNA, 20 bp, mouse
gaggtccctagaagcccctc

SEQ ID NO: 461934 - DNA, 20 bp, mouse
ggagtatgacgctccagtaa

SEQ ID NO: 461935 - DNA, 20 bp, mouse
gaaggtgtgaagggtatggt

SEQ ID NO: 461936 - DNA, 20 bp, mouse
gcgacgcccgtagagaggta

SEQ ID NO: 461937 - DNA, 20 bp, mouse
gcggccgccgcgagcccctc

SEQ ID NO: 461938 - DNA, 20 bp, mouse
gacgcctccgaggccggagg

SEQ ID NO: 461939 - DNA, 20 bp, mouse
gggagtgcgggcgacctcgg

SEQ ID NO: 461940 - DNA, 20 bp, mouse
gggacccgaggggctcgcgg

SEQ ID NO: 461941 - DNA, 20 bp, mouse
gcgcgcgcgcgggaggccag

SEQ ID NO: 461942 - DNA, 20 bp, mouse
gagcacgcctccgaggccgg

SEQ ID NO: 461943 - DNA, 20 bp, mouse
gccctcccgggtctcccccg

SEQ ID NO: 461944 - DNA, 20 bp, mouse
gcgccgcgcgcgctcccgtc

SEQ ID NO: 461945 - DNA, 20 bp, mouse
gggagccgacgcccgtagag

SEQ ID NO: 461946 - DNA, 20 bp, mouse
gcgtcgcggcccaggcaggt

SEQ ID NO: 461947 - DNA, 20 bp, mouse
gtgtgggcgctggatcccag

SEQ ID NO: 461948 - DNA, 20 bp, mouse
gaggccaccgacgcgagtct

SEQ ID NO: 461949 - DNA, 20 bp, mouse
gagggatcccagactcgcgt

SEQ ID NO: 461950 - DNA, 20 bp, mouse
gtcccgtcgcctacctgcct

SEQ ID NO: 461951 - DNA, 20 bp, mouse
gctgggatccctgcgcgagg

SEQ ID NO: 461952 - DNA, 20 bp, mouse
gggcccaggcaggtaggcga

SEQ ID NO: 461953 - DNA, 20 bp, mouse
gaggcgacgggatgcagcga

SEQ ID NO: 461954 - DNA, 20 bp, mouse
gagtctgggatccctgcgcg

SEQ ID NO: 461955 - DNA, 20 bp, mouse
gtctgcgagactgggatgag

SEQ ID NO: 461956 - DNA, 20 bp, mouse
gccacgaggcagcttagtgt

SEQ ID NO: 461957 - DNA, 20 bp, mouse
ggccacacgctgtctcccaa

SEQ ID NO: 461958 - DNA, 20 bp, mouse
gtgagcaagaaggatgtgaa

SEQ ID NO: 461959 - DNA, 20 bp, mouse
ggctcaattacggagtacac

SEQ ID NO: 461960 - DNA, 20 bp, mouse
gactccgtaattgagcaaga

SEQ ID NO: 461961 - DNA, 20 bp, mouse
gaattacggagtacacagga

SEQ ID NO: 461962 - DNA, 20 bp, mouse
gcatccttcttgctcaatta

SEQ ID NO: 461963 - DNA, 20 bp, mouse
gaggggtaggccgaaccctc

SEQ ID NO: 461964 - DNA, 20 bp, mouse
ggcctttgggagacagcgtg

SEQ ID NO: 461965 - DNA, 20 bp, mouse
gaagttgtgattggagacca

SEQ ID NO: 461966 - DNA, 20 bp, mouse
gctggcaaccagcccaagag

SEQ ID NO: 461967 - DNA, 20 bp, mouse
gaagcctccccgcctctctt

SEQ ID NO: 461968 - DNA, 20 bp, mouse
ggcaaccagcccaagagagg

SEQ ID NO: 461969 - DNA, 20 bp, mouse
gcggggtgacgcgactcaga

SEQ ID NO: 461970 - DNA, 20 bp, mouse
ggggcaggggtgctccgctg

SEQ ID NO: 461971 - DNA, 20 bp, mouse
gacaactccagcagccccga

SEQ ID NO: 461972 - DNA, 20 bp, mouse
gcgcggcctggagcaggtaa

SEQ ID NO: 461973 - DNA, 20 bp, mouse
gaccccggcccgacaatcga

SEQ ID NO: 461974 - DNA, 20 bp, mouse
gcagctcatagggcaactgg

SEQ ID NO: 461975 - DNA, 20 bp, mouse
gaggcggggaggcttgggca

SEQ ID NO: 461976 - DNA, 20 bp, mouse
gcggcgggcgggacacgagg

SEQ ID NO: 461977 - DNA, 20 bp, mouse
gacgagggggctgaatgtcg

SEQ ID NO: 461978 - DNA, 20 bp, mouse
gacggccctgaggaggtgac

SEQ ID NO: 461979 - DNA, 20 bp, mouse
gcccgcccgccgcgcatgag

SEQ ID NO: 461980 - DNA, 20 bp, mouse
gagctgtcacggccctgagg

SEQ ID NO: 461981 - DNA, 20 bp, mouse
gctgatcccctcatgcgcgg

SEQ ID NO: 461982 - DNA, 20 bp, mouse
gagtctgatcccctcatgcg

SEQ ID NO: 461983 - DNA, 20 bp, mouse
gcgagccgggtgataggact

SEQ ID NO: 461984 - DNA, 20 bp, mouse
gcggcccccgcgcgagcacc

SEQ ID NO: 461985 - DNA, 20 bp, mouse
gcagtccggagggacccccc

SEQ ID NO: 461986 - DNA, 20 bp, mouse
ggccccagggtgctgaaggt

SEQ ID NO: 461987 - DNA, 20 bp, mouse
gagagtcctgaggtgcccca

SEQ ID NO: 461988 - DNA, 20 bp, mouse
gctggcgggtagcttgcaag

SEQ ID NO: 461989 - DNA, 20 bp, mouse
gggctgagagagtgcttcag

SEQ ID NO: 461990 - DNA, 20 bp, mouse
gttaggcacaaagggactgt

SEQ ID NO: 461991 - DNA, 20 bp, mouse
ggagagtgcttcagagggga

SEQ ID NO: 461992 - DNA, 20 bp, mouse
ggcctaactacagacaccta

SEQ ID NO: 461993 - DNA, 20 bp, mouse
gatggcctgaccctggggag

SEQ ID NO: 461994 - DNA, 20 bp, mouse
gtccttaggtgtctgtagtt

SEQ ID NO: 461995 - DNA, 20 bp, mouse
gactaggtaaagttaagcta

SEQ ID NO: 461996 - DNA, 20 bp, mouse
gaccgcgcggctggaactag

SEQ ID NO: 461997 - DNA, 20 bp, mouse
gtccagccgcgcggtcctcc

SEQ ID NO: 461998 - DNA, 20 bp, mouse
gagggcgcgttgaagagctt

SEQ ID NO: 461999 - DNA, 20 bp, mouse
gttggggtccccagcaacgt

SEQ ID NO: 462000 - DNA, 20 bp, mouse
ggacatggcgcactcgactt

SEQ ID NO: 462001 - DNA, 20 bp, mouse
gtggaactagcggtgtggtg

SEQ ID NO: 462002 - DNA, 20 bp, mouse
ggggagccgggaggaccgcg

SEQ ID NO: 462003 - DNA, 20 bp, mouse
gtcccagggcaggcaggtag

SEQ ID NO: 462004 - DNA, 20 bp, mouse
gtgctatccagccccggaca

SEQ ID NO: 462005 - DNA, 20 bp, mouse
ggtcgagtgcgccatgtccg

SEQ ID NO: 462006 - DNA, 20 bp, mouse
gccgcccccgcagaaggaaa

SEQ ID NO: 462007 - DNA, 20 bp, mouse
gtggaaaagagcggaaggaa

SEQ ID NO: 462008 - DNA, 20 bp, mouse
gcgcgcggccgggtctccag

SEQ ID NO: 462009 - DNA, 20 bp, mouse
gccgacaccggagcttcctg

SEQ ID NO: 462010 - DNA, 20 bp, mouse
ggagcgggaggaatcgggca

SEQ ID NO: 462011 - DNA, 20 bp, mouse
gtggcggagcgggaggaatc

SEQ ID NO: 462012 - DNA, 20 bp, mouse
gggtgttctgtggaaaagag

SEQ ID NO: 462013 - DNA, 20 bp, mouse
gggtgccgcaggtgaatcca

SEQ ID NO: 462014 - DNA, 20 bp, mouse
gggcccgcgagcccttcggt

SEQ ID NO: 462015 - DNA, 20 bp, mouse
ggggaaggcaaaaaagaata

SEQ ID NO: 462016 - DNA, 20 bp, mouse
gtgctcaggccgcggtgcag

SEQ ID NO: 462017 - DNA, 20 bp, mouse
gggtgcagaggacagcgtcc

SEQ ID NO: 462018 - DNA, 20 bp, mouse
gctcggcccggagccatgag

SEQ ID NO: 462019 - DNA, 20 bp, mouse
gcccttcctcaggcttgctc

SEQ ID NO: 462020 - DNA, 20 bp, mouse
gggcccggagccatgagcgg

SEQ ID NO: 462021 - DNA, 20 bp, mouse
ggcgcccccctgccccggca

SEQ ID NO: 462022 - DNA, 20 bp, mouse
ggccaccccgcgccgcatcc

SEQ ID NO: 462023 - DNA, 20 bp, mouse
gccgctctccgcccttcctc

SEQ ID NO: 462024 - DNA, 20 bp, mouse
gtccaggatgcggcgcgggg

SEQ ID NO: 462025 - DNA, 20 bp, mouse
gccgggagcccagtgagggt

SEQ ID NO: 462026 - DNA, 20 bp, mouse
ggacgctggtaccgaggaag

SEQ ID NO: 462027 - DNA, 20 bp, mouse
gccagcgtctagaaggatcc

SEQ ID NO: 462028 - DNA, 20 bp, mouse
gcttctagacgctggtaccg

SEQ ID NO: 462029 - DNA, 20 bp, mouse
gtctagaaggatcccggccg

SEQ ID NO: 462030 - DNA, 20 bp, mouse
gcggctagatgggcactcgt

SEQ ID NO: 462031 - DNA, 20 bp, mouse
gaccccagcgacggtcgcac

SEQ ID NO: 462032 - DNA, 20 bp, mouse
gcatggccgcgcaatcgccg

SEQ ID NO: 462033 - DNA, 20 bp, mouse
gacaaggacccaacacccag

SEQ ID NO: 462034 - DNA, 20 bp, mouse
gggcagcgcggcgggatgag

SEQ ID NO: 462035 - DNA, 20 bp, mouse
gctcgcggaggaggccaccg

SEQ ID NO: 462036 - DNA, 20 bp, mouse
ggagccatccgccaccccct

SEQ ID NO: 462037 - DNA, 20 bp, mouse
gggctcaagcgcctaggggg

SEQ ID NO: 462038 - DNA, 20 bp, mouse
gggcggctcaagcgcctagg

SEQ ID NO: 462039 - DNA, 20 bp, mouse
ggcggcgcggtccgcagcgg

SEQ ID NO: 462040 - DNA, 20 bp, mouse
gtctgcggcgcggtccgcag

SEQ ID NO: 462041 - DNA, 20 bp, mouse
ggtcgcgctggaggacgagg

SEQ ID NO: 462042 - DNA, 20 bp, mouse
ggcttgagccgcctccgctg

SEQ ID NO: 462043 - DNA, 20 bp, mouse
gctattccgggagtccggag

SEQ ID NO: 462044 - DNA, 20 bp, mouse
gcggaggcctgcgcgctctg

SEQ ID NO: 462045 - DNA, 20 bp, mouse
gggagtcgcgctggaggacg

SEQ ID NO: 462046 - DNA, 20 bp, mouse
ggccggggcccgggacccac

SEQ ID NO: 462047 - DNA, 20 bp, mouse
gggacccaccggcacctcca

SEQ ID NO: 462048 - DNA, 20 bp, mouse
ggcggtacccgggcacgttg

SEQ ID NO: 462049 - DNA, 20 bp, mouse
gcagctcgactgctccgagg

SEQ ID NO: 462050 - DNA, 20 bp, mouse
ggctggagctgctaccatgg

SEQ ID NO: 462051 - DNA, 20 bp, mouse
ggaaacgcaggggttcacct

SEQ ID NO: 462052 - DNA, 20 bp, mouse
ggcgctagaggtgagctgat

SEQ ID NO: 462053 - DNA, 20 bp, mouse
gcacgttgcggagaaacgca

SEQ ID NO: 462054 - DNA, 20 bp, mouse
ggagctgggccaggcgctag

SEQ ID NO: 462055 - DNA, 20 bp, mouse
gtggcccagctccagatcga

SEQ ID NO: 462056 - DNA, 20 bp, mouse
ggccccagcagcgaatttcg

SEQ ID NO: 462057 - DNA, 20 bp, mouse
gccacaggaggcccccatgt

SEQ ID NO: 462058 - DNA, 20 bp, mouse
gtcgcttcagctggcgggag

SEQ ID NO: 462059 - DNA, 20 bp, mouse
gcaactcctcttcccggcca

SEQ ID NO: 462060 - DNA, 20 bp, mouse
ggacatcccggggactccac

SEQ ID NO: 462061 - DNA, 20 bp, mouse
ggtgcccagaatgcaaggtg

SEQ ID NO: 462062 - DNA, 20 bp, mouse
gtccacgcccgcccacatgg

SEQ ID NO: 462063 - DNA, 20 bp, mouse
gacagggacgaagtcactcg

SEQ ID NO: 462064 - DNA, 20 bp, mouse
gcatgtgtcgcttcagctgg

SEQ ID NO: 462065 - DNA, 20 bp, mouse
gggacaggtagcccgctgga

SEQ ID NO: 462066 - DNA, 20 bp, mouse
gactcgggataccagatccc

SEQ ID NO: 462067 - DNA, 20 bp, mouse
gagtagctctgaatcccctc

SEQ ID NO: 462068 - DNA, 20 bp, mouse
gggagagggaccagagaccg

SEQ ID NO: 462069 - DNA, 20 bp, mouse
gtggtatcccgagtgagcca

SEQ ID NO: 462070 - DNA, 20 bp, mouse
gcaagctggtaagaacgtgg

SEQ ID NO: 462071 - DNA, 20 bp, mouse
ggatattcaaatcagcagcg

SEQ ID NO: 462072 - DNA, 20 bp, mouse
gtccgagcgaagctgattgg

SEQ ID NO: 462073 - DNA, 20 bp, mouse
gaggttttccgagggatcct

SEQ ID NO: 462074 - DNA, 20 bp, mouse
gtggtaagaacgtggaggag

SEQ ID NO: 462075 - DNA, 20 bp, mouse
gatctccgagcgaagctgat

SEQ ID NO: 462076 - DNA, 20 bp, mouse
gcggcccgggtcccactacg

SEQ ID NO: 462077 - DNA, 20 bp, mouse
gggagtcagccctaccaagg

SEQ ID NO: 462078 - DNA, 20 bp, mouse
gagcagtcgcggggcaacgc

SEQ ID NO: 462079 - DNA, 20 bp, mouse
gctccgtctggagtccccgc

SEQ ID NO: 462080 - DNA, 20 bp, mouse
gcaatggagcaccgcgtagt

SEQ ID NO: 462081 - DNA, 20 bp, mouse
gtgccaacgcgcagcagtcg

SEQ ID NO: 462082 - DNA, 20 bp, mouse
gccagggcaagatcgaccgt

SEQ ID NO: 462083 - DNA, 20 bp, mouse
gagttcatgccaccttggta

SEQ ID NO: 462084 - DNA, 20 bp, mouse
gagtcgcggggcaacgccgg

SEQ ID NO: 462085 - DNA, 20 bp, mouse
gccccgcgactgctgcgcgt

SEQ ID NO: 462086 - DNA, 20 bp, mouse
gtcaggtgagcgctcttcgg

SEQ ID NO: 462087 - DNA, 20 bp, mouse
gggagtcgagcgccaacctc

SEQ ID NO: 462088 - DNA, 20 bp, mouse
ggaagctgcgcgaactgtgg

SEQ ID NO: 462089 - DNA, 20 bp, mouse
gtcgcgcagcttccgcacca

SEQ ID NO: 462090 - DNA, 20 bp, mouse
gcctcgggctgagacttgag

SEQ ID NO: 462091 - DNA, 20 bp, mouse
gggctcaggtgagcgctctt

SEQ ID NO: 462092 - DNA, 20 bp, mouse
gaagagtcgggcctcgaacc

SEQ ID NO: 462093 - DNA, 20 bp, mouse
gtgtctggttcctagagccc

SEQ ID NO: 462094 - DNA, 20 bp, mouse
ggaccgcagcggtgaaatgg

SEQ ID NO: 462095 - DNA, 20 bp, mouse
ggctcaggtgggatatcctg

SEQ ID NO: 462096 - DNA, 20 bp, mouse
gcgcgcagtctgtggagcag

SEQ ID NO: 462097 - DNA, 20 bp, mouse
gaccgtggccatgtcagcgg

SEQ ID NO: 462098 - DNA, 20 bp, mouse
ggccacggttcgagagaagg

SEQ ID NO: 462099 - DNA, 20 bp, mouse
gcccgccgctgacatggcca

SEQ ID NO: 462100 - DNA, 20 bp, mouse
ggcggcggcgctgaacctgt

SEQ ID NO: 462101 - DNA, 20 bp, mouse
gggcgcgggcgcgcagtctg

SEQ ID NO: 462102 - DNA, 20 bp, mouse
gatggccacggttcgagaga

SEQ ID NO: 462103 - DNA, 20 bp, mouse
gctccccgggagttaacccg

SEQ ID NO: 462104 - DNA, 20 bp, mouse
ggactgcatggtgggatcag

SEQ ID NO: 462105 - DNA, 20 bp, mouse
ggtccagcccgccgctgaca

SEQ ID NO: 462106 - DNA, 20 bp, mouse
ggcacccgccgggacagcaa

SEQ ID NO: 462107 - DNA, 20 bp, mouse
gtggaagagggcagcagcgg

SEQ ID NO: 462108 - DNA, 20 bp, mouse
gaaccgcgcggtcaggaaca

SEQ ID NO: 462109 - DNA, 20 bp, mouse
gcgggacagcaaaggcagag

SEQ ID NO: 462110 - DNA, 20 bp, mouse
gaggcagagtggcaaccgcg

SEQ ID NO: 462111 - DNA, 20 bp, mouse
ggagtggcaaccgcgcggtc

SEQ ID NO: 462112 - DNA, 20 bp, mouse
ggagcagctccggtaaggaa

SEQ ID NO: 462113 - DNA, 20 bp, mouse
ggtagcagcgacagcaacgc

SEQ ID NO: 462114 - DNA, 20 bp, mouse
gacagcaacgccggcgggag

SEQ ID NO: 462115 - DNA, 20 bp, mouse
ggcagcgacagcaacgccgg

SEQ ID NO: 462116 - DNA, 20 bp, mouse
gctttcagcggtggccacaa

SEQ ID NO: 462117 - DNA, 20 bp, mouse
ggtgtggcgacctggagcaa

SEQ ID NO: 462118 - DNA, 20 bp, mouse
gggcgacctggagcaagggt

SEQ ID NO: 462119 - DNA, 20 bp, mouse
gcttaccgagctctgtgccc

SEQ ID NO: 462120 - DNA, 20 bp, mouse
gtgaatggcacacaagtacc

SEQ ID NO: 462121 - DNA, 20 bp, mouse
gctctgggcggggacttgac

SEQ ID NO: 462122 - DNA, 20 bp, mouse
gagagctcggtaagggccag

SEQ ID NO: 462123 - DNA, 20 bp, mouse
gaagggttggctttcagcgg

SEQ ID NO: 462124 - DNA, 20 bp, mouse
gcggggacttgacaggaagg

SEQ ID NO: 462125 - DNA, 20 bp, mouse
gccaggcccgtgtggcgacc

SEQ ID NO: 462126 - DNA, 20 bp, mouse
gtgcaggaggcggagaccga

SEQ ID NO: 462127 - DNA, 20 bp, mouse
gtagccgcggggacacctgg

SEQ ID NO: 462128 - DNA, 20 bp, mouse
gaggcggagaccgacggacg

SEQ ID NO: 462129 - DNA, 20 bp, mouse
ggcgcagccggtcacctgac

SEQ ID NO: 462130 - DNA, 20 bp, mouse
gggtagtagctggcgtaggg

SEQ ID NO: 462131 - DNA, 20 bp, mouse
gtgccgagcttgccgatcaa

SEQ ID NO: 462132 - DNA, 20 bp, mouse
gtactacctggaagcgatag

SEQ ID NO: 462133 - DNA, 20 bp, mouse
gtccgcggccggcttggcca

SEQ ID NO: 462134 - DNA, 20 bp, mouse
gtgtccccgcggctacggaa

SEQ ID NO: 462135 - DNA, 20 bp, mouse
gtgggtcccgggaggtcctg

SEQ ID NO: 462136 - DNA, 20 bp, mouse
gtataggcgcggctgaccgg

SEQ ID NO: 462137 - DNA, 20 bp, mouse
gaggacgcaggcggtagtat

SEQ ID NO: 462138 - DNA, 20 bp, mouse
gtagtataggcgcggctgac

SEQ ID NO: 462139 - DNA, 20 bp, mouse
ggagtacctgcagatcccgc

SEQ ID NO: 462140 - DNA, 20 bp, mouse
ggcgtaccagagcctccggc

SEQ ID NO: 462141 - DNA, 20 bp, mouse
ggctgaccggcgggatctgc

SEQ ID NO: 462142 - DNA, 20 bp, mouse
ggcaggcggtagtataggcg

SEQ ID NO: 462143 - DNA, 20 bp, mouse
gccgccgcctggcatactgg

SEQ ID NO: 462144 - DNA, 20 bp, mouse
gacatccggagctgactcta

SEQ ID NO: 462145 - DNA, 20 bp, mouse
ggtactccagccggaggctc

SEQ ID NO: 462146 - DNA, 20 bp, mouse
gtgtaggcgcgtgtcaccgc

SEQ ID NO: 462147 - DNA, 20 bp, mouse
gaggacgcaggccgcggtgt

SEQ ID NO: 462148 - DNA, 20 bp, mouse
ggtgacacgcgcctacaccg

SEQ ID NO: 462149 - DNA, 20 bp, mouse
gtgtcaccgcgggcacctgc

SEQ ID NO: 462150 - DNA, 20 bp, mouse
gccagctgctgtgggacagg

SEQ ID NO: 462151 - DNA, 20 bp, mouse
ggcggcctgcgtcctcacca

SEQ ID NO: 462152 - DNA, 20 bp, mouse
ggctgggcagaggctggcgg

SEQ ID NO: 462153 - DNA, 20 bp, mouse
ggttgaagtagagctggaag

SEQ ID NO: 462154 - DNA, 20 bp, mouse
gggtgaggcgcggggatgga

SEQ ID NO: 462155 - DNA, 20 bp, mouse
gcaccactgcggccgtggtg

SEQ ID NO: 462156 - DNA, 20 bp, mouse
gctgggcggacgcacagagg

SEQ ID NO: 462157 - DNA, 20 bp, mouse
gtggctgggcggacgcacag

SEQ ID NO: 462158 - DNA, 20 bp, mouse
ggagtaggcctggctcatgg

SEQ ID NO: 462159 - DNA, 20 bp, mouse
ggagcaggcttcggtaccaa

SEQ ID NO: 462160 - DNA, 20 bp, mouse
gggcgtggacgaggctggct

SEQ ID NO: 462161 - DNA, 20 bp, mouse
gagcctgctcgagggaacac

SEQ ID NO: 462162 - DNA, 20 bp, mouse
gacgcgctggctggacgagt

SEQ ID NO: 462163 - DNA, 20 bp, mouse
ggacgagtaggcctggctca

SEQ ID NO: 462164 - DNA, 20 bp, mouse
gaatagtgcagacagctaag

SEQ ID NO: 462165 - DNA, 20 bp, mouse
gcatggtggcggcgtggacg

SEQ ID NO: 462166 - DNA, 20 bp, mouse
gaccggcaacgactactgtg

SEQ ID NO: 462167 - DNA, 20 bp, mouse
ggcgcccggacacccgcgac

SEQ ID NO: 462168 - DNA, 20 bp, mouse
ggcttcaccggatagagatt

SEQ ID NO: 462169 - DNA, 20 bp, mouse
gtccgggcgcgagcagcgca

SEQ ID NO: 462170 - DNA, 20 bp, mouse
gtggtaggaaagatccacta

SEQ ID NO: 462171 - DNA, 20 bp, mouse
gagactccgcacggaacagg

SEQ ID NO: 462172 - DNA, 20 bp, mouse
gtggggagaagagggagcgg

SEQ ID NO: 462173 - DNA, 20 bp, mouse
gccgccgccacgggtcctga

SEQ ID NO: 462174 - DNA, 20 bp, mouse
ggagccgccaaatctctatc

SEQ ID NO: 462175 - DNA, 20 bp, mouse
ggccctcgggcacccggcag

SEQ ID NO: 462176 - DNA, 20 bp, mouse
gtctggccgggtcctcgtac

SEQ ID NO: 462177 - DNA, 20 bp, mouse
ggcggagaccgagcggctgg

SEQ ID NO: 462178 - DNA, 20 bp, mouse
gcctgcgcgttgaggctctc

SEQ ID NO: 462179 - DNA, 20 bp, mouse
gtggtgagtgcgtcccctgg

SEQ ID NO: 462180 - DNA, 20 bp, mouse
gacatggtgagtgcgtcccc

SEQ ID NO: 462181 - DNA, 20 bp, mouse
gcgggctcatccctggatcc

SEQ ID NO: 462182 - DNA, 20 bp, mouse
gcggccagcgcgggccgcca

SEQ ID NO: 462183 - DNA, 20 bp, mouse
gtgagcccgcctgcgcgttg

SEQ ID NO: 462184 - DNA, 20 bp, mouse
gctcggtctccgcggggcgg

SEQ ID NO: 462185 - DNA, 20 bp, mouse
ggctgtcagaaacctgtacg

SEQ ID NO: 462186 - DNA, 20 bp, mouse
gtgcctcgggaccccggcgt

SEQ ID NO: 462187 - DNA, 20 bp, mouse
gcggggtcccgaggcatggt

SEQ ID NO: 462188 - DNA, 20 bp, mouse
ggtgtgcgcggagcaggcta

SEQ ID NO: 462189 - DNA, 20 bp, mouse
gtgccgacgccggggtcccg

SEQ ID NO: 462190 - DNA, 20 bp, mouse
gcggtagcgggcggaaaccc

SEQ ID NO: 462191 - DNA, 20 bp, mouse
gccccggaaagaaaagccca

SEQ ID NO: 462192 - DNA, 20 bp, mouse
ggctcatggggccagggcaa

SEQ ID NO: 462193 - DNA, 20 bp, mouse
gccatgagccaggactcgac

SEQ ID NO: 462194 - DNA, 20 bp, mouse
gctggtggctgccgacgccg

SEQ ID NO: 462195 - DNA, 20 bp, mouse
ggggctggaagagtataccg

SEQ ID NO: 462196 - DNA, 20 bp, mouse
gtgggaagcccagagcgact

SEQ ID NO: 462197 - DNA, 20 bp, mouse
ggtgcctgaggaacgcctcg

SEQ ID NO: 462198 - DNA, 20 bp, mouse
ggaagcccagagcgacttgg

SEQ ID NO: 462199 - DNA, 20 bp, mouse
gggccgctgctgtctccccg

SEQ ID NO: 462200 - DNA, 20 bp, mouse
gggcgttcctcaggcacctt

SEQ ID NO: 462201 - DNA, 20 bp, mouse
ggcgccccggggctcggtgg

SEQ ID NO: 462202 - DNA, 20 bp, mouse
gcggcctcaactctgagctg

SEQ ID NO: 462203 - DNA, 20 bp, mouse
gccgccgcagctcagagttg

SEQ ID NO: 462204 - DNA, 20 bp, mouse
ggggcccagagcgtccaggt

SEQ ID NO: 462205 - DNA, 20 bp, mouse
ggatgggcagtgagcctgcg

SEQ ID NO: 462206 - DNA, 20 bp, mouse
gggactgcagggacccacgt

SEQ ID NO: 462207 - DNA, 20 bp, mouse
gaggaaggttgtcaaagctt

SEQ ID NO: 462208 - DNA, 20 bp, mouse
ggtggggacctggcgactct

SEQ ID NO: 462209 - DNA, 20 bp, mouse
gtctcccgtcaggcagcggg

SEQ ID NO: 462210 - DNA, 20 bp, mouse
gagcttagggaaggggctct

SEQ ID NO: 462211 - DNA, 20 bp, mouse
gtacatctcccgtcaggcag

SEQ ID NO: 462212 - DNA, 20 bp, mouse
ggttgtcaaagcttagggaa

SEQ ID NO: 462213 - DNA, 20 bp, mouse
gtcgaggagctgaggagcaa

SEQ ID NO: 462214 - DNA, 20 bp, mouse
gtcacggctcctctcagtgt

SEQ ID NO: 462215 - DNA, 20 bp, mouse
gacagctccatcctcaaagt

SEQ ID NO: 462216 - DNA, 20 bp, mouse
ggagcaccgcgcacattgca

SEQ ID NO: 462217 - DNA, 20 bp, mouse
ggtctacgcaccacagttcc

SEQ ID NO: 462218 - DNA, 20 bp, mouse
gtgcggtaccgtagcgacac

SEQ ID NO: 462219 - DNA, 20 bp, mouse
gtacaagtccagtgtcgcta

SEQ ID NO: 462220 - DNA, 20 bp, mouse
gaacttgcaggcgctatgta

SEQ ID NO: 462221 - DNA, 20 bp, mouse
gaagaggatggaaatcgtag

SEQ ID NO: 462222 - DNA, 20 bp, mouse
gacgttcctgcccggaactg

SEQ ID NO: 462223 - DNA, 20 bp, mouse
ggccaggagctgctgcgtaa

SEQ ID NO: 462224 - DNA, 20 bp, mouse
gcaacttgacgcatttgggt

SEQ ID NO: 462225 - DNA, 20 bp, mouse
gacgcaccacagttccgggc

SEQ ID NO: 462226 - DNA, 20 bp, mouse
gcggagcgtgcaggacggag

SEQ ID NO: 462227 - DNA, 20 bp, mouse
ggcgcgtgcgcgtgaaagaa

SEQ ID NO: 462228 - DNA, 20 bp, mouse
gcgagctgcgggttccgctt

SEQ ID NO: 462229 - DNA, 20 bp, mouse
ggaggcggcgcgcgggtaag

SEQ ID NO: 462230 - DNA, 20 bp, mouse
gaagaacggagcgtgcagga

SEQ ID NO: 462231 - DNA, 20 bp, mouse
gctgctcctactggaaggtg

SEQ ID NO: 462232 - DNA, 20 bp, mouse
gcccaggccaggacacaatg

SEQ ID NO: 462233 - DNA, 20 bp, mouse
gcatcccaggaccacaggag

SEQ ID NO: 462234 - DNA, 20 bp, mouse
gccggacacccacagagaag

SEQ ID NO: 462235 - DNA, 20 bp, mouse
gggccaggacacaatgcggg

SEQ ID NO: 462236 - DNA, 20 bp, mouse
gcagcgagaaagctagtagt

SEQ ID NO: 462237 - DNA, 20 bp, mouse
gcccgagagcgtcagctaag

SEQ ID NO: 462238 - DNA, 20 bp, mouse
gctctctgcaccactaaagg

SEQ ID NO: 462239 - DNA, 20 bp, mouse
gcacctccctttaaggacaa

SEQ ID NO: 462240 - DNA, 20 bp, mouse
gctttaaggacaaaggactg

SEQ ID NO: 462241 - DNA, 20 bp, mouse
gaggaagccacctcccttta

SEQ ID NO: 462242 - DNA, 20 bp, mouse
gaggctctctgcaccactaa

SEQ ID NO: 462243 - DNA, 20 bp, mouse
gaggcgggaggggaaactcg

SEQ ID NO: 462244 - DNA, 20 bp, mouse
gactagctttctcgctgaga

SEQ ID NO: 462245 - DNA, 20 bp, mouse
gccctgggcccgctgctgtc

SEQ ID NO: 462246 - DNA, 20 bp, mouse
gcaaactacttggtgagcgt

SEQ ID NO: 462247 - DNA, 20 bp, mouse
gcatcaaggaaggcttagtt

SEQ ID NO: 462248 - DNA, 20 bp, mouse
gtgcacaccagcaaactact

SEQ ID NO: 462249 - DNA, 20 bp, mouse
gcaccaccagactcaggggt

SEQ ID NO: 462250 - DNA, 20 bp, mouse
gtaccaacccctgagtctgg

SEQ ID NO: 462251 - DNA, 20 bp, mouse
gctgtatttaacatcaagga

SEQ ID NO: 462252 - DNA, 20 bp, mouse
ggtaactgtatttaacatca

SEQ ID NO: 462253 - DNA, 20 bp, mouse
gcttcgctgaggcttgggac

SEQ ID NO: 462254 - DNA, 20 bp, mouse
ggtacttgtcagcttcgctg

SEQ ID NO: 462255 - DNA, 20 bp, mouse
gatgttaaatacagttacgc

SEQ ID NO: 462256 - DNA, 20 bp, mouse
ggagccggcggagcacgact

SEQ ID NO: 462257 - DNA, 20 bp, mouse
ggcctctggaccctgagcaa

SEQ ID NO: 462258 - DNA, 20 bp, mouse
gggagtctgggtagaggagt

SEQ ID NO: 462259 - DNA, 20 bp, mouse
gcgacggctactgggatctg

SEQ ID NO: 462260 - DNA, 20 bp, mouse
gcggaggcgcgggaagctct

SEQ ID NO: 462261 - DNA, 20 bp, mouse
gcgcagcctcagcgtcgcag

SEQ ID NO: 462262 - DNA, 20 bp, mouse
ggactacctctgcgacgctg

SEQ ID NO: 462263 - DNA, 20 bp, mouse
gatgctgcggagcagctgac

SEQ ID NO: 462264 - DNA, 20 bp, mouse
gggctacggaggccggcagg

SEQ ID NO: 462265 - DNA, 20 bp, mouse
gcccaaggtagaagaggacg

SEQ ID NO: 462266 - DNA, 20 bp, mouse
ggacagcgcccaggccgtgg

SEQ ID NO: 462267 - DNA, 20 bp, mouse
gtgctcatctagggtggcag

SEQ ID NO: 462268 - DNA, 20 bp, mouse
gagggacagcgcccaggccg

SEQ ID NO: 462269 - DNA, 20 bp, mouse
gctggctttctgctcatcta

SEQ ID NO: 462270 - DNA, 20 bp, mouse
gccccgcaggaccccggagt

SEQ ID NO: 462271 - DNA, 20 bp, mouse
gcgcaggaccccggagtagg

SEQ ID NO: 462272 - DNA, 20 bp, mouse
gagccagcgaagcgcggcca

SEQ ID NO: 462273 - DNA, 20 bp, mouse
gtagccgtccgtccagcaca

SEQ ID NO: 462274 - DNA, 20 bp, mouse
gggtcctgcggggtgagcgt

SEQ ID NO: 462275 - DNA, 20 bp, mouse
gtctcgccctgctgccgcca

SEQ ID NO: 462276 - DNA, 20 bp, mouse
gcggcttggagcttctggtt

SEQ ID NO: 462277 - DNA, 20 bp, mouse
gagccgctcagatggagcga

SEQ ID NO: 462278 - DNA, 20 bp, mouse
gagctgctggaccctcacat

SEQ ID NO: 462279 - DNA, 20 bp, mouse
gatccagtccacccctggag

SEQ ID NO: 462280 - DNA, 20 bp, mouse
ggctcagatggagcgatggc

SEQ ID NO: 462281 - DNA, 20 bp, mouse
gagatctagacaggagaaag

SEQ ID NO: 462282 - DNA, 20 bp, mouse
gcagtccacccctggagggg

SEQ ID NO: 462283 - DNA, 20 bp, mouse
gggtcaggcaaccccatgtg

SEQ ID NO: 462284 - DNA, 20 bp, mouse
gatgagaagagataagagca

SEQ ID NO: 462285 - DNA, 20 bp, mouse
gtaagtatgggccagagtgg

SEQ ID NO: 462286 - DNA, 20 bp, mouse
ggggacgcccgggacctcgg

SEQ ID NO: 462287 - DNA, 20 bp, mouse
ggagcacccgccgaggtccc

SEQ ID NO: 462288 - DNA, 20 bp, mouse
gcgattctgggatagcgatg

SEQ ID NO: 462289 - DNA, 20 bp, mouse
gagaaacagagcacccgccg

SEQ ID NO: 462290 - DNA, 20 bp, mouse
gatggggacgcccgggacct

SEQ ID NO: 462291 - DNA, 20 bp, mouse
gcttgagggcgcggacgcgg

SEQ ID NO: 462292 - DNA, 20 bp, mouse
gcagccgcgcgcttccttga

SEQ ID NO: 462293 - DNA, 20 bp, mouse
gcgctatcccagaatcgctc

SEQ ID NO: 462294 - DNA, 20 bp, mouse
ggacgccgcccgagcgattc

SEQ ID NO: 462295 - DNA, 20 bp, mouse
gggacaggaacgcgaatagg

SEQ ID NO: 462296 - DNA, 20 bp, mouse
gtagagtgcgcgcgagtcgg

SEQ ID NO: 462297 - DNA, 20 bp, mouse
ggcactctaggccgcaggag

SEQ ID NO: 462298 - DNA, 20 bp, mouse
ggcctagagtgcgcgcgagt

SEQ ID NO: 462299 - DNA, 20 bp, mouse
gcaggagcgggatgagattc

SEQ ID NO: 462300 - DNA, 20 bp, mouse
gctgccccggggacgatgaa

SEQ ID NO: 462301 - DNA, 20 bp, mouse
ggcaggcgagggatccagct

SEQ ID NO: 462302 - DNA, 20 bp, mouse
gtccggctcgcgcaagatgg

SEQ ID NO: 462303 - DNA, 20 bp, mouse
gggacctggccgagaggagt

SEQ ID NO: 462304 - DNA, 20 bp, mouse
gccccggggacgatgaacgg

SEQ ID NO: 462305 - DNA, 20 bp, mouse
gaaggccggactccgacctg

SEQ ID NO: 462306 - DNA, 20 bp, mouse
gcctaggagaccgagtagag

SEQ ID NO: 462307 - DNA, 20 bp, mouse
gaggagaccgagtagagggg

SEQ ID NO: 462308 - DNA, 20 bp, mouse
gcgatccgccgcctcatccc

SEQ ID NO: 462309 - DNA, 20 bp, mouse
gatccccggcggccgcatag

SEQ ID NO: 462310 - DNA, 20 bp, mouse
gagaccgagtagaggggcgg

SEQ ID NO: 462311 - DNA, 20 bp, mouse
gcgcatagcggtccatcgcg

SEQ ID NO: 462312 - DNA, 20 bp, mouse
gcccccgccgcccctctact

SEQ ID NO: 462313 - DNA, 20 bp, mouse
ggcggccgccggggatgagg

SEQ ID NO: 462314 - DNA, 20 bp, mouse
ggagctgcgggtagatcgcc

SEQ ID NO: 462315 - DNA, 20 bp, mouse
ggggcgcgccggggcaccct

SEQ ID NO: 462316 - DNA, 20 bp, mouse
ggcgccgccacaacccgcga

SEQ ID NO: 462317 - DNA, 20 bp, mouse
ggggccttcgcgggttgtgg

SEQ ID NO: 462318 - DNA, 20 bp, mouse
gagagccgagcgctttgcaa

SEQ ID NO: 462319 - DNA, 20 bp, mouse
ggctttgcaagggccttcgc

SEQ ID NO: 462320 - DNA, 20 bp, mouse
gcttctggcgggagaggtgt

SEQ ID NO: 462321 - DNA, 20 bp, mouse
ggcggcgccggggtcggtga

SEQ ID NO: 462322 - DNA, 20 bp, mouse
ggcccaggcatcatgaacgt

SEQ ID NO: 462323 - DNA, 20 bp, mouse
gggtcgaccctcaccgaccc

SEQ ID NO: 462324 - DNA, 20 bp, mouse
ggttgtggcggcgccggggt

SEQ ID NO: 462325 - DNA, 20 bp, mouse
gcgggcgaggccacaggccg

SEQ ID NO: 462326 - DNA, 20 bp, mouse
gagagcgcacggtcagagca

SEQ ID NO: 462327 - DNA, 20 bp, mouse
ggtcccctcctgtccagctc

SEQ ID NO: 462328 - DNA, 20 bp, mouse
ggggctgcggcgtccagaga

SEQ ID NO: 462329 - DNA, 20 bp, mouse
gtgagcaagagggataaggg

SEQ ID NO: 462330 - DNA, 20 bp, mouse
ggtgccacacgggtgaagaa

SEQ ID NO: 462331 - DNA, 20 bp, mouse
gtctgaccgtgcgctctctt

SEQ ID NO: 462332 - DNA, 20 bp, mouse
gtgcgtcttgcgcagcgcta

SEQ ID NO: 462333 - DNA, 20 bp, mouse
gcttgacccaagagagcgca

SEQ ID NO: 462334 - DNA, 20 bp, mouse
gcgcagcgctacggcagtcc

SEQ ID NO: 462335 - DNA, 20 bp, mouse
gcaggtgtggaaaggatcgg

SEQ ID NO: 462336 - DNA, 20 bp, mouse
gtgcaactcaaaaacagcgg

SEQ ID NO: 462337 - DNA, 20 bp, mouse
gcaaatgatctgggagtggt

SEQ ID NO: 462338 - DNA, 20 bp, mouse
gttcttccaggcgatggcag

SEQ ID NO: 462339 - DNA, 20 bp, mouse
ggttgcaaatgatctgggag

SEQ ID NO: 462340 - DNA, 20 bp, mouse
gtgcagcgtgatgcaggcga

SEQ ID NO: 462341 - DNA, 20 bp, mouse
ggtgggaggagtgagatgtg

SEQ ID NO: 462342 - DNA, 20 bp, mouse
gatttgcaactcaaaaacag

SEQ ID NO: 462343 - DNA, 20 bp, mouse
gcgtgatgcaggcgaaggct

SEQ ID NO: 462344 - DNA, 20 bp, mouse
ggaagtcttcttccaggcga

SEQ ID NO: 462345 - DNA, 20 bp, mouse
ggagctgagagcgtgtgaat

SEQ ID NO: 462346 - DNA, 20 bp, mouse
ggtggctgaggaggacccgg

SEQ ID NO: 462347 - DNA, 20 bp, mouse
gcgctggccgggcagcatgg

SEQ ID NO: 462348 - DNA, 20 bp, mouse
gtgaggaggacccggcggag

SEQ ID NO: 462349 - DNA, 20 bp, mouse
gcggacgactcctcaggcgg

SEQ ID NO: 462350 - DNA, 20 bp, mouse
gcactgtcggacgactcctc

SEQ ID NO: 462351 - DNA, 20 bp, mouse
gcgggcctcggtctcctcag

SEQ ID NO: 462352 - DNA, 20 bp, mouse
ggcgcgctggccgggcagca

SEQ ID NO: 462353 - DNA, 20 bp, mouse
gtcgtccgacagtgaacccg

SEQ ID NO: 462354 - DNA, 20 bp, mouse
gacggtcacgggcctcggca

SEQ ID NO: 462355 - DNA, 20 bp, mouse
gcgggcctcggcagggaccg

SEQ ID NO: 462356 - DNA, 20 bp, mouse
gagatctgcgtgggatgagg

SEQ ID NO: 462357 - DNA, 20 bp, mouse
ggatctcgcggcctgagggt

SEQ ID NO: 462358 - DNA, 20 bp, mouse
gcaggccgcgagatctgcgt

SEQ ID NO: 462359 - DNA, 20 bp, mouse
ggacctcgcgagagaggcac

SEQ ID NO: 462360 - DNA, 20 bp, mouse
ggcgagatctgcgtgggatg

SEQ ID NO: 462361 - DNA, 20 bp, mouse
gcggcctgagggtgggacgg

SEQ ID NO: 462362 - DNA, 20 bp, mouse
gcaggtgcgcttctcaagcg

SEQ ID NO: 462363 - DNA, 20 bp, mouse
ggcggccactgcgttcacaa

SEQ ID NO: 462364 - DNA, 20 bp, mouse
gaccgcgagagcgaactggg

SEQ ID NO: 462365 - DNA, 20 bp, mouse
gccggaggcttggctgtagg

SEQ ID NO: 462366 - DNA, 20 bp, mouse
ggtgccgtagcgggtagcag

SEQ ID NO: 462367 - DNA, 20 bp, mouse
gctgcctctgctacccgcta

SEQ ID NO: 462368 - DNA, 20 bp, mouse
gtgcgatgctgcgagggaca

SEQ ID NO: 462369 - DNA, 20 bp, mouse
gcagagccgcagtgccgtag

SEQ ID NO: 462370 - DNA, 20 bp, mouse
gtcccaagtaagggaataag

SEQ ID NO: 462371 - DNA, 20 bp, mouse
ggctacccgctacggcactg

SEQ ID NO: 462372 - DNA, 20 bp, mouse
gtcccttccagcagcgaagg

SEQ ID NO: 462373 - DNA, 20 bp, mouse
ggccgcttattcccttactt

SEQ ID NO: 462374 - DNA, 20 bp, mouse
gcagcgaaggcggaagaccc

SEQ ID NO: 462375 - DNA, 20 bp, mouse
ggccagggcaaagcaagagt

SEQ ID NO: 462376 - DNA, 20 bp, mouse
gcacgcagaggtctcggcag

SEQ ID NO: 462377 - DNA, 20 bp, mouse
ggtgaagcacgcagaggtct

SEQ ID NO: 462378 - DNA, 20 bp, mouse
gccagatgtgaagcacgcag

SEQ ID NO: 462379 - DNA, 20 bp, mouse
gtagctggcgccatcttccg

SEQ ID NO: 462380 - DNA, 20 bp, mouse
gaggggcggcgcgtgatccc

SEQ ID NO: 462381 - DNA, 20 bp, mouse
ggggcctgcgagagggttgt

SEQ ID NO: 462382 - DNA, 20 bp, mouse
ggcgcagggctcagacgttc

SEQ ID NO: 462383 - DNA, 20 bp, mouse
gggtccagggtgctgcgtgg

SEQ ID NO: 462384 - DNA, 20 bp, mouse
gtcccgcgacgccctgaggg

SEQ ID NO: 462385 - DNA, 20 bp, mouse
gtggcggggaccacggaaga

SEQ ID NO: 462386 - DNA, 20 bp, mouse
ggtccgcgcgccgctggcag

SEQ ID NO: 462387 - DNA, 20 bp, mouse
gcgctggcaggggcagcaaa

SEQ ID NO: 462388 - DNA, 20 bp, mouse
gggatggatgctgcgggaag

SEQ ID NO: 462389 - DNA, 20 bp, mouse
gaggagagaggggcgacggg

SEQ ID NO: 462390 - DNA, 20 bp, mouse
ggcgcccaggcagcagctcc

SEQ ID NO: 462391 - DNA, 20 bp, mouse
ggtcgggctgagggcgctgg

SEQ ID NO: 462392 - DNA, 20 bp, mouse
ggcccgaccggcctctgcag

SEQ ID NO: 462393 - DNA, 20 bp, mouse
gccgcggctgcaccgcaccg

SEQ ID NO: 462394 - DNA, 20 bp, mouse
ggccgctgcagaggccggtc

SEQ ID NO: 462395 - DNA, 20 bp, mouse
ggcggacccgcggggtgcag

SEQ ID NO: 462396 - DNA, 20 bp, mouse
gccgaagccggactcagaac

SEQ ID NO: 462397 - DNA, 20 bp, mouse
gggcttcggggccggctctg

SEQ ID NO: 462398 - DNA, 20 bp, mouse
gccggactcagaaccggact

SEQ ID NO: 462399 - DNA, 20 bp, mouse
gctgaggccaactctagggt

SEQ ID NO: 462400 - DNA, 20 bp, mouse
ggactctggggccctctcca

SEQ ID NO: 462401 - DNA, 20 bp, mouse
gggctctgagtctggttcga

SEQ ID NO: 462402 - DNA, 20 bp, mouse
gctgagtccggcttcggggc

SEQ ID NO: 462403 - DNA, 20 bp, mouse
gctggagtcgccactgcaca

SEQ ID NO: 462404 - DNA, 20 bp, mouse
gggctctaggacaggttctg

SEQ ID NO: 462405 - DNA, 20 bp, mouse
gctgcacagggtcccagagc

SEQ ID NO: 462406 - DNA, 20 bp, mouse
ggagggccctctctacaccg

SEQ ID NO: 462407 - DNA, 20 bp, mouse
gcaggtccgcggtgtagaga

SEQ ID NO: 462408 - DNA, 20 bp, mouse
gcgcagtcggaagccgggag

SEQ ID NO: 462409 - DNA, 20 bp, mouse
gcacgataaagccaggtccg

SEQ ID NO: 462410 - DNA, 20 bp, mouse
gcctcggcagagcccgctcc

SEQ ID NO: 462411 - DNA, 20 bp, mouse
gctaacgcgcaggctcacgt

SEQ ID NO: 462412 - DNA, 20 bp, mouse
gagcagaggtggcagaaggt

SEQ ID NO: 462413 - DNA, 20 bp, mouse
gggtagcgcagtcggaagcc

SEQ ID NO: 462414 - DNA, 20 bp, mouse
gggcagtgtcccgggaagga

SEQ ID NO: 462415 - DNA, 20 bp, mouse
ggatgaagtccgagcagagg

SEQ ID NO: 462416 - DNA, 20 bp, mouse
gctgtcggcacttcctgaag

SEQ ID NO: 462417 - DNA, 20 bp, mouse
ggtcctcgcgccccactccc

SEQ ID NO: 462418 - DNA, 20 bp, mouse
gtcggcacttcctgaagcgg

SEQ ID NO: 462419 - DNA, 20 bp, mouse
gtcggagccgctggacgagg

SEQ ID NO: 462420 - DNA, 20 bp, mouse
ggagggccggagcagcgact

SEQ ID NO: 462421 - DNA, 20 bp, mouse
gagcagtggtgaccagtcgt

SEQ ID NO: 462422 - DNA, 20 bp, mouse
gtccccggcacctgggagtg

SEQ ID NO: 462423 - DNA, 20 bp, mouse
gcaggaagtgccgacagccg

SEQ ID NO: 462424 - DNA, 20 bp, mouse
gatgagcttggcgggcggtg

SEQ ID NO: 462425 - DNA, 20 bp, mouse
gaggcccggccagctatgcg

SEQ ID NO: 462426 - DNA, 20 bp, mouse
gcaaactggagcaagagcag

SEQ ID NO: 462427 - DNA, 20 bp, mouse
ggcagctagctgtccaaact

SEQ ID NO: 462428 - DNA, 20 bp, mouse
gatctggggagggtagatca

SEQ ID NO: 462429 - DNA, 20 bp, mouse
gagcaagagcagaggcgcct

SEQ ID NO: 462430 - DNA, 20 bp, mouse
ggaaggcagccagctcgtct

SEQ ID NO: 462431 - DNA, 20 bp, mouse
gtttccatcagaccgagggg

SEQ ID NO: 462432 - DNA, 20 bp, mouse
gtgctgggccccccacgcct

SEQ ID NO: 462433 - DNA, 20 bp, mouse
gagcccttatctggagatgg

SEQ ID NO: 462434 - DNA, 20 bp, mouse
gtgtgggagccgagcagcca

SEQ ID NO: 462435 - DNA, 20 bp, mouse
gagggcctgcccaggcgtgg

SEQ ID NO: 462436 - DNA, 20 bp, mouse
gctctcagccacctactcgg

SEQ ID NO: 462437 - DNA, 20 bp, mouse
gcgccttgctcggcttgggt

SEQ ID NO: 462438 - DNA, 20 bp, mouse
ggcagggtgggacagatctg

SEQ ID NO: 462439 - DNA, 20 bp, mouse
gcgctcggagacgacgcaga

SEQ ID NO: 462440 - DNA, 20 bp, mouse
gcaggcggaagtgctctcgg

SEQ ID NO: 462441 - DNA, 20 bp, mouse
gttgctcggcttgggtagga

SEQ ID NO: 462442 - DNA, 20 bp, mouse
gccagggccatgcacgacgg

SEQ ID NO: 462443 - DNA, 20 bp, mouse
gcggggaacggaaagacgct

SEQ ID NO: 462444 - DNA, 20 bp, mouse
gccacgagcgcgttccgcag

SEQ ID NO: 462445 - DNA, 20 bp, mouse
gtgcccgccttgctcggctt

SEQ ID NO: 462446 - DNA, 20 bp, mouse
gagcgggcgaaggagacggg

SEQ ID NO: 462447 - DNA, 20 bp, mouse
gcgcaccgcgcggaagggtg

SEQ ID NO: 462448 - DNA, 20 bp, mouse
ggacttacaggctcccgggg

SEQ ID NO: 462449 - DNA, 20 bp, mouse
gcacacggccagcgacacgg

SEQ ID NO: 462450 - DNA, 20 bp, mouse
gcgcggcgcaccgcgcggaa

SEQ ID NO: 462451 - DNA, 20 bp, mouse
gtatcgaagatgagcgagag

SEQ ID NO: 462452 - DNA, 20 bp, mouse
gagcgacacggcgggctcca

SEQ ID NO: 462453 - DNA, 20 bp, mouse
gcccgacttacaggctcccg

SEQ ID NO: 462454 - DNA, 20 bp, mouse
gggcgggctccatggtgtcg

SEQ ID NO: 462455 - DNA, 20 bp, mouse
ggagcccgcacccttccgcg

SEQ ID NO: 462456 - DNA, 20 bp, mouse
gcctgagtgcggaatccagg

SEQ ID NO: 462457 - DNA, 20 bp, mouse
gtcacctgagtgcggaatcc

SEQ ID NO: 462458 - DNA, 20 bp, mouse
gagagcgtggatcagccgcc

SEQ ID NO: 462459 - DNA, 20 bp, mouse
gcaggtgcacctgaccatct

SEQ ID NO: 462460 - DNA, 20 bp, mouse
ggaattcgtgtgcacggacc

SEQ ID NO: 462461 - DNA, 20 bp, mouse
gagaacactgctggagagcg

SEQ ID NO: 462462 - DNA, 20 bp, mouse
gcacctgtgatgaggtatgg

SEQ ID NO: 462463 - DNA, 20 bp, mouse
gacgaattctcacctgagtg

SEQ ID NO: 462464 - DNA, 20 bp, mouse
gcttctcctgcactctggcc

SEQ ID NO: 462465 - DNA, 20 bp, mouse
gtgaaggccgagtaggaggg

SEQ ID NO: 462466 - DNA, 20 bp, mouse
gtccaggacgctctgacctt

SEQ ID NO: 462467 - DNA, 20 bp, mouse
gctctgaccttgggcaacag

SEQ ID NO: 462468 - DNA, 20 bp, mouse
ggcccaaggtcagagcgtcc

SEQ ID NO: 462469 - DNA, 20 bp, mouse
gatggcaaaggaaatgatcc

SEQ ID NO: 462470 - DNA, 20 bp, mouse
gaaggagcgcctgcgcagta

SEQ ID NO: 462471 - DNA, 20 bp, mouse
gagtgggcagaagtcctctt

SEQ ID NO: 462472 - DNA, 20 bp, mouse
gctatcaaaagtcgctcaga

SEQ ID NO: 462473 - DNA, 20 bp, mouse
gcctttaaagtagggcccta

SEQ ID NO: 462474 - DNA, 20 bp, mouse
gaggccgtcacatcaatcat

SEQ ID NO: 462475 - DNA, 20 bp, mouse
ggctcacagagagctcacag

SEQ ID NO: 462476 - DNA, 20 bp, mouse
ggtaagtcgcccgggagtgg

SEQ ID NO: 462477 - DNA, 20 bp, mouse
ggtcgtaagtcgcccgggag

SEQ ID NO: 462478 - DNA, 20 bp, mouse
gccacctaggacgcaggaga

SEQ ID NO: 462479 - DNA, 20 bp, mouse
ggccaagtcgtaagtcgccc

SEQ ID NO: 462480 - DNA, 20 bp, mouse
gggcggagccaatcacgtag

SEQ ID NO: 462481 - DNA, 20 bp, mouse
gctgtgtttactccccacct

SEQ ID NO: 462482 - DNA, 20 bp, mouse
gtactccccacctaggacgc

SEQ ID NO: 462483 - DNA, 20 bp, mouse
ggcgcttttccaccactccc

SEQ ID NO: 462484 - DNA, 20 bp, mouse
ggattgaccaagcaagatgt

SEQ ID NO: 462485 - DNA, 20 bp, mouse
gcagatgcggcatccaagga

SEQ ID NO: 462486 - DNA, 20 bp, mouse
gctgcgctggggcatcgtgt

SEQ ID NO: 462487 - DNA, 20 bp, mouse
ggagggagccccgagtgtga

SEQ ID NO: 462488 - DNA, 20 bp, mouse
ggcaaaatggcgctgcgctg

SEQ ID NO: 462489 - DNA, 20 bp, mouse
gaggcagaagacgtgcaaaa

SEQ ID NO: 462490 - DNA, 20 bp, mouse
gagcacggtggtaaagtcgt

SEQ ID NO: 462491 - DNA, 20 bp, mouse
gggagccccgagtgtgaggg

SEQ ID NO: 462492 - DNA, 20 bp, mouse
gtccctagtccgaggaacga

SEQ ID NO: 462493 - DNA, 20 bp, mouse
gagtcactgccttagaccta

SEQ ID NO: 462494 - DNA, 20 bp, mouse
ggcacgtcttctgcctgcgg

SEQ ID NO: 462495 - DNA, 20 bp, mouse
gctatgcgccccagtctgag

SEQ ID NO: 462496 - DNA, 20 bp, mouse
gcggcgacgatgcagttcaa

SEQ ID NO: 462497 - DNA, 20 bp, mouse
gtcctagcgtgaaggctggt

SEQ ID NO: 462498 - DNA, 20 bp, mouse
gttcaatggtcgaaccatga

SEQ ID NO: 462499 - DNA, 20 bp, mouse
ggacggcaatcctagcgtga

SEQ ID NO: 462500 - DNA, 20 bp, mouse
ggcaatcctagcgtgaaggc

SEQ ID NO: 462501 - DNA, 20 bp, mouse
ggcaagtggtacacagctca

SEQ ID NO: 462502 - DNA, 20 bp, mouse
ggatttcgcgccaaacttga

SEQ ID NO: 462503 - DNA, 20 bp, mouse
gccagggagcctgtgagcaa

SEQ ID NO: 462504 - DNA, 20 bp, mouse
gtcgaaccatgatggcagcg

SEQ ID NO: 462505 - DNA, 20 bp, mouse
ggcgtgagcggtaggcctac

SEQ ID NO: 462506 - DNA, 20 bp, mouse
gtacagagcaggtgggtcga

SEQ ID NO: 462507 - DNA, 20 bp, mouse
gatggtagtctatcagtagt

SEQ ID NO: 462508 - DNA, 20 bp, mouse
gtaccatttacagagcaggt

SEQ ID NO: 462509 - DNA, 20 bp, mouse
gggcatgtaggcagagttag

SEQ ID NO: 462510 - DNA, 20 bp, mouse
gcccttccgacccaagtcca

SEQ ID NO: 462511 - DNA, 20 bp, mouse
gcagcacaggggcaacagac

SEQ ID NO: 462512 - DNA, 20 bp, mouse
gacaggggcaacagactggc

SEQ ID NO: 462513 - DNA, 20 bp, mouse
gcagagtacctggagcgctg

SEQ ID NO: 462514 - DNA, 20 bp, mouse
ggggtccgctcgggcatact

SEQ ID NO: 462515 - DNA, 20 bp, mouse
gccgcctgatgacagaggta

SEQ ID NO: 462516 - DNA, 20 bp, mouse
gtccaatgggatgcaggcag

SEQ ID NO: 462517 - DNA, 20 bp, mouse
gcaggcagaggcgggcttaa

SEQ ID NO: 462518 - DNA, 20 bp, mouse
ggcgcggggaagctcattcg

SEQ ID NO: 462519 - DNA, 20 bp, mouse
ggtggtgtggataaccggca

SEQ ID NO: 462520 - DNA, 20 bp, mouse
ggcctctgcctgcatcccat

SEQ ID NO: 462521 - DNA, 20 bp, mouse
gtggataaccggcagggagg

SEQ ID NO: 462522 - DNA, 20 bp, mouse
gtcgctgtcgcgcctcctaa

SEQ ID NO: 462523 - DNA, 20 bp, mouse
gtgagagtgagtcctgcgcg

SEQ ID NO: 462524 - DNA, 20 bp, mouse
gcagagcagcgtcccttagg

SEQ ID NO: 462525 - DNA, 20 bp, mouse
gctgaacctgagagatacgc

SEQ ID NO: 462526 - DNA, 20 bp, mouse
gggctgctgagacctgagag

SEQ ID NO: 462527 - DNA, 20 bp, mouse
gctctcgagtcgcacttcct

SEQ ID NO: 462528 - DNA, 20 bp, mouse
ggctccggccgacctcgctg

SEQ ID NO: 462529 - DNA, 20 bp, mouse
gtgcgggtctcagggcgccg

SEQ ID NO: 462530 - DNA, 20 bp, mouse
gtgcgactcgagagccttgg

SEQ ID NO: 462531 - DNA, 20 bp, mouse
gcggccgcgagcacatggaa

SEQ ID NO: 462532 - DNA, 20 bp, mouse
gccgagagcgcccaggtcca

SEQ ID NO: 462533 - DNA, 20 bp, mouse
gatggaagggaccccgccag

SEQ ID NO: 462534 - DNA, 20 bp, mouse
gaaggctacgacttcaaccg

SEQ ID NO: 462535 - DNA, 20 bp, mouse
gacctcgctgagggattttg

SEQ ID NO: 462536 - DNA, 20 bp, mouse
gccaggcacgcactccaacg

SEQ ID NO: 462537 - DNA, 20 bp, mouse
gaaggctctgaccacttcag

SEQ ID NO: 462538 - DNA, 20 bp, mouse
gcgcacccggacttccatcc

SEQ ID NO: 462539 - DNA, 20 bp, mouse
gactatagatctggcgatct

SEQ ID NO: 462540 - DNA, 20 bp, mouse
gtatggccacgaagagtcct

SEQ ID NO: 462541 - DNA, 20 bp, mouse
gggtgcggataacgatgata

SEQ ID NO: 462542 - DNA, 20 bp, mouse
gggctacccgtccagaccca

SEQ ID NO: 462543 - DNA, 20 bp, mouse
gagggtcagacccagtgggg

SEQ ID NO: 462544 - DNA, 20 bp, mouse
ggagtgaagctgacttggta

SEQ ID NO: 462545 - DNA, 20 bp, mouse
gggtctgaccctggaactcc

SEQ ID NO: 462546 - DNA, 20 bp, mouse
ggagcggggagcttagtctg

SEQ ID NO: 462547 - DNA, 20 bp, mouse
gcgttcggcgaaccaggcac

SEQ ID NO: 462548 - DNA, 20 bp, mouse
gctggttcgccgaacgaggt

SEQ ID NO: 462549 - DNA, 20 bp, mouse
gtggggttactgaagatcgg

SEQ ID NO: 462550 - DNA, 20 bp, mouse
gtcccccactgcagtgacca

SEQ ID NO: 462551 - DNA, 20 bp, mouse
gcgaaccaggcactgggagc

SEQ ID NO: 462552 - DNA, 20 bp, mouse
ggctccccgctcccagtgcc

SEQ ID NO: 462553 - DNA, 20 bp, mouse
gtggtgacgggagcctcggg

SEQ ID NO: 462554 - DNA, 20 bp, mouse
gcgttggcaacatcgaggta

SEQ ID NO: 462555 - DNA, 20 bp, mouse
gcgcaccgttggcaacatcg

SEQ ID NO: 462556 - DNA, 20 bp, mouse
gggcgggagcgacgaggccc

SEQ ID NO: 462557 - DNA, 20 bp, mouse
gtcccgcctcggcctcgcga

SEQ ID NO: 462558 - DNA, 20 bp, mouse
gcgggaatcgggagcactgc

SEQ ID NO: 462559 - DNA, 20 bp, mouse
gcgaggcccgggcgggaatc

SEQ ID NO: 462560 - DNA, 20 bp, mouse
gagcagcagcatctccatgc

SEQ ID NO: 462561 - DNA, 20 bp, mouse
ggcgagggcggcggcaggct

SEQ ID NO: 462562 - DNA, 20 bp, mouse
gctcggcctcgcgagggcgg

SEQ ID NO: 462563 - DNA, 20 bp, mouse
ggggagcgacgaggcccggg

SEQ ID NO: 462564 - DNA, 20 bp, mouse
gcgcccgcaggcgccaatag

SEQ ID NO: 462565 - DNA, 20 bp, mouse
gcgcctcggcctcgcgaggg

SEQ ID NO: 462566 - DNA, 20 bp, mouse
gagggagccttggaagaata

SEQ ID NO: 462567 - DNA, 20 bp, mouse
ggagtccactggcccgaggt

SEQ ID NO: 462568 - DNA, 20 bp, mouse
gaggcactcagattcctgga

SEQ ID NO: 462569 - DNA, 20 bp, mouse
gggctccctgacctcagaaa

SEQ ID NO: 462570 - DNA, 20 bp, mouse
gtctgagtgcctgagtccac

SEQ ID NO: 462571 - DNA, 20 bp, mouse
gcaaacctacctcgggccag

SEQ ID NO: 462572 - DNA, 20 bp, mouse
gggtttgccgtattcttcca

SEQ ID NO: 462573 - DNA, 20 bp, mouse
gccctgacctcagaaatgga

SEQ ID NO: 462574 - DNA, 20 bp, mouse
gggagagagttggcttccag

SEQ ID NO: 462575 - DNA, 20 bp, mouse
gaagtgtgagcccacagaca

SEQ ID NO: 462576 - DNA, 20 bp, mouse
ggggctgtggagagtccaag

SEQ ID NO: 462577 - DNA, 20 bp, mouse
gcagaccgacagaagagttt

SEQ ID NO: 462578 - DNA, 20 bp, mouse
gtttcggctgggaaattcac

SEQ ID NO: 462579 - DNA, 20 bp, mouse
gggacagggcgaggaaaaat

SEQ ID NO: 462580 - DNA, 20 bp, mouse
gagttcaagagtgaccaggt

SEQ ID NO: 462581 - DNA, 20 bp, mouse
gctgtggagagtccaagggg

SEQ ID NO: 462582 - DNA, 20 bp, mouse
gctttcagatgtaaaggaca

SEQ ID NO: 462583 - DNA, 20 bp, mouse
gcttgccccaacagccgttt

SEQ ID NO: 462584 - DNA, 20 bp, mouse
ggcgtctcagaagattggga

SEQ ID NO: 462585 - DNA, 20 bp, mouse
gaagattgggacggtgagag

SEQ ID NO: 462586 - DNA, 20 bp, mouse
gaagcgggacggctgttagg

SEQ ID NO: 462587 - DNA, 20 bp, mouse
gaactatgcagaaagcggga

SEQ ID NO: 462588 - DNA, 20 bp, mouse
gtcaagcgtggatgtcggtg

SEQ ID NO: 462589 - DNA, 20 bp, mouse
gagaaagcgggacggctgtt

SEQ ID NO: 462590 - DNA, 20 bp, mouse
gtggactcaagcgtggatgt

SEQ ID NO: 462591 - DNA, 20 bp, mouse
gggctcgaggacaacagtcc

SEQ ID NO: 462592 - DNA, 20 bp, mouse
gagagccggtcctagaagag

SEQ ID NO: 462593 - DNA, 20 bp, mouse
gtccaggtaaggggtcccta

SEQ ID NO: 462594 - DNA, 20 bp, mouse
gggtgaggatggccagttcc

SEQ ID NO: 462595 - DNA, 20 bp, mouse
ggggacggctgttaggtggt

SEQ ID NO: 462596 - DNA, 20 bp, mouse
gggcagagtcgggtaggcaa

SEQ ID NO: 462597 - DNA, 20 bp, mouse
gcaagggacagcgatgagct

SEQ ID NO: 462598 - DNA, 20 bp, mouse
gcaagggctgagggtccggg

SEQ ID NO: 462599 - DNA, 20 bp, mouse
gctgagggtccgggaggaag

SEQ ID NO: 462600 - DNA, 20 bp, mouse
gttccgcttgcggcagagtc

SEQ ID NO: 462601 - DNA, 20 bp, mouse
gagagtgtccggggatccta

SEQ ID NO: 462602 - DNA, 20 bp, mouse
gaagcgcaagagctgcacaa

SEQ ID NO: 462603 - DNA, 20 bp, mouse
gctgtagaggatgctcacct

SEQ ID NO: 462604 - DNA, 20 bp, mouse
ggaccctcagcccttggtca

SEQ ID NO: 462605 - DNA, 20 bp, mouse
gagcttggcaacagctggga

SEQ ID NO: 462606 - DNA, 20 bp, mouse
gctaaaggacggagagatca

SEQ ID NO: 462607 - DNA, 20 bp, mouse
gctagcctttacctaaagga

SEQ ID NO: 462608 - DNA, 20 bp, mouse
gtagggatgttgcaacctct

SEQ ID NO: 462609 - DNA, 20 bp, mouse
gctctccgtcctttaggtaa

SEQ ID NO: 462610 - DNA, 20 bp, mouse
gccgcggcgccccacagtga

SEQ ID NO: 462611 - DNA, 20 bp, mouse
gctcttggtgagtggaaatg

SEQ ID NO: 462612 - DNA, 20 bp, mouse
gccccacagtgaaggaagca

SEQ ID NO: 462613 - DNA, 20 bp, mouse
ggggttcaggcactccgccc

SEQ ID NO: 462614 - DNA, 20 bp, mouse
gcgcgtgtgcatagctactg

SEQ ID NO: 462615 - DNA, 20 bp, mouse
gtaaccggcacagttagggt

SEQ ID NO: 462616 - DNA, 20 bp, mouse
ggctcagagtctctcctcca

SEQ ID NO: 462617 - DNA, 20 bp, mouse
gcagctgggaaggacctccc

SEQ ID NO: 462618 - DNA, 20 bp, mouse
gaccctggttgcaaccccca

SEQ ID NO: 462619 - DNA, 20 bp, mouse
ggtgttaaggccactcgctt

SEQ ID NO: 462620 - DNA, 20 bp, mouse
ggaggtccttcccagctgag

SEQ ID NO: 462621 - DNA, 20 bp, mouse
gttcacactgaaggagtcca

SEQ ID NO: 462622 - DNA, 20 bp, mouse
gcaggacagcgggatgacaa

SEQ ID NO: 462623 - DNA, 20 bp, mouse
gtgtcctgcagagcaagatg

SEQ ID NO: 462624 - DNA, 20 bp, mouse
gcctgcagaacccaactccc

SEQ ID NO: 462625 - DNA, 20 bp, mouse
gccattagagcccaagcgag

SEQ ID NO: 462626 - DNA, 20 bp, mouse
gcttgagaggatcagcttga

SEQ ID NO: 462627 - DNA, 20 bp, mouse
gcctgctgtggtccagggga

SEQ ID NO: 462628 - DNA, 20 bp, mouse
gtcagagctccgcagaccgc

SEQ ID NO: 462629 - DNA, 20 bp, mouse
gtgtgactcactgagagaag

SEQ ID NO: 462630 - DNA, 20 bp, mouse
gtcaaggtgcctgcggtctg

SEQ ID NO: 462631 - DNA, 20 bp, mouse
gagtcacagagccctgtcct

SEQ ID NO: 462632 - DNA, 20 bp, mouse
ggattgtcaccttcctgctg

SEQ ID NO: 462633 - DNA, 20 bp, mouse
ggagtgaagggacaaacgat

SEQ ID NO: 462634 - DNA, 20 bp, mouse
gaatcaaggacatgagtgaa

SEQ ID NO: 462635 - DNA, 20 bp, mouse
gataggaacacggaaaatca

SEQ ID NO: 462636 - DNA, 20 bp, mouse
gcgagggtccggtgcaggag

SEQ ID NO: 462637 - DNA, 20 bp, mouse
gctacaaccaaggagagcga

SEQ ID NO: 462638 - DNA, 20 bp, mouse
gaccaaggagagcgagggtc

SEQ ID NO: 462639 - DNA, 20 bp, mouse
ggagagcgagggtccggtgc

SEQ ID NO: 462640 - DNA, 20 bp, mouse
gaaaataagagctacaacca

SEQ ID NO: 462641 - DNA, 20 bp, mouse
gacgggtcctcagactcacg

SEQ ID NO: 462642 - DNA, 20 bp, mouse
gcgggtctcctctcctgcac

SEQ ID NO: 462643 - DNA, 20 bp, mouse
gtctggggtcgaagacgccg

SEQ ID NO: 462644 - DNA, 20 bp, mouse
ggaggggcgtctatggatac

SEQ ID NO: 462645 - DNA, 20 bp, mouse
ggctgcatccccaacctgag

SEQ ID NO: 462646 - DNA, 20 bp, mouse
gtggttcgggccgcacggag

SEQ ID NO: 462647 - DNA, 20 bp, mouse
gaggcccgcggctcaactcg

SEQ ID NO: 462648 - DNA, 20 bp, mouse
gcgcacggagcgggctgtgg

SEQ ID NO: 462649 - DNA, 20 bp, mouse
gggccgcacggagcgggctg

SEQ ID NO: 462650 - DNA, 20 bp, mouse
ggccggccgacggcagacaa

SEQ ID NO: 462651 - DNA, 20 bp, mouse
ggcaggccctgccctcgtcg

SEQ ID NO: 462652 - DNA, 20 bp, mouse
ggaagcgtgcggggaccgat

SEQ ID NO: 462653 - DNA, 20 bp, mouse
ggcgggctgtggtggcggga

SEQ ID NO: 462654 - DNA, 20 bp, mouse
gcgcccgccgccgcccacgg

SEQ ID NO: 462655 - DNA, 20 bp, mouse
ggaaccaggagctaaaatgg

SEQ ID NO: 462656 - DNA, 20 bp, mouse
gtacggcagccggagcgagg

SEQ ID NO: 462657 - DNA, 20 bp, mouse
gtgtggaattggagtctcta

SEQ ID NO: 462658 - DNA, 20 bp, mouse
gcgcggaacggccaggactg

SEQ ID NO: 462659 - DNA, 20 bp, mouse
gagcgaggcggtagtaccgc

SEQ ID NO: 462660 - DNA, 20 bp, mouse
gggaacggccaggactgcgg

SEQ ID NO: 462661 - DNA, 20 bp, mouse
gcgggcgcgcaaccgcggaa

SEQ ID NO: 462662 - DNA, 20 bp, mouse
gcgctgcacgaactcctcgg

SEQ ID NO: 462663 - DNA, 20 bp, mouse
gaggcgctgcacgaactcct

SEQ ID NO: 462664 - DNA, 20 bp, mouse
ggcgcaaccgcggaacggcc

SEQ ID NO: 462665 - DNA, 20 bp, mouse
gtgctccgggcgcgcaaccg

SEQ ID NO: 462666 - DNA, 20 bp, mouse
gggaggctgggtggaggcgt

SEQ ID NO: 462667 - DNA, 20 bp, mouse
gcgcggagcccggatggagg

SEQ ID NO: 462668 - DNA, 20 bp, mouse
ggcaaacgtgaagagctctc

SEQ ID NO: 462669 - DNA, 20 bp, mouse
gcccagccgcggagcccgga

SEQ ID NO: 462670 - DNA, 20 bp, mouse
gcgcagcggggatctggatc

SEQ ID NO: 462671 - DNA, 20 bp, mouse
gcctgcagctgaaacatggg

SEQ ID NO: 462672 - DNA, 20 bp, mouse
gaaggctgggcactgggtca

SEQ ID NO: 462673 - DNA, 20 bp, mouse
ggcagaggccggagctgttg

SEQ ID NO: 462674 - DNA, 20 bp, mouse
gctcgctcccgggagccgag

SEQ ID NO: 462675 - DNA, 20 bp, mouse
gaggcggagtctgaggacac

SEQ ID NO: 462676 - DNA, 20 bp, mouse
gccgcgggcccccccaacta

SEQ ID NO: 462677 - DNA, 20 bp, mouse
gctgtaacaacaggtgaatt

SEQ ID NO: 462678 - DNA, 20 bp, mouse
gagtccggccgtagttgggg

SEQ ID NO: 462679 - DNA, 20 bp, mouse
gtagcggcctggcagagagt

SEQ ID NO: 462680 - DNA, 20 bp, mouse
gtgcttcaaggggcgcgaaa

SEQ ID NO: 462681 - DNA, 20 bp, mouse
gcgtgtcaggctgcttcaag

SEQ ID NO: 462682 - DNA, 20 bp, mouse
gcgccccggctccatggcaa

SEQ ID NO: 462683 - DNA, 20 bp, mouse
ggaaaaccgagcatcccctg

SEQ ID NO: 462684 - DNA, 20 bp, mouse
ggtgcacggcgcatgagccg

SEQ ID NO: 462685 - DNA, 20 bp, mouse
gtgtagtccggccgtagttg

SEQ ID NO: 462686 - DNA, 20 bp, mouse
gagcagcgcacgggcgggag

SEQ ID NO: 462687 - DNA, 20 bp, mouse
gcggccgccgctgcaggtaa

SEQ ID NO: 462688 - DNA, 20 bp, mouse
gacgcagagcagcgcacggg

SEQ ID NO: 462689 - DNA, 20 bp, mouse
ggccgctgcaggtaacggca

SEQ ID NO: 462690 - DNA, 20 bp, mouse
gcccgaccaggcacagctga

SEQ ID NO: 462691 - DNA, 20 bp, mouse
gacgggcgggagtggcgcag

SEQ ID NO: 462692 - DNA, 20 bp, mouse
gcggcggacggcgagaggga

SEQ ID NO: 462693 - DNA, 20 bp, mouse
gcgcaggggggtcgcgaccc

SEQ ID NO: 462694 - DNA, 20 bp, mouse
gggaaacgcagagcagcgca

SEQ ID NO: 462695 - DNA, 20 bp, mouse
ggagggaccaaaaagtgacg

SEQ ID NO: 462696 - DNA, 20 bp, mouse
ggcacgtggcgagaaagggg

SEQ ID NO: 462697 - DNA, 20 bp, mouse
gcctgcacgtggcgagaaag

SEQ ID NO: 462698 - DNA, 20 bp, mouse
gagggcctcgcggtagggac

SEQ ID NO: 462699 - DNA, 20 bp, mouse
gcggcatgtcgggaggaccg

SEQ ID NO: 462700 - DNA, 20 bp, mouse
ggcccccgcgcccggaagat

SEQ ID NO: 462701 - DNA, 20 bp, mouse
ggctccagggcctcgcggta

SEQ ID NO: 462702 - DNA, 20 bp, mouse
gaggaccgcggccggaggca

SEQ ID NO: 462703 - DNA, 20 bp, mouse
gcactactcgtctcccggga

SEQ ID NO: 462704 - DNA, 20 bp, mouse
ggcggctgtgaggtcatcgg

SEQ ID NO: 462705 - DNA, 20 bp, mouse
gtccctggctctgtgcacga

SEQ ID NO: 462706 - DNA, 20 bp, mouse
gctatttcggaggtaagggg

SEQ ID NO: 462707 - DNA, 20 bp, mouse
gggcgtccgtgctatttcgg

SEQ ID NO: 462708 - DNA, 20 bp, mouse
gctgcaagagaggctcacaa

SEQ ID NO: 462709 - DNA, 20 bp, mouse
ggtgctatttcggaggtaag

SEQ ID NO: 462710 - DNA, 20 bp, mouse
ggcgcaggcgcagaccattt

SEQ ID NO: 462711 - DNA, 20 bp, mouse
gcatttaggaccggaagttg

SEQ ID NO: 462712 - DNA, 20 bp, mouse
gtagaagctggaggaccaag

SEQ ID NO: 462713 - DNA, 20 bp, mouse
gtgtgtgcggggtgtctgcg

SEQ ID NO: 462714 - DNA, 20 bp, mouse
ggcacggacgcctcaacttc

SEQ ID NO: 462715 - DNA, 20 bp, mouse
gccacacaaatcctgcacca

SEQ ID NO: 462716 - DNA, 20 bp, mouse
gcagctcctatgaacaagaa

SEQ ID NO: 462717 - DNA, 20 bp, mouse
gaagaagggctcaggtgagt

SEQ ID NO: 462718 - DNA, 20 bp, mouse
ggctcaggtgagtgggctct

SEQ ID NO: 462719 - DNA, 20 bp, mouse
ggcactgaggagaatatacc

SEQ ID NO: 462720 - DNA, 20 bp, mouse
gacgctgtcagccctctggg

SEQ ID NO: 462721 - DNA, 20 bp, mouse
gacgcaggcgcaaggtgctg

SEQ ID NO: 462722 - DNA, 20 bp, mouse
gctatgaacaagaagggctc

SEQ ID NO: 462723 - DNA, 20 bp, mouse
gcggggccaggggcatgaag

SEQ ID NO: 462724 - DNA, 20 bp, mouse
gcccaggggacagctacagt

SEQ ID NO: 462725 - DNA, 20 bp, mouse
gagcgatgaagaggaccgag

SEQ ID NO: 462726 - DNA, 20 bp, mouse
ggactcgcgcgggtctagag

SEQ ID NO: 462727 - DNA, 20 bp, mouse
gcaagggcgcagccatgctg

SEQ ID NO: 462728 - DNA, 20 bp, mouse
gagaatttcactggtcccaa

SEQ ID NO: 462729 - DNA, 20 bp, mouse
gtcgcgcgggtctagagggg

SEQ ID NO: 462730 - DNA, 20 bp, mouse
gtaagctgggcggaaactct

SEQ ID NO: 462731 - DNA, 20 bp, mouse
gatctcaagaggtgccgagg

SEQ ID NO: 462732 - DNA, 20 bp, mouse
gaaattctggaaaccgggta

SEQ ID NO: 462733 - DNA, 20 bp, mouse
gcaggccgaaagtcatgtcc

SEQ ID NO: 462734 - DNA, 20 bp, mouse
gcatgtccgggcatctaccc

SEQ ID NO: 462735 - DNA, 20 bp, mouse
gaggatgctgcagcccacgg

SEQ ID NO: 462736 - DNA, 20 bp, mouse
ggcccggacgccattttcag

SEQ ID NO: 462737 - DNA, 20 bp, mouse
ggatagtcgtagctcattgt

SEQ ID NO: 462738 - DNA, 20 bp, mouse
gcagacgcagaagaacaagg

SEQ ID NO: 462739 - DNA, 20 bp, mouse
gggcatcccgcacaccttaa

SEQ ID NO: 462740 - DNA, 20 bp, mouse
gtggcgtccgggcccggaag

SEQ ID NO: 462741 - DNA, 20 bp, mouse
ggccccgtgggcccccatcg

SEQ ID NO: 462742 - DNA, 20 bp, mouse
ggctccggccagggctccag

SEQ ID NO: 462743 - DNA, 20 bp, mouse
gcgccggaagcaaagcagag

SEQ ID NO: 462744 - DNA, 20 bp, mouse
gaagcagacgcagaagaaca

SEQ ID NO: 462745 - DNA, 20 bp, mouse
ggccctggccggagccccgt

SEQ ID NO: 462746 - DNA, 20 bp, mouse
gagccaggttcggtttccct

SEQ ID NO: 462747 - DNA, 20 bp, mouse
gctcccagggaaaccgaacc

SEQ ID NO: 462748 - DNA, 20 bp, mouse
gcgtggcgcgagggagccat

SEQ ID NO: 462749 - DNA, 20 bp, mouse
ggaagtctcctagccaggtt

SEQ ID NO: 462750 - DNA, 20 bp, mouse
ggagaagccggggaccggga

SEQ ID NO: 462751 - DNA, 20 bp, mouse
gccgctacaacgtgaagggg

SEQ ID NO: 462752 - DNA, 20 bp, mouse
ggggcagtacccccatatcg

SEQ ID NO: 462753 - DNA, 20 bp, mouse
gccgctctaccgcgatatgg

SEQ ID NO: 462754 - DNA, 20 bp, mouse
gacgccgctacaacgtgaag

SEQ ID NO: 462755 - DNA, 20 bp, mouse
ggctgagggagccacgcgcg

SEQ ID NO: 462756 - DNA, 20 bp, mouse
gcgatccgagggtctcaaag

SEQ ID NO: 462757 - DNA, 20 bp, mouse
gcggccaccgctcgatccga

SEQ ID NO: 462758 - DNA, 20 bp, mouse
gagaccctcggatcgagcgg

SEQ ID NO: 462759 - DNA, 20 bp, mouse
ggctccgcgcagggcattat

SEQ ID NO: 462760 - DNA, 20 bp, mouse
gtagttggagagcctgggta

SEQ ID NO: 462761 - DNA, 20 bp, mouse
gttgagaccctcggatcgag

SEQ ID NO: 462762 - DNA, 20 bp, mouse
ggatggccgctttcaaacag

SEQ ID NO: 462763 - DNA, 20 bp, mouse
gcgcgtactgccctaaacga

SEQ ID NO: 462764 - DNA, 20 bp, mouse
gggctccaggcggccggtgt

SEQ ID NO: 462765 - DNA, 20 bp, mouse
gcggccccacggagattcag

SEQ ID NO: 462766 - DNA, 20 bp, mouse
gtccacggagccgaggagat

SEQ ID NO: 462767 - DNA, 20 bp, mouse
gccgggacatagacccggtc

SEQ ID NO: 462768 - DNA, 20 bp, mouse
ggacgtgttcgcttcttctc

SEQ ID NO: 462769 - DNA, 20 bp, mouse
gcgcgggcagggcgccaagg

SEQ ID NO: 462770 - DNA, 20 bp, mouse
gcgcatcgctgacagaggta

SEQ ID NO: 462771 - DNA, 20 bp, mouse
gtacggtccgcgggacgctg

SEQ ID NO: 462772 - DNA, 20 bp, mouse
ggaacacgtccacggagccg

SEQ ID NO: 462773 - DNA, 20 bp, mouse
gtcccatctcctcggctccg

SEQ ID NO: 462774 - DNA, 20 bp, mouse
gcgaaaagtacatctgtggg

SEQ ID NO: 462775 - DNA, 20 bp, mouse
gaggctggcggcccgacgaa

SEQ ID NO: 462776 - DNA, 20 bp, mouse
gctgcgggtgaggtccaaga

SEQ ID NO: 462777 - DNA, 20 bp, mouse
gcaacgctacgagccaggta

SEQ ID NO: 462778 - DNA, 20 bp, mouse
gggaggcggcacccagggtc

SEQ ID NO: 462779 - DNA, 20 bp, mouse
gagccaggtacggcctgacg

SEQ ID NO: 462780 - DNA, 20 bp, mouse
ggctggctgcggagctcagg

SEQ ID NO: 462781 - DNA, 20 bp, mouse
gtgtgatcactagagagggg

SEQ ID NO: 462782 - DNA, 20 bp, mouse
gctggacctgcagaatcctg

SEQ ID NO: 462783 - DNA, 20 bp, mouse
gtcgaggtcgtccacaccca

SEQ ID NO: 462784 - DNA, 20 bp, mouse
gggatgtgatcactagagag

SEQ ID NO: 462785 - DNA, 20 bp, mouse
gtcactgcccctgggctgac

SEQ ID NO: 462786 - DNA, 20 bp, mouse
gactggccaggattaggatg

SEQ ID NO: 462787 - DNA, 20 bp, mouse
gactaggctggtctctgcgg

SEQ ID NO: 462788 - DNA, 20 bp, mouse
ggagctgcgaccctaccagt

SEQ ID NO: 462789 - DNA, 20 bp, mouse
ggggtcttcccagcacccgt

SEQ ID NO: 462790 - DNA, 20 bp, mouse
ggaaccaaggagaggagacc

SEQ ID NO: 462791 - DNA, 20 bp, mouse
ggaactcgtagataactacc

SEQ ID NO: 462792 - DNA, 20 bp, mouse
gaaatgaatagcagcagact

SEQ ID NO: 462793 - DNA, 20 bp, mouse
gatctagagacggtagacag

SEQ ID NO: 462794 - DNA, 20 bp, mouse
ggccaagaggcatctagaga

SEQ ID NO: 462795 - DNA, 20 bp, mouse
gtgatcttacctgctctgga

SEQ ID NO: 462796 - DNA, 20 bp, mouse
ggagcccattaggaccccgg

SEQ ID NO: 462797 - DNA, 20 bp, mouse
gccgccgccggggtcctaat

SEQ ID NO: 462798 - DNA, 20 bp, mouse
gcggccggaaggagaccaaa

SEQ ID NO: 462799 - DNA, 20 bp, mouse
gtccgagcccattaggaccc

SEQ ID NO: 462800 - DNA, 20 bp, mouse
ggagctgccggtgaaggctg

SEQ ID NO: 462801 - DNA, 20 bp, mouse
gagctggaggaaggtcccga

SEQ ID NO: 462802 - DNA, 20 bp, mouse
gatgggctcggagcccggcc

SEQ ID NO: 462803 - DNA, 20 bp, mouse
gacgagcgccgacccggaag

SEQ ID NO: 462804 - DNA, 20 bp, mouse
gcggagctggacaatcactt

SEQ ID NO: 462805 - DNA, 20 bp, mouse
gcgagttcttccgccgggcc

SEQ ID NO: 462806 - DNA, 20 bp, mouse
gctcacccgcatggaagcag

SEQ ID NO: 462807 - DNA, 20 bp, mouse
gcgccaaccttccacgagaa

SEQ ID NO: 462808 - DNA, 20 bp, mouse
gtccgactgcaggacccagg

SEQ ID NO: 462809 - DNA, 20 bp, mouse
gcgccgttctcgtggaaggt

SEQ ID NO: 462810 - DNA, 20 bp, mouse
gttcgccgctgcttccatgc

SEQ ID NO: 462811 - DNA, 20 bp, mouse
ggtcaggccgagtgaggaag

SEQ ID NO: 462812 - DNA, 20 bp, mouse
ggctgcgaactcgcctaaga

SEQ ID NO: 462813 - DNA, 20 bp, mouse
gccgctgcgcgaggcgccca

SEQ ID NO: 462814 - DNA, 20 bp, mouse
gcagttgcgtgtaggggtag

SEQ ID NO: 462815 - DNA, 20 bp, mouse
gcggaggagggtaagaaagg

SEQ ID NO: 462816 - DNA, 20 bp, mouse
gatggcggctctgagaagtt

SEQ ID NO: 462817 - DNA, 20 bp, mouse
gtctcagagccgccatcccg

SEQ ID NO: 462818 - DNA, 20 bp, mouse
gtcggtccgccgcgggatgg

SEQ ID NO: 462819 - DNA, 20 bp, mouse
gcagagccgccatcccgcgg

SEQ ID NO: 462820 - DNA, 20 bp, mouse
ggcgtcggtccgccgcggga

SEQ ID NO: 462821 - DNA, 20 bp, mouse
gaggcgcccgtccctgatgg

SEQ ID NO: 462822 - DNA, 20 bp, mouse
gcgtccctgatggaggacga

SEQ ID NO: 462823 - DNA, 20 bp, mouse
gctcctcccacgcatcccgg

SEQ ID NO: 462824 - DNA, 20 bp, mouse
gcgtccctcgtcctccatca

SEQ ID NO: 462825 - DNA, 20 bp, mouse
gactcggccaccggcgacag

SEQ ID NO: 462826 - DNA, 20 bp, mouse
gggctaagaaggctgctggg

SEQ ID NO: 462827 - DNA, 20 bp, mouse
ggcgcgagcggcgtagacaa

SEQ ID NO: 462828 - DNA, 20 bp, mouse
ggccggctaagaaggctgct

SEQ ID NO: 462829 - DNA, 20 bp, mouse
ggcgcggcggccggctaaga

SEQ ID NO: 462830 - DNA, 20 bp, mouse
ggccaggctgaagagcaggg

SEQ ID NO: 462831 - DNA, 20 bp, mouse
gagggtcgcccgagtccaga

SEQ ID NO: 462832 - DNA, 20 bp, mouse
gggcggtggttgctggctcg

SEQ ID NO: 462833 - DNA, 20 bp, mouse
ggcaggcagacgcccccgga

SEQ ID NO: 462834 - DNA, 20 bp, mouse
ggtcgcccgagtccagaggg

SEQ ID NO: 462835 - DNA, 20 bp, mouse
gagcgagggaagctccaagg

SEQ ID NO: 462836 - DNA, 20 bp, mouse
gccgcgtccacggacagaga

SEQ ID NO: 462837 - DNA, 20 bp, mouse
gcagcgctgagtggtggcac

SEQ ID NO: 462838 - DNA, 20 bp, mouse
ggcctgggcttggggagacc

SEQ ID NO: 462839 - DNA, 20 bp, mouse
gtgggcttggggagacccgg

SEQ ID NO: 462840 - DNA, 20 bp, mouse
ggcgccgctcccaggccacc

SEQ ID NO: 462841 - DNA, 20 bp, mouse
gaagatggaggagctcgggg

SEQ ID NO: 462842 - DNA, 20 bp, mouse
ggtggcggcgaggaacacgg

SEQ ID NO: 462843 - DNA, 20 bp, mouse
gaaccgggccgccaacgaag

SEQ ID NO: 462844 - DNA, 20 bp, mouse
gtggggagacccggtggcct

SEQ ID NO: 462845 - DNA, 20 bp, mouse
gggctcccaggcgtgttcct

SEQ ID NO: 462846 - DNA, 20 bp, mouse
gtaggtcgcgacctgatctg

SEQ ID NO: 462847 - DNA, 20 bp, mouse
gcaggtcgcgacctagaccc

SEQ ID NO: 462848 - DNA, 20 bp, mouse
gtagacccgggaagatggag

SEQ ID NO: 462849 - DNA, 20 bp, mouse
gcggagcaaagccccagatc

SEQ ID NO: 462850 - DNA, 20 bp, mouse
ggcgcagtgggcgtgggacc

SEQ ID NO: 462851 - DNA, 20 bp, mouse
ggaccgggaagttgagcccg

SEQ ID NO: 462852 - DNA, 20 bp, mouse
gcgacctagacccgggaaga

SEQ ID NO: 462853 - DNA, 20 bp, mouse
ggttaatgcgcagtgggcgt

SEQ ID NO: 462854 - DNA, 20 bp, mouse
gctccgcgggctcaacttcc

SEQ ID NO: 462855 - DNA, 20 bp, mouse
gcaacgtgcggcgactcccg

SEQ ID NO: 462856 - DNA, 20 bp, mouse
gccgcggcgacggcgcacag

SEQ ID NO: 462857 - DNA, 20 bp, mouse
ggcggcttggagaatcccac

SEQ ID NO: 462858 - DNA, 20 bp, mouse
ggacagcgggaacgagacga

SEQ ID NO: 462859 - DNA, 20 bp, mouse
ggacggcgagcggcaggaaa

SEQ ID NO: 462860 - DNA, 20 bp, mouse
gaggccgcgacgccgagccc

SEQ ID NO: 462861 - DNA, 20 bp, mouse
gggaacgagacgacggcgag

SEQ ID NO: 462862 - DNA, 20 bp, mouse
gcgtcacagcccaggcctcc

SEQ ID NO: 462863 - DNA, 20 bp, mouse
ggaaccatcggaccccgctc

SEQ ID NO: 462864 - DNA, 20 bp, mouse
gcccgggcccggacacaaag

SEQ ID NO: 462865 - DNA, 20 bp, mouse
ggaatggagtaacctgacag

SEQ ID NO: 462866 - DNA, 20 bp, mouse
gaatggctgcgggatcccgg

SEQ ID NO: 462867 - DNA, 20 bp, mouse
ggcggcctaccactctagga

SEQ ID NO: 462868 - DNA, 20 bp, mouse
gggtctctgctctatatccg

SEQ ID NO: 462869 - DNA, 20 bp, mouse
gccgcgcggcctaccactct

SEQ ID NO: 462870 - DNA, 20 bp, mouse
gtctaggacggtagtctcgc

SEQ ID NO: 462871 - DNA, 20 bp, mouse
ggaagccgtgtggacccgaa

SEQ ID NO: 462872 - DNA, 20 bp, mouse
ggactctgtactgtgaagga

SEQ ID NO: 462873 - DNA, 20 bp, mouse
gagtacagagtcacttaccc

SEQ ID NO: 462874 - DNA, 20 bp, mouse
gactaccgtcctagagtggt

SEQ ID NO: 462875 - DNA, 20 bp, mouse
gccgggctgagggatcgcgg

SEQ ID NO: 462876 - DNA, 20 bp, mouse
gcccagccagggccgcgtaa

SEQ ID NO: 462877 - DNA, 20 bp, mouse
ggacagcgacaacttgccac

SEQ ID NO: 462878 - DNA, 20 bp, mouse
gagttgtcgctgtcgcacgt

SEQ ID NO: 462879 - DNA, 20 bp, mouse
gcaggacgggaaccccgctg

SEQ ID NO: 462880 - DNA, 20 bp, mouse
ggggcacgctggctttacgg

SEQ ID NO: 462881 - DNA, 20 bp, mouse
gttccggcgtttgcccatag

SEQ ID NO: 462882 - DNA, 20 bp, mouse
ggaccggacccggctcaact

SEQ ID NO: 462883 - DNA, 20 bp, mouse
gccggaaccagccctcccgg

SEQ ID NO: 462884 - DNA, 20 bp, mouse
gctgtcgcacgtgggcacgc

SEQ ID NO: 462885 - DNA, 20 bp, mouse
gggtccggtcggtgcaggac

SEQ ID NO: 462886 - DNA, 20 bp, mouse
gagaggcgcaggccaccgta

SEQ ID NO: 462887 - DNA, 20 bp, mouse
gtagtcgtgacggcgactga

SEQ ID NO: 462888 - DNA, 20 bp, mouse
gtagccgccccgaggagggt

SEQ ID NO: 462889 - DNA, 20 bp, mouse
gctcgggcgcctagtcgtga

SEQ ID NO: 462890 - DNA, 20 bp, mouse
gactgagggcgacttccacg

SEQ ID NO: 462891 - DNA, 20 bp, mouse
gtgagcgcccaccctcctcg

SEQ ID NO: 462892 - DNA, 20 bp, mouse
gcctctagccgccccgagga

SEQ ID NO: 462893 - DNA, 20 bp, mouse
ggcggggaagtgggcctctc

SEQ ID NO: 462894 - DNA, 20 bp, mouse
gccgcggcgggggagcccta

SEQ ID NO: 462895 - DNA, 20 bp, mouse
gcctgctggcaaggaagacc

SEQ ID NO: 462896 - DNA, 20 bp, mouse
gtctgccccgtgctgagatg

SEQ ID NO: 462897 - DNA, 20 bp, mouse
ggatggggctgccccagcta

SEQ ID NO: 462898 - DNA, 20 bp, mouse
ggcagccccatctcagcacg

SEQ ID NO: 462899 - DNA, 20 bp, mouse
ggctgccccagctatggctg

SEQ ID NO: 462900 - DNA, 20 bp, mouse
ggagcagctggagtgatgat

SEQ ID NO: 462901 - DNA, 20 bp, mouse
gagcctgcagactgaaggag

SEQ ID NO: 462902 - DNA, 20 bp, mouse
gcaggacaaaccagaagtac

SEQ ID NO: 462903 - DNA, 20 bp, mouse
gactggatgctgaagaaggt

SEQ ID NO: 462904 - DNA, 20 bp, mouse
ggttgtcaggggcgaatcgg

SEQ ID NO: 462905 - DNA, 20 bp, mouse
gcttcagccacagccatagc

SEQ ID NO: 462906 - DNA, 20 bp, mouse
gaccatctctgcagtctcat

SEQ ID NO: 462907 - DNA, 20 bp, mouse
gaactgtgctgtaagggtag

SEQ ID NO: 462908 - DNA, 20 bp, mouse
ggtcagagtccgttaaagac

SEQ ID NO: 462909 - DNA, 20 bp, mouse
gggtaaactggattagggac

SEQ ID NO: 462910 - DNA, 20 bp, mouse
gctttaacggactctgacag

SEQ ID NO: 462911 - DNA, 20 bp, mouse
ggggctgcagagcctgaacc

SEQ ID NO: 462912 - DNA, 20 bp, mouse
ggactctgacaggggtaaac

SEQ ID NO: 462913 - DNA, 20 bp, mouse
gtagaacttcctgtctttaa

SEQ ID NO: 462914 - DNA, 20 bp, mouse
gtgggtacactccaactgct

SEQ ID NO: 462915 - DNA, 20 bp, mouse
gtttcttaactgtgctgtaa

SEQ ID NO: 462916 - DNA, 20 bp, mouse
gcgccaggccgcctcgaggt

SEQ ID NO: 462917 - DNA, 20 bp, mouse
gagcagagagcggagcatgg

SEQ ID NO: 462918 - DNA, 20 bp, mouse
gcgggccccgaagcccccgg

SEQ ID NO: 462919 - DNA, 20 bp, mouse
gccgaccaccaacctcgagg

SEQ ID NO: 462920 - DNA, 20 bp, mouse
gtggtggtcggagaaggtga

SEQ ID NO: 462921 - DNA, 20 bp, mouse
gcgaggttggtggtcggaga

SEQ ID NO: 462922 - DNA, 20 bp, mouse
gcaggccgcctcgaggttgg

SEQ ID NO: 462923 - DNA, 20 bp, mouse
gagggtggtcaggatggcga

SEQ ID NO: 462924 - DNA, 20 bp, mouse
gagcagcagagagcggagca

SEQ ID NO: 462925 - DNA, 20 bp, mouse
gggcgctgggccaccctcat

SEQ ID NO: 462926 - DNA, 20 bp, mouse
gggccggggctgcttcgcag

SEQ ID NO: 462927 - DNA, 20 bp, mouse
ggaggtgctcgagagcctgg

SEQ ID NO: 462928 - DNA, 20 bp, mouse
gccggcgagcggcccagaca

SEQ ID NO: 462929 - DNA, 20 bp, mouse
gcgcctccagagggcatccg

SEQ ID NO: 462930 - DNA, 20 bp, mouse
ggaccgcggatgccctctgg

SEQ ID NO: 462931 - DNA, 20 bp, mouse
gaggctctcgagcacctcgg

SEQ ID NO: 462932 - DNA, 20 bp, mouse
gatccccgccggcctctcct

SEQ ID NO: 462933 - DNA, 20 bp, mouse
gaggcagtctgaggttccag

SEQ ID NO: 462934 - DNA, 20 bp, mouse
gtcaggcgttcccccaaccg

SEQ ID NO: 462935 - DNA, 20 bp, mouse
ggggtacccgcaggttccgg

SEQ ID NO: 462936 - DNA, 20 bp, mouse
gccatgaacaagtaccaaga

SEQ ID NO: 462937 - DNA, 20 bp, mouse
gtgggtcactcatcactatg

SEQ ID NO: 462938 - DNA, 20 bp, mouse
gtcactatgtggagccctct

SEQ ID NO: 462939 - DNA, 20 bp, mouse
gaggtgctgtgaactgactg

SEQ ID NO: 462940 - DNA, 20 bp, mouse
gggagctctacaagagaaga

SEQ ID NO: 462941 - DNA, 20 bp, mouse
gaggctgtgccgagcataca

SEQ ID NO: 462942 - DNA, 20 bp, mouse
gagaagtaaagtcttaagtg

SEQ ID NO: 462943 - DNA, 20 bp, mouse
ggtgccgagcatacatggaa

SEQ ID NO: 462944 - DNA, 20 bp, mouse
gctctgtcgctgtgacaact

SEQ ID NO: 462945 - DNA, 20 bp, mouse
gcatggttggctttcacaga

SEQ ID NO: 462946 - DNA, 20 bp, mouse
ggagcagctcgagagccctg

SEQ ID NO: 462947 - DNA, 20 bp, mouse
gaggcgctgaggagacgctg

SEQ ID NO: 462948 - DNA, 20 bp, mouse
gagcgcggccccgaccctgg

SEQ ID NO: 462949 - DNA, 20 bp, mouse
ggactgacgaggcactgagg

SEQ ID NO: 462950 - DNA, 20 bp, mouse
gccgctgaggagccctccgt

SEQ ID NO: 462951 - DNA, 20 bp, mouse
gcgcgcaccgggcaacaaga

SEQ ID NO: 462952 - DNA, 20 bp, mouse
gggagactgacgaggcactg

SEQ ID NO: 462953 - DNA, 20 bp, mouse
ggagactgacgaggctgagg

SEQ ID NO: 462954 - DNA, 20 bp, mouse
gacccggaggagccgcactg

SEQ ID NO: 462955 - DNA, 20 bp, mouse
ggacgctgaggaggctgacg

SEQ ID NO: 462956 - DNA, 20 bp, mouse
ggcagcggcggggaccacag

SEQ ID NO: 462957 - DNA, 20 bp, mouse
gccacagcggcccaggtagg

SEQ ID NO: 462958 - DNA, 20 bp, mouse
gggcgcggacagcagcgcag

SEQ ID NO: 462959 - DNA, 20 bp, mouse
gagccgcggccacagagggt

SEQ ID NO: 462960 - DNA, 20 bp, mouse
gcagcggcccaggtaggcgg

SEQ ID NO: 462961 - DNA, 20 bp, mouse
ggctgccccgccgcctacct

SEQ ID NO: 462962 - DNA, 20 bp, mouse
ggggcagccgcggccacaga

SEQ ID NO: 462963 - DNA, 20 bp, mouse
ggctctgcgtggtcaggtag

SEQ ID NO: 462964 - DNA, 20 bp, mouse
gcagctggggcggggacatc

SEQ ID NO: 462965 - DNA, 20 bp, mouse
gggtgtccatcagcaaccgg

SEQ ID NO: 462966 - DNA, 20 bp, mouse
ggagccagagagcaccgcgt

SEQ ID NO: 462967 - DNA, 20 bp, mouse
gagcggtgctggaggttgta

SEQ ID NO: 462968 - DNA, 20 bp, mouse
gcagagaggggcagcacagg

SEQ ID NO: 462969 - DNA, 20 bp, mouse
gctccagccgagagccgtgg

SEQ ID NO: 462970 - DNA, 20 bp, mouse
ggctgtgcagagagctcggg

SEQ ID NO: 462971 - DNA, 20 bp, mouse
ggagctcgggcgggtgcata

SEQ ID NO: 462972 - DNA, 20 bp, mouse
gcgcgtgggaggactgcaca

SEQ ID NO: 462973 - DNA, 20 bp, mouse
gcgggtgcataaggcagaga

SEQ ID NO: 462974 - DNA, 20 bp, mouse
gtgcgcgcagcgcgatgcgg

SEQ ID NO: 462975 - DNA, 20 bp, mouse
gggagcaggattactctctg

SEQ ID NO: 462976 - DNA, 20 bp, mouse
ggaccagccgggagctgact

SEQ ID NO: 462977 - DNA, 20 bp, mouse
gccgaggactagagcagctc

SEQ ID NO: 462978 - DNA, 20 bp, mouse
gcgcagcagacgcgcccggg

SEQ ID NO: 462979 - DNA, 20 bp, mouse
gagacgcgcccgggaggccg

SEQ ID NO: 462980 - DNA, 20 bp, mouse
gactagagcagctccggctc

SEQ ID NO: 462981 - DNA, 20 bp, mouse
ggctgactgggcgggtggag

SEQ ID NO: 462982 - DNA, 20 bp, mouse
gtgggagactggagcgaagt

SEQ ID NO: 462983 - DNA, 20 bp, mouse
gcgagccccggccccagcag

SEQ ID NO: 462984 - DNA, 20 bp, mouse
gaagcccgggaccctacgag

SEQ ID NO: 462985 - DNA, 20 bp, mouse
gtcctcccctcgggctcggg

SEQ ID NO: 462986 - DNA, 20 bp, mouse
ggccgtcagctaagaaaccg

SEQ ID NO: 462987 - DNA, 20 bp, mouse
ggcctcgcggcgtgggatcc

SEQ ID NO: 462988 - DNA, 20 bp, mouse
gtgtccggcagaaggtagtg

SEQ ID NO: 462989 - DNA, 20 bp, mouse
ggtagtgcggccacgggcag

SEQ ID NO: 462990 - DNA, 20 bp, mouse
gcagaaggtagtgcggccac

SEQ ID NO: 462991 - DNA, 20 bp, mouse
gactacctgcgggatgacat

SEQ ID NO: 462992 - DNA, 20 bp, mouse
ggccgcgaggcgagatgctc

SEQ ID NO: 462993 - DNA, 20 bp, mouse
gccagccagcgggcaaaagc

SEQ ID NO: 462994 - DNA, 20 bp, mouse
gggctgctcgcctggtcccg

SEQ ID NO: 462995 - DNA, 20 bp, mouse
gcagctaagaaaccgaggcg

SEQ ID NO: 462996 - DNA, 20 bp, mouse
ggcccgggcgggaagagcga

SEQ ID NO: 462997 - DNA, 20 bp, mouse
gaccgggagcgacctagcca

SEQ ID NO: 462998 - DNA, 20 bp, mouse
ggagccggagagggaagccg

SEQ ID NO: 462999 - DNA, 20 bp, mouse
gactgtggccgggaagcggc

SEQ ID NO: 463000 - DNA, 20 bp, mouse
gtgctgctgaggaccttcca

SEQ ID NO: 463001 - DNA, 20 bp, mouse
gcggcactgtggccgggaag

SEQ ID NO: 463002 - DNA, 20 bp, mouse
gctgcccgaccaggcccgag

SEQ ID NO: 463003 - DNA, 20 bp, mouse
ggcaggctcaggcgagaccg

SEQ ID NO: 463004 - DNA, 20 bp, mouse
ggcgcgagcgaagggacctg

SEQ ID NO: 463005 - DNA, 20 bp, mouse
ggccgggactcggagaacga

SEQ ID NO: 463006 - DNA, 20 bp, mouse
ggccggcctcccgggagcga

SEQ ID NO: 463007 - DNA, 20 bp, mouse
gcctcccgggagcgacggtg

SEQ ID NO: 463008 - DNA, 20 bp, mouse
ggtgcctccggagtgatgag

SEQ ID NO: 463009 - DNA, 20 bp, mouse
gcctagcaactgcgggtctg

SEQ ID NO: 463010 - DNA, 20 bp, mouse
ggagcctcaccgtcgctccc

SEQ ID NO: 463011 - DNA, 20 bp, mouse
ggagggaaggccaggccgga

SEQ ID NO: 463012 - DNA, 20 bp, mouse
ggcattctccctagcaactg

SEQ ID NO: 463013 - DNA, 20 bp, mouse
gacggccggggcgtgcgcag

SEQ ID NO: 463014 - DNA, 20 bp, mouse
ggccggcggaaggcgaccag

SEQ ID NO: 463015 - DNA, 20 bp, mouse
gtgcggcgccgccggcctcc

SEQ ID NO: 463016 - DNA, 20 bp, mouse
gcgcggaggcggcgggaaac

SEQ ID NO: 463017 - DNA, 20 bp, mouse
ggagaggaagcggcggtcct

SEQ ID NO: 463018 - DNA, 20 bp, mouse
gaggcggcgggaaacgggca

SEQ ID NO: 463019 - DNA, 20 bp, mouse
gcggacggcggtgactgtgg

SEQ ID NO: 463020 - DNA, 20 bp, mouse
gccccggacggcggtgactg

SEQ ID NO: 463021 - DNA, 20 bp, mouse
ggaggctggagaggaagcgg

SEQ ID NO: 463022 - DNA, 20 bp, mouse
gaagaagccagccctcggct

SEQ ID NO: 463023 - DNA, 20 bp, mouse
gcgaggggccgaggctggag

SEQ ID NO: 463024 - DNA, 20 bp, mouse
gcggccggctgcgccccgga

SEQ ID NO: 463025 - DNA, 20 bp, mouse
ggggcagggggccgagccga

SEQ ID NO: 463026 - DNA, 20 bp, mouse
gacgggcgtccgggacactg

SEQ ID NO: 463027 - DNA, 20 bp, mouse
gggccaggatccgcgagctc

SEQ ID NO: 463028 - DNA, 20 bp, mouse
gcgggagagcagggatctcg

SEQ ID NO: 463029 - DNA, 20 bp, mouse
gttgcagggagacgctccag

SEQ ID NO: 463030 - DNA, 20 bp, mouse
gctccggctggagcagagtt

SEQ ID NO: 463031 - DNA, 20 bp, mouse
gaggatccgcgagctccggc

SEQ ID NO: 463032 - DNA, 20 bp, mouse
ggaccgcggcccgcgccagg

SEQ ID NO: 463033 - DNA, 20 bp, mouse
gggacgcggacacaccccca

SEQ ID NO: 463034 - DNA, 20 bp, mouse
gagggatctcggggtgagga

SEQ ID NO: 463035 - DNA, 20 bp, mouse
ggttcggagcctcagtgtcc

SEQ ID NO: 463036 - DNA, 20 bp, mouse
gctgagggtagccacagcca

SEQ ID NO: 463037 - DNA, 20 bp, mouse
gtttaaaagaagaaacttca

SEQ ID NO: 463038 - DNA, 20 bp, mouse
ggtttggtctgcaaaagctg

SEQ ID NO: 463039 - DNA, 20 bp, mouse
gttgataagaacgataggta

SEQ ID NO: 463040 - DNA, 20 bp, mouse
gtccccaattcaggcagaga

SEQ ID NO: 463041 - DNA, 20 bp, mouse
gttgtaatgtggtgcagtag

SEQ ID NO: 463042 - DNA, 20 bp, mouse
gggccattgataagaacgat

SEQ ID NO: 463043 - DNA, 20 bp, mouse
ggcagtagtttccccaattc

SEQ ID NO: 463044 - DNA, 20 bp, mouse
gaccacattacaaattcaaa

SEQ ID NO: 463045 - DNA, 20 bp, mouse
gaccttctctgcctgaattg

SEQ ID NO: 463046 - DNA, 20 bp, mouse
gagcaccagagcccggacag

SEQ ID NO: 463047 - DNA, 20 bp, mouse
gggacagcggcgccgcccac

SEQ ID NO: 463048 - DNA, 20 bp, mouse
gtaccaccgtccatgcccgt

SEQ ID NO: 463049 - DNA, 20 bp, mouse
gtccagcaggatctacggag

SEQ ID NO: 463050 - DNA, 20 bp, mouse
gggcagctgccggaacaagt

SEQ ID NO: 463051 - DNA, 20 bp, mouse
gtggatgaggtgatatgtgg

SEQ ID NO: 463052 - DNA, 20 bp, mouse
gctgcttgcggttcagaaac

SEQ ID NO: 463053 - DNA, 20 bp, mouse
ggcggcgccgcccacgggca

SEQ ID NO: 463054 - DNA, 20 bp, mouse
gctgcttcagcaccagagcc

SEQ ID NO: 463055 - DNA, 20 bp, mouse
ggatcttccagcaggatcta

SEQ ID NO: 463056 - DNA, 20 bp, mouse
gggtctaggtttccagtaag

SEQ ID NO: 463057 - DNA, 20 bp, mouse
ggggactccagagagctccc

SEQ ID NO: 463058 - DNA, 20 bp, mouse
gtctcccgaagggaatcctg

SEQ ID NO: 463059 - DNA, 20 bp, mouse
gagtcccgcatgccacttac

SEQ ID NO: 463060 - DNA, 20 bp, mouse
gggaagggcaggcaggacta

SEQ ID NO: 463061 - DNA, 20 bp, mouse
gtagacccgagccaaactag

SEQ ID NO: 463062 - DNA, 20 bp, mouse
gagcctgggtggtagagtca

SEQ ID NO: 463063 - DNA, 20 bp, mouse
gccccacccgggaagccccg

SEQ ID NO: 463064 - DNA, 20 bp, mouse
gctgcaagagggcttcaatg

SEQ ID NO: 463065 - DNA, 20 bp, mouse
gggattcccttcgggagatt

SEQ ID NO: 463066 - DNA, 20 bp, mouse
gagaaggtaagaggttctgg

SEQ ID NO: 463067 - DNA, 20 bp, mouse
gcacgcggtgcagttcaaga

SEQ ID NO: 463068 - DNA, 20 bp, mouse
ggcggtgcagttcaagatgg

SEQ ID NO: 463069 - DNA, 20 bp, mouse
ggtcgtgtaggaggccccac

SEQ ID NO: 463070 - DNA, 20 bp, mouse
gaggtagagccagagccgag

SEQ ID NO: 463071 - DNA, 20 bp, mouse
gaggacaggacggggtacgg

SEQ ID NO: 463072 - DNA, 20 bp, mouse
ggcagtgccatgagacctgt

SEQ ID NO: 463073 - DNA, 20 bp, mouse
gggcggatgcagaaggtaag

SEQ ID NO: 463074 - DNA, 20 bp, mouse
gaactagctccgggtcgtgt

SEQ ID NO: 463075 - DNA, 20 bp, mouse
gctaggggcggtgcaacggt

SEQ ID NO: 463076 - DNA, 20 bp, mouse
gcagccagagactccaccag

SEQ ID NO: 463077 - DNA, 20 bp, mouse
ggctgggagcctgagtataa

SEQ ID NO: 463078 - DNA, 20 bp, mouse
gccagagactccaccagcgg

SEQ ID NO: 463079 - DNA, 20 bp, mouse
gggctgcagagtctggactg

SEQ ID NO: 463080 - DNA, 20 bp, mouse
gactggctcctagcagaggg

SEQ ID NO: 463081 - DNA, 20 bp, mouse
gagcggaggtcccgaagttg

SEQ ID NO: 463082 - DNA, 20 bp, mouse
ggactgcggaacctcaactt

SEQ ID NO: 463083 - DNA, 20 bp, mouse
ggagaggtcactttgcacgg

SEQ ID NO: 463084 - DNA, 20 bp, mouse
gacttcgggacctccgctgg

SEQ ID NO: 463085 - DNA, 20 bp, mouse
gatgagaactgagttcaagg

SEQ ID NO: 463086 - DNA, 20 bp, mouse
ggtggccccgtgtgaaccaa

SEQ ID NO: 463087 - DNA, 20 bp, mouse
gcttcgctggcagggcttag

SEQ ID NO: 463088 - DNA, 20 bp, mouse
ggagagctaaagcacaggag

SEQ ID NO: 463089 - DNA, 20 bp, mouse
gccagcaagcgcactcccac

SEQ ID NO: 463090 - DNA, 20 bp, mouse
ggcggttaggagttgtccct

SEQ ID NO: 463091 - DNA, 20 bp, mouse
gcactcccactggtgcggtt

SEQ ID NO: 463092 - DNA, 20 bp, mouse
gtaaaaagctaagagggcgg

SEQ ID NO: 463093 - DNA, 20 bp, mouse
gttgtcccttggttcacacg

SEQ ID NO: 463094 - DNA, 20 bp, mouse
ggaagcagtgatgcgctgcg

SEQ ID NO: 463095 - DNA, 20 bp, mouse
gcagcgcatcactgcttcgc

SEQ ID NO: 463096 - DNA, 20 bp, mouse
ggctttccgggacacacagg

SEQ ID NO: 463097 - DNA, 20 bp, mouse
gatagctttccgggacacac

SEQ ID NO: 463098 - DNA, 20 bp, mouse
gttccgggacacacaggcgg

SEQ ID NO: 463099 - DNA, 20 bp, mouse
gcaaacatgcagcggctcgg

SEQ ID NO: 463100 - DNA, 20 bp, mouse
ggcagtgccgtggaggaggt

SEQ ID NO: 463101 - DNA, 20 bp, mouse
gggagtccaagtgaccgtcg

SEQ ID NO: 463102 - DNA, 20 bp, mouse
gccaggctggagaggagtag

SEQ ID NO: 463103 - DNA, 20 bp, mouse
ggatgggaggaggatgaact

SEQ ID NO: 463104 - DNA, 20 bp, mouse
gggaggtgggtgcaccctga

SEQ ID NO: 463105 - DNA, 20 bp, mouse
gtcagagccaggcgccctca

SEQ ID NO: 463106 - DNA, 20 bp, mouse
ggagagactctgcccaagga

SEQ ID NO: 463107 - DNA, 20 bp, mouse
gcatttaacacaccttcctt

SEQ ID NO: 463108 - DNA, 20 bp, mouse
gatctgcaagtcgcccacag

SEQ ID NO: 463109 - DNA, 20 bp, mouse
gtttcagaaaaggcctctgt

SEQ ID NO: 463110 - DNA, 20 bp, mouse
gcgaaggctgcgctgctgag

SEQ ID NO: 463111 - DNA, 20 bp, mouse
gagagtatgctggtcagacc

SEQ ID NO: 463112 - DNA, 20 bp, mouse
gtccagaaccagggctgcca

SEQ ID NO: 463113 - DNA, 20 bp, mouse
gtgcgctgctgagtggccct

SEQ ID NO: 463114 - DNA, 20 bp, mouse
ggtaccccttgagtcttcga

SEQ ID NO: 463115 - DNA, 20 bp, mouse
ggcagccttcgaagactcaa

SEQ ID NO: 463116 - DNA, 20 bp, mouse
gctccggacaccgccggata

SEQ ID NO: 463117 - DNA, 20 bp, mouse
gtgaccgggtgtccagcaga

SEQ ID NO: 463118 - DNA, 20 bp, mouse
gccaggctcgagaccagaac

SEQ ID NO: 463119 - DNA, 20 bp, mouse
gaaggcgcgaatgaaggcaa

SEQ ID NO: 463120 - DNA, 20 bp, mouse
gattaactgtccgtatccgg

SEQ ID NO: 463121 - DNA, 20 bp, mouse
gaggctccgaccctaggtga

SEQ ID NO: 463122 - DNA, 20 bp, mouse
gacacccggtcacccggctc

SEQ ID NO: 463123 - DNA, 20 bp, mouse
gcgggtccctcacctagggt

SEQ ID NO: 463124 - DNA, 20 bp, mouse
gcagcagaaggcgcgaatga

SEQ ID NO: 463125 - DNA, 20 bp, mouse
ggcctggaaagagccgacaa

SEQ ID NO: 463126 - DNA, 20 bp, mouse
ggaggtcactccggagacgg

SEQ ID NO: 463127 - DNA, 20 bp, mouse
gggagaggtcactccggaga

SEQ ID NO: 463128 - DNA, 20 bp, mouse
gaccgacccccacgccccaa

SEQ ID NO: 463129 - DNA, 20 bp, mouse
ggctcttggagaggtcactc

SEQ ID NO: 463130 - DNA, 20 bp, mouse
ggagccctgaacccatccct

SEQ ID NO: 463131 - DNA, 20 bp, mouse
gcggagcctttggggcgtgg

SEQ ID NO: 463132 - DNA, 20 bp, mouse
ggctccagccgcacaaggag

SEQ ID NO: 463133 - DNA, 20 bp, mouse
gccaaaggctccgccgtctc

SEQ ID NO: 463134 - DNA, 20 bp, mouse
gcaaggagcggaccccatag

SEQ ID NO: 463135 - DNA, 20 bp, mouse
ggacctctccaagagcagcg

SEQ ID NO: 463136 - DNA, 20 bp, mouse
gcagcgaggacgcacagcca

SEQ ID NO: 463137 - DNA, 20 bp, mouse
gggacgcacagccatggctc

SEQ ID NO: 463138 - DNA, 20 bp, mouse
gagccgtggctccaacagcg

SEQ ID NO: 463139 - DNA, 20 bp, mouse
gtaggaaggcgcggccccta

SEQ ID NO: 463140 - DNA, 20 bp, mouse
gcccacgtcgggacccacgg

SEQ ID NO: 463141 - DNA, 20 bp, mouse
ggagcgcactgggaacgtcg

SEQ ID NO: 463142 - DNA, 20 bp, mouse
ggagcacttcagcgtttggg

SEQ ID NO: 463143 - DNA, 20 bp, mouse
ggtcctcgctgttggagcca

SEQ ID NO: 463144 - DNA, 20 bp, mouse
ggcagagcacttcagcgttt

SEQ ID NO: 463145 - DNA, 20 bp, mouse
gccagctcgggcaaaatcgt

SEQ ID NO: 463146 - DNA, 20 bp, mouse
ggtcccgtccctccaaccag

SEQ ID NO: 463147 - DNA, 20 bp, mouse
gagtcttaccaggcgttcag

SEQ ID NO: 463148 - DNA, 20 bp, mouse
gggaggtgaaaacccctggt

SEQ ID NO: 463149 - DNA, 20 bp, mouse
gcctcaccttggccaaggag

SEQ ID NO: 463150 - DNA, 20 bp, mouse
gcttaccaggcgttcagcgg

SEQ ID NO: 463151 - DNA, 20 bp, mouse
ggttggagggacgggaccga

SEQ ID NO: 463152 - DNA, 20 bp, mouse
ggtgaaaacccctggttgga

SEQ ID NO: 463153 - DNA, 20 bp, mouse
ggcgcagggtggggagacct

SEQ ID NO: 463154 - DNA, 20 bp, mouse
gaacccctggttggagggac

SEQ ID NO: 463155 - DNA, 20 bp, mouse
gggctcggtgcggcctcccg

SEQ ID NO: 463156 - DNA, 20 bp, mouse
ggtctccaaggacgacataa

SEQ ID NO: 463157 - DNA, 20 bp, mouse
gtccttgctctcggaatcca

SEQ ID NO: 463158 - DNA, 20 bp, mouse
ggcggagccggaagaagaag

SEQ ID NO: 463159 - DNA, 20 bp, mouse
ggccatggattccgagagca

SEQ ID NO: 463160 - DNA, 20 bp, mouse
gctgcggctccgggagtgga

SEQ ID NO: 463161 - DNA, 20 bp, mouse
gcagagacgctgcagactcc

SEQ ID NO: 463162 - DNA, 20 bp, mouse
ggacaaaaactgggtctcca

SEQ ID NO: 463163 - DNA, 20 bp, mouse
gaaggacgacataacggccg

SEQ ID NO: 463164 - DNA, 20 bp, mouse
gcagcaatgcacagcttcct

SEQ ID NO: 463165 - DNA, 20 bp, mouse
gggcgtagacgcagcgtctg

SEQ ID NO: 463166 - DNA, 20 bp, mouse
gctgcagagccaccatttgg

SEQ ID NO: 463167 - DNA, 20 bp, mouse
ggccagccctgcgcccttag

SEQ ID NO: 463168 - DNA, 20 bp, mouse
gggtctgcagagccaccatt

SEQ ID NO: 463169 - DNA, 20 bp, mouse
gcccagctgctagccggcta

SEQ ID NO: 463170 - DNA, 20 bp, mouse
gcagctgggcgctgacgagc

SEQ ID NO: 463171 - DNA, 20 bp, mouse
gccagctgcggacccggagg

SEQ ID NO: 463172 - DNA, 20 bp, mouse
gctgggcgctgacgagcagg

SEQ ID NO: 463173 - DNA, 20 bp, mouse
ggcaggtggagcgcaggcaa

SEQ ID NO: 463174 - DNA, 20 bp, mouse
gggaagccactaagggcgca

SEQ ID NO: 463175 - DNA, 20 bp, mouse
gtcagcgcccagctgctagc

SEQ ID NO: 463176 - DNA, 20 bp, mouse
gagctccagggccgccatct

SEQ ID NO: 463177 - DNA, 20 bp, mouse
gttagggggagagcgactgg

SEQ ID NO: 463178 - DNA, 20 bp, mouse
ggaaggaggcgaggttccgg

SEQ ID NO: 463179 - DNA, 20 bp, mouse
gatcttggcggaaagtttag

SEQ ID NO: 463180 - DNA, 20 bp, mouse
gtcggggaaagcagtcacgt

SEQ ID NO: 463181 - DNA, 20 bp, mouse
gtccggccggagcgcacccg

SEQ ID NO: 463182 - DNA, 20 bp, mouse
ggcggaaagcgagttctcgg

SEQ ID NO: 463183 - DNA, 20 bp, mouse
gcgccgggaggagacgaacg

SEQ ID NO: 463184 - DNA, 20 bp, mouse
ggctcatgcacccccctccg

SEQ ID NO: 463185 - DNA, 20 bp, mouse
gcgactgggggcgcggaagg

SEQ ID NO: 463186 - DNA, 20 bp, mouse
ggccccacacacacgatcct

SEQ ID NO: 463187 - DNA, 20 bp, mouse
ggcccaggatcgtgtgtgtg

SEQ ID NO: 463188 - DNA, 20 bp, mouse
gctttcggatgctgaatcct

SEQ ID NO: 463189 - DNA, 20 bp, mouse
gcaactgaggttctaacttt

SEQ ID NO: 463190 - DNA, 20 bp, mouse
ggccagcaacaagaaaccag

SEQ ID NO: 463191 - DNA, 20 bp, mouse
gtcctgggcatgtgctgcta

SEQ ID NO: 463192 - DNA, 20 bp, mouse
gggagcgagtcagaacgctg

SEQ ID NO: 463193 - DNA, 20 bp, mouse
ggttctgactcgctccccca

SEQ ID NO: 463194 - DNA, 20 bp, mouse
gtccttagcagcacatgccc

SEQ ID NO: 463195 - DNA, 20 bp, mouse
gagggagcgagacggccact

SEQ ID NO: 463196 - DNA, 20 bp, mouse
gtggcgctcagtcggagtcc

SEQ ID NO: 463197 - DNA, 20 bp, mouse
ggcagtcgaggaagccaagg

SEQ ID NO: 463198 - DNA, 20 bp, mouse
ggtcgaggaagccaaggtgg

SEQ ID NO: 463199 - DNA, 20 bp, mouse
gcagagggaccggccggagc

SEQ ID NO: 463200 - DNA, 20 bp, mouse
gtgtcccgcgcgggagacca

SEQ ID NO: 463201 - DNA, 20 bp, mouse
ggcgggacagagggaccggc

SEQ ID NO: 463202 - DNA, 20 bp, mouse
gtccgactgagcgccaggtg

SEQ ID NO: 463203 - DNA, 20 bp, mouse
gctttctcgacaactagacc

SEQ ID NO: 463204 - DNA, 20 bp, mouse
gactgagcgccaggtgaggt

SEQ ID NO: 463205 - DNA, 20 bp, mouse
gctagttgtcgagaaagcgc

SEQ ID NO: 463206 - DNA, 20 bp, mouse
ggaatcgggcgcccaggcaa

SEQ ID NO: 463207 - DNA, 20 bp, mouse
gtccccaggatggatctgag

SEQ ID NO: 463208 - DNA, 20 bp, mouse
ggggcgcccaggcaaaggct

SEQ ID NO: 463209 - DNA, 20 bp, mouse
gctggggacctgagcagaag

SEQ ID NO: 463210 - DNA, 20 bp, mouse
gtccactcagatccatcctg

SEQ ID NO: 463211 - DNA, 20 bp, mouse
gagtgtgctagggagcccgg

SEQ ID NO: 463212 - DNA, 20 bp, mouse
gcccagcggcaaagaagaat

SEQ ID NO: 463213 - DNA, 20 bp, mouse
gaaagaagaatcgggcgccc

SEQ ID NO: 463214 - DNA, 20 bp, mouse
gcttctgggccgaggcccag

SEQ ID NO: 463215 - DNA, 20 bp, mouse
gctcggcccagaagccacaa

SEQ ID NO: 463216 - DNA, 20 bp, mouse
ggcggagccgaggagggaag

SEQ ID NO: 463217 - DNA, 20 bp, mouse
gtgtagccgcggagccgagg

SEQ ID NO: 463218 - DNA, 20 bp, mouse
ggcagcggccgatgtagccg

SEQ ID NO: 463219 - DNA, 20 bp, mouse
gcgatgtagccgcggagccg

SEQ ID NO: 463220 - DNA, 20 bp, mouse
gtggcagccccggagttctg

SEQ ID NO: 463221 - DNA, 20 bp, mouse
gcgattctcaggaggggtag

SEQ ID NO: 463222 - DNA, 20 bp, mouse
gcaggggctaggggccgtgg

SEQ ID NO: 463223 - DNA, 20 bp, mouse
gaaggggctccccagtggag

SEQ ID NO: 463224 - DNA, 20 bp, mouse
gccccagccccagaactccg

SEQ ID NO: 463225 - DNA, 20 bp, mouse
gacaccccgattctcaggag

SEQ ID NO: 463226 - DNA, 20 bp, mouse
gctgcggccagggaaagggg

SEQ ID NO: 463227 - DNA, 20 bp, mouse
gggtatgggtgggatagcaa

SEQ ID NO: 463228 - DNA, 20 bp, mouse
gtagcaagggtgctgggttg

SEQ ID NO: 463229 - DNA, 20 bp, mouse
ggaggctgcggccagggaaa

SEQ ID NO: 463230 - DNA, 20 bp, mouse
gcgacaggaggctgcggcca

SEQ ID NO: 463231 - DNA, 20 bp, mouse
gagaccccacgccaagctga

SEQ ID NO: 463232 - DNA, 20 bp, mouse
gtacgggagagcgtcatgat

SEQ ID NO: 463233 - DNA, 20 bp, mouse
gggcggcgcctgcgcagtac

SEQ ID NO: 463234 - DNA, 20 bp, mouse
gtgaagctcttgagattgag

SEQ ID NO: 463235 - DNA, 20 bp, mouse
gtccgagtcgacatgaagaa

SEQ ID NO: 463236 - DNA, 20 bp, mouse
gcctcggggccgggacgatc

SEQ ID NO: 463237 - DNA, 20 bp, mouse
gacgatcgggcagctctcaa

SEQ ID NO: 463238 - DNA, 20 bp, mouse
ggccgccgccgtagccaaca

SEQ ID NO: 463239 - DNA, 20 bp, mouse
gcggcgctgcggctccatgg

SEQ ID NO: 463240 - DNA, 20 bp, mouse
ggccatgttggctacggcgg

SEQ ID NO: 463241 - DNA, 20 bp, mouse
gagccaacatggctgcgccc

SEQ ID NO: 463242 - DNA, 20 bp, mouse
ggcagccatgttggctacgg

SEQ ID NO: 463243 - DNA, 20 bp, mouse
ggcgaggcggcggggcccat

SEQ ID NO: 463244 - DNA, 20 bp, mouse
gggctgcacgccgaactggg

SEQ ID NO: 463245 - DNA, 20 bp, mouse
ggcccaggccatgaccgagg

SEQ ID NO: 463246 - DNA, 20 bp, mouse
ggcagcgctcgcctctggag

SEQ ID NO: 463247 - DNA, 20 bp, mouse
gcgccgcaagcccgaggacg

SEQ ID NO: 463248 - DNA, 20 bp, mouse
gttcgggcgccgcaagcccg

SEQ ID NO: 463249 - DNA, 20 bp, mouse
gtcctcgctccgaggctcgt

SEQ ID NO: 463250 - DNA, 20 bp, mouse
gtcctgccgctccccgccgg

SEQ ID NO: 463251 - DNA, 20 bp, mouse
ggctgcgaggccgcgtcctc

SEQ ID NO: 463252 - DNA, 20 bp, mouse
gagaggcgagcgctgcgctt

SEQ ID NO: 463253 - DNA, 20 bp, mouse
gcggtcctgccgctccccgc

SEQ ID NO: 463254 - DNA, 20 bp, mouse
ggcagcgacggacagactgc

SEQ ID NO: 463255 - DNA, 20 bp, mouse
gcgtgggacggactgacaga

SEQ ID NO: 463256 - DNA, 20 bp, mouse
gctgtcacagcagtgaggaa

SEQ ID NO: 463257 - DNA, 20 bp, mouse
gcccaggagcaggagtgtca

SEQ ID NO: 463258 - DNA, 20 bp, mouse
ggcacctgccagccataatg

SEQ ID NO: 463259 - DNA, 20 bp, mouse
gctgccagccataatgggga

SEQ ID NO: 463260 - DNA, 20 bp, mouse
gctggcaaatggacaaacac

SEQ ID NO: 463261 - DNA, 20 bp, mouse
gcaaatggacaaacacagga

SEQ ID NO: 463262 - DNA, 20 bp, mouse
ggagccaaggtggtcagtaa

SEQ ID NO: 463263 - DNA, 20 bp, mouse
ggccataatggggacggctc

SEQ ID NO: 463264 - DNA, 20 bp, mouse
gacctgagccgtccccatta

SEQ ID NO: 463265 - DNA, 20 bp, mouse
gtcagccggtcaagggacct

SEQ ID NO: 463266 - DNA, 20 bp, mouse
ggaggcaccggcgcactggg

SEQ ID NO: 463267 - DNA, 20 bp, mouse
gctcagatggagccacgcac

SEQ ID NO: 463268 - DNA, 20 bp, mouse
gcagcccggaaggaccccag

SEQ ID NO: 463269 - DNA, 20 bp, mouse
gtcggcgcccggggaggcac

SEQ ID NO: 463270 - DNA, 20 bp, mouse
gtggaggcgataagcggtag

SEQ ID NO: 463271 - DNA, 20 bp, mouse
gggcgcacggtcggtcctca

SEQ ID NO: 463272 - DNA, 20 bp, mouse
gcggtggtggaggcgataag

SEQ ID NO: 463273 - DNA, 20 bp, mouse
ggcgcaccgcctggcctgag

SEQ ID NO: 463274 - DNA, 20 bp, mouse
gcccaagctcgagaatcctt

SEQ ID NO: 463275 - DNA, 20 bp, mouse
gcagtgggtgcagagcgaca

SEQ ID NO: 463276 - DNA, 20 bp, mouse
ggccccgagcgagtgctgag

SEQ ID NO: 463277 - DNA, 20 bp, mouse
gggaggggccgcgccagctg

SEQ ID NO: 463278 - DNA, 20 bp, mouse
gggaggcggccaagccacgg

SEQ ID NO: 463279 - DNA, 20 bp, mouse
ggacactgcggagcccccgg

SEQ ID NO: 463280 - DNA, 20 bp, mouse
gtgcggagcccccggcggag

SEQ ID NO: 463281 - DNA, 20 bp, mouse
ggccggaggcggccaagcca

SEQ ID NO: 463282 - DNA, 20 bp, mouse
ggctcccggacccgacactg

SEQ ID NO: 463283 - DNA, 20 bp, mouse
gcccggggaccaggacgggg

SEQ ID NO: 463284 - DNA, 20 bp, mouse
gccgggaaatccagcctccg

SEQ ID NO: 463285 - DNA, 20 bp, mouse
gcggctgcgggagcgagtgc

SEQ ID NO: 463286 - DNA, 20 bp, mouse
gccagtccagagctcagtat

SEQ ID NO: 463287 - DNA, 20 bp, mouse
gccactcccatactgagctc

SEQ ID NO: 463288 - DNA, 20 bp, mouse
ggcagggctgatgtagacat

SEQ ID NO: 463289 - DNA, 20 bp, mouse
gaagggacagaatgggccca

SEQ ID NO: 463290 - DNA, 20 bp, mouse
gctggaaggaagaagaaccc

SEQ ID NO: 463291 - DNA, 20 bp, mouse
gttacacacaggaagaggag

SEQ ID NO: 463292 - DNA, 20 bp, mouse
gggcacggaggcagaagact

SEQ ID NO: 463293 - DNA, 20 bp, mouse
gaaagtatcttgttaacaaa

SEQ ID NO: 463294 - DNA, 20 bp, mouse
gagctcccatctggactggg

SEQ ID NO: 463295 - DNA, 20 bp, mouse
gtcctccccccagtccagat

SEQ ID NO: 463296 - DNA, 20 bp, mouse
gggagtgacggatggactgg

SEQ ID NO: 463297 - DNA, 20 bp, mouse
gctcgggccgggccgcgtga

SEQ ID NO: 463298 - DNA, 20 bp, mouse
gacggacagacgggaagacg

SEQ ID NO: 463299 - DNA, 20 bp, mouse
gcgtgggtcggacagacgga

SEQ ID NO: 463300 - DNA, 20 bp, mouse
gggcagctgcggccagcggc

SEQ ID NO: 463301 - DNA, 20 bp, mouse
gacgacgtgggtcggacaga

SEQ ID NO: 463302 - DNA, 20 bp, mouse
gcagtggcccgacagaagga

SEQ ID NO: 463303 - DNA, 20 bp, mouse
gcctctcgggcgtacaaaac

SEQ ID NO: 463304 - DNA, 20 bp, mouse
gcggcggcgacgacgtgggt

SEQ ID NO: 463305 - DNA, 20 bp, mouse
gcgtggctgtaagagaggag

SEQ ID NO: 463306 - DNA, 20 bp, mouse
gagttccttctgcggatcgg

SEQ ID NO: 463307 - DNA, 20 bp, mouse
ggatccgcagaaggaactcc

SEQ ID NO: 463308 - DNA, 20 bp, mouse
gcttcccagcatcccacgta

SEQ ID NO: 463309 - DNA, 20 bp, mouse
gggtccgggagttccttctg

SEQ ID NO: 463310 - DNA, 20 bp, mouse
gagctggtatgcagccacgg

SEQ ID NO: 463311 - DNA, 20 bp, mouse
gttccgtgaagggtcggtcc

SEQ ID NO: 463312 - DNA, 20 bp, mouse
gctcccggaccgacccttca

SEQ ID NO: 463313 - DNA, 20 bp, mouse
gctgtgttgcgacattgttg

SEQ ID NO: 463314 - DNA, 20 bp, mouse
gtcgagctggtatgcagcca

SEQ ID NO: 463315 - DNA, 20 bp, mouse
gaccagctcgagaatggcct

SEQ ID NO: 463316 - DNA, 20 bp, mouse
gtggttgcggaccacgaagg

SEQ ID NO: 463317 - DNA, 20 bp, mouse
ggggcgcacgctgctaagtg

SEQ ID NO: 463318 - DNA, 20 bp, mouse
ggaaagccagggttgcaccg

SEQ ID NO: 463319 - DNA, 20 bp, mouse
gggccgcagcggcagctcct

SEQ ID NO: 463320 - DNA, 20 bp, mouse
gcggaccacgaagggggcac

SEQ ID NO: 463321 - DNA, 20 bp, mouse
gcaagccaaaccgccagggg

SEQ ID NO: 463322 - DNA, 20 bp, mouse
ggtccagcgggaagaaagcc

SEQ ID NO: 463323 - DNA, 20 bp, mouse
ggtgcgccccggtgcaaccc

SEQ ID NO: 463324 - DNA, 20 bp, mouse
ggccagggggggctcaccat

SEQ ID NO: 463325 - DNA, 20 bp, mouse
gctttcggccacagcaccta

SEQ ID NO: 463326 - DNA, 20 bp, mouse
gctgcaagccggggaggcgt

SEQ ID NO: 463327 - DNA, 20 bp, mouse
gcacgatgcgcggtagacag

SEQ ID NO: 463328 - DNA, 20 bp, mouse
gggcgtgggctggtgacagg

SEQ ID NO: 463329 - DNA, 20 bp, mouse
gagtgtgctcgggctaaaac

SEQ ID NO: 463330 - DNA, 20 bp, mouse
gaggaaggtggcagcaagca

SEQ ID NO: 463331 - DNA, 20 bp, mouse
gaaaacaggagagccgggaa

SEQ ID NO: 463332 - DNA, 20 bp, mouse
gaaggctctgcaagccgggg

SEQ ID NO: 463333 - DNA, 20 bp, mouse
gggaggcgtgggctggtgac

SEQ ID NO: 463334 - DNA, 20 bp, mouse
gtgcaggcgaccccgagcgg

SEQ ID NO: 463335 - DNA, 20 bp, mouse
ggcatggcttcagtgtgctc

SEQ ID NO: 463336 - DNA, 20 bp, mouse
gtcacgggagagcaccggtg

SEQ ID NO: 463337 - DNA, 20 bp, mouse
gacgccgggccgggaaacca

SEQ ID NO: 463338 - DNA, 20 bp, mouse
ggtctgaccagggcaggtca

SEQ ID NO: 463339 - DNA, 20 bp, mouse
ggcaggtcacgggagagcac

SEQ ID NO: 463340 - DNA, 20 bp, mouse
gcggttaccctgtctgacca

SEQ ID NO: 463341 - DNA, 20 bp, mouse
gggaccggaggccgaagcgt

SEQ ID NO: 463342 - DNA, 20 bp, mouse
gaacactctgggagcggcag

SEQ ID NO: 463343 - DNA, 20 bp, mouse
gccggaggccgaagcgtggg

SEQ ID NO: 463344 - DNA, 20 bp, mouse
gccccggcaagagctctacg

SEQ ID NO: 463345 - DNA, 20 bp, mouse
gaacacacaccgaggaccgg

SEQ ID NO: 463346 - DNA, 20 bp, mouse
gggatcagcgtctgggaaag

SEQ ID NO: 463347 - DNA, 20 bp, mouse
gaaagccaggatcagcgtct

SEQ ID NO: 463348 - DNA, 20 bp, mouse
ggagcaccccggagagtcag

SEQ ID NO: 463349 - DNA, 20 bp, mouse
gtgctttgggggacaggatg

SEQ ID NO: 463350 - DNA, 20 bp, mouse
ggtacgaggccatcaggcag

SEQ ID NO: 463351 - DNA, 20 bp, mouse
gtgcagagagaccattgctt

SEQ ID NO: 463352 - DNA, 20 bp, mouse
gggtcttagagactttcatg

SEQ ID NO: 463353 - DNA, 20 bp, mouse
gaggccatcaggcagcggca

SEQ ID NO: 463354 - DNA, 20 bp, mouse
gaggatggggaaatagtctc

SEQ ID NO: 463355 - DNA, 20 bp, mouse
gcctttctgtatctgacctg

SEQ ID NO: 463356 - DNA, 20 bp, mouse
gcctgcgcgcccggctacat

SEQ ID NO: 463357 - DNA, 20 bp, mouse
gagttcgctgtgcgcccgga

SEQ ID NO: 463358 - DNA, 20 bp, mouse
gcaccgcgtccgcgccgtcc

SEQ ID NO: 463359 - DNA, 20 bp, mouse
gatcctggccaggacctcgg

SEQ ID NO: 463360 - DNA, 20 bp, mouse
ggctgtgcgcccggacggcg

SEQ ID NO: 463361 - DNA, 20 bp, mouse
ggtgtggaccgaaggctccc

SEQ ID NO: 463362 - DNA, 20 bp, mouse
gaggtcctggccaggatacc

SEQ ID NO: 463363 - DNA, 20 bp, mouse
gcgcccggacggcgcggacg

SEQ ID NO: 463364 - DNA, 20 bp, mouse
gggctagggctagaacacct

SEQ ID NO: 463365 - DNA, 20 bp, mouse
gccgggagcgtgtggaccga

SEQ ID NO: 463366 - DNA, 20 bp, mouse
gctcgcaggctaggaacccg

SEQ ID NO: 463367 - DNA, 20 bp, mouse
ggctgcagccaaagtcactt

SEQ ID NO: 463368 - DNA, 20 bp, mouse
gtgtcctggagcaaatccta

SEQ ID NO: 463369 - DNA, 20 bp, mouse
ggtctcgagcgggctagtga

SEQ ID NO: 463370 - DNA, 20 bp, mouse
gagcaagcaggtttcagtag

SEQ ID NO: 463371 - DNA, 20 bp, mouse
gagccactagaggcctggag

SEQ ID NO: 463372 - DNA, 20 bp, mouse
gaagggagcagcgtcccgag

SEQ ID NO: 463373 - DNA, 20 bp, mouse
gagtggagaggacaccccaa

SEQ ID NO: 463374 - DNA, 20 bp, mouse
gcactgcacccaagtgactt

SEQ ID NO: 463375 - DNA, 20 bp, mouse
gcagattcggagtcccggag

SEQ ID NO: 463376 - DNA, 20 bp, mouse
ggaccgggacagcatcgcgg

SEQ ID NO: 463377 - DNA, 20 bp, mouse
gcgtgaccgggacagcatcg

SEQ ID NO: 463378 - DNA, 20 bp, mouse
gctggaaggcagaaagcgag

SEQ ID NO: 463379 - DNA, 20 bp, mouse
gcgggacacgcagcgtgacc

SEQ ID NO: 463380 - DNA, 20 bp, mouse
gagcgagcggctgaacgccc

SEQ ID NO: 463381 - DNA, 20 bp, mouse
gccagacagtaccttctgga

SEQ ID NO: 463382 - DNA, 20 bp, mouse
gggagaggacaggggctccg

SEQ ID NO: 463383 - DNA, 20 bp, mouse
gtgctgccgggccctgtatc

SEQ ID NO: 463384 - DNA, 20 bp, mouse
gtggccaggccggccaccaa

SEQ ID NO: 463385 - DNA, 20 bp, mouse
ggacagcatcgcggaggcag

SEQ ID NO: 463386 - DNA, 20 bp, mouse
gcccaatttaagcggaacag

SEQ ID NO: 463387 - DNA, 20 bp, mouse
gagtagtgcccgtgggacat

SEQ ID NO: 463388 - DNA, 20 bp, mouse
gagcaagcccctgggaacgg

SEQ ID NO: 463389 - DNA, 20 bp, mouse
gccgcggccggactctggag

SEQ ID NO: 463390 - DNA, 20 bp, mouse
ggcgcactgggcgacaaccc

SEQ ID NO: 463391 - DNA, 20 bp, mouse
ggctgaccgagttgacgtag

SEQ ID NO: 463392 - DNA, 20 bp, mouse
gactgcacggaactgatgta

SEQ ID NO: 463393 - DNA, 20 bp, mouse
gccgttgccaccgttcccag

SEQ ID NO: 463394 - DNA, 20 bp, mouse
gagacgctcagaaggaccgc

SEQ ID NO: 463395 - DNA, 20 bp, mouse
gccgaactgtaggcaccgtc

SEQ ID NO: 463396 - DNA, 20 bp, mouse
gcaatcgtaaagctgctcgg

SEQ ID NO: 463397 - DNA, 20 bp, mouse
gagagcggtcagacccggta

SEQ ID NO: 463398 - DNA, 20 bp, mouse
gcggtaggggctccaggagg

SEQ ID NO: 463399 - DNA, 20 bp, mouse
ggacccggagagatagacag

SEQ ID NO: 463400 - DNA, 20 bp, mouse
gtgccgggcaggctcctgca

SEQ ID NO: 463401 - DNA, 20 bp, mouse
gcggtgatcgcctcctccag

SEQ ID NO: 463402 - DNA, 20 bp, mouse
gcggggggcgggcaatggag

SEQ ID NO: 463403 - DNA, 20 bp, mouse
gtaggcgcctcctcccctgg

SEQ ID NO: 463404 - DNA, 20 bp, mouse
ggagaggaaaacaagaaatg

SEQ ID NO: 463405 - DNA, 20 bp, mouse
gaggtccgagaggcccggga

SEQ ID NO: 463406 - DNA, 20 bp, mouse
gtggcttgggacgcggagag

SEQ ID NO: 463407 - DNA, 20 bp, mouse
gagctggcagcatttgactg

SEQ ID NO: 463408 - DNA, 20 bp, mouse
gagagggcgagggcaggacg

SEQ ID NO: 463409 - DNA, 20 bp, mouse
ggcagcgactgaccgacagc

SEQ ID NO: 463410 - DNA, 20 bp, mouse
gcgagctggagatgtcggtg

SEQ ID NO: 463411 - DNA, 20 bp, mouse
gactgaccgacagccggcga

SEQ ID NO: 463412 - DNA, 20 bp, mouse
gcggcgctcgccagcatgag

SEQ ID NO: 463413 - DNA, 20 bp, mouse
ggtgtgtgtccagagggcga

SEQ ID NO: 463414 - DNA, 20 bp, mouse
gggggcgcttagaccatcgc

SEQ ID NO: 463415 - DNA, 20 bp, mouse
gttagaccatcgccggctgt

SEQ ID NO: 463416 - DNA, 20 bp, mouse
gccgccgagcgcccagagcc

SEQ ID NO: 463417 - DNA, 20 bp, mouse
ggggtggtgaggcgcagtgg

SEQ ID NO: 463418 - DNA, 20 bp, mouse
gcgctgccagggctctgcga

SEQ ID NO: 463419 - DNA, 20 bp, mouse
gtgggggtggtgaggcgcag

SEQ ID NO: 463420 - DNA, 20 bp, mouse
ggtcgcggcgtgccaggctc

SEQ ID NO: 463421 - DNA, 20 bp, mouse
gaggtccgggaagacaacgt

SEQ ID NO: 463422 - DNA, 20 bp, mouse
gcgtgcaccgggaaacggga

SEQ ID NO: 463423 - DNA, 20 bp, mouse
ggaggcaccacggtcaggaa

SEQ ID NO: 463424 - DNA, 20 bp, mouse
gtcccgggaaccgaacccag

SEQ ID NO: 463425 - DNA, 20 bp, mouse
gtggtgaggcgcagtggcgg

SEQ ID NO: 463426 - DNA, 20 bp, mouse
gaggaggctgggagtcgtgg

SEQ ID NO: 463427 - DNA, 20 bp, mouse
ggacatggctgtgggagcga

SEQ ID NO: 463428 - DNA, 20 bp, mouse
gaccgcccgggagctatgac

SEQ ID NO: 463429 - DNA, 20 bp, mouse
gtcctgtcatagctcccggg

SEQ ID NO: 463430 - DNA, 20 bp, mouse
gtcagccagcagtcagcctg

SEQ ID NO: 463431 - DNA, 20 bp, mouse
ggagtcccaagcatccgatc

SEQ ID NO: 463432 - DNA, 20 bp, mouse
gtgccataagaagcagaggt

SEQ ID NO: 463433 - DNA, 20 bp, mouse
gtggcggcggacgtcgggaa

SEQ ID NO: 463434 - DNA, 20 bp, mouse
gtctcccgcaggctgactgc

SEQ ID NO: 463435 - DNA, 20 bp, mouse
gctgtagtagtcagaatcgg

SEQ ID NO: 463436 - DNA, 20 bp, mouse
gagcggtgcgagccaagtgg

SEQ ID NO: 463437 - DNA, 20 bp, mouse
gaggatcccgggagctaagg

SEQ ID NO: 463438 - DNA, 20 bp, mouse
ggcccccaaaaatccaaggg

SEQ ID NO: 463439 - DNA, 20 bp, mouse
gtccccccttggatttttgg

SEQ ID NO: 463440 - DNA, 20 bp, mouse
gtatatattagagaagagtg

SEQ ID NO: 463441 - DNA, 20 bp, mouse
gtaaagcagagattttaagg

SEQ ID NO: 463442 - DNA, 20 bp, mouse
gctgcgagtggctcatgtag

SEQ ID NO: 463443 - DNA, 20 bp, mouse
ggagtggctcatgtaggggt

SEQ ID NO: 463444 - DNA, 20 bp, mouse
gaccagcccccaaaaatcca

SEQ ID NO: 463445 - DNA, 20 bp, mouse
gtccaaggggggaaaagcaa

SEQ ID NO: 463446 - DNA, 20 bp, mouse
gtctctgaagacccacggat

SEQ ID NO: 463447 - DNA, 20 bp, mouse
ggccggaagttcctatccgt

SEQ ID NO: 463448 - DNA, 20 bp, mouse
gcaactcccgctccaagtgg

SEQ ID NO: 463449 - DNA, 20 bp, mouse
gggtagtaccccgacgtcaa

SEQ ID NO: 463450 - DNA, 20 bp, mouse
ggtaccccgacgtcaagggt

SEQ ID NO: 463451 - DNA, 20 bp, mouse
gttcagagagaggtaatttg

SEQ ID NO: 463452 - DNA, 20 bp, mouse
gagggacaccgcccccttaa

SEQ ID NO: 463453 - DNA, 20 bp, mouse
gacccacggataggaacttc

SEQ ID NO: 463454 - DNA, 20 bp, mouse
gcgaccggaagtgtttctaa

SEQ ID NO: 463455 - DNA, 20 bp, mouse
gccatcacgcccgagggatg

SEQ ID NO: 463456 - DNA, 20 bp, mouse
gcatatttcaaagataacag

SEQ ID NO: 463457 - DNA, 20 bp, mouse
gtcgagaggaaccggcacaa

SEQ ID NO: 463458 - DNA, 20 bp, mouse
gtctgcctgagagatagaag

SEQ ID NO: 463459 - DNA, 20 bp, mouse
gtactcaaatcgagaggaac

SEQ ID NO: 463460 - DNA, 20 bp, mouse
ggcctgagagatagaagagg

SEQ ID NO: 463461 - DNA, 20 bp, mouse
ggccgcctcttctatctctc

SEQ ID NO: 463462 - DNA, 20 bp, mouse
gaagtccccaggctcaggaa

SEQ ID NO: 463463 - DNA, 20 bp, mouse
gctatctctcaggcagacat

SEQ ID NO: 463464 - DNA, 20 bp, mouse
ggtgactgtccgtctcaagg

SEQ ID NO: 463465 - DNA, 20 bp, mouse
ggtgttctcagggagtcgtt

SEQ ID NO: 463466 - DNA, 20 bp, mouse
gggacgcgcgtagatggcag

SEQ ID NO: 463467 - DNA, 20 bp, mouse
gttaggggagacgagatccg

SEQ ID NO: 463468 - DNA, 20 bp, mouse
gcaaggagaccaggtgcgag

SEQ ID NO: 463469 - DNA, 20 bp, mouse
gaggaggagggagctccatg

SEQ ID NO: 463470 - DNA, 20 bp, mouse
gcagcccggacgcgcgtaga

SEQ ID NO: 463471 - DNA, 20 bp, mouse
gccgggtcccaggccgctcc

SEQ ID NO: 463472 - DNA, 20 bp, mouse
ggagaccaggtgcgagcggg

SEQ ID NO: 463473 - DNA, 20 bp, mouse
gctgtagtctgggagtcggt

SEQ ID NO: 463474 - DNA, 20 bp, mouse
gggacccggcgggactggga

SEQ ID NO: 463475 - DNA, 20 bp, mouse
gagccccgcccgctcgcacc

SEQ ID NO: 463476 - DNA, 20 bp, mouse
gacgccgacccagaacgcgg

SEQ ID NO: 463477 - DNA, 20 bp, mouse
gcggcctccgcgttctgggt

SEQ ID NO: 463478 - DNA, 20 bp, mouse
gctaacgccgacccagaacg

SEQ ID NO: 463479 - DNA, 20 bp, mouse
gccggagctgttcgacgaca

SEQ ID NO: 463480 - DNA, 20 bp, mouse
gagctgttcgacgacagggc

SEQ ID NO: 463481 - DNA, 20 bp, mouse
gttcaaggcgacacccgctc

SEQ ID NO: 463482 - DNA, 20 bp, mouse
gtgctcccgcggccctcatt

SEQ ID NO: 463483 - DNA, 20 bp, mouse
gccgctccggctttcccgtc

SEQ ID NO: 463484 - DNA, 20 bp, mouse
gcgggcttggcgccaaatga

SEQ ID NO: 463485 - DNA, 20 bp, mouse
gggcctctgagaccgagact

SEQ ID NO: 463486 - DNA, 20 bp, mouse
gaagagctgagtcctgtaag

SEQ ID NO: 463487 - DNA, 20 bp, mouse
gtacaggactcagctcttga

SEQ ID NO: 463488 - DNA, 20 bp, mouse
gtcactcacttgccccttac

SEQ ID NO: 463489 - DNA, 20 bp, mouse
gatgttgactcactcagtgt

SEQ ID NO: 463490 - DNA, 20 bp, mouse
gctttatagaaaaaacgaat

SEQ ID NO: 463491 - DNA, 20 bp, mouse
gctcctggagcaataaaact

SEQ ID NO: 463492 - DNA, 20 bp, mouse
gttcttccaaatgctttggt

SEQ ID NO: 463493 - DNA, 20 bp, mouse
gttcttcccaccaaagcatt

SEQ ID NO: 463494 - DNA, 20 bp, mouse
gttattgctccaggaggctt

SEQ ID NO: 463495 - DNA, 20 bp, mouse
gcaaggctgctgaagtttat

SEQ ID NO: 463496 - DNA, 20 bp, mouse
gcagccgcagcgcgcccggg

SEQ ID NO: 463497 - DNA, 20 bp, mouse
gacctcgccatgctccgccc

SEQ ID NO: 463498 - DNA, 20 bp, mouse
gccgcagccgcagcgcgccc

SEQ ID NO: 463499 - DNA, 20 bp, mouse
gccggaggccagcggagctt

SEQ ID NO: 463500 - DNA, 20 bp, mouse
ggggtactcacccttcccgg

SEQ ID NO: 463501 - DNA, 20 bp, mouse
gccccctggcctgtcaccag

SEQ ID NO: 463502 - DNA, 20 bp, mouse
gacagatcccggccttagga

SEQ ID NO: 463503 - DNA, 20 bp, mouse
gcctctctacctccctccta

SEQ ID NO: 463504 - DNA, 20 bp, mouse
gctccgctggcctccgggaa

SEQ ID NO: 463505 - DNA, 20 bp, mouse
ggtggagcatggacagatcc

SEQ ID NO: 463506 - DNA, 20 bp, mouse
gctggaaagcagggaagtct

SEQ ID NO: 463507 - DNA, 20 bp, mouse
ggccctatgtctgggtggtg

SEQ ID NO: 463508 - DNA, 20 bp, mouse
gggaaaaggtctcagcccag

SEQ ID NO: 463509 - DNA, 20 bp, mouse
gtcctgctggccctatgtct

SEQ ID NO: 463510 - DNA, 20 bp, mouse
gctaggccaggggcacggag

SEQ ID NO: 463511 - DNA, 20 bp, mouse
gtaacccgctgcacagtgga

SEQ ID NO: 463512 - DNA, 20 bp, mouse
ggccccaccacccagacata

SEQ ID NO: 463513 - DNA, 20 bp, mouse
ggccaggggcacggagagga

SEQ ID NO: 463514 - DNA, 20 bp, mouse
gccgctgcacagtggagggg

SEQ ID NO: 463515 - DNA, 20 bp, mouse
gccagaatgccctaggccag

SEQ ID NO: 463516 - DNA, 20 bp, mouse
gctcttcgagaacttcgctg

SEQ ID NO: 463517 - DNA, 20 bp, mouse
gcttgtgggaaaaagacctt

SEQ ID NO: 463518 - DNA, 20 bp, mouse
gggaatggccttaccctctc

SEQ ID NO: 463519 - DNA, 20 bp, mouse
ggaaatacgaacatgttaca

SEQ ID NO: 463520 - DNA, 20 bp, mouse
gacaaggcattgatttccag

SEQ ID NO: 463521 - DNA, 20 bp, mouse
ggcatcaccaggcaaacacc

SEQ ID NO: 463522 - DNA, 20 bp, mouse
gttgatttccagaggaagat

SEQ ID NO: 463523 - DNA, 20 bp, mouse
gttagacagagatctaatta

SEQ ID NO: 463524 - DNA, 20 bp, mouse
gtaagaattaaatgatggaa

SEQ ID NO: 463525 - DNA, 20 bp, mouse
gttatctgtaggcttcttag

SEQ ID NO: 463526 - DNA, 20 bp, mouse
gggttctggggcctggacag

SEQ ID NO: 463527 - DNA, 20 bp, mouse
ggagacccaagggatagtca

SEQ ID NO: 463528 - DNA, 20 bp, mouse
gacgggcagacatgcagcta

SEQ ID NO: 463529 - DNA, 20 bp, mouse
gacatgcagctagggttctg

SEQ ID NO: 463530 - DNA, 20 bp, mouse
gcccaagggatagtcaggga

SEQ ID NO: 463531 - DNA, 20 bp, mouse
gctggtggacgcccaggaga

SEQ ID NO: 463532 - DNA, 20 bp, mouse
gaggcagaggtgggtctaca

SEQ ID NO: 463533 - DNA, 20 bp, mouse
ggtcttcccgtcacagggcc

SEQ ID NO: 463534 - DNA, 20 bp, mouse
ggggcagccaggccctgtga

SEQ ID NO: 463535 - DNA, 20 bp, mouse
gccaggagaaggtcgagcag

SEQ ID NO: 463536 - DNA, 20 bp, mouse
ggcgtgaggaacctccgtcg

SEQ ID NO: 463537 - DNA, 20 bp, mouse
gtgggctaggcgcgccaaaa

SEQ ID NO: 463538 - DNA, 20 bp, mouse
gtatccaaaagtcctgggct

SEQ ID NO: 463539 - DNA, 20 bp, mouse
gaaccttccgaggattgcgt

SEQ ID NO: 463540 - DNA, 20 bp, mouse
gcgcccacgcaatcctcgga

SEQ ID NO: 463541 - DNA, 20 bp, mouse
gaaaagtatccaaaagtcct

SEQ ID NO: 463542 - DNA, 20 bp, mouse
gcagccggctgggtggatcc

SEQ ID NO: 463543 - DNA, 20 bp, mouse
gctcccgcccacgcaatcct

SEQ ID NO: 463544 - DNA, 20 bp, mouse
gaagccctctaccccgacgg

SEQ ID NO: 463545 - DNA, 20 bp, mouse
gctagaaggcgcgcaggagg

SEQ ID NO: 463546 - DNA, 20 bp, mouse
ggaggcgggagcccactgga

SEQ ID NO: 463547 - DNA, 20 bp, mouse
gagcaagcagggtgcgcctg

SEQ ID NO: 463548 - DNA, 20 bp, mouse
ggcaggaggcgggagcccac

SEQ ID NO: 463549 - DNA, 20 bp, mouse
ggctgctcgggagccaggga

SEQ ID NO: 463550 - DNA, 20 bp, mouse
gaagcagggtgcgcctgagg

SEQ ID NO: 463551 - DNA, 20 bp, mouse
gagaggccggaggcgagtca

SEQ ID NO: 463552 - DNA, 20 bp, mouse
gcccactggatggcgaccgg

SEQ ID NO: 463553 - DNA, 20 bp, mouse
ggcgcctgaggcggagtcct

SEQ ID NO: 463554 - DNA, 20 bp, mouse
gaccgggggacagaggccgg

SEQ ID NO: 463555 - DNA, 20 bp, mouse
gtcccccggtcgccatccag

SEQ ID NO: 463556 - DNA, 20 bp, mouse
gtgctggagagcctcagcgt

SEQ ID NO: 463557 - DNA, 20 bp, mouse
gcgcaggtcctcccacgctg

SEQ ID NO: 463558 - DNA, 20 bp, mouse
gtccgcggcggccggagcta

SEQ ID NO: 463559 - DNA, 20 bp, mouse
gtggagagcctcagcgtggg

SEQ ID NO: 463560 - DNA, 20 bp, mouse
gggagcctgcgccccgagag

SEQ ID NO: 463561 - DNA, 20 bp, mouse
gccggggagagctctgatta

SEQ ID NO: 463562 - DNA, 20 bp, mouse
ggctggagcacagagctcgg

SEQ ID NO: 463563 - DNA, 20 bp, mouse
gccctgggcatgaacggcta

SEQ ID NO: 463564 - DNA, 20 bp, mouse
gggccgcccatgtacaggta

SEQ ID NO: 463565 - DNA, 20 bp, mouse
ggggtccagtctgcgaggaa

SEQ ID NO: 463566 - DNA, 20 bp, mouse
gcccagctgtctagactcag

SEQ ID NO: 463567 - DNA, 20 bp, mouse
gagctccagaacctgaccga

SEQ ID NO: 463568 - DNA, 20 bp, mouse
gcagtctcctgagcctagaa

SEQ ID NO: 463569 - DNA, 20 bp, mouse
gccctggggccagatggggt

SEQ ID NO: 463570 - DNA, 20 bp, mouse
gttctgagaaggcgcctctg

SEQ ID NO: 463571 - DNA, 20 bp, mouse
ggaatggagcgattacctca

SEQ ID NO: 463572 - DNA, 20 bp, mouse
ggttctggagctcttagacc

SEQ ID NO: 463573 - DNA, 20 bp, mouse
ggcctctgagtctagacagc

SEQ ID NO: 463574 - DNA, 20 bp, mouse
gacggtcgtagagaccgcag

SEQ ID NO: 463575 - DNA, 20 bp, mouse
gcccagagcaagaaaccgcc

SEQ ID NO: 463576 - DNA, 20 bp, mouse
ggcgtccggagcgcaccgag

SEQ ID NO: 463577 - DNA, 20 bp, mouse
gcgagcggctcattgagagc

SEQ ID NO: 463578 - DNA, 20 bp, mouse
gcgccccgggccgggtagtc

SEQ ID NO: 463579 - DNA, 20 bp, mouse
gctgaggagcaacaatagag

SEQ ID NO: 463580 - DNA, 20 bp, mouse
gggtgacgtggtcagagaag

SEQ ID NO: 463581 - DNA, 20 bp, mouse
gccggggcgagcgcagcgtc

SEQ ID NO: 463582 - DNA, 20 bp, mouse
gtggctgaaggagggtgacg

SEQ ID NO: 463583 - DNA, 20 bp, mouse
ggacgaggccaagagagccg

SEQ ID NO: 463584 - DNA, 20 bp, mouse
gcggagctcgaggcaggtag

SEQ ID NO: 463585 - DNA, 20 bp, mouse
gctggcagcgccggactacc

SEQ ID NO: 463586 - DNA, 20 bp, mouse
gtacaggccggaggaaccgt

SEQ ID NO: 463587 - DNA, 20 bp, mouse
gcccaccccggcaccagtct

SEQ ID NO: 463588 - DNA, 20 bp, mouse
ggactccagcttagagccgg

SEQ ID NO: 463589 - DNA, 20 bp, mouse
gtgggactccagcttagagc

SEQ ID NO: 463590 - DNA, 20 bp, mouse
gggttcctccggcctgtacc

SEQ ID NO: 463591 - DNA, 20 bp, mouse
ggcagcctccggctctaagc

SEQ ID NO: 463592 - DNA, 20 bp, mouse
ggtgcagccgacggttcctc

SEQ ID NO: 463593 - DNA, 20 bp, mouse
gcgctagaggggccacggaa

SEQ ID NO: 463594 - DNA, 20 bp, mouse
gtctcaagcggggttacctg

SEQ ID NO: 463595 - DNA, 20 bp, mouse
gtcctcttgcaaaagtacag

SEQ ID NO: 463596 - DNA, 20 bp, mouse
gtgatttgagaactcagtat

SEQ ID NO: 463597 - DNA, 20 bp, mouse
ggagaactcagtatgggtgt

SEQ ID NO: 463598 - DNA, 20 bp, mouse
gcaggtaccaagtatttagt

SEQ ID NO: 463599 - DNA, 20 bp, mouse
ggagagtctattgcctaagg

SEQ ID NO: 463600 - DNA, 20 bp, mouse
gcaaatactgaggcccaagg

SEQ ID NO: 463601 - DNA, 20 bp, mouse
ggaggaggaggtcatacagt

SEQ ID NO: 463602 - DNA, 20 bp, mouse
gaaatggtttgccaagcatc

SEQ ID NO: 463603 - DNA, 20 bp, mouse
gcaggttgacacagcaaccc

SEQ ID NO: 463604 - DNA, 20 bp, mouse
gttttcagctccctgatgct

SEQ ID NO: 463605 - DNA, 20 bp, mouse
ggggtactggctaatgagga

SEQ ID NO: 463606 - DNA, 20 bp, mouse
ggggctagacacagatcata

SEQ ID NO: 463607 - DNA, 20 bp, mouse
gatatgcagcgcagttgcaa

SEQ ID NO: 463608 - DNA, 20 bp, mouse
gcagatcatagggcccctaa

SEQ ID NO: 463609 - DNA, 20 bp, mouse
ggcctgaacacaaggtcccc

SEQ ID NO: 463610 - DNA, 20 bp, mouse
gggtgagtggcccttctgag

SEQ ID NO: 463611 - DNA, 20 bp, mouse
gctgtggaaacccctcagaa

SEQ ID NO: 463612 - DNA, 20 bp, mouse
gggctgaactgaaaatgcag

SEQ ID NO: 463613 - DNA, 20 bp, mouse
ggctgagagcaatctcctca

SEQ ID NO: 463614 - DNA, 20 bp, mouse
gggacggggagaccacagac

SEQ ID NO: 463615 - DNA, 20 bp, mouse
gcagggaggaaagctagaag

SEQ ID NO: 463616 - DNA, 20 bp, mouse
gctgcactcggccctcagaa

SEQ ID NO: 463617 - DNA, 20 bp, mouse
gaccagggacgcccttctga

SEQ ID NO: 463618 - DNA, 20 bp, mouse
gaggaagctcagggcctctg

SEQ ID NO: 463619 - DNA, 20 bp, mouse
ggccgagtgcaggaagctca

SEQ ID NO: 463620 - DNA, 20 bp, mouse
ggaagtggagtcgaaggcca

SEQ ID NO: 463621 - DNA, 20 bp, mouse
gcttgggcgctgactctgaa

SEQ ID NO: 463622 - DNA, 20 bp, mouse
ggccctcagaagggcgtccc

SEQ ID NO: 463623 - DNA, 20 bp, mouse
gaagcaggaagtggagtcga

SEQ ID NO: 463624 - DNA, 20 bp, mouse
gagggcctctgaggcaaagc

SEQ ID NO: 463625 - DNA, 20 bp, mouse
ggactggacggagcctgtgg

SEQ ID NO: 463626 - DNA, 20 bp, mouse
ggtgccaagaggcggttggt

SEQ ID NO: 463627 - DNA, 20 bp, mouse
ggccagtgccaagaggcggt

SEQ ID NO: 463628 - DNA, 20 bp, mouse
ggagtctgagcagatcgatt

SEQ ID NO: 463629 - DNA, 20 bp, mouse
gtaatggagccagtgccaag

SEQ ID NO: 463630 - DNA, 20 bp, mouse
gccaagaggcggttggtggg

SEQ ID NO: 463631 - DNA, 20 bp, mouse
ggcggttggtgggaggtact

SEQ ID NO: 463632 - DNA, 20 bp, mouse
gctcctggaaatgggatgtg

SEQ ID NO: 463633 - DNA, 20 bp, mouse
ggagcagatcgattgggtaa

SEQ ID NO: 463634 - DNA, 20 bp, mouse
gatgctggtggtgaccatgt

SEQ ID NO: 463635 - DNA, 20 bp, mouse
ggagtacaaatgggagatga

SEQ ID NO: 463636 - DNA, 20 bp, mouse
gtagagggtgagaaggacca

SEQ ID NO: 463637 - DNA, 20 bp, mouse
gtgggacaggaatggctccc

SEQ ID NO: 463638 - DNA, 20 bp, mouse
gaggggccgccattccacat

SEQ ID NO: 463639 - DNA, 20 bp, mouse
gaccttgtgactgttggcac

SEQ ID NO: 463640 - DNA, 20 bp, mouse
ggaagatgggtggacaactg

SEQ ID NO: 463641 - DNA, 20 bp, mouse
gtgcgatgactctggaagat

SEQ ID NO: 463642 - DNA, 20 bp, mouse
gatcgcaaccttgtgactgt

SEQ ID NO: 463643 - DNA, 20 bp, mouse
gcacaaggttgcgatgactc

SEQ ID NO: 463644 - DNA, 20 bp, mouse
ggatgactctggaagatggg

SEQ ID NO: 463645 - DNA, 20 bp, mouse
gaactggggagtagatgtgg

SEQ ID NO: 463646 - DNA, 20 bp, mouse
gctgcactcggccctcagaa

SEQ ID NO: 463647 - DNA, 20 bp, mouse
gaccagggacgcccttctga

SEQ ID NO: 463648 - DNA, 20 bp, mouse
gaggaagctcagggcctctg

SEQ ID NO: 463649 - DNA, 20 bp, mouse
ggccgagtgcaggaagctca

SEQ ID NO: 463650 - DNA, 20 bp, mouse
ggaagtggagtcgaaggcca

SEQ ID NO: 463651 - DNA, 20 bp, mouse
gcttgggcgctgactctgaa

SEQ ID NO: 463652 - DNA, 20 bp, mouse
ggccctcagaagggcgtccc

SEQ ID NO: 463653 - DNA, 20 bp, mouse
gaagcaggaagtggagtcga

SEQ ID NO: 463654 - DNA, 20 bp, mouse
gagggcctctgaggcaaagc

SEQ ID NO: 463655 - DNA, 20 bp, mouse
ggactggacggagcctgtgg

SEQ ID NO: 463656 - DNA, 20 bp, mouse
gctcctggctgactgtgatt

SEQ ID NO: 463657 - DNA, 20 bp, mouse
gacacagtggcgaagaggaa

SEQ ID NO: 463658 - DNA, 20 bp, mouse
ggggcgacacagtggcgaag

SEQ ID NO: 463659 - DNA, 20 bp, mouse
gagtggcgaagaggaacggc

SEQ ID NO: 463660 - DNA, 20 bp, mouse
gtgtggtaaccacccgctgg

SEQ ID NO: 463661 - DNA, 20 bp, mouse
ggaggaacggccggctcgag

SEQ ID NO: 463662 - DNA, 20 bp, mouse
gtgttcatgccgccagcggg

SEQ ID NO: 463663 - DNA, 20 bp, mouse
gtggatgactgctggaaggg

SEQ ID NO: 463664 - DNA, 20 bp, mouse
gacccagctcaggagaggcg

SEQ ID NO: 463665 - DNA, 20 bp, mouse
gctgtgtcgcccttttctct

SEQ ID NO: 463666 - DNA, 20 bp, mouse
gaagcagccgcgggagagag

SEQ ID NO: 463667 - DNA, 20 bp, mouse
gctgcagccactctctcccg

SEQ ID NO: 463668 - DNA, 20 bp, mouse
ggagagagtggctgcagctg

SEQ ID NO: 463669 - DNA, 20 bp, mouse
gaggatggaggaagcagccg

SEQ ID NO: 463670 - DNA, 20 bp, mouse
gggaggctccaaaaaatacc

SEQ ID NO: 463671 - DNA, 20 bp, mouse
gagcgagcgcaaccagccac

SEQ ID NO: 463672 - DNA, 20 bp, mouse
ggctccaaaaaataccagga

SEQ ID NO: 463673 - DNA, 20 bp, mouse
gcgagccgaggagaaatggt

SEQ ID NO: 463674 - DNA, 20 bp, mouse
ggcgggctggaggaactaaa

SEQ ID NO: 463675 - DNA, 20 bp, mouse
gagccggcgacggagaccgc

SEQ ID NO: 463676 - DNA, 20 bp, mouse
ggtggcttgcagagcagcag

SEQ ID NO: 463677 - DNA, 20 bp, mouse
gctccgggaacccaagccgg

SEQ ID NO: 463678 - DNA, 20 bp, mouse
gcagctccgggaacccaagc

SEQ ID NO: 463679 - DNA, 20 bp, mouse
gttgcagagcagcaggggac

SEQ ID NO: 463680 - DNA, 20 bp, mouse
gggactggtgaagcgggtgg

SEQ ID NO: 463681 - DNA, 20 bp, mouse
gggctaggccctggtcgact

SEQ ID NO: 463682 - DNA, 20 bp, mouse
gggagctggtctcagctcag

SEQ ID NO: 463683 - DNA, 20 bp, mouse
ggtgggagctggcgaaggag

SEQ ID NO: 463684 - DNA, 20 bp, mouse
gtaggccctggtcgactggg

SEQ ID NO: 463685 - DNA, 20 bp, mouse
ggcggccacccagtcgacca

SEQ ID NO: 463686 - DNA, 20 bp, mouse
gggtctggcggtgggcggtc

SEQ ID NO: 463687 - DNA, 20 bp, mouse
gcccccagccggaagttgag

SEQ ID NO: 463688 - DNA, 20 bp, mouse
gcggggggcggccaagatgg

SEQ ID NO: 463689 - DNA, 20 bp, mouse
ggtgctagcccctcaacttc

SEQ ID NO: 463690 - DNA, 20 bp, mouse
ggcccggggggcggccaaga

SEQ ID NO: 463691 - DNA, 20 bp, mouse
ggggcggtcgggctgcggtg

SEQ ID NO: 463692 - DNA, 20 bp, mouse
ggaggggctagcaccggaag

SEQ ID NO: 463693 - DNA, 20 bp, mouse
gtccgcgcagtcgcccatgg

SEQ ID NO: 463694 - DNA, 20 bp, mouse
gccagtccggagggcgtgga

SEQ ID NO: 463695 - DNA, 20 bp, mouse
gtaggcgcaccaggctgagg

SEQ ID NO: 463696 - DNA, 20 bp, mouse
gggagccgcgtagcgagcgc

SEQ ID NO: 463697 - DNA, 20 bp, mouse
gagcggccccagcccagccg

SEQ ID NO: 463698 - DNA, 20 bp, mouse
ggcgctgctcctcaccagag

SEQ ID NO: 463699 - DNA, 20 bp, mouse
gggctggggccgctctggtg

SEQ ID NO: 463700 - DNA, 20 bp, mouse
gccgcacagcccgagaagcg

SEQ ID NO: 463701 - DNA, 20 bp, mouse
ggctgccagcgctcgctacg

SEQ ID NO: 463702 - DNA, 20 bp, mouse
gtatcgcgagaagtccttca

SEQ ID NO: 463703 - DNA, 20 bp, mouse
gagcggccgccgcccctagg

SEQ ID NO: 463704 - DNA, 20 bp, mouse
ggaatggccagtgggacaca

SEQ ID NO: 463705 - DNA, 20 bp, mouse
gccggctcgggaggatcgtg

SEQ ID NO: 463706 - DNA, 20 bp, mouse
ggccgccgcccggccatgag

SEQ ID NO: 463707 - DNA, 20 bp, mouse
ggcggcggccggcagacgac

SEQ ID NO: 463708 - DNA, 20 bp, mouse
gcggcggccggagcctctca

SEQ ID NO: 463709 - DNA, 20 bp, mouse
gggagcctctcatggccggg

SEQ ID NO: 463710 - DNA, 20 bp, mouse
gcatttccgcagccgagcgg

SEQ ID NO: 463711 - DNA, 20 bp, mouse
gggcagacgacaggcgagcg

SEQ ID NO: 463712 - DNA, 20 bp, mouse
gctgagtcccgaggacgcac

SEQ ID NO: 463713 - DNA, 20 bp, mouse
gggccggagcctctcatggc

SEQ ID NO: 463714 - DNA, 20 bp, mouse
gccgcagccgagcggcggtc

SEQ ID NO: 463715 - DNA, 20 bp, mouse
gctgcatcaggtcctcaccg

SEQ ID NO: 463716 - DNA, 20 bp, mouse
gcgaagcccgccgggagagc

SEQ ID NO: 463717 - DNA, 20 bp, mouse
ggcaggtccagctcgtccag

SEQ ID NO: 463718 - DNA, 20 bp, mouse
gcggcgggcttcggcaggaa

SEQ ID NO: 463719 - DNA, 20 bp, mouse
gtctctagcgccgcgagtta

SEQ ID NO: 463720 - DNA, 20 bp, mouse
gagcgggcagccgtaactcg

SEQ ID NO: 463721 - DNA, 20 bp, mouse
gtcggcaggaatggagccgc

SEQ ID NO: 463722 - DNA, 20 bp, mouse
gtgctgctggaagaggacgg

SEQ ID NO: 463723 - DNA, 20 bp, mouse
gaggctcacagctccacccg

SEQ ID NO: 463724 - DNA, 20 bp, mouse
gttagctggagggtgatcgt

SEQ ID NO: 463725 - DNA, 20 bp, mouse
gctggaagaggacggcggag

SEQ ID NO: 463726 - DNA, 20 bp, mouse
gcgcggaccgtagagtatta

SEQ ID NO: 463727 - DNA, 20 bp, mouse
ggtagagtattagggctgag

SEQ ID NO: 463728 - DNA, 20 bp, mouse
ggctccgccacgctgtccac

SEQ ID NO: 463729 - DNA, 20 bp, mouse
ggcggcgaccgggaaagcgt

SEQ ID NO: 463730 - DNA, 20 bp, mouse
gcggcggctcagagacttcg

SEQ ID NO: 463731 - DNA, 20 bp, mouse
gccgccacgctgtccaccgg

SEQ ID NO: 463732 - DNA, 20 bp, mouse
gcgttggacagccaacgacg

SEQ ID NO: 463733 - DNA, 20 bp, mouse
gagtattagggctgagtggt

SEQ ID NO: 463734 - DNA, 20 bp, mouse
gtagcgctgggaagccaaag

SEQ ID NO: 463735 - DNA, 20 bp, mouse
gactctacggtccgcgtcgt

SEQ ID NO: 463736 - DNA, 20 bp, mouse
ggaccagtccaagaaggtaa

SEQ ID NO: 463737 - DNA, 20 bp, mouse
ggctatagggcagggaccag

SEQ ID NO: 463738 - DNA, 20 bp, mouse
gtaggatgcgcttcagagtc

SEQ ID NO: 463739 - DNA, 20 bp, mouse
gcagggtgaattgagtgtct

SEQ ID NO: 463740 - DNA, 20 bp, mouse
gcgcttcagagtctggctca

SEQ ID NO: 463741 - DNA, 20 bp, mouse
ggtactcggagaacattcgg

SEQ ID NO: 463742 - DNA, 20 bp, mouse
gggtaacggctggattgtca

SEQ ID NO: 463743 - DNA, 20 bp, mouse
gttggatctgagcagagagg

SEQ ID NO: 463744 - DNA, 20 bp, mouse
ggagtacgccgcggagatca

SEQ ID NO: 463745 - DNA, 20 bp, mouse
gcacggaccccgagaaccgg

SEQ ID NO: 463746 - DNA, 20 bp, mouse
gtattcttcaaaatatccgt

SEQ ID NO: 463747 - DNA, 20 bp, mouse
gttgggtgatgactcagagt

SEQ ID NO: 463748 - DNA, 20 bp, mouse
gtccccggcgctggacctac

SEQ ID NO: 463749 - DNA, 20 bp, mouse
gctctgggaaactgttgtgg

SEQ ID NO: 463750 - DNA, 20 bp, mouse
gggtgaggggattaacgtgg

SEQ ID NO: 463751 - DNA, 20 bp, mouse
gcagagtgggcgaagcctct

SEQ ID NO: 463752 - DNA, 20 bp, mouse
gggcgaaggggtaagaagcg

SEQ ID NO: 463753 - DNA, 20 bp, mouse
gttcaaaatatccgtaggta

SEQ ID NO: 463754 - DNA, 20 bp, mouse
ggattaacgtggaggcgaag

SEQ ID NO: 463755 - DNA, 20 bp, mouse
gaaaggtgaggggattaacg

SEQ ID NO: 463756 - DNA, 20 bp, mouse
gtcagtgcttcccgtctcta

SEQ ID NO: 463757 - DNA, 20 bp, mouse
gagccggtaggtccatgagg

SEQ ID NO: 463758 - DNA, 20 bp, mouse
gtggtcccgccccctcgcaa

SEQ ID NO: 463759 - DNA, 20 bp, mouse
gagtgtccttccctagagac

SEQ ID NO: 463760 - DNA, 20 bp, mouse
gcgcctcctcatggacctac

SEQ ID NO: 463761 - DNA, 20 bp, mouse
ggggagccggtaggtccatg

SEQ ID NO: 463762 - DNA, 20 bp, mouse
gtgcttcccgtctctaggga

SEQ ID NO: 463763 - DNA, 20 bp, mouse
gcactgagtccgttgcgagg

SEQ ID NO: 463764 - DNA, 20 bp, mouse
gccccgacaaggctctgtag

SEQ ID NO: 463765 - DNA, 20 bp, mouse
gtataggagaaggcacttaa

SEQ ID NO: 463766 - DNA, 20 bp, mouse
ggcagggcgcagaacagact

SEQ ID NO: 463767 - DNA, 20 bp, mouse
gaggacccgcaggtcgtcca

SEQ ID NO: 463768 - DNA, 20 bp, mouse
gctcctcaggcaccagtatg

SEQ ID NO: 463769 - DNA, 20 bp, mouse
gtacgcggtcgcgcatccac

SEQ ID NO: 463770 - DNA, 20 bp, mouse
gtcctcgaatagcatagggt

SEQ ID NO: 463771 - DNA, 20 bp, mouse
gctgcgccatggacgacctg

SEQ ID NO: 463772 - DNA, 20 bp, mouse
ggccaggtgagcgtgagcag

SEQ ID NO: 463773 - DNA, 20 bp, mouse
gcgcagacctgagcagcgca

SEQ ID NO: 463774 - DNA, 20 bp, mouse
ggctgctcaggtctgcgcca

SEQ ID NO: 463775 - DNA, 20 bp, mouse
ggttgaaggcagtgtatacg

SEQ ID NO: 463776 - DNA, 20 bp, mouse
gggctcggtgatagcctcct

SEQ ID NO: 463777 - DNA, 20 bp, mouse
gcctgcagagctaggtgcac

SEQ ID NO: 463778 - DNA, 20 bp, mouse
gaggtgcactggaagcgagg

SEQ ID NO: 463779 - DNA, 20 bp, mouse
ggactccaagaatcctctct

SEQ ID NO: 463780 - DNA, 20 bp, mouse
gaagcgcacccgcgggtcta

SEQ ID NO: 463781 - DNA, 20 bp, mouse
gttggagtcgtgcgccaagg

SEQ ID NO: 463782 - DNA, 20 bp, mouse
gtctggagagcgatgaccac

SEQ ID NO: 463783 - DNA, 20 bp, mouse
gaggttcccggaggagacgt

SEQ ID NO: 463784 - DNA, 20 bp, mouse
gttcttggagtcgtgcgcca

SEQ ID NO: 463785 - DNA, 20 bp, mouse
gatcctctctaggtacgaga

SEQ ID NO: 463786 - DNA, 20 bp, mouse
ggacagatgttacagaacat

SEQ ID NO: 463787 - DNA, 20 bp, mouse
gaaggcgttatgacaagtcg

SEQ ID NO: 463788 - DNA, 20 bp, mouse
gtcctcaggtctcataagat

SEQ ID NO: 463789 - DNA, 20 bp, mouse
gaataaaagaggggccaaag

SEQ ID NO: 463790 - DNA, 20 bp, mouse
gtgtaacatctgtcagttaa

SEQ ID NO: 463791 - DNA, 20 bp, mouse
gggatagtttatattaaatt

SEQ ID NO: 463792 - DNA, 20 bp, mouse
gtcctatcttatgagacctg

SEQ ID NO: 463793 - DNA, 20 bp, mouse
gccacaataatgatagatct

SEQ ID NO: 463794 - DNA, 20 bp, mouse
gagataagttaataaaagag

SEQ ID NO: 463795 - DNA, 20 bp, mouse
gacctgctttgccacctctt

SEQ ID NO: 463796 - DNA, 20 bp, mouse
ggagatgcagagttgtagac

SEQ ID NO: 463797 - DNA, 20 bp, mouse
gcacaagagaacataaatag

SEQ ID NO: 463798 - DNA, 20 bp, mouse
gctggccccgaggctcccac

SEQ ID NO: 463799 - DNA, 20 bp, mouse
gtcggggccagcaactacag

SEQ ID NO: 463800 - DNA, 20 bp, mouse
gagatgcagacaaagaggta

SEQ ID NO: 463801 - DNA, 20 bp, mouse
ggacatttacccacagtctg

SEQ ID NO: 463802 - DNA, 20 bp, mouse
gtggatttcgacacacgttg

SEQ ID NO: 463803 - DNA, 20 bp, mouse
gctccagatgcatgcagggg

SEQ ID NO: 463804 - DNA, 20 bp, mouse
ggcaactacagcggatcata

SEQ ID NO: 463805 - DNA, 20 bp, mouse
gctttcctgtgggagcctcg

SEQ ID NO: 463806 - DNA, 20 bp, mouse
gtctgtcctcctcaagttca

SEQ ID NO: 463807 - DNA, 20 bp, mouse
gaagttcaaggcagacaagt

SEQ ID NO: 463808 - DNA, 20 bp, mouse
ggacctcagaatcgattatc

SEQ ID NO: 463809 - DNA, 20 bp, mouse
ggagcgtcagcaccaggaca

SEQ ID NO: 463810 - DNA, 20 bp, mouse
gggcaaactgattggagcag

SEQ ID NO: 463811 - DNA, 20 bp, mouse
gatgtccccgtagatgaggt

SEQ ID NO: 463812 - DNA, 20 bp, mouse
gcagagtccctcaagtccaa

SEQ ID NO: 463813 - DNA, 20 bp, mouse
gattggagcagaggagaaca

SEQ ID NO: 463814 - DNA, 20 bp, mouse
ggaccagttgattgcagtag

SEQ ID NO: 463815 - DNA, 20 bp, mouse
ggcaatcaactggtccacgg

SEQ ID NO: 463816 - DNA, 20 bp, mouse
ggccgagaagaagcgaaaag

SEQ ID NO: 463817 - DNA, 20 bp, mouse
gaccgtgggcagaagtagag

SEQ ID NO: 463818 - DNA, 20 bp, mouse
gctgaggagctcggacaact

SEQ ID NO: 463819 - DNA, 20 bp, mouse
gagtacttgctgggacggag

SEQ ID NO: 463820 - DNA, 20 bp, mouse
gggacttagaaatggaccgt

SEQ ID NO: 463821 - DNA, 20 bp, mouse
gagtctggcaaggaggactc

SEQ ID NO: 463822 - DNA, 20 bp, mouse
gagaagaagcgaaaagtggc

SEQ ID NO: 463823 - DNA, 20 bp, mouse
gcggacaactcggcctgccc

SEQ ID NO: 463824 - DNA, 20 bp, mouse
gagcgaaaagtggctggccg

SEQ ID NO: 463825 - DNA, 20 bp, mouse
gaggagccagagcccgagtc

SEQ ID NO: 463826 - DNA, 20 bp, mouse
gaggagagagggatcagtgt

SEQ ID NO: 463827 - DNA, 20 bp, mouse
gacggaactggtccagggca

SEQ ID NO: 463828 - DNA, 20 bp, mouse
gagttccgtgagaaccagag

SEQ ID NO: 463829 - DNA, 20 bp, mouse
ggctgacctgagtatccatt

SEQ ID NO: 463830 - DNA, 20 bp, mouse
gagggcggttgctggcacag

SEQ ID NO: 463831 - DNA, 20 bp, mouse
gtcacgaagatctagaggta

SEQ ID NO: 463832 - DNA, 20 bp, mouse
ggagtatccattaggagaga

SEQ ID NO: 463833 - DNA, 20 bp, mouse
ggggtccctgaggggtgtaa

SEQ ID NO: 463834 - DNA, 20 bp, mouse
gggatactcaggtcagccag

SEQ ID NO: 463835 - DNA, 20 bp, mouse
ggcttctcacgaagatctag

SEQ ID NO: 463836 - DNA, 20 bp, mouse
gggttccttaggccagaacg

SEQ ID NO: 463837 - DNA, 20 bp, mouse
ggctggagcacagagtctaa

SEQ ID NO: 463838 - DNA, 20 bp, mouse
gacagctgctttgaaatctg

SEQ ID NO: 463839 - DNA, 20 bp, mouse
gagaacggggacttgagcag

SEQ ID NO: 463840 - DNA, 20 bp, mouse
gaccttcccagcctaagact

SEQ ID NO: 463841 - DNA, 20 bp, mouse
gaagtgtatcgattgaagaa

SEQ ID NO: 463842 - DNA, 20 bp, mouse
gccagcctaagactaggccc

SEQ ID NO: 463843 - DNA, 20 bp, mouse
gggggacttgagcagcggaa

SEQ ID NO: 463844 - DNA, 20 bp, mouse
gagagtctaagggcattgga

SEQ ID NO: 463845 - DNA, 20 bp, mouse
gtattccagggcctagtctt

SEQ ID NO: 463846 - DNA, 20 bp, mouse
gctcgatattcacagaactg

SEQ ID NO: 463847 - DNA, 20 bp, mouse
gacgaaggaccacagaatcg

SEQ ID NO: 463848 - DNA, 20 bp, mouse
ggatatatgagcatcgcaga

SEQ ID NO: 463849 - DNA, 20 bp, mouse
gagttagaagaccattctgg

SEQ ID NO: 463850 - DNA, 20 bp, mouse
gttgctgggatgtttaggat

SEQ ID NO: 463851 - DNA, 20 bp, mouse
ggatcggcagacgacaactc

SEQ ID NO: 463852 - DNA, 20 bp, mouse
gggtagttagaagaccattc

SEQ ID NO: 463853 - DNA, 20 bp, mouse
ggctacatgtagttattctc

SEQ ID NO: 463854 - DNA, 20 bp, mouse
gctccttaccgtcagaactc

SEQ ID NO: 463855 - DNA, 20 bp, mouse
gcacaggcaaagactctaag

SEQ ID NO: 463856 - DNA, 20 bp, mouse
ggttcccgaagggtctccag

SEQ ID NO: 463857 - DNA, 20 bp, mouse
ggcccagcaatacctggtct

SEQ ID NO: 463858 - DNA, 20 bp, mouse
gcaacagcagcgttcccgaa

SEQ ID NO: 463859 - DNA, 20 bp, mouse
gtcccagaccaggtattgct

SEQ ID NO: 463860 - DNA, 20 bp, mouse
gtgggcctctggagaccctt

SEQ ID NO: 463861 - DNA, 20 bp, mouse
gagacttctgttcccagacc

SEQ ID NO: 463862 - DNA, 20 bp, mouse
gaaccgcttggtgagtccat

SEQ ID NO: 463863 - DNA, 20 bp, mouse
gggcgtctaatgaacaggac

SEQ ID NO: 463864 - DNA, 20 bp, mouse
gacagtcagtatgtagtctt

SEQ ID NO: 463865 - DNA, 20 bp, mouse
gagcgaggactagagatgct

SEQ ID NO: 463866 - DNA, 20 bp, mouse
gagagcctagagctgtccag

SEQ ID NO: 463867 - DNA, 20 bp, mouse
gcggaactcaggacctggag

SEQ ID NO: 463868 - DNA, 20 bp, mouse
gtgctgcggaactcaggacc

SEQ ID NO: 463869 - DNA, 20 bp, mouse
gttcgccgctggacagctct

SEQ ID NO: 463870 - DNA, 20 bp, mouse
gagcaacgaatcgaccacgg

SEQ ID NO: 463871 - DNA, 20 bp, mouse
ggatcgctgctgcggaactc

SEQ ID NO: 463872 - DNA, 20 bp, mouse
gacaacgaggtccaacggtt

SEQ ID NO: 463873 - DNA, 20 bp, mouse
ggcgaacaactctcctctcc

SEQ ID NO: 463874 - DNA, 20 bp, mouse
gttacgacaacgaggtccaa

SEQ ID NO: 463875 - DNA, 20 bp, mouse
gccggccgggatcgctgctg

SEQ ID NO: 463876 - DNA, 20 bp, mouse
ggaccaagcaagcagtccag

SEQ ID NO: 463877 - DNA, 20 bp, mouse
gagcaacgaatcgaccttgg

SEQ ID NO: 463878 - DNA, 20 bp, mouse
gagggaaacgctcaacgccg

SEQ ID NO: 463879 - DNA, 20 bp, mouse
gcacaggagcagtaccgccc

SEQ ID NO: 463880 - DNA, 20 bp, mouse
ggaaacgctcaacgccgggg

SEQ ID NO: 463881 - DNA, 20 bp, mouse
gacaaccaggtccagcggtt

SEQ ID NO: 463882 - DNA, 20 bp, mouse
gcgccgctggactgcttgct

SEQ ID NO: 463883 - DNA, 20 bp, mouse
gtcggccgggatcgttgctg

SEQ ID NO: 463884 - DNA, 20 bp, mouse
ggccagcctggcctaaatac

SEQ ID NO: 463885 - DNA, 20 bp, mouse
gcttgcgggccaggcaggat

SEQ ID NO: 463886 - DNA, 20 bp, mouse
gggttcttttgaacatgggt

SEQ ID NO: 463887 - DNA, 20 bp, mouse
gagtctggaagtaaatagtc

SEQ ID NO: 463888 - DNA, 20 bp, mouse
gttatccccaagatgaaaac

SEQ ID NO: 463889 - DNA, 20 bp, mouse
ggttattgctcccatgtctt

SEQ ID NO: 463890 - DNA, 20 bp, mouse
ggtaaaccctgccaaagaca

SEQ ID NO: 463891 - DNA, 20 bp, mouse
gcagggtttacctgtaacag

SEQ ID NO: 463892 - DNA, 20 bp, mouse
ggtaacagcggtctgtgagt

SEQ ID NO: 463893 - DNA, 20 bp, mouse
gtaactcaatcactggccta

SEQ ID NO: 463894 - DNA, 20 bp, mouse
gtcttagccttggcagttgt

SEQ ID NO: 463895 - DNA, 20 bp, mouse
gttacctgtaactcaatcac

SEQ ID NO: 463896 - DNA, 20 bp, mouse
ggagtggcagcagagactgg

SEQ ID NO: 463897 - DNA, 20 bp, mouse
gccaaagcaggtcccaacag

SEQ ID NO: 463898 - DNA, 20 bp, mouse
gcccgagtggcagcagagac

SEQ ID NO: 463899 - DNA, 20 bp, mouse
ggtcccaacagtggctgctc

SEQ ID NO: 463900 - DNA, 20 bp, mouse
gtcaacggctgcgccccgag

SEQ ID NO: 463901 - DNA, 20 bp, mouse
gtaccagagcagccactgtt

SEQ ID NO: 463902 - DNA, 20 bp, mouse
ggcagccgttgagagtacaa

SEQ ID NO: 463903 - DNA, 20 bp, mouse
ggaagtgccgggatcctgtc

SEQ ID NO: 463904 - DNA, 20 bp, mouse
gcaggcaggcgagtgagtgg

SEQ ID NO: 463905 - DNA, 20 bp, mouse
gctgcctgtaaactggtggg

SEQ ID NO: 463906 - DNA, 20 bp, mouse
gaggcacagccgaggcgggg

SEQ ID NO: 463907 - DNA, 20 bp, mouse
gatgcccggcgccaaggagc

SEQ ID NO: 463908 - DNA, 20 bp, mouse
gagcagtggccgcggatccg

SEQ ID NO: 463909 - DNA, 20 bp, mouse
ggccaaggagcaggcagcgc

SEQ ID NO: 463910 - DNA, 20 bp, mouse
gggcagcgctggcggagtct

SEQ ID NO: 463911 - DNA, 20 bp, mouse
gcacgcgatgcccggcgcca

SEQ ID NO: 463912 - DNA, 20 bp, mouse
gctggccccgctgctctcag

SEQ ID NO: 463913 - DNA, 20 bp, mouse
gcctggcatccccgtcgcta

SEQ ID NO: 463914 - DNA, 20 bp, mouse
gtgcaggcacagccgaggcg

SEQ ID NO: 463915 - DNA, 20 bp, mouse
ggctggcaacacgcgatgcc

SEQ ID NO: 463916 - DNA, 20 bp, mouse
gtggtgactgggaattgaag

SEQ ID NO: 463917 - DNA, 20 bp, mouse
gctccttcttgaccacacac

SEQ ID NO: 463918 - DNA, 20 bp, mouse
gagctgtccccgaagaaccc

SEQ ID NO: 463919 - DNA, 20 bp, mouse
gcccagtcaccagggttctt

SEQ ID NO: 463920 - DNA, 20 bp, mouse
gttcctgtgtgtggtcaaga

SEQ ID NO: 463921 - DNA, 20 bp, mouse
gcccgaagaaccctggtgac

SEQ ID NO: 463922 - DNA, 20 bp, mouse
ggtcaacaggaaataactgg

SEQ ID NO: 463923 - DNA, 20 bp, mouse
gtggagtgttgggagattaa

SEQ ID NO: 463924 - DNA, 20 bp, mouse
gaactggcggttaaggtcag

SEQ ID NO: 463925 - DNA, 20 bp, mouse
gcaaaacgcttcctctcctg

SEQ ID NO: 463926 - DNA, 20 bp, mouse
ggctgcgctggagctgggac

SEQ ID NO: 463927 - DNA, 20 bp, mouse
gggtcttgggcgcttctcct

SEQ ID NO: 463928 - DNA, 20 bp, mouse
gggaggtgagccaggataag

SEQ ID NO: 463929 - DNA, 20 bp, mouse
gagctccagcgcagcttaaa

SEQ ID NO: 463930 - DNA, 20 bp, mouse
gggacgcccgccccttatcc

SEQ ID NO: 463931 - DNA, 20 bp, mouse
gtggagctgggactggtctt

SEQ ID NO: 463932 - DNA, 20 bp, mouse
gcttaaacggctgggagctg

SEQ ID NO: 463933 - DNA, 20 bp, mouse
gtaaggggcgggcgtcctag

SEQ ID NO: 463934 - DNA, 20 bp, mouse
ggaaatctcggagaactgtc

SEQ ID NO: 463935 - DNA, 20 bp, mouse
gggagcttgaagaatattca

SEQ ID NO: 463936 - DNA, 20 bp, mouse
gcggggctcggctacaaaag

SEQ ID NO: 463937 - DNA, 20 bp, mouse
gaggcctgcggggcgagagt

SEQ ID NO: 463938 - DNA, 20 bp, mouse
gagcgacactggactcccgg

SEQ ID NO: 463939 - DNA, 20 bp, mouse
gccggggaaggcgcagccgg

SEQ ID NO: 463940 - DNA, 20 bp, mouse
ggaggcggttggtcccgcgt

SEQ ID NO: 463941 - DNA, 20 bp, mouse
gtccgccgcccgggccgggt

SEQ ID NO: 463942 - DNA, 20 bp, mouse
gaggtcggctgcggcgggcc

SEQ ID NO: 463943 - DNA, 20 bp, mouse
ggcacgcgcggagcaaggca

SEQ ID NO: 463944 - DNA, 20 bp, mouse
gccgcccgcacgcctcgagg

SEQ ID NO: 463945 - DNA, 20 bp, mouse
ggcagggcgccgggcattcc

SEQ ID NO: 463946 - DNA, 20 bp, mouse
ggcgcgacccggaccacgag

SEQ ID NO: 463947 - DNA, 20 bp, mouse
gggcagcactcgcaagcagg

SEQ ID NO: 463948 - DNA, 20 bp, mouse
ggagcggaaggagcgcgacc

SEQ ID NO: 463949 - DNA, 20 bp, mouse
gccgggcagcactcgcaagc

SEQ ID NO: 463950 - DNA, 20 bp, mouse
gccggggaggagctgaccgc

SEQ ID NO: 463951 - DNA, 20 bp, mouse
ggtgtcggccacgttcgcca

SEQ ID NO: 463952 - DNA, 20 bp, mouse
gcaggccgccatggcgaacg

SEQ ID NO: 463953 - DNA, 20 bp, mouse
ggccgccgccgctcgtggtc

SEQ ID NO: 463954 - DNA, 20 bp, mouse
ggccacccggaaaaacaggt

SEQ ID NO: 463955 - DNA, 20 bp, mouse
gcaggccgaggagacggcgc

SEQ ID NO: 463956 - DNA, 20 bp, mouse
gtccccacgctggttgaggg

SEQ ID NO: 463957 - DNA, 20 bp, mouse
gggtggcagtggggactccc

SEQ ID NO: 463958 - DNA, 20 bp, mouse
gcagtgtccccgggccaaaa

SEQ ID NO: 463959 - DNA, 20 bp, mouse
ggaagcctccctcacctgtg

SEQ ID NO: 463960 - DNA, 20 bp, mouse
gtgttccccacgctggttga

SEQ ID NO: 463961 - DNA, 20 bp, mouse
gttgccactacgcccccctg

SEQ ID NO: 463962 - DNA, 20 bp, mouse
gtccgcctcacaggtgaggg

SEQ ID NO: 463963 - DNA, 20 bp, mouse
ggccaccctcaaccagcgtg

SEQ ID NO: 463964 - DNA, 20 bp, mouse
gcgctggttgagggtggcag

SEQ ID NO: 463965 - DNA, 20 bp, mouse
ggcgcccatggaaagcccga

SEQ ID NO: 463966 - DNA, 20 bp, mouse
ggaagcggccgcgaccgaga

SEQ ID NO: 463967 - DNA, 20 bp, mouse
gcggtgccgggagcgcaact

SEQ ID NO: 463968 - DNA, 20 bp, mouse
gggtaccggcggctcgagtg

SEQ ID NO: 463969 - DNA, 20 bp, mouse
gaagccggcggcggaggtac

SEQ ID NO: 463970 - DNA, 20 bp, mouse
gcggtcgcggccgcttcccg

SEQ ID NO: 463971 - DNA, 20 bp, mouse
gggcctgcgcgtcaccgtct

SEQ ID NO: 463972 - DNA, 20 bp, mouse
gccgtcccgagcgtgagccc

SEQ ID NO: 463973 - DNA, 20 bp, mouse
gccggcggcggaggtaccgg

SEQ ID NO: 463974 - DNA, 20 bp, mouse
gcgggagcgcaactgggtcc

SEQ ID NO: 463975 - DNA, 20 bp, mouse
gacgctcgggacggagcccc

SEQ ID NO: 463976 - DNA, 20 bp, mouse
gggacgggtatatagagtcc

SEQ ID NO: 463977 - DNA, 20 bp, mouse
ggtatatagagtccgggacg

SEQ ID NO: 463978 - DNA, 20 bp, mouse
gctccgctgctgccccgtcc

SEQ ID NO: 463979 - DNA, 20 bp, mouse
gggcggcgacagctgggcgg

SEQ ID NO: 463980 - DNA, 20 bp, mouse
gactctatatacccgtccgg

SEQ ID NO: 463981 - DNA, 20 bp, mouse
gctggaagcttccgccggac

SEQ ID NO: 463982 - DNA, 20 bp, mouse
gcccggccgaggtcttggag

SEQ ID NO: 463983 - DNA, 20 bp, mouse
ggcggcggtggccatgggca

SEQ ID NO: 463984 - DNA, 20 bp, mouse
gggcgctgaggagaagttca

SEQ ID NO: 463985 - DNA, 20 bp, mouse
gaggcattccggggatctag

SEQ ID NO: 463986 - DNA, 20 bp, mouse
gtcccggaaggtggcagctg

SEQ ID NO: 463987 - DNA, 20 bp, mouse
gggcgcgctacctgtctccg

SEQ ID NO: 463988 - DNA, 20 bp, mouse
ggctgagagggtaggaccag

SEQ ID NO: 463989 - DNA, 20 bp, mouse
gtctctctcttgcccggccg

SEQ ID NO: 463990 - DNA, 20 bp, mouse
gcggctctggggctcccgga

SEQ ID NO: 463991 - DNA, 20 bp, mouse
ggggaggccgcctcacgccg

SEQ ID NO: 463992 - DNA, 20 bp, mouse
gcttgcccggccgcggagac

SEQ ID NO: 463993 - DNA, 20 bp, mouse
ggatcgccgggtgaggaagg

SEQ ID NO: 463994 - DNA, 20 bp, mouse
gtcctcagctgccaccttcc

SEQ ID NO: 463995 - DNA, 20 bp, mouse
gcgtgcagcaagaggccgag

SEQ ID NO: 463996 - DNA, 20 bp, mouse
gcgagcacggaaccagggag

SEQ ID NO: 463997 - DNA, 20 bp, mouse
ggaacccgagcacggaacca

SEQ ID NO: 463998 - DNA, 20 bp, mouse
ggggaggccgggcgagcgaa

SEQ ID NO: 463999 - DNA, 20 bp, mouse
ggcgccgcagggaccgaagg

SEQ ID NO: 464000 - DNA, 20 bp, mouse
gtccttgttggattccatgg

SEQ ID NO: 464001 - DNA, 20 bp, mouse
gccatggcggaacccgagca

SEQ ID NO: 464002 - DNA, 20 bp, mouse
gacccgacgccacgagtcag

SEQ ID NO: 464003 - DNA, 20 bp, mouse
gtcatccttgttggattcca

SEQ ID NO: 464004 - DNA, 20 bp, mouse
gcgagtcagcggtgagtggg

SEQ ID NO: 464005 - DNA, 20 bp, mouse
ggccagcatcctagagaccg

SEQ ID NO: 464006 - DNA, 20 bp, mouse
gccccatggctggtaccaat

SEQ ID NO: 464007 - DNA, 20 bp, mouse
ggaagatgcccagatcaaga

SEQ ID NO: 464008 - DNA, 20 bp, mouse
gacttacgccttcttgatct

SEQ ID NO: 464009 - DNA, 20 bp, mouse
ggacccattggtaccagcca

SEQ ID NO: 464010 - DNA, 20 bp, mouse
gaggcaggagcattggacgt

SEQ ID NO: 464011 - DNA, 20 bp, mouse
gacagaacgcaaactaacag

SEQ ID NO: 464012 - DNA, 20 bp, mouse
gagctaagaggcaggagcat

SEQ ID NO: 464013 - DNA, 20 bp, mouse
ggaagcccactgatgcactt

SEQ ID NO: 464014 - DNA, 20 bp, mouse
gtcaagaaggcgtaagtggg

SEQ ID NO: 464015 - DNA, 20 bp, mouse
gctgggcatcttctgagttg

SEQ ID NO: 464016 - DNA, 20 bp, mouse
gggcaggcgcgagccatgga

SEQ ID NO: 464017 - DNA, 20 bp, mouse
ggaagcgctgggccttgtcg

SEQ ID NO: 464018 - DNA, 20 bp, mouse
gaggggcctaggctgatctg

SEQ ID NO: 464019 - DNA, 20 bp, mouse
ggagggcaaccgcgacgagg

SEQ ID NO: 464020 - DNA, 20 bp, mouse
gatggagggcaaccgcgacg

SEQ ID NO: 464021 - DNA, 20 bp, mouse
gacaggagcggggactccag

SEQ ID NO: 464022 - DNA, 20 bp, mouse
gctgcgaggggggcccgccg

SEQ ID NO: 464023 - DNA, 20 bp, mouse
ggcggcggcggcccggcgac

SEQ ID NO: 464024 - DNA, 20 bp, mouse
gagcgccggcaaccgcgaca

SEQ ID NO: 464025 - DNA, 20 bp, mouse
gcggccgcgcagctgcgagg

SEQ ID NO: 464026 - DNA, 20 bp, mouse
gggcctgcgggaccagataa

SEQ ID NO: 464027 - DNA, 20 bp, mouse
gcctggcgtgtcgtacgcag

SEQ ID NO: 464028 - DNA, 20 bp, mouse
ggagtctctagtagtttcca

SEQ ID NO: 464029 - DNA, 20 bp, mouse
ggctatctcacggcaggagt

SEQ ID NO: 464030 - DNA, 20 bp, mouse
gcctgccgtgagatagccct

SEQ ID NO: 464031 - DNA, 20 bp, mouse
ggcgtacgacacgccaggct

SEQ ID NO: 464032 - DNA, 20 bp, mouse
gacgcctgcggccagtgact

SEQ ID NO: 464033 - DNA, 20 bp, mouse
ggaaggggtcaggccgacag

SEQ ID NO: 464034 - DNA, 20 bp, mouse
gccgggcagcgggtgctagg

SEQ ID NO: 464035 - DNA, 20 bp, mouse
gttgcgcacacaacccagcc

SEQ ID NO: 464036 - DNA, 20 bp, mouse
ggccatggtggactactacg

SEQ ID NO: 464037 - DNA, 20 bp, mouse
gacctcgtagtagtccacca

SEQ ID NO: 464038 - DNA, 20 bp, mouse
ggcgggccggccagccgcca

SEQ ID NO: 464039 - DNA, 20 bp, mouse
gcgcggcctcggcgctggag

SEQ ID NO: 464040 - DNA, 20 bp, mouse
gacgtccgataagacctcgt

SEQ ID NO: 464041 - DNA, 20 bp, mouse
gacgaccgctgcggcgaagt

SEQ ID NO: 464042 - DNA, 20 bp, mouse
gaagaaccccgagcacaagg

SEQ ID NO: 464043 - DNA, 20 bp, mouse
gagtagtccaccatggcggc

SEQ ID NO: 464044 - DNA, 20 bp, mouse
gcaggtggcgcaggcctacg

SEQ ID NO: 464045 - DNA, 20 bp, mouse
gcgtggaagcagaagccgag

SEQ ID NO: 464046 - DNA, 20 bp, mouse
gtctctatttaattcctccc

SEQ ID NO: 464047 - DNA, 20 bp, mouse
gatctgtaagtgagctgccg

SEQ ID NO: 464048 - DNA, 20 bp, mouse
gttgtccgggtgaaatttga

SEQ ID NO: 464049 - DNA, 20 bp, mouse
gacgattcagacactgccaa

SEQ ID NO: 464050 - DNA, 20 bp, mouse
gacattttgggaattgacaa

SEQ ID NO: 464051 - DNA, 20 bp, mouse
gaaaagaaaacagcgtcccc

SEQ ID NO: 464052 - DNA, 20 bp, mouse
gtcatgtaacgataaccaga

SEQ ID NO: 464053 - DNA, 20 bp, mouse
ggaaatctaagttcatttca

SEQ ID NO: 464054 - DNA, 20 bp, mouse
ggagaaatatatgatcagtt

SEQ ID NO: 464055 - DNA, 20 bp, mouse
ggaggagatttgttcttgtc

SEQ ID NO: 464056 - DNA, 20 bp, mouse
gcgccgaggcgagggaacaa

SEQ ID NO: 464057 - DNA, 20 bp, mouse
gcgcgggcggcacacttccc

SEQ ID NO: 464058 - DNA, 20 bp, mouse
gccggcccgggtggagacat

SEQ ID NO: 464059 - DNA, 20 bp, mouse
gtccctcgcctcggcggctg

SEQ ID NO: 464060 - DNA, 20 bp, mouse
gagtcccctacaagcgcggg

SEQ ID NO: 464061 - DNA, 20 bp, mouse
gggctgaggcagtggcgccc

SEQ ID NO: 464062 - DNA, 20 bp, mouse
ggtgccgcccgcgcttgtag

SEQ ID NO: 464063 - DNA, 20 bp, mouse
gggccattgttccctcgcct

SEQ ID NO: 464064 - DNA, 20 bp, mouse
gacgagagtagggtctctct

SEQ ID NO: 464065 - DNA, 20 bp, mouse
gccaagtcccctacaagcgc

SEQ ID NO: 464066 - DNA, 20 bp, mouse
gctcctgtcccgagtggagg

SEQ ID NO: 464067 - DNA, 20 bp, mouse
gaggcgactcctgtcccgag

SEQ ID NO: 464068 - DNA, 20 bp, mouse
gcgactcctgtcccgagtgg

SEQ ID NO: 464069 - DNA, 20 bp, mouse
ggcccgccggccgcagacag

SEQ ID NO: 464070 - DNA, 20 bp, mouse
gctacgacagaggagactat

SEQ ID NO: 464071 - DNA, 20 bp, mouse
gcgccgcctccactcgggac

SEQ ID NO: 464072 - DNA, 20 bp, mouse
ggctccggtggagcgatcag

SEQ ID NO: 464073 - DNA, 20 bp, mouse
ggctgatagaaggaccgcgg

SEQ ID NO: 464074 - DNA, 20 bp, mouse
gcccctcacccctacgacag

SEQ ID NO: 464075 - DNA, 20 bp, mouse
gagagaggtcctggtatggg

SEQ ID NO: 464076 - DNA, 20 bp, mouse
ggaagagaaaggaaagcgcg

SEQ ID NO: 464077 - DNA, 20 bp, mouse
gcgcttggctcccggaatac

SEQ ID NO: 464078 - DNA, 20 bp, mouse
gaccttcgaccagagaacta

SEQ ID NO: 464079 - DNA, 20 bp, mouse
gaccctcaccgaggacacgg

SEQ ID NO: 464080 - DNA, 20 bp, mouse
gtgactacggcgggagggga

SEQ ID NO: 464081 - DNA, 20 bp, mouse
gcaggaagtgcgtcacgcgg

SEQ ID NO: 464082 - DNA, 20 bp, mouse
ggccgcagagctccaggagt

SEQ ID NO: 464083 - DNA, 20 bp, mouse
gagctaggcctgaccaagaa

SEQ ID NO: 464084 - DNA, 20 bp, mouse
ggaggggaaggcctgcgaat

SEQ ID NO: 464085 - DNA, 20 bp, mouse
ggccgaacgggttccagtct

SEQ ID NO: 464086 - DNA, 20 bp, mouse
gggcagaagtgactgcaaat

SEQ ID NO: 464087 - DNA, 20 bp, mouse
gaaggtaatgttagtactgt

SEQ ID NO: 464088 - DNA, 20 bp, mouse
gcagattgtgtggcaagcag

SEQ ID NO: 464089 - DNA, 20 bp, mouse
gctcgagggagtcctcaaag

SEQ ID NO: 464090 - DNA, 20 bp, mouse
gccctcaagtcttttagcag

SEQ ID NO: 464091 - DNA, 20 bp, mouse
gtcgtaaagtagcacttaaa

SEQ ID NO: 464092 - DNA, 20 bp, mouse
gcttgagggttcagattgtg

SEQ ID NO: 464093 - DNA, 20 bp, mouse
gacacagtgctcacgatcaa

SEQ ID NO: 464094 - DNA, 20 bp, mouse
ggccactgctaaaagacttg

SEQ ID NO: 464095 - DNA, 20 bp, mouse
gtgccttccggaatgtgaag

SEQ ID NO: 464096 - DNA, 20 bp, mouse
ggtggagcctccactgagag

SEQ ID NO: 464097 - DNA, 20 bp, mouse
gacccccaagcccctctcag

SEQ ID NO: 464098 - DNA, 20 bp, mouse
ggcttcggcctggcccagag

SEQ ID NO: 464099 - DNA, 20 bp, mouse
gccccgttctcagggacagg

SEQ ID NO: 464100 - DNA, 20 bp, mouse
gcctccccgttctcagggac

SEQ ID NO: 464101 - DNA, 20 bp, mouse
gctccacctgtccctgagaa

SEQ ID NO: 464102 - DNA, 20 bp, mouse
ggccatggtaagggcagtgg

SEQ ID NO: 464103 - DNA, 20 bp, mouse
gtagtagttggccatggtaa

SEQ ID NO: 464104 - DNA, 20 bp, mouse
ggtagggacagtgccgctct

SEQ ID NO: 464105 - DNA, 20 bp, mouse
ggagtctgacaagacttcgt

SEQ ID NO: 464106 - DNA, 20 bp, mouse
gggctcccgccagtagggaa

SEQ ID NO: 464107 - DNA, 20 bp, mouse
gcggcgttcggaggcgaggt

SEQ ID NO: 464108 - DNA, 20 bp, mouse
gtcccaacgcggctgatagg

SEQ ID NO: 464109 - DNA, 20 bp, mouse
ggtagggaacgggccgagct

SEQ ID NO: 464110 - DNA, 20 bp, mouse
gccacgggctcccgccagta

SEQ ID NO: 464111 - DNA, 20 bp, mouse
gggctccggttccctgaccc

SEQ ID NO: 464112 - DNA, 20 bp, mouse
gctgtgacgcagccatctcg

SEQ ID NO: 464113 - DNA, 20 bp, mouse
ggcctgtgcggccggggtca

SEQ ID NO: 464114 - DNA, 20 bp, mouse
gacgcgactgtaccccgaga

SEQ ID NO: 464115 - DNA, 20 bp, mouse
gtcggcccgttccctactgg

SEQ ID NO: 464116 - DNA, 20 bp, mouse
ggccgtgcgccggcagagag

SEQ ID NO: 464117 - DNA, 20 bp, mouse
gggcacccaagcggccgtgt

SEQ ID NO: 464118 - DNA, 20 bp, mouse
gccggcagagagcggagacg

SEQ ID NO: 464119 - DNA, 20 bp, mouse
ggccagcgctggcacccaag

SEQ ID NO: 464120 - DNA, 20 bp, mouse
gccggggcgagggtctagag

SEQ ID NO: 464121 - DNA, 20 bp, mouse
gccaagcggccgtgtgggag

SEQ ID NO: 464122 - DNA, 20 bp, mouse
ggcgctgggctcaaagaggt

SEQ ID NO: 464123 - DNA, 20 bp, mouse
ggccccggcctaggaacagc

SEQ ID NO: 464124 - DNA, 20 bp, mouse
ggcagagagcggagacgtgg

SEQ ID NO: 464125 - DNA, 20 bp, mouse
gcatcgcgctgggctcaaag

SEQ ID NO: 464126 - DNA, 20 bp, mouse
gagctcggcgacctgaggat

SEQ ID NO: 464127 - DNA, 20 bp, mouse
gtagctgaggacgccgaggt

SEQ ID NO: 464128 - DNA, 20 bp, mouse
gtccggagctcggcgacctg

SEQ ID NO: 464129 - DNA, 20 bp, mouse
ggctccggacccggcaggac

SEQ ID NO: 464130 - DNA, 20 bp, mouse
ggcagtagctgaggacgccg

SEQ ID NO: 464131 - DNA, 20 bp, mouse
gagcagaagggggctcgcag

SEQ ID NO: 464132 - DNA, 20 bp, mouse
gccgctcctagccagagata

SEQ ID NO: 464133 - DNA, 20 bp, mouse
gaagggggctcgcagaggtg

SEQ ID NO: 464134 - DNA, 20 bp, mouse
gcgcgttcgcaggcagcgtc

SEQ ID NO: 464135 - DNA, 20 bp, mouse
gcaaccgctggcggaaggaa

SEQ ID NO: 464136 - DNA, 20 bp, mouse
ggcgacggccttgagcgagg

SEQ ID NO: 464137 - DNA, 20 bp, mouse
gggctggcaggcgcacacgg

SEQ ID NO: 464138 - DNA, 20 bp, mouse
gaaggttgcgaagatggcga

SEQ ID NO: 464139 - DNA, 20 bp, mouse
gctagggtaggagtatgtag

SEQ ID NO: 464140 - DNA, 20 bp, mouse
gatggcgacggccttgagcg

SEQ ID NO: 464141 - DNA, 20 bp, mouse
gcgccggaccctcttaacca

SEQ ID NO: 464142 - DNA, 20 bp, mouse
ggccggtttggcggggtgaa

SEQ ID NO: 464143 - DNA, 20 bp, mouse
gggcgaggccgtggttaaga

SEQ ID NO: 464144 - DNA, 20 bp, mouse
ggaccctaccctctagccta

SEQ ID NO: 464145 - DNA, 20 bp, mouse
gctgctgaacgtgcgcaggg

SEQ ID NO: 464146 - DNA, 20 bp, mouse
gagtgtcggtggcgtcggag

SEQ ID NO: 464147 - DNA, 20 bp, mouse
gaccgacactgtgagctccg

SEQ ID NO: 464148 - DNA, 20 bp, mouse
ggtatcgcgtccatttacag

SEQ ID NO: 464149 - DNA, 20 bp, mouse
gctcacagtgtcggtggcgt

SEQ ID NO: 464150 - DNA, 20 bp, mouse
ggttggagttccaggagacg

SEQ ID NO: 464151 - DNA, 20 bp, mouse
gtactgaactacaggccgga

SEQ ID NO: 464152 - DNA, 20 bp, mouse
gttcggctcggagaaagtga

SEQ ID NO: 464153 - DNA, 20 bp, mouse
gtacaggccggagggcagcg

SEQ ID NO: 464154 - DNA, 20 bp, mouse
gaagagctttgctgtcgccc

SEQ ID NO: 464155 - DNA, 20 bp, mouse
gggatgcgatgagctctcct

SEQ ID NO: 464156 - DNA, 20 bp, mouse
gtccagggcgagcctctgag

SEQ ID NO: 464157 - DNA, 20 bp, mouse
gcaagcctggtggaagatgg

SEQ ID NO: 464158 - DNA, 20 bp, mouse
gtggaagatggcggcgtcca

SEQ ID NO: 464159 - DNA, 20 bp, mouse
ggcctctcagaggctcgccc

SEQ ID NO: 464160 - DNA, 20 bp, mouse
gtcagcgctcgcaagcctgg

SEQ ID NO: 464161 - DNA, 20 bp, mouse
gcgcagaaacccagagccgg

SEQ ID NO: 464162 - DNA, 20 bp, mouse
ggccgcggcgcaggaacccg

SEQ ID NO: 464163 - DNA, 20 bp, mouse
gtacttcccgagaggcggaa

SEQ ID NO: 464164 - DNA, 20 bp, mouse
ggagttgccgagagaagtgg

SEQ ID NO: 464165 - DNA, 20 bp, mouse
gccgggcagggaccccagag

SEQ ID NO: 464166 - DNA, 20 bp, mouse
gcagctgcgcctgaggccag

SEQ ID NO: 464167 - DNA, 20 bp, mouse
ggcgacgtaccgagcagcag

SEQ ID NO: 464168 - DNA, 20 bp, mouse
gcaggcgcagctgcttgagg

SEQ ID NO: 464169 - DNA, 20 bp, mouse
gcccaccgacggggtaccag

SEQ ID NO: 464170 - DNA, 20 bp, mouse
gtccccctggcagctccccc

SEQ ID NO: 464171 - DNA, 20 bp, mouse
gctgctcctgtagctccccc

SEQ ID NO: 464172 - DNA, 20 bp, mouse
gcctcaggcgcagctgcttg

SEQ ID NO: 464173 - DNA, 20 bp, mouse
ggacggggtaccaggggcga

SEQ ID NO: 464174 - DNA, 20 bp, mouse
gacccgagaacccaccgacg

SEQ ID NO: 464175 - DNA, 20 bp, mouse
gaagactgcctgaaagaggg

SEQ ID NO: 464176 - DNA, 20 bp, mouse
ggcgtagcgcagcccctctc

SEQ ID NO: 464177 - DNA, 20 bp, mouse
ggcagtgccatggctaccgg

SEQ ID NO: 464178 - DNA, 20 bp, mouse
ggcggcgtgacctccagaga

SEQ ID NO: 464179 - DNA, 20 bp, mouse
ggtgccatggctaccggtgg

SEQ ID NO: 464180 - DNA, 20 bp, mouse
gacgccgccaccggtagcca

SEQ ID NO: 464181 - DNA, 20 bp, mouse
gccgacctttgggcagaagg

SEQ ID NO: 464182 - DNA, 20 bp, mouse
ggcagaaggaggcaggtatt

SEQ ID NO: 464183 - DNA, 20 bp, mouse
gtcggagtcctgcagtgcca

SEQ ID NO: 464184 - DNA, 20 bp, mouse
gctggaggtcacgccgccac

SEQ ID NO: 464185 - DNA, 20 bp, mouse
gctgcccagggggaacccat

SEQ ID NO: 464186 - DNA, 20 bp, mouse
ggtccacaccagagaacctg

SEQ ID NO: 464187 - DNA, 20 bp, mouse
ggagccgacaggaaccgggg

SEQ ID NO: 464188 - DNA, 20 bp, mouse
gtgctccagtgaatccgccg

SEQ ID NO: 464189 - DNA, 20 bp, mouse
gcgggagccgacaggaaccg

SEQ ID NO: 464190 - DNA, 20 bp, mouse
gcgggttacgaccttccggg

SEQ ID NO: 464191 - DNA, 20 bp, mouse
gctggaagcgccggccccgg

SEQ ID NO: 464192 - DNA, 20 bp, mouse
gggaaggagttaccgggaaa

SEQ ID NO: 464193 - DNA, 20 bp, mouse
ggaaagggcaccggcccaac

SEQ ID NO: 464194 - DNA, 20 bp, mouse
gcactggagcacggacgctg

SEQ ID NO: 464195 - DNA, 20 bp, mouse
gcaccagagaacctggggag

SEQ ID NO: 464196 - DNA, 20 bp, mouse
gtcgctccgggtccaggata

SEQ ID NO: 464197 - DNA, 20 bp, mouse
gctggacccggagcgaggga

SEQ ID NO: 464198 - DNA, 20 bp, mouse
gctccgggtccaggataggg

SEQ ID NO: 464199 - DNA, 20 bp, mouse
gcctccgggcacttcctgaa

SEQ ID NO: 464200 - DNA, 20 bp, mouse
gggagtctgagcgtgtgcgt

SEQ ID NO: 464201 - DNA, 20 bp, mouse
gttgaggactgggttaggga

SEQ ID NO: 464202 - DNA, 20 bp, mouse
gaaccggcctccaaacagtg

SEQ ID NO: 464203 - DNA, 20 bp, mouse
gcggccaatgactaaaaagg

SEQ ID NO: 464204 - DNA, 20 bp, mouse
gcctgaaaggcttgaggact

SEQ ID NO: 464205 - DNA, 20 bp, mouse
ggactaaaaagggggcctcc

SEQ ID NO: 464206 - DNA, 20 bp, mouse
gccgatatggcgaccactct

SEQ ID NO: 464207 - DNA, 20 bp, mouse
gcgctctccgctgcccagag

SEQ ID NO: 464208 - DNA, 20 bp, mouse
gtggcgaccactctgggcag

SEQ ID NO: 464209 - DNA, 20 bp, mouse
gtcagcctccgggacttgag

SEQ ID NO: 464210 - DNA, 20 bp, mouse
gtgagcctctcaagtcccgg

SEQ ID NO: 464211 - DNA, 20 bp, mouse
gtgctgacagaaaaccgata

SEQ ID NO: 464212 - DNA, 20 bp, mouse
ggcgctggacccaaggtact

SEQ ID NO: 464213 - DNA, 20 bp, mouse
gtactaggtccgggactgga

SEQ ID NO: 464214 - DNA, 20 bp, mouse
gggaacactagctcagacag

SEQ ID NO: 464215 - DNA, 20 bp, mouse
ggacccaaggtactaggtcc

SEQ ID NO: 464216 - DNA, 20 bp, mouse
gacagctgtggagaacgaca

SEQ ID NO: 464217 - DNA, 20 bp, mouse
gaacagcccgacctcctagg

SEQ ID NO: 464218 - DNA, 20 bp, mouse
gggtaacagcccgacctcct

SEQ ID NO: 464219 - DNA, 20 bp, mouse
ggcgccgcgcaacacggcag

SEQ ID NO: 464220 - DNA, 20 bp, mouse
gccactagcgccgcgcaaca

SEQ ID NO: 464221 - DNA, 20 bp, mouse
gctgcctgcaagcagataag

SEQ ID NO: 464222 - DNA, 20 bp, mouse
gtgtcagctggagccaccgg

SEQ ID NO: 464223 - DNA, 20 bp, mouse
ggcgctgacgggctccgaag

SEQ ID NO: 464224 - DNA, 20 bp, mouse
gccaccggaggccggagtaa

SEQ ID NO: 464225 - DNA, 20 bp, mouse
gaaggggcgctgggcggata

SEQ ID NO: 464226 - DNA, 20 bp, mouse
gtccgcgtccgcactacctg

SEQ ID NO: 464227 - DNA, 20 bp, mouse
ggctccggggcgtaaagcct

SEQ ID NO: 464228 - DNA, 20 bp, mouse
gcgccgtgcgagccccatcc

SEQ ID NO: 464229 - DNA, 20 bp, mouse
gtctccatgcgccggctccg

SEQ ID NO: 464230 - DNA, 20 bp, mouse
gcgagcgccgcggagggcca

SEQ ID NO: 464231 - DNA, 20 bp, mouse
gtggtctgagcctcgcgcct

SEQ ID NO: 464232 - DNA, 20 bp, mouse
gggcagggcggaaactgggt

SEQ ID NO: 464233 - DNA, 20 bp, mouse
gggcaggggcgcccgaggca

SEQ ID NO: 464234 - DNA, 20 bp, mouse
gaccacaggtagtgcggacg

SEQ ID NO: 464235 - DNA, 20 bp, mouse
ggtcaaggctaccgagccag

SEQ ID NO: 464236 - DNA, 20 bp, mouse
gcgccagccagcgagcccgg

SEQ ID NO: 464237 - DNA, 20 bp, mouse
gcgcgcggcggtggacgacg

SEQ ID NO: 464238 - DNA, 20 bp, mouse
gctacccgggtgccacctca

SEQ ID NO: 464239 - DNA, 20 bp, mouse
gcggcgcgacgccagcgagg

SEQ ID NO: 464240 - DNA, 20 bp, mouse
gcggtggacgacgcgggctg

SEQ ID NO: 464241 - DNA, 20 bp, mouse
gggcgccgacagctccgcat

SEQ ID NO: 464242 - DNA, 20 bp, mouse
gtcgtagtgacacttcatgg

SEQ ID NO: 464243 - DNA, 20 bp, mouse
gtgtcactacgaggcgctgg

SEQ ID NO: 464244 - DNA, 20 bp, mouse
ggcctcgtagtgacacttca

SEQ ID NO: 464245 - DNA, 20 bp, mouse
ggcccgccggtcacctaccc

SEQ ID NO: 464246 - DNA, 20 bp, mouse
gccagcagggccgcagtacc

SEQ ID NO: 464247 - DNA, 20 bp, mouse
ggaggtgagagcagttacag

SEQ ID NO: 464248 - DNA, 20 bp, mouse
gccgcagtacctggcagccc

SEQ ID NO: 464249 - DNA, 20 bp, mouse
gccctgctgggactgcctga

SEQ ID NO: 464250 - DNA, 20 bp, mouse
gtcgaaggcactctacaaag

SEQ ID NO: 464251 - DNA, 20 bp, mouse
gcctggcagcccaggcttcc

SEQ ID NO: 464252 - DNA, 20 bp, mouse
gctggttgatagggatagga

SEQ ID NO: 464253 - DNA, 20 bp, mouse
gctgtggggtgctaaggtct

SEQ ID NO: 464254 - DNA, 20 bp, mouse
gtccctatcaaccagatcga

SEQ ID NO: 464255 - DNA, 20 bp, mouse
gtgatagggataggatggct

SEQ ID NO: 464256 - DNA, 20 bp, mouse
gtgacgctgtgtggagccag

SEQ ID NO: 464257 - DNA, 20 bp, mouse
gagcaggagtccacttgctg

SEQ ID NO: 464258 - DNA, 20 bp, mouse
gccacacagcgtcagactta

SEQ ID NO: 464259 - DNA, 20 bp, mouse
ggacttatggcgcttcactt

SEQ ID NO: 464260 - DNA, 20 bp, mouse
ggcaggcgtccgccccaccg

SEQ ID NO: 464261 - DNA, 20 bp, mouse
ggcggcagccggacggaaag

SEQ ID NO: 464262 - DNA, 20 bp, mouse
gcagcagggacagcctcggt

SEQ ID NO: 464263 - DNA, 20 bp, mouse
gcttccggcggaaaagaaag

SEQ ID NO: 464264 - DNA, 20 bp, mouse
ggccggaagttggagtacag

SEQ ID NO: 464265 - DNA, 20 bp, mouse
gcggctgcttcagggtgagt

SEQ ID NO: 464266 - DNA, 20 bp, mouse
gcgccgctctgccagcacag

SEQ ID NO: 464267 - DNA, 20 bp, mouse
gggccgctgtgctggcagag

SEQ ID NO: 464268 - DNA, 20 bp, mouse
ggctcgcgggcgctgatggg

SEQ ID NO: 464269 - DNA, 20 bp, mouse
gtggtggaagggctgtactg

SEQ ID NO: 464270 - DNA, 20 bp, mouse
gcagtgtgctggggtcgtag

SEQ ID NO: 464271 - DNA, 20 bp, mouse
gcggcccgccgaggccctgg

SEQ ID NO: 464272 - DNA, 20 bp, mouse
ggcagccgcggccgctgtgc

SEQ ID NO: 464273 - DNA, 20 bp, mouse
gaccttgagcgtctcgtagg

SEQ ID NO: 464274 - DNA, 20 bp, mouse
gcggcgccagcagcagccat

SEQ ID NO: 464275 - DNA, 20 bp, mouse
ggggccggtagcgatctggg

SEQ ID NO: 464276 - DNA, 20 bp, mouse
gtccgtccgcggccaggcag

SEQ ID NO: 464277 - DNA, 20 bp, mouse
gagggtggtgacgagcacag

SEQ ID NO: 464278 - DNA, 20 bp, mouse
ggcgagccgcggagccaggg

SEQ ID NO: 464279 - DNA, 20 bp, mouse
gatggcgagccgcggagcca

SEQ ID NO: 464280 - DNA, 20 bp, mouse
gcgtcaccaccctggctccg

SEQ ID NO: 464281 - DNA, 20 bp, mouse
gtccgcggccaggcagcggt

SEQ ID NO: 464282 - DNA, 20 bp, mouse
gcctggccgcggacggacga

SEQ ID NO: 464283 - DNA, 20 bp, mouse
gcggacggacgagggcggtt

SEQ ID NO: 464284 - DNA, 20 bp, mouse
gggccgcggacggacgaggg

SEQ ID NO: 464285 - DNA, 20 bp, mouse
gagactccgctcgccctccg

SEQ ID NO: 464286 - DNA, 20 bp, mouse
gaacagaggacagactcccc

SEQ ID NO: 464287 - DNA, 20 bp, mouse
gaccatcccccacggaacag

SEQ ID NO: 464288 - DNA, 20 bp, mouse
gcacaacaacaagcgtccag

SEQ ID NO: 464289 - DNA, 20 bp, mouse
gtctgtcctctgttccgtgg

SEQ ID NO: 464290 - DNA, 20 bp, mouse
gagacgtgatgggggttcag

SEQ ID NO: 464291 - DNA, 20 bp, mouse
ggggtccagtagccgagaca

SEQ ID NO: 464292 - DNA, 20 bp, mouse
gccagtagccgagacaggga

SEQ ID NO: 464293 - DNA, 20 bp, mouse
ggagtctgtcctctgttccg

SEQ ID NO: 464294 - DNA, 20 bp, mouse
gcgtctgtgaaggtgagtag

SEQ ID NO: 464295 - DNA, 20 bp, mouse
gtgccctcgaaagcgggtag

SEQ ID NO: 464296 - DNA, 20 bp, mouse
ggtcagcgctcgggcctcag

SEQ ID NO: 464297 - DNA, 20 bp, mouse
ggcgagcgagcgagtggacg

SEQ ID NO: 464298 - DNA, 20 bp, mouse
gagcgctcgggcctcagcgg

SEQ ID NO: 464299 - DNA, 20 bp, mouse
ggcccggcggcggaaaacag

SEQ ID NO: 464300 - DNA, 20 bp, mouse
ggctcgctcggtcagcgctc

SEQ ID NO: 464301 - DNA, 20 bp, mouse
gccgggaggaggcgaaacgg

SEQ ID NO: 464302 - DNA, 20 bp, mouse
gtggtggacctgcagtacga

SEQ ID NO: 464303 - DNA, 20 bp, mouse
gctggtcgtggagctgtcag

SEQ ID NO: 464304 - DNA, 20 bp, mouse
gcgcctctgataggataacg

SEQ ID NO: 464305 - DNA, 20 bp, mouse
ggtgccgggaggaggcgaaa

SEQ ID NO: 464306 - DNA, 20 bp, mouse
ggagatggtggcaggtccgg

SEQ ID NO: 464307 - DNA, 20 bp, mouse
gggaactcggaggcaacccc

SEQ ID NO: 464308 - DNA, 20 bp, mouse
ggatcaaagcggcgtactac

SEQ ID NO: 464309 - DNA, 20 bp, mouse
gccccctcccagccacaaca

SEQ ID NO: 464310 - DNA, 20 bp, mouse
ggtggaccctgtcaccgcta

SEQ ID NO: 464311 - DNA, 20 bp, mouse
gtgcttgcgtggccgtggag

SEQ ID NO: 464312 - DNA, 20 bp, mouse
ggcgccgaggcagccaatgg

SEQ ID NO: 464313 - DNA, 20 bp, mouse
gcggccacgggcgtcttaga

SEQ ID NO: 464314 - DNA, 20 bp, mouse
gggagaagccctagagccac

SEQ ID NO: 464315 - DNA, 20 bp, mouse
gatggagatggtggcaggtc

SEQ ID NO: 464316 - DNA, 20 bp, mouse
gccgcccctgccccactcac

SEQ ID NO: 464317 - DNA, 20 bp, mouse
gtcataggcgcaggaaatgg

SEQ ID NO: 464318 - DNA, 20 bp, mouse
gacccccaatgagggatcag

SEQ ID NO: 464319 - DNA, 20 bp, mouse
gtcaggggcggggccttcat

SEQ ID NO: 464320 - DNA, 20 bp, mouse
gtctcacccaaagcattagg

SEQ ID NO: 464321 - DNA, 20 bp, mouse
ggaccaaggagcctgtgagt

SEQ ID NO: 464322 - DNA, 20 bp, mouse
gccttcataggcgcaggaaa

SEQ ID NO: 464323 - DNA, 20 bp, mouse
gacagccggcataggcgcag

SEQ ID NO: 464324 - DNA, 20 bp, mouse
ggaccacccgctaggcactt

SEQ ID NO: 464325 - DNA, 20 bp, mouse
gcaggaaatggcggcgacca

SEQ ID NO: 464326 - DNA, 20 bp, mouse
gtagcagcggcagaggacgg

SEQ ID NO: 464327 - DNA, 20 bp, mouse
gtcggcctgaggatcccggg

SEQ ID NO: 464328 - DNA, 20 bp, mouse
ggcggcgacagccgtagcag

SEQ ID NO: 464329 - DNA, 20 bp, mouse
gccgtagcagcggcagagga

SEQ ID NO: 464330 - DNA, 20 bp, mouse
gacggcggaagcaacactgg

SEQ ID NO: 464331 - DNA, 20 bp, mouse
ggtcgccgcccgggatcctc

SEQ ID NO: 464332 - DNA, 20 bp, mouse
gagccggccggcctactgct

SEQ ID NO: 464333 - DNA, 20 bp, mouse
gctgctcggcctgaggatcc

SEQ ID NO: 464334 - DNA, 20 bp, mouse
gctcaggccgagcagtaggc

SEQ ID NO: 464335 - DNA, 20 bp, mouse
gctgcccgcagcggaaatgg

SEQ ID NO: 464336 - DNA, 20 bp, mouse
gtcagttattgacagagcag

SEQ ID NO: 464337 - DNA, 20 bp, mouse
gagcaggggaagaacactcg

SEQ ID NO: 464338 - DNA, 20 bp, mouse
gactcgtggaaggacccaga

SEQ ID NO: 464339 - DNA, 20 bp, mouse
gtaccttgtacctgaactgg

SEQ ID NO: 464340 - DNA, 20 bp, mouse
gtgagaaggaaaagcaacgg

SEQ ID NO: 464341 - DNA, 20 bp, mouse
gggggaagaacactcgtgga

SEQ ID NO: 464342 - DNA, 20 bp, mouse
gcatggctggctgatccttc

SEQ ID NO: 464343 - DNA, 20 bp, mouse
gagggatggtaggaatccag

SEQ ID NO: 464344 - DNA, 20 bp, mouse
gaagtaaagctggtatatcc

SEQ ID NO: 464345 - DNA, 20 bp, mouse
gcttctgctggaagcccctc

SEQ ID NO: 464346 - DNA, 20 bp, mouse
gctgtgggcttgaggctgag

SEQ ID NO: 464347 - DNA, 20 bp, mouse
gagagcggcctagaaaggag

SEQ ID NO: 464348 - DNA, 20 bp, mouse
ggcgcttgcgcactttgtag

SEQ ID NO: 464349 - DNA, 20 bp, mouse
gtgggttcaggaccccatga

SEQ ID NO: 464350 - DNA, 20 bp, mouse
gcgcgagtctaggccctcat

SEQ ID NO: 464351 - DNA, 20 bp, mouse
gggctccctggacagagggg

SEQ ID NO: 464352 - DNA, 20 bp, mouse
gaggatggctccctggacag

SEQ ID NO: 464353 - DNA, 20 bp, mouse
gctgagaggaacgcgagtct

SEQ ID NO: 464354 - DNA, 20 bp, mouse
gccaccaggtggtcaggtgt

SEQ ID NO: 464355 - DNA, 20 bp, mouse
gaactagccagatcaaagat

SEQ ID NO: 464356 - DNA, 20 bp, mouse
gagacagtcagcgatcccgg

SEQ ID NO: 464357 - DNA, 20 bp, mouse
gtaaggggctgacatcagag

SEQ ID NO: 464358 - DNA, 20 bp, mouse
gggggctgacatcagagggg

SEQ ID NO: 464359 - DNA, 20 bp, mouse
ggggcgaagtccctcaacgc

SEQ ID NO: 464360 - DNA, 20 bp, mouse
gtgctgaagcggaagggatg

SEQ ID NO: 464361 - DNA, 20 bp, mouse
gtgcttatgctgaagcggaa

SEQ ID NO: 464362 - DNA, 20 bp, mouse
ggcggctggtagacgcttgg

SEQ ID NO: 464363 - DNA, 20 bp, mouse
ggcctgctctcgtgcagcag

SEQ ID NO: 464364 - DNA, 20 bp, mouse
ggtatgctattatcatagcc

SEQ ID NO: 464365 - DNA, 20 bp, mouse
gaatggaaaactgaatgaca

SEQ ID NO: 464366 - DNA, 20 bp, mouse
gggtcccggcggtaagatgg

SEQ ID NO: 464367 - DNA, 20 bp, mouse
ggcggagtgcgatgtggtaa

SEQ ID NO: 464368 - DNA, 20 bp, mouse
gccgccgggaccagagagcc

SEQ ID NO: 464369 - DNA, 20 bp, mouse
gtctggtcccggcggtaaga

SEQ ID NO: 464370 - DNA, 20 bp, mouse
ggctaccgcggagtgcgatg

SEQ ID NO: 464371 - DNA, 20 bp, mouse
gccacccggctctctggtcc

SEQ ID NO: 464372 - DNA, 20 bp, mouse
gtcgactccagctcagatgg

SEQ ID NO: 464373 - DNA, 20 bp, mouse
gtcctccagcagttcaggct

SEQ ID NO: 464374 - DNA, 20 bp, mouse
gaccgagcctgaactgctgg

SEQ ID NO: 464375 - DNA, 20 bp, mouse
gccgggtggtagagtcatgg

SEQ ID NO: 464376 - DNA, 20 bp, mouse
gtggttagccgggaaaatgg

SEQ ID NO: 464377 - DNA, 20 bp, mouse
gacctcagtagccacagtgg

SEQ ID NO: 464378 - DNA, 20 bp, mouse
gtggcctggggactgcggat

SEQ ID NO: 464379 - DNA, 20 bp, mouse
ggggacctcagtagccacag

SEQ ID NO: 464380 - DNA, 20 bp, mouse
gtcgggagagagtggtgctt

SEQ ID NO: 464381 - DNA, 20 bp, mouse
ggcgggccaacggtcccagg

SEQ ID NO: 464382 - DNA, 20 bp, mouse
gtggtggttagccgggaaaa

SEQ ID NO: 464383 - DNA, 20 bp, mouse
ggggcctgtggacccagacc

SEQ ID NO: 464384 - DNA, 20 bp, mouse
gaccgccactgtggctactg

SEQ ID NO: 464385 - DNA, 20 bp, mouse
gaggctgcgcttgcgcagaa

SEQ ID NO: 464386 - DNA, 20 bp, mouse
gaggctgctccgcgaacccg

SEQ ID NO: 464387 - DNA, 20 bp, mouse
ggtgcaccccgaccgagtag

SEQ ID NO: 464388 - DNA, 20 bp, mouse
gctgtccagcagagcggctg

SEQ ID NO: 464389 - DNA, 20 bp, mouse
gctgtggctacagcttcccc

SEQ ID NO: 464390 - DNA, 20 bp, mouse
ggcaggcgcccagagttatt

SEQ ID NO: 464391 - DNA, 20 bp, mouse
gctgctggacagcggaccgc

SEQ ID NO: 464392 - DNA, 20 bp, mouse
gcaccccgaccgagtagagg

SEQ ID NO: 464393 - DNA, 20 bp, mouse
gcgcggagcagcctcttccc

SEQ ID NO: 464394 - DNA, 20 bp, mouse
gcccgcgagagcacaagtcc

SEQ ID NO: 464395 - DNA, 20 bp, mouse
gtgcggcgcgaggcttcgga

SEQ ID NO: 464396 - DNA, 20 bp, mouse
gagggtactcaccattccgg

SEQ ID NO: 464397 - DNA, 20 bp, mouse
gctagcaaccagagcagtga

SEQ ID NO: 464398 - DNA, 20 bp, mouse
gacggtagcaaccgccggaa

SEQ ID NO: 464399 - DNA, 20 bp, mouse
gtggagggtactcaccattc

SEQ ID NO: 464400 - DNA, 20 bp, mouse
ggcctgcgcactgaccccgg

SEQ ID NO: 464401 - DNA, 20 bp, mouse
gtttggctgcgaggcctgga

SEQ ID NO: 464402 - DNA, 20 bp, mouse
gcagtgacggtagcaaccgc

SEQ ID NO: 464403 - DNA, 20 bp, mouse
gtggttgctagggcccgccg

SEQ ID NO: 464404 - DNA, 20 bp, mouse
gagagccgcaggcccaaggc

SEQ ID NO: 464405 - DNA, 20 bp, mouse
ggttgctaccgtcactgctc

SEQ ID NO: 464406 - DNA, 20 bp, mouse
gcccccgcgggagcaggtga

SEQ ID NO: 464407 - DNA, 20 bp, mouse
gagccagcgcacccccgcca

SEQ ID NO: 464408 - DNA, 20 bp, mouse
gtccttgacaaccctggcgg

SEQ ID NO: 464409 - DNA, 20 bp, mouse
gacccccgccagggttgtca

SEQ ID NO: 464410 - DNA, 20 bp, mouse
ggctcgctccttgacaaccc

SEQ ID NO: 464411 - DNA, 20 bp, mouse
gcgggctggggacctaggtg

SEQ ID NO: 464412 - DNA, 20 bp, mouse
gtgtcccacgtaggagacca

SEQ ID NO: 464413 - DNA, 20 bp, mouse
gtcctacgtgggacaagggg

SEQ ID NO: 464414 - DNA, 20 bp, mouse
gacctccccttgtcccacgt

SEQ ID NO: 464415 - DNA, 20 bp, mouse
ggtctcctacgtgggacaag

SEQ ID NO: 464416 - DNA, 20 bp, mouse
ggagtctgctgggggtatca

SEQ ID NO: 464417 - DNA, 20 bp, mouse
gaggggtaacaactccgtag

SEQ ID NO: 464418 - DNA, 20 bp, mouse
gaactccgtagcggcccctg

SEQ ID NO: 464419 - DNA, 20 bp, mouse
gtgggacagggatggaggtt

SEQ ID NO: 464420 - DNA, 20 bp, mouse
gttccggctcaccaacaccg

SEQ ID NO: 464421 - DNA, 20 bp, mouse
ggtatgaacaggcgtctcag

SEQ ID NO: 464422 - DNA, 20 bp, mouse
gaggccccgccccatccatg

SEQ ID NO: 464423 - DNA, 20 bp, mouse
ggtctagagagtcagaacag

SEQ ID NO: 464424 - DNA, 20 bp, mouse
gtcaagtccaagaagaggtc

SEQ ID NO: 464425 - DNA, 20 bp, mouse
gggtagtcaagtccaagaag

SEQ ID NO: 464426 - DNA, 20 bp, mouse
gacagacctgctagctctca

SEQ ID NO: 464427 - DNA, 20 bp, mouse
gagcgaccctgagagctagc

SEQ ID NO: 464428 - DNA, 20 bp, mouse
gagttccagtgcagactcgg

SEQ ID NO: 464429 - DNA, 20 bp, mouse
ggctctcagggtcgctgtcc

SEQ ID NO: 464430 - DNA, 20 bp, mouse
gagctgcagcaggttgacca

SEQ ID NO: 464431 - DNA, 20 bp, mouse
gggctttcaggtaagtacag

SEQ ID NO: 464432 - DNA, 20 bp, mouse
gaaggcaggttggcattgcc

SEQ ID NO: 464433 - DNA, 20 bp, mouse
gctgcctgaacctttaaaac

SEQ ID NO: 464434 - DNA, 20 bp, mouse
gcctgaaagccaatctgaga

SEQ ID NO: 464435 - DNA, 20 bp, mouse
ggtacacatgcgccctgggg

SEQ ID NO: 464436 - DNA, 20 bp, mouse
ggctccagccaaggcgggta

SEQ ID NO: 464437 - DNA, 20 bp, mouse
ggagctgcgattctgtggag

SEQ ID NO: 464438 - DNA, 20 bp, mouse
gggctggagctgcgattctg

SEQ ID NO: 464439 - DNA, 20 bp, mouse
gatcgcagctccagccaagg

SEQ ID NO: 464440 - DNA, 20 bp, mouse
ggccagctaggaagatactg

SEQ ID NO: 464441 - DNA, 20 bp, mouse
gtgcgcgtccttacccgcct

SEQ ID NO: 464442 - DNA, 20 bp, mouse
gcgggtaaggacgcgcagtt

SEQ ID NO: 464443 - DNA, 20 bp, mouse
ggcaggcgtggggccgactt

SEQ ID NO: 464444 - DNA, 20 bp, mouse
gtcaacgctgaggcaggcgt

SEQ ID NO: 464445 - DNA, 20 bp, mouse
ggaggaggttgtctctactg

SEQ ID NO: 464446 - DNA, 20 bp, mouse
gccagactgagggcctaaga

SEQ ID NO: 464447 - DNA, 20 bp, mouse
gcagccccttggacttacct

SEQ ID NO: 464448 - DNA, 20 bp, mouse
gtgagattcagtccagactg

SEQ ID NO: 464449 - DNA, 20 bp, mouse
gcgggctgcaggccaatcct

SEQ ID NO: 464450 - DNA, 20 bp, mouse
gcagcccaggtaagtccaag

SEQ ID NO: 464451 - DNA, 20 bp, mouse
gcctgggtgccagatctagt

SEQ ID NO: 464452 - DNA, 20 bp, mouse
gtagatctggcacccaggat

SEQ ID NO: 464453 - DNA, 20 bp, mouse
gggactgaatctcactgact

SEQ ID NO: 464454 - DNA, 20 bp, mouse
ggagccacagcgctgcggat

SEQ ID NO: 464455 - DNA, 20 bp, mouse
gagaaacacgggagtgtgtc

SEQ ID NO: 464456 - DNA, 20 bp, mouse
gcagcagggaggccaggcgt

SEQ ID NO: 464457 - DNA, 20 bp, mouse
gccttagggccagggtgtca

SEQ ID NO: 464458 - DNA, 20 bp, mouse
ggaaggtgcgagtggtgtcc

SEQ ID NO: 464459 - DNA, 20 bp, mouse
gctcccagctgtggactcca

SEQ ID NO: 464460 - DNA, 20 bp, mouse
gagctgggagaaggtgcgag

SEQ ID NO: 464461 - DNA, 20 bp, mouse
gcagggtgtcatggagggca

SEQ ID NO: 464462 - DNA, 20 bp, mouse
gcgtggggaagctgggtgca

SEQ ID NO: 464463 - DNA, 20 bp, mouse
ggggtctgaagttgccctgg

SEQ ID NO: 464464 - DNA, 20 bp, mouse
ggctggatgaagacagtgcc

SEQ ID NO: 464465 - DNA, 20 bp, mouse
gggatctgtgcttccctcgg

SEQ ID NO: 464466 - DNA, 20 bp, mouse
gtgccatgaggcgacagcaa

SEQ ID NO: 464467 - DNA, 20 bp, mouse
ggcagctcagggcttcggca

SEQ ID NO: 464468 - DNA, 20 bp, mouse
gcccgccaggcccaatacgg

SEQ ID NO: 464469 - DNA, 20 bp, mouse
gtccgtgaagacatgaggtt

SEQ ID NO: 464470 - DNA, 20 bp, mouse
ggaagccctgagctgctatg

SEQ ID NO: 464471 - DNA, 20 bp, mouse
gggagtccccatagcagctc

SEQ ID NO: 464472 - DNA, 20 bp, mouse
gggaggtccgtgaagacatg

SEQ ID NO: 464473 - DNA, 20 bp, mouse
gaagcccgccaggcccaata

SEQ ID NO: 464474 - DNA, 20 bp, mouse
gggtctagggatactccaaa

SEQ ID NO: 464475 - DNA, 20 bp, mouse
ggcttgtgggacaacttcat

SEQ ID NO: 464476 - DNA, 20 bp, mouse
ggcacttgtccgcagagtaa

SEQ ID NO: 464477 - DNA, 20 bp, mouse
gagcatgcttctgatgccag

SEQ ID NO: 464478 - DNA, 20 bp, mouse
ggaatgtgtcacttacagga

SEQ ID NO: 464479 - DNA, 20 bp, mouse
gagactaggcgactaactac

SEQ ID NO: 464480 - DNA, 20 bp, mouse
gaggagaatgtgtcacttac

SEQ ID NO: 464481 - DNA, 20 bp, mouse
ggcatcagaagcatgctcta

SEQ ID NO: 464482 - DNA, 20 bp, mouse
gacttggcgggaggaggact

SEQ ID NO: 464483 - DNA, 20 bp, mouse
ggataaaagggcatcgaaga

SEQ ID NO: 464484 - DNA, 20 bp, mouse
gttacatgatatagtcctgg

SEQ ID NO: 464485 - DNA, 20 bp, mouse
ggttagtcgcctagtctgta

SEQ ID NO: 464486 - DNA, 20 bp, mouse
gagtcgacaactgagcacaa

SEQ ID NO: 464487 - DNA, 20 bp, mouse
ggagtcccatgtcatctgat

SEQ ID NO: 464488 - DNA, 20 bp, mouse
gagaacccatcagatgacat

SEQ ID NO: 464489 - DNA, 20 bp, mouse
gacccgcaagggagccaacg

SEQ ID NO: 464490 - DNA, 20 bp, mouse
gggtgaagctgtggactggt

SEQ ID NO: 464491 - DNA, 20 bp, mouse
gatatggtgaagctgtggac

SEQ ID NO: 464492 - DNA, 20 bp, mouse
gaagaaagaactgttcttag

SEQ ID NO: 464493 - DNA, 20 bp, mouse
gtggccttcattccatgcag

SEQ ID NO: 464494 - DNA, 20 bp, mouse
ggaaagtctgggactgtctc

SEQ ID NO: 464495 - DNA, 20 bp, mouse
gatgtgcaaatagaaagtct

SEQ ID NO: 464496 - DNA, 20 bp, mouse
gagggcagggaatcttccag

SEQ ID NO: 464497 - DNA, 20 bp, mouse
gagaggcagaagccgaaaga

SEQ ID NO: 464498 - DNA, 20 bp, mouse
gccgaaagaaggtctaaaga

SEQ ID NO: 464499 - DNA, 20 bp, mouse
gccgtgcccaacaatcactt

SEQ ID NO: 464500 - DNA, 20 bp, mouse
gcttacctcgcactcccgtt

SEQ ID NO: 464501 - DNA, 20 bp, mouse
ggagaacaaggcagccctgg

SEQ ID NO: 464502 - DNA, 20 bp, mouse
ggaacttgagggggcgtgga

SEQ ID NO: 464503 - DNA, 20 bp, mouse
gcagtccaaacgggagtgcg

SEQ ID NO: 464504 - DNA, 20 bp, mouse
gctggggctactgtacctgg

SEQ ID NO: 464505 - DNA, 20 bp, mouse
gcccccagcaatggtgtgag

SEQ ID NO: 464506 - DNA, 20 bp, mouse
gctgctagcggcggagatgg

SEQ ID NO: 464507 - DNA, 20 bp, mouse
ggtgacggcggcgctgctag

SEQ ID NO: 464508 - DNA, 20 bp, mouse
gacggcggcgctgctagcgg

SEQ ID NO: 464509 - DNA, 20 bp, mouse
ggaggagctgggcgcggtga

SEQ ID NO: 464510 - DNA, 20 bp, mouse
gacggtcccggagcaggcag

SEQ ID NO: 464511 - DNA, 20 bp, mouse
ggcggagagaacgcagaagc

SEQ ID NO: 464512 - DNA, 20 bp, mouse
gcaggggcgcggcggacacc

SEQ ID NO: 464513 - DNA, 20 bp, mouse
gggcggggaggcatagcgag

SEQ ID NO: 464514 - DNA, 20 bp, mouse
gcccagccctgtcggaacgg

SEQ ID NO: 464515 - DNA, 20 bp, mouse
ggctgggaggcgcacggtcc

SEQ ID NO: 464516 - DNA, 20 bp, mouse
gagaagctagaggacctgag

SEQ ID NO: 464517 - DNA, 20 bp, mouse
ggtacaacagtcactcttgg

SEQ ID NO: 464518 - DNA, 20 bp, mouse
gcagcagctgtaatgggagc

SEQ ID NO: 464519 - DNA, 20 bp, mouse
gagaagtcagcagctgtaat

SEQ ID NO: 464520 - DNA, 20 bp, mouse
gtgtatggagggaagacata

SEQ ID NO: 464521 - DNA, 20 bp, mouse
gaagaatgctggaatccaac

SEQ ID NO: 464522 - DNA, 20 bp, mouse
gatggagggaagacataggg

SEQ ID NO: 464523 - DNA, 20 bp, mouse
ggatttacataattgttaat

SEQ ID NO: 464524 - DNA, 20 bp, mouse
gggtaatccaactgaaaaag

SEQ ID NO: 464525 - DNA, 20 bp, mouse
gtatttgtccataggacatg

SEQ ID NO: 464526 - DNA, 20 bp, mouse
gtggtcgacgcagcttcacg

SEQ ID NO: 464527 - DNA, 20 bp, mouse
gtcgacgcagcttcacgggg

SEQ ID NO: 464528 - DNA, 20 bp, mouse
gcacggggcggtgcaagaaa

SEQ ID NO: 464529 - DNA, 20 bp, mouse
ggctgcgcccgttaccaaaa

SEQ ID NO: 464530 - DNA, 20 bp, mouse
ggcacactacgaagtagtgt

SEQ ID NO: 464531 - DNA, 20 bp, mouse
gattcgcaggcgggatgttg

SEQ ID NO: 464532 - DNA, 20 bp, mouse
ggtgcaagaaaaggtggcta

SEQ ID NO: 464533 - DNA, 20 bp, mouse
gaaggtggctaaggattcgc

SEQ ID NO: 464534 - DNA, 20 bp, mouse
ggagctccgcgccgggatca

SEQ ID NO: 464535 - DNA, 20 bp, mouse
gggggctcgcctaaagaccg

SEQ ID NO: 464536 - DNA, 20 bp, mouse
gagagccagagcaggagcgg

SEQ ID NO: 464537 - DNA, 20 bp, mouse
gggcccggcgggctgcgatc

SEQ ID NO: 464538 - DNA, 20 bp, mouse
gccgggcccgccgcaaccat

SEQ ID NO: 464539 - DNA, 20 bp, mouse
gccggccgccgctcctgctc

SEQ ID NO: 464540 - DNA, 20 bp, mouse
ggctgcagccgcgaagccgg

SEQ ID NO: 464541 - DNA, 20 bp, mouse
gcgcacgcagtcgggatatt

SEQ ID NO: 464542 - DNA, 20 bp, mouse
ggccagcccgcggatatcag

SEQ ID NO: 464543 - DNA, 20 bp, mouse
gctcttggcccccggcttcg

SEQ ID NO: 464544 - DNA, 20 bp, mouse
ggacgatggggtgaacgagg

SEQ ID NO: 464545 - DNA, 20 bp, mouse
gtttcgtgggcaggtaggag

SEQ ID NO: 464546 - DNA, 20 bp, mouse
ggtgcgggctcccgaggaaa

SEQ ID NO: 464547 - DNA, 20 bp, mouse
ggaggaagcaagcgggctgt

SEQ ID NO: 464548 - DNA, 20 bp, mouse
ggctcccgaggaaagggcgg

SEQ ID NO: 464549 - DNA, 20 bp, mouse
gggagttgctgtgagcagac

SEQ ID NO: 464550 - DNA, 20 bp, mouse
gcagacaggcagcaagctag

SEQ ID NO: 464551 - DNA, 20 bp, mouse
gccggccgctgaggacgcga

SEQ ID NO: 464552 - DNA, 20 bp, mouse
ggagtccgtcgcgtcctcag

SEQ ID NO: 464553 - DNA, 20 bp, mouse
gttggcccaagggcactcgg

SEQ ID NO: 464554 - DNA, 20 bp, mouse
gcagcaagctagtggtgagt

SEQ ID NO: 464555 - DNA, 20 bp, mouse
gaggccacgcgccacgacag

SEQ ID NO: 464556 - DNA, 20 bp, mouse
ggcctgagaaccggatgagg

SEQ ID NO: 464557 - DNA, 20 bp, mouse
gggatgaggcggcgactctg

SEQ ID NO: 464558 - DNA, 20 bp, mouse
gagcgggcgtcgcggcgaag

SEQ ID NO: 464559 - DNA, 20 bp, mouse
ggtcgcctgagaaccggatg

SEQ ID NO: 464560 - DNA, 20 bp, mouse
gtcgccgcgacgcccgctcc

SEQ ID NO: 464561 - DNA, 20 bp, mouse
ggtcgcggcgaaggggagac

SEQ ID NO: 464562 - DNA, 20 bp, mouse
gcggcggaggcggacaccat

SEQ ID NO: 464563 - DNA, 20 bp, mouse
gggcgaaggggagaccgggc

SEQ ID NO: 464564 - DNA, 20 bp, mouse
ggagccgggagcgggcgtcg

SEQ ID NO: 464565 - DNA, 20 bp, mouse
gtcgggtgtcgcctgagaac

SEQ ID NO: 464566 - DNA, 20 bp, mouse
gggaggcagggatcggacat

SEQ ID NO: 464567 - DNA, 20 bp, mouse
gtcgctgtgcggggctcaca

SEQ ID NO: 464568 - DNA, 20 bp, mouse
gctgtgcggggctcacacgg

SEQ ID NO: 464569 - DNA, 20 bp, mouse
ggctgtcaggatcctagcag

SEQ ID NO: 464570 - DNA, 20 bp, mouse
ggccccgcacagcgacaacc

SEQ ID NO: 464571 - DNA, 20 bp, mouse
gtcgtgggctgtgagctgtc

SEQ ID NO: 464572 - DNA, 20 bp, mouse
gagtcgaacagggacctgtg

SEQ ID NO: 464573 - DNA, 20 bp, mouse
gggctgcgcaagcgcgtcgt

SEQ ID NO: 464574 - DNA, 20 bp, mouse
gtggccgcacaggcaagatg

SEQ ID NO: 464575 - DNA, 20 bp, mouse
gcagcccagagaggcgaagg

SEQ ID NO: 464576 - DNA, 20 bp, mouse
gcagttcctctgagacgcta

SEQ ID NO: 464577 - DNA, 20 bp, mouse
gtaacgtcccccacgaagag

SEQ ID NO: 464578 - DNA, 20 bp, mouse
ggaactgccactcttcgtgg

SEQ ID NO: 464579 - DNA, 20 bp, mouse
gttctgccctagcgtctcag

SEQ ID NO: 464580 - DNA, 20 bp, mouse
gctcccagcactgtgaacca

SEQ ID NO: 464581 - DNA, 20 bp, mouse
gcacagtgtgtgcactggac

SEQ ID NO: 464582 - DNA, 20 bp, mouse
ggaggaactgccactcttcg

SEQ ID NO: 464583 - DNA, 20 bp, mouse
gacatcagtgggaccccaag

SEQ ID NO: 464584 - DNA, 20 bp, mouse
gatggggctacagaggtcaa

SEQ ID NO: 464585 - DNA, 20 bp, mouse
gtcaaagatggctcggacca

SEQ ID NO: 464586 - DNA, 20 bp, mouse
gcaagcgcaggcactcgggc

SEQ ID NO: 464587 - DNA, 20 bp, mouse
gcgcgcgcgcgaaaaagccg

SEQ ID NO: 464588 - DNA, 20 bp, mouse
ggggctggagctgttcgcgc

SEQ ID NO: 464589 - DNA, 20 bp, mouse
gagcctggctgaccaaagag

SEQ ID NO: 464590 - DNA, 20 bp, mouse
ggcgcgcgcggaaaccaatt

SEQ ID NO: 464591 - DNA, 20 bp, mouse
ggtgcctgcgcttgcctccc

SEQ ID NO: 464592 - DNA, 20 bp, mouse
gtaggtgccacgcagggtgg

SEQ ID NO: 464593 - DNA, 20 bp, mouse
gtgcgcgccctggctgtcag

SEQ ID NO: 464594 - DNA, 20 bp, mouse
gacagctctgaacgagaccc

SEQ ID NO: 464595 - DNA, 20 bp, mouse
gcaaagaggggaacccctga

SEQ ID NO: 464596 - DNA, 20 bp, mouse
gcagaggacgagccgggacg

SEQ ID NO: 464597 - DNA, 20 bp, mouse
ggcggcgcgcagaagaggag

SEQ ID NO: 464598 - DNA, 20 bp, mouse
ggcgcgagcagaggacgagc

SEQ ID NO: 464599 - DNA, 20 bp, mouse
gctgccgcggcgccgcgtcc

SEQ ID NO: 464600 - DNA, 20 bp, mouse
gaccgtgtggcccggcgggt

SEQ ID NO: 464601 - DNA, 20 bp, mouse
ggagccgggacgcggcgccg

SEQ ID NO: 464602 - DNA, 20 bp, mouse
gggccgtgctggttaccgtg

SEQ ID NO: 464603 - DNA, 20 bp, mouse
gagagcccggaaggcggagg

SEQ ID NO: 464604 - DNA, 20 bp, mouse
gtgtggcccggcgggtcggg

SEQ ID NO: 464605 - DNA, 20 bp, mouse
gctgagagcgcggaccgccc

SEQ ID NO: 464606 - DNA, 20 bp, mouse
gagagtcctggggataacgg

SEQ ID NO: 464607 - DNA, 20 bp, mouse
gcctgagctgtactgcagag

SEQ ID NO: 464608 - DNA, 20 bp, mouse
gtgcacctggccttatgggt

SEQ ID NO: 464609 - DNA, 20 bp, mouse
ggggctgcacctggccttat

SEQ ID NO: 464610 - DNA, 20 bp, mouse
ggtccagaaacctacccata

SEQ ID NO: 464611 - DNA, 20 bp, mouse
ggacagagtcctggggataa

SEQ ID NO: 464612 - DNA, 20 bp, mouse
gccccgcccccgttatcccc

SEQ ID NO: 464613 - DNA, 20 bp, mouse
ggtttctggacagagtcctg

SEQ ID NO: 464614 - DNA, 20 bp, mouse
ggaaacctacccataaggcc

SEQ ID NO: 464615 - DNA, 20 bp, mouse
gtccctgctgaagacagtag

SEQ ID NO: 464616 - DNA, 20 bp, mouse
ggcggctgcgagacgagggg

SEQ ID NO: 464617 - DNA, 20 bp, mouse
gcaggcgagagcgtccacgc

SEQ ID NO: 464618 - DNA, 20 bp, mouse
gggctgcggctgcgagacga

SEQ ID NO: 464619 - DNA, 20 bp, mouse
ggcggcgacgaggacgctac

SEQ ID NO: 464620 - DNA, 20 bp, mouse
gagagcgtccacgcgggctg

SEQ ID NO: 464621 - DNA, 20 bp, mouse
ggagacgaggggcggcgacg

SEQ ID NO: 464622 - DNA, 20 bp, mouse
gggccacccgggctagtccg

SEQ ID NO: 464623 - DNA, 20 bp, mouse
ggcgcgccagtgggccaccc

SEQ ID NO: 464624 - DNA, 20 bp, mouse
ggccgggcgcgcacgggagt

SEQ ID NO: 464625 - DNA, 20 bp, mouse
gcgacgaggacgctacgggc

SEQ ID NO: 464626 - DNA, 20 bp, mouse
gtgggctctgtccccagagt

SEQ ID NO: 464627 - DNA, 20 bp, mouse
gatgatagatccccactctg

SEQ ID NO: 464628 - DNA, 20 bp, mouse
ggctcaggaagcttgccctt

SEQ ID NO: 464629 - DNA, 20 bp, mouse
gagatggatacagtagatgt

SEQ ID NO: 464630 - DNA, 20 bp, mouse
gaagctgctagtccatagct

SEQ ID NO: 464631 - DNA, 20 bp, mouse
gggaggaacgctgaagtacg

SEQ ID NO: 464632 - DNA, 20 bp, mouse
gcagtgcaatttcccagcta

SEQ ID NO: 464633 - DNA, 20 bp, mouse
gctacagggcctagcagaag

SEQ ID NO: 464634 - DNA, 20 bp, mouse
gtggatggactgcctaggag

SEQ ID NO: 464635 - DNA, 20 bp, mouse
gcctactgtgaggcatgggg

SEQ ID NO: 464636 - DNA, 20 bp, mouse
gggcgaggcctgatccggga

SEQ ID NO: 464637 - DNA, 20 bp, mouse
gcgaaggcgaggcctgatcc

SEQ ID NO: 464638 - DNA, 20 bp, mouse
gcccggtgcggcctgacgag

SEQ ID NO: 464639 - DNA, 20 bp, mouse
gggtgcggcctgacgagagg

SEQ ID NO: 464640 - DNA, 20 bp, mouse
gagggaggagcggagcgtca

SEQ ID NO: 464641 - DNA, 20 bp, mouse
ggccgaagtggaggcgggac

SEQ ID NO: 464642 - DNA, 20 bp, mouse
gccctgtagatggctatgaa

SEQ ID NO: 464643 - DNA, 20 bp, mouse
ggcctgccaccgagccgaag

SEQ ID NO: 464644 - DNA, 20 bp, mouse
gcggagtccggctcctggag

SEQ ID NO: 464645 - DNA, 20 bp, mouse
ggaaggtcaggccacctcgg

SEQ ID NO: 464646 - DNA, 20 bp, mouse
gtgcccgcgcgcggcgatgg

SEQ ID NO: 464647 - DNA, 20 bp, mouse
gccaggtcacgtggtagcgg

SEQ ID NO: 464648 - DNA, 20 bp, mouse
gacttctgcgggagcatccg

SEQ ID NO: 464649 - DNA, 20 bp, mouse
gagccagtgggtctcctatc

SEQ ID NO: 464650 - DNA, 20 bp, mouse
gcgcggcgatggcggcatcc

SEQ ID NO: 464651 - DNA, 20 bp, mouse
gcacgtggtagcggcggcag

SEQ ID NO: 464652 - DNA, 20 bp, mouse
gtgccggataggagacccac

SEQ ID NO: 464653 - DNA, 20 bp, mouse
gttcccaggtcacgtggtag

SEQ ID NO: 464654 - DNA, 20 bp, mouse
gtaaggggaccggctgacta

SEQ ID NO: 464655 - DNA, 20 bp, mouse
ggacccgcaggctagaccgg

SEQ ID NO: 464656 - DNA, 20 bp, mouse
gactgcttgcagtggatcca

SEQ ID NO: 464657 - DNA, 20 bp, mouse
gttctggagacaccacctga

SEQ ID NO: 464658 - DNA, 20 bp, mouse
gctctgtctgtaccatcagg

SEQ ID NO: 464659 - DNA, 20 bp, mouse
gtcctcggaagaaaagaccc

SEQ ID NO: 464660 - DNA, 20 bp, mouse
gccaggtggactgcttgcag

SEQ ID NO: 464661 - DNA, 20 bp, mouse
gtttcttccgaggacccagg

SEQ ID NO: 464662 - DNA, 20 bp, mouse
gtagctctgtctgtaccatc

SEQ ID NO: 464663 - DNA, 20 bp, mouse
ggtggaaaatgagctcaggt

SEQ ID NO: 464664 - DNA, 20 bp, mouse
gtggctaagggagatgagtg

SEQ ID NO: 464665 - DNA, 20 bp, mouse
gtcccttggggacgtcctca

SEQ ID NO: 464666 - DNA, 20 bp, mouse
ggtgtcgccagtcgccccca

SEQ ID NO: 464667 - DNA, 20 bp, mouse
ggggcgctcccgtgacgtca

SEQ ID NO: 464668 - DNA, 20 bp, mouse
ggcccgcgggcgaaagaacg

SEQ ID NO: 464669 - DNA, 20 bp, mouse
ggaggttgttgtgggccggg

SEQ ID NO: 464670 - DNA, 20 bp, mouse
gtcgcccccatggcgccccc

SEQ ID NO: 464671 - DNA, 20 bp, mouse
gagtcgagctgaggttgttg

SEQ ID NO: 464672 - DNA, 20 bp, mouse
gtgaggcgggtgacgagtca

SEQ ID NO: 464673 - DNA, 20 bp, mouse
gcgcgggcgaaagaacgcgg

SEQ ID NO: 464674 - DNA, 20 bp, mouse
gcctagggtctactatgagg

SEQ ID NO: 464675 - DNA, 20 bp, mouse
gtggtgggatgggctgataa

SEQ ID NO: 464676 - DNA, 20 bp, mouse
gtccggagtcggaaagatgg

SEQ ID NO: 464677 - DNA, 20 bp, mouse
ggatggtggtcaccaggtcc

SEQ ID NO: 464678 - DNA, 20 bp, mouse
gctttcttggagcctggtcc

SEQ ID NO: 464679 - DNA, 20 bp, mouse
ggcgctggctgccgggaatc

SEQ ID NO: 464680 - DNA, 20 bp, mouse
ggaatccggagtcggaaaga

SEQ ID NO: 464681 - DNA, 20 bp, mouse
gagagcgacgaggaaccgag

SEQ ID NO: 464682 - DNA, 20 bp, mouse
ggctgccgggaatccggagt

SEQ ID NO: 464683 - DNA, 20 bp, mouse
gccctccggcaactgaaggg

SEQ ID NO: 464684 - DNA, 20 bp, mouse
ggccgagccgctctgctcag

SEQ ID NO: 464685 - DNA, 20 bp, mouse
gcaccaggtccgggctctcc

SEQ ID NO: 464686 - DNA, 20 bp, mouse
gaggtgcacgccaagttctc

SEQ ID NO: 464687 - DNA, 20 bp, mouse
gcccgtgggcgcaggctggg

SEQ ID NO: 464688 - DNA, 20 bp, mouse
ggcgaggaccgagcgagaag

SEQ ID NO: 464689 - DNA, 20 bp, mouse
gctggcccaaggctcacggg

SEQ ID NO: 464690 - DNA, 20 bp, mouse
gacgcgtgtgagctggccca

SEQ ID NO: 464691 - DNA, 20 bp, mouse
ggcacactcacccgagaact

SEQ ID NO: 464692 - DNA, 20 bp, mouse
gcaccgggcgcctctcgcgg

SEQ ID NO: 464693 - DNA, 20 bp, mouse
ggaacaccgggcgcctctcg

SEQ ID NO: 464694 - DNA, 20 bp, mouse
gtggcgtgcacctccgcgag

SEQ ID NO: 464695 - DNA, 20 bp, mouse
gggtctcccgggaggagctg

SEQ ID NO: 464696 - DNA, 20 bp, mouse
gcccccggacggccctgacg

SEQ ID NO: 464697 - DNA, 20 bp, mouse
ggcaggcagcagccgcgtca

SEQ ID NO: 464698 - DNA, 20 bp, mouse
gagccgcgtcagggccgtcc

SEQ ID NO: 464699 - DNA, 20 bp, mouse
ggccccgcactcactcgcac

SEQ ID NO: 464700 - DNA, 20 bp, mouse
gtcatcgccagcgtggcccc

SEQ ID NO: 464701 - DNA, 20 bp, mouse
gtgcctgcatgaccctccgg

SEQ ID NO: 464702 - DNA, 20 bp, mouse
ggctgctgcctgctcggcgg

SEQ ID NO: 464703 - DNA, 20 bp, mouse
gcggccggtgcgagtgagtg

SEQ ID NO: 464704 - DNA, 20 bp, mouse
gcggcccgggggcaagtcag

SEQ ID NO: 464705 - DNA, 20 bp, mouse
ggtcccgcggggcgctgcgg

SEQ ID NO: 464706 - DNA, 20 bp, mouse
gtgctgctggctctaggtgt

SEQ ID NO: 464707 - DNA, 20 bp, mouse
gagaagctcccacctactgg

SEQ ID NO: 464708 - DNA, 20 bp, mouse
ggccatggtggtccagacat

SEQ ID NO: 464709 - DNA, 20 bp, mouse
gtgctcagatggttcacctc

SEQ ID NO: 464710 - DNA, 20 bp, mouse
gcagcaccggctccaagaag

SEQ ID NO: 464711 - DNA, 20 bp, mouse
gacacagctctcaagaggta

SEQ ID NO: 464712 - DNA, 20 bp, mouse
gccctatgtctggaccacca

SEQ ID NO: 464713 - DNA, 20 bp, mouse
gtgtgctcggtgcccccagt

SEQ ID NO: 464714 - DNA, 20 bp, mouse
gctcggtgcccccagtaggt

SEQ ID NO: 464715 - DNA, 20 bp, mouse
ggccagccagtgggcgacag

SEQ ID NO: 464716 - DNA, 20 bp, mouse
ggagtttcctgcccgagcag

SEQ ID NO: 464717 - DNA, 20 bp, mouse
gcagcagcggcggctccagt

SEQ ID NO: 464718 - DNA, 20 bp, mouse
gccgccgcgacaggatgggg

SEQ ID NO: 464719 - DNA, 20 bp, mouse
gtttcctgcccgagcagcgg

SEQ ID NO: 464720 - DNA, 20 bp, mouse
gcgcgcacgcaggagcacac

SEQ ID NO: 464721 - DNA, 20 bp, mouse
gctgccgccgctgctcgggc

SEQ ID NO: 464722 - DNA, 20 bp, mouse
gccaagcgagaggagaagta

SEQ ID NO: 464723 - DNA, 20 bp, mouse
gcatcctgtcgcggcgggga

SEQ ID NO: 464724 - DNA, 20 bp, mouse
ggagaggagaagtacggcgt

SEQ ID NO: 464725 - DNA, 20 bp, mouse
gcaccgcgcggcaacaggct

SEQ ID NO: 464726 - DNA, 20 bp, mouse
gagcttgagcgggagcgaag

SEQ ID NO: 464727 - DNA, 20 bp, mouse
gagtcgccgcggagcttgag

SEQ ID NO: 464728 - DNA, 20 bp, mouse
gtccggggccgaggcgcgag

SEQ ID NO: 464729 - DNA, 20 bp, mouse
gcgctcccgctcaagctccg

SEQ ID NO: 464730 - DNA, 20 bp, mouse
gtccccgctcaactcacaag

SEQ ID NO: 464731 - DNA, 20 bp, mouse
gcaggctccgggtgaacctg

SEQ ID NO: 464732 - DNA, 20 bp, mouse
gctgctgagaccgggacagg

SEQ ID NO: 464733 - DNA, 20 bp, mouse
gctgctgacggccaccgcgg

SEQ ID NO: 464734 - DNA, 20 bp, mouse
gcccggagcctgctgagacc

SEQ ID NO: 464735 - DNA, 20 bp, mouse
gccgctcaactcacaagagg

SEQ ID NO: 464736 - DNA, 20 bp, mouse
gcccgtcggcgtgtaaacac

SEQ ID NO: 464737 - DNA, 20 bp, mouse
gtcagtgccccgggcccggg

SEQ ID NO: 464738 - DNA, 20 bp, mouse
gtgagatgtggccggcccgt

SEQ ID NO: 464739 - DNA, 20 bp, mouse
gggctgctccctctcaccaa

SEQ ID NO: 464740 - DNA, 20 bp, mouse
gcgcgcgcgctggagaccac

SEQ ID NO: 464741 - DNA, 20 bp, mouse
ggagctccgccagagcgtgt

SEQ ID NO: 464742 - DNA, 20 bp, mouse
gggggcggcgagctgagatg

SEQ ID NO: 464743 - DNA, 20 bp, mouse
gccaagggccccgacctgag

SEQ ID NO: 464744 - DNA, 20 bp, mouse
gcacaccgggagcagcgcgg

SEQ ID NO: 464745 - DNA, 20 bp, mouse
ggcgggagcgctcagtgccc

SEQ ID NO: 464746 - DNA, 20 bp, mouse
gagagaacaggaggctctca

SEQ ID NO: 464747 - DNA, 20 bp, mouse
gtcacggagtgggtaggtgt

SEQ ID NO: 464748 - DNA, 20 bp, mouse
gccctggcgcaaaactgaca

SEQ ID NO: 464749 - DNA, 20 bp, mouse
gacaaggagcgtcacggagt

SEQ ID NO: 464750 - DNA, 20 bp, mouse
ggaagctggctggggtggtt

SEQ ID NO: 464751 - DNA, 20 bp, mouse
gaaactgacaaggagcgtca

SEQ ID NO: 464752 - DNA, 20 bp, mouse
gaaggaagtggggccctgca

SEQ ID NO: 464753 - DNA, 20 bp, mouse
gggcgggccatgctaactta

SEQ ID NO: 464754 - DNA, 20 bp, mouse
ggccatggtggcttgaagac

SEQ ID NO: 464755 - DNA, 20 bp, mouse
ggttttgcgccagggggcca

SEQ ID NO: 464756 - DNA, 20 bp, mouse
ggctgtgagggaccgaacgg

SEQ ID NO: 464757 - DNA, 20 bp, mouse
gggagctgtgagggaccgaa

SEQ ID NO: 464758 - DNA, 20 bp, mouse
gggcgccgggaagccagcga

SEQ ID NO: 464759 - DNA, 20 bp, mouse
ggccagcgacggagctgtga

SEQ ID NO: 464760 - DNA, 20 bp, mouse
ggcgtcccgcgagcccgctg

SEQ ID NO: 464761 - DNA, 20 bp, mouse
ggaggcgatccgagccgcgg

SEQ ID NO: 464762 - DNA, 20 bp, mouse
ggccatgtggacccccacgg

SEQ ID NO: 464763 - DNA, 20 bp, mouse
ggacggtggagacggacagg

SEQ ID NO: 464764 - DNA, 20 bp, mouse
ggcaccgcgaggcaaggcgg

SEQ ID NO: 464765 - DNA, 20 bp, mouse
ggcggctcggatcgcctcag

SEQ ID NO: 464766 - DNA, 20 bp, mouse
ggccctgcgacgcgctcccg

SEQ ID NO: 464767 - DNA, 20 bp, mouse
ggcagccgcggccggcagag

SEQ ID NO: 464768 - DNA, 20 bp, mouse
gagcggagcgagctgcgtgg

SEQ ID NO: 464769 - DNA, 20 bp, mouse
gatgccgcgaggcagtgggt

SEQ ID NO: 464770 - DNA, 20 bp, mouse
ggaactaagcgaacacgccg

SEQ ID NO: 464771 - DNA, 20 bp, mouse
gtccccgggagcgcgtcgca

SEQ ID NO: 464772 - DNA, 20 bp, mouse
gcccgccgctctgccggccg

SEQ ID NO: 464773 - DNA, 20 bp, mouse
gaatccccgcgcccctccag

SEQ ID NO: 464774 - DNA, 20 bp, mouse
ggaacacgccggggcactcg

SEQ ID NO: 464775 - DNA, 20 bp, mouse
gtgacactacaccgccgagg

SEQ ID NO: 464776 - DNA, 20 bp, mouse
gcgcggtcacctgctgggac

SEQ ID NO: 464777 - DNA, 20 bp, mouse
gccgttggatccctaccaag

SEQ ID NO: 464778 - DNA, 20 bp, mouse
ggccccgggcgcgagcgagg

SEQ ID NO: 464779 - DNA, 20 bp, mouse
gggtcacctgctgggaccgg

SEQ ID NO: 464780 - DNA, 20 bp, mouse
ggggcgcgagcgaggcggga

SEQ ID NO: 464781 - DNA, 20 bp, mouse
gcacggccgccggtcccagc

SEQ ID NO: 464782 - DNA, 20 bp, mouse
ggtgcagcagcgggaccgag

SEQ ID NO: 464783 - DNA, 20 bp, mouse
gtaccaagaggcagaagtat

SEQ ID NO: 464784 - DNA, 20 bp, mouse
gagaggcagaagtatggggt

SEQ ID NO: 464785 - DNA, 20 bp, mouse
gggccctcgctggccaccaa

SEQ ID NO: 464786 - DNA, 20 bp, mouse
gccggctgcccagactcggg

SEQ ID NO: 464787 - DNA, 20 bp, mouse
gagcccggctgcccagactc

SEQ ID NO: 464788 - DNA, 20 bp, mouse
ggcgaaggcgcggcgctccg

SEQ ID NO: 464789 - DNA, 20 bp, mouse
gcagactcgggaggctgcgg

SEQ ID NO: 464790 - DNA, 20 bp, mouse
gccgggccaactctaggatg

SEQ ID NO: 464791 - DNA, 20 bp, mouse
gggcgggacgcggggcgtca

SEQ ID NO: 464792 - DNA, 20 bp, mouse
ggggacgcggggcgtcatgg

SEQ ID NO: 464793 - DNA, 20 bp, mouse
gccagccgcggaaccaagac

SEQ ID NO: 464794 - DNA, 20 bp, mouse
ggatcaacaggtagtgagag

SEQ ID NO: 464795 - DNA, 20 bp, mouse
gctccccgaggacttcccgg

SEQ ID NO: 464796 - DNA, 20 bp, mouse
ggtggggtccggagagccga

SEQ ID NO: 464797 - DNA, 20 bp, mouse
gccgctggagcgcggaacca

SEQ ID NO: 464798 - DNA, 20 bp, mouse
gccagcctcgcggtggggtc

SEQ ID NO: 464799 - DNA, 20 bp, mouse
gaccgcgcggcaaggcccgt

SEQ ID NO: 464800 - DNA, 20 bp, mouse
ggcgtccggggtgctgtcag

SEQ ID NO: 464801 - DNA, 20 bp, mouse
ggccggcccagcctcgcggt

SEQ ID NO: 464802 - DNA, 20 bp, mouse
gctctccggaccccaccgcg

SEQ ID NO: 464803 - DNA, 20 bp, mouse
gtccggggtgctgtcagcgg

SEQ ID NO: 464804 - DNA, 20 bp, mouse
gaaggcgcggcgctccgcca

SEQ ID NO: 464805 - DNA, 20 bp, mouse
ggccaccgctgacagcaccc

SEQ ID NO: 464806 - DNA, 20 bp, mouse
gggcgcgccgggctctgcag

SEQ ID NO: 464807 - DNA, 20 bp, mouse
gggagcagagccctcccccc

SEQ ID NO: 464808 - DNA, 20 bp, mouse
ggcggcgcggctgacagatg

SEQ ID NO: 464809 - DNA, 20 bp, mouse
gcgcggccaaggtggaaatg

SEQ ID NO: 464810 - DNA, 20 bp, mouse
gcagcagcgcgggtgacaag

SEQ ID NO: 464811 - DNA, 20 bp, mouse
gccttccagtcgggagacag

SEQ ID NO: 464812 - DNA, 20 bp, mouse
ggcgcgcgcgcgcggttcca

SEQ ID NO: 464813 - DNA, 20 bp, mouse
gcccgggagctgcgcggcca

SEQ ID NO: 464814 - DNA, 20 bp, mouse
gcgcgcagctcccgggggga

SEQ ID NO: 464815 - DNA, 20 bp, mouse
gcccgcgagccccgaagccg

SEQ ID NO: 464816 - DNA, 20 bp, mouse
gcgcaccgctggccagagaa

SEQ ID NO: 464817 - DNA, 20 bp, mouse
gaagtgcagagcctgagggg

SEQ ID NO: 464818 - DNA, 20 bp, mouse
ggatgcagctcaggcagacg

SEQ ID NO: 464819 - DNA, 20 bp, mouse
gctttcctttctctggccag

SEQ ID NO: 464820 - DNA, 20 bp, mouse
gcaggccagtctataaggaa

SEQ ID NO: 464821 - DNA, 20 bp, mouse
gcagtcacggtcccgggaca

SEQ ID NO: 464822 - DNA, 20 bp, mouse
gctgagaagtacaggacgag

SEQ ID NO: 464823 - DNA, 20 bp, mouse
ggagtcccccctgcagtaca

SEQ ID NO: 464824 - DNA, 20 bp, mouse
gccagcggtgcggctggtgg

SEQ ID NO: 464825 - DNA, 20 bp, mouse
gccgggacagggcgacagga

SEQ ID NO: 464826 - DNA, 20 bp, mouse
ggtgccccgggcgcacctgg

SEQ ID NO: 464827 - DNA, 20 bp, mouse
gagcgcctgaggacccgacc

SEQ ID NO: 464828 - DNA, 20 bp, mouse
gccgccgccaggtgcgcccg

SEQ ID NO: 464829 - DNA, 20 bp, mouse
gcggcagagcgtgtcagagg

SEQ ID NO: 464830 - DNA, 20 bp, mouse
ggaggacccgaccgggaccg

SEQ ID NO: 464831 - DNA, 20 bp, mouse
gacctggcggcggcgcgacc

SEQ ID NO: 464832 - DNA, 20 bp, mouse
gagaggacaggtaacgtggg

SEQ ID NO: 464833 - DNA, 20 bp, mouse
ggcacgggaacccgcggtcc

SEQ ID NO: 464834 - DNA, 20 bp, mouse
gtccggagcagacagagaaa

SEQ ID NO: 464835 - DNA, 20 bp, mouse
gctgctgctgcgccatcctc

SEQ ID NO: 464836 - DNA, 20 bp, mouse
gagctccaagaacaggtccg

SEQ ID NO: 464837 - DNA, 20 bp, mouse
gggtcacgtggccatcaaga

SEQ ID NO: 464838 - DNA, 20 bp, mouse
gtcaagatggcggcgtccag

SEQ ID NO: 464839 - DNA, 20 bp, mouse
gccccgtaggaccccctcaa

SEQ ID NO: 464840 - DNA, 20 bp, mouse
ggtcgcgcgagatgcgtccg

SEQ ID NO: 464841 - DNA, 20 bp, mouse
gcatctcgcgcgacgtcctc

SEQ ID NO: 464842 - DNA, 20 bp, mouse
gtccgtatactcgggacaga

SEQ ID NO: 464843 - DNA, 20 bp, mouse
ggcgtccgcggacctgttct

SEQ ID NO: 464844 - DNA, 20 bp, mouse
gagaagtgcccccccttcgg

SEQ ID NO: 464845 - DNA, 20 bp, mouse
gctgcacgtgagccccgcat

SEQ ID NO: 464846 - DNA, 20 bp, mouse
ggaatcgcctgggccatgga

SEQ ID NO: 464847 - DNA, 20 bp, mouse
gtggacggggctgtgatgga

SEQ ID NO: 464848 - DNA, 20 bp, mouse
gcccaagaccgcaccaagga

SEQ ID NO: 464849 - DNA, 20 bp, mouse
gccctccgggccaggaagcg

SEQ ID NO: 464850 - DNA, 20 bp, mouse
ggaaggaatcgcctgggcca

SEQ ID NO: 464851 - DNA, 20 bp, mouse
gagcgcggaaggaatcgcct

SEQ ID NO: 464852 - DNA, 20 bp, mouse
gggccggaagaaggtcggaa

SEQ ID NO: 464853 - DNA, 20 bp, mouse
gagtcagcgcttcgggacca

SEQ ID NO: 464854 - DNA, 20 bp, mouse
gacagccccgtccatggccc

SEQ ID NO: 464855 - DNA, 20 bp, mouse
gacccctctggactagaagt

SEQ ID NO: 464856 - DNA, 20 bp, mouse
gagggcagaggcaatggcag

SEQ ID NO: 464857 - DNA, 20 bp, mouse
ggaagctgcgatggtcagga

SEQ ID NO: 464858 - DNA, 20 bp, mouse
gagctgaagctgcgatggtc

SEQ ID NO: 464859 - DNA, 20 bp, mouse
gtggggagctgaagctgcga

SEQ ID NO: 464860 - DNA, 20 bp, mouse
ggctgcgatggtcaggatgg

SEQ ID NO: 464861 - DNA, 20 bp, mouse
gggagcacatggtctcataa

SEQ ID NO: 464862 - DNA, 20 bp, mouse
gagggccctgttactatccc

SEQ ID NO: 464863 - DNA, 20 bp, mouse
gaaggcaaggcacgttgaga

SEQ ID NO: 464864 - DNA, 20 bp, mouse
gttcagcagcagcagacctt

SEQ ID NO: 464865 - DNA, 20 bp, mouse
ggcaaggtaagagtaaggct

SEQ ID NO: 464866 - DNA, 20 bp, mouse
gtggagcccccggtcaaaga

SEQ ID NO: 464867 - DNA, 20 bp, mouse
gggatgccgtctttgaccgg

SEQ ID NO: 464868 - DNA, 20 bp, mouse
gactagacctgagggaactg

SEQ ID NO: 464869 - DNA, 20 bp, mouse
gctttacgtgctgctggtag

SEQ ID NO: 464870 - DNA, 20 bp, mouse
gagaggatgccgtctttgac

SEQ ID NO: 464871 - DNA, 20 bp, mouse
gtcttggcccaagaaggtta

SEQ ID NO: 464872 - DNA, 20 bp, mouse
ggttccggggagactggtac

SEQ ID NO: 464873 - DNA, 20 bp, mouse
gcggaacttcagaactgcgg

SEQ ID NO: 464874 - DNA, 20 bp, mouse
gttcagaactgcggtggcca

SEQ ID NO: 464875 - DNA, 20 bp, mouse
gaccccaggctgccagccgt

SEQ ID NO: 464876 - DNA, 20 bp, mouse
gcggccgggaggggaaggta

SEQ ID NO: 464877 - DNA, 20 bp, mouse
ggatccagaggagactcggg

SEQ ID NO: 464878 - DNA, 20 bp, mouse
gtccggatccagaggagact

SEQ ID NO: 464879 - DNA, 20 bp, mouse
ggaagcgcagccgccagctc

SEQ ID NO: 464880 - DNA, 20 bp, mouse
gggagtctcacgtctcggtg

SEQ ID NO: 464881 - DNA, 20 bp, mouse
gtcggcgcctaggtaaatag

SEQ ID NO: 464882 - DNA, 20 bp, mouse
ggggctccggaggtgaccac

SEQ ID NO: 464883 - DNA, 20 bp, mouse
gcgccccaggatgagagttg

SEQ ID NO: 464884 - DNA, 20 bp, mouse
ggtaggacgctcccatagct

SEQ ID NO: 464885 - DNA, 20 bp, mouse
gttgcgggagtctcacgtct

SEQ ID NO: 464886 - DNA, 20 bp, mouse
gctccccaaagcctgaaagt

SEQ ID NO: 464887 - DNA, 20 bp, mouse
gccgccgctctcccccaaag

SEQ ID NO: 464888 - DNA, 20 bp, mouse
gcggcgggccgcccactttc

SEQ ID NO: 464889 - DNA, 20 bp, mouse
ggcgcccagcagccactttg

SEQ ID NO: 464890 - DNA, 20 bp, mouse
gggtgccgagcgcacgctgg

SEQ ID NO: 464891 - DNA, 20 bp, mouse
gggcttcgaggagggatgtg

SEQ ID NO: 464892 - DNA, 20 bp, mouse
gccgcggtagcctgggatgt

SEQ ID NO: 464893 - DNA, 20 bp, mouse
gagggtcaggacagagactg

SEQ ID NO: 464894 - DNA, 20 bp, mouse
gggtgaaaccaggcgtcaga

SEQ ID NO: 464895 - DNA, 20 bp, mouse
ggtgcgctcggcaccctgag

SEQ ID NO: 464896 - DNA, 20 bp, mouse
gcgcccccggcagcacccac

SEQ ID NO: 464897 - DNA, 20 bp, mouse
gaggctggcgcctcactcgg

SEQ ID NO: 464898 - DNA, 20 bp, mouse
ggagcctggggagaaatcag

SEQ ID NO: 464899 - DNA, 20 bp, mouse
ggagtgaggcgccagcctgt

SEQ ID NO: 464900 - DNA, 20 bp, mouse
gccgccacacacggagacaa

SEQ ID NO: 464901 - DNA, 20 bp, mouse
gtggccggagcgcaccatcg

SEQ ID NO: 464902 - DNA, 20 bp, mouse
gatccgcagcaggaagctag

SEQ ID NO: 464903 - DNA, 20 bp, mouse
gcggaggggggtacaactgg

SEQ ID NO: 464904 - DNA, 20 bp, mouse
gtccgcgccagcaggagcct

SEQ ID NO: 464905 - DNA, 20 bp, mouse
ggagacctgcgtggaccggg

SEQ ID NO: 464906 - DNA, 20 bp, mouse
gacgcgtggagagggcgcag

SEQ ID NO: 464907 - DNA, 20 bp, mouse
gcgcccaggacgcgtggaga

SEQ ID NO: 464908 - DNA, 20 bp, mouse
gctcaggcgcccaggacgcg

SEQ ID NO: 464909 - DNA, 20 bp, mouse
gccatgacagaagatgaccg

SEQ ID NO: 464910 - DNA, 20 bp, mouse
gcgctgtcctgtctccgcag

SEQ ID NO: 464911 - DNA, 20 bp, mouse
gctgcgcaagccatcgccgg

SEQ ID NO: 464912 - DNA, 20 bp, mouse
gctgccggccctacaaccgg

SEQ ID NO: 464913 - DNA, 20 bp, mouse
gcccgccgctcacctgccac

SEQ ID NO: 464914 - DNA, 20 bp, mouse
ggctcacctgccaccggcga

SEQ ID NO: 464915 - DNA, 20 bp, mouse
gcgccctctccacgcgtcct

SEQ ID NO: 464916 - DNA, 20 bp, mouse
gctggtgcgaggggagtccg

SEQ ID NO: 464917 - DNA, 20 bp, mouse
gaggcggtggagactgtgag

SEQ ID NO: 464918 - DNA, 20 bp, mouse
gggtgggcgtggtcaagatg

SEQ ID NO: 464919 - DNA, 20 bp, mouse
ggtgcgaggggagtccgcgg

SEQ ID NO: 464920 - DNA, 20 bp, mouse
ggcttccgccacgtgatggt

SEQ ID NO: 464921 - DNA, 20 bp, mouse
gctcaacccgccaagcagag

SEQ ID NO: 464922 - DNA, 20 bp, mouse
gagactgtgagcggtgaaga

SEQ ID NO: 464923 - DNA, 20 bp, mouse
gcaagatggggctgtcaaga

SEQ ID NO: 464924 - DNA, 20 bp, mouse
gtggcgctgccctggtgcga

SEQ ID NO: 464925 - DNA, 20 bp, mouse
gcgcctccgctgtcaaccta

SEQ ID NO: 464926 - DNA, 20 bp, mouse
gtctccgggtaagatggcag

SEQ ID NO: 464927 - DNA, 20 bp, mouse
gcgccggccgagcccctcca

SEQ ID NO: 464928 - DNA, 20 bp, mouse
ggtcactggccgccatgaag

SEQ ID NO: 464929 - DNA, 20 bp, mouse
gcgggtaagatggcagcgga

SEQ ID NO: 464930 - DNA, 20 bp, mouse
gctcgctccccgcttcatgg

SEQ ID NO: 464931 - DNA, 20 bp, mouse
gcaaacagcgagccttggag

SEQ ID NO: 464932 - DNA, 20 bp, mouse
ggcccggtctccgggtaaga

SEQ ID NO: 464933 - DNA, 20 bp, mouse
ggtgctcgctccccgcttca

SEQ ID NO: 464934 - DNA, 20 bp, mouse
ggagaacgtcctcggagccg

SEQ ID NO: 464935 - DNA, 20 bp, mouse
gcgaggccgattgcaggtag

SEQ ID NO: 464936 - DNA, 20 bp, mouse
gcagccattgcgcagcaccg

SEQ ID NO: 464937 - DNA, 20 bp, mouse
gtgaagctaggcgagtagcc

SEQ ID NO: 464938 - DNA, 20 bp, mouse
gctgcctcggtgctgcgcaa

SEQ ID NO: 464939 - DNA, 20 bp, mouse
gcggggcgcgcgggaagccc

SEQ ID NO: 464940 - DNA, 20 bp, mouse
gggagccgcacggtctcagg

SEQ ID NO: 464941 - DNA, 20 bp, mouse
gcaggcggcctcttgaagct

SEQ ID NO: 464942 - DNA, 20 bp, mouse
gcgaccgccggcggcagagg

SEQ ID NO: 464943 - DNA, 20 bp, mouse
gtgctgcgcaatggctgtct

SEQ ID NO: 464944 - DNA, 20 bp, mouse
gcggtcgggaaggggcgcaa

SEQ ID NO: 464945 - DNA, 20 bp, mouse
ggaggccgcctgagaccgtg

SEQ ID NO: 464946 - DNA, 20 bp, mouse
gtgggctggcggccttcgtg

SEQ ID NO: 464947 - DNA, 20 bp, mouse
ggccgctctcttggcaaccg

SEQ ID NO: 464948 - DNA, 20 bp, mouse
gctgtcactaggccctgggc

SEQ ID NO: 464949 - DNA, 20 bp, mouse
gaaccgcggcagccgcacga

SEQ ID NO: 464950 - DNA, 20 bp, mouse
gcacgctggtagctgtcact

SEQ ID NO: 464951 - DNA, 20 bp, mouse
ggccaagagagcggcgccag

SEQ ID NO: 464952 - DNA, 20 bp, mouse
gacctgagcccgcctctggg

SEQ ID NO: 464953 - DNA, 20 bp, mouse
gcagaggcgggctcaggtgg

SEQ ID NO: 464954 - DNA, 20 bp, mouse
gggccttcgtgcggctgccg

SEQ ID NO: 464955 - DNA, 20 bp, mouse
ggggctctgctgctccccgc

SEQ ID NO: 464956 - DNA, 20 bp, mouse
ggcttcggcagagacctcga

SEQ ID NO: 464957 - DNA, 20 bp, mouse
gcgtcggctgcgggacaagg

SEQ ID NO: 464958 - DNA, 20 bp, mouse
gggcgtgggacggagcccgt

SEQ ID NO: 464959 - DNA, 20 bp, mouse
gtcggcagagacctcgaagg

SEQ ID NO: 464960 - DNA, 20 bp, mouse
gacaaggcggctctgcgctt

SEQ ID NO: 464961 - DNA, 20 bp, mouse
gggacctcggcggtgggcgt

SEQ ID NO: 464962 - DNA, 20 bp, mouse
ggcccgtcggctgcgggaca

SEQ ID NO: 464963 - DNA, 20 bp, mouse
ggcagagacctcgaaggcgg

SEQ ID NO: 464964 - DNA, 20 bp, mouse
ggggccggctaggctgacag

SEQ ID NO: 464965 - DNA, 20 bp, mouse
gctcggcggtgggcgtggga

SEQ ID NO: 464966 - DNA, 20 bp, mouse
gtcgcagtgcgagccagacg

SEQ ID NO: 464967 - DNA, 20 bp, mouse
gagggcgggcggcagataca

SEQ ID NO: 464968 - DNA, 20 bp, mouse
gccagacgcggcggcgagag

SEQ ID NO: 464969 - DNA, 20 bp, mouse
gcagtgcgagccagacgcgg

SEQ ID NO: 464970 - DNA, 20 bp, mouse
ggtcaggctgcgggaccggg

SEQ ID NO: 464971 - DNA, 20 bp, mouse
gacagagccaggggccggag

SEQ ID NO: 464972 - DNA, 20 bp, mouse
ggcggtcaggctgcgggacc

SEQ ID NO: 464973 - DNA, 20 bp, mouse
ggatacacggctctcccggt

SEQ ID NO: 464974 - DNA, 20 bp, mouse
gccgcgcgcgacaggaccag

SEQ ID NO: 464975 - DNA, 20 bp, mouse
ggagagcggcgggggcggtc

SEQ ID NO: 464976 - DNA, 20 bp, mouse
gtgtaggagtcacagagccg

SEQ ID NO: 464977 - DNA, 20 bp, mouse
gtcctcacgccggcccaaga

SEQ ID NO: 464978 - DNA, 20 bp, mouse
gcggccgcgcgcgccgacat

SEQ ID NO: 464979 - DNA, 20 bp, mouse
gaggggagctggggccacac

SEQ ID NO: 464980 - DNA, 20 bp, mouse
gccgcccgcctagcatggtg

SEQ ID NO: 464981 - DNA, 20 bp, mouse
ggcggcggctctagacgccc

SEQ ID NO: 464982 - DNA, 20 bp, mouse
gagctggggccacacgggag

SEQ ID NO: 464983 - DNA, 20 bp, mouse
gttgggccggcgtgaggaga

SEQ ID NO: 464984 - DNA, 20 bp, mouse
gaccggccgcgtcagggcaa

SEQ ID NO: 464985 - DNA, 20 bp, mouse
gagcggccacgggtagacgg

SEQ ID NO: 464986 - DNA, 20 bp, mouse
gagccagagctggaatctct

SEQ ID NO: 464987 - DNA, 20 bp, mouse
gaagggaggaagcacagtca

SEQ ID NO: 464988 - DNA, 20 bp, mouse
gggaggaagcacagtcaggg

SEQ ID NO: 464989 - DNA, 20 bp, mouse
gtctggcttcagctgcgtaa

SEQ ID NO: 464990 - DNA, 20 bp, mouse
gctcaggtctgagaacacct

SEQ ID NO: 464991 - DNA, 20 bp, mouse
ggttttaccctggaggaagt

SEQ ID NO: 464992 - DNA, 20 bp, mouse
gctaggaccaccttcttgtt

SEQ ID NO: 464993 - DNA, 20 bp, mouse
gcagtcaggggggataagac

SEQ ID NO: 464994 - DNA, 20 bp, mouse
gaggaaccagacctcctgtg

SEQ ID NO: 464995 - DNA, 20 bp, mouse
gacagttcacagtgctgttc

SEQ ID NO: 464996 - DNA, 20 bp, mouse
gagcttcttgctggtcagga

SEQ ID NO: 464997 - DNA, 20 bp, mouse
gttcttgctggtcaggaggg

SEQ ID NO: 464998 - DNA, 20 bp, mouse
gcagcggcaggggcaactcc

SEQ ID NO: 464999 - DNA, 20 bp, mouse
gacaatgggtaggtgcagcg

SEQ ID NO: 465000 - DNA, 20 bp, mouse
gcaccggagggtcaccatgt

SEQ ID NO: 465001 - DNA, 20 bp, mouse
gagctcttaggaagcaacct

SEQ ID NO: 465002 - DNA, 20 bp, mouse
ggcaggattgtgcagaacag

SEQ ID NO: 465003 - DNA, 20 bp, mouse
gaattcaccagcagcggcag

SEQ ID NO: 465004 - DNA, 20 bp, mouse
ggaggcgcgcggcgataaag

SEQ ID NO: 465005 - DNA, 20 bp, mouse
gctggcgccggaatcctctg

SEQ ID NO: 465006 - DNA, 20 bp, mouse
gggcccggcgcgttcctggg

SEQ ID NO: 465007 - DNA, 20 bp, mouse
gttcctgggcggagggaaga

SEQ ID NO: 465008 - DNA, 20 bp, mouse
gagtggcccggcgcgttcct

SEQ ID NO: 465009 - DNA, 20 bp, mouse
gatcggtcgggtagttgcca

SEQ ID NO: 465010 - DNA, 20 bp, mouse
ggtcatccggaagtgatcat

SEQ ID NO: 465011 - DNA, 20 bp, mouse
gttgcggtcggccgagaaga

SEQ ID NO: 465012 - DNA, 20 bp, mouse
gcggcgcgttcctgggcgga

SEQ ID NO: 465013 - DNA, 20 bp, mouse
gacgcgccgggccactgcca

SEQ ID NO: 465014 - DNA, 20 bp, mouse
gccggaagtgatcatcggtc

SEQ ID NO: 465015 - DNA, 20 bp, mouse
gcccagggagatgacccgag

SEQ ID NO: 465016 - DNA, 20 bp, mouse
gtagaatagaggccactggt

SEQ ID NO: 465017 - DNA, 20 bp, mouse
gccaagaagccggaaagaag

SEQ ID NO: 465018 - DNA, 20 bp, mouse
gagagctgggaggctgctca

SEQ ID NO: 465019 - DNA, 20 bp, mouse
ggaagccaaaagtagaatag

SEQ ID NO: 465020 - DNA, 20 bp, mouse
ggctcagggactatggacca

SEQ ID NO: 465021 - DNA, 20 bp, mouse
gaaagtagaatagaggccac

SEQ ID NO: 465022 - DNA, 20 bp, mouse
gtatgcaggtcatacaggag

SEQ ID NO: 465023 - DNA, 20 bp, mouse
ggtcagatttgacgtcacag

SEQ ID NO: 465024 - DNA, 20 bp, mouse
gaagccctccccctcaataa

SEQ ID NO: 465025 - DNA, 20 bp, mouse
gccactcacagaaatgaatg

SEQ ID NO: 465026 - DNA, 20 bp, mouse
gcaggcacagcagctccatc

SEQ ID NO: 465027 - DNA, 20 bp, mouse
gggagctgctgtgcctgatc

SEQ ID NO: 465028 - DNA, 20 bp, mouse
gagatgcccgcaagggtcag

SEQ ID NO: 465029 - DNA, 20 bp, mouse
gtgatcaggagaaaggacag

SEQ ID NO: 465030 - DNA, 20 bp, mouse
gctgtggaagcagatccctg

SEQ ID NO: 465031 - DNA, 20 bp, mouse
gcggtcatcgacgggtgagt

SEQ ID NO: 465032 - DNA, 20 bp, mouse
gggaggtgccaaagccgctg

SEQ ID NO: 465033 - DNA, 20 bp, mouse
gcctatcgagatgcccgcaa

SEQ ID NO: 465034 - DNA, 20 bp, mouse
ggttctgtgcataggcacgg

SEQ ID NO: 465035 - DNA, 20 bp, mouse
gcacccgtcgatgaccggtg

SEQ ID NO: 465036 - DNA, 20 bp, mouse
gacgagcacacgcgggtcag

SEQ ID NO: 465037 - DNA, 20 bp, mouse
gcacaggactgaagccacat

SEQ ID NO: 465038 - DNA, 20 bp, mouse
gcaggctgtcccgtctctct

SEQ ID NO: 465039 - DNA, 20 bp, mouse
gggtggcccttcaaagctgg

SEQ ID NO: 465040 - DNA, 20 bp, mouse
gtcagatgatagacacggag

SEQ ID NO: 465041 - DNA, 20 bp, mouse
gactcaccacgagcacacgc

SEQ ID NO: 465042 - DNA, 20 bp, mouse
gaccagactgggcatccaga

SEQ ID NO: 465043 - DNA, 20 bp, mouse
gcgcaaacaggacctcaatg

SEQ ID NO: 465044 - DNA, 20 bp, mouse
gagaggtggcccttcaaagc

SEQ ID NO: 465045 - DNA, 20 bp, mouse
gggtgctgggaagtagcagt

SEQ ID NO: 465046 - DNA, 20 bp, mouse
gtacctcagtgtggaagcca

SEQ ID NO: 465047 - DNA, 20 bp, mouse
gacctgctacttgtgtccag

SEQ ID NO: 465048 - DNA, 20 bp, mouse
gtgccctggcttccacactg

SEQ ID NO: 465049 - DNA, 20 bp, mouse
ggccgctggacacaagtagc

SEQ ID NO: 465050 - DNA, 20 bp, mouse
gctgacctcctacctcagtg

SEQ ID NO: 465051 - DNA, 20 bp, mouse
gacaccaggcgtggagccgc

SEQ ID NO: 465052 - DNA, 20 bp, mouse
gtgctggctggagtcttcag

SEQ ID NO: 465053 - DNA, 20 bp, mouse
ggcttccacactgaggtagg

SEQ ID NO: 465054 - DNA, 20 bp, mouse
gagggcttatccatctgccc

SEQ ID NO: 465055 - DNA, 20 bp, mouse
gccagcaactgggaactatt

SEQ ID NO: 465056 - DNA, 20 bp, mouse
gcaagcgaggccacgtccta

SEQ ID NO: 465057 - DNA, 20 bp, mouse
ggacgtggcctcgcttggaa

SEQ ID NO: 465058 - DNA, 20 bp, mouse
gcagagggcgacaatgggtt

SEQ ID NO: 465059 - DNA, 20 bp, mouse
gcttgagaagggcagggata

SEQ ID NO: 465060 - DNA, 20 bp, mouse
gtagggcagagggcgacaat

SEQ ID NO: 465061 - DNA, 20 bp, mouse
gattcagggtccctaggacg

SEQ ID NO: 465062 - DNA, 20 bp, mouse
gcctagggaccctgaatcga

SEQ ID NO: 465063 - DNA, 20 bp, mouse
gtgttgtcggagcactggag

SEQ ID NO: 465064 - DNA, 20 bp, mouse
ggaggggctcggagtagtca

SEQ ID NO: 465065 - DNA, 20 bp, mouse
gggttcggaccttcgattca

SEQ ID NO: 465066 - DNA, 20 bp, mouse
gaccgctgggaggaccgacc

SEQ ID NO: 465067 - DNA, 20 bp, mouse
ggccgggtcggtcctcccag

SEQ ID NO: 465068 - DNA, 20 bp, mouse
gcaggacccggggagcaaga

SEQ ID NO: 465069 - DNA, 20 bp, mouse
gccacccgcaccacctcagg

SEQ ID NO: 465070 - DNA, 20 bp, mouse
gcagcaggtccctgccgggt

SEQ ID NO: 465071 - DNA, 20 bp, mouse
gcccctgggaatgaatggat

SEQ ID NO: 465072 - DNA, 20 bp, mouse
gcagtcctggagcaacgcgt

SEQ ID NO: 465073 - DNA, 20 bp, mouse
gccgtggccatcttgctccc

SEQ ID NO: 465074 - DNA, 20 bp, mouse
ggcccccagcaggtccctgc

SEQ ID NO: 465075 - DNA, 20 bp, mouse
gcagcgcccgcccgaccgct

SEQ ID NO: 465076 - DNA, 20 bp, mouse
ggggctgggcccgcgctcag

SEQ ID NO: 465077 - DNA, 20 bp, mouse
ggaaatcgtagcgcgctggg

SEQ ID NO: 465078 - DNA, 20 bp, mouse
gccgaggagcagagatgagt

SEQ ID NO: 465079 - DNA, 20 bp, mouse
gtaaccccaggggcaatagg

SEQ ID NO: 465080 - DNA, 20 bp, mouse
ggcgccccggtgatccagaa

SEQ ID NO: 465081 - DNA, 20 bp, mouse
ggacttgagcgggttctgaa

SEQ ID NO: 465082 - DNA, 20 bp, mouse
gaggggagtgagacgcaagg

SEQ ID NO: 465083 - DNA, 20 bp, mouse
ggcagcagcagcggcgcccc

SEQ ID NO: 465084 - DNA, 20 bp, mouse
ggggcaccccaaagactccg

SEQ ID NO: 465085 - DNA, 20 bp, mouse
gaggacccgctcctgaggga

SEQ ID NO: 465086 - DNA, 20 bp, mouse
ggcctcccggcctgagggag

SEQ ID NO: 465087 - DNA, 20 bp, mouse
gcgaggaggacacccgtcgg

SEQ ID NO: 465088 - DNA, 20 bp, mouse
gaatgtagtgaagctgtgag

SEQ ID NO: 465089 - DNA, 20 bp, mouse
ggcacaccggagcccccgac

SEQ ID NO: 465090 - DNA, 20 bp, mouse
ggctgcgggctgcgaaggag

SEQ ID NO: 465091 - DNA, 20 bp, mouse
gttgctgtgcgactgctggg

SEQ ID NO: 465092 - DNA, 20 bp, mouse
gcctatggccccagggacgg

SEQ ID NO: 465093 - DNA, 20 bp, mouse
gcaacaggagactcgggaga

SEQ ID NO: 465094 - DNA, 20 bp, mouse
gtaggactccgcagggacgg

SEQ ID NO: 465095 - DNA, 20 bp, mouse
gccggcggcactaggagatc

SEQ ID NO: 465096 - DNA, 20 bp, mouse
gtggctgaccgggaccggga

SEQ ID NO: 465097 - DNA, 20 bp, mouse
gtcttacttacgctttcagg

SEQ ID NO: 465098 - DNA, 20 bp, mouse
gcccagcgcgcagaaatgtc

SEQ ID NO: 465099 - DNA, 20 bp, mouse
ggcgccggctgcgctccaca

SEQ ID NO: 465100 - DNA, 20 bp, mouse
gccgagaaccgtgaagaccc

SEQ ID NO: 465101 - DNA, 20 bp, mouse
gtgagcagcccgggtcttca

SEQ ID NO: 465102 - DNA, 20 bp, mouse
ggcgtggtggtagttattag

SEQ ID NO: 465103 - DNA, 20 bp, mouse
gcggctggtcgccaagtggg

SEQ ID NO: 465104 - DNA, 20 bp, mouse
ggacacctcccgctgcgccc

SEQ ID NO: 465105 - DNA, 20 bp, mouse
ggccggctcaggagctgcgg

SEQ ID NO: 465106 - DNA, 20 bp, mouse
gagtcggccctggcagaggt

SEQ ID NO: 465107 - DNA, 20 bp, mouse
gcaggaagccgagtcggccc

SEQ ID NO: 465108 - DNA, 20 bp, mouse
gctggttgtgtccgagactg

SEQ ID NO: 465109 - DNA, 20 bp, mouse
gatcacccaagagcccacgt

SEQ ID NO: 465110 - DNA, 20 bp, mouse
gcggagccaggaagccgagt

SEQ ID NO: 465111 - DNA, 20 bp, mouse
ggccgagtcggccctggcag

SEQ ID NO: 465112 - DNA, 20 bp, mouse
gcccaggaggggcagtccca

SEQ ID NO: 465113 - DNA, 20 bp, mouse
gcttcctggctccgcagtct

SEQ ID NO: 465114 - DNA, 20 bp, mouse
gctgtctgctagctgggata

SEQ ID NO: 465115 - DNA, 20 bp, mouse
ggaaaataaactcccaggag

SEQ ID NO: 465116 - DNA, 20 bp, mouse
ggaggcagccctgcaacggg

SEQ ID NO: 465117 - DNA, 20 bp, mouse
gtccgtaggtccatgtgtag

SEQ ID NO: 465118 - DNA, 20 bp, mouse
gtccactacacatggaccta

SEQ ID NO: 465119 - DNA, 20 bp, mouse
gctaggacccgaggacaggt

SEQ ID NO: 465120 - DNA, 20 bp, mouse
gtccggaccaacctgtcctc

SEQ ID NO: 465121 - DNA, 20 bp, mouse
ggatcctaggacccgaggac

SEQ ID NO: 465122 - DNA, 20 bp, mouse
gacccggaagtaatctccgt

SEQ ID NO: 465123 - DNA, 20 bp, mouse
gtagtggagagccgggaatt

SEQ ID NO: 465124 - DNA, 20 bp, mouse
gccatgtgtagtggagagcc

SEQ ID NO: 465125 - DNA, 20 bp, mouse
gacgttcagcagccctgcgg

SEQ ID NO: 465126 - DNA, 20 bp, mouse
gagggtggaccgggaagacc

SEQ ID NO: 465127 - DNA, 20 bp, mouse
gaccctgcctgggcgcaggt

SEQ ID NO: 465128 - DNA, 20 bp, mouse
ggcccaggcagggtaaggcc

SEQ ID NO: 465129 - DNA, 20 bp, mouse
gagcttgcctacctgcgccc

SEQ ID NO: 465130 - DNA, 20 bp, mouse
ggcctacctgcgcccaggca

SEQ ID NO: 465131 - DNA, 20 bp, mouse
gttcctgcgccagggtggac

SEQ ID NO: 465132 - DNA, 20 bp, mouse
ggcaggtaggcaagctgatg

SEQ ID NO: 465133 - DNA, 20 bp, mouse
gaccgccatggtcacccggt

SEQ ID NO: 465134 - DNA, 20 bp, mouse
gagtgactgttcctgcgcca

SEQ ID NO: 465135 - DNA, 20 bp, mouse
ggccgaccgggtgaccatgg

SEQ ID NO: 465136 - DNA, 20 bp, mouse
gggagaggctatccccacag

SEQ ID NO: 465137 - DNA, 20 bp, mouse
ggatagcctctccatcacta

SEQ ID NO: 465138 - DNA, 20 bp, mouse
gcctaagtcctgaacctcgg

SEQ ID NO: 465139 - DNA, 20 bp, mouse
gaaggactttcaatatgatg

SEQ ID NO: 465140 - DNA, 20 bp, mouse
gattgccgacctgctgacca

SEQ ID NO: 465141 - DNA, 20 bp, mouse
gatcttccttagtgatggag

SEQ ID NO: 465142 - DNA, 20 bp, mouse
gactgccatggtcagcaggt

SEQ ID NO: 465143 - DNA, 20 bp, mouse
ggtcctgtggatggcctcat

SEQ ID NO: 465144 - DNA, 20 bp, mouse
gtccaggtatgatatatcac

SEQ ID NO: 465145 - DNA, 20 bp, mouse
gtttctgtccctgcccctgt

SEQ ID NO: 465146 - DNA, 20 bp, mouse
gtacccgcttagagactcgg

SEQ ID NO: 465147 - DNA, 20 bp, mouse
gggcgccgttaggtgagacc

SEQ ID NO: 465148 - DNA, 20 bp, mouse
gcggaagctctgtctctgat

SEQ ID NO: 465149 - DNA, 20 bp, mouse
gaccggggacctaaagtcta

SEQ ID NO: 465150 - DNA, 20 bp, mouse
gctctgatgggcacatggtt

SEQ ID NO: 465151 - DNA, 20 bp, mouse
ggcttccgggtctcacctaa

SEQ ID NO: 465152 - DNA, 20 bp, mouse
ggattacccgcttagagact

SEQ ID NO: 465153 - DNA, 20 bp, mouse
gggggactgcaattattaaa

SEQ ID NO: 465154 - DNA, 20 bp, mouse
gagtctgtgcagtctagggt

SEQ ID NO: 465155 - DNA, 20 bp, mouse
gcagtctagggtaggagaat

SEQ ID NO: 465156 - DNA, 20 bp, mouse
ggggccgcgaccctcattct

SEQ ID NO: 465157 - DNA, 20 bp, mouse
gcacactgcgcccagaatga

SEQ ID NO: 465158 - DNA, 20 bp, mouse
ggcgcccagaatgagggtcg

SEQ ID NO: 465159 - DNA, 20 bp, mouse
gcacgcggcgccccaagaag

SEQ ID NO: 465160 - DNA, 20 bp, mouse
gcggccctgatcaggtaatg

SEQ ID NO: 465161 - DNA, 20 bp, mouse
ggccccacgcgcctcctctc

SEQ ID NO: 465162 - DNA, 20 bp, mouse
ggagggtcgcggccctgatc

SEQ ID NO: 465163 - DNA, 20 bp, mouse
gagtcctcattacctgatca

SEQ ID NO: 465164 - DNA, 20 bp, mouse
gcgcagcagacaccaggtcg

SEQ ID NO: 465165 - DNA, 20 bp, mouse
gccagtcgccgcgggatccc

SEQ ID NO: 465166 - DNA, 20 bp, mouse
gcgggagggtgaagcaacag

SEQ ID NO: 465167 - DNA, 20 bp, mouse
ggagggtcggcagtgactga

SEQ ID NO: 465168 - DNA, 20 bp, mouse
gaccaggtgcatgaccggga

SEQ ID NO: 465169 - DNA, 20 bp, mouse
ggagggactgctaacctcag

SEQ ID NO: 465170 - DNA, 20 bp, mouse
ggactcgcaacgtccctgcg

SEQ ID NO: 465171 - DNA, 20 bp, mouse
gagggaccaggtgcatgacc

SEQ ID NO: 465172 - DNA, 20 bp, mouse
gttggttctggctcaatggc

SEQ ID NO: 465173 - DNA, 20 bp, mouse
gaatggcgggtagccacgca

SEQ ID NO: 465174 - DNA, 20 bp, mouse
gctgtaccgggaatcttcgg

SEQ ID NO: 465175 - DNA, 20 bp, mouse
ggtagacactgagcttaccg

SEQ ID NO: 465176 - DNA, 20 bp, mouse
ggccgtcatggcttccacgg

SEQ ID NO: 465177 - DNA, 20 bp, mouse
ggcctctcgcagagccgtca

SEQ ID NO: 465178 - DNA, 20 bp, mouse
ggcgaggagcggccctgcgg

SEQ ID NO: 465179 - DNA, 20 bp, mouse
ggccatgacggctctgcgag

SEQ ID NO: 465180 - DNA, 20 bp, mouse
gagagccgtcatggcttcca

SEQ ID NO: 465181 - DNA, 20 bp, mouse
gagactgcgactcgcccccg

SEQ ID NO: 465182 - DNA, 20 bp, mouse
ggccgcgagcaggctcggga

SEQ ID NO: 465183 - DNA, 20 bp, mouse
gcttctccgagaggtagaag

SEQ ID NO: 465184 - DNA, 20 bp, mouse
ggtcgcgaggagcggccctg

SEQ ID NO: 465185 - DNA, 20 bp, mouse
ggagcaggctcgggagggag

SEQ ID NO: 465186 - DNA, 20 bp, mouse
gtggagagatggtgagcctg

SEQ ID NO: 465187 - DNA, 20 bp, mouse
gcggcggaacgctggagaga

SEQ ID NO: 465188 - DNA, 20 bp, mouse
gtactcagagccccgacccc

SEQ ID NO: 465189 - DNA, 20 bp, mouse
gttgagggtaccaggggtcg

SEQ ID NO: 465190 - DNA, 20 bp, mouse
gggtgacacgaggcctgacg

SEQ ID NO: 465191 - DNA, 20 bp, mouse
ggcggtggagagagcgatct

SEQ ID NO: 465192 - DNA, 20 bp, mouse
gagccggaaaggcctaaacc

SEQ ID NO: 465193 - DNA, 20 bp, mouse
gacggagggcttactagaag

SEQ ID NO: 465194 - DNA, 20 bp, mouse
ggtgtacaagcactaacgga

SEQ ID NO: 465195 - DNA, 20 bp, mouse
ggctcgtgtacaagcactaa

SEQ ID NO: 465196 - DNA, 20 bp, mouse
gttgtcagcgcggcacacgg

SEQ ID NO: 465197 - DNA, 20 bp, mouse
gggcacacggaggtacgctt

SEQ ID NO: 465198 - DNA, 20 bp, mouse
ggtggaaagacggaaatggg

SEQ ID NO: 465199 - DNA, 20 bp, mouse
gccagcggagaccaacaggt

SEQ ID NO: 465200 - DNA, 20 bp, mouse
gcggaggtacgcttaggtgg

SEQ ID NO: 465201 - DNA, 20 bp, mouse
ggagctgcagagccagatcg

SEQ ID NO: 465202 - DNA, 20 bp, mouse
gcccatggtcagggcagccc

SEQ ID NO: 465203 - DNA, 20 bp, mouse
gccacaggacctctcggcag

SEQ ID NO: 465204 - DNA, 20 bp, mouse
gctgcagagccagatcgtgg

SEQ ID NO: 465205 - DNA, 20 bp, mouse
gccctgaccatgggagcact

SEQ ID NO: 465206 - DNA, 20 bp, mouse
gcggcctgggctacaccagt

SEQ ID NO: 465207 - DNA, 20 bp, mouse
gaccagtggggagcgcgtac

SEQ ID NO: 465208 - DNA, 20 bp, mouse
gccccgtacgcgctccccac

SEQ ID NO: 465209 - DNA, 20 bp, mouse
ggggagcccgtagagcctgg

SEQ ID NO: 465210 - DNA, 20 bp, mouse
gggactatccctccagggag

SEQ ID NO: 465211 - DNA, 20 bp, mouse
ggcacctgatcgcgccggag

SEQ ID NO: 465212 - DNA, 20 bp, mouse
ggaaggggagcgccagggag

SEQ ID NO: 465213 - DNA, 20 bp, mouse
gccaggccgccaggctctac

SEQ ID NO: 465214 - DNA, 20 bp, mouse
ggagcaaccttaaagcgcgc

SEQ ID NO: 465215 - DNA, 20 bp, mouse
ggatgctggagcgcaaagcc

SEQ ID NO: 465216 - DNA, 20 bp, mouse
gcaggtgaggtacagcgcct

SEQ ID NO: 465217 - DNA, 20 bp, mouse
gctgttgggaagccatataa

SEQ ID NO: 465218 - DNA, 20 bp, mouse
gcaggaagtgagtttgcgaa

SEQ ID NO: 465219 - DNA, 20 bp, mouse
gcggagcgtggagaatgtgg

SEQ ID NO: 465220 - DNA, 20 bp, mouse
gcgaacggagcagctgcagc

SEQ ID NO: 465221 - DNA, 20 bp, mouse
gtggaagaggcactgaaggg

SEQ ID NO: 465222 - DNA, 20 bp, mouse
gtcttcaggagatcagagcg

SEQ ID NO: 465223 - DNA, 20 bp, mouse
ggcgcaaataaggagtacag

SEQ ID NO: 465224 - DNA, 20 bp, mouse
gaagaaaacaggatagtgaa

SEQ ID NO: 465225 - DNA, 20 bp, mouse
gactgaagggtggacagaaa

SEQ ID NO: 465226 - DNA, 20 bp, mouse
gaccaggagctgccattagg

SEQ ID NO: 465227 - DNA, 20 bp, mouse
gaagtcactgcgcgcagaga

SEQ ID NO: 465228 - DNA, 20 bp, mouse
gaggagccgcccgaccatga

SEQ ID NO: 465229 - DNA, 20 bp, mouse
ggggccaccctcacaggtga

SEQ ID NO: 465230 - DNA, 20 bp, mouse
gaactctgaagcttgagcgc

SEQ ID NO: 465231 - DNA, 20 bp, mouse
ggcaaccaggagctgccatt

SEQ ID NO: 465232 - DNA, 20 bp, mouse
gcagagacggacgtcctgcg

SEQ ID NO: 465233 - DNA, 20 bp, mouse
ggtgcactagtagacctgag

SEQ ID NO: 465234 - DNA, 20 bp, mouse
gtggcatcagacgggtgggt

SEQ ID NO: 465235 - DNA, 20 bp, mouse
gactcaccttcatggtcggg

SEQ ID NO: 465236 - DNA, 20 bp, mouse
gcgcggcagcggacaggagg

SEQ ID NO: 465237 - DNA, 20 bp, mouse
ggaagcagcacgcatcactc

SEQ ID NO: 465238 - DNA, 20 bp, mouse
ggcaactggcggctgagtgc

SEQ ID NO: 465239 - DNA, 20 bp, mouse
gcaccaggatcagaatggta

SEQ ID NO: 465240 - DNA, 20 bp, mouse
gcctttgcgcggcagcggac

SEQ ID NO: 465241 - DNA, 20 bp, mouse
gggatcagaatggtagggtg

SEQ ID NO: 465242 - DNA, 20 bp, mouse
gtcagaatggtagggtgagg

SEQ ID NO: 465243 - DNA, 20 bp, mouse
ggtttctgtggcgattgcag

SEQ ID NO: 465244 - DNA, 20 bp, mouse
gcgccaccccagagacagaa

SEQ ID NO: 465245 - DNA, 20 bp, mouse
gcggagcatgcgcctttgcg

SEQ ID NO: 465246 - DNA, 20 bp, mouse
ggcagagtcgctcaacaccc

SEQ ID NO: 465247 - DNA, 20 bp, mouse
gactcgcgtgtggcgcggag

SEQ ID NO: 465248 - DNA, 20 bp, mouse
gcgtgtggcgcggagcggcc

SEQ ID NO: 465249 - DNA, 20 bp, mouse
gaggcgattcgactcgcgtg

SEQ ID NO: 465250 - DNA, 20 bp, mouse
ggaaagaagaaaggcgagcc

SEQ ID NO: 465251 - DNA, 20 bp, mouse
gcgctgtaccaaaggttcac

SEQ ID NO: 465252 - DNA, 20 bp, mouse
ggcgcggagcgactgtgacg

SEQ ID NO: 465253 - DNA, 20 bp, mouse
ggaaggcgactggcctccgg

SEQ ID NO: 465254 - DNA, 20 bp, mouse
gccagtgagccagcgcacgg

SEQ ID NO: 465255 - DNA, 20 bp, mouse
gtggcgcccagggagcgcgg

SEQ ID NO: 465256 - DNA, 20 bp, mouse
ggatccaggaggggacacca

SEQ ID NO: 465257 - DNA, 20 bp, mouse
gagcagcaggaccaggatcc

SEQ ID NO: 465258 - DNA, 20 bp, mouse
ggtccacagggtaacaagga

SEQ ID NO: 465259 - DNA, 20 bp, mouse
gcttgttaccctgtggacca

SEQ ID NO: 465260 - DNA, 20 bp, mouse
ggagctggttgggatcatca

SEQ ID NO: 465261 - DNA, 20 bp, mouse
gggaccatggtgtcccctcc

SEQ ID NO: 465262 - DNA, 20 bp, mouse
gagggcaggtgcagagactc

SEQ ID NO: 465263 - DNA, 20 bp, mouse
gacgcaggtaggaacccatg

SEQ ID NO: 465264 - DNA, 20 bp, mouse
ggccagtctgtactcacctc

SEQ ID NO: 465265 - DNA, 20 bp, mouse
gggatcatcagggatctagg

SEQ ID NO: 465266 - DNA, 20 bp, mouse
gggacgaagggacttaaaag

SEQ ID NO: 465267 - DNA, 20 bp, mouse
gcccccaggcagcggacgaa

SEQ ID NO: 465268 - DNA, 20 bp, mouse
ggcggaggcgaagacagcac

SEQ ID NO: 465269 - DNA, 20 bp, mouse
ggccacagcagcttcctcgg

SEQ ID NO: 465270 - DNA, 20 bp, mouse
gcgaagggacttaaaagcgg

SEQ ID NO: 465271 - DNA, 20 bp, mouse
gagggacttaaaagcggcgg

SEQ ID NO: 465272 - DNA, 20 bp, mouse
ggccccgacgggagcggagg

SEQ ID NO: 465273 - DNA, 20 bp, mouse
ggaggcggcgcggcatgaag

SEQ ID NO: 465274 - DNA, 20 bp, mouse
gaagacagcaccggaggcct

SEQ ID NO: 465275 - DNA, 20 bp, mouse
gccggaagtgccgaggcctc

SEQ ID NO: 465276 - DNA, 20 bp, mouse
gcaagacgagggcccggaag

SEQ ID NO: 465277 - DNA, 20 bp, mouse
gcgaagcgcggcgaccagag

SEQ ID NO: 465278 - DNA, 20 bp, mouse
gcgctccatgcccaagacga

SEQ ID NO: 465279 - DNA, 20 bp, mouse
gacgagggcccggaagtggc

SEQ ID NO: 465280 - DNA, 20 bp, mouse
gcgctctgcgatgaagctgg

SEQ ID NO: 465281 - DNA, 20 bp, mouse
gggcggggacgacgaggaca

SEQ ID NO: 465282 - DNA, 20 bp, mouse
ggcatggagcgtcgcgtgtg

SEQ ID NO: 465283 - DNA, 20 bp, mouse
gagcgcggcgaccagagcgg

SEQ ID NO: 465284 - DNA, 20 bp, mouse
gcatgcccaagacgagggcc

SEQ ID NO: 465285 - DNA, 20 bp, mouse
gcgaaggcggcggacaccgg

SEQ ID NO: 465286 - DNA, 20 bp, mouse
gtacagtcacatctaaagta

SEQ ID NO: 465287 - DNA, 20 bp, mouse
gccaggtgttgaagtccccc

SEQ ID NO: 465288 - DNA, 20 bp, mouse
gctagatagcatctgctcac

SEQ ID NO: 465289 - DNA, 20 bp, mouse
gccctaagtacaggtaagtg

SEQ ID NO: 465290 - DNA, 20 bp, mouse
gacatggtacagacactcca

SEQ ID NO: 465291 - DNA, 20 bp, mouse
gaacgtgggacattaaacag

SEQ ID NO: 465292 - DNA, 20 bp, mouse
ggtgatgtggggttgaacgt

SEQ ID NO: 465293 - DNA, 20 bp, mouse
ggagtcaggatagtgttcct

SEQ ID NO: 465294 - DNA, 20 bp, mouse
gttacgtgagaagtgatgtg

SEQ ID NO: 465295 - DNA, 20 bp, mouse
gtccccacttacctgtactt

SEQ ID NO: 465296 - DNA, 20 bp, mouse
ggaagtcggcattcattcag

SEQ ID NO: 465297 - DNA, 20 bp, mouse
gggcctggagactttcaacg

SEQ ID NO: 465298 - DNA, 20 bp, mouse
ggtggagtatcaagcagaga

SEQ ID NO: 465299 - DNA, 20 bp, mouse
gggcttccgaggaactgcgt

SEQ ID NO: 465300 - DNA, 20 bp, mouse
gtcactctagggctcctgtc

SEQ ID NO: 465301 - DNA, 20 bp, mouse
gagttcctcggaagccagac

SEQ ID NO: 465302 - DNA, 20 bp, mouse
ggagtaaatcgtctcagact

SEQ ID NO: 465303 - DNA, 20 bp, mouse
gggctcctgtctggcttccg

SEQ ID NO: 465304 - DNA, 20 bp, mouse
gagagagggttccaagattg

SEQ ID NO: 465305 - DNA, 20 bp, mouse
gatggggaaacccaccaact

SEQ ID NO: 465306 - DNA, 20 bp, mouse
gtagctgaacgagaagagaa

SEQ ID NO: 465307 - DNA, 20 bp, mouse
gagtagcctgggggtagact

SEQ ID NO: 465308 - DNA, 20 bp, mouse
gcagtcagtctgtgaatggg

SEQ ID NO: 465309 - DNA, 20 bp, mouse
gtacagccgagtctaccccc

SEQ ID NO: 465310 - DNA, 20 bp, mouse
gtagcattaaagtagcctgg

SEQ ID NO: 465311 - DNA, 20 bp, mouse
gcgctttggatgatacaggt

SEQ ID NO: 465312 - DNA, 20 bp, mouse
ggtagactcggctgtataaa

SEQ ID NO: 465313 - DNA, 20 bp, mouse
gtagcagtcagtctgtgaat

SEQ ID NO: 465314 - DNA, 20 bp, mouse
gctgactcagtggaggacca

SEQ ID NO: 465315 - DNA, 20 bp, mouse
gcccaaaaccccgggcagaa

SEQ ID NO: 465316 - DNA, 20 bp, mouse
gaagagggcctcaagacaac

SEQ ID NO: 465317 - DNA, 20 bp, mouse
gttatcccgggaccagctac

SEQ ID NO: 465318 - DNA, 20 bp, mouse
gtaactggggactccttccg

SEQ ID NO: 465319 - DNA, 20 bp, mouse
gtaaaacagggtataaactg

SEQ ID NO: 465320 - DNA, 20 bp, mouse
gttaacctgagaggacccga

SEQ ID NO: 465321 - DNA, 20 bp, mouse
gcatctacacccgggcccca

SEQ ID NO: 465322 - DNA, 20 bp, mouse
gcgcgcaaggccacttcgag

SEQ ID NO: 465323 - DNA, 20 bp, mouse
gggccttgcgcgagaccctg

SEQ ID NO: 465324 - DNA, 20 bp, mouse
ggtagatgtgttaggagagg

SEQ ID NO: 465325 - DNA, 20 bp, mouse
gggtcctctcaggttaactg

SEQ ID NO: 465326 - DNA, 20 bp, mouse
gagctgtgggccgtgcgtgg

SEQ ID NO: 465327 - DNA, 20 bp, mouse
gggtcaccatcatcctgcca

SEQ ID NO: 465328 - DNA, 20 bp, mouse
gtggagctgtgggccgtgcg

SEQ ID NO: 465329 - DNA, 20 bp, mouse
gtgtgggcctgtccggggaa

SEQ ID NO: 465330 - DNA, 20 bp, mouse
ggaagttttagtacctgtgt

SEQ ID NO: 465331 - DNA, 20 bp, mouse
gcaagcttatccaccacgca

SEQ ID NO: 465332 - DNA, 20 bp, mouse
gtactaaaacttcctgaacc

SEQ ID NO: 465333 - DNA, 20 bp, mouse
gtcattgcctttccccggac

SEQ ID NO: 465334 - DNA, 20 bp, mouse
ggagactctcacctttttgc

SEQ ID NO: 465335 - DNA, 20 bp, mouse
gtggttccttggcaggatga

SEQ ID NO: 465336 - DNA, 20 bp, mouse
gcagcctggggccagtatgg

SEQ ID NO: 465337 - DNA, 20 bp, mouse
ggagtgaggtccatactgcc

SEQ ID NO: 465338 - DNA, 20 bp, mouse
gtatggacctcactcttctg

SEQ ID NO: 465339 - DNA, 20 bp, mouse
gtctgggaaccacatgtcag

SEQ ID NO: 465340 - DNA, 20 bp, mouse
gtgccagaagccgggcagta

SEQ ID NO: 465341 - DNA, 20 bp, mouse
ggagcccactgagtgctggt

SEQ ID NO: 465342 - DNA, 20 bp, mouse
ggtcctggtactgctggtat

SEQ ID NO: 465343 - DNA, 20 bp, mouse
gcacttgcccgtggggacac

SEQ ID NO: 465344 - DNA, 20 bp, mouse
gtggtgggaggagatcaaca

SEQ ID NO: 465345 - DNA, 20 bp, mouse
gaccagcagtaccaggacta

SEQ ID NO: 465346 - DNA, 20 bp, mouse
gccgggcgcgcgcagctagc

SEQ ID NO: 465347 - DNA, 20 bp, mouse
ggcaggcgcggagcaagcac

SEQ ID NO: 465348 - DNA, 20 bp, mouse
ggtgagcgaccgccagtccg

SEQ ID NO: 465349 - DNA, 20 bp, mouse
gtatgccaagatggtcctgc

SEQ ID NO: 465350 - DNA, 20 bp, mouse
ggcgacgagcgggccgaccg

SEQ ID NO: 465351 - DNA, 20 bp, mouse
gggacggcggccgggatccg

SEQ ID NO: 465352 - DNA, 20 bp, mouse
ggctgcgcgcgcccggacgg

SEQ ID NO: 465353 - DNA, 20 bp, mouse
gcggatgccccgctcagtgg

SEQ ID NO: 465354 - DNA, 20 bp, mouse
gcggagcaagcaccgggacg

SEQ ID NO: 465355 - DNA, 20 bp, mouse
gcggcccgcgaggccgtccg

SEQ ID NO: 465356 - DNA, 20 bp, mouse
gacgacgaggctgcccgcaa

SEQ ID NO: 465357 - DNA, 20 bp, mouse
gacgaggctgcccgcaacgg

SEQ ID NO: 465358 - DNA, 20 bp, mouse
gggggggcggacacaccacc

SEQ ID NO: 465359 - DNA, 20 bp, mouse
gcacggtcgccatgacgacg

SEQ ID NO: 465360 - DNA, 20 bp, mouse
gccgctgggcaatgtccggg

SEQ ID NO: 465361 - DNA, 20 bp, mouse
gtcaccgctgggcaatgtcc

SEQ ID NO: 465362 - DNA, 20 bp, mouse
gggtcgttgaggctgcctgg

SEQ ID NO: 465363 - DNA, 20 bp, mouse
gcaacggtggctggtcgttg

SEQ ID NO: 465364 - DNA, 20 bp, mouse
gcgtagttgcgagcacccga

SEQ ID NO: 465365 - DNA, 20 bp, mouse
gatggagctggatcaccgct

SEQ ID NO: 465366 - DNA, 20 bp, mouse
gctacagcgaggtgaagact

SEQ ID NO: 465367 - DNA, 20 bp, mouse
gcagcgaggtgaagactagg

SEQ ID NO: 465368 - DNA, 20 bp, mouse
gagggacgcgcccacttcac

SEQ ID NO: 465369 - DNA, 20 bp, mouse
gcacttcacgggctacagcg

SEQ ID NO: 465370 - DNA, 20 bp, mouse
gtgcggcgcgctgcaaggat

SEQ ID NO: 465371 - DNA, 20 bp, mouse
gcagtgtctacgggacacgt

SEQ ID NO: 465372 - DNA, 20 bp, mouse
gagctgttcccggctctgtg

SEQ ID NO: 465373 - DNA, 20 bp, mouse
ggcagcgcgccgcacagagc

SEQ ID NO: 465374 - DNA, 20 bp, mouse
gcggcctcagcagtcctcag

SEQ ID NO: 465375 - DNA, 20 bp, mouse
ggctgcaaggatgggcctgg

SEQ ID NO: 465376 - DNA, 20 bp, mouse
ggattaccttgcaggagggt

SEQ ID NO: 465377 - DNA, 20 bp, mouse
gagagcgagagatctcattc

SEQ ID NO: 465378 - DNA, 20 bp, mouse
gtcccggcagctactgatgt

SEQ ID NO: 465379 - DNA, 20 bp, mouse
gccgggattaccttgcagga

SEQ ID NO: 465380 - DNA, 20 bp, mouse
gtctcattcaggacggaatg

SEQ ID NO: 465381 - DNA, 20 bp, mouse
gtcaggtgcaaagaggggaa

SEQ ID NO: 465382 - DNA, 20 bp, mouse
gaggctccgaccctcctgca

SEQ ID NO: 465383 - DNA, 20 bp, mouse
gatgcatcaggtgcaaagag

SEQ ID NO: 465384 - DNA, 20 bp, mouse
gtactacaagcagatgctgc

SEQ ID NO: 465385 - DNA, 20 bp, mouse
ggctgccgggattaccttgc

SEQ ID NO: 465386 - DNA, 20 bp, mouse
ggcggggtttggatactcgg

SEQ ID NO: 465387 - DNA, 20 bp, mouse
gggagacccgagtggcccta

SEQ ID NO: 465388 - DNA, 20 bp, mouse
gcggaggtttgggagactcc

SEQ ID NO: 465389 - DNA, 20 bp, mouse
gcagttggcggagacaccag

SEQ ID NO: 465390 - DNA, 20 bp, mouse
gggttccactgcaaactcgg

SEQ ID NO: 465391 - DNA, 20 bp, mouse
ggtctccgcggagacccgag

SEQ ID NO: 465392 - DNA, 20 bp, mouse
ggccgcggggtttggatact

SEQ ID NO: 465393 - DNA, 20 bp, mouse
ggggctgctcgggagccgta

SEQ ID NO: 465394 - DNA, 20 bp, mouse
gtttggatactcggaggttt

SEQ ID NO: 465395 - DNA, 20 bp, mouse
gtccgcggagacgatggcaa

SEQ ID NO: 465396 - DNA, 20 bp, mouse
gggtcgtcccaaggatgtag

SEQ ID NO: 465397 - DNA, 20 bp, mouse
gggttcgcgctgtgagtcgg

SEQ ID NO: 465398 - DNA, 20 bp, mouse
gggttcctaagtgccctgca

SEQ ID NO: 465399 - DNA, 20 bp, mouse
ggagtcggtggcgccgtgca

SEQ ID NO: 465400 - DNA, 20 bp, mouse
gagcggttcgcgctgtgagt

SEQ ID NO: 465401 - DNA, 20 bp, mouse
ggtcccaaggatgtagcggt

SEQ ID NO: 465402 - DNA, 20 bp, mouse
gggcgccgtgcagggcactt

SEQ ID NO: 465403 - DNA, 20 bp, mouse
gttacccgcgccaaggctgt

SEQ ID NO: 465404 - DNA, 20 bp, mouse
gaagacgccaggacccggtg

SEQ ID NO: 465405 - DNA, 20 bp, mouse
ggcgcgacgtccctcactta

SEQ ID NO: 465406 - DNA, 20 bp, mouse
gagtcagtgcaccagtgctg

SEQ ID NO: 465407 - DNA, 20 bp, mouse
ggcaagctgaggctttggtg

SEQ ID NO: 465408 - DNA, 20 bp, mouse
gcaggctggacactgtactc

SEQ ID NO: 465409 - DNA, 20 bp, mouse
ggtctgtgtgcgggagtctg

SEQ ID NO: 465410 - DNA, 20 bp, mouse
gaccacggaggggacagagg

SEQ ID NO: 465411 - DNA, 20 bp, mouse
gcaggacctggttacttcgt

SEQ ID NO: 465412 - DNA, 20 bp, mouse
gtgcccgagccaaggcaata

SEQ ID NO: 465413 - DNA, 20 bp, mouse
gtctgggtcactatgactta

SEQ ID NO: 465414 - DNA, 20 bp, mouse
gagatccgcgaagtttcccc

SEQ ID NO: 465415 - DNA, 20 bp, mouse
gaaaaccacggaggggacag

SEQ ID NO: 465416 - DNA, 20 bp, mouse
gccagcgggagagggagttc

SEQ ID NO: 465417 - DNA, 20 bp, mouse
gggagttctggcacagttcg

SEQ ID NO: 465418 - DNA, 20 bp, mouse
gcagttcgtggagagcttaa

SEQ ID NO: 465419 - DNA, 20 bp, mouse
gtcctgaggacgcatctcgg

SEQ ID NO: 465420 - DNA, 20 bp, mouse
gtggggactgcgaacaaagt

SEQ ID NO: 465421 - DNA, 20 bp, mouse
ggccttcagcccagcgggag

SEQ ID NO: 465422 - DNA, 20 bp, mouse
gctgcccgccttcagcccag

SEQ ID NO: 465423 - DNA, 20 bp, mouse
gcctggaccatggcaccaca

SEQ ID NO: 465424 - DNA, 20 bp, mouse
gggtggcaggtgaggtacaa

SEQ ID NO: 465425 - DNA, 20 bp, mouse
ggcagtagtagggactgagg

SEQ ID NO: 465426 - DNA, 20 bp, mouse
gtccaacacagatccagcta

SEQ ID NO: 465427 - DNA, 20 bp, mouse
gtcgaggccgactggaacca

SEQ ID NO: 465428 - DNA, 20 bp, mouse
gcggagagatgtcttatcag

SEQ ID NO: 465429 - DNA, 20 bp, mouse
gaacacagatccagctaggg

SEQ ID NO: 465430 - DNA, 20 bp, mouse
ggataagacatctctccggg

SEQ ID NO: 465431 - DNA, 20 bp, mouse
gtaggtgcgaggatgcatgg

SEQ ID NO: 465432 - DNA, 20 bp, mouse
gtggatctgtgttggaggag

SEQ ID NO: 465433 - DNA, 20 bp, mouse
gaggcgcgatcgaggccgac

SEQ ID NO: 465434 - DNA, 20 bp, mouse
gggcggcgcaggcgcgatcg

SEQ ID NO: 465435 - DNA, 20 bp, mouse
gtcaccaccatcgcctacgt

SEQ ID NO: 465436 - DNA, 20 bp, mouse
gttgccctggtaggacatgg

SEQ ID NO: 465437 - DNA, 20 bp, mouse
gtcgccaccatgtcctacca

SEQ ID NO: 465438 - DNA, 20 bp, mouse
gttcttgccctggtaggaca

SEQ ID NO: 465439 - DNA, 20 bp, mouse
ggccggcaagaagccaccgg

SEQ ID NO: 465440 - DNA, 20 bp, mouse
gtaggacatggtggcgattc

SEQ ID NO: 465441 - DNA, 20 bp, mouse
ggcggactcaccgtgatccg

SEQ ID NO: 465442 - DNA, 20 bp, mouse
ggtgcggcggtcagtccaga

SEQ ID NO: 465443 - DNA, 20 bp, mouse
gacccgaccgggcacgccaa

SEQ ID NO: 465444 - DNA, 20 bp, mouse
gtcgggtcccccgggaaata

SEQ ID NO: 465445 - DNA, 20 bp, mouse
gcggtccgggtgctggagtg

SEQ ID NO: 465446 - DNA, 20 bp, mouse
ggctccgcgcgtgtcctcgt

SEQ ID NO: 465447 - DNA, 20 bp, mouse
ggaggacacgcgcggagctt

SEQ ID NO: 465448 - DNA, 20 bp, mouse
ggggcgtggacgtaccgacg

SEQ ID NO: 465449 - DNA, 20 bp, mouse
gggctgagtgtcctcggtag

SEQ ID NO: 465450 - DNA, 20 bp, mouse
gtggcggcgcgcgaaggaga

SEQ ID NO: 465451 - DNA, 20 bp, mouse
gagccgggctagctcacact

SEQ ID NO: 465452 - DNA, 20 bp, mouse
gtcctcggtaggggctgcgc

SEQ ID NO: 465453 - DNA, 20 bp, mouse
ggcccgcgcagcccctaccg

SEQ ID NO: 465454 - DNA, 20 bp, mouse
ggccaagccactcccgccgt

SEQ ID NO: 465455 - DNA, 20 bp, mouse
ggacatcctgatacacgggc

SEQ ID NO: 465456 - DNA, 20 bp, mouse
gtagctgcggttgcacgggg

SEQ ID NO: 465457 - DNA, 20 bp, mouse
gtgctagcgcgctctctcgg

SEQ ID NO: 465458 - DNA, 20 bp, mouse
gcggtagctgcggttgcacg

SEQ ID NO: 465459 - DNA, 20 bp, mouse
gcctggagcggagtcccgag

SEQ ID NO: 465460 - DNA, 20 bp, mouse
gcggtctctgggtctcgccg

SEQ ID NO: 465461 - DNA, 20 bp, mouse
gtcatcggctggaggagcct

SEQ ID NO: 465462 - DNA, 20 bp, mouse
gggctgctagcgcgctctct

SEQ ID NO: 465463 - DNA, 20 bp, mouse
ggcagatccggactaaggtg

SEQ ID NO: 465464 - DNA, 20 bp, mouse
gactccgctccaggcgcgca

SEQ ID NO: 465465 - DNA, 20 bp, mouse
gagacccagagaccgaccga

SEQ ID NO: 465466 - DNA, 20 bp, mouse
ggcagctctgggacacggtc

SEQ ID NO: 465467 - DNA, 20 bp, mouse
gctagcacagggacccacgg

SEQ ID NO: 465468 - DNA, 20 bp, mouse
gtctaagaggacatcaccag

SEQ ID NO: 465469 - DNA, 20 bp, mouse
gcaaacctgccagcagctct

SEQ ID NO: 465470 - DNA, 20 bp, mouse
ggagaaggggacagtaggta

SEQ ID NO: 465471 - DNA, 20 bp, mouse
gactccagggaggcctgggt

SEQ ID NO: 465472 - DNA, 20 bp, mouse
ggggatcccagctacaaaca

SEQ ID NO: 465473 - DNA, 20 bp, mouse
ggtagggccattaatgattc

SEQ ID NO: 465474 - DNA, 20 bp, mouse
gcagccaggcacaccaaccc

SEQ ID NO: 465475 - DNA, 20 bp, mouse
gcgtgctgggtgtctctaag

SEQ ID NO: 465476 - DNA, 20 bp, mouse
gcaggctgtgcgagcaggag

SEQ ID NO: 465477 - DNA, 20 bp, mouse
ggcaggagcggcgctaacgg

SEQ ID NO: 465478 - DNA, 20 bp, mouse
gcgagcaggagcggcgctaa

SEQ ID NO: 465479 - DNA, 20 bp, mouse
ggctaacggtggtctctcta

SEQ ID NO: 465480 - DNA, 20 bp, mouse
gctctacgggccggggaagg

SEQ ID NO: 465481 - DNA, 20 bp, mouse
gtctagggacaccactccca

SEQ ID NO: 465482 - DNA, 20 bp, mouse
ggggagcgcacgcaagacag

SEQ ID NO: 465483 - DNA, 20 bp, mouse
gaacactgcgggagccgcag

SEQ ID NO: 465484 - DNA, 20 bp, mouse
gtggaccgggccgaacactg

SEQ ID NO: 465485 - DNA, 20 bp, mouse
ggtggtctctctacgggccg

SEQ ID NO: 465486 - DNA, 20 bp, mouse
gcgggacagagactccggga

SEQ ID NO: 465487 - DNA, 20 bp, mouse
gggacaggcccagccccgga

SEQ ID NO: 465488 - DNA, 20 bp, mouse
gaggcccagccccggaggga

SEQ ID NO: 465489 - DNA, 20 bp, mouse
ggcggcgggacagagactcc

SEQ ID NO: 465490 - DNA, 20 bp, mouse
ggaagcgctcagagacccga

SEQ ID NO: 465491 - DNA, 20 bp, mouse
gaggcgtgcaagccaggcat

SEQ ID NO: 465492 - DNA, 20 bp, mouse
ggcgctcagagacccgaggg

SEQ ID NO: 465493 - DNA, 20 bp, mouse
ggagagcaccgcgaccacgt

SEQ ID NO: 465494 - DNA, 20 bp, mouse
gccaagacacagacagctaa

SEQ ID NO: 465495 - DNA, 20 bp, mouse
gagagtcaggaagcacgtgt

SEQ ID NO: 465496 - DNA, 20 bp, mouse
gagaaggcagagggcccaaa

SEQ ID NO: 465497 - DNA, 20 bp, mouse
gaccaacaggtaagcgaccc

SEQ ID NO: 465498 - DNA, 20 bp, mouse
ggcccattggcacactgcag

SEQ ID NO: 465499 - DNA, 20 bp, mouse
gtgggacccacccaaccaac

SEQ ID NO: 465500 - DNA, 20 bp, mouse
gccctctgccttctgcacgg

SEQ ID NO: 465501 - DNA, 20 bp, mouse
ggcttacctgttggttgggt

SEQ ID NO: 465502 - DNA, 20 bp, mouse
ggtgggtcccaccgtgcaga

SEQ ID NO: 465503 - DNA, 20 bp, mouse
gggcgcacgcgcagatggga

SEQ ID NO: 465504 - DNA, 20 bp, mouse
ggttcatcaggattgcccat

SEQ ID NO: 465505 - DNA, 20 bp, mouse
ggcagagggcccaaagggca

SEQ ID NO: 465506 - DNA, 20 bp, mouse
gccgcccaggctcctacagt

SEQ ID NO: 465507 - DNA, 20 bp, mouse
gggctggagctggctggtcg

SEQ ID NO: 465508 - DNA, 20 bp, mouse
gcgactgagtgactgatagg

SEQ ID NO: 465509 - DNA, 20 bp, mouse
gggctcgcgactctagtcgt

SEQ ID NO: 465510 - DNA, 20 bp, mouse
gaggcccactgtaggagcct

SEQ ID NO: 465511 - DNA, 20 bp, mouse
ggagctggctggtcggggac

SEQ ID NO: 465512 - DNA, 20 bp, mouse
ggcgctcccgagtagctcgg

SEQ ID NO: 465513 - DNA, 20 bp, mouse
gcgcgcgcccgtgggaccaa

SEQ ID NO: 465514 - DNA, 20 bp, mouse
gatcacgggagatgacaact

SEQ ID NO: 465515 - DNA, 20 bp, mouse
ggcgcgagccacgcgaacct

SEQ ID NO: 465516 - DNA, 20 bp, mouse
gaccctgcgggaagtggtgt

SEQ ID NO: 465517 - DNA, 20 bp, mouse
gggaggtgcaggtcttcggg

SEQ ID NO: 465518 - DNA, 20 bp, mouse
gctgggcccggcgcaacgag

SEQ ID NO: 465519 - DNA, 20 bp, mouse
ggcggtgcgcgtccttcccc

SEQ ID NO: 465520 - DNA, 20 bp, mouse
gctgggcttcggatcctctg

SEQ ID NO: 465521 - DNA, 20 bp, mouse
gggacaggcccggggccggg

SEQ ID NO: 465522 - DNA, 20 bp, mouse
gaggacgcgcaccgccccag

SEQ ID NO: 465523 - DNA, 20 bp, mouse
gggagctgcttgtctacggg

SEQ ID NO: 465524 - DNA, 20 bp, mouse
gggcaggcagggctcccggg

SEQ ID NO: 465525 - DNA, 20 bp, mouse
gaagtcaggagggcatggaa

SEQ ID NO: 465526 - DNA, 20 bp, mouse
gggcggagggagaggtgcac

SEQ ID NO: 465527 - DNA, 20 bp, mouse
gggccgagcgcctgcgggag

SEQ ID NO: 465528 - DNA, 20 bp, mouse
gggaggggaccgagggctca

SEQ ID NO: 465529 - DNA, 20 bp, mouse
ggaggctgctcgggctgcga

SEQ ID NO: 465530 - DNA, 20 bp, mouse
gctcagggccgagcgcctgc

SEQ ID NO: 465531 - DNA, 20 bp, mouse
gagcgggacacagagccggg

SEQ ID NO: 465532 - DNA, 20 bp, mouse
gtggtggaccaccctgacca

SEQ ID NO: 465533 - DNA, 20 bp, mouse
gcgaagtgaagacaagagtt

SEQ ID NO: 465534 - DNA, 20 bp, mouse
gggtccgcaacctgctggaa

SEQ ID NO: 465535 - DNA, 20 bp, mouse
gcggtgccaggaagcagatc

SEQ ID NO: 465536 - DNA, 20 bp, mouse
gggcggagctgccagtgggt

SEQ ID NO: 465537 - DNA, 20 bp, mouse
gtccaggcggagctgccagt

SEQ ID NO: 465538 - DNA, 20 bp, mouse
ggttcctgagggattcatgg

SEQ ID NO: 465539 - DNA, 20 bp, mouse
gttctgctctaggaccccaa

SEQ ID NO: 465540 - DNA, 20 bp, mouse
gacccggctgctggtccagg

SEQ ID NO: 465541 - DNA, 20 bp, mouse
ggagggtccgagaatcgggg

SEQ ID NO: 465542 - DNA, 20 bp, mouse
gaccgagggtccgagaatcg

SEQ ID NO: 465543 - DNA, 20 bp, mouse
gacgccgccatgaatccctc

SEQ ID NO: 465544 - DNA, 20 bp, mouse
gaggaccccaatggttcctg

SEQ ID NO: 465545 - DNA, 20 bp, mouse
gtcgtcaggaagcccgaagg

SEQ ID NO: 465546 - DNA, 20 bp, mouse
ggcgcggagagcagagcgag

SEQ ID NO: 465547 - DNA, 20 bp, mouse
ggagcgagcggcacaggaga

SEQ ID NO: 465548 - DNA, 20 bp, mouse
gacaggagagggcgcagggt

SEQ ID NO: 465549 - DNA, 20 bp, mouse
gagagcagagcgagcggcac

SEQ ID NO: 465550 - DNA, 20 bp, mouse
gcggcacaggagagggcgca

SEQ ID NO: 465551 - DNA, 20 bp, mouse
gaccgcagaagcgccttggc

SEQ ID NO: 465552 - DNA, 20 bp, mouse
gcgcagggttggcggagtcg

SEQ ID NO: 465553 - DNA, 20 bp, mouse
ggcagaagcgccttggcggg

SEQ ID NO: 465554 - DNA, 20 bp, mouse
gactagcagggcgtgggtgt

SEQ ID NO: 465555 - DNA, 20 bp, mouse
ggttgaccgcagaagcgcct

SEQ ID NO: 465556 - DNA, 20 bp, mouse
gcgcgagaggcgaccagctc

SEQ ID NO: 465557 - DNA, 20 bp, mouse
gcgcagcgcggggaccaggc

SEQ ID NO: 465558 - DNA, 20 bp, mouse
ggcgcggcgctctgactcca

SEQ ID NO: 465559 - DNA, 20 bp, mouse
gggagccgagggacccgcag

SEQ ID NO: 465560 - DNA, 20 bp, mouse
gagggacccgcagaggggac

SEQ ID NO: 465561 - DNA, 20 bp, mouse
ggcgaccagctccggcactg

SEQ ID NO: 465562 - DNA, 20 bp, mouse
gtgcccgccggggatctgaa

SEQ ID NO: 465563 - DNA, 20 bp, mouse
gcggggaccaggcggggagg

SEQ ID NO: 465564 - DNA, 20 bp, mouse
gcccgcggggagcagtggac

SEQ ID NO: 465565 - DNA, 20 bp, mouse
ggggcgcccggggccagaga

SEQ ID NO: 465566 - DNA, 20 bp, mouse
gggtgccatggcccagacag

SEQ ID NO: 465567 - DNA, 20 bp, mouse
gcgggcccggttgacaccag

SEQ ID NO: 465568 - DNA, 20 bp, mouse
gcagtaggacagggcgtagt

SEQ ID NO: 465569 - DNA, 20 bp, mouse
gatgagtgcacagtaggaca

SEQ ID NO: 465570 - DNA, 20 bp, mouse
gtagttggtggtggtctgta

SEQ ID NO: 465571 - DNA, 20 bp, mouse
gaccaccaccaactacctag

SEQ ID NO: 465572 - DNA, 20 bp, mouse
gaattcctctgtctgggcca

SEQ ID NO: 465573 - DNA, 20 bp, mouse
gcctccaagtacaccaccca

SEQ ID NO: 465574 - DNA, 20 bp, mouse
ggcgtagtaggcatgtggac

SEQ ID NO: 465575 - DNA, 20 bp, mouse
ggccaggatgagtgcacagt

SEQ ID NO: 465576 - DNA, 20 bp, mouse
gcagcgctactgaggacggt

SEQ ID NO: 465577 - DNA, 20 bp, mouse
gcccggagcgggttcagcag

SEQ ID NO: 465578 - DNA, 20 bp, mouse
gacagcagcgctactgagga

SEQ ID NO: 465579 - DNA, 20 bp, mouse
gggttcagcagtggcaccat

SEQ ID NO: 465580 - DNA, 20 bp, mouse
ggggaacagcagcgctactg

SEQ ID NO: 465581 - DNA, 20 bp, mouse
gagcaccgcgaggaggaggt

SEQ ID NO: 465582 - DNA, 20 bp, mouse
gagcccggcgccagtcccca

SEQ ID NO: 465583 - DNA, 20 bp, mouse
gggcgtgggccagaatccct

SEQ ID NO: 465584 - DNA, 20 bp, mouse
gaggctcacgatgaagtagt

SEQ ID NO: 465585 - DNA, 20 bp, mouse
gcctcggagtagacaaagag

SEQ ID NO: 465586 - DNA, 20 bp, mouse
ggctcgcgggccgatcctgt

SEQ ID NO: 465587 - DNA, 20 bp, mouse
gaggatcggcccgcgagcac

SEQ ID NO: 465588 - DNA, 20 bp, mouse
gggatgggacaggaagcgac

SEQ ID NO: 465589 - DNA, 20 bp, mouse
gggcgcgctgccgacaggat

SEQ ID NO: 465590 - DNA, 20 bp, mouse
gcgcctctagtccccaggat

SEQ ID NO: 465591 - DNA, 20 bp, mouse
gtcggcagcgcgccggacgg

SEQ ID NO: 465592 - DNA, 20 bp, mouse
gggaagcgaccggtgctcgc

SEQ ID NO: 465593 - DNA, 20 bp, mouse
gcgcttcctgtcccatcctg

SEQ ID NO: 465594 - DNA, 20 bp, mouse
ggggccgggagcaccctctg

SEQ ID NO: 465595 - DNA, 20 bp, mouse
gacctgcgcgggtcccagtg

SEQ ID NO: 465596 - DNA, 20 bp, mouse
ggctaaggtcccgctcatgg

SEQ ID NO: 465597 - DNA, 20 bp, mouse
gggggacctaaccagtgtgg

SEQ ID NO: 465598 - DNA, 20 bp, mouse
ggcgctgcagtggtggccag

SEQ ID NO: 465599 - DNA, 20 bp, mouse
gaagggggacctaaccagtg

SEQ ID NO: 465600 - DNA, 20 bp, mouse
ggtggtggccagaggcgcgg

SEQ ID NO: 465601 - DNA, 20 bp, mouse
ggcgcggcgggcgcgagaag

SEQ ID NO: 465602 - DNA, 20 bp, mouse
gaccagcctccacactggtt

SEQ ID NO: 465603 - DNA, 20 bp, mouse
gaaggtcccgctcatggtgg

SEQ ID NO: 465604 - DNA, 20 bp, mouse
gcgcttgcgcgctgcagtgg

SEQ ID NO: 465605 - DNA, 20 bp, mouse
ggacgccgcggacgcaacac

SEQ ID NO: 465606 - DNA, 20 bp, mouse
gcccatagttgcagcttcgg

SEQ ID NO: 465607 - DNA, 20 bp, mouse
gcgaggccggagaaacaccg

SEQ ID NO: 465608 - DNA, 20 bp, mouse
gtccgccgaagctgcaacta

SEQ ID NO: 465609 - DNA, 20 bp, mouse
gccagctgccaggaccctag

SEQ ID NO: 465610 - DNA, 20 bp, mouse
ggagcgctcacgtctaatgc

SEQ ID NO: 465611 - DNA, 20 bp, mouse
gacaactggagccaccaccg

SEQ ID NO: 465612 - DNA, 20 bp, mouse
gggtaagggcgggatcggag

SEQ ID NO: 465613 - DNA, 20 bp, mouse
gctcgaacgcagaagaacaa

SEQ ID NO: 465614 - DNA, 20 bp, mouse
ggcacgcctcggcacttccc

SEQ ID NO: 465615 - DNA, 20 bp, mouse
gcgcagaagaacaagggtaa

SEQ ID NO: 465616 - DNA, 20 bp, mouse
gctacctacagagagtcccg

SEQ ID NO: 465617 - DNA, 20 bp, mouse
gctctctgtaggtagacggg

SEQ ID NO: 465618 - DNA, 20 bp, mouse
gggagggtgttatagtaacc

SEQ ID NO: 465619 - DNA, 20 bp, mouse
ggtggcgcctcagccgtgga

SEQ ID NO: 465620 - DNA, 20 bp, mouse
gcctgttccggaggcgtggg

SEQ ID NO: 465621 - DNA, 20 bp, mouse
gcggccccgcgcctggacca

SEQ ID NO: 465622 - DNA, 20 bp, mouse
gtaaccaggctgggctttga

SEQ ID NO: 465623 - DNA, 20 bp, mouse
gggactctctgtaggtagac

SEQ ID NO: 465624 - DNA, 20 bp, mouse
gataacaccctccacggctg

SEQ ID NO: 465625 - DNA, 20 bp, mouse
gcggtacagatcccgtagat

SEQ ID NO: 465626 - DNA, 20 bp, mouse
gtgtcggcatccctgtctga

SEQ ID NO: 465627 - DNA, 20 bp, mouse
gcaaagaagtccctcagaca

SEQ ID NO: 465628 - DNA, 20 bp, mouse
gtgcgaagcaggcagtagct

SEQ ID NO: 465629 - DNA, 20 bp, mouse
gtcaagggtactgtctaagg

SEQ ID NO: 465630 - DNA, 20 bp, mouse
ggatataggggaagcttcaa

SEQ ID NO: 465631 - DNA, 20 bp, mouse
gagcagctcggagagggcgg

SEQ ID NO: 465632 - DNA, 20 bp, mouse
gtccccccaaaggcacacgc

SEQ ID NO: 465633 - DNA, 20 bp, mouse
gagccggctgaacgaggaca

SEQ ID NO: 465634 - DNA, 20 bp, mouse
gtcgaagcagaagagcaaag

SEQ ID NO: 465635 - DNA, 20 bp, mouse
gcgttcagccggctgatata

SEQ ID NO: 465636 - DNA, 20 bp, mouse
gtggcctggagtgcacaggg

SEQ ID NO: 465637 - DNA, 20 bp, mouse
gtggtcccaatggccaggga

SEQ ID NO: 465638 - DNA, 20 bp, mouse
ggagagggtttcctacaagt

SEQ ID NO: 465639 - DNA, 20 bp, mouse
ggtaactggaaggagacgac

SEQ ID NO: 465640 - DNA, 20 bp, mouse
gggacggtgaacagctgata

SEQ ID NO: 465641 - DNA, 20 bp, mouse
gagggtggcctggagtgcac

SEQ ID NO: 465642 - DNA, 20 bp, mouse
gctggccttgagagaatcga

SEQ ID NO: 465643 - DNA, 20 bp, mouse
gcggtgaacagctgataggg

SEQ ID NO: 465644 - DNA, 20 bp, mouse
ggaagtggtcccaatggcca

SEQ ID NO: 465645 - DNA, 20 bp, mouse
ggcaagtgataagcaacagg

SEQ ID NO: 465646 - DNA, 20 bp, mouse
ggtgtcccaggccgaaggca

SEQ ID NO: 465647 - DNA, 20 bp, mouse
gaacaggtgtcccaggccga

SEQ ID NO: 465648 - DNA, 20 bp, mouse
gctgtcccttgagctggcca

SEQ ID NO: 465649 - DNA, 20 bp, mouse
gtccccggagctcaccgcaa

SEQ ID NO: 465650 - DNA, 20 bp, mouse
gaagggtcaacaggtgtccc

SEQ ID NO: 465651 - DNA, 20 bp, mouse
gagttgttggcggtgaggga

SEQ ID NO: 465652 - DNA, 20 bp, mouse
gagctccggggaccatctca

SEQ ID NO: 465653 - DNA, 20 bp, mouse
gccgagcgaccgggactcca

SEQ ID NO: 465654 - DNA, 20 bp, mouse
ggctcaccgcaagggtcaac

SEQ ID NO: 465655 - DNA, 20 bp, mouse
gcgcgatcggatggagacgg

SEQ ID NO: 465656 - DNA, 20 bp, mouse
gtctaagcctggacgcagga

SEQ ID NO: 465657 - DNA, 20 bp, mouse
gcgcaggccggcgccaaaca

SEQ ID NO: 465658 - DNA, 20 bp, mouse
ggggcgaagaagcttgagag

SEQ ID NO: 465659 - DNA, 20 bp, mouse
gagaggccagaacgacttct

SEQ ID NO: 465660 - DNA, 20 bp, mouse
gggactctaagcctggacgc

SEQ ID NO: 465661 - DNA, 20 bp, mouse
gaggcgagaacaccgctcct

SEQ ID NO: 465662 - DNA, 20 bp, mouse
gacttctcggcaaactgctg

SEQ ID NO: 465663 - DNA, 20 bp, mouse
gcggaaaccctcctgcgtcc

SEQ ID NO: 465664 - DNA, 20 bp, mouse
gcgcacagtgcagcctcagg

SEQ ID NO: 465665 - DNA, 20 bp, mouse
gaagcttcttcgcccaggag

SEQ ID NO: 465666 - DNA, 20 bp, mouse
gagactgcagagcgccccag

SEQ ID NO: 465667 - DNA, 20 bp, mouse
gtcccctgctctggccgctg

SEQ ID NO: 465668 - DNA, 20 bp, mouse
gcgccccagcggccagagca

SEQ ID NO: 465669 - DNA, 20 bp, mouse
gcagcagcagaggagtgcgg

SEQ ID NO: 465670 - DNA, 20 bp, mouse
gcccgggagcaggtgtgcgg

SEQ ID NO: 465671 - DNA, 20 bp, mouse
gacgcagtcggcgggaccca

SEQ ID NO: 465672 - DNA, 20 bp, mouse
gggccgcgctgcgcatcggg

SEQ ID NO: 465673 - DNA, 20 bp, mouse
gtgcctggctgcggagggtg

SEQ ID NO: 465674 - DNA, 20 bp, mouse
gccgcgcgcggaggcgagcg

SEQ ID NO: 465675 - DNA, 20 bp, mouse
gcttccctgcctgagcccgg

SEQ ID NO: 465676 - DNA, 20 bp, mouse
gcggctgggagcgcgctgag

SEQ ID NO: 465677 - DNA, 20 bp, mouse
gcgcggctggaggcaaggtg

SEQ ID NO: 465678 - DNA, 20 bp, mouse
ggctcccagccgcccgcact

SEQ ID NO: 465679 - DNA, 20 bp, mouse
gctccggggaggtggtcctg

SEQ ID NO: 465680 - DNA, 20 bp, mouse
ggaggccctattctccgggg

SEQ ID NO: 465681 - DNA, 20 bp, mouse
gccgagtgggtccagcactc

SEQ ID NO: 465682 - DNA, 20 bp, mouse
ggccgccgcgcgctgggctg

SEQ ID NO: 465683 - DNA, 20 bp, mouse
gccacgggcgcgcccctaaa

SEQ ID NO: 465684 - DNA, 20 bp, mouse
gcggttccgagagaagggtc

SEQ ID NO: 465685 - DNA, 20 bp, mouse
gaccacctccccggagaata

SEQ ID NO: 465686 - DNA, 20 bp, mouse
ggacatctcgcagcacggag

SEQ ID NO: 465687 - DNA, 20 bp, mouse
gtcctccgggaagcgctcgg

SEQ ID NO: 465688 - DNA, 20 bp, mouse
gacttcctcgcgggtcctcc

SEQ ID NO: 465689 - DNA, 20 bp, mouse
ggggtcctccgggaagcgct

SEQ ID NO: 465690 - DNA, 20 bp, mouse
ggtcctcgacctaaactccc

SEQ ID NO: 465691 - DNA, 20 bp, mouse
ggcttcccggaggacccgcg

SEQ ID NO: 465692 - DNA, 20 bp, mouse
gagctcaggcagtgcaccgt

SEQ ID NO: 465693 - DNA, 20 bp, mouse
ggtcccgggagtttaggtcg

SEQ ID NO: 465694 - DNA, 20 bp, mouse
gaccgtgggcagcagctcgg

SEQ ID NO: 465695 - DNA, 20 bp, mouse
gcaggtgagccgggatggtg

SEQ ID NO: 465696 - DNA, 20 bp, mouse
gtccgcccggaggatactgg

SEQ ID NO: 465697 - DNA, 20 bp, mouse
gttgcggataatctgagatg

SEQ ID NO: 465698 - DNA, 20 bp, mouse
gtctgagatggggaccactc

SEQ ID NO: 465699 - DNA, 20 bp, mouse
gcacgccggggtaagtggag

SEQ ID NO: 465700 - DNA, 20 bp, mouse
gggggcaaccgggtcacgag

SEQ ID NO: 465701 - DNA, 20 bp, mouse
gttaatcttgatgtccagag

SEQ ID NO: 465702 - DNA, 20 bp, mouse
ggagtccgtgccaaccgcag

SEQ ID NO: 465703 - DNA, 20 bp, mouse
ggacgcggctacagggatgg

SEQ ID NO: 465704 - DNA, 20 bp, mouse
ggccaccgccagtatcctcc

SEQ ID NO: 465705 - DNA, 20 bp, mouse
gaccgccagtatcctccggg

SEQ ID NO: 465706 - DNA, 20 bp, mouse
ggccgagccatccgagctca

SEQ ID NO: 465707 - DNA, 20 bp, mouse
gctccgcccagtccgcacgg

SEQ ID NO: 465708 - DNA, 20 bp, mouse
gcagtccgcacggcggctag

SEQ ID NO: 465709 - DNA, 20 bp, mouse
ggcagcgccctgagctcgga

SEQ ID NO: 465710 - DNA, 20 bp, mouse
gggctgcagcggcgcacccc

SEQ ID NO: 465711 - DNA, 20 bp, mouse
ggctgagggcccgactccag

SEQ ID NO: 465712 - DNA, 20 bp, mouse
gggtctccgcccagtccgca

SEQ ID NO: 465713 - DNA, 20 bp, mouse
gagctcagggcgctgcgccc

SEQ ID NO: 465714 - DNA, 20 bp, mouse
gcggactgggcggagaccgt

SEQ ID NO: 465715 - DNA, 20 bp, mouse
gactgggcggagaccgtcgg

SEQ ID NO: 465716 - DNA, 20 bp, mouse
ggcgcagcgacggtgaccta

SEQ ID NO: 465717 - DNA, 20 bp, mouse
ggagccgcctagcccacgga

SEQ ID NO: 465718 - DNA, 20 bp, mouse
gggcctgatgctgcctagac

SEQ ID NO: 465719 - DNA, 20 bp, mouse
gctcggcggagcgccggtct

SEQ ID NO: 465720 - DNA, 20 bp, mouse
gccgccctccgtgggctagg

SEQ ID NO: 465721 - DNA, 20 bp, mouse
gtccgcacccagaggagcag

SEQ ID NO: 465722 - DNA, 20 bp, mouse
gtaggcggctccagctagct

SEQ ID NO: 465723 - DNA, 20 bp, mouse
gtgggtgcggagtctcctca

SEQ ID NO: 465724 - DNA, 20 bp, mouse
gcccacggagggcggaaaaa

SEQ ID NO: 465725 - DNA, 20 bp, mouse
gcgggcggcgggtgatctcc

SEQ ID NO: 465726 - DNA, 20 bp, mouse
ggagtgatcaatcattgact

SEQ ID NO: 465727 - DNA, 20 bp, mouse
gtatgaactgcgattttaag

SEQ ID NO: 465728 - DNA, 20 bp, mouse
gatgatattcctggtgtatc

SEQ ID NO: 465729 - DNA, 20 bp, mouse
gggctatgctgaggctgggg

SEQ ID NO: 465730 - DNA, 20 bp, mouse
ggctgaggctgggggggtaa

SEQ ID NO: 465731 - DNA, 20 bp, mouse
gtttctttctcccactctgc

SEQ ID NO: 465732 - DNA, 20 bp, mouse
gaatcagacaccagcagagt

SEQ ID NO: 465733 - DNA, 20 bp, mouse
gttgactaggatgtcggaca

SEQ ID NO: 465734 - DNA, 20 bp, mouse
gttcaactagatgatattcc

SEQ ID NO: 465735 - DNA, 20 bp, mouse
gtcggacatggtcttgtgag

SEQ ID NO: 465736 - DNA, 20 bp, mouse
gaccattgggatgtcagaca

SEQ ID NO: 465737 - DNA, 20 bp, mouse
gtcccgagtgaccaaccatt

SEQ ID NO: 465738 - DNA, 20 bp, mouse
gtcccaatggttggtcactc

SEQ ID NO: 465739 - DNA, 20 bp, mouse
gaccatgtctgacatcccaa

SEQ ID NO: 465740 - DNA, 20 bp, mouse
gtcagacatggtttggtgag

SEQ ID NO: 465741 - DNA, 20 bp, mouse
gaagcaaatacaactacttt

SEQ ID NO: 465742 - DNA, 20 bp, mouse
gtagatattccagttttgtc

SEQ ID NO: 465743 - DNA, 20 bp, mouse
gaatcagacaccagcaaagt

SEQ ID NO: 465744 - DNA, 20 bp, mouse
gtgctgaggctggggggtaa

SEQ ID NO: 465745 - DNA, 20 bp, mouse
gcctggtaagtggattcttc

SEQ ID NO: 465746 - DNA, 20 bp, mouse
gaacctacaaggacatcttc

SEQ ID NO: 465747 - DNA, 20 bp, mouse
gagtcaatgactggtcacta

SEQ ID NO: 465748 - DNA, 20 bp, mouse
gctcttctctgctagcttgc

SEQ ID NO: 465749 - DNA, 20 bp, mouse
gtgacatcctagtcaatgac

SEQ ID NO: 465750 - DNA, 20 bp, mouse
gcttttcaactagatattcc

SEQ ID NO: 465751 - DNA, 20 bp, mouse
gttccagaagatgtccttgt

SEQ ID NO: 465752 - DNA, 20 bp, mouse
gaaaatattgattttaagga

SEQ ID NO: 465753 - DNA, 20 bp, mouse
gtggaaaaatattgatttta

SEQ ID NO: 465754 - DNA, 20 bp, mouse
gttgactaggatgtcagaca

SEQ ID NO: 465755 - DNA, 20 bp, mouse
gtcagacatggtcttgtgag

SEQ ID NO: 465756 - DNA, 20 bp, mouse
gggtgtgcccgggtcagaaa

SEQ ID NO: 465757 - DNA, 20 bp, mouse
ggcgccctgcggatcctcct

SEQ ID NO: 465758 - DNA, 20 bp, mouse
gtctgactctgcgggacccg

SEQ ID NO: 465759 - DNA, 20 bp, mouse
gcagcgaagggcccaacctg

SEQ ID NO: 465760 - DNA, 20 bp, mouse
gctgcccaggaggatccgca

SEQ ID NO: 465761 - DNA, 20 bp, mouse
gcctgggcaggtccctcccg

SEQ ID NO: 465762 - DNA, 20 bp, mouse
gagagaagggcggccccggg

SEQ ID NO: 465763 - DNA, 20 bp, mouse
gaggctaccctttctgaccc

SEQ ID NO: 465764 - DNA, 20 bp, mouse
gctctgcgggacccggggtg

SEQ ID NO: 465765 - DNA, 20 bp, mouse
gtgtcgcaccacggggacag

SEQ ID NO: 465766 - DNA, 20 bp, mouse
gggccaccaggagagtcctg

SEQ ID NO: 465767 - DNA, 20 bp, mouse
gcctgggtgtctgtatatct

SEQ ID NO: 465768 - DNA, 20 bp, mouse
gtgaagctcccttctggcag

SEQ ID NO: 465769 - DNA, 20 bp, mouse
gtaccacagaagattgaata

SEQ ID NO: 465770 - DNA, 20 bp, mouse
gcagagccaccactgccaga

SEQ ID NO: 465771 - DNA, 20 bp, mouse
ggggtctctggccctcctga

SEQ ID NO: 465772 - DNA, 20 bp, mouse
gctttttagaacatacaaca

SEQ ID NO: 465773 - DNA, 20 bp, mouse
gaaggctctagggaagaggc

SEQ ID NO: 465774 - DNA, 20 bp, mouse
gatgagacttaccatcagga

SEQ ID NO: 465775 - DNA, 20 bp, mouse
ggatcacaaacctctcgtta

SEQ ID NO: 465776 - DNA, 20 bp, mouse
gaggagatgtcctgtcagga

SEQ ID NO: 465777 - DNA, 20 bp, mouse
gtactaggagatgtcctgtc

SEQ ID NO: 465778 - DNA, 20 bp, mouse
gctgcttcaaggactaatct

SEQ ID NO: 465779 - DNA, 20 bp, mouse
ggataactgtggggctccct

SEQ ID NO: 465780 - DNA, 20 bp, mouse
gcctagtacagcctgcttca

SEQ ID NO: 465781 - DNA, 20 bp, mouse
gtggaagactgggactagaa

SEQ ID NO: 465782 - DNA, 20 bp, mouse
gagggtatggatgataactg

SEQ ID NO: 465783 - DNA, 20 bp, mouse
gcaaggactaatctgggatt

SEQ ID NO: 465784 - DNA, 20 bp, mouse
gatctgggatttggaagact

SEQ ID NO: 465785 - DNA, 20 bp, mouse
gctagaacggattctcactg

SEQ ID NO: 465786 - DNA, 20 bp, mouse
gcgcgggagaggaccttctg

SEQ ID NO: 465787 - DNA, 20 bp, mouse
ggcagcggggaaccccgaac

SEQ ID NO: 465788 - DNA, 20 bp, mouse
gggagtttcgtaagtagcgg

SEQ ID NO: 465789 - DNA, 20 bp, mouse
ggcgggagtttcgtaagtag

SEQ ID NO: 465790 - DNA, 20 bp, mouse
gaccccgaaccggactgacg

SEQ ID NO: 465791 - DNA, 20 bp, mouse
gagtgcccgggagcgaggag

SEQ ID NO: 465792 - DNA, 20 bp, mouse
gccgggcagaggcgggtcag

SEQ ID NO: 465793 - DNA, 20 bp, mouse
ggtaagtagcggaggcagcg

SEQ ID NO: 465794 - DNA, 20 bp, mouse
ggtcctctcccgcgtcagtc

SEQ ID NO: 465795 - DNA, 20 bp, mouse
ggtcccacaactctgagtaa

SEQ ID NO: 465796 - DNA, 20 bp, mouse
gctaggcgcgggaaccggag

SEQ ID NO: 465797 - DNA, 20 bp, mouse
gagcagggcggagacgggga

SEQ ID NO: 465798 - DNA, 20 bp, mouse
gagtggagctgtggctcgga

SEQ ID NO: 465799 - DNA, 20 bp, mouse
gctccagcagggcggagacg

SEQ ID NO: 465800 - DNA, 20 bp, mouse
ggggaaccggagtggagctg

SEQ ID NO: 465801 - DNA, 20 bp, mouse
gagcgcggaacgcggaggac

SEQ ID NO: 465802 - DNA, 20 bp, mouse
gacggggacggcgactggct

SEQ ID NO: 465803 - DNA, 20 bp, mouse
gcggagacggggacggcgac

SEQ ID NO: 465804 - DNA, 20 bp, mouse
gactggctaggcgcgggaac

SEQ ID NO: 465805 - DNA, 20 bp, mouse
gacggcgactggctaggcgc

SEQ ID NO: 465806 - DNA, 20 bp, mouse
gtaccttcaaagcctccgag

SEQ ID NO: 465807 - DNA, 20 bp, mouse
gcagtgtgccactctcagcc

SEQ ID NO: 465808 - DNA, 20 bp, mouse
gataatgtgtgattcaggaa

SEQ ID NO: 465809 - DNA, 20 bp, mouse
gtgagagtggcacactgtcc

SEQ ID NO: 465810 - DNA, 20 bp, mouse
gattttcaaagtcccctcgg

SEQ ID NO: 465811 - DNA, 20 bp, mouse
ggtcccctcggaggctttga

SEQ ID NO: 465812 - DNA, 20 bp, mouse
gataagacgacgaatcactg

SEQ ID NO: 465813 - DNA, 20 bp, mouse
gaagtctcaacaatatactg

SEQ ID NO: 465814 - DNA, 20 bp, mouse
gtttccttatctctctttcc

SEQ ID NO: 465815 - DNA, 20 bp, mouse
gatcagatggtctcatcaga

SEQ ID NO: 465816 - DNA, 20 bp, mouse
gagcgcggcgcatcccggcg

SEQ ID NO: 465817 - DNA, 20 bp, mouse
ggggatgcgccgcgcttctg

SEQ ID NO: 465818 - DNA, 20 bp, mouse
ggcgcttctgcggcatctcc

SEQ ID NO: 465819 - DNA, 20 bp, mouse
gctctccaggacatcctcat

SEQ ID NO: 465820 - DNA, 20 bp, mouse
gtggaggcgtcagcaacccc

SEQ ID NO: 465821 - DNA, 20 bp, mouse
gcctcccgggcgggcgtctg

SEQ ID NO: 465822 - DNA, 20 bp, mouse
ggacccggcgccccgggcca

SEQ ID NO: 465823 - DNA, 20 bp, mouse
gtccccaaggaaggcttcgg

SEQ ID NO: 465824 - DNA, 20 bp, mouse
gtctgcagcgccgtggcccg

SEQ ID NO: 465825 - DNA, 20 bp, mouse
gcctccagacccggcgcccc

SEQ ID NO: 465826 - DNA, 20 bp, mouse
gagcaggcgcagggcggacg

SEQ ID NO: 465827 - DNA, 20 bp, mouse
gcgctggggcggacttcggg

SEQ ID NO: 465828 - DNA, 20 bp, mouse
gtcctgcttttgctacccgg

SEQ ID NO: 465829 - DNA, 20 bp, mouse
gtttgctacccggaggacga

SEQ ID NO: 465830 - DNA, 20 bp, mouse
gggcagctcgagcttattaa

SEQ ID NO: 465831 - DNA, 20 bp, mouse
gaagcaggagagcaggcgca

SEQ ID NO: 465832 - DNA, 20 bp, mouse
gggtagatccccgggatggg

SEQ ID NO: 465833 - DNA, 20 bp, mouse
gctaccgacttcgggatcga

SEQ ID NO: 465834 - DNA, 20 bp, mouse
ggtcggtagatccccgggat

SEQ ID NO: 465835 - DNA, 20 bp, mouse
gaacctgagaccatccgtgt

SEQ ID NO: 465836 - DNA, 20 bp, mouse
gtgtcgggcccgggtcccgg

SEQ ID NO: 465837 - DNA, 20 bp, mouse
ggaggccgacgggcagtcat

SEQ ID NO: 465838 - DNA, 20 bp, mouse
ggccagggacgagctcacag

SEQ ID NO: 465839 - DNA, 20 bp, mouse
gccgacgggcagtcatgggc

SEQ ID NO: 465840 - DNA, 20 bp, mouse
gcgggcccgggtcccggagg

SEQ ID NO: 465841 - DNA, 20 bp, mouse
gagccagccgcgaagacagc

SEQ ID NO: 465842 - DNA, 20 bp, mouse
gtgggccggcgagtccgtgt

SEQ ID NO: 465843 - DNA, 20 bp, mouse
ggccgctccgccgcccgcgg

SEQ ID NO: 465844 - DNA, 20 bp, mouse
ggcctcggggatcttagatg

SEQ ID NO: 465845 - DNA, 20 bp, mouse
gcagccgtcccaggtagcgg

SEQ ID NO: 465846 - DNA, 20 bp, mouse
gccggtcgaggagccaccgg

SEQ ID NO: 465847 - DNA, 20 bp, mouse
gtgcaccacggccttcatgg

SEQ ID NO: 465848 - DNA, 20 bp, mouse
gcgccgtggccgagaagatc

SEQ ID NO: 465849 - DNA, 20 bp, mouse
gtggcggcggctgtagcgac

SEQ ID NO: 465850 - DNA, 20 bp, mouse
ggcgccggtcgaggagccac

SEQ ID NO: 465851 - DNA, 20 bp, mouse
gagccaccggcggagtcgca

SEQ ID NO: 465852 - DNA, 20 bp, mouse
ggaggctgcccggtaactcg

SEQ ID NO: 465853 - DNA, 20 bp, mouse
gcgagtgacgcgctgcacca

SEQ ID NO: 465854 - DNA, 20 bp, mouse
gctcgaccggcgccctctac

SEQ ID NO: 465855 - DNA, 20 bp, mouse
ggaccttgcgactccgccgg

SEQ ID NO: 465856 - DNA, 20 bp, mouse
gctaggcagcccactaaagt

SEQ ID NO: 465857 - DNA, 20 bp, mouse
gtgcaggagcgcacgagcct

SEQ ID NO: 465858 - DNA, 20 bp, mouse
ggctgcagagcgaaccagtg

SEQ ID NO: 465859 - DNA, 20 bp, mouse
gcccgcgccatggcggacgg

SEQ ID NO: 465860 - DNA, 20 bp, mouse
gggacccgcgccatggcgga

SEQ ID NO: 465861 - DNA, 20 bp, mouse
gcacttgcaggcgagcgtgc

SEQ ID NO: 465862 - DNA, 20 bp, mouse
gacacgaccaccgtccgcca

SEQ ID NO: 465863 - DNA, 20 bp, mouse
gtaaagtgggcagacggaaa

SEQ ID NO: 465864 - DNA, 20 bp, mouse
ggacggtggtcgtgtggccc

SEQ ID NO: 465865 - DNA, 20 bp, mouse
ggtgcggacccgcgccatgg

SEQ ID NO: 465866 - DNA, 20 bp, mouse
gttgtggagggtgcagacgg

SEQ ID NO: 465867 - DNA, 20 bp, mouse
ggtctgcaccctccacaacg

SEQ ID NO: 465868 - DNA, 20 bp, mouse
gcggctcctgtggaacttgg

SEQ ID NO: 465869 - DNA, 20 bp, mouse
gtggcggccggggctcttag

SEQ ID NO: 465870 - DNA, 20 bp, mouse
gtcttagtggcgggagttgg

SEQ ID NO: 465871 - DNA, 20 bp, mouse
ggatcgcccccaagttccac

SEQ ID NO: 465872 - DNA, 20 bp, mouse
ggtgcagacggcggctcctg

SEQ ID NO: 465873 - DNA, 20 bp, mouse
gcacagtcggcagcgatcca

SEQ ID NO: 465874 - DNA, 20 bp, mouse
gcggccggggctcttagtgg

SEQ ID NO: 465875 - DNA, 20 bp, mouse
gccggccgcgggagacctgg

SEQ ID NO: 465876 - DNA, 20 bp, mouse
gcacagtggacgccagaaac

SEQ ID NO: 465877 - DNA, 20 bp, mouse
gaaccaattctgaaattcta

SEQ ID NO: 465878 - DNA, 20 bp, mouse
gaagttaaagatagacacag

SEQ ID NO: 465879 - DNA, 20 bp, mouse
gccagggtaagtgagaacac

SEQ ID NO: 465880 - DNA, 20 bp, mouse
ggaattggttatgatctcag

SEQ ID NO: 465881 - DNA, 20 bp, mouse
gtggaggtgcatctctggaa

SEQ ID NO: 465882 - DNA, 20 bp, mouse
gagacaggagtttaaaaacc

SEQ ID NO: 465883 - DNA, 20 bp, mouse
gtgagaacactggtacttgg

SEQ ID NO: 465884 - DNA, 20 bp, mouse
gggatgctgtacctggtcca

SEQ ID NO: 465885 - DNA, 20 bp, mouse
ggaaaggtggatgttgactt

SEQ ID NO: 465886 - DNA, 20 bp, mouse
ggcccccgcggcgaacggaa

SEQ ID NO: 465887 - DNA, 20 bp, mouse
gcagcaagcagcgactgagg

SEQ ID NO: 465888 - DNA, 20 bp, mouse
gggagtgcgcggccctggag

SEQ ID NO: 465889 - DNA, 20 bp, mouse
gccgtcgcgtggctctccgg

SEQ ID NO: 465890 - DNA, 20 bp, mouse
gccggcgtgctgtctcccaa

SEQ ID NO: 465891 - DNA, 20 bp, mouse
ggcggctccggggcctgagt

SEQ ID NO: 465892 - DNA, 20 bp, mouse
gcaagcagcgactgaggcgg

SEQ ID NO: 465893 - DNA, 20 bp, mouse
gtcctccaacccggccccct

SEQ ID NO: 465894 - DNA, 20 bp, mouse
gaagcagcaagcagcgactg

SEQ ID NO: 465895 - DNA, 20 bp, mouse
gtcagccgagggggccgggt

SEQ ID NO: 465896 - DNA, 20 bp, mouse
gaagcgagagccgacgcgcg

SEQ ID NO: 465897 - DNA, 20 bp, mouse
gagcccgccggcctaccccg

SEQ ID NO: 465898 - DNA, 20 bp, mouse
ggcagagctgccccgcgaca

SEQ ID NO: 465899 - DNA, 20 bp, mouse
gctccgggtgagtacgcggt

SEQ ID NO: 465900 - DNA, 20 bp, mouse
gtggcgcgaggcctgaggga

SEQ ID NO: 465901 - DNA, 20 bp, mouse
gcgcgccctcggacgccgtc

SEQ ID NO: 465902 - DNA, 20 bp, mouse
gacgcggtgggcggccgaaa

SEQ ID NO: 465903 - DNA, 20 bp, mouse
gtctccgcgcgccgaccgga

SEQ ID NO: 465904 - DNA, 20 bp, mouse
ggtccccgctgaaagaggag

SEQ ID NO: 465905 - DNA, 20 bp, mouse
gagggctcccccacgcgcgt

SEQ ID NO: 465906 - DNA, 20 bp, mouse
gccgagccacccgacccgag

SEQ ID NO: 465907 - DNA, 20 bp, mouse
gggtcggcatcccctcgggt

SEQ ID NO: 465908 - DNA, 20 bp, mouse
gggacgccggccaggcccag

SEQ ID NO: 465909 - DNA, 20 bp, mouse
gggcatcccctcgggtcggg

SEQ ID NO: 465910 - DNA, 20 bp, mouse
ggtgcaggtcggcatcccct

SEQ ID NO: 465911 - DNA, 20 bp, mouse
gacggaccgagagttgagcg

SEQ ID NO: 465912 - DNA, 20 bp, mouse
gggagcgcgtggagcggagg

SEQ ID NO: 465913 - DNA, 20 bp, mouse
gcccagcggaggtctcactg

SEQ ID NO: 465914 - DNA, 20 bp, mouse
gcgccggccaggcccagcgg

SEQ ID NO: 465915 - DNA, 20 bp, mouse
ggagtgagcaacgccgactc

SEQ ID NO: 465916 - DNA, 20 bp, mouse
gacgccaaggcgccagaagg

SEQ ID NO: 465917 - DNA, 20 bp, mouse
gcggcctgcggctccatggg

SEQ ID NO: 465918 - DNA, 20 bp, mouse
gccaaggcgccagaaggcgg

SEQ ID NO: 465919 - DNA, 20 bp, mouse
gggccgaggagcgaactctc

SEQ ID NO: 465920 - DNA, 20 bp, mouse
gcctcggcctgcggctccat

SEQ ID NO: 465921 - DNA, 20 bp, mouse
gctgactctaccaccaccca

SEQ ID NO: 465922 - DNA, 20 bp, mouse
ggagtgcagacgggctctgg

SEQ ID NO: 465923 - DNA, 20 bp, mouse
gggacagcacgagtgcagac

SEQ ID NO: 465924 - DNA, 20 bp, mouse
gacgaagaggagcggaccga

SEQ ID NO: 465925 - DNA, 20 bp, mouse
ggtgacgccaaggcgccaga

SEQ ID NO: 465926 - DNA, 20 bp, mouse
gtgtctgtctgtctatccgg

SEQ ID NO: 465927 - DNA, 20 bp, mouse
gcaggaggacgcagtagtcc

SEQ ID NO: 465928 - DNA, 20 bp, mouse
gagccagcgcggggagatca

SEQ ID NO: 465929 - DNA, 20 bp, mouse
gtcctggcgcgcggacgcgt

SEQ ID NO: 465930 - DNA, 20 bp, mouse
gcgctggctcccgggaggga

SEQ ID NO: 465931 - DNA, 20 bp, mouse
gctggctctggcgggcccac

SEQ ID NO: 465932 - DNA, 20 bp, mouse
gtctccgctggctcccggga

SEQ ID NO: 465933 - DNA, 20 bp, mouse
gtccggcggcgggcgaggtc

SEQ ID NO: 465934 - DNA, 20 bp, mouse
gcccacgggcagatgccacc

SEQ ID NO: 465935 - DNA, 20 bp, mouse
gggtccgggctggggcaaag

SEQ ID NO: 465936 - DNA, 20 bp, mouse
ggagtcggagacatactcga

SEQ ID NO: 465937 - DNA, 20 bp, mouse
gagccaagctgagaccggaa

SEQ ID NO: 465938 - DNA, 20 bp, mouse
gaggcagccggagtgaaact

SEQ ID NO: 465939 - DNA, 20 bp, mouse
ggctgcctccggctcggagt

SEQ ID NO: 465940 - DNA, 20 bp, mouse
ggtctccgactccgagccgg

SEQ ID NO: 465941 - DNA, 20 bp, mouse
ggcggtcgtgcgaggaggga

SEQ ID NO: 465942 - DNA, 20 bp, mouse
ggcgacgccgagtttcactc

SEQ ID NO: 465943 - DNA, 20 bp, mouse
gagggccgtgccggcgggat

SEQ ID NO: 465944 - DNA, 20 bp, mouse
ggagaggaccgccgacctcc

SEQ ID NO: 465945 - DNA, 20 bp, mouse
gcaggactcacccatcccgc

SEQ ID NO: 465946 - DNA, 20 bp, mouse
gggcggcgctgacgagaggt

SEQ ID NO: 465947 - DNA, 20 bp, mouse
gcaatggcggcgctgacgag

SEQ ID NO: 465948 - DNA, 20 bp, mouse
ggtgcggacccggcctgggg

SEQ ID NO: 465949 - DNA, 20 bp, mouse
gtcagtcatgtgaccggcaa

SEQ ID NO: 465950 - DNA, 20 bp, mouse
ggcgtcatgtagccgagggt

SEQ ID NO: 465951 - DNA, 20 bp, mouse
gggtccaatggcggaggagg

SEQ ID NO: 465952 - DNA, 20 bp, mouse
ggacgagaggtaggtgagcc

SEQ ID NO: 465953 - DNA, 20 bp, mouse
gaccaagcggcgggactccg

SEQ ID NO: 465954 - DNA, 20 bp, mouse
gtggcagggacggcgagaaa

SEQ ID NO: 465955 - DNA, 20 bp, mouse
gaaagggcaagggtcccctg

SEQ ID NO: 465956 - DNA, 20 bp, mouse
ggccccaaacgagccagacg

SEQ ID NO: 465957 - DNA, 20 bp, mouse
ggccgtacgagtagcgggga

SEQ ID NO: 465958 - DNA, 20 bp, mouse
gagccagacgcggatagcca

SEQ ID NO: 465959 - DNA, 20 bp, mouse
gagccggggcaggggaaaca

SEQ ID NO: 465960 - DNA, 20 bp, mouse
ggtacgagtagcggggacgg

SEQ ID NO: 465961 - DNA, 20 bp, mouse
ggactccctccatcccacag

SEQ ID NO: 465962 - DNA, 20 bp, mouse
gcccgcagccgtacgagtag

SEQ ID NO: 465963 - DNA, 20 bp, mouse
gcagcggctggactcatacg

SEQ ID NO: 465964 - DNA, 20 bp, mouse
gagcgccccggacacctacg

SEQ ID NO: 465965 - DNA, 20 bp, mouse
gtcaggggcgctgcacagac

SEQ ID NO: 465966 - DNA, 20 bp, mouse
ggacgaggatgaggtaataa

SEQ ID NO: 465967 - DNA, 20 bp, mouse
gggtaataacggacagaaca

SEQ ID NO: 465968 - DNA, 20 bp, mouse
gctagggaacggtgcagacg

SEQ ID NO: 465969 - DNA, 20 bp, mouse
gacagaacaaggagagcgtg

SEQ ID NO: 465970 - DNA, 20 bp, mouse
ggtccgcggcgtgagctcag

SEQ ID NO: 465971 - DNA, 20 bp, mouse
gaggaggagtcgcccctccc

SEQ ID NO: 465972 - DNA, 20 bp, mouse
gcatctttgatggacagcta

SEQ ID NO: 465973 - DNA, 20 bp, mouse
gcgcgtgctctcgagactgg

SEQ ID NO: 465974 - DNA, 20 bp, mouse
gttggcgctctgcccgggag

SEQ ID NO: 465975 - DNA, 20 bp, mouse
ggtggcagctgggaccggga

SEQ ID NO: 465976 - DNA, 20 bp, mouse
ggccatcgcccgcacagcac

SEQ ID NO: 465977 - DNA, 20 bp, mouse
gcttctgctgcatctaacat

SEQ ID NO: 465978 - DNA, 20 bp, mouse
ggggaacctggcaagttgac

SEQ ID NO: 465979 - DNA, 20 bp, mouse
gttccaaccggaagagggca

SEQ ID NO: 465980 - DNA, 20 bp, mouse
gtctaacattggcgggaacc

SEQ ID NO: 465981 - DNA, 20 bp, mouse
gagcagaagcccggcgtgca

SEQ ID NO: 465982 - DNA, 20 bp, mouse
gtgcgcctcgggccacagag

SEQ ID NO: 465983 - DNA, 20 bp, mouse
gcagcaccggtcaacttgcc

SEQ ID NO: 465984 - DNA, 20 bp, mouse
gctgctgcatctaacattgg

SEQ ID NO: 465985 - DNA, 20 bp, mouse
ggagcgctcatcgtgctgga

SEQ ID NO: 465986 - DNA, 20 bp, mouse
gaatccaggccagagctaag

SEQ ID NO: 465987 - DNA, 20 bp, mouse
ggctaagtggaaccccatga

SEQ ID NO: 465988 - DNA, 20 bp, mouse
gatgatggaaatggtaacgt

SEQ ID NO: 465989 - DNA, 20 bp, mouse
gatggggttccacttagctc

SEQ ID NO: 465990 - DNA, 20 bp, mouse
gtagagttgcagaggaacca

SEQ ID NO: 465991 - DNA, 20 bp, mouse
gattctcctggttgggacac

SEQ ID NO: 465992 - DNA, 20 bp, mouse
gttgggacactggcttcttt

SEQ ID NO: 465993 - DNA, 20 bp, mouse
gtggcctggattctcctggt

SEQ ID NO: 465994 - DNA, 20 bp, mouse
ggtgagtattagagttgcag

SEQ ID NO: 465995 - DNA, 20 bp, mouse
gcaagcacctggtatataca

SEQ ID NO: 465996 - DNA, 20 bp, mouse
gggcgcgagcgacacctgct

SEQ ID NO: 465997 - DNA, 20 bp, mouse
gaggcaggacgaagagcgaa

SEQ ID NO: 465998 - DNA, 20 bp, mouse
ggtgaacgggcatccaggaa

SEQ ID NO: 465999 - DNA, 20 bp, mouse
gcgaagagcgaagggtgaac

SEQ ID NO: 466000 - DNA, 20 bp, mouse
gtcggagctgctcccaggag

SEQ ID NO: 466001 - DNA, 20 bp, mouse
gcattcacacctgctagcgg

SEQ ID NO: 466002 - DNA, 20 bp, mouse
ggaagggtgaacgggcatcc

SEQ ID NO: 466003 - DNA, 20 bp, mouse
gaccctggtcaggagcgcag

SEQ ID NO: 466004 - DNA, 20 bp, mouse
gaccggatcccttacaccag

SEQ ID NO: 466005 - DNA, 20 bp, mouse
gcccagcaggtacgtagtag

SEQ ID NO: 466006 - DNA, 20 bp, mouse
gtctggggcggggcacagta

SEQ ID NO: 466007 - DNA, 20 bp, mouse
gaaggggaccggagcatgaa

SEQ ID NO: 466008 - DNA, 20 bp, mouse
gaggagccctgcatcctaca

SEQ ID NO: 466009 - DNA, 20 bp, mouse
ggacccgcgtgaaaggggac

SEQ ID NO: 466010 - DNA, 20 bp, mouse
ggcggggacccgcgtgaaag

SEQ ID NO: 466011 - DNA, 20 bp, mouse
gtgagaccttgtaggatgca

SEQ ID NO: 466012 - DNA, 20 bp, mouse
gagagggtggaagataaaca

SEQ ID NO: 466013 - DNA, 20 bp, mouse
ggccaacgtgcctgaaccct

SEQ ID NO: 466014 - DNA, 20 bp, mouse
ggcggaatagaagctagcgc

SEQ ID NO: 466015 - DNA, 20 bp, mouse
gacagcgcgtcccagctctg

SEQ ID NO: 466016 - DNA, 20 bp, mouse
gtgtgaacttcagttctgag

SEQ ID NO: 466017 - DNA, 20 bp, mouse
gtcagttctgagtggtctgt

SEQ ID NO: 466018 - DNA, 20 bp, mouse
gctggggtgcctgaggaaca

SEQ ID NO: 466019 - DNA, 20 bp, mouse
ggcgcttacttgggagggag

SEQ ID NO: 466020 - DNA, 20 bp, mouse
gcgttgtgttggcgttgaca

SEQ ID NO: 466021 - DNA, 20 bp, mouse
ggcaaggtctgagcattact

SEQ ID NO: 466022 - DNA, 20 bp, mouse
gagtgggtcagtgtggacgt

SEQ ID NO: 466023 - DNA, 20 bp, mouse
ggcgtcaacatcaccctcac

SEQ ID NO: 466024 - DNA, 20 bp, mouse
gcaacccaaggaatgcactg

SEQ ID NO: 466025 - DNA, 20 bp, mouse
gagtcccaagtgggtcagtg

SEQ ID NO: 466026 - DNA, 20 bp, mouse
ggctctcctaagaagcgcag

SEQ ID NO: 466027 - DNA, 20 bp, mouse
gagcggtacgctgaagctgg

SEQ ID NO: 466028 - DNA, 20 bp, mouse
ggcttcttaggagagccgca

SEQ ID NO: 466029 - DNA, 20 bp, mouse
gccaggataacaatgagcag

SEQ ID NO: 466030 - DNA, 20 bp, mouse
gcatcttgcctggaatccgt

SEQ ID NO: 466031 - DNA, 20 bp, mouse
gctcaggacagaagagacta

SEQ ID NO: 466032 - DNA, 20 bp, mouse
gataaaaagtccgagccctg

SEQ ID NO: 466033 - DNA, 20 bp, mouse
gttcttctagaatccctcta

SEQ ID NO: 466034 - DNA, 20 bp, mouse
gtgaagctggcggcatgcct

SEQ ID NO: 466035 - DNA, 20 bp, mouse
ggattccaggcaagatgaac

SEQ ID NO: 466036 - DNA, 20 bp, mouse
gtaagaggtaccagtccgaa

SEQ ID NO: 466037 - DNA, 20 bp, mouse
gtaccagtccgaagggtgtg

SEQ ID NO: 466038 - DNA, 20 bp, mouse
gtgccacacacccttcggac

SEQ ID NO: 466039 - DNA, 20 bp, mouse
gagtgcctggctgggctaag

SEQ ID NO: 466040 - DNA, 20 bp, mouse
ggctctggagggttagtgta

SEQ ID NO: 466041 - DNA, 20 bp, mouse
gacaggtaaggcccttgaat

SEQ ID NO: 466042 - DNA, 20 bp, mouse
gcaatagtcttcccattcaa

SEQ ID NO: 466043 - DNA, 20 bp, mouse
gacgcttggctacaccccgt

SEQ ID NO: 466044 - DNA, 20 bp, mouse
gcatggagcaggggaaatag

SEQ ID NO: 466045 - DNA, 20 bp, mouse
gttccctcggatcatgtgta

SEQ ID NO: 466046 - DNA, 20 bp, mouse
ggccagcaggacccgcacga

SEQ ID NO: 466047 - DNA, 20 bp, mouse
gagcaggacccgcacgaagg

SEQ ID NO: 466048 - DNA, 20 bp, mouse
gcagcccaggggttaggtag

SEQ ID NO: 466049 - DNA, 20 bp, mouse
gcgggagccgccaagcgccg

SEQ ID NO: 466050 - DNA, 20 bp, mouse
gttgcgctgagtctgagcca

SEQ ID NO: 466051 - DNA, 20 bp, mouse
ggtagcctctgcctgacccg

SEQ ID NO: 466052 - DNA, 20 bp, mouse
gaggacccgcacgaaggcgg

SEQ ID NO: 466053 - DNA, 20 bp, mouse
gggctcccgccgccttcgtg

SEQ ID NO: 466054 - DNA, 20 bp, mouse
gtctgagccacggcgcttgg

SEQ ID NO: 466055 - DNA, 20 bp, mouse
gccggctccggcacttccgg

SEQ ID NO: 466056 - DNA, 20 bp, mouse
gtggctggcgcggatcaggg

SEQ ID NO: 466057 - DNA, 20 bp, mouse
ggcagcaccggctggaagga

SEQ ID NO: 466058 - DNA, 20 bp, mouse
ggcgtgtggcgctgcagcac

SEQ ID NO: 466059 - DNA, 20 bp, mouse
gcagtggctgcgaggtctgt

SEQ ID NO: 466060 - DNA, 20 bp, mouse
ggccaccgtactccagacta

SEQ ID NO: 466061 - DNA, 20 bp, mouse
gaccgtagtctggagtacgg

SEQ ID NO: 466062 - DNA, 20 bp, mouse
ggccaccgtagtctggagta

SEQ ID NO: 466063 - DNA, 20 bp, mouse
gcggtggctggcgcggatca

SEQ ID NO: 466064 - DNA, 20 bp, mouse
gaggtctgtaggtttccacc

SEQ ID NO: 466065 - DNA, 20 bp, mouse
gtggctcaaggaatcgagtg

SEQ ID NO: 466066 - DNA, 20 bp, mouse
gactccagagctggtgtgag

SEQ ID NO: 466067 - DNA, 20 bp, mouse
gagacggcagcggagagcgg

SEQ ID NO: 466068 - DNA, 20 bp, mouse
gctggtgtgaggggcatcga

SEQ ID NO: 466069 - DNA, 20 bp, mouse
ggtgtgaggggcatcgatgg

SEQ ID NO: 466070 - DNA, 20 bp, mouse
gtcgatggcggagacggcag

SEQ ID NO: 466071 - DNA, 20 bp, mouse
gcggagacggcagcggagag

SEQ ID NO: 466072 - DNA, 20 bp, mouse
gggggcatcgatggcggaga

SEQ ID NO: 466073 - DNA, 20 bp, mouse
gctggagagcggcatcccgg

SEQ ID NO: 466074 - DNA, 20 bp, mouse
gccagaggacacgagcgacc

SEQ ID NO: 466075 - DNA, 20 bp, mouse
ggtggcggcatcctggagag

SEQ ID NO: 466076 - DNA, 20 bp, mouse
ggaatgggagaaggccccgg

SEQ ID NO: 466077 - DNA, 20 bp, mouse
gtccaggcggggactaggta

SEQ ID NO: 466078 - DNA, 20 bp, mouse
ggcggaatgggagaaggccc

SEQ ID NO: 466079 - DNA, 20 bp, mouse
gtagcaggcagtatatgctg

SEQ ID NO: 466080 - DNA, 20 bp, mouse
gcctacgtgcaaggaaagac

SEQ ID NO: 466081 - DNA, 20 bp, mouse
gacgtaggattgtagtactt

SEQ ID NO: 466082 - DNA, 20 bp, mouse
ggcggtggctgcgtccggag

SEQ ID NO: 466083 - DNA, 20 bp, mouse
gtccggagcggaatgggaga

SEQ ID NO: 466084 - DNA, 20 bp, mouse
ggctgcgtccggagcggaat

SEQ ID NO: 466085 - DNA, 20 bp, mouse
gcccggcccgggttgcgttt

SEQ ID NO: 466086 - DNA, 20 bp, mouse
gagcgcggtgaagccagatt

SEQ ID NO: 466087 - DNA, 20 bp, mouse
gcgagcgcgcagtgaaggac

SEQ ID NO: 466088 - DNA, 20 bp, mouse
ggcgcgcagtgaaggactgg

SEQ ID NO: 466089 - DNA, 20 bp, mouse
ggcgagcacttggggactta

SEQ ID NO: 466090 - DNA, 20 bp, mouse
gttaggagcagcgagcactt

SEQ ID NO: 466091 - DNA, 20 bp, mouse
ggtgctcgctgctcctaatc

SEQ ID NO: 466092 - DNA, 20 bp, mouse
gcaggcacactagtactcag

SEQ ID NO: 466093 - DNA, 20 bp, mouse
gtcggacgagcgcgcagtga

SEQ ID NO: 466094 - DNA, 20 bp, mouse
ggccaggaggatatagaaag

SEQ ID NO: 466095 - DNA, 20 bp, mouse
gtgcgcgcgctgctgcgaga

SEQ ID NO: 466096 - DNA, 20 bp, mouse
gaatgaagctgagtgaatgg

SEQ ID NO: 466097 - DNA, 20 bp, mouse
gcgcgagcgcatagctggag

SEQ ID NO: 466098 - DNA, 20 bp, mouse
ggcgggcgccagatggtaga

SEQ ID NO: 466099 - DNA, 20 bp, mouse
gagcgtagccctctaccatc

SEQ ID NO: 466100 - DNA, 20 bp, mouse
gagctggagcgggcgccaga

SEQ ID NO: 466101 - DNA, 20 bp, mouse
gtgctcatgatgctcagtgg

SEQ ID NO: 466102 - DNA, 20 bp, mouse
ggacggacctacgtcaggta

SEQ ID NO: 466103 - DNA, 20 bp, mouse
gtcaggtaaggaagatccta

SEQ ID NO: 466104 - DNA, 20 bp, mouse
gcactgcgcgagcgcatagc

SEQ ID NO: 466105 - DNA, 20 bp, mouse
gcacggaaccctccaccctc

SEQ ID NO: 466106 - DNA, 20 bp, mouse
gaagaggccgcgggatccag

SEQ ID NO: 466107 - DNA, 20 bp, mouse
gcaaagtggcgacttcaggg

SEQ ID NO: 466108 - DNA, 20 bp, mouse
gcgtgccagagcggccaaag

SEQ ID NO: 466109 - DNA, 20 bp, mouse
gggccaaagtggcgacttca

SEQ ID NO: 466110 - DNA, 20 bp, mouse
ggtgccccacccaagaagaa

SEQ ID NO: 466111 - DNA, 20 bp, mouse
ggatccagaggcgcccgcaa

SEQ ID NO: 466112 - DNA, 20 bp, mouse
gcgggcgcctctggatcccg

SEQ ID NO: 466113 - DNA, 20 bp, mouse
gcggagactcgaggccaccg

SEQ ID NO: 466114 - DNA, 20 bp, mouse
gaacgccaggcgtgccagag

SEQ ID NO: 466115 - DNA, 20 bp, mouse
gctgtggcttcggagatcaa

SEQ ID NO: 466116 - DNA, 20 bp, mouse
gaagcgcagggttctaacca

SEQ ID NO: 466117 - DNA, 20 bp, mouse
ggaaccctgcgcttccaaca

SEQ ID NO: 466118 - DNA, 20 bp, mouse
gagcctggcgctcgcagcca

SEQ ID NO: 466119 - DNA, 20 bp, mouse
ggtccagcgccggcacgaag

SEQ ID NO: 466120 - DNA, 20 bp, mouse
gagcccgggccgcacttcca

SEQ ID NO: 466121 - DNA, 20 bp, mouse
ggcggaaccgggccatctga

SEQ ID NO: 466122 - DNA, 20 bp, mouse
gcttcctggctctgccatgt

SEQ ID NO: 466123 - DNA, 20 bp, mouse
gctgcccgccaccaagtcac

SEQ ID NO: 466124 - DNA, 20 bp, mouse
gggccacgcagcgatccagg

SEQ ID NO: 466125 - DNA, 20 bp, mouse
gagctggcgggactggcagt

SEQ ID NO: 466126 - DNA, 20 bp, mouse
ggacctgaccgcaggcagag

SEQ ID NO: 466127 - DNA, 20 bp, mouse
gggagagcagacctgaccgc

SEQ ID NO: 466128 - DNA, 20 bp, mouse
gaggatactggggcaaggtg

SEQ ID NO: 466129 - DNA, 20 bp, mouse
gggatggaggcatcagccat

SEQ ID NO: 466130 - DNA, 20 bp, mouse
gctctagctgcaggatactg

SEQ ID NO: 466131 - DNA, 20 bp, mouse
ggcctccatcccaaaacctg

SEQ ID NO: 466132 - DNA, 20 bp, mouse
gtggcaaggagaaatagcac

SEQ ID NO: 466133 - DNA, 20 bp, mouse
gcagctagaggagctcctga

SEQ ID NO: 466134 - DNA, 20 bp, mouse
gtcttccccaggttttggga

SEQ ID NO: 466135 - DNA, 20 bp, mouse
ggtaggagtcgggcaagacg

SEQ ID NO: 466136 - DNA, 20 bp, mouse
gtgccaagggcagactgcag

SEQ ID NO: 466137 - DNA, 20 bp, mouse
gacaggtctgtctccctcca

SEQ ID NO: 466138 - DNA, 20 bp, mouse
gcagctcctggtgaagactc

SEQ ID NO: 466139 - DNA, 20 bp, mouse
ggaccactgcagtctgccct

SEQ ID NO: 466140 - DNA, 20 bp, mouse
gtttggcaggtaaatgccaa

SEQ ID NO: 466141 - DNA, 20 bp, mouse
ggaaggacatcgaggtgtct

SEQ ID NO: 466142 - DNA, 20 bp, mouse
gtctgcccagcctgcatccc

SEQ ID NO: 466143 - DNA, 20 bp, mouse
gctgtatacagaggcagtgt

SEQ ID NO: 466144 - DNA, 20 bp, mouse
gaggttacagctaaagaggt

SEQ ID NO: 466145 - DNA, 20 bp, mouse
gtagggagcacagaccaagt

SEQ ID NO: 466146 - DNA, 20 bp, mouse
gagaggaggactaagctcag

SEQ ID NO: 466147 - DNA, 20 bp, mouse
gcggcgcggcgctctcgaaa

SEQ ID NO: 466148 - DNA, 20 bp, mouse
gtcaaaggtttccttccgag

SEQ ID NO: 466149 - DNA, 20 bp, mouse
gtgcagtcagccagtatcaa

SEQ ID NO: 466150 - DNA, 20 bp, mouse
gaaggtttccttccgagagg

SEQ ID NO: 466151 - DNA, 20 bp, mouse
gccataaaacgggagacagt

SEQ ID NO: 466152 - DNA, 20 bp, mouse
gggaaggaaacctttgatac

SEQ ID NO: 466153 - DNA, 20 bp, mouse
gtggctttcccccataaaac

SEQ ID NO: 466154 - DNA, 20 bp, mouse
gctgtgtgcagctctattaa

SEQ ID NO: 466155 - DNA, 20 bp, mouse
ggactttgggattgaaatta

SEQ ID NO: 466156 - DNA, 20 bp, mouse
ggtaccgagtgtgccggtgg

SEQ ID NO: 466157 - DNA, 20 bp, mouse
gcccgtaccgagtgtgccgg

SEQ ID NO: 466158 - DNA, 20 bp, mouse
gcactcggtacggggtgcgg

SEQ ID NO: 466159 - DNA, 20 bp, mouse
gctgccgccaccggcacact

SEQ ID NO: 466160 - DNA, 20 bp, mouse
gtcgggtccgtgctgctgcg

SEQ ID NO: 466161 - DNA, 20 bp, mouse
gcaccccgtaccgagtgtgc

SEQ ID NO: 466162 - DNA, 20 bp, mouse
gggtagggaagggagccgag

SEQ ID NO: 466163 - DNA, 20 bp, mouse
gcccgggcgcatgcgaccct

SEQ ID NO: 466164 - DNA, 20 bp, mouse
ggaaagccaagtgtttccag

SEQ ID NO: 466165 - DNA, 20 bp, mouse
gagcgggaggcgcgcgaggc

SEQ ID NO: 466166 - DNA, 20 bp, mouse
gcagccccggagggaagtga

SEQ ID NO: 466167 - DNA, 20 bp, mouse
gcctccatcacttccctccg

SEQ ID NO: 466168 - DNA, 20 bp, mouse
ggaggagcctacagcggcag

SEQ ID NO: 466169 - DNA, 20 bp, mouse
gaggtcagcgacctgtgtgg

SEQ ID NO: 466170 - DNA, 20 bp, mouse
gcccacatgaccgagggagt

SEQ ID NO: 466171 - DNA, 20 bp, mouse
gggcacgagcagaggcggaa

SEQ ID NO: 466172 - DNA, 20 bp, mouse
gagacaggcacgagcagagg

SEQ ID NO: 466173 - DNA, 20 bp, mouse
gctttgaaggcgctaagata

SEQ ID NO: 466174 - DNA, 20 bp, mouse
ggacagacaggcacgagcag

SEQ ID NO: 466175 - DNA, 20 bp, mouse
gtaggcaaatgcagtctgga

SEQ ID NO: 466176 - DNA, 20 bp, mouse
gacggtgatgcccgcaggag

SEQ ID NO: 466177 - DNA, 20 bp, mouse
gaccagggggggtagtgtgg

SEQ ID NO: 466178 - DNA, 20 bp, mouse
ggcgcgggaaaagcgagagg

SEQ ID NO: 466179 - DNA, 20 bp, mouse
gggatgagagcccccccaaa

SEQ ID NO: 466180 - DNA, 20 bp, mouse
gttcagaggagaagccccgg

SEQ ID NO: 466181 - DNA, 20 bp, mouse
ggggagagagaaagagtcgc

SEQ ID NO: 466182 - DNA, 20 bp, mouse
gctctccgcccacccttcag

SEQ ID NO: 466183 - DNA, 20 bp, mouse
gcggcggccggcacgaggag

SEQ ID NO: 466184 - DNA, 20 bp, mouse
gcaagcgcggatgaggtcat

SEQ ID NO: 466185 - DNA, 20 bp, mouse
gggcttctcctctgaagggt

SEQ ID NO: 466186 - DNA, 20 bp, mouse
gggcgcatttctgtgaagac

SEQ ID NO: 466187 - DNA, 20 bp, mouse
ggaaggactacgcagttccc

SEQ ID NO: 466188 - DNA, 20 bp, mouse
gctgccctgaaagatttcgg

SEQ ID NO: 466189 - DNA, 20 bp, mouse
gtaggagacgaagggtgagt

SEQ ID NO: 466190 - DNA, 20 bp, mouse
gtcttggagagggtcgtccg

SEQ ID NO: 466191 - DNA, 20 bp, mouse
ggtgttgcctaggagacgaa

SEQ ID NO: 466192 - DNA, 20 bp, mouse
ggtgcccccgaaatctttca

SEQ ID NO: 466193 - DNA, 20 bp, mouse
gggcggggcgtgcaggcggt

SEQ ID NO: 466194 - DNA, 20 bp, mouse
ggagtccacaagtagatgag

SEQ ID NO: 466195 - DNA, 20 bp, mouse
gacgcagttcccaggcgttt

SEQ ID NO: 466196 - DNA, 20 bp, mouse
gaggggccagctccagtaag

SEQ ID NO: 466197 - DNA, 20 bp, mouse
gggtgaggttgtcactgcag

SEQ ID NO: 466198 - DNA, 20 bp, mouse
gcctgggctgtgctcttctc

SEQ ID NO: 466199 - DNA, 20 bp, mouse
ggctgtgctcttctctggaa

SEQ ID NO: 466200 - DNA, 20 bp, mouse
ggtctccacaacatgaactg

SEQ ID NO: 466201 - DNA, 20 bp, mouse
gcccagcctaggactccaca

SEQ ID NO: 466202 - DNA, 20 bp, mouse
gtggcaaaggaacccagcct

SEQ ID NO: 466203 - DNA, 20 bp, mouse
gtggagacagagcccagcgg

SEQ ID NO: 466204 - DNA, 20 bp, mouse
gagacagagcccagcggtgg

SEQ ID NO: 466205 - DNA, 20 bp, mouse
gatcagctctcaccttacaa

SEQ ID NO: 466206 - DNA, 20 bp, mouse
gaccgcgccgccggagccga

SEQ ID NO: 466207 - DNA, 20 bp, mouse
ggccgccggagccgagggag

SEQ ID NO: 466208 - DNA, 20 bp, mouse
gtcctctccctcggctccgg

SEQ ID NO: 466209 - DNA, 20 bp, mouse
ggaggacatccggaagcagg

SEQ ID NO: 466210 - DNA, 20 bp, mouse
gcggcggcgcggtgtctgtg

SEQ ID NO: 466211 - DNA, 20 bp, mouse
gatgtcctctccctcggctc

SEQ ID NO: 466212 - DNA, 20 bp, mouse
ggcagaaggccaggaacggg

SEQ ID NO: 466213 - DNA, 20 bp, mouse
ggccgcagcagcgcgttcca

SEQ ID NO: 466214 - DNA, 20 bp, mouse
gcgggagctgacggttctgg

SEQ ID NO: 466215 - DNA, 20 bp, mouse
gcggcgcggtgtctgtgtgg

SEQ ID NO: 466216 - DNA, 20 bp, mouse
gagctctgcactagattcct

SEQ ID NO: 466217 - DNA, 20 bp, mouse
gcaccagtctctgcaacttt

SEQ ID NO: 466218 - DNA, 20 bp, mouse
gcagctgctcttctggtctc

SEQ ID NO: 466219 - DNA, 20 bp, mouse
gcccaacaggataacatcta

SEQ ID NO: 466220 - DNA, 20 bp, mouse
gctcttctggtctcaggcaa

SEQ ID NO: 466221 - DNA, 20 bp, mouse
ggagttactgataaaaagac

SEQ ID NO: 466222 - DNA, 20 bp, mouse
gaaggcagagagttgctgag

SEQ ID NO: 466223 - DNA, 20 bp, mouse
gctgttgtcatcacggtgac

SEQ ID NO: 466224 - DNA, 20 bp, mouse
gccatagctgatcacatcca

SEQ ID NO: 466225 - DNA, 20 bp, mouse
ggtatttcatgagataggca

SEQ ID NO: 466226 - DNA, 20 bp, mouse
ggcgctcgcgggaggagacc

SEQ ID NO: 466227 - DNA, 20 bp, mouse
gtcctcccgcgagcgcggag

SEQ ID NO: 466228 - DNA, 20 bp, mouse
gcggcgcggccatggggagt

SEQ ID NO: 466229 - DNA, 20 bp, mouse
gaagagggtgcggccgggac

SEQ ID NO: 466230 - DNA, 20 bp, mouse
gcgagcccggcgcggccatg

SEQ ID NO: 466231 - DNA, 20 bp, mouse
ggccgggaccggacgttacc

SEQ ID NO: 466232 - DNA, 20 bp, mouse
gggatgagccaggtaacgtc

SEQ ID NO: 466233 - DNA, 20 bp, mouse
gtcaaggggcccggtctcag

SEQ ID NO: 466234 - DNA, 20 bp, mouse
gtgtgggtggcagacgtcaa

SEQ ID NO: 466235 - DNA, 20 bp, mouse
gttggtgaaccgggccagat

SEQ ID NO: 466236 - DNA, 20 bp, mouse
ggagactacgtggcccgcta

SEQ ID NO: 466237 - DNA, 20 bp, mouse
gttgggtcaccccccctctg

SEQ ID NO: 466238 - DNA, 20 bp, mouse
gcggaatccagccccagagg

SEQ ID NO: 466239 - DNA, 20 bp, mouse
gcgctagggcaagtgctgag

SEQ ID NO: 466240 - DNA, 20 bp, mouse
gcctactctgccgggagatt

SEQ ID NO: 466241 - DNA, 20 bp, mouse
gggggggtgacccaatctcc

SEQ ID NO: 466242 - DNA, 20 bp, mouse
ggagggtccaagagactacg

SEQ ID NO: 466243 - DNA, 20 bp, mouse
gcggcacctggtgtccctga

SEQ ID NO: 466244 - DNA, 20 bp, mouse
ggacagctgtcactgtgagg

SEQ ID NO: 466245 - DNA, 20 bp, mouse
gggggttgcacgcccatcgt

SEQ ID NO: 466246 - DNA, 20 bp, mouse
gtgcgcggggctgtaaacag

SEQ ID NO: 466247 - DNA, 20 bp, mouse
gtgcgcgctggtgacaccca

SEQ ID NO: 466248 - DNA, 20 bp, mouse
ggccccggcgcgcaggtgga

SEQ ID NO: 466249 - DNA, 20 bp, mouse
gcaccagcgcgcacaccgag

SEQ ID NO: 466250 - DNA, 20 bp, mouse
gctggcgcagcggggaagca

SEQ ID NO: 466251 - DNA, 20 bp, mouse
ggggctgtgtcgctgcggtg

SEQ ID NO: 466252 - DNA, 20 bp, mouse
ggggacaccgtgtcacgcag

SEQ ID NO: 466253 - DNA, 20 bp, mouse
gcaggaggtagagacatgtg

SEQ ID NO: 466254 - DNA, 20 bp, mouse
gggggccgcgaaagagccat

SEQ ID NO: 466255 - DNA, 20 bp, mouse
gagggtctcagatcccgagg

SEQ ID NO: 466256 - DNA, 20 bp, mouse
ggtttggtctagagagggac

SEQ ID NO: 466257 - DNA, 20 bp, mouse
gcagaagtttggtctagaga

SEQ ID NO: 466258 - DNA, 20 bp, mouse
gaccaaggaccaagaacccc

SEQ ID NO: 466259 - DNA, 20 bp, mouse
gaggaaagtgaccagaagtt

SEQ ID NO: 466260 - DNA, 20 bp, mouse
gtgctggtgtgtcctcacca

SEQ ID NO: 466261 - DNA, 20 bp, mouse
gtagctgggactagctatca

SEQ ID NO: 466262 - DNA, 20 bp, mouse
gccttaataggtaggctatg

SEQ ID NO: 466263 - DNA, 20 bp, mouse
gtaataggtaggctatgggg

SEQ ID NO: 466264 - DNA, 20 bp, mouse
gtcctggggttcttggtcct

SEQ ID NO: 466265 - DNA, 20 bp, mouse
gctgtgtcattcagggcctt

SEQ ID NO: 466266 - DNA, 20 bp, mouse
gcgaccctagggccatctag

SEQ ID NO: 466267 - DNA, 20 bp, mouse
gtggtgaggtcgcctcctag

SEQ ID NO: 466268 - DNA, 20 bp, mouse
gcggcccctagatggcccta

SEQ ID NO: 466269 - DNA, 20 bp, mouse
ggatggccctagggtcgcag

SEQ ID NO: 466270 - DNA, 20 bp, mouse
ggaggcaaccccgcaactcg

SEQ ID NO: 466271 - DNA, 20 bp, mouse
gcgacgcgcgcgaaaggcgg

SEQ ID NO: 466272 - DNA, 20 bp, mouse
ggcaactcgcggcccctaga

SEQ ID NO: 466273 - DNA, 20 bp, mouse
gcataacccctgcgacccta

SEQ ID NO: 466274 - DNA, 20 bp, mouse
gttgcggggttgcctctagg

SEQ ID NO: 466275 - DNA, 20 bp, mouse
gaggtaggcggtgcagacgg

SEQ ID NO: 466276 - DNA, 20 bp, mouse
gggcggggcgctgcacgcca

SEQ ID NO: 466277 - DNA, 20 bp, mouse
gagttcgaacgagctggaca

SEQ ID NO: 466278 - DNA, 20 bp, mouse
gaacgagctggacatggcgg

SEQ ID NO: 466279 - DNA, 20 bp, mouse
gagggcaggagcgaacgagg

SEQ ID NO: 466280 - DNA, 20 bp, mouse
ggccagggcaggagcgaacg

SEQ ID NO: 466281 - DNA, 20 bp, mouse
gtcgtcccgagggtctacgt

SEQ ID NO: 466282 - DNA, 20 bp, mouse
gggccccgactactacttgg

SEQ ID NO: 466283 - DNA, 20 bp, mouse
gagtcggggcccgctgggag

SEQ ID NO: 466284 - DNA, 20 bp, mouse
gctggagtggggtccatggg

SEQ ID NO: 466285 - DNA, 20 bp, mouse
ggcgggccccgactactact

SEQ ID NO: 466286 - DNA, 20 bp, mouse
ggcagtgcgtgcagctccgg

SEQ ID NO: 466287 - DNA, 20 bp, mouse
gtgcagctccggcggtgcag

SEQ ID NO: 466288 - DNA, 20 bp, mouse
gtccggcggtgcagcggtgg

SEQ ID NO: 466289 - DNA, 20 bp, mouse
gggggaaacggcggagccca

SEQ ID NO: 466290 - DNA, 20 bp, mouse
gggtgcagcggtgggggaaa

SEQ ID NO: 466291 - DNA, 20 bp, mouse
gctagggctgcttctgccgt

SEQ ID NO: 466292 - DNA, 20 bp, mouse
gagctccggcggtgcagcgg

SEQ ID NO: 466293 - DNA, 20 bp, mouse
gaaccaggcgagggctaaga

SEQ ID NO: 466294 - DNA, 20 bp, mouse
gccagaggcgacaaaccgag

SEQ ID NO: 466295 - DNA, 20 bp, mouse
gggggcagtgcgtgcagctc

SEQ ID NO: 466296 - DNA, 20 bp, mouse
ggccgggagcccagcgagcg

SEQ ID NO: 466297 - DNA, 20 bp, mouse
gagctttctggggcagcgag

SEQ ID NO: 466298 - DNA, 20 bp, mouse
gacgcggcgaaggccaggta

SEQ ID NO: 466299 - DNA, 20 bp, mouse
gatgctccgcaaggaggcgg

SEQ ID NO: 466300 - DNA, 20 bp, mouse
gtctggggcagcgagcggcg

SEQ ID NO: 466301 - DNA, 20 bp, mouse
gagaaagctggggattccgc

SEQ ID NO: 466302 - DNA, 20 bp, mouse
gcccacagctgccagaggac

SEQ ID NO: 466303 - DNA, 20 bp, mouse
ggagccgcgcacgctcgacg

SEQ ID NO: 466304 - DNA, 20 bp, mouse
gcgcaagatgctccgcaagg

SEQ ID NO: 466305 - DNA, 20 bp, mouse
gcgggcgggccacctcgcgg

SEQ ID NO: 466306 - DNA, 20 bp, mouse
ggtgctctcgcggagtccta

SEQ ID NO: 466307 - DNA, 20 bp, mouse
ggaggagctgcctcgcacag

SEQ ID NO: 466308 - DNA, 20 bp, mouse
ggtgcgaggcagctcctcaa

SEQ ID NO: 466309 - DNA, 20 bp, mouse
gactgggtaggaacaaaact

SEQ ID NO: 466310 - DNA, 20 bp, mouse
gagagcacaccccctgtgcg

SEQ ID NO: 466311 - DNA, 20 bp, mouse
gcgcccctcgaggcaggcat

SEQ ID NO: 466312 - DNA, 20 bp, mouse
gcgccggattattcaagact

SEQ ID NO: 466313 - DNA, 20 bp, mouse
ggctggagctgggcaacgaa

SEQ ID NO: 466314 - DNA, 20 bp, mouse
ggacacagaagtcaagtcgg

SEQ ID NO: 466315 - DNA, 20 bp, mouse
gctgcacctcggatccaacc

SEQ ID NO: 466316 - DNA, 20 bp, mouse
gcacgcgcggagggccggcc

SEQ ID NO: 466317 - DNA, 20 bp, mouse
gaattggggctgtcaggccg

SEQ ID NO: 466318 - DNA, 20 bp, mouse
gggccgggcgggactgaggc

SEQ ID NO: 466319 - DNA, 20 bp, mouse
gaggcgggcgcccggagacg

SEQ ID NO: 466320 - DNA, 20 bp, mouse
gcggagccgcggtttaattg

SEQ ID NO: 466321 - DNA, 20 bp, mouse
gcgggcgggactgaggccgg

SEQ ID NO: 466322 - DNA, 20 bp, mouse
ggcgcacatgtcgacttcgg

SEQ ID NO: 466323 - DNA, 20 bp, mouse
ggctccgcgggcccccagtg

SEQ ID NO: 466324 - DNA, 20 bp, mouse
gtccggcgcaggcatcggag

SEQ ID NO: 466325 - DNA, 20 bp, mouse
ggacagccccaattaaaccg

SEQ ID NO: 466326 - DNA, 20 bp, mouse
gcggcgtccggcgtccgggt

SEQ ID NO: 466327 - DNA, 20 bp, mouse
ggccccgggcctgtcactcg

SEQ ID NO: 466328 - DNA, 20 bp, mouse
gtcactcgcggctcccgcgg

SEQ ID NO: 466329 - DNA, 20 bp, mouse
ggctcccgcggtggccgagc

SEQ ID NO: 466330 - DNA, 20 bp, mouse
ggagccggctcggccaccgc

SEQ ID NO: 466331 - DNA, 20 bp, mouse
ggtgagccaggcgctgacag

SEQ ID NO: 466332 - DNA, 20 bp, mouse
ggagcgagcgctccccgcgg

SEQ ID NO: 466333 - DNA, 20 bp, mouse
ggccgcgagtgacaggcccg

SEQ ID NO: 466334 - DNA, 20 bp, mouse
gcgtccggcgtccggcgtcc

SEQ ID NO: 466335 - DNA, 20 bp, mouse
gcgggtggggcgggggtccg

SEQ ID NO: 466336 - DNA, 20 bp, mouse
ggaagcggccggcgcacgag

SEQ ID NO: 466337 - DNA, 20 bp, mouse
ggacctggagcgagatccag

SEQ ID NO: 466338 - DNA, 20 bp, mouse
gaggcttgggcgctcggaga

SEQ ID NO: 466339 - DNA, 20 bp, mouse
ggcacgagtggcgcgaggct

SEQ ID NO: 466340 - DNA, 20 bp, mouse
gggtggagcaggctcgcacg

SEQ ID NO: 466341 - DNA, 20 bp, mouse
gtgctacttagtcggtccga

SEQ ID NO: 466342 - DNA, 20 bp, mouse
gagctgtggccaggacgtcc

SEQ ID NO: 466343 - DNA, 20 bp, mouse
gatccagattccaccttgga

SEQ ID NO: 466344 - DNA, 20 bp, mouse
gtcgccgaggcccacaacct

SEQ ID NO: 466345 - DNA, 20 bp, mouse
gcacagctagtgccacggca

SEQ ID NO: 466346 - DNA, 20 bp, mouse
gtccgctcgagccctcttgg

SEQ ID NO: 466347 - DNA, 20 bp, mouse
ggcagcagcacgcttaggag

SEQ ID NO: 466348 - DNA, 20 bp, mouse
ggcctccaagagggctcgag

SEQ ID NO: 466349 - DNA, 20 bp, mouse
gttggaggcagagacggccg

SEQ ID NO: 466350 - DNA, 20 bp, mouse
gccctgctcggaagatgccg

SEQ ID NO: 466351 - DNA, 20 bp, mouse
gtcctccgctcgagccctct

SEQ ID NO: 466352 - DNA, 20 bp, mouse
ggcatcttccgagcagggca

SEQ ID NO: 466353 - DNA, 20 bp, mouse
gcggagccacgactgcaccc

SEQ ID NO: 466354 - DNA, 20 bp, mouse
gctcgagcgcggcctagagg

SEQ ID NO: 466355 - DNA, 20 bp, mouse
gccctggtctgagcaggtaa

SEQ ID NO: 466356 - DNA, 20 bp, mouse
ggtccattgctgtgcgcccc

SEQ ID NO: 466357 - DNA, 20 bp, mouse
gcaggtcaggcagaatatca

SEQ ID NO: 466358 - DNA, 20 bp, mouse
gttgctgtgcgccccaggtc

SEQ ID NO: 466359 - DNA, 20 bp, mouse
gcagggagagagagacagaa

SEQ ID NO: 466360 - DNA, 20 bp, mouse
gcagagagcaagacagagac

SEQ ID NO: 466361 - DNA, 20 bp, mouse
gaatggaccctggtgatcat

SEQ ID NO: 466362 - DNA, 20 bp, mouse
gagagagttgagctaatcac

SEQ ID NO: 466363 - DNA, 20 bp, mouse
ggatgtagtagagcccagag

SEQ ID NO: 466364 - DNA, 20 bp, mouse
gggcgcacagcaatggaccc

SEQ ID NO: 466365 - DNA, 20 bp, mouse
ggaaatgggtgggccactct

SEQ ID NO: 466366 - DNA, 20 bp, mouse
gtcaccagggtccattgctg

SEQ ID NO: 466367 - DNA, 20 bp, mouse
gcaggtcaggcagaatatca

SEQ ID NO: 466368 - DNA, 20 bp, mouse
gttgctgtgggccccaggtc

SEQ ID NO: 466369 - DNA, 20 bp, mouse
gcagggagagagagacagaa

SEQ ID NO: 466370 - DNA, 20 bp, mouse
gcagagagcaagacagagac

SEQ ID NO: 466371 - DNA, 20 bp, mouse
gaatggaccctggtgatcat

SEQ ID NO: 466372 - DNA, 20 bp, mouse
gagagagttgagctaatcac

SEQ ID NO: 466373 - DNA, 20 bp, mouse
ggatgtagtagagcccagag

SEQ ID NO: 466374 - DNA, 20 bp, mouse
ggaaatgggtgggccactct

SEQ ID NO: 466375 - DNA, 20 bp, mouse
gcctctgggtgtgtctgggg

SEQ ID NO: 466376 - DNA, 20 bp, mouse
gtcaccagggtccattgctg

SEQ ID NO: 466377 - DNA, 20 bp, mouse
gcaggtcaggcagaatatca

SEQ ID NO: 466378 - DNA, 20 bp, mouse
gttgctgtgggccccaggtc

SEQ ID NO: 466379 - DNA, 20 bp, mouse
gcagggagagagagacagaa

SEQ ID NO: 466380 - DNA, 20 bp, mouse
gcagagagcaagacagagac

SEQ ID NO: 466381 - DNA, 20 bp, mouse
gaatggaccctggtgatcat

SEQ ID NO: 466382 - DNA, 20 bp, mouse
gagagagttgagctaatcac

SEQ ID NO: 466383 - DNA, 20 bp, mouse
ggatgtagtagagcccagag

SEQ ID NO: 466384 - DNA, 20 bp, mouse
ggaaatgggtgggccactct

SEQ ID NO: 466385 - DNA, 20 bp, mouse
gcctctgggtgtgtctgggg

SEQ ID NO: 466386 - DNA, 20 bp, mouse
ggttcgtgaacagcccgagg

SEQ ID NO: 466387 - DNA, 20 bp, mouse
ggagcgggcgccagggaaag

SEQ ID NO: 466388 - DNA, 20 bp, mouse
ggccccgaagcgccctccgg

SEQ ID NO: 466389 - DNA, 20 bp, mouse
gccagggaaagcggctctga

SEQ ID NO: 466390 - DNA, 20 bp, mouse
ggttcacgaaccgcctgctg

SEQ ID NO: 466391 - DNA, 20 bp, mouse
ggcggctctgagggctcccg

SEQ ID NO: 466392 - DNA, 20 bp, mouse
gtgcgagccgggaccgggag

SEQ ID NO: 466393 - DNA, 20 bp, mouse
gcgtgaacagcccgaggggg

SEQ ID NO: 466394 - DNA, 20 bp, mouse
gtgacgcgctcgggagctac

SEQ ID NO: 466395 - DNA, 20 bp, mouse
ggcggttcgtgaacagcccg

SEQ ID NO: 466396 - DNA, 20 bp, mouse
gctgatcgggaagagctgtg

SEQ ID NO: 466397 - DNA, 20 bp, mouse
ggagcgcgcgagcgagacca

SEQ ID NO: 466398 - DNA, 20 bp, mouse
gctagtggccctcgactgtg

SEQ ID NO: 466399 - DNA, 20 bp, mouse
ggcgcgagcgagaccatggc

SEQ ID NO: 466400 - DNA, 20 bp, mouse
gtcgagggccactagctcca

SEQ ID NO: 466401 - DNA, 20 bp, mouse
gacctagaccgcacagtcga

SEQ ID NO: 466402 - DNA, 20 bp, mouse
ggcgacgtccgtggagctag

SEQ ID NO: 466403 - DNA, 20 bp, mouse
gtaagcgcgaggcctagact

SEQ ID NO: 466404 - DNA, 20 bp, mouse
gctagactgggaaggacggt

SEQ ID NO: 466405 - DNA, 20 bp, mouse
ggcgcttagtcctgttgggt

SEQ ID NO: 466406 - DNA, 20 bp, mouse
gcagcggggccgggcctctc

SEQ ID NO: 466407 - DNA, 20 bp, mouse
ggggagcggccggagaacaa

SEQ ID NO: 466408 - DNA, 20 bp, mouse
gcccggccggcggctgagtg

SEQ ID NO: 466409 - DNA, 20 bp, mouse
gcgcggcgcgcggcctgctt

SEQ ID NO: 466410 - DNA, 20 bp, mouse
ggcgccgagctctgccggag

SEQ ID NO: 466411 - DNA, 20 bp, mouse
gacgtctcgctggaccaggg

SEQ ID NO: 466412 - DNA, 20 bp, mouse
ggccgagcgccgagctctgc

SEQ ID NO: 466413 - DNA, 20 bp, mouse
ggggccgaggccggagccat

SEQ ID NO: 466414 - DNA, 20 bp, mouse
ggcgcggcctgcttgggcag

SEQ ID NO: 466415 - DNA, 20 bp, mouse
ggagctggcggcccggccgg

SEQ ID NO: 466416 - DNA, 20 bp, mouse
gagggccgcacgtcagaagc

SEQ ID NO: 466417 - DNA, 20 bp, mouse
gtgacgccgtagcctcgagg

SEQ ID NO: 466418 - DNA, 20 bp, mouse
gccgccctcagcgtcggagt

SEQ ID NO: 466419 - DNA, 20 bp, mouse
gccggagaaggatgcaaaca

SEQ ID NO: 466420 - DNA, 20 bp, mouse
gaggaggtggaggtcggtca

SEQ ID NO: 466421 - DNA, 20 bp, mouse
gcgtagcctcgaggaggtgg

SEQ ID NO: 466422 - DNA, 20 bp, mouse
ggtcgggagccaatcagcag

SEQ ID NO: 466423 - DNA, 20 bp, mouse
gagaaaagcggagaagacag

SEQ ID NO: 466424 - DNA, 20 bp, mouse
gaccgacctccacctcctcg

SEQ ID NO: 466425 - DNA, 20 bp, mouse
gacccacggaccaacgaacg

SEQ ID NO: 466426 - DNA, 20 bp, mouse
gtcagctgcgtggaccaagg

SEQ ID NO: 466427 - DNA, 20 bp, mouse
gtgcgtggaccaaggaggct

SEQ ID NO: 466428 - DNA, 20 bp, mouse
gctagtgggccggagatggg

SEQ ID NO: 466429 - DNA, 20 bp, mouse
ggcaacgggacgcgactcac

SEQ ID NO: 466430 - DNA, 20 bp, mouse
gtggctagtgggccggagat

SEQ ID NO: 466431 - DNA, 20 bp, mouse
ggaaccggttcgaaggaaaa

SEQ ID NO: 466432 - DNA, 20 bp, mouse
gcgggacgcgactcactggc

SEQ ID NO: 466433 - DNA, 20 bp, mouse
gcactagagaaccggttcga

SEQ ID NO: 466434 - DNA, 20 bp, mouse
gggagaaaccggaagagagg

SEQ ID NO: 466435 - DNA, 20 bp, mouse
gagcagctgctccagttcag

SEQ ID NO: 466436 - DNA, 20 bp, mouse
gttggcacattatcagtcaa

SEQ ID NO: 466437 - DNA, 20 bp, mouse
gagtggtcatcagtcttgag

SEQ ID NO: 466438 - DNA, 20 bp, mouse
gtatcagtcaagggtggtga

SEQ ID NO: 466439 - DNA, 20 bp, mouse
gggtcctggagagaaactct

SEQ ID NO: 466440 - DNA, 20 bp, mouse
gtgatgaccactgggactca

SEQ ID NO: 466441 - DNA, 20 bp, mouse
gtacagagaaaataaggtcc

SEQ ID NO: 466442 - DNA, 20 bp, mouse
ggctattggcaagtataatt

SEQ ID NO: 466443 - DNA, 20 bp, mouse
gactagagaggaattggctt

SEQ ID NO: 466444 - DNA, 20 bp, mouse
gcatttggagttaacactac

SEQ ID NO: 466445 - DNA, 20 bp, mouse
gtgacgtattccagctgaaa

SEQ ID NO: 466446 - DNA, 20 bp, mouse
ggacgcgtctggggaccgaa

SEQ ID NO: 466447 - DNA, 20 bp, mouse
ggcggagacgcaggaggagt

SEQ ID NO: 466448 - DNA, 20 bp, mouse
ggtccgtgcggagacgcagg

SEQ ID NO: 466449 - DNA, 20 bp, mouse
gcaccgcgttccagccccag

SEQ ID NO: 466450 - DNA, 20 bp, mouse
gccggcccgccgggacccaa

SEQ ID NO: 466451 - DNA, 20 bp, mouse
ggccccagcggctgtccgtg

SEQ ID NO: 466452 - DNA, 20 bp, mouse
ggcgccggggaagcccacct

SEQ ID NO: 466453 - DNA, 20 bp, mouse
gaaccggagcccctgaccta

SEQ ID NO: 466454 - DNA, 20 bp, mouse
ggctgtccgtgcggagacgc

SEQ ID NO: 466455 - DNA, 20 bp, mouse
gtccgcacggacagccgctg

SEQ ID NO: 466456 - DNA, 20 bp, mouse
gcctcttgggaaaggtctaa

SEQ ID NO: 466457 - DNA, 20 bp, mouse
gtaaagaaaagtagagacac

SEQ ID NO: 466458 - DNA, 20 bp, mouse
gtgtagctatttatcctctt

SEQ ID NO: 466459 - DNA, 20 bp, mouse
gtcctccttggtactttaaa

SEQ ID NO: 466460 - DNA, 20 bp, mouse
gacctctgtcagctcactaa

SEQ ID NO: 466461 - DNA, 20 bp, mouse
gttgaatgttgagcaaaacg

SEQ ID NO: 466462 - DNA, 20 bp, mouse
gtatatcaaaacataggata

SEQ ID NO: 466463 - DNA, 20 bp, mouse
ggctgctttctaaccatcct

SEQ ID NO: 466464 - DNA, 20 bp, mouse
gtacatagcatgccagacta

SEQ ID NO: 466465 - DNA, 20 bp, mouse
gtagaattcacatcgactaa

SEQ ID NO: 466466 - DNA, 20 bp, mouse
gagcagtgagcgaggggaac

SEQ ID NO: 466467 - DNA, 20 bp, mouse
gcagtcggccgcgggttagc

SEQ ID NO: 466468 - DNA, 20 bp, mouse
gagcgaggggaaccggcgac

SEQ ID NO: 466469 - DNA, 20 bp, mouse
ggtgtcggcggtgcagaatg

SEQ ID NO: 466470 - DNA, 20 bp, mouse
gcgctctgcccgctaacccg

SEQ ID NO: 466471 - DNA, 20 bp, mouse
gacatggcggatccacggaa

SEQ ID NO: 466472 - DNA, 20 bp, mouse
gacgagagagcagtgagcga

SEQ ID NO: 466473 - DNA, 20 bp, mouse
gagccgagaggagcggcctc

SEQ ID NO: 466474 - DNA, 20 bp, mouse
gggagcggcggcctttaggg

SEQ ID NO: 466475 - DNA, 20 bp, mouse
gtcggcggtgcagaatgtgg

SEQ ID NO: 466476 - DNA, 20 bp, mouse
ggctaggctagcgctcctcc

SEQ ID NO: 466477 - DNA, 20 bp, mouse
gaggaagtgatcgctccggg

SEQ ID NO: 466478 - DNA, 20 bp, mouse
ggagaggaagtgatcgctcc

SEQ ID NO: 466479 - DNA, 20 bp, mouse
ggacatgacctcccacccat

SEQ ID NO: 466480 - DNA, 20 bp, mouse
gggctcactggaggtcgtgg

SEQ ID NO: 466481 - DNA, 20 bp, mouse
ggcccaggctgtgtgcccag

SEQ ID NO: 466482 - DNA, 20 bp, mouse
gctgacagctcccaacacca

SEQ ID NO: 466483 - DNA, 20 bp, mouse
gctacatccgcaggacaccg

SEQ ID NO: 466484 - DNA, 20 bp, mouse
gcagctccccaggagcggag

SEQ ID NO: 466485 - DNA, 20 bp, mouse
gagccccgcagccctggtgt

SEQ ID NO: 466486 - DNA, 20 bp, mouse
gggacgccgcggatctgcgg

SEQ ID NO: 466487 - DNA, 20 bp, mouse
gcggcggcgacagttggaga

SEQ ID NO: 466488 - DNA, 20 bp, mouse
gttgggacgccgcggatctg

SEQ ID NO: 466489 - DNA, 20 bp, mouse
gtgtcgccgccgcagatccg

SEQ ID NO: 466490 - DNA, 20 bp, mouse
ggatctgcggcggcgacagt

SEQ ID NO: 466491 - DNA, 20 bp, mouse
gctctggccggtaacttccc

SEQ ID NO: 466492 - DNA, 20 bp, mouse
ggacgttcccgggaagttac

SEQ ID NO: 466493 - DNA, 20 bp, mouse
ggcctgcggagggtcccgaa

SEQ ID NO: 466494 - DNA, 20 bp, mouse
ggacctgtcaggtggcggag

SEQ ID NO: 466495 - DNA, 20 bp, mouse
gcgaccgacctgtcaggtgg

SEQ ID NO: 466496 - DNA, 20 bp, mouse
gcagggctggaagaacgaag

SEQ ID NO: 466497 - DNA, 20 bp, mouse
gggcgggcgacgatgaggac

SEQ ID NO: 466498 - DNA, 20 bp, mouse
gaacgaagcggcgactgcgg

SEQ ID NO: 466499 - DNA, 20 bp, mouse
gaatcacaccactcctgaca

SEQ ID NO: 466500 - DNA, 20 bp, mouse
gggcggacggaacccggata

SEQ ID NO: 466501 - DNA, 20 bp, mouse
gacaccactcctgacagggc

SEQ ID NO: 466502 - DNA, 20 bp, mouse
ggcccggagcgtccatatcc

SEQ ID NO: 466503 - DNA, 20 bp, mouse
gcggggctcggggatcccag

SEQ ID NO: 466504 - DNA, 20 bp, mouse
gcccgcgggggaccggagag

SEQ ID NO: 466505 - DNA, 20 bp, mouse
gctggcgaggagataacccg

SEQ ID NO: 466506 - DNA, 20 bp, mouse
gaccgtgggcagacattgat

SEQ ID NO: 466507 - DNA, 20 bp, mouse
gtggcaagatggcgccggtg

SEQ ID NO: 466508 - DNA, 20 bp, mouse
gcccaacgggcccgcagtgg

SEQ ID NO: 466509 - DNA, 20 bp, mouse
ggagtccagggtgccctccc

SEQ ID NO: 466510 - DNA, 20 bp, mouse
ggacattgatgggcagtcgt

SEQ ID NO: 466511 - DNA, 20 bp, mouse
gtcgccggcggccgccactg

SEQ ID NO: 466512 - DNA, 20 bp, mouse
gggtcccaacgggcccgcag

SEQ ID NO: 466513 - DNA, 20 bp, mouse
ggcggcgacaatgacaagag

SEQ ID NO: 466514 - DNA, 20 bp, mouse
ggctcaagatcgaagacctg

SEQ ID NO: 466515 - DNA, 20 bp, mouse
ggccgccactgcgggcccgt

SEQ ID NO: 466516 - DNA, 20 bp, mouse
ggcggttgcacgtcaggagt

SEQ ID NO: 466517 - DNA, 20 bp, mouse
gaaacccgccagaaaatctc

SEQ ID NO: 466518 - DNA, 20 bp, mouse
gagaaaatctccggagattc

SEQ ID NO: 466519 - DNA, 20 bp, mouse
gcatgagggagaaaaggaca

SEQ ID NO: 466520 - DNA, 20 bp, mouse
ggaccggaagtgacgtagaa

SEQ ID NO: 466521 - DNA, 20 bp, mouse
gtggagcggtctctctactt

SEQ ID NO: 466522 - DNA, 20 bp, mouse
gcgtagaaaggaagctcgca

SEQ ID NO: 466523 - DNA, 20 bp, mouse
gaaaggaagctcgcagggcc

SEQ ID NO: 466524 - DNA, 20 bp, mouse
gggcgttgcctcagcacagg

SEQ ID NO: 466525 - DNA, 20 bp, mouse
gaaactgaccctgagcatga

SEQ ID NO: 466526 - DNA, 20 bp, mouse
gtggcaactgctgagtgtag

SEQ ID NO: 466527 - DNA, 20 bp, mouse
gacctgggcacgagggacag

SEQ ID NO: 466528 - DNA, 20 bp, mouse
ggaagcggtcgccatagcga

SEQ ID NO: 466529 - DNA, 20 bp, mouse
gaggcttcccgccatggccg

SEQ ID NO: 466530 - DNA, 20 bp, mouse
ggcgctcagtaggcgtgaag

SEQ ID NO: 466531 - DNA, 20 bp, mouse
ggagtttgcggacatctccg

SEQ ID NO: 466532 - DNA, 20 bp, mouse
gccgggcagttgctcaacgg

SEQ ID NO: 466533 - DNA, 20 bp, mouse
ggggagccgaggcccgacct

SEQ ID NO: 466534 - DNA, 20 bp, mouse
gcctccgggcagttgctcaa

SEQ ID NO: 466535 - DNA, 20 bp, mouse
gggaaactcctactatacga

SEQ ID NO: 466536 - DNA, 20 bp, mouse
gtgaggaacaaccctgaccc

SEQ ID NO: 466537 - DNA, 20 bp, mouse
ggcgccgccccagagttcct

SEQ ID NO: 466538 - DNA, 20 bp, mouse
gttgcagcctgcctgggtca

SEQ ID NO: 466539 - DNA, 20 bp, mouse
gggccggttcagcaatacct

SEQ ID NO: 466540 - DNA, 20 bp, mouse
gagttcctgggctccgcgtg

SEQ ID NO: 466541 - DNA, 20 bp, mouse
gaggctgcaaacacctagtt

SEQ ID NO: 466542 - DNA, 20 bp, mouse
ggaacaaccctgacccaggc

SEQ ID NO: 466543 - DNA, 20 bp, mouse
gaggtgtttgcagcctgcct

SEQ ID NO: 466544 - DNA, 20 bp, mouse
ggtcagggttgttcctcacg

SEQ ID NO: 466545 - DNA, 20 bp, mouse
gtagttgggccagagaatgc

SEQ ID NO: 466546 - DNA, 20 bp, mouse
ggggcagcttagatgcgcca

SEQ ID NO: 466547 - DNA, 20 bp, mouse
ggcggggcctagggattagg

SEQ ID NO: 466548 - DNA, 20 bp, mouse
gcccagaggacgcagaatcg

SEQ ID NO: 466549 - DNA, 20 bp, mouse
ggcccccacccgcttccgag

SEQ ID NO: 466550 - DNA, 20 bp, mouse
ggggcctagggattaggcgg

SEQ ID NO: 466551 - DNA, 20 bp, mouse
gcggtctcaccgtggagcag

SEQ ID NO: 466552 - DNA, 20 bp, mouse
gtgacgaagcgcagggaaga

SEQ ID NO: 466553 - DNA, 20 bp, mouse
gcgctcgctgccctcccgac

SEQ ID NO: 466554 - DNA, 20 bp, mouse
ggcccctcggaagcgggtgg

SEQ ID NO: 466555 - DNA, 20 bp, mouse
ggacctcgggagctgcccct

SEQ ID NO: 466556 - DNA, 20 bp, mouse
ggcgaggtatcagccgagac

SEQ ID NO: 466557 - DNA, 20 bp, mouse
gcccggccgaccgcctgtct

SEQ ID NO: 466558 - DNA, 20 bp, mouse
gtcggccgggtggcacgagg

SEQ ID NO: 466559 - DNA, 20 bp, mouse
gatcagccgagacaggcggt

SEQ ID NO: 466560 - DNA, 20 bp, mouse
ggcgtccggggaagctcgga

SEQ ID NO: 466561 - DNA, 20 bp, mouse
ggtcgccctccgagcttccc

SEQ ID NO: 466562 - DNA, 20 bp, mouse
ggcctccagccagggcacga

SEQ ID NO: 466563 - DNA, 20 bp, mouse
gcgagtccgcacaggcccct

SEQ ID NO: 466564 - DNA, 20 bp, mouse
ggagcagggggataccgcgg

SEQ ID NO: 466565 - DNA, 20 bp, mouse
gtgctccccaggggcctgtg

SEQ ID NO: 466566 - DNA, 20 bp, mouse
gactgtgcgcaggctcagaa

SEQ ID NO: 466567 - DNA, 20 bp, mouse
ggagtgtccacccaaggcgg

SEQ ID NO: 466568 - DNA, 20 bp, mouse
gctcagaagggcggggaacg

SEQ ID NO: 466569 - DNA, 20 bp, mouse
gggacactcaccatctcgga

SEQ ID NO: 466570 - DNA, 20 bp, mouse
gctgcaggatccgtccgaga

SEQ ID NO: 466571 - DNA, 20 bp, mouse
gggggaacgcggctaagtgt

SEQ ID NO: 466572 - DNA, 20 bp, mouse
ggcgcaggctcagaagggcg

SEQ ID NO: 466573 - DNA, 20 bp, mouse
gcgaccagaacccctaccgg

SEQ ID NO: 466574 - DNA, 20 bp, mouse
gagcccgctaccgccgcctt

SEQ ID NO: 466575 - DNA, 20 bp, mouse
gacccggcgtgaccatcccc

SEQ ID NO: 466576 - DNA, 20 bp, mouse
ggagccaggagctgtcccac

SEQ ID NO: 466577 - DNA, 20 bp, mouse
gttgtctagaagggtagagg

SEQ ID NO: 466578 - DNA, 20 bp, mouse
ggtctgagttgcagtttctg

SEQ ID NO: 466579 - DNA, 20 bp, mouse
gagctgtcccacaggcgcga

SEQ ID NO: 466580 - DNA, 20 bp, mouse
gcaaagagctatgacagagg

SEQ ID NO: 466581 - DNA, 20 bp, mouse
gcctggttgcctagcaacgg

SEQ ID NO: 466582 - DNA, 20 bp, mouse
ggatttaccatcgcgcctgt

SEQ ID NO: 466583 - DNA, 20 bp, mouse
ggctgagaaagaaggagacc

SEQ ID NO: 466584 - DNA, 20 bp, mouse
gtgcaactcagacttgagcc
